United States Patent 7,777,022 (BIOINFORMATICALLY DETECTABLE GROUP OF NOVEL REGULATORY VIRAL AND VIRAL ASSOCIATED OLIGONUCLEOTIDES AND USES THEREOF) - sequence listing, part 55

SEQ ID NO: 2483248 - RNA, 18 nt, Human
ucaggcaugaacauguac

SEQ ID NO: 2483249 - RNA, 14 nt, Human
ucaggcaugccugu

SEQ ID NO: 2483250 - RNA, 15 nt, Human
ucaggcaugccugug

SEQ ID NO: 2483251 - RNA, 20 nt, Human
ucaggaagaugaaagaggag

SEQ ID NO: 2483252 - RNA, 18 nt, Human
ucaggcauaggccugggu

SEQ ID NO: 2483253 - RNA, 22 nt, Human
ucaggaagaacacccucuaaau

SEQ ID NO: 2483254 - RNA, 19 nt, Human
ucaggcauaggccugggug

SEQ ID NO: 2483255 - RNA, 20 nt, Human
ucaggcauaggccugggugc

SEQ ID NO: 2483256 - RNA, 17 nt, Human
ucaggcaugaacaugua

SEQ ID NO: 2483257 - RNA, 22 nt, Human
ucaggcauaggccugggugcug

SEQ ID NO: 2483258 - RNA, 11 nt, Human
ucaggccaggc

SEQ ID NO: 2483259 - RNA, 20 nt, Human
ucaggccagcugcuugggcu

SEQ ID NO: 2483260 - RNA, 15 nt, Human
ucaggccagcugcuu

SEQ ID NO: 2483261 - RNA, 14 nt, Human
ucaggcccaaagcc

SEQ ID NO: 2483262 - RNA, 21 nt, Human
ucaggccaucaucaguggagc

SEQ ID NO: 2483263 - RNA, 22 nt, Human
ucaggccaucaucaguggagcc

SEQ ID NO: 2483264 - RNA, 16 nt, Human
ucaggccaggugcagu

SEQ ID NO: 2483265 - RNA, 17 nt, Human
ucaggccaggugcagug

SEQ ID NO: 2483266 - RNA, 18 nt, Human
ucaggccaggugcagugg

SEQ ID NO: 2483267 - RNA, 19 nt, Human
ucaggccaggugcaguggc

SEQ ID NO: 2483268 - RNA, 15 nt, Human
ucaggccgaaggagg

SEQ ID NO: 2483269 - RNA, 23 nt, Human
ucaggccaucaucaguggagcca

SEQ ID NO: 2483270 - RNA, 19 nt, Human
accccuucgcuccuguguc

SEQ ID NO: 2483271 - RNA, 16 nt, Human
ucagguaacaggcaga

SEQ ID NO: 2483272 - RNA, 15 nt, Human
ucagguaacaggcag

SEQ ID NO: 2483273 - RNA, 13 nt, Human
ucagguaacaggc

SEQ ID NO: 2483274 - RNA, 18 nt, Human
ucagggucccugguggca

SEQ ID NO: 2483275 - RNA, 14 nt, Human
ucagggucccuggu

SEQ ID NO: 2483276 - RNA, 13 nt, Human
ucagggucccugg

SEQ ID NO: 2483277 - RNA, 19 nt, Human
ucaggcccuuauuuucaag

SEQ ID NO: 2483278 - RNA, 22 nt, Human
ucagggguucgagaccagucug

SEQ ID NO: 2483279 - RNA, 18 nt, Human
ucagggguucgagaccag

SEQ ID NO: 2483280 - RNA, 15 nt, Human
ucagggucauagcau

SEQ ID NO: 2483281 - RNA, 23 nt, Human
accccuucucuccuccccaaauc

SEQ ID NO: 2483282 - RNA, 17 nt, Human
accccuuuucagcuucu

SEQ ID NO: 2483283 - RNA, 16 nt, Human
accccuuuucagcuuc

SEQ ID NO: 2483284 - RNA, 17 nt, Human
accccuuucuggcucuc

SEQ ID NO: 2483285 - RNA, 12 nt, Human
accccuuuccug

SEQ ID NO: 2483286 - RNA, 17 nt, Human
accccuucucuccuccc

SEQ ID NO: 2483287 - RNA, 15 nt, Human
accccuucucuccuc

SEQ ID NO: 2483288 - RNA, 20 nt, Human
accccuucgcuccugugucu

SEQ ID NO: 2483289 - RNA, 21 nt, Human
acccgacagagggaagaaaag

SEQ ID NO: 2483290 - RNA, 20 nt, Human
accccuuuucagcuucugcu

SEQ ID NO: 2483291 - RNA, 19 nt, Human
accccuuuucagcuucugc

SEQ ID NO: 2483292 - RNA, 23 nt, Human
accccuuuucagcuucugcuggg

SEQ ID NO: 2483293 - RNA, 16 nt, Human
acccgacagagggaag

SEQ ID NO: 2483294 - RNA, 13 nt, Human
acccgaggaaacu

SEQ ID NO: 2483295 - RNA, 14 nt, Human
acccgaggcccgca

SEQ ID NO: 2483296 - RNA, 14 nt, Human
acccgaggcugccc

SEQ ID NO: 2483297 - RNA, 15 nt, Human
acccgaggcugccca

SEQ ID NO: 2483298 - RNA, 17 nt, Human
acccgaggcugcccacu

SEQ ID NO: 2483299 - RNA, 17 nt, Human
acccuccacccuguccc

SEQ ID NO: 2483300 - RNA, 16 nt, Human
acccuccacccugucc

SEQ ID NO: 2483301 - RNA, 15 nt, Human
acccuccacccuguc

SEQ ID NO: 2483302 - RNA, 14 nt, Human
acccuccacccugu

SEQ ID NO: 2483303 - RNA, 23 nt, Human
acccgaugcugcuuuccccugug

SEQ ID NO: 2483304 - RNA, 13 nt, Human
acccuccacccug

SEQ ID NO: 2483305 - RNA, 22 nt, Human
acccgaugcugcuuuccccugu

SEQ ID NO: 2483306 - RNA, 14 nt, Human
acccgaugcugcuu

SEQ ID NO: 2483307 - RNA, 13 nt, Human
acccgaugcugcu

SEQ ID NO: 2483308 - RNA, 12 nt, Human
acccgaugcugc

SEQ ID NO: 2483309 - RNA, 21 nt, Human
acccgagucauucguucugug

SEQ ID NO: 2483310 - RNA, 24 nt, Human
acccgaggcugcccacuaugguca

SEQ ID NO: 2483311 - RNA, 11 nt, Human
acccucccugc

SEQ ID NO: 2483312 - RNA, 17 nt, Human
acccucccauggcaccu

SEQ ID NO: 2483313 - RNA, 23 nt, Human
acccucccucuacugggagccua

SEQ ID NO: 2483314 - RNA, 16 nt, Human
acccucccagaccugc

SEQ ID NO: 2483315 - RNA, 15 nt, Human
acccucccagaccug

SEQ ID NO: 2483316 - RNA, 16 nt, Human
acccucccauggcacc

SEQ ID NO: 2483317 - RNA, 14 nt, Human
acccucccaccccc

SEQ ID NO: 2483318 - RNA, 20 nt, Human
acccucccacccccuucucu

SEQ ID NO: 2483319 - RNA, 13 nt, Human
acccucccagacc

SEQ ID NO: 2483320 - RNA, 23 nt, Human
acccuccacccugucccccagcu

SEQ ID NO: 2483321 - RNA, 23 nt, Human
acccucccacccccuucucugcu

SEQ ID NO: 2483322 - RNA, 15 nt, Human
acccuccacucuccu

SEQ ID NO: 2483323 - RNA, 12 nt, Human
acccucccaccc

SEQ ID NO: 2483324 - RNA, 13 nt, Human
acccucccacccc

SEQ ID NO: 2483325 - RNA, 20 nt, Human
acccucugccaccagagacc

SEQ ID NO: 2483326 - RNA, 18 nt, Human
acccuccugucuucccag

SEQ ID NO: 2483327 - RNA, 16 nt, Human
acccuccugucuuccc

SEQ ID NO: 2483328 - RNA, 13 nt, Human
acccuccugucuu

SEQ ID NO: 2483329 - RNA, 21 nt, Human
acccuccuguaaaugguguac

SEQ ID NO: 2483330 - RNA, 17 nt, Human
acccuccuguaaauggu

SEQ ID NO: 2483331 - RNA, 14 nt, Human
acccuccuguaaau

SEQ ID NO: 2483332 - RNA, 11 nt, Human
acccuccuggc

SEQ ID NO: 2483333 - RNA, 13 nt, Human
acccuccuggcuc

SEQ ID NO: 2483334 - RNA, 19 nt, Human
acccuccuccagaccauuc

SEQ ID NO: 2483335 - RNA, 21 nt, Human
acccuccuaucaccuccccuc

SEQ ID NO: 2483336 - RNA, 13 nt, Human
acccucccuggag

SEQ ID NO: 2483337 - RNA, 12 nt, Human
acccucccugga

SEQ ID NO: 2483338 - RNA, 21 nt, Human
acccucccugcuguccccucu

SEQ ID NO: 2483339 - RNA, 20 nt, Human
acccucccugcuguccccuc

SEQ ID NO: 2483340 - RNA, 15 nt, Human
acccucccugcuguc

SEQ ID NO: 2483341 - RNA, 14 nt, Human
acccucccugcugu

SEQ ID NO: 2483342 - RNA, 13 nt, Human
acccucccugcug

SEQ ID NO: 2483343 - RNA, 12 nt, Human
acccucccugcu

SEQ ID NO: 2483344 - RNA, 15 nt, Human
acccucccuggagug

SEQ ID NO: 2483345 - RNA, 15 nt, Human
acccuccgccuucac

SEQ ID NO: 2483346 - RNA, 22 nt, Human
acccuccgccuucacuccggug

SEQ ID NO: 2483347 - RNA, 14 nt, Human
acccucccuggagu

SEQ ID NO: 2483348 - RNA, 17 nt, Human
acccuccuaucaccucc

SEQ ID NO: 2483349 - RNA, 12 nt, Human
acccugcccugu

SEQ ID NO: 2483350 - RNA, 11 nt, Human
acccugcccug

SEQ ID NO: 2483351 - RNA, 13 nt, Human
acccugcccugug

SEQ ID NO: 2483352 - RNA, 14 nt, Human
acccugcccugugg

SEQ ID NO: 2483353 - RNA, 19 nt, Human
acccucugccaccagagac

SEQ ID NO: 2483354 - RNA, 23 nt, Human
acccucuggagggguguggcucc

SEQ ID NO: 2483355 - RNA, 14 nt, Human
acccucuuagaaaa

SEQ ID NO: 2483356 - RNA, 13 nt, Human
acccucuucaugg

SEQ ID NO: 2483357 - RNA, 15 nt, Human
acccugccccugccc

SEQ ID NO: 2483358 - RNA, 18 nt, Human
acccugccccugccccgu

SEQ ID NO: 2483359 - RNA, 14 nt, Human
acccugccccugcc

SEQ ID NO: 2483360 - RNA, 17 nt, Human
acccuuguggucccacc

SEQ ID NO: 2483361 - RNA, 16 nt, Human
acccuuguggucccac

SEQ ID NO: 2483362 - RNA, 19 nt, Human
acccuuguggucccacccc

SEQ ID NO: 2483363 - RNA, 15 nt, Human
acccuugugguccca

SEQ ID NO: 2483364 - RNA, 20 nt, Human
acccuuugaauuggacaaua

SEQ ID NO: 2483365 - RNA, 12 nt, Human
acccuuugcccc

SEQ ID NO: 2483366 - RNA, 21 nt, Human
acccuucacauacccuccccc

SEQ ID NO: 2483367 - RNA, 20 nt, Human
acccuucccuugagcccucu

SEQ ID NO: 2483368 - RNA, 19 nt, Human
acccuucccuugagcccuc

SEQ ID NO: 2483369 - RNA, 22 nt, Human
acccuuccccuccuucucccuu

SEQ ID NO: 2483370 - RNA, 19 nt, Human
acccuuccucaccacuucc

SEQ ID NO: 2483371 - RNA, 21 nt, Human
acccuucuccucuuguaaaua

SEQ ID NO: 2483372 - RNA, 19 nt, Human
acccuucuccucuuguaaa

SEQ ID NO: 2483373 - RNA, 17 nt, Human
acccuucuccucuugua

SEQ ID NO: 2483374 - RNA, 15 nt, Human
acccuucuccucuug

SEQ ID NO: 2483375 - RNA, 13 nt, Human
ugacucagggcuc

SEQ ID NO: 2483376 - RNA, 14 nt, Human
ugacucagggcucc

SEQ ID NO: 2483377 - RNA, 15 nt, Human
ugacucagggcuccu

SEQ ID NO: 2483378 - RNA, 17 nt, Human
ugacucagggcuccugg

SEQ ID NO: 2483379 - RNA, 18 nt, Human
ugacucagggcuccuggg

SEQ ID NO: 2483380 - RNA, 19 nt, Human
ugacucagggcuccugggu

SEQ ID NO: 2483381 - RNA, 20 nt, Human
ugacucauucugaaggagcc

SEQ ID NO: 2483382 - RNA, 19 nt, Human
ugacuccagaauuucccaa

SEQ ID NO: 2483383 - RNA, 17 nt, Human
ugacuccagaauuuccc

SEQ ID NO: 2483384 - RNA, 15 nt, Human
ugaccugaggcccuu

SEQ ID NO: 2483385 - RNA, 14 nt, Human
ugaccugaggcccu

SEQ ID NO: 2483386 - RNA, 17 nt, Human
ugaccugaggcccuucu

SEQ ID NO: 2483387 - RNA, 14 nt, Human
ugaccugaggaagc

SEQ ID NO: 2483388 - RNA, 15 nt, Human
ugaccugaggaagcg

SEQ ID NO: 2483389 - RNA, 18 nt, Human
ugacucacuuaucccaag

SEQ ID NO: 2483390 - RNA, 21 nt, Human
ugacucagcauaccugcuggu

SEQ ID NO: 2483391 - RNA, 16 nt, Human
ugacucagaugucucu

SEQ ID NO: 2483392 - RNA, 15 nt, Human
ugacucacccaagca

SEQ ID NO: 2483393 - RNA, 23 nt, Human
ugacuccagaauuucccaaagca

SEQ ID NO: 2483394 - RNA, 20 nt, Human
ugacuccagaauuucccaaa

SEQ ID NO: 2483395 - RNA, 13 nt, Human
ugacugucacugu

SEQ ID NO: 2483396 - RNA, 16 nt, Human
ugacugucacuguucc

SEQ ID NO: 2483397 - RNA, 17 nt, Human
ugacugucacuguuccu

SEQ ID NO: 2483398 - RNA, 11 nt, Human
ugacuccagga

SEQ ID NO: 2483399 - RNA, 13 nt, Human
ugacucauccucu

SEQ ID NO: 2483400 - RNA, 12 nt, Human
ugacuccaggag

SEQ ID NO: 2483401 - RNA, 15 nt, Human
ugacuguuuccauca

SEQ ID NO: 2483402 - RNA, 24 nt, Human
ugacuguucaagagcacacuuggc

SEQ ID NO: 2483403 - RNA, 11 nt, Human
ugacugugugu

SEQ ID NO: 2483404 - RNA, 17 nt, Human
ugacuucaaugauagua

SEQ ID NO: 2483405 - RNA, 19 nt, Human
ugacuuauuuucucugugu

SEQ ID NO: 2483406 - RNA, 18 nt, Human
ugacuuauuuucucugug

SEQ ID NO: 2483407 - RNA, 18 nt, Human
ugacuguucaagagcaca

SEQ ID NO: 2483408 - RNA, 21 nt, Human
ugacuuauuuauauaaauuuu

SEQ ID NO: 2483409 - RNA, 17 nt, Human
ugacuuauuuauauaaa

SEQ ID NO: 2483410 - RNA, 20 nt, Human
ugacuuauuuauauaaauuu

SEQ ID NO: 2483411 - RNA, 18 nt, Human
ugacuuuagucugcaaaa

SEQ ID NO: 2483412 - RNA, 19 nt, Human
ugacuuuagucugcaaaau

SEQ ID NO: 2483413 - RNA, 18 nt, Human
ugacuuuauauggaugau

SEQ ID NO: 2483414 - RNA, 12 nt, Human
ugacuuucaggu

SEQ ID NO: 2483415 - RNA, 20 nt, Human
agauuauaggcaccuaccac

SEQ ID NO: 2483416 - RNA, 16 nt, Human
agauucaaucccagga

SEQ ID NO: 2483417 - RNA, 22 nt, Human
agauucacaccugacucugaaa

SEQ ID NO: 2483418 - RNA, 20 nt, Human
agauuauggagcuuuuuucc

SEQ ID NO: 2483419 - RNA, 16 nt, Human
ugacuucugccuggag

SEQ ID NO: 2483420 - RNA, 15 nt, Human
ugacuucugccugga

SEQ ID NO: 2483421 - RNA, 13 nt, Human
ugacuucugccug

SEQ ID NO: 2483422 - RNA, 12 nt, Human
ugacuucugccu

SEQ ID NO: 2483423 - RNA, 16 nt, Human
ugacuucuccaggucu

SEQ ID NO: 2483424 - RNA, 15 nt, Human
ugacuucuccagguc

SEQ ID NO: 2483425 - RNA, 23 nt, Human
ugacuucuccaggucucacgggc

SEQ ID NO: 2483426 - RNA, 14 nt, Human
ugacuucuccaggu

SEQ ID NO: 2483427 - RNA, 18 nt, Human
ugacuucaggggcugccc

SEQ ID NO: 2483428 - RNA, 17 nt, Human
ugacuucaggggcugcc

SEQ ID NO: 2483429 - RNA, 13 nt, Human
ugacuucaggggc

SEQ ID NO: 2483430 - RNA, 23 nt, Human
ugacuucaaugauaguaagaaaa

SEQ ID NO: 2483431 - RNA, 22 nt, Human
ugacuucaggggcugcccgcuc

SEQ ID NO: 2483432 - RNA, 22 nt, Human
ugacuucauuaauaauaaauuc

SEQ ID NO: 2483433 - RNA, 20 nt, Human
ugacuucgacugugaccugu

SEQ ID NO: 2483434 - RNA, 21 nt, Human
ugacuucaggggcugcccgcu

SEQ ID NO: 2483435 - RNA, 14 nt, Human
ugacuuccacaccu

SEQ ID NO: 2483436 - RNA, 15 nt, Human
ugacuugugucccau

SEQ ID NO: 2483437 - RNA, 19 nt, Human
ugacuuguauauuuuaaga

SEQ ID NO: 2483438 - RNA, 12 nt, Human
ugacuuguauau

SEQ ID NO: 2483439 - RNA, 19 nt, Human
ugacuuggggagauggagu

SEQ ID NO: 2483440 - RNA, 18 nt, Human
ugacuuggggagauggag

SEQ ID NO: 2483441 - RNA, 13 nt, Human
ugacuugcccagu

SEQ ID NO: 2483442 - RNA, 16 nt, Human
ugacuugacuuuaguc

SEQ ID NO: 2483443 - RNA, 18 nt, Human
ugacuucugccuggagac

SEQ ID NO: 2483444 - RNA, 19 nt, Human
ugacuugacagaacacugu

SEQ ID NO: 2483445 - RNA, 17 nt, Human
ugacuugacagaacacu

SEQ ID NO: 2483446 - RNA, 16 nt, Human
agauugugccccugca

SEQ ID NO: 2483447 - RNA, 21 nt, Human
agauugugccccugcacucca

SEQ ID NO: 2483448 - RNA, 12 nt, Human
agauugggucua

SEQ ID NO: 2483449 - RNA, 22 nt, Human
agauuggcucacacugagaaug

SEQ ID NO: 2483450 - RNA, 13 nt, Human
agauucacacugu

SEQ ID NO: 2483451 - RNA, 23 nt, Human
agauuggcucacacugagaaugu

SEQ ID NO: 2483452 - RNA, 17 nt, Human
agauucacacugucugg

SEQ ID NO: 2483453 - RNA, 16 nt, Human
agauuuaccacuugug

SEQ ID NO: 2483454 - RNA, 18 nt, Human
agauugugaauauuucca

SEQ ID NO: 2483455 - RNA, 14 nt, Human
agauuuaugcauau

SEQ ID NO: 2483456 - RNA, 22 nt, Human
agauuuaauuaaucaugaaugu

SEQ ID NO: 2483457 - RNA, 13 nt, Human
agauuuaauuaau

SEQ ID NO: 2483458 - RNA, 18 nt, Human
agauuuagugaaagcuag

SEQ ID NO: 2483459 - RNA, 12 nt, Human
agauuugaccua

SEQ ID NO: 2483460 - RNA, 13 nt, Human
agauuucaagaga

SEQ ID NO: 2483461 - RNA, 14 nt, Human
agauuucaagagau

SEQ ID NO: 2483462 - RNA, 16 nt, Human
agauuugaaggucugc

SEQ ID NO: 2483463 - RNA, 13 nt, Human
agauuugggcugg

SEQ ID NO: 2483464 - RNA, 16 nt, Human
agauuugugaacucag

SEQ ID NO: 2483465 - RNA, 15 nt, Human
agauuugugaacuca

SEQ ID NO: 2483466 - RNA, 13 nt, Human
agauuugugaacu

SEQ ID NO: 2483467 - RNA, 11 nt, Human
agauuugugaa

SEQ ID NO: 2483468 - RNA, 17 nt, Human
agauuugggcuggaaca

SEQ ID NO: 2483469 - RNA, 14 nt, Human
agauuugggcugga

SEQ ID NO: 2483470 - RNA, 14 nt, Human
agauuucacucucc

SEQ ID NO: 2483471 - RNA, 13 nt, Human
agauuucacucuc

SEQ ID NO: 2483472 - RNA, 16 nt, Human
agauuuaucaaaucag

SEQ ID NO: 2483473 - RNA, 15 nt, Human
agauuuaucaaauca

SEQ ID NO: 2483474 - RNA, 17 nt, Human
agauuuaucaaaucagu

SEQ ID NO: 2483475 - RNA, 13 nt, Human
agauuuaucaaau

SEQ ID NO: 2483476 - RNA, 16 nt, Human
agauuuacacugggag

SEQ ID NO: 2483477 - RNA, 15 nt, Human
agauuuacacuggga

SEQ ID NO: 2483478 - RNA, 22 nt, Human
agauuugugaacucagccaagc

SEQ ID NO: 2483479 - RNA, 19 nt, Human
agauuuucagcaaacucuu

SEQ ID NO: 2483480 - RNA, 17 nt, Human
agauuuucagaaaauau

SEQ ID NO: 2483481 - RNA, 15 nt, Human
agcaaaaagcaaaau

SEQ ID NO: 2483482 - RNA, 21 nt, Human
agauuugugaacucagccaag

SEQ ID NO: 2483483 - RNA, 19 nt, Human
agauuugugaacucagcca

SEQ ID NO: 2483484 - RNA, 12 nt, Human
agauuuucagaa

SEQ ID NO: 2483485 - RNA, 15 nt, Human
agcaacaauuuauga

SEQ ID NO: 2483486 - RNA, 12 nt, Human
agcaaaacaaaa

SEQ ID NO: 2483487 - RNA, 23 nt, Human
agauuuuccacaagauucccaga

SEQ ID NO: 2483488 - RNA, 15 nt, Human
agcaaccccaggcug

SEQ ID NO: 2483489 - RNA, 16 nt, Human
agcaaccccaggcuga

SEQ ID NO: 2483490 - RNA, 14 nt, Human
agcaaccccaggcu

SEQ ID NO: 2483491 - RNA, 15 nt, Human
agcaaccaguuggcu

SEQ ID NO: 2483492 - RNA, 22 nt, Human
agcaacauuuuacccacacaca

SEQ ID NO: 2483493 - RNA, 19 nt, Human
agcaacagguuuuauaauu

SEQ ID NO: 2483494 - RNA, 21 nt, Human
agcaacaucuagcaaauguua

SEQ ID NO: 2483495 - RNA, 23 nt, Human
agcaacaggaaucaagagcugcc

SEQ ID NO: 2483496 - RNA, 22 nt, Human
agcaacaggaaucaagagcugc

SEQ ID NO: 2483497 - RNA, 21 nt, Human
agcaacaggaaucaagagcug

SEQ ID NO: 2483498 - RNA, 18 nt, Human
agcaacagguuuuauaau

SEQ ID NO: 2483499 - RNA, 20 nt, Human
agcaacauuuuacccacaca

SEQ ID NO: 2483500 - RNA, 17 nt, Human
agcaacacaagcuggaa

SEQ ID NO: 2483501 - RNA, 14 nt, Human
agcaacacaagcug

SEQ ID NO: 2483502 - RNA, 21 nt, Human
agcaacaauuuaugaauugaa

SEQ ID NO: 2483503 - RNA, 20 nt, Human
agcaacacaagcuggaagca

SEQ ID NO: 2483504 - RNA, 18 nt, Human
agcaacacaagcuggaag

SEQ ID NO: 2483505 - RNA, 22 nt, Human
agcaacagagugagacccuguc

SEQ ID NO: 2483506 - RNA, 23 nt, Human
agcaacagagugagacccugucu

SEQ ID NO: 2483507 - RNA, 20 nt, Human
agcaacagagugagacccug

SEQ ID NO: 2483508 - RNA, 22 nt, Human
agaugucccuuucuuggccagu

SEQ ID NO: 2483509 - RNA, 20 nt, Human
agaugucccuuucuuggcca

SEQ ID NO: 2483510 - RNA, 21 nt, Human
agaugucccuuucuuggccag

SEQ ID NO: 2483511 - RNA, 18 nt, Human
agaugucagccgagccgg

SEQ ID NO: 2483512 - RNA, 20 nt, Human
agaugucagccgagccgggc

SEQ ID NO: 2483513 - RNA, 18 nt, Human
agaugucagacuggcugg

SEQ ID NO: 2483514 - RNA, 20 nt, Human
agaugucuucguacaguucu

SEQ ID NO: 2483515 - RNA, 19 nt, Human
agaugucuucguacaguuc

SEQ ID NO: 2483516 - RNA, 18 nt, Human
agaugucuucguacaguu

SEQ ID NO: 2483517 - RNA, 15 nt, Human
agaugucuucguaca

SEQ ID NO: 2483518 - RNA, 17 nt, Human
agaugucuucugccugu

SEQ ID NO: 2483519 - RNA, 16 nt, Human
agaugucuucugccug

SEQ ID NO: 2483520 - RNA, 18 nt, Human
agaugucuucugccuguu

SEQ ID NO: 2483521 - RNA, 13 nt, Human
agaugucuucgua

SEQ ID NO: 2483522 - RNA, 22 nt, Human
agaugucucuggcgugugggua

SEQ ID NO: 2483523 - RNA, 12 nt, Human
agaugucuauuc

SEQ ID NO: 2483524 - RNA, 18 nt, Human
agaugucuaauaguuauu

SEQ ID NO: 2483525 - RNA, 19 nt, Human
agauggaguucuugugcca

SEQ ID NO: 2483526 - RNA, 17 nt, Human
agauggaguucuugugc

SEQ ID NO: 2483527 - RNA, 11 nt, Human
agauggauucu

SEQ ID NO: 2483528 - RNA, 15 nt, Human
agauggauucucaga

SEQ ID NO: 2483529 - RNA, 16 nt, Human
agauggauucucagau

SEQ ID NO: 2483530 - RNA, 17 nt, Human
agauggauucucagaua

SEQ ID NO: 2483531 - RNA, 15 nt, Human
agaugucagacuggc

SEQ ID NO: 2483532 - RNA, 16 nt, Human
agauggcaaaugacca

SEQ ID NO: 2483533 - RNA, 23 nt, Human
agauggauucuccacucaguugc

SEQ ID NO: 2483534 - RNA, 18 nt, Human
agauggauugguguaaaa

SEQ ID NO: 2483535 - RNA, 15 nt, Human
agauggauuugccug

SEQ ID NO: 2483536 - RNA, 20 nt, Human
agauggauuugccugugcca

SEQ ID NO: 2483537 - RNA, 13 nt, Human
agauggauucucc

SEQ ID NO: 2483538 - RNA, 18 nt, Human
agauggauucuccacuca

SEQ ID NO: 2483539 - RNA, 18 nt, Human
agauggauucucagauau

SEQ ID NO: 2483540 - RNA, 20 nt, Human
agauggauucucagauauuu

SEQ ID NO: 2483541 - RNA, 18 nt, Human
agaugcuucucacugcca

SEQ ID NO: 2483542 - RNA, 16 nt, Human
agaugcuucucacugc

SEQ ID NO: 2483543 - RNA, 22 nt, Human
agaugcuuuucugucucugccu

SEQ ID NO: 2483544 - RNA, 19 nt, Human
agaugcuuuucugucucug

SEQ ID NO: 2483545 - RNA, 17 nt, Human
agaugcuuuucugucuc

SEQ ID NO: 2483546 - RNA, 16 nt, Human
agaugcuuuucugucu

SEQ ID NO: 2483547 - RNA, 12 nt, Human
agaugcuucugg

SEQ ID NO: 2483548 - RNA, 15 nt, Human
agaugcuucugggag

SEQ ID NO: 2483549 - RNA, 16 nt, Human
agaugcuucugggaga

SEQ ID NO: 2483550 - RNA, 23 nt, Human
agaugcuagaacucccuuucaac

SEQ ID NO: 2483551 - RNA, 22 nt, Human
agaugcuagaacucccuuucaa

SEQ ID NO: 2483552 - RNA, 14 nt, Human
agaugcaaagaggc

SEQ ID NO: 2483553 - RNA, 15 nt, Human
agaugcaaagaggca

SEQ ID NO: 2483554 - RNA, 16 nt, Human
agaugcaaagaggcaa

SEQ ID NO: 2483555 - RNA, 17 nt, Human
agaugcaaagaggcaag

SEQ ID NO: 2483556 - RNA, 18 nt, Human
agaugcaaagaggcaaga

SEQ ID NO: 2483557 - RNA, 17 nt, Human
ugaccccucauagcccu

SEQ ID NO: 2483558 - RNA, 13 nt, Human
ugacccagugaga

SEQ ID NO: 2483559 - RNA, 14 nt, Human
ugacccccagcucc

SEQ ID NO: 2483560 - RNA, 22 nt, Human
ugacccccaaccaaguggcucc

SEQ ID NO: 2483561 - RNA, 19 nt, Human
ugaccccucauagcccuca

SEQ ID NO: 2483562 - RNA, 20 nt, Human
ugaccccucauagcccucac

SEQ ID NO: 2483563 - RNA, 13 nt, Human
ugaccucugccug

SEQ ID NO: 2483564 - RNA, 18 nt, Human
ugaccugaaguucaccau

SEQ ID NO: 2483565 - RNA, 14 nt, Human
ugaccugaaguuca

SEQ ID NO: 2483566 - RNA, 13 nt, Human
ugaccugaaguuc

SEQ ID NO: 2483567 - RNA, 21 nt, Human
ugaccucuguuguccuccccu

SEQ ID NO: 2483568 - RNA, 22 nt, Human
ugaccucuguuguccuccccuu

SEQ ID NO: 2483569 - RNA, 12 nt, Human
ugaccugaggcc

SEQ ID NO: 2483570 - RNA, 19 nt, Human
ugaccucuguuguccuccc

SEQ ID NO: 2483571 - RNA, 18 nt, Human
ugaccucuguuguccucc

SEQ ID NO: 2483572 - RNA, 17 nt, Human
ugaccucuguuguccuc

SEQ ID NO: 2483573 - RNA, 14 nt, Human
ugaccucugccuga

SEQ ID NO: 2483574 - RNA, 23 nt, Human
ugacccagugcccccacugacca

SEQ ID NO: 2483575 - RNA, 17 nt, Human
ugacccagugcccccac

SEQ ID NO: 2483576 - RNA, 18 nt, Human
ugacccagugcccccacu

SEQ ID NO: 2483577 - RNA, 16 nt, Human
ugacccagugccccca

SEQ ID NO: 2483578 - RNA, 16 nt, Human
ugacccagucccuggg

SEQ ID NO: 2483579 - RNA, 20 nt, Human
ugacccagucccugggggaa

SEQ ID NO: 2483580 - RNA, 21 nt, Human
ugacccaguccccgugccccg

SEQ ID NO: 2483581 - RNA, 12 nt, Human
ugacccaguccc

SEQ ID NO: 2483582 - RNA, 14 nt, Human
ugacccagucccug

SEQ ID NO: 2483583 - RNA, 15 nt, Human
ugacccagucccugg

SEQ ID NO: 2483584 - RNA, 22 nt, Human
ugacccaggccgcagcucuugc

SEQ ID NO: 2483585 - RNA, 21 nt, Human
ugacccaggccgcagcucuug

SEQ ID NO: 2483586 - RNA, 19 nt, Human
ugacccaggccgcagcucu

SEQ ID NO: 2483587 - RNA, 16 nt, Human
ugacccaggccgcagc

SEQ ID NO: 2483588 - RNA, 19 nt, Human
agauguguugcuauccuga

SEQ ID NO: 2483589 - RNA, 19 nt, Human
ugacccaggcugggcaagg

SEQ ID NO: 2483590 - RNA, 17 nt, Human
ugacccaggcugggcaa

SEQ ID NO: 2483591 - RNA, 15 nt, Human
ugacccaggcugggc

SEQ ID NO: 2483592 - RNA, 14 nt, Human
ugacccaggcuggg

SEQ ID NO: 2483593 - RNA, 12 nt, Human
ugacccaggcug

SEQ ID NO: 2483594 - RNA, 13 nt, Human
ugacccaggcugg

SEQ ID NO: 2483595 - RNA, 18 nt, Human
agauguguucacaaugga

SEQ ID NO: 2483596 - RNA, 15 nt, Human
agauguguucacaau

SEQ ID NO: 2483597 - RNA, 16 nt, Human
agaugugucuauggcu

SEQ ID NO: 2483598 - RNA, 17 nt, Human
agaucagagcagcagug

SEQ ID NO: 2483599 - RNA, 20 nt, Human
agaucagcaaaccggggccu

SEQ ID NO: 2483600 - RNA, 18 nt, Human
agaucacuuucucaguuu

SEQ ID NO: 2483601 - RNA, 19 nt, Human
agaucacuuucucaguuuu

SEQ ID NO: 2483602 - RNA, 23 nt, Human
agaucacuuucucaguuuucaua

SEQ ID NO: 2483603 - RNA, 19 nt, Human
ugaauuuaauaaucuguag

SEQ ID NO: 2483604 - RNA, 19 nt, Human
ugaauuuaaauauaauucu

SEQ ID NO: 2483605 - RNA, 16 nt, Human
ugaauuuaaauauaau

SEQ ID NO: 2483606 - RNA, 15 nt, Human
ugaauuuaaauauaa

SEQ ID NO: 2483607 - RNA, 20 nt, Human
ugaauuuaaauauaauucug

SEQ ID NO: 2483608 - RNA, 18 nt, Human
ugaauuuauuauuguucu

SEQ ID NO: 2483609 - RNA, 15 nt, Human
ugaauuuauuauugu

SEQ ID NO: 2483610 - RNA, 14 nt, Human
ugacaguaguacca

SEQ ID NO: 2483611 - RNA, 17 nt, Human
ugacagguuugggaccc

SEQ ID NO: 2483612 - RNA, 15 nt, Human
ugacauugcguuuga

SEQ ID NO: 2483613 - RNA, 19 nt, Human
ugacauugcguuugaccuu

SEQ ID NO: 2483614 - RNA, 20 nt, Human
ugacagugccugggaaugua

SEQ ID NO: 2483615 - RNA, 23 nt, Human
ugacagucuugugcuuuuccuau

SEQ ID NO: 2483616 - RNA, 17 nt, Human
ugacagugccugggaau

SEQ ID NO: 2483617 - RNA, 15 nt, Human
ugacagucuugugcu

SEQ ID NO: 2483618 - RNA, 18 nt, Human
ugacaguccucuccaccu

SEQ ID NO: 2483619 - RNA, 14 nt, Human
ugacagugccuggg

SEQ ID NO: 2483620 - RNA, 17 nt, Human
ugacaguccucuccacc

SEQ ID NO: 2483621 - RNA, 16 nt, Human
ugacaguccucuccac

SEQ ID NO: 2483622 - RNA, 15 nt, Human
ugacaguccucucca

SEQ ID NO: 2483623 - RNA, 21 nt, Human
ugacaguaguaccaaaugcuu

SEQ ID NO: 2483624 - RNA, 15 nt, Human
ugacauugcuuuacu

SEQ ID NO: 2483625 - RNA, 13 nt, Human
ugacauugcuuua

SEQ ID NO: 2483626 - RNA, 19 nt, Human
ugacauugcuaagaugcuc

SEQ ID NO: 2483627 - RNA, 18 nt, Human
ugacauugcuaagaugcu

SEQ ID NO: 2483628 - RNA, 16 nt, Human
ugacauugcuaagaug

SEQ ID NO: 2483629 - RNA, 18 nt, Human
ugacauuguagagcuucu

SEQ ID NO: 2483630 - RNA, 14 nt, Human
ugacauuuugccaa

SEQ ID NO: 2483631 - RNA, 14 nt, Human
ugaccaaaguccuu

SEQ ID NO: 2483632 - RNA, 16 nt, Human
ugaccaaaguccuuuu

SEQ ID NO: 2483633 - RNA, 16 nt, Human
ugaccaaaauccccuu

SEQ ID NO: 2483634 - RNA, 18 nt, Human
ugaccaaaauccccuucu

SEQ ID NO: 2483635 - RNA, 12 nt, Human
ugaccacacucc

SEQ ID NO: 2483636 - RNA, 17 nt, Human
ugaccacacuccagcug

SEQ ID NO: 2483637 - RNA, 19 nt, Human
ugaccacacuccagcuggg

SEQ ID NO: 2483638 - RNA, 20 nt, Human
ugaccacacuccagcuggga

SEQ ID NO: 2483639 - RNA, 17 nt, Human
ugaccaacaguuccuuc

SEQ ID NO: 2483640 - RNA, 16 nt, Human
ugaccaacauggagaa

SEQ ID NO: 2483641 - RNA, 17 nt, Human
ugaccaacauggagaaa

SEQ ID NO: 2483642 - RNA, 15 nt, Human
ugaccaaugucuuga

SEQ ID NO: 2483643 - RNA, 18 nt, Human
ugaccaacauggagaaac

SEQ ID NO: 2483644 - RNA, 20 nt, Human
ugaccaacauggagaaaccc

SEQ ID NO: 2483645 - RNA, 21 nt, Human
agaucauugugaaauuauuca

SEQ ID NO: 2483646 - RNA, 15 nt, Human
ugaccacacuuccug

SEQ ID NO: 2483647 - RNA, 18 nt, Human
ugaccacacuuccugucc

SEQ ID NO: 2483648 - RNA, 20 nt, Human
ugaccacacuuccuguccag

SEQ ID NO: 2483649 - RNA, 12 nt, Human
agaucauuguga

SEQ ID NO: 2483650 - RNA, 23 nt, Human
agauccaaaagaagcccccagcu

SEQ ID NO: 2483651 - RNA, 18 nt, Human
agauccaaaagaagcccc

SEQ ID NO: 2483652 - RNA, 23 nt, Human
ugaccacacuuccuguccagaga

SEQ ID NO: 2483653 - RNA, 21 nt, Human
agauccaaaagaagcccccag

SEQ ID NO: 2483654 - RNA, 14 nt, Human
agauccacacacag

SEQ ID NO: 2483655 - RNA, 15 nt, Human
agauccacacacaga

SEQ ID NO: 2483656 - RNA, 16 nt, Human
agauccacacacagag

SEQ ID NO: 2483657 - RNA, 17 nt, Human
agauccacacacagagg

SEQ ID NO: 2483658 - RNA, 18 nt, Human
agauccacacacagagga

SEQ ID NO: 2483659 - RNA, 19 nt, Human
agaugauuuaaaagggaag

SEQ ID NO: 2483660 - RNA, 17 nt, Human
agaugaugggggagggg

SEQ ID NO: 2483661 - RNA, 19 nt, Human
agaugauggaugccaauau

SEQ ID NO: 2483662 - RNA, 16 nt, Human
agaugauggaugccaa

SEQ ID NO: 2483663 - RNA, 21 nt, Human
agaucgugccguuacucucca

SEQ ID NO: 2483664 - RNA, 19 nt, Human
agaugaugaugaucuuuaa

SEQ ID NO: 2483665 - RNA, 20 nt, Human
agauccuuguuucaaacaca

SEQ ID NO: 2483666 - RNA, 18 nt, Human
agauccuuguuucaaaca

SEQ ID NO: 2483667 - RNA, 20 nt, Human
agauccuuuaaauccuucca

SEQ ID NO: 2483668 - RNA, 14 nt, Human
agaucgcaguuugc

SEQ ID NO: 2483669 - RNA, 15 nt, Human
agaucgcccccaccu

SEQ ID NO: 2483670 - RNA, 16 nt, Human
agaucgcaucauugca

SEQ ID NO: 2483671 - RNA, 15 nt, Human
agaucgcaguuugcc

SEQ ID NO: 2483672 - RNA, 20 nt, Human
agaucgcgccacugcacucc

SEQ ID NO: 2483673 - RNA, 15 nt, Human
agaucgcgccacugc

SEQ ID NO: 2483674 - RNA, 13 nt, Human
agauccagccugg

SEQ ID NO: 2483675 - RNA, 14 nt, Human
agauccagccuggg

SEQ ID NO: 2483676 - RNA, 12 nt, Human
agauccaggacu

SEQ ID NO: 2483677 - RNA, 21 nt, Human
agauccugucuuuaaggaaaa

SEQ ID NO: 2483678 - RNA, 15 nt, Human
agauccuuguuucaa

SEQ ID NO: 2483679 - RNA, 14 nt, Human
agauccuuguuuca

SEQ ID NO: 2483680 - RNA, 15 nt, Human
agauccuuccuuuug

SEQ ID NO: 2483681 - RNA, 21 nt, Human
agauaauguuagagguuuuaa

SEQ ID NO: 2483682 - RNA, 19 nt, Human
agauaaugugauauuauac

SEQ ID NO: 2483683 - RNA, 12 nt, Human
agauaauuauaa

SEQ ID NO: 2483684 - RNA, 18 nt, Human
agauaauucuagcuuuga

SEQ ID NO: 2483685 - RNA, 13 nt, Human
agauaaugugaaa

SEQ ID NO: 2483686 - RNA, 18 nt, Human
agauaaugugaaaauggu

SEQ ID NO: 2483687 - RNA, 12 nt, Human
agauaaugugaa

SEQ ID NO: 2483688 - RNA, 15 nt, Human
agauaaucucucagc

SEQ ID NO: 2483689 - RNA, 23 nt, Human
agauaaucuagaacacaggcaaa

SEQ ID NO: 2483690 - RNA, 16 nt, Human
agauaaucuagaacac

SEQ ID NO: 2483691 - RNA, 16 nt, Human
agauaaguguauuuuu

SEQ ID NO: 2483692 - RNA, 18 nt, Human
agauaaguguauuuuuca

SEQ ID NO: 2483693 - RNA, 20 nt, Human
agauaaguguauuuuucaau

SEQ ID NO: 2483694 - RNA, 14 nt, Human
agauaauaauauau

SEQ ID NO: 2483695 - RNA, 17 nt, Human
agauaauaauauauguu

SEQ ID NO: 2483696 - RNA, 16 nt, Human
agauaauaauauaugu

SEQ ID NO: 2483697 - RNA, 15 nt, Human
agauaaucagccucu

SEQ ID NO: 2483698 - RNA, 19 nt, Human
agauaaucagugugucuaa

SEQ ID NO: 2483699 - RNA, 16 nt, Human
agauaaucagccucuu

SEQ ID NO: 2483700 - RNA, 17 nt, Human
agauaaucagccucuua

SEQ ID NO: 2483701 - RNA, 19 nt, Human
agaguuuugucuugaaugu

SEQ ID NO: 2483702 - RNA, 16 nt, Human
agaguuuugucuugaa

SEQ ID NO: 2483703 - RNA, 14 nt, Human
agaguuuugucuug

SEQ ID NO: 2483704 - RNA, 13 nt, Human
agaguuuugucuu

SEQ ID NO: 2483705 - RNA, 21 nt, Human
agaguuuuggaugcagugcuc

SEQ ID NO: 2483706 - RNA, 18 nt, Human
agagugagggccugaggu

SEQ ID NO: 2483707 - RNA, 21 nt, Human
agagugagagggcaugcgcac

SEQ ID NO: 2483708 - RNA, 19 nt, Human
agagugagacucugucuca

SEQ ID NO: 2483709 - RNA, 15 nt, Human
agagugagacccugu

SEQ ID NO: 2483710 - RNA, 18 nt, Human
agagugagacucagucuu

SEQ ID NO: 2483711 - RNA, 14 nt, Human
agagugagagggca

SEQ ID NO: 2483712 - RNA, 15 nt, Human
agauaaagaugaucu

SEQ ID NO: 2483713 - RNA, 13 nt, Human
agauaaagaugau

SEQ ID NO: 2483714 - RNA, 16 nt, Human
agauaaagaugaucua

SEQ ID NO: 2483715 - RNA, 11 nt, Human
agauaaagaug

SEQ ID NO: 2483716 - RNA, 19 nt, Human
agauaaacucagaaauuua

SEQ ID NO: 2483717 - RNA, 22 nt, Human
agauaaaauuauagaugggaau

SEQ ID NO: 2483718 - RNA, 21 nt, Human
agauaaaauuauagaugggaa

SEQ ID NO: 2483719 - RNA, 13 nt, Human
agauaaacucaga

SEQ ID NO: 2483720 - RNA, 19 nt, Human
agauaaggguaucugguga

SEQ ID NO: 2483721 - RNA, 17 nt, Human
agauaaggguaucuggu

SEQ ID NO: 2483722 - RNA, 14 nt, Human
agauaaagauuucu

SEQ ID NO: 2483723 - RNA, 17 nt, Human
agauaaagauuucuuga

SEQ ID NO: 2483724 - RNA, 14 nt, Human
agauaccagcgagg

SEQ ID NO: 2483725 - RNA, 19 nt, Human
agauaccagcgaggaggcu

SEQ ID NO: 2483726 - RNA, 21 nt, Human
agauaccagcgaggaggcucc

SEQ ID NO: 2483727 - RNA, 23 nt, Human
agauaccagcgaggaggcuccag

SEQ ID NO: 2483728 - RNA, 23 nt, Human
agauacaauguauuuauuuaaaa

SEQ ID NO: 2483729 - RNA, 21 nt, Human
agauacaugguugugaccuga

SEQ ID NO: 2483730 - RNA, 20 nt, Human
agauacagaacucuuucaaa

SEQ ID NO: 2483731 - RNA, 13 nt, Human
agauacaauguau

SEQ ID NO: 2483732 - RNA, 16 nt, Human
agauacaauguauuua

SEQ ID NO: 2483733 - RNA, 15 nt, Human
agauacaauguauuu

SEQ ID NO: 2483734 - RNA, 18 nt, Human
agauacagaacucuuuca

SEQ ID NO: 2483735 - RNA, 19 nt, Human
agauacaggaaaagcugcu

SEQ ID NO: 2483736 - RNA, 17 nt, Human
agauaccucacccugcu

SEQ ID NO: 2483737 - RNA, 14 nt, Human
agauaccucacccu

SEQ ID NO: 2483738 - RNA, 13 nt, Human
agauaccucaccc

SEQ ID NO: 2483739 - RNA, 22 nt, Human
agauaccuaaaagagauuucaa

SEQ ID NO: 2483740 - RNA, 19 nt, Human
agauaccuaaaagagauuu

SEQ ID NO: 2483741 - RNA, 18 nt, Human
agauaccagguugaaaga

SEQ ID NO: 2483742 - RNA, 19 nt, Human
agauaccagguugaaagac

SEQ ID NO: 2483743 - RNA, 22 nt, Human
agauauuuugcuuugugauuuu

SEQ ID NO: 2483744 - RNA, 17 nt, Human
agauauuuuuaucuuua

SEQ ID NO: 2483745 - RNA, 19 nt, Human
agauauuuuuaucuuuaua

SEQ ID NO: 2483746 - RNA, 14 nt, Human
agauacgacuuuau

SEQ ID NO: 2483747 - RNA, 19 nt, Human
agaucaaccccuucgcucc

SEQ ID NO: 2483748 - RNA, 14 nt, Human
agaucaaccccuuc

SEQ ID NO: 2483749 - RNA, 20 nt, Human
agauauuuuuaucuuuauau

SEQ ID NO: 2483750 - RNA, 21 nt, Human
agauauuuuuaucuuuauaug

SEQ ID NO: 2483751 - RNA, 13 nt, Human
agauauuuuucau

SEQ ID NO: 2483752 - RNA, 12 nt, Human
agauauuuuuca

SEQ ID NO: 2483753 - RNA, 19 nt, Human
agauauuuuucaugauuuu

SEQ ID NO: 2483754 - RNA, 16 nt, Human
agauauuuuucaugau

SEQ ID NO: 2483755 - RNA, 19 nt, Human
agauauuuuuccauuuuuu

SEQ ID NO: 2483756 - RNA, 16 nt, Human
agauacgacuuuauuu

SEQ ID NO: 2483757 - RNA, 18 nt, Human
agauauuuuuucagaaau

SEQ ID NO: 2483758 - RNA, 15 nt, Human
agaucaagagaucaa

SEQ ID NO: 2483759 - RNA, 19 nt, Human
agauauuuuuucagaaaua

SEQ ID NO: 2483760 - RNA, 21 nt, Human
agauauuuuuucagaaauaug

SEQ ID NO: 2483761 - RNA, 22 nt, Human
agauauuuuuucagaaauaugu

SEQ ID NO: 2483762 - RNA, 21 nt, Human
agaucaaccccuucgcuccug

SEQ ID NO: 2483763 - RNA, 11 nt, Human
agaucacuuuc

SEQ ID NO: 2483764 - RNA, 15 nt, Human
agaucacuacugcag

SEQ ID NO: 2483765 - RNA, 14 nt, Human
agaucacuacugca

SEQ ID NO: 2483766 - RNA, 23 nt, Human
agaucacgcuccccgccuguucc

SEQ ID NO: 2483767 - RNA, 22 nt, Human
agaucacgcuccccgccuguuc

SEQ ID NO: 2483768 - RNA, 21 nt, Human
agaucacgcuccccgccuguu

SEQ ID NO: 2483769 - RNA, 18 nt, Human
agaucacguuccuucccc

SEQ ID NO: 2483770 - RNA, 12 nt, Human
ugaaugcuuuuu

SEQ ID NO: 2483771 - RNA, 19 nt, Human
ugaaugcuuuuugaauguu

SEQ ID NO: 2483772 - RNA, 18 nt, Human
ugaaugcuuuuugaaugu

SEQ ID NO: 2483773 - RNA, 23 nt, Human
ugaaugcuuuuugaauguuauuu

SEQ ID NO: 2483774 - RNA, 22 nt, Human
ugaaugccacugccuucgcuuc

SEQ ID NO: 2483775 - RNA, 21 nt, Human
ugaaugccacugccuucgcuu

SEQ ID NO: 2483776 - RNA, 21 nt, Human
ugaaugcuuauagguggccuc

SEQ ID NO: 2483777 - RNA, 14 nt, Human
ugaaugcauaaaau

SEQ ID NO: 2483778 - RNA, 23 nt, Human
ugaaugcccacaggcaaaugcau

SEQ ID NO: 2483779 - RNA, 23 nt, Human
ugaauggauuggauuauuuaaua

SEQ ID NO: 2483780 - RNA, 22 nt, Human
ugaauggauuggauuauuuaau

SEQ ID NO: 2483781 - RNA, 21 nt, Human
ugaauggauuggauuauuuaa

SEQ ID NO: 2483782 - RNA, 20 nt, Human
ugaauggauuggauuauuua

SEQ ID NO: 2483783 - RNA, 17 nt, Human
ugaauggauuggauuau

SEQ ID NO: 2483784 - RNA, 15 nt, Human
ugaauggauuggauu

SEQ ID NO: 2483785 - RNA, 14 nt, Human
ugaauggauuggau

SEQ ID NO: 2483786 - RNA, 12 nt, Human
ugaauggccugc

SEQ ID NO: 2483787 - RNA, 15 nt, Human
ugaauggccugccuu

SEQ ID NO: 2483788 - RNA, 17 nt, Human
ugaauggccugccuuga

SEQ ID NO: 2483789 - RNA, 21 nt, Human
ugaauggccugccuugaagcc

SEQ ID NO: 2483790 - RNA, 14 nt, Human
ugaaugcauuuugu

SEQ ID NO: 2483791 - RNA, 13 nt, Human
ugaaugcauuuug

SEQ ID NO: 2483792 - RNA, 12 nt, Human
ugaaugcauuuu

SEQ ID NO: 2483793 - RNA, 21 nt, Human
ugaaugcauuuuguuugguau

SEQ ID NO: 2483794 - RNA, 15 nt, Human
ugaaugcauuuuguu

SEQ ID NO: 2483795 - RNA, 15 nt, Human
ugaaugccacugccu

SEQ ID NO: 2483796 - RNA, 22 nt, Human
ugaaugcauuuuguuugguauu

SEQ ID NO: 2483797 - RNA, 16 nt, Human
ugaaugcauaaaaugu

SEQ ID NO: 2483798 - RNA, 15 nt, Human
ugaaugcauaaaaug

SEQ ID NO: 2483799 - RNA, 18 nt, Human
ugaauauccccucccagu

SEQ ID NO: 2483800 - RNA, 16 nt, Human
ugaauauccccuccca

SEQ ID NO: 2483801 - RNA, 14 nt, Human
ugaauauccccucc

SEQ ID NO: 2483802 - RNA, 13 nt, Human
ugaauauccccuc

SEQ ID NO: 2483803 - RNA, 23 nt, Human
ugaagguuuacaauuuacaaagu

SEQ ID NO: 2483804 - RNA, 18 nt, Human
ugaauauauuauaaucuu

SEQ ID NO: 2483805 - RNA, 21 nt, Human
ugaauauacagcaggugcuca

SEQ ID NO: 2483806 - RNA, 22 nt, Human
ugaauauaccccuuaguguuug

SEQ ID NO: 2483807 - RNA, 16 nt, Human
ugaauauaaacacuau

SEQ ID NO: 2483808 - RNA, 22 nt, Human
ugaauauaauauauuuguguau

SEQ ID NO: 2483809 - RNA, 21 nt, Human
ugaauauaauauauuugugua

SEQ ID NO: 2483810 - RNA, 22 nt, Human
ugaagguuuacaauuuacaaag

SEQ ID NO: 2483811 - RNA, 21 nt, Human
ugaagguuuacaauuuacaaa

SEQ ID NO: 2483812 - RNA, 14 nt, Human
ugaagguuuacaau

SEQ ID NO: 2483813 - RNA, 20 nt, Human
ugaagguuaggauuuaacag

SEQ ID NO: 2483814 - RNA, 16 nt, Human
ugaagguuaggauuua

SEQ ID NO: 2483815 - RNA, 14 nt, Human
ugaagguugaagag

SEQ ID NO: 2483816 - RNA, 14 nt, Human
ugaauauaaacacu

SEQ ID NO: 2483817 - RNA, 15 nt, Human
ugaauauaaacacua

SEQ ID NO: 2483818 - RNA, 13 nt, Human
ugaagguuucuga

SEQ ID NO: 2483819 - RNA, 18 nt, Human
ugaagguggaaauaaacu

SEQ ID NO: 2483820 - RNA, 19 nt, Human
ugaaggugcugacggccag

SEQ ID NO: 2483821 - RNA, 20 nt, Human
ugaaggugcugacggccagg

SEQ ID NO: 2483822 - RNA, 14 nt, Human
ugaaggugucagaa

SEQ ID NO: 2483823 - RNA, 15 nt, Human
ugaagguuaggauuu

SEQ ID NO: 2483824 - RNA, 15 nt, Human
ugaaggugucagaau

SEQ ID NO: 2483825 - RNA, 15 nt, Human
ugaaggugcugacgg

SEQ ID NO: 2483826 - RNA, 23 nt, Human
ugaagcuuuauacguguagcuau

SEQ ID NO: 2483827 - RNA, 14 nt, Human
ugaagcuuuauacg

SEQ ID NO: 2483828 - RNA, 23 nt, Human
ugaagcuuguguauccauuauca

SEQ ID NO: 2483829 - RNA, 15 nt, Human
ugaagcuuguguauc

SEQ ID NO: 2483830 - RNA, 12 nt, Human
ugaagcuuuaua

SEQ ID NO: 2483831 - RNA, 14 nt, Human
ugaagcuuguguau

SEQ ID NO: 2483832 - RNA, 13 nt, Human
ugaagcuugugua

SEQ ID NO: 2483833 - RNA, 12 nt, Human
ugaagcuuccuu

SEQ ID NO: 2483834 - RNA, 14 nt, Human
agagugaacaaauu

SEQ ID NO: 2483835 - RNA, 22 nt, Human
agagucucacuguugcccaggc

SEQ ID NO: 2483836 - RNA, 20 nt, Human
agagucucacuguugcccag

SEQ ID NO: 2483837 - RNA, 22 nt, Human
agagugaacaaauuuacagaga

SEQ ID NO: 2483838 - RNA, 16 nt, Human
agagugagacucuguc

SEQ ID NO: 2483839 - RNA, 15 nt, Human
agagugagacucugu

SEQ ID NO: 2483840 - RNA, 18 nt, Human
ugaaugucagugugacug

SEQ ID NO: 2483841 - RNA, 15 nt, Human
ugaaugucaguguga

SEQ ID NO: 2483842 - RNA, 17 nt, Human
ugaauguauuuauuugg

SEQ ID NO: 2483843 - RNA, 14 nt, Human
ugaaugucagugug

SEQ ID NO: 2483844 - RNA, 22 nt, Human
agagucggaacggagaaaggug

SEQ ID NO: 2483845 - RNA, 21 nt, Human
agaguccugcacaguuuucug

SEQ ID NO: 2483846 - RNA, 14 nt, Human
agaguccugcacag

SEQ ID NO: 2483847 - RNA, 14 nt, Human
agaguccucuggau

SEQ ID NO: 2483848 - RNA, 14 nt, Human
agaguccucacucc

SEQ ID NO: 2483849 - RNA, 14 nt, Human
agaguccucugaau

SEQ ID NO: 2483850 - RNA, 19 nt, Human
ugaauguauuuauuuggga

SEQ ID NO: 2483851 - RNA, 23 nt, Human
ugaauguauuuauuugggagacc

SEQ ID NO: 2483852 - RNA, 12 nt, Human
agaguccucuga

SEQ ID NO: 2483853 - RNA, 13 nt, Human
agaguccucugaa

SEQ ID NO: 2483854 - RNA, 19 nt, Human
agagcuucuguugcugccu

SEQ ID NO: 2483855 - RNA, 20 nt, Human
agagcuucuguugcugccuc

SEQ ID NO: 2483856 - RNA, 20 nt, Human
agaggaaaaugaauaauaca

SEQ ID NO: 2483857 - RNA, 17 nt, Human
agaggaaaaugaauaau

SEQ ID NO: 2483858 - RNA, 16 nt, Human
agaggaaaaugaauaa

SEQ ID NO: 2483859 - RNA, 21 nt, Human
agagcuucuguugcugccuca

SEQ ID NO: 2483860 - RNA, 17 nt, Human
agagcuucccugacuca

SEQ ID NO: 2483861 - RNA, 20 nt, Human
agagcuucccugacucauuc

SEQ ID NO: 2483862 - RNA, 15 nt, Human
agagcuucuggcacu

SEQ ID NO: 2483863 - RNA, 13 nt, Human
agagcuucccuga

SEQ ID NO: 2483864 - RNA, 16 nt, Human
agagcuucccugacuc

SEQ ID NO: 2483865 - RNA, 12 nt, Human
agagcuucccug

SEQ ID NO: 2483866 - RNA, 15 nt, Human
agagcuggugcccgg

SEQ ID NO: 2483867 - RNA, 19 nt, Human
agagcugggugucaagagg

SEQ ID NO: 2483868 - RNA, 13 nt, Human
agagcuggugccc

SEQ ID NO: 2483869 - RNA, 21 nt, Human
agagcugguaguuaguagcau

SEQ ID NO: 2483870 - RNA, 23 nt, Human
agagcugguaguuaguagcaugu

SEQ ID NO: 2483871 - RNA, 18 nt, Human
agagcuggggcugaggga

SEQ ID NO: 2483872 - RNA, 13 nt, Human
agagcugggaggg

SEQ ID NO: 2483873 - RNA, 21 nt, Human
agagcuggggcugagggaugg

SEQ ID NO: 2483874 - RNA, 23 nt, Human
agagcugggaggcauggcccugg

SEQ ID NO: 2483875 - RNA, 22 nt, Human
agagcugggaggcauggcccug

SEQ ID NO: 2483876 - RNA, 12 nt, Human
agagcugggagg

SEQ ID NO: 2483877 - RNA, 21 nt, Human
ugaacuuucucuucauacuuu

SEQ ID NO: 2483878 - RNA, 16 nt, Human
agagcuggcucugagc

SEQ ID NO: 2483879 - RNA, 15 nt, Human
agagcuggcucugag

SEQ ID NO: 2483880 - RNA, 12 nt, Human
agagcuggcucu

SEQ ID NO: 2483881 - RNA, 13 nt, Human
agagcuggcucug

SEQ ID NO: 2483882 - RNA, 19 nt, Human
agaggaaagcaaaggagau

SEQ ID NO: 2483883 - RNA, 18 nt, Human
agaggaaagcaaaggaga

SEQ ID NO: 2483884 - RNA, 16 nt, Human
agaggaaagcaaagga

SEQ ID NO: 2483885 - RNA, 12 nt, Human
agaggaaagcaa

SEQ ID NO: 2483886 - RNA, 12 nt, Human
agaggaaaucac

SEQ ID NO: 2483887 - RNA, 11 nt, Human
agaggaaauca

SEQ ID NO: 2483888 - RNA, 21 nt, Human
agaggaaaucaccgaaaacgu

SEQ ID NO: 2483889 - RNA, 23 nt, Human
agaggaaauaagaaaaaucaugu

SEQ ID NO: 2483890 - RNA, 22 nt, Human
agaggaaauaagaaaaaucaug

SEQ ID NO: 2483891 - RNA, 14 nt, Human
agaggaaauaagaa

SEQ ID NO: 2483892 - RNA, 18 nt, Human
agaggcaacugcauuggc

SEQ ID NO: 2483893 - RNA, 11 nt, Human
ugaacuuugac

SEQ ID NO: 2483894 - RNA, 15 nt, Human
ucuuuguaaugaaaa

SEQ ID NO: 2483895 - RNA, 13 nt, Human
ucuuuguaaugaa

SEQ ID NO: 2483896 - RNA, 21 nt, Human
ucuuuggucuacacugugcug

SEQ ID NO: 2483897 - RNA, 14 nt, Human
ucuuuggucuacac

SEQ ID NO: 2483898 - RNA, 12 nt, Human
ucuuuguaauga

SEQ ID NO: 2483899 - RNA, 22 nt, Human
ucuuuguaagaguguagaagca

SEQ ID NO: 2483900 - RNA, 21 nt, Human
ucuuuguaagaguguagaagc

SEQ ID NO: 2483901 - RNA, 19 nt, Human
ucuuuguaagaguguagaa

SEQ ID NO: 2483902 - RNA, 24 nt, Human
ucuuuguaagaguguagaagcauu

SEQ ID NO: 2483903 - RNA, 23 nt, Human
ucuuuguaagaguguagaagcau

SEQ ID NO: 2483904 - RNA, 20 nt, Human
ugaagaagcaccaaucauga

SEQ ID NO: 2483905 - RNA, 14 nt, Human
ugaagaagauggua

SEQ ID NO: 2483906 - RNA, 16 nt, Human
ugaacuuugaccucug

SEQ ID NO: 2483907 - RNA, 17 nt, Human
ugaacuuugaccucugc

SEQ ID NO: 2483908 - RNA, 20 nt, Human
ugaagaacugcaggcccugg

SEQ ID NO: 2483909 - RNA, 22 nt, Human
ugaacuuucucuucauacuuuu

SEQ ID NO: 2483910 - RNA, 11 nt, Human
ugaacuuucuc

SEQ ID NO: 2483911 - RNA, 23 nt, Human
ucuuuguaaucguuaugugugua

SEQ ID NO: 2483912 - RNA, 13 nt, Human
ugaagacaaugac

SEQ ID NO: 2483913 - RNA, 17 nt, Human
ugaagacaaugacuuac

SEQ ID NO: 2483914 - RNA, 11 nt, Human
ugaagacaaug

SEQ ID NO: 2483915 - RNA, 23 nt, Human
ugaagaacugcaggcccuggccu

SEQ ID NO: 2483916 - RNA, 11 nt, Human
ugaagaagaga

SEQ ID NO: 2483917 - RNA, 21 nt, Human
agaggcuucuucagaucagug

SEQ ID NO: 2483918 - RNA, 16 nt, Human
agaggcuagcuucugc

SEQ ID NO: 2483919 - RNA, 19 nt, Human
agaggcuaaauuacucagg

SEQ ID NO: 2483920 - RNA, 17 nt, Human
agaggcuagcuucugcu

SEQ ID NO: 2483921 - RNA, 21 nt, Human
agaggcuaaauuacucaggaa

SEQ ID NO: 2483922 - RNA, 19 nt, Human
agaggcuagcuucugcuuu

SEQ ID NO: 2483923 - RNA, 14 nt, Human
agagggaagaaaag

SEQ ID NO: 2483924 - RNA, 15 nt, Human
agagggaagaaaaga

SEQ ID NO: 2483925 - RNA, 23 nt, Human
agagggaagaaaagagcuuucuu

SEQ ID NO: 2483926 - RNA, 20 nt, Human
agaggcgggccagccaggcg

SEQ ID NO: 2483927 - RNA, 19 nt, Human
agaggcgggccagccaggc

SEQ ID NO: 2483928 - RNA, 18 nt, Human
agaggcgggccagccagg

SEQ ID NO: 2483929 - RNA, 17 nt, Human
agaggcgggccagccag

SEQ ID NO: 2483930 - RNA, 16 nt, Human
agaggcgucuguauau

SEQ ID NO: 2483931 - RNA, 16 nt, Human
agaggcgggccagcca

SEQ ID NO: 2483932 - RNA, 15 nt, Human
agaggcgggccagcc

SEQ ID NO: 2483933 - RNA, 14 nt, Human
agaggcgggccagc

SEQ ID NO: 2483934 - RNA, 13 nt, Human
agaggcgggccag

SEQ ID NO: 2483935 - RNA, 19 nt, Human
agaggccuuuuggaaugug

SEQ ID NO: 2483936 - RNA, 18 nt, Human
agaggcaccugucccaga

SEQ ID NO: 2483937 - RNA, 18 nt, Human
agaggcagaaaauugcac

SEQ ID NO: 2483938 - RNA, 20 nt, Human
agaggcagaaaauugcacaa

SEQ ID NO: 2483939 - RNA, 21 nt, Human
agaggauuuuuuucugagcga

SEQ ID NO: 2483940 - RNA, 20 nt, Human
agaggaaauauugcuggggu

SEQ ID NO: 2483941 - RNA, 19 nt, Human
agaggaaauauugcugggg

SEQ ID NO: 2483942 - RNA, 24 nt, Human
agaggcaccacuaaaagaucgcag

SEQ ID NO: 2483943 - RNA, 21 nt, Human
agaggcgcaugaauuugugaa

SEQ ID NO: 2483944 - RNA, 21 nt, Human
agaggcagagaaagaagagac

SEQ ID NO: 2483945 - RNA, 20 nt, Human
agaggcagagaaagaagaga

SEQ ID NO: 2483946 - RNA, 18 nt, Human
agaggcagagaaagaaga

SEQ ID NO: 2483947 - RNA, 17 nt, Human
agaggcagagaaagaag

SEQ ID NO: 2483948 - RNA, 14 nt, Human
agaggcagagaaag

SEQ ID NO: 2483949 - RNA, 13 nt, Human
agaggcagagaaa

SEQ ID NO: 2483950 - RNA, 21 nt, Human
agagggacgccugggggugcc

SEQ ID NO: 2483951 - RNA, 15 nt, Human
agagggacgccuggg

SEQ ID NO: 2483952 - RNA, 13 nt, Human
agagggaggggcc

SEQ ID NO: 2483953 - RNA, 14 nt, Human
agagggaggggccu

SEQ ID NO: 2483954 - RNA, 22 nt, Human
agagggagggagggcuccagac

SEQ ID NO: 2483955 - RNA, 14 nt, Human
agaggugagggaag

SEQ ID NO: 2483956 - RNA, 16 nt, Human
agagggaggggccuag

SEQ ID NO: 2483957 - RNA, 18 nt, Human
agagggaggggccuaggc

SEQ ID NO: 2483958 - RNA, 16 nt, Human
agaggucuuuuuuaaa

SEQ ID NO: 2483959 - RNA, 20 nt, Human
agagggaggggccuaggccu

SEQ ID NO: 2483960 - RNA, 19 nt, Human
agaggucuuuuuuaaaagg

SEQ ID NO: 2483961 - RNA, 20 nt, Human
agagggagggagggcuccag

SEQ ID NO: 2483962 - RNA, 21 nt, Human
agagggagggagggcuccaga

SEQ ID NO: 2483963 - RNA, 12 nt, Human
agagggacagau

SEQ ID NO: 2483964 - RNA, 17 nt, Human
agagggaagagugcauu

SEQ ID NO: 2483965 - RNA, 15 nt, Human
agagggaccucuccc

SEQ ID NO: 2483966 - RNA, 16 nt, Human
agagggaccucuccca

SEQ ID NO: 2483967 - RNA, 19 nt, Human
agagggaccucucccaggg

SEQ ID NO: 2483968 - RNA, 19 nt, Human
agaggugggcagguggugg

SEQ ID NO: 2483969 - RNA, 17 nt, Human
agaggugggcagguggu

SEQ ID NO: 2483970 - RNA, 14 nt, Human
agaggugggcaggu

SEQ ID NO: 2483971 - RNA, 13 nt, Human
agaggugggcagg

SEQ ID NO: 2483972 - RNA, 21 nt, Human
agaggugggccagucugugga

SEQ ID NO: 2483973 - RNA, 13 nt, Human
agaggugggccag

SEQ ID NO: 2483974 - RNA, 17 nt, Human
ugaagauguagaggaga

SEQ ID NO: 2483975 - RNA, 22 nt, Human
agaggugccagcaacugaauaa

SEQ ID NO: 2483976 - RNA, 13 nt, Human
agagguggccaga

SEQ ID NO: 2483977 - RNA, 18 nt, Human
agagguggccagagcugg

SEQ ID NO: 2483978 - RNA, 12 nt, Human
agaggugggcag

SEQ ID NO: 2483979 - RNA, 21 nt, Human
agaggugccagcaacugaaua

SEQ ID NO: 2483980 - RNA, 20 nt, Human
agaggugccagcaacugaau

SEQ ID NO: 2483981 - RNA, 19 nt, Human
agaggugccagcaacugaa

SEQ ID NO: 2483982 - RNA, 18 nt, Human
agaggugccagcaacuga

SEQ ID NO: 2483983 - RNA, 16 nt, Human
agaggugccagcaacu

SEQ ID NO: 2483984 - RNA, 14 nt, Human
agaggugccagcaa

SEQ ID NO: 2483985 - RNA, 12 nt, Human
agaggugccagc

SEQ ID NO: 2483986 - RNA, 18 nt, Human
ugaagauguagaggagaa

SEQ ID NO: 2483987 - RNA, 18 nt, Human
ugaagauucuccugugcu

SEQ ID NO: 2483988 - RNA, 15 nt, Human
ugaagauucuccugu

SEQ ID NO: 2483989 - RNA, 16 nt, Human
ugaagaugucuaauag

SEQ ID NO: 2483990 - RNA, 19 nt, Human
ugaagcagcuuuaaacaaa

SEQ ID NO: 2483991 - RNA, 17 nt, Human
ugaagcagcuuuaaaca

SEQ ID NO: 2483992 - RNA, 20 nt, Human
ugaagcagccucuccccagg

SEQ ID NO: 2483993 - RNA, 15 nt, Human
ugaagcagccucucc

SEQ ID NO: 2483994 - RNA, 13 nt, Human
ugaagcagccucu

SEQ ID NO: 2483995 - RNA, 16 nt, Human
ugaagauucuuuccca

SEQ ID NO: 2483996 - RNA, 19 nt, Human
ugaagauucuccugugcua

SEQ ID NO: 2483997 - RNA, 19 nt, Human
ugaagcagaugcaaagagg

SEQ ID NO: 2483998 - RNA, 22 nt, Human
ugaagcagaugcaaagaggcaa

SEQ ID NO: 2483999 - RNA, 23 nt, Human
ugaagcagaugcaaagaggcaag

SEQ ID NO: 2484000 - RNA, 19 nt, Human
ugaagcaggagaaucacuu

SEQ ID NO: 2484001 - RNA, 19 nt, Human
ugaagcagguucccaagcu

SEQ ID NO: 2484002 - RNA, 17 nt, Human
ugaagcaguugugucag

SEQ ID NO: 2484003 - RNA, 14 nt, Human
ugaagcaguugugu

SEQ ID NO: 2484004 - RNA, 20 nt, Human
ugaagcagguucccaagcuc

SEQ ID NO: 2484005 - RNA, 20 nt, Human
ugaagcauguuucauguuuu

SEQ ID NO: 2484006 - RNA, 19 nt, Human
ugaagccacugaagcuggg

SEQ ID NO: 2484007 - RNA, 16 nt, Human
ugaagcauguuucaug

SEQ ID NO: 2484008 - RNA, 14 nt, Human
ugaagcauguuuca

SEQ ID NO: 2484009 - RNA, 16 nt, Human
ugaagccagccuucuu

SEQ ID NO: 2484010 - RNA, 16 nt, Human
ugaagcccaagugaaa

SEQ ID NO: 2484011 - RNA, 19 nt, Human
ugaagcccaauaaaccucu

SEQ ID NO: 2484012 - RNA, 16 nt, Human
ugaagcccuccaaaag

SEQ ID NO: 2484013 - RNA, 15 nt, Human
ugaagcccaauaaac

SEQ ID NO: 2484014 - RNA, 21 nt, Human
ugaagccagccuucuuccauc

SEQ ID NO: 2484015 - RNA, 14 nt, Human
ugaagccagccuuc

SEQ ID NO: 2484016 - RNA, 13 nt, Human
ugaagccagccuu

SEQ ID NO: 2484017 - RNA, 12 nt, Human
ugaagccagccu

SEQ ID NO: 2484018 - RNA, 19 nt, Human
ugaagcauguuucauguuu

SEQ ID NO: 2484019 - RNA, 20 nt, Human
ugaagccacugaagcuggga

SEQ ID NO: 2484020 - RNA, 16 nt, Human
ugaagcugccugcuuu

SEQ ID NO: 2484021 - RNA, 15 nt, Human
ugaagcugccugcuu

SEQ ID NO: 2484022 - RNA, 15 nt, Human
ugaagccuuagccag

SEQ ID NO: 2484023 - RNA, 22 nt, Human
ugaagcccuccaaaagcacuua

SEQ ID NO: 2484024 - RNA, 13 nt, Human
ugaagccugcccu

SEQ ID NO: 2484025 - RNA, 13 nt, Human
ugaagccucuggg

SEQ ID NO: 2484026 - RNA, 14 nt, Human
ugaagccucuggga

SEQ ID NO: 2484027 - RNA, 22 nt, Human
ugaagcucuggugacaccagcc

SEQ ID NO: 2484028 - RNA, 20 nt, Human
ugaggguugggcugguguca

SEQ ID NO: 2484029 - RNA, 22 nt, Human
ugagggugacuauggagcugag

SEQ ID NO: 2484030 - RNA, 12 nt, Human
ugagggucuucu

SEQ ID NO: 2484031 - RNA, 19 nt, Human
ugagggucuucuuacaugc

SEQ ID NO: 2484032 - RNA, 17 nt, Human
ugagguacugagaguga

SEQ ID NO: 2484033 - RNA, 19 nt, Human
ugaggguuucugagcugcu

SEQ ID NO: 2484034 - RNA, 14 nt, Human
ugaggguggagacu

SEQ ID NO: 2484035 - RNA, 18 nt, Human
ugaggguuucagagagcc

SEQ ID NO: 2484036 - RNA, 21 nt, Human
ugagggugcuuguucccucuc

SEQ ID NO: 2484037 - RNA, 22 nt, Human
ugagguacugagagugaacaaa

SEQ ID NO: 2484038 - RNA, 13 nt, Human
ugaggucagagcc

SEQ ID NO: 2484039 - RNA, 16 nt, Human
ugaggucagagccugc

SEQ ID NO: 2484040 - RNA, 14 nt, Human
ugaggucagagccu

SEQ ID NO: 2484041 - RNA, 19 nt, Human
agcagagaccaucccugaa

SEQ ID NO: 2484042 - RNA, 18 nt, Human
agcagagaccaucccuga

SEQ ID NO: 2484043 - RNA, 17 nt, Human
agcagagaccaucccug

SEQ ID NO: 2484044 - RNA, 17 nt, Human
ugaggucagagccugca

SEQ ID NO: 2484045 - RNA, 20 nt, Human
agcagagaccaucccugaag

SEQ ID NO: 2484046 - RNA, 19 nt, Human
ugagguacaaccuguucug

SEQ ID NO: 2484047 - RNA, 20 nt, Human
ugaggucaaguaagaagaca

SEQ ID NO: 2484048 - RNA, 20 nt, Human
agcagagcaccuuagacagu

SEQ ID NO: 2484049 - RNA, 20 nt, Human
agcagagcaagucugcaggu

SEQ ID NO: 2484050 - RNA, 19 nt, Human
agcagagcaagucugcagg

SEQ ID NO: 2484051 - RNA, 18 nt, Human
agcagagcaagucugcag

SEQ ID NO: 2484052 - RNA, 17 nt, Human
agcagagcaagucugca

SEQ ID NO: 2484053 - RNA, 14 nt, Human
agcagagcaggggc

SEQ ID NO: 2484054 - RNA, 15 nt, Human
agcagagcaggggca

SEQ ID NO: 2484055 - RNA, 14 nt, Human
agcagaggggcuga

SEQ ID NO: 2484056 - RNA, 23 nt, Human
agcagagguggccagagcuggga

SEQ ID NO: 2484057 - RNA, 13 nt, Human
agcagaggcagcg

SEQ ID NO: 2484058 - RNA, 18 nt, Human
agcagagggacuuuguau

SEQ ID NO: 2484059 - RNA, 18 nt, Human
agcagauaccucacccug

SEQ ID NO: 2484060 - RNA, 22 nt, Human
agcagauacauaugagugugga

SEQ ID NO: 2484061 - RNA, 20 nt, Human
agcagauacauaugagugug

SEQ ID NO: 2484062 - RNA, 19 nt, Human
agcagauaccucacccugc

SEQ ID NO: 2484063 - RNA, 16 nt, Human
agcagaucccagcuca

SEQ ID NO: 2484064 - RNA, 17 nt, Human
agcagaugcaaagaggc

SEQ ID NO: 2484065 - RNA, 18 nt, Human
agcagaugcaaagaggca

SEQ ID NO: 2484066 - RNA, 19 nt, Human
agcagaugcaaagaggcaa

SEQ ID NO: 2484067 - RNA, 20 nt, Human
agcagaugcaaagaggcaag

SEQ ID NO: 2484068 - RNA, 13 nt, Human
agcagaugcaaag

SEQ ID NO: 2484069 - RNA, 14 nt, Human
agcagaugcaaaga

SEQ ID NO: 2484070 - RNA, 17 nt, Human
agcagaugaccccuccc

SEQ ID NO: 2484071 - RNA, 15 nt, Human
agcagagcucugccg

SEQ ID NO: 2484072 - RNA, 17 nt, Human
agcagaggaaggagagg

SEQ ID NO: 2484073 - RNA, 16 nt, Human
agcagagcuuccucag

SEQ ID NO: 2484074 - RNA, 12 nt, Human
agcagaggaggg

SEQ ID NO: 2484075 - RNA, 15 nt, Human
agcagaggaggggcc

SEQ ID NO: 2484076 - RNA, 17 nt, Human
agcagaggcacuggggg

SEQ ID NO: 2484077 - RNA, 15 nt, Human
agcagaggcacuggg

SEQ ID NO: 2484078 - RNA, 14 nt, Human
agcagaggcacugg

SEQ ID NO: 2484079 - RNA, 22 nt, Human
agcagaggaggggccgcugcca

SEQ ID NO: 2484080 - RNA, 19 nt, Human
agcagaggaggggccgcug

SEQ ID NO: 2484081 - RNA, 21 nt, Human
agcagaggaggggccgcugcc

SEQ ID NO: 2484082 - RNA, 13 nt, Human
agcagaggcacug

SEQ ID NO: 2484083 - RNA, 17 nt, Human
agcagauuuuaggaaau

SEQ ID NO: 2484084 - RNA, 20 nt, Human
agcagauuuuaggaaaugaa

SEQ ID NO: 2484085 - RNA, 22 nt, Human
agcagauuuuaauuuugaauaa

SEQ ID NO: 2484086 - RNA, 21 nt, Human
agcagauuuuaauuuugaaua

SEQ ID NO: 2484087 - RNA, 13 nt, Human
agcagauuuuaau

SEQ ID NO: 2484088 - RNA, 14 nt, Human
agcagaugcugguc

SEQ ID NO: 2484089 - RNA, 18 nt, Human
agcagauuuaacaauucc

SEQ ID NO: 2484090 - RNA, 13 nt, Human
agcagaugcuggu

SEQ ID NO: 2484091 - RNA, 21 nt, Human
agcagaugcagagagccauuu

SEQ ID NO: 2484092 - RNA, 20 nt, Human
agcagauuggagaaacccuu

SEQ ID NO: 2484093 - RNA, 21 nt, Human
agcagauggaaugcuguguua

SEQ ID NO: 2484094 - RNA, 19 nt, Human
agcagauggagaccccuug

SEQ ID NO: 2484095 - RNA, 18 nt, Human
agcagaugcagagagcca

SEQ ID NO: 2484096 - RNA, 17 nt, Human
agcagaugcagagagcc

SEQ ID NO: 2484097 - RNA, 16 nt, Human
agcagaugcagagagc

SEQ ID NO: 2484098 - RNA, 13 nt, Human
agcagaugcagag

SEQ ID NO: 2484099 - RNA, 12 nt, Human
agcagaugcaga

SEQ ID NO: 2484100 - RNA, 21 nt, Human
agcagaugcaaagaggcaaga

SEQ ID NO: 2484101 - RNA, 19 nt, Human
agcagaugcaaugacucag

SEQ ID NO: 2484102 - RNA, 24 nt, Human
ugaggcccuucucuccagccccug

SEQ ID NO: 2484103 - RNA, 23 nt, Human
ugaggcccuucucuccagccccu

SEQ ID NO: 2484104 - RNA, 22 nt, Human
ugaggcccuucucuccagcccc

SEQ ID NO: 2484105 - RNA, 20 nt, Human
ugaggcccuucucuccagcc

SEQ ID NO: 2484106 - RNA, 19 nt, Human
ugaggcccuucucuccagc

SEQ ID NO: 2484107 - RNA, 18 nt, Human
ugaggcccuucucuccag

SEQ ID NO: 2484108 - RNA, 21 nt, Human
ugaggccccuucuagguggca

SEQ ID NO: 2484109 - RNA, 16 nt, Human
ugaggcccuucucucc

SEQ ID NO: 2484110 - RNA, 22 nt, Human
ugaggccgcuagaggccugagg

SEQ ID NO: 2484111 - RNA, 20 nt, Human
ugaggccgcuagaggccuga

SEQ ID NO: 2484112 - RNA, 19 nt, Human
ugaggccgcuagaggccug

SEQ ID NO: 2484113 - RNA, 18 nt, Human
ugaggccgcuagaggccu

SEQ ID NO: 2484114 - RNA, 17 nt, Human
ugaggccgcuagaggcc

SEQ ID NO: 2484115 - RNA, 16 nt, Human
ugaggccgcuagaggc

SEQ ID NO: 2484116 - RNA, 23 nt, Human
ugaggccgcuagaggccugagga

SEQ ID NO: 2484117 - RNA, 19 nt, Human
ugaggccuaaaaguaaaca

SEQ ID NO: 2484118 - RNA, 18 nt, Human
ugagggaggaggccaccu

SEQ ID NO: 2484119 - RNA, 14 nt, Human
ugagggaggaggcc

SEQ ID NO: 2484120 - RNA, 13 nt, Human
ugagggaggaggc

SEQ ID NO: 2484121 - RNA, 18 nt, Human
ugaggccugcccucaggg

SEQ ID NO: 2484122 - RNA, 17 nt, Human
ugaggccugcccucagg

SEQ ID NO: 2484123 - RNA, 21 nt, Human
ugaggccucuuggaccucugc

SEQ ID NO: 2484124 - RNA, 15 nt, Human
ugaggccucuuggac

SEQ ID NO: 2484125 - RNA, 14 nt, Human
ugaggccucuugga

SEQ ID NO: 2484126 - RNA, 23 nt, Human
ugaggccucuuggaccucugcuc

SEQ ID NO: 2484127 - RNA, 15 nt, Human
ugaggccucagugga

SEQ ID NO: 2484128 - RNA, 22 nt, Human
ugaggccuccagcuucaggcag

SEQ ID NO: 2484129 - RNA, 19 nt, Human
ugaggccucaguggacuuu

SEQ ID NO: 2484130 - RNA, 15 nt, Human
ugagggauuaucuuu

SEQ ID NO: 2484131 - RNA, 19 nt, Human
ugagggauacccaucccau

SEQ ID NO: 2484132 - RNA, 20 nt, Human
ugagggaggaggccaccucu

SEQ ID NO: 2484133 - RNA, 19 nt, Human
ugagggaggaggccaccuc

SEQ ID NO: 2484134 - RNA, 23 nt, Human
ugagggaggaggccaccucucca

SEQ ID NO: 2484135 - RNA, 17 nt, Human
ugagggaucacagggcc

SEQ ID NO: 2484136 - RNA, 18 nt, Human
ugagggaucacagggccc

SEQ ID NO: 2484137 - RNA, 11 nt, Human
ugagggcaguc

SEQ ID NO: 2484138 - RNA, 16 nt, Human
ugagggcccagagcag

SEQ ID NO: 2484139 - RNA, 15 nt, Human
ugagggcccagagca

SEQ ID NO: 2484140 - RNA, 14 nt, Human
ugagggcccagagc

SEQ ID NO: 2484141 - RNA, 13 nt, Human
ugagggcccagag

SEQ ID NO: 2484142 - RNA, 21 nt, Human
ugagggcaucuugguccagga

SEQ ID NO: 2484143 - RNA, 12 nt, Human
ugagggcccaga

SEQ ID NO: 2484144 - RNA, 18 nt, Human
ugagggccaagaaagagu

SEQ ID NO: 2484145 - RNA, 16 nt, Human
ugagggccccucugcc

SEQ ID NO: 2484146 - RNA, 15 nt, Human
ugagggccccucugc

SEQ ID NO: 2484147 - RNA, 14 nt, Human
ugagggccccucug

SEQ ID NO: 2484148 - RNA, 21 nt, Human
ugagggcccagagcaggaagc

SEQ ID NO: 2484149 - RNA, 20 nt, Human
ugagggcccagagcaggaag

SEQ ID NO: 2484150 - RNA, 19 nt, Human
ugagggcccagagcaggaa

SEQ ID NO: 2484151 - RNA, 18 nt, Human
ugagggcccagagcagga

SEQ ID NO: 2484152 - RNA, 17 nt, Human
ugagggcccagagcagg

SEQ ID NO: 2484153 - RNA, 19 nt, Human
ugagggccccucugcccag

SEQ ID NO: 2484154 - RNA, 17 nt, Human
ugagggccccucugccc

SEQ ID NO: 2484155 - RNA, 21 nt, Human
ugagggccccucugcccagcu

SEQ ID NO: 2484156 - RNA, 17 nt, Human
ugagggcgaggggaggg

SEQ ID NO: 2484157 - RNA, 21 nt, Human
ugaggggaggaucacuggagc

SEQ ID NO: 2484158 - RNA, 22 nt, Human
ugaggggaggaucacuggagcc

SEQ ID NO: 2484159 - RNA, 12 nt, Human
ugaggggccucu

SEQ ID NO: 2484160 - RNA, 16 nt, Human
ugaggggcccgagcag

SEQ ID NO: 2484161 - RNA, 22 nt, Human
ugaggggcaucugccccucccc

SEQ ID NO: 2484162 - RNA, 15 nt, Human
ugaggggaggggggc

SEQ ID NO: 2484163 - RNA, 21 nt, Human
ugaggggaggaaacucaccug

SEQ ID NO: 2484164 - RNA, 17 nt, Human
ugaggggcaucugcccc

SEQ ID NO: 2484165 - RNA, 23 nt, Human
ugaggguaaccccaaaccuccaa

SEQ ID NO: 2484166 - RNA, 22 nt, Human
ugaggguaauaaacuuagaaua

SEQ ID NO: 2484167 - RNA, 21 nt, Human
ugaggguaauaaacuuagaau

SEQ ID NO: 2484168 - RNA, 18 nt, Human
ugaggguaauaaacuuag

SEQ ID NO: 2484169 - RNA, 19 nt, Human
ugaggguccccaccuggga

SEQ ID NO: 2484170 - RNA, 15 nt, Human
ugaggguccccaccu

SEQ ID NO: 2484171 - RNA, 18 nt, Human
ugaggguaucaaauaaaa

SEQ ID NO: 2484172 - RNA, 22 nt, Human
ugagggucagagaggagucaga

SEQ ID NO: 2484173 - RNA, 13 nt, Human
ugaggggccucuu

SEQ ID NO: 2484174 - RNA, 14 nt, Human
ugaggggcuccugg

SEQ ID NO: 2484175 - RNA, 22 nt, Human
ugaggggggccgugcccagggg

SEQ ID NO: 2484176 - RNA, 20 nt, Human
ugaggggggccgugcccagg

SEQ ID NO: 2484177 - RNA, 22 nt, Human
ugagggggaauagucuagaugg

SEQ ID NO: 2484178 - RNA, 22 nt, Human
ugaggggcuggccuuccugccc

SEQ ID NO: 2484179 - RNA, 14 nt, Human
ugaggggcuggccu

SEQ ID NO: 2484180 - RNA, 15 nt, Human
ugaggggcuccugga

SEQ ID NO: 2484181 - RNA, 18 nt, Human
ugagggguaaaagcugau

SEQ ID NO: 2484182 - RNA, 14 nt, Human
ugaggggucccuga

SEQ ID NO: 2484183 - RNA, 20 nt, Human
ugaggggucuccaggaggag

SEQ ID NO: 2484184 - RNA, 19 nt, Human
ugaggaauguauauguuuu

SEQ ID NO: 2484185 - RNA, 17 nt, Human
ugaggaauguauauguu

SEQ ID NO: 2484186 - RNA, 15 nt, Human
ugaggaauuucaccu

SEQ ID NO: 2484187 - RNA, 21 nt, Human
ugaggaauuucaccuguaaac

SEQ ID NO: 2484188 - RNA, 22 nt, Human
ugaggaauuucaccuguaaacc

SEQ ID NO: 2484189 - RNA, 13 nt, Human
ugaggaauuuucu

SEQ ID NO: 2484190 - RNA, 14 nt, Human
ugaggaauuuucuu

SEQ ID NO: 2484191 - RNA, 18 nt, Human
ugaggaauuuucuuugug

SEQ ID NO: 2484192 - RNA, 19 nt, Human
ugaggacaaccauuccaga

SEQ ID NO: 2484193 - RNA, 20 nt, Human
ugaggacaaccauuccagac

SEQ ID NO: 2484194 - RNA, 16 nt, Human
ugaggaaugaugaagc

SEQ ID NO: 2484195 - RNA, 20 nt, Human
ugaggaauaguugagcccca

SEQ ID NO: 2484196 - RNA, 22 nt, Human
ugaggaauccagacccggcugc

SEQ ID NO: 2484197 - RNA, 21 nt, Human
ugaggaauccagacccggcug

SEQ ID NO: 2484198 - RNA, 15 nt, Human
ugaggacagcugucc

SEQ ID NO: 2484199 - RNA, 14 nt, Human
ugaggacagcuguc

SEQ ID NO: 2484200 - RNA, 13 nt, Human
ugaggacagcugu

SEQ ID NO: 2484201 - RNA, 15 nt, Human
ugaggacacugauau

SEQ ID NO: 2484202 - RNA, 21 nt, Human
ugaggacacuaaccacgcugg

SEQ ID NO: 2484203 - RNA, 22 nt, Human
ugaggccacugcugcuucucca

SEQ ID NO: 2484204 - RNA, 20 nt, Human
ugaggccacacucagcacaa

SEQ ID NO: 2484205 - RNA, 23 nt, Human
ugaggccacacucagcacaaggc

SEQ ID NO: 2484206 - RNA, 12 nt, Human
ugaggccagaga

SEQ ID NO: 2484207 - RNA, 17 nt, Human
ugaggacagcuguccuc

SEQ ID NO: 2484208 - RNA, 16 nt, Human
ugaggacagcuguccu

SEQ ID NO: 2484209 - RNA, 18 nt, Human
ugaggacagcuguccucu

SEQ ID NO: 2484210 - RNA, 23 nt, Human
ugaggcauuuguuugaacugaua

SEQ ID NO: 2484211 - RNA, 13 nt, Human
ugaggccacacuc

SEQ ID NO: 2484212 - RNA, 19 nt, Human
ugaggccacacucagcaca

SEQ ID NO: 2484213 - RNA, 12 nt, Human
ugaggccacacu

SEQ ID NO: 2484214 - RNA, 22 nt, Human
ugaggccaaacguuuugaacua

SEQ ID NO: 2484215 - RNA, 16 nt, Human
ugaggccagagacaca

SEQ ID NO: 2484216 - RNA, 14 nt, Human
ugaggccagagaca

SEQ ID NO: 2484217 - RNA, 20 nt, Human
ugaggccagagacacaagcc

SEQ ID NO: 2484218 - RNA, 13 nt, Human
ugaggcccagagg

SEQ ID NO: 2484219 - RNA, 12 nt, Human
ugaggcccagag

SEQ ID NO: 2484220 - RNA, 13 nt, Human
ugaggccagggca

SEQ ID NO: 2484221 - RNA, 14 nt, Human
ugaggccagggcag

SEQ ID NO: 2484222 - RNA, 15 nt, Human
ugaggccagggcaga

SEQ ID NO: 2484223 - RNA, 16 nt, Human
ugaggccagggcagag

SEQ ID NO: 2484224 - RNA, 12 nt, Human
ugaggccaggag

SEQ ID NO: 2484225 - RNA, 13 nt, Human
ugaggccaggagu

SEQ ID NO: 2484226 - RNA, 20 nt, Human
ugaggcccagagggccugca

SEQ ID NO: 2484227 - RNA, 18 nt, Human
ugaggcccagagggccug

SEQ ID NO: 2484228 - RNA, 17 nt, Human
ugaggcccagagggccu

SEQ ID NO: 2484229 - RNA, 15 nt, Human
ugaggcccagagggc

SEQ ID NO: 2484230 - RNA, 22 nt, Human
ugaggcccagagggccugcaag

SEQ ID NO: 2484231 - RNA, 21 nt, Human
ugaggcccagagggccugcaa

SEQ ID NO: 2484232 - RNA, 23 nt, Human
ugaggcccagagggccugcaagg

SEQ ID NO: 2484233 - RNA, 13 nt, Human
ugaggcccaggga

SEQ ID NO: 2484234 - RNA, 14 nt, Human
ugaggcccagggag

SEQ ID NO: 2484235 - RNA, 17 nt, Human
ugaggcccagggagagg

SEQ ID NO: 2484236 - RNA, 20 nt, Human
ugaggcccagggagaggcca

SEQ ID NO: 2484237 - RNA, 23 nt, Human
ugaggcccagggagaggccauga

SEQ ID NO: 2484238 - RNA, 18 nt, Human
ugaggaagccgcuggggc

SEQ ID NO: 2484239 - RNA, 17 nt, Human
ugaggaagccgcugggg

SEQ ID NO: 2484240 - RNA, 14 nt, Human
ugaggaagccgcug

SEQ ID NO: 2484241 - RNA, 22 nt, Human
ugaggaagcaaaagcaucuaug

SEQ ID NO: 2484242 - RNA, 21 nt, Human
ugaggaagccgcuggggccag

SEQ ID NO: 2484243 - RNA, 19 nt, Human
ugaggaagccgcuggggcc

SEQ ID NO: 2484244 - RNA, 17 nt, Human
ugaggaagagggacugu

SEQ ID NO: 2484245 - RNA, 23 nt, Human
ugaggaagaugggggcaagaaga

SEQ ID NO: 2484246 - RNA, 23 nt, Human
ugaggaagccagguccacggucu

SEQ ID NO: 2484247 - RNA, 17 nt, Human
ugaggaagcgugaaggc

SEQ ID NO: 2484248 - RNA, 19 nt, Human
ugaggaauaguugagcccc

SEQ ID NO: 2484249 - RNA, 19 nt, Human
ugaggaauaauuauuuauu

SEQ ID NO: 2484250 - RNA, 17 nt, Human
ugaggaauaauuauuua

SEQ ID NO: 2484251 - RNA, 20 nt, Human
ugaggaaggcaggaagagag

SEQ ID NO: 2484252 - RNA, 19 nt, Human
ugaggaaggcaggaagaga

SEQ ID NO: 2484253 - RNA, 22 nt, Human
ugaggaagcgugaaggccgaga

SEQ ID NO: 2484254 - RNA, 24 nt, Human
ugaggaagaacggggcucuucuca

SEQ ID NO: 2484255 - RNA, 23 nt, Human
ugaggaagaacggggcucuucuc

SEQ ID NO: 2484256 - RNA, 19 nt, Human
ugaggaagaacggggcucu

SEQ ID NO: 2484257 - RNA, 17 nt, Human
ugaggaagaacggggcu

SEQ ID NO: 2484258 - RNA, 15 nt, Human
ugaggaagcaaaagc

SEQ ID NO: 2484259 - RNA, 22 nt, Human
ugaggaaagucauuggcuuuau

SEQ ID NO: 2484260 - RNA, 21 nt, Human
ugaggaaagucauuggcuuua

SEQ ID NO: 2484261 - RNA, 19 nt, Human
ugaggaaaggccagcuggc

SEQ ID NO: 2484262 - RNA, 19 nt, Human
ugaggaaagucauuggcuu

SEQ ID NO: 2484263 - RNA, 18 nt, Human
ugaggaaagucauuggcu

SEQ ID NO: 2484264 - RNA, 17 nt, Human
ugaggaaagucauuggc

SEQ ID NO: 2484265 - RNA, 15 nt, Human
ugaggaaagucauug

SEQ ID NO: 2484266 - RNA, 19 nt, Human
ugaggaaagcauguauuca

SEQ ID NO: 2484267 - RNA, 15 nt, Human
ugaggaaaggccagc

SEQ ID NO: 2484268 - RNA, 16 nt, Human
ugagcuuggccagaag

SEQ ID NO: 2484269 - RNA, 16 nt, Human
ugaggaaaggccagcu

SEQ ID NO: 2484270 - RNA, 18 nt, Human
ugaggaaaggccagcugg

SEQ ID NO: 2484271 - RNA, 13 nt, Human
ugagcuuuucuag

SEQ ID NO: 2484272 - RNA, 17 nt, Human
ugagcuuugcugcuaca

SEQ ID NO: 2484273 - RNA, 16 nt, Human
ugagcuuugcugcuac

SEQ ID NO: 2484274 - RNA, 15 nt, Human
ugagcuuugcugcua

SEQ ID NO: 2484275 - RNA, 12 nt, Human
ugagcuuuucua

SEQ ID NO: 2484276 - RNA, 23 nt, Human
ugaggaaaaaaaucguccaggga

SEQ ID NO: 2484277 - RNA, 16 nt, Human
ugaggaaacaacagcu

SEQ ID NO: 2484278 - RNA, 13 nt, Human
ugagcuacaaaug

SEQ ID NO: 2484279 - RNA, 14 nt, Human
ugagcuacaaaugc

SEQ ID NO: 2484280 - RNA, 22 nt, Human
ugagcgcuccugccgcagagcu

SEQ ID NO: 2484281 - RNA, 18 nt, Human
ugagcgcuccugccgcag

SEQ ID NO: 2484282 - RNA, 20 nt, Human
ugagcgccuccauccaaggc

SEQ ID NO: 2484283 - RNA, 14 nt, Human
ugagcgcuccugcc

SEQ ID NO: 2484284 - RNA, 23 nt, Human
ugagcgccuccauccaaggccag

SEQ ID NO: 2484285 - RNA, 18 nt, Human
ugagcgccuccauccaag

SEQ ID NO: 2484286 - RNA, 12 nt, Human
ugagcgccagga

SEQ ID NO: 2484287 - RNA, 23 nt, Human
ugagcgauuauuaucuaaagugu

SEQ ID NO: 2484288 - RNA, 17 nt, Human
ugagcgaggacauucuc

SEQ ID NO: 2484289 - RNA, 22 nt, Human
ugagcgaggagaugcuccuugg

SEQ ID NO: 2484290 - RNA, 23 nt, Human
ugagcgaggagaugcuccuuggg

SEQ ID NO: 2484291 - RNA, 16 nt, Human
ugagccuuuucccucu

SEQ ID NO: 2484292 - RNA, 13 nt, Human
ugagccuuguaau

SEQ ID NO: 2484293 - RNA, 17 nt, Human
ugagcgacaaagaugau

SEQ ID NO: 2484294 - RNA, 16 nt, Human
ugagcgacaaagauga

SEQ ID NO: 2484295 - RNA, 14 nt, Human
ugagcuuugcugcu

SEQ ID NO: 2484296 - RNA, 23 nt, Human
ugagcuuugcauguuccacuaac

SEQ ID NO: 2484297 - RNA, 22 nt, Human
ugagcuuugcauguuccacuaa

SEQ ID NO: 2484298 - RNA, 22 nt, Human
ugagcuuuccauguugcugcca

SEQ ID NO: 2484299 - RNA, 21 nt, Human
ugagcuuuccauguugcugcc

SEQ ID NO: 2484300 - RNA, 20 nt, Human
ugagcuuuccauguugcugc

SEQ ID NO: 2484301 - RNA, 19 nt, Human
ugagcuuuccauguugcug

SEQ ID NO: 2484302 - RNA, 14 nt, Human
ugagcuaggaauug

SEQ ID NO: 2484303 - RNA, 19 nt, Human
ugagcuuggccagaagggg

SEQ ID NO: 2484304 - RNA, 12 nt, Human
ugagcuuuaaaa

SEQ ID NO: 2484305 - RNA, 21 nt, Human
ugagcuuggccagaagggggc

SEQ ID NO: 2484306 - RNA, 18 nt, Human
ugagcuuuccauguugcu

SEQ ID NO: 2484307 - RNA, 22 nt, Human
ugagcuuuauguaauaauguga

SEQ ID NO: 2484308 - RNA, 16 nt, Human
ugagcuacaaaugcau

SEQ ID NO: 2484309 - RNA, 22 nt, Human
ugagcuagaagcuggaggacua

SEQ ID NO: 2484310 - RNA, 19 nt, Human
ugagcuagaagcuggagga

SEQ ID NO: 2484311 - RNA, 20 nt, Human
ugagcggugcuguccucagg

SEQ ID NO: 2484312 - RNA, 18 nt, Human
ugagcuacgccugccucc

SEQ ID NO: 2484313 - RNA, 21 nt, Human
ugagcggugcuguccucaggu

SEQ ID NO: 2484314 - RNA, 24 nt, Human
agcaagugagagagaugggagcuc

SEQ ID NO: 2484315 - RNA, 18 nt, Human
agcaagugagagagaugg

SEQ ID NO: 2484316 - RNA, 17 nt, Human
agcaagugagagagaug

SEQ ID NO: 2484317 - RNA, 23 nt, Human
ugagccaguucaguaccuggagg

SEQ ID NO: 2484318 - RNA, 15 nt, Human
ugagcccacaaagcc

SEQ ID NO: 2484319 - RNA, 22 nt, Human
ugagccaguucaguaccuggag

SEQ ID NO: 2484320 - RNA, 18 nt, Human
ugagccagucccaggggc

SEQ ID NO: 2484321 - RNA, 13 nt, Human
agcaagugagagc

SEQ ID NO: 2484322 - RNA, 19 nt, Human
ugagccagucccaggggca

SEQ ID NO: 2484323 - RNA, 17 nt, Human
ugagccagucccagggg

SEQ ID NO: 2484324 - RNA, 16 nt, Human
ugagccagucccaggg

SEQ ID NO: 2484325 - RNA, 14 nt, Human
ugagccagucccag

SEQ ID NO: 2484326 - RNA, 13 nt, Human
ugagccaguccca

SEQ ID NO: 2484327 - RNA, 21 nt, Human
ugagccagguaaugagggacu

SEQ ID NO: 2484328 - RNA, 20 nt, Human
agcaagugagacccugucuc

SEQ ID NO: 2484329 - RNA, 22 nt, Human
ugagccagauuucacucuccuu

SEQ ID NO: 2484330 - RNA, 17 nt, Human
ugagccagauuucacuc

SEQ ID NO: 2484331 - RNA, 20 nt, Human
ugagccagguaaugagggac

SEQ ID NO: 2484332 - RNA, 18 nt, Human
ugagccaggccugggucu

SEQ ID NO: 2484333 - RNA, 18 nt, Human
ugagccagcagacauugu

SEQ ID NO: 2484334 - RNA, 17 nt, Human
ugagccagcagacauug

SEQ ID NO: 2484335 - RNA, 23 nt, Human
ugagccagcagacauugucagca

SEQ ID NO: 2484336 - RNA, 14 nt, Human
ugagccaggccugg

SEQ ID NO: 2484337 - RNA, 16 nt, Human
ugagccagcagacauu

SEQ ID NO: 2484338 - RNA, 13 nt, Human
ugagccagcagac

SEQ ID NO: 2484339 - RNA, 12 nt, Human
ugagccaccacg

SEQ ID NO: 2484340 - RNA, 14 nt, Human
ugagccagacaaau

SEQ ID NO: 2484341 - RNA, 20 nt, Human
ugagccagacaaauggagga

SEQ ID NO: 2484342 - RNA, 14 nt, Human
agcaagugagagcu

SEQ ID NO: 2484343 - RNA, 18 nt, Human
agcaagugagagcugggu

SEQ ID NO: 2484344 - RNA, 21 nt, Human
agcaagugauugggacagagg

SEQ ID NO: 2484345 - RNA, 16 nt, Human
agcaaguuacagugau

SEQ ID NO: 2484346 - RNA, 22 nt, Human
agcaagugagagcuggguguca

SEQ ID NO: 2484347 - RNA, 14 nt, Human
agcaauaaagaaga

SEQ ID NO: 2484348 - RNA, 23 nt, Human
agcaaguucuagagaagaggcug

SEQ ID NO: 2484349 - RNA, 21 nt, Human
agcaaguucuagagaagaggc

SEQ ID NO: 2484350 - RNA, 20 nt, Human
agcaaguucuagagaagagg

SEQ ID NO: 2484351 - RNA, 17 nt, Human
agcaaguucuagagaag

SEQ ID NO: 2484352 - RNA, 24 nt, Human
agcacagcaaggaggcuggcuggg

SEQ ID NO: 2484353 - RNA, 23 nt, Human
agcacagcaaggaggcuggcugg

SEQ ID NO: 2484354 - RNA, 22 nt, Human
agcacagcaaggaggcuggcug

SEQ ID NO: 2484355 - RNA, 19 nt, Human
agcacagcaaggaggcugg

SEQ ID NO: 2484356 - RNA, 10 nt, Human
agcacagcag

SEQ ID NO: 2484357 - RNA, 12 nt, Human
agcacagcagcc

SEQ ID NO: 2484358 - RNA, 23 nt, Human
agcacagcagccuggggcuggcc

SEQ ID NO: 2484359 - RNA, 12 nt, Human
agcacagccaac

SEQ ID NO: 2484360 - RNA, 13 nt, Human
agcacagccaaca

SEQ ID NO: 2484361 - RNA, 23 nt, Human
agcacagccaacacgcaccugcc

SEQ ID NO: 2484362 - RNA, 13 nt, Human
agcacagcagccu

SEQ ID NO: 2484363 - RNA, 15 nt, Human
agcacagcagccugg

SEQ ID NO: 2484364 - RNA, 21 nt, Human
agcacagcagccccugcacaa

SEQ ID NO: 2484365 - RNA, 22 nt, Human
agcacagcccucccgccccuuc

SEQ ID NO: 2484366 - RNA, 21 nt, Human
agcacagcccucccgccccuu

SEQ ID NO: 2484367 - RNA, 16 nt, Human
agcacagcccucccgc

SEQ ID NO: 2484368 - RNA, 15 nt, Human
agcacagcccucccg

SEQ ID NO: 2484369 - RNA, 14 nt, Human
agcacagcccuccc

SEQ ID NO: 2484370 - RNA, 13 nt, Human
agcacagcccucc

SEQ ID NO: 2484371 - RNA, 12 nt, Human
agcacagcccuc

SEQ ID NO: 2484372 - RNA, 10 nt, Human
agcacagccc

SEQ ID NO: 2484373 - RNA, 22 nt, Human
agcacagccucuuagaugcagu

SEQ ID NO: 2484374 - RNA, 12 nt, Human
agcacagccuag

SEQ ID NO: 2484375 - RNA, 16 nt, Human
agcacagcuucauuuc

SEQ ID NO: 2484376 - RNA, 18 nt, Human
agcacaguguuaaaugaa

SEQ ID NO: 2484377 - RNA, 16 nt, Human
agcacaguguuaaaug

SEQ ID NO: 2484378 - RNA, 23 nt, Human
agcacagugguggcagggccuag

SEQ ID NO: 2484379 - RNA, 20 nt, Human
agcacagugguggcagggcc

SEQ ID NO: 2484380 - RNA, 19 nt, Human
agcacagugguggcagggc

SEQ ID NO: 2484381 - RNA, 18 nt, Human
agcacagugguggcaggg

SEQ ID NO: 2484382 - RNA, 17 nt, Human
agcacagugguggcagg

SEQ ID NO: 2484383 - RNA, 16 nt, Human
agcacagugguggcag

SEQ ID NO: 2484384 - RNA, 14 nt, Human
agcacaguuugaac

SEQ ID NO: 2484385 - RNA, 12 nt, Human
agcacaguuuga

SEQ ID NO: 2484386 - RNA, 22 nt, Human
agcacaguguuaaaugaaauug

SEQ ID NO: 2484387 - RNA, 19 nt, Human
agcacaguguuaaaugaaa

SEQ ID NO: 2484388 - RNA, 17 nt, Human
agcacaguuugaacaaa

SEQ ID NO: 2484389 - RNA, 19 nt, Human
agcacaggugggcuuccca

SEQ ID NO: 2484390 - RNA, 21 nt, Human
agcacaggugggcuucccagu

SEQ ID NO: 2484391 - RNA, 19 nt, Human
agcacagucugaugacaca

SEQ ID NO: 2484392 - RNA, 14 nt, Human
agcacagugccugc

SEQ ID NO: 2484393 - RNA, 15 nt, Human
agcacagugguggca

SEQ ID NO: 2484394 - RNA, 15 nt, Human
agcacagugccugca

SEQ ID NO: 2484395 - RNA, 13 nt, Human
agcacaugccucu

SEQ ID NO: 2484396 - RNA, 15 nt, Human
agcacaucugcauuu

SEQ ID NO: 2484397 - RNA, 16 nt, Human
agcacaucugcauuuu

SEQ ID NO: 2484398 - RNA, 14 nt, Human
agcacaugccucuc

SEQ ID NO: 2484399 - RNA, 22 nt, Human
agcaccaaaagcuuaccaaggg

SEQ ID NO: 2484400 - RNA, 18 nt, Human
agcaccaaaauaagaaaa

SEQ ID NO: 2484401 - RNA, 19 nt, Human
agcaccaaaauaagaaaag

SEQ ID NO: 2484402 - RNA, 20 nt, Human
agcaccaaaauaagaaaaga

SEQ ID NO: 2484403 - RNA, 21 nt, Human
agcaccaaaauaagaaaagau

SEQ ID NO: 2484404 - RNA, 16 nt, Human
agcaccaaaauaagaa

SEQ ID NO: 2484405 - RNA, 17 nt, Human
agcaccaaaauaagaaa

SEQ ID NO: 2484406 - RNA, 23 nt, Human
agcacaugaaaccuuauuuuuuc

SEQ ID NO: 2484407 - RNA, 23 nt, Human
agcacaucugcauuuucacccca

SEQ ID NO: 2484408 - RNA, 16 nt, Human
agcaccaaucaugaau

SEQ ID NO: 2484409 - RNA, 12 nt, Human
agcaccacccua

SEQ ID NO: 2484410 - RNA, 16 nt, Human
ugagccagauuucacu

SEQ ID NO: 2484411 - RNA, 14 nt, Human
ugagccagauuuca

SEQ ID NO: 2484412 - RNA, 13 nt, Human
ugagccagauuuc

SEQ ID NO: 2484413 - RNA, 23 nt, Human
ugagccacugcaccgggccacag

SEQ ID NO: 2484414 - RNA, 18 nt, Human
ugagccaccgugccuggc

SEQ ID NO: 2484415 - RNA, 19 nt, Human
ugagccaccgugccuggcc

SEQ ID NO: 2484416 - RNA, 20 nt, Human
ugagccaccgugccuggcca

SEQ ID NO: 2484417 - RNA, 21 nt, Human
ugagccaccgugccuggccac

SEQ ID NO: 2484418 - RNA, 18 nt, Human
ugagccacugcaccgggc

SEQ ID NO: 2484419 - RNA, 21 nt, Human
ugagccacugcaccgggccac

SEQ ID NO: 2484420 - RNA, 24 nt, Human
ugagcaucaggccaggcccucugc

SEQ ID NO: 2484421 - RNA, 22 nt, Human
ugagcaucaggccaggcccucu

SEQ ID NO: 2484422 - RNA, 15 nt, Human
ugagccaccacgccc

SEQ ID NO: 2484423 - RNA, 14 nt, Human
ugagccaccgugcc

SEQ ID NO: 2484424 - RNA, 17 nt, Human
ugagcagacuggugagc

SEQ ID NO: 2484425 - RNA, 19 nt, Human
ugagcagacuggugagcag

SEQ ID NO: 2484426 - RNA, 23 nt, Human
ugagcacucccaagucuacagag

SEQ ID NO: 2484427 - RNA, 18 nt, Human
ugagcacucccaagucua

SEQ ID NO: 2484428 - RNA, 17 nt, Human
ugagcacucccaagucu

SEQ ID NO: 2484429 - RNA, 15 nt, Human
ugagcacucccaagu

SEQ ID NO: 2484430 - RNA, 13 nt, Human
ugagcacuguagg

SEQ ID NO: 2484431 - RNA, 21 nt, Human
ugagcaucaggccaggcccuc

SEQ ID NO: 2484432 - RNA, 16 nt, Human
ugagcagacuggugag

SEQ ID NO: 2484433 - RNA, 14 nt, Human
agcaacgcaggccc

SEQ ID NO: 2484434 - RNA, 21 nt, Human
agcaaccuggguccaaauaaa

SEQ ID NO: 2484435 - RNA, 20 nt, Human
agcaaccuggguccaaauaa

SEQ ID NO: 2484436 - RNA, 19 nt, Human
agcaaccuggguccaaaua

SEQ ID NO: 2484437 - RNA, 18 nt, Human
agcaaccuggguccaaau

SEQ ID NO: 2484438 - RNA, 22 nt, Human
agcaaccuggguccaaauaaaa

SEQ ID NO: 2484439 - RNA, 15 nt, Human
agcaaccugggucca

SEQ ID NO: 2484440 - RNA, 18 nt, Human
agcaaccgguggauccuc

SEQ ID NO: 2484441 - RNA, 22 nt, Human
agcaacccuccuaucaccuccc

SEQ ID NO: 2484442 - RNA, 19 nt, Human
ugagcaaauguggcuccug

SEQ ID NO: 2484443 - RNA, 18 nt, Human
ugagcaaauguggcuccu

SEQ ID NO: 2484444 - RNA, 16 nt, Human
ugagcaaauguggcuc

SEQ ID NO: 2484445 - RNA, 15 nt, Human
ugagcaauccugcaa

SEQ ID NO: 2484446 - RNA, 16 nt, Human
ugagcaacucuugauu

SEQ ID NO: 2484447 - RNA, 18 nt, Human
ugagcaacucuugauuau

SEQ ID NO: 2484448 - RNA, 15 nt, Human
ugagcaaauguggcu

SEQ ID NO: 2484449 - RNA, 23 nt, Human
ugagcacuaaggugugcucugau

SEQ ID NO: 2484450 - RNA, 22 nt, Human
ugagcacuaaggugugcucuga

SEQ ID NO: 2484451 - RNA, 21 nt, Human
ugagcacuaaggugugcucug

SEQ ID NO: 2484452 - RNA, 20 nt, Human
ugagcacuaaggugugcucu

SEQ ID NO: 2484453 - RNA, 12 nt, Human
ugagcaccugcu

SEQ ID NO: 2484454 - RNA, 20 nt, Human
ugagcacggccaacaaagcu

SEQ ID NO: 2484455 - RNA, 21 nt, Human
ugagcaccugcuucaugcuca

SEQ ID NO: 2484456 - RNA, 19 nt, Human
ugagcaccgucauggcuua

SEQ ID NO: 2484457 - RNA, 16 nt, Human
ugagcaccaggggaug

SEQ ID NO: 2484458 - RNA, 13 nt, Human
ugagcacauucug

SEQ ID NO: 2484459 - RNA, 13 nt, Human
ugagcacacuuua

SEQ ID NO: 2484460 - RNA, 17 nt, Human
ugagcacagccuagggc

SEQ ID NO: 2484461 - RNA, 17 nt, Human
ugagcaccgucauggcu

SEQ ID NO: 2484462 - RNA, 13 nt, Human
ugagcaccagggg

SEQ ID NO: 2484463 - RNA, 14 nt, Human
ugagcaccagggga

SEQ ID NO: 2484464 - RNA, 14 nt, Human
ugagcaauucuccu

SEQ ID NO: 2484465 - RNA, 20 nt, Human
ugagcaaugucugugcuagg

SEQ ID NO: 2484466 - RNA, 18 nt, Human
ugagcaaugucugugcua

SEQ ID NO: 2484467 - RNA, 17 nt, Human
ugagcaaugucugugcu

SEQ ID NO: 2484468 - RNA, 20 nt, Human
ugagcacacuuuaguggccg

SEQ ID NO: 2484469 - RNA, 21 nt, Human
ugagcacaacuuuaagaggac

SEQ ID NO: 2484470 - RNA, 22 nt, Human
ugagcacaacuuuaagaggaca

SEQ ID NO: 2484471 - RNA, 17 nt, Human
ugagcaacuuucuuaca

SEQ ID NO: 2484472 - RNA, 16 nt, Human
ugagcaaugucugugc

SEQ ID NO: 2484473 - RNA, 21 nt, Human
agcaccugcuucaugcucagc

SEQ ID NO: 2484474 - RNA, 20 nt, Human
agcaccugcuucaugcucag

SEQ ID NO: 2484475 - RNA, 16 nt, Human
agcaccuuccucacuu

SEQ ID NO: 2484476 - RNA, 15 nt, Human
agcaccuuccucacu

SEQ ID NO: 2484477 - RNA, 22 nt, Human
agcaccugucuccuuucacccc

SEQ ID NO: 2484478 - RNA, 23 nt, Human
agcaccuuagacagucccugcca

SEQ ID NO: 2484479 - RNA, 20 nt, Human
agcaccuuccucacuuccau

SEQ ID NO: 2484480 - RNA, 19 nt, Human
agcaccuuccucacuucca

SEQ ID NO: 2484481 - RNA, 18 nt, Human
agcaccuuccucacuucc

SEQ ID NO: 2484482 - RNA, 17 nt, Human
agcacgaaauguuauuu

SEQ ID NO: 2484483 - RNA, 13 nt, Human
agcacgauuucug

SEQ ID NO: 2484484 - RNA, 14 nt, Human
agcacgauuucugu

SEQ ID NO: 2484485 - RNA, 15 nt, Human
agcacgauuucuguu

SEQ ID NO: 2484486 - RNA, 16 nt, Human
agcacgauuucuguuu

SEQ ID NO: 2484487 - RNA, 12 nt, Human
agcacuuguaua

SEQ ID NO: 2484488 - RNA, 18 nt, Human
agcacgaaauguuauuuu

SEQ ID NO: 2484489 - RNA, 23 nt, Human
agcacuuggagccaaggguucag

SEQ ID NO: 2484490 - RNA, 22 nt, Human
agcaccuuagacagucccugcc

SEQ ID NO: 2484491 - RNA, 21 nt, Human
agcaccuuagacagucccugc

SEQ ID NO: 2484492 - RNA, 20 nt, Human
agcaccuuagacagucccug

SEQ ID NO: 2484493 - RNA, 19 nt, Human
agcaccuuagacagucccu

SEQ ID NO: 2484494 - RNA, 18 nt, Human
agcaccaagcucaaagcg

SEQ ID NO: 2484495 - RNA, 17 nt, Human
agcaccaagcucaaagc

SEQ ID NO: 2484496 - RNA, 23 nt, Human
agcaccacccuagucccuucccc

SEQ ID NO: 2484497 - RNA, 17 nt, Human
agcaccagcuucuccag

SEQ ID NO: 2484498 - RNA, 18 nt, Human
agcaccagcuucuccagg

SEQ ID NO: 2484499 - RNA, 20 nt, Human
agcaccagcuucuccaggcu

SEQ ID NO: 2484500 - RNA, 19 nt, Human
agcaccagcuucuccaggc

SEQ ID NO: 2484501 - RNA, 21 nt, Human
agcaccagcuucuccaggcuc

SEQ ID NO: 2484502 - RNA, 14 nt, Human
agcaccaggcacga

SEQ ID NO: 2484503 - RNA, 10 nt, Human
agcaccaggg

SEQ ID NO: 2484504 - RNA, 12 nt, Human
agcaccagggaa

SEQ ID NO: 2484505 - RNA, 13 nt, Human
agcaccagggaag

SEQ ID NO: 2484506 - RNA, 17 nt, Human
agcaccagggcucacgu

SEQ ID NO: 2484507 - RNA, 15 nt, Human
agcaccagggacuau

SEQ ID NO: 2484508 - RNA, 23 nt, Human
agcaccaggcacgaacccaccug

SEQ ID NO: 2484509 - RNA, 12 nt, Human
agcagaaaugcc

SEQ ID NO: 2484510 - RNA, 13 nt, Human
agcagaaaugccu

SEQ ID NO: 2484511 - RNA, 19 nt, Human
agcagaaaugccuuacccu

SEQ ID NO: 2484512 - RNA, 13 nt, Human
agcagaaauacau

SEQ ID NO: 2484513 - RNA, 15 nt, Human
agcagaaaucuagaa

SEQ ID NO: 2484514 - RNA, 13 nt, Human
agcagaauaaagc

SEQ ID NO: 2484515 - RNA, 12 nt, Human
agcagaauaaag

SEQ ID NO: 2484516 - RNA, 11 nt, Human
agcagaauaaa

SEQ ID NO: 2484517 - RNA, 16 nt, Human
agcagaaguggagcug

SEQ ID NO: 2484518 - RNA, 23 nt, Human
agcagaaggggguggugucucca

SEQ ID NO: 2484519 - RNA, 22 nt, Human
agcagaaggggguggugucucc

SEQ ID NO: 2484520 - RNA, 16 nt, Human
agcagaaggggguggu

SEQ ID NO: 2484521 - RNA, 12 nt, Human
agcagaaggggg

SEQ ID NO: 2484522 - RNA, 14 nt, Human
agcagaacagugau

SEQ ID NO: 2484523 - RNA, 21 nt, Human
agcagaacggagccccaggcc

SEQ ID NO: 2484524 - RNA, 14 nt, Human
agcagaacugaacc

SEQ ID NO: 2484525 - RNA, 22 nt, Human
agcacuuugggaggccaaggug

SEQ ID NO: 2484526 - RNA, 14 nt, Human
agcacuuugggagg

SEQ ID NO: 2484527 - RNA, 19 nt, Human
agcacuuugggaggccaag

SEQ ID NO: 2484528 - RNA, 15 nt, Human
agcacuuugggaggc

SEQ ID NO: 2484529 - RNA, 12 nt, Human
agcacuuuggga

SEQ ID NO: 2484530 - RNA, 21 nt, Human
agcacuuguggguuuuuguuu

SEQ ID NO: 2484531 - RNA, 13 nt, Human
agcacuuguauau

SEQ ID NO: 2484532 - RNA, 16 nt, Human
agcacuuguccagcug

SEQ ID NO: 2484533 - RNA, 22 nt, Human
agcacuuucuacaaugugaacu

SEQ ID NO: 2484534 - RNA, 23 nt, Human
agcacuuugggaggccaaggugg

SEQ ID NO: 2484535 - RNA, 16 nt, Human
agcacuuugggaggcu

SEQ ID NO: 2484536 - RNA, 21 nt, Human
agcacuuugggaggccaaggu

SEQ ID NO: 2484537 - RNA, 20 nt, Human
agcacuuugggaggccaagg

SEQ ID NO: 2484538 - RNA, 21 nt, Human
agcacuuugggaggcugaggc

SEQ ID NO: 2484539 - RNA, 22 nt, Human
agcacuuugggaggcugaggcg

SEQ ID NO: 2484540 - RNA, 19 nt, Human
agcagaaaauacagcugga

SEQ ID NO: 2484541 - RNA, 13 nt, Human
agcagaaaauaca

SEQ ID NO: 2484542 - RNA, 13 nt, Human
ugagcgacaguga

SEQ ID NO: 2484543 - RNA, 14 nt, Human
ugagcgacagugag

SEQ ID NO: 2484544 - RNA, 16 nt, Human
ugagcgacagugagac

SEQ ID NO: 2484545 - RNA, 20 nt, Human
ugagcgacagugagacucug

SEQ ID NO: 2484546 - RNA, 15 nt, Human
ugagccuugaacuuu

SEQ ID NO: 2484547 - RNA, 17 nt, Human
ugagccuugaacuuuga

SEQ ID NO: 2484548 - RNA, 18 nt, Human
ugagccuugaacuuugac

SEQ ID NO: 2484549 - RNA, 19 nt, Human
ugagccuugaacuuugacc

SEQ ID NO: 2484550 - RNA, 11 nt, Human
ugagccuggcc

SEQ ID NO: 2484551 - RNA, 12 nt, Human
ugagccuggcca

SEQ ID NO: 2484552 - RNA, 18 nt, Human
ugagccuggcucuugugc

SEQ ID NO: 2484553 - RNA, 13 nt, Human
ugagccuggcucu

SEQ ID NO: 2484554 - RNA, 16 nt, Human
ugagccuggccagccu

SEQ ID NO: 2484555 - RNA, 14 nt, Human
ugagccugggaggu

SEQ ID NO: 2484556 - RNA, 11 nt, Human
ugagccuggca

SEQ ID NO: 2484557 - RNA, 16 nt, Human
ugagccuggcaagaau

SEQ ID NO: 2484558 - RNA, 19 nt, Human
ugagccugggaggucaagg

SEQ ID NO: 2484559 - RNA, 22 nt, Human
ugagccugggaggucaaggcug

SEQ ID NO: 2484560 - RNA, 14 nt, Human
ugagccuugaacuu

SEQ ID NO: 2484561 - RNA, 13 nt, Human
ugagccuucaguc

SEQ ID NO: 2484562 - RNA, 17 nt, Human
ugagccuggcuggcaca

SEQ ID NO: 2484563 - RNA, 13 nt, Human
ugagccuggcugg

SEQ ID NO: 2484564 - RNA, 14 nt, Human
ugagccuucagucu

SEQ ID NO: 2484565 - RNA, 23 nt, Human
agcagagaaugaaagggcccaga

SEQ ID NO: 2484566 - RNA, 22 nt, Human
agcagagaaugaaagggcccag

SEQ ID NO: 2484567 - RNA, 14 nt, Human
agcagagaauucuc

SEQ ID NO: 2484568 - RNA, 21 nt, Human
agcagagaauucucuuaucca

SEQ ID NO: 2484569 - RNA, 16 nt, Human
agcagagaccaucccu

SEQ ID NO: 2484570 - RNA, 15 nt, Human
agcagagaccauccc

SEQ ID NO: 2484571 - RNA, 15 nt, Human
agcagagacacuaac

SEQ ID NO: 2484572 - RNA, 14 nt, Human
agcagacuggugag

SEQ ID NO: 2484573 - RNA, 19 nt, Human
agcagacuggugagcagac

SEQ ID NO: 2484574 - RNA, 10 nt, Human
ugagccuggc

SEQ ID NO: 2484575 - RNA, 12 nt, Human
agcagacauugu

SEQ ID NO: 2484576 - RNA, 21 nt, Human
agcagacaguguuuucuggga

SEQ ID NO: 2484577 - RNA, 12 nt, Human
agcagacaggcc

SEQ ID NO: 2484578 - RNA, 23 nt, Human
agcagaauaaagcaauuuuccuu

SEQ ID NO: 2484579 - RNA, 22 nt, Human
agcagaauaaagcaauuuuccu

SEQ ID NO: 2484580 - RNA, 21 nt, Human
agcagaauaaagcaauuuucc

SEQ ID NO: 2484581 - RNA, 18 nt, Human
agcagaauaaagcaauuu

SEQ ID NO: 2484582 - RNA, 17 nt, Human
agcagaauaaagcaauu

SEQ ID NO: 2484583 - RNA, 16 nt, Human
agcagaauaaagcaau

SEQ ID NO: 2484584 - RNA, 15 nt, Human
agcagaauaaagcaa

SEQ ID NO: 2484585 - RNA, 14 nt, Human
agcagaauaaagca

SEQ ID NO: 2484586 - RNA, 19 nt, Human
agcagaauagcaaggugcu

SEQ ID NO: 2484587 - RNA, 23 nt, Human
agcagacauugucagcaaauuaa

SEQ ID NO: 2484588 - RNA, 22 nt, Human
agcagaccaccccgccugcccu

SEQ ID NO: 2484589 - RNA, 17 nt, Human
agcagacauugucagca

SEQ ID NO: 2484590 - RNA, 13 nt, Human
agcagacauuguc

SEQ ID NO: 2484591 - RNA, 21 nt, Human
agcagagaaugaaagggccca

SEQ ID NO: 2484592 - RNA, 19 nt, Human
agacauguagguguuuguu

SEQ ID NO: 2484593 - RNA, 16 nt, Human
agacauguagguguuu

SEQ ID NO: 2484594 - RNA, 18 nt, Human
agacaugucuguucuaca

SEQ ID NO: 2484595 - RNA, 16 nt, Human
agacauggggaggaag

SEQ ID NO: 2484596 - RNA, 18 nt, Human
agacauggggaggaagga

SEQ ID NO: 2484597 - RNA, 19 nt, Human
agacauggggaggaaggac

SEQ ID NO: 2484598 - RNA, 14 nt, Human
agacaugugacauu

SEQ ID NO: 2484599 - RNA, 13 nt, Human
agacaugugacau

SEQ ID NO: 2484600 - RNA, 12 nt, Human
agacaugugaca

SEQ ID NO: 2484601 - RNA, 20 nt, Human
agacaugucuguucuacaua

SEQ ID NO: 2484602 - RNA, 16 nt, Human
agacaugugacauuua

SEQ ID NO: 2484603 - RNA, 15 nt, Human
agacaugugacauuu

SEQ ID NO: 2484604 - RNA, 17 nt, Human
agacaugugacauuuau

SEQ ID NO: 2484605 - RNA, 17 nt, Human
agacauguggugggaca

SEQ ID NO: 2484606 - RNA, 21 nt, Human
ucuuccuauuugccaugggcu

SEQ ID NO: 2484607 - RNA, 21 nt, Human
ucuuccuaguuuucuccuccc

SEQ ID NO: 2484608 - RNA, 23 nt, Human
ucuuccuaguuuucuccucccag

SEQ ID NO: 2484609 - RNA, 19 nt, Human
ucuuccuaguuuucuccuc

SEQ ID NO: 2484610 - RNA, 21 nt, Human
ucuuccggagauguagcaaaa

SEQ ID NO: 2484611 - RNA, 18 nt, Human
ucuuccggagauguagca

SEQ ID NO: 2484612 - RNA, 19 nt, Human
ucuuccggagauguagcaa

SEQ ID NO: 2484613 - RNA, 12 nt, Human
agacccucucaa

SEQ ID NO: 2484614 - RNA, 17 nt, Human
agacauguuuuagacaa

SEQ ID NO: 2484615 - RNA, 15 nt, Human
agacauguuuuagac

SEQ ID NO: 2484616 - RNA, 22 nt, Human
agacauguagguguuuguucau

SEQ ID NO: 2484617 - RNA, 23 nt, Human
agacauguuuuagacaaauacuc

SEQ ID NO: 2484618 - RNA, 19 nt, Human
agacauguuuuagacaaau

SEQ ID NO: 2484619 - RNA, 14 nt, Human
agacccugcccugu

SEQ ID NO: 2484620 - RNA, 13 nt, Human
agacccugcccug

SEQ ID NO: 2484621 - RNA, 12 nt, Human
agacccugcccu

SEQ ID NO: 2484622 - RNA, 17 nt, Human
agacccucugccaccag

SEQ ID NO: 2484623 - RNA, 16 nt, Human
agacccucugccacca

SEQ ID NO: 2484624 - RNA, 15 nt, Human
agacccucugccacc

SEQ ID NO: 2484625 - RNA, 14 nt, Human
agacccucguggcc

SEQ ID NO: 2484626 - RNA, 23 nt, Human
agacccugcccugugggccccca

SEQ ID NO: 2484627 - RNA, 21 nt, Human
agacccugcccugugggcccc

SEQ ID NO: 2484628 - RNA, 19 nt, Human
agacccugcccugugggcc

SEQ ID NO: 2484629 - RNA, 16 nt, Human
agacccugcccugugg

SEQ ID NO: 2484630 - RNA, 15 nt, Human
agacccuuguggucc

SEQ ID NO: 2484631 - RNA, 13 nt, Human
agacccuuguggu

SEQ ID NO: 2484632 - RNA, 20 nt, Human
agacccugggugggcucugu

SEQ ID NO: 2484633 - RNA, 19 nt, Human
agacccugggugggcucug

SEQ ID NO: 2484634 - RNA, 17 nt, Human
agacccugggugggcuc

SEQ ID NO: 2484635 - RNA, 21 nt, Human
agacccucugccaccagagac

SEQ ID NO: 2484636 - RNA, 20 nt, Human
agacccucugccaccagaga

SEQ ID NO: 2484637 - RNA, 18 nt, Human
agacccuugacaccugcu

SEQ ID NO: 2484638 - RNA, 17 nt, Human
agacccuuauuacacgg

SEQ ID NO: 2484639 - RNA, 22 nt, Human
agacccugggugggcucugugc

SEQ ID NO: 2484640 - RNA, 13 nt, Human
agacccugucucu

SEQ ID NO: 2484641 - RNA, 23 nt, Human
agacccuuguggucccaccccac

SEQ ID NO: 2484642 - RNA, 22 nt, Human
agacccuuguggucccacccca

SEQ ID NO: 2484643 - RNA, 20 nt, Human
agacccuuguggucccaccc

SEQ ID NO: 2484644 - RNA, 19 nt, Human
agacccuuguggucccacc

SEQ ID NO: 2484645 - RNA, 23 nt, Human
agaccuaccucagguugcugguu

SEQ ID NO: 2484646 - RNA, 19 nt, Human
agaccuaccucagguugcu

SEQ ID NO: 2484647 - RNA, 16 nt, Human
agaccuaccucagguu

SEQ ID NO: 2484648 - RNA, 15 nt, Human
agaccuaccucaggu

SEQ ID NO: 2484649 - RNA, 14 nt, Human
agaccuaccucagg

SEQ ID NO: 2484650 - RNA, 18 nt, Human
agaccuaaugcuccuugu

SEQ ID NO: 2484651 - RNA, 15 nt, Human
agaccuaaugcuccu

SEQ ID NO: 2484652 - RNA, 19 nt, Human
agaccuaacgagaaauaga

SEQ ID NO: 2484653 - RNA, 13 nt, Human
agacuccaaagaa

SEQ ID NO: 2484654 - RNA, 14 nt, Human
agacuccaaagaaa

SEQ ID NO: 2484655 - RNA, 12 nt, Human
agacuccaaaga

SEQ ID NO: 2484656 - RNA, 18 nt, Human
agacucauucuucuguac

SEQ ID NO: 2484657 - RNA, 18 nt, Human
agacuauucaaacagucu

SEQ ID NO: 2484658 - RNA, 20 nt, Human
agacuauucaaacagucuca

SEQ ID NO: 2484659 - RNA, 21 nt, Human
agacuauucaaacagucucag

SEQ ID NO: 2484660 - RNA, 17 nt, Human
agacucauucuucugua

SEQ ID NO: 2484661 - RNA, 12 nt, Human
agaccugccccu

SEQ ID NO: 2484662 - RNA, 19 nt, Human
agacuaucuaaauguugaa

SEQ ID NO: 2484663 - RNA, 17 nt, Human
agacuaucuaaauguug

SEQ ID NO: 2484664 - RNA, 18 nt, Human
agacuaucuaaauguuga

SEQ ID NO: 2484665 - RNA, 18 nt, Human
agaccugauccuggaggc

SEQ ID NO: 2484666 - RNA, 19 nt, Human
agaccugauccuggaggcc

SEQ ID NO: 2484667 - RNA, 21 nt, Human
agaccugauccuggaggccca

SEQ ID NO: 2484668 - RNA, 22 nt, Human
agaccugauccuggaggcccag

SEQ ID NO: 2484669 - RNA, 15 nt, Human
agacuaucuaaaugu

SEQ ID NO: 2484670 - RNA, 15 nt, Human
agaccugauccugga

SEQ ID NO: 2484671 - RNA, 16 nt, Human
agaccugauccuggag

SEQ ID NO: 2484672 - RNA, 14 nt, Human
agaccugauccugg

SEQ ID NO: 2484673 - RNA, 16 nt, Human
agaccugagcucccca

SEQ ID NO: 2484674 - RNA, 17 nt, Human
agaccugacaagcacug

SEQ ID NO: 2484675 - RNA, 15 nt, Human
agaccugaauucuuu

SEQ ID NO: 2484676 - RNA, 19 nt, Human
agaccugacaagcacugcu

SEQ ID NO: 2484677 - RNA, 19 nt, Human
agaccugacaccuuucaua

SEQ ID NO: 2484678 - RNA, 21 nt, Human
ucuuggaccucugcucugagg

SEQ ID NO: 2484679 - RNA, 18 nt, Human
ucuuggaccucugcucug

SEQ ID NO: 2484680 - RNA, 16 nt, Human
ucuuggaccucugcuc

SEQ ID NO: 2484681 - RNA, 14 nt, Human
ucuuggaccucugc

SEQ ID NO: 2484682 - RNA, 17 nt, Human
ucuuggacacuguacaa

SEQ ID NO: 2484683 - RNA, 16 nt, Human
ucuuggacacuguaca

SEQ ID NO: 2484684 - RNA, 13 nt, Human
ucuuggagccugc

SEQ ID NO: 2484685 - RNA, 14 nt, Human
ucuuggagccugca

SEQ ID NO: 2484686 - RNA, 23 nt, Human
ucuuggaccucugcucugaggcu

SEQ ID NO: 2484687 - RNA, 12 nt, Human
ucuuggagccug

SEQ ID NO: 2484688 - RNA, 16 nt, Human
ucuugcaauggcagcc

SEQ ID NO: 2484689 - RNA, 13 nt, Human
ucuugcaauggca

SEQ ID NO: 2484690 - RNA, 17 nt, Human
ucuugcaauggcagccu

SEQ ID NO: 2484691 - RNA, 15 nt, Human
ucuuggaaaaaguga

SEQ ID NO: 2484692 - RNA, 16 nt, Human
ucuuggaaaaagugau

SEQ ID NO: 2484693 - RNA, 16 nt, Human
ucuuggaaagaaacaa

SEQ ID NO: 2484694 - RNA, 20 nt, Human
ucuugaugccuggcggggug

SEQ ID NO: 2484695 - RNA, 13 nt, Human
ucuugaugcaugc

SEQ ID NO: 2484696 - RNA, 21 nt, Human
ucuugaugcaugcacuguucc

SEQ ID NO: 2484697 - RNA, 14 nt, Human
ucuugaugccuggc

SEQ ID NO: 2484698 - RNA, 15 nt, Human
ucuugaucuguucug

SEQ ID NO: 2484699 - RNA, 23 nt, Human
ucuugaucugcucagcccuggag

SEQ ID NO: 2484700 - RNA, 12 nt, Human
ucuugaugacca

SEQ ID NO: 2484701 - RNA, 16 nt, Human
agacuccaaagaaaug

SEQ ID NO: 2484702 - RNA, 19 nt, Human
agacuccaaagaaauguaa

SEQ ID NO: 2484703 - RNA, 22 nt, Human
ucuugaucugcucagcccugga

SEQ ID NO: 2484704 - RNA, 21 nt, Human
ucuugaucugcucagcccugg

SEQ ID NO: 2484705 - RNA, 20 nt, Human
ucuugaucugcucagcccug

SEQ ID NO: 2484706 - RNA, 19 nt, Human
ucuugaucugcucagcccu

SEQ ID NO: 2484707 - RNA, 17 nt, Human
ucuugaucugcucagcc

SEQ ID NO: 2484708 - RNA, 14 nt, Human
ucuugaucugcuca

SEQ ID NO: 2484709 - RNA, 23 nt, Human
agaccugauccuggaggcccagu

SEQ ID NO: 2484710 - RNA, 18 nt, Human
ucuuuagaguuagacugu

SEQ ID NO: 2484711 - RNA, 17 nt, Human
ucuuuagaguuagacug

SEQ ID NO: 2484712 - RNA, 16 nt, Human
ucuuuagaguuagacu

SEQ ID NO: 2484713 - RNA, 14 nt, Human
ucuuuagaguuaga

SEQ ID NO: 2484714 - RNA, 17 nt, Human
ucuuuaggauugugaug

SEQ ID NO: 2484715 - RNA, 19 nt, Human
ucuuuagagcauugccauu

SEQ ID NO: 2484716 - RNA, 19 nt, Human
ucuuuagaguuagacuguu

SEQ ID NO: 2484717 - RNA, 14 nt, Human
ucuuuagagcauug

SEQ ID NO: 2484718 - RNA, 13 nt, Human
ucuuuagagcauu

SEQ ID NO: 2484719 - RNA, 12 nt, Human
ucuuuagaguua

SEQ ID NO: 2484720 - RNA, 16 nt, Human
ucuuuaccugagacca

SEQ ID NO: 2484721 - RNA, 18 nt, Human
ucuuuaccugagaccagu

SEQ ID NO: 2484722 - RNA, 12 nt, Human
ucuuuacuuuua

SEQ ID NO: 2484723 - RNA, 13 nt, Human
ucuuuaccugaga

SEQ ID NO: 2484724 - RNA, 15 nt, Human
ucuuuacuucaugga

SEQ ID NO: 2484725 - RNA, 15 nt, Human
ucuuggagccugcag

SEQ ID NO: 2484726 - RNA, 18 nt, Human
ucuuggagccugcagagc

SEQ ID NO: 2484727 - RNA, 16 nt, Human
ucuuggagcugagccu

SEQ ID NO: 2484728 - RNA, 19 nt, Human
ucuuggagccugcagagcu

SEQ ID NO: 2484729 - RNA, 22 nt, Human
ucuuggcacauuuaagagacag

SEQ ID NO: 2484730 - RNA, 21 nt, Human
ucuuggcacauuuaagagaca

SEQ ID NO: 2484731 - RNA, 14 nt, Human
ucuuggagucuucc

SEQ ID NO: 2484732 - RNA, 21 nt, Human
ucuuggagcugagccucucac

SEQ ID NO: 2484733 - RNA, 17 nt, Human
ucuuuaaaauacacacu

SEQ ID NO: 2484734 - RNA, 21 nt, Human
ucuuuaaaauuuaaguaucuu

SEQ ID NO: 2484735 - RNA, 21 nt, Human
ucuuuaaagggauggcaagau

SEQ ID NO: 2484736 - RNA, 18 nt, Human
ucuuuaaagucaggucca

SEQ ID NO: 2484737 - RNA, 17 nt, Human
agacuccugcaggcagc

SEQ ID NO: 2484738 - RNA, 16 nt, Human
agacuccugcaggcag

SEQ ID NO: 2484739 - RNA, 15 nt, Human
agacuccugcaggca

SEQ ID NO: 2484740 - RNA, 14 nt, Human
agacuccugcaggc

SEQ ID NO: 2484741 - RNA, 23 nt, Human
ucuuuaggauugugaugguucgu

SEQ ID NO: 2484742 - RNA, 16 nt, Human
ucuuuccugaggcugg

SEQ ID NO: 2484743 - RNA, 15 nt, Human
ucuuuccugaggcug

SEQ ID NO: 2484744 - RNA, 14 nt, Human
ucuuuccugaggcu

SEQ ID NO: 2484745 - RNA, 13 nt, Human
ucuuuccugaggc

SEQ ID NO: 2484746 - RNA, 23 nt, Human
agacuccugcaggcagccaggcc

SEQ ID NO: 2484747 - RNA, 20 nt, Human
agacuccugcaggcagccag

SEQ ID NO: 2484748 - RNA, 19 nt, Human
agacuccugcaggcagcca

SEQ ID NO: 2484749 - RNA, 18 nt, Human
agacuccugcaggcagcc

SEQ ID NO: 2484750 - RNA, 21 nt, Human
agacucgcgacaaugcaaacc

SEQ ID NO: 2484751 - RNA, 17 nt, Human
agacucuacagaggcca

SEQ ID NO: 2484752 - RNA, 19 nt, Human
agacucuacagaggccaug

SEQ ID NO: 2484753 - RNA, 20 nt, Human
agagacacacugaagaagca

SEQ ID NO: 2484754 - RNA, 18 nt, Human
agagacacacugaagaag

SEQ ID NO: 2484755 - RNA, 14 nt, Human
agagaccaucccug

SEQ ID NO: 2484756 - RNA, 13 nt, Human
agagaccaucccu

SEQ ID NO: 2484757 - RNA, 18 nt, Human
ucuuugggaauguuuguc

SEQ ID NO: 2484758 - RNA, 14 nt, Human
ucuuugggaauguu

SEQ ID NO: 2484759 - RNA, 15 nt, Human
ucuuugggccagaca

SEQ ID NO: 2484760 - RNA, 16 nt, Human
ucuuugggccagacau

SEQ ID NO: 2484761 - RNA, 20 nt, Human
ucuuuggguaccuauuuuca

SEQ ID NO: 2484762 - RNA, 19 nt, Human
ucuuuggguaccuauuuuc

SEQ ID NO: 2484763 - RNA, 18 nt, Human
ucuuuggggucagccagg

SEQ ID NO: 2484764 - RNA, 21 nt, Human
ucuuuggggucagccagggcc

SEQ ID NO: 2484765 - RNA, 20 nt, Human
ucuuugggccagacaugcca

SEQ ID NO: 2484766 - RNA, 19 nt, Human
agagaccaggcaaagcaag

SEQ ID NO: 2484767 - RNA, 20 nt, Human
ucuuugggaauauuugaauc

SEQ ID NO: 2484768 - RNA, 15 nt, Human
agagaccaucccuga

SEQ ID NO: 2484769 - RNA, 15 nt, Human
agagaaugagagaca

SEQ ID NO: 2484770 - RNA, 20 nt, Human
agagaaucaacauuucucaa

SEQ ID NO: 2484771 - RNA, 15 nt, Human
agagaaucauacuua

SEQ ID NO: 2484772 - RNA, 22 nt, Human
agagaaugaaauugcugaaaga

SEQ ID NO: 2484773 - RNA, 17 nt, Human
agagacacacugaagaa

SEQ ID NO: 2484774 - RNA, 23 nt, Human
agagaaucccuagucuucaagca

SEQ ID NO: 2484775 - RNA, 15 nt, Human
agagaauggaaaaca

SEQ ID NO: 2484776 - RNA, 12 nt, Human
agacuuuggaaa

SEQ ID NO: 2484777 - RNA, 14 nt, Human
agacuuuggaaaau

SEQ ID NO: 2484778 - RNA, 21 nt, Human
agacuuuggaaaaugcauugu

SEQ ID NO: 2484779 - RNA, 22 nt, Human
agacuuuggaaaaugcauugua

SEQ ID NO: 2484780 - RNA, 23 nt, Human
agacuuuggaaaaugcauuguau

SEQ ID NO: 2484781 - RNA, 14 nt, Human
agacuuuggaaaga

SEQ ID NO: 2484782 - RNA, 18 nt, Human
agagaaugaaagggccca

SEQ ID NO: 2484783 - RNA, 14 nt, Human
agacuugaaauacu

SEQ ID NO: 2484784 - RNA, 18 nt, Human
agacuuggcaacagaagc

SEQ ID NO: 2484785 - RNA, 17 nt, Human
agacuuggcaacagaag

SEQ ID NO: 2484786 - RNA, 15 nt, Human
agacuugggacauug

SEQ ID NO: 2484787 - RNA, 19 nt, Human
agacuuggcaacagaagca

SEQ ID NO: 2484788 - RNA, 13 nt, Human
agacuugcucucu

SEQ ID NO: 2484789 - RNA, 17 nt, Human
agacuucaucccucugg

SEQ ID NO: 2484790 - RNA, 21 nt, Human
agacuucaguauguugucaaa

SEQ ID NO: 2484791 - RNA, 19 nt, Human
agacuucaguauguuguca

SEQ ID NO: 2484792 - RNA, 13 nt, Human
agacuucaguaug

SEQ ID NO: 2484793 - RNA, 12 nt, Human
agacuucugcuu

SEQ ID NO: 2484794 - RNA, 22 nt, Human
agacuucaguauguugucaaag

SEQ ID NO: 2484795 - RNA, 18 nt, Human
agacuucugcuuuccaca

SEQ ID NO: 2484796 - RNA, 14 nt, Human
agacuucaucccuc

SEQ ID NO: 2484797 - RNA, 23 nt, Human
agacuguugcucaaaucuauuca

SEQ ID NO: 2484798 - RNA, 21 nt, Human
agacuucacacugcaagagcc

SEQ ID NO: 2484799 - RNA, 15 nt, Human
agacuucacacugca

SEQ ID NO: 2484800 - RNA, 14 nt, Human
agacuggcacaguu

SEQ ID NO: 2484801 - RNA, 15 nt, Human
agacuggcacaguuu

SEQ ID NO: 2484802 - RNA, 14 nt, Human
agacugucucaaga

SEQ ID NO: 2484803 - RNA, 18 nt, Human
agacuggcacaguuuucu

SEQ ID NO: 2484804 - RNA, 11 nt, Human
agacuguguau

SEQ ID NO: 2484805 - RNA, 11 nt, Human
agacuguggcu

SEQ ID NO: 2484806 - RNA, 14 nt, Human
agacuguggcugcu

SEQ ID NO: 2484807 - RNA, 20 nt, Human
agacuguggcugcuagcacu

SEQ ID NO: 2484808 - RNA, 15 nt, Human
agacuguugcucaaa

SEQ ID NO: 2484809 - RNA, 14 nt, Human
agacuguugcucaa

SEQ ID NO: 2484810 - RNA, 18 nt, Human
agacuguuaaaugaaacc

SEQ ID NO: 2484811 - RNA, 17 nt, Human
agacuguuaaaugaaac

SEQ ID NO: 2484812 - RNA, 23 nt, Human
agacuguugggguggguauaaaa

SEQ ID NO: 2484813 - RNA, 11 nt, Human
agacuguuggg

SEQ ID NO: 2484814 - RNA, 14 nt, Human
agacuuaucaacau

SEQ ID NO: 2484815 - RNA, 17 nt, Human
agacagucccugccaau

SEQ ID NO: 2484816 - RNA, 16 nt, Human
agacagucccugccaa

SEQ ID NO: 2484817 - RNA, 15 nt, Human
agacagucccugcca

SEQ ID NO: 2484818 - RNA, 21 nt, Human
agacaguauacaguccugugg

SEQ ID NO: 2484819 - RNA, 17 nt, Human
agacaguauacaguccu

SEQ ID NO: 2484820 - RNA, 15 nt, Human
agacaguauauuuau

SEQ ID NO: 2484821 - RNA, 14 nt, Human
agacaguauacagu

SEQ ID NO: 2484822 - RNA, 12 nt, Human
agacaguaugag

SEQ ID NO: 2484823 - RNA, 12 nt, Human
ucuuaagcuucc

SEQ ID NO: 2484824 - RNA, 17 nt, Human
ucuuaaguuucucagcu

SEQ ID NO: 2484825 - RNA, 15 nt, Human
ucuuaaguuucucag

SEQ ID NO: 2484826 - RNA, 16 nt, Human
ucuuaaggggcagcuu

SEQ ID NO: 2484827 - RNA, 17 nt, Human
agacaguauauuuauag

SEQ ID NO: 2484828 - RNA, 18 nt, Human
agacaguauauuuauagu

SEQ ID NO: 2484829 - RNA, 23 nt, Human
ucuuaaggauugugauauuuuua

SEQ ID NO: 2484830 - RNA, 18 nt, Human
ucuuaaguuucucagcuc

SEQ ID NO: 2484831 - RNA, 15 nt, Human
ucuuaauauaacugc

SEQ ID NO: 2484832 - RNA, 19 nt, Human
ucuuaauauaacugccuua

SEQ ID NO: 2484833 - RNA, 18 nt, Human
ucuuaauauaacugccuu

SEQ ID NO: 2484834 - RNA, 15 nt, Human
agacaggaccaggga

SEQ ID NO: 2484835 - RNA, 14 nt, Human
agacaggaaaggga

SEQ ID NO: 2484836 - RNA, 15 nt, Human
agacaggcccaagag

SEQ ID NO: 2484837 - RNA, 16 nt, Human
agacaggcccaagaga

SEQ ID NO: 2484838 - RNA, 18 nt, Human
agacaggaaagggaaggc

SEQ ID NO: 2484839 - RNA, 21 nt, Human
agacaggacagugcuucagcc

SEQ ID NO: 2484840 - RNA, 23 nt, Human
agacaggcaagcaccuccugccu

SEQ ID NO: 2484841 - RNA, 22 nt, Human
agacaggguuuggcugugucua

SEQ ID NO: 2484842 - RNA, 21 nt, Human
agacaggguuuggcugugucu

SEQ ID NO: 2484843 - RNA, 23 nt, Human
agacaggguuuggcugugucuaa

SEQ ID NO: 2484844 - RNA, 16 nt, Human
agacaggguuuggcug

SEQ ID NO: 2484845 - RNA, 23 nt, Human
agacaggguuucaccauguugcc

SEQ ID NO: 2484846 - RNA, 21 nt, Human
agacaggguuuugccauguug

SEQ ID NO: 2484847 - RNA, 15 nt, Human
agacaggcucuuagc

SEQ ID NO: 2484848 - RNA, 18 nt, Human
agacaggcccaagagaug

SEQ ID NO: 2484849 - RNA, 22 nt, Human
agacaggcccaagagaugaaga

SEQ ID NO: 2484850 - RNA, 20 nt, Human
agacaggcucuuagcagcuu

SEQ ID NO: 2484851 - RNA, 23 nt, Human
agacaggcccaagagaugaagag

SEQ ID NO: 2484852 - RNA, 19 nt, Human
agacaggguuucaccaugu

SEQ ID NO: 2484853 - RNA, 15 nt, Human
agacaccagagcaga

SEQ ID NO: 2484854 - RNA, 13 nt, Human
agacaccagagca

SEQ ID NO: 2484855 - RNA, 18 nt, Human
agaauuugagugcucuga

SEQ ID NO: 2484856 - RNA, 17 nt, Human
agaauuugagugcucug

SEQ ID NO: 2484857 - RNA, 21 nt, Human
agacacccucaaccucuucug

SEQ ID NO: 2484858 - RNA, 22 nt, Human
agacaccgccacauggcuuccu

SEQ ID NO: 2484859 - RNA, 21 nt, Human
agacacggaucugagaaucuu

SEQ ID NO: 2484860 - RNA, 20 nt, Human
agacacggaucugagaaucu

SEQ ID NO: 2484861 - RNA, 18 nt, Human
agacacggaucugagaau

SEQ ID NO: 2484862 - RNA, 15 nt, Human
agacacggaucugag

SEQ ID NO: 2484863 - RNA, 20 nt, Human
agacacuccccgaagucuuu

SEQ ID NO: 2484864 - RNA, 15 nt, Human
agacacuaaguuaua

SEQ ID NO: 2484865 - RNA, 22 nt, Human
agacacuaacgacuucagggca

SEQ ID NO: 2484866 - RNA, 20 nt, Human
agacaccagagcagaugcag

SEQ ID NO: 2484867 - RNA, 12 nt, Human
agacacccagga

SEQ ID NO: 2484868 - RNA, 13 nt, Human
agacacccaggac

SEQ ID NO: 2484869 - RNA, 14 nt, Human
agacacccaggacu

SEQ ID NO: 2484870 - RNA, 15 nt, Human
agacacccaggacuu

SEQ ID NO: 2484871 - RNA, 16 nt, Human
agacacccaggacuua

SEQ ID NO: 2484872 - RNA, 19 nt, Human
agacacccucaaccucuuc

SEQ ID NO: 2484873 - RNA, 21 nt, Human
agacaccaucuuuugugagau

SEQ ID NO: 2484874 - RNA, 19 nt, Human
agacagagacccucugcca

SEQ ID NO: 2484875 - RNA, 12 nt, Human
agacagaaucuc

SEQ ID NO: 2484876 - RNA, 16 nt, Human
agacagacacacacac

SEQ ID NO: 2484877 - RNA, 15 nt, Human
agacagacacacaca

SEQ ID NO: 2484878 - RNA, 14 nt, Human
agacagacacacac

SEQ ID NO: 2484879 - RNA, 22 nt, Human
agacagagacccucugccacca

SEQ ID NO: 2484880 - RNA, 18 nt, Human
agacaggaaaauccucug

SEQ ID NO: 2484881 - RNA, 19 nt, Human
agacaggaaaauccucugg

SEQ ID NO: 2484882 - RNA, 20 nt, Human
agacaggaaaauccucuggc

SEQ ID NO: 2484883 - RNA, 21 nt, Human
agacaggaaaauccucuggcu

SEQ ID NO: 2484884 - RNA, 23 nt, Human
agacagcuucucauccugcaggc

SEQ ID NO: 2484885 - RNA, 22 nt, Human
agacagcuucucauccugcagg

SEQ ID NO: 2484886 - RNA, 16 nt, Human
agacacucugcucugc

SEQ ID NO: 2484887 - RNA, 15 nt, Human
agacacucugcucug

SEQ ID NO: 2484888 - RNA, 14 nt, Human
agacacucugcucu

SEQ ID NO: 2484889 - RNA, 12 nt, Human
agacacucugcu

SEQ ID NO: 2484890 - RNA, 22 nt, Human
agacacuccccgaagucuuuug

SEQ ID NO: 2484891 - RNA, 23 nt, Human
agacacuccccgaagucuuuugu

SEQ ID NO: 2484892 - RNA, 16 nt, Human
agacacucuggcuggu

SEQ ID NO: 2484893 - RNA, 13 nt, Human
agacacucuggcu

SEQ ID NO: 2484894 - RNA, 18 nt, Human
agacacucugcucugccc

SEQ ID NO: 2484895 - RNA, 17 nt, Human
agacacucugcucugcc

SEQ ID NO: 2484896 - RNA, 18 nt, Human
agacacugaaaaaucuaa

SEQ ID NO: 2484897 - RNA, 13 nt, Human
agacacugaaaua

SEQ ID NO: 2484898 - RNA, 18 nt, Human
agacagaaucucgcucug

SEQ ID NO: 2484899 - RNA, 22 nt, Human
agacagaaucucgcucugucgc

SEQ ID NO: 2484900 - RNA, 18 nt, Human
agacagaagcugaagugc

SEQ ID NO: 2484901 - RNA, 20 nt, Human
agacacugaaauauacacac

SEQ ID NO: 2484902 - RNA, 21 nt, Human
agacacugaaauauacacaca

SEQ ID NO: 2484903 - RNA, 10 nt, Human
ucuucccucc

SEQ ID NO: 2484904 - RNA, 19 nt, Human
ucuuccaucauguccccaa

SEQ ID NO: 2484905 - RNA, 20 nt, Human
ucuucccuagaggguuccug

SEQ ID NO: 2484906 - RNA, 13 nt, Human
ucuucccuaccuc

SEQ ID NO: 2484907 - RNA, 14 nt, Human
ucuucccuaccuca

SEQ ID NO: 2484908 - RNA, 21 nt, Human
ucuucccuaccucaggcagga

SEQ ID NO: 2484909 - RNA, 19 nt, Human
ucuucccuuuuacauacug

SEQ ID NO: 2484910 - RNA, 21 nt, Human
ucuucccuuuuacauacugcu

SEQ ID NO: 2484911 - RNA, 22 nt, Human
ucuucccuuuuacauacugcug

SEQ ID NO: 2484912 - RNA, 21 nt, Human
ucuuccgaaaaauccucuucc

SEQ ID NO: 2484913 - RNA, 15 nt, Human
ucuuccggagaugua

SEQ ID NO: 2484914 - RNA, 16 nt, Human
ucuuccggagauguag

SEQ ID NO: 2484915 - RNA, 15 nt, Human
ucuuccaggugccca

SEQ ID NO: 2484916 - RNA, 13 nt, Human
ucuuccagguggg

SEQ ID NO: 2484917 - RNA, 18 nt, Human
ucuuccaggugcccagcu

SEQ ID NO: 2484918 - RNA, 22 nt, Human
ucuuccaggcugggagagccuu

SEQ ID NO: 2484919 - RNA, 18 nt, Human
ucuuccagucuuccugac

SEQ ID NO: 2484920 - RNA, 21 nt, Human
ucuuccagucuuccugacacu

SEQ ID NO: 2484921 - RNA, 19 nt, Human
ucuuccagguggggugagg

SEQ ID NO: 2484922 - RNA, 16 nt, Human
ucuuccaucauguccc

SEQ ID NO: 2484923 - RNA, 18 nt, Human
ucuuccaucauggauuca

SEQ ID NO: 2484924 - RNA, 13 nt, Human
ucuuccaucaugg

SEQ ID NO: 2484925 - RNA, 12 nt, Human
ucuuccauaaug

SEQ ID NO: 2484926 - RNA, 19 nt, Human
ucuuccauaugaccucaug

SEQ ID NO: 2484927 - RNA, 16 nt, Human
ucuuccauaauguaua

SEQ ID NO: 2484928 - RNA, 23 nt, Human
ucuucaccugauucaacuaaaaa

SEQ ID NO: 2484929 - RNA, 14 nt, Human
ucuucacggcagga

SEQ ID NO: 2484930 - RNA, 21 nt, Human
ucuucaccugauucaacuaaa

SEQ ID NO: 2484931 - RNA, 23 nt, Human
ucuucagaaagugugcuuuaugc

SEQ ID NO: 2484932 - RNA, 13 nt, Human
ucuucagaagaca

SEQ ID NO: 2484933 - RNA, 18 nt, Human
ucuucagaagacacugca

SEQ ID NO: 2484934 - RNA, 18 nt, Human
ucuucacucucugaagau

SEQ ID NO: 2484935 - RNA, 20 nt, Human
ucuucagaaagugugcuuua

SEQ ID NO: 2484936 - RNA, 14 nt, Human
ucuucacucgcccc

SEQ ID NO: 2484937 - RNA, 20 nt, Human
ucuucacccagcuaaucugu

SEQ ID NO: 2484938 - RNA, 19 nt, Human
ucuucacccagcuaaucug

SEQ ID NO: 2484939 - RNA, 17 nt, Human
ucuucaccauuuggcaa

SEQ ID NO: 2484940 - RNA, 24 nt, Human
ucuucaacaucaauguucauugua

SEQ ID NO: 2484941 - RNA, 21 nt, Human
ucuucaacaucaauguucauu

SEQ ID NO: 2484942 - RNA, 23 nt, Human
ucuucaacaucaauguucauugu

SEQ ID NO: 2484943 - RNA, 18 nt, Human
ucuucacagcucuguguu

SEQ ID NO: 2484944 - RNA, 16 nt, Human
ucuucaaauuagaaga

SEQ ID NO: 2484945 - RNA, 18 nt, Human
ucuucaacaggagaauuu

SEQ ID NO: 2484946 - RNA, 11 nt, Human
ucuucaacaga

SEQ ID NO: 2484947 - RNA, 19 nt, Human
ucuucaacaucaauguuca

SEQ ID NO: 2484948 - RNA, 20 nt, Human
ucuucaacaucaauguucau

SEQ ID NO: 2484949 - RNA, 19 nt, Human
ucuucaaauuagaagacau

SEQ ID NO: 2484950 - RNA, 20 nt, Human
ucuucaaauuagaagacauu

SEQ ID NO: 2484951 - RNA, 17 nt, Human
ucuucaaaaugagcccu

SEQ ID NO: 2484952 - RNA, 14 nt, Human
ucuuauuuaacuua

SEQ ID NO: 2484953 - RNA, 14 nt, Human
ucuuaugggcuggg

SEQ ID NO: 2484954 - RNA, 16 nt, Human
ucuuaugggcuggguu

SEQ ID NO: 2484955 - RNA, 15 nt, Human
ucuuaugggcugggu

SEQ ID NO: 2484956 - RNA, 22 nt, Human
ucuuauugcccacgcuggagug

SEQ ID NO: 2484957 - RNA, 18 nt, Human
ucuuauugcccacgcugg

SEQ ID NO: 2484958 - RNA, 14 nt, Human
ucuuauugcccacg

SEQ ID NO: 2484959 - RNA, 18 nt, Human
ucuuaugggcuggguucu

SEQ ID NO: 2484960 - RNA, 12 nt, Human
ucuuaauuauua

SEQ ID NO: 2484961 - RNA, 14 nt, Human
ucuuagaaaugaag

SEQ ID NO: 2484962 - RNA, 11 nt, Human
ucuuagaaauu

SEQ ID NO: 2484963 - RNA, 18 nt, Human
ucuuaaucuuuucacaaa

SEQ ID NO: 2484964 - RNA, 17 nt, Human
ucuuaaucuuuucacaa

SEQ ID NO: 2484965 - RNA, 15 nt, Human
ucuuagaaauuuauu

SEQ ID NO: 2484966 - RNA, 12 nt, Human
ucuuagaaauuu

SEQ ID NO: 2484967 - RNA, 15 nt, Human
ucuuagaaaugaagg

SEQ ID NO: 2484968 - RNA, 19 nt, Human
ucuuagaaguggaccagga

SEQ ID NO: 2484969 - RNA, 15 nt, Human
ucuuagacuucugcu

SEQ ID NO: 2484970 - RNA, 20 nt, Human
ucuuagacuacauuuagaga

SEQ ID NO: 2484971 - RNA, 14 nt, Human
ucuuagacuacauu

SEQ ID NO: 2484972 - RNA, 21 nt, Human
ucuuagaaguggaccaggaca

SEQ ID NO: 2484973 - RNA, 20 nt, Human
ucuuagacuucugcuuucca

SEQ ID NO: 2484974 - RNA, 18 nt, Human
ucuuagacuucugcuuuc

SEQ ID NO: 2484975 - RNA, 18 nt, Human
ucuuagacuugaaauacu

SEQ ID NO: 2484976 - RNA, 23 nt, Human
ucuuagacuugaaauacuacuua

SEQ ID NO: 2484977 - RNA, 18 nt, Human
ucuuaauuaaaagaauau

SEQ ID NO: 2484978 - RNA, 21 nt, Human
ucuuaauuaaaagaauauuuu

SEQ ID NO: 2484979 - RNA, 14 nt, Human
ucuuaauuaaaaga

SEQ ID NO: 2484980 - RNA, 16 nt, Human
ucuuaauauuaaauau

SEQ ID NO: 2484981 - RNA, 20 nt, Human
ucuguuggccagugugacaa

SEQ ID NO: 2484982 - RNA, 19 nt, Human
ucuguuggccagugugaca

SEQ ID NO: 2484983 - RNA, 18 nt, Human
ucuguuggccagugugac

SEQ ID NO: 2484984 - RNA, 18 nt, Human
ucuguucccccuucacaa

SEQ ID NO: 2484985 - RNA, 20 nt, Human
ucuguucccccuucacaaag

SEQ ID NO: 2484986 - RNA, 13 nt, Human
ucuguuccuucac

SEQ ID NO: 2484987 - RNA, 20 nt, Human
ucuguucuacauagaugcuu

SEQ ID NO: 2484988 - RNA, 15 nt, Human
ucuguuccuucacau

SEQ ID NO: 2484989 - RNA, 16 nt, Human
ucuguucaguguaaau

SEQ ID NO: 2484990 - RNA, 17 nt, Human
ucuguucaguguaaaua

SEQ ID NO: 2484991 - RNA, 21 nt, Human
ucugugcuggagauguuuuag

SEQ ID NO: 2484992 - RNA, 19 nt, Human
ucugugcuggagauguuuu

SEQ ID NO: 2484993 - RNA, 23 nt, Human
ucugugcugacccuccuguugca

SEQ ID NO: 2484994 - RNA, 19 nt, Human
ucugugcugacccuccugu

SEQ ID NO: 2484995 - RNA, 14 nt, Human
ucugugcuccuccu

SEQ ID NO: 2484996 - RNA, 13 nt, Human
ucugugcucagga

SEQ ID NO: 2484997 - RNA, 20 nt, Human
ucuguuccccauggccacuu

SEQ ID NO: 2484998 - RNA, 13 nt, Human
ucuguucccccuu

SEQ ID NO: 2484999 - RNA, 18 nt, Human
ucuguucauuuccucaaa

SEQ ID NO: 2485000 - RNA, 21 nt, Human
ucugugaaaggaaagagggag

SEQ ID NO: 2485001 - RNA, 15 nt, Human
ucugugaaaggaaag

SEQ ID NO: 2485002 - RNA, 12 nt, Human
ucuguccaagga

SEQ ID NO: 2485003 - RNA, 24 nt, Human
ucuguccaggcacugcugcccagc

SEQ ID NO: 2485004 - RNA, 22 nt, Human
ucugugcuagggaaacuucccg

SEQ ID NO: 2485005 - RNA, 21 nt, Human
ucugugcuagggaaacuuccc

SEQ ID NO: 2485006 - RNA, 16 nt, Human
ucugugcgugaaacac

SEQ ID NO: 2485007 - RNA, 22 nt, Human
ucugugcgugaaacacaccagg

SEQ ID NO: 2485008 - RNA, 18 nt, Human
ucugugccuucuuuugau

SEQ ID NO: 2485009 - RNA, 22 nt, Human
ucugugccuucuuuugauuaug

SEQ ID NO: 2485010 - RNA, 16 nt, Human
ucugugccuucgucuu

SEQ ID NO: 2485011 - RNA, 13 nt, Human
ucuguccaaggaa

SEQ ID NO: 2485012 - RNA, 15 nt, Human
ucugugccugaauau

SEQ ID NO: 2485013 - RNA, 17 nt, Human
ucugugccugaauauuu

SEQ ID NO: 2485014 - RNA, 22 nt, Human
ucugugccccaugccuguccag

SEQ ID NO: 2485015 - RNA, 23 nt, Human
agaauuucccaaagcagugcaug

SEQ ID NO: 2485016 - RNA, 16 nt, Human
agaauuucuaccauuu

SEQ ID NO: 2485017 - RNA, 20 nt, Human
agaauuucuaccauuucaga

SEQ ID NO: 2485018 - RNA, 21 nt, Human
agaauuuauucaauuccucug

SEQ ID NO: 2485019 - RNA, 21 nt, Human
agaauuucuaccauuucagag

SEQ ID NO: 2485020 - RNA, 13 nt, Human
agaauuucuuggu

SEQ ID NO: 2485021 - RNA, 21 nt, Human
agaauuucuugguaagaagcc

SEQ ID NO: 2485022 - RNA, 22 nt, Human
agaauuucuugguaagaagccg

SEQ ID NO: 2485023 - RNA, 18 nt, Human
agaauuucccaaagcagu

SEQ ID NO: 2485024 - RNA, 17 nt, Human
agaauuucccaaagcag

SEQ ID NO: 2485025 - RNA, 22 nt, Human
agaauuuagggagaaauguugu

SEQ ID NO: 2485026 - RNA, 19 nt, Human
agaauuuagggagaaaugu

SEQ ID NO: 2485027 - RNA, 14 nt, Human
agaauuuagggaga

SEQ ID NO: 2485028 - RNA, 14 nt, Human
agaauuuauucaau

SEQ ID NO: 2485029 - RNA, 13 nt, Human
agaauuuauucaa

SEQ ID NO: 2485030 - RNA, 15 nt, Human
agaauuuagguuuuu

SEQ ID NO: 2485031 - RNA, 21 nt, Human
agaauuuaucacacuucugug

SEQ ID NO: 2485032 - RNA, 13 nt, Human
ucuguuuccuuuu

SEQ ID NO: 2485033 - RNA, 18 nt, Human
ucuguuucucuuuccuug

SEQ ID NO: 2485034 - RNA, 14 nt, Human
ucuguuugacaaac

SEQ ID NO: 2485035 - RNA, 16 nt, Human
ucuguuucucuuuccu

SEQ ID NO: 2485036 - RNA, 18 nt, Human
ucuguuuuauaauuuugu

SEQ ID NO: 2485037 - RNA, 18 nt, Human
agaauugugucugcagga

SEQ ID NO: 2485038 - RNA, 17 nt, Human
agaauugugucugcagg

SEQ ID NO: 2485039 - RNA, 16 nt, Human
agaauugugucugcag

SEQ ID NO: 2485040 - RNA, 15 nt, Human
agaauugugucugca

SEQ ID NO: 2485041 - RNA, 15 nt, Human
agaauuguaucauuu

SEQ ID NO: 2485042 - RNA, 22 nt, Human
agaauuggcugaacucaugaga

SEQ ID NO: 2485043 - RNA, 21 nt, Human
agaauuggcugaacucaugag

SEQ ID NO: 2485044 - RNA, 18 nt, Human
agaauuggcugaacucau

SEQ ID NO: 2485045 - RNA, 20 nt, Human
agaauugucuuucugucucu

SEQ ID NO: 2485046 - RNA, 21 nt, Human
agaauuggagaguaaaaacug

SEQ ID NO: 2485047 - RNA, 18 nt, Human
ucuguuuuagguuaaaaa

SEQ ID NO: 2485048 - RNA, 22 nt, Human
agaauugcugauucuugaguuu

SEQ ID NO: 2485049 - RNA, 18 nt, Human
ucuggucuccucagccuc

SEQ ID NO: 2485050 - RNA, 17 nt, Human
ucuggucuccucagccu

SEQ ID NO: 2485051 - RNA, 20 nt, Human
ucuguagagggcccuggugu

SEQ ID NO: 2485052 - RNA, 19 nt, Human
ucuguagagggcccuggug

SEQ ID NO: 2485053 - RNA, 18 nt, Human
ucuguagagggcccuggu

SEQ ID NO: 2485054 - RNA, 17 nt, Human
ucuguagagggcccugg

SEQ ID NO: 2485055 - RNA, 22 nt, Human
ucuguagaaaugguuguauuag

SEQ ID NO: 2485056 - RNA, 16 nt, Human
ucuguagagggcccug

SEQ ID NO: 2485057 - RNA, 16 nt, Human
ucuguagggcuggacc

SEQ ID NO: 2485058 - RNA, 15 nt, Human
ucuguagggcuggac

SEQ ID NO: 2485059 - RNA, 20 nt, Human
ucuguaggguaauuaguaac

SEQ ID NO: 2485060 - RNA, 22 nt, Human
ucuguagggauuuuuggcuaca

SEQ ID NO: 2485061 - RNA, 14 nt, Human
ucuguagggcugga

SEQ ID NO: 2485062 - RNA, 23 nt, Human
ucuguagcuccucaacucaccua

SEQ ID NO: 2485063 - RNA, 23 nt, Human
ucuguagauucuguggaacaagc

SEQ ID NO: 2485064 - RNA, 19 nt, Human
ucuguagauucuguggaac

SEQ ID NO: 2485065 - RNA, 16 nt, Human
ucuguagauucugugg

SEQ ID NO: 2485066 - RNA, 19 nt, Human
ucuguagggaacucugggg

SEQ ID NO: 2485067 - RNA, 13 nt, Human
ucuguagcuccuc

SEQ ID NO: 2485068 - RNA, 14 nt, Human
ucuguagcuccuca

SEQ ID NO: 2485069 - RNA, 22 nt, Human
ucuguauaaguaagaaaauauu

SEQ ID NO: 2485070 - RNA, 18 nt, Human
ucuguauaaguaagaaaa

SEQ ID NO: 2485071 - RNA, 17 nt, Human
ucuguauaaguaagaaa

SEQ ID NO: 2485072 - RNA, 16 nt, Human
ucuguauaaguaagaa

SEQ ID NO: 2485073 - RNA, 23 nt, Human
ucuguauaaagccuguauucuca

SEQ ID NO: 2485074 - RNA, 15 nt, Human
ucuguauacaacccu

SEQ ID NO: 2485075 - RNA, 21 nt, Human
ucuguauaaguaagaaaauau

SEQ ID NO: 2485076 - RNA, 14 nt, Human
ucuguauacugugg

SEQ ID NO: 2485077 - RNA, 17 nt, Human
ucuguagggcuggaccu

SEQ ID NO: 2485078 - RNA, 23 nt, Human
ucuguaguuuuaucacauguaug

SEQ ID NO: 2485079 - RNA, 22 nt, Human
ucuguaguuuuaucacauguau

SEQ ID NO: 2485080 - RNA, 21 nt, Human
ucuguaguuuuaucacaugua

SEQ ID NO: 2485081 - RNA, 17 nt, Human
ucuguagugagauagca

SEQ ID NO: 2485082 - RNA, 14 nt, Human
ucuguagugagaua

SEQ ID NO: 2485083 - RNA, 15 nt, Human
ucuguauauaaaaua

SEQ ID NO: 2485084 - RNA, 14 nt, Human
ucuguauauaaaau

SEQ ID NO: 2485085 - RNA, 22 nt, Human
ucuguauauaaaauauuuucau

SEQ ID NO: 2485086 - RNA, 21 nt, Human
ucugucagcgcagguuuaguu

SEQ ID NO: 2485087 - RNA, 17 nt, Human
ucugucaggagagcagc

SEQ ID NO: 2485088 - RNA, 16 nt, Human
ucugucaggagagcag

SEQ ID NO: 2485089 - RNA, 13 nt, Human
ucugucagucaca

SEQ ID NO: 2485090 - RNA, 17 nt, Human
ucugucagucacagcca

SEQ ID NO: 2485091 - RNA, 19 nt, Human
ucugucagucacagccacc

SEQ ID NO: 2485092 - RNA, 15 nt, Human
ucugucauuugagca

SEQ ID NO: 2485093 - RNA, 23 nt, Human
ucuguccaaaggaggcuggcagg

SEQ ID NO: 2485094 - RNA, 19 nt, Human
ucuguccaaaggaggcugg

SEQ ID NO: 2485095 - RNA, 22 nt, Human
ucuguccaaaggaggcuggcag

SEQ ID NO: 2485096 - RNA, 22 nt, Human
ucugucaugaacauguuccuga

SEQ ID NO: 2485097 - RNA, 15 nt, Human
ucuguccaaaggagg

SEQ ID NO: 2485098 - RNA, 16 nt, Human
ucuguccaaaggaggc

SEQ ID NO: 2485099 - RNA, 17 nt, Human
ucuguccaaaggaggcu

SEQ ID NO: 2485100 - RNA, 23 nt, Human
ucugucauuugagcagggcucag

SEQ ID NO: 2485101 - RNA, 20 nt, Human
ucugucauuugagcagggcu

SEQ ID NO: 2485102 - RNA, 16 nt, Human
ucuggguucacugcaa

SEQ ID NO: 2485103 - RNA, 14 nt, Human
ucuggguucacugc

SEQ ID NO: 2485104 - RNA, 11 nt, Human
ucuggggcugu

SEQ ID NO: 2485105 - RNA, 18 nt, Human
ucugggugcucccuacca

SEQ ID NO: 2485106 - RNA, 16 nt, Human
ucuggggccacacaga

SEQ ID NO: 2485107 - RNA, 16 nt, Human
ucuggggcucugggau

SEQ ID NO: 2485108 - RNA, 18 nt, Human
ucugguccauagagagca

SEQ ID NO: 2485109 - RNA, 16 nt, Human
ucuggguuccuuccuc

SEQ ID NO: 2485110 - RNA, 13 nt, Human
ucuggguggccuc

SEQ ID NO: 2485111 - RNA, 17 nt, Human
ucuggucgcuccugccc

SEQ ID NO: 2485112 - RNA, 15 nt, Human
ucuggucgcuccugc

SEQ ID NO: 2485113 - RNA, 14 nt, Human
ucugguccuaccca

SEQ ID NO: 2485114 - RNA, 18 nt, Human
ucugguccggacacuccu

SEQ ID NO: 2485115 - RNA, 13 nt, Human
ucugguccuaccc

SEQ ID NO: 2485116 - RNA, 21 nt, Human
ucuggucaaccuccuggacau

SEQ ID NO: 2485117 - RNA, 17 nt, Human
ucuggucaaccuccugg

SEQ ID NO: 2485118 - RNA, 13 nt, Human
ucuggucccuugc

SEQ ID NO: 2485119 - RNA, 14 nt, Human
ucuggucccuugca

SEQ ID NO: 2485120 - RNA, 13 nt, Human
agaaggaagggca

SEQ ID NO: 2485121 - RNA, 17 nt, Human
agaaggaagugaagagg

SEQ ID NO: 2485122 - RNA, 15 nt, Human
ucuggggcucuggga

SEQ ID NO: 2485123 - RNA, 13 nt, Human
ucuggggccccuu

SEQ ID NO: 2485124 - RNA, 15 nt, Human
ucuggggcaggguua

SEQ ID NO: 2485125 - RNA, 22 nt, Human
agaaggaaggagacucaccucu

SEQ ID NO: 2485126 - RNA, 19 nt, Human
agaaggaaaaugaucugag

SEQ ID NO: 2485127 - RNA, 18 nt, Human
agaaggaaaaauguguaa

SEQ ID NO: 2485128 - RNA, 9 nt, Human
agaaggaag

SEQ ID NO: 2485129 - RNA, 17 nt, Human
agaaggaaauugagauu

SEQ ID NO: 2485130 - RNA, 16 nt, Human
agaagcuuaggcaggg

SEQ ID NO: 2485131 - RNA, 15 nt, Human
agaagcuuaggcagg

SEQ ID NO: 2485132 - RNA, 13 nt, Human
agaagcuuaggca

SEQ ID NO: 2485133 - RNA, 23 nt, Human
agaagcuguuguacauuuaugau

SEQ ID NO: 2485134 - RNA, 18 nt, Human
agaagcuuccauuccaag

SEQ ID NO: 2485135 - RNA, 16 nt, Human
agaagcuucagaaguu

SEQ ID NO: 2485136 - RNA, 17 nt, Human
agaagcuuaggcagggc

SEQ ID NO: 2485137 - RNA, 17 nt, Human
agaagcuucagaaguuu

SEQ ID NO: 2485138 - RNA, 22 nt, Human
agaagcuuuugaauaaaaacuu

SEQ ID NO: 2485139 - RNA, 17 nt, Human
agaaggaaaaaugugua

SEQ ID NO: 2485140 - RNA, 16 nt, Human
agaaggaaaaaugugu

SEQ ID NO: 2485141 - RNA, 16 nt, Human
agaaggaaaaggcagg

SEQ ID NO: 2485142 - RNA, 18 nt, Human
agaaauuuaaaagacacu

SEQ ID NO: 2485143 - RNA, 22 nt, Human
agaaauuuuuauuuuucuaagg

SEQ ID NO: 2485144 - RNA, 13 nt, Human
agaaauuuuuauu

SEQ ID NO: 2485145 - RNA, 20 nt, Human
agaaauuugauuucuauuca

SEQ ID NO: 2485146 - RNA, 17 nt, Human
agaaauuuaauucaugu

SEQ ID NO: 2485147 - RNA, 21 nt, Human
agaaauuuaauucauguuucu

SEQ ID NO: 2485148 - RNA, 22 nt, Human
agaaauuuaauucauguuucuu

SEQ ID NO: 2485149 - RNA, 16 nt, Human
agaaccuagaagggcu

SEQ ID NO: 2485150 - RNA, 21 nt, Human
agaaccgagcaaagaucaaaa

SEQ ID NO: 2485151 - RNA, 20 nt, Human
agaaccgagcaaagaucaaa

SEQ ID NO: 2485152 - RNA, 22 nt, Human
agaaccgagcaaagaucaaaau

SEQ ID NO: 2485153 - RNA, 18 nt, Human
agaaccgagcaaagauca

SEQ ID NO: 2485154 - RNA, 16 nt, Human
agaacaaagugagaca

SEQ ID NO: 2485155 - RNA, 22 nt, Human
agaacaaaggacagaguaugaa

SEQ ID NO: 2485156 - RNA, 21 nt, Human
agaacaaaggacagaguauga

SEQ ID NO: 2485157 - RNA, 14 nt, Human
agaacaaaggacag

SEQ ID NO: 2485158 - RNA, 21 nt, Human
agaacaaaaaaaucugcagaa

SEQ ID NO: 2485159 - RNA, 23 nt, Human
agaacaaaaaaaucugcagaagg

SEQ ID NO: 2485160 - RNA, 17 nt, Human
agaaauuuuucagaugc

SEQ ID NO: 2485161 - RNA, 18 nt, Human
agaaauuuuucagaugcu

SEQ ID NO: 2485162 - RNA, 21 nt, Human
agaaauuuuucagaugcuucu

SEQ ID NO: 2485163 - RNA, 22 nt, Human
agaaauuuuucagaugcuucug

SEQ ID NO: 2485164 - RNA, 20 nt, Human
agaacaaaaaaaucugcaga

SEQ ID NO: 2485165 - RNA, 19 nt, Human
agaacaaaaaaaucugcag

SEQ ID NO: 2485166 - RNA, 10 nt, Human
agaacaaaaa

SEQ ID NO: 2485167 - RNA, 23 nt, Human
agaaauuuuucagaugcuucugg

SEQ ID NO: 2485168 - RNA, 22 nt, Human
agaaauuggaacagaauguuuu

SEQ ID NO: 2485169 - RNA, 15 nt, Human
agaaauuggcuggau

SEQ ID NO: 2485170 - RNA, 19 nt, Human
agaaauuggaacagaaugu

SEQ ID NO: 2485171 - RNA, 14 nt, Human
agaaauuggcugga

SEQ ID NO: 2485172 - RNA, 20 nt, Human
agaaaugucuaaaugcugaa

SEQ ID NO: 2485173 - RNA, 16 nt, Human
agaaauguuguucauu

SEQ ID NO: 2485174 - RNA, 11 nt, Human
agaaauguguu

SEQ ID NO: 2485175 - RNA, 12 nt, Human
ucugcagagcag

SEQ ID NO: 2485176 - RNA, 17 nt, Human
agaaauguacagcaagg

SEQ ID NO: 2485177 - RNA, 16 nt, Human
agaaauguacagcaag

SEQ ID NO: 2485178 - RNA, 22 nt, Human
ucugcagaaggaaaaaugugua

SEQ ID NO: 2485179 - RNA, 21 nt, Human
ucugcagaaggaaaaaugugu

SEQ ID NO: 2485180 - RNA, 15 nt, Human
ucugcagaaggaaaa

SEQ ID NO: 2485181 - RNA, 13 nt, Human
ucugcagaaggaa

SEQ ID NO: 2485182 - RNA, 23 nt, Human
ucugcagaaggaaaaauguguaa

SEQ ID NO: 2485183 - RNA, 22 nt, Human
ucugcacugagcagagucuugc

SEQ ID NO: 2485184 - RNA, 15 nt, Human
ucugcacugagcaga

SEQ ID NO: 2485185 - RNA, 10 nt, Human
ucugcagaag

SEQ ID NO: 2485186 - RNA, 15 nt, Human
ucugcagaaacagaa

SEQ ID NO: 2485187 - RNA, 19 nt, Human
agaacggggcucuucucau

SEQ ID NO: 2485188 - RNA, 17 nt, Human
agaacggggcucuucuc

SEQ ID NO: 2485189 - RNA, 15 nt, Human
agaaccucuucccca

SEQ ID NO: 2485190 - RNA, 22 nt, Human
agaaccucacgcaccucccauc

SEQ ID NO: 2485191 - RNA, 21 nt, Human
agaacggagccccaggccucu

SEQ ID NO: 2485192 - RNA, 21 nt, Human
agaacggggcucuucucauuu

SEQ ID NO: 2485193 - RNA, 20 nt, Human
agaacggggcucuucucauu

SEQ ID NO: 2485194 - RNA, 18 nt, Human
agaacguggcucugcugg

SEQ ID NO: 2485195 - RNA, 17 nt, Human
agaacguggcucugcug

SEQ ID NO: 2485196 - RNA, 22 nt, Human
agaacguauugguccagcuugc

SEQ ID NO: 2485197 - RNA, 13 nt, Human
agaaccucuuccc

SEQ ID NO: 2485198 - RNA, 14 nt, Human
agaaccucuucccc

SEQ ID NO: 2485199 - RNA, 18 nt, Human
agaaccucacgcaccucc

SEQ ID NO: 2485200 - RNA, 21 nt, Human
agaaccucacgcaccucccau

SEQ ID NO: 2485201 - RNA, 12 nt, Human
agaaccucaggc

SEQ ID NO: 2485202 - RNA, 19 nt, Human
agaaccucaggcuuccuug

SEQ ID NO: 2485203 - RNA, 21 nt, Human
agaaccucaggcuuccuuggc

SEQ ID NO: 2485204 - RNA, 18 nt, Human
agaacuacaaacaaaauu

SEQ ID NO: 2485205 - RNA, 22 nt, Human
agaacuaacacuauuuuaugca

SEQ ID NO: 2485206 - RNA, 16 nt, Human
agaacuaaacucauuu

SEQ ID NO: 2485207 - RNA, 18 nt, Human
agaacuaaacucauuuau

SEQ ID NO: 2485208 - RNA, 19 nt, Human
agaacguggcucugcuggc

SEQ ID NO: 2485209 - RNA, 12 nt, Human
agaacuaaacuc

SEQ ID NO: 2485210 - RNA, 23 nt, Human
agaacuacaaacaaaauuucuau

SEQ ID NO: 2485211 - RNA, 22 nt, Human
agaacuacaaacaaaauuucua

SEQ ID NO: 2485212 - RNA, 19 nt, Human
agaacucacuggggccuac

SEQ ID NO: 2485213 - RNA, 17 nt, Human
agaacucaguuuuaacu

SEQ ID NO: 2485214 - RNA, 23 nt, Human
agaacucaucccuaaugcugcag

SEQ ID NO: 2485215 - RNA, 21 nt, Human
agaacucaugacggaagaguu

SEQ ID NO: 2485216 - RNA, 14 nt, Human
agaacucugggcug

SEQ ID NO: 2485217 - RNA, 23 nt, Human
agaacucuccaucuuauuuucau

SEQ ID NO: 2485218 - RNA, 14 nt, Human
agaacucccuuuca

SEQ ID NO: 2485219 - RNA, 23 nt, Human
agaacugaaccggcuuuaccaaa

SEQ ID NO: 2485220 - RNA, 21 nt, Human
agaacugaaccggcuuuacca

SEQ ID NO: 2485221 - RNA, 14 nt, Human
agaacucuuucaaa

SEQ ID NO: 2485222 - RNA, 20 nt, Human
agaacucugggcugccaugu

SEQ ID NO: 2485223 - RNA, 20 nt, Human
agaacucugggcugcuaccc

SEQ ID NO: 2485224 - RNA, 23 nt, Human
agaagaaaacaucuauucucucc

SEQ ID NO: 2485225 - RNA, 15 nt, Human
agaagaaaacaucua

SEQ ID NO: 2485226 - RNA, 22 nt, Human
ucugcacuccccugcugggugu

SEQ ID NO: 2485227 - RNA, 21 nt, Human
ucugcacucuaacccuaggca

SEQ ID NO: 2485228 - RNA, 22 nt, Human
ucugauauuccaugaauguauc

SEQ ID NO: 2485229 - RNA, 21 nt, Human
ucugauucccaagcucugcuc

SEQ ID NO: 2485230 - RNA, 20 nt, Human
ucugauucccaagcucugcu

SEQ ID NO: 2485231 - RNA, 19 nt, Human
ucugauucccaagcucugc

SEQ ID NO: 2485232 - RNA, 16 nt, Human
ucugauacccagagca

SEQ ID NO: 2485233 - RNA, 14 nt, Human
ucugauacccagag

SEQ ID NO: 2485234 - RNA, 23 nt, Human
ucugauaggaaugugaaagcacg

SEQ ID NO: 2485235 - RNA, 15 nt, Human
ucugauaggccaagu

SEQ ID NO: 2485236 - RNA, 17 nt, Human
ucugauauuccaugaau

SEQ ID NO: 2485237 - RNA, 19 nt, Human
ucugauauuccaugaaugu

SEQ ID NO: 2485238 - RNA, 20 nt, Human
ucugauauuccaugaaugua

SEQ ID NO: 2485239 - RNA, 19 nt, Human
ucugaggggcaacugaguc

SEQ ID NO: 2485240 - RNA, 17 nt, Human
ucugagggaggaggcca

SEQ ID NO: 2485241 - RNA, 13 nt, Human
ucugagggaggag

SEQ ID NO: 2485242 - RNA, 19 nt, Human
ucugaggcuuccagagagu

SEQ ID NO: 2485243 - RNA, 16 nt, Human
ucugaggcuuccagag

SEQ ID NO: 2485244 - RNA, 15 nt, Human
ucugaggcuuccaga

SEQ ID NO: 2485245 - RNA, 14 nt, Human
ucugaggcuuccag

SEQ ID NO: 2485246 - RNA, 22 nt, Human
ucugagggaggaggccaccucu

SEQ ID NO: 2485247 - RNA, 21 nt, Human
ucugagggaggaggccaccuc

SEQ ID NO: 2485248 - RNA, 20 nt, Human
ucugagggaggaggccaccu

SEQ ID NO: 2485249 - RNA, 18 nt, Human
ucugagggaggaggccac

SEQ ID NO: 2485250 - RNA, 15 nt, Human
ucugagggcuuccuu

SEQ ID NO: 2485251 - RNA, 23 nt, Human
ucugagggaggaggccaccucuc

SEQ ID NO: 2485252 - RNA, 18 nt, Human
ucugagggcuuccuuugg

SEQ ID NO: 2485253 - RNA, 21 nt, Human
ucugagaaagacuauucaaac

SEQ ID NO: 2485254 - RNA, 22 nt, Human
ucugagaaagacuauucaaaca

SEQ ID NO: 2485255 - RNA, 23 nt, Human
ucugagaaagacuauucaaacag

SEQ ID NO: 2485256 - RNA, 22 nt, Human
ucugagaaaagcuuugaacccu

SEQ ID NO: 2485257 - RNA, 12 nt, Human
ucugaggcugua

SEQ ID NO: 2485258 - RNA, 11 nt, Human
ucugaggcugu

SEQ ID NO: 2485259 - RNA, 14 nt, Human
ucugagaaagacua

SEQ ID NO: 2485260 - RNA, 15 nt, Human
ucugagaaagacuau

SEQ ID NO: 2485261 - RNA, 19 nt, Human
ucugagaaagacuauucaa

SEQ ID NO: 2485262 - RNA, 20 nt, Human
ucugagaaagacuauucaaa

SEQ ID NO: 2485263 - RNA, 17 nt, Human
ucugacuucugccugga

SEQ ID NO: 2485264 - RNA, 16 nt, Human
ucugacuucugccugg

SEQ ID NO: 2485265 - RNA, 15 nt, Human
ucugacuucugccug

SEQ ID NO: 2485266 - RNA, 14 nt, Human
ucugacuucugccu

SEQ ID NO: 2485267 - RNA, 20 nt, Human
ucugacuucugccuggagac

SEQ ID NO: 2485268 - RNA, 19 nt, Human
ucugacuucugccuggaga

SEQ ID NO: 2485269 - RNA, 16 nt, Human
agaaacucuacauaau

SEQ ID NO: 2485270 - RNA, 21 nt, Human
ucugacuguuuccaucaaggg

SEQ ID NO: 2485271 - RNA, 20 nt, Human
ucugacuuaagcugccucaa

SEQ ID NO: 2485272 - RNA, 12 nt, Human
ucugacuucugc

SEQ ID NO: 2485273 - RNA, 14 nt, Human
ucugaccugcaggc

SEQ ID NO: 2485274 - RNA, 18 nt, Human
ucugaccucuuggccaca

SEQ ID NO: 2485275 - RNA, 19 nt, Human
agaaagacuauucaaacag

SEQ ID NO: 2485276 - RNA, 18 nt, Human
agaaagacuauucaaaca

SEQ ID NO: 2485277 - RNA, 20 nt, Human
agaaagacuauucaaacagu

SEQ ID NO: 2485278 - RNA, 23 nt, Human
agaaagacuauucaaacagucuc

SEQ ID NO: 2485279 - RNA, 14 nt, Human
ucugaccuccauga

SEQ ID NO: 2485280 - RNA, 16 nt, Human
ucugaccucuuggcca

SEQ ID NO: 2485281 - RNA, 18 nt, Human
ucugaccugcacugggga

SEQ ID NO: 2485282 - RNA, 12 nt, Human
ucugaccugcag

SEQ ID NO: 2485283 - RNA, 17 nt, Human
ucugaccccuccucacu

SEQ ID NO: 2485284 - RNA, 16 nt, Human
ucugaccccuccucac

SEQ ID NO: 2485285 - RNA, 18 nt, Human
ucugaccccuccucacug

SEQ ID NO: 2485286 - RNA, 16 nt, Human
ucugacccucucccca

SEQ ID NO: 2485287 - RNA, 14 nt, Human
ucugacccucucca

SEQ ID NO: 2485288 - RNA, 23 nt, Human
ucugacccuuacagccucugacu

SEQ ID NO: 2485289 - RNA, 21 nt, Human
ucugaccgaaacagcgcuggg

SEQ ID NO: 2485290 - RNA, 19 nt, Human
ucugacccugcuucaaaua

SEQ ID NO: 2485291 - RNA, 13 nt, Human
agaaagaagagac

SEQ ID NO: 2485292 - RNA, 18 nt, Human
agaaagaaggaagugaag

SEQ ID NO: 2485293 - RNA, 15 nt, Human
ucugaccccuccuca

SEQ ID NO: 2485294 - RNA, 13 nt, Human
ucugaccccuccu

SEQ ID NO: 2485295 - RNA, 18 nt, Human
ucuggcaguucuggaaug

SEQ ID NO: 2485296 - RNA, 21 nt, Human
ucuggcagccucccauccagg

SEQ ID NO: 2485297 - RNA, 11 nt, Human
ucuggccaggc

SEQ ID NO: 2485298 - RNA, 18 nt, Human
ucuggcauuagaauuauu

SEQ ID NO: 2485299 - RNA, 19 nt, Human
ucuggccaggauggagggg

SEQ ID NO: 2485300 - RNA, 11 nt, Human
ucuggcccuau

SEQ ID NO: 2485301 - RNA, 19 nt, Human
ucuggcccucaccccugcc

SEQ ID NO: 2485302 - RNA, 23 nt, Human
ucuggcccucaccccugcccugg

SEQ ID NO: 2485303 - RNA, 21 nt, Human
ucuggcccucuaccccugauc

SEQ ID NO: 2485304 - RNA, 13 nt, Human
ucuggcccugccu

SEQ ID NO: 2485305 - RNA, 16 nt, Human
agaagccuguuuuguu

SEQ ID NO: 2485306 - RNA, 21 nt, Human
agaagccugaugcugacauuc

SEQ ID NO: 2485307 - RNA, 14 nt, Human
ucuggcccugccuu

SEQ ID NO: 2485308 - RNA, 15 nt, Human
ucuggcccugccuuc

SEQ ID NO: 2485309 - RNA, 16 nt, Human
ucuggcccugccuucu

SEQ ID NO: 2485310 - RNA, 22 nt, Human
agaagcuguuguacauuuauga

SEQ ID NO: 2485311 - RNA, 21 nt, Human
agaagcuguuguacauuuaug

SEQ ID NO: 2485312 - RNA, 20 nt, Human
agaagcuguuguacauuuau

SEQ ID NO: 2485313 - RNA, 19 nt, Human
agaagcuguuguacauuua

SEQ ID NO: 2485314 - RNA, 18 nt, Human
agaagcuguuguacauuu

SEQ ID NO: 2485315 - RNA, 16 nt, Human
agaagcuguuguacau

SEQ ID NO: 2485316 - RNA, 14 nt, Human
agaagcuguuguac

SEQ ID NO: 2485317 - RNA, 13 nt, Human
agaagcuguagua

SEQ ID NO: 2485318 - RNA, 16 nt, Human
agaagcuggaggacua

SEQ ID NO: 2485319 - RNA, 13 nt, Human
agaagcuggagga

SEQ ID NO: 2485320 - RNA, 17 nt, Human
agaagcugcucuggaau

SEQ ID NO: 2485321 - RNA, 14 nt, Human
agaagcuccaggua

SEQ ID NO: 2485322 - RNA, 15 nt, Human
agaagcugagcacca

SEQ ID NO: 2485323 - RNA, 20 nt, Human
agaagcugagcaccagggga

SEQ ID NO: 2485324 - RNA, 15 nt, Human
agaagcggcuggcag

SEQ ID NO: 2485325 - RNA, 16 nt, Human
agaagcggcuggcagc

SEQ ID NO: 2485326 - RNA, 18 nt, Human
agaagcuaaaaccugagc

SEQ ID NO: 2485327 - RNA, 19 nt, Human
agaagcgugagacgccacc

SEQ ID NO: 2485328 - RNA, 23 nt, Human
agaagcgggacgagacccuacag

SEQ ID NO: 2485329 - RNA, 19 nt, Human
agaagccuuugggaagggg

SEQ ID NO: 2485330 - RNA, 14 nt, Human
agaagcgagcacug

SEQ ID NO: 2485331 - RNA, 21 nt, Human
agaagcuauaaauuccucuuu

SEQ ID NO: 2485332 - RNA, 20 nt, Human
agaagcuauaaauuccucuu

SEQ ID NO: 2485333 - RNA, 16 nt, Human
ucuggcagccucccau

SEQ ID NO: 2485334 - RNA, 15 nt, Human
ucuggcagcucagag

SEQ ID NO: 2485335 - RNA, 14 nt, Human
ucuggcagcucaga

SEQ ID NO: 2485336 - RNA, 18 nt, Human
ucuggauuauauuaugaa

SEQ ID NO: 2485337 - RNA, 12 nt, Human
ucuggauuauau

SEQ ID NO: 2485338 - RNA, 19 nt, Human
ucuggauggcaccagaggc

SEQ ID NO: 2485339 - RNA, 18 nt, Human
ucuggauggcaccagagg

SEQ ID NO: 2485340 - RNA, 22 nt, Human
ucuggaugccugauugccaagc

SEQ ID NO: 2485341 - RNA, 18 nt, Human
ucuggaugcauuucucug

SEQ ID NO: 2485342 - RNA, 17 nt, Human
ucuggaugcauuucucu

SEQ ID NO: 2485343 - RNA, 14 nt, Human
ucuggaucugggac

SEQ ID NO: 2485344 - RNA, 21 nt, Human
ucuggauaggagccugcuggu

SEQ ID NO: 2485345 - RNA, 20 nt, Human
ucuggauaggagccugcugg

SEQ ID NO: 2485346 - RNA, 16 nt, Human
ucuggauaggagccug

SEQ ID NO: 2485347 - RNA, 14 nt, Human
ucuggauaggagcc

SEQ ID NO: 2485348 - RNA, 19 nt, Human
ucuggagucuccagugguu

SEQ ID NO: 2485349 - RNA, 20 nt, Human
ucuggagguugauaacuuug

SEQ ID NO: 2485350 - RNA, 21 nt, Human
ucuggagucucacuugucuca

SEQ ID NO: 2485351 - RNA, 14 nt, Human
ucuggaguggccac

SEQ ID NO: 2485352 - RNA, 15 nt, Human
ucuggaguggccacu

SEQ ID NO: 2485353 - RNA, 19 nt, Human
ucuggaguggccacuaagc

SEQ ID NO: 2485354 - RNA, 16 nt, Human
ucuggaguugaucugg

SEQ ID NO: 2485355 - RNA, 17 nt, Human
ucuggaguugaucugga

SEQ ID NO: 2485356 - RNA, 24 nt, Human
ucuggaguuuuuguuuggagagca

SEQ ID NO: 2485357 - RNA, 22 nt, Human
ucuggaguuuuuguuuggagag

SEQ ID NO: 2485358 - RNA, 21 nt, Human
ucuggaguugaucuggaaccc

SEQ ID NO: 2485359 - RNA, 22 nt, Human
ucuggaacccagacucagacau

SEQ ID NO: 2485360 - RNA, 23 nt, Human
ucuggaacccagacucagacauu

SEQ ID NO: 2485361 - RNA, 15 nt, Human
ucuggaaccucagcc

SEQ ID NO: 2485362 - RNA, 19 nt, Human
ucuggagguugauaacuuu

SEQ ID NO: 2485363 - RNA, 17 nt, Human
ucuggagguugauaacu

SEQ ID NO: 2485364 - RNA, 17 nt, Human
ucuggaguauucuauaa

SEQ ID NO: 2485365 - RNA, 18 nt, Human
ucuggagguacgaaaaga

SEQ ID NO: 2485366 - RNA, 23 nt, Human
ucugcuuuuuaaagaaugcucuu

SEQ ID NO: 2485367 - RNA, 20 nt, Human
ucugcuugagucagguuuga

SEQ ID NO: 2485368 - RNA, 18 nt, Human
ucuggaaaaugugaccca

SEQ ID NO: 2485369 - RNA, 15 nt, Human
ucuggaacccagacu

SEQ ID NO: 2485370 - RNA, 16 nt, Human
ucuggaacccagacuc

SEQ ID NO: 2485371 - RNA, 17 nt, Human
ucuggaacccagacuca

SEQ ID NO: 2485372 - RNA, 18 nt, Human
ucuggaacccagacucag

SEQ ID NO: 2485373 - RNA, 13 nt, Human
ucuggaacccaga

SEQ ID NO: 2485374 - RNA, 14 nt, Human
ucuggaacccagac

SEQ ID NO: 2485375 - RNA, 19 nt, Human
ucuggaaaggggggagcug

SEQ ID NO: 2485376 - RNA, 13 nt, Human
ucuggaaaagagg

SEQ ID NO: 2485377 - RNA, 18 nt, Human
ucugcuugauuuuugccu

SEQ ID NO: 2485378 - RNA, 12 nt, Human
ucugcuugaguc

SEQ ID NO: 2485379 - RNA, 14 nt, Human
ucugcuugagucag

SEQ ID NO: 2485380 - RNA, 19 nt, Human
ucugcuucucugacuucug

SEQ ID NO: 2485381 - RNA, 16 nt, Human
ucugcuucucugacuu

SEQ ID NO: 2485382 - RNA, 22 nt, Human
ucugcuucucugacuucugccu

SEQ ID NO: 2485383 - RNA, 18 nt, Human
ucugcuugacaacaucug

SEQ ID NO: 2485384 - RNA, 19 nt, Human
ucugcuugacaacaucuga

SEQ ID NO: 2485385 - RNA, 23 nt, Human
ucugcuuacaauucccugcuguc

SEQ ID NO: 2485386 - RNA, 22 nt, Human
ucugcuuacaauucccugcugu

SEQ ID NO: 2485387 - RNA, 21 nt, Human
ucugcuuacaauucccugcug

SEQ ID NO: 2485388 - RNA, 14 nt, Human
ucugcuucucugac

SEQ ID NO: 2485389 - RNA, 17 nt, Human
ucugcuuaggagagacc

SEQ ID NO: 2485390 - RNA, 16 nt, Human
ucugcuuaggagagac

SEQ ID NO: 2485391 - RNA, 21 nt, Human
ucugcuuaugcaguuuuucag

SEQ ID NO: 2485392 - RNA, 14 nt, Human
ucugcucaucauuc

SEQ ID NO: 2485393 - RNA, 15 nt, Human
ucugcucaucauucu

SEQ ID NO: 2485394 - RNA, 18 nt, Human
ucugcucaucauucucug

SEQ ID NO: 2485395 - RNA, 22 nt, Human
ucugcucaucauucucugucuc

SEQ ID NO: 2485396 - RNA, 18 nt, Human
ucugcuguccagacagcc

SEQ ID NO: 2485397 - RNA, 17 nt, Human
ucugcuguccagacagc

SEQ ID NO: 2485398 - RNA, 15 nt, Human
ucugcuguccagaca

SEQ ID NO: 2485399 - RNA, 14 nt, Human
ucugcuguccagac

SEQ ID NO: 2485400 - RNA, 19 nt, Human
ucugcuguccagacagccu

SEQ ID NO: 2485401 - RNA, 21 nt, Human
ucugcuaacuuggagccccag

SEQ ID NO: 2485402 - RNA, 21 nt, Human
ucugcuguccagacagccugu

SEQ ID NO: 2485403 - RNA, 16 nt, Human
ucugcugucucagccu

SEQ ID NO: 2485404 - RNA, 15 nt, Human
ucugcugucucagcc

SEQ ID NO: 2485405 - RNA, 20 nt, Human
ucugcuuacaauucccugcu

SEQ ID NO: 2485406 - RNA, 19 nt, Human
ucugcuuacaauucccugc

SEQ ID NO: 2485407 - RNA, 17 nt, Human
ucugcuuacaauucccu

SEQ ID NO: 2485408 - RNA, 13 nt, Human
ucugccuuuuuua

SEQ ID NO: 2485409 - RNA, 22 nt, Human
ucugccuuuggggacuuuucuu

SEQ ID NO: 2485410 - RNA, 16 nt, Human
ucugccuuccuugcua

SEQ ID NO: 2485411 - RNA, 16 nt, Human
ucugcggaccccagcu

SEQ ID NO: 2485412 - RNA, 15 nt, Human
ucugcggaccccagc

SEQ ID NO: 2485413 - RNA, 14 nt, Human
ucugcggaccccag

SEQ ID NO: 2485414 - RNA, 22 nt, Human
ucugcggaccccagcugugagc

SEQ ID NO: 2485415 - RNA, 17 nt, Human
ucugcggaccccagcug

SEQ ID NO: 2485416 - RNA, 22 nt, Human
ucugcuaacuuggagccccagu

SEQ ID NO: 2485417 - RNA, 22 nt, Human
ucugcuaagcucaaggcgugag

SEQ ID NO: 2485418 - RNA, 16 nt, Human
ucugcucacauaucug

SEQ ID NO: 2485419 - RNA, 17 nt, Human
ucugcuaccucacuggg

SEQ ID NO: 2485420 - RNA, 14 nt, Human
ucugcuaccucacu

SEQ ID NO: 2485421 - RNA, 19 nt, Human
ucugcuacguuccuauugu

SEQ ID NO: 2485422 - RNA, 14 nt, Human
ucugcuaauaaaac

SEQ ID NO: 2485423 - RNA, 21 nt, Human
ucugcuacguuccuauuguca

SEQ ID NO: 2485424 - RNA, 15 nt, Human
ucugcucagcagcua

SEQ ID NO: 2485425 - RNA, 15 nt, Human
ucugcucagcccugg

SEQ ID NO: 2485426 - RNA, 14 nt, Human
ucugcucagcccug

SEQ ID NO: 2485427 - RNA, 13 nt, Human
ucugcucagcccu

SEQ ID NO: 2485428 - RNA, 17 nt, Human
ucugcuauauuuucaug

SEQ ID NO: 2485429 - RNA, 16 nt, Human
ucugcucagcagcuau

SEQ ID NO: 2485430 - RNA, 16 nt, Human
ucugcuaugugacuug

SEQ ID NO: 2485431 - RNA, 19 nt, Human
ucugcucagcccuggaggu

SEQ ID NO: 2485432 - RNA, 18 nt, Human
ucugcucagcccuggagg

SEQ ID NO: 2485433 - RNA, 17 nt, Human
ucugcucagcccuggag

SEQ ID NO: 2485434 - RNA, 16 nt, Human
ucugcucagcccugga

SEQ ID NO: 2485435 - RNA, 14 nt, Human
ucugcucagcucug

SEQ ID NO: 2485436 - RNA, 16 nt, Human
ucugcucagcucuggg

SEQ ID NO: 2485437 - RNA, 22 nt, Human
ucugcucaguaauuugaggaca

SEQ ID NO: 2485438 - RNA, 12 nt, Human
ucugcucaucau

SEQ ID NO: 2485439 - RNA, 14 nt, Human
ucugcucagcuucu

SEQ ID NO: 2485440 - RNA, 15 nt, Human
ucugcucagcuucuc

SEQ ID NO: 2485441 - RNA, 18 nt, Human
ucugcucagcuucuccug

SEQ ID NO: 2485442 - RNA, 23 nt, Human
ucugccgcagcccugcagagggc

SEQ ID NO: 2485443 - RNA, 14 nt, Human
ucugcccuccaaga

SEQ ID NO: 2485444 - RNA, 23 nt, Human
ucugccggcucuuuccuugcuca

SEQ ID NO: 2485445 - RNA, 13 nt, Human
ucugccggcucuu

SEQ ID NO: 2485446 - RNA, 17 nt, Human
ucugccggcccuggggc

SEQ ID NO: 2485447 - RNA, 23 nt, Human
ucugcccgggaaggucaccagca

SEQ ID NO: 2485448 - RNA, 10 nt, Human
ucugcccggg

SEQ ID NO: 2485449 - RNA, 15 nt, Human
ucugccggcccuggg

SEQ ID NO: 2485450 - RNA, 16 nt, Human
ucugccggcccugggg

SEQ ID NO: 2485451 - RNA, 15 nt, Human
ucugccuuccuugcu

SEQ ID NO: 2485452 - RNA, 14 nt, Human
ucugccuuccuugc

SEQ ID NO: 2485453 - RNA, 20 nt, Human
ucugccuucucaugauccaa

SEQ ID NO: 2485454 - RNA, 11 nt, Human
ucugccuuuau

SEQ ID NO: 2485455 - RNA, 18 nt, Human
ucugccuuuauuguguuu

SEQ ID NO: 2485456 - RNA, 16 nt, Human
ucugccuuuauugugu

SEQ ID NO: 2485457 - RNA, 23 nt, Human
ucugccuuuauuguguuugucau

SEQ ID NO: 2485458 - RNA, 20 nt, Human
ucugccuuuauuguguuugu

SEQ ID NO: 2485459 - RNA, 22 nt, Human
ucugccccucuccaggcgccgg

SEQ ID NO: 2485460 - RNA, 18 nt, Human
ucugccccucccugcuuc

SEQ ID NO: 2485461 - RNA, 15 nt, Human
ucugccccucccugc

SEQ ID NO: 2485462 - RNA, 13 nt, Human
ucugccccucccu

SEQ ID NO: 2485463 - RNA, 12 nt, Human
ucugccccuccc

SEQ ID NO: 2485464 - RNA, 15 nt, Human
ucugccccuccccca

SEQ ID NO: 2485465 - RNA, 16 nt, Human
ucugccccucccccaa

SEQ ID NO: 2485466 - RNA, 18 nt, Human
ucugccccucccccaacc

SEQ ID NO: 2485467 - RNA, 22 nt, Human
ucugccccucccccaaccccca

SEQ ID NO: 2485468 - RNA, 13 nt, Human
ucugccccucccc

SEQ ID NO: 2485469 - RNA, 14 nt, Human
ucugccccuccccc

SEQ ID NO: 2485470 - RNA, 17 nt, Human
agaagaagucagagagg

SEQ ID NO: 2485471 - RNA, 16 nt, Human
agaagaagucagagag

SEQ ID NO: 2485472 - RNA, 21 nt, Human
agaagaaggcagcagguggca

SEQ ID NO: 2485473 - RNA, 20 nt, Human
agaagaacuguguuucaagu

SEQ ID NO: 2485474 - RNA, 21 nt, Human
agaagaacuguguuucaaguu

SEQ ID NO: 2485475 - RNA, 14 nt, Human
agaagaaggcagca

SEQ ID NO: 2485476 - RNA, 13 nt, Human
agaagaaggcagc

SEQ ID NO: 2485477 - RNA, 21 nt, Human
agaagaacuugcauggagcag

SEQ ID NO: 2485478 - RNA, 21 nt, Human
agaagaacugaaaucauacuu

SEQ ID NO: 2485479 - RNA, 13 nt, Human
agaagaaacuagg

SEQ ID NO: 2485480 - RNA, 19 nt, Human
agaagaaaauugcugugcc

SEQ ID NO: 2485481 - RNA, 16 nt, Human
agaagaaaauugcugu

SEQ ID NO: 2485482 - RNA, 18 nt, Human
agaagaaacgucuaugug

SEQ ID NO: 2485483 - RNA, 21 nt, Human
agaaaccaguuaugugaauga

SEQ ID NO: 2485484 - RNA, 13 nt, Human
agaaacccugucu

SEQ ID NO: 2485485 - RNA, 15 nt, Human
agaaacccagacuga

SEQ ID NO: 2485486 - RNA, 16 nt, Human
agaaacccgacagagg

SEQ ID NO: 2485487 - RNA, 18 nt, Human
agaaacccgacagaggga

SEQ ID NO: 2485488 - RNA, 14 nt, Human
agaaaacuucuuuu

SEQ ID NO: 2485489 - RNA, 13 nt, Human
agaaaacauguuu

SEQ ID NO: 2485490 - RNA, 11 nt, Human
agaaaacauug

SEQ ID NO: 2485491 - RNA, 15 nt, Human
agaaaacaugccucu

SEQ ID NO: 2485492 - RNA, 12 nt, Human
agaaaacaucua

SEQ ID NO: 2485493 - RNA, 19 nt, Human
agaaaacauuguuccagau

SEQ ID NO: 2485494 - RNA, 13 nt, Human
agaaaacauuguu

SEQ ID NO: 2485495 - RNA, 12 nt, Human
agaaaacauugu

SEQ ID NO: 2485496 - RNA, 15 nt, Human
agaaaacauuguucc

SEQ ID NO: 2485497 - RNA, 14 nt, Human
agaaaacccacccc

SEQ ID NO: 2485498 - RNA, 13 nt, Human
agaaaacccaccc

SEQ ID NO: 2485499 - RNA, 16 nt, Human
agaaaacccuuuucua

SEQ ID NO: 2485500 - RNA, 16 nt, Human
agaaaacugaaaaucu

SEQ ID NO: 2485501 - RNA, 15 nt, Human
agaaaacugaaaauc

SEQ ID NO: 2485502 - RNA, 21 nt, Human
agaaaacuccuuuagcaggug

SEQ ID NO: 2485503 - RNA, 20 nt, Human
agaaaacgguuaaaacuguc

SEQ ID NO: 2485504 - RNA, 13 nt, Human
agaaacuggaacu

SEQ ID NO: 2485505 - RNA, 15 nt, Human
agaaacuggaacucu

SEQ ID NO: 2485506 - RNA, 13 nt, Human
agaaacugaggaa

SEQ ID NO: 2485507 - RNA, 16 nt, Human
agaaacugaggaauuu

SEQ ID NO: 2485508 - RNA, 21 nt, Human
agaaacccgacagagggaaga

SEQ ID NO: 2485509 - RNA, 14 nt, Human
agaaacccugucuc

SEQ ID NO: 2485510 - RNA, 18 nt, Human
agaaacugaggaauuuuc

SEQ ID NO: 2485511 - RNA, 15 nt, Human
agaaacugcagggaa

SEQ ID NO: 2485512 - RNA, 16 nt, Human
agaaacugagaccaaa

SEQ ID NO: 2485513 - RNA, 16 nt, Human
agaaagaaaaugaaga

SEQ ID NO: 2485514 - RNA, 20 nt, Human
agaaagaaacccgacagagg

SEQ ID NO: 2485515 - RNA, 22 nt, Human
agaaagaaacccgacagaggga

SEQ ID NO: 2485516 - RNA, 12 nt, Human
agaaagaagccc

SEQ ID NO: 2485517 - RNA, 12 nt, Human
agaaagaaggaa

SEQ ID NO: 2485518 - RNA, 13 nt, Human
agaaagaaggaag

SEQ ID NO: 2485519 - RNA, 14 nt, Human
agaaagaaggaagu

SEQ ID NO: 2485520 - RNA, 12 nt, Human
agaaagaagaga

SEQ ID NO: 2485521 - RNA, 15 nt, Human
agaaagaagaugaau

SEQ ID NO: 2485522 - RNA, 19 nt, Human
agaaaacaaggaugaauua

SEQ ID NO: 2485523 - RNA, 21 nt, Human
agaaaaaucauguuugcucuc

SEQ ID NO: 2485524 - RNA, 23 nt, Human
agaaaacauaaucuucugccuuc

SEQ ID NO: 2485525 - RNA, 15 nt, Human
agaaaacaucacuga

SEQ ID NO: 2485526 - RNA, 12 nt, Human
agaaaacagaaa

SEQ ID NO: 2485527 - RNA, 16 nt, Human
agaaaacagaaaacaa

SEQ ID NO: 2485528 - RNA, 17 nt, Human
agaaaacacuuguaagu

SEQ ID NO: 2485529 - RNA, 14 nt, Human
agaaaaaucauguu

SEQ ID NO: 2485530 - RNA, 17 nt, Human
agaaaaaugagccuggc

SEQ ID NO: 2485531 - RNA, 15 nt, Human
agaaaaauaacccuu

SEQ ID NO: 2485532 - RNA, 19 nt, Human
agaaaaauaugaccacacu

SEQ ID NO: 2485533 - RNA, 18 nt, Human
agaaaaaggaugcacaga

SEQ ID NO: 2485534 - RNA, 19 nt, Human
ucucuuucuucucugcugc

SEQ ID NO: 2485535 - RNA, 13 nt, Human
ucucuugagccug

SEQ ID NO: 2485536 - RNA, 14 nt, Human
ucucuugagccugg

SEQ ID NO: 2485537 - RNA, 13 nt, Human
ucucuucuugaac

SEQ ID NO: 2485538 - RNA, 15 nt, Human
ucucuugagccuggg

SEQ ID NO: 2485539 - RNA, 22 nt, Human
ucucuuuaaugucacaggcagg

SEQ ID NO: 2485540 - RNA, 16 nt, Human
ucucuucuuuuggcuu

SEQ ID NO: 2485541 - RNA, 18 nt, Human
ucucuucuuuuggcuucc

SEQ ID NO: 2485542 - RNA, 14 nt, Human
ucucuuucucuccu

SEQ ID NO: 2485543 - RNA, 19 nt, Human
ucucuuuccuucuugccuu

SEQ ID NO: 2485544 - RNA, 18 nt, Human
ucucuuuccuucuugccu

SEQ ID NO: 2485545 - RNA, 12 nt, Human
ucucuuuccuug

SEQ ID NO: 2485546 - RNA, 23 nt, Human
ucucuuucuccuuagucuucuca

SEQ ID NO: 2485547 - RNA, 16 nt, Human
ucucuuuccuucuugc

SEQ ID NO: 2485548 - RNA, 15 nt, Human
ucucuuucaugaguu

SEQ ID NO: 2485549 - RNA, 13 nt, Human
ucucuccagaugu

SEQ ID NO: 2485550 - RNA, 16 nt, Human
ucucuccagauguuuc

SEQ ID NO: 2485551 - RNA, 15 nt, Human
ucucuccagccccug

SEQ ID NO: 2485552 - RNA, 20 nt, Human
ucucuccuguaccucuugag

SEQ ID NO: 2485553 - RNA, 22 nt, Human
ucucuccuguaccucuugagcc

SEQ ID NO: 2485554 - RNA, 13 nt, Human
ucucugcaucuga

SEQ ID NO: 2485555 - RNA, 21 nt, Human
ucucugcaucuacucccaagu

SEQ ID NO: 2485556 - RNA, 19 nt, Human
ucucugcaucuacucccaa

SEQ ID NO: 2485557 - RNA, 18 nt, Human
ucucugcaucuacuccca

SEQ ID NO: 2485558 - RNA, 22 nt, Human
ucucuccuuucuuuuucuucuu

SEQ ID NO: 2485559 - RNA, 14 nt, Human
ucucuccuuucuuu

SEQ ID NO: 2485560 - RNA, 19 nt, Human
ucucuccuuguucugauaa

SEQ ID NO: 2485561 - RNA, 15 nt, Human
ucucuccuuguucug

SEQ ID NO: 2485562 - RNA, 14 nt, Human
ucucuccuguccaa

SEQ ID NO: 2485563 - RNA, 13 nt, Human
ucucuccugucca

SEQ ID NO: 2485564 - RNA, 14 nt, Human
ucucuccuguacuu

SEQ ID NO: 2485565 - RNA, 17 nt, Human
ucucugcaucugaccac

SEQ ID NO: 2485566 - RNA, 16 nt, Human
ucucugcaucugacca

SEQ ID NO: 2485567 - RNA, 15 nt, Human
ucucugcaucugacc

SEQ ID NO: 2485568 - RNA, 15 nt, Human
ucucugccagugaca

SEQ ID NO: 2485569 - RNA, 14 nt, Human
ucucugccagugac

SEQ ID NO: 2485570 - RNA, 12 nt, Human
ucucugcccaac

SEQ ID NO: 2485571 - RNA, 13 nt, Human
ucucugcccaacc

SEQ ID NO: 2485572 - RNA, 21 nt, Human
ucucugccagugacagacagg

SEQ ID NO: 2485573 - RNA, 14 nt, Human
ucucuccagccccu

SEQ ID NO: 2485574 - RNA, 13 nt, Human
ucucuccagcccc

SEQ ID NO: 2485575 - RNA, 14 nt, Human
ucuccuuccugugu

SEQ ID NO: 2485576 - RNA, 19 nt, Human
ucuccuuccccuuucccca

SEQ ID NO: 2485577 - RNA, 13 nt, Human
ucuccuuccugug

SEQ ID NO: 2485578 - RNA, 20 nt, Human
ucuccuucagcccucacccc

SEQ ID NO: 2485579 - RNA, 19 nt, Human
ucuccuucagcccucaccc

SEQ ID NO: 2485580 - RNA, 15 nt, Human
ucuccuucagcccuc

SEQ ID NO: 2485581 - RNA, 18 nt, Human
ucuccuucaccuuugucc

SEQ ID NO: 2485582 - RNA, 20 nt, Human
ucuccuucaccuuugucccc

SEQ ID NO: 2485583 - RNA, 16 nt, Human
acuuuuuuuugagaau

SEQ ID NO: 2485584 - RNA, 14 nt, Human
agaaaaaaaaagaa

SEQ ID NO: 2485585 - RNA, 15 nt, Human
agaaaaaaaaagaaa

SEQ ID NO: 2485586 - RNA, 22 nt, Human
acuuuuuuuuuccaaaaaaaua

SEQ ID NO: 2485587 - RNA, 16 nt, Human
agaaaaaaaaagaaaa

SEQ ID NO: 2485588 - RNA, 20 nt, Human
agaaaaaaaaaaacuuacac

SEQ ID NO: 2485589 - RNA, 15 nt, Human
acuuuuuuuugagaa

SEQ ID NO: 2485590 - RNA, 17 nt, Human
acuuuuuuuuguauguu

SEQ ID NO: 2485591 - RNA, 22 nt, Human
ucucugcccuaaugcgcaggcu

SEQ ID NO: 2485592 - RNA, 11 nt, Human
ucucugcccua

SEQ ID NO: 2485593 - RNA, 21 nt, Human
ucucugccggcucuuuccuug

SEQ ID NO: 2485594 - RNA, 19 nt, Human
ucucugccggcucuuuccu

SEQ ID NO: 2485595 - RNA, 15 nt, Human
ucucugccggcucuu

SEQ ID NO: 2485596 - RNA, 23 nt, Human
ucucugccucccucacccugagc

SEQ ID NO: 2485597 - RNA, 21 nt, Human
ucucugccucccucacccuga

SEQ ID NO: 2485598 - RNA, 11 nt, Human
ucucugcucca

SEQ ID NO: 2485599 - RNA, 12 nt, Human
ucucugcuccac

SEQ ID NO: 2485600 - RNA, 13 nt, Human
ucucugcuccacc

SEQ ID NO: 2485601 - RNA, 16 nt, Human
ucucuggccuucggcc

SEQ ID NO: 2485602 - RNA, 17 nt, Human
ucucuggccuucggccu

SEQ ID NO: 2485603 - RNA, 13 nt, Human
ucucuggccuucg

SEQ ID NO: 2485604 - RNA, 14 nt, Human
ucucugcuccacca

SEQ ID NO: 2485605 - RNA, 15 nt, Human
ucucugcuccaccac

SEQ ID NO: 2485606 - RNA, 17 nt, Human
ucucugcuccaccacau

SEQ ID NO: 2485607 - RNA, 19 nt, Human
ucucugcuccaccacaucc

SEQ ID NO: 2485608 - RNA, 12 nt, Human
ucucuucuuuaa

SEQ ID NO: 2485609 - RNA, 21 nt, Human
ucucuucuggguuccuuccuc

SEQ ID NO: 2485610 - RNA, 19 nt, Human
ucucuucugcuccacccuu

SEQ ID NO: 2485611 - RNA, 13 nt, Human
ucucuucuuuaaa

SEQ ID NO: 2485612 - RNA, 14 nt, Human
ucucuugagagggu

SEQ ID NO: 2485613 - RNA, 19 nt, Human
ucucuucuggguuccuucc

SEQ ID NO: 2485614 - RNA, 20 nt, Human
ucucuucuggguuccuuccu

SEQ ID NO: 2485615 - RNA, 18 nt, Human
ucucuucuggguuccuuc

SEQ ID NO: 2485616 - RNA, 16 nt, Human
ucucuucugcuccacc

SEQ ID NO: 2485617 - RNA, 17 nt, Human
ucucuucugcuccaccc

SEQ ID NO: 2485618 - RNA, 21 nt, Human
ucucuucugagcuauuucauc

SEQ ID NO: 2485619 - RNA, 22 nt, Human
ucucuucugagcuauuucaucu

SEQ ID NO: 2485620 - RNA, 13 nt, Human
ucucuucugcucc

SEQ ID NO: 2485621 - RNA, 14 nt, Human
ucucuucugcucca

SEQ ID NO: 2485622 - RNA, 18 nt, Human
ucucugcucugcguguca

SEQ ID NO: 2485623 - RNA, 21 nt, Human
ucucugcucugcgugucaccu

SEQ ID NO: 2485624 - RNA, 22 nt, Human
ucucugcucugcgugucaccug

SEQ ID NO: 2485625 - RNA, 23 nt, Human
acuugugucccaugaucccugug

SEQ ID NO: 2485626 - RNA, 14 nt, Human
ucuccucugcugcu

SEQ ID NO: 2485627 - RNA, 13 nt, Human
ucuccucugcugc

SEQ ID NO: 2485628 - RNA, 19 nt, Human
acuuguugauuaauggaaa

SEQ ID NO: 2485629 - RNA, 21 nt, Human
acuuguugauuaauggaaaug

SEQ ID NO: 2485630 - RNA, 16 nt, Human
acuugugucucugugc

SEQ ID NO: 2485631 - RNA, 21 nt, Human
acuugugucucugugcuuuua

SEQ ID NO: 2485632 - RNA, 14 nt, Human
acuugugucucugu

SEQ ID NO: 2485633 - RNA, 22 nt, Human
acuugugucucugugcuuuuaa

SEQ ID NO: 2485634 - RNA, 20 nt, Human
acuugugugugggcugugag

SEQ ID NO: 2485635 - RNA, 21 nt, Human
acuugugugugggcugugagu

SEQ ID NO: 2485636 - RNA, 22 nt, Human
acuugugugugggcugugagug

SEQ ID NO: 2485637 - RNA, 17 nt, Human
acuuguuccagcucuuu

SEQ ID NO: 2485638 - RNA, 21 nt, Human
ucucccuuggauuguccccga

SEQ ID NO: 2485639 - RNA, 19 nt, Human
ucucccuuggauugucccc

SEQ ID NO: 2485640 - RNA, 21 nt, Human
ucuccgccagccuccucugga

SEQ ID NO: 2485641 - RNA, 20 nt, Human
ucuccgccagccuccucugg

SEQ ID NO: 2485642 - RNA, 18 nt, Human
ucuccgccagccuccucu

SEQ ID NO: 2485643 - RNA, 15 nt, Human
ucuccgccagccucc

SEQ ID NO: 2485644 - RNA, 14 nt, Human
ucuccgccagccuc

SEQ ID NO: 2485645 - RNA, 13 nt, Human
ucuccgccagccu

SEQ ID NO: 2485646 - RNA, 17 nt, Human
ucuccgacugcuaggga

SEQ ID NO: 2485647 - RNA, 18 nt, Human
ucucccuucucccaugag

SEQ ID NO: 2485648 - RNA, 19 nt, Human
ucuccguuagcuccugugg

SEQ ID NO: 2485649 - RNA, 18 nt, Human
ucuccguuagcuccugug

SEQ ID NO: 2485650 - RNA, 17 nt, Human
ucuccguuagcuccugu

SEQ ID NO: 2485651 - RNA, 16 nt, Human
ucuccguuagcuccug

SEQ ID NO: 2485652 - RNA, 12 nt, Human
ucuccucugcug

SEQ ID NO: 2485653 - RNA, 13 nt, Human
acuguagggaggg

SEQ ID NO: 2485654 - RNA, 15 nt, Human
acuguaggcacacuu

SEQ ID NO: 2485655 - RNA, 19 nt, Human
acuguaggaagaguagcau

SEQ ID NO: 2485656 - RNA, 17 nt, Human
acuguagccuggauauu

SEQ ID NO: 2485657 - RNA, 22 nt, Human
acuguagccucgccgucuguga

SEQ ID NO: 2485658 - RNA, 20 nt, Human
acuguaggaagaguagcauu

SEQ ID NO: 2485659 - RNA, 13 nt, Human
acuguagucucag

SEQ ID NO: 2485660 - RNA, 15 nt, Human
acuguagucucagga

SEQ ID NO: 2485661 - RNA, 16 nt, Human
acuguagucucaggac

SEQ ID NO: 2485662 - RNA, 18 nt, Human
acuguaguuuuucuucaa

SEQ ID NO: 2485663 - RNA, 20 nt, Human
acuguaguuuuucuucaaca

SEQ ID NO: 2485664 - RNA, 18 nt, Human
acuguauauaaaggaaaa

SEQ ID NO: 2485665 - RNA, 13 nt, Human
acuguauauaaag

SEQ ID NO: 2485666 - RNA, 23 nt, Human
acuguauaaauaggagaggauga

SEQ ID NO: 2485667 - RNA, 22 nt, Human
acuguauaaauaggagaggaug

SEQ ID NO: 2485668 - RNA, 21 nt, Human
acuguauaaauaggagaggau

SEQ ID NO: 2485669 - RNA, 20 nt, Human
acuguauaaauaggagagga

SEQ ID NO: 2485670 - RNA, 17 nt, Human
acuguauaaauaggaga

SEQ ID NO: 2485671 - RNA, 15 nt, Human
acuguauaaauagga

SEQ ID NO: 2485672 - RNA, 14 nt, Human
acuguauaaauagg

SEQ ID NO: 2485673 - RNA, 13 nt, Human
acuguauaaauag

SEQ ID NO: 2485674 - RNA, 12 nt, Human
acuguauaaaua

SEQ ID NO: 2485675 - RNA, 21 nt, Human
acuguaguuuuucuucaacau

SEQ ID NO: 2485676 - RNA, 18 nt, Human
ucucccagucuacccaga

SEQ ID NO: 2485677 - RNA, 19 nt, Human
ucucccagguaccagcugc

SEQ ID NO: 2485678 - RNA, 18 nt, Human
ucucccagguaccagcug

SEQ ID NO: 2485679 - RNA, 17 nt, Human
ucucccagguaccagcu

SEQ ID NO: 2485680 - RNA, 20 nt, Human
ucucccagucuacccagaga

SEQ ID NO: 2485681 - RNA, 19 nt, Human
ucucccagucuacccagag

SEQ ID NO: 2485682 - RNA, 15 nt, Human
ucucccagucauuua

SEQ ID NO: 2485683 - RNA, 18 nt, Human
ucucccuuggauuguccc

SEQ ID NO: 2485684 - RNA, 11 nt, Human
ucucccuugga

SEQ ID NO: 2485685 - RNA, 18 nt, Human
ucucccaaagugcuggga

SEQ ID NO: 2485686 - RNA, 12 nt, Human
ucucccaaggcu

SEQ ID NO: 2485687 - RNA, 13 nt, Human
ucucccaggaagc

SEQ ID NO: 2485688 - RNA, 19 nt, Human
ucucccaaggcugcgucug

SEQ ID NO: 2485689 - RNA, 12 nt, Human
ucucccacacug

SEQ ID NO: 2485690 - RNA, 13 nt, Human
ucucccaggccag

SEQ ID NO: 2485691 - RNA, 14 nt, Human
ucucccaggccagg

SEQ ID NO: 2485692 - RNA, 18 nt, Human
ucucccaggccaggcucc

SEQ ID NO: 2485693 - RNA, 23 nt, Human
ucucccaggccaggcuccuuccu

SEQ ID NO: 2485694 - RNA, 23 nt, Human
ucucccaggggcuggcuucagga

SEQ ID NO: 2485695 - RNA, 18 nt, Human
ucucccaggggcuggcuu

SEQ ID NO: 2485696 - RNA, 12 nt, Human
ucucccaggggc

SEQ ID NO: 2485697 - RNA, 17 nt, Human
acuuuuguaagacaaag

SEQ ID NO: 2485698 - RNA, 12 nt, Human
acuuuuguaaga

SEQ ID NO: 2485699 - RNA, 22 nt, Human
acuuuuuauggcacuaguauuu

SEQ ID NO: 2485700 - RNA, 13 nt, Human
acuuuuucauuug

SEQ ID NO: 2485701 - RNA, 18 nt, Human
acuuuuucauuugccuau

SEQ ID NO: 2485702 - RNA, 11 nt, Human
acuuuuuccag

SEQ ID NO: 2485703 - RNA, 16 nt, Human
acuuuugguuaagucu

SEQ ID NO: 2485704 - RNA, 20 nt, Human
acuuuugguuaagucuguuu

SEQ ID NO: 2485705 - RNA, 22 nt, Human
acuuuugguuaagucuguuuua

SEQ ID NO: 2485706 - RNA, 14 nt, Human
acuuuuggcauuuu

SEQ ID NO: 2485707 - RNA, 20 nt, Human
acuuugggauaggaaaaaug

SEQ ID NO: 2485708 - RNA, 19 nt, Human
acuuugguacauggccagu

SEQ ID NO: 2485709 - RNA, 19 nt, Human
acuuugggaggcugaggcg

SEQ ID NO: 2485710 - RNA, 19 nt, Human
acuuugggauucuuuccau

SEQ ID NO: 2485711 - RNA, 22 nt, Human
acuuuuuuuuuuuaagaguaaa

SEQ ID NO: 2485712 - RNA, 15 nt, Human
acuuuuuuuuaaguu

SEQ ID NO: 2485713 - RNA, 23 nt, Human
acuuuuuuggggauaugcuuagu

SEQ ID NO: 2485714 - RNA, 22 nt, Human
acuuuuuuggggauaugcuuag

SEQ ID NO: 2485715 - RNA, 21 nt, Human
acuuuuuugaaauaauaaauc

SEQ ID NO: 2485716 - RNA, 22 nt, Human
acuuuuuugaguggaugauguu

SEQ ID NO: 2485717 - RNA, 21 nt, Human
acuuuuuuggggauaugcuua

SEQ ID NO: 2485718 - RNA, 23 nt, Human
acuuuuuugcuauccagcuauuu

SEQ ID NO: 2485719 - RNA, 13 nt, Human
acuuuuuuccaca

SEQ ID NO: 2485720 - RNA, 18 nt, Human
acuuuuugguuugcagau

SEQ ID NO: 2485721 - RNA, 13 nt, Human
acuuuuugcauuu

SEQ ID NO: 2485722 - RNA, 15 nt, Human
acuuuuucuuuaugu

SEQ ID NO: 2485723 - RNA, 18 nt, Human
acuuuaccuuuuuuauac

SEQ ID NO: 2485724 - RNA, 21 nt, Human
acuuguuguuuuacuaaagaa

SEQ ID NO: 2485725 - RNA, 19 nt, Human
acuuuaccuuuuuuauaca

SEQ ID NO: 2485726 - RNA, 22 nt, Human
acuuuaccuuuuuuauacauaa

SEQ ID NO: 2485727 - RNA, 23 nt, Human
acuuuaccuuuuuuauacauaaa

SEQ ID NO: 2485728 - RNA, 13 nt, Human
acuuguuuccaau

SEQ ID NO: 2485729 - RNA, 19 nt, Human
acuuugaccucugcagcaa

SEQ ID NO: 2485730 - RNA, 23 nt, Human
acuuugaccucugcagcaauaaa

SEQ ID NO: 2485731 - RNA, 15 nt, Human
acuuugacuuuuugc

SEQ ID NO: 2485732 - RNA, 20 nt, Human
acuuugacuuuuugcauuua

SEQ ID NO: 2485733 - RNA, 17 nt, Human
acuuguuuuaugcucag

SEQ ID NO: 2485734 - RNA, 14 nt, Human
acuuuggaaagacu

SEQ ID NO: 2485735 - RNA, 13 nt, Human
acuuuggaaagac

SEQ ID NO: 2485736 - RNA, 21 nt, Human
acuuugacuuuuugcauuuaa

SEQ ID NO: 2485737 - RNA, 12 nt, Human
acuuuggaaaga

SEQ ID NO: 2485738 - RNA, 14 nt, Human
acuuuggcugcaug

SEQ ID NO: 2485739 - RNA, 17 nt, Human
acuuuggcugcaugcga

SEQ ID NO: 2485740 - RNA, 13 nt, Human
acuuuggcugcau

SEQ ID NO: 2485741 - RNA, 17 nt, Human
acuuuggaaagacuuuu

SEQ ID NO: 2485742 - RNA, 12 nt, Human
acuuugggaggc

SEQ ID NO: 2485743 - RNA, 15 nt, Human
acuuugggaggccaa

SEQ ID NO: 2485744 - RNA, 14 nt, Human
acuuugggaggcca

SEQ ID NO: 2485745 - RNA, 20 nt, Human
acuuugggaggccaaggugg

SEQ ID NO: 2485746 - RNA, 17 nt, Human
acuuugggaggcugagg

SEQ ID NO: 2485747 - RNA, 19 nt, Human
acuuugggaggccaaggug

SEQ ID NO: 2485748 - RNA, 16 nt, Human
acuuugggaggccaag

SEQ ID NO: 2485749 - RNA, 17 nt, Human
acuuugggaggccaagg

SEQ ID NO: 2485750 - RNA, 19 nt, Human
agccugagcgacagugaga

SEQ ID NO: 2485751 - RNA, 17 nt, Human
ugcagccggcacagggu

SEQ ID NO: 2485752 - RNA, 14 nt, Human
ugcagccgcugagc

SEQ ID NO: 2485753 - RNA, 19 nt, Human
ugcagccucaaccuccugg

SEQ ID NO: 2485754 - RNA, 18 nt, Human
ugcagccucaaccuccug

SEQ ID NO: 2485755 - RNA, 19 nt, Human
ugcagccggcacagggucu

SEQ ID NO: 2485756 - RNA, 18 nt, Human
ugcagccggcacaggguc

SEQ ID NO: 2485757 - RNA, 21 nt, Human
ugcagcugaccucuguugucc

SEQ ID NO: 2485758 - RNA, 19 nt, Human
ugcagcugagagaaaauaa

SEQ ID NO: 2485759 - RNA, 16 nt, Human
ugcagcugauguugga

SEQ ID NO: 2485760 - RNA, 14 nt, Human
ugcagcugauuuua

SEQ ID NO: 2485761 - RNA, 15 nt, Human
ugcagcugauuuuaa

SEQ ID NO: 2485762 - RNA, 16 nt, Human
ugcagcugauuuuaac

SEQ ID NO: 2485763 - RNA, 18 nt, Human
ugcagcugauuuuaacaa

SEQ ID NO: 2485764 - RNA, 19 nt, Human
ugcagcugauuuuaacaau

SEQ ID NO: 2485765 - RNA, 19 nt, Human
ugcagcuggaaaagggucu

SEQ ID NO: 2485766 - RNA, 20 nt, Human
ugcagcugauuuuaacaaua

SEQ ID NO: 2485767 - RNA, 22 nt, Human
ugcagcugauuuuaacaauaac

SEQ ID NO: 2485768 - RNA, 15 nt, Human
ugcagcuucuguccu

SEQ ID NO: 2485769 - RNA, 18 nt, Human
agccugagcgacagugag

SEQ ID NO: 2485770 - RNA, 16 nt, Human
agccugagcaacucuu

SEQ ID NO: 2485771 - RNA, 21 nt, Human
agccugagcaacucuugauua

SEQ ID NO: 2485772 - RNA, 15 nt, Human
agccucagcauccug

SEQ ID NO: 2485773 - RNA, 14 nt, Human
agccucagcauccu

SEQ ID NO: 2485774 - RNA, 13 nt, Human
agccucagcaucc

SEQ ID NO: 2485775 - RNA, 18 nt, Human
agccucaaccuccugggc

SEQ ID NO: 2485776 - RNA, 17 nt, Human
agccucaaccuccuggg

SEQ ID NO: 2485777 - RNA, 16 nt, Human
ugcaguuuuucagagu

SEQ ID NO: 2485778 - RNA, 15 nt, Human
ugcaguuuuucagag

SEQ ID NO: 2485779 - RNA, 14 nt, Human
ugcaguuuuucaga

SEQ ID NO: 2485780 - RNA, 15 nt, Human
ugcagugagccaaga

SEQ ID NO: 2485781 - RNA, 22 nt, Human
ugcagugacgugcaccuguacu

SEQ ID NO: 2485782 - RNA, 11 nt, Human
ugcauaaaaug

SEQ ID NO: 2485783 - RNA, 13 nt, Human
ugcauaaauaugc

SEQ ID NO: 2485784 - RNA, 12 nt, Human
ugcauaaauaug

SEQ ID NO: 2485785 - RNA, 17 nt, Human
ugcauaaagucagugcc

SEQ ID NO: 2485786 - RNA, 19 nt, Human
ugcagugagccgagauugu

SEQ ID NO: 2485787 - RNA, 12 nt, Human
ugcaguuuuccu

SEQ ID NO: 2485788 - RNA, 15 nt, Human
ugcauaauggucaga

SEQ ID NO: 2485789 - RNA, 23 nt, Human
ugcauaauaagcuaaagaggcug

SEQ ID NO: 2485790 - RNA, 24 nt, Human
ugcauaauaagcuaaagaggcuga

SEQ ID NO: 2485791 - RNA, 19 nt, Human
ugcauaaauaugcagugau

SEQ ID NO: 2485792 - RNA, 15 nt, Human
ugcauaaauaugcag

SEQ ID NO: 2485793 - RNA, 14 nt, Human
ugcauaaauaugca

SEQ ID NO: 2485794 - RNA, 17 nt, Human
ugcauaacaauuccucu

SEQ ID NO: 2485795 - RNA, 18 nt, Human
ugcauaacaauuccucua

SEQ ID NO: 2485796 - RNA, 19 nt, Human
ugcauaauaagcuaaagag

SEQ ID NO: 2485797 - RNA, 22 nt, Human
ugcauaauaagcuaaagaggcu

SEQ ID NO: 2485798 - RNA, 20 nt, Human
ugcaggucccuaauaaagcu

SEQ ID NO: 2485799 - RNA, 19 nt, Human
ugcaggucccuaauaaagc

SEQ ID NO: 2485800 - RNA, 16 nt, Human
ugcagcuucuguccug

SEQ ID NO: 2485801 - RNA, 18 nt, Human
ugcaggucccuaauaaag

SEQ ID NO: 2485802 - RNA, 14 nt, Human
ugcagugagccgag

SEQ ID NO: 2485803 - RNA, 17 nt, Human
ugcaggucccuaauaaa

SEQ ID NO: 2485804 - RNA, 21 nt, Human
ugcaggucccuaauaaagcug

SEQ ID NO: 2485805 - RNA, 13 nt, Human
ugcagucugggug

SEQ ID NO: 2485806 - RNA, 18 nt, Human
ugcagugacgugcaccug

SEQ ID NO: 2485807 - RNA, 19 nt, Human
ugcagugacgugcaccugu

SEQ ID NO: 2485808 - RNA, 13 nt, Human
ugcagugaauugu

SEQ ID NO: 2485809 - RNA, 12 nt, Human
agccugcagagc

SEQ ID NO: 2485810 - RNA, 13 nt, Human
agccugcagagcu

SEQ ID NO: 2485811 - RNA, 14 nt, Human
agccugcagagcug

SEQ ID NO: 2485812 - RNA, 15 nt, Human
agccugcagagcugc

SEQ ID NO: 2485813 - RNA, 21 nt, Human
agccugcaauuucauaugcug

SEQ ID NO: 2485814 - RNA, 19 nt, Human
agccugcaaacucacugcu

SEQ ID NO: 2485815 - RNA, 18 nt, Human
agccugcaaacucacugc

SEQ ID NO: 2485816 - RNA, 21 nt, Human
agccugcaacucaucuuucau

SEQ ID NO: 2485817 - RNA, 16 nt, Human
ugcaugcugucccuua

SEQ ID NO: 2485818 - RNA, 18 nt, Human
agccugagucuccugugc

SEQ ID NO: 2485819 - RNA, 17 nt, Human
agccugagucuccugug

SEQ ID NO: 2485820 - RNA, 16 nt, Human
agccugagucuccugu

SEQ ID NO: 2485821 - RNA, 14 nt, Human
ugcaugauguauuu

SEQ ID NO: 2485822 - RNA, 18 nt, Human
agccugaucaccugcccu

SEQ ID NO: 2485823 - RNA, 17 nt, Human
agccugcaaacucacug

SEQ ID NO: 2485824 - RNA, 19 nt, Human
agccugcaauuucauaugc

SEQ ID NO: 2485825 - RNA, 19 nt, Human
agccugaucaccugcccug

SEQ ID NO: 2485826 - RNA, 21 nt, Human
agccugcaggguggugcuggg

SEQ ID NO: 2485827 - RNA, 19 nt, Human
agccugcaggguggugcug

SEQ ID NO: 2485828 - RNA, 18 nt, Human
agccugcaggguggugcu

SEQ ID NO: 2485829 - RNA, 12 nt, Human
agccugcagggu

SEQ ID NO: 2485830 - RNA, 15 nt, Human
agccugagucuccug

SEQ ID NO: 2485831 - RNA, 22 nt, Human
agccugcaggugcugcugcgug

SEQ ID NO: 2485832 - RNA, 20 nt, Human
agccugcaggugcugcugcg

SEQ ID NO: 2485833 - RNA, 19 nt, Human
agccugcaggugcugcugc

SEQ ID NO: 2485834 - RNA, 18 nt, Human
agccugcaggugcugcug

SEQ ID NO: 2485835 - RNA, 17 nt, Human
agccugcaggugcugcu

SEQ ID NO: 2485836 - RNA, 15 nt, Human
agccugcaggugcug

SEQ ID NO: 2485837 - RNA, 23 nt, Human
agccugcaggguggugcugggac

SEQ ID NO: 2485838 - RNA, 22 nt, Human
agccugcaggguggugcuggga

SEQ ID NO: 2485839 - RNA, 23 nt, Human
agccugcaguuauuaacacuaac

SEQ ID NO: 2485840 - RNA, 18 nt, Human
agccugccacucaggccc

SEQ ID NO: 2485841 - RNA, 12 nt, Human
agccugcccucc

SEQ ID NO: 2485842 - RNA, 16 nt, Human
agccugccucuucucu

SEQ ID NO: 2485843 - RNA, 19 nt, Human
agccugccucuucucuacu

SEQ ID NO: 2485844 - RNA, 21 nt, Human
ugcaugaggcuaguguggugu

SEQ ID NO: 2485845 - RNA, 22 nt, Human
ugcaugaaguaauaugcacaca

SEQ ID NO: 2485846 - RNA, 20 nt, Human
ugcaugaaguaauaugcaca

SEQ ID NO: 2485847 - RNA, 22 nt, Human
ugcaucuguauaaguaagaaaa

SEQ ID NO: 2485848 - RNA, 21 nt, Human
ugcaucuguauaaguaagaaa

SEQ ID NO: 2485849 - RNA, 20 nt, Human
ugcaucuguauaaguaagaa

SEQ ID NO: 2485850 - RNA, 11 nt, Human
ugcaucuguau

SEQ ID NO: 2485851 - RNA, 20 nt, Human
ugcaucuggguagcuguaag

SEQ ID NO: 2485852 - RNA, 21 nt, Human
ugcaucuggguagcuguaagg

SEQ ID NO: 2485853 - RNA, 15 nt, Human
ugcaugcugucccuu

SEQ ID NO: 2485854 - RNA, 14 nt, Human
ugcaugcugucccu

SEQ ID NO: 2485855 - RNA, 13 nt, Human
ugcaugcuguccc

SEQ ID NO: 2485856 - RNA, 21 nt, Human
ugcaugagcuacgccugccuc

SEQ ID NO: 2485857 - RNA, 23 nt, Human
ugcaucuguauaaguaagaaaau

SEQ ID NO: 2485858 - RNA, 19 nt, Human
ugcaugaauaaaauuauuc

SEQ ID NO: 2485859 - RNA, 15 nt, Human
ugcaugagcuuuuau

SEQ ID NO: 2485860 - RNA, 22 nt, Human
ugcaugagcuacgccugccucc

SEQ ID NO: 2485861 - RNA, 15 nt, Human
ugcaucucagcccac

SEQ ID NO: 2485862 - RNA, 13 nt, Human
ugcaucuccaccu

SEQ ID NO: 2485863 - RNA, 13 nt, Human
ugcauacacacac

SEQ ID NO: 2485864 - RNA, 14 nt, Human
ugcaucuccaccug

SEQ ID NO: 2485865 - RNA, 13 nt, Human
ugcaucucccaga

SEQ ID NO: 2485866 - RNA, 18 nt, Human
ugcaucucccagauaaug

SEQ ID NO: 2485867 - RNA, 15 nt, Human
ugcaucugaccagca

SEQ ID NO: 2485868 - RNA, 17 nt, Human
ugcaucugaccagcagc

SEQ ID NO: 2485869 - RNA, 22 nt, Human
ugcaucugaccagcagcgccuu

SEQ ID NO: 2485870 - RNA, 18 nt, Human
ugcaucugaccagcagcg

SEQ ID NO: 2485871 - RNA, 21 nt, Human
ugcaucugaccagcagcgccu

SEQ ID NO: 2485872 - RNA, 23 nt, Human
ugcaucugggauucccaccaagg

SEQ ID NO: 2485873 - RNA, 20 nt, Human
ugcaucugggauucccacca

SEQ ID NO: 2485874 - RNA, 19 nt, Human
ugcaucugggauucccacc

SEQ ID NO: 2485875 - RNA, 18 nt, Human
ugcaucuggguagcugua

SEQ ID NO: 2485876 - RNA, 19 nt, Human
ugcaucuggguagcuguaa

SEQ ID NO: 2485877 - RNA, 12 nt, Human
ugcauacacaca

SEQ ID NO: 2485878 - RNA, 22 nt, Human
ugcauaccacuuuuguucuugg

SEQ ID NO: 2485879 - RNA, 10 nt, Human
ugcauacaca

SEQ ID NO: 2485880 - RNA, 11 nt, Human
ugcauacacac

SEQ ID NO: 2485881 - RNA, 21 nt, Human
ugcauaccacuuuuguucuug

SEQ ID NO: 2485882 - RNA, 9 nt, Human
ugcauacac

SEQ ID NO: 2485883 - RNA, 23 nt, Human
ugcacaagcuccaagcucccagg

SEQ ID NO: 2485884 - RNA, 22 nt, Human
ugcacaagcuccaagcucccag

SEQ ID NO: 2485885 - RNA, 20 nt, Human
ugcacaagcuccaagcuccc

SEQ ID NO: 2485886 - RNA, 18 nt, Human
ugcacaagcuccaagcuc

SEQ ID NO: 2485887 - RNA, 16 nt, Human
ugcacaagcuccaagc

SEQ ID NO: 2485888 - RNA, 15 nt, Human
ugcacaagcuccaag

SEQ ID NO: 2485889 - RNA, 21 nt, Human
ugcacaaccaucugucccugc

SEQ ID NO: 2485890 - RNA, 18 nt, Human
agcagcaccguucugugc

SEQ ID NO: 2485891 - RNA, 14 nt, Human
ugcacaacauuaca

SEQ ID NO: 2485892 - RNA, 23 nt, Human
ugcacaugaaucccacccacaug

SEQ ID NO: 2485893 - RNA, 12 nt, Human
ugcacaugucuu

SEQ ID NO: 2485894 - RNA, 21 nt, Human
ugcacaugacucggggguggg

SEQ ID NO: 2485895 - RNA, 19 nt, Human
ugcacaauauugaacuuuu

SEQ ID NO: 2485896 - RNA, 17 nt, Human
ugcacaauauugaacuu

SEQ ID NO: 2485897 - RNA, 15 nt, Human
ugcacacaccagagc

SEQ ID NO: 2485898 - RNA, 15 nt, Human
ugcacaauaaaaaug

SEQ ID NO: 2485899 - RNA, 20 nt, Human
ugcacaauaaaaauguuuaa

SEQ ID NO: 2485900 - RNA, 21 nt, Human
ugcacaauaaaaauguuuaac

SEQ ID NO: 2485901 - RNA, 14 nt, Human
ugcacaagcugcac

SEQ ID NO: 2485902 - RNA, 13 nt, Human
ugcacuccccugc

SEQ ID NO: 2485903 - RNA, 12 nt, Human
ugcacuccccug

SEQ ID NO: 2485904 - RNA, 16 nt, Human
ugcacuacugacaugu

SEQ ID NO: 2485905 - RNA, 15 nt, Human
ugcacuacugacaug

SEQ ID NO: 2485906 - RNA, 22 nt, Human
ugcacuauagccuaggugacag

SEQ ID NO: 2485907 - RNA, 18 nt, Human
ugcacuacugacaugugg

SEQ ID NO: 2485908 - RNA, 19 nt, Human
ugcacuccagccugggcga

SEQ ID NO: 2485909 - RNA, 17 nt, Human
ugcacuaaggggcccgg

SEQ ID NO: 2485910 - RNA, 22 nt, Human
ugcacuaaggggcccggccagc

SEQ ID NO: 2485911 - RNA, 23 nt, Human
ugcacuaaggggcccggccagcc

SEQ ID NO: 2485912 - RNA, 15 nt, Human
ugcacuaaggggccc

SEQ ID NO: 2485913 - RNA, 23 nt, Human
ugcacuacuccucugcagugccu

SEQ ID NO: 2485914 - RNA, 19 nt, Human
ugcacuacuccucugcagu

SEQ ID NO: 2485915 - RNA, 14 nt, Human
ugcacuacugacau

SEQ ID NO: 2485916 - RNA, 18 nt, Human
ugcacuacuccucugcag

SEQ ID NO: 2485917 - RNA, 16 nt, Human
ugcacuacuccucugc

SEQ ID NO: 2485918 - RNA, 15 nt, Human
ugcacuacuccucug

SEQ ID NO: 2485919 - RNA, 18 nt, Human
ugcacuaaaguauguaaa

SEQ ID NO: 2485920 - RNA, 20 nt, Human
ugcacguuaugguguuucuc

SEQ ID NO: 2485921 - RNA, 16 nt, Human
ugcacguggccucuug

SEQ ID NO: 2485922 - RNA, 15 nt, Human
ugcacguggccucuu

SEQ ID NO: 2485923 - RNA, 14 nt, Human
ugcacguggccucu

SEQ ID NO: 2485924 - RNA, 23 nt, Human
ugcacguggcauguggccugugg

SEQ ID NO: 2485925 - RNA, 16 nt, Human
ugcacguggcaugugg

SEQ ID NO: 2485926 - RNA, 21 nt, Human
ugcacguggagagcuggugcc

SEQ ID NO: 2485927 - RNA, 15 nt, Human
ugcacaugucuuaau

SEQ ID NO: 2485928 - RNA, 14 nt, Human
ugcacaugucuuaa

SEQ ID NO: 2485929 - RNA, 16 nt, Human
ugcacaugucuuaaug

SEQ ID NO: 2485930 - RNA, 15 nt, Human
ugcacaugucuugua

SEQ ID NO: 2485931 - RNA, 23 nt, Human
ugcaccaacccagccgcugcccg

SEQ ID NO: 2485932 - RNA, 22 nt, Human
ugcaccaacccagccgcugccc

SEQ ID NO: 2485933 - RNA, 14 nt, Human
ugcaccaagcagga

SEQ ID NO: 2485934 - RNA, 20 nt, Human
ugcaccaacccagccgcugc

SEQ ID NO: 2485935 - RNA, 19 nt, Human
ugcaccaacccagccgcug

SEQ ID NO: 2485936 - RNA, 19 nt, Human
ugcacaugucuuguacaug

SEQ ID NO: 2485937 - RNA, 15 nt, Human
ugcaccaccaagcca

SEQ ID NO: 2485938 - RNA, 14 nt, Human
ugcaccaccaagcc

SEQ ID NO: 2485939 - RNA, 12 nt, Human
ugcaccaccaag

SEQ ID NO: 2485940 - RNA, 22 nt, Human
ugcaccaagcaggaaaugaaaa

SEQ ID NO: 2485941 - RNA, 14 nt, Human
ugcaccacugcacu

SEQ ID NO: 2485942 - RNA, 19 nt, Human
ugcacguacacacacauac

SEQ ID NO: 2485943 - RNA, 18 nt, Human
ugcaccaccaagccaagg

SEQ ID NO: 2485944 - RNA, 16 nt, Human
ugcaccaccaagccaa

SEQ ID NO: 2485945 - RNA, 19 nt, Human
ugcaccaccaagccaaggg

SEQ ID NO: 2485946 - RNA, 19 nt, Human
ugcacguaguagggucagg

SEQ ID NO: 2485947 - RNA, 16 nt, Human
ugcacguggagagcug

SEQ ID NO: 2485948 - RNA, 17 nt, Human
ugcacguggagagcugg

SEQ ID NO: 2485949 - RNA, 18 nt, Human
ugcacguggagagcuggu

SEQ ID NO: 2485950 - RNA, 20 nt, Human
ugcacguggagagcuggugc

SEQ ID NO: 2485951 - RNA, 12 nt, Human
ugcacguggaga

SEQ ID NO: 2485952 - RNA, 22 nt, Human
ugcacguaguagggucaggcca

SEQ ID NO: 2485953 - RNA, 15 nt, Human
ugcacgucaugggag

SEQ ID NO: 2485954 - RNA, 18 nt, Human
ugcagacucuacagaggc

SEQ ID NO: 2485955 - RNA, 20 nt, Human
ugcagacucuacagaggcca

SEQ ID NO: 2485956 - RNA, 19 nt, Human
ugcagacucuacagaggcc

SEQ ID NO: 2485957 - RNA, 15 nt, Human
ugcacuccccugcug

SEQ ID NO: 2485958 - RNA, 13 nt, Human
ugcagaaaacauu

SEQ ID NO: 2485959 - RNA, 12 nt, Human
ugcagaaaacau

SEQ ID NO: 2485960 - RNA, 15 nt, Human
ugcagaaaacauugu

SEQ ID NO: 2485961 - RNA, 14 nt, Human
ugcagaaaacauug

SEQ ID NO: 2485962 - RNA, 16 nt, Human
ugcagaaaacauuguu

SEQ ID NO: 2485963 - RNA, 16 nt, Human
ugcagaaaagcaccug

SEQ ID NO: 2485964 - RNA, 21 nt, Human
ugcagaaaagcaccugccgac

SEQ ID NO: 2485965 - RNA, 22 nt, Human
ugcagaaaagcaccugccgacc

SEQ ID NO: 2485966 - RNA, 17 nt, Human
ugcagaaaagcaccugc

SEQ ID NO: 2485967 - RNA, 18 nt, Human
ugcagaaaagcaccugcc

SEQ ID NO: 2485968 - RNA, 19 nt, Human
ugcagaaaagcaccugccg

SEQ ID NO: 2485969 - RNA, 20 nt, Human
ugcagaaaagcaccugccga

SEQ ID NO: 2485970 - RNA, 14 nt, Human
agcccuucauuugg

SEQ ID NO: 2485971 - RNA, 13 nt, Human
agcccuucauuug

SEQ ID NO: 2485972 - RNA, 22 nt, Human
ugcagagagccauuuugugaau

SEQ ID NO: 2485973 - RNA, 21 nt, Human
ugcagagagccauuuugugaa

SEQ ID NO: 2485974 - RNA, 23 nt, Human
ugcagagagccauuuugugaaug

SEQ ID NO: 2485975 - RNA, 23 nt, Human
agcccuuccaugucgccucugca

SEQ ID NO: 2485976 - RNA, 22 nt, Human
agcccuuccaugucgccucugc

SEQ ID NO: 2485977 - RNA, 19 nt, Human
agcccuuccaugucgccuc

SEQ ID NO: 2485978 - RNA, 22 nt, Human
ugcagacucuacagaggccaug

SEQ ID NO: 2485979 - RNA, 22 nt, Human
ugcagacugcugcuagagccag

SEQ ID NO: 2485980 - RNA, 13 nt, Human
ugcagacuggagg

SEQ ID NO: 2485981 - RNA, 17 nt, Human
ugcagacuggaggggac

SEQ ID NO: 2485982 - RNA, 14 nt, Human
ugcagacuggaggg

SEQ ID NO: 2485983 - RNA, 16 nt, Human
ugcagacuggagggga

SEQ ID NO: 2485984 - RNA, 18 nt, Human
ugcagagagccauuuugu

SEQ ID NO: 2485985 - RNA, 17 nt, Human
ugcagagagccauuuug

SEQ ID NO: 2485986 - RNA, 16 nt, Human
ugcagagagccauuuu

SEQ ID NO: 2485987 - RNA, 15 nt, Human
ugcagagagccauuu

SEQ ID NO: 2485988 - RNA, 15 nt, Human
ugcagagagaagccu

SEQ ID NO: 2485989 - RNA, 14 nt, Human
ugcagagagaagcc

SEQ ID NO: 2485990 - RNA, 13 nt, Human
ugcagagagaagc

SEQ ID NO: 2485991 - RNA, 17 nt, Human
ugcagagacaggaccug

SEQ ID NO: 2485992 - RNA, 20 nt, Human
ugcagagacaggaccugacu

SEQ ID NO: 2485993 - RNA, 24 nt, Human
ugcagagacagagaggacgugggc

SEQ ID NO: 2485994 - RNA, 19 nt, Human
agcccuucuuuccacagaa

SEQ ID NO: 2485995 - RNA, 18 nt, Human
agcccuucuuuccacaga

SEQ ID NO: 2485996 - RNA, 23 nt, Human
agccguuuguuccccaagacauu

SEQ ID NO: 2485997 - RNA, 19 nt, Human
agccguuuguuccccaaga

SEQ ID NO: 2485998 - RNA, 20 nt, Human
agcccuugagcuccccaaaa

SEQ ID NO: 2485999 - RNA, 16 nt, Human
agcccuugaagauauc

SEQ ID NO: 2486000 - RNA, 18 nt, Human
agcccuuaucugugcuca

SEQ ID NO: 2486001 - RNA, 17 nt, Human
agcccuugagcucccca

SEQ ID NO: 2486002 - RNA, 15 nt, Human
agccuaauacaacau

SEQ ID NO: 2486003 - RNA, 18 nt, Human
agccuaagaugaagagga

SEQ ID NO: 2486004 - RNA, 15 nt, Human
agccuaaucccuggg

SEQ ID NO: 2486005 - RNA, 22 nt, Human
agccuaaucccugggcauugcu

SEQ ID NO: 2486006 - RNA, 14 nt, Human
agccuaggggucag

SEQ ID NO: 2486007 - RNA, 23 nt, Human
agccuaaucccugggcauugcuu

SEQ ID NO: 2486008 - RNA, 17 nt, Human
agccuaggugacagagu

SEQ ID NO: 2486009 - RNA, 15 nt, Human
agccuaggugacaga

SEQ ID NO: 2486010 - RNA, 20 nt, Human
agccuagugaaggcuucucu

SEQ ID NO: 2486011 - RNA, 14 nt, Human
agccuaguucaucc

SEQ ID NO: 2486012 - RNA, 15 nt, Human
agccuaguucaucca

SEQ ID NO: 2486013 - RNA, 17 nt, Human
agccuaguucauccaau

SEQ ID NO: 2486014 - RNA, 20 nt, Human
agccuaguucauccaauccu

SEQ ID NO: 2486015 - RNA, 23 nt, Human
agccuaguucauccaauccucac

SEQ ID NO: 2486016 - RNA, 23 nt, Human
agccuagugaaggcuucucucug

SEQ ID NO: 2486017 - RNA, 14 nt, Human
agccuagugaaggc

SEQ ID NO: 2486018 - RNA, 20 nt, Human
agccuaggggucagggacca

SEQ ID NO: 2486019 - RNA, 23 nt, Human
agccuaggggucagggaccaagg

SEQ ID NO: 2486020 - RNA, 15 nt, Human
agccucaaccuccug

SEQ ID NO: 2486021 - RNA, 17 nt, Human
agccuaucaaagaccuu

SEQ ID NO: 2486022 - RNA, 14 nt, Human
agccuauauuuaca

SEQ ID NO: 2486023 - RNA, 22 nt, Human
agccuaguucauccaauccuca

SEQ ID NO: 2486024 - RNA, 18 nt, Human
agccuauauuuacaguga

SEQ ID NO: 2486025 - RNA, 19 nt, Human
ugccauagucacauggccu

SEQ ID NO: 2486026 - RNA, 18 nt, Human
ugccauagucacauggcc

SEQ ID NO: 2486027 - RNA, 15 nt, Human
ugccauauucuguug

SEQ ID NO: 2486028 - RNA, 17 nt, Human
ugccauauucuguuggc

SEQ ID NO: 2486029 - RNA, 16 nt, Human
ugccauauucuguugg

SEQ ID NO: 2486030 - RNA, 23 nt, Human
ugccagucaccccggccaccugc

SEQ ID NO: 2486031 - RNA, 22 nt, Human
ugccagucaccccggccaccug

SEQ ID NO: 2486032 - RNA, 17 nt, Human
ugccagucccccugccc

SEQ ID NO: 2486033 - RNA, 20 nt, Human
ugccacuucacuccagccug

SEQ ID NO: 2486034 - RNA, 19 nt, Human
ugccagucccccugcccca

SEQ ID NO: 2486035 - RNA, 20 nt, Human
ugccagucaccccggccacc

SEQ ID NO: 2486036 - RNA, 18 nt, Human
ugccagucaccccggcca

SEQ ID NO: 2486037 - RNA, 16 nt, Human
ugccagucaccccggc

SEQ ID NO: 2486038 - RNA, 15 nt, Human
ugccagucaccccgg

SEQ ID NO: 2486039 - RNA, 16 nt, Human
ugccacuucccaggua

SEQ ID NO: 2486040 - RNA, 21 nt, Human
ugccacugccuucgcuucuug

SEQ ID NO: 2486041 - RNA, 19 nt, Human
ugccacugccuucgcuucu

SEQ ID NO: 2486042 - RNA, 22 nt, Human
ugccacugccuucgcuucuugc

SEQ ID NO: 2486043 - RNA, 12 nt, Human
ugccacacuuca

SEQ ID NO: 2486044 - RNA, 23 nt, Human
ugccacugccucuuccucccuca

SEQ ID NO: 2486045 - RNA, 23 nt, Human
agcgugguggacaugcacagcua

SEQ ID NO: 2486046 - RNA, 23 nt, Human
agcgugucuguauuuauguguga

SEQ ID NO: 2486047 - RNA, 21 nt, Human
agcuacucaagaggcugaggc

SEQ ID NO: 2486048 - RNA, 14 nt, Human
agcuacucagaagc

SEQ ID NO: 2486049 - RNA, 15 nt, Human
agcuacucagaagcc

SEQ ID NO: 2486050 - RNA, 18 nt, Human
agcuacucagaagccuga

SEQ ID NO: 2486051 - RNA, 19 nt, Human
agcuacucagaagccugag

SEQ ID NO: 2486052 - RNA, 20 nt, Human
agcuacucagaagccugagg

SEQ ID NO: 2486053 - RNA, 15 nt, Human
agcguggacaggugu

SEQ ID NO: 2486054 - RNA, 20 nt, Human
agcgugcuccagccuggcuc

SEQ ID NO: 2486055 - RNA, 19 nt, Human
agcgugcuccagccuggcu

SEQ ID NO: 2486056 - RNA, 17 nt, Human
agcgugcuuuaaaaaau

SEQ ID NO: 2486057 - RNA, 20 nt, Human
agcgugguggacaugcacag

SEQ ID NO: 2486058 - RNA, 17 nt, Human
agcgugagccacugcac

SEQ ID NO: 2486059 - RNA, 16 nt, Human
agcgugagccacugca

SEQ ID NO: 2486060 - RNA, 21 nt, Human
ugccauauucuguuggccagu

SEQ ID NO: 2486061 - RNA, 20 nt, Human
ugccauauucuguuggccag

SEQ ID NO: 2486062 - RNA, 19 nt, Human
ugccauauugcacaugucu

SEQ ID NO: 2486063 - RNA, 16 nt, Human
ugccauauugcacaug

SEQ ID NO: 2486064 - RNA, 15 nt, Human
ugccauauugcacau

SEQ ID NO: 2486065 - RNA, 15 nt, Human
agcggggacagcucc

SEQ ID NO: 2486066 - RNA, 17 nt, Human
agcggggacagcuccuu

SEQ ID NO: 2486067 - RNA, 16 nt, Human
agcggggacagcuccu

SEQ ID NO: 2486068 - RNA, 15 nt, Human
agcgugagccacugc

SEQ ID NO: 2486069 - RNA, 13 nt, Human
agcgggcgccugu

SEQ ID NO: 2486070 - RNA, 13 nt, Human
agcgugagccacu

SEQ ID NO: 2486071 - RNA, 19 nt, Human
ugcauuugaaaauuuugau

SEQ ID NO: 2486072 - RNA, 23 nt, Human
ugcauuugaaaauuuugauguuu

SEQ ID NO: 2486073 - RNA, 14 nt, Human
ugcauuucucuggg

SEQ ID NO: 2486074 - RNA, 14 nt, Human
ugcauuuccugaca

SEQ ID NO: 2486075 - RNA, 19 nt, Human
ugcauugaacacaaacugu

SEQ ID NO: 2486076 - RNA, 21 nt, Human
ugcauugaacacaaacuguaa

SEQ ID NO: 2486077 - RNA, 13 nt, Human
ugcauuuccugac

SEQ ID NO: 2486078 - RNA, 21 nt, Human
ugcauucuuuuaaaagacaag

SEQ ID NO: 2486079 - RNA, 16 nt, Human
ugcauucuuuuaaaag

SEQ ID NO: 2486080 - RNA, 22 nt, Human
ugcauucuuuuaaaagacaaga

SEQ ID NO: 2486081 - RNA, 13 nt, Human
ugcauugaacaca

SEQ ID NO: 2486082 - RNA, 14 nt, Human
ugcauugaacacaa

SEQ ID NO: 2486083 - RNA, 15 nt, Human
ugcauugaacacaaa

SEQ ID NO: 2486084 - RNA, 17 nt, Human
ugcauugaacacaaacu

SEQ ID NO: 2486085 - RNA, 18 nt, Human
ugcauugaacacaaacug

SEQ ID NO: 2486086 - RNA, 20 nt, Human
agcggcuggaauuggguggg

SEQ ID NO: 2486087 - RNA, 17 nt, Human
agcggcuggacuuggag

SEQ ID NO: 2486088 - RNA, 16 nt, Human
ugcauucuuucuguau

SEQ ID NO: 2486089 - RNA, 20 nt, Human
ugcauucuugguuggcuggc

SEQ ID NO: 2486090 - RNA, 21 nt, Human
agcggcugagucaugaucucc

SEQ ID NO: 2486091 - RNA, 19 nt, Human
ugccaauauguauuguaaa

SEQ ID NO: 2486092 - RNA, 16 nt, Human
ugccaauauguauugu

SEQ ID NO: 2486093 - RNA, 18 nt, Human
ugccaauauuaaaucugc

SEQ ID NO: 2486094 - RNA, 19 nt, Human
ugccacaaggacuuccugu

SEQ ID NO: 2486095 - RNA, 16 nt, Human
ugccacaaggacuucc

SEQ ID NO: 2486096 - RNA, 14 nt, Human
ugccacacaaacgu

SEQ ID NO: 2486097 - RNA, 22 nt, Human
ugccacacaaggauagaugcug

SEQ ID NO: 2486098 - RNA, 13 nt, Human
ugccacacagagu

SEQ ID NO: 2486099 - RNA, 20 nt, Human
ugccacacagaguggucuuu

SEQ ID NO: 2486100 - RNA, 19 nt, Human
ugccacaccaagcugugcc

SEQ ID NO: 2486101 - RNA, 23 nt, Human
ugccacacagaguggucuuucug

SEQ ID NO: 2486102 - RNA, 23 nt, Human
ugccacaccaagcugugccaccc

SEQ ID NO: 2486103 - RNA, 22 nt, Human
ugccacaccaagcugugccacc

SEQ ID NO: 2486104 - RNA, 21 nt, Human
ugccacaccaagcugugccac

SEQ ID NO: 2486105 - RNA, 20 nt, Human
ugccacaccaagcugugcca

SEQ ID NO: 2486106 - RNA, 13 nt, Human
ugccacacccucc

SEQ ID NO: 2486107 - RNA, 22 nt, Human
ugccacacccucccccgccacu

SEQ ID NO: 2486108 - RNA, 14 nt, Human
ugccacacccuccc

SEQ ID NO: 2486109 - RNA, 16 nt, Human
ugccacacgucugacc

SEQ ID NO: 2486110 - RNA, 15 nt, Human
ugccaauauguauug

SEQ ID NO: 2486111 - RNA, 13 nt, Human
ugcauuugagguc

SEQ ID NO: 2486112 - RNA, 22 nt, Human
agcgcccaguuggguggaugcc

SEQ ID NO: 2486113 - RNA, 14 nt, Human
agcgcccaguuggg

SEQ ID NO: 2486114 - RNA, 12 nt, Human
agcgccaggcug

SEQ ID NO: 2486115 - RNA, 21 nt, Human
agcgccaggcugaccacagca

SEQ ID NO: 2486116 - RNA, 20 nt, Human
agcgcccacuagacccacug

SEQ ID NO: 2486117 - RNA, 18 nt, Human
agcgccagccugucccau

SEQ ID NO: 2486118 - RNA, 18 nt, Human
agccugcggccugcugga

SEQ ID NO: 2486119 - RNA, 14 nt, Human
agccugcccuuguc

SEQ ID NO: 2486120 - RNA, 13 nt, Human
agccugcccuugu

SEQ ID NO: 2486121 - RNA, 23 nt, Human
agccugcccuugucugagaugcu

SEQ ID NO: 2486122 - RNA, 17 nt, Human
agccugcccuugucuga

SEQ ID NO: 2486123 - RNA, 13 nt, Human
agccugccuggag

SEQ ID NO: 2486124 - RNA, 21 nt, Human
agccugcgccaccgcccagag

SEQ ID NO: 2486125 - RNA, 14 nt, Human
agccugccuggagc

SEQ ID NO: 2486126 - RNA, 15 nt, Human
agccugccuggagcg

SEQ ID NO: 2486127 - RNA, 14 nt, Human
agccugccuggcag

SEQ ID NO: 2486128 - RNA, 22 nt, Human
agcgcgccacucgcuuccccca

SEQ ID NO: 2486129 - RNA, 12 nt, Human
agcgcgccacuc

SEQ ID NO: 2486130 - RNA, 19 nt, Human
agcgcgccacucgcuuccc

SEQ ID NO: 2486131 - RNA, 20 nt, Human
agcgcgccacucgcuucccc

SEQ ID NO: 2486132 - RNA, 21 nt, Human
agcgcuccugccgcagagcug

SEQ ID NO: 2486133 - RNA, 20 nt, Human
agcgcuccugccgcagagcu

SEQ ID NO: 2486134 - RNA, 17 nt, Human
agcgcuccugccgcaga

SEQ ID NO: 2486135 - RNA, 18 nt, Human
agcggccccucccacaca

SEQ ID NO: 2486136 - RNA, 14 nt, Human
agcggccccuccca

SEQ ID NO: 2486137 - RNA, 13 nt, Human
agcggccccuccc

SEQ ID NO: 2486138 - RNA, 12 nt, Human
agcggccccucc

SEQ ID NO: 2486139 - RNA, 22 nt, Human
agcgcuccugccgcagagcugg

SEQ ID NO: 2486140 - RNA, 17 nt, Human
agcgcugccgcacccca

SEQ ID NO: 2486141 - RNA, 18 nt, Human
agcgcugccgcaccccag

SEQ ID NO: 2486142 - RNA, 11 nt, Human
agcggccggcc

SEQ ID NO: 2486143 - RNA, 18 nt, Human
agcggccggccagccccu

SEQ ID NO: 2486144 - RNA, 23 nt, Human
agcggccccuugacucuggggac

SEQ ID NO: 2486145 - RNA, 20 nt, Human
agcggccccuugacucuggg

SEQ ID NO: 2486146 - RNA, 22 nt, Human
agcggccggccagccccuggcc

SEQ ID NO: 2486147 - RNA, 16 nt, Human
agcggcugagucauga

SEQ ID NO: 2486148 - RNA, 19 nt, Human
agcggcugagucaugaucu

SEQ ID NO: 2486149 - RNA, 16 nt, Human
ugccccgucccccucu

SEQ ID NO: 2486150 - RNA, 18 nt, Human
ugccccgucccccucugg

SEQ ID NO: 2486151 - RNA, 16 nt, Human
ugccccgugcagacug

SEQ ID NO: 2486152 - RNA, 18 nt, Human
ugccccgugcagacugga

SEQ ID NO: 2486153 - RNA, 22 nt, Human
ugccccguccacggcucuaggu

SEQ ID NO: 2486154 - RNA, 20 nt, Human
ugccccgucaccaucucagg

SEQ ID NO: 2486155 - RNA, 21 nt, Human
ugccccgucaccaucucaggc

SEQ ID NO: 2486156 - RNA, 22 nt, Human
ugcccccugguggacaguccug

SEQ ID NO: 2486157 - RNA, 12 nt, Human
ugcccccuucuc

SEQ ID NO: 2486158 - RNA, 13 nt, Human
ugcccccuucucc

SEQ ID NO: 2486159 - RNA, 15 nt, Human
ugcccccuucuccca

SEQ ID NO: 2486160 - RNA, 16 nt, Human
ugcccccuucucccac

SEQ ID NO: 2486161 - RNA, 17 nt, Human
ugcccccuucucccaca

SEQ ID NO: 2486162 - RNA, 18 nt, Human
ugcccccuucucccacac

SEQ ID NO: 2486163 - RNA, 19 nt, Human
ugcccccuucucccacacu

SEQ ID NO: 2486164 - RNA, 20 nt, Human
ugcccccuucucccacacug

SEQ ID NO: 2486165 - RNA, 22 nt, Human
ugcccccuucucccacacugcu

SEQ ID NO: 2486166 - RNA, 17 nt, Human
ugccccgucaccaucuc

SEQ ID NO: 2486167 - RNA, 18 nt, Human
ugccccgucaccaucuca

SEQ ID NO: 2486168 - RNA, 19 nt, Human
ugccccgucaccaucucag

SEQ ID NO: 2486169 - RNA, 16 nt, Human
ugccccuagcuuagag

SEQ ID NO: 2486170 - RNA, 17 nt, Human
ugcccuagagcacacug

SEQ ID NO: 2486171 - RNA, 23 nt, Human
ugccccuagcuuagagccucccu

SEQ ID NO: 2486172 - RNA, 21 nt, Human
ugccccgugcagacuggaggg

SEQ ID NO: 2486173 - RNA, 23 nt, Human
ugcccuagagcacacuguagcau

SEQ ID NO: 2486174 - RNA, 13 nt, Human
ugcccuagcucca

SEQ ID NO: 2486175 - RNA, 14 nt, Human
ugcccuagcuccac

SEQ ID NO: 2486176 - RNA, 14 nt, Human
ugcccuaggcuccg

SEQ ID NO: 2486177 - RNA, 23 nt, Human
ugcccucauggccccucugaccu

SEQ ID NO: 2486178 - RNA, 19 nt, Human
ugcccucauggccccucug

SEQ ID NO: 2486179 - RNA, 17 nt, Human
ugcccucauggccccuc

SEQ ID NO: 2486180 - RNA, 12 nt, Human
ugcccucaggga

SEQ ID NO: 2486181 - RNA, 12 nt, Human
ugcccucagggg

SEQ ID NO: 2486182 - RNA, 16 nt, Human
ugcccucaaucccagc

SEQ ID NO: 2486183 - RNA, 18 nt, Human
ugcccuaggcuccgucag

SEQ ID NO: 2486184 - RNA, 14 nt, Human
ugcccccagggcac

SEQ ID NO: 2486185 - RNA, 16 nt, Human
ugcccccagcuggccc

SEQ ID NO: 2486186 - RNA, 19 nt, Human
ugcccccaggacugggcca

SEQ ID NO: 2486187 - RNA, 17 nt, Human
ugcccccaggacugggc

SEQ ID NO: 2486188 - RNA, 16 nt, Human
ugcccccaggacuggg

SEQ ID NO: 2486189 - RNA, 15 nt, Human
ugcccccaggacugg

SEQ ID NO: 2486190 - RNA, 14 nt, Human
ugcccccaggacug

SEQ ID NO: 2486191 - RNA, 13 nt, Human
ugcccccaggacu

SEQ ID NO: 2486192 - RNA, 12 nt, Human
ugcccccaggac

SEQ ID NO: 2486193 - RNA, 12 nt, Human
ugccccccagcc

SEQ ID NO: 2486194 - RNA, 14 nt, Human
ugccccccacccca

SEQ ID NO: 2486195 - RNA, 15 nt, Human
ugccccccaccccag

SEQ ID NO: 2486196 - RNA, 16 nt, Human
ugccccccaccccagc

SEQ ID NO: 2486197 - RNA, 17 nt, Human
ugccccccaccccagcc

SEQ ID NO: 2486198 - RNA, 15 nt, Human
ugcccccagggcacu

SEQ ID NO: 2486199 - RNA, 12 nt, Human
ugccccccaccc

SEQ ID NO: 2486200 - RNA, 13 nt, Human
ugccccccacccc

SEQ ID NO: 2486201 - RNA, 14 nt, Human
ugccccccauccug

SEQ ID NO: 2486202 - RNA, 13 nt, Human
ugccccccauccu

SEQ ID NO: 2486203 - RNA, 16 nt, Human
ugccccccauccuggc

SEQ ID NO: 2486204 - RNA, 20 nt, Human
ugccccccagccucuggcau

SEQ ID NO: 2486205 - RNA, 12 nt, Human
ugccccccaucc

SEQ ID NO: 2486206 - RNA, 19 nt, Human
ugccccccagccucuggca

SEQ ID NO: 2486207 - RNA, 15 nt, Human
ugccccccagccucu

SEQ ID NO: 2486208 - RNA, 14 nt, Human
ugccccccagccuc

SEQ ID NO: 2486209 - RNA, 18 nt, Human
ugccccccaccccagccu

SEQ ID NO: 2486210 - RNA, 20 nt, Human
ugccccccaccccagccuaa

SEQ ID NO: 2486211 - RNA, 14 nt, Human
ugcccccugcuggc

SEQ ID NO: 2486212 - RNA, 13 nt, Human
ugcccccugcugg

SEQ ID NO: 2486213 - RNA, 22 nt, Human
ugcccccugcuggcucuucugc

SEQ ID NO: 2486214 - RNA, 16 nt, Human
ugcccccugcuggcuc

SEQ ID NO: 2486215 - RNA, 12 nt, Human
ugcccccuggug

SEQ ID NO: 2486216 - RNA, 13 nt, Human
ugcccccuggugg

SEQ ID NO: 2486217 - RNA, 21 nt, Human
ugcccccugguggacaguccu

SEQ ID NO: 2486218 - RNA, 22 nt, Human
ugcccaggccccugccacccug

SEQ ID NO: 2486219 - RNA, 20 nt, Human
ugcccaggccccugccaccc

SEQ ID NO: 2486220 - RNA, 21 nt, Human
ugcccaauuggaggaaagcaa

SEQ ID NO: 2486221 - RNA, 16 nt, Human
ugcccaauuggaggaa

SEQ ID NO: 2486222 - RNA, 14 nt, Human
ugcccaggccccug

SEQ ID NO: 2486223 - RNA, 12 nt, Human
ugcccaggcccc

SEQ ID NO: 2486224 - RNA, 20 nt, Human
ugcccccagccccgggguga

SEQ ID NO: 2486225 - RNA, 16 nt, Human
ugcccccagccccggg

SEQ ID NO: 2486226 - RNA, 14 nt, Human
ugcccccagccccg

SEQ ID NO: 2486227 - RNA, 14 nt, Human
ugcccccagcuggc

SEQ ID NO: 2486228 - RNA, 13 nt, Human
ugcccccagcugg

SEQ ID NO: 2486229 - RNA, 11 nt, Human
ugcccccagga

SEQ ID NO: 2486230 - RNA, 23 nt, Human
ugcccccaccccggggacccugu

SEQ ID NO: 2486231 - RNA, 17 nt, Human
ugcccccacugaccaga

SEQ ID NO: 2486232 - RNA, 22 nt, Human
ugcccccaccccggggacccug

SEQ ID NO: 2486233 - RNA, 15 nt, Human
ugcccaggcccagac

SEQ ID NO: 2486234 - RNA, 17 nt, Human
ugcccaggccugccugu

SEQ ID NO: 2486235 - RNA, 15 nt, Human
ugcccaggccugccu

SEQ ID NO: 2486236 - RNA, 14 nt, Human
ugcccaggcccaga

SEQ ID NO: 2486237 - RNA, 11 nt, Human
ugcccaggccc

SEQ ID NO: 2486238 - RNA, 20 nt, Human
ugcccaggcaggucuugaac

SEQ ID NO: 2486239 - RNA, 17 nt, Human
ugcccaggcaggucuug

SEQ ID NO: 2486240 - RNA, 16 nt, Human
ugcccaggcaggucuu

SEQ ID NO: 2486241 - RNA, 15 nt, Human
ugcccaggcaggucu

SEQ ID NO: 2486242 - RNA, 14 nt, Human
ugcccacaggauca

SEQ ID NO: 2486243 - RNA, 22 nt, Human
ugcccaagccagaggcuggguu

SEQ ID NO: 2486244 - RNA, 14 nt, Human
ugcccaagggaaag

SEQ ID NO: 2486245 - RNA, 22 nt, Human
ugcccaauaugcaguucugcag

SEQ ID NO: 2486246 - RNA, 22 nt, Human
ugcccaaguuguggugcugaca

SEQ ID NO: 2486247 - RNA, 14 nt, Human
ugcccaacuguuau

SEQ ID NO: 2486248 - RNA, 20 nt, Human
ugcccaauaugcaguucugc

SEQ ID NO: 2486249 - RNA, 15 nt, Human
ugcccaauuggagga

SEQ ID NO: 2486250 - RNA, 16 nt, Human
ugcccacacaccccaa

SEQ ID NO: 2486251 - RNA, 21 nt, Human
ugccauguuggccaggcuggu

SEQ ID NO: 2486252 - RNA, 20 nt, Human
ugccauguuggccaggcugg

SEQ ID NO: 2486253 - RNA, 16 nt, Human
ugccauucacuucaua

SEQ ID NO: 2486254 - RNA, 16 nt, Human
ugccauuaucccugaa

SEQ ID NO: 2486255 - RNA, 21 nt, Human
agcuauuuuuacuagaacaca

SEQ ID NO: 2486256 - RNA, 24 nt, Human
ugcccaaccugcucuccucuugcc

SEQ ID NO: 2486257 - RNA, 23 nt, Human
ugcccaaccugcucuccucuugc

SEQ ID NO: 2486258 - RNA, 23 nt, Human
ugcccaagccagaggcuggguuc

SEQ ID NO: 2486259 - RNA, 19 nt, Human
ugcccaacccuucccucac

SEQ ID NO: 2486260 - RNA, 23 nt, Human
ugccauuaucccugaaucccccu

SEQ ID NO: 2486261 - RNA, 18 nt, Human
ugccauucccugccuggg

SEQ ID NO: 2486262 - RNA, 20 nt, Human
ugcccaacccuucccucacc

SEQ ID NO: 2486263 - RNA, 22 nt, Human
ugcccaacccuucccucaccuu

SEQ ID NO: 2486264 - RNA, 22 nt, Human
ugcccaaccugcucuccucuug

SEQ ID NO: 2486265 - RNA, 18 nt, Human
ugcccaaccugcucuccu

SEQ ID NO: 2486266 - RNA, 19 nt, Human
ugccauguuggccaggcug

SEQ ID NO: 2486267 - RNA, 18 nt, Human
ugccauguuggccaggcu

SEQ ID NO: 2486268 - RNA, 17 nt, Human
agcucagggccuggcuc

SEQ ID NO: 2486269 - RNA, 17 nt, Human
ugccauguuggccaggc

SEQ ID NO: 2486270 - RNA, 16 nt, Human
agcucagggccuggcu

SEQ ID NO: 2486271 - RNA, 15 nt, Human
agcucagggccuggc

SEQ ID NO: 2486272 - RNA, 20 nt, Human
agcuauuuccauuccagaau

SEQ ID NO: 2486273 - RNA, 10 nt, Human
agcuauuuuu

SEQ ID NO: 2486274 - RNA, 16 nt, Human
agcuauuuuuacuaga

SEQ ID NO: 2486275 - RNA, 22 nt, Human
agcuauuuuuauuuguuugugc

SEQ ID NO: 2486276 - RNA, 18 nt, Human
agcuauaaaaugaauaca

SEQ ID NO: 2486277 - RNA, 12 nt, Human
agcuaguuuucu

SEQ ID NO: 2486278 - RNA, 15 nt, Human
agcuauaccugugcc

SEQ ID NO: 2486279 - RNA, 16 nt, Human
agcuauaccugugccu

SEQ ID NO: 2486280 - RNA, 23 nt, Human
agcuauaaauuccucuuugcuuu

SEQ ID NO: 2486281 - RNA, 16 nt, Human
agcuacuuccuccucc

SEQ ID NO: 2486282 - RNA, 15 nt, Human
agcuacuuccuccuc

SEQ ID NO: 2486283 - RNA, 23 nt, Human
agcuacugugugugugaaugaac

SEQ ID NO: 2486284 - RNA, 22 nt, Human
agcuacuugggaagcugaggcg

SEQ ID NO: 2486285 - RNA, 21 nt, Human
agcuacuuccuccuccccacu

SEQ ID NO: 2486286 - RNA, 16 nt, Human
agcuacugauuuuugu

SEQ ID NO: 2486287 - RNA, 18 nt, Human
agcuacugcggaaaagga

SEQ ID NO: 2486288 - RNA, 19 nt, Human
agcuacugcggaaaaggaa

SEQ ID NO: 2486289 - RNA, 15 nt, Human
agcuacugugugugu

SEQ ID NO: 2486290 - RNA, 19 nt, Human
agcuacugugugugugaau

SEQ ID NO: 2486291 - RNA, 20 nt, Human
agcuacugugugugugaaug

SEQ ID NO: 2486292 - RNA, 21 nt, Human
agcuacucagaagccugaggc

SEQ ID NO: 2486293 - RNA, 22 nt, Human
agcuacucaagaggcugaggca

SEQ ID NO: 2486294 - RNA, 13 nt, Human
agcuacucaggag

SEQ ID NO: 2486295 - RNA, 15 nt, Human
agcuacucaggaggc

SEQ ID NO: 2486296 - RNA, 17 nt, Human
agcuacucaggaggcug

SEQ ID NO: 2486297 - RNA, 18 nt, Human
agcuacucaggaggcuga

SEQ ID NO: 2486298 - RNA, 23 nt, Human
agcuacugauuuccuuuggagcu

SEQ ID NO: 2486299 - RNA, 20 nt, Human
agcuacugauuuccuuugga

SEQ ID NO: 2486300 - RNA, 17 nt, Human
agcuauggugagaugca

SEQ ID NO: 2486301 - RNA, 22 nt, Human
agcuaugggagccccagggucu

SEQ ID NO: 2486302 - RNA, 18 nt, Human
agcuaugggagccccagg

SEQ ID NO: 2486303 - RNA, 19 nt, Human
agcuaugggagccccaggg

SEQ ID NO: 2486304 - RNA, 23 nt, Human
agcuaugcugguaggcuccugcc

SEQ ID NO: 2486305 - RNA, 17 nt, Human
agcuaugggagccccag

SEQ ID NO: 2486306 - RNA, 24 nt, Human
agcuaucuggucaaccuccuggac

SEQ ID NO: 2486307 - RNA, 14 nt, Human
agcuauauccaugu

SEQ ID NO: 2486308 - RNA, 15 nt, Human
agcuauauccaugua

SEQ ID NO: 2486309 - RNA, 19 nt, Human
agcuauagacccgaggaaa

SEQ ID NO: 2486310 - RNA, 17 nt, Human
agcuauaccugugccuc

SEQ ID NO: 2486311 - RNA, 17 nt, Human
agcuauagacccgagga

SEQ ID NO: 2486312 - RNA, 18 nt, Human
agcuauagacccgaggaa

SEQ ID NO: 2486313 - RNA, 19 nt, Human
agcuauggugucauaggcu

SEQ ID NO: 2486314 - RNA, 14 nt, Human
agcuauuucaucua

SEQ ID NO: 2486315 - RNA, 17 nt, Human
agcuauuucaucuauuu

SEQ ID NO: 2486316 - RNA, 18 nt, Human
agcuauuuccauuccaga

SEQ ID NO: 2486317 - RNA, 20 nt, Human
agcuauggugagaugcagcu

SEQ ID NO: 2486318 - RNA, 21 nt, Human
agcuauuucaucuauuuuugg

SEQ ID NO: 2486319 - RNA, 13 nt, Human
agcuauuucaucu

SEQ ID NO: 2486320 - RNA, 17 nt, Human
agcuauugauauaaaua

SEQ ID NO: 2486321 - RNA, 23 nt, Human
agcuauugauauaaauaaaacau

SEQ ID NO: 2486322 - RNA, 20 nt, Human
agcugccuccccucuccuuc

SEQ ID NO: 2486323 - RNA, 14 nt, Human
agcugccucuucug

SEQ ID NO: 2486324 - RNA, 16 nt, Human
agcugccucuucugug

SEQ ID NO: 2486325 - RNA, 23 nt, Human
agcugccugcuuuucacugcugc

SEQ ID NO: 2486326 - RNA, 12 nt, Human
agcugccugcuu

SEQ ID NO: 2486327 - RNA, 23 nt, Human
agcugccuccccucuccuuccug

SEQ ID NO: 2486328 - RNA, 20 nt, Human
agcugccucucgguggccag

SEQ ID NO: 2486329 - RNA, 22 nt, Human
ugccucugacacacagcucugu

SEQ ID NO: 2486330 - RNA, 19 nt, Human
agcugccugggaucccuca

SEQ ID NO: 2486331 - RNA, 13 nt, Human
agcugccugggau

SEQ ID NO: 2486332 - RNA, 21 nt, Human
agcugccugggaucccucauc

SEQ ID NO: 2486333 - RNA, 15 nt, Human
agcugccugguauau

SEQ ID NO: 2486334 - RNA, 13 nt, Human
agcuggaaaagua

SEQ ID NO: 2486335 - RNA, 12 nt, Human
agcuggaagcac

SEQ ID NO: 2486336 - RNA, 16 nt, Human
agcuggacuacccacg

SEQ ID NO: 2486337 - RNA, 15 nt, Human
agcuggacuacccac

SEQ ID NO: 2486338 - RNA, 17 nt, Human
agcuggagaaauauggu

SEQ ID NO: 2486339 - RNA, 15 nt, Human
agcuggagaagaccc

SEQ ID NO: 2486340 - RNA, 12 nt, Human
agcugggaggaa

SEQ ID NO: 2486341 - RNA, 13 nt, Human
agcugggaggaaa

SEQ ID NO: 2486342 - RNA, 14 nt, Human
agcugggaggaaaa

SEQ ID NO: 2486343 - RNA, 15 nt, Human
agcugggaggaaaag

SEQ ID NO: 2486344 - RNA, 13 nt, Human
agcugggaggcaa

SEQ ID NO: 2486345 - RNA, 18 nt, Human
agcugggaggaaaagaaa

SEQ ID NO: 2486346 - RNA, 19 nt, Human
agcugggacuacaggugug

SEQ ID NO: 2486347 - RNA, 17 nt, Human
agcugggacuacaggug

SEQ ID NO: 2486348 - RNA, 23 nt, Human
agcugggaugauuggagggggga

SEQ ID NO: 2486349 - RNA, 18 nt, Human
agcugggauuacaggcuc

SEQ ID NO: 2486350 - RNA, 21 nt, Human
agcugggauuacaggcuccug

SEQ ID NO: 2486351 - RNA, 20 nt, Human
agcugggaggcauggcccug

SEQ ID NO: 2486352 - RNA, 19 nt, Human
agcugggaggcauggcccu

SEQ ID NO: 2486353 - RNA, 16 nt, Human
agcugggaggcauggc

SEQ ID NO: 2486354 - RNA, 14 nt, Human
agcugggaggcaug

SEQ ID NO: 2486355 - RNA, 23 nt, Human
agcugggaggcaagaggggugga

SEQ ID NO: 2486356 - RNA, 19 nt, Human
agcugggaggcaagagggg

SEQ ID NO: 2486357 - RNA, 17 nt, Human
agcugggaggcaagagg

SEQ ID NO: 2486358 - RNA, 16 nt, Human
agcugggaggcaagag

SEQ ID NO: 2486359 - RNA, 22 nt, Human
agcugggaucacauguggacuu

SEQ ID NO: 2486360 - RNA, 22 nt, Human
agcugggaggcauggcccuggg

SEQ ID NO: 2486361 - RNA, 21 nt, Human
agcugggaggcauggcccugg

SEQ ID NO: 2486362 - RNA, 22 nt, Human
agcugggcucugccacccuacc

SEQ ID NO: 2486363 - RNA, 14 nt, Human
agcugggcucugcc

SEQ ID NO: 2486364 - RNA, 15 nt, Human
agcugggcucugcaa

SEQ ID NO: 2486365 - RNA, 22 nt, Human
agcugggccccagcccacccuc

SEQ ID NO: 2486366 - RNA, 18 nt, Human
agcugggccccagcccac

SEQ ID NO: 2486367 - RNA, 17 nt, Human
agcugggccccagccca

SEQ ID NO: 2486368 - RNA, 20 nt, Human
agcugggccccagcccaccc

SEQ ID NO: 2486369 - RNA, 11 nt, Human
agcugggcugu

SEQ ID NO: 2486370 - RNA, 15 nt, Human
agcugggcucugcca

SEQ ID NO: 2486371 - RNA, 14 nt, Human
agcuggggaccugg

SEQ ID NO: 2486372 - RNA, 15 nt, Human
agcuggggaucccuc

SEQ ID NO: 2486373 - RNA, 22 nt, Human
agcuggggaucccuccccccca

SEQ ID NO: 2486374 - RNA, 17 nt, Human
agcuggggccaggcugg

SEQ ID NO: 2486375 - RNA, 22 nt, Human
agcugggauuacaggcuccugc

SEQ ID NO: 2486376 - RNA, 23 nt, Human
agcugggauuacaggcuccugcc

SEQ ID NO: 2486377 - RNA, 14 nt, Human
agcugggcagguug

SEQ ID NO: 2486378 - RNA, 16 nt, Human
agcugggccccagccc

SEQ ID NO: 2486379 - RNA, 15 nt, Human
agcugggccccagcc

SEQ ID NO: 2486380 - RNA, 14 nt, Human
agcugggccccagc

SEQ ID NO: 2486381 - RNA, 13 nt, Human
agcugggccccag

SEQ ID NO: 2486382 - RNA, 21 nt, Human
agcugggcccaacccugucug

SEQ ID NO: 2486383 - RNA, 20 nt, Human
agcugggcccaacccugucu

SEQ ID NO: 2486384 - RNA, 15 nt, Human
agcugggcccaaccc

SEQ ID NO: 2486385 - RNA, 12 nt, Human
agcugggcccaa

SEQ ID NO: 2486386 - RNA, 18 nt, Human
agcugggcagaaggccaa

SEQ ID NO: 2486387 - RNA, 16 nt, Human
agcugggcagaaggcc

SEQ ID NO: 2486388 - RNA, 17 nt, Human
agcugggauguuucugu

SEQ ID NO: 2486389 - RNA, 17 nt, Human
ugccuguucagcuccag

SEQ ID NO: 2486390 - RNA, 18 nt, Human
ugccuuaccuccugccca

SEQ ID NO: 2486391 - RNA, 19 nt, Human
ugccuuaccuccugcccag

SEQ ID NO: 2486392 - RNA, 20 nt, Human
ugccuuaccuccugcccagg

SEQ ID NO: 2486393 - RNA, 21 nt, Human
ugccuuaccuccugcccagga

SEQ ID NO: 2486394 - RNA, 16 nt, Human
ugccuguucagcucca

SEQ ID NO: 2486395 - RNA, 15 nt, Human
ugccuguucagcucc

SEQ ID NO: 2486396 - RNA, 11 nt, Human
ugccuguucag

SEQ ID NO: 2486397 - RNA, 20 nt, Human
ugccuguuauaacucugcac

SEQ ID NO: 2486398 - RNA, 19 nt, Human
ugccuguuauaacucugca

SEQ ID NO: 2486399 - RNA, 18 nt, Human
ugccuguuauaacucugc

SEQ ID NO: 2486400 - RNA, 14 nt, Human
ugccugugucuucu

SEQ ID NO: 2486401 - RNA, 21 nt, Human
ugccugugugacaucaguggc

SEQ ID NO: 2486402 - RNA, 17 nt, Human
ugccuuagaaccuuucu

SEQ ID NO: 2486403 - RNA, 14 nt, Human
ugccuuagaaccuu

SEQ ID NO: 2486404 - RNA, 15 nt, Human
ugccuuacucuucuu

SEQ ID NO: 2486405 - RNA, 18 nt, Human
ugccuuacucuucuugaa

SEQ ID NO: 2486406 - RNA, 19 nt, Human
ugccuuacucuucuugaaa

SEQ ID NO: 2486407 - RNA, 21 nt, Human
ugccuuagaaccuuucuuaca

SEQ ID NO: 2486408 - RNA, 19 nt, Human
ugccuugugaaggaauuau

SEQ ID NO: 2486409 - RNA, 19 nt, Human
ugccuuguguacaguuauu

SEQ ID NO: 2486410 - RNA, 15 nt, Human
ugccuuagagccagg

SEQ ID NO: 2486411 - RNA, 23 nt, Human
ugccuuaccuccugcccaggaga

SEQ ID NO: 2486412 - RNA, 20 nt, Human
agcuggggccaggcuggguc

SEQ ID NO: 2486413 - RNA, 15 nt, Human
agcuggggaugucuc

SEQ ID NO: 2486414 - RNA, 20 nt, Human
agcuggggcguggggagggc

SEQ ID NO: 2486415 - RNA, 18 nt, Human
agcuggggcguggggagg

SEQ ID NO: 2486416 - RNA, 16 nt, Human
agcuggggcgugggga

SEQ ID NO: 2486417 - RNA, 20 nt, Human
agcuggggaagcuucuuaaa

SEQ ID NO: 2486418 - RNA, 20 nt, Human
agcugggggugggccaggcu

SEQ ID NO: 2486419 - RNA, 21 nt, Human
agcugggggugggccaggcug

SEQ ID NO: 2486420 - RNA, 18 nt, Human
agcugggggugggccagg

SEQ ID NO: 2486421 - RNA, 19 nt, Human
agcugggggugggccaggc

SEQ ID NO: 2486422 - RNA, 17 nt, Human
agcugggggugggccag

SEQ ID NO: 2486423 - RNA, 20 nt, Human
agcugggggccaugagcucc

SEQ ID NO: 2486424 - RNA, 16 nt, Human
agcugggggccaugag

SEQ ID NO: 2486425 - RNA, 17 nt, Human
agcuggggcugagggau

SEQ ID NO: 2486426 - RNA, 18 nt, Human
agcugggggccaugagcu

SEQ ID NO: 2486427 - RNA, 19 nt, Human
agcugugagacagugggaa

SEQ ID NO: 2486428 - RNA, 18 nt, Human
agcugugagacaguggga

SEQ ID NO: 2486429 - RNA, 18 nt, Human
agcugugacuucuccagg

SEQ ID NO: 2486430 - RNA, 17 nt, Human
agcugugaacauggacu

SEQ ID NO: 2486431 - RNA, 17 nt, Human
agcugugaccucucccc

SEQ ID NO: 2486432 - RNA, 10 nt, Human
agcugugcag

SEQ ID NO: 2486433 - RNA, 12 nt, Human
agcugugcaggu

SEQ ID NO: 2486434 - RNA, 18 nt, Human
agcugugcagguggggag

SEQ ID NO: 2486435 - RNA, 22 nt, Human
ugccuguguccaugcgcucagg

SEQ ID NO: 2486436 - RNA, 17 nt, Human
agcugugagccuuggcu

SEQ ID NO: 2486437 - RNA, 16 nt, Human
agcugugagccuuggc

SEQ ID NO: 2486438 - RNA, 15 nt, Human
agcugugagccuugg

SEQ ID NO: 2486439 - RNA, 21 nt, Human
agcugugagacagugggaaau

SEQ ID NO: 2486440 - RNA, 18 nt, Human
agcugugagccuuggcug

SEQ ID NO: 2486441 - RNA, 20 nt, Human
ugccuuuuuucacggaaguu

SEQ ID NO: 2486442 - RNA, 13 nt, Human
ugcgaaaggauga

SEQ ID NO: 2486443 - RNA, 21 nt, Human
ugccuuuauuguguuugucau

SEQ ID NO: 2486444 - RNA, 20 nt, Human
ugccuuuauuguguuuguca

SEQ ID NO: 2486445 - RNA, 14 nt, Human
ugccuuuaaaucug

SEQ ID NO: 2486446 - RNA, 18 nt, Human
ugccuuuaaaguaugaau

SEQ ID NO: 2486447 - RNA, 17 nt, Human
ugccuuuaaaguaugaa

SEQ ID NO: 2486448 - RNA, 16 nt, Human
ugccuuuaaaguauga

SEQ ID NO: 2486449 - RNA, 14 nt, Human
ugccuuuauugugu

SEQ ID NO: 2486450 - RNA, 18 nt, Human
ugccuuuaaaucugugau

SEQ ID NO: 2486451 - RNA, 15 nt, Human
ugccuuuaaaucugu

SEQ ID NO: 2486452 - RNA, 19 nt, Human
ugccuuuaaaucugugaug

SEQ ID NO: 2486453 - RNA, 17 nt, Human
ugcggacagccacggcc

SEQ ID NO: 2486454 - RNA, 18 nt, Human
ugcggacagccacggcca

SEQ ID NO: 2486455 - RNA, 21 nt, Human
ugcgacuuucugccuggagug

SEQ ID NO: 2486456 - RNA, 18 nt, Human
ugcgacuuucugccugga

SEQ ID NO: 2486457 - RNA, 17 nt, Human
ugcgacuuucugccugg

SEQ ID NO: 2486458 - RNA, 16 nt, Human
ugcgacuuucugccug

SEQ ID NO: 2486459 - RNA, 15 nt, Human
ugcgacuuucugccu

SEQ ID NO: 2486460 - RNA, 19 nt, Human
ugcgaaaggaugaaaguga

SEQ ID NO: 2486461 - RNA, 21 nt, Human
ugccuuuuuucacggaaguuu

SEQ ID NO: 2486462 - RNA, 14 nt, Human
ugccuuuuuugauc

SEQ ID NO: 2486463 - RNA, 16 nt, Human
ugcgaaggggcccugg

SEQ ID NO: 2486464 - RNA, 21 nt, Human
ugcgaaggggcccugguccuu

SEQ ID NO: 2486465 - RNA, 18 nt, Human
ugcgaaggggcccugguc

SEQ ID NO: 2486466 - RNA, 22 nt, Human
ugcgaaugguuccauucucucu

SEQ ID NO: 2486467 - RNA, 20 nt, Human
ugcgaccccaucugcccagg

SEQ ID NO: 2486468 - RNA, 19 nt, Human
ugcgaccccaucugcccag

SEQ ID NO: 2486469 - RNA, 18 nt, Human
ugcgaccccaucugccca

SEQ ID NO: 2486470 - RNA, 15 nt, Human
ugcgaccccaucugc

SEQ ID NO: 2486471 - RNA, 14 nt, Human
ugcgaccccaucug

SEQ ID NO: 2486472 - RNA, 12 nt, Human
agcucugcuccu

SEQ ID NO: 2486473 - RNA, 17 nt, Human
agcucugccgcaauggc

SEQ ID NO: 2486474 - RNA, 20 nt, Human
agcucugguccauagagagc

SEQ ID NO: 2486475 - RNA, 22 nt, Human
agcucugcuccucuccccagca

SEQ ID NO: 2486476 - RNA, 17 nt, Human
agcucucggaacugcau

SEQ ID NO: 2486477 - RNA, 18 nt, Human
agcucucggaacugcaug

SEQ ID NO: 2486478 - RNA, 20 nt, Human
agcucucggaacugcaugcu

SEQ ID NO: 2486479 - RNA, 22 nt, Human
agcucucggaacugcaugcugc

SEQ ID NO: 2486480 - RNA, 23 nt, Human
agcucucggaacugcaugcugcu

SEQ ID NO: 2486481 - RNA, 16 nt, Human
agcucucuccucccuu

SEQ ID NO: 2486482 - RNA, 18 nt, Human
agcucuccggucucucuc

SEQ ID NO: 2486483 - RNA, 19 nt, Human
agcucucccucuggcccug

SEQ ID NO: 2486484 - RNA, 20 nt, Human
agcucucccucuggcccugc

SEQ ID NO: 2486485 - RNA, 22 nt, Human
agcucucccucuggcccugccu

SEQ ID NO: 2486486 - RNA, 23 nt, Human
agcucucccucuggcccugccuu

SEQ ID NO: 2486487 - RNA, 19 nt, Human
agcucuccagucaggaggc

SEQ ID NO: 2486488 - RNA, 11 nt, Human
agcucucccuc

SEQ ID NO: 2486489 - RNA, 13 nt, Human
agcucucccucug

SEQ ID NO: 2486490 - RNA, 14 nt, Human
agcucucccucugg

SEQ ID NO: 2486491 - RNA, 15 nt, Human
agcucucccucuggc

SEQ ID NO: 2486492 - RNA, 16 nt, Human
agcucucccucuggcc

SEQ ID NO: 2486493 - RNA, 17 nt, Human
agcucucccucuggccc

SEQ ID NO: 2486494 - RNA, 18 nt, Human
agcucucccucuggcccu

SEQ ID NO: 2486495 - RNA, 20 nt, Human
ugcccuccaagaccuucucc

SEQ ID NO: 2486496 - RNA, 19 nt, Human
ugcccuccaagaccuucuc

SEQ ID NO: 2486497 - RNA, 22 nt, Human
ugcccuccaagaccuucuccuu

SEQ ID NO: 2486498 - RNA, 21 nt, Human
ugcccucauggccccucugac

SEQ ID NO: 2486499 - RNA, 18 nt, Human
ugcccucauuuuauguca

SEQ ID NO: 2486500 - RNA, 18 nt, Human
ugcccuccacagccgcag

SEQ ID NO: 2486501 - RNA, 21 nt, Human
ugcccuccacagccgcagccu

SEQ ID NO: 2486502 - RNA, 22 nt, Human
agcucuauuaagauuuccaagu

SEQ ID NO: 2486503 - RNA, 20 nt, Human
agcucuauuaagauuuccaa

SEQ ID NO: 2486504 - RNA, 22 nt, Human
agcucuauguuuacaaauggac

SEQ ID NO: 2486505 - RNA, 22 nt, Human
agcucuaucaccaaggagccaa

SEQ ID NO: 2486506 - RNA, 17 nt, Human
agcucuaucaccaagga

SEQ ID NO: 2486507 - RNA, 18 nt, Human
ugcccuccagcucuuucc

SEQ ID NO: 2486508 - RNA, 19 nt, Human
ugcccuccagcucuuuccu

SEQ ID NO: 2486509 - RNA, 12 nt, Human
agcucucagcca

SEQ ID NO: 2486510 - RNA, 13 nt, Human
agcucucagccaa

SEQ ID NO: 2486511 - RNA, 14 nt, Human
agcucuccagcucc

SEQ ID NO: 2486512 - RNA, 13 nt, Human
agcucuccagcuc

SEQ ID NO: 2486513 - RNA, 17 nt, Human
agcucuccagcuccaag

SEQ ID NO: 2486514 - RNA, 16 nt, Human
agcucuccagcuccaa

SEQ ID NO: 2486515 - RNA, 15 nt, Human
agcucuccccucaga

SEQ ID NO: 2486516 - RNA, 18 nt, Human
agcugcacccucaggcag

SEQ ID NO: 2486517 - RNA, 19 nt, Human
agcugcacccucaggcagg

SEQ ID NO: 2486518 - RNA, 20 nt, Human
agcugcacccucaggcaggu

SEQ ID NO: 2486519 - RNA, 22 nt, Human
agcugcacccucaggcaggugg

SEQ ID NO: 2486520 - RNA, 13 nt, Human
agcugcacccuca

SEQ ID NO: 2486521 - RNA, 17 nt, Human
agcugcacccucaggca

SEQ ID NO: 2486522 - RNA, 14 nt, Human
agcugauuuuaaca

SEQ ID NO: 2486523 - RNA, 17 nt, Human
agcugauguuggaagag

SEQ ID NO: 2486524 - RNA, 12 nt, Human
agcucuguccug

SEQ ID NO: 2486525 - RNA, 17 nt, Human
agcucuucuccaggcug

SEQ ID NO: 2486526 - RNA, 22 nt, Human
agcucuguaucaggacccagag

SEQ ID NO: 2486527 - RNA, 23 nt, Human
agcucuguaucaggacccagagg

SEQ ID NO: 2486528 - RNA, 12 nt, Human
agcucuguauca

SEQ ID NO: 2486529 - RNA, 23 nt, Human
agcucuggugagucuuggcggca

SEQ ID NO: 2486530 - RNA, 21 nt, Human
agcucuggugacaccagccuu

SEQ ID NO: 2486531 - RNA, 17 nt, Human
agcucuggugacaccag

SEQ ID NO: 2486532 - RNA, 19 nt, Human
agcucuggugacaccagcc

SEQ ID NO: 2486533 - RNA, 20 nt, Human
agcucuggugacaccagccu

SEQ ID NO: 2486534 - RNA, 18 nt, Human
agcucuucuccaggcugu

SEQ ID NO: 2486535 - RNA, 20 nt, Human
agcucuucuccccaggugug

SEQ ID NO: 2486536 - RNA, 17 nt, Human
agcucuucuccccaggu

SEQ ID NO: 2486537 - RNA, 16 nt, Human
agcucuucuccccagg

SEQ ID NO: 2486538 - RNA, 20 nt, Human
agcucuucugccggcccugg

SEQ ID NO: 2486539 - RNA, 21 nt, Human
agcucuucugccggcccuggg

SEQ ID NO: 2486540 - RNA, 22 nt, Human
agcucuucugccggcccugggg

SEQ ID NO: 2486541 - RNA, 23 nt, Human
agcucuucugccggcccuggggc

SEQ ID NO: 2486542 - RNA, 15 nt, Human
agcugauccagagca

SEQ ID NO: 2486543 - RNA, 15 nt, Human
agcucuugcccuucc

SEQ ID NO: 2486544 - RNA, 14 nt, Human
agcucuugcccuuc

SEQ ID NO: 2486545 - RNA, 12 nt, Human
agcucuugcccu

SEQ ID NO: 2486546 - RNA, 18 nt, Human
agcucuucuuaaaguauu

SEQ ID NO: 2486547 - RNA, 19 nt, Human
agcucuugaagacacugaa

SEQ ID NO: 2486548 - RNA, 19 nt, Human
agcugauccagagcacaga

SEQ ID NO: 2486549 - RNA, 22 nt, Human
agcugaugaacuuauucuguag

SEQ ID NO: 2486550 - RNA, 20 nt, Human
agcugaugaacuuauucugu

SEQ ID NO: 2486551 - RNA, 14 nt, Human
ugccucucucaggc

SEQ ID NO: 2486552 - RNA, 13 nt, Human
ugccucucucagg

SEQ ID NO: 2486553 - RNA, 19 nt, Human
ugccucccaucacccgcua

SEQ ID NO: 2486554 - RNA, 14 nt, Human
ugccucccaucacc

SEQ ID NO: 2486555 - RNA, 13 nt, Human
ugccucccaucac

SEQ ID NO: 2486556 - RNA, 15 nt, Human
ugccuccaggugugc

SEQ ID NO: 2486557 - RNA, 13 nt, Human
ugccuccaggugu

SEQ ID NO: 2486558 - RNA, 23 nt, Human
ugccuccaccaccacuggccacc

SEQ ID NO: 2486559 - RNA, 22 nt, Human
ugccuccaccaccacuggccac

SEQ ID NO: 2486560 - RNA, 21 nt, Human
ugccuccaccaccacuggcca

SEQ ID NO: 2486561 - RNA, 20 nt, Human
ugccuccaccaccacuggcc

SEQ ID NO: 2486562 - RNA, 14 nt, Human
ugccuccacccucu

SEQ ID NO: 2486563 - RNA, 13 nt, Human
ugccuccacccuc

SEQ ID NO: 2486564 - RNA, 12 nt, Human
ugccuccacccu

SEQ ID NO: 2486565 - RNA, 18 nt, Human
ugccuccaccccccagaa

SEQ ID NO: 2486566 - RNA, 16 nt, Human
ugccuccacccucuga

SEQ ID NO: 2486567 - RNA, 15 nt, Human
ugccuccacccucug

SEQ ID NO: 2486568 - RNA, 17 nt, Human
ugccuccacccucugag

SEQ ID NO: 2486569 - RNA, 11 nt, Human
ugccuccaccg

SEQ ID NO: 2486570 - RNA, 13 nt, Human
ugccuccaccgcu

SEQ ID NO: 2486571 - RNA, 16 nt, Human
ugccuccaccgcugcc

SEQ ID NO: 2486572 - RNA, 17 nt, Human
ugccuccaccgcugccu

SEQ ID NO: 2486573 - RNA, 18 nt, Human
ugccuccaccgcugccua

SEQ ID NO: 2486574 - RNA, 20 nt, Human
ugccucucugcaggucccua

SEQ ID NO: 2486575 - RNA, 19 nt, Human
ugccucucugcaggucccu

SEQ ID NO: 2486576 - RNA, 21 nt, Human
ugccucugacacacagcucug

SEQ ID NO: 2486577 - RNA, 20 nt, Human
ugccucugacacacagcucu

SEQ ID NO: 2486578 - RNA, 18 nt, Human
ugccucucugcagguccc

SEQ ID NO: 2486579 - RNA, 16 nt, Human
ugccucucugcagguc

SEQ ID NO: 2486580 - RNA, 15 nt, Human
ugccucucucaggcc

SEQ ID NO: 2486581 - RNA, 17 nt, Human
ugccuccaggugugcac

SEQ ID NO: 2486582 - RNA, 19 nt, Human
ugccuccaccaccacuggc

SEQ ID NO: 2486583 - RNA, 17 nt, Human
ugccuccaccaccacug

SEQ ID NO: 2486584 - RNA, 16 nt, Human
ugccuccaccaccacu

SEQ ID NO: 2486585 - RNA, 15 nt, Human
ugccuccaccaccac

SEQ ID NO: 2486586 - RNA, 14 nt, Human
ugccuccaccacca

SEQ ID NO: 2486587 - RNA, 12 nt, Human
ugccuccaccac

SEQ ID NO: 2486588 - RNA, 15 nt, Human
ugccucaguguauuu

SEQ ID NO: 2486589 - RNA, 18 nt, Human
ugccucaguaaaaugaac

SEQ ID NO: 2486590 - RNA, 19 nt, Human
ugccggguucuagucuccu

SEQ ID NO: 2486591 - RNA, 21 nt, Human
ugccucauuuuagaaccacca

SEQ ID NO: 2486592 - RNA, 22 nt, Human
ugccucauuuagagaggaaaag

SEQ ID NO: 2486593 - RNA, 19 nt, Human
ugccucaguguauuuguau

SEQ ID NO: 2486594 - RNA, 20 nt, Human
ugccucaucuauaacaugca

SEQ ID NO: 2486595 - RNA, 14 nt, Human
ugccggcccugggg

SEQ ID NO: 2486596 - RNA, 16 nt, Human
ugccggccggggcuga

SEQ ID NO: 2486597 - RNA, 15 nt, Human
ugccggcccuggggc

SEQ ID NO: 2486598 - RNA, 20 nt, Human
ugccggcucuuuccuugcuc

SEQ ID NO: 2486599 - RNA, 14 nt, Human
ugccggaugugcuu

SEQ ID NO: 2486600 - RNA, 12 nt, Human
ugccgccugccc

SEQ ID NO: 2486601 - RNA, 20 nt, Human
ugccgcgucgcccucccagg

SEQ ID NO: 2486602 - RNA, 15 nt, Human
ugcccuuucugggca

SEQ ID NO: 2486603 - RNA, 13 nt, Human
ugccgaaccagga

SEQ ID NO: 2486604 - RNA, 16 nt, Human
ugccgccucccagccu

SEQ ID NO: 2486605 - RNA, 19 nt, Human
ugccgaaugugcagguuug

SEQ ID NO: 2486606 - RNA, 17 nt, Human
ugccgccucccagccug

SEQ ID NO: 2486607 - RNA, 10 nt, Human
ugccgccugc

SEQ ID NO: 2486608 - RNA, 18 nt, Human
ugccgccucccagccugg

SEQ ID NO: 2486609 - RNA, 24 nt, Human
ugccgccuccccacggccgcucca

SEQ ID NO: 2486610 - RNA, 16 nt, Human
ugccgcgucgcccucc

SEQ ID NO: 2486611 - RNA, 21 nt, Human
ugccgcgucgcccucccaggc

SEQ ID NO: 2486612 - RNA, 22 nt, Human
agcugcaccugccagccuggcu

SEQ ID NO: 2486613 - RNA, 18 nt, Human
agcugcaccugccagccu

SEQ ID NO: 2486614 - RNA, 21 nt, Human
agcugcaccugccagccuggc

SEQ ID NO: 2486615 - RNA, 21 nt, Human
agcugcauccuccaagaaucu

SEQ ID NO: 2486616 - RNA, 19 nt, Human
agcugcauccuccaagaau

SEQ ID NO: 2486617 - RNA, 18 nt, Human
agcugcauccuccaagaa

SEQ ID NO: 2486618 - RNA, 22 nt, Human
agcugcauccuccaagaaucua

SEQ ID NO: 2486619 - RNA, 18 nt, Human
agcugcauacaguuugca

SEQ ID NO: 2486620 - RNA, 16 nt, Human
agcugcaccugccagc

SEQ ID NO: 2486621 - RNA, 21 nt, Human
agcugauguuggaagagaaag

SEQ ID NO: 2486622 - RNA, 20 nt, Human
agcugauguuggaagagaaa

SEQ ID NO: 2486623 - RNA, 15 nt, Human
agcugauuuuaacaa

SEQ ID NO: 2486624 - RNA, 16 nt, Human
agcugauuuuaacaau

SEQ ID NO: 2486625 - RNA, 13 nt, Human
agcugccaccugc

SEQ ID NO: 2486626 - RNA, 12 nt, Human
agcugccagaga

SEQ ID NO: 2486627 - RNA, 13 nt, Human
agcugccagagaa

SEQ ID NO: 2486628 - RNA, 15 nt, Human
ugcccuugcccugac

SEQ ID NO: 2486629 - RNA, 14 nt, Human
ugcccuugcccuga

SEQ ID NO: 2486630 - RNA, 13 nt, Human
ugcccuugcccug

SEQ ID NO: 2486631 - RNA, 14 nt, Human
agcugccagagaag

SEQ ID NO: 2486632 - RNA, 18 nt, Human
ugcccuugcccugaccuc

SEQ ID NO: 2486633 - RNA, 17 nt, Human
ugcccuugcccugaccu

SEQ ID NO: 2486634 - RNA, 19 nt, Human
ugcccuugcccugaccucc

SEQ ID NO: 2486635 - RNA, 17 nt, Human
ugcccuuggaggccagc

SEQ ID NO: 2486636 - RNA, 15 nt, Human
ugcccuugucugaga

SEQ ID NO: 2486637 - RNA, 14 nt, Human
ugcccuugucugag

SEQ ID NO: 2486638 - RNA, 13 nt, Human
ugcccuugucuga

SEQ ID NO: 2486639 - RNA, 17 nt, Human
ugcccuugucccacuca

SEQ ID NO: 2486640 - RNA, 19 nt, Human
ugcccuuggaggccagcca

SEQ ID NO: 2486641 - RNA, 16 nt, Human
ugcccuugucccacuc

SEQ ID NO: 2486642 - RNA, 23 nt, Human
aggaauccagacccggcugcgug

SEQ ID NO: 2486643 - RNA, 16 nt, Human
aggaagcucucuuucc

SEQ ID NO: 2486644 - RNA, 15 nt, Human
aggaagcuccacugu

SEQ ID NO: 2486645 - RNA, 19 nt, Human
aggaaucgaggaaccagag

SEQ ID NO: 2486646 - RNA, 20 nt, Human
aggaaucgaggaaccagagc

SEQ ID NO: 2486647 - RNA, 19 nt, Human
aggaauugacccacaagaa

SEQ ID NO: 2486648 - RNA, 20 nt, Human
aggaauuuuauuuuuuucug

SEQ ID NO: 2486649 - RNA, 23 nt, Human
aggaaugaaauccugcuucagug

SEQ ID NO: 2486650 - RNA, 22 nt, Human
aggaagcucagggccuggcuca

SEQ ID NO: 2486651 - RNA, 18 nt, Human
aggaagcucagggccugg

SEQ ID NO: 2486652 - RNA, 17 nt, Human
aggaagcucagggccug

SEQ ID NO: 2486653 - RNA, 14 nt, Human
aggaagagagcaug

SEQ ID NO: 2486654 - RNA, 12 nt, Human
aggaagagcagg

SEQ ID NO: 2486655 - RNA, 17 nt, Human
aggaagagcaggcacau

SEQ ID NO: 2486656 - RNA, 20 nt, Human
aggaagagcaggcacaugga

SEQ ID NO: 2486657 - RNA, 14 nt, Human
aggaagagaaaaaa

SEQ ID NO: 2486658 - RNA, 14 nt, Human
aggaagagaaacca

SEQ ID NO: 2486659 - RNA, 15 nt, Human
aggaagacuuuggaa

SEQ ID NO: 2486660 - RNA, 19 nt, Human
aggaaaucaaauaugcaaa

SEQ ID NO: 2486661 - RNA, 21 nt, Human
aggaaaggccagcuggcagca

SEQ ID NO: 2486662 - RNA, 17 nt, Human
aggaaaggccagcuggc

SEQ ID NO: 2486663 - RNA, 18 nt, Human
aggaaaggccagcuggca

SEQ ID NO: 2486664 - RNA, 15 nt, Human
ugcugccauccaggu

SEQ ID NO: 2486665 - RNA, 14 nt, Human
ugcugccauccagg

SEQ ID NO: 2486666 - RNA, 13 nt, Human
ugcugccauccag

SEQ ID NO: 2486667 - RNA, 12 nt, Human
ugcugccaucca

SEQ ID NO: 2486668 - RNA, 16 nt, Human
ugcugcccaugccacc

SEQ ID NO: 2486669 - RNA, 14 nt, Human
ugcugcccaugcca

SEQ ID NO: 2486670 - RNA, 16 nt, Human
ugcugcccaggcccag

SEQ ID NO: 2486671 - RNA, 16 nt, Human
ugcugcccagccucca

SEQ ID NO: 2486672 - RNA, 14 nt, Human
ugcugcccagccuc

SEQ ID NO: 2486673 - RNA, 22 nt, Human
ugcugccauccagguucagcuu

SEQ ID NO: 2486674 - RNA, 21 nt, Human
ugcugccauccagguucagcu

SEQ ID NO: 2486675 - RNA, 19 nt, Human
ugcugccacacuucaggcu

SEQ ID NO: 2486676 - RNA, 16 nt, Human
ugcugccacacuucag

SEQ ID NO: 2486677 - RNA, 15 nt, Human
ugcugccacacuuca

SEQ ID NO: 2486678 - RNA, 14 nt, Human
ugcugccacuuuuu

SEQ ID NO: 2486679 - RNA, 22 nt, Human
ugcugccacacuucaggcucuu

SEQ ID NO: 2486680 - RNA, 11 nt, Human
ugcugccaucc

SEQ ID NO: 2486681 - RNA, 14 nt, Human
aggacaaccauucc

SEQ ID NO: 2486682 - RNA, 19 nt, Human
aggacaaaaaugaacugaa

SEQ ID NO: 2486683 - RNA, 16 nt, Human
aggacaaacagcucag

SEQ ID NO: 2486684 - RNA, 18 nt, Human
aggacaaaaaugaacuga

SEQ ID NO: 2486685 - RNA, 22 nt, Human
aggaauuuuauuuuuuucugaa

SEQ ID NO: 2486686 - RNA, 14 nt, Human
aggaauuuucuuug

SEQ ID NO: 2486687 - RNA, 16 nt, Human
aggaauuuucuuugug

SEQ ID NO: 2486688 - RNA, 15 nt, Human
ugcugagucccaggc

SEQ ID NO: 2486689 - RNA, 18 nt, Human
ugcugagucccaggcuga

SEQ ID NO: 2486690 - RNA, 22 nt, Human
ugcugagucccaggcugagccu

SEQ ID NO: 2486691 - RNA, 17 nt, Human
ugcugagucucccaagg

SEQ ID NO: 2486692 - RNA, 16 nt, Human
ugcugagucucccaag

SEQ ID NO: 2486693 - RNA, 15 nt, Human
ugcugagucucccaa

SEQ ID NO: 2486694 - RNA, 22 nt, Human
aggaaagcaauaaaugaauggg

SEQ ID NO: 2486695 - RNA, 18 nt, Human
aggaaagcaauaaaugaa

SEQ ID NO: 2486696 - RNA, 19 nt, Human
aggaaagcaauaaaugaau

SEQ ID NO: 2486697 - RNA, 16 nt, Human
aggaaagcaauaaaug

SEQ ID NO: 2486698 - RNA, 21 nt, Human
ugcugacuguuuucucuugag

SEQ ID NO: 2486699 - RNA, 24 nt, Human
ugcugacuguuuucucuugagagg

SEQ ID NO: 2486700 - RNA, 21 nt, Human
ugcugaguauguuaagcucuu

SEQ ID NO: 2486701 - RNA, 17 nt, Human
ugcugagggaccagcca

SEQ ID NO: 2486702 - RNA, 19 nt, Human
ugcugagggaccagccaag

SEQ ID NO: 2486703 - RNA, 20 nt, Human
ugcugagggaccagccaaga

SEQ ID NO: 2486704 - RNA, 12 nt, Human
ugcucuuagcug

SEQ ID NO: 2486705 - RNA, 14 nt, Human
ugcugagggaccag

SEQ ID NO: 2486706 - RNA, 16 nt, Human
ugcugagggaccagcc

SEQ ID NO: 2486707 - RNA, 18 nt, Human
aggaaauauuuauuuuaa

SEQ ID NO: 2486708 - RNA, 14 nt, Human
aggaaauauuuauu

SEQ ID NO: 2486709 - RNA, 22 nt, Human
aggaaaggcuccaggagcagcc

SEQ ID NO: 2486710 - RNA, 20 nt, Human
aggaaaggcuccaggagcag

SEQ ID NO: 2486711 - RNA, 18 nt, Human
aggaaaggcuccaggagc

SEQ ID NO: 2486712 - RNA, 13 nt, Human
aggaaaggccagc

SEQ ID NO: 2486713 - RNA, 14 nt, Human
aggaaaggccagcu

SEQ ID NO: 2486714 - RNA, 15 nt, Human
aggaaaggccagcug

SEQ ID NO: 2486715 - RNA, 16 nt, Human
aggaaaggccagcugg

SEQ ID NO: 2486716 - RNA, 19 nt, Human
aggaaagccccagcacuaa

SEQ ID NO: 2486717 - RNA, 20 nt, Human
aggaaagccccagcacuaac

SEQ ID NO: 2486718 - RNA, 18 nt, Human
ugcucugaugaagaggag

SEQ ID NO: 2486719 - RNA, 19 nt, Human
ugcucugaugaagaggagu

SEQ ID NO: 2486720 - RNA, 19 nt, Human
ugcucugcaggcaccuuag

SEQ ID NO: 2486721 - RNA, 16 nt, Human
ugcucugcaggcaccu

SEQ ID NO: 2486722 - RNA, 15 nt, Human
ugcucugcaggcacc

SEQ ID NO: 2486723 - RNA, 13 nt, Human
ugcucugaucccu

SEQ ID NO: 2486724 - RNA, 14 nt, Human
ugcucugaucccuc

SEQ ID NO: 2486725 - RNA, 16 nt, Human
ugcucugaucccucua

SEQ ID NO: 2486726 - RNA, 19 nt, Human
ugcucugaucccucuacag

SEQ ID NO: 2486727 - RNA, 22 nt, Human
ugcucugaucauccacugugcc

SEQ ID NO: 2486728 - RNA, 14 nt, Human
ugcuaucacacagu

SEQ ID NO: 2486729 - RNA, 15 nt, Human
ugcuauccauuucuc

SEQ ID NO: 2486730 - RNA, 22 nt, Human
ugcuauccauuucucauguuuu

SEQ ID NO: 2486731 - RNA, 20 nt, Human
ugcuauccugccaaaaucau

SEQ ID NO: 2486732 - RNA, 19 nt, Human
ugcucugaucauccacugu

SEQ ID NO: 2486733 - RNA, 20 nt, Human
ugcuauaggcuggagaagcu

SEQ ID NO: 2486734 - RNA, 19 nt, Human
ugcuauaggcuggagaagc

SEQ ID NO: 2486735 - RNA, 23 nt, Human
ugcuauaggcuggagaagcucac

SEQ ID NO: 2486736 - RNA, 18 nt, Human
ugcuauauuuucaugacu

SEQ ID NO: 2486737 - RNA, 16 nt, Human
ugcuauauuuucauga

SEQ ID NO: 2486738 - RNA, 22 nt, Human
ugcuauauuuucaugacuuuuc

SEQ ID NO: 2486739 - RNA, 19 nt, Human
ugcuauccagcuauuuuua

SEQ ID NO: 2486740 - RNA, 15 nt, Human
ugcucugcauguuac

SEQ ID NO: 2486741 - RNA, 18 nt, Human
ugcucugcauguuacaua

SEQ ID NO: 2486742 - RNA, 17 nt, Human
ugcucuggacaggcaug

SEQ ID NO: 2486743 - RNA, 20 nt, Human
ugcucugcaggcaccuuagu

SEQ ID NO: 2486744 - RNA, 17 nt, Human
ugcugacuguuuucucu

SEQ ID NO: 2486745 - RNA, 22 nt, Human
ugcucugucuucuuugcccaca

SEQ ID NO: 2486746 - RNA, 22 nt, Human
ugcucuguaaucucguuucaaa

SEQ ID NO: 2486747 - RNA, 19 nt, Human
ugcucugugcccacccucc

SEQ ID NO: 2486748 - RNA, 21 nt, Human
ugcggacagccacggccaggc

SEQ ID NO: 2486749 - RNA, 20 nt, Human
ugcggacagccacggccagg

SEQ ID NO: 2486750 - RNA, 23 nt, Human
ugcuacccucccugcuguccccu

SEQ ID NO: 2486751 - RNA, 20 nt, Human
ugcuacccucccugcugucc

SEQ ID NO: 2486752 - RNA, 19 nt, Human
ugcuacccucccugcuguc

SEQ ID NO: 2486753 - RNA, 18 nt, Human
ugcuacccucccugcugu

SEQ ID NO: 2486754 - RNA, 17 nt, Human
ugcuacccucccugcug

SEQ ID NO: 2486755 - RNA, 15 nt, Human
ugcgaguauguguuu

SEQ ID NO: 2486756 - RNA, 14 nt, Human
ugcgaguauguguu

SEQ ID NO: 2486757 - RNA, 14 nt, Human
ugcuaccucacugg

SEQ ID NO: 2486758 - RNA, 15 nt, Human
ugcuaccucacuggg

SEQ ID NO: 2486759 - RNA, 16 nt, Human
ugcuaccucacugggg

SEQ ID NO: 2486760 - RNA, 22 nt, Human
ugcuaccucacugggguccugg

SEQ ID NO: 2486761 - RNA, 16 nt, Human
ugcuacgugugauuuu

SEQ ID NO: 2486762 - RNA, 15 nt, Human
ugcuacgugugauuu

SEQ ID NO: 2486763 - RNA, 14 nt, Human
ugcuacgugugauu

SEQ ID NO: 2486764 - RNA, 13 nt, Human
ugcuacgugugau

SEQ ID NO: 2486765 - RNA, 14 nt, Human
agcuguuuccauag

SEQ ID NO: 2486766 - RNA, 13 nt, Human
agcuguuugucau

SEQ ID NO: 2486767 - RNA, 20 nt, Human
agcuguuuuaguuaaauuuc

SEQ ID NO: 2486768 - RNA, 18 nt, Human
agcuguuuuaguuaaauu

SEQ ID NO: 2486769 - RNA, 15 nt, Human
agcuguuuucccuga

SEQ ID NO: 2486770 - RNA, 13 nt, Human
ugcuacgccugca

SEQ ID NO: 2486771 - RNA, 16 nt, Human
ugcuacgccugcaugu

SEQ ID NO: 2486772 - RNA, 19 nt, Human
ugcuacguacaugugaggc

SEQ ID NO: 2486773 - RNA, 20 nt, Human
ugcuacgccugcauguaaac

SEQ ID NO: 2486774 - RNA, 23 nt, Human
ugcuaccuggguccuuuucagaa

SEQ ID NO: 2486775 - RNA, 22 nt, Human
ugcuaccuggguccuuuucaga

SEQ ID NO: 2486776 - RNA, 16 nt, Human
ugcuaccucagucagu

SEQ ID NO: 2486777 - RNA, 13 nt, Human
ugcuaccucaguc

SEQ ID NO: 2486778 - RNA, 21 nt, Human
ugcuacccucccugcuguccc

SEQ ID NO: 2486779 - RNA, 19 nt, Human
ugcuaccuggguccuuuuc

SEQ ID NO: 2486780 - RNA, 15 nt, Human
agcuuagagccuccc

SEQ ID NO: 2486781 - RNA, 14 nt, Human
agcuuagcaggaga

SEQ ID NO: 2486782 - RNA, 22 nt, Human
agcuuagcaggagaggagagcc

SEQ ID NO: 2486783 - RNA, 16 nt, Human
agcuuagcaggagagg

SEQ ID NO: 2486784 - RNA, 17 nt, Human
agcuuagccaauguggg

SEQ ID NO: 2486785 - RNA, 14 nt, Human
agcuguuuucuucu

SEQ ID NO: 2486786 - RNA, 18 nt, Human
agcuguuuucccugaccu

SEQ ID NO: 2486787 - RNA, 12 nt, Human
agcuuaucucag

SEQ ID NO: 2486788 - RNA, 13 nt, Human
agcuuaggcaggg

SEQ ID NO: 2486789 - RNA, 15 nt, Human
agcuuaucaugcugu

SEQ ID NO: 2486790 - RNA, 14 nt, Human
agcuuaucucaggg

SEQ ID NO: 2486791 - RNA, 15 nt, Human
agcuuaucucagggg

SEQ ID NO: 2486792 - RNA, 20 nt, Human
agcuuauuaaaacucauuuu

SEQ ID NO: 2486793 - RNA, 15 nt, Human
agcuuauuaaaacuc

SEQ ID NO: 2486794 - RNA, 19 nt, Human
agcuuaucaugcugucuuu

SEQ ID NO: 2486795 - RNA, 21 nt, Human
agcuuauugucuagugaaacu

SEQ ID NO: 2486796 - RNA, 22 nt, Human
agcuuauucaucuguuuuucuu

SEQ ID NO: 2486797 - RNA, 20 nt, Human
agcuugcugcccuaggcucc

SEQ ID NO: 2486798 - RNA, 15 nt, Human
agcuuggcagccgag

SEQ ID NO: 2486799 - RNA, 14 nt, Human
agcuuggcagccga

SEQ ID NO: 2486800 - RNA, 13 nt, Human
agcuuggcagccg

SEQ ID NO: 2486801 - RNA, 12 nt, Human
agcuuggcagcc

SEQ ID NO: 2486802 - RNA, 20 nt, Human
agcuuggcagccgagcucgu

SEQ ID NO: 2486803 - RNA, 17 nt, Human
agcuuggcagccgagcu

SEQ ID NO: 2486804 - RNA, 21 nt, Human
agcuuggcagccgagcucgug

SEQ ID NO: 2486805 - RNA, 14 nt, Human
agcuuggccagaag

SEQ ID NO: 2486806 - RNA, 18 nt, Human
agcuuggaagagccugca

SEQ ID NO: 2486807 - RNA, 17 nt, Human
agcuuggaagagccugc

SEQ ID NO: 2486808 - RNA, 16 nt, Human
agcuuggaagagccug

SEQ ID NO: 2486809 - RNA, 17 nt, Human
agcuuggaaaggaccag

SEQ ID NO: 2486810 - RNA, 23 nt, Human
agcuuggaaacuggaugagguca

SEQ ID NO: 2486811 - RNA, 21 nt, Human
agcuuguaaauagcucaggug

SEQ ID NO: 2486812 - RNA, 20 nt, Human
agcuuguaaauagcucaggu

SEQ ID NO: 2486813 - RNA, 12 nt, Human
agcuugggaaug

SEQ ID NO: 2486814 - RNA, 14 nt, Human
agcuugggaaugga

SEQ ID NO: 2486815 - RNA, 16 nt, Human
agcuuggcuguagaag

SEQ ID NO: 2486816 - RNA, 23 nt, Human
agcuuggcuguagaaggagacag

SEQ ID NO: 2486817 - RNA, 19 nt, Human
agcuuguaaauagcucagg

SEQ ID NO: 2486818 - RNA, 16 nt, Human
agcuugggacaaauca

SEQ ID NO: 2486819 - RNA, 23 nt, Human
agcuuuccugccccaggccugaa

SEQ ID NO: 2486820 - RNA, 20 nt, Human
agcuuucuguccuuuuggca

SEQ ID NO: 2486821 - RNA, 22 nt, Human
agcuuucuguccuuuuggcacu

SEQ ID NO: 2486822 - RNA, 19 nt, Human
aggaaagagaacuuccaga

SEQ ID NO: 2486823 - RNA, 13 nt, Human
aggaaagagaacu

SEQ ID NO: 2486824 - RNA, 13 nt, Human
aggaaagaggcuc

SEQ ID NO: 2486825 - RNA, 12 nt, Human
aggaaagaggcu

SEQ ID NO: 2486826 - RNA, 21 nt, Human
aggaaacuccacaucugccuu

SEQ ID NO: 2486827 - RNA, 20 nt, Human
aggaaacuccacaucugccu

SEQ ID NO: 2486828 - RNA, 19 nt, Human
aggaaacuccacaucugcc

SEQ ID NO: 2486829 - RNA, 16 nt, Human
aggaaacuccacaucu

SEQ ID NO: 2486830 - RNA, 20 nt, Human
aggaaacuccugacagucuu

SEQ ID NO: 2486831 - RNA, 22 nt, Human
aggaaacuccacaucugccuua

SEQ ID NO: 2486832 - RNA, 21 nt, Human
aggaaacucugcauucuagua

SEQ ID NO: 2486833 - RNA, 16 nt, Human
aggaaacucaccugcu

SEQ ID NO: 2486834 - RNA, 17 nt, Human
aggaaacucaccugcug

SEQ ID NO: 2486835 - RNA, 20 nt, Human
aggaaacucaccugcuggcc

SEQ ID NO: 2486836 - RNA, 21 nt, Human
aggaaacucaccugcuggccc

SEQ ID NO: 2486837 - RNA, 22 nt, Human
aggaaacucaccugcuggcccc

SEQ ID NO: 2486838 - RNA, 23 nt, Human
aggaaacucaccugcuggccccu

SEQ ID NO: 2486839 - RNA, 17 nt, Human
aggaaacucuuaucuca

SEQ ID NO: 2486840 - RNA, 13 nt, Human
aggaaacucuuau

SEQ ID NO: 2486841 - RNA, 12 nt, Human
aggaaacucuua

SEQ ID NO: 2486842 - RNA, 19 nt, Human
aggaaacuggguuccugca

SEQ ID NO: 2486843 - RNA, 22 nt, Human
aggaaacucuuaucucagucau

SEQ ID NO: 2486844 - RNA, 18 nt, Human
aggaaacucuuaucucag

SEQ ID NO: 2486845 - RNA, 17 nt, Human
aggaaagaaagaaggaa

SEQ ID NO: 2486846 - RNA, 14 nt, Human
ugcuaguaauugga

SEQ ID NO: 2486847 - RNA, 19 nt, Human
aggaaagcaaaggagauug

SEQ ID NO: 2486848 - RNA, 17 nt, Human
aggaaagcaaaggagau

SEQ ID NO: 2486849 - RNA, 16 nt, Human
aggaaagaggcucugg

SEQ ID NO: 2486850 - RNA, 16 nt, Human
ugcuaguaauuggaaa

SEQ ID NO: 2486851 - RNA, 20 nt, Human
aggaaagaaugaaagaguaa

SEQ ID NO: 2486852 - RNA, 16 nt, Human
ugcuagucuuaagaac

SEQ ID NO: 2486853 - RNA, 21 nt, Human
ugcuauaacuauguugauaaa

SEQ ID NO: 2486854 - RNA, 13 nt, Human
ugcuauacugcau

SEQ ID NO: 2486855 - RNA, 14 nt, Human
ugcuauagccuggg

SEQ ID NO: 2486856 - RNA, 22 nt, Human
aggaaagauuuuuguuguuauu

SEQ ID NO: 2486857 - RNA, 12 nt, Human
agcuuugaaaau

SEQ ID NO: 2486858 - RNA, 16 nt, Human
agcuuugaaaauucag

SEQ ID NO: 2486859 - RNA, 18 nt, Human
agcuuugaaaauucagug

SEQ ID NO: 2486860 - RNA, 19 nt, Human
agcuuugaaaauucagugg

SEQ ID NO: 2486861 - RNA, 16 nt, Human
aggaaaaguacauuua

SEQ ID NO: 2486862 - RNA, 21 nt, Human
aggaaaaggugauauccauuc

SEQ ID NO: 2486863 - RNA, 18 nt, Human
aggaaaaggugauaucca

SEQ ID NO: 2486864 - RNA, 22 nt, Human
agcuuugaaggccgaaggcagu

SEQ ID NO: 2486865 - RNA, 19 nt, Human
agcuuugaaggccgaaggc

SEQ ID NO: 2486866 - RNA, 20 nt, Human
aggaaacccagcucuggucc

SEQ ID NO: 2486867 - RNA, 18 nt, Human
aggaaacccagcucuggu

SEQ ID NO: 2486868 - RNA, 21 nt, Human
aggaaacccagcucuggucca

SEQ ID NO: 2486869 - RNA, 23 nt, Human
aggaaaccaguuaggucucaaua

SEQ ID NO: 2486870 - RNA, 14 nt, Human
aggaaaauccucug

SEQ ID NO: 2486871 - RNA, 17 nt, Human
aggaaacccagcucugg

SEQ ID NO: 2486872 - RNA, 16 nt, Human
aggaaacccagcucug

SEQ ID NO: 2486873 - RNA, 15 nt, Human
aggaaacccagcucu

SEQ ID NO: 2486874 - RNA, 22 nt, Human
aggaaaaguacauuuaauacag

SEQ ID NO: 2486875 - RNA, 19 nt, Human
aggaaaaguacauuuaaua

SEQ ID NO: 2486876 - RNA, 16 nt, Human
aggaaaauaguaaugu

SEQ ID NO: 2486877 - RNA, 13 nt, Human
aggcacaaaauga

SEQ ID NO: 2486878 - RNA, 17 nt, Human
aggcacaaaaugaugga

SEQ ID NO: 2486879 - RNA, 22 nt, Human
aggcaaugucaggaacagaagg

SEQ ID NO: 2486880 - RNA, 23 nt, Human
aggcaaugucaggaacagaagga

SEQ ID NO: 2486881 - RNA, 17 nt, Human
aggcacagugaaggcug

SEQ ID NO: 2486882 - RNA, 13 nt, Human
aggcacauggagg

SEQ ID NO: 2486883 - RNA, 14 nt, Human
aggcacauggagga

SEQ ID NO: 2486884 - RNA, 17 nt, Human
aggcacauggaggagcu

SEQ ID NO: 2486885 - RNA, 16 nt, Human
aggcaaugcuggcugu

SEQ ID NO: 2486886 - RNA, 13 nt, Human
uggaggaaagcaa

SEQ ID NO: 2486887 - RNA, 21 nt, Human
uggagcuuuuuucuuuaagau

SEQ ID NO: 2486888 - RNA, 16 nt, Human
uggagcuuuuuucuuu

SEQ ID NO: 2486889 - RNA, 14 nt, Human
uggagcuuuuuucc

SEQ ID NO: 2486890 - RNA, 17 nt, Human
aggcaaugucaggaaca

SEQ ID NO: 2486891 - RNA, 19 nt, Human
aggcaaugucaggaacaga

SEQ ID NO: 2486892 - RNA, 23 nt, Human
uggaggaaaaccaagccguggcu

SEQ ID NO: 2486893 - RNA, 21 nt, Human
uggaggaaaaccaagccgugg

SEQ ID NO: 2486894 - RNA, 15 nt, Human
aggcaaugcuggcug

SEQ ID NO: 2486895 - RNA, 13 nt, Human
uggagccuggugc

SEQ ID NO: 2486896 - RNA, 15 nt, Human
uggagccugcagggu

SEQ ID NO: 2486897 - RNA, 23 nt, Human
uggagccugcaggguggugcugg

SEQ ID NO: 2486898 - RNA, 16 nt, Human
uggagccugcagagcu

SEQ ID NO: 2486899 - RNA, 13 nt, Human
uggagccugcagg

SEQ ID NO: 2486900 - RNA, 12 nt, Human
uggagccugugu

SEQ ID NO: 2486901 - RNA, 14 nt, Human
uggagccuggugcc

SEQ ID NO: 2486902 - RNA, 13 nt, Human
uggagcugagccu

SEQ ID NO: 2486903 - RNA, 15 nt, Human
uggagcugagccucu

SEQ ID NO: 2486904 - RNA, 14 nt, Human
uggagccuguguaa

SEQ ID NO: 2486905 - RNA, 17 nt, Human
uggagcugagccucuca

SEQ ID NO: 2486906 - RNA, 15 nt, Human
uggagcugccugaua

SEQ ID NO: 2486907 - RNA, 13 nt, Human
uggagcugccuga

SEQ ID NO: 2486908 - RNA, 21 nt, Human
uggagcuucauggcagaaggc

SEQ ID NO: 2486909 - RNA, 18 nt, Human
uggagcuggcgucugucu

SEQ ID NO: 2486910 - RNA, 11 nt, Human
uggagccugca

SEQ ID NO: 2486911 - RNA, 20 nt, Human
uggagccggacuuucggagu

SEQ ID NO: 2486912 - RNA, 15 nt, Human
uggagcccuuggguu

SEQ ID NO: 2486913 - RNA, 17 nt, Human
uggagccgaggccuacc

SEQ ID NO: 2486914 - RNA, 23 nt, Human
uggagccggacuuucggaguugg

SEQ ID NO: 2486915 - RNA, 22 nt, Human
uggagccggacuuucggaguug

SEQ ID NO: 2486916 - RNA, 22 nt, Human
uggagccuagagugagggccug

SEQ ID NO: 2486917 - RNA, 23 nt, Human
uggagcccagaggagggcagcag

SEQ ID NO: 2486918 - RNA, 20 nt, Human
uggagcccagaggagggcag

SEQ ID NO: 2486919 - RNA, 12 nt, Human
uggagccgaggc

SEQ ID NO: 2486920 - RNA, 13 nt, Human
uggagcccaggcg

SEQ ID NO: 2486921 - RNA, 19 nt, Human
uggagcccagaggagggca

SEQ ID NO: 2486922 - RNA, 15 nt, Human
uggagcccagaggag

SEQ ID NO: 2486923 - RNA, 21 nt, Human
uggagaagccacaggccugag

SEQ ID NO: 2486924 - RNA, 11 nt, Human
uggagaagcca

SEQ ID NO: 2486925 - RNA, 16 nt, Human
uggacccgcucuggac

SEQ ID NO: 2486926 - RNA, 15 nt, Human
uggacccgcucugga

SEQ ID NO: 2486927 - RNA, 19 nt, Human
uggacccgcucuggaccaa

SEQ ID NO: 2486928 - RNA, 14 nt, Human
uggacccgcucugg

SEQ ID NO: 2486929 - RNA, 11 nt, Human
uggacuuuguu

SEQ ID NO: 2486930 - RNA, 22 nt, Human
uggacuuuguuaguuucuccaa

SEQ ID NO: 2486931 - RNA, 23 nt, Human
uggacaccccuuauccaggacuc

SEQ ID NO: 2486932 - RNA, 20 nt, Human
uggaccccagcugggaggca

SEQ ID NO: 2486933 - RNA, 19 nt, Human
uggaccccagcugggaggc

SEQ ID NO: 2486934 - RNA, 18 nt, Human
uggaccccagcugggagg

SEQ ID NO: 2486935 - RNA, 16 nt, Human
uggaccccagcuggga

SEQ ID NO: 2486936 - RNA, 15 nt, Human
uggaccccagcuggg

SEQ ID NO: 2486937 - RNA, 14 nt, Human
uggaccccagcugg

SEQ ID NO: 2486938 - RNA, 13 nt, Human
uggaccccagcug

SEQ ID NO: 2486939 - RNA, 13 nt, Human
uggacccccagcu

SEQ ID NO: 2486940 - RNA, 23 nt, Human
uggaccccagcugggaggcaaga

SEQ ID NO: 2486941 - RNA, 14 nt, Human
uggacccccagcuu

SEQ ID NO: 2486942 - RNA, 16 nt, Human
uggaccccaucuguga

SEQ ID NO: 2486943 - RNA, 18 nt, Human
uggaccccaucugugaau

SEQ ID NO: 2486944 - RNA, 20 nt, Human
uggaccccaucugugaauaa

SEQ ID NO: 2486945 - RNA, 21 nt, Human
uggaccccaucugugaauaag

SEQ ID NO: 2486946 - RNA, 23 nt, Human
uggagcccacuguacuugcucuu

SEQ ID NO: 2486947 - RNA, 19 nt, Human
uggagcccacuguacuugc

SEQ ID NO: 2486948 - RNA, 16 nt, Human
uggagcccacuguacu

SEQ ID NO: 2486949 - RNA, 20 nt, Human
uggagaagccacaggccuga

SEQ ID NO: 2486950 - RNA, 19 nt, Human
uggagaagccacaggccug

SEQ ID NO: 2486951 - RNA, 18 nt, Human
uggagaagccacaggccu

SEQ ID NO: 2486952 - RNA, 16 nt, Human
uggagaagagaggaga

SEQ ID NO: 2486953 - RNA, 13 nt, Human
uggagaagcagug

SEQ ID NO: 2486954 - RNA, 16 nt, Human
uggagaagaacugaaa

SEQ ID NO: 2486955 - RNA, 19 nt, Human
uggagaagagaggagagga

SEQ ID NO: 2486956 - RNA, 14 nt, Human
uggagaagagagga

SEQ ID NO: 2486957 - RNA, 20 nt, Human
uggagaagagagaggaaagg

SEQ ID NO: 2486958 - RNA, 17 nt, Human
uggagaagacccucccc

SEQ ID NO: 2486959 - RNA, 12 nt, Human
uggagaagagag

SEQ ID NO: 2486960 - RNA, 24 nt, Human
uggacuuuguuaguuucuccaagc

SEQ ID NO: 2486961 - RNA, 14 nt, Human
uggacuuuguucac

SEQ ID NO: 2486962 - RNA, 20 nt, Human
aggcagcucuaaaugucaau

SEQ ID NO: 2486963 - RNA, 22 nt, Human
aggcagccuggacauagagagg

SEQ ID NO: 2486964 - RNA, 20 nt, Human
aggcagccuggacauagaga

SEQ ID NO: 2486965 - RNA, 22 nt, Human
aggcagccccauucugccugcc

SEQ ID NO: 2486966 - RNA, 20 nt, Human
aggcagcccugucugaagga

SEQ ID NO: 2486967 - RNA, 21 nt, Human
aggcagccccauucugccugc

SEQ ID NO: 2486968 - RNA, 20 nt, Human
aggcagccccauucugccug

SEQ ID NO: 2486969 - RNA, 19 nt, Human
aggcagccccauucugccu

SEQ ID NO: 2486970 - RNA, 15 nt, Human
aggcacccaccauca

SEQ ID NO: 2486971 - RNA, 23 nt, Human
aggcaggacaugcugaagccaaa

SEQ ID NO: 2486972 - RNA, 21 nt, Human
aggcaggacaugcugaagcca

SEQ ID NO: 2486973 - RNA, 17 nt, Human
aggcaggagaaucacuu

SEQ ID NO: 2486974 - RNA, 12 nt, Human
aggcagggaagu

SEQ ID NO: 2486975 - RNA, 21 nt, Human
aggcagggaaguguaagaaac

SEQ ID NO: 2486976 - RNA, 13 nt, Human
aggcagggaaguc

SEQ ID NO: 2486977 - RNA, 19 nt, Human
aggcagggaaguccccagg

SEQ ID NO: 2486978 - RNA, 23 nt, Human
aggcagggaaguccccaggcccc

SEQ ID NO: 2486979 - RNA, 16 nt, Human
aggcagggauuugagg

SEQ ID NO: 2486980 - RNA, 15 nt, Human
aggcagggauuugag

SEQ ID NO: 2486981 - RNA, 14 nt, Human
aggcagggauuuga

SEQ ID NO: 2486982 - RNA, 16 nt, Human
aggcagggagggccug

SEQ ID NO: 2486983 - RNA, 12 nt, Human
aggcagggaggg

SEQ ID NO: 2486984 - RNA, 13 nt, Human
aggcagggagggg

SEQ ID NO: 2486985 - RNA, 14 nt, Human
aggcagggagggga

SEQ ID NO: 2486986 - RNA, 16 nt, Human
aggcagggaggggacu

SEQ ID NO: 2486987 - RNA, 20 nt, Human
aggcagcgccaagcaaccug

SEQ ID NO: 2486988 - RNA, 19 nt, Human
aggcagcgccaagcaaccu

SEQ ID NO: 2486989 - RNA, 14 nt, Human
aggcagcgccaagc

SEQ ID NO: 2486990 - RNA, 21 nt, Human
aggcaggaccuucgggcugug

SEQ ID NO: 2486991 - RNA, 22 nt, Human
aggcaggaccuucgggcugugc

SEQ ID NO: 2486992 - RNA, 23 nt, Human
aggcaggaccuucgggcugugcc

SEQ ID NO: 2486993 - RNA, 20 nt, Human
aggcaggaguuucguuuuca

SEQ ID NO: 2486994 - RNA, 12 nt, Human
aggcaggauggc

SEQ ID NO: 2486995 - RNA, 21 nt, Human
aggcagggucucacucugucg

SEQ ID NO: 2486996 - RNA, 20 nt, Human
aggcagggucucacucuguc

SEQ ID NO: 2486997 - RNA, 18 nt, Human
aggcagggucucacucug

SEQ ID NO: 2486998 - RNA, 19 nt, Human
aggcagggucucacucugu

SEQ ID NO: 2486999 - RNA, 14 nt, Human
aggcagguccaggg

SEQ ID NO: 2487000 - RNA, 11 nt, Human
aggcagguccc

SEQ ID NO: 2487001 - RNA, 15 nt, Human
aggcagguagccagg

SEQ ID NO: 2487002 - RNA, 14 nt, Human
aggcagguagccag

SEQ ID NO: 2487003 - RNA, 22 nt, Human
aggcagggucucacucugucgc

SEQ ID NO: 2487004 - RNA, 19 nt, Human
aggcagggccuugcccaga

SEQ ID NO: 2487005 - RNA, 14 nt, Human
aggcagggugcagu

SEQ ID NO: 2487006 - RNA, 20 nt, Human
aggcagggccuugcccagag

SEQ ID NO: 2487007 - RNA, 22 nt, Human
aggcagucgggggcuggccuag

SEQ ID NO: 2487008 - RNA, 21 nt, Human
aggcagucgggggcuggccua

SEQ ID NO: 2487009 - RNA, 20 nt, Human
aggcagucgggggcuggccu

SEQ ID NO: 2487010 - RNA, 19 nt, Human
aggcagucgggggcuggcc

SEQ ID NO: 2487011 - RNA, 18 nt, Human
aggcagucgggggcuggc

SEQ ID NO: 2487012 - RNA, 23 nt, Human
aggcagucgggggcuggccuagg

SEQ ID NO: 2487013 - RNA, 22 nt, Human
aggcagugcaagagacucuggc

SEQ ID NO: 2487014 - RNA, 19 nt, Human
aggcagugaugcuggaugc

SEQ ID NO: 2487015 - RNA, 19 nt, Human
aggcagugggucccacuuc

SEQ ID NO: 2487016 - RNA, 18 nt, Human
aggcagugggucccacuu

SEQ ID NO: 2487017 - RNA, 16 nt, Human
aggcagugggucccac

SEQ ID NO: 2487018 - RNA, 12 nt, Human
aggcaggucccc

SEQ ID NO: 2487019 - RNA, 13 nt, Human
aggcaggucccca

SEQ ID NO: 2487020 - RNA, 14 nt, Human
aggcagguccccag

SEQ ID NO: 2487021 - RNA, 15 nt, Human
aggcagguccccaga

SEQ ID NO: 2487022 - RNA, 16 nt, Human
aggcagguccccagac

SEQ ID NO: 2487023 - RNA, 19 nt, Human
aggcaguaauaaaaagauu

SEQ ID NO: 2487024 - RNA, 16 nt, Human
aggcagguagccaggg

SEQ ID NO: 2487025 - RNA, 21 nt, Human
aggcaggucuugaacuccugg

SEQ ID NO: 2487026 - RNA, 18 nt, Human
aggaugcuuguacauaau

SEQ ID NO: 2487027 - RNA, 22 nt, Human
aggauugcuacuguccuaccca

SEQ ID NO: 2487028 - RNA, 13 nt, Human
aggauuguaaaaa

SEQ ID NO: 2487029 - RNA, 21 nt, Human
aggauugcuugagcccaggag

SEQ ID NO: 2487030 - RNA, 22 nt, Human
aggauugcuugagcccaggagu

SEQ ID NO: 2487031 - RNA, 17 nt, Human
aggauugcuugagccca

SEQ ID NO: 2487032 - RNA, 18 nt, Human
aggauugcuugagcccag

SEQ ID NO: 2487033 - RNA, 19 nt, Human
aggauugcuugagcccagg

SEQ ID NO: 2487034 - RNA, 20 nt, Human
aggauugcuugagcccagga

SEQ ID NO: 2487035 - RNA, 23 nt, Human
aggauuuuaacaaaagcaagacu

SEQ ID NO: 2487036 - RNA, 11 nt, Human
aggauuuuaug

SEQ ID NO: 2487037 - RNA, 14 nt, Human
aggauuuuaugcuu

SEQ ID NO: 2487038 - RNA, 15 nt, Human
aggauuuuaugcuuu

SEQ ID NO: 2487039 - RNA, 19 nt, Human
aggauuuuaacaaaagcaa

SEQ ID NO: 2487040 - RNA, 13 nt, Human
aggauuucguggg

SEQ ID NO: 2487041 - RNA, 20 nt, Human
aggauuucaugauuucauuu

SEQ ID NO: 2487042 - RNA, 19 nt, Human
aggauuucaugauuucauu

SEQ ID NO: 2487043 - RNA, 20 nt, Human
aggauuuaacagucauuuaa

SEQ ID NO: 2487044 - RNA, 18 nt, Human
aggauuuaacagucauuu

SEQ ID NO: 2487045 - RNA, 12 nt, Human
aggauuucaagc

SEQ ID NO: 2487046 - RNA, 21 nt, Human
aggauuuaacagucauuuaaa

SEQ ID NO: 2487047 - RNA, 14 nt, Human
aggauuucaagccu

SEQ ID NO: 2487048 - RNA, 15 nt, Human
aggauuucaagccug

SEQ ID NO: 2487049 - RNA, 16 nt, Human
aggauuucaagccugc

SEQ ID NO: 2487050 - RNA, 16 nt, Human
aggauuuaacagucau

SEQ ID NO: 2487051 - RNA, 12 nt, Human
aggauuuaacag

SEQ ID NO: 2487052 - RNA, 23 nt, Human
aggauuguaaaaaaaaaugccuu

SEQ ID NO: 2487053 - RNA, 19 nt, Human
aggauuguaaaaaaaaaug

SEQ ID NO: 2487054 - RNA, 16 nt, Human
aggauugugauauuuu

SEQ ID NO: 2487055 - RNA, 13 nt, Human
aggaucucucagg

SEQ ID NO: 2487056 - RNA, 22 nt, Human
aggaucuagaauguguuuucug

SEQ ID NO: 2487057 - RNA, 16 nt, Human
aggaucuagaaugugu

SEQ ID NO: 2487058 - RNA, 14 nt, Human
aggaucuagagggg

SEQ ID NO: 2487059 - RNA, 18 nt, Human
aggaucacagugcugaga

SEQ ID NO: 2487060 - RNA, 16 nt, Human
aggaucagauugcaug

SEQ ID NO: 2487061 - RNA, 21 nt, Human
aggauccugagccagauuuca

SEQ ID NO: 2487062 - RNA, 12 nt, Human
aggaucagucug

SEQ ID NO: 2487063 - RNA, 15 nt, Human
aggaugcuuguacau

SEQ ID NO: 2487064 - RNA, 16 nt, Human
aggaugcuuguacaua

SEQ ID NO: 2487065 - RNA, 23 nt, Human
aggaugcuaacaucuaaaaauag

SEQ ID NO: 2487066 - RNA, 22 nt, Human
aggaucucucaggagcacaggc

SEQ ID NO: 2487067 - RNA, 21 nt, Human
aggaucucucaggagcacagg

SEQ ID NO: 2487068 - RNA, 22 nt, Human
aggaugcuaacaucuaaaaaua

SEQ ID NO: 2487069 - RNA, 20 nt, Human
aggaucucucaggagcacag

SEQ ID NO: 2487070 - RNA, 19 nt, Human
aggaucucucaggagcaca

SEQ ID NO: 2487071 - RNA, 15 nt, Human
aggaucucucaggag

SEQ ID NO: 2487072 - RNA, 14 nt, Human
aggaucucucagga

SEQ ID NO: 2487073 - RNA, 22 nt, Human
uggacaccccuuauccaggacu

SEQ ID NO: 2487074 - RNA, 21 nt, Human
uggacaccccuuauccaggac

SEQ ID NO: 2487075 - RNA, 15 nt, Human
uggacaccggaaaca

SEQ ID NO: 2487076 - RNA, 20 nt, Human
uggacaccaggagucccugg

SEQ ID NO: 2487077 - RNA, 20 nt, Human
uggacaccccuuauccagga

SEQ ID NO: 2487078 - RNA, 22 nt, Human
uggacaagcagagguggccaga

SEQ ID NO: 2487079 - RNA, 21 nt, Human
uggacaccaggagucccuggu

SEQ ID NO: 2487080 - RNA, 23 nt, Human
uggaauuuuucauugauaugaaa

SEQ ID NO: 2487081 - RNA, 12 nt, Human
uggaauuuuuca

SEQ ID NO: 2487082 - RNA, 16 nt, Human
uggaauuuguaaguuu

SEQ ID NO: 2487083 - RNA, 14 nt, Human
uggaauuuguaagu

SEQ ID NO: 2487084 - RNA, 19 nt, Human
uggaauuuguaaccucagc

SEQ ID NO: 2487085 - RNA, 18 nt, Human
uggaauuuguaaccucag

SEQ ID NO: 2487086 - RNA, 17 nt, Human
uggaauuuguaaccuca

SEQ ID NO: 2487087 - RNA, 16 nt, Human
uggaauuuguaaccuc

SEQ ID NO: 2487088 - RNA, 22 nt, Human
uggaauuugcaagucauggcug

SEQ ID NO: 2487089 - RNA, 14 nt, Human
uggaauuugaaaca

SEQ ID NO: 2487090 - RNA, 13 nt, Human
aggcaagaggggu

SEQ ID NO: 2487091 - RNA, 21 nt, Human
aggcaagaggggguggagggg

SEQ ID NO: 2487092 - RNA, 17 nt, Human
aggcaagagggggugga

SEQ ID NO: 2487093 - RNA, 24 nt, Human
aggcaagagggguggagacugcuu

SEQ ID NO: 2487094 - RNA, 14 nt, Human
aggcaagcaccucc

SEQ ID NO: 2487095 - RNA, 19 nt, Human
aggcaacugcauuggcuuu

SEQ ID NO: 2487096 - RNA, 16 nt, Human
aggcaacuugggaacu

SEQ ID NO: 2487097 - RNA, 16 nt, Human
aggauuuuaugcuuua

SEQ ID NO: 2487098 - RNA, 12 nt, Human
aggcaagagaau

SEQ ID NO: 2487099 - RNA, 21 nt, Human
aggauauguucacaccuagcg

SEQ ID NO: 2487100 - RNA, 23 nt, Human
aggauauguucacaccuagcguc

SEQ ID NO: 2487101 - RNA, 15 nt, Human
aggaucaagaaagug

SEQ ID NO: 2487102 - RNA, 24 nt, Human
aggaguuugaggcugcagcgagcu

SEQ ID NO: 2487103 - RNA, 14 nt, Human
aggaucacuggagc

SEQ ID NO: 2487104 - RNA, 15 nt, Human
aggaucacuggagcc

SEQ ID NO: 2487105 - RNA, 16 nt, Human
aggaucacuggagccc

SEQ ID NO: 2487106 - RNA, 18 nt, Human
aggaucacuggagcccag

SEQ ID NO: 2487107 - RNA, 19 nt, Human
aggaucacuggagcccagg

SEQ ID NO: 2487108 - RNA, 20 nt, Human
aggaucacuggagcccagga

SEQ ID NO: 2487109 - RNA, 22 nt, Human
aggaucacuggagcccaggagu

SEQ ID NO: 2487110 - RNA, 19 nt, Human
aggaguuucguuuucaaaa

SEQ ID NO: 2487111 - RNA, 12 nt, Human
aggaggccucca

SEQ ID NO: 2487112 - RNA, 16 nt, Human
aggaggccggggccgg

SEQ ID NO: 2487113 - RNA, 18 nt, Human
aggaggccccuggcccag

SEQ ID NO: 2487114 - RNA, 17 nt, Human
aggaggccccuggccca

SEQ ID NO: 2487115 - RNA, 17 nt, Human
aggaggccuccaucuca

SEQ ID NO: 2487116 - RNA, 15 nt, Human
aggaggccuccaucu

SEQ ID NO: 2487117 - RNA, 21 nt, Human
aggaguuugagaccaaccugg

SEQ ID NO: 2487118 - RNA, 16 nt, Human
aggaguuugagaccag

SEQ ID NO: 2487119 - RNA, 19 nt, Human
aggaguuugagaccagccu

SEQ ID NO: 2487120 - RNA, 19 nt, Human
aggaguuugaggcugcagc

SEQ ID NO: 2487121 - RNA, 20 nt, Human
aggaguuugaggcugcagcg

SEQ ID NO: 2487122 - RNA, 23 nt, Human
aggaggccaccucuccaagggcu

SEQ ID NO: 2487123 - RNA, 22 nt, Human
aggaggccaccucuccaagggc

SEQ ID NO: 2487124 - RNA, 20 nt, Human
aggaggccaccucuccaagg

SEQ ID NO: 2487125 - RNA, 19 nt, Human
aggaggccaccucuccaag

SEQ ID NO: 2487126 - RNA, 18 nt, Human
aggaggccaccucuccaa

SEQ ID NO: 2487127 - RNA, 17 nt, Human
aggaggccaccucucca

SEQ ID NO: 2487128 - RNA, 16 nt, Human
aggaggccaccucucc

SEQ ID NO: 2487129 - RNA, 15 nt, Human
aggaggccaccucuc

SEQ ID NO: 2487130 - RNA, 20 nt, Human
uggaagugugggucugugug

SEQ ID NO: 2487131 - RNA, 14 nt, Human
aggaggccaccucu

SEQ ID NO: 2487132 - RNA, 19 nt, Human
aggaggccacgugaugugg

SEQ ID NO: 2487133 - RNA, 14 nt, Human
aggaggccacguga

SEQ ID NO: 2487134 - RNA, 13 nt, Human
aggaggccaggcc

SEQ ID NO: 2487135 - RNA, 12 nt, Human
aggaggccccug

SEQ ID NO: 2487136 - RNA, 16 nt, Human
aggaggccaggcucag

SEQ ID NO: 2487137 - RNA, 22 nt, Human
aggaggccaggccggcgagccc

SEQ ID NO: 2487138 - RNA, 15 nt, Human
aggaggccagccuug

SEQ ID NO: 2487139 - RNA, 13 nt, Human
uggaagugugggu

SEQ ID NO: 2487140 - RNA, 14 nt, Human
uggaaguguggguc

SEQ ID NO: 2487141 - RNA, 14 nt, Human
uggaagugcuaauu

SEQ ID NO: 2487142 - RNA, 15 nt, Human
uggaagugacuuugg

SEQ ID NO: 2487143 - RNA, 17 nt, Human
uggaagugacuuuggcu

SEQ ID NO: 2487144 - RNA, 23 nt, Human
uggaagugacuuuggcugcaugc

SEQ ID NO: 2487145 - RNA, 14 nt, Human
uggaagugaggcau

SEQ ID NO: 2487146 - RNA, 15 nt, Human
uggaagcuguguccu

SEQ ID NO: 2487147 - RNA, 16 nt, Human
uggaagugaggcauug

SEQ ID NO: 2487148 - RNA, 18 nt, Human
uggaagugagggucagag

SEQ ID NO: 2487149 - RNA, 19 nt, Human
uggaagugagggucagaga

SEQ ID NO: 2487150 - RNA, 21 nt, Human
uggaagugagggucagagagg

SEQ ID NO: 2487151 - RNA, 10 nt, Human
ugcugcccug

SEQ ID NO: 2487152 - RNA, 17 nt, Human
ugcugcccgucuucagc

SEQ ID NO: 2487153 - RNA, 20 nt, Human
ugcugcccgucuucagccua

SEQ ID NO: 2487154 - RNA, 21 nt, Human
ugcugcccgucuucagccuag

SEQ ID NO: 2487155 - RNA, 21 nt, Human
ugcugcccaugccaccgcuuc

SEQ ID NO: 2487156 - RNA, 18 nt, Human
ugcugccccaucagugcu

SEQ ID NO: 2487157 - RNA, 19 nt, Human
ugcugccccaucagugcuc

SEQ ID NO: 2487158 - RNA, 21 nt, Human
ugcugccccaucagugcuccc

SEQ ID NO: 2487159 - RNA, 20 nt, Human
ugcugcccccaccccgggga

SEQ ID NO: 2487160 - RNA, 22 nt, Human
ugcugcccccaccccggggacc

SEQ ID NO: 2487161 - RNA, 15 nt, Human
ugcugcccccacccc

SEQ ID NO: 2487162 - RNA, 14 nt, Human
ugcugcccccaccc

SEQ ID NO: 2487163 - RNA, 17 nt, Human
uggaacacggccacauc

SEQ ID NO: 2487164 - RNA, 21 nt, Human
uggaacaaucuaaaaguuuaa

SEQ ID NO: 2487165 - RNA, 22 nt, Human
uggaacaccuaccaaaaaauaa

SEQ ID NO: 2487166 - RNA, 15 nt, Human
uggaacacggccaca

SEQ ID NO: 2487167 - RNA, 12 nt, Human
ugcugcccugcc

SEQ ID NO: 2487168 - RNA, 13 nt, Human
ugcugcccuccau

SEQ ID NO: 2487169 - RNA, 22 nt, Human
ugcugcccgucuucagccuagc

SEQ ID NO: 2487170 - RNA, 17 nt, Human
ugcugcccgcucugcag

SEQ ID NO: 2487171 - RNA, 14 nt, Human
ugcugcccuaggcu

SEQ ID NO: 2487172 - RNA, 12 nt, Human
uggaacacucug

SEQ ID NO: 2487173 - RNA, 16 nt, Human
uggaagcuaauuugca

SEQ ID NO: 2487174 - RNA, 17 nt, Human
uggaagcuaauuugcau

SEQ ID NO: 2487175 - RNA, 14 nt, Human
uggaacacucugag

SEQ ID NO: 2487176 - RNA, 14 nt, Human
uggaagcuagcucc

SEQ ID NO: 2487177 - RNA, 12 nt, Human
uggaagcuagcu

SEQ ID NO: 2487178 - RNA, 18 nt, Human
uggaagcuaauuugcauu

SEQ ID NO: 2487179 - RNA, 13 nt, Human
uggaagcuccgcu

SEQ ID NO: 2487180 - RNA, 17 nt, Human
uggaagcugcccugccc

SEQ ID NO: 2487181 - RNA, 18 nt, Human
uggaagcugcccugccca

SEQ ID NO: 2487182 - RNA, 20 nt, Human
uggaagcuagcuccccuccu

SEQ ID NO: 2487183 - RNA, 18 nt, Human
uggaagcuagcuccccuc

SEQ ID NO: 2487184 - RNA, 22 nt, Human
uggaagcuagcuccccuccucu

SEQ ID NO: 2487185 - RNA, 17 nt, Human
uggaagccggcggccca

SEQ ID NO: 2487186 - RNA, 20 nt, Human
uggaaguacuauaauuuacc

SEQ ID NO: 2487187 - RNA, 17 nt, Human
uggaaguccaauguggc

SEQ ID NO: 2487188 - RNA, 16 nt, Human
uggaagcuguguccuu

SEQ ID NO: 2487189 - RNA, 16 nt, Human
aggccugacucucagc

SEQ ID NO: 2487190 - RNA, 22 nt, Human
aggccuggacuuuccugcaacu

SEQ ID NO: 2487191 - RNA, 19 nt, Human
aggccuggacuuuccugca

SEQ ID NO: 2487192 - RNA, 18 nt, Human
aggccuggacuuuccugc

SEQ ID NO: 2487193 - RNA, 12 nt, Human
aggccuggccag

SEQ ID NO: 2487194 - RNA, 15 nt, Human
aggccuggcacagug

SEQ ID NO: 2487195 - RNA, 14 nt, Human
aggccuggcacagu

SEQ ID NO: 2487196 - RNA, 13 nt, Human
aggccuggcacag

SEQ ID NO: 2487197 - RNA, 17 nt, Human
aggccuggacuuuccug

SEQ ID NO: 2487198 - RNA, 18 nt, Human
aggccuggcacagugucu

SEQ ID NO: 2487199 - RNA, 16 nt, Human
aggccuggcacagugu

SEQ ID NO: 2487200 - RNA, 23 nt, Human
aggccuggcacagugucugggcu

SEQ ID NO: 2487201 - RNA, 11 nt, Human
aggccuggcca

SEQ ID NO: 2487202 - RNA, 18 nt, Human
uggcaucagcuggcguca

SEQ ID NO: 2487203 - RNA, 15 nt, Human
uggcaucagcuggcg

SEQ ID NO: 2487204 - RNA, 13 nt, Human
aggccuggccaga

SEQ ID NO: 2487205 - RNA, 15 nt, Human
uggcaucacagggca

SEQ ID NO: 2487206 - RNA, 18 nt, Human
uggcaucacagggcagag

SEQ ID NO: 2487207 - RNA, 20 nt, Human
uggcaucacagggcagagcc

SEQ ID NO: 2487208 - RNA, 14 nt, Human
uggcaucagcuggc

SEQ ID NO: 2487209 - RNA, 23 nt, Human
uggcaucaccuuaggcagggaag

SEQ ID NO: 2487210 - RNA, 24 nt, Human
aggccucuuggaccucugcucuga

SEQ ID NO: 2487211 - RNA, 23 nt, Human
aggccucuuggaccucugcucug

SEQ ID NO: 2487212 - RNA, 22 nt, Human
aggccucuuggaccucugcucu

SEQ ID NO: 2487213 - RNA, 21 nt, Human
aggccucuuggaccucugcuc

SEQ ID NO: 2487214 - RNA, 18 nt, Human
aggccucuuggaccucug

SEQ ID NO: 2487215 - RNA, 23 nt, Human
aggccucuguguccuucccugca

SEQ ID NO: 2487216 - RNA, 22 nt, Human
aggccucuguguccuucccugc

SEQ ID NO: 2487217 - RNA, 21 nt, Human
aggccugaaagaggcugaggc

SEQ ID NO: 2487218 - RNA, 17 nt, Human
aggccugaaagaggcug

SEQ ID NO: 2487219 - RNA, 23 nt, Human
aggccugaaagaggcugaggccu

SEQ ID NO: 2487220 - RNA, 18 nt, Human
aggccugaaaggagcccu

SEQ ID NO: 2487221 - RNA, 20 nt, Human
aggccucuguguccuucccu

SEQ ID NO: 2487222 - RNA, 16 nt, Human
aggccucuguguccuu

SEQ ID NO: 2487223 - RNA, 15 nt, Human
aggccucuguguccu

SEQ ID NO: 2487224 - RNA, 14 nt, Human
aggccucugugucc

SEQ ID NO: 2487225 - RNA, 16 nt, Human
aggccuauaaccccag

SEQ ID NO: 2487226 - RNA, 16 nt, Human
aggccuaaaaguaaac

SEQ ID NO: 2487227 - RNA, 22 nt, Human
aggccuaccccgcagacaccuu

SEQ ID NO: 2487228 - RNA, 19 nt, Human
aggccuaccccgcagacac

SEQ ID NO: 2487229 - RNA, 16 nt, Human
aggccuaccccgcaga

SEQ ID NO: 2487230 - RNA, 23 nt, Human
aggccuacaugcuuugugaacaa

SEQ ID NO: 2487231 - RNA, 17 nt, Human
aggccuaaaaguaaaca

SEQ ID NO: 2487232 - RNA, 22 nt, Human
aggccuacaugcuuugugaaca

SEQ ID NO: 2487233 - RNA, 20 nt, Human
aggccguggcugcccacaca

SEQ ID NO: 2487234 - RNA, 12 nt, Human
aggccccuggcc

SEQ ID NO: 2487235 - RNA, 21 nt, Human
aggccccugccacccugggga

SEQ ID NO: 2487236 - RNA, 18 nt, Human
aggccccugccacccugg

SEQ ID NO: 2487237 - RNA, 17 nt, Human
aggccccugccacccug

SEQ ID NO: 2487238 - RNA, 20 nt, Human
aggcccagagggccugcaag

SEQ ID NO: 2487239 - RNA, 19 nt, Human
aggcccagagggccugcaa

SEQ ID NO: 2487240 - RNA, 15 nt, Human
aggccccugccaccc

SEQ ID NO: 2487241 - RNA, 13 nt, Human
aggccccugccac

SEQ ID NO: 2487242 - RNA, 21 nt, Human
aggccgggccgaauccccucc

SEQ ID NO: 2487243 - RNA, 20 nt, Human
aggccccuggcccagcggcc

SEQ ID NO: 2487244 - RNA, 16 nt, Human
aggccccuggcccagc

SEQ ID NO: 2487245 - RNA, 21 nt, Human
aggccguccucccgggcccuc

SEQ ID NO: 2487246 - RNA, 17 nt, Human
aggccguccucccgggc

SEQ ID NO: 2487247 - RNA, 16 nt, Human
aggccguccucccggg

SEQ ID NO: 2487248 - RNA, 13 nt, Human
aggccguccuccc

SEQ ID NO: 2487249 - RNA, 19 nt, Human
aggccggggccggguacug

SEQ ID NO: 2487250 - RNA, 15 nt, Human
aggccggggccgggu

SEQ ID NO: 2487251 - RNA, 20 nt, Human
aggccgggugcucagggcug

SEQ ID NO: 2487252 - RNA, 22 nt, Human
aggccguccucccgggcccucc

SEQ ID NO: 2487253 - RNA, 12 nt, Human
aggccguggcug

SEQ ID NO: 2487254 - RNA, 16 nt, Human
aggcccggcuccaggc

SEQ ID NO: 2487255 - RNA, 15 nt, Human
aggcccggcuccagg

SEQ ID NO: 2487256 - RNA, 14 nt, Human
aggcccggcuccag

SEQ ID NO: 2487257 - RNA, 15 nt, Human
aggccccuggcccag

SEQ ID NO: 2487258 - RNA, 14 nt, Human
aggccccuggccca

SEQ ID NO: 2487259 - RNA, 17 nt, Human
aggccccuggacaagca

SEQ ID NO: 2487260 - RNA, 21 nt, Human
aggccccugucucagggugag

SEQ ID NO: 2487261 - RNA, 16 nt, Human
aggcccagagggccug

SEQ ID NO: 2487262 - RNA, 15 nt, Human
aggcccagagggccu

SEQ ID NO: 2487263 - RNA, 23 nt, Human
aggccauguuccaauaaacagga

SEQ ID NO: 2487264 - RNA, 13 nt, Human
aggccauuauugu

SEQ ID NO: 2487265 - RNA, 20 nt, Human
aggccauuccccgucucugg

SEQ ID NO: 2487266 - RNA, 23 nt, Human
aggccagagacacaagccuucgg

SEQ ID NO: 2487267 - RNA, 21 nt, Human
aggccauguuccaauaaacag

SEQ ID NO: 2487268 - RNA, 20 nt, Human
aggccauguuccaauaaaca

SEQ ID NO: 2487269 - RNA, 18 nt, Human
aggccaugggccuccugu

SEQ ID NO: 2487270 - RNA, 18 nt, Human
aggccagagacacaagcc

SEQ ID NO: 2487271 - RNA, 13 nt, Human
aggccagagacac

SEQ ID NO: 2487272 - RNA, 18 nt, Human
uggcagcucagagagggu

SEQ ID NO: 2487273 - RNA, 16 nt, Human
uggcagcucagagagg

SEQ ID NO: 2487274 - RNA, 15 nt, Human
uggcagcucagagag

SEQ ID NO: 2487275 - RNA, 14 nt, Human
uggcagcucagaga

SEQ ID NO: 2487276 - RNA, 21 nt, Human
uggcagccgugccuucagcuc

SEQ ID NO: 2487277 - RNA, 20 nt, Human
uggcagccgugccuucagcu

SEQ ID NO: 2487278 - RNA, 19 nt, Human
uggcagccgugccuucagc

SEQ ID NO: 2487279 - RNA, 18 nt, Human
uggcagccgugccuucag

SEQ ID NO: 2487280 - RNA, 16 nt, Human
aggcaucaugcagagu

SEQ ID NO: 2487281 - RNA, 20 nt, Human
aggcaucagucccuauguau

SEQ ID NO: 2487282 - RNA, 19 nt, Human
aggcaucagucccuaugua

SEQ ID NO: 2487283 - RNA, 14 nt, Human
aggcaucacagcua

SEQ ID NO: 2487284 - RNA, 22 nt, Human
aggcauauugcuuuuucuaaug

SEQ ID NO: 2487285 - RNA, 20 nt, Human
aggcauauugcuuuuucuaa

SEQ ID NO: 2487286 - RNA, 20 nt, Human
aggcauaucagucucugagg

SEQ ID NO: 2487287 - RNA, 20 nt, Human
aggcauaggccugggugcug

SEQ ID NO: 2487288 - RNA, 16 nt, Human
aggcauaggccugggu

SEQ ID NO: 2487289 - RNA, 17 nt, Human
aggcauaggccugggug

SEQ ID NO: 2487290 - RNA, 18 nt, Human
aggcauaggccugggugc

SEQ ID NO: 2487291 - RNA, 19 nt, Human
aggcauaggccugggugcu

SEQ ID NO: 2487292 - RNA, 13 nt, Human
aggcaucccaggg

SEQ ID NO: 2487293 - RNA, 16 nt, Human
aggcaucccaggggac

SEQ ID NO: 2487294 - RNA, 17 nt, Human
aggcaucccaggggacc

SEQ ID NO: 2487295 - RNA, 18 nt, Human
aggcaucccaggggacca

SEQ ID NO: 2487296 - RNA, 18 nt, Human
aggcauccuuccucacac

SEQ ID NO: 2487297 - RNA, 22 nt, Human
uggcacacaccuguagucccag

SEQ ID NO: 2487298 - RNA, 23 nt, Human
aggcaucccaggggaccacaccu

SEQ ID NO: 2487299 - RNA, 14 nt, Human
uggcacagaaacac

SEQ ID NO: 2487300 - RNA, 20 nt, Human
aggcauccuuccucacacca

SEQ ID NO: 2487301 - RNA, 16 nt, Human
uggcacaggcccccuu

SEQ ID NO: 2487302 - RNA, 15 nt, Human
uggcacagggcagug

SEQ ID NO: 2487303 - RNA, 20 nt, Human
uggcaccagacacccaggac

SEQ ID NO: 2487304 - RNA, 21 nt, Human
uggcaccagacacccaggacu

SEQ ID NO: 2487305 - RNA, 14 nt, Human
uggcacaggacaug

SEQ ID NO: 2487306 - RNA, 18 nt, Human
uggcacagcccaaagaag

SEQ ID NO: 2487307 - RNA, 22 nt, Human
uggcacagaaaccucuacuaaa

SEQ ID NO: 2487308 - RNA, 20 nt, Human
uggcacagcccaaagaagga

SEQ ID NO: 2487309 - RNA, 23 nt, Human
uggcaccagacacccaggacuua

SEQ ID NO: 2487310 - RNA, 14 nt, Human
uggcaccagaggcu

SEQ ID NO: 2487311 - RNA, 17 nt, Human
uggcaccagacacccag

SEQ ID NO: 2487312 - RNA, 20 nt, Human
uggcaccagaggcugcagaa

SEQ ID NO: 2487313 - RNA, 19 nt, Human
uggcaccagaggcugcaga

SEQ ID NO: 2487314 - RNA, 23 nt, Human
uggcaccagaggcugcagaaggc

SEQ ID NO: 2487315 - RNA, 16 nt, Human
uggcaccagcagccug

SEQ ID NO: 2487316 - RNA, 17 nt, Human
uggcaccagcagccugg

SEQ ID NO: 2487317 - RNA, 14 nt, Human
uggcagcauaaagg

SEQ ID NO: 2487318 - RNA, 13 nt, Human
uggcagcauaaag

SEQ ID NO: 2487319 - RNA, 21 nt, Human
uggcagcaggugcugcuaccc

SEQ ID NO: 2487320 - RNA, 20 nt, Human
uggcagcaggugcugcuacc

SEQ ID NO: 2487321 - RNA, 17 nt, Human
uggcagccgugccuuca

SEQ ID NO: 2487322 - RNA, 17 nt, Human
uggcagcaggugcugcu

SEQ ID NO: 2487323 - RNA, 16 nt, Human
uggcagcaggugcugc

SEQ ID NO: 2487324 - RNA, 15 nt, Human
uggcagcaggugcug

SEQ ID NO: 2487325 - RNA, 11 nt, Human
uggcagcagau

SEQ ID NO: 2487326 - RNA, 14 nt, Human
uggcagcagagugu

SEQ ID NO: 2487327 - RNA, 20 nt, Human
uggcagcagaguguggccuu

SEQ ID NO: 2487328 - RNA, 13 nt, Human
uggcagcaggugc

SEQ ID NO: 2487329 - RNA, 18 nt, Human
uggcagcaccugucuccu

SEQ ID NO: 2487330 - RNA, 22 nt, Human
uggcagauuuagugaaagcuag

SEQ ID NO: 2487331 - RNA, 22 nt, Human
uggcaugggaaugaaugucagu

SEQ ID NO: 2487332 - RNA, 15 nt, Human
uggcaucccaguggc

SEQ ID NO: 2487333 - RNA, 19 nt, Human
uggcaucccaguggccuca

SEQ ID NO: 2487334 - RNA, 19 nt, Human
uggcauuacagcuggagaa

SEQ ID NO: 2487335 - RNA, 17 nt, Human
uggcauuagaauuauuu

SEQ ID NO: 2487336 - RNA, 13 nt, Human
uggcauuaugucc

SEQ ID NO: 2487337 - RNA, 18 nt, Human
uggcauguggccuguggc

SEQ ID NO: 2487338 - RNA, 17 nt, Human
uggcauguggccugugg

SEQ ID NO: 2487339 - RNA, 12 nt, Human
uggcauguguuu

SEQ ID NO: 2487340 - RNA, 16 nt, Human
uggcauguggccugug

SEQ ID NO: 2487341 - RNA, 15 nt, Human
uggcauguggccugu

SEQ ID NO: 2487342 - RNA, 14 nt, Human
uggcauguggccug

SEQ ID NO: 2487343 - RNA, 19 nt, Human
uggcccacgcacuucggga

SEQ ID NO: 2487344 - RNA, 13 nt, Human
uggcauuggcagc

SEQ ID NO: 2487345 - RNA, 23 nt, Human
uggcauuauguccacuguguaua

SEQ ID NO: 2487346 - RNA, 20 nt, Human
uggcccacgccuguaauccc

SEQ ID NO: 2487347 - RNA, 13 nt, Human
uggcccacugcau

SEQ ID NO: 2487348 - RNA, 14 nt, Human
uggcccacugcauc

SEQ ID NO: 2487349 - RNA, 21 nt, Human
uggcccugccaucuucccagc

SEQ ID NO: 2487350 - RNA, 19 nt, Human
uggcccugccaucuuccca

SEQ ID NO: 2487351 - RNA, 15 nt, Human
uggcccugcaaaagg

SEQ ID NO: 2487352 - RNA, 12 nt, Human
uggcccugcccu

SEQ ID NO: 2487353 - RNA, 15 nt, Human
uggcccucuguguug

SEQ ID NO: 2487354 - RNA, 23 nt, Human
uggcccugaggugugggggcugc

SEQ ID NO: 2487355 - RNA, 18 nt, Human
uggcccugaggugugggg

SEQ ID NO: 2487356 - RNA, 16 nt, Human
uggcccugaggugugg

SEQ ID NO: 2487357 - RNA, 17 nt, Human
uggcccaggaccaucau

SEQ ID NO: 2487358 - RNA, 23 nt, Human
uggcccucaaggccucccacagu

SEQ ID NO: 2487359 - RNA, 16 nt, Human
uggcccucaccccugc

SEQ ID NO: 2487360 - RNA, 18 nt, Human
uggcccucaccccugccc

SEQ ID NO: 2487361 - RNA, 14 nt, Human
uggcccucuacccc

SEQ ID NO: 2487362 - RNA, 21 nt, Human
uggcccucccaguaccuccug

SEQ ID NO: 2487363 - RNA, 20 nt, Human
uggcccucaccccugcccug

SEQ ID NO: 2487364 - RNA, 14 nt, Human
uggcccucaguuuc

SEQ ID NO: 2487365 - RNA, 22 nt, Human
uggcccagcucccccgggaggg

SEQ ID NO: 2487366 - RNA, 15 nt, Human
uggcccagcucccca

SEQ ID NO: 2487367 - RNA, 14 nt, Human
uggcccagcucccc

SEQ ID NO: 2487368 - RNA, 13 nt, Human
uggcccagcuccc

SEQ ID NO: 2487369 - RNA, 12 nt, Human
uggcccagcucc

SEQ ID NO: 2487370 - RNA, 21 nt, Human
uggcccagcggccccucccac

SEQ ID NO: 2487371 - RNA, 20 nt, Human
uggcccagcggccccuccca

SEQ ID NO: 2487372 - RNA, 19 nt, Human
uggcccagcggccccuccc

SEQ ID NO: 2487373 - RNA, 17 nt, Human
uggcccagcggccccuc

SEQ ID NO: 2487374 - RNA, 16 nt, Human
uggcccagcggccccu

SEQ ID NO: 2487375 - RNA, 14 nt, Human
uggcccagcggccc

SEQ ID NO: 2487376 - RNA, 23 nt, Human
uggcccagccggccucucuggcc

SEQ ID NO: 2487377 - RNA, 22 nt, Human
uggcccagccggccucucuggc

SEQ ID NO: 2487378 - RNA, 18 nt, Human
uggcccagccggccucuc

SEQ ID NO: 2487379 - RNA, 17 nt, Human
uggcccagccggccucu

SEQ ID NO: 2487380 - RNA, 15 nt, Human
uggcccagccggccu

SEQ ID NO: 2487381 - RNA, 13 nt, Human
uggcccagccggc

SEQ ID NO: 2487382 - RNA, 11 nt, Human
uggcccagccg

SEQ ID NO: 2487383 - RNA, 20 nt, Human
uggcccagcccugcuggccg

SEQ ID NO: 2487384 - RNA, 19 nt, Human
uggcccagcccugcuggcc

SEQ ID NO: 2487385 - RNA, 17 nt, Human
uggcccagcccugcugg

SEQ ID NO: 2487386 - RNA, 15 nt, Human
uggcccagcccugcu

SEQ ID NO: 2487387 - RNA, 14 nt, Human
uggcccagcccugc

SEQ ID NO: 2487388 - RNA, 13 nt, Human
uggcccagcccug

SEQ ID NO: 2487389 - RNA, 12 nt, Human
uggcccagcccu

SEQ ID NO: 2487390 - RNA, 10 nt, Human
uggcccagcc

SEQ ID NO: 2487391 - RNA, 18 nt, Human
uggcauuauguccacugu

SEQ ID NO: 2487392 - RNA, 22 nt, Human
uggcccagccaaacccugucug

SEQ ID NO: 2487393 - RNA, 23 nt, Human
uggcccugucccucccaccucug

SEQ ID NO: 2487394 - RNA, 22 nt, Human
uggcccugucccucccaccucu

SEQ ID NO: 2487395 - RNA, 21 nt, Human
uggcccugucccucccaccuc

SEQ ID NO: 2487396 - RNA, 19 nt, Human
uggcccuucccacuggagg

SEQ ID NO: 2487397 - RNA, 20 nt, Human
uggcccugucccucccaccu

SEQ ID NO: 2487398 - RNA, 19 nt, Human
uggcccugucccucccacc

SEQ ID NO: 2487399 - RNA, 17 nt, Human
uggcccugucccuccca

SEQ ID NO: 2487400 - RNA, 13 nt, Human
uggcccugcccug

SEQ ID NO: 2487401 - RNA, 18 nt, Human
uggccgaggguccuggcu

SEQ ID NO: 2487402 - RNA, 23 nt, Human
uggcccuugcaguucagcaccac

SEQ ID NO: 2487403 - RNA, 22 nt, Human
uggcccuugcaguucagcacca

SEQ ID NO: 2487404 - RNA, 20 nt, Human
uggccucugcacuccccugc

SEQ ID NO: 2487405 - RNA, 15 nt, Human
uggccgaguccaagc

SEQ ID NO: 2487406 - RNA, 21 nt, Human
uggccucugcugauccuccca

SEQ ID NO: 2487407 - RNA, 19 nt, Human
uggccucugcacuccccug

SEQ ID NO: 2487408 - RNA, 18 nt, Human
uggccucugcacuccccu

SEQ ID NO: 2487409 - RNA, 19 nt, Human
uggccgaggguccuggcuc

SEQ ID NO: 2487410 - RNA, 20 nt, Human
uggccgaggguccuggcucc

SEQ ID NO: 2487411 - RNA, 15 nt, Human
uggccuguggccugu

SEQ ID NO: 2487412 - RNA, 14 nt, Human
uggccuguguccca

SEQ ID NO: 2487413 - RNA, 24 nt, Human
uggccugucucauccccagggguc

SEQ ID NO: 2487414 - RNA, 14 nt, Human
uggccugucucauc

SEQ ID NO: 2487415 - RNA, 16 nt, Human
uggccugucucauccc

SEQ ID NO: 2487416 - RNA, 18 nt, Human
uggccugucucaucccca

SEQ ID NO: 2487417 - RNA, 20 nt, Human
uggccugucucauccccagg

SEQ ID NO: 2487418 - RNA, 17 nt, Human
uggccugggccuccuca

SEQ ID NO: 2487419 - RNA, 14 nt, Human
uggccugggccucc

SEQ ID NO: 2487420 - RNA, 12 nt, Human
uggccugucuca

SEQ ID NO: 2487421 - RNA, 12 nt, Human
uggccugcugug

SEQ ID NO: 2487422 - RNA, 13 nt, Human
uggccuggacugu

SEQ ID NO: 2487423 - RNA, 17 nt, Human
uggccugggagagcugg

SEQ ID NO: 2487424 - RNA, 11 nt, Human
uggccugggca

SEQ ID NO: 2487425 - RNA, 22 nt, Human
uggccugaucagaccacggcuc

SEQ ID NO: 2487426 - RNA, 18 nt, Human
uggccugagcugggauga

SEQ ID NO: 2487427 - RNA, 16 nt, Human
uggccucuggcucuca

SEQ ID NO: 2487428 - RNA, 23 nt, Human
uggccucuguggagccccagcau

SEQ ID NO: 2487429 - RNA, 23 nt, Human
uggccugcacggugggccuugcu

SEQ ID NO: 2487430 - RNA, 21 nt, Human
uggccugcacggugggccuug

SEQ ID NO: 2487431 - RNA, 14 nt, Human
uggccugcacuaau

SEQ ID NO: 2487432 - RNA, 16 nt, Human
uggccugcacuaauuu

SEQ ID NO: 2487433 - RNA, 20 nt, Human
uggccugcugggcucuccac

SEQ ID NO: 2487434 - RNA, 18 nt, Human
uggccugccuugaagcca

SEQ ID NO: 2487435 - RNA, 24 nt, Human
uggccugcacggugggccuugcug

SEQ ID NO: 2487436 - RNA, 21 nt, Human
uggccugcugggcucuccacc

SEQ ID NO: 2487437 - RNA, 11 nt, Human
uggccugcugu

SEQ ID NO: 2487438 - RNA, 22 nt, Human
uggccugcugggcucuccaccu

SEQ ID NO: 2487439 - RNA, 14 nt, Human
aggcgccggcgggc

SEQ ID NO: 2487440 - RNA, 14 nt, Human
aggcgccccuuccc

SEQ ID NO: 2487441 - RNA, 23 nt, Human
aggcgcacuuuccuccuggcaga

SEQ ID NO: 2487442 - RNA, 22 nt, Human
aggcgcacuuuccuccuggcag

SEQ ID NO: 2487443 - RNA, 21 nt, Human
aggcgcagugcuucucuacag

SEQ ID NO: 2487444 - RNA, 22 nt, Human
aggcgcacugugacccccagcu

SEQ ID NO: 2487445 - RNA, 21 nt, Human
aggcgcacuuuccuccuggca

SEQ ID NO: 2487446 - RNA, 21 nt, Human
aggcgcacugugacccccagc

SEQ ID NO: 2487447 - RNA, 24 nt, Human
aggcgagugccaggacuccccagg

SEQ ID NO: 2487448 - RNA, 20 nt, Human
aggcgaucacaacgugcauu

SEQ ID NO: 2487449 - RNA, 19 nt, Human
aggcgaucacaacgugcau

SEQ ID NO: 2487450 - RNA, 21 nt, Human
aggcgaucacaacgugcauug

SEQ ID NO: 2487451 - RNA, 23 nt, Human
aggcgauccaccugucucagccu

SEQ ID NO: 2487452 - RNA, 14 nt, Human
aggcggccccuccc

SEQ ID NO: 2487453 - RNA, 24 nt, Human
aggcggagaguacagugagccaag

SEQ ID NO: 2487454 - RNA, 20 nt, Human
aggcggagaguacagugagc

SEQ ID NO: 2487455 - RNA, 15 nt, Human
aggcggagaguacag

SEQ ID NO: 2487456 - RNA, 18 nt, Human
aggcggacguuccagccg

SEQ ID NO: 2487457 - RNA, 17 nt, Human
aggcggacguuccagcc

SEQ ID NO: 2487458 - RNA, 15 nt, Human
aggcggacguuccag

SEQ ID NO: 2487459 - RNA, 12 nt, Human
aggcggccccuc

SEQ ID NO: 2487460 - RNA, 16 nt, Human
aggcuauuauuuucac

SEQ ID NO: 2487461 - RNA, 18 nt, Human
aggcuauuauuuucacug

SEQ ID NO: 2487462 - RNA, 19 nt, Human
aggcuauuauuuucacugu

SEQ ID NO: 2487463 - RNA, 21 nt, Human
aggcuauuguccccuaaacca

SEQ ID NO: 2487464 - RNA, 15 nt, Human
aggccuugcgcuguu

SEQ ID NO: 2487465 - RNA, 21 nt, Human
uggccugugucccaugaccca

SEQ ID NO: 2487466 - RNA, 11 nt, Human
aggccuugcuc

SEQ ID NO: 2487467 - RNA, 22 nt, Human
uggccugugucccaugacccac

SEQ ID NO: 2487468 - RNA, 20 nt, Human
uggccugugucccaugaccc

SEQ ID NO: 2487469 - RNA, 16 nt, Human
uggccugugucccaug

SEQ ID NO: 2487470 - RNA, 13 nt, Human
uggccuguucugu

SEQ ID NO: 2487471 - RNA, 9 nt, Human
aggccuugc

SEQ ID NO: 2487472 - RNA, 18 nt, Human
aggccuucucugaaggac

SEQ ID NO: 2487473 - RNA, 17 nt, Human
aggccuucucugaagga

SEQ ID NO: 2487474 - RNA, 16 nt, Human
aggccuuuuggaaugu

SEQ ID NO: 2487475 - RNA, 18 nt, Human
aggcgagugccaggacuc

SEQ ID NO: 2487476 - RNA, 17 nt, Human
aggcgagugccaggacu

SEQ ID NO: 2487477 - RNA, 15 nt, Human
aggcgagugccagga

SEQ ID NO: 2487478 - RNA, 14 nt, Human
aggcgagugccagg

SEQ ID NO: 2487479 - RNA, 14 nt, Human
aggccuugucccag

SEQ ID NO: 2487480 - RNA, 14 nt, Human
aggccuuuaaaauu

SEQ ID NO: 2487481 - RNA, 15 nt, Human
aggccuuuaaaauuu

SEQ ID NO: 2487482 - RNA, 21 nt, Human
aggccuuuagauauuauucau

SEQ ID NO: 2487483 - RNA, 24 nt, Human
aggcucacugccaggccagccucc

SEQ ID NO: 2487484 - RNA, 23 nt, Human
aggcucacugccaggccagccuc

SEQ ID NO: 2487485 - RNA, 22 nt, Human
aggcucacugccaggccagccu

SEQ ID NO: 2487486 - RNA, 21 nt, Human
aggcucacugccaggccagcc

SEQ ID NO: 2487487 - RNA, 20 nt, Human
aggcucacugccaggccagc

SEQ ID NO: 2487488 - RNA, 19 nt, Human
aggcucacugccaggccag

SEQ ID NO: 2487489 - RNA, 17 nt, Human
aggcucacugccaggcc

SEQ ID NO: 2487490 - RNA, 16 nt, Human
aggcucacugccaggc

SEQ ID NO: 2487491 - RNA, 14 nt, Human
aggcucagagaugu

SEQ ID NO: 2487492 - RNA, 13 nt, Human
aggcucagagaug

SEQ ID NO: 2487493 - RNA, 11 nt, Human
aggcucagaga

SEQ ID NO: 2487494 - RNA, 16 nt, Human
aggcucaacuagggag

SEQ ID NO: 2487495 - RNA, 15 nt, Human
aggcucaacuaggga

SEQ ID NO: 2487496 - RNA, 16 nt, Human
aggcucacccccuucu

SEQ ID NO: 2487497 - RNA, 19 nt, Human
aggcucacccccuucucca

SEQ ID NO: 2487498 - RNA, 15 nt, Human
aggcucacugccagg

SEQ ID NO: 2487499 - RNA, 14 nt, Human
aggcucacugccag

SEQ ID NO: 2487500 - RNA, 13 nt, Human
aggcucacugcca

SEQ ID NO: 2487501 - RNA, 12 nt, Human
aggcucacugcc

SEQ ID NO: 2487502 - RNA, 21 nt, Human
aggcucacccccuucuccauc

SEQ ID NO: 2487503 - RNA, 23 nt, Human
aggcucacccccuucuccaucca

SEQ ID NO: 2487504 - RNA, 16 nt, Human
aggcucaggucccugg

SEQ ID NO: 2487505 - RNA, 16 nt, Human
aggcucagucucagga

SEQ ID NO: 2487506 - RNA, 17 nt, Human
aggcucagucucaggag

SEQ ID NO: 2487507 - RNA, 18 nt, Human
aggcucagucucaggagc

SEQ ID NO: 2487508 - RNA, 20 nt, Human
aggcucauagggaagaccug

SEQ ID NO: 2487509 - RNA, 21 nt, Human
aggcucauagggaagaccugc

SEQ ID NO: 2487510 - RNA, 22 nt, Human
aggcucauagggaagaccugcu

SEQ ID NO: 2487511 - RNA, 19 nt, Human
aggcucagucucaggagca

SEQ ID NO: 2487512 - RNA, 23 nt, Human
aggcucagucucaggagcauggg

SEQ ID NO: 2487513 - RNA, 24 nt, Human
aggcucagagaugugcacccaugg

SEQ ID NO: 2487514 - RNA, 21 nt, Human
aggcucagagaugugcaccca

SEQ ID NO: 2487515 - RNA, 10 nt, Human
aggcucaggu

SEQ ID NO: 2487516 - RNA, 11 nt, Human
aggcuccacuu

SEQ ID NO: 2487517 - RNA, 17 nt, Human
aggcuccacuuggucug

SEQ ID NO: 2487518 - RNA, 21 nt, Human
aggcuccacuuggucugugag

SEQ ID NO: 2487519 - RNA, 22 nt, Human
aggcuccacuuggucugugaga

SEQ ID NO: 2487520 - RNA, 16 nt, Human
aggcuccaggagcagc

SEQ ID NO: 2487521 - RNA, 14 nt, Human
aggcuccaggagca

SEQ ID NO: 2487522 - RNA, 13 nt, Human
aggcuccaggagc

SEQ ID NO: 2487523 - RNA, 13 nt, Human
aggcuccagaggg

SEQ ID NO: 2487524 - RNA, 14 nt, Human
aggcuccagagggc

SEQ ID NO: 2487525 - RNA, 22 nt, Human
aggcuccaccccauccaguuca

SEQ ID NO: 2487526 - RNA, 23 nt, Human
aggcuccaggagcagccacauuc

SEQ ID NO: 2487527 - RNA, 19 nt, Human
aggcuccaggagcagccac

SEQ ID NO: 2487528 - RNA, 18 nt, Human
aggcuccaggagcagcca

SEQ ID NO: 2487529 - RNA, 17 nt, Human
aggcuccaggagcagcc

SEQ ID NO: 2487530 - RNA, 21 nt, Human
uggcuaacuauauuugcuuuu

SEQ ID NO: 2487531 - RNA, 14 nt, Human
uggcuaaauucaug

SEQ ID NO: 2487532 - RNA, 18 nt, Human
uggcuaagcaaaauguga

SEQ ID NO: 2487533 - RNA, 15 nt, Human
aggcuccagagggca

SEQ ID NO: 2487534 - RNA, 16 nt, Human
aggcuccagagggcac

SEQ ID NO: 2487535 - RNA, 12 nt, Human
aggcucauuuua

SEQ ID NO: 2487536 - RNA, 14 nt, Human
aggcuccauuagga

SEQ ID NO: 2487537 - RNA, 17 nt, Human
uggcuaauguacugcau

SEQ ID NO: 2487538 - RNA, 19 nt, Human
uggcuaauguacugcauau

SEQ ID NO: 2487539 - RNA, 15 nt, Human
uggcuaauucccaga

SEQ ID NO: 2487540 - RNA, 15 nt, Human
uggcuaagagugucc

SEQ ID NO: 2487541 - RNA, 15 nt, Human
uggcuauaggugcua

SEQ ID NO: 2487542 - RNA, 19 nt, Human
uggcuauaggugcuacaaa

SEQ ID NO: 2487543 - RNA, 19 nt, Human
uggcuagaggccagcccca

SEQ ID NO: 2487544 - RNA, 20 nt, Human
uggcuagaauauccuacuuc

SEQ ID NO: 2487545 - RNA, 19 nt, Human
uggcuauaaauauauaaaa

SEQ ID NO: 2487546 - RNA, 23 nt, Human
uggcuagaggccagccccaccca

SEQ ID NO: 2487547 - RNA, 21 nt, Human
uggcuagaggccagccccacc

SEQ ID NO: 2487548 - RNA, 22 nt, Human
uggcuagaggccagccccaccc

SEQ ID NO: 2487549 - RNA, 21 nt, Human
uggcucuugauaccccccucu

SEQ ID NO: 2487550 - RNA, 20 nt, Human
uggcucuugauaccccccuc

SEQ ID NO: 2487551 - RNA, 19 nt, Human
uggcucuugauaccccccu

SEQ ID NO: 2487552 - RNA, 12 nt, Human
uggcucagccag

SEQ ID NO: 2487553 - RNA, 18 nt, Human
uggcucagacauguuuuc

SEQ ID NO: 2487554 - RNA, 13 nt, Human
uggcucagccagc

SEQ ID NO: 2487555 - RNA, 16 nt, Human
uggcucagccagcacu

SEQ ID NO: 2487556 - RNA, 20 nt, Human
uggcugaaauucuccuggag

SEQ ID NO: 2487557 - RNA, 19 nt, Human
uggcugaaauucuccugga

SEQ ID NO: 2487558 - RNA, 18 nt, Human
uggcugaaauucuccugg

SEQ ID NO: 2487559 - RNA, 16 nt, Human
uggcugaaauucuccu

SEQ ID NO: 2487560 - RNA, 19 nt, Human
uggcucuuuggagaucaag

SEQ ID NO: 2487561 - RNA, 23 nt, Human
uggcucuugauaccccccucugu

SEQ ID NO: 2487562 - RNA, 15 nt, Human
uggcugaaggacugu

SEQ ID NO: 2487563 - RNA, 14 nt, Human
uggcugaaggacug

SEQ ID NO: 2487564 - RNA, 13 nt, Human
uggcugaaggacu

SEQ ID NO: 2487565 - RNA, 12 nt, Human
uggcugaaggac

SEQ ID NO: 2487566 - RNA, 11 nt, Human
uggcugaagga

SEQ ID NO: 2487567 - RNA, 23 nt, Human
uggcugaacccugugcugguguc

SEQ ID NO: 2487568 - RNA, 13 nt, Human
uggcugaacucau

SEQ ID NO: 2487569 - RNA, 20 nt, Human
uggcugaacccugugcuggu

SEQ ID NO: 2487570 - RNA, 18 nt, Human
uggcugaacccugugcug

SEQ ID NO: 2487571 - RNA, 16 nt, Human
uggcugaacccugugc

SEQ ID NO: 2487572 - RNA, 15 nt, Human
uggcugaacccugug

SEQ ID NO: 2487573 - RNA, 22 nt, Human
uggcugaaauucuccuggaggu

SEQ ID NO: 2487574 - RNA, 21 nt, Human
uggcugaaauucuccuggagg

SEQ ID NO: 2487575 - RNA, 16 nt, Human
uggcugaaggacugug

SEQ ID NO: 2487576 - RNA, 15 nt, Human
uggcugacccagucc

SEQ ID NO: 2487577 - RNA, 16 nt, Human
uggcugacccaguccc

SEQ ID NO: 2487578 - RNA, 17 nt, Human
uggcugacccagucccu

SEQ ID NO: 2487579 - RNA, 19 nt, Human
uggcugacccagucccugg

SEQ ID NO: 2487580 - RNA, 20 nt, Human
uggcugacccagucccuggg

SEQ ID NO: 2487581 - RNA, 22 nt, Human
uggcugaccccaaagagccugg

SEQ ID NO: 2487582 - RNA, 21 nt, Human
uggcugaccccaaagagccug

SEQ ID NO: 2487583 - RNA, 20 nt, Human
uggcugaccccaaagagccu

SEQ ID NO: 2487584 - RNA, 21 nt, Human
uggcugacccagucccugggg

SEQ ID NO: 2487585 - RNA, 16 nt, Human
uggcugacuuugcucu

SEQ ID NO: 2487586 - RNA, 13 nt, Human
uggcucacgccug

SEQ ID NO: 2487587 - RNA, 15 nt, Human
uggcucacccaagca

SEQ ID NO: 2487588 - RNA, 17 nt, Human
uggcucacgccuguaau

SEQ ID NO: 2487589 - RNA, 19 nt, Human
uggcucacgccuguaaucc

SEQ ID NO: 2487590 - RNA, 18 nt, Human
uggcucacuauggugcca

SEQ ID NO: 2487591 - RNA, 20 nt, Human
uggcucacuaugaaucuauu

SEQ ID NO: 2487592 - RNA, 16 nt, Human
uggcucacgccuguaa

SEQ ID NO: 2487593 - RNA, 16 nt, Human
uggcucacguguguga

SEQ ID NO: 2487594 - RNA, 21 nt, Human
uggcucacuauggugccaaug

SEQ ID NO: 2487595 - RNA, 21 nt, Human
uggcucacugcaacuucugcc

SEQ ID NO: 2487596 - RNA, 23 nt, Human
uggcuauaggugcuacaaaaaca

SEQ ID NO: 2487597 - RNA, 21 nt, Human
uggcuauauggcaagaaagcu

SEQ ID NO: 2487598 - RNA, 16 nt, Human
uggcucacacugagaa

SEQ ID NO: 2487599 - RNA, 15 nt, Human
uggcucacacugaga

SEQ ID NO: 2487600 - RNA, 14 nt, Human
uggcucacacugag

SEQ ID NO: 2487601 - RNA, 13 nt, Human
uggcucacacuga

SEQ ID NO: 2487602 - RNA, 12 nt, Human
uggcucacacug

SEQ ID NO: 2487603 - RNA, 19 nt, Human
uggcucacaccuguaaucc

SEQ ID NO: 2487604 - RNA, 16 nt, Human
uggcucaauccucuaa

SEQ ID NO: 2487605 - RNA, 16 nt, Human
uggcucacaccuguaa

SEQ ID NO: 2487606 - RNA, 23 nt, Human
uggcugcagcagcgguggccucu

SEQ ID NO: 2487607 - RNA, 21 nt, Human
uggcugcagcagcgguggccu

SEQ ID NO: 2487608 - RNA, 15 nt, Human
uggcugugaggcccc

SEQ ID NO: 2487609 - RNA, 12 nt, Human
uggcugugagga

SEQ ID NO: 2487610 - RNA, 23 nt, Human
uggcuguccagugcccauuccuc

SEQ ID NO: 2487611 - RNA, 18 nt, Human
uggcuguccagugcccau

SEQ ID NO: 2487612 - RNA, 17 nt, Human
uggcugugccucugccu

SEQ ID NO: 2487613 - RNA, 16 nt, Human
uggcugugccucugcc

SEQ ID NO: 2487614 - RNA, 15 nt, Human
uggcugugccucugc

SEQ ID NO: 2487615 - RNA, 14 nt, Human
uggcugugccucug

SEQ ID NO: 2487616 - RNA, 15 nt, Human
uggcugcagagcagu

SEQ ID NO: 2487617 - RNA, 18 nt, Human
uggcugcagagcaguggg

SEQ ID NO: 2487618 - RNA, 13 nt, Human
uggcugcagcagc

SEQ ID NO: 2487619 - RNA, 12 nt, Human
uggcugcagcag

SEQ ID NO: 2487620 - RNA, 19 nt, Human
uggcugagcggaugcaucu

SEQ ID NO: 2487621 - RNA, 19 nt, Human
uggcugagccuggcuggca

SEQ ID NO: 2487622 - RNA, 22 nt, Human
uggcugcagagcagugggccug

SEQ ID NO: 2487623 - RNA, 20 nt, Human
uggcugagagaguggcauug

SEQ ID NO: 2487624 - RNA, 19 nt, Human
uggcugagauaugaacaua

SEQ ID NO: 2487625 - RNA, 16 nt, Human
uggcugagccuggcug

SEQ ID NO: 2487626 - RNA, 13 nt, Human
uggcugagcccug

SEQ ID NO: 2487627 - RNA, 13 nt, Human
uggcugagccccu

SEQ ID NO: 2487628 - RNA, 17 nt, Human
uggcugagccccugucu

SEQ ID NO: 2487629 - RNA, 23 nt, Human
uggcugcaaaggguaucaggugc

SEQ ID NO: 2487630 - RNA, 23 nt, Human
uggcuguuggcugggggccucag

SEQ ID NO: 2487631 - RNA, 14 nt, Human
uggcuucacggaag

SEQ ID NO: 2487632 - RNA, 18 nt, Human
uggcuguuggcugggggc

SEQ ID NO: 2487633 - RNA, 16 nt, Human
uggcuguuggcugggg

SEQ ID NO: 2487634 - RNA, 17 nt, Human
uggcugugucuaaacug

SEQ ID NO: 2487635 - RNA, 15 nt, Human
uggcugugucuaaac

SEQ ID NO: 2487636 - RNA, 14 nt, Human
uggcugugucuaaa

SEQ ID NO: 2487637 - RNA, 19 nt, Human
uggcugugccucugccugu

SEQ ID NO: 2487638 - RNA, 18 nt, Human
uggcugugccucugccug

SEQ ID NO: 2487639 - RNA, 16 nt, Human
uggcuguggagugugg

SEQ ID NO: 2487640 - RNA, 22 nt, Human
uggcugugccucugccugucuc

SEQ ID NO: 2487641 - RNA, 18 nt, Human
ugggaaacaaaaggauaa

SEQ ID NO: 2487642 - RNA, 21 nt, Human
uggcuuuugugcauuaucuag

SEQ ID NO: 2487643 - RNA, 17 nt, Human
uggcuucaaaauagaga

SEQ ID NO: 2487644 - RNA, 23 nt, Human
ugggaaaaaugcccuuaaaucau

SEQ ID NO: 2487645 - RNA, 19 nt, Human
uggcuuuuuuccuccugug

SEQ ID NO: 2487646 - RNA, 15 nt, Human
uggcuuuugugcauu

SEQ ID NO: 2487647 - RNA, 16 nt, Human
uggcuuuugugcauua

SEQ ID NO: 2487648 - RNA, 17 nt, Human
uggcuucacggaagagc

SEQ ID NO: 2487649 - RNA, 20 nt, Human
uggcuucacggaagagccuu

SEQ ID NO: 2487650 - RNA, 17 nt, Human
ugggaaagcauuguaaa

SEQ ID NO: 2487651 - RNA, 18 nt, Human
ugggaaagcauuguaaau

SEQ ID NO: 2487652 - RNA, 21 nt, Human
ugggaaagcauuguaaaugug

SEQ ID NO: 2487653 - RNA, 19 nt, Human
ugggaaaugagaaggcagc

SEQ ID NO: 2487654 - RNA, 20 nt, Human
ugggaaauauuuagcaaaua

SEQ ID NO: 2487655 - RNA, 19 nt, Human
ugggaaauauuuagcaaau

SEQ ID NO: 2487656 - RNA, 20 nt, Human
ugggaacaccauaggucacc

SEQ ID NO: 2487657 - RNA, 20 nt, Human
ugggaaaugagaaggcagcc

SEQ ID NO: 2487658 - RNA, 15 nt, Human
ugggaaauggcuuga

SEQ ID NO: 2487659 - RNA, 14 nt, Human
ugggaaagcauugu

SEQ ID NO: 2487660 - RNA, 16 nt, Human
ugggaaagcauuguaa

SEQ ID NO: 2487661 - RNA, 23 nt, Human
ugggaaagacauccauaaagaag

SEQ ID NO: 2487662 - RNA, 21 nt, Human
ugggaaagaaggcaaaguccc

SEQ ID NO: 2487663 - RNA, 23 nt, Human
ugggaaaauaccccaucauucau

SEQ ID NO: 2487664 - RNA, 18 nt, Human
ugggaaacuuggcucgaa

SEQ ID NO: 2487665 - RNA, 16 nt, Human
ugggaaaacacugcca

SEQ ID NO: 2487666 - RNA, 15 nt, Human
ugggaaacagaggcu

SEQ ID NO: 2487667 - RNA, 15 nt, Human
aggcuuaguuugugu

SEQ ID NO: 2487668 - RNA, 20 nt, Human
aggcuucagcauauuuauag

SEQ ID NO: 2487669 - RNA, 12 nt, Human
aggcuucacccu

SEQ ID NO: 2487670 - RNA, 14 nt, Human
aggcuuccuucauu

SEQ ID NO: 2487671 - RNA, 16 nt, Human
aggcuuccuucauuuc

SEQ ID NO: 2487672 - RNA, 18 nt, Human
aggcuuccuucauuuccu

SEQ ID NO: 2487673 - RNA, 19 nt, Human
aggcuuccuucauuuccuc

SEQ ID NO: 2487674 - RNA, 21 nt, Human
aggcuuccugcguccuccuca

SEQ ID NO: 2487675 - RNA, 20 nt, Human
aggcuuccugcguccuccuc

SEQ ID NO: 2487676 - RNA, 10 nt, Human
aggcuuccug

SEQ ID NO: 2487677 - RNA, 23 nt, Human
aggcuuccagagaguccucugga

SEQ ID NO: 2487678 - RNA, 14 nt, Human
aggcuuccagagag

SEQ ID NO: 2487679 - RNA, 13 nt, Human
aggcuuccagaga

SEQ ID NO: 2487680 - RNA, 14 nt, Human
aggcuuaguuugug

SEQ ID NO: 2487681 - RNA, 23 nt, Human
aggcuuagucacugagacagccc

SEQ ID NO: 2487682 - RNA, 22 nt, Human
aggcuuagucacugagacagcc

SEQ ID NO: 2487683 - RNA, 21 nt, Human
aggcuuagucacugagacagc

SEQ ID NO: 2487684 - RNA, 21 nt, Human
aggcuggggcugaccuuccuc

SEQ ID NO: 2487685 - RNA, 16 nt, Human
aggcuggggcugaccu

SEQ ID NO: 2487686 - RNA, 16 nt, Human
aggcuucucucucacc

SEQ ID NO: 2487687 - RNA, 14 nt, Human
aggcuucucucuca

SEQ ID NO: 2487688 - RNA, 13 nt, Human
aggcuucucucuc

SEQ ID NO: 2487689 - RNA, 12 nt, Human
aggcuucucucu

SEQ ID NO: 2487690 - RNA, 18 nt, Human
aggcuucucucucaccag

SEQ ID NO: 2487691 - RNA, 16 nt, Human
aggcuucucucugugg

SEQ ID NO: 2487692 - RNA, 23 nt, Human
aggcuucugguugaugccuguga

SEQ ID NO: 2487693 - RNA, 23 nt, Human
aggcuucuccgccagccuccucu

SEQ ID NO: 2487694 - RNA, 22 nt, Human
aggcuucuccgccagccuccuc

SEQ ID NO: 2487695 - RNA, 21 nt, Human
aggcuucuccgccagccuccu

SEQ ID NO: 2487696 - RNA, 20 nt, Human
aggcuucuccgccagccucc

SEQ ID NO: 2487697 - RNA, 19 nt, Human
aggcuucuccgccagccuc

SEQ ID NO: 2487698 - RNA, 18 nt, Human
aggcuucuccgccagccu

SEQ ID NO: 2487699 - RNA, 17 nt, Human
aggcuucuccgccagcc

SEQ ID NO: 2487700 - RNA, 16 nt, Human
aggcuucuccgccagc

SEQ ID NO: 2487701 - RNA, 15 nt, Human
aggcuucuccgccag

SEQ ID NO: 2487702 - RNA, 14 nt, Human
aggcuucuccgcca

SEQ ID NO: 2487703 - RNA, 22 nt, Human
aggcuucuccaauucugcccaa

SEQ ID NO: 2487704 - RNA, 22 nt, Human
aggcuuccugcguccuccucac

SEQ ID NO: 2487705 - RNA, 21 nt, Human
aggcuuccuucauuuccuccg

SEQ ID NO: 2487706 - RNA, 13 nt, Human
aggcuuccuuggc

SEQ ID NO: 2487707 - RNA, 16 nt, Human
aggcuucuucagauca

SEQ ID NO: 2487708 - RNA, 22 nt, Human
aggcuucuucagaucagugcuu

SEQ ID NO: 2487709 - RNA, 23 nt, Human
aggcuucuucagaucagugcuug

SEQ ID NO: 2487710 - RNA, 18 nt, Human
aggcuugcauaauaagcu

SEQ ID NO: 2487711 - RNA, 16 nt, Human
aggcuugccugcaggc

SEQ ID NO: 2487712 - RNA, 15 nt, Human
aggcuugccugcagg

SEQ ID NO: 2487713 - RNA, 22 nt, Human
aggcuugggaccgccagauggg

SEQ ID NO: 2487714 - RNA, 15 nt, Human
aggcuugucagagcu

SEQ ID NO: 2487715 - RNA, 20 nt, Human
aggcuugcugagaggggcug

SEQ ID NO: 2487716 - RNA, 19 nt, Human
aggcuugcugagaggggcu

SEQ ID NO: 2487717 - RNA, 14 nt, Human
aggcuugcugagag

SEQ ID NO: 2487718 - RNA, 17 nt, Human
aggcuugccugcaggca

SEQ ID NO: 2487719 - RNA, 21 nt, Human
aggcuuuuuuaucaugugaaa

SEQ ID NO: 2487720 - RNA, 18 nt, Human
aggcuuuuuuaucaugug

SEQ ID NO: 2487721 - RNA, 15 nt, Human
agggaaaacauucca

SEQ ID NO: 2487722 - RNA, 16 nt, Human
agggaaaacauuccau

SEQ ID NO: 2487723 - RNA, 18 nt, Human
agggaaaacauuccaucc

SEQ ID NO: 2487724 - RNA, 19 nt, Human
aggcuuuggauuugacauu

SEQ ID NO: 2487725 - RNA, 15 nt, Human
aggcuuuuuuaucau

SEQ ID NO: 2487726 - RNA, 19 nt, Human
aggcuuucacuauuuccuu

SEQ ID NO: 2487727 - RNA, 20 nt, Human
aggcuuucacuauuuccuuu

SEQ ID NO: 2487728 - RNA, 15 nt, Human
aggcuuucacuauuu

SEQ ID NO: 2487729 - RNA, 18 nt, Human
aggcuugucagagcuggg

SEQ ID NO: 2487730 - RNA, 16 nt, Human
aggcuugucagagcug

SEQ ID NO: 2487731 - RNA, 17 nt, Human
aggcuugucagagcugg

SEQ ID NO: 2487732 - RNA, 20 nt, Human
aggcuugucagagcugggag

SEQ ID NO: 2487733 - RNA, 16 nt, Human
agggaaacugccagca

SEQ ID NO: 2487734 - RNA, 19 nt, Human
agggaaacugccagcaacg

SEQ ID NO: 2487735 - RNA, 21 nt, Human
agggaaacugccagcaacgca

SEQ ID NO: 2487736 - RNA, 23 nt, Human
agggaaacugccagcaacgcagg

SEQ ID NO: 2487737 - RNA, 14 nt, Human
agggaaacugccag

SEQ ID NO: 2487738 - RNA, 15 nt, Human
agggaaacugccagc

SEQ ID NO: 2487739 - RNA, 18 nt, Human
agggaaaauuauuugcau

SEQ ID NO: 2487740 - RNA, 17 nt, Human
agggaaaaugcagcagg

SEQ ID NO: 2487741 - RNA, 22 nt, Human
agggaaaaugcagcagggaugc

SEQ ID NO: 2487742 - RNA, 16 nt, Human
agggaaacuauugucc

SEQ ID NO: 2487743 - RNA, 16 nt, Human
agggaaaagcagcucu

SEQ ID NO: 2487744 - RNA, 23 nt, Human
aggcugggcuucaguggcagcug

SEQ ID NO: 2487745 - RNA, 22 nt, Human
aggcugggcuucaguggcagcu

SEQ ID NO: 2487746 - RNA, 12 nt, Human
aggcuggggcug

SEQ ID NO: 2487747 - RNA, 22 nt, Human
aggcuggggaaguccucugggu

SEQ ID NO: 2487748 - RNA, 21 nt, Human
aggcuggggaaguccucuggg

SEQ ID NO: 2487749 - RNA, 18 nt, Human
aggcuggggaaguccucu

SEQ ID NO: 2487750 - RNA, 16 nt, Human
aggcuggggaaguccu

SEQ ID NO: 2487751 - RNA, 17 nt, Human
aggcugggggaagaagc

SEQ ID NO: 2487752 - RNA, 21 nt, Human
aggcugggcuucaguggcagc

SEQ ID NO: 2487753 - RNA, 20 nt, Human
aggcugggcuucaguggcag

SEQ ID NO: 2487754 - RNA, 19 nt, Human
aggcugggcuucaguggca

SEQ ID NO: 2487755 - RNA, 18 nt, Human
aggcugggcuucaguggc

SEQ ID NO: 2487756 - RNA, 17 nt, Human
aggcuggguucugaucc

SEQ ID NO: 2487757 - RNA, 14 nt, Human
aggcuggguucuga

SEQ ID NO: 2487758 - RNA, 21 nt, Human
aggcugggucgcccuggacug

SEQ ID NO: 2487759 - RNA, 20 nt, Human
aggcugggucgcccuggacu

SEQ ID NO: 2487760 - RNA, 18 nt, Human
aggcugggucgcccugga

SEQ ID NO: 2487761 - RNA, 15 nt, Human
aggcugggucgcccu

SEQ ID NO: 2487762 - RNA, 10 nt, Human
aggcuggguc

SEQ ID NO: 2487763 - RNA, 22 nt, Human
aggcugggggaagaagcucucu

SEQ ID NO: 2487764 - RNA, 21 nt, Human
aggcugggagagccuuccagg

SEQ ID NO: 2487765 - RNA, 20 nt, Human
aggcugggagagccuuccag

SEQ ID NO: 2487766 - RNA, 13 nt, Human
aggcugggcaagg

SEQ ID NO: 2487767 - RNA, 21 nt, Human
ugggaaccccccucccaccca

SEQ ID NO: 2487768 - RNA, 22 nt, Human
aggcugggagagccuuccaggg

SEQ ID NO: 2487769 - RNA, 20 nt, Human
ugggaacccaaguccaagca

SEQ ID NO: 2487770 - RNA, 23 nt, Human
ugggaaaugguaugagcugaggg

SEQ ID NO: 2487771 - RNA, 22 nt, Human
ugggaaaugguaugagcugagg

SEQ ID NO: 2487772 - RNA, 22 nt, Human
ugggaaccccuucauccucuga

SEQ ID NO: 2487773 - RNA, 20 nt, Human
ugggaaccccuucauccucu

SEQ ID NO: 2487774 - RNA, 16 nt, Human
aggcugggagagccuu

SEQ ID NO: 2487775 - RNA, 19 nt, Human
aggcugggagagccuucca

SEQ ID NO: 2487776 - RNA, 18 nt, Human
aggcugggcucccuuccc

SEQ ID NO: 2487777 - RNA, 14 nt, Human
aggcugggcucccu

SEQ ID NO: 2487778 - RNA, 13 nt, Human
aggcugggcuccc

SEQ ID NO: 2487779 - RNA, 23 nt, Human
aggcugggcucccuucccaccuc

SEQ ID NO: 2487780 - RNA, 21 nt, Human
aggcugggcucccuucccacc

SEQ ID NO: 2487781 - RNA, 14 nt, Human
aggcugggcuucag

SEQ ID NO: 2487782 - RNA, 18 nt, Human
aggcugggcguaguggcu

SEQ ID NO: 2487783 - RNA, 20 nt, Human
agggagugaguugauagcac

SEQ ID NO: 2487784 - RNA, 20 nt, Human
agggagugacagaggcagcc

SEQ ID NO: 2487785 - RNA, 16 nt, Human
agggaguccccucccc

SEQ ID NO: 2487786 - RNA, 15 nt, Human
agggaguccccuccc

SEQ ID NO: 2487787 - RNA, 22 nt, Human
agggaguccccuccccggcccu

SEQ ID NO: 2487788 - RNA, 14 nt, Human
agggaguccccucc

SEQ ID NO: 2487789 - RNA, 23 nt, Human
agggaguccgaaagggacuugga

SEQ ID NO: 2487790 - RNA, 22 nt, Human
agggagggcuccagacacaugu

SEQ ID NO: 2487791 - RNA, 15 nt, Human
agggagggcugucau

SEQ ID NO: 2487792 - RNA, 21 nt, Human
agggagguggggaugagaaga

SEQ ID NO: 2487793 - RNA, 23 nt, Human
agggagguguuuaaagagagguu

SEQ ID NO: 2487794 - RNA, 22 nt, Human
agggagguguuuaaagagaggu

SEQ ID NO: 2487795 - RNA, 20 nt, Human
agggagguguuuaaagagag

SEQ ID NO: 2487796 - RNA, 20 nt, Human
agggaguccgaaagggacuu

SEQ ID NO: 2487797 - RNA, 19 nt, Human
agggagggcuccagacaca

SEQ ID NO: 2487798 - RNA, 17 nt, Human
agggagggcuccagaca

SEQ ID NO: 2487799 - RNA, 12 nt, Human
agggagggcucc

SEQ ID NO: 2487800 - RNA, 13 nt, Human
agggagggccugg

SEQ ID NO: 2487801 - RNA, 15 nt, Human
agggagggccugggc

SEQ ID NO: 2487802 - RNA, 17 nt, Human
agggagggagggcucca

SEQ ID NO: 2487803 - RNA, 16 nt, Human
ugggccaacucaccug

SEQ ID NO: 2487804 - RNA, 20 nt, Human
ugggccaagucaaagacauu

SEQ ID NO: 2487805 - RNA, 17 nt, Human
ugggcauugauggggaa

SEQ ID NO: 2487806 - RNA, 18 nt, Human
ugggcauugauggggaag

SEQ ID NO: 2487807 - RNA, 23 nt, Human
ugggcauugauggggaaggaggc

SEQ ID NO: 2487808 - RNA, 12 nt, Human
ugggcauugcuu

SEQ ID NO: 2487809 - RNA, 13 nt, Human
ugggcauugcuuu

SEQ ID NO: 2487810 - RNA, 23 nt, Human
ugggccaacaaagaacacuaacu

SEQ ID NO: 2487811 - RNA, 16 nt, Human
ugggcauuugugaggc

SEQ ID NO: 2487812 - RNA, 14 nt, Human
ugggcauugcuuuc

SEQ ID NO: 2487813 - RNA, 15 nt, Human
ugggcauugcuuucc

SEQ ID NO: 2487814 - RNA, 20 nt, Human
ugggcauugcuuuccacuga

SEQ ID NO: 2487815 - RNA, 15 nt, Human
ugggcauuugugagg

SEQ ID NO: 2487816 - RNA, 13 nt, Human
agggcauuggcca

SEQ ID NO: 2487817 - RNA, 22 nt, Human
agggcaucuccaggaaggcggg

SEQ ID NO: 2487818 - RNA, 22 nt, Human
agggcauuugagaaaugcauau

SEQ ID NO: 2487819 - RNA, 19 nt, Human
agggcauuugagaaaugca

SEQ ID NO: 2487820 - RNA, 17 nt, Human
agggcauggccaggugg

SEQ ID NO: 2487821 - RNA, 19 nt, Human
agggcaucuccaggaaggc

SEQ ID NO: 2487822 - RNA, 16 nt, Human
agggcaucuccaggaa

SEQ ID NO: 2487823 - RNA, 19 nt, Human
agggcauaaugaugauggg

SEQ ID NO: 2487824 - RNA, 15 nt, Human
agggcauaaugauga

SEQ ID NO: 2487825 - RNA, 15 nt, Human
agggcaucuccagga

SEQ ID NO: 2487826 - RNA, 14 nt, Human
agggcaucuccagg

SEQ ID NO: 2487827 - RNA, 13 nt, Human
agggcaucuccag

SEQ ID NO: 2487828 - RNA, 18 nt, Human
agggcauccuucugccuu

SEQ ID NO: 2487829 - RNA, 22 nt, Human
agggcauaaugaugaugggaau

SEQ ID NO: 2487830 - RNA, 17 nt, Human
agggcaucaugcaucuu

SEQ ID NO: 2487831 - RNA, 13 nt, Human
agggcccagagag

SEQ ID NO: 2487832 - RNA, 12 nt, Human
agggcccagaga

SEQ ID NO: 2487833 - RNA, 16 nt, Human
agggccaacccuucuc

SEQ ID NO: 2487834 - RNA, 15 nt, Human
agggccaacccuucu

SEQ ID NO: 2487835 - RNA, 23 nt, Human
agggccaacuugagggcccagag

SEQ ID NO: 2487836 - RNA, 21 nt, Human
agggccaagcccagcacugcu

SEQ ID NO: 2487837 - RNA, 21 nt, Human
agggccaacccuucuccucuu

SEQ ID NO: 2487838 - RNA, 17 nt, Human
agggccaacccuucucc

SEQ ID NO: 2487839 - RNA, 18 nt, Human
agggcaguguuuccuuuu

SEQ ID NO: 2487840 - RNA, 17 nt, Human
agggcaguguuuccuuu

SEQ ID NO: 2487841 - RNA, 16 nt, Human
agggcaguguuuccuu

SEQ ID NO: 2487842 - RNA, 15 nt, Human
agggcaguguuuccu

SEQ ID NO: 2487843 - RNA, 13 nt, Human
agggcaguguuuc

SEQ ID NO: 2487844 - RNA, 12 nt, Human
agggcagaguga

SEQ ID NO: 2487845 - RNA, 20 nt, Human
agggcagucgauagagcugu

SEQ ID NO: 2487846 - RNA, 17 nt, Human
agggcagaggcuggagg

SEQ ID NO: 2487847 - RNA, 20 nt, Human
agggcagaggcuggaggcag

SEQ ID NO: 2487848 - RNA, 17 nt, Human
agggcagagucacacgg

SEQ ID NO: 2487849 - RNA, 22 nt, Human
agggcagaggcuggaggcaggg

SEQ ID NO: 2487850 - RNA, 14 nt, Human
agggcagaggcugg

SEQ ID NO: 2487851 - RNA, 15 nt, Human
agggcagaggcugga

SEQ ID NO: 2487852 - RNA, 20 nt, Human
agggcagaaagguucugccc

SEQ ID NO: 2487853 - RNA, 19 nt, Human
agggcagaaagguucugcc

SEQ ID NO: 2487854 - RNA, 23 nt, Human
agggcacuucacagagugugcug

SEQ ID NO: 2487855 - RNA, 17 nt, Human
agggcacuucacagagu

SEQ ID NO: 2487856 - RNA, 16 nt, Human
agggcacuucacagag

SEQ ID NO: 2487857 - RNA, 17 nt, Human
agggcagaacacuaacc

SEQ ID NO: 2487858 - RNA, 15 nt, Human
agggcagaacacuaa

SEQ ID NO: 2487859 - RNA, 22 nt, Human
agggcagaacacuaaccugacc

SEQ ID NO: 2487860 - RNA, 15 nt, Human
agggcagagccggga

SEQ ID NO: 2487861 - RNA, 17 nt, Human
agggcacugguggcccg

SEQ ID NO: 2487862 - RNA, 15 nt, Human
agggauaagguaccu

SEQ ID NO: 2487863 - RNA, 16 nt, Human
agggauacaugcucuu

SEQ ID NO: 2487864 - RNA, 14 nt, Human
agggauacacugaa

SEQ ID NO: 2487865 - RNA, 21 nt, Human
agggaguuaucuaaaagaaau

SEQ ID NO: 2487866 - RNA, 14 nt, Human
agggcccagagagg

SEQ ID NO: 2487867 - RNA, 24 nt, Human
agggccacacuauuaccaugagaa

SEQ ID NO: 2487868 - RNA, 18 nt, Human
agggccacacuauuacca

SEQ ID NO: 2487869 - RNA, 16 nt, Human
agggccaagacuuggc

SEQ ID NO: 2487870 - RNA, 16 nt, Human
agggcccagagcccag

SEQ ID NO: 2487871 - RNA, 17 nt, Human
agggcccagagcccagc

SEQ ID NO: 2487872 - RNA, 11 nt, Human
agggcccagag

SEQ ID NO: 2487873 - RNA, 18 nt, Human
agggcccagagcccagcu

SEQ ID NO: 2487874 - RNA, 19 nt, Human
agggcccagagcccagcuc

SEQ ID NO: 2487875 - RNA, 20 nt, Human
agggcccagagcccagcucc

SEQ ID NO: 2487876 - RNA, 21 nt, Human
agggcccagagcccagcucca

SEQ ID NO: 2487877 - RNA, 14 nt, Human
agggcccaggcagg

SEQ ID NO: 2487878 - RNA, 15 nt, Human
agggcccaggcaggc

SEQ ID NO: 2487879 - RNA, 11 nt, Human
agggccccucu

SEQ ID NO: 2487880 - RNA, 20 nt, Human
agggcuccagacacaugucc

SEQ ID NO: 2487881 - RNA, 19 nt, Human
agggccccucacccugccu

SEQ ID NO: 2487882 - RNA, 14 nt, Human
agggccccagcacu

SEQ ID NO: 2487883 - RNA, 18 nt, Human
agggccccagcacuaaag

SEQ ID NO: 2487884 - RNA, 18 nt, Human
agggccccagaaggcagg

SEQ ID NO: 2487885 - RNA, 12 nt, Human
agggccccagca

SEQ ID NO: 2487886 - RNA, 17 nt, Human
agggcccaggcaggcca

SEQ ID NO: 2487887 - RNA, 20 nt, Human
agggcuggacugaggccuga

SEQ ID NO: 2487888 - RNA, 18 nt, Human
agggcuggacugaggccu

SEQ ID NO: 2487889 - RNA, 17 nt, Human
agggcuggacugaggcc

SEQ ID NO: 2487890 - RNA, 16 nt, Human
agggcuggacugaggc

SEQ ID NO: 2487891 - RNA, 13 nt, Human
agggcuggaccua

SEQ ID NO: 2487892 - RNA, 12 nt, Human
agggcuggaccu

SEQ ID NO: 2487893 - RNA, 22 nt, Human
agggcuggaaucuggagagcua

SEQ ID NO: 2487894 - RNA, 15 nt, Human
agggcuggacugagg

SEQ ID NO: 2487895 - RNA, 14 nt, Human
agggcuggacugag

SEQ ID NO: 2487896 - RNA, 13 nt, Human
agggcugcuguga

SEQ ID NO: 2487897 - RNA, 17 nt, Human
agggcugcuagacggag

SEQ ID NO: 2487898 - RNA, 13 nt, Human
agggcugccacca

SEQ ID NO: 2487899 - RNA, 20 nt, Human
agggcugacacguccacccc

SEQ ID NO: 2487900 - RNA, 16 nt, Human
agggcugagcugggga

SEQ ID NO: 2487901 - RNA, 17 nt, Human
agggcugagcucucugu

SEQ ID NO: 2487902 - RNA, 22 nt, Human
agggcuccugccuucuguccug

SEQ ID NO: 2487903 - RNA, 15 nt, Human
agggcuccugccuuc

SEQ ID NO: 2487904 - RNA, 12 nt, Human
agggcuccuggg

SEQ ID NO: 2487905 - RNA, 21 nt, Human
agggcugacacguccacccca

SEQ ID NO: 2487906 - RNA, 14 nt, Human
agggcuccugccuu

SEQ ID NO: 2487907 - RNA, 12 nt, Human
agggcuccugcc

SEQ ID NO: 2487908 - RNA, 11 nt, Human
agggcuccugc

SEQ ID NO: 2487909 - RNA, 20 nt, Human
agggcuccccacugccuacu

SEQ ID NO: 2487910 - RNA, 11 nt, Human
agggcucccca

SEQ ID NO: 2487911 - RNA, 15 nt, Human
agggcucccugcccu

SEQ ID NO: 2487912 - RNA, 15 nt, Human
ugggcucccugacug

SEQ ID NO: 2487913 - RNA, 19 nt, Human
ugggcucccugacugggag

SEQ ID NO: 2487914 - RNA, 15 nt, Human
ugggcucccuuccca

SEQ ID NO: 2487915 - RNA, 21 nt, Human
ugggcucccuucccaccucuc

SEQ ID NO: 2487916 - RNA, 17 nt, Human
ugggcucccuugugcgu

SEQ ID NO: 2487917 - RNA, 14 nt, Human
ugggcucccuuccc

SEQ ID NO: 2487918 - RNA, 11 nt, Human
ugggcucccug

SEQ ID NO: 2487919 - RNA, 16 nt, Human
ugggcucaagcagucu

SEQ ID NO: 2487920 - RNA, 16 nt, Human
ugggcucgucuuugca

SEQ ID NO: 2487921 - RNA, 15 nt, Human
ugggcucgucuuugc

SEQ ID NO: 2487922 - RNA, 17 nt, Human
ugggcucggaggcugcc

SEQ ID NO: 2487923 - RNA, 14 nt, Human
ugggcucgcccacc

SEQ ID NO: 2487924 - RNA, 23 nt, Human
ugggcuccuccagggugugugcu

SEQ ID NO: 2487925 - RNA, 13 nt, Human
ugggcuccuccag

SEQ ID NO: 2487926 - RNA, 15 nt, Human
ugggcuccuccaggg

SEQ ID NO: 2487927 - RNA, 23 nt, Human
ugggcucuccaccucagccuugg

SEQ ID NO: 2487928 - RNA, 19 nt, Human
ugggcucugacagaaagca

SEQ ID NO: 2487929 - RNA, 21 nt, Human
ugggcucuccaccucagccuu

SEQ ID NO: 2487930 - RNA, 17 nt, Human
ugggcucgucuuugcag

SEQ ID NO: 2487931 - RNA, 14 nt, Human
ugggcucuccaccu

SEQ ID NO: 2487932 - RNA, 15 nt, Human
ugggcucuccaccuc

SEQ ID NO: 2487933 - RNA, 16 nt, Human
ugggcucuccaccuca

SEQ ID NO: 2487934 - RNA, 17 nt, Human
ugggcucuccaccucag

SEQ ID NO: 2487935 - RNA, 18 nt, Human
ugggcucuccaccucagc

SEQ ID NO: 2487936 - RNA, 19 nt, Human
ugggcucuccaccucagcc

SEQ ID NO: 2487937 - RNA, 20 nt, Human
ugggcucuccaccucagccu

SEQ ID NO: 2487938 - RNA, 22 nt, Human
agggcuggcccagcccugcugg

SEQ ID NO: 2487939 - RNA, 20 nt, Human
agggcuggcccagcccugcu

SEQ ID NO: 2487940 - RNA, 19 nt, Human
agggcuggcccagcccugc

SEQ ID NO: 2487941 - RNA, 18 nt, Human
agggcuggcccagcccug

SEQ ID NO: 2487942 - RNA, 17 nt, Human
agggcuggcccagcccu

SEQ ID NO: 2487943 - RNA, 16 nt, Human
agggcuggcccagccc

SEQ ID NO: 2487944 - RNA, 15 nt, Human
agggcuggcccagcc

SEQ ID NO: 2487945 - RNA, 14 nt, Human
agggcuggcccagc

SEQ ID NO: 2487946 - RNA, 13 nt, Human
agggcuggcccag

SEQ ID NO: 2487947 - RNA, 22 nt, Human
agggcuggaccuauguccuaag

SEQ ID NO: 2487948 - RNA, 23 nt, Human
agggcuggcccagcccugcuggc

SEQ ID NO: 2487949 - RNA, 16 nt, Human
agggcuggucucugcu

SEQ ID NO: 2487950 - RNA, 22 nt, Human
agggcuguuauaaucuuucaca

SEQ ID NO: 2487951 - RNA, 18 nt, Human
agggcugucaucugugca

SEQ ID NO: 2487952 - RNA, 19 nt, Human
agggcugucaucugugcac

SEQ ID NO: 2487953 - RNA, 20 nt, Human
agggcugucaucugugcacu

SEQ ID NO: 2487954 - RNA, 19 nt, Human
agggaaagaaaaggaaggc

SEQ ID NO: 2487955 - RNA, 15 nt, Human
agggaaacuucccgu

SEQ ID NO: 2487956 - RNA, 12 nt, Human
agggaaagaaaa

SEQ ID NO: 2487957 - RNA, 23 nt, Human
agggaaagaaaguugcacggcug

SEQ ID NO: 2487958 - RNA, 18 nt, Human
agggaaaggauauuuucu

SEQ ID NO: 2487959 - RNA, 18 nt, Human
agggaaaggggugcuuuu

SEQ ID NO: 2487960 - RNA, 15 nt, Human
agggaaaggggugcu

SEQ ID NO: 2487961 - RNA, 22 nt, Human
agggaaaggcucugaaagccag

SEQ ID NO: 2487962 - RNA, 22 nt, Human
agggaaauagaaaaacccugcc

SEQ ID NO: 2487963 - RNA, 15 nt, Human
agggaaauagaaaaa

SEQ ID NO: 2487964 - RNA, 19 nt, Human
agggaaaggggugcuuuua

SEQ ID NO: 2487965 - RNA, 15 nt, Human
agggaaauaucauuu

SEQ ID NO: 2487966 - RNA, 14 nt, Human
agggaaaugaaaga

SEQ ID NO: 2487967 - RNA, 23 nt, Human
agggacuucugucuucacaacag

SEQ ID NO: 2487968 - RNA, 15 nt, Human
agggacuuggaagcu

SEQ ID NO: 2487969 - RNA, 19 nt, Human
agggacuuggaagcuccgc

SEQ ID NO: 2487970 - RNA, 18 nt, Human
agggacuuggaagcuccg

SEQ ID NO: 2487971 - RNA, 16 nt, Human
agggagaagaaaggug

SEQ ID NO: 2487972 - RNA, 13 nt, Human
agggagaaauguu

SEQ ID NO: 2487973 - RNA, 16 nt, Human
agggacuugaaguugu

SEQ ID NO: 2487974 - RNA, 15 nt, Human
agggacuugaaguug

SEQ ID NO: 2487975 - RNA, 14 nt, Human
agggacuugaaguu

SEQ ID NO: 2487976 - RNA, 23 nt, Human
agggaaauagaaaaacccugccc

SEQ ID NO: 2487977 - RNA, 16 nt, Human
agggaaaugaucaguu

SEQ ID NO: 2487978 - RNA, 20 nt, Human
agggacuuggaagcuccgcu

SEQ ID NO: 2487979 - RNA, 20 nt, Human
agggagacacuggccccuca

SEQ ID NO: 2487980 - RNA, 18 nt, Human
agggagaagggauggagg

SEQ ID NO: 2487981 - RNA, 12 nt, Human
agggagacagag

SEQ ID NO: 2487982 - RNA, 19 nt, Human
agggagacccguccauuug

SEQ ID NO: 2487983 - RNA, 22 nt, Human
agggagaaggaucuagaaugug

SEQ ID NO: 2487984 - RNA, 16 nt, Human
agggagaaggaucuag

SEQ ID NO: 2487985 - RNA, 15 nt, Human
agggagaaggaucua

SEQ ID NO: 2487986 - RNA, 15 nt, Human
agggagaagaaguca

SEQ ID NO: 2487987 - RNA, 13 nt, Human
agggagaagcucc

SEQ ID NO: 2487988 - RNA, 21 nt, Human
agggagaagacuauauuguac

SEQ ID NO: 2487989 - RNA, 13 nt, Human
agggagagaagau

SEQ ID NO: 2487990 - RNA, 14 nt, Human
agggagagaagaua

SEQ ID NO: 2487991 - RNA, 11 nt, Human
agggagagaga

SEQ ID NO: 2487992 - RNA, 17 nt, Human
agggagcagacaggagg

SEQ ID NO: 2487993 - RNA, 19 nt, Human
agggagcaggcggugggca

SEQ ID NO: 2487994 - RNA, 23 nt, Human
agggagagaccucaucaggauga

SEQ ID NO: 2487995 - RNA, 16 nt, Human
agggagagaccucauc

SEQ ID NO: 2487996 - RNA, 15 nt, Human
ugggacuucuuuuca

SEQ ID NO: 2487997 - RNA, 13 nt, Human
ugggacuucuuuu

SEQ ID NO: 2487998 - RNA, 20 nt, Human
ugggacuuccuugcucuccc

SEQ ID NO: 2487999 - RNA, 19 nt, Human
ugggacuuccuugcucucc

SEQ ID NO: 2488000 - RNA, 19 nt, Human
ugggacuggguuuggaccc

SEQ ID NO: 2488001 - RNA, 17 nt, Human
ugggacuuccuugcucu

SEQ ID NO: 2488002 - RNA, 14 nt, Human
ugggacuuaacucc

SEQ ID NO: 2488003 - RNA, 15 nt, Human
ugggagaaaugaaaa

SEQ ID NO: 2488004 - RNA, 14 nt, Human
ugggacuggccucu

SEQ ID NO: 2488005 - RNA, 16 nt, Human
ugggacuggccucugc

SEQ ID NO: 2488006 - RNA, 12 nt, Human
ugggacugggag

SEQ ID NO: 2488007 - RNA, 13 nt, Human
ugggacugggagg

SEQ ID NO: 2488008 - RNA, 15 nt, Human
ugggacugggagggc

SEQ ID NO: 2488009 - RNA, 16 nt, Human
ugggacugggagggcc

SEQ ID NO: 2488010 - RNA, 18 nt, Human
ugggacugggagggccca

SEQ ID NO: 2488011 - RNA, 13 nt, Human
ugggacuggccuc

SEQ ID NO: 2488012 - RNA, 18 nt, Human
ugggacucaaugcacuga

SEQ ID NO: 2488013 - RNA, 16 nt, Human
ugggacuacaggugug

SEQ ID NO: 2488014 - RNA, 13 nt, Human
agggagccuccug

SEQ ID NO: 2488015 - RNA, 11 nt, Human
agggagccucc

SEQ ID NO: 2488016 - RNA, 17 nt, Human
agggagccccuuugaug

SEQ ID NO: 2488017 - RNA, 18 nt, Human
agggagcaucagugcccu

SEQ ID NO: 2488018 - RNA, 19 nt, Human
agggagcauagaaggcagg

SEQ ID NO: 2488019 - RNA, 17 nt, Human
agggagcauagaaggca

SEQ ID NO: 2488020 - RNA, 21 nt, Human
agggagcauagaaggcaggug

SEQ ID NO: 2488021 - RNA, 20 nt, Human
agggagcauagaaggcaggu

SEQ ID NO: 2488022 - RNA, 14 nt, Human
agggagcauggcug

SEQ ID NO: 2488023 - RNA, 17 nt, Human
agggagcauuuuccucc

SEQ ID NO: 2488024 - RNA, 15 nt, Human
agggagcauuuuccu

SEQ ID NO: 2488025 - RNA, 17 nt, Human
agggagccuccugccca

SEQ ID NO: 2488026 - RNA, 16 nt, Human
agggagccuccugccc

SEQ ID NO: 2488027 - RNA, 15 nt, Human
agggagccuccugcc

SEQ ID NO: 2488028 - RNA, 14 nt, Human
agggagccuccugc

SEQ ID NO: 2488029 - RNA, 14 nt, Human
agggagccuggccc

SEQ ID NO: 2488030 - RNA, 18 nt, Human
agggagccuuugguucug

SEQ ID NO: 2488031 - RNA, 19 nt, Human
agggagcggccggccagcc

SEQ ID NO: 2488032 - RNA, 17 nt, Human
agggagcggaaagcagc

SEQ ID NO: 2488033 - RNA, 18 nt, Human
agggagcggaaagcagcu

SEQ ID NO: 2488034 - RNA, 22 nt, Human
agggagccuccugcccaguccc

SEQ ID NO: 2488035 - RNA, 14 nt, Human
agggagcggaaagc

SEQ ID NO: 2488036 - RNA, 16 nt, Human
agggagcgagggagaa

SEQ ID NO: 2488037 - RNA, 18 nt, Human
ugggacuacaggcaccca

SEQ ID NO: 2488038 - RNA, 21 nt, Human
agggagcggccggccagcccc

SEQ ID NO: 2488039 - RNA, 22 nt, Human
agggagcggccggccagccccu

SEQ ID NO: 2488040 - RNA, 21 nt, Human
ugggagaaccaaaaagaggcu

SEQ ID NO: 2488041 - RNA, 22 nt, Human
ugggacuucuuuucacauucuu

SEQ ID NO: 2488042 - RNA, 21 nt, Human
ugggacuucuuuucacauucu

SEQ ID NO: 2488043 - RNA, 20 nt, Human
ugggacuucuuuucacauuc

SEQ ID NO: 2488044 - RNA, 18 nt, Human
ugggacuucuuuucacau

SEQ ID NO: 2488045 - RNA, 19 nt, Human
ugggagaaauugacagauc

SEQ ID NO: 2488046 - RNA, 18 nt, Human
ugggagaaauugacagau

SEQ ID NO: 2488047 - RNA, 16 nt, Human
ugggagaaaugaaaaa

SEQ ID NO: 2488048 - RNA, 22 nt, Human
ugggaggauugcuugagcucag

SEQ ID NO: 2488049 - RNA, 17 nt, Human
ugggaggcgggagugga

SEQ ID NO: 2488050 - RNA, 22 nt, Human
ugggaggcggagaguacaguga

SEQ ID NO: 2488051 - RNA, 13 nt, Human
ugggaggcucacc

SEQ ID NO: 2488052 - RNA, 14 nt, Human
ugggaggcgcgagc

SEQ ID NO: 2488053 - RNA, 20 nt, Human
ugggaggauucuaugaggca

SEQ ID NO: 2488054 - RNA, 18 nt, Human
ugggaggauugcuugagc

SEQ ID NO: 2488055 - RNA, 21 nt, Human
ugggaggauugcuugagcuca

SEQ ID NO: 2488056 - RNA, 19 nt, Human
ugggaggcugagaugggag

SEQ ID NO: 2488057 - RNA, 11 nt, Human
ugggaggcuga

SEQ ID NO: 2488058 - RNA, 13 nt, Human
ugggaggcugagg

SEQ ID NO: 2488059 - RNA, 14 nt, Human
ugggaggcugaggc

SEQ ID NO: 2488060 - RNA, 15 nt, Human
ugggaggcugaggcg

SEQ ID NO: 2488061 - RNA, 19 nt, Human
ugggagggagcagacagga

SEQ ID NO: 2488062 - RNA, 18 nt, Human
ugggagggagcagacagg

SEQ ID NO: 2488063 - RNA, 17 nt, Human
ugggagggagcagacag

SEQ ID NO: 2488064 - RNA, 14 nt, Human
ugggaggcuucccc

SEQ ID NO: 2488065 - RNA, 18 nt, Human
ugggaggccuaggcgggc

SEQ ID NO: 2488066 - RNA, 16 nt, Human
ugggagggaggcucag

SEQ ID NO: 2488067 - RNA, 17 nt, Human
ugggagggaggcucagg

SEQ ID NO: 2488068 - RNA, 22 nt, Human
ugggagggaggcucaggucccu

SEQ ID NO: 2488069 - RNA, 18 nt, Human
ugggagggauagaggggg

SEQ ID NO: 2488070 - RNA, 23 nt, Human
ugggaggcucuggagcccacugu

SEQ ID NO: 2488071 - RNA, 17 nt, Human
ugggaggcucuggagcc

SEQ ID NO: 2488072 - RNA, 14 nt, Human
ugggaggcucugga

SEQ ID NO: 2488073 - RNA, 20 nt, Human
ugggaggcucacccccuucu

SEQ ID NO: 2488074 - RNA, 22 nt, Human
ugggaggcucacccccuucucc

SEQ ID NO: 2488075 - RNA, 21 nt, Human
ugggcaacccccagccugcua

SEQ ID NO: 2488076 - RNA, 14 nt, Human
ugggcaaggaggcc

SEQ ID NO: 2488077 - RNA, 16 nt, Human
ugggcaacauugcugg

SEQ ID NO: 2488078 - RNA, 15 nt, Human
ugggcaaagagugua

SEQ ID NO: 2488079 - RNA, 16 nt, Human
ugggcaacagagcaag

SEQ ID NO: 2488080 - RNA, 22 nt, Human
ugggcaaaacugaauuauaaga

SEQ ID NO: 2488081 - RNA, 14 nt, Human
ugggcaaacaggca

SEQ ID NO: 2488082 - RNA, 15 nt, Human
ugggcaaacaggcag

SEQ ID NO: 2488083 - RNA, 16 nt, Human
ugggcaaacaggcagu

SEQ ID NO: 2488084 - RNA, 15 nt, Human
ugggcaaagccuagu

SEQ ID NO: 2488085 - RNA, 21 nt, Human
ugggcaaagccuagugaaggc

SEQ ID NO: 2488086 - RNA, 12 nt, Human
ugggcaacagag

SEQ ID NO: 2488087 - RNA, 14 nt, Human
ugggcaacagagca

SEQ ID NO: 2488088 - RNA, 23 nt, Human
ugggaggggcgcccaccucccca

SEQ ID NO: 2488089 - RNA, 19 nt, Human
ugggaggggcgcccaccuc

SEQ ID NO: 2488090 - RNA, 19 nt, Human
ugggaggggcaggcugaca

SEQ ID NO: 2488091 - RNA, 23 nt, Human
ugggagggggcuugaagccaaag

SEQ ID NO: 2488092 - RNA, 16 nt, Human
ugggcaaaaaacucga

SEQ ID NO: 2488093 - RNA, 15 nt, Human
ugggcaaaaaacucg

SEQ ID NO: 2488094 - RNA, 20 nt, Human
ugggaggggcgcccaccucc

SEQ ID NO: 2488095 - RNA, 16 nt, Human
ugggauuuggucaaca

SEQ ID NO: 2488096 - RNA, 14 nt, Human
ugggagggcagcag

SEQ ID NO: 2488097 - RNA, 17 nt, Human
ugggagggcagcagggc

SEQ ID NO: 2488098 - RNA, 18 nt, Human
ugggagggcagcagggcu

SEQ ID NO: 2488099 - RNA, 19 nt, Human
ugggagggcagcagggcua

SEQ ID NO: 2488100 - RNA, 18 nt, Human
ugggaggggcaggcugac

SEQ ID NO: 2488101 - RNA, 17 nt, Human
ugggaggggcaggcuga

SEQ ID NO: 2488102 - RNA, 16 nt, Human
ugggaggggcaggcug

SEQ ID NO: 2488103 - RNA, 15 nt, Human
ugggaggggcaggcu

SEQ ID NO: 2488104 - RNA, 14 nt, Human
ugggaggggcaggc

SEQ ID NO: 2488105 - RNA, 12 nt, Human
ugggaggggcag

SEQ ID NO: 2488106 - RNA, 11 nt, Human
ugggaggggca

SEQ ID NO: 2488107 - RNA, 12 nt, Human
ugggagggccca

SEQ ID NO: 2488108 - RNA, 20 nt, Human
ugggcagaaggaagacuuca

SEQ ID NO: 2488109 - RNA, 16 nt, Human
ugggcagaaggaagac

SEQ ID NO: 2488110 - RNA, 23 nt, Human
ugggcagaaggaagacuucaucc

SEQ ID NO: 2488111 - RNA, 15 nt, Human
ugggcaagugauuga

SEQ ID NO: 2488112 - RNA, 15 nt, Human
ugggcaauauagcaa

SEQ ID NO: 2488113 - RNA, 16 nt, Human
ugggcaauauagcaag

SEQ ID NO: 2488114 - RNA, 13 nt, Human
ugggcagaaggaa

SEQ ID NO: 2488115 - RNA, 21 nt, Human
ugggcacacgccucccacugg

SEQ ID NO: 2488116 - RNA, 16 nt, Human
ugggcacacgccuccc

SEQ ID NO: 2488117 - RNA, 19 nt, Human
ugggcaaugauggcaauuu

SEQ ID NO: 2488118 - RNA, 18 nt, Human
uguacaucuauuuuggau

SEQ ID NO: 2488119 - RNA, 19 nt, Human
uguacaucuauuuuggauu

SEQ ID NO: 2488120 - RNA, 20 nt, Human
uguacaucuauuuuggauug

SEQ ID NO: 2488121 - RNA, 21 nt, Human
uguacaucuauuuuggauugu

SEQ ID NO: 2488122 - RNA, 14 nt, Human
uguacaugaaaaca

SEQ ID NO: 2488123 - RNA, 16 nt, Human
uguacaugaaaacaca

SEQ ID NO: 2488124 - RNA, 23 nt, Human
uguacaucuauuuuggauuguau

SEQ ID NO: 2488125 - RNA, 14 nt, Human
uguacaucuggccu

SEQ ID NO: 2488126 - RNA, 22 nt, Human
uguacauagccuauauuuacag

SEQ ID NO: 2488127 - RNA, 16 nt, Human
uguacauagccuauau

SEQ ID NO: 2488128 - RNA, 15 nt, Human
uguacauagccuaua

SEQ ID NO: 2488129 - RNA, 11 nt, Human
uguacauagcc

SEQ ID NO: 2488130 - RNA, 23 nt, Human
uguacauagccuauauuuacagu

SEQ ID NO: 2488131 - RNA, 18 nt, Human
uguacauaguuauuuauu

SEQ ID NO: 2488132 - RNA, 21 nt, Human
uguacauacccuggccgcccc

SEQ ID NO: 2488133 - RNA, 17 nt, Human
uguacauaacugaaaau

SEQ ID NO: 2488134 - RNA, 18 nt, Human
uguacauaacugaaaaug

SEQ ID NO: 2488135 - RNA, 19 nt, Human
uguacauaacugaaaaugu

SEQ ID NO: 2488136 - RNA, 23 nt, Human
uguaauuuuguucuaguuuucag

SEQ ID NO: 2488137 - RNA, 16 nt, Human
uguaauuguuguuugu

SEQ ID NO: 2488138 - RNA, 20 nt, Human
uguaauuuuuuuaucgucac

SEQ ID NO: 2488139 - RNA, 13 nt, Human
uguacaaaauaaa

SEQ ID NO: 2488140 - RNA, 19 nt, Human
uguacauaaugcgugcaua

SEQ ID NO: 2488141 - RNA, 20 nt, Human
uguacauaaugcgugcauac

SEQ ID NO: 2488142 - RNA, 17 nt, Human
uguacaaaauaaacaaa

SEQ ID NO: 2488143 - RNA, 13 nt, Human
uguacauaacuga

SEQ ID NO: 2488144 - RNA, 14 nt, Human
uguacauaacugaa

SEQ ID NO: 2488145 - RNA, 15 nt, Human
uguacauaacugaaa

SEQ ID NO: 2488146 - RNA, 12 nt, Human
uguacaguuuuu

SEQ ID NO: 2488147 - RNA, 21 nt, Human
uguaauuccuaccucccugca

SEQ ID NO: 2488148 - RNA, 15 nt, Human
uguaauuccuaccuc

SEQ ID NO: 2488149 - RNA, 14 nt, Human
uguaauucuaaaug

SEQ ID NO: 2488150 - RNA, 13 nt, Human
uguaauucuaaau

SEQ ID NO: 2488151 - RNA, 23 nt, Human
uguaauugcuuacauuuuuacaa

SEQ ID NO: 2488152 - RNA, 18 nt, Human
uguaauugcuuacauuuu

SEQ ID NO: 2488153 - RNA, 17 nt, Human
uguaauugcuuacauuu

SEQ ID NO: 2488154 - RNA, 16 nt, Human
uguaauugcuuacauu

SEQ ID NO: 2488155 - RNA, 15 nt, Human
uguaauugcuuacau

SEQ ID NO: 2488156 - RNA, 14 nt, Human
uguaauugcuuaca

SEQ ID NO: 2488157 - RNA, 16 nt, Human
uguaauucuaaaugaa

SEQ ID NO: 2488158 - RNA, 15 nt, Human
uguaauucuaaauga

SEQ ID NO: 2488159 - RNA, 15 nt, Human
uguaauugaauaaag

SEQ ID NO: 2488160 - RNA, 19 nt, Human
uguaauuaaguacuaugua

SEQ ID NO: 2488161 - RNA, 21 nt, Human
uguaauuaaguacuauguauc

SEQ ID NO: 2488162 - RNA, 19 nt, Human
uguaagggaaacugccagc

SEQ ID NO: 2488163 - RNA, 18 nt, Human
uguaauuaaguacuaugu

SEQ ID NO: 2488164 - RNA, 19 nt, Human
agguuggaagcuagcuccc

SEQ ID NO: 2488165 - RNA, 18 nt, Human
agguuggaagcuagcucc

SEQ ID NO: 2488166 - RNA, 20 nt, Human
agguuggcaaaaaggcagga

SEQ ID NO: 2488167 - RNA, 21 nt, Human
agguuucauacucuagauuuu

SEQ ID NO: 2488168 - RNA, 12 nt, Human
agguuucauacu

SEQ ID NO: 2488169 - RNA, 17 nt, Human
agguuucguuucuguau

SEQ ID NO: 2488170 - RNA, 14 nt, Human
agguuucugaaaau

SEQ ID NO: 2488171 - RNA, 13 nt, Human
uguaagggaaacu

SEQ ID NO: 2488172 - RNA, 18 nt, Human
uguaagggaaacugccag

SEQ ID NO: 2488173 - RNA, 18 nt, Human
agguuucuggucucuagg

SEQ ID NO: 2488174 - RNA, 19 nt, Human
agguuucugaguuccugca

SEQ ID NO: 2488175 - RNA, 21 nt, Human
agguuucugaguuccugcaug

SEQ ID NO: 2488176 - RNA, 23 nt, Human
agguuucugaaaauuaacacugc

SEQ ID NO: 2488177 - RNA, 15 nt, Human
agguuucugaaaauu

SEQ ID NO: 2488178 - RNA, 12 nt, Human
ugggcugaggga

SEQ ID NO: 2488179 - RNA, 16 nt, Human
ugggcugagggagccu

SEQ ID NO: 2488180 - RNA, 11 nt, Human
ugggcugaggg

SEQ ID NO: 2488181 - RNA, 14 nt, Human
ugggcucugggagc

SEQ ID NO: 2488182 - RNA, 23 nt, Human
ugggcucugccccagcucuggcu

SEQ ID NO: 2488183 - RNA, 20 nt, Human
ugggcucugccccagcucug

SEQ ID NO: 2488184 - RNA, 21 nt, Human
ugggcucugccccagcucugg

SEQ ID NO: 2488185 - RNA, 18 nt, Human
ugggcucugccacccuac

SEQ ID NO: 2488186 - RNA, 15 nt, Human
ugggcucugccaccc

SEQ ID NO: 2488187 - RNA, 13 nt, Human
ugggcucugccac

SEQ ID NO: 2488188 - RNA, 22 nt, Human
ugggcucugcaauuccccucug

SEQ ID NO: 2488189 - RNA, 20 nt, Human
ugggcucugcaauuccccuc

SEQ ID NO: 2488190 - RNA, 12 nt, Human
ugggcucugccc

SEQ ID NO: 2488191 - RNA, 15 nt, Human
ugggcucugccccag

SEQ ID NO: 2488192 - RNA, 17 nt, Human
ugggcucugccccagcu

SEQ ID NO: 2488193 - RNA, 19 nt, Human
ugggcucugccccagcucu

SEQ ID NO: 2488194 - RNA, 18 nt, Human
aggugccugugaggcagg

SEQ ID NO: 2488195 - RNA, 15 nt, Human
ugggcugcccuggug

SEQ ID NO: 2488196 - RNA, 19 nt, Human
aggugccugugaggcaggg

SEQ ID NO: 2488197 - RNA, 20 nt, Human
aggugccugugaggcagggg

SEQ ID NO: 2488198 - RNA, 22 nt, Human
aggugccugugaggcaggggcg

SEQ ID NO: 2488199 - RNA, 23 nt, Human
aggugccuucuuauucucacucc

SEQ ID NO: 2488200 - RNA, 14 nt, Human
ugggcugcccuggu

SEQ ID NO: 2488201 - RNA, 13 nt, Human
ugggcugcccugg

SEQ ID NO: 2488202 - RNA, 20 nt, Human
ugggcugcacucugugccca

SEQ ID NO: 2488203 - RNA, 19 nt, Human
ugggcugcacucugugccc

SEQ ID NO: 2488204 - RNA, 18 nt, Human
ugggcugcacucugugcc

SEQ ID NO: 2488205 - RNA, 17 nt, Human
ugggcugcacucugugc

SEQ ID NO: 2488206 - RNA, 22 nt, Human
ugggcugcacucugugcccaug

SEQ ID NO: 2488207 - RNA, 21 nt, Human
ugggcugcacucugugcccau

SEQ ID NO: 2488208 - RNA, 21 nt, Human
ugggcugcagcagaggcacug

SEQ ID NO: 2488209 - RNA, 16 nt, Human
ugggcugccaugugaa

SEQ ID NO: 2488210 - RNA, 17 nt, Human
aggugggagcaggagau

SEQ ID NO: 2488211 - RNA, 16 nt, Human
aggugggagcaggaga

SEQ ID NO: 2488212 - RNA, 15 nt, Human
aggugggagcaggag

SEQ ID NO: 2488213 - RNA, 14 nt, Human
aggugggagcagga

SEQ ID NO: 2488214 - RNA, 13 nt, Human
aggugggagcagg

SEQ ID NO: 2488215 - RNA, 19 nt, Human
agguggcugagccccuguc

SEQ ID NO: 2488216 - RNA, 23 nt, Human
aggugggaaaugguaugagcuga

SEQ ID NO: 2488217 - RNA, 21 nt, Human
aggugccuuggagggucccaa

SEQ ID NO: 2488218 - RNA, 15 nt, Human
agguggcugagcccc

SEQ ID NO: 2488219 - RNA, 17 nt, Human
agguggcugagccccug

SEQ ID NO: 2488220 - RNA, 14 nt, Human
agguggcugagccc

SEQ ID NO: 2488221 - RNA, 23 nt, Human
agguggcugacccagucccuggg

SEQ ID NO: 2488222 - RNA, 16 nt, Human
aggugcuacaaaaaca

SEQ ID NO: 2488223 - RNA, 21 nt, Human
aggugccugugaggcaggggc

SEQ ID NO: 2488224 - RNA, 13 nt, Human
aggugccuucuua

SEQ ID NO: 2488225 - RNA, 10 nt, Human
aggugccuug

SEQ ID NO: 2488226 - RNA, 22 nt, Human
aggugccuucuuauucucacuc

SEQ ID NO: 2488227 - RNA, 23 nt, Human
aggugccuuggagggucccaagc

SEQ ID NO: 2488228 - RNA, 23 nt, Human
aggugcuaaauggucgcccagga

SEQ ID NO: 2488229 - RNA, 12 nt, Human
aggugggaggau

SEQ ID NO: 2488230 - RNA, 20 nt, Human
aggugggagcaggagauuga

SEQ ID NO: 2488231 - RNA, 13 nt, Human
aggugggagcuug

SEQ ID NO: 2488232 - RNA, 20 nt, Human
aggugggcgggcagcacagc

SEQ ID NO: 2488233 - RNA, 19 nt, Human
aggugggcgggcagcacag

SEQ ID NO: 2488234 - RNA, 18 nt, Human
aggugggcgggcagcaca

SEQ ID NO: 2488235 - RNA, 16 nt, Human
aggugggcgggcagca

SEQ ID NO: 2488236 - RNA, 15 nt, Human
aggugggccuugcua

SEQ ID NO: 2488237 - RNA, 19 nt, Human
aggugggccuugcuaccuc

SEQ ID NO: 2488238 - RNA, 21 nt, Human
aggugggccuugcuaccucaa

SEQ ID NO: 2488239 - RNA, 22 nt, Human
aggugggccuugcuaccucaag

SEQ ID NO: 2488240 - RNA, 16 nt, Human
aggugggcugagcccu

SEQ ID NO: 2488241 - RNA, 17 nt, Human
aggugggcugagcccug

SEQ ID NO: 2488242 - RNA, 15 nt, Human
aggugggcugagccc

SEQ ID NO: 2488243 - RNA, 22 nt, Human
aggugggcguggucacugcugu

SEQ ID NO: 2488244 - RNA, 22 nt, Human
aggugugagucaccaagcccag

SEQ ID NO: 2488245 - RNA, 21 nt, Human
aggugugagucaccaagccca

SEQ ID NO: 2488246 - RNA, 20 nt, Human
aggugucccugcacuugcag

SEQ ID NO: 2488247 - RNA, 16 nt, Human
aggugucccugcacuu

SEQ ID NO: 2488248 - RNA, 19 nt, Human
aggugucaggcugcuggcg

SEQ ID NO: 2488249 - RNA, 18 nt, Human
aggugucaggcugcuggc

SEQ ID NO: 2488250 - RNA, 17 nt, Human
aggugucaggcugcugg

SEQ ID NO: 2488251 - RNA, 17 nt, Human
agguggggacagggaug

SEQ ID NO: 2488252 - RNA, 20 nt, Human
agguguauggagagaaaaca

SEQ ID NO: 2488253 - RNA, 15 nt, Human
aggugucauacagau

SEQ ID NO: 2488254 - RNA, 21 nt, Human
aggugucauacagauuugcaa

SEQ ID NO: 2488255 - RNA, 15 nt, Human
aggugucauuuccau

SEQ ID NO: 2488256 - RNA, 17 nt, Human
aggugucauuuccauua

SEQ ID NO: 2488257 - RNA, 14 nt, Human
agguggggacaggg

SEQ ID NO: 2488258 - RNA, 13 nt, Human
agguggggacagg

SEQ ID NO: 2488259 - RNA, 18 nt, Human
agguggggagacugggcu

SEQ ID NO: 2488260 - RNA, 21 nt, Human
aggugggcuucccaguggcug

SEQ ID NO: 2488261 - RNA, 15 nt, Human
aggugggcuucccag

SEQ ID NO: 2488262 - RNA, 18 nt, Human
aggugggcugagcccugg

SEQ ID NO: 2488263 - RNA, 19 nt, Human
aggugggcugagcccuggc

SEQ ID NO: 2488264 - RNA, 22 nt, Human
aggugggcgggcagcacagcaa

SEQ ID NO: 2488265 - RNA, 22 nt, Human
agguggcugacccagucccugg

SEQ ID NO: 2488266 - RNA, 20 nt, Human
aggugggcugagcccuggca

SEQ ID NO: 2488267 - RNA, 12 nt, Human
aggugugcucug

SEQ ID NO: 2488268 - RNA, 14 nt, Human
aggugugcaagaga

SEQ ID NO: 2488269 - RNA, 19 nt, Human
agguucuucccuuuuacau

SEQ ID NO: 2488270 - RNA, 12 nt, Human
agguugaaagac

SEQ ID NO: 2488271 - RNA, 21 nt, Human
agguucuucuuccugaagcug

SEQ ID NO: 2488272 - RNA, 19 nt, Human
agguucuucuuccugaagc

SEQ ID NO: 2488273 - RNA, 23 nt, Human
agguucuucuuccugaagcugag

SEQ ID NO: 2488274 - RNA, 23 nt, Human
agguucuucccuuuuacauacug

SEQ ID NO: 2488275 - RNA, 16 nt, Human
agguucuucuuccuga

SEQ ID NO: 2488276 - RNA, 14 nt, Human
agguugaagcacca

SEQ ID NO: 2488277 - RNA, 14 nt, Human
agguugcagugagc

SEQ ID NO: 2488278 - RNA, 19 nt, Human
agguugcagugagccaaga

SEQ ID NO: 2488279 - RNA, 18 nt, Human
agguugcagugagccaag

SEQ ID NO: 2488280 - RNA, 17 nt, Human
agguugcagugagcuga

SEQ ID NO: 2488281 - RNA, 24 nt, Human
agguugcugguugcugugugguuu

SEQ ID NO: 2488282 - RNA, 17 nt, Human
agguugcugguugcugu

SEQ ID NO: 2488283 - RNA, 15 nt, Human
agguugaagccaagu

SEQ ID NO: 2488284 - RNA, 13 nt, Human
agguugaagccaa

SEQ ID NO: 2488285 - RNA, 12 nt, Human
agguugaagcca

SEQ ID NO: 2488286 - RNA, 12 nt, Human
agguugaagagg

SEQ ID NO: 2488287 - RNA, 23 nt, Human
agguugaagccaaguggggugcu

SEQ ID NO: 2488288 - RNA, 13 nt, Human
uguauauaugugu

SEQ ID NO: 2488289 - RNA, 14 nt, Human
uguauauaugugug

SEQ ID NO: 2488290 - RNA, 12 nt, Human
uguauauaugug

SEQ ID NO: 2488291 - RNA, 17 nt, Human
uguauauaucugcuuca

SEQ ID NO: 2488292 - RNA, 18 nt, Human
uguauauauuuccuauau

SEQ ID NO: 2488293 - RNA, 21 nt, Human
uguauauacgcaucuauaaau

SEQ ID NO: 2488294 - RNA, 17 nt, Human
uguauauacgcaucuau

SEQ ID NO: 2488295 - RNA, 12 nt, Human
uguauauacuuu

SEQ ID NO: 2488296 - RNA, 13 nt, Human
uguauauacuuuu

SEQ ID NO: 2488297 - RNA, 17 nt, Human
uguauauauauuaagag

SEQ ID NO: 2488298 - RNA, 18 nt, Human
uguauaucagaaaaggga

SEQ ID NO: 2488299 - RNA, 14 nt, Human
uguauaucagaaaa

SEQ ID NO: 2488300 - RNA, 13 nt, Human
uguauaucagaaa

SEQ ID NO: 2488301 - RNA, 18 nt, Human
uguauauccuuucuaaca

SEQ ID NO: 2488302 - RNA, 20 nt, Human
uguauauauguguguuuaaa

SEQ ID NO: 2488303 - RNA, 19 nt, Human
uguauauauguguguuuaa

SEQ ID NO: 2488304 - RNA, 18 nt, Human
uguauauauguguguuua

SEQ ID NO: 2488305 - RNA, 15 nt, Human
uguauauaugugugu

SEQ ID NO: 2488306 - RNA, 22 nt, Human
uguauauauuuccuauauuguu

SEQ ID NO: 2488307 - RNA, 18 nt, Human
uguaguguuggagaagaa

SEQ ID NO: 2488308 - RNA, 17 nt, Human
uguaguguuggagaaga

SEQ ID NO: 2488309 - RNA, 24 nt, Human
uguauaguguaaaauaagaaugau

SEQ ID NO: 2488310 - RNA, 16 nt, Human
uguauaguguaaaaua

SEQ ID NO: 2488311 - RNA, 15 nt, Human
uguauaguguaaaau

SEQ ID NO: 2488312 - RNA, 17 nt, Human
uguagugagauagcauu

SEQ ID NO: 2488313 - RNA, 22 nt, Human
uguauaguugcuugccugauau

SEQ ID NO: 2488314 - RNA, 16 nt, Human
uguauaguugcuugcc

SEQ ID NO: 2488315 - RNA, 14 nt, Human
uguauaguugcuug

SEQ ID NO: 2488316 - RNA, 14 nt, Human
uguauaguucacgu

SEQ ID NO: 2488317 - RNA, 13 nt, Human
uguauaguugcuu

SEQ ID NO: 2488318 - RNA, 20 nt, Human
uguauaguuaggauagcauu

SEQ ID NO: 2488319 - RNA, 19 nt, Human
uguauauaaaauauuuuca

SEQ ID NO: 2488320 - RNA, 21 nt, Human
uguauaguuguggacauuuaa

SEQ ID NO: 2488321 - RNA, 15 nt, Human
uguauauacaauaac

SEQ ID NO: 2488322 - RNA, 16 nt, Human
uguauauacaauaaca

SEQ ID NO: 2488323 - RNA, 18 nt, Human
uguauauacaauaacaua

SEQ ID NO: 2488324 - RNA, 22 nt, Human
uguauauacauuuaugaauuaa

SEQ ID NO: 2488325 - RNA, 18 nt, Human
uguauaguugcuugccug

SEQ ID NO: 2488326 - RNA, 17 nt, Human
uguauauacaauaacau

SEQ ID NO: 2488327 - RNA, 16 nt, Human
uguaguguuggagaag

SEQ ID NO: 2488328 - RNA, 22 nt, Human
uguaguccgugcugacagcugc

SEQ ID NO: 2488329 - RNA, 17 nt, Human
uguaguccucauaaaaa

SEQ ID NO: 2488330 - RNA, 23 nt, Human
uguaguccuagccacucaggagg

SEQ ID NO: 2488331 - RNA, 20 nt, Human
uguaguccgugcugacagcu

SEQ ID NO: 2488332 - RNA, 14 nt, Human
uguagucccagcua

SEQ ID NO: 2488333 - RNA, 17 nt, Human
uguagucccagcuacuc

SEQ ID NO: 2488334 - RNA, 21 nt, Human
uguagugagauagcauuguga

SEQ ID NO: 2488335 - RNA, 21 nt, Human
uguaguccucauaaaaagcaa

SEQ ID NO: 2488336 - RNA, 14 nt, Human
uguagucucaggac

SEQ ID NO: 2488337 - RNA, 22 nt, Human
uguagugaaucacguaaagcua

SEQ ID NO: 2488338 - RNA, 16 nt, Human
uguaggguuauaauaa

SEQ ID NO: 2488339 - RNA, 16 nt, Human
uguagggcuggaccua

SEQ ID NO: 2488340 - RNA, 15 nt, Human
uguagggcuggaccu

SEQ ID NO: 2488341 - RNA, 19 nt, Human
uguaggggacgagaaagau

SEQ ID NO: 2488342 - RNA, 18 nt, Human
uguaggguaaggugccuu

SEQ ID NO: 2488343 - RNA, 17 nt, Human
uguaggguuauaauaau

SEQ ID NO: 2488344 - RNA, 15 nt, Human
uguagucccagccac

SEQ ID NO: 2488345 - RNA, 21 nt, Human
aguagauuuucuuuaaaagaa

SEQ ID NO: 2488346 - RNA, 20 nt, Human
aguagauuuucuuuaaaaga

SEQ ID NO: 2488347 - RNA, 18 nt, Human
aguagauuuucuuuaaaa

SEQ ID NO: 2488348 - RNA, 17 nt, Human
aguagauuuucuuuaaa

SEQ ID NO: 2488349 - RNA, 16 nt, Human
aguagauuuucuuuaa

SEQ ID NO: 2488350 - RNA, 13 nt, Human
aguagauuuucuu

SEQ ID NO: 2488351 - RNA, 15 nt, Human
aguagauuuuccaaa

SEQ ID NO: 2488352 - RNA, 22 nt, Human
aguagcaaguucuagagaagag

SEQ ID NO: 2488353 - RNA, 20 nt, Human
aguagcaaguucuagagaag

SEQ ID NO: 2488354 - RNA, 16 nt, Human
aguagcaaguucuaga

SEQ ID NO: 2488355 - RNA, 23 nt, Human
aguagauuuucuuuaaaagaaug

SEQ ID NO: 2488356 - RNA, 14 nt, Human
aguagcaugagaga

SEQ ID NO: 2488357 - RNA, 23 nt, Human
aguagcaugagagaauuguauca

SEQ ID NO: 2488358 - RNA, 19 nt, Human
aguagcauguugagccagg

SEQ ID NO: 2488359 - RNA, 22 nt, Human
uguagggagggcggcaggggcc

SEQ ID NO: 2488360 - RNA, 12 nt, Human
uguagggcugga

SEQ ID NO: 2488361 - RNA, 18 nt, Human
aguagcacccuggauuga

SEQ ID NO: 2488362 - RNA, 20 nt, Human
aguagcaguagaugcaugua

SEQ ID NO: 2488363 - RNA, 19 nt, Human
aguaccauaguaccauuua

SEQ ID NO: 2488364 - RNA, 15 nt, Human
aguaccacucaggcc

SEQ ID NO: 2488365 - RNA, 21 nt, Human
aguaccauaguaccauuuaua

SEQ ID NO: 2488366 - RNA, 23 nt, Human
aguaccauaguaccauuuauaca

SEQ ID NO: 2488367 - RNA, 19 nt, Human
aguacaggcagcacagaga

SEQ ID NO: 2488368 - RNA, 14 nt, Human
aguaccaaaugcuu

SEQ ID NO: 2488369 - RNA, 15 nt, Human
aguaccaaucauuuu

SEQ ID NO: 2488370 - RNA, 16 nt, Human
aguaccaaucauuuua

SEQ ID NO: 2488371 - RNA, 16 nt, Human
aguaaaaccacagcag

SEQ ID NO: 2488372 - RNA, 17 nt, Human
aguaaaaccacagcagu

SEQ ID NO: 2488373 - RNA, 19 nt, Human
aguaaaaccacagcaguug

SEQ ID NO: 2488374 - RNA, 20 nt, Human
aguaaaaccacagcaguuga

SEQ ID NO: 2488375 - RNA, 20 nt, Human
aguaaguaccacucaggcca

SEQ ID NO: 2488376 - RNA, 19 nt, Human
aguaaguaccacucaggcc

SEQ ID NO: 2488377 - RNA, 23 nt, Human
aguaagugggguugcaaccacug

SEQ ID NO: 2488378 - RNA, 15 nt, Human
aguaagugccuucca

SEQ ID NO: 2488379 - RNA, 13 nt, Human
aguaagugccuuc

SEQ ID NO: 2488380 - RNA, 16 nt, Human
aguaagugccuuccau

SEQ ID NO: 2488381 - RNA, 16 nt, Human
aguaauaaacuguguu

SEQ ID NO: 2488382 - RNA, 13 nt, Human
aguaauagagcaa

SEQ ID NO: 2488383 - RNA, 22 nt, Human
aguaaucccgccaccuaucucg

SEQ ID NO: 2488384 - RNA, 17 nt, Human
aguaauaaacuguguuu

SEQ ID NO: 2488385 - RNA, 18 nt, Human
agguuuuuuuccuucuga

SEQ ID NO: 2488386 - RNA, 16 nt, Human
agguuuuuuuccuucu

SEQ ID NO: 2488387 - RNA, 15 nt, Human
uguacauguguagcc

SEQ ID NO: 2488388 - RNA, 11 nt, Human
uguacaugugu

SEQ ID NO: 2488389 - RNA, 19 nt, Human
uguacauggcagaguuugu

SEQ ID NO: 2488390 - RNA, 17 nt, Human
uguacauggcagaguuu

SEQ ID NO: 2488391 - RNA, 22 nt, Human
uguacaugaagaagcuaaaucc

SEQ ID NO: 2488392 - RNA, 14 nt, Human
uguacaugcauuca

SEQ ID NO: 2488393 - RNA, 16 nt, Human
uguacaugagaaggaa

SEQ ID NO: 2488394 - RNA, 21 nt, Human
uguacauggaauaacauguaa

SEQ ID NO: 2488395 - RNA, 16 nt, Human
aguaaaaacaaagaaa

SEQ ID NO: 2488396 - RNA, 21 nt, Human
agguuuuuuuguauaguaaag

SEQ ID NO: 2488397 - RNA, 22 nt, Human
agguuuuuuuguauaguaaagu

SEQ ID NO: 2488398 - RNA, 23 nt, Human
aguaaaaacaaagaaauuaugug

SEQ ID NO: 2488399 - RNA, 19 nt, Human
agguuuuuuuccuucugaa

SEQ ID NO: 2488400 - RNA, 19 nt, Human
aguaaaaaacaacuucuuu

SEQ ID NO: 2488401 - RNA, 16 nt, Human
aguaauugugaaaaag

SEQ ID NO: 2488402 - RNA, 13 nt, Human
aguaauugugaaa

SEQ ID NO: 2488403 - RNA, 15 nt, Human
aguaauugugaaaaa

SEQ ID NO: 2488404 - RNA, 22 nt, Human
aguaauugguccgaucuuugac

SEQ ID NO: 2488405 - RNA, 12 nt, Human
aguaauugugaa

SEQ ID NO: 2488406 - RNA, 21 nt, Human
aguacacuguuucaaacuuua

SEQ ID NO: 2488407 - RNA, 19 nt, Human
aguaauuguugguuaucuu

SEQ ID NO: 2488408 - RNA, 13 nt, Human
aguaauuuauugu

SEQ ID NO: 2488409 - RNA, 23 nt, Human
aguacacuguuucaaacuuuacu

SEQ ID NO: 2488410 - RNA, 23 nt, Human
aguaauuuauuguuuuuccuugu

SEQ ID NO: 2488411 - RNA, 22 nt, Human
aguaauuuauuguuuuuccuug

SEQ ID NO: 2488412 - RNA, 19 nt, Human
aguacauuuggagacacaa

SEQ ID NO: 2488413 - RNA, 14 nt, Human
aguacaggcagcac

SEQ ID NO: 2488414 - RNA, 17 nt, Human
aguacaggcagcacaga

SEQ ID NO: 2488415 - RNA, 18 nt, Human
aguacaggcagcacagag

SEQ ID NO: 2488416 - RNA, 13 nt, Human
aguaauuggaaag

SEQ ID NO: 2488417 - RNA, 12 nt, Human
aguaauuggaaa

SEQ ID NO: 2488418 - RNA, 19 nt, Human
aguaauucaagaaaacaac

SEQ ID NO: 2488419 - RNA, 17 nt, Human
aguaauucugcugucuc

SEQ ID NO: 2488420 - RNA, 14 nt, Human
aguaauucucaggc

SEQ ID NO: 2488421 - RNA, 21 nt, Human
aguaaucuguguacaaagaaa

SEQ ID NO: 2488422 - RNA, 18 nt, Human
aguaauugacaugugcca

SEQ ID NO: 2488423 - RNA, 20 nt, Human
aguaauugacaugugccagg

SEQ ID NO: 2488424 - RNA, 13 nt, Human
aguaaugauaacu

SEQ ID NO: 2488425 - RNA, 12 nt, Human
aguaaugaauuu

SEQ ID NO: 2488426 - RNA, 21 nt, Human
aguaaugaauuuuuaugauau

SEQ ID NO: 2488427 - RNA, 22 nt, Human
aguaaugaauuuuuaugauauu

SEQ ID NO: 2488428 - RNA, 17 nt, Human
aguaaucgcuuaaagau

SEQ ID NO: 2488429 - RNA, 19 nt, Human
aguaaucuaauauggccac

SEQ ID NO: 2488430 - RNA, 19 nt, Human
aguaaucuguguacaaaga

SEQ ID NO: 2488431 - RNA, 13 nt, Human
aguaaucugugua

SEQ ID NO: 2488432 - RNA, 23 nt, Human
ugucccugcacuugcagacucua

SEQ ID NO: 2488433 - RNA, 22 nt, Human
ugucccugcacuugcagacucu

SEQ ID NO: 2488434 - RNA, 20 nt, Human
ugucccugcacuugcagacu

SEQ ID NO: 2488435 - RNA, 22 nt, Human
uguccccuucucucaucucuua

SEQ ID NO: 2488436 - RNA, 16 nt, Human
ugucccgggguccugu

SEQ ID NO: 2488437 - RNA, 21 nt, Human
ugucccgggguccuguggcag

SEQ ID NO: 2488438 - RNA, 20 nt, Human
ugucccgggguccuguggca

SEQ ID NO: 2488439 - RNA, 19 nt, Human
ugucccgggguccuguggc

SEQ ID NO: 2488440 - RNA, 21 nt, Human
uguccccucuugccccaaccc

SEQ ID NO: 2488441 - RNA, 17 nt, Human
uguccccucuugcccca

SEQ ID NO: 2488442 - RNA, 20 nt, Human
uguccccuucucucaucucu

SEQ ID NO: 2488443 - RNA, 16 nt, Human
uguccccuucucucau

SEQ ID NO: 2488444 - RNA, 14 nt, Human
uguccccuucucuc

SEQ ID NO: 2488445 - RNA, 11 nt, Human
uguccccuucu

SEQ ID NO: 2488446 - RNA, 15 nt, Human
uguccccucuugccc

SEQ ID NO: 2488447 - RNA, 14 nt, Human
uguccccucuugcc

SEQ ID NO: 2488448 - RNA, 14 nt, Human
uguccccucuugac

SEQ ID NO: 2488449 - RNA, 11 nt, Human
uguccccucuu

SEQ ID NO: 2488450 - RNA, 21 nt, Human
uguccccuccucacucccuuc

SEQ ID NO: 2488451 - RNA, 14 nt, Human
uguccagcgccuag

SEQ ID NO: 2488452 - RNA, 14 nt, Human
uguccagccugggc

SEQ ID NO: 2488453 - RNA, 19 nt, Human
uguccagccugggcagcca

SEQ ID NO: 2488454 - RNA, 22 nt, Human
uguccagccugggcagccaggc

SEQ ID NO: 2488455 - RNA, 23 nt, Human
uguccagccugggcagccaggcu

SEQ ID NO: 2488456 - RNA, 22 nt, Human
uguccaagaagcccaggaaagg

SEQ ID NO: 2488457 - RNA, 18 nt, Human
uguccaagaagcccagga

SEQ ID NO: 2488458 - RNA, 17 nt, Human
uguccaagaagcccagg

SEQ ID NO: 2488459 - RNA, 16 nt, Human
uguccaagaagcccag

SEQ ID NO: 2488460 - RNA, 12 nt, Human
uguccagccugg

SEQ ID NO: 2488461 - RNA, 17 nt, Human
uguccagacagccugua

SEQ ID NO: 2488462 - RNA, 16 nt, Human
uguccagacagccugu

SEQ ID NO: 2488463 - RNA, 11 nt, Human
uguccagagag

SEQ ID NO: 2488464 - RNA, 21 nt, Human
uguccagagagcaacucugag

SEQ ID NO: 2488465 - RNA, 23 nt, Human
uguccagagagagaagugccccu

SEQ ID NO: 2488466 - RNA, 15 nt, Human
uguccagacagccug

SEQ ID NO: 2488467 - RNA, 14 nt, Human
uguccagacagccu

SEQ ID NO: 2488468 - RNA, 13 nt, Human
uguccagacagcc

SEQ ID NO: 2488469 - RNA, 15 nt, Human
uguccacacccagcu

SEQ ID NO: 2488470 - RNA, 23 nt, Human
uguccaauuguugacaguucuga

SEQ ID NO: 2488471 - RNA, 12 nt, Human
uguccagacagc

SEQ ID NO: 2488472 - RNA, 14 nt, Human
uguccaauccuaug

SEQ ID NO: 2488473 - RNA, 16 nt, Human
uguccaauucucuuua

SEQ ID NO: 2488474 - RNA, 18 nt, Human
uguccaagugugugugcg

SEQ ID NO: 2488475 - RNA, 14 nt, Human
uguccaaggaaacu

SEQ ID NO: 2488476 - RNA, 17 nt, Human
uguccaagugugugugc

SEQ ID NO: 2488477 - RNA, 22 nt, Human
ugucauuugagcagggcucagc

SEQ ID NO: 2488478 - RNA, 21 nt, Human
ugucauuugagcagggcucag

SEQ ID NO: 2488479 - RNA, 20 nt, Human
ugucauuugagcagggcuca

SEQ ID NO: 2488480 - RNA, 20 nt, Human
ugucagguggggcagcuuga

SEQ ID NO: 2488481 - RNA, 18 nt, Human
ugucagguggggcagcuu

SEQ ID NO: 2488482 - RNA, 17 nt, Human
ugucagguggggcagcu

SEQ ID NO: 2488483 - RNA, 23 nt, Human
ugucagcaaaaagcaaaaucauu

SEQ ID NO: 2488484 - RNA, 22 nt, Human
ugucagcaaaaagcaaaaucau

SEQ ID NO: 2488485 - RNA, 19 nt, Human
ugucagcaaaaagcaaaau

SEQ ID NO: 2488486 - RNA, 18 nt, Human
ugucagcaaaaagcaaaa

SEQ ID NO: 2488487 - RNA, 14 nt, Human
ugucagcaaaaagc

SEQ ID NO: 2488488 - RNA, 13 nt, Human
ugucagcaaaaag

SEQ ID NO: 2488489 - RNA, 15 nt, Human
uguccaagaagccca

SEQ ID NO: 2488490 - RNA, 14 nt, Human
uguccaagaagccc

SEQ ID NO: 2488491 - RNA, 21 nt, Human
uguccaaccuaaccccuuucc

SEQ ID NO: 2488492 - RNA, 19 nt, Human
uguccaaagcagggucugg

SEQ ID NO: 2488493 - RNA, 15 nt, Human
uguccaaccuaaccc

SEQ ID NO: 2488494 - RNA, 22 nt, Human
uguccaaccuaaccccuuuccu

SEQ ID NO: 2488495 - RNA, 18 nt, Human
uguccaacccgaggcccg

SEQ ID NO: 2488496 - RNA, 19 nt, Human
uguccaaaggaggcuggca

SEQ ID NO: 2488497 - RNA, 18 nt, Human
uguccaaagcagggucug

SEQ ID NO: 2488498 - RNA, 17 nt, Human
uguccaaagcagggucu

SEQ ID NO: 2488499 - RNA, 12 nt, Human
uguccaaagcag

SEQ ID NO: 2488500 - RNA, 13 nt, Human
ugucagcaggaag

SEQ ID NO: 2488501 - RNA, 15 nt, Human
uguccaaaacugccu

SEQ ID NO: 2488502 - RNA, 23 nt, Human
uguccaaaccaaccgcacaugca

SEQ ID NO: 2488503 - RNA, 16 nt, Human
uguccaaaacugccuc

SEQ ID NO: 2488504 - RNA, 17 nt, Human
uguccaaacugccuaag

SEQ ID NO: 2488505 - RNA, 15 nt, Human
uguccaaacugccua

SEQ ID NO: 2488506 - RNA, 22 nt, Human
uguccaaacugccuaagcccuc

SEQ ID NO: 2488507 - RNA, 19 nt, Human
aguauucuuauuuaaugaa

SEQ ID NO: 2488508 - RNA, 12 nt, Human
aguauuuauaua

SEQ ID NO: 2488509 - RNA, 13 nt, Human
aguauuuauauau

SEQ ID NO: 2488510 - RNA, 14 nt, Human
aguauuuauauauu

SEQ ID NO: 2488511 - RNA, 15 nt, Human
aguauuuauauauuu

SEQ ID NO: 2488512 - RNA, 16 nt, Human
aguauuuauauauuua

SEQ ID NO: 2488513 - RNA, 16 nt, Human
aguauuucaaauugga

SEQ ID NO: 2488514 - RNA, 14 nt, Human
aguauuugugggga

SEQ ID NO: 2488515 - RNA, 21 nt, Human
aguauuugggaagugaagacu

SEQ ID NO: 2488516 - RNA, 17 nt, Human
aguauuuauauauuuau

SEQ ID NO: 2488517 - RNA, 19 nt, Human
aguauuuauauauuuauaa

SEQ ID NO: 2488518 - RNA, 20 nt, Human
aguauuuauauauuuauaac

SEQ ID NO: 2488519 - RNA, 23 nt, Human
aguauuuauauauuuauaacuca

SEQ ID NO: 2488520 - RNA, 20 nt, Human
aguauuuauuuaauguuaug

SEQ ID NO: 2488521 - RNA, 15 nt, Human
aguauuuauuuaaug

SEQ ID NO: 2488522 - RNA, 17 nt, Human
aguauuuugcuggaaua

SEQ ID NO: 2488523 - RNA, 14 nt, Human
aguauuuuccugua

SEQ ID NO: 2488524 - RNA, 12 nt, Human
aguauuuuccug

SEQ ID NO: 2488525 - RNA, 19 nt, Human
aguauuuucccugcuaggg

SEQ ID NO: 2488526 - RNA, 23 nt, Human
aguauuuugguucuuaguucuca

SEQ ID NO: 2488527 - RNA, 18 nt, Human
aguauuuugguucuuagu

SEQ ID NO: 2488528 - RNA, 17 nt, Human
aguauuuugguucuuag

SEQ ID NO: 2488529 - RNA, 16 nt, Human
aguauuuuccuguaaa

SEQ ID NO: 2488530 - RNA, 15 nt, Human
agucaccaagcccag

SEQ ID NO: 2488531 - RNA, 17 nt, Human
agucaccccggccaccu

SEQ ID NO: 2488532 - RNA, 13 nt, Human
agucaccaggaau

SEQ ID NO: 2488533 - RNA, 16 nt, Human
agucacccaugaagac

SEQ ID NO: 2488534 - RNA, 17 nt, Human
agucacccaugaagaca

SEQ ID NO: 2488535 - RNA, 20 nt, Human
agucacccaugaagacagga

SEQ ID NO: 2488536 - RNA, 13 nt, Human
agucaccccagga

SEQ ID NO: 2488537 - RNA, 19 nt, Human
agucaccaggaauguuaaa

SEQ ID NO: 2488538 - RNA, 12 nt, Human
ugucagagcugg

SEQ ID NO: 2488539 - RNA, 13 nt, Human
ugucagagcuggg

SEQ ID NO: 2488540 - RNA, 14 nt, Human
ugucagagcuggga

SEQ ID NO: 2488541 - RNA, 15 nt, Human
ugucagagcugggag

SEQ ID NO: 2488542 - RNA, 16 nt, Human
ugucagauacaaugua

SEQ ID NO: 2488543 - RNA, 15 nt, Human
ugucagauacaaugu

SEQ ID NO: 2488544 - RNA, 16 nt, Human
ugucagaguucugcuc

SEQ ID NO: 2488545 - RNA, 20 nt, Human
ugucagaggcacaaaagggu

SEQ ID NO: 2488546 - RNA, 15 nt, Human
ugucagauaugauau

SEQ ID NO: 2488547 - RNA, 20 nt, Human
ugucagauauuuuuucagaa

SEQ ID NO: 2488548 - RNA, 21 nt, Human
ugucagauauuuuuucagaaa

SEQ ID NO: 2488549 - RNA, 23 nt, Human
ugucagauauuuuuucagaaaua

SEQ ID NO: 2488550 - RNA, 15 nt, Human
uguauauuuguacaa

SEQ ID NO: 2488551 - RNA, 14 nt, Human
uguauauuuguaca

SEQ ID NO: 2488552 - RNA, 21 nt, Human
uguauauuugugauagcacuu

SEQ ID NO: 2488553 - RNA, 14 nt, Human
uguauauucacuuu

SEQ ID NO: 2488554 - RNA, 12 nt, Human
uguauauucacu

SEQ ID NO: 2488555 - RNA, 20 nt, Human
uguauauuguguuuguguau

SEQ ID NO: 2488556 - RNA, 19 nt, Human
uguauauugucagauauuu

SEQ ID NO: 2488557 - RNA, 18 nt, Human
uguauauuuaaaagaaag

SEQ ID NO: 2488558 - RNA, 22 nt, Human
uguauauuauuucuaggaagaa

SEQ ID NO: 2488559 - RNA, 21 nt, Human
uguauauuauuucuaggaaga

SEQ ID NO: 2488560 - RNA, 16 nt, Human
uguauauuauuucuag

SEQ ID NO: 2488561 - RNA, 15 nt, Human
uguauauuauuucua

SEQ ID NO: 2488562 - RNA, 14 nt, Human
uguauauuauuucu

SEQ ID NO: 2488563 - RNA, 21 nt, Human
uguauauuauggaagauuuua

SEQ ID NO: 2488564 - RNA, 12 nt, Human
uguauauuauuu

SEQ ID NO: 2488565 - RNA, 23 nt, Human
uguauauuauggaagauuuuaaa

SEQ ID NO: 2488566 - RNA, 18 nt, Human
aguauguugucaaagaga

SEQ ID NO: 2488567 - RNA, 15 nt, Human
aguauguugucaaag

SEQ ID NO: 2488568 - RNA, 14 nt, Human
aguauguugucaaa

SEQ ID NO: 2488569 - RNA, 16 nt, Human
aguauguuuuagcaug

SEQ ID NO: 2488570 - RNA, 18 nt, Human
aguauguuuuagcaugug

SEQ ID NO: 2488571 - RNA, 19 nt, Human
aguauguuuuagcaugugu

SEQ ID NO: 2488572 - RNA, 20 nt, Human
aguauguuuuagcauguguu

SEQ ID NO: 2488573 - RNA, 15 nt, Human
aguauaccugauuuu

SEQ ID NO: 2488574 - RNA, 16 nt, Human
uguauauuuguacaaa

SEQ ID NO: 2488575 - RNA, 13 nt, Human
aguauuauuuucc

SEQ ID NO: 2488576 - RNA, 14 nt, Human
aguauuauuuucca

SEQ ID NO: 2488577 - RNA, 15 nt, Human
aguauuauuuuccaa

SEQ ID NO: 2488578 - RNA, 18 nt, Human
aguauuauuuuccaaaag

SEQ ID NO: 2488579 - RNA, 20 nt, Human
aguauuccagaccugaagaa

SEQ ID NO: 2488580 - RNA, 19 nt, Human
aguauuccauugugugagu

SEQ ID NO: 2488581 - RNA, 20 nt, Human
aguauuccauugugugagug

SEQ ID NO: 2488582 - RNA, 22 nt, Human
aguauuccauugugugagugua

SEQ ID NO: 2488583 - RNA, 16 nt, Human
agucgucgcacagucu

SEQ ID NO: 2488584 - RNA, 22 nt, Human
agucgucaucacuuuucaguga

SEQ ID NO: 2488585 - RNA, 18 nt, Human
agucguacagaaagcugc

SEQ ID NO: 2488586 - RNA, 12 nt, Human
agucuaaaguuu

SEQ ID NO: 2488587 - RNA, 17 nt, Human
agucuaaaguuuacagu

SEQ ID NO: 2488588 - RNA, 14 nt, Human
agucuaaaguuuac

SEQ ID NO: 2488589 - RNA, 13 nt, Human
agucuaaaguuua

SEQ ID NO: 2488590 - RNA, 21 nt, Human
agucgggggcuggccuaggag

SEQ ID NO: 2488591 - RNA, 20 nt, Human
agucgggggcuggccuagga

SEQ ID NO: 2488592 - RNA, 17 nt, Human
agucgggggcuggccua

SEQ ID NO: 2488593 - RNA, 16 nt, Human
agucgggggcuggccu

SEQ ID NO: 2488594 - RNA, 15 nt, Human
agucgggggcuggcc

SEQ ID NO: 2488595 - RNA, 20 nt, Human
agucggaacggagaaaggug

SEQ ID NO: 2488596 - RNA, 19 nt, Human
agucgcugugguuguuuua

SEQ ID NO: 2488597 - RNA, 18 nt, Human
agucgcgcugccugugug

SEQ ID NO: 2488598 - RNA, 13 nt, Human
agucgcugaggaa

SEQ ID NO: 2488599 - RNA, 15 nt, Human
agucgcugaggaaaa

SEQ ID NO: 2488600 - RNA, 16 nt, Human
agucgcugaggaaaaa

SEQ ID NO: 2488601 - RNA, 16 nt, Human
aguccucccaucucac

SEQ ID NO: 2488602 - RNA, 14 nt, Human
aguccucccaucuc

SEQ ID NO: 2488603 - RNA, 19 nt, Human
aguccuccccucacagccu

SEQ ID NO: 2488604 - RNA, 18 nt, Human
aguccuccccucacagcc

SEQ ID NO: 2488605 - RNA, 16 nt, Human
aguccuccccucacag

SEQ ID NO: 2488606 - RNA, 15 nt, Human
aguccuccccucaca

SEQ ID NO: 2488607 - RNA, 14 nt, Human
aguccuccccucac

SEQ ID NO: 2488608 - RNA, 13 nt, Human
aguccuccccuca

SEQ ID NO: 2488609 - RNA, 12 nt, Human
aguccuccccuc

SEQ ID NO: 2488610 - RNA, 17 nt, Human
agucgcgcugccugugu

SEQ ID NO: 2488611 - RNA, 14 nt, Human
agucgcgcugccug

SEQ ID NO: 2488612 - RNA, 13 nt, Human
agucgcgcugccu

SEQ ID NO: 2488613 - RNA, 19 nt, Human
agucgcaucucagugcagg

SEQ ID NO: 2488614 - RNA, 15 nt, Human
agucgaugaacuauu

SEQ ID NO: 2488615 - RNA, 18 nt, Human
aguccccucccaucuggg

SEQ ID NO: 2488616 - RNA, 16 nt, Human
aguccccucccaucug

SEQ ID NO: 2488617 - RNA, 13 nt, Human
aguccccucccau

SEQ ID NO: 2488618 - RNA, 20 nt, Human
aguccccgugccccgccucc

SEQ ID NO: 2488619 - RNA, 23 nt, Human
aguccccgugccccgccuccccg

SEQ ID NO: 2488620 - RNA, 16 nt, Human
aguccccucaccuccu

SEQ ID NO: 2488621 - RNA, 18 nt, Human
aguccccgugccccgccu

SEQ ID NO: 2488622 - RNA, 15 nt, Human
aguccccgugccccg

SEQ ID NO: 2488623 - RNA, 19 nt, Human
aguccccgaguuuccccag

SEQ ID NO: 2488624 - RNA, 16 nt, Human
agucccccugccccag

SEQ ID NO: 2488625 - RNA, 21 nt, Human
aguccccuccccggcccuacc

SEQ ID NO: 2488626 - RNA, 18 nt, Human
aguccccuccccggcccu

SEQ ID NO: 2488627 - RNA, 21 nt, Human
aguccccucccaucugggagu

SEQ ID NO: 2488628 - RNA, 20 nt, Human
aguccuacaagcuaaaauua

SEQ ID NO: 2488629 - RNA, 19 nt, Human
aguccccuccccggcccua

SEQ ID NO: 2488630 - RNA, 20 nt, Human
aguccuagcugcacagggca

SEQ ID NO: 2488631 - RNA, 16 nt, Human
aguccuagcugcacag

SEQ ID NO: 2488632 - RNA, 15 nt, Human
aguccuagcugcaca

SEQ ID NO: 2488633 - RNA, 14 nt, Human
aguccuagcugcac

SEQ ID NO: 2488634 - RNA, 13 nt, Human
aguccuagcugca

SEQ ID NO: 2488635 - RNA, 12 nt, Human
aguccuagcugc

SEQ ID NO: 2488636 - RNA, 17 nt, Human
aguccuagccacucagg

SEQ ID NO: 2488637 - RNA, 22 nt, Human
aguccuagcugcacagggcagc

SEQ ID NO: 2488638 - RNA, 21 nt, Human
aguccuagcugcacagggcag

SEQ ID NO: 2488639 - RNA, 16 nt, Human
aguccuauucuauugc

SEQ ID NO: 2488640 - RNA, 20 nt, Human
aguccucaaggggccauccu

SEQ ID NO: 2488641 - RNA, 17 nt, Human
aguccucauaaaaagca

SEQ ID NO: 2488642 - RNA, 18 nt, Human
aguccucauaaaaagcaa

SEQ ID NO: 2488643 - RNA, 15 nt, Human
aguccucacucccag

SEQ ID NO: 2488644 - RNA, 16 nt, Human
aguccucacucccagu

SEQ ID NO: 2488645 - RNA, 17 nt, Human
aguccucacucccaguc

SEQ ID NO: 2488646 - RNA, 18 nt, Human
aguccucacucccagucc

SEQ ID NO: 2488647 - RNA, 17 nt, Human
agucuaaauauuuccuu

SEQ ID NO: 2488648 - RNA, 23 nt, Human
agucuaaauauuuccuuaaacug

SEQ ID NO: 2488649 - RNA, 20 nt, Human
agucuaaaguuuacaguaaa

SEQ ID NO: 2488650 - RNA, 18 nt, Human
agucuaaaguuuacagua

SEQ ID NO: 2488651 - RNA, 23 nt, Human
agucuaaaguuuacaguaaauaa

SEQ ID NO: 2488652 - RNA, 16 nt, Human
agucuaaauauuuccu

SEQ ID NO: 2488653 - RNA, 20 nt, Human
agucuaauuuuuauucauaa

SEQ ID NO: 2488654 - RNA, 17 nt, Human
agucuaauuuuuauuca

SEQ ID NO: 2488655 - RNA, 14 nt, Human
agucuacagaguga

SEQ ID NO: 2488656 - RNA, 13 nt, Human
agucuaauuuuua

SEQ ID NO: 2488657 - RNA, 14 nt, Human
agucuacccagaga

SEQ ID NO: 2488658 - RNA, 13 nt, Human
agucuacccagag

SEQ ID NO: 2488659 - RNA, 14 nt, Human
agucuacgcucucc

SEQ ID NO: 2488660 - RNA, 15 nt, Human
agucuacgcucuccu

SEQ ID NO: 2488661 - RNA, 17 nt, Human
agucuacgcucuccuuu

SEQ ID NO: 2488662 - RNA, 18 nt, Human
agucuaggagcugggagg

SEQ ID NO: 2488663 - RNA, 22 nt, Human
agucuaggagcugggaggaaaa

SEQ ID NO: 2488664 - RNA, 20 nt, Human
agucuaggagcugggaggaa

SEQ ID NO: 2488665 - RNA, 18 nt, Human
agucuaucaaucaacuua

SEQ ID NO: 2488666 - RNA, 14 nt, Human
agucuauccacaga

SEQ ID NO: 2488667 - RNA, 18 nt, Human
agucuauaugaaaaacaa

SEQ ID NO: 2488668 - RNA, 15 nt, Human
agucuauccacagag

SEQ ID NO: 2488669 - RNA, 16 nt, Human
agucuauccacagaga

SEQ ID NO: 2488670 - RNA, 17 nt, Human
agucuauucauuauauu

SEQ ID NO: 2488671 - RNA, 14 nt, Human
agucuauucauuau

SEQ ID NO: 2488672 - RNA, 14 nt, Human
agucuauuagccac

SEQ ID NO: 2488673 - RNA, 23 nt, Human
agucucacuguugcccaggcugg

SEQ ID NO: 2488674 - RNA, 16 nt, Human
agucucaggaaaucaa

SEQ ID NO: 2488675 - RNA, 11 nt, Human
ugucucaucca

SEQ ID NO: 2488676 - RNA, 16 nt, Human
ugucucauccaucauc

SEQ ID NO: 2488677 - RNA, 17 nt, Human
ugucucauccaucauca

SEQ ID NO: 2488678 - RNA, 13 nt, Human
agucucaggaaau

SEQ ID NO: 2488679 - RNA, 19 nt, Human
agucucacuuugucgccca

SEQ ID NO: 2488680 - RNA, 23 nt, Human
ugucuccaaccccccagcacuga

SEQ ID NO: 2488681 - RNA, 22 nt, Human
ugucuccaaccccccagcacug

SEQ ID NO: 2488682 - RNA, 21 nt, Human
ugucuccaaccccccagcacu

SEQ ID NO: 2488683 - RNA, 20 nt, Human
ugucuccaaccccccagcac

SEQ ID NO: 2488684 - RNA, 19 nt, Human
ugucuccaaccccccagca

SEQ ID NO: 2488685 - RNA, 17 nt, Human
ugucuccaaccccccag

SEQ ID NO: 2488686 - RNA, 16 nt, Human
ugucuccaacccccca

SEQ ID NO: 2488687 - RNA, 11 nt, Human
ugucuccaacc

SEQ ID NO: 2488688 - RNA, 12 nt, Human
ugucucauccca

SEQ ID NO: 2488689 - RNA, 11 nt, Human
ugucucauccc

SEQ ID NO: 2488690 - RNA, 21 nt, Human
ugucucauccaucaucaugug

SEQ ID NO: 2488691 - RNA, 13 nt, Human
ugucucaucccca

SEQ ID NO: 2488692 - RNA, 16 nt, Human
ugucucauccccaggg

SEQ ID NO: 2488693 - RNA, 20 nt, Human
ugucucaugugugcucuucu

SEQ ID NO: 2488694 - RNA, 13 nt, Human
ugucucaugugug

SEQ ID NO: 2488695 - RNA, 23 nt, Human
ugucucauccccaggggucccag

SEQ ID NO: 2488696 - RNA, 20 nt, Human
agucccaggagcugcccaga

SEQ ID NO: 2488697 - RNA, 21 nt, Human
aguccccaggccccaggaagc

SEQ ID NO: 2488698 - RNA, 19 nt, Human
agucccaggcugagccuca

SEQ ID NO: 2488699 - RNA, 18 nt, Human
agucccccaaccccagcc

SEQ ID NO: 2488700 - RNA, 22 nt, Human
agucccccaacagaugcuuuuc

SEQ ID NO: 2488701 - RNA, 15 nt, Human
agucccccaacccca

SEQ ID NO: 2488702 - RNA, 17 nt, Human
agucccaggcugagccu

SEQ ID NO: 2488703 - RNA, 18 nt, Human
agucccaggcugagccuc

SEQ ID NO: 2488704 - RNA, 18 nt, Human
agucccagcuacucagga

SEQ ID NO: 2488705 - RNA, 19 nt, Human
agucccagcuacucaggag

SEQ ID NO: 2488706 - RNA, 22 nt, Human
agucccagcuacucagaagccu

SEQ ID NO: 2488707 - RNA, 23 nt, Human
agucccagagcaggaggccccug

SEQ ID NO: 2488708 - RNA, 12 nt, Human
agucccagagca

SEQ ID NO: 2488709 - RNA, 23 nt, Human
agucccacugccucagguuccua

SEQ ID NO: 2488710 - RNA, 20 nt, Human
agucccaaggaaagccccag

SEQ ID NO: 2488711 - RNA, 21 nt, Human
agucccaaggaaagccccagc

SEQ ID NO: 2488712 - RNA, 20 nt, Human
agucccacugccucagguuc

SEQ ID NO: 2488713 - RNA, 19 nt, Human
agucccaccuuggcugcag

SEQ ID NO: 2488714 - RNA, 18 nt, Human
agucccaccuuggcugca

SEQ ID NO: 2488715 - RNA, 16 nt, Human
agucccaccuuggcug

SEQ ID NO: 2488716 - RNA, 15 nt, Human
agucccaccuuggcu

SEQ ID NO: 2488717 - RNA, 19 nt, Human
aguccauucucccagguac

SEQ ID NO: 2488718 - RNA, 15 nt, Human
aguccauucucccag

SEQ ID NO: 2488719 - RNA, 14 nt, Human
aguccauucuccca

SEQ ID NO: 2488720 - RNA, 20 nt, Human
agucauauuuugauuauugu

SEQ ID NO: 2488721 - RNA, 17 nt, Human
aguccauucucccaggu

SEQ ID NO: 2488722 - RNA, 16 nt, Human
aguccauucucccagg

SEQ ID NO: 2488723 - RNA, 14 nt, Human
agucccaaggaaag

SEQ ID NO: 2488724 - RNA, 17 nt, Human
agucccaaggaaagccc

SEQ ID NO: 2488725 - RNA, 22 nt, Human
agucauagguuaauauuuaaga

SEQ ID NO: 2488726 - RNA, 16 nt, Human
agucauagguuaauau

SEQ ID NO: 2488727 - RNA, 17 nt, Human
agucauaccaaugaaaa

SEQ ID NO: 2488728 - RNA, 23 nt, Human
agucauaccaaugaaaaaaugua

SEQ ID NO: 2488729 - RNA, 21 nt, Human
agucauauuuugauuauugua

SEQ ID NO: 2488730 - RNA, 15 nt, Human
agucauauuuugauu

SEQ ID NO: 2488731 - RNA, 18 nt, Human
agucauauaaaagcuaug

SEQ ID NO: 2488732 - RNA, 18 nt, Human
agucauaaaccuuaagua

SEQ ID NO: 2488733 - RNA, 15 nt, Human
agucauaaaccuuaa

SEQ ID NO: 2488734 - RNA, 20 nt, Human
agucauaaaccuuaaguaag

SEQ ID NO: 2488735 - RNA, 21 nt, Human
agucauaaucauuagggggaa

SEQ ID NO: 2488736 - RNA, 14 nt, Human
agucauaccaauga

SEQ ID NO: 2488737 - RNA, 14 nt, Human
agucaguuugcagu

SEQ ID NO: 2488738 - RNA, 16 nt, Human
agucaguugaaauucu

SEQ ID NO: 2488739 - RNA, 14 nt, Human
agucauaaaccuua

SEQ ID NO: 2488740 - RNA, 13 nt, Human
agucauaaaccuu

SEQ ID NO: 2488741 - RNA, 14 nt, Human
ugucggccucuaac

SEQ ID NO: 2488742 - RNA, 12 nt, Human
ugucggccucua

SEQ ID NO: 2488743 - RNA, 19 nt, Human
ugucgcucugcuggccugg

SEQ ID NO: 2488744 - RNA, 17 nt, Human
ugucgcucugcuggccu

SEQ ID NO: 2488745 - RNA, 22 nt, Human
ugucgcucaugugugcaacagg

SEQ ID NO: 2488746 - RNA, 16 nt, Human
ugucgcucaugugugc

SEQ ID NO: 2488747 - RNA, 14 nt, Human
ugucgcgcucagca

SEQ ID NO: 2488748 - RNA, 20 nt, Human
ugucgcgccuucuccccccc

SEQ ID NO: 2488749 - RNA, 14 nt, Human
ugucgcgccuucuc

SEQ ID NO: 2488750 - RNA, 17 nt, Human
ugucccuucacauaguu

SEQ ID NO: 2488751 - RNA, 15 nt, Human
ugucgcucaugugug

SEQ ID NO: 2488752 - RNA, 14 nt, Human
ugucgcucaugugu

SEQ ID NO: 2488753 - RNA, 16 nt, Human
ugucccuuaaacaaaa

SEQ ID NO: 2488754 - RNA, 13 nt, Human
ugucgccucugca

SEQ ID NO: 2488755 - RNA, 14 nt, Human
ugucgccucugcau

SEQ ID NO: 2488756 - RNA, 23 nt, Human
ugucccuuacgugaguccuggca

SEQ ID NO: 2488757 - RNA, 19 nt, Human
ugucccuuacgugaguccu

SEQ ID NO: 2488758 - RNA, 12 nt, Human
ugucccuacacc

SEQ ID NO: 2488759 - RNA, 13 nt, Human
ugucccugucacc

SEQ ID NO: 2488760 - RNA, 14 nt, Human
ugucccugugccua

SEQ ID NO: 2488761 - RNA, 16 nt, Human
ugucccugucaccaag

SEQ ID NO: 2488762 - RNA, 21 nt, Human
ugucccugucaccaagcucac

SEQ ID NO: 2488763 - RNA, 18 nt, Human
agucagccucucucccag

SEQ ID NO: 2488764 - RNA, 17 nt, Human
agucagccucucuccca

SEQ ID NO: 2488765 - RNA, 16 nt, Human
agucagccucucuccc

SEQ ID NO: 2488766 - RNA, 15 nt, Human
agucagccucucucc

SEQ ID NO: 2488767 - RNA, 11 nt, Human
agucagccucu

SEQ ID NO: 2488768 - RNA, 21 nt, Human
agucagccucucucccagucu

SEQ ID NO: 2488769 - RNA, 22 nt, Human
agucagccuucccccucccagg

SEQ ID NO: 2488770 - RNA, 23 nt, Human
agucagccuucccccucccaggg

SEQ ID NO: 2488771 - RNA, 14 nt, Human
agucaggaaagaga

SEQ ID NO: 2488772 - RNA, 19 nt, Human
agucagcuuugccuuccac

SEQ ID NO: 2488773 - RNA, 22 nt, Human
agucagcuuugccuuccacgcu

SEQ ID NO: 2488774 - RNA, 22 nt, Human
agucagugggaacgugacugcc

SEQ ID NO: 2488775 - RNA, 23 nt, Human
agucacuugaugugccauuuuaa

SEQ ID NO: 2488776 - RNA, 21 nt, Human
agucacuugaugugccauuuu

SEQ ID NO: 2488777 - RNA, 20 nt, Human
agucacuugaugugccauuu

SEQ ID NO: 2488778 - RNA, 24 nt, Human
agucacuucgugggaucugccccu

SEQ ID NO: 2488779 - RNA, 19 nt, Human
agucacuuuuuuuuuccaa

SEQ ID NO: 2488780 - RNA, 17 nt, Human
agucacuuuuuuuuucc

SEQ ID NO: 2488781 - RNA, 14 nt, Human
agucagcagaacug

SEQ ID NO: 2488782 - RNA, 14 nt, Human
agucacugccugca

SEQ ID NO: 2488783 - RNA, 21 nt, Human
agucacugccucucccuggcc

SEQ ID NO: 2488784 - RNA, 22 nt, Human
ugucggccucuaaccccaggcc

SEQ ID NO: 2488785 - RNA, 21 nt, Human
ugucggccucuaaccccaggc

SEQ ID NO: 2488786 - RNA, 22 nt, Human
agucacuggagguugaagccaa

SEQ ID NO: 2488787 - RNA, 16 nt, Human
agucacugccugcaga

SEQ ID NO: 2488788 - RNA, 21 nt, Human
agucacuggagguugaagcca

SEQ ID NO: 2488789 - RNA, 16 nt, Human
agucacuuauuucaua

SEQ ID NO: 2488790 - RNA, 10 nt, Human
agucacuguc

SEQ ID NO: 2488791 - RNA, 23 nt, Human
agucacuggagguugaagccaag

SEQ ID NO: 2488792 - RNA, 22 nt, Human
uguguuaucacccagaagaaaa

SEQ ID NO: 2488793 - RNA, 19 nt, Human
uguguguuuaaauaaagua

SEQ ID NO: 2488794 - RNA, 18 nt, Human
uguguguuuaaauaaagu

SEQ ID NO: 2488795 - RNA, 16 nt, Human
uguguguuuaaauaaa

SEQ ID NO: 2488796 - RNA, 15 nt, Human
uguguguuuaaauaa

SEQ ID NO: 2488797 - RNA, 22 nt, Human
uguguuaaguauguguaaaaug

SEQ ID NO: 2488798 - RNA, 19 nt, Human
uguguuacccuccuguaaa

SEQ ID NO: 2488799 - RNA, 23 nt, Human
uguguuaccugaaaacacugugc

SEQ ID NO: 2488800 - RNA, 22 nt, Human
uguguguuuaaauaaaguauca

SEQ ID NO: 2488801 - RNA, 17 nt, Human
uguguuaguucccaaca

SEQ ID NO: 2488802 - RNA, 14 nt, Human
uguguuaguuccca

SEQ ID NO: 2488803 - RNA, 16 nt, Human
uguuaacugagugccu

SEQ ID NO: 2488804 - RNA, 22 nt, Human
uguuaacugagugccuuuuggu

SEQ ID NO: 2488805 - RNA, 23 nt, Human
uguuaagcagauggaaugcugug

SEQ ID NO: 2488806 - RNA, 22 nt, Human
uguuaacuuaauaguauuuaug

SEQ ID NO: 2488807 - RNA, 14 nt, Human
uguuaacuuagcuu

SEQ ID NO: 2488808 - RNA, 18 nt, Human
uguuacaaauuguagaag

SEQ ID NO: 2488809 - RNA, 17 nt, Human
uguuacaaauuguagaa

SEQ ID NO: 2488810 - RNA, 19 nt, Human
uguuacauaagauaaaugu

SEQ ID NO: 2488811 - RNA, 18 nt, Human
uguuaauacuaguuguga

SEQ ID NO: 2488812 - RNA, 19 nt, Human
uguuaauaaaaguacaugu

SEQ ID NO: 2488813 - RNA, 17 nt, Human
uguuaaguauuuucaua

SEQ ID NO: 2488814 - RNA, 22 nt, Human
uguuaaguugauggugaugaaa

SEQ ID NO: 2488815 - RNA, 18 nt, Human
uguuaauaaaaguacaug

SEQ ID NO: 2488816 - RNA, 13 nt, Human
uguuaauaaaagu

SEQ ID NO: 2488817 - RNA, 17 nt, Human
agugggcugcaucuggg

SEQ ID NO: 2488818 - RNA, 19 nt, Human
agugggcccuccgacagcc

SEQ ID NO: 2488819 - RNA, 22 nt, Human
agugggcccaaugcacuuuguu

SEQ ID NO: 2488820 - RNA, 16 nt, Human
agugggcuugauucug

SEQ ID NO: 2488821 - RNA, 22 nt, Human
agugggcuugauucugcaguaa

SEQ ID NO: 2488822 - RNA, 14 nt, Human
aguggggaggggcu

SEQ ID NO: 2488823 - RNA, 15 nt, Human
aguggggacagagca

SEQ ID NO: 2488824 - RNA, 16 nt, Human
agugggguagguuggg

SEQ ID NO: 2488825 - RNA, 21 nt, Human
aguggggugcugggaggaggg

SEQ ID NO: 2488826 - RNA, 18 nt, Human
aguggggugcugggagga

SEQ ID NO: 2488827 - RNA, 18 nt, Human
agugggguuaucucugug

SEQ ID NO: 2488828 - RNA, 19 nt, Human
agugggguuaucucugugu

SEQ ID NO: 2488829 - RNA, 18 nt, Human
aguggggucucccucucc

SEQ ID NO: 2488830 - RNA, 19 nt, Human
aguggggucucccucuccu

SEQ ID NO: 2488831 - RNA, 20 nt, Human
aguggggucucccucuccug

SEQ ID NO: 2488832 - RNA, 16 nt, Human
aguggggugcugggag

SEQ ID NO: 2488833 - RNA, 14 nt, Human
aguggggugcuggg

SEQ ID NO: 2488834 - RNA, 22 nt, Human
aguggggucucccucuccugcc

SEQ ID NO: 2488835 - RNA, 23 nt, Human
aguggggucucccucuccugccu

SEQ ID NO: 2488836 - RNA, 18 nt, Human
aguggacuggccccuggg

SEQ ID NO: 2488837 - RNA, 17 nt, Human
aguggacuggccccugg

SEQ ID NO: 2488838 - RNA, 21 nt, Human
aguggacuguucccugaggug

SEQ ID NO: 2488839 - RNA, 16 nt, Human
aguggacuggccccug

SEQ ID NO: 2488840 - RNA, 15 nt, Human
aguggacuggccccu

SEQ ID NO: 2488841 - RNA, 19 nt, Human
aguggacuggaguggagca

SEQ ID NO: 2488842 - RNA, 16 nt, Human
aguggacucagggcag

SEQ ID NO: 2488843 - RNA, 18 nt, Human
aguggacucuuugguggc

SEQ ID NO: 2488844 - RNA, 19 nt, Human
aguggaccuugagaccaca

SEQ ID NO: 2488845 - RNA, 13 nt, Human
aguggacucaggg

SEQ ID NO: 2488846 - RNA, 18 nt, Human
aguggaccuugagaccac

SEQ ID NO: 2488847 - RNA, 17 nt, Human
aguggaccuuaggccuu

SEQ ID NO: 2488848 - RNA, 19 nt, Human
aguggaccuuaggccuucc

SEQ ID NO: 2488849 - RNA, 20 nt, Human
aguggaccuuaggccuuccu

SEQ ID NO: 2488850 - RNA, 23 nt, Human
aguggaccuuaggccuuccucuc

SEQ ID NO: 2488851 - RNA, 23 nt, Human
uguuacaggcaccgagaauguug

SEQ ID NO: 2488852 - RNA, 21 nt, Human
uguuacaggcaccgagaaugu

SEQ ID NO: 2488853 - RNA, 17 nt, Human
aguggauggaaggggcu

SEQ ID NO: 2488854 - RNA, 14 nt, Human
aguggauugcauuu

SEQ ID NO: 2488855 - RNA, 13 nt, Human
aguggaugauguu

SEQ ID NO: 2488856 - RNA, 23 nt, Human
aguggaucuccaaggaccagguu

SEQ ID NO: 2488857 - RNA, 15 nt, Human
aguggaugauguuuc

SEQ ID NO: 2488858 - RNA, 20 nt, Human
aguggaugauguuucgugaa

SEQ ID NO: 2488859 - RNA, 20 nt, Human
aguggcacgucaucuaguuu

SEQ ID NO: 2488860 - RNA, 17 nt, Human
aguggcaauauagaaac

SEQ ID NO: 2488861 - RNA, 12 nt, Human
uguguaacacag

SEQ ID NO: 2488862 - RNA, 20 nt, Human
ugugucagguggggcagcuu

SEQ ID NO: 2488863 - RNA, 17 nt, Human
uguguaaaguuagucua

SEQ ID NO: 2488864 - RNA, 14 nt, Human
uguguaaaguuagu

SEQ ID NO: 2488865 - RNA, 21 nt, Human
uguguaacaauuuuaaugcua

SEQ ID NO: 2488866 - RNA, 21 nt, Human
uguguaaaguguaaauccuuu

SEQ ID NO: 2488867 - RNA, 23 nt, Human
uguggucacagcggaggugugga

SEQ ID NO: 2488868 - RNA, 14 nt, Human
uguguaaaauguga

SEQ ID NO: 2488869 - RNA, 15 nt, Human
uguguaaaaagagag

SEQ ID NO: 2488870 - RNA, 22 nt, Human
ugugguuuuccccucccugggu

SEQ ID NO: 2488871 - RNA, 21 nt, Human
ugugguuuuccccucccuggg

SEQ ID NO: 2488872 - RNA, 18 nt, Human
ugugguuuuccccucccu

SEQ ID NO: 2488873 - RNA, 16 nt, Human
ugugguuuuccccucc

SEQ ID NO: 2488874 - RNA, 23 nt, Human
ugugguuuuccccucccuggguu

SEQ ID NO: 2488875 - RNA, 16 nt, Human
agugcccuccaggaua

SEQ ID NO: 2488876 - RNA, 22 nt, Human
agugccccugcugccuccccaa

SEQ ID NO: 2488877 - RNA, 20 nt, Human
agugccccugcugccucccc

SEQ ID NO: 2488878 - RNA, 21 nt, Human
agugccccugcugccucccca

SEQ ID NO: 2488879 - RNA, 16 nt, Human
agugcccuccacagcc

SEQ ID NO: 2488880 - RNA, 17 nt, Human
agugcccuccacagccg

SEQ ID NO: 2488881 - RNA, 21 nt, Human
agugcccuccacagccgcagc

SEQ ID NO: 2488882 - RNA, 11 nt, Human
agugccccugc

SEQ ID NO: 2488883 - RNA, 12 nt, Human
agugccccugcu

SEQ ID NO: 2488884 - RNA, 13 nt, Human
agugccccugcug

SEQ ID NO: 2488885 - RNA, 14 nt, Human
agugccccugcugc

SEQ ID NO: 2488886 - RNA, 19 nt, Human
agugccccugcugccuccc

SEQ ID NO: 2488887 - RNA, 18 nt, Human
agugcccccacugaccag

SEQ ID NO: 2488888 - RNA, 20 nt, Human
agugccagucuugugucugc

SEQ ID NO: 2488889 - RNA, 14 nt, Human
agugcccaacuguu

SEQ ID NO: 2488890 - RNA, 16 nt, Human
ugugguacaaucucaa

SEQ ID NO: 2488891 - RNA, 21 nt, Human
ugugguacaagcauucugucu

SEQ ID NO: 2488892 - RNA, 18 nt, Human
ugugguagggggugucuc

SEQ ID NO: 2488893 - RNA, 22 nt, Human
ugugguagggacuuaaaaaacu

SEQ ID NO: 2488894 - RNA, 19 nt, Human
uguguccuggugcucucug

SEQ ID NO: 2488895 - RNA, 15 nt, Human
uguguccuggugcuc

SEQ ID NO: 2488896 - RNA, 16 nt, Human
ugugucccccucuguc

SEQ ID NO: 2488897 - RNA, 18 nt, Human
ugugucccccucugucca

SEQ ID NO: 2488898 - RNA, 21 nt, Human
ugugucccccucuguccaggc

SEQ ID NO: 2488899 - RNA, 22 nt, Human
uguguccuggugcucucugcca

SEQ ID NO: 2488900 - RNA, 20 nt, Human
uguguccuggugcucucugc

SEQ ID NO: 2488901 - RNA, 14 nt, Human
uguguccugguucc

SEQ ID NO: 2488902 - RNA, 16 nt, Human
uguguccuucccugca

SEQ ID NO: 2488903 - RNA, 14 nt, Human
uguguccuucccug

SEQ ID NO: 2488904 - RNA, 17 nt, Human
uguguccuucccugcau

SEQ ID NO: 2488905 - RNA, 14 nt, Human
uguguccuugcacc

SEQ ID NO: 2488906 - RNA, 17 nt, Human
ugugucuaaacugcauu

SEQ ID NO: 2488907 - RNA, 15 nt, Human
ugugucuaaacugca

SEQ ID NO: 2488908 - RNA, 13 nt, Human
ugugucuaaacug

SEQ ID NO: 2488909 - RNA, 12 nt, Human
ugugucuaaacu

SEQ ID NO: 2488910 - RNA, 18 nt, Human
uguguccuugcaccugca

SEQ ID NO: 2488911 - RNA, 19 nt, Human
uguguccuugcaccugcau

SEQ ID NO: 2488912 - RNA, 16 nt, Human
uguguccuugugcaug

SEQ ID NO: 2488913 - RNA, 20 nt, Human
uguguccuugcaccugcauc

SEQ ID NO: 2488914 - RNA, 17 nt, Human
uguguccacgacugucu

SEQ ID NO: 2488915 - RNA, 18 nt, Human
uguguccacgacugucuc

SEQ ID NO: 2488916 - RNA, 20 nt, Human
uguguccaugcgcucagggc

SEQ ID NO: 2488917 - RNA, 19 nt, Human
uguguccacgacugucucc

SEQ ID NO: 2488918 - RNA, 16 nt, Human
uguguccaaaacugcc

SEQ ID NO: 2488919 - RNA, 19 nt, Human
uguguccaagugugugugc

SEQ ID NO: 2488920 - RNA, 22 nt, Human
ugugucccaugacccaccccug

SEQ ID NO: 2488921 - RNA, 21 nt, Human
ugugucccaugacccaccccu

SEQ ID NO: 2488922 - RNA, 19 nt, Human
ugugucccaugacccaccc

SEQ ID NO: 2488923 - RNA, 14 nt, Human
ugugucccaugacc

SEQ ID NO: 2488924 - RNA, 20 nt, Human
ugugucccaugaucccugug

SEQ ID NO: 2488925 - RNA, 19 nt, Human
ugugucccaugaucccugu

SEQ ID NO: 2488926 - RNA, 18 nt, Human
uguguccaugugugugca

SEQ ID NO: 2488927 - RNA, 14 nt, Human
uguguccaugugug

SEQ ID NO: 2488928 - RNA, 16 nt, Human
uguguccaugugugug

SEQ ID NO: 2488929 - RNA, 17 nt, Human
uguguccaugugugugc

SEQ ID NO: 2488930 - RNA, 20 nt, Human
ugugucuugcaauggcagcc

SEQ ID NO: 2488931 - RNA, 19 nt, Human
uguguguugccacaggaca

SEQ ID NO: 2488932 - RNA, 20 nt, Human
uguguguugccacaggacac

SEQ ID NO: 2488933 - RNA, 16 nt, Human
uguguguugccacagg

SEQ ID NO: 2488934 - RNA, 17 nt, Human
uguguguugccacagga

SEQ ID NO: 2488935 - RNA, 22 nt, Human
uguguguugaucccaagacaau

SEQ ID NO: 2488936 - RNA, 11 nt, Human
uguguguuuau

SEQ ID NO: 2488937 - RNA, 18 nt, Human
uguguguuguguguggga

SEQ ID NO: 2488938 - RNA, 18 nt, Human
uguguguugucucuugag

SEQ ID NO: 2488939 - RNA, 18 nt, Human
uguguguugucuugaaag

SEQ ID NO: 2488940 - RNA, 16 nt, Human
ugugucuuaauuauua

SEQ ID NO: 2488941 - RNA, 14 nt, Human
ugugucuuaauuau

SEQ ID NO: 2488942 - RNA, 21 nt, Human
ugugucuguacacguguccug

SEQ ID NO: 2488943 - RNA, 14 nt, Human
ugugucuguacacg

SEQ ID NO: 2488944 - RNA, 14 nt, Human
ugugucugcucagu

SEQ ID NO: 2488945 - RNA, 13 nt, Human
ugugucuguacac

SEQ ID NO: 2488946 - RNA, 16 nt, Human
ugugucucuuuucucu

SEQ ID NO: 2488947 - RNA, 19 nt, Human
ugugucugcgucuguguug

SEQ ID NO: 2488948 - RNA, 22 nt, Human
ugugucuaaauuugaauguuaa

SEQ ID NO: 2488949 - RNA, 19 nt, Human
ugugucuaaauuugaaugu

SEQ ID NO: 2488950 - RNA, 22 nt, Human
ugugucucuugguccugcugca

SEQ ID NO: 2488951 - RNA, 21 nt, Human
ugugucuaaacugcauuaccg

SEQ ID NO: 2488952 - RNA, 14 nt, Human
ugugucucuuuucu

SEQ ID NO: 2488953 - RNA, 12 nt, Human
ugugucugcagg

SEQ ID NO: 2488954 - RNA, 21 nt, Human
aguguucauaaauaaaguuug

SEQ ID NO: 2488955 - RNA, 18 nt, Human
aguguguguuuuucauaa

SEQ ID NO: 2488956 - RNA, 21 nt, Human
aguguuccccuuccacugagg

SEQ ID NO: 2488957 - RNA, 21 nt, Human
aguguuccgugguuaaacucg

SEQ ID NO: 2488958 - RNA, 16 nt, Human
aguguuccccuuccac

SEQ ID NO: 2488959 - RNA, 12 nt, Human
agugugugugcg

SEQ ID NO: 2488960 - RNA, 16 nt, Human
aguguuguggauuuaa

SEQ ID NO: 2488961 - RNA, 16 nt, Human
aguguugaaaauguuc

SEQ ID NO: 2488962 - RNA, 15 nt, Human
aguguucuguuuaau

SEQ ID NO: 2488963 - RNA, 20 nt, Human
aguguuccuauuuggggcuu

SEQ ID NO: 2488964 - RNA, 17 nt, Human
aguguucugcaaaaaua

SEQ ID NO: 2488965 - RNA, 16 nt, Human
aguguuccuauuuggg

SEQ ID NO: 2488966 - RNA, 18 nt, Human
aguguucccuuuccuacu

SEQ ID NO: 2488967 - RNA, 11 nt, Human
aguuagcacca

SEQ ID NO: 2488968 - RNA, 14 nt, Human
aguuagcucaggag

SEQ ID NO: 2488969 - RNA, 16 nt, Human
aguuagcucaggaggc

SEQ ID NO: 2488970 - RNA, 22 nt, Human
aguuagcaaacuuuguauguca

SEQ ID NO: 2488971 - RNA, 16 nt, Human
aguuagcaaacuuugu

SEQ ID NO: 2488972 - RNA, 15 nt, Human
aguuagcaaacuuug

SEQ ID NO: 2488973 - RNA, 19 nt, Human
aguuagaggccagccuggc

SEQ ID NO: 2488974 - RNA, 12 nt, Human
aguuagagcuga

SEQ ID NO: 2488975 - RNA, 23 nt, Human
aguuacuaucaugucaaacguga

SEQ ID NO: 2488976 - RNA, 12 nt, Human
aguuacucagcc

SEQ ID NO: 2488977 - RNA, 13 nt, Human
aguuacucagccc

SEQ ID NO: 2488978 - RNA, 14 nt, Human
aguuacucagcccu

SEQ ID NO: 2488979 - RNA, 13 nt, Human
aguuagacuguug

SEQ ID NO: 2488980 - RNA, 19 nt, Human
aguuacucagcccugggcc

SEQ ID NO: 2488981 - RNA, 15 nt, Human
aguuacucagcccug

SEQ ID NO: 2488982 - RNA, 16 nt, Human
aguuacucagcccugg

SEQ ID NO: 2488983 - RNA, 17 nt, Human
aguuacucagcccuggg

SEQ ID NO: 2488984 - RNA, 18 nt, Human
aguuacucagcccugggc

SEQ ID NO: 2488985 - RNA, 19 nt, Human
aguguuguggauuuaacag

SEQ ID NO: 2488986 - RNA, 20 nt, Human
aguguuguggauuuaacaga

SEQ ID NO: 2488987 - RNA, 13 nt, Human
aguuacucagaau

SEQ ID NO: 2488988 - RNA, 17 nt, Human
aguuacuagguaacuuc

SEQ ID NO: 2488989 - RNA, 18 nt, Human
aguuacuagguaacuuca

SEQ ID NO: 2488990 - RNA, 19 nt, Human
aguuacuagguaacuucau

SEQ ID NO: 2488991 - RNA, 22 nt, Human
aguuacuagguaacuucauauu

SEQ ID NO: 2488992 - RNA, 16 nt, Human
aguuacuagguaacuu

SEQ ID NO: 2488993 - RNA, 15 nt, Human
uguucuaagaaguga

SEQ ID NO: 2488994 - RNA, 15 nt, Human
uguugcacccagccc

SEQ ID NO: 2488995 - RNA, 14 nt, Human
uguugcacccagcc

SEQ ID NO: 2488996 - RNA, 23 nt, Human
uguugcacacccacucagcuccg

SEQ ID NO: 2488997 - RNA, 19 nt, Human
uguugcacccagcccuggu

SEQ ID NO: 2488998 - RNA, 18 nt, Human
uguugcacccagcccugg

SEQ ID NO: 2488999 - RNA, 17 nt, Human
uguugcacccagcccug

SEQ ID NO: 2489000 - RNA, 16 nt, Human
uguugcacccagcccu

SEQ ID NO: 2489001 - RNA, 15 nt, Human
uguugcauagaauaa

SEQ ID NO: 2489002 - RNA, 14 nt, Human
uguugcaugggcua

SEQ ID NO: 2489003 - RNA, 17 nt, Human
uguugcauggauguuuu

SEQ ID NO: 2489004 - RNA, 14 nt, Human
uguugcauggaugu

SEQ ID NO: 2489005 - RNA, 17 nt, Human
uguugcaugauguauuu

SEQ ID NO: 2489006 - RNA, 22 nt, Human
uguugccaaauauguccugggg

SEQ ID NO: 2489007 - RNA, 20 nt, Human
uguugccaaauauguccugg

SEQ ID NO: 2489008 - RNA, 20 nt, Human
uguugcaugggcuaaugaag

SEQ ID NO: 2489009 - RNA, 19 nt, Human
uguugccaaauauguccug

SEQ ID NO: 2489010 - RNA, 20 nt, Human
uguugccaagcuccaagccc

SEQ ID NO: 2489011 - RNA, 18 nt, Human
uguugccaagcuccaagc

SEQ ID NO: 2489012 - RNA, 23 nt, Human
uguugccaaauauguccuggggu

SEQ ID NO: 2489013 - RNA, 13 nt, Human
uguugcccugagu

SEQ ID NO: 2489014 - RNA, 12 nt, Human
uguugcccuggg

SEQ ID NO: 2489015 - RNA, 20 nt, Human
uguugccuugaaccacuucc

SEQ ID NO: 2489016 - RNA, 22 nt, Human
agugugugcacaugugugcgug

SEQ ID NO: 2489017 - RNA, 20 nt, Human
agugugugcacaugugugcg

SEQ ID NO: 2489018 - RNA, 14 nt, Human
agugugugcaugug

SEQ ID NO: 2489019 - RNA, 16 nt, Human
agugugugcaugugug

SEQ ID NO: 2489020 - RNA, 17 nt, Human
agugugugcaugugugc

SEQ ID NO: 2489021 - RNA, 23 nt, Human
agugugugcaugugugugcucag

SEQ ID NO: 2489022 - RNA, 14 nt, Human
agugugugggucua

SEQ ID NO: 2489023 - RNA, 17 nt, Human
agugugugcaugugugu

SEQ ID NO: 2489024 - RNA, 18 nt, Human
agugugugcaugugugug

SEQ ID NO: 2489025 - RNA, 20 nt, Human
uguugcccaggcuggcgugc

SEQ ID NO: 2489026 - RNA, 23 nt, Human
uguugcccaggcuggcgugcagu

SEQ ID NO: 2489027 - RNA, 22 nt, Human
uguugcccacagcuguaugauu

SEQ ID NO: 2489028 - RNA, 14 nt, Human
uguugccaagcugg

SEQ ID NO: 2489029 - RNA, 14 nt, Human
uguugccacaggac

SEQ ID NO: 2489030 - RNA, 15 nt, Human
uguugccacaggaca

SEQ ID NO: 2489031 - RNA, 16 nt, Human
uguugccacaggacac

SEQ ID NO: 2489032 - RNA, 12 nt, Human
uguugccagaga

SEQ ID NO: 2489033 - RNA, 20 nt, Human
agugugacugaucucucgug

SEQ ID NO: 2489034 - RNA, 14 nt, Human
agugugaccaggca

SEQ ID NO: 2489035 - RNA, 12 nt, Human
agugugagaauc

SEQ ID NO: 2489036 - RNA, 20 nt, Human
agugugccugaagucccaga

SEQ ID NO: 2489037 - RNA, 21 nt, Human
agugugagcagugaguuacag

SEQ ID NO: 2489038 - RNA, 16 nt, Human
agugugagcagugagu

SEQ ID NO: 2489039 - RNA, 15 nt, Human
agugugaggccaggg

SEQ ID NO: 2489040 - RNA, 12 nt, Human
agugugaguaag

SEQ ID NO: 2489041 - RNA, 19 nt, Human
agugguccauggaaugcuu

SEQ ID NO: 2489042 - RNA, 18 nt, Human
agugguccauggaaugcu

SEQ ID NO: 2489043 - RNA, 17 nt, Human
agugguccacaucccgg

SEQ ID NO: 2489044 - RNA, 16 nt, Human
aguggucccugcccuc

SEQ ID NO: 2489045 - RNA, 15 nt, Human
aguggucccugcccu

SEQ ID NO: 2489046 - RNA, 23 nt, Human
aguggucaaaccgcacucaccca

SEQ ID NO: 2489047 - RNA, 19 nt, Human
agugguaagcucuggcuuu

SEQ ID NO: 2489048 - RNA, 22 nt, Human
aguggucaaaccgcacucaccc

SEQ ID NO: 2489049 - RNA, 18 nt, Human
agugguauagaaaugcug

SEQ ID NO: 2489050 - RNA, 16 nt, Human
agugguauagaaaugc

SEQ ID NO: 2489051 - RNA, 15 nt, Human
agugguauagaaaug

SEQ ID NO: 2489052 - RNA, 16 nt, Human
agugguaagcucuggc

SEQ ID NO: 2489053 - RNA, 14 nt, Human
agugguauagaaau

SEQ ID NO: 2489054 - RNA, 15 nt, Human
agugugcuggaggac

SEQ ID NO: 2489055 - RNA, 13 nt, Human
agugugcuggagg

SEQ ID NO: 2489056 - RNA, 12 nt, Human
agugugcuggag

SEQ ID NO: 2489057 - RNA, 12 nt, Human
agugugcuuuau

SEQ ID NO: 2489058 - RNA, 18 nt, Human
agugugcuuuaugcugaa

SEQ ID NO: 2489059 - RNA, 21 nt, Human
agugugcuuuaugcugaaaca

SEQ ID NO: 2489060 - RNA, 17 nt, Human
aguguggaaauuaagaa

SEQ ID NO: 2489061 - RNA, 19 nt, Human
aguguggaaauuaagaaga

SEQ ID NO: 2489062 - RNA, 21 nt, Human
agugugccugaagucccagau

SEQ ID NO: 2489063 - RNA, 18 nt, Human
agugugaggccagggcag

SEQ ID NO: 2489064 - RNA, 16 nt, Human
agugugaguaagagcu

SEQ ID NO: 2489065 - RNA, 17 nt, Human
agugugaguaagagcug

SEQ ID NO: 2489066 - RNA, 18 nt, Human
agugugaguaagagcugg

SEQ ID NO: 2489067 - RNA, 19 nt, Human
agugugaguaagagcuggu

SEQ ID NO: 2489068 - RNA, 15 nt, Human
agugugggaagggag

SEQ ID NO: 2489069 - RNA, 17 nt, Human
agugugggaagggagag

SEQ ID NO: 2489070 - RNA, 14 nt, Human
agugugggaaugcg

SEQ ID NO: 2489071 - RNA, 20 nt, Human
agugugguguuuccuggcac

SEQ ID NO: 2489072 - RNA, 16 nt, Human
aguguggcuccccucu

SEQ ID NO: 2489073 - RNA, 17 nt, Human
aguguggcuccccucua

SEQ ID NO: 2489074 - RNA, 20 nt, Human
aguguggcugaggaggccuc

SEQ ID NO: 2489075 - RNA, 21 nt, Human
aguguggcuccccucuauuua

SEQ ID NO: 2489076 - RNA, 14 nt, Human
aguguggcuccccu

SEQ ID NO: 2489077 - RNA, 16 nt, Human
aguguggcaguuuggc

SEQ ID NO: 2489078 - RNA, 17 nt, Human
aguguggcaguuuggca

SEQ ID NO: 2489079 - RNA, 20 nt, Human
aguguggaagccggagggug

SEQ ID NO: 2489080 - RNA, 13 nt, Human
uguuaugacucca

SEQ ID NO: 2489081 - RNA, 17 nt, Human
uguuaugacuccagaau

SEQ ID NO: 2489082 - RNA, 20 nt, Human
uguucauuuugagcugaaau

SEQ ID NO: 2489083 - RNA, 18 nt, Human
uguucauuuugagcugaa

SEQ ID NO: 2489084 - RNA, 17 nt, Human
uguuccaaaugaauguu

SEQ ID NO: 2489085 - RNA, 14 nt, Human
uguucauuuccuca

SEQ ID NO: 2489086 - RNA, 17 nt, Human
uguucauuuugagcuga

SEQ ID NO: 2489087 - RNA, 9 nt, Human
aguguguaa

SEQ ID NO: 2489088 - RNA, 22 nt, Human
agugugguguuuccuggcacug

SEQ ID NO: 2489089 - RNA, 11 nt, Human
aguguguaaag

SEQ ID NO: 2489090 - RNA, 16 nt, Human
aguguguaugugcgug

SEQ ID NO: 2489091 - RNA, 19 nt, Human
aguguguaugugcgugugu

SEQ ID NO: 2489092 - RNA, 11 nt, Human
aguguguauua

SEQ ID NO: 2489093 - RNA, 20 nt, Human
aguguguaugugcgugugug

SEQ ID NO: 2489094 - RNA, 19 nt, Human
aguguguauuaaaaaaaac

SEQ ID NO: 2489095 - RNA, 14 nt, Human
aguguguauuaaaa

SEQ ID NO: 2489096 - RNA, 21 nt, Human
uguuaugaaauaaagaaauug

SEQ ID NO: 2489097 - RNA, 16 nt, Human
uguuaugaaauaaaga

SEQ ID NO: 2489098 - RNA, 13 nt, Human
uguuaugaaauaa

SEQ ID NO: 2489099 - RNA, 22 nt, Human
uguuccugaauucuauuugcug

SEQ ID NO: 2489100 - RNA, 20 nt, Human
uguuccaagacauugucaau

SEQ ID NO: 2489101 - RNA, 19 nt, Human
uguuccacaaguuaaauaa

SEQ ID NO: 2489102 - RNA, 14 nt, Human
uguuccaacugccc

SEQ ID NO: 2489103 - RNA, 11 nt, Human
uguuccaagac

SEQ ID NO: 2489104 - RNA, 14 nt, Human
uguuccaagacauu

SEQ ID NO: 2489105 - RNA, 15 nt, Human
uguuccaagacauug

SEQ ID NO: 2489106 - RNA, 18 nt, Human
uguuccaagacauuguca

SEQ ID NO: 2489107 - RNA, 19 nt, Human
uguuccaagacauugucaa

SEQ ID NO: 2489108 - RNA, 15 nt, Human
uguuccaauaaacag

SEQ ID NO: 2489109 - RNA, 21 nt, Human
uguuccaagacauugucaaua

SEQ ID NO: 2489110 - RNA, 22 nt, Human
uguucgcauggucacacacuga

SEQ ID NO: 2489111 - RNA, 23 nt, Human
uguucgcauggucacacacugau

SEQ ID NO: 2489112 - RNA, 23 nt, Human
uguucgcguguguggguggauau

SEQ ID NO: 2489113 - RNA, 15 nt, Human
uguucgcgugugugg

SEQ ID NO: 2489114 - RNA, 15 nt, Human
uguuccuggcaguuu

SEQ ID NO: 2489115 - RNA, 19 nt, Human
uguuccuggcaguuuaaaa

SEQ ID NO: 2489116 - RNA, 14 nt, Human
uguuccuggcaaua

SEQ ID NO: 2489117 - RNA, 21 nt, Human
uguuccuggcaauaguguguu

SEQ ID NO: 2489118 - RNA, 18 nt, Human
uguuccuucacauccugu

SEQ ID NO: 2489119 - RNA, 19 nt, Human
uguuccuuagaccuuccau

SEQ ID NO: 2489120 - RNA, 20 nt, Human
uguucgcauggucacacacu

SEQ ID NO: 2489121 - RNA, 18 nt, Human
agucugaacagcuguaau

SEQ ID NO: 2489122 - RNA, 16 nt, Human
agucugaacagcugua

SEQ ID NO: 2489123 - RNA, 15 nt, Human
agucugaacagcugu

SEQ ID NO: 2489124 - RNA, 23 nt, Human
agucucuuuucuuuagagcauug

SEQ ID NO: 2489125 - RNA, 12 nt, Human
agucugaaggcu

SEQ ID NO: 2489126 - RNA, 21 nt, Human
agucugaagcagaugcaaaga

SEQ ID NO: 2489127 - RNA, 14 nt, Human
agucugaagcagau

SEQ ID NO: 2489128 - RNA, 13 nt, Human
agucuuagaugua

SEQ ID NO: 2489129 - RNA, 14 nt, Human
agucuuagauguau

SEQ ID NO: 2489130 - RNA, 16 nt, Human
agucuuagauguauau

SEQ ID NO: 2489131 - RNA, 23 nt, Human
agucuuagauguauauauuuccu

SEQ ID NO: 2489132 - RNA, 17 nt, Human
agucucuugauucauaa

SEQ ID NO: 2489133 - RNA, 16 nt, Human
agucucuugauucaua

SEQ ID NO: 2489134 - RNA, 21 nt, Human
agucucuucuccacuggaugg

SEQ ID NO: 2489135 - RNA, 18 nt, Human
agucucuucuccacugga

SEQ ID NO: 2489136 - RNA, 17 nt, Human
agucucuuguauuaaac

SEQ ID NO: 2489137 - RNA, 15 nt, Human
agucucuuuaaucuu

SEQ ID NO: 2489138 - RNA, 17 nt, Human
agucucuuuaaucuuca

SEQ ID NO: 2489139 - RNA, 21 nt, Human
agucucuuuaaucuucaguuu

SEQ ID NO: 2489140 - RNA, 23 nt, Human
agucucuuuaaucuucaguuuua

SEQ ID NO: 2489141 - RNA, 22 nt, Human
agucucuuuucuuuagagcauu

SEQ ID NO: 2489142 - RNA, 21 nt, Human
agucucuuuucuuuagagcau

SEQ ID NO: 2489143 - RNA, 15 nt, Human
agucucuuuucuuua

SEQ ID NO: 2489144 - RNA, 22 nt, Human
agucucuuuaaucuucaguuuu

SEQ ID NO: 2489145 - RNA, 17 nt, Human
agucucccuuucccuuc

SEQ ID NO: 2489146 - RNA, 23 nt, Human
agucuccuuugcacugagggcca

SEQ ID NO: 2489147 - RNA, 22 nt, Human
agucuccuuugcacugagggcc

SEQ ID NO: 2489148 - RNA, 21 nt, Human
agucuccuuugcacugagggc

SEQ ID NO: 2489149 - RNA, 19 nt, Human
agucuccuuugcacugagg

SEQ ID NO: 2489150 - RNA, 18 nt, Human
agucuccuuugcacugag

SEQ ID NO: 2489151 - RNA, 17 nt, Human
agucuccuuugcacuga

SEQ ID NO: 2489152 - RNA, 17 nt, Human
agucucccuucucccau

SEQ ID NO: 2489153 - RNA, 14 nt, Human
agucuccuuccccu

SEQ ID NO: 2489154 - RNA, 19 nt, Human
agucucuucuccacuggau

SEQ ID NO: 2489155 - RNA, 16 nt, Human
agucucuagguucuga

SEQ ID NO: 2489156 - RNA, 20 nt, Human
agucucgcucugucacccag

SEQ ID NO: 2489157 - RNA, 15 nt, Human
agucucgcucuguca

SEQ ID NO: 2489158 - RNA, 19 nt, Human
agucucgcucuguugccca

SEQ ID NO: 2489159 - RNA, 24 nt, Human
ugugagaagugaaugcugggacuc

SEQ ID NO: 2489160 - RNA, 23 nt, Human
ugugagaagugaaugcugggacu

SEQ ID NO: 2489161 - RNA, 22 nt, Human
ugugagaagugaaugcugggac

SEQ ID NO: 2489162 - RNA, 21 nt, Human
ugugagaagugaaugcuggga

SEQ ID NO: 2489163 - RNA, 19 nt, Human
ugugagacagugggaaaua

SEQ ID NO: 2489164 - RNA, 18 nt, Human
ugugagacagugggaaau

SEQ ID NO: 2489165 - RNA, 14 nt, Human
ugugagaaucaaaa

SEQ ID NO: 2489166 - RNA, 13 nt, Human
ugugagaccccca

SEQ ID NO: 2489167 - RNA, 14 nt, Human
ugugagacccccac

SEQ ID NO: 2489168 - RNA, 19 nt, Human
ugugagacucgagaacuuu

SEQ ID NO: 2489169 - RNA, 18 nt, Human
ugugagcccagcuggguc

SEQ ID NO: 2489170 - RNA, 17 nt, Human
ugugagccccugguccu

SEQ ID NO: 2489171 - RNA, 14 nt, Human
ugugagccccuggu

SEQ ID NO: 2489172 - RNA, 12 nt, Human
ugugagccccug

SEQ ID NO: 2489173 - RNA, 13 nt, Human
ugugagagaaagu

SEQ ID NO: 2489174 - RNA, 15 nt, Human
ugugagacccccaca

SEQ ID NO: 2489175 - RNA, 16 nt, Human
ugugagacccccacac

SEQ ID NO: 2489176 - RNA, 18 nt, Human
ugugagacccccacaccu

SEQ ID NO: 2489177 - RNA, 19 nt, Human
ugugagacccccacaccuc

SEQ ID NO: 2489178 - RNA, 11 nt, Human
ugugaggaagc

SEQ ID NO: 2489179 - RNA, 14 nt, Human
agucucccuucucc

SEQ ID NO: 2489180 - RNA, 23 nt, Human
ugugaggaaagucauuggcuuua

SEQ ID NO: 2489181 - RNA, 22 nt, Human
ugugaggaaagucauuggcuuu

SEQ ID NO: 2489182 - RNA, 16 nt, Human
ugugaggaaagucauu

SEQ ID NO: 2489183 - RNA, 14 nt, Human
ugugagccuuggcu

SEQ ID NO: 2489184 - RNA, 22 nt, Human
ugugagccccugguccugaggg

SEQ ID NO: 2489185 - RNA, 21 nt, Human
ugugagccccugguccugagg

SEQ ID NO: 2489186 - RNA, 16 nt, Human
ugugacugaucucucg

SEQ ID NO: 2489187 - RNA, 16 nt, Human
ugucucccuggcccuc

SEQ ID NO: 2489188 - RNA, 15 nt, Human
ugucucccuggcccu

SEQ ID NO: 2489189 - RNA, 15 nt, Human
ugucuccauggcccu

SEQ ID NO: 2489190 - RNA, 22 nt, Human
ugucuccagacccccaccccuu

SEQ ID NO: 2489191 - RNA, 23 nt, Human
ugucuccagacccccaccccuuc

SEQ ID NO: 2489192 - RNA, 14 nt, Human
ugucucccuggccc

SEQ ID NO: 2489193 - RNA, 11 nt, Human
ugucuccagac

SEQ ID NO: 2489194 - RNA, 12 nt, Human
ugucuccagacc

SEQ ID NO: 2489195 - RNA, 14 nt, Human
ugucuccagacccc

SEQ ID NO: 2489196 - RNA, 16 nt, Human
ugucuccagaccccca

SEQ ID NO: 2489197 - RNA, 17 nt, Human
ugucuccagacccccac

SEQ ID NO: 2489198 - RNA, 19 nt, Human
ugucuccagacccccaccc

SEQ ID NO: 2489199 - RNA, 20 nt, Human
ugucuccagacccccacccc

SEQ ID NO: 2489200 - RNA, 15 nt, Human
ugugacuucuccagg

SEQ ID NO: 2489201 - RNA, 23 nt, Human
ugugacuugcaucguggagacag

SEQ ID NO: 2489202 - RNA, 19 nt, Human
ugugacuucagcucuguuu

SEQ ID NO: 2489203 - RNA, 18 nt, Human
ugugacuucagcucuguu

SEQ ID NO: 2489204 - RNA, 22 nt, Human
ugugacugauguuacaucacag

SEQ ID NO: 2489205 - RNA, 20 nt, Human
agucuuuacagcugagcaca

SEQ ID NO: 2489206 - RNA, 20 nt, Human
agucuugugcuuuuccuauu

SEQ ID NO: 2489207 - RNA, 21 nt, Human
agugaacaaauuuacagagac

SEQ ID NO: 2489208 - RNA, 18 nt, Human
agucuuucacauuuaaau

SEQ ID NO: 2489209 - RNA, 16 nt, Human
agucuuucacauuuaa

SEQ ID NO: 2489210 - RNA, 22 nt, Human
agucuuguauuaaguuguuaau

SEQ ID NO: 2489211 - RNA, 12 nt, Human
agucuugugcuu

SEQ ID NO: 2489212 - RNA, 15 nt, Human
agucuugugcuuuuc

SEQ ID NO: 2489213 - RNA, 21 nt, Human
agugacucgggcuccugugcc

SEQ ID NO: 2489214 - RNA, 20 nt, Human
agugacucgggcuccugugc

SEQ ID NO: 2489215 - RNA, 19 nt, Human
agugacucgggcuccugug

SEQ ID NO: 2489216 - RNA, 17 nt, Human
agugacucgggcuccug

SEQ ID NO: 2489217 - RNA, 15 nt, Human
agugacucgggcucc

SEQ ID NO: 2489218 - RNA, 14 nt, Human
agugacucgagggu

SEQ ID NO: 2489219 - RNA, 17 nt, Human
agugacuccaggagagg

SEQ ID NO: 2489220 - RNA, 13 nt, Human
agugacuccagga

SEQ ID NO: 2489221 - RNA, 21 nt, Human
agugacugauggcuaauguac

SEQ ID NO: 2489222 - RNA, 20 nt, Human
agugaacuacgcuugcucau

SEQ ID NO: 2489223 - RNA, 17 nt, Human
agugaaccuaccuucau

SEQ ID NO: 2489224 - RNA, 15 nt, Human
agugaaccuguauaa

SEQ ID NO: 2489225 - RNA, 13 nt, Human
agugaaccaucau

SEQ ID NO: 2489226 - RNA, 21 nt, Human
agugaaccaucauuauaaacg

SEQ ID NO: 2489227 - RNA, 22 nt, Human
agugacuaugaacuucucucag

SEQ ID NO: 2489228 - RNA, 18 nt, Human
agugacucauccucuuga

SEQ ID NO: 2489229 - RNA, 23 nt, Human
agugacucauccucuugaagaug

SEQ ID NO: 2489230 - RNA, 22 nt, Human
agugaacaaauuuacagagaca

SEQ ID NO: 2489231 - RNA, 23 nt, Human
agugaacaaauuuacagagacag

SEQ ID NO: 2489232 - RNA, 17 nt, Human
agugaacacuagccaga

SEQ ID NO: 2489233 - RNA, 16 nt, Human
agugaacacuagccag

SEQ ID NO: 2489234 - RNA, 23 nt, Human
agugaaccaaagagacuggagca

SEQ ID NO: 2489235 - RNA, 22 nt, Human
agugaaccaaagagacuggagc

SEQ ID NO: 2489236 - RNA, 15 nt, Human
agugaaccaaagaga

SEQ ID NO: 2489237 - RNA, 13 nt, Human
agugaaccaaaga

SEQ ID NO: 2489238 - RNA, 16 nt, Human
agugaacuugggccac

SEQ ID NO: 2489239 - RNA, 18 nt, Human
agugacuugugucccaug

SEQ ID NO: 2489240 - RNA, 16 nt, Human
agugacuuguguccca

SEQ ID NO: 2489241 - RNA, 15 nt, Human
agugacuugcccagu

SEQ ID NO: 2489242 - RNA, 14 nt, Human
agugacuugcccag

SEQ ID NO: 2489243 - RNA, 22 nt, Human
agugagaaaaagcuccuguccu

SEQ ID NO: 2489244 - RNA, 19 nt, Human
agugagaaaaagcuccugu

SEQ ID NO: 2489245 - RNA, 18 nt, Human
agugagaaaaagcuccug

SEQ ID NO: 2489246 - RNA, 18 nt, Human
agugacuuuggcugcaug

SEQ ID NO: 2489247 - RNA, 14 nt, Human
agugagaaaaagcu

SEQ ID NO: 2489248 - RNA, 22 nt, Human
agugacucgggcuccugugccc

SEQ ID NO: 2489249 - RNA, 21 nt, Human
agugacuuagcagaugcuggu

SEQ ID NO: 2489250 - RNA, 20 nt, Human
agugacuguucaagagcaca

SEQ ID NO: 2489251 - RNA, 19 nt, Human
agugacuguucaagagcac

SEQ ID NO: 2489252 - RNA, 17 nt, Human
agugacuguucaagagc

SEQ ID NO: 2489253 - RNA, 22 nt, Human
agugagagggcaugcgcacaag

SEQ ID NO: 2489254 - RNA, 20 nt, Human
agugagaagcuuugcccucc

SEQ ID NO: 2489255 - RNA, 14 nt, Human
agugagagggcaug

SEQ ID NO: 2489256 - RNA, 13 nt, Human
agugagagggcau

SEQ ID NO: 2489257 - RNA, 12 nt, Human
agugagacagaa

SEQ ID NO: 2489258 - RNA, 17 nt, Human
agugagaauaggcagcc

SEQ ID NO: 2489259 - RNA, 20 nt, Human
agugagaaaaagcuccuguc

SEQ ID NO: 2489260 - RNA, 16 nt, Human
agugagaagcuuugcc

SEQ ID NO: 2489261 - RNA, 22 nt, Human
agugagcacuaaggugugcucu

SEQ ID NO: 2489262 - RNA, 14 nt, Human
agugagcacuaagg

SEQ ID NO: 2489263 - RNA, 22 nt, Human
ugugaugaugaaaugaggucag

SEQ ID NO: 2489264 - RNA, 15 nt, Human
ugugauucaaucugu

SEQ ID NO: 2489265 - RNA, 15 nt, Human
ugugaugccacacag

SEQ ID NO: 2489266 - RNA, 17 nt, Human
ugugaugccacacagag

SEQ ID NO: 2489267 - RNA, 16 nt, Human
ugugaugaggggaggg

SEQ ID NO: 2489268 - RNA, 16 nt, Human
ugugaugaggcagagg

SEQ ID NO: 2489269 - RNA, 14 nt, Human
ugugaugaggggag

SEQ ID NO: 2489270 - RNA, 19 nt, Human
ugugaugagaggaaaucac

SEQ ID NO: 2489271 - RNA, 23 nt, Human
agugagcugagaucgugccguua

SEQ ID NO: 2489272 - RNA, 18 nt, Human
ugugaugagaggaaauca

SEQ ID NO: 2489273 - RNA, 22 nt, Human
agugagauagcauugugaacug

SEQ ID NO: 2489274 - RNA, 16 nt, Human
agugagauagcauugu

SEQ ID NO: 2489275 - RNA, 12 nt, Human
agugagaugcau

SEQ ID NO: 2489276 - RNA, 19 nt, Human
agugagauagcauugugaa

SEQ ID NO: 2489277 - RNA, 16 nt, Human
agugagaugcauucuu

SEQ ID NO: 2489278 - RNA, 19 nt, Human
agugagccgcaucuucucc

SEQ ID NO: 2489279 - RNA, 21 nt, Human
agugagccugaauuuuguugc

SEQ ID NO: 2489280 - RNA, 13 nt, Human
agugagccuggcu

SEQ ID NO: 2489281 - RNA, 24 nt, Human
agugagccgcaucuucuccaucug

SEQ ID NO: 2489282 - RNA, 11 nt, Human
agugagccuga

SEQ ID NO: 2489283 - RNA, 20 nt, Human
agugagccgcaucuucucca

SEQ ID NO: 2489284 - RNA, 22 nt, Human
agugagccgcaucuucuccauc

SEQ ID NO: 2489285 - RNA, 12 nt, Human
agugagcugguu

SEQ ID NO: 2489286 - RNA, 17 nt, Human
agugagcucuaugggca

SEQ ID NO: 2489287 - RNA, 16 nt, Human
agugagcucuaugggc

SEQ ID NO: 2489288 - RNA, 23 nt, Human
agugagcggugcuguccucaggu

SEQ ID NO: 2489289 - RNA, 15 nt, Human
agugagccuggcucu

SEQ ID NO: 2489290 - RNA, 14 nt, Human
agugagccuggcuc

SEQ ID NO: 2489291 - RNA, 22 nt, Human
agugagcggugcuguccucagg

SEQ ID NO: 2489292 - RNA, 19 nt, Human
ugugcucuccaagcccagu

SEQ ID NO: 2489293 - RNA, 20 nt, Human
ugugcuccgugccuccacca

SEQ ID NO: 2489294 - RNA, 16 nt, Human
ugugcuccgugccucc

SEQ ID NO: 2489295 - RNA, 16 nt, Human
ugugcuccuccuuggu

SEQ ID NO: 2489296 - RNA, 14 nt, Human
ugugcucuccaagc

SEQ ID NO: 2489297 - RNA, 21 nt, Human
ugugcucaggagcccugggag

SEQ ID NO: 2489298 - RNA, 16 nt, Human
ugugccuaacaccagc

SEQ ID NO: 2489299 - RNA, 14 nt, Human
ugugcuccgugccu

SEQ ID NO: 2489300 - RNA, 21 nt, Human
ugugcucccugguucugauga

SEQ ID NO: 2489301 - RNA, 17 nt, Human
ugugcuccccuuugccu

SEQ ID NO: 2489302 - RNA, 21 nt, Human
ugugcugaggccuuaucauuc

SEQ ID NO: 2489303 - RNA, 14 nt, Human
ugugcugaggccuu

SEQ ID NO: 2489304 - RNA, 21 nt, Human
ugugcugacggaagccaacuu

SEQ ID NO: 2489305 - RNA, 17 nt, Human
ugugcugacccuccugu

SEQ ID NO: 2489306 - RNA, 14 nt, Human
ugugcugacccucc

SEQ ID NO: 2489307 - RNA, 19 nt, Human
ugugcugaauucugcaaug

SEQ ID NO: 2489308 - RNA, 23 nt, Human
ugugcuccgugccuccaccacca

SEQ ID NO: 2489309 - RNA, 18 nt, Human
ugugcugagucugaaggc

SEQ ID NO: 2489310 - RNA, 19 nt, Human
ugugcugagucugaaggcu

SEQ ID NO: 2489311 - RNA, 20 nt, Human
ugugcugcccgucuucagcc

SEQ ID NO: 2489312 - RNA, 16 nt, Human
ugugccgaaugugcag

SEQ ID NO: 2489313 - RNA, 15 nt, Human
ugugccgaaugugca

SEQ ID NO: 2489314 - RNA, 14 nt, Human
ugugcccuggugga

SEQ ID NO: 2489315 - RNA, 13 nt, Human
ugugcccuggugg

SEQ ID NO: 2489316 - RNA, 11 nt, Human
ugugcccuggu

SEQ ID NO: 2489317 - RNA, 14 nt, Human
ugugcccucuugau

SEQ ID NO: 2489318 - RNA, 20 nt, Human
ugugcucaggagcccuggga

SEQ ID NO: 2489319 - RNA, 15 nt, Human
ugugccgacagaagg

SEQ ID NO: 2489320 - RNA, 15 nt, Human
ugugccuaacaccag

SEQ ID NO: 2489321 - RNA, 16 nt, Human
ugugauucuaaugucu

SEQ ID NO: 2489322 - RNA, 14 nt, Human
ugugauucuaaugu

SEQ ID NO: 2489323 - RNA, 21 nt, Human
ugugauuccuuugaagaggaa

SEQ ID NO: 2489324 - RNA, 20 nt, Human
ugugauuccuuugaagagga

SEQ ID NO: 2489325 - RNA, 19 nt, Human
ugugauuccuuugaagagg

SEQ ID NO: 2489326 - RNA, 22 nt, Human
ugugauuccacuacaccuggcu

SEQ ID NO: 2489327 - RNA, 16 nt, Human
ugugauucaaucugua

SEQ ID NO: 2489328 - RNA, 20 nt, Human
ugugauucaaucuguaaacu

SEQ ID NO: 2489329 - RNA, 22 nt, Human
ugugauucaaucuguaaacugu

SEQ ID NO: 2489330 - RNA, 13 nt, Human
ugugauugaaucu

SEQ ID NO: 2489331 - RNA, 17 nt, Human
ugugauucuaaugucuu

SEQ ID NO: 2489332 - RNA, 21 nt, Human
ugugauucuaaugucuucauu

SEQ ID NO: 2489333 - RNA, 15 nt, Human
ugugauugaaucuga

SEQ ID NO: 2489334 - RNA, 16 nt, Human
ugugauugacagcuuu

SEQ ID NO: 2489335 - RNA, 22 nt, Human
ugugauugacagcuuugcugcu

SEQ ID NO: 2489336 - RNA, 23 nt, Human
ugugauugacagcuuugcugcug

SEQ ID NO: 2489337 - RNA, 15 nt, Human
ugugauugggaauaa

SEQ ID NO: 2489338 - RNA, 19 nt, Human
ugugauugggaauaaauau

SEQ ID NO: 2489339 - RNA, 17 nt, Human
ugugauugggaauaaau

SEQ ID NO: 2489340 - RNA, 19 nt, Human
uguggauuuaacagaaaug

SEQ ID NO: 2489341 - RNA, 20 nt, Human
uguggauuuaacagaaaugu

SEQ ID NO: 2489342 - RNA, 22 nt, Human
uguggauuuaacagaaauguac

SEQ ID NO: 2489343 - RNA, 23 nt, Human
agugagcugguuuuuagcggaga

SEQ ID NO: 2489344 - RNA, 17 nt, Human
uguggaucagagaugca

SEQ ID NO: 2489345 - RNA, 19 nt, Human
uguggaucaaccaucgcuu

SEQ ID NO: 2489346 - RNA, 20 nt, Human
uguggaucaaccaucgcuuu

SEQ ID NO: 2489347 - RNA, 21 nt, Human
uguggaucaaauccagccugc

SEQ ID NO: 2489348 - RNA, 14 nt, Human
uguggaucagagau

SEQ ID NO: 2489349 - RNA, 19 nt, Human
uguggaugagcccucagaa

SEQ ID NO: 2489350 - RNA, 23 nt, Human
uguggaugagcccucagaacccu

SEQ ID NO: 2489351 - RNA, 14 nt, Human
uguggaugauaaaa

SEQ ID NO: 2489352 - RNA, 21 nt, Human
ugugcugcccugcccaccugg

SEQ ID NO: 2489353 - RNA, 20 nt, Human
ugugcugcccugcccaccug

SEQ ID NO: 2489354 - RNA, 19 nt, Human
ugugcugcccugcccaccu

SEQ ID NO: 2489355 - RNA, 18 nt, Human
ugugcugcccugcccacc

SEQ ID NO: 2489356 - RNA, 23 nt, Human
ugugcuguguaaaguuagucuac

SEQ ID NO: 2489357 - RNA, 16 nt, Human
ugugcuguguaaaguu

SEQ ID NO: 2489358 - RNA, 12 nt, Human
ugugcugugugu

SEQ ID NO: 2489359 - RNA, 15 nt, Human
ugugcugugugugac

SEQ ID NO: 2489360 - RNA, 15 nt, Human
ugugcuguguaaagu

SEQ ID NO: 2489361 - RNA, 14 nt, Human
ugugcuguguaaag

SEQ ID NO: 2489362 - RNA, 13 nt, Human
ugugcuguguaaa

SEQ ID NO: 2489363 - RNA, 20 nt, Human
ugugcuguggggcugguagc

SEQ ID NO: 2489364 - RNA, 17 nt, Human
ugugcuguggggcuggu

SEQ ID NO: 2489365 - RNA, 17 nt, Human
ugugcuguggaagcaac

SEQ ID NO: 2489366 - RNA, 12 nt, Human
ugugcuguguaa

SEQ ID NO: 2489367 - RNA, 16 nt, Human
ugugcuguggaagcaa

SEQ ID NO: 2489368 - RNA, 17 nt, Human
ugugcugugcccaaguu

SEQ ID NO: 2489369 - RNA, 14 nt, Human
ugugcuguggaagc

SEQ ID NO: 2489370 - RNA, 19 nt, Human
ugugcugguguccugacca

SEQ ID NO: 2489371 - RNA, 23 nt, Human
ugugcugguguccugaccacccu

SEQ ID NO: 2489372 - RNA, 16 nt, Human
agugaggaugaaaaaa

SEQ ID NO: 2489373 - RNA, 20 nt, Human
agugaggaaggcaggaagag

SEQ ID NO: 2489374 - RNA, 14 nt, Human
agugaggaaggcag

SEQ ID NO: 2489375 - RNA, 19 nt, Human
agugaggaagccaggucca

SEQ ID NO: 2489376 - RNA, 20 nt, Human
agugaggaauaguugagccc

SEQ ID NO: 2489377 - RNA, 22 nt, Human
agugaggaaggcaggaagagag

SEQ ID NO: 2489378 - RNA, 21 nt, Human
agugaggaauaguugagcccc

SEQ ID NO: 2489379 - RNA, 20 nt, Human
agugagcuuugcugcuacag

SEQ ID NO: 2489380 - RNA, 19 nt, Human
agugagcuuugcugcuaca

SEQ ID NO: 2489381 - RNA, 16 nt, Human
agugagcuuugcugcu

SEQ ID NO: 2489382 - RNA, 14 nt, Human
agugagcuuugcug

SEQ ID NO: 2489383 - RNA, 17 nt, Human
agugagcuguaggugug

SEQ ID NO: 2489384 - RNA, 19 nt, Human
uguggauguuuuaauucca

SEQ ID NO: 2489385 - RNA, 15 nt, Human
uguggaugucuuccu

SEQ ID NO: 2489386 - RNA, 22 nt, Human
uguggauguuuuaauuccauga

SEQ ID NO: 2489387 - RNA, 21 nt, Human
agugagcuuggaaaggaccag

SEQ ID NO: 2489388 - RNA, 14 nt, Human
agugaggaugucug

SEQ ID NO: 2489389 - RNA, 22 nt, Human
agugaggcauugcacagggaga

SEQ ID NO: 2489390 - RNA, 18 nt, Human
agugaggcauugcacagg

SEQ ID NO: 2489391 - RNA, 12 nt, Human
agugaggcucug

SEQ ID NO: 2489392 - RNA, 13 nt, Human
agugaggcucugc

SEQ ID NO: 2489393 - RNA, 13 nt, Human
agugaggcccagg

SEQ ID NO: 2489394 - RNA, 15 nt, Human
agugaggcccaggga

SEQ ID NO: 2489395 - RNA, 17 nt, Human
agugauauggcagaaga

SEQ ID NO: 2489396 - RNA, 14 nt, Human
agugauauggcaga

SEQ ID NO: 2489397 - RNA, 14 nt, Human
agugauauaaauca

SEQ ID NO: 2489398 - RNA, 21 nt, Human
agugauagucuuuugcuuuug

SEQ ID NO: 2489399 - RNA, 20 nt, Human
agugauagucuuuugcuuuu

SEQ ID NO: 2489400 - RNA, 19 nt, Human
agugaguuguugcccuggg

SEQ ID NO: 2489401 - RNA, 18 nt, Human
agugaguuguugcccugg

SEQ ID NO: 2489402 - RNA, 20 nt, Human
agugaguuguugcccugggu

SEQ ID NO: 2489403 - RNA, 19 nt, Human
agugauaauuucuggaauu

SEQ ID NO: 2489404 - RNA, 17 nt, Human
agugauagucuuuugcu

SEQ ID NO: 2489405 - RNA, 15 nt, Human
agugauagucuuuug

SEQ ID NO: 2489406 - RNA, 23 nt, Human
agugauacaacuucaagugcaug

SEQ ID NO: 2489407 - RNA, 20 nt, Human
agugauagagcuaacccuua

SEQ ID NO: 2489408 - RNA, 17 nt, Human
agugauacaacuucaag

SEQ ID NO: 2489409 - RNA, 14 nt, Human
agugcaaauuguca

SEQ ID NO: 2489410 - RNA, 20 nt, Human
agugcaacagcacuggcucu

SEQ ID NO: 2489411 - RNA, 15 nt, Human
agugcaacaguagca

SEQ ID NO: 2489412 - RNA, 18 nt, Human
agugcaaaucauagcugg

SEQ ID NO: 2489413 - RNA, 17 nt, Human
agugcaaaucauagcug

SEQ ID NO: 2489414 - RNA, 21 nt, Human
agugcaaagauuugcuuuaau

SEQ ID NO: 2489415 - RNA, 18 nt, Human
agugcaaauuugauacau

SEQ ID NO: 2489416 - RNA, 17 nt, Human
agugcaacacugaagcu

SEQ ID NO: 2489417 - RNA, 21 nt, Human
agugcauccaaaggugcucag

SEQ ID NO: 2489418 - RNA, 15 nt, Human
agugcauccaaaggu

SEQ ID NO: 2489419 - RNA, 14 nt, Human
agugcauccaaagg

SEQ ID NO: 2489420 - RNA, 20 nt, Human
agugcauauuccuuucuauc

SEQ ID NO: 2489421 - RNA, 19 nt, Human
agugcauauuccuuucuau

SEQ ID NO: 2489422 - RNA, 18 nt, Human
agugcauauuccuuucua

SEQ ID NO: 2489423 - RNA, 16 nt, Human
agugcauauuccuuuc

SEQ ID NO: 2489424 - RNA, 14 nt, Human
agugcauauuccuu

SEQ ID NO: 2489425 - RNA, 14 nt, Human
agugcaugcugucc

SEQ ID NO: 2489426 - RNA, 22 nt, Human
agugcauuuaugagcucuucau

SEQ ID NO: 2489427 - RNA, 16 nt, Human
agugcaugcugucccu

SEQ ID NO: 2489428 - RNA, 19 nt, Human
agugccagaggugggcagg

SEQ ID NO: 2489429 - RNA, 18 nt, Human
agugccagaggugggcag

SEQ ID NO: 2489430 - RNA, 16 nt, Human
agugccagaggugggc

SEQ ID NO: 2489431 - RNA, 15 nt, Human
agugccagagguggg

SEQ ID NO: 2489432 - RNA, 21 nt, Human
agugccagaggugggcaggug

SEQ ID NO: 2489433 - RNA, 20 nt, Human
agugccagaggugggcaggu

SEQ ID NO: 2489434 - RNA, 13 nt, Human
agugccaggacuc

SEQ ID NO: 2489435 - RNA, 24 nt, Human
agugccaggacuccccaggccagg

SEQ ID NO: 2489436 - RNA, 23 nt, Human
agugccaggacuccccaggccag

SEQ ID NO: 2489437 - RNA, 19 nt, Human
agugccaggacuccccagg

SEQ ID NO: 2489438 - RNA, 22 nt, Human
agugccagaggugggcaggugg

SEQ ID NO: 2489439 - RNA, 18 nt, Human
agugccaggauggaauga

SEQ ID NO: 2489440 - RNA, 14 nt, Human
agugccaaaaacaa

SEQ ID NO: 2489441 - RNA, 15 nt, Human
agugcauuuucccag

SEQ ID NO: 2489442 - RNA, 17 nt, Human
agugcauuuucccagau

SEQ ID NO: 2489443 - RNA, 23 nt, Human
agugcaguccugaucagagccgu

SEQ ID NO: 2489444 - RNA, 17 nt, Human
agugcagugagccgaga

SEQ ID NO: 2489445 - RNA, 21 nt, Human
agugcaauaaaucugacccag

SEQ ID NO: 2489446 - RNA, 22 nt, Human
agugcaauaaaucugacccagu

SEQ ID NO: 2489447 - RNA, 23 nt, Human
agugcaauaaaucugacccagug

SEQ ID NO: 2489448 - RNA, 20 nt, Human
agugcaauaaaucugaccca

SEQ ID NO: 2489449 - RNA, 18 nt, Human
agugcaagccccugcucc

SEQ ID NO: 2489450 - RNA, 15 nt, Human
agugcaagccccugc

SEQ ID NO: 2489451 - RNA, 17 nt, Human
agugcaagccccugcuc

SEQ ID NO: 2489452 - RNA, 13 nt, Human
auagaaguaaaaa

SEQ ID NO: 2489453 - RNA, 13 nt, Human
auagaaggcaggu

SEQ ID NO: 2489454 - RNA, 16 nt, Human
auagaagcuguaguag

SEQ ID NO: 2489455 - RNA, 18 nt, Human
auagaauaaaauauaauu

SEQ ID NO: 2489456 - RNA, 19 nt, Human
auagaagaacugcaaaggu

SEQ ID NO: 2489457 - RNA, 20 nt, Human
auagaagaauacaaacauau

SEQ ID NO: 2489458 - RNA, 15 nt, Human
auagaagaacugcaa

SEQ ID NO: 2489459 - RNA, 14 nt, Human
auagaacugaauga

SEQ ID NO: 2489460 - RNA, 18 nt, Human
auagaacucugaaaugaa

SEQ ID NO: 2489461 - RNA, 13 nt, Human
auagaacagugcu

SEQ ID NO: 2489462 - RNA, 15 nt, Human
auagaacucugggcu

SEQ ID NO: 2489463 - RNA, 13 nt, Human
auagaagcuguag

SEQ ID NO: 2489464 - RNA, 14 nt, Human
auagaagcuguagu

SEQ ID NO: 2489465 - RNA, 19 nt, Human
auagaaggcuauggggaua

SEQ ID NO: 2489466 - RNA, 19 nt, Human
auagaaggauguacauuuc

SEQ ID NO: 2489467 - RNA, 16 nt, Human
auagaaauuuccagag

SEQ ID NO: 2489468 - RNA, 17 nt, Human
auagaacagagaaagag

SEQ ID NO: 2489469 - RNA, 21 nt, Human
auagaacucaguuuuaacuag

SEQ ID NO: 2489470 - RNA, 22 nt, Human
auagaaaugcugguuuuucagu

SEQ ID NO: 2489471 - RNA, 22 nt, Human
auacuguauuaagagugaaaau

SEQ ID NO: 2489472 - RNA, 20 nt, Human
auacuguauuaagagugaaa

SEQ ID NO: 2489473 - RNA, 15 nt, Human
auagaaauuuccaga

SEQ ID NO: 2489474 - RNA, 19 nt, Human
auagaaaugcugguuuuuc

SEQ ID NO: 2489475 - RNA, 16 nt, Human
auacuguaaagaaaga

SEQ ID NO: 2489476 - RNA, 18 nt, Human
auacuguaaagaaagaga

SEQ ID NO: 2489477 - RNA, 19 nt, Human
auacuguaaagaaagagag

SEQ ID NO: 2489478 - RNA, 20 nt, Human
auacuguaaagaaagagaga

SEQ ID NO: 2489479 - RNA, 21 nt, Human
auacuguaaagaaagagagaa

SEQ ID NO: 2489480 - RNA, 22 nt, Human
auacuguaaagaaagagagaaa

SEQ ID NO: 2489481 - RNA, 12 nt, Human
auacuguaacac

SEQ ID NO: 2489482 - RNA, 23 nt, Human
auacuguaaagaaagagagaaaa

SEQ ID NO: 2489483 - RNA, 22 nt, Human
auacuggccucgccuggccuga

SEQ ID NO: 2489484 - RNA, 20 nt, Human
auacuguacaaugacuuuau

SEQ ID NO: 2489485 - RNA, 16 nt, Human
auacuguacuuaauaa

SEQ ID NO: 2489486 - RNA, 17 nt, Human
auacuguacuuaauaaa

SEQ ID NO: 2489487 - RNA, 16 nt, Human
auacuguauuaagagu

SEQ ID NO: 2489488 - RNA, 15 nt, Human
auacuguauuaagag

SEQ ID NO: 2489489 - RNA, 13 nt, Human
auacuguauuaag

SEQ ID NO: 2489490 - RNA, 13 nt, Human
auagaaaugcugg

SEQ ID NO: 2489491 - RNA, 22 nt, Human
auagaauaaaauuuuuaaucuu

SEQ ID NO: 2489492 - RNA, 19 nt, Human
auagaauaaaauuuuuaau

SEQ ID NO: 2489493 - RNA, 14 nt, Human
auagaauaaaauuu

SEQ ID NO: 2489494 - RNA, 17 nt, Human
auagaauuaacacauga

SEQ ID NO: 2489495 - RNA, 19 nt, Human
auagaauauaauuaucgga

SEQ ID NO: 2489496 - RNA, 22 nt, Human
auagaauauuuauuaccucuga

SEQ ID NO: 2489497 - RNA, 19 nt, Human
auagaauauuuauuaccuc

SEQ ID NO: 2489498 - RNA, 13 nt, Human
auagaauauuuau

SEQ ID NO: 2489499 - RNA, 12 nt, Human
auagaauauuua

SEQ ID NO: 2489500 - RNA, 16 nt, Human
auagacaauuuauuau

SEQ ID NO: 2489501 - RNA, 22 nt, Human
auagacaauuuauuauggcaca

SEQ ID NO: 2489502 - RNA, 14 nt, Human
auagaauuuccaau

SEQ ID NO: 2489503 - RNA, 22 nt, Human
auagacacuccccgaagucuuu

SEQ ID NO: 2489504 - RNA, 23 nt, Human
auagacaauuuauuauggcacau

SEQ ID NO: 2489505 - RNA, 20 nt, Human
auagacaguauauuuauagu

SEQ ID NO: 2489506 - RNA, 21 nt, Human
auagaguguacuuaacuauuc

SEQ ID NO: 2489507 - RNA, 19 nt, Human
auagaguguacuuaacuau

SEQ ID NO: 2489508 - RNA, 14 nt, Human
auagaguguacuua

SEQ ID NO: 2489509 - RNA, 18 nt, Human
auagauaggucagugcaa

SEQ ID NO: 2489510 - RNA, 18 nt, Human
auagaggcuucuccgcca

SEQ ID NO: 2489511 - RNA, 20 nt, Human
auagaggcuagcuucugcuu

SEQ ID NO: 2489512 - RNA, 19 nt, Human
auagaggcuagcuucugcu

SEQ ID NO: 2489513 - RNA, 12 nt, Human
auagaggcuagc

SEQ ID NO: 2489514 - RNA, 13 nt, Human
auagagcuguauu

SEQ ID NO: 2489515 - RNA, 19 nt, Human
auagaggcuaaauuacuca

SEQ ID NO: 2489516 - RNA, 14 nt, Human
auagaguauaugca

SEQ ID NO: 2489517 - RNA, 13 nt, Human
auagagucuugcu

SEQ ID NO: 2489518 - RNA, 15 nt, Human
auagaguauaugcac

SEQ ID NO: 2489519 - RNA, 14 nt, Human
auagagggccaaga

SEQ ID NO: 2489520 - RNA, 23 nt, Human
auagaggcuucuccgccagccuc

SEQ ID NO: 2489521 - RNA, 22 nt, Human
auagaggcuucuccgccagccu

SEQ ID NO: 2489522 - RNA, 21 nt, Human
auagaggcuucuccgccagcc

SEQ ID NO: 2489523 - RNA, 16 nt, Human
auagagguaccagcaa

SEQ ID NO: 2489524 - RNA, 15 nt, Human
auagaggugagggaa

SEQ ID NO: 2489525 - RNA, 22 nt, Human
auagaggugagggaagccugaa

SEQ ID NO: 2489526 - RNA, 22 nt, Human
auagagcaaaauugauguguuu

SEQ ID NO: 2489527 - RNA, 21 nt, Human
auagagcaaaauugauguguu

SEQ ID NO: 2489528 - RNA, 17 nt, Human
auagagcaaaauugaug

SEQ ID NO: 2489529 - RNA, 15 nt, Human
auagagcaaaauuga

SEQ ID NO: 2489530 - RNA, 13 nt, Human
auagagccugagg

SEQ ID NO: 2489531 - RNA, 15 nt, Human
auagagccugaggga

SEQ ID NO: 2489532 - RNA, 14 nt, Human
auagagcuguauua

SEQ ID NO: 2489533 - RNA, 21 nt, Human
auagagcaccuaguccaguga

SEQ ID NO: 2489534 - RNA, 21 nt, Human
auagagagggagaagaaguca

SEQ ID NO: 2489535 - RNA, 14 nt, Human
auagagagagacca

SEQ ID NO: 2489536 - RNA, 16 nt, Human
auagagauguuuuuaa

SEQ ID NO: 2489537 - RNA, 14 nt, Human
auagagaucauccu

SEQ ID NO: 2489538 - RNA, 18 nt, Human
auagagagggagaagaag

SEQ ID NO: 2489539 - RNA, 18 nt, Human
auagacccacaagaggca

SEQ ID NO: 2489540 - RNA, 15 nt, Human
auagacccucucaag

SEQ ID NO: 2489541 - RNA, 16 nt, Human
auagacauuuguaaau

SEQ ID NO: 2489542 - RNA, 15 nt, Human
auagacuuaaaucuc

SEQ ID NO: 2489543 - RNA, 12 nt, Human
auagaugugugg

SEQ ID NO: 2489544 - RNA, 13 nt, Human
auagaugugugga

SEQ ID NO: 2489545 - RNA, 11 nt, Human
auagaugugug

SEQ ID NO: 2489546 - RNA, 15 nt, Human
auagaugggaaugaa

SEQ ID NO: 2489547 - RNA, 13 nt, Human
auagaugggaaug

SEQ ID NO: 2489548 - RNA, 13 nt, Human
auagaugggucug

SEQ ID NO: 2489549 - RNA, 23 nt, Human
auagaugcuggcccagggcccag

SEQ ID NO: 2489550 - RNA, 12 nt, Human
auagaugggaau

SEQ ID NO: 2489551 - RNA, 22 nt, Human
auagaugggucuggcugagcug

SEQ ID NO: 2489552 - RNA, 19 nt, Human
auagaugggaaugaagcuu

SEQ ID NO: 2489553 - RNA, 22 nt, Human
auagauguagauaaacucagaa

SEQ ID NO: 2489554 - RNA, 23 nt, Human
auagaugggucuggcugagcuga

SEQ ID NO: 2489555 - RNA, 19 nt, Human
auagaugucccuuucuugg

SEQ ID NO: 2489556 - RNA, 22 nt, Human
auagaugucccuuucuuggcca

SEQ ID NO: 2489557 - RNA, 23 nt, Human
auagaugucccuuucuuggccag

SEQ ID NO: 2489558 - RNA, 21 nt, Human
auagaugcaagauauuuauau

SEQ ID NO: 2489559 - RNA, 19 nt, Human
auagaugcaagauauuuau

SEQ ID NO: 2489560 - RNA, 16 nt, Human
auagaugcaagauauu

SEQ ID NO: 2489561 - RNA, 16 nt, Human
auagaucccccagacu

SEQ ID NO: 2489562 - RNA, 15 nt, Human
auagaugcuggccca

SEQ ID NO: 2489563 - RNA, 16 nt, Human
auagaugcuggcccag

SEQ ID NO: 2489564 - RNA, 17 nt, Human
auagaugcuggcccagg

SEQ ID NO: 2489565 - RNA, 20 nt, Human
auagaugcuggcccagggcc

SEQ ID NO: 2489566 - RNA, 20 nt, Human
auagauaagaguagaaacug

SEQ ID NO: 2489567 - RNA, 15 nt, Human
auagaguuugcuauu

SEQ ID NO: 2489568 - RNA, 16 nt, Human
auagaguuuaacacaa

SEQ ID NO: 2489569 - RNA, 14 nt, Human
auagaguguuauca

SEQ ID NO: 2489570 - RNA, 15 nt, Human
auagaucccccagac

SEQ ID NO: 2489571 - RNA, 13 nt, Human
auagauuugaccu

SEQ ID NO: 2489572 - RNA, 23 nt, Human
auagauuggagccaccaugccca

SEQ ID NO: 2489573 - RNA, 21 nt, Human
auagauuauaacuugucuaaa

SEQ ID NO: 2489574 - RNA, 15 nt, Human
auagauuauaacuug

SEQ ID NO: 2489575 - RNA, 14 nt, Human
auagauuauaacuu

SEQ ID NO: 2489576 - RNA, 18 nt, Human
auagaugucuagguacuu

SEQ ID NO: 2489577 - RNA, 14 nt, Human
auagauguguggac

SEQ ID NO: 2489578 - RNA, 15 nt, Human
auacucauguguaug

SEQ ID NO: 2489579 - RNA, 13 nt, Human
auacucaugugua

SEQ ID NO: 2489580 - RNA, 20 nt, Human
uuauuccugauaauaauuga

SEQ ID NO: 2489581 - RNA, 14 nt, Human
auacucauguguau

SEQ ID NO: 2489582 - RNA, 11 nt, Human
auacucccauc

SEQ ID NO: 2489583 - RNA, 16 nt, Human
auacucauuaggaugg

SEQ ID NO: 2489584 - RNA, 17 nt, Human
uuauuccugauaauaau

SEQ ID NO: 2489585 - RNA, 20 nt, Human
uuauuccuccugcucauauu

SEQ ID NO: 2489586 - RNA, 16 nt, Human
uuauuccuccugcuca

SEQ ID NO: 2489587 - RNA, 22 nt, Human
uuauuccuauauaguuuauuga

SEQ ID NO: 2489588 - RNA, 19 nt, Human
uuauuccacaucuacguuu

SEQ ID NO: 2489589 - RNA, 13 nt, Human
uuauuccacaucu

SEQ ID NO: 2489590 - RNA, 12 nt, Human
uuauuccacauc

SEQ ID NO: 2489591 - RNA, 14 nt, Human
uuauucauuugagu

SEQ ID NO: 2489592 - RNA, 20 nt, Human
uuauucauuuaaaaugauua

SEQ ID NO: 2489593 - RNA, 18 nt, Human
uuauucauuuaaaaugau

SEQ ID NO: 2489594 - RNA, 17 nt, Human
uuauucauuuaaaauga

SEQ ID NO: 2489595 - RNA, 17 nt, Human
uuauuccagaaugcugu

SEQ ID NO: 2489596 - RNA, 20 nt, Human
uuauuccagaaugcuguaca

SEQ ID NO: 2489597 - RNA, 22 nt, Human
uuauuccagaaugcuguacauc

SEQ ID NO: 2489598 - RNA, 20 nt, Human
uuauuccauauucauguaaa

SEQ ID NO: 2489599 - RNA, 19 nt, Human
uuauuccauauucauguaa

SEQ ID NO: 2489600 - RNA, 20 nt, Human
uuauuccccauucuuccuag

SEQ ID NO: 2489601 - RNA, 16 nt, Human
uuauucccuguacaau

SEQ ID NO: 2489602 - RNA, 19 nt, Human
uuauucccuuucacaaaau

SEQ ID NO: 2489603 - RNA, 20 nt, Human
uuauuccuauauaguuuauu

SEQ ID NO: 2489604 - RNA, 18 nt, Human
auacucuuauagacaaca

SEQ ID NO: 2489605 - RNA, 22 nt, Human
auacucuuaggaagagaaacca

SEQ ID NO: 2489606 - RNA, 21 nt, Human
auacucuuaggaagagaaacc

SEQ ID NO: 2489607 - RNA, 16 nt, Human
auacucugcuuagaau

SEQ ID NO: 2489608 - RNA, 19 nt, Human
auacucuuaggaagagaaa

SEQ ID NO: 2489609 - RNA, 15 nt, Human
auacucugucagaug

SEQ ID NO: 2489610 - RNA, 16 nt, Human
auacucugucagaugg

SEQ ID NO: 2489611 - RNA, 12 nt, Human
auacucugucag

SEQ ID NO: 2489612 - RNA, 13 nt, Human
auacucugucaga

SEQ ID NO: 2489613 - RNA, 14 nt, Human
auacucugucagau

SEQ ID NO: 2489614 - RNA, 14 nt, Human
auacucccaucugu

SEQ ID NO: 2489615 - RNA, 17 nt, Human
auacuccuccaagguua

SEQ ID NO: 2489616 - RNA, 22 nt, Human
auacucuagauuuuguuuugcu

SEQ ID NO: 2489617 - RNA, 21 nt, Human
auacucuagauuuuguuuugc

SEQ ID NO: 2489618 - RNA, 20 nt, Human
auacucuagauuuuguuuug

SEQ ID NO: 2489619 - RNA, 15 nt, Human
auacucuagauuuug

SEQ ID NO: 2489620 - RNA, 17 nt, Human
auacucuagaugaaguu

SEQ ID NO: 2489621 - RNA, 23 nt, Human
auacucuagaugaaguuuuacau

SEQ ID NO: 2489622 - RNA, 22 nt, Human
auacugcgacuuucugccugga

SEQ ID NO: 2489623 - RNA, 20 nt, Human
auacugcgacuuucugccug

SEQ ID NO: 2489624 - RNA, 15 nt, Human
auacugcuacuguaa

SEQ ID NO: 2489625 - RNA, 19 nt, Human
auacugcgacuuucugccu

SEQ ID NO: 2489626 - RNA, 16 nt, Human
auacugcuacuguaau

SEQ ID NO: 2489627 - RNA, 19 nt, Human
auacugcuacuguaauuuu

SEQ ID NO: 2489628 - RNA, 20 nt, Human
auacugcuacuguaauuuua

SEQ ID NO: 2489629 - RNA, 22 nt, Human
auacugcuacuguaauuuuaua

SEQ ID NO: 2489630 - RNA, 13 nt, Human
auacuggaaguuu

SEQ ID NO: 2489631 - RNA, 12 nt, Human
auacuguaaaga

SEQ ID NO: 2489632 - RNA, 13 nt, Human
auacuguaaagaa

SEQ ID NO: 2489633 - RNA, 14 nt, Human
auacuguaaagaaa

SEQ ID NO: 2489634 - RNA, 15 nt, Human
auacuguaaagaaag

SEQ ID NO: 2489635 - RNA, 15 nt, Human
auacuggccuggacu

SEQ ID NO: 2489636 - RNA, 14 nt, Human
auacuggccuggac

SEQ ID NO: 2489637 - RNA, 14 nt, Human
auacuggcugguga

SEQ ID NO: 2489638 - RNA, 21 nt, Human
auacuggugcagucauuauga

SEQ ID NO: 2489639 - RNA, 14 nt, Human
auacuggaaguuuu

SEQ ID NO: 2489640 - RNA, 16 nt, Human
auacuggaaguuuugc

SEQ ID NO: 2489641 - RNA, 17 nt, Human
auacuggaaguuuugca

SEQ ID NO: 2489642 - RNA, 18 nt, Human
auacuggaaguuuugcau

SEQ ID NO: 2489643 - RNA, 19 nt, Human
auacuggaaguuuugcauu

SEQ ID NO: 2489644 - RNA, 20 nt, Human
auacuggaaguuuugcauuu

SEQ ID NO: 2489645 - RNA, 17 nt, Human
auacuggccucgccugg

SEQ ID NO: 2489646 - RNA, 23 nt, Human
auacugcaauuaaagugauacug

SEQ ID NO: 2489647 - RNA, 14 nt, Human
auacugcaagaaaa

SEQ ID NO: 2489648 - RNA, 16 nt, Human
auacugcaagaaaaug

SEQ ID NO: 2489649 - RNA, 22 nt, Human
auacugagggaccaacugggcc

SEQ ID NO: 2489650 - RNA, 20 nt, Human
auacugaaggaaaaacacaa

SEQ ID NO: 2489651 - RNA, 14 nt, Human
auacugagggacca

SEQ ID NO: 2489652 - RNA, 19 nt, Human
auacugcagggccaggacu

SEQ ID NO: 2489653 - RNA, 17 nt, Human
auacugcagggccagga

SEQ ID NO: 2489654 - RNA, 15 nt, Human
auacugcagggccag

SEQ ID NO: 2489655 - RNA, 14 nt, Human
auacugcagggcca

SEQ ID NO: 2489656 - RNA, 15 nt, Human
auacugcauacuuuu

SEQ ID NO: 2489657 - RNA, 21 nt, Human
auacugcauacuuuuuaaaug

SEQ ID NO: 2489658 - RNA, 17 nt, Human
auacugccagaugcuga

SEQ ID NO: 2489659 - RNA, 16 nt, Human
auacugccagaugcug

SEQ ID NO: 2489660 - RNA, 15 nt, Human
auacugccagaugcu

SEQ ID NO: 2489661 - RNA, 19 nt, Human
auacugccagaugcugaug

SEQ ID NO: 2489662 - RNA, 18 nt, Human
auacugccagaugcugau

SEQ ID NO: 2489663 - RNA, 21 nt, Human
auacugccagaugcugauguu

SEQ ID NO: 2489664 - RNA, 22 nt, Human
auacugcccggggcagcugcca

SEQ ID NO: 2489665 - RNA, 17 nt, Human
auacucuuucuguauau

SEQ ID NO: 2489666 - RNA, 22 nt, Human
auacucuuucuguauauacuuu

SEQ ID NO: 2489667 - RNA, 23 nt, Human
auacucuuucuguauauacuuuu

SEQ ID NO: 2489668 - RNA, 15 nt, Human
auacucuuucuguau

SEQ ID NO: 2489669 - RNA, 16 nt, Human
auacucuuucuguaua

SEQ ID NO: 2489670 - RNA, 14 nt, Human
auacucuuucugua

SEQ ID NO: 2489671 - RNA, 13 nt, Human
auacugaagaugc

SEQ ID NO: 2489672 - RNA, 11 nt, Human
auacugaagau

SEQ ID NO: 2489673 - RNA, 15 nt, Human
auacugaaggaaaaa

SEQ ID NO: 2489674 - RNA, 14 nt, Human
auacugaaggaaaa

SEQ ID NO: 2489675 - RNA, 13 nt, Human
auacugaaggaaa

SEQ ID NO: 2489676 - RNA, 12 nt, Human
auacugaaggaa

SEQ ID NO: 2489677 - RNA, 22 nt, Human
auacugaaggaaaaacacaagc

SEQ ID NO: 2489678 - RNA, 19 nt, Human
auacugacugagaauauaa

SEQ ID NO: 2489679 - RNA, 22 nt, Human
uuauuaucuaaaguguguuguu

SEQ ID NO: 2489680 - RNA, 16 nt, Human
uuauuauuauuuuuua

SEQ ID NO: 2489681 - RNA, 13 nt, Human
uuauuaugcauga

SEQ ID NO: 2489682 - RNA, 16 nt, Human
uuauuauuuucaccug

SEQ ID NO: 2489683 - RNA, 12 nt, Human
uuauucaauaaa

SEQ ID NO: 2489684 - RNA, 16 nt, Human
uuauucaaguuauugu

SEQ ID NO: 2489685 - RNA, 16 nt, Human
uuauuauugaaauugu

SEQ ID NO: 2489686 - RNA, 15 nt, Human
uuauuauugaaauug

SEQ ID NO: 2489687 - RNA, 14 nt, Human
uuauuauuacuguu

SEQ ID NO: 2489688 - RNA, 22 nt, Human
uuauuauuuguguuuuaauuua

SEQ ID NO: 2489689 - RNA, 23 nt, Human
uuauucaggaaaagccucugugu

SEQ ID NO: 2489690 - RNA, 22 nt, Human
uuauucaggaaaagccucugug

SEQ ID NO: 2489691 - RNA, 21 nt, Human
uuauucaggaaaagccucugu

SEQ ID NO: 2489692 - RNA, 20 nt, Human
uuauucaggaaaagccucug

SEQ ID NO: 2489693 - RNA, 13 nt, Human
uuauucaguguca

SEQ ID NO: 2489694 - RNA, 14 nt, Human
uuauucagugucac

SEQ ID NO: 2489695 - RNA, 12 nt, Human
uuauucauaauu

SEQ ID NO: 2489696 - RNA, 23 nt, Human
uuauucauaagccaauuuuucug

SEQ ID NO: 2489697 - RNA, 16 nt, Human
uuauucauuuaaaaug

SEQ ID NO: 2489698 - RNA, 13 nt, Human
uuauucauuuaaa

SEQ ID NO: 2489699 - RNA, 12 nt, Human
uuauucauuuaa

SEQ ID NO: 2489700 - RNA, 20 nt, Human
uuauucacuuuuauuuagca

SEQ ID NO: 2489701 - RNA, 20 nt, Human
uuauucagcuucauuugugu

SEQ ID NO: 2489702 - RNA, 15 nt, Human
uuauucagcuucauu

SEQ ID NO: 2489703 - RNA, 21 nt, Human
uuauucaauaaaguauuuaau

SEQ ID NO: 2489704 - RNA, 20 nt, Human
uuauucaauaaaguauuuaa

SEQ ID NO: 2489705 - RNA, 19 nt, Human
uuauucaauuccucuggga

SEQ ID NO: 2489706 - RNA, 18 nt, Human
uuauucaauuccucuggg

SEQ ID NO: 2489707 - RNA, 19 nt, Human
uuauucaauaaaguauuua

SEQ ID NO: 2489708 - RNA, 17 nt, Human
uuauucaauaaaguauu

SEQ ID NO: 2489709 - RNA, 14 nt, Human
uuauucaauaaagu

SEQ ID NO: 2489710 - RNA, 15 nt, Human
uuauuaguuaauaua

SEQ ID NO: 2489711 - RNA, 14 nt, Human
uuauuaguuuacau

SEQ ID NO: 2489712 - RNA, 20 nt, Human
uuauuaguguaugcuuugaa

SEQ ID NO: 2489713 - RNA, 24 nt, Human
uuauuaguaccauaguaccauuua

SEQ ID NO: 2489714 - RNA, 20 nt, Human
uuauuaguaagaaaacauca

SEQ ID NO: 2489715 - RNA, 14 nt, Human
uuauuauauuuaca

SEQ ID NO: 2489716 - RNA, 19 nt, Human
uuauguuaaaacugggaca

SEQ ID NO: 2489717 - RNA, 13 nt, Human
uuauguuaaacua

SEQ ID NO: 2489718 - RNA, 12 nt, Human
uuauguuaaacu

SEQ ID NO: 2489719 - RNA, 11 nt, Human
uuauguuaaac

SEQ ID NO: 2489720 - RNA, 10 nt, Human
uuauguuaaa

SEQ ID NO: 2489721 - RNA, 17 nt, Human
uuauguuaaaucaauaa

SEQ ID NO: 2489722 - RNA, 14 nt, Human
uuauguuaaacuag

SEQ ID NO: 2489723 - RNA, 22 nt, Human
uuauguuaagggaagaauucca

SEQ ID NO: 2489724 - RNA, 15 nt, Human
uuauguuacaucugu

SEQ ID NO: 2489725 - RNA, 20 nt, Human
uuauguuauuuauauauugg

SEQ ID NO: 2489726 - RNA, 12 nt, Human
uuauuaugcaug

SEQ ID NO: 2489727 - RNA, 16 nt, Human
uuauuaucuaaagugu

SEQ ID NO: 2489728 - RNA, 15 nt, Human
uuauuauauuuacaa

SEQ ID NO: 2489729 - RNA, 18 nt, Human
uuauuauaauuguaucag

SEQ ID NO: 2489730 - RNA, 15 nt, Human
uuauuauaauuguau

SEQ ID NO: 2489731 - RNA, 20 nt, Human
uuauuauaauuguaucagag

SEQ ID NO: 2489732 - RNA, 12 nt, Human
uuauuauaauug

SEQ ID NO: 2489733 - RNA, 18 nt, Human
uuauuaguuuacaucauu

SEQ ID NO: 2489734 - RNA, 15 nt, Human
uuauuaguuuacauc

SEQ ID NO: 2489735 - RNA, 15 nt, Human
auaccuuugccuugg

SEQ ID NO: 2489736 - RNA, 14 nt, Human
auaccuuuuuuaga

SEQ ID NO: 2489737 - RNA, 13 nt, Human
auacgacuuuauu

SEQ ID NO: 2489738 - RNA, 17 nt, Human
auaccacuuuuguucuu

SEQ ID NO: 2489739 - RNA, 18 nt, Human
auaccacuuuuguucuug

SEQ ID NO: 2489740 - RNA, 16 nt, Human
auaccacccaaugcug

SEQ ID NO: 2489741 - RNA, 14 nt, Human
auacaugguuguga

SEQ ID NO: 2489742 - RNA, 20 nt, Human
auacaugguugugaccugag

SEQ ID NO: 2489743 - RNA, 14 nt, Human
auacguacacauuu

SEQ ID NO: 2489744 - RNA, 15 nt, Human
auacguacacauuuu

SEQ ID NO: 2489745 - RNA, 16 nt, Human
auacguacacauuuua

SEQ ID NO: 2489746 - RNA, 17 nt, Human
auacgcacuacaugugg

SEQ ID NO: 2489747 - RNA, 13 nt, Human
auacguacacauu

SEQ ID NO: 2489748 - RNA, 23 nt, Human
auacgcaacauaauuaaauuuug

SEQ ID NO: 2489749 - RNA, 16 nt, Human
auacgcacuacaugug

SEQ ID NO: 2489750 - RNA, 21 nt, Human
auacgccuguaguccuagcca

SEQ ID NO: 2489751 - RNA, 17 nt, Human
auacgacuuuauuuucu

SEQ ID NO: 2489752 - RNA, 13 nt, Human
auacgauaaauaa

SEQ ID NO: 2489753 - RNA, 13 nt, Human
auacuaaccagca

SEQ ID NO: 2489754 - RNA, 13 nt, Human
auacguguagcua

SEQ ID NO: 2489755 - RNA, 21 nt, Human
auacgugaaaauuauuugaaa

SEQ ID NO: 2489756 - RNA, 14 nt, Human
auacguccaccaug

SEQ ID NO: 2489757 - RNA, 19 nt, Human
auacuaaccagcagaaaug

SEQ ID NO: 2489758 - RNA, 20 nt, Human
auacuaaccagcagaaaugc

SEQ ID NO: 2489759 - RNA, 15 nt, Human
auacuauauuuuagg

SEQ ID NO: 2489760 - RNA, 17 nt, Human
auacuauggaauuucuc

SEQ ID NO: 2489761 - RNA, 20 nt, Human
auacuaguugugaccuuagu

SEQ ID NO: 2489762 - RNA, 16 nt, Human
auacuaguugugaccu

SEQ ID NO: 2489763 - RNA, 14 nt, Human
auacuaguugugac

SEQ ID NO: 2489764 - RNA, 14 nt, Human
auacuauauuuaug

SEQ ID NO: 2489765 - RNA, 21 nt, Human
auacuaaaaguucuucuccaa

SEQ ID NO: 2489766 - RNA, 13 nt, Human
auacuaguuguga

SEQ ID NO: 2489767 - RNA, 13 nt, Human
auacuaaaaauca

SEQ ID NO: 2489768 - RNA, 18 nt, Human
auacuaaaaaucaugaga

SEQ ID NO: 2489769 - RNA, 19 nt, Human
uuauauuugaaauauugac

SEQ ID NO: 2489770 - RNA, 19 nt, Human
uuauauuuuacuacugugg

SEQ ID NO: 2489771 - RNA, 13 nt, Human
uuauauuuuuaaa

SEQ ID NO: 2489772 - RNA, 15 nt, Human
uuauauuuuuauaga

SEQ ID NO: 2489773 - RNA, 15 nt, Human
uuaucaagugucuuc

SEQ ID NO: 2489774 - RNA, 17 nt, Human
uuaucaagugucuucca

SEQ ID NO: 2489775 - RNA, 16 nt, Human
uuaucaaaaauuucau

SEQ ID NO: 2489776 - RNA, 19 nt, Human
uuaucaccagcugccucuu

SEQ ID NO: 2489777 - RNA, 17 nt, Human
uuaucaccagcugccuc

SEQ ID NO: 2489778 - RNA, 20 nt, Human
uuaucaccagagagggacug

SEQ ID NO: 2489779 - RNA, 22 nt, Human
uuaucaccacaguaaguuccua

SEQ ID NO: 2489780 - RNA, 19 nt, Human
uuaucacauguauguuuug

SEQ ID NO: 2489781 - RNA, 18 nt, Human
uuaucacauguauguuuu

SEQ ID NO: 2489782 - RNA, 18 nt, Human
uuaucaccacaguaaguu

SEQ ID NO: 2489783 - RNA, 18 nt, Human
uuaucacauuauuugcau

SEQ ID NO: 2489784 - RNA, 17 nt, Human
uuaucacauguauguuu

SEQ ID NO: 2489785 - RNA, 16 nt, Human
uuaucacauguauguu

SEQ ID NO: 2489786 - RNA, 15 nt, Human
uuaucacauguaugu

SEQ ID NO: 2489787 - RNA, 17 nt, Human
uuauaaacuuuaccuuu

SEQ ID NO: 2489788 - RNA, 18 nt, Human
uuauaaacuuuaccuuuu

SEQ ID NO: 2489789 - RNA, 16 nt, Human
uuauaaacuuuuuucu

SEQ ID NO: 2489790 - RNA, 12 nt, Human
uuauaaacuuuu

SEQ ID NO: 2489791 - RNA, 22 nt, Human
auacaacccuggcauuaugucc

SEQ ID NO: 2489792 - RNA, 20 nt, Human
auacaacauguagcugaguu

SEQ ID NO: 2489793 - RNA, 21 nt, Human
auacaacagugcuaaaaaugg

SEQ ID NO: 2489794 - RNA, 20 nt, Human
auacaacagugcuaaaaaug

SEQ ID NO: 2489795 - RNA, 18 nt, Human
auacaacagugcuaaaaa

SEQ ID NO: 2489796 - RNA, 16 nt, Human
auacaacagugcuaaa

SEQ ID NO: 2489797 - RNA, 15 nt, Human
auacaacagugcuaa

SEQ ID NO: 2489798 - RNA, 14 nt, Human
auacaacagugcua

SEQ ID NO: 2489799 - RNA, 12 nt, Human
auacaacagugc

SEQ ID NO: 2489800 - RNA, 15 nt, Human
uuauaaauauauuua

SEQ ID NO: 2489801 - RNA, 22 nt, Human
uuauaaacuuuuuucuuacugu

SEQ ID NO: 2489802 - RNA, 23 nt, Human
auacagacacuaaguuauaguau

SEQ ID NO: 2489803 - RNA, 19 nt, Human
auacagacacuaaguuaua

SEQ ID NO: 2489804 - RNA, 18 nt, Human
auacagacacuaaguuau

SEQ ID NO: 2489805 - RNA, 15 nt, Human
auacagacacuaagu

SEQ ID NO: 2489806 - RNA, 14 nt, Human
auacagacacuaag

SEQ ID NO: 2489807 - RNA, 12 nt, Human
auacagacacua

SEQ ID NO: 2489808 - RNA, 22 nt, Human
auacagaauugugucugcagga

SEQ ID NO: 2489809 - RNA, 21 nt, Human
auacagaauugugucugcagg

SEQ ID NO: 2489810 - RNA, 21 nt, Human
auacagaccgaacuguuguau

SEQ ID NO: 2489811 - RNA, 18 nt, Human
auacagaccgaacuguug

SEQ ID NO: 2489812 - RNA, 20 nt, Human
auacagaccgaacuguugua

SEQ ID NO: 2489813 - RNA, 16 nt, Human
auacagaggcaacugc

SEQ ID NO: 2489814 - RNA, 17 nt, Human
auacagaggcaacugca

SEQ ID NO: 2489815 - RNA, 20 nt, Human
auacagaauugugucugcag

SEQ ID NO: 2489816 - RNA, 23 nt, Human
auacagaacucuuucaaaaccuu

SEQ ID NO: 2489817 - RNA, 18 nt, Human
auacagaacucuuucaaa

SEQ ID NO: 2489818 - RNA, 20 nt, Human
auacagaacucuuucaaaac

SEQ ID NO: 2489819 - RNA, 15 nt, Human
auacagaacucuuuc

SEQ ID NO: 2489820 - RNA, 16 nt, Human
auacagaacucuuuca

SEQ ID NO: 2489821 - RNA, 14 nt, Human
auacagaacucuuu

SEQ ID NO: 2489822 - RNA, 14 nt, Human
auacaauaacauaa

SEQ ID NO: 2489823 - RNA, 23 nt, Human
auacagaaagauggaugugcuuu

SEQ ID NO: 2489824 - RNA, 14 nt, Human
auacaaccugcuug

SEQ ID NO: 2489825 - RNA, 22 nt, Human
auacaagccauucuaaggaaau

SEQ ID NO: 2489826 - RNA, 18 nt, Human
auacaaccugcuugggug

SEQ ID NO: 2489827 - RNA, 16 nt, Human
auacaacuuaaauaau

SEQ ID NO: 2489828 - RNA, 16 nt, Human
auacagggaugguguu

SEQ ID NO: 2489829 - RNA, 17 nt, Human
auacaggaaugaagccu

SEQ ID NO: 2489830 - RNA, 21 nt, Human
auacaggauuugaacucagau

SEQ ID NO: 2489831 - RNA, 21 nt, Human
auacaggaugaugacuaugga

SEQ ID NO: 2489832 - RNA, 19 nt, Human
auacagucuuccauuugca

SEQ ID NO: 2489833 - RNA, 20 nt, Human
auacagucuuccauuugcaa

SEQ ID NO: 2489834 - RNA, 18 nt, Human
auacaguuacucagaauu

SEQ ID NO: 2489835 - RNA, 23 nt, Human
auacaggaaaagcugcugacagu

SEQ ID NO: 2489836 - RNA, 22 nt, Human
auacaggaaaagcugcugacag

SEQ ID NO: 2489837 - RNA, 23 nt, Human
auacagauagauauaugcucugc

SEQ ID NO: 2489838 - RNA, 20 nt, Human
auacaguuacucagaauucu

SEQ ID NO: 2489839 - RNA, 20 nt, Human
auacauaaacaagaccacgu

SEQ ID NO: 2489840 - RNA, 14 nt, Human
auacaguguuauuu

SEQ ID NO: 2489841 - RNA, 15 nt, Human
auacaguguuauuuu

SEQ ID NO: 2489842 - RNA, 23 nt, Human
auacauacaccagcauuccuuuu

SEQ ID NO: 2489843 - RNA, 15 nt, Human
auacauacaccagca

SEQ ID NO: 2489844 - RNA, 21 nt, Human
auacauaagcggcguaaguuu

SEQ ID NO: 2489845 - RNA, 23 nt, Human
auacaguguuauuuucuuugaaa

SEQ ID NO: 2489846 - RNA, 21 nt, Human
auacaugugccgaaugugcag

SEQ ID NO: 2489847 - RNA, 15 nt, Human
auacaugcucuuaga

SEQ ID NO: 2489848 - RNA, 13 nt, Human
auacaugcugcua

SEQ ID NO: 2489849 - RNA, 14 nt, Human
auacauggauaaca

SEQ ID NO: 2489850 - RNA, 15 nt, Human
auacaugcugcuaau

SEQ ID NO: 2489851 - RNA, 22 nt, Human
auacaugguagccaguugaauu

SEQ ID NO: 2489852 - RNA, 10 nt, Human
auacaugcca

SEQ ID NO: 2489853 - RNA, 17 nt, Human
auacauaucuuuauuaa

SEQ ID NO: 2489854 - RNA, 20 nt, Human
auacauaucuuuauuaauca

SEQ ID NO: 2489855 - RNA, 13 nt, Human
auacauaucuuua

SEQ ID NO: 2489856 - RNA, 14 nt, Human
auacauaucuuuau

SEQ ID NO: 2489857 - RNA, 16 nt, Human
auacauaucuuuauua

SEQ ID NO: 2489858 - RNA, 17 nt, Human
uuaucacccagaagaaa

SEQ ID NO: 2489859 - RNA, 18 nt, Human
uuaucacccagaagaaaa

SEQ ID NO: 2489860 - RNA, 19 nt, Human
uuaucacccagaagaaaau

SEQ ID NO: 2489861 - RNA, 21 nt, Human
uuaucacccagaagaaaauag

SEQ ID NO: 2489862 - RNA, 18 nt, Human
uuaucaccgugggcuccc

SEQ ID NO: 2489863 - RNA, 12 nt, Human
uuaucauuuuca

SEQ ID NO: 2489864 - RNA, 16 nt, Human
uuaucauuuucaaaau

SEQ ID NO: 2489865 - RNA, 21 nt, Human
uuaucaccagcugccucuucu

SEQ ID NO: 2489866 - RNA, 19 nt, Human
uuauccacagaaacauuuu

SEQ ID NO: 2489867 - RNA, 18 nt, Human
uuauccaggacucuguca

SEQ ID NO: 2489868 - RNA, 12 nt, Human
uuauccaggacu

SEQ ID NO: 2489869 - RNA, 16 nt, Human
uuauccaccuccaucu

SEQ ID NO: 2489870 - RNA, 22 nt, Human
uuauccaagguguaacucuaau

SEQ ID NO: 2489871 - RNA, 20 nt, Human
uuaucccucaccuguagcag

SEQ ID NO: 2489872 - RNA, 17 nt, Human
uuaucccucaccuguag

SEQ ID NO: 2489873 - RNA, 15 nt, Human
uuaucccucaccugu

SEQ ID NO: 2489874 - RNA, 17 nt, Human
uuauccauauugaguca

SEQ ID NO: 2489875 - RNA, 19 nt, Human
uuauccauauugagucaaa

SEQ ID NO: 2489876 - RNA, 18 nt, Human
uuauccauggggaaggga

SEQ ID NO: 2489877 - RNA, 20 nt, Human
uuaugaagcuuuuaugugaa

SEQ ID NO: 2489878 - RNA, 19 nt, Human
uuaugaaauucacccccuu

SEQ ID NO: 2489879 - RNA, 20 nt, Human
uuaugaaauaaagaaauugc

SEQ ID NO: 2489880 - RNA, 18 nt, Human
uuaugaagaaaaaauaca

SEQ ID NO: 2489881 - RNA, 23 nt, Human
uuaugaagaaaaaauacauuuua

SEQ ID NO: 2489882 - RNA, 14 nt, Human
uuaugaaauaaaga

SEQ ID NO: 2489883 - RNA, 18 nt, Human
uuaugaaagguuuacauu

SEQ ID NO: 2489884 - RNA, 17 nt, Human
uuaugaauuacauuugu

SEQ ID NO: 2489885 - RNA, 16 nt, Human
uuaugaauuacauuug

SEQ ID NO: 2489886 - RNA, 14 nt, Human
uuaugaauuacauu

SEQ ID NO: 2489887 - RNA, 19 nt, Human
uuaugaauauuuacguuuu

SEQ ID NO: 2489888 - RNA, 14 nt, Human
uuaugaaugaaaaa

SEQ ID NO: 2489889 - RNA, 16 nt, Human
uuaugacaucacuugu

SEQ ID NO: 2489890 - RNA, 18 nt, Human
uuaugacaucacuuguac

SEQ ID NO: 2489891 - RNA, 21 nt, Human
uuaugacaucacuuguacaaa

SEQ ID NO: 2489892 - RNA, 23 nt, Human
uuaugacaucacuuguacaaaau

SEQ ID NO: 2489893 - RNA, 11 nt, Human
uuaugacucca

SEQ ID NO: 2489894 - RNA, 21 nt, Human
uuaugaauuacauuuguauaa

SEQ ID NO: 2489895 - RNA, 14 nt, Human
uuaugacaguuaua

SEQ ID NO: 2489896 - RNA, 15 nt, Human
uuaugaguuugcuua

SEQ ID NO: 2489897 - RNA, 20 nt, Human
uuaugauacuugaaaauuaa

SEQ ID NO: 2489898 - RNA, 13 nt, Human
uuaugaguuuuug

SEQ ID NO: 2489899 - RNA, 15 nt, Human
uuaugaguuuuugau

SEQ ID NO: 2489900 - RNA, 21 nt, Human
uuaugaguuuuugauagcuuu

SEQ ID NO: 2489901 - RNA, 23 nt, Human
uuaugaguuuuugauagcuuuau

SEQ ID NO: 2489902 - RNA, 19 nt, Human
uuaugacuucauuaauaau

SEQ ID NO: 2489903 - RNA, 22 nt, Human
uuaugacuucauuaauaauaaa

SEQ ID NO: 2489904 - RNA, 18 nt, Human
uuaugaccucuuccuuua

SEQ ID NO: 2489905 - RNA, 18 nt, Human
uuaugagcucuucauguu

SEQ ID NO: 2489906 - RNA, 18 nt, Human
uuaugagggccacggguc

SEQ ID NO: 2489907 - RNA, 13 nt, Human
uuaugagggccac

SEQ ID NO: 2489908 - RNA, 17 nt, Human
uuaugucaucauacaug

SEQ ID NO: 2489909 - RNA, 18 nt, Human
uuauguccacuguguaua

SEQ ID NO: 2489910 - RNA, 17 nt, Human
uuauguccacuguguau

SEQ ID NO: 2489911 - RNA, 15 nt, Human
uuauguccacugugu

SEQ ID NO: 2489912 - RNA, 22 nt, Human
uuaugucccuucacauaguuuu

SEQ ID NO: 2489913 - RNA, 18 nt, Human
uuaugucccuucacauag

SEQ ID NO: 2489914 - RNA, 17 nt, Human
uuaugucccuucacaua

SEQ ID NO: 2489915 - RNA, 15 nt, Human
uuaugucucuucuga

SEQ ID NO: 2489916 - RNA, 17 nt, Human
uuaugucuauuuaagcc

SEQ ID NO: 2489917 - RNA, 13 nt, Human
uuaugucuaaaga

SEQ ID NO: 2489918 - RNA, 13 nt, Human
uuaugugaaacau

SEQ ID NO: 2489919 - RNA, 19 nt, Human
uuaugucugcugaauaaua

SEQ ID NO: 2489920 - RNA, 21 nt, Human
uuaugucugcugaauaauaaa

SEQ ID NO: 2489921 - RNA, 18 nt, Human
uuauguaagagcaccuuc

SEQ ID NO: 2489922 - RNA, 16 nt, Human
uuauguaauaauguga

SEQ ID NO: 2489923 - RNA, 17 nt, Human
uuauguaauaaugugaa

SEQ ID NO: 2489924 - RNA, 15 nt, Human
uuauguagaugugca

SEQ ID NO: 2489925 - RNA, 15 nt, Human
uuauguaaucuaugu

SEQ ID NO: 2489926 - RNA, 21 nt, Human
uuauguaauaaugugaaucau

SEQ ID NO: 2489927 - RNA, 19 nt, Human
uuauguaguaauugacaug

SEQ ID NO: 2489928 - RNA, 21 nt, Human
uuauguauauuuaaaagaaag

SEQ ID NO: 2489929 - RNA, 15 nt, Human
uuauguaguaauuga

SEQ ID NO: 2489930 - RNA, 16 nt, Human
uuauguaguaauugac

SEQ ID NO: 2489931 - RNA, 16 nt, Human
uuauguagaugugcau

SEQ ID NO: 2489932 - RNA, 15 nt, Human
uuaugugaaacaugu

SEQ ID NO: 2489933 - RNA, 23 nt, Human
uuaugugaaugaucucucugaau

SEQ ID NO: 2489934 - RNA, 22 nt, Human
uuaugugccagauuuaugcaua

SEQ ID NO: 2489935 - RNA, 13 nt, Human
uuaugugagagaa

SEQ ID NO: 2489936 - RNA, 19 nt, Human
uuaugugugaggagcugcu

SEQ ID NO: 2489937 - RNA, 15 nt, Human
uuauguguaaauaca

SEQ ID NO: 2489938 - RNA, 18 nt, Human
uuaugugccguguuauug

SEQ ID NO: 2489939 - RNA, 12 nt, Human
uuaugugugugu

SEQ ID NO: 2489940 - RNA, 14 nt, Human
uuaugugugugugu

SEQ ID NO: 2489941 - RNA, 10 nt, Human
uuaugugugu

SEQ ID NO: 2489942 - RNA, 12 nt, Human
uuauguguguau

SEQ ID NO: 2489943 - RNA, 18 nt, Human
uuauguguguauauguau

SEQ ID NO: 2489944 - RNA, 22 nt, Human
uuauguguguauauguaugugu

SEQ ID NO: 2489945 - RNA, 22 nt, Human
uuaugggcuggguucuacccag

SEQ ID NO: 2489946 - RNA, 13 nt, Human
uuaugguguuucu

SEQ ID NO: 2489947 - RNA, 20 nt, Human
uuaugguguuucucccucuc

SEQ ID NO: 2489948 - RNA, 11 nt, Human
uuaugguuuug

SEQ ID NO: 2489949 - RNA, 20 nt, Human
uuauguaaaauguuuuagca

SEQ ID NO: 2489950 - RNA, 16 nt, Human
uuauguaaaauguuuu

SEQ ID NO: 2489951 - RNA, 20 nt, Human
uuauguaaaaggccaaaccu

SEQ ID NO: 2489952 - RNA, 22 nt, Human
uuauguaaaaggccaaaccucu

SEQ ID NO: 2489953 - RNA, 17 nt, Human
uuaugguuuugugaugu

SEQ ID NO: 2489954 - RNA, 19 nt, Human
uuaugauuaaguaaugaua

SEQ ID NO: 2489955 - RNA, 16 nt, Human
uuaugauguauauuua

SEQ ID NO: 2489956 - RNA, 22 nt, Human
uuaugauuaaguaaugauaacu

SEQ ID NO: 2489957 - RNA, 19 nt, Human
uuauggcuuuugugcauua

SEQ ID NO: 2489958 - RNA, 13 nt, Human
uuaugggcugggu

SEQ ID NO: 2489959 - RNA, 17 nt, Human
uuaugggaaucaagauu

SEQ ID NO: 2489960 - RNA, 23 nt, Human
uuaugggaaccccuucauccucu

SEQ ID NO: 2489961 - RNA, 21 nt, Human
uuaugaugugggucaaggaau

SEQ ID NO: 2489962 - RNA, 20 nt, Human
uuaugaugugggucaaggaa

SEQ ID NO: 2489963 - RNA, 21 nt, Human
aguuuuaucacauguauguuu

SEQ ID NO: 2489964 - RNA, 20 nt, Human
aguuuuaucacauguauguu

SEQ ID NO: 2489965 - RNA, 12 nt, Human
aguuuuaucauu

SEQ ID NO: 2489966 - RNA, 13 nt, Human
aguuuuaucauuu

SEQ ID NO: 2489967 - RNA, 19 nt, Human
aguuuuaucacauguaugu

SEQ ID NO: 2489968 - RNA, 17 nt, Human
aguuuuaucacauguau

SEQ ID NO: 2489969 - RNA, 13 nt, Human
aguuuuaucacau

SEQ ID NO: 2489970 - RNA, 16 nt, Human
aguuuuauaugcuucu

SEQ ID NO: 2489971 - RNA, 19 nt, Human
aguuuuacuuuuaaacugu

SEQ ID NO: 2489972 - RNA, 20 nt, Human
aguuuuacuuuuaaacugug

SEQ ID NO: 2489973 - RNA, 16 nt, Human
aguuuuaccagaugau

SEQ ID NO: 2489974 - RNA, 20 nt, Human
aguuuuacucugcugcaaaa

SEQ ID NO: 2489975 - RNA, 21 nt, Human
aguuuuaguugcagaaacauu

SEQ ID NO: 2489976 - RNA, 15 nt, Human
aguuuuaguugcaga

SEQ ID NO: 2489977 - RNA, 20 nt, Human
aguuuuuguucuuaauugca

SEQ ID NO: 2489978 - RNA, 12 nt, Human
aguuuuuguucu

SEQ ID NO: 2489979 - RNA, 19 nt, Human
aguuuuuguacuguaaaga

SEQ ID NO: 2489980 - RNA, 18 nt, Human
aguuuuuguacuguaaag

SEQ ID NO: 2489981 - RNA, 12 nt, Human
aguuuuuguacu

SEQ ID NO: 2489982 - RNA, 16 nt, Human
aguuuuuguaauuuau

SEQ ID NO: 2489983 - RNA, 15 nt, Human
aguuuuuuuuauaca

SEQ ID NO: 2489984 - RNA, 17 nt, Human
aguuuuuucucuugggc

SEQ ID NO: 2489985 - RNA, 18 nt, Human
aguuuuuucucuugggcu

SEQ ID NO: 2489986 - RNA, 18 nt, Human
aguuuuguuuuaaaauua

SEQ ID NO: 2489987 - RNA, 17 nt, Human
aguuuuuaaaauaucuu

SEQ ID NO: 2489988 - RNA, 22 nt, Human
aguuuuucagaguggaaugcuu

SEQ ID NO: 2489989 - RNA, 17 nt, Human
aguuuuucagaaagcau

SEQ ID NO: 2489990 - RNA, 20 nt, Human
aguuuuuauugcuuguugga

SEQ ID NO: 2489991 - RNA, 13 nt, Human
aguuuuucuguca

SEQ ID NO: 2489992 - RNA, 12 nt, Human
aguuuuucuguc

SEQ ID NO: 2489993 - RNA, 16 nt, Human
aguuuuucuguauuuu

SEQ ID NO: 2489994 - RNA, 16 nt, Human
aguuuuugauagcuuu

SEQ ID NO: 2489995 - RNA, 23 nt, Human
aguuuuucccagcuacaccuuuc

SEQ ID NO: 2489996 - RNA, 22 nt, Human
aguuuuucccagcuacaccuuu

SEQ ID NO: 2489997 - RNA, 20 nt, Human
uuaagacacugaaaaaucua

SEQ ID NO: 2489998 - RNA, 14 nt, Human
uuaagaaugaaaua

SEQ ID NO: 2489999 - RNA, 20 nt, Human
uuaagaaugaaauacuguuu

SEQ ID NO: 2490000 - RNA, 22 nt, Human
uuaagaaugaaauacuguuuga

SEQ ID NO: 2490001 - RNA, 18 nt, Human
uuaagaaggcaaaaaugu

SEQ ID NO: 2490002 - RNA, 21 nt, Human
uuaagaaaaaauaacacacau

SEQ ID NO: 2490003 - RNA, 20 nt, Human
uuaagaaaaaauaacacaca

SEQ ID NO: 2490004 - RNA, 11 nt, Human
uuaagaccugg

SEQ ID NO: 2490005 - RNA, 14 nt, Human
uuaagaccuggcag

SEQ ID NO: 2490006 - RNA, 18 nt, Human
uuaagaccuggcagcucu

SEQ ID NO: 2490007 - RNA, 19 nt, Human
uuaagacgaaacauuuguu

SEQ ID NO: 2490008 - RNA, 16 nt, Human
uuaagacaugauuucc

SEQ ID NO: 2490009 - RNA, 18 nt, Human
uuaagacauuuuuggaag

SEQ ID NO: 2490010 - RNA, 23 nt, Human
uuaagacauuuuuggaaggggac

SEQ ID NO: 2490011 - RNA, 18 nt, Human
uuaagacaugauuuccuu

SEQ ID NO: 2490012 - RNA, 20 nt, Human
auaaaaggcaaauguguaca

SEQ ID NO: 2490013 - RNA, 19 nt, Human
auaaaaggcaaauguguac

SEQ ID NO: 2490014 - RNA, 19 nt, Human
auaaaaggaagccaaagag

SEQ ID NO: 2490015 - RNA, 20 nt, Human
auaaaaggaagccaaagagu

SEQ ID NO: 2490016 - RNA, 23 nt, Human
uuaacuuuuauaaacuuuaccuu

SEQ ID NO: 2490017 - RNA, 22 nt, Human
uuaacuuuuauaaacuuuaccu

SEQ ID NO: 2490018 - RNA, 15 nt, Human
auaaaagcuauggug

SEQ ID NO: 2490019 - RNA, 12 nt, Human
auaaaaggaaaa

SEQ ID NO: 2490020 - RNA, 15 nt, Human
auaaaaggaagccaa

SEQ ID NO: 2490021 - RNA, 17 nt, Human
auaaaaggaagccaaag

SEQ ID NO: 2490022 - RNA, 20 nt, Human
auaaaagccuguuuaagaga

SEQ ID NO: 2490023 - RNA, 23 nt, Human
aguuuuuuuuuauacacuguaau

SEQ ID NO: 2490024 - RNA, 19 nt, Human
auaaaagccuguuuaagag

SEQ ID NO: 2490025 - RNA, 20 nt, Human
uuaaucaauuuaaacccauu

SEQ ID NO: 2490026 - RNA, 18 nt, Human
uuaaucaauuuaaaccca

SEQ ID NO: 2490027 - RNA, 17 nt, Human
uuaaucaauuaauuuuu

SEQ ID NO: 2490028 - RNA, 16 nt, Human
uuaaucaauuaauuuu

SEQ ID NO: 2490029 - RNA, 20 nt, Human
uuaauaaaauaauucuaaag

SEQ ID NO: 2490030 - RNA, 16 nt, Human
uuaauaaaauaauucu

SEQ ID NO: 2490031 - RNA, 17 nt, Human
uuaaucacuauuguucc

SEQ ID NO: 2490032 - RNA, 15 nt, Human
uuaaucaucuauaaa

SEQ ID NO: 2490033 - RNA, 20 nt, Human
uuaaucagguccucagagaa

SEQ ID NO: 2490034 - RNA, 16 nt, Human
uuaaucagacaaagua

SEQ ID NO: 2490035 - RNA, 21 nt, Human
uuaauccccaguaaaauugcc

SEQ ID NO: 2490036 - RNA, 18 nt, Human
uuaauccccaguaaaauu

SEQ ID NO: 2490037 - RNA, 23 nt, Human
uuaauccagaauaacuagcacca

SEQ ID NO: 2490038 - RNA, 17 nt, Human
uuaauccccaguaaaau

SEQ ID NO: 2490039 - RNA, 22 nt, Human
uuaaucauuuugccucuuuucu

SEQ ID NO: 2490040 - RNA, 18 nt, Human
uuaaucaucuauaaagaa

SEQ ID NO: 2490041 - RNA, 12 nt, Human
uuaauccaaugg

SEQ ID NO: 2490042 - RNA, 20 nt, Human
uuaauccagaauaacuagca

SEQ ID NO: 2490043 - RNA, 18 nt, Human
uuaauccagaauaacuag

SEQ ID NO: 2490044 - RNA, 15 nt, Human
uuaaucuaaauggaa

SEQ ID NO: 2490045 - RNA, 20 nt, Human
uuaauccuucuaguuuccca

SEQ ID NO: 2490046 - RNA, 14 nt, Human
uuaauccuucuagu

SEQ ID NO: 2490047 - RNA, 11 nt, Human
uuaauaaaaag

SEQ ID NO: 2490048 - RNA, 14 nt, Human
uuaauaaaaaggca

SEQ ID NO: 2490049 - RNA, 15 nt, Human
uuaauaaaaaggcac

SEQ ID NO: 2490050 - RNA, 16 nt, Human
uuaauaaaaguacaug

SEQ ID NO: 2490051 - RNA, 20 nt, Human
uuaauaaaaaaacaaucauu

SEQ ID NO: 2490052 - RNA, 15 nt, Human
uuaaguuucucagcu

SEQ ID NO: 2490053 - RNA, 12 nt, Human
uuaaguuucuca

SEQ ID NO: 2490054 - RNA, 11 nt, Human
uuaaguuucuc

SEQ ID NO: 2490055 - RNA, 19 nt, Human
uuaaguuguuugcauguga

SEQ ID NO: 2490056 - RNA, 22 nt, Human
uuaagagccauauaaguuugaa

SEQ ID NO: 2490057 - RNA, 15 nt, Human
uuaaguuucaggaua

SEQ ID NO: 2490058 - RNA, 16 nt, Human
uuaaguuguuugcaug

SEQ ID NO: 2490059 - RNA, 22 nt, Human
uuaagacgaaacauuuguucua

SEQ ID NO: 2490060 - RNA, 21 nt, Human
uuaagacugagcaccugcuuc

SEQ ID NO: 2490061 - RNA, 17 nt, Human
uuaagacguguuugugu

SEQ ID NO: 2490062 - RNA, 16 nt, Human
uuaagacguguuugug

SEQ ID NO: 2490063 - RNA, 13 nt, Human
uuaagacguguuu

SEQ ID NO: 2490064 - RNA, 17 nt, Human
uuaauuuuguauuuucc

SEQ ID NO: 2490065 - RNA, 16 nt, Human
uuaauuuuguauuuuc

SEQ ID NO: 2490066 - RNA, 15 nt, Human
uuaauuuuguauuuu

SEQ ID NO: 2490067 - RNA, 14 nt, Human
uuaauuuuguauuu

SEQ ID NO: 2490068 - RNA, 18 nt, Human
uuaauuuuguauuuucca

SEQ ID NO: 2490069 - RNA, 22 nt, Human
uuaauuuugacacuauaucugu

SEQ ID NO: 2490070 - RNA, 17 nt, Human
uuaauuuugguuguauu

SEQ ID NO: 2490071 - RNA, 13 nt, Human
uuaauuuucagua

SEQ ID NO: 2490072 - RNA, 20 nt, Human
uuaauuuugguuguauucuu

SEQ ID NO: 2490073 - RNA, 18 nt, Human
uuaauuuugguuguauuc

SEQ ID NO: 2490074 - RNA, 23 nt, Human
uuaauuuugguuguauucuuuga

SEQ ID NO: 2490075 - RNA, 13 nt, Human
uuaauuuuguauu

SEQ ID NO: 2490076 - RNA, 13 nt, Human
uuaauuuuccugg

SEQ ID NO: 2490077 - RNA, 20 nt, Human
uuaauuugauaucacagucu

SEQ ID NO: 2490078 - RNA, 14 nt, Human
uuaauuuauuuuug

SEQ ID NO: 2490079 - RNA, 19 nt, Human
uuaauuuauuauugaaauu

SEQ ID NO: 2490080 - RNA, 20 nt, Human
uuaauuuaugaguuuuugau

SEQ ID NO: 2490081 - RNA, 24 nt, Human
uuaaucuuucuuuaccugagacca

SEQ ID NO: 2490082 - RNA, 15 nt, Human
uuaauuuaugaguuu

SEQ ID NO: 2490083 - RNA, 18 nt, Human
uuaauuuaugaguuuuug

SEQ ID NO: 2490084 - RNA, 17 nt, Human
uuaaucuuuaauuuuac

SEQ ID NO: 2490085 - RNA, 23 nt, Human
uuaaucuuucuuuaccugagacc

SEQ ID NO: 2490086 - RNA, 21 nt, Human
uuaaucuuucuuuaccugaga

SEQ ID NO: 2490087 - RNA, 16 nt, Human
uuaaucuuuucacaaa

SEQ ID NO: 2490088 - RNA, 17 nt, Human
uuaaucuuucuuuaccu

SEQ ID NO: 2490089 - RNA, 14 nt, Human
uuaaucuuuccuga

SEQ ID NO: 2490090 - RNA, 22 nt, Human
uuaaucuucaguuuuaucuuua

SEQ ID NO: 2490091 - RNA, 13 nt, Human
uuaaucuuuaauu

SEQ ID NO: 2490092 - RNA, 15 nt, Human
uuaaucuucaguuuu

SEQ ID NO: 2490093 - RNA, 17 nt, Human
uuaaucuucaguuuuau

SEQ ID NO: 2490094 - RNA, 15 nt, Human
aguuuagcuggaaaa

SEQ ID NO: 2490095 - RNA, 14 nt, Human
aguuuagaggaaaa

SEQ ID NO: 2490096 - RNA, 16 nt, Human
aguuuacuauuuuacu

SEQ ID NO: 2490097 - RNA, 14 nt, Human
aguuuacuauuuua

SEQ ID NO: 2490098 - RNA, 15 nt, Human
aguuuacuauuuuac

SEQ ID NO: 2490099 - RNA, 20 nt, Human
aguuuaccucuuuaaaaaca

SEQ ID NO: 2490100 - RNA, 16 nt, Human
aguuuaccucuuuaaa

SEQ ID NO: 2490101 - RNA, 12 nt, Human
aguuuaacacaa

SEQ ID NO: 2490102 - RNA, 20 nt, Human
aguuuaccuuguauacugua

SEQ ID NO: 2490103 - RNA, 14 nt, Human
aguuuaccuuguau

SEQ ID NO: 2490104 - RNA, 19 nt, Human
uuaaaaaagaaacauuugg

SEQ ID NO: 2490105 - RNA, 16 nt, Human
aguuuagcuggaaaag

SEQ ID NO: 2490106 - RNA, 21 nt, Human
aguuuagaggaaaaaaaugac

SEQ ID NO: 2490107 - RNA, 19 nt, Human
aguuuagaggaaaaaaaug

SEQ ID NO: 2490108 - RNA, 17 nt, Human
aguuuaaauuguaauag

SEQ ID NO: 2490109 - RNA, 20 nt, Human
aguuuaaauuguaauaggcg

SEQ ID NO: 2490110 - RNA, 13 nt, Human
aguuuacauugua

SEQ ID NO: 2490111 - RNA, 13 nt, Human
aguuaggaaauaa

SEQ ID NO: 2490112 - RNA, 14 nt, Human
aguuaggaaauaaa

SEQ ID NO: 2490113 - RNA, 12 nt, Human
aguuaggaaaua

SEQ ID NO: 2490114 - RNA, 19 nt, Human
aguuagcucaggaggcuug

SEQ ID NO: 2490115 - RNA, 22 nt, Human
aguuagcucaggaggcuuggaa

SEQ ID NO: 2490116 - RNA, 17 nt, Human
aguuuacauuguaaaua

SEQ ID NO: 2490117 - RNA, 15 nt, Human
aguuuacauuguaaa

SEQ ID NO: 2490118 - RNA, 16 nt, Human
uuaaaaaauggaacau

SEQ ID NO: 2490119 - RNA, 19 nt, Human
uuaaaaaucucaaauuucu

SEQ ID NO: 2490120 - RNA, 20 nt, Human
uuaaaaaucucaaauuucua

SEQ ID NO: 2490121 - RNA, 12 nt, Human
uuaaaaaugcaa

SEQ ID NO: 2490122 - RNA, 17 nt, Human
uuaaaaaucucaaauuu

SEQ ID NO: 2490123 - RNA, 22 nt, Human
uuaaaaucauuucugcaucagc

SEQ ID NO: 2490124 - RNA, 14 nt, Human
uuaaaaucauuucu

SEQ ID NO: 2490125 - RNA, 13 nt, Human
uuaaaauccucaa

SEQ ID NO: 2490126 - RNA, 11 nt, Human
uuaaaaucuua

SEQ ID NO: 2490127 - RNA, 14 nt, Human
uuaaaaucuuaaac

SEQ ID NO: 2490128 - RNA, 12 nt, Human
uuaaaauccuca

SEQ ID NO: 2490129 - RNA, 15 nt, Human
uuaaaaaugcaaauc

SEQ ID NO: 2490130 - RNA, 19 nt, Human
uuaaaaugagaaaucuaaa

SEQ ID NO: 2490131 - RNA, 12 nt, Human
uuaaaaugagaa

SEQ ID NO: 2490132 - RNA, 16 nt, Human
uuaaaaugcaacaugu

SEQ ID NO: 2490133 - RNA, 16 nt, Human
uuaaaaugauuguaaa

SEQ ID NO: 2490134 - RNA, 18 nt, Human
uuaaaaugauuguaaaau

SEQ ID NO: 2490135 - RNA, 19 nt, Human
uuaaaccauaaaaagcuga

SEQ ID NO: 2490136 - RNA, 22 nt, Human
uuaaacauugguucuuguauua

SEQ ID NO: 2490137 - RNA, 18 nt, Human
uuaaacauugguucuugu

SEQ ID NO: 2490138 - RNA, 20 nt, Human
uuaaacauugguucuuguau

SEQ ID NO: 2490139 - RNA, 23 nt, Human
uuaaaauguauucuuaaauucau

SEQ ID NO: 2490140 - RNA, 11 nt, Human
aguuucucagc

SEQ ID NO: 2490141 - RNA, 23 nt, Human
aguuucucagauccuuguuucaa

SEQ ID NO: 2490142 - RNA, 22 nt, Human
aguuucucagauccuuguuuca

SEQ ID NO: 2490143 - RNA, 18 nt, Human
aguuucucagauccuugu

SEQ ID NO: 2490144 - RNA, 15 nt, Human
aguuucucagauccu

SEQ ID NO: 2490145 - RNA, 21 nt, Human
aguuucuagcuagaaauauga

SEQ ID NO: 2490146 - RNA, 16 nt, Human
aguuucuagcuagaaa

SEQ ID NO: 2490147 - RNA, 22 nt, Human
aguuuauuuccaaauaaaauga

SEQ ID NO: 2490148 - RNA, 22 nt, Human
aguuuauugacaauaauuucag

SEQ ID NO: 2490149 - RNA, 14 nt, Human
aguuucucagcucc

SEQ ID NO: 2490150 - RNA, 12 nt, Human
aguuucucagcu

SEQ ID NO: 2490151 - RNA, 15 nt, Human
aguuucugccgcagc

SEQ ID NO: 2490152 - RNA, 13 nt, Human
aguuucucagcuc

SEQ ID NO: 2490153 - RNA, 14 nt, Human
aguuucucuuuuca

SEQ ID NO: 2490154 - RNA, 16 nt, Human
aguuugugugucuuaa

SEQ ID NO: 2490155 - RNA, 15 nt, Human
aguuugugugucuua

SEQ ID NO: 2490156 - RNA, 14 nt, Human
aguuugugugucuu

SEQ ID NO: 2490157 - RNA, 19 nt, Human
aguuucugccgcagcccug

SEQ ID NO: 2490158 - RNA, 18 nt, Human
aguuuguguguugucuug

SEQ ID NO: 2490159 - RNA, 16 nt, Human
aguuuguguguugucu

SEQ ID NO: 2490160 - RNA, 21 nt, Human
aguuuguguguugucucuuga

SEQ ID NO: 2490161 - RNA, 14 nt, Human
aguuuguguguugu

SEQ ID NO: 2490162 - RNA, 22 nt, Human
aguuugugugucuuaauuauua

SEQ ID NO: 2490163 - RNA, 22 nt, Human
aguuuguuaguaugaggcauuu

SEQ ID NO: 2490164 - RNA, 15 nt, Human
aguuuguugaaacac

SEQ ID NO: 2490165 - RNA, 14 nt, Human
aguuuguuuacaca

SEQ ID NO: 2490166 - RNA, 20 nt, Human
aguuuguguguugucuugaa

SEQ ID NO: 2490167 - RNA, 19 nt, Human
aguuuguguguugucuuga

SEQ ID NO: 2490168 - RNA, 23 nt, Human
aguuuuaaaaaaauaaaacauuu

SEQ ID NO: 2490169 - RNA, 22 nt, Human
aguuuuaaaaaaauaaaacauu

SEQ ID NO: 2490170 - RNA, 16 nt, Human
aguuuuaaaaaaauaa

SEQ ID NO: 2490171 - RNA, 16 nt, Human
aguuuuaauccagaau

SEQ ID NO: 2490172 - RNA, 18 nt, Human
aguuuuaacuagaauuua

SEQ ID NO: 2490173 - RNA, 13 nt, Human
uuaaauaaaagaa

SEQ ID NO: 2490174 - RNA, 11 nt, Human
uuaaauaaaag

SEQ ID NO: 2490175 - RNA, 20 nt, Human
uuaaauuuugaguucuacau

SEQ ID NO: 2490176 - RNA, 16 nt, Human
uuaaauuuugugucuc

SEQ ID NO: 2490177 - RNA, 14 nt, Human
uuaaauuuuguguc

SEQ ID NO: 2490178 - RNA, 15 nt, Human
uuaaauuuugaguuc

SEQ ID NO: 2490179 - RNA, 20 nt, Human
uuaaauuuuacccuuuagac

SEQ ID NO: 2490180 - RNA, 16 nt, Human
uuaaauuuuacccuuu

SEQ ID NO: 2490181 - RNA, 23 nt, Human
uuaaauuuuacccuuuagacugu

SEQ ID NO: 2490182 - RNA, 15 nt, Human
uuaaaguucuguaaa

SEQ ID NO: 2490183 - RNA, 13 nt, Human
uuaacagaaaugu

SEQ ID NO: 2490184 - RNA, 14 nt, Human
uuaacagaaaugua

SEQ ID NO: 2490185 - RNA, 12 nt, Human
uuaacagaaaug

SEQ ID NO: 2490186 - RNA, 16 nt, Human
uuaacagaaauguaca

SEQ ID NO: 2490187 - RNA, 19 nt, Human
uuaacacugcuuguguuuu

SEQ ID NO: 2490188 - RNA, 17 nt, Human
aguuuaucauucaagug

SEQ ID NO: 2490189 - RNA, 16 nt, Human
aguuuaucauucaagu

SEQ ID NO: 2490190 - RNA, 15 nt, Human
aguuuaucauucaag

SEQ ID NO: 2490191 - RNA, 14 nt, Human
aguuuaucauucaa

SEQ ID NO: 2490192 - RNA, 16 nt, Human
aguuuaugucuaaaga

SEQ ID NO: 2490193 - RNA, 15 nt, Human
aguuuaugucuaaag

SEQ ID NO: 2490194 - RNA, 21 nt, Human
aguuuaugucuaaagagcuuu

SEQ ID NO: 2490195 - RNA, 15 nt, Human
auaacuauguugaua

SEQ ID NO: 2490196 - RNA, 16 nt, Human
auaacuaguguugcuu

SEQ ID NO: 2490197 - RNA, 19 nt, Human
auaacuaguguugcuugga

SEQ ID NO: 2490198 - RNA, 13 nt, Human
auaaauuguauau

SEQ ID NO: 2490199 - RNA, 19 nt, Human
auaaauuguaauuguaaag

SEQ ID NO: 2490200 - RNA, 18 nt, Human
auaaauugcuccuugaca

SEQ ID NO: 2490201 - RNA, 15 nt, Human
auaacucaucauaaa

SEQ ID NO: 2490202 - RNA, 16 nt, Human
auaacucaucauaaaa

SEQ ID NO: 2490203 - RNA, 17 nt, Human
auaacucaucauaaaau

SEQ ID NO: 2490204 - RNA, 18 nt, Human
auaacucaucauaaaaua

SEQ ID NO: 2490205 - RNA, 19 nt, Human
auaacucaucauaaaauaa

SEQ ID NO: 2490206 - RNA, 11 nt, Human
auaacucugca

SEQ ID NO: 2490207 - RNA, 20 nt, Human
auaacuccuucuuguaguag

SEQ ID NO: 2490208 - RNA, 12 nt, Human
auaacuccuucu

SEQ ID NO: 2490209 - RNA, 20 nt, Human
uuacagggagccuccugccc

SEQ ID NO: 2490210 - RNA, 19 nt, Human
auaacucugcacuacuccu

SEQ ID NO: 2490211 - RNA, 21 nt, Human
auaacucugcacuacuccucu

SEQ ID NO: 2490212 - RNA, 20 nt, Human
uuacagggaugagccaccgc

SEQ ID NO: 2490213 - RNA, 14 nt, Human
uuacaggugugaac

SEQ ID NO: 2490214 - RNA, 18 nt, Human
uuacagguggacacacaa

SEQ ID NO: 2490215 - RNA, 21 nt, Human
uuacagggagccuccugccca

SEQ ID NO: 2490216 - RNA, 18 nt, Human
uuacagggagcugggaca

SEQ ID NO: 2490217 - RNA, 18 nt, Human
uuacaguuucaaaaacug

SEQ ID NO: 2490218 - RNA, 19 nt, Human
uuaccagcagagcaccuua

SEQ ID NO: 2490219 - RNA, 22 nt, Human
uuaccagccuccguauuucaga

SEQ ID NO: 2490220 - RNA, 20 nt, Human
uuaccagccuccguauuuca

SEQ ID NO: 2490221 - RNA, 21 nt, Human
uuaccagccuccguauuucag

SEQ ID NO: 2490222 - RNA, 23 nt, Human
uuaccagccuccguauuucagac

SEQ ID NO: 2490223 - RNA, 17 nt, Human
uuacaguaggagcccag

SEQ ID NO: 2490224 - RNA, 22 nt, Human
uuacaguaaauaaauuguuuga

SEQ ID NO: 2490225 - RNA, 18 nt, Human
uuacaguaaauaaauugu

SEQ ID NO: 2490226 - RNA, 17 nt, Human
uuacaguaaauaaauug

SEQ ID NO: 2490227 - RNA, 16 nt, Human
uuacaguaaauaaauu

SEQ ID NO: 2490228 - RNA, 15 nt, Human
uuacaguaaauaaau

SEQ ID NO: 2490229 - RNA, 13 nt, Human
uuacaguaaauaa

SEQ ID NO: 2490230 - RNA, 13 nt, Human
uuacaguguuccg

SEQ ID NO: 2490231 - RNA, 18 nt, Human
auaaaugauucuuaguga

SEQ ID NO: 2490232 - RNA, 16 nt, Human
auaaaugauucuuagu

SEQ ID NO: 2490233 - RNA, 17 nt, Human
auaaaugcaauauguau

SEQ ID NO: 2490234 - RNA, 18 nt, Human
auaaaugcaauauguauu

SEQ ID NO: 2490235 - RNA, 20 nt, Human
auaaaugcaauauguauuaa

SEQ ID NO: 2490236 - RNA, 22 nt, Human
auaaaugcaauauguauuaaua

SEQ ID NO: 2490237 - RNA, 16 nt, Human
auaaauugcuccuuga

SEQ ID NO: 2490238 - RNA, 13 nt, Human
auaaauugcuccu

SEQ ID NO: 2490239 - RNA, 21 nt, Human
auaaauuccucuuugcuuugc

SEQ ID NO: 2490240 - RNA, 21 nt, Human
auaaaugcuuuuaaaaaucua

SEQ ID NO: 2490241 - RNA, 23 nt, Human
auaaaugcuauuuuuuauuuuac

SEQ ID NO: 2490242 - RNA, 21 nt, Human
auaaaugcuauuuuuuauuuu

SEQ ID NO: 2490243 - RNA, 19 nt, Human
auaaaugcuauuuuuuauu

SEQ ID NO: 2490244 - RNA, 15 nt, Human
auaaaugcaauauua

SEQ ID NO: 2490245 - RNA, 23 nt, Human
auaaaugcaauauuaaugccuuu

SEQ ID NO: 2490246 - RNA, 16 nt, Human
auaaauggcugguuuu

SEQ ID NO: 2490247 - RNA, 13 nt, Human
auaaauggcuggu

SEQ ID NO: 2490248 - RNA, 13 nt, Human
auaaaugcuuuua

SEQ ID NO: 2490249 - RNA, 16 nt, Human
auaaauucuauaggaa

SEQ ID NO: 2490250 - RNA, 21 nt, Human
auaaauucuauaggaacauau

SEQ ID NO: 2490251 - RNA, 15 nt, Human
auaaaucugacccag

SEQ ID NO: 2490252 - RNA, 16 nt, Human
auaaaucugacccagu

SEQ ID NO: 2490253 - RNA, 18 nt, Human
auaaaucugacccagugc

SEQ ID NO: 2490254 - RNA, 19 nt, Human
auaaaucugacccagugcc

SEQ ID NO: 2490255 - RNA, 16 nt, Human
auaaaucgcuuuugau

SEQ ID NO: 2490256 - RNA, 19 nt, Human
auaaaucgcuuuugauaau

SEQ ID NO: 2490257 - RNA, 21 nt, Human
auaaaucgcuuuugauaauca

SEQ ID NO: 2490258 - RNA, 14 nt, Human
auaaaucgcuuuug

SEQ ID NO: 2490259 - RNA, 22 nt, Human
uuacaaaguguguauuaaaaaa

SEQ ID NO: 2490260 - RNA, 18 nt, Human
uuacaaaguguguauuaa

SEQ ID NO: 2490261 - RNA, 17 nt, Human
uuacaaaguguguauua

SEQ ID NO: 2490262 - RNA, 16 nt, Human
uuacaaaguguguauu

SEQ ID NO: 2490263 - RNA, 15 nt, Human
uuacaaaguguguau

SEQ ID NO: 2490264 - RNA, 14 nt, Human
uuacaaagugugua

SEQ ID NO: 2490265 - RNA, 13 nt, Human
uuacaaagugugu

SEQ ID NO: 2490266 - RNA, 12 nt, Human
uuacaaacaugu

SEQ ID NO: 2490267 - RNA, 13 nt, Human
uuaauuuuuccua

SEQ ID NO: 2490268 - RNA, 15 nt, Human
uuacaaacauguggu

SEQ ID NO: 2490269 - RNA, 11 nt, Human
uuacuccccuu

SEQ ID NO: 2490270 - RNA, 20 nt, Human
uuacuccccuugagcugaga

SEQ ID NO: 2490271 - RNA, 15 nt, Human
uuacugcagcuuugu

SEQ ID NO: 2490272 - RNA, 22 nt, Human
uuacugcagccuuugccucccc

SEQ ID NO: 2490273 - RNA, 21 nt, Human
uuacugcuaaguauuucccag

SEQ ID NO: 2490274 - RNA, 20 nt, Human
uuacugcuaaguauuuccca

SEQ ID NO: 2490275 - RNA, 17 nt, Human
uuacugcuaaguauuuc

SEQ ID NO: 2490276 - RNA, 11 nt, Human
uuacugccacu

SEQ ID NO: 2490277 - RNA, 21 nt, Human
uuacugccaaagggaaauauc

SEQ ID NO: 2490278 - RNA, 20 nt, Human
uuaccaugagaagagggccu

SEQ ID NO: 2490279 - RNA, 11 nt, Human
uuaccaugaga

SEQ ID NO: 2490280 - RNA, 15 nt, Human
uuaccauaugugcuu

SEQ ID NO: 2490281 - RNA, 13 nt, Human
uuacucagcccug

SEQ ID NO: 2490282 - RNA, 14 nt, Human
uuacucagcccugg

SEQ ID NO: 2490283 - RNA, 22 nt, Human
uuacucagcccugggccccacc

SEQ ID NO: 2490284 - RNA, 18 nt, Human
uuacucauagcacuuccc

SEQ ID NO: 2490285 - RNA, 14 nt, Human
uuacucaggaagaa

SEQ ID NO: 2490286 - RNA, 17 nt, Human
uuacucaggaagaacac

SEQ ID NO: 2490287 - RNA, 21 nt, Human
uuacucauuuuuuuaauuuau

SEQ ID NO: 2490288 - RNA, 17 nt, Human
uuacucaugaucuugug

SEQ ID NO: 2490289 - RNA, 13 nt, Human
uuacuguacauga

SEQ ID NO: 2490290 - RNA, 14 nt, Human
uuacuguacaugaa

SEQ ID NO: 2490291 - RNA, 22 nt, Human
uuacuguacaugaaaacacauu

SEQ ID NO: 2490292 - RNA, 23 nt, Human
uuacuguacaugaaaacacauuu

SEQ ID NO: 2490293 - RNA, 12 nt, Human
uuacuguacaug

SEQ ID NO: 2490294 - RNA, 23 nt, Human
uuacuguacagacagaaaaaacu

SEQ ID NO: 2490295 - RNA, 23 nt, Human
uuacugcuaaguauuucccagca

SEQ ID NO: 2490296 - RNA, 22 nt, Human
uuacugcuaaguauuucccagc

SEQ ID NO: 2490297 - RNA, 16 nt, Human
auaagauauuuuucau

SEQ ID NO: 2490298 - RNA, 18 nt, Human
auaagauauuuuucauga

SEQ ID NO: 2490299 - RNA, 16 nt, Human
auaagaaaaaucaugu

SEQ ID NO: 2490300 - RNA, 22 nt, Human
auaagaaaagauguagauuuau

SEQ ID NO: 2490301 - RNA, 17 nt, Human
auaagauuagaaugaaa

SEQ ID NO: 2490302 - RNA, 13 nt, Human
auaagauuagaau

SEQ ID NO: 2490303 - RNA, 14 nt, Human
auaagauucauauu

SEQ ID NO: 2490304 - RNA, 17 nt, Human
auaagaaaaaucauguu

SEQ ID NO: 2490305 - RNA, 15 nt, Human
auaagaaaaaucaug

SEQ ID NO: 2490306 - RNA, 11 nt, Human
auaagaaaaga

SEQ ID NO: 2490307 - RNA, 12 nt, Human
auaagaaaagau

SEQ ID NO: 2490308 - RNA, 18 nt, Human
auaagaaaagauguagau

SEQ ID NO: 2490309 - RNA, 21 nt, Human
auaagaaaagauguagauuua

SEQ ID NO: 2490310 - RNA, 18 nt, Human
auaacuuuuuuuuaaguu

SEQ ID NO: 2490311 - RNA, 18 nt, Human
uuagaauuccuucagggu

SEQ ID NO: 2490312 - RNA, 16 nt, Human
uuagaauuaaaaguug

SEQ ID NO: 2490313 - RNA, 16 nt, Human
uuagaauuauuuaaac

SEQ ID NO: 2490314 - RNA, 15 nt, Human
uuagaauuauuuaaa

SEQ ID NO: 2490315 - RNA, 13 nt, Human
uuagaauuauuua

SEQ ID NO: 2490316 - RNA, 13 nt, Human
uuagaaugaaaau

SEQ ID NO: 2490317 - RNA, 12 nt, Human
uuagaauuauuu

SEQ ID NO: 2490318 - RNA, 22 nt, Human
uuagaauccaaacuuggauuuu

SEQ ID NO: 2490319 - RNA, 12 nt, Human
uuagaaugaaaa

SEQ ID NO: 2490320 - RNA, 18 nt, Human
uuagaauccaaacuugga

SEQ ID NO: 2490321 - RNA, 21 nt, Human
uuagaaucagccuugaaacau

SEQ ID NO: 2490322 - RNA, 23 nt, Human
uuacugucugguuuuaacaauuu

SEQ ID NO: 2490323 - RNA, 18 nt, Human
uuagaagguucucuccuc

SEQ ID NO: 2490324 - RNA, 23 nt, Human
uuacugucaaggcugcuuagaau

SEQ ID NO: 2490325 - RNA, 15 nt, Human
uuacuguaauuccuc

SEQ ID NO: 2490326 - RNA, 22 nt, Human
uuacugucugguuuuaacaauu

SEQ ID NO: 2490327 - RNA, 13 nt, Human
uuacuguaccugu

SEQ ID NO: 2490328 - RNA, 16 nt, Human
uuagaagucacacagu

SEQ ID NO: 2490329 - RNA, 14 nt, Human
uuagaauaaaauug

SEQ ID NO: 2490330 - RNA, 13 nt, Human
uuagaaguguuaa

SEQ ID NO: 2490331 - RNA, 15 nt, Human
uuagaauaaaauugu

SEQ ID NO: 2490332 - RNA, 16 nt, Human
uuaggguuaugauuaa

SEQ ID NO: 2490333 - RNA, 14 nt, Human
uuaggguuaugauu

SEQ ID NO: 2490334 - RNA, 12 nt, Human
uuagggcagcuu

SEQ ID NO: 2490335 - RNA, 17 nt, Human
uuagggcaccagggguu

SEQ ID NO: 2490336 - RNA, 15 nt, Human
uuaggggaacugggu

SEQ ID NO: 2490337 - RNA, 15 nt, Human
uuagggccaggcagg

SEQ ID NO: 2490338 - RNA, 14 nt, Human
uuagggcagcuugc

SEQ ID NO: 2490339 - RNA, 22 nt, Human
uuagauguucucuaucauuuaa

SEQ ID NO: 2490340 - RNA, 21 nt, Human
uuagauguucucuaucauuua

SEQ ID NO: 2490341 - RNA, 23 nt, Human
uuagauguucucuaucauuuaau

SEQ ID NO: 2490342 - RNA, 15 nt, Human
uuagggagagaagau

SEQ ID NO: 2490343 - RNA, 18 nt, Human
uuagggagagucauauuu

SEQ ID NO: 2490344 - RNA, 23 nt, Human
uuagggagagucauauuuugauu

SEQ ID NO: 2490345 - RNA, 21 nt, Human
uuagggagagucauauuuuga

SEQ ID NO: 2490346 - RNA, 12 nt, Human
uuagggaggggu

SEQ ID NO: 2490347 - RNA, 19 nt, Human
uuaggugugggggaagcac

SEQ ID NO: 2490348 - RNA, 13 nt, Human
uuaggucaagaag

SEQ ID NO: 2490349 - RNA, 20 nt, Human
uuagguuaaaaaaaggcauu

SEQ ID NO: 2490350 - RNA, 19 nt, Human
uuagguguugauuuucugu

SEQ ID NO: 2490351 - RNA, 14 nt, Human
uuaggucucuuccc

SEQ ID NO: 2490352 - RNA, 14 nt, Human
uuaguaaucauauu

SEQ ID NO: 2490353 - RNA, 14 nt, Human
uuaguaaggcugug

SEQ ID NO: 2490354 - RNA, 20 nt, Human
uuaguaaggcuguguacacu

SEQ ID NO: 2490355 - RNA, 13 nt, Human
uuaguaaucauau

SEQ ID NO: 2490356 - RNA, 23 nt, Human
uuaguaacauguguuaaguauuu

SEQ ID NO: 2490357 - RNA, 21 nt, Human
uuaguaaugcuacgugugauu

SEQ ID NO: 2490358 - RNA, 20 nt, Human
uuaguaaugcuacgugugau

SEQ ID NO: 2490359 - RNA, 22 nt, Human
uuaguaaugcuacgugugauuu

SEQ ID NO: 2490360 - RNA, 13 nt, Human
uuaguagagacag

SEQ ID NO: 2490361 - RNA, 19 nt, Human
uuaguacuccccuccuuga

SEQ ID NO: 2490362 - RNA, 12 nt, Human
uuaguaaugcua

SEQ ID NO: 2490363 - RNA, 15 nt, Human
uuauaaaaauaaaaa

SEQ ID NO: 2490364 - RNA, 19 nt, Human
uuauaaaaaauggugccug

SEQ ID NO: 2490365 - RNA, 21 nt, Human
uuaguuuuugugaaguuuaau

SEQ ID NO: 2490366 - RNA, 14 nt, Human
uuaguagagacagg

SEQ ID NO: 2490367 - RNA, 18 nt, Human
uuaguuuuugugaaguuu

SEQ ID NO: 2490368 - RNA, 13 nt, Human
uuauaaacuuuac

SEQ ID NO: 2490369 - RNA, 17 nt, Human
uuauaaaccucuaauuu

SEQ ID NO: 2490370 - RNA, 16 nt, Human
uuauaaaccucuaauu

SEQ ID NO: 2490371 - RNA, 23 nt, Human
uuauaaaccucuaauuuauuuug

SEQ ID NO: 2490372 - RNA, 13 nt, Human
uuauaaaagugau

SEQ ID NO: 2490373 - RNA, 13 nt, Human
uuauaaaacuucu

SEQ ID NO: 2490374 - RNA, 16 nt, Human
uuauaaaauuaagcaa

SEQ ID NO: 2490375 - RNA, 22 nt, Human
uuauaaaaauaaaaaacacugg

SEQ ID NO: 2490376 - RNA, 21 nt, Human
uuauaaaaauaaaaaacacug

SEQ ID NO: 2490377 - RNA, 23 nt, Human
uuauaaaagaauaaaauugcacu

SEQ ID NO: 2490378 - RNA, 12 nt, Human
uuauaaaacuuc

SEQ ID NO: 2490379 - RNA, 22 nt, Human
uuauaaaaccaucaaaaauauu

SEQ ID NO: 2490380 - RNA, 20 nt, Human
uuauaaaaaauggugccuga

SEQ ID NO: 2490381 - RNA, 18 nt, Human
auaauuuaccugaagucu

SEQ ID NO: 2490382 - RNA, 23 nt, Human
auaauucacauuguauucagagu

SEQ ID NO: 2490383 - RNA, 21 nt, Human
auaauuauuuauuuaauaaca

SEQ ID NO: 2490384 - RNA, 18 nt, Human
auaauuauuuauuuaaua

SEQ ID NO: 2490385 - RNA, 17 nt, Human
auaauuauuuauuuaau

SEQ ID NO: 2490386 - RNA, 16 nt, Human
auaauuauuuauuuaa

SEQ ID NO: 2490387 - RNA, 14 nt, Human
auaaucuuucacag

SEQ ID NO: 2490388 - RNA, 23 nt, Human
auaaucuuauuagggagaaaauu

SEQ ID NO: 2490389 - RNA, 19 nt, Human
auaauuaugacaguuauac

SEQ ID NO: 2490390 - RNA, 21 nt, Human
auaauuaugaguuugcuuaug

SEQ ID NO: 2490391 - RNA, 20 nt, Human
auaauuaugacaguuauacu

SEQ ID NO: 2490392 - RNA, 20 nt, Human
auaaucuucugccuucucau

SEQ ID NO: 2490393 - RNA, 18 nt, Human
auaauuaugacaguuaua

SEQ ID NO: 2490394 - RNA, 20 nt, Human
uuagauguucucuaucauuu

SEQ ID NO: 2490395 - RNA, 19 nt, Human
uuagauguucucuaucauu

SEQ ID NO: 2490396 - RNA, 15 nt, Human
uuagauguucucuau

SEQ ID NO: 2490397 - RNA, 22 nt, Human
uuagauguucuaagucuuucca

SEQ ID NO: 2490398 - RNA, 13 nt, Human
uuagauguucuaa

SEQ ID NO: 2490399 - RNA, 20 nt, Human
uuagauguucuaagucuuuc

SEQ ID NO: 2490400 - RNA, 21 nt, Human
uuagauguuccaguaaucuaa

SEQ ID NO: 2490401 - RNA, 22 nt, Human
uuagauguuccaguaaucuaau

SEQ ID NO: 2490402 - RNA, 14 nt, Human
auaauuuuaaaugu

SEQ ID NO: 2490403 - RNA, 20 nt, Human
uuagaugugauuuaauagug

SEQ ID NO: 2490404 - RNA, 21 nt, Human
uuagaugugauuuaauagugu

SEQ ID NO: 2490405 - RNA, 13 nt, Human
uuagaugugauuu

SEQ ID NO: 2490406 - RNA, 13 nt, Human
auaauuuuaaaug

SEQ ID NO: 2490407 - RNA, 12 nt, Human
auaauuuuaaau

SEQ ID NO: 2490408 - RNA, 15 nt, Human
auaauuuuaaacaaa

SEQ ID NO: 2490409 - RNA, 19 nt, Human
auaauuuguacauauguaa

SEQ ID NO: 2490410 - RNA, 22 nt, Human
auaauuuguacauauguaaaau

SEQ ID NO: 2490411 - RNA, 18 nt, Human
auaauuucuuacuaaaca

SEQ ID NO: 2490412 - RNA, 21 nt, Human
auaauuucccaauuaggaagu

SEQ ID NO: 2490413 - RNA, 11 nt, Human
auaauuuccca

SEQ ID NO: 2490414 - RNA, 18 nt, Human
auaauuucccaauuagga

SEQ ID NO: 2490415 - RNA, 22 nt, Human
auaauuucccaauuaggaagug

SEQ ID NO: 2490416 - RNA, 15 nt, Human
auaauauauuuucug

SEQ ID NO: 2490417 - RNA, 22 nt, Human
auaauauauguuuaccuuuuaa

SEQ ID NO: 2490418 - RNA, 12 nt, Human
auaauaugagaa

SEQ ID NO: 2490419 - RNA, 15 nt, Human
auaauaugagaauca

SEQ ID NO: 2490420 - RNA, 12 nt, Human
auaauaugcaca

SEQ ID NO: 2490421 - RNA, 20 nt, Human
auaauaugcacacagugcuu

SEQ ID NO: 2490422 - RNA, 21 nt, Human
auaauaugcugccaaauuuug

SEQ ID NO: 2490423 - RNA, 18 nt, Human
auaauauuuuuaauauau

SEQ ID NO: 2490424 - RNA, 14 nt, Human
auaauauuuuuaau

SEQ ID NO: 2490425 - RNA, 15 nt, Human
auaaucuucugccuu

SEQ ID NO: 2490426 - RNA, 17 nt, Human
auaaucuucugccuucu

SEQ ID NO: 2490427 - RNA, 14 nt, Human
auaaucuucugccu

SEQ ID NO: 2490428 - RNA, 15 nt, Human
auaaucuuauuaggg

SEQ ID NO: 2490429 - RNA, 17 nt, Human
auaaucuguacaaugaa

SEQ ID NO: 2490430 - RNA, 14 nt, Human
auaaucuguacaau

SEQ ID NO: 2490431 - RNA, 18 nt, Human
auaaucacaacccuucag

SEQ ID NO: 2490432 - RNA, 22 nt, Human
auaaucuggacuccucugucca

SEQ ID NO: 2490433 - RNA, 20 nt, Human
auaauauuuuuaauuaaaua

SEQ ID NO: 2490434 - RNA, 20 nt, Human
auaagauuagaaugaaaauu

SEQ ID NO: 2490435 - RNA, 21 nt, Human
auaagauucauauuuacuucu

SEQ ID NO: 2490436 - RNA, 22 nt, Human
auaagccaaaaaaugcuugcuu

SEQ ID NO: 2490437 - RNA, 16 nt, Human
auaagcaucaaacucu

SEQ ID NO: 2490438 - RNA, 17 nt, Human
auaagcaucaaacucuu

SEQ ID NO: 2490439 - RNA, 14 nt, Human
auaagccagacauc

SEQ ID NO: 2490440 - RNA, 18 nt, Human
auaauauaccaaugcuuu

SEQ ID NO: 2490441 - RNA, 23 nt, Human
auaagccaauuuuucugcacuga

SEQ ID NO: 2490442 - RNA, 22 nt, Human
auaagccaauuuuucugcacug

SEQ ID NO: 2490443 - RNA, 19 nt, Human
auaagccaauuuuucugca

SEQ ID NO: 2490444 - RNA, 18 nt, Human
auaagccaauuuuucugc

SEQ ID NO: 2490445 - RNA, 14 nt, Human
auaagccaauuuuu

SEQ ID NO: 2490446 - RNA, 20 nt, Human
auaauauacuuguggacuaa

SEQ ID NO: 2490447 - RNA, 14 nt, Human
auaauauacuugug

SEQ ID NO: 2490448 - RNA, 13 nt, Human
auaauauacuugu

SEQ ID NO: 2490449 - RNA, 13 nt, Human
auaauauauuuuc

SEQ ID NO: 2490450 - RNA, 19 nt, Human
auaauauauuuuaaauauu

SEQ ID NO: 2490451 - RNA, 14 nt, Human
auaauauauuugug

SEQ ID NO: 2490452 - RNA, 22 nt, Human
augaagacuguuaaaugaaacc

SEQ ID NO: 2490453 - RNA, 21 nt, Human
augaagacuguuaaaugaaac

SEQ ID NO: 2490454 - RNA, 20 nt, Human
augaagagauuuuucaugau

SEQ ID NO: 2490455 - RNA, 11 nt, Human
augaagaggag

SEQ ID NO: 2490456 - RNA, 16 nt, Human
augaauauuuaguguu

SEQ ID NO: 2490457 - RNA, 16 nt, Human
augaagagauuuuuca

SEQ ID NO: 2490458 - RNA, 18 nt, Human
augaagagugagagggca

SEQ ID NO: 2490459 - RNA, 19 nt, Human
augaagagugagagggcau

SEQ ID NO: 2490460 - RNA, 15 nt, Human
augaagaacugagga

SEQ ID NO: 2490461 - RNA, 23 nt, Human
augaacuucgcaucaaaagacaa

SEQ ID NO: 2490462 - RNA, 16 nt, Human
augaagacaggacagu

SEQ ID NO: 2490463 - RNA, 21 nt, Human
augaagacaggacagugcuuc

SEQ ID NO: 2490464 - RNA, 21 nt, Human
augaaagguuuacauugucaa

SEQ ID NO: 2490465 - RNA, 16 nt, Human
augaaaugguuaagaa

SEQ ID NO: 2490466 - RNA, 19 nt, Human
augaaagggcccagagagg

SEQ ID NO: 2490467 - RNA, 16 nt, Human
augaaagguuuacauu

SEQ ID NO: 2490468 - RNA, 20 nt, Human
augaaauugucuagcagagc

SEQ ID NO: 2490469 - RNA, 22 nt, Human
augaaauugucuagcagagcag

SEQ ID NO: 2490470 - RNA, 23 nt, Human
augaaauuacuuaucauccacau

SEQ ID NO: 2490471 - RNA, 16 nt, Human
augaaauuacuuauca

SEQ ID NO: 2490472 - RNA, 22 nt, Human
augaacuucgcaucaaaagaca

SEQ ID NO: 2490473 - RNA, 20 nt, Human
augaacuucgcaucaaaaga

SEQ ID NO: 2490474 - RNA, 17 nt, Human
augaacuucgcaucaaa

SEQ ID NO: 2490475 - RNA, 13 nt, Human
augaacuucgcau

SEQ ID NO: 2490476 - RNA, 23 nt, Human
augaaauugucuagcagagcagg

SEQ ID NO: 2490477 - RNA, 18 nt, Human
augaacuuauucuguaga

SEQ ID NO: 2490478 - RNA, 17 nt, Human
augaacuuauucuguag

SEQ ID NO: 2490479 - RNA, 17 nt, Human
augaaauuuaauauagc

SEQ ID NO: 2490480 - RNA, 12 nt, Human
augaaucaaugg

SEQ ID NO: 2490481 - RNA, 14 nt, Human
augaaucaaagaca

SEQ ID NO: 2490482 - RNA, 23 nt, Human
augaauggcuaagcaaaauguga

SEQ ID NO: 2490483 - RNA, 21 nt, Human
augaauauuuaguguucauaa

SEQ ID NO: 2490484 - RNA, 18 nt, Human
augaaugggcaaaacuga

SEQ ID NO: 2490485 - RNA, 17 nt, Human
augaaugggcaaaacug

SEQ ID NO: 2490486 - RNA, 23 nt, Human
augaauggcucacuauggugcca

SEQ ID NO: 2490487 - RNA, 23 nt, Human
augaauggagauuugaaggucug

SEQ ID NO: 2490488 - RNA, 23 nt, Human
augaauggacucaaacugccuug

SEQ ID NO: 2490489 - RNA, 21 nt, Human
augaaugggcaaaacugaauu

SEQ ID NO: 2490490 - RNA, 21 nt, Human
augaaugggcugagcugccug

SEQ ID NO: 2490491 - RNA, 21 nt, Human
augaaugguauggaacucucu

SEQ ID NO: 2490492 - RNA, 15 nt, Human
augaauuacauuugu

SEQ ID NO: 2490493 - RNA, 15 nt, Human
augaauuaaguuuuu

SEQ ID NO: 2490494 - RNA, 13 nt, Human
augaauguaucag

SEQ ID NO: 2490495 - RNA, 17 nt, Human
augaauuacauuuguau

SEQ ID NO: 2490496 - RNA, 16 nt, Human
augaauuacauuugua

SEQ ID NO: 2490497 - RNA, 15 nt, Human
uuggggaauuuccuc

SEQ ID NO: 2490498 - RNA, 19 nt, Human
uuggggacaucucuuugaa

SEQ ID NO: 2490499 - RNA, 23 nt, Human
uuggggacaggggcaggaggaag

SEQ ID NO: 2490500 - RNA, 18 nt, Human
uuggggaccagagcugcc

SEQ ID NO: 2490501 - RNA, 18 nt, Human
uuggugcacagugauuuu

SEQ ID NO: 2490502 - RNA, 17 nt, Human
uuggugcacagugauuu

SEQ ID NO: 2490503 - RNA, 13 nt, Human
uuggugccuggcc

SEQ ID NO: 2490504 - RNA, 12 nt, Human
uuggugccuggc

SEQ ID NO: 2490505 - RNA, 16 nt, Human
uuggugcaacccuuac

SEQ ID NO: 2490506 - RNA, 15 nt, Human
uuggugcacagugau

SEQ ID NO: 2490507 - RNA, 21 nt, Human
uuggugcaacccuuaccccuu

SEQ ID NO: 2490508 - RNA, 17 nt, Human
uuggggaguuaagaccu

SEQ ID NO: 2490509 - RNA, 19 nt, Human
uuggggaguuaagaccugg

SEQ ID NO: 2490510 - RNA, 20 nt, Human
uuggggaguuaagaccuggc

SEQ ID NO: 2490511 - RNA, 21 nt, Human
uuggggaguuaagaccuggca

SEQ ID NO: 2490512 - RNA, 17 nt, Human
uuggcucacacugagaa

SEQ ID NO: 2490513 - RNA, 16 nt, Human
uuggcucacacugaga

SEQ ID NO: 2490514 - RNA, 22 nt, Human
uuggcucacccaagcaaggcca

SEQ ID NO: 2490515 - RNA, 12 nt, Human
uuggcucaccca

SEQ ID NO: 2490516 - RNA, 13 nt, Human
uuggcucagacau

SEQ ID NO: 2490517 - RNA, 14 nt, Human
uuggcucagacaug

SEQ ID NO: 2490518 - RNA, 17 nt, Human
uuggcucgaaucucugu

SEQ ID NO: 2490519 - RNA, 22 nt, Human
uuggcucccauucacucuucca

SEQ ID NO: 2490520 - RNA, 18 nt, Human
aucuuucuugaucaacau

SEQ ID NO: 2490521 - RNA, 13 nt, Human
aucuuucuugauc

SEQ ID NO: 2490522 - RNA, 19 nt, Human
aucuuucuucuauuuuauu

SEQ ID NO: 2490523 - RNA, 22 nt, Human
aucuuucuucuauuuuauuccc

SEQ ID NO: 2490524 - RNA, 21 nt, Human
uuggcucgaaucucugugccu

SEQ ID NO: 2490525 - RNA, 20 nt, Human
uuggcucgaaucucugugcc

SEQ ID NO: 2490526 - RNA, 11 nt, Human
aucuuucuucu

SEQ ID NO: 2490527 - RNA, 13 nt, Human
aucuuucugcaga

SEQ ID NO: 2490528 - RNA, 15 nt, Human
aucuuugauucuccu

SEQ ID NO: 2490529 - RNA, 14 nt, Human
aucuuugauucucc

SEQ ID NO: 2490530 - RNA, 20 nt, Human
aucuuucuuuaccugagacc

SEQ ID NO: 2490531 - RNA, 18 nt, Human
aucuuucuuuaccugaga

SEQ ID NO: 2490532 - RNA, 17 nt, Human
aucuuucuuuaccugag

SEQ ID NO: 2490533 - RNA, 14 nt, Human
aucuuucuuuaccu

SEQ ID NO: 2490534 - RNA, 22 nt, Human
aucuuucuuuaccugagaccag

SEQ ID NO: 2490535 - RNA, 21 nt, Human
aucuuucuuuaccugagacca

SEQ ID NO: 2490536 - RNA, 15 nt, Human
aucuuucuuucuuag

SEQ ID NO: 2490537 - RNA, 20 nt, Human
aucuuucuuucuuagaaauu

SEQ ID NO: 2490538 - RNA, 17 nt, Human
aucuuucuuucuuagaa

SEQ ID NO: 2490539 - RNA, 21 nt, Human
aucuuucuuucuuagaaauuu

SEQ ID NO: 2490540 - RNA, 21 nt, Human
aucuuucuuuugauucuuccu

SEQ ID NO: 2490541 - RNA, 17 nt, Human
aucuuuucacaaauaaa

SEQ ID NO: 2490542 - RNA, 20 nt, Human
aucuuugauucuccuucagc

SEQ ID NO: 2490543 - RNA, 22 nt, Human
aucuuuucauuuaggugaggaa

SEQ ID NO: 2490544 - RNA, 19 nt, Human
aucuuugauucuccuucag

SEQ ID NO: 2490545 - RNA, 18 nt, Human
aucuuugauucuccuuca

SEQ ID NO: 2490546 - RNA, 17 nt, Human
aucuuugauucuccuuc

SEQ ID NO: 2490547 - RNA, 16 nt, Human
aucuuugauucuccuu

SEQ ID NO: 2490548 - RNA, 17 nt, Human
aucuuugcagacaggca

SEQ ID NO: 2490549 - RNA, 19 nt, Human
aucuuuugaccuguggugc

SEQ ID NO: 2490550 - RNA, 15 nt, Human
aucuuuuguauaguu

SEQ ID NO: 2490551 - RNA, 18 nt, Human
augaaagggcccagagag

SEQ ID NO: 2490552 - RNA, 23 nt, Human
aucuuuucuugccucuguccccu

SEQ ID NO: 2490553 - RNA, 14 nt, Human
aucuuuucuugccu

SEQ ID NO: 2490554 - RNA, 11 nt, Human
aucuuuugaac

SEQ ID NO: 2490555 - RNA, 13 nt, Human
aucuuuucuauuu

SEQ ID NO: 2490556 - RNA, 11 nt, Human
uuggagacaga

SEQ ID NO: 2490557 - RNA, 17 nt, Human
uuggagacauuccuggg

SEQ ID NO: 2490558 - RNA, 18 nt, Human
uugcuugagcccaggagu

SEQ ID NO: 2490559 - RNA, 20 nt, Human
uuggagacacaacuauuuuu

SEQ ID NO: 2490560 - RNA, 16 nt, Human
uugcuugagcccagga

SEQ ID NO: 2490561 - RNA, 17 nt, Human
uugcuugagcccaggag

SEQ ID NO: 2490562 - RNA, 14 nt, Human
uugcuugaaagaaa

SEQ ID NO: 2490563 - RNA, 22 nt, Human
uugcuugaaagaaaauaugcau

SEQ ID NO: 2490564 - RNA, 14 nt, Human
uugcuugagcccag

SEQ ID NO: 2490565 - RNA, 12 nt, Human
uugcuugaaaga

SEQ ID NO: 2490566 - RNA, 15 nt, Human
uugcuugaaagaaaa

SEQ ID NO: 2490567 - RNA, 15 nt, Human
uuggaggggggagcc

SEQ ID NO: 2490568 - RNA, 16 nt, Human
uuggagaguuuccuga

SEQ ID NO: 2490569 - RNA, 17 nt, Human
uuggaggccuuucaucc

SEQ ID NO: 2490570 - RNA, 22 nt, Human
uuggagggucccaagcugggcc

SEQ ID NO: 2490571 - RNA, 21 nt, Human
uuggagggucccaagcugggc

SEQ ID NO: 2490572 - RNA, 17 nt, Human
uuggagggucccaagcu

SEQ ID NO: 2490573 - RNA, 19 nt, Human
uuggagggguuuaugcuca

SEQ ID NO: 2490574 - RNA, 22 nt, Human
uuggagggugggagagcccagc

SEQ ID NO: 2490575 - RNA, 23 nt, Human
uuggagggugggagagcccagcc

SEQ ID NO: 2490576 - RNA, 15 nt, Human
uuggagaguuuccug

SEQ ID NO: 2490577 - RNA, 18 nt, Human
uuggagaguaaaaacuga

SEQ ID NO: 2490578 - RNA, 20 nt, Human
uuggagaguaaaaacugaau

SEQ ID NO: 2490579 - RNA, 22 nt, Human
uuggagagcuagaaccuggaga

SEQ ID NO: 2490580 - RNA, 13 nt, Human
uuggagaguaaaa

SEQ ID NO: 2490581 - RNA, 17 nt, Human
uuggagaguaaaaacug

SEQ ID NO: 2490582 - RNA, 20 nt, Human
uuggagacucuguggggccu

SEQ ID NO: 2490583 - RNA, 13 nt, Human
uuggagacucugu

SEQ ID NO: 2490584 - RNA, 15 nt, Human
uuggagacucugugg

SEQ ID NO: 2490585 - RNA, 19 nt, Human
uuggccuccggccuccccu

SEQ ID NO: 2490586 - RNA, 13 nt, Human
uuggccuccggcc

SEQ ID NO: 2490587 - RNA, 22 nt, Human
uuggccucugcaaaggaaauac

SEQ ID NO: 2490588 - RNA, 17 nt, Human
uuggccuccccugcuga

SEQ ID NO: 2490589 - RNA, 12 nt, Human
uuggccucagaa

SEQ ID NO: 2490590 - RNA, 22 nt, Human
uuggccgggugcgguggcucac

SEQ ID NO: 2490591 - RNA, 19 nt, Human
uuggcccccgagcuggggg

SEQ ID NO: 2490592 - RNA, 23 nt, Human
uuggcuauuagagaucaaccccu

SEQ ID NO: 2490593 - RNA, 17 nt, Human
uuggcuauuuaaaacuu

SEQ ID NO: 2490594 - RNA, 16 nt, Human
uuggcuauuuaaaacu

SEQ ID NO: 2490595 - RNA, 13 nt, Human
uuggcucaauccu

SEQ ID NO: 2490596 - RNA, 14 nt, Human
uuggcucaauccuc

SEQ ID NO: 2490597 - RNA, 23 nt, Human
uuggaguccccucaccuccucua

SEQ ID NO: 2490598 - RNA, 18 nt, Human
uuggaggugcuuaagcag

SEQ ID NO: 2490599 - RNA, 23 nt, Human
uuggagggucccaagcugggccc

SEQ ID NO: 2490600 - RNA, 23 nt, Human
uuggaggugcuuaagcagaagca

SEQ ID NO: 2490601 - RNA, 16 nt, Human
uuggagggugucccaa

SEQ ID NO: 2490602 - RNA, 18 nt, Human
uuggccccugcccggcug

SEQ ID NO: 2490603 - RNA, 15 nt, Human
uuggagucuuccaaa

SEQ ID NO: 2490604 - RNA, 20 nt, Human
uuggagugaguguggcuccc

SEQ ID NO: 2490605 - RNA, 15 nt, Human
uuggcccccgagcug

SEQ ID NO: 2490606 - RNA, 16 nt, Human
uuggcccccgagcugg

SEQ ID NO: 2490607 - RNA, 12 nt, Human
aucugcccagga

SEQ ID NO: 2490608 - RNA, 23 nt, Human
aucugcccaggggugcccccucc

SEQ ID NO: 2490609 - RNA, 22 nt, Human
aucugcccaggggugcccccuc

SEQ ID NO: 2490610 - RNA, 21 nt, Human
aucugcccaggggugcccccu

SEQ ID NO: 2490611 - RNA, 19 nt, Human
aucugcccaggggugcccc

SEQ ID NO: 2490612 - RNA, 16 nt, Human
aucugcccaggggugc

SEQ ID NO: 2490613 - RNA, 15 nt, Human
aucugcccaggggug

SEQ ID NO: 2490614 - RNA, 13 nt, Human
aucugcccagggg

SEQ ID NO: 2490615 - RNA, 13 nt, Human
aucugcccaggac

SEQ ID NO: 2490616 - RNA, 11 nt, Human
aucugccccuc

SEQ ID NO: 2490617 - RNA, 12 nt, Human
aucugccccucc

SEQ ID NO: 2490618 - RNA, 15 nt, Human
aucugccccuccccc

SEQ ID NO: 2490619 - RNA, 16 nt, Human
aucugccccuccccca

SEQ ID NO: 2490620 - RNA, 17 nt, Human
uugcauuuuaaaaauga

SEQ ID NO: 2490621 - RNA, 12 nt, Human
uugcauuuuugc

SEQ ID NO: 2490622 - RNA, 22 nt, Human
uugcauuuaaaacagacacugg

SEQ ID NO: 2490623 - RNA, 15 nt, Human
uugcauuuaugguca

SEQ ID NO: 2490624 - RNA, 15 nt, Human
uugcauuugcucuuu

SEQ ID NO: 2490625 - RNA, 21 nt, Human
uugcauuuggauugggguccc

SEQ ID NO: 2490626 - RNA, 15 nt, Human
uugcauuuggucaag

SEQ ID NO: 2490627 - RNA, 17 nt, Human
aucugccuuaaaaccaa

SEQ ID NO: 2490628 - RNA, 19 nt, Human
aucugccuuaaaaccaaag

SEQ ID NO: 2490629 - RNA, 18 nt, Human
aucugccuuaaaaccaaa

SEQ ID NO: 2490630 - RNA, 16 nt, Human
aucugccuuuauugug

SEQ ID NO: 2490631 - RNA, 16 nt, Human
aucugccccucccugc

SEQ ID NO: 2490632 - RNA, 14 nt, Human
aucugccccucccu

SEQ ID NO: 2490633 - RNA, 17 nt, Human
aucugccccucccccaa

SEQ ID NO: 2490634 - RNA, 16 nt, Human
aucugcgugacaauaa

SEQ ID NO: 2490635 - RNA, 21 nt, Human
aucugccuuaaaaccaaagag

SEQ ID NO: 2490636 - RNA, 22 nt, Human
aucugccuuuauuguguuuguc

SEQ ID NO: 2490637 - RNA, 21 nt, Human
aucugccuuuauuguguuugu

SEQ ID NO: 2490638 - RNA, 19 nt, Human
aucugccuuuauuguguuu

SEQ ID NO: 2490639 - RNA, 23 nt, Human
aucugcgugacaauaaaacauua

SEQ ID NO: 2490640 - RNA, 22 nt, Human
aucugcgugacaauaaaacauu

SEQ ID NO: 2490641 - RNA, 21 nt, Human
aucugcgugacaauaaaacau

SEQ ID NO: 2490642 - RNA, 17 nt, Human
aucugcgugacaauaaa

SEQ ID NO: 2490643 - RNA, 14 nt, Human
aucugcuaauaaaa

SEQ ID NO: 2490644 - RNA, 20 nt, Human
aucugcuagggaauaucaau

SEQ ID NO: 2490645 - RNA, 15 nt, Human
aucuguccucagccu

SEQ ID NO: 2490646 - RNA, 16 nt, Human
aucuguccucagccuu

SEQ ID NO: 2490647 - RNA, 17 nt, Human
aucuguccucagccuug

SEQ ID NO: 2490648 - RNA, 18 nt, Human
aucuguccucagccuugc

SEQ ID NO: 2490649 - RNA, 21 nt, Human
aucuguccucagccuugccag

SEQ ID NO: 2490650 - RNA, 17 nt, Human
aucugugaaaggaaaga

SEQ ID NO: 2490651 - RNA, 16 nt, Human
aucugucugguggccc

SEQ ID NO: 2490652 - RNA, 14 nt, Human
aucugucugguggc

SEQ ID NO: 2490653 - RNA, 13 nt, Human
aucuguccaagga

SEQ ID NO: 2490654 - RNA, 17 nt, Human
aucuguauuuaauuuug

SEQ ID NO: 2490655 - RNA, 14 nt, Human
aucuguccaaggaa

SEQ ID NO: 2490656 - RNA, 16 nt, Human
aucugucccugccuca

SEQ ID NO: 2490657 - RNA, 14 nt, Human
aucuguccucagcc

SEQ ID NO: 2490658 - RNA, 18 nt, Human
aucuguccaaaggaggcu

SEQ ID NO: 2490659 - RNA, 19 nt, Human
aucuguccaaaggaggcug

SEQ ID NO: 2490660 - RNA, 21 nt, Human
aucuguccaaaggaggcuggc

SEQ ID NO: 2490661 - RNA, 23 nt, Human
aucuguccaaaggaggcuggcag

SEQ ID NO: 2490662 - RNA, 18 nt, Human
aucuguauuuaauuuuga

SEQ ID NO: 2490663 - RNA, 15 nt, Human
aucuguauuuaauuu

SEQ ID NO: 2490664 - RNA, 13 nt, Human
aucuguaucucuc

SEQ ID NO: 2490665 - RNA, 22 nt, Human
aucuguauauaaaauauuuuca

SEQ ID NO: 2490666 - RNA, 21 nt, Human
aucuguauauacaauaacaua

SEQ ID NO: 2490667 - RNA, 15 nt, Human
aucuguaucucucuc

SEQ ID NO: 2490668 - RNA, 14 nt, Human
aucuguaucucucu

SEQ ID NO: 2490669 - RNA, 17 nt, Human
aucuggugacuuuccuc

SEQ ID NO: 2490670 - RNA, 16 nt, Human
aucuggugacuuuccu

SEQ ID NO: 2490671 - RNA, 10 nt, Human
aucuggugac

SEQ ID NO: 2490672 - RNA, 16 nt, Human
aucugcucagcccugg

SEQ ID NO: 2490673 - RNA, 15 nt, Human
aucugcucagcccug

SEQ ID NO: 2490674 - RNA, 14 nt, Human
aucugcucagcccu

SEQ ID NO: 2490675 - RNA, 13 nt, Human
aucugcucagccc

SEQ ID NO: 2490676 - RNA, 15 nt, Human
aucugcucagcagcu

SEQ ID NO: 2490677 - RNA, 14 nt, Human
aucugcucagcagc

SEQ ID NO: 2490678 - RNA, 23 nt, Human
aucuguauaaguaagaaaauauu

SEQ ID NO: 2490679 - RNA, 20 nt, Human
aucuguauaaguaagaaaau

SEQ ID NO: 2490680 - RNA, 19 nt, Human
aucuguauaaguaagaaaa

SEQ ID NO: 2490681 - RNA, 18 nt, Human
aucuguauacccucuguu

SEQ ID NO: 2490682 - RNA, 19 nt, Human
aucuguauauaaaauauuu

SEQ ID NO: 2490683 - RNA, 17 nt, Human
aucuguauauaaaauau

SEQ ID NO: 2490684 - RNA, 16 nt, Human
aucuguauauaaaaua

SEQ ID NO: 2490685 - RNA, 21 nt, Human
aucuguauaaguaagaaaaua

SEQ ID NO: 2490686 - RNA, 14 nt, Human
aucuguauauacaa

SEQ ID NO: 2490687 - RNA, 20 nt, Human
aucuguauauacaauaacau

SEQ ID NO: 2490688 - RNA, 17 nt, Human
aucuguauaaguaagaa

SEQ ID NO: 2490689 - RNA, 18 nt, Human
aucuguagggcuggaccu

SEQ ID NO: 2490690 - RNA, 17 nt, Human
aucuguagggcuggacc

SEQ ID NO: 2490691 - RNA, 15 nt, Human
aucuguagggcugga

SEQ ID NO: 2490692 - RNA, 22 nt, Human
aucugguuugacuccgcuggag

SEQ ID NO: 2490693 - RNA, 14 nt, Human
aucuguagggcugg

SEQ ID NO: 2490694 - RNA, 18 nt, Human
aucugcucagcccuggag

SEQ ID NO: 2490695 - RNA, 17 nt, Human
aucugcucagcccugga

SEQ ID NO: 2490696 - RNA, 14 nt, Human
aucuuauaauuuaa

SEQ ID NO: 2490697 - RNA, 23 nt, Human
aucuuaguuuggauucuuaugua

SEQ ID NO: 2490698 - RNA, 24 nt, Human
aucuugcaccccaaagcuuuccug

SEQ ID NO: 2490699 - RNA, 23 nt, Human
aucuugaucugcucagcccugga

SEQ ID NO: 2490700 - RNA, 23 nt, Human
aucuugguaaauuuccccaacag

SEQ ID NO: 2490701 - RNA, 19 nt, Human
aucuugguccaggaaaugu

SEQ ID NO: 2490702 - RNA, 22 nt, Human
aucuugguacuacuagaugucu

SEQ ID NO: 2490703 - RNA, 23 nt, Human
aucuugguccaggaaaugugcac

SEQ ID NO: 2490704 - RNA, 13 nt, Human
aucuugcucugcu

SEQ ID NO: 2490705 - RNA, 20 nt, Human
aucuuggucagauuugaacu

SEQ ID NO: 2490706 - RNA, 18 nt, Human
aucugugaaaggaaagag

SEQ ID NO: 2490707 - RNA, 15 nt, Human
aucuguuuacagugu

SEQ ID NO: 2490708 - RNA, 17 nt, Human
aucuguuuacaguguuc

SEQ ID NO: 2490709 - RNA, 14 nt, Human
aucuguuucccagc

SEQ ID NO: 2490710 - RNA, 13 nt, Human
aucuguuucccag

SEQ ID NO: 2490711 - RNA, 14 nt, Human
aucuguuuuaaauu

SEQ ID NO: 2490712 - RNA, 17 nt, Human
aucuguuuugaaggcaa

SEQ ID NO: 2490713 - RNA, 18 nt, Human
aucuguuuugaaggcaaa

SEQ ID NO: 2490714 - RNA, 22 nt, Human
aucuguuuuaaauuuauuucaa

SEQ ID NO: 2490715 - RNA, 19 nt, Human
aucuguuuugaaggcaaaa

SEQ ID NO: 2490716 - RNA, 18 nt, Human
aucuguuuuuaaaaauca

SEQ ID NO: 2490717 - RNA, 19 nt, Human
aucuguuuuuaaaaaucau

SEQ ID NO: 2490718 - RNA, 20 nt, Human
aucuuaggggagagcuuucu

SEQ ID NO: 2490719 - RNA, 22 nt, Human
aucuuaguuuggauucuuaugu

SEQ ID NO: 2490720 - RNA, 14 nt, Human
aucuuaguuuggau

SEQ ID NO: 2490721 - RNA, 16 nt, Human
aucuuaguauuugcau

SEQ ID NO: 2490722 - RNA, 18 nt, Human
aucuuagugccugagagu

SEQ ID NO: 2490723 - RNA, 12 nt, Human
aucuuagugguu

SEQ ID NO: 2490724 - RNA, 21 nt, Human
aucuuagugccugagaguauu

SEQ ID NO: 2490725 - RNA, 17 nt, Human
uugcuauuagagcauug

SEQ ID NO: 2490726 - RNA, 14 nt, Human
uugcuauuagagca

SEQ ID NO: 2490727 - RNA, 22 nt, Human
uugcuauuagacuguaggaaga

SEQ ID NO: 2490728 - RNA, 12 nt, Human
uugcuauuguaa

SEQ ID NO: 2490729 - RNA, 19 nt, Human
uugcuauuguaaauauguu

SEQ ID NO: 2490730 - RNA, 15 nt, Human
uugcuauuguaaaua

SEQ ID NO: 2490731 - RNA, 17 nt, Human
uugcucaaaaaaugagc

SEQ ID NO: 2490732 - RNA, 15 nt, Human
aucuugucucugggc

SEQ ID NO: 2490733 - RNA, 23 nt, Human
aucuugucucaaugcucauaacg

SEQ ID NO: 2490734 - RNA, 14 nt, Human
aucuugucucuggg

SEQ ID NO: 2490735 - RNA, 20 nt, Human
aucuugucucaaugcucaua

SEQ ID NO: 2490736 - RNA, 16 nt, Human
aucuugucucaaugcu

SEQ ID NO: 2490737 - RNA, 15 nt, Human
aucuugucucaaugc

SEQ ID NO: 2490738 - RNA, 14 nt, Human
aucuugucucaaug

SEQ ID NO: 2490739 - RNA, 13 nt, Human
aucuugucucaau

SEQ ID NO: 2490740 - RNA, 19 nt, Human
uugcucaaaucuauucaga

SEQ ID NO: 2490741 - RNA, 16 nt, Human
uugcucaaaaaucugu

SEQ ID NO: 2490742 - RNA, 18 nt, Human
uugcucaaaaaaugagcu

SEQ ID NO: 2490743 - RNA, 13 nt, Human
uugcucaccuggg

SEQ ID NO: 2490744 - RNA, 15 nt, Human
uugcucaccuggggu

SEQ ID NO: 2490745 - RNA, 21 nt, Human
uugcucuccccugcccugcug

SEQ ID NO: 2490746 - RNA, 13 nt, Human
uugcucagucucc

SEQ ID NO: 2490747 - RNA, 12 nt, Human
uugcuccuugac

SEQ ID NO: 2490748 - RNA, 16 nt, Human
uugcucucccucuucu

SEQ ID NO: 2490749 - RNA, 13 nt, Human
uugcucucccucu

SEQ ID NO: 2490750 - RNA, 23 nt, Human
uugcucucccgguucuuccagug

SEQ ID NO: 2490751 - RNA, 22 nt, Human
uugcucucccgguucuuccagu

SEQ ID NO: 2490752 - RNA, 21 nt, Human
uugcucucccgguucuuccag

SEQ ID NO: 2490753 - RNA, 20 nt, Human
uugcucucccgguucuucca

SEQ ID NO: 2490754 - RNA, 13 nt, Human
uugcucucccggu

SEQ ID NO: 2490755 - RNA, 17 nt, Human
uugcucugcaggcaccu

SEQ ID NO: 2490756 - RNA, 15 nt, Human
uugcucugcaggcac

SEQ ID NO: 2490757 - RNA, 13 nt, Human
uugcucugcaccc

SEQ ID NO: 2490758 - RNA, 12 nt, Human
uugcucugcacc

SEQ ID NO: 2490759 - RNA, 23 nt, Human
uugcucucccucuucucaagugc

SEQ ID NO: 2490760 - RNA, 18 nt, Human
uugcucucccucuucuca

SEQ ID NO: 2490761 - RNA, 20 nt, Human
uugcucucuggccuuuuccu

SEQ ID NO: 2490762 - RNA, 13 nt, Human
uugcuugaaacca

SEQ ID NO: 2490763 - RNA, 20 nt, Human
uugcucugccaacuucuuca

SEQ ID NO: 2490764 - RNA, 22 nt, Human
uugcuucuucuccuauguguaa

SEQ ID NO: 2490765 - RNA, 11 nt, Human
auccuccugca

SEQ ID NO: 2490766 - RNA, 14 nt, Human
auccuccucccacc

SEQ ID NO: 2490767 - RNA, 23 nt, Human
auccuagccuuauccucugaucu

SEQ ID NO: 2490768 - RNA, 20 nt, Human
auccucucaaccaccuuuca

SEQ ID NO: 2490769 - RNA, 18 nt, Human
auccucugagugugacca

SEQ ID NO: 2490770 - RNA, 12 nt, Human
auccucugaucu

SEQ ID NO: 2490771 - RNA, 10 nt, Human
auccucuggc

SEQ ID NO: 2490772 - RNA, 17 nt, Human
auccucuguacagagcc

SEQ ID NO: 2490773 - RNA, 16 nt, Human
auccucuguacagagc

SEQ ID NO: 2490774 - RNA, 20 nt, Human
auccucuguaaacuuuuugu

SEQ ID NO: 2490775 - RNA, 19 nt, Human
aucgugccguuacucucca

SEQ ID NO: 2490776 - RNA, 14 nt, Human
auccucuggcuggc

SEQ ID NO: 2490777 - RNA, 23 nt, Human
aucgugccguuacucuccaaccu

SEQ ID NO: 2490778 - RNA, 12 nt, Human
aucgugcuaaau

SEQ ID NO: 2490779 - RNA, 15 nt, Human
aucgugcuaaauuuu

SEQ ID NO: 2490780 - RNA, 17 nt, Human
aucgugcuaaauuuuca

SEQ ID NO: 2490781 - RNA, 12 nt, Human
aucguggagaca

SEQ ID NO: 2490782 - RNA, 16 nt, Human
aucgugcuaaauuuuc

SEQ ID NO: 2490783 - RNA, 22 nt, Human
aucguuaguaucuaacauguau

SEQ ID NO: 2490784 - RNA, 17 nt, Human
aucuaaauggaaccacu

SEQ ID NO: 2490785 - RNA, 18 nt, Human
aucuaaauggaaccacuc

SEQ ID NO: 2490786 - RNA, 15 nt, Human
uugaagccaaagaaa

SEQ ID NO: 2490787 - RNA, 14 nt, Human
uugaagccaaagaa

SEQ ID NO: 2490788 - RNA, 11 nt, Human
uugaagccaaa

SEQ ID NO: 2490789 - RNA, 23 nt, Human
uugaagcauuuuauaaaucgcuu

SEQ ID NO: 2490790 - RNA, 20 nt, Human
uugaagccaaguggggugcu

SEQ ID NO: 2490791 - RNA, 23 nt, Human
uugaagccaagucagcuuugccu

SEQ ID NO: 2490792 - RNA, 13 nt, Human
uugaagccacuga

SEQ ID NO: 2490793 - RNA, 17 nt, Human
uugaagccacugaagcu

SEQ ID NO: 2490794 - RNA, 21 nt, Human
uugaagccacugaagcuggga

SEQ ID NO: 2490795 - RNA, 13 nt, Human
aucuaaauggaac

SEQ ID NO: 2490796 - RNA, 21 nt, Human
aucguuauguguguauaugua

SEQ ID NO: 2490797 - RNA, 15 nt, Human
aucguuccaguuccc

SEQ ID NO: 2490798 - RNA, 14 nt, Human
aucguuaugugugu

SEQ ID NO: 2490799 - RNA, 15 nt, Human
aucguuaugugugua

SEQ ID NO: 2490800 - RNA, 16 nt, Human
aucguuauguguguau

SEQ ID NO: 2490801 - RNA, 18 nt, Human
aucguuauguguguauau

SEQ ID NO: 2490802 - RNA, 14 nt, Human
aucguucucugccu

SEQ ID NO: 2490803 - RNA, 10 nt, Human
uugaaucaau

SEQ ID NO: 2490804 - RNA, 22 nt, Human
uugaaucaauaauauauuuucu

SEQ ID NO: 2490805 - RNA, 14 nt, Human
uugaaucaauaaua

SEQ ID NO: 2490806 - RNA, 13 nt, Human
uugaaucacagua

SEQ ID NO: 2490807 - RNA, 22 nt, Human
uugaauaaugguaccagauaaa

SEQ ID NO: 2490808 - RNA, 19 nt, Human
uugaauaaugguaccagau

SEQ ID NO: 2490809 - RNA, 12 nt, Human
uugaauaauggu

SEQ ID NO: 2490810 - RNA, 12 nt, Human
uugaauaaauaa

SEQ ID NO: 2490811 - RNA, 17 nt, Human
uugacagaacacugucu

SEQ ID NO: 2490812 - RNA, 16 nt, Human
uugacagaacacuguc

SEQ ID NO: 2490813 - RNA, 15 nt, Human
uugacagaacacugu

SEQ ID NO: 2490814 - RNA, 14 nt, Human
uugacagaacacug

SEQ ID NO: 2490815 - RNA, 23 nt, Human
uugaaucaauaauauauuuucug

SEQ ID NO: 2490816 - RNA, 17 nt, Human
uugaaucaguauaaaca

SEQ ID NO: 2490817 - RNA, 23 nt, Human
uugaaucauguaguaucaaauau

SEQ ID NO: 2490818 - RNA, 22 nt, Human
uugaaucauguaguaucaaaua

SEQ ID NO: 2490819 - RNA, 17 nt, Human
uugaauccaugcuuggg

SEQ ID NO: 2490820 - RNA, 19 nt, Human
uugaauccaugcuugggug

SEQ ID NO: 2490821 - RNA, 17 nt, Human
uugaaucuauuuaagua

SEQ ID NO: 2490822 - RNA, 15 nt, Human
uugaauccucucucu

SEQ ID NO: 2490823 - RNA, 15 nt, Human
uugaaucuauuuaag

SEQ ID NO: 2490824 - RNA, 13 nt, Human
uugaagccugccc

SEQ ID NO: 2490825 - RNA, 21 nt, Human
uugaagccugcccuugucuga

SEQ ID NO: 2490826 - RNA, 13 nt, Human
uugaagccuuugu

SEQ ID NO: 2490827 - RNA, 14 nt, Human
uugaagcuaagauu

SEQ ID NO: 2490828 - RNA, 13 nt, Human
uugaagcucuggu

SEQ ID NO: 2490829 - RNA, 17 nt, Human
uugaaggcaaaauugca

SEQ ID NO: 2490830 - RNA, 15 nt, Human
uugaaggcagaaagc

SEQ ID NO: 2490831 - RNA, 17 nt, Human
uugaaggcagaaagcaa

SEQ ID NO: 2490832 - RNA, 12 nt, Human
uugaaggcaaaa

SEQ ID NO: 2490833 - RNA, 15 nt, Human
uugaaggcaaaauug

SEQ ID NO: 2490834 - RNA, 23 nt, Human
uugaagcucuggugacaccagcc

SEQ ID NO: 2490835 - RNA, 17 nt, Human
uugaagggaaauuucag

SEQ ID NO: 2490836 - RNA, 12 nt, Human
uugaauaaacua

SEQ ID NO: 2490837 - RNA, 19 nt, Human
uugaauaaaguugaagcua

SEQ ID NO: 2490838 - RNA, 21 nt, Human
uugaauaaagccugcuuuuua

SEQ ID NO: 2490839 - RNA, 16 nt, Human
uugaauaaaaaugcac

SEQ ID NO: 2490840 - RNA, 20 nt, Human
uugaauaaaaauauguacaa

SEQ ID NO: 2490841 - RNA, 21 nt, Human
uugaauaaaaacuuugcuaaa

SEQ ID NO: 2490842 - RNA, 14 nt, Human
uugacagcuuugcu

SEQ ID NO: 2490843 - RNA, 17 nt, Human
uugacagcuuugcugcu

SEQ ID NO: 2490844 - RNA, 18 nt, Human
uugacagcuuugcugcug

SEQ ID NO: 2490845 - RNA, 19 nt, Human
uugacuguuuuuacccaua

SEQ ID NO: 2490846 - RNA, 18 nt, Human
uugacagaucaagcugug

SEQ ID NO: 2490847 - RNA, 17 nt, Human
uugacagaucaagcugu

SEQ ID NO: 2490848 - RNA, 19 nt, Human
uugacagaucaagcuguga

SEQ ID NO: 2490849 - RNA, 16 nt, Human
uugacuuauuuucucu

SEQ ID NO: 2490850 - RNA, 12 nt, Human
uugacuuucagg

SEQ ID NO: 2490851 - RNA, 21 nt, Human
uugacuugacagaacacuguc

SEQ ID NO: 2490852 - RNA, 15 nt, Human
uugacuuauuuucuc

SEQ ID NO: 2490853 - RNA, 23 nt, Human
uugacuguuuuuacccauauccc

SEQ ID NO: 2490854 - RNA, 20 nt, Human
uugacuugacagaacacugu

SEQ ID NO: 2490855 - RNA, 19 nt, Human
uugacuugacagaacacug

SEQ ID NO: 2490856 - RNA, 12 nt, Human
uugagacagagu

SEQ ID NO: 2490857 - RNA, 13 nt, Human
uugacuuucaggu

SEQ ID NO: 2490858 - RNA, 14 nt, Human
uugacuuucaggua

SEQ ID NO: 2490859 - RNA, 15 nt, Human
uugacuuucagguac

SEQ ID NO: 2490860 - RNA, 21 nt, Human
uugacuuucagguacuaaaua

SEQ ID NO: 2490861 - RNA, 19 nt, Human
uugagacaguuucuuagcu

SEQ ID NO: 2490862 - RNA, 17 nt, Human
uugagacaguuucuuag

SEQ ID NO: 2490863 - RNA, 13 nt, Human
uugagacaguuuc

SEQ ID NO: 2490864 - RNA, 12 nt, Human
uugagacaguuu

SEQ ID NO: 2490865 - RNA, 13 nt, Human
uugagaccagccu

SEQ ID NO: 2490866 - RNA, 15 nt, Human
uugagaccagccugg

SEQ ID NO: 2490867 - RNA, 11 nt, Human
uugacuuuguc

SEQ ID NO: 2490868 - RNA, 12 nt, Human
uugacuuugucu

SEQ ID NO: 2490869 - RNA, 17 nt, Human
uugagauuagagggagg

SEQ ID NO: 2490870 - RNA, 17 nt, Human
uugagauguauuucaac

SEQ ID NO: 2490871 - RNA, 16 nt, Human
uugagauguguucaca

SEQ ID NO: 2490872 - RNA, 13 nt, Human
uugaguagaggcu

SEQ ID NO: 2490873 - RNA, 12 nt, Human
uugagauuagag

SEQ ID NO: 2490874 - RNA, 16 nt, Human
uugagucaaaaaaucu

SEQ ID NO: 2490875 - RNA, 22 nt, Human
uugagucauuauccuugcuaug

SEQ ID NO: 2490876 - RNA, 14 nt, Human
uugagucugugcca

SEQ ID NO: 2490877 - RNA, 22 nt, Human
uugagacaguuucuuagcuuuu

SEQ ID NO: 2490878 - RNA, 14 nt, Human
uugagaccucagcc

SEQ ID NO: 2490879 - RNA, 15 nt, Human
uugagaccucagcca

SEQ ID NO: 2490880 - RNA, 14 nt, Human
uugagacuaguuuu

SEQ ID NO: 2490881 - RNA, 15 nt, Human
uugagaucagccugg

SEQ ID NO: 2490882 - RNA, 16 nt, Human
uugagaucagccuggg

SEQ ID NO: 2490883 - RNA, 17 nt, Human
uugagaccucagccaug

SEQ ID NO: 2490884 - RNA, 19 nt, Human
aucuacacuccagugagac

SEQ ID NO: 2490885 - RNA, 20 nt, Human
aucuacaucuuuuuucacaa

SEQ ID NO: 2490886 - RNA, 17 nt, Human
aucuacaucuuuuuuca

SEQ ID NO: 2490887 - RNA, 14 nt, Human
aucuacaucuuuuu

SEQ ID NO: 2490888 - RNA, 21 nt, Human
aucuacaucuuuuuucacaaa

SEQ ID NO: 2490889 - RNA, 18 nt, Human
aucuacacuccagugaga

SEQ ID NO: 2490890 - RNA, 23 nt, Human
aucuaauauggccacaguagucu

SEQ ID NO: 2490891 - RNA, 15 nt, Human
uugauaccccccucu

SEQ ID NO: 2490892 - RNA, 13 nt, Human
uugauaccccccu

SEQ ID NO: 2490893 - RNA, 21 nt, Human
aucuaauagcggguuacuuuc

SEQ ID NO: 2490894 - RNA, 22 nt, Human
aucuaauaccucugugugcucc

SEQ ID NO: 2490895 - RNA, 22 nt, Human
aucuaauagcggguuacuuuca

SEQ ID NO: 2490896 - RNA, 16 nt, Human
aucuaauauggccaca

SEQ ID NO: 2490897 - RNA, 18 nt, Human
aucuaauauguaacaagc

SEQ ID NO: 2490898 - RNA, 22 nt, Human
uugauaauguuaaauuuguaag

SEQ ID NO: 2490899 - RNA, 21 nt, Human
uugauaauguuaaauuuguaa

SEQ ID NO: 2490900 - RNA, 20 nt, Human
uugauaauguuaaauuugua

SEQ ID NO: 2490901 - RNA, 19 nt, Human
uugauaauguuaaauuugu

SEQ ID NO: 2490902 - RNA, 18 nt, Human
uugauaauguuaaauuug

SEQ ID NO: 2490903 - RNA, 15 nt, Human
uugauaauguuaaau

SEQ ID NO: 2490904 - RNA, 14 nt, Human
uugauaauguuaaa

SEQ ID NO: 2490905 - RNA, 23 nt, Human
uugauaauugcauucaucuugug

SEQ ID NO: 2490906 - RNA, 15 nt, Human
uugauaauugcauuc

SEQ ID NO: 2490907 - RNA, 13 nt, Human
uugauaauguuaa

SEQ ID NO: 2490908 - RNA, 18 nt, Human
uugaguuuucuucuguga

SEQ ID NO: 2490909 - RNA, 19 nt, Human
uugaguuuucuucugugau

SEQ ID NO: 2490910 - RNA, 14 nt, Human
uugaguuuucagug

SEQ ID NO: 2490911 - RNA, 19 nt, Human
uugaguuuucaguggggca

SEQ ID NO: 2490912 - RNA, 20 nt, Human
uugaguuuuauuuauuuuau

SEQ ID NO: 2490913 - RNA, 16 nt, Human
uugaguuuuauuuauu

SEQ ID NO: 2490914 - RNA, 23 nt, Human
uugaguuugucgcucaugugugc

SEQ ID NO: 2490915 - RNA, 11 nt, Human
uugaguuuguc

SEQ ID NO: 2490916 - RNA, 22 nt, Human
uugaguuuccucaggcugcugg

SEQ ID NO: 2490917 - RNA, 12 nt, Human
uugagugauuau

SEQ ID NO: 2490918 - RNA, 19 nt, Human
uugaguuuccucaggcugc

SEQ ID NO: 2490919 - RNA, 16 nt, Human
uugaguucagguagcu

SEQ ID NO: 2490920 - RNA, 20 nt, Human
uugaguugauucagcucugc

SEQ ID NO: 2490921 - RNA, 20 nt, Human
uugagugaagcugggagaac

SEQ ID NO: 2490922 - RNA, 20 nt, Human
uugagugacucgaggguugg

SEQ ID NO: 2490923 - RNA, 14 nt, Human
uugagugacucgag

SEQ ID NO: 2490924 - RNA, 16 nt, Human
aucugaaaauguaugu

SEQ ID NO: 2490925 - RNA, 19 nt, Human
aucugaaaauguaugugua

SEQ ID NO: 2490926 - RNA, 20 nt, Human
aucugaaaauguauguguaa

SEQ ID NO: 2490927 - RNA, 22 nt, Human
aucugaaaauguauguguaagu

SEQ ID NO: 2490928 - RNA, 18 nt, Human
aucucuugagccugggag

SEQ ID NO: 2490929 - RNA, 14 nt, Human
aucugaaaauguau

SEQ ID NO: 2490930 - RNA, 14 nt, Human
aucucuucuuuuaa

SEQ ID NO: 2490931 - RNA, 20 nt, Human
aucucuucuuuuggcuucca

SEQ ID NO: 2490932 - RNA, 15 nt, Human
aucucuugagccugg

SEQ ID NO: 2490933 - RNA, 17 nt, Human
aucucccccagccccau

SEQ ID NO: 2490934 - RNA, 16 nt, Human
aucucccccagcccca

SEQ ID NO: 2490935 - RNA, 21 nt, Human
aucucuucuggguuccuuccu

SEQ ID NO: 2490936 - RNA, 19 nt, Human
aucuccaccugcucccagg

SEQ ID NO: 2490937 - RNA, 14 nt, Human
aucucccccagccc

SEQ ID NO: 2490938 - RNA, 15 nt, Human
aucucccccagcccc

SEQ ID NO: 2490939 - RNA, 15 nt, Human
aucuccaccugcucc

SEQ ID NO: 2490940 - RNA, 13 nt, Human
aucuccaccugcu

SEQ ID NO: 2490941 - RNA, 22 nt, Human
aucuccacccccagcugcuugu

SEQ ID NO: 2490942 - RNA, 21 nt, Human
aucuccacccccagcugcuug

SEQ ID NO: 2490943 - RNA, 19 nt, Human
aucuccacccccagcugcu

SEQ ID NO: 2490944 - RNA, 15 nt, Human
aucuccacccccagc

SEQ ID NO: 2490945 - RNA, 12 nt, Human
aucuccaaggac

SEQ ID NO: 2490946 - RNA, 16 nt, Human
aucuccaaggaccagg

SEQ ID NO: 2490947 - RNA, 19 nt, Human
aucuccacagucaaagaag

SEQ ID NO: 2490948 - RNA, 18 nt, Human
aucuccaagaaugcugaa

SEQ ID NO: 2490949 - RNA, 17 nt, Human
aucuccaagaaugcuga

SEQ ID NO: 2490950 - RNA, 16 nt, Human
aucuccaagaaugcug

SEQ ID NO: 2490951 - RNA, 15 nt, Human
aucuccaagaaugcu

SEQ ID NO: 2490952 - RNA, 22 nt, Human
aucuccaagaaugcugaaacca

SEQ ID NO: 2490953 - RNA, 20 nt, Human
aucuccaagaaugcugaaac

SEQ ID NO: 2490954 - RNA, 18 nt, Human
aucuccaagaccagagau

SEQ ID NO: 2490955 - RNA, 19 nt, Human
aucucauguaucaucugga

SEQ ID NO: 2490956 - RNA, 16 nt, Human
aucucauguaucaucu

SEQ ID NO: 2490957 - RNA, 16 nt, Human
aucucauugcuuacaa

SEQ ID NO: 2490958 - RNA, 17 nt, Human
aucucauugcuuacaag

SEQ ID NO: 2490959 - RNA, 14 nt, Human
aucucauuggaccc

SEQ ID NO: 2490960 - RNA, 15 nt, Human
aucucauuggacccu

SEQ ID NO: 2490961 - RNA, 19 nt, Human
aucucauuggacccuucca

SEQ ID NO: 2490962 - RNA, 20 nt, Human
aucucauuggacccuuccau

SEQ ID NO: 2490963 - RNA, 14 nt, Human
aucucauuuccaag

SEQ ID NO: 2490964 - RNA, 14 nt, Human
aucuccaaaauaaa

SEQ ID NO: 2490965 - RNA, 17 nt, Human
aucuccaaaauaaaacu

SEQ ID NO: 2490966 - RNA, 20 nt, Human
aucuccaaaauaaaacuuuu

SEQ ID NO: 2490967 - RNA, 21 nt, Human
aucuccaaaauaaaacuuuuu

SEQ ID NO: 2490968 - RNA, 14 nt, Human
aucuccaagaaugc

SEQ ID NO: 2490969 - RNA, 13 nt, Human
aucuccaagaaug

SEQ ID NO: 2490970 - RNA, 13 nt, Human
aucuccaaaauaa

SEQ ID NO: 2490971 - RNA, 21 nt, Human
aucucaggggcuguuugagga

SEQ ID NO: 2490972 - RNA, 20 nt, Human
aucucaggggcuguuugagg

SEQ ID NO: 2490973 - RNA, 17 nt, Human
aucucaggggcuguuug

SEQ ID NO: 2490974 - RNA, 23 nt, Human
aucucaggggccagaggaacugu

SEQ ID NO: 2490975 - RNA, 17 nt, Human
aucucaggggccagagg

SEQ ID NO: 2490976 - RNA, 16 nt, Human
aucucaggggccagag

SEQ ID NO: 2490977 - RNA, 15 nt, Human
aucucaggggccaga

SEQ ID NO: 2490978 - RNA, 20 nt, Human
aucuagagcuugaugccagu

SEQ ID NO: 2490979 - RNA, 16 nt, Human
aucucagggccugguc

SEQ ID NO: 2490980 - RNA, 21 nt, Human
aucucagucaugcauaaauau

SEQ ID NO: 2490981 - RNA, 21 nt, Human
aucucaugccccuggcuggga

SEQ ID NO: 2490982 - RNA, 24 nt, Human
aucucauggagaagcagaaauaca

SEQ ID NO: 2490983 - RNA, 22 nt, Human
aucucauggagaagcagaaaua

SEQ ID NO: 2490984 - RNA, 23 nt, Human
aucucaugccccuggcugggacg

SEQ ID NO: 2490985 - RNA, 20 nt, Human
aucucagucaugcauaaaua

SEQ ID NO: 2490986 - RNA, 18 nt, Human
aucucagucaugcauaaa

SEQ ID NO: 2490987 - RNA, 16 nt, Human
aucucagucaugcaua

SEQ ID NO: 2490988 - RNA, 15 nt, Human
aucucagucaugcau

SEQ ID NO: 2490989 - RNA, 16 nt, Human
aucucagguucuccuu

SEQ ID NO: 2490990 - RNA, 14 nt, Human
aucucagggccugg

SEQ ID NO: 2490991 - RNA, 17 nt, Human
aucuagaggcuuccuuc

SEQ ID NO: 2490992 - RNA, 19 nt, Human
aucuagaggcuuccuucau

SEQ ID NO: 2490993 - RNA, 18 nt, Human
aucuagagcuugaugcca

SEQ ID NO: 2490994 - RNA, 21 nt, Human
aucuagacucaagguucccag

SEQ ID NO: 2490995 - RNA, 19 nt, Human
aucuagacccaucuucuuu

SEQ ID NO: 2490996 - RNA, 21 nt, Human
aucuagaauguguuuucugaa

SEQ ID NO: 2490997 - RNA, 21 nt, Human
aucuagaacacaggcaaaauc

SEQ ID NO: 2490998 - RNA, 12 nt, Human
aucuagaagacu

SEQ ID NO: 2490999 - RNA, 16 nt, Human
aucugacauccccacu

SEQ ID NO: 2491000 - RNA, 18 nt, Human
aucugacaugauuccuuc

SEQ ID NO: 2491001 - RNA, 19 nt, Human
aucugacaugauuccuucc

SEQ ID NO: 2491002 - RNA, 20 nt, Human
aucugacaugauuccuuccu

SEQ ID NO: 2491003 - RNA, 23 nt, Human
aucugacaugauuccuuccuguu

SEQ ID NO: 2491004 - RNA, 14 nt, Human
aucugaccagcagc

SEQ ID NO: 2491005 - RNA, 15 nt, Human
aucugaccagcagcg

SEQ ID NO: 2491006 - RNA, 16 nt, Human
aucugaccagcagcgc

SEQ ID NO: 2491007 - RNA, 23 nt, Human
uugauguuuuaaggaugcuugua

SEQ ID NO: 2491008 - RNA, 13 nt, Human
uugauuaaauucu

SEQ ID NO: 2491009 - RNA, 12 nt, Human
aucugacccagu

SEQ ID NO: 2491010 - RNA, 20 nt, Human
uugauguuuguggccucaga

SEQ ID NO: 2491011 - RNA, 22 nt, Human
uugauguuuguggccucagaau

SEQ ID NO: 2491012 - RNA, 13 nt, Human
aucugaaauguga

SEQ ID NO: 2491013 - RNA, 16 nt, Human
aucugacaucucugca

SEQ ID NO: 2491014 - RNA, 20 nt, Human
aucugacaucucugcaaucu

SEQ ID NO: 2491015 - RNA, 15 nt, Human
aucugacaucucugc

SEQ ID NO: 2491016 - RNA, 14 nt, Human
aucugacaucccca

SEQ ID NO: 2491017 - RNA, 23 nt, Human
aucugaaaauguauguguaagua

SEQ ID NO: 2491018 - RNA, 14 nt, Human
aucugaaaauguga

SEQ ID NO: 2491019 - RNA, 12 nt, Human
aucugaaaaugu

SEQ ID NO: 2491020 - RNA, 22 nt, Human
uugauuaagaucucagugguua

SEQ ID NO: 2491021 - RNA, 14 nt, Human
uugauuaaauucuu

SEQ ID NO: 2491022 - RNA, 18 nt, Human
uugauuaauccagaauaa

SEQ ID NO: 2491023 - RNA, 20 nt, Human
aucugaccagcagcgccuuu

SEQ ID NO: 2491024 - RNA, 21 nt, Human
uugauuauccauauugaguca

SEQ ID NO: 2491025 - RNA, 13 nt, Human
uugauuaugcaua

SEQ ID NO: 2491026 - RNA, 13 nt, Human
uugauuaugcaga

SEQ ID NO: 2491027 - RNA, 16 nt, Human
uugauuauuagccagg

SEQ ID NO: 2491028 - RNA, 22 nt, Human
uugcaagccagauuuuccugaa

SEQ ID NO: 2491029 - RNA, 20 nt, Human
uugauuauucugauuccacu

SEQ ID NO: 2491030 - RNA, 15 nt, Human
uugauuauucagugu

SEQ ID NO: 2491031 - RNA, 17 nt, Human
uugauuauucaguguca

SEQ ID NO: 2491032 - RNA, 13 nt, Human
uugcaagggaaaa

SEQ ID NO: 2491033 - RNA, 19 nt, Human
uugcaagggaaaagucucu

SEQ ID NO: 2491034 - RNA, 14 nt, Human
uugcaaggccgcug

SEQ ID NO: 2491035 - RNA, 17 nt, Human
uugcaaggccgcuguuc

SEQ ID NO: 2491036 - RNA, 23 nt, Human
uugcaaggccgcuguucacccac

SEQ ID NO: 2491037 - RNA, 13 nt, Human
uugcaaggaagcc

SEQ ID NO: 2491038 - RNA, 12 nt, Human
uugauuauucug

SEQ ID NO: 2491039 - RNA, 12 nt, Human
uugcaaggaagc

SEQ ID NO: 2491040 - RNA, 19 nt, Human
uugcaauggcagccuuggc

SEQ ID NO: 2491041 - RNA, 17 nt, Human
uugcaauggcagccuug

SEQ ID NO: 2491042 - RNA, 22 nt, Human
uugcaagggaaaagucucuugu

SEQ ID NO: 2491043 - RNA, 16 nt, Human
uugcaauggcagccuu

SEQ ID NO: 2491044 - RNA, 14 nt, Human
uugcaccacugcac

SEQ ID NO: 2491045 - RNA, 15 nt, Human
uugcaccacugcacu

SEQ ID NO: 2491046 - RNA, 16 nt, Human
uugcaccacugcacuc

SEQ ID NO: 2491047 - RNA, 18 nt, Human
uugcaccacugcacucca

SEQ ID NO: 2491048 - RNA, 15 nt, Human
uugcauuuaaaacag

SEQ ID NO: 2491049 - RNA, 20 nt, Human
uugcauuuaaaacagacacu

SEQ ID NO: 2491050 - RNA, 21 nt, Human
uugcauuuaaaacagacacug

SEQ ID NO: 2491051 - RNA, 21 nt, Human
uugcauugaccgcgacuaauu

SEQ ID NO: 2491052 - RNA, 14 nt, Human
uugcauugaauaua

SEQ ID NO: 2491053 - RNA, 23 nt, Human
uugcauugaacacaaacuguaaa

SEQ ID NO: 2491054 - RNA, 17 nt, Human
uugcauugaauauauua

SEQ ID NO: 2491055 - RNA, 14 nt, Human
uugcauugaacaca

SEQ ID NO: 2491056 - RNA, 15 nt, Human
uugcauugaacacaa

SEQ ID NO: 2491057 - RNA, 18 nt, Human
uugcauugaacacaaacu

SEQ ID NO: 2491058 - RNA, 22 nt, Human
uugcauugaacacaaacuguaa

SEQ ID NO: 2491059 - RNA, 20 nt, Human
uugcaaugguguugcccuga

SEQ ID NO: 2491060 - RNA, 14 nt, Human
uugcauauaacuua

SEQ ID NO: 2491061 - RNA, 17 nt, Human
uugcauauaacuuauau

SEQ ID NO: 2491062 - RNA, 22 nt, Human
uugcauauaacuuauauuguaa

SEQ ID NO: 2491063 - RNA, 19 nt, Human
uugcaauggcuauauggca

SEQ ID NO: 2491064 - RNA, 15 nt, Human
uugcaagucauggcu

SEQ ID NO: 2491065 - RNA, 23 nt, Human
uugcauaguaccaaucauuuuaa

SEQ ID NO: 2491066 - RNA, 21 nt, Human
uugcaaguauguuuuagcaug

SEQ ID NO: 2491067 - RNA, 22 nt, Human
uugcaaguauguuuuagcaugu

SEQ ID NO: 2491068 - RNA, 13 nt, Human
uugcaucaauuuu

SEQ ID NO: 2491069 - RNA, 14 nt, Human
uugcauauguauga

SEQ ID NO: 2491070 - RNA, 23 nt, Human
uugcauauaacuuauauuguaag

SEQ ID NO: 2491071 - RNA, 14 nt, Human
uugcauauauacau

SEQ ID NO: 2491072 - RNA, 19 nt, Human
uuccucugcagcugaccuc

SEQ ID NO: 2491073 - RNA, 17 nt, Human
uuccucugcagcugacc

SEQ ID NO: 2491074 - RNA, 13 nt, Human
uuccucugcagcu

SEQ ID NO: 2491075 - RNA, 10 nt, Human
uuccucugca

SEQ ID NO: 2491076 - RNA, 12 nt, Human
uuccucugccug

SEQ ID NO: 2491077 - RNA, 22 nt, Human
uuccucugcagcugaccucugu

SEQ ID NO: 2491078 - RNA, 21 nt, Human
uuccucugaggcugaaauuca

SEQ ID NO: 2491079 - RNA, 21 nt, Human
uuccucugaggcuggauccua

SEQ ID NO: 2491080 - RNA, 13 nt, Human
uuccucugaggcu

SEQ ID NO: 2491081 - RNA, 14 nt, Human
uuccucugagccuu

SEQ ID NO: 2491082 - RNA, 17 nt, Human
uuccucugagccuuggg

SEQ ID NO: 2491083 - RNA, 20 nt, Human
uuccuacaagagcagccugu

SEQ ID NO: 2491084 - RNA, 22 nt, Human
uuccuacaagagcagccugugg

SEQ ID NO: 2491085 - RNA, 23 nt, Human
uuccuacaagagcagccuguggc

SEQ ID NO: 2491086 - RNA, 16 nt, Human
uuccuacaaagauguu

SEQ ID NO: 2491087 - RNA, 17 nt, Human
uuccuaauccucuagga

SEQ ID NO: 2491088 - RNA, 16 nt, Human
uuccuaauuccacagc

SEQ ID NO: 2491089 - RNA, 17 nt, Human
uuccuaauuccacagcu

SEQ ID NO: 2491090 - RNA, 18 nt, Human
uuccuaauuccacagcug

SEQ ID NO: 2491091 - RNA, 23 nt, Human
uuccuaauuuuagugacagcucu

SEQ ID NO: 2491092 - RNA, 14 nt, Human
uuccuaauuuuagu

SEQ ID NO: 2491093 - RNA, 13 nt, Human
uuccuaauuuuag

SEQ ID NO: 2491094 - RNA, 15 nt, Human
uuccugaagaaccag

SEQ ID NO: 2491095 - RNA, 13 nt, Human
uuccucuuugcuu

SEQ ID NO: 2491096 - RNA, 16 nt, Human
uuccugaagaaccagu

SEQ ID NO: 2491097 - RNA, 19 nt, Human
uuccugaagaaccaguccc

SEQ ID NO: 2491098 - RNA, 18 nt, Human
uuccugaagaauugaaaa

SEQ ID NO: 2491099 - RNA, 17 nt, Human
uuccucuuugcauggaa

SEQ ID NO: 2491100 - RNA, 15 nt, Human
uuccucuuugcaugg

SEQ ID NO: 2491101 - RNA, 12 nt, Human
uuccucuuugca

SEQ ID NO: 2491102 - RNA, 14 nt, Human
uuccugaaccgaug

SEQ ID NO: 2491103 - RNA, 16 nt, Human
uuccucugccugcccc

SEQ ID NO: 2491104 - RNA, 15 nt, Human
uuccucugccugccc

SEQ ID NO: 2491105 - RNA, 14 nt, Human
uuccucugccugcc

SEQ ID NO: 2491106 - RNA, 13 nt, Human
uuccucugccugc

SEQ ID NO: 2491107 - RNA, 13 nt, Human
uuccucuuuccau

SEQ ID NO: 2491108 - RNA, 17 nt, Human
uuccucuuuccaucuac

SEQ ID NO: 2491109 - RNA, 22 nt, Human
uuccucuuuccaucuacccucc

SEQ ID NO: 2491110 - RNA, 14 nt, Human
uuccggcuccugug

SEQ ID NO: 2491111 - RNA, 17 nt, Human
uuccguaacccaacucu

SEQ ID NO: 2491112 - RNA, 18 nt, Human
uuccguagccagcugcuc

SEQ ID NO: 2491113 - RNA, 18 nt, Human
uuccgugacgucacugga

SEQ ID NO: 2491114 - RNA, 17 nt, Human
uuccgugaaaacggagc

SEQ ID NO: 2491115 - RNA, 14 nt, Human
uuccguuaaaauac

SEQ ID NO: 2491116 - RNA, 16 nt, Human
uuccguuaaaauacca

SEQ ID NO: 2491117 - RNA, 19 nt, Human
uuccguagguuauuuucag

SEQ ID NO: 2491118 - RNA, 15 nt, Human
uucccucaucucucc

SEQ ID NO: 2491119 - RNA, 21 nt, Human
uucccgucccauauccugccu

SEQ ID NO: 2491120 - RNA, 17 nt, Human
uucccucaucucuccuc

SEQ ID NO: 2491121 - RNA, 23 nt, Human
uuccggauuggcuuguguguuuc

SEQ ID NO: 2491122 - RNA, 16 nt, Human
auagcaaacuuggaau

SEQ ID NO: 2491123 - RNA, 22 nt, Human
uucccgcucagcccucccugcc

SEQ ID NO: 2491124 - RNA, 21 nt, Human
uucccgcucagcccucccugc

SEQ ID NO: 2491125 - RNA, 18 nt, Human
uucccgcucagcccuccc

SEQ ID NO: 2491126 - RNA, 16 nt, Human
uucccgcucagcccuc

SEQ ID NO: 2491127 - RNA, 20 nt, Human
uucccucaccuuucccaucu

SEQ ID NO: 2491128 - RNA, 21 nt, Human
uucccucaccuuggcaccaga

SEQ ID NO: 2491129 - RNA, 15 nt, Human
uucccuauuagagaa

SEQ ID NO: 2491130 - RNA, 20 nt, Human
uucccgucccauauccugcc

SEQ ID NO: 2491131 - RNA, 21 nt, Human
uucccggacugcaagcagggc

SEQ ID NO: 2491132 - RNA, 23 nt, Human
uucccguggaacguuuuuccugu

SEQ ID NO: 2491133 - RNA, 23 nt, Human
aucaagggaauguaacugcugaa

SEQ ID NO: 2491134 - RNA, 22 nt, Human
aucaaucaucugugugaaaaug

SEQ ID NO: 2491135 - RNA, 16 nt, Human
aucaaucauuguacag

SEQ ID NO: 2491136 - RNA, 15 nt, Human
aucaaucauuguaca

SEQ ID NO: 2491137 - RNA, 14 nt, Human
aucaaucauuguac

SEQ ID NO: 2491138 - RNA, 13 nt, Human
aucaaucauugua

SEQ ID NO: 2491139 - RNA, 19 nt, Human
aucaaucauuguacaguuu

SEQ ID NO: 2491140 - RNA, 17 nt, Human
aucaaucauuguacagu

SEQ ID NO: 2491141 - RNA, 14 nt, Human
aucaaggcacugcc

SEQ ID NO: 2491142 - RNA, 13 nt, Human
aucaaggcacugc

SEQ ID NO: 2491143 - RNA, 22 nt, Human
aucaagcuucaguuuccugguc

SEQ ID NO: 2491144 - RNA, 16 nt, Human
aucaaggcacugccug

SEQ ID NO: 2491145 - RNA, 15 nt, Human
aucaaggcacugccu

SEQ ID NO: 2491146 - RNA, 21 nt, Human
aucaagcuucaguuuccuggu

SEQ ID NO: 2491147 - RNA, 12 nt, Human
aucaagcuguga

SEQ ID NO: 2491148 - RNA, 11 nt, Human
aucaagcugug

SEQ ID NO: 2491149 - RNA, 20 nt, Human
aucaagcuagaaggccacau

SEQ ID NO: 2491150 - RNA, 16 nt, Human
aucaagcuagaaggcc

SEQ ID NO: 2491151 - RNA, 17 nt, Human
aucaagcuagaaggcca

SEQ ID NO: 2491152 - RNA, 21 nt, Human
aucaauggcgcagugccucug

SEQ ID NO: 2491153 - RNA, 12 nt, Human
aucaaugacaga

SEQ ID NO: 2491154 - RNA, 15 nt, Human
aucaccuuaggcagg

SEQ ID NO: 2491155 - RNA, 14 nt, Human
aucaaugaguaaca

SEQ ID NO: 2491156 - RNA, 21 nt, Human
aucaaucauuguacaguuugu

SEQ ID NO: 2491157 - RNA, 16 nt, Human
aucaauccuuguucag

SEQ ID NO: 2491158 - RNA, 15 nt, Human
aucacggcucacugc

SEQ ID NO: 2491159 - RNA, 14 nt, Human
aucacgcuuuccug

SEQ ID NO: 2491160 - RNA, 13 nt, Human
aucacgccacugc

SEQ ID NO: 2491161 - RNA, 20 nt, Human
aucaccuuaggcagggaagu

SEQ ID NO: 2491162 - RNA, 16 nt, Human
aucaccuuaggcaggg

SEQ ID NO: 2491163 - RNA, 17 nt, Human
aucaccuuaggcaggga

SEQ ID NO: 2491164 - RNA, 18 nt, Human
aucaccuuaggcagggaa

SEQ ID NO: 2491165 - RNA, 18 nt, Human
aucacgcuuuccugaauc

SEQ ID NO: 2491166 - RNA, 21 nt, Human
aucacugaacuuugcugagcc

SEQ ID NO: 2491167 - RNA, 19 nt, Human
aucacggcucacugcagcc

SEQ ID NO: 2491168 - RNA, 18 nt, Human
aucacggcucacugcagc

SEQ ID NO: 2491169 - RNA, 14 nt, Human
aucaacagauaaau

SEQ ID NO: 2491170 - RNA, 18 nt, Human
aucaacaagaguugucuu

SEQ ID NO: 2491171 - RNA, 16 nt, Human
aucaacaaaaauuguc

SEQ ID NO: 2491172 - RNA, 22 nt, Human
aucaaauuucacgucgucuucu

SEQ ID NO: 2491173 - RNA, 21 nt, Human
aucaagaugugacauguuuua

SEQ ID NO: 2491174 - RNA, 14 nt, Human
aucaagcagccaag

SEQ ID NO: 2491175 - RNA, 13 nt, Human
aucaagcccuuua

SEQ ID NO: 2491176 - RNA, 16 nt, Human
aucaagcacagaagga

SEQ ID NO: 2491177 - RNA, 13 nt, Human
aucaacaucuuuu

SEQ ID NO: 2491178 - RNA, 15 nt, Human
aucaacaucuuuucu

SEQ ID NO: 2491179 - RNA, 18 nt, Human
auauuuuuuguuaaauga

SEQ ID NO: 2491180 - RNA, 18 nt, Human
auauuuuuucagaaauau

SEQ ID NO: 2491181 - RNA, 16 nt, Human
auauuuuuauuuuauu

SEQ ID NO: 2491182 - RNA, 18 nt, Human
auauuuuuauauuuaguu

SEQ ID NO: 2491183 - RNA, 20 nt, Human
auauuuuuuauauauacagu

SEQ ID NO: 2491184 - RNA, 20 nt, Human
auauuuuuuguuaaaugauu

SEQ ID NO: 2491185 - RNA, 15 nt, Human
auauuuuuucugaau

SEQ ID NO: 2491186 - RNA, 21 nt, Human
auauuuuuuuaaaauguuaaa

SEQ ID NO: 2491187 - RNA, 20 nt, Human
aucaaauuucacgucgucuu

SEQ ID NO: 2491188 - RNA, 20 nt, Human
auauuuuuaucuuuauauga

SEQ ID NO: 2491189 - RNA, 22 nt, Human
auauuuuuaucuuuauaugaag

SEQ ID NO: 2491190 - RNA, 14 nt, Human
auauuuuuaucuuu

SEQ ID NO: 2491191 - RNA, 15 nt, Human
auauuuuuaucuuua

SEQ ID NO: 2491192 - RNA, 21 nt, Human
uuccuguggauguaaagugau

SEQ ID NO: 2491193 - RNA, 11 nt, Human
uuccugugucu

SEQ ID NO: 2491194 - RNA, 14 nt, Human
uuccugucuuccug

SEQ ID NO: 2491195 - RNA, 24 nt, Human
uuccuguccuucucucaccuccua

SEQ ID NO: 2491196 - RNA, 23 nt, Human
uuccuguccuucucucaccuccu

SEQ ID NO: 2491197 - RNA, 15 nt, Human
uuccugaaccugaug

SEQ ID NO: 2491198 - RNA, 18 nt, Human
aucagggaggucauuuug

SEQ ID NO: 2491199 - RNA, 16 nt, Human
aucagguccucagaga

SEQ ID NO: 2491200 - RNA, 20 nt, Human
aucagguccucagagaauuu

SEQ ID NO: 2491201 - RNA, 17 nt, Human
aucaggguuaguauugu

SEQ ID NO: 2491202 - RNA, 21 nt, Human
aucagggcaaucccaacacau

SEQ ID NO: 2491203 - RNA, 13 nt, Human
aucaggccauugu

SEQ ID NO: 2491204 - RNA, 16 nt, Human
aucaggccauuguccc

SEQ ID NO: 2491205 - RNA, 14 nt, Human
aucaggccaggccc

SEQ ID NO: 2491206 - RNA, 13 nt, Human
aucaggcugaggu

SEQ ID NO: 2491207 - RNA, 16 nt, Human
aucaggcucugccuca

SEQ ID NO: 2491208 - RNA, 21 nt, Human
aucagcaagucucuuuauaug

SEQ ID NO: 2491209 - RNA, 16 nt, Human
aucaggccugccagac

SEQ ID NO: 2491210 - RNA, 15 nt, Human
aucaggcuauguaug

SEQ ID NO: 2491211 - RNA, 18 nt, Human
aucaggccaggcccucug

SEQ ID NO: 2491212 - RNA, 16 nt, Human
aucaggccaggcccuc

SEQ ID NO: 2491213 - RNA, 15 nt, Human
aucaggccaggcccu

SEQ ID NO: 2491214 - RNA, 13 nt, Human
aucagcacgauuu

SEQ ID NO: 2491215 - RNA, 22 nt, Human
aucagaauagccacauuuggaa

SEQ ID NO: 2491216 - RNA, 12 nt, Human
aucagaauucuc

SEQ ID NO: 2491217 - RNA, 14 nt, Human
aucagauugcaugu

SEQ ID NO: 2491218 - RNA, 15 nt, Human
aucagauugcaugug

SEQ ID NO: 2491219 - RNA, 16 nt, Human
aucagauugcauguga

SEQ ID NO: 2491220 - RNA, 18 nt, Human
aucagauugcaugugacu

SEQ ID NO: 2491221 - RNA, 21 nt, Human
aucagauugcaugugacucug

SEQ ID NO: 2491222 - RNA, 21 nt, Human
aucagcaaaccggggccuacu

SEQ ID NO: 2491223 - RNA, 23 nt, Human
aucagcaacaaccagcaucccuu

SEQ ID NO: 2491224 - RNA, 17 nt, Human
uucucaggcaugaacau

SEQ ID NO: 2491225 - RNA, 18 nt, Human
uucucagcucuucugacu

SEQ ID NO: 2491226 - RNA, 14 nt, Human
uucucagcucuucu

SEQ ID NO: 2491227 - RNA, 20 nt, Human
uucucagcucccccuguccc

SEQ ID NO: 2491228 - RNA, 18 nt, Human
uucucagcucccccuguc

SEQ ID NO: 2491229 - RNA, 17 nt, Human
uucucagcucccccugu

SEQ ID NO: 2491230 - RNA, 18 nt, Human
uucucacuccuaccuggu

SEQ ID NO: 2491231 - RNA, 13 nt, Human
uucucaccaggaa

SEQ ID NO: 2491232 - RNA, 12 nt, Human
uucucaccagga

SEQ ID NO: 2491233 - RNA, 16 nt, Human
uucucacuccuaccug

SEQ ID NO: 2491234 - RNA, 14 nt, Human
uucucacuccacca

SEQ ID NO: 2491235 - RNA, 15 nt, Human
uucucacuccaccac

SEQ ID NO: 2491236 - RNA, 16 nt, Human
uucucacuccaccacc

SEQ ID NO: 2491237 - RNA, 23 nt, Human
uucuaggaagaauuuuaaaaaug

SEQ ID NO: 2491238 - RNA, 19 nt, Human
uucuaggaagaauuuuaaa

SEQ ID NO: 2491239 - RNA, 18 nt, Human
uucuaggaagaauuuuaa

SEQ ID NO: 2491240 - RNA, 14 nt, Human
uucuaggaagaauu

SEQ ID NO: 2491241 - RNA, 22 nt, Human
uucucacagugggagccagggc

SEQ ID NO: 2491242 - RNA, 21 nt, Human
uucucacagugggagccaggg

SEQ ID NO: 2491243 - RNA, 19 nt, Human
uucucacagugggagccag

SEQ ID NO: 2491244 - RNA, 13 nt, Human
aucacuuguuguu

SEQ ID NO: 2491245 - RNA, 19 nt, Human
aucacuugagacaaaucua

SEQ ID NO: 2491246 - RNA, 21 nt, Human
aucacuuguacaaaauaaaca

SEQ ID NO: 2491247 - RNA, 17 nt, Human
aucacuuguuguuuuac

SEQ ID NO: 2491248 - RNA, 16 nt, Human
aucacuuucucaguuu

SEQ ID NO: 2491249 - RNA, 22 nt, Human
aucacuugucaauaaaauccau

SEQ ID NO: 2491250 - RNA, 19 nt, Human
aucagaauagccacauuug

SEQ ID NO: 2491251 - RNA, 18 nt, Human
aucagaaguuucucagcu

SEQ ID NO: 2491252 - RNA, 11 nt, Human
aucagaauucu

SEQ ID NO: 2491253 - RNA, 14 nt, Human
aucacuuguacaaa

SEQ ID NO: 2491254 - RNA, 16 nt, Human
aucacuuguacaaaau

SEQ ID NO: 2491255 - RNA, 17 nt, Human
aucacuuguacaaaaua

SEQ ID NO: 2491256 - RNA, 18 nt, Human
aucacuuguacaaaauaa

SEQ ID NO: 2491257 - RNA, 19 nt, Human
uucucagguguugccaaau

SEQ ID NO: 2491258 - RNA, 17 nt, Human
uucucagguguugccaa

SEQ ID NO: 2491259 - RNA, 17 nt, Human
aucacuugaauccuagg

SEQ ID NO: 2491260 - RNA, 21 nt, Human
uucucagggucucugcugccg

SEQ ID NO: 2491261 - RNA, 19 nt, Human
aucacuugaggucaggagu

SEQ ID NO: 2491262 - RNA, 18 nt, Human
uucucagggucucugcug

SEQ ID NO: 2491263 - RNA, 17 nt, Human
uucucagggucucugcu

SEQ ID NO: 2491264 - RNA, 16 nt, Human
uucucagggucucugc

SEQ ID NO: 2491265 - RNA, 13 nt, Human
uucucagggucuc

SEQ ID NO: 2491266 - RNA, 20 nt, Human
uucucagggucucugcugcc

SEQ ID NO: 2491267 - RNA, 19 nt, Human
uucucagggucucugcugc

SEQ ID NO: 2491268 - RNA, 16 nt, Human
uucucagguguugcca

SEQ ID NO: 2491269 - RNA, 18 nt, Human
uucucagggcuccugccu

SEQ ID NO: 2491270 - RNA, 17 nt, Human
uucucagggcuccugcc

SEQ ID NO: 2491271 - RNA, 16 nt, Human
uucucagggcuccugc

SEQ ID NO: 2491272 - RNA, 15 nt, Human
uucucagggcuccug

SEQ ID NO: 2491273 - RNA, 13 nt, Human
uucucagggcucc

SEQ ID NO: 2491274 - RNA, 12 nt, Human
uucucagggcuc

SEQ ID NO: 2491275 - RNA, 17 nt, Human
uucucaggccaucauca

SEQ ID NO: 2491276 - RNA, 20 nt, Human
uucucaggcucugcccugcc

SEQ ID NO: 2491277 - RNA, 21 nt, Human
uucuagcccgaauacaaacac

SEQ ID NO: 2491278 - RNA, 18 nt, Human
uucuagcccgaauacaaa

SEQ ID NO: 2491279 - RNA, 18 nt, Human
uucuagcccauggacuuc

SEQ ID NO: 2491280 - RNA, 16 nt, Human
uucuagcauggcugcc

SEQ ID NO: 2491281 - RNA, 21 nt, Human
uucuagcuguugagcuguuuu

SEQ ID NO: 2491282 - RNA, 20 nt, Human
uucuagcuguugagcuguuu

SEQ ID NO: 2491283 - RNA, 22 nt, Human
uucuagcuagaaauaugauuuu

SEQ ID NO: 2491284 - RNA, 19 nt, Human
uucuagcuagaaauaugau

SEQ ID NO: 2491285 - RNA, 12 nt, Human
uucuagcuguug

SEQ ID NO: 2491286 - RNA, 17 nt, Human
uucuagcuaauguaaua

SEQ ID NO: 2491287 - RNA, 18 nt, Human
uucuagcuagaaauauga

SEQ ID NO: 2491288 - RNA, 17 nt, Human
uucuagcuagaaauaug

SEQ ID NO: 2491289 - RNA, 16 nt, Human
uucuagcuagaaauau

SEQ ID NO: 2491290 - RNA, 17 nt, Human
uucuagcacuggccugc

SEQ ID NO: 2491291 - RNA, 16 nt, Human
uucuagcacuggccug

SEQ ID NO: 2491292 - RNA, 15 nt, Human
uucuagcacuggccu

SEQ ID NO: 2491293 - RNA, 14 nt, Human
uucuagcacuggcc

SEQ ID NO: 2491294 - RNA, 12 nt, Human
uucuagcacugg

SEQ ID NO: 2491295 - RNA, 15 nt, Human
uucuaaguaaaacca

SEQ ID NO: 2491296 - RNA, 16 nt, Human
uucuaaguaaaaccac

SEQ ID NO: 2491297 - RNA, 23 nt, Human
uucuaagaagugaaaaucuacac

SEQ ID NO: 2491298 - RNA, 13 nt, Human
uucuaagaaguga

SEQ ID NO: 2491299 - RNA, 13 nt, Human
uucuaagagaagu

SEQ ID NO: 2491300 - RNA, 12 nt, Human
uucuaagagaag

SEQ ID NO: 2491301 - RNA, 20 nt, Human
uucuaaaugcauauccugag

SEQ ID NO: 2491302 - RNA, 15 nt, Human
uucggccuccauccu

SEQ ID NO: 2491303 - RNA, 19 nt, Human
uucuaaaggcuaccuuugu

SEQ ID NO: 2491304 - RNA, 15 nt, Human
uucggaguugggggu

SEQ ID NO: 2491305 - RNA, 20 nt, Human
uucuaaaggcuaccuuugua

SEQ ID NO: 2491306 - RNA, 21 nt, Human
uucuaaaggcuaccuuuguau

SEQ ID NO: 2491307 - RNA, 21 nt, Human
uucuaaaucuccaaaauaaaa

SEQ ID NO: 2491308 - RNA, 15 nt, Human
uucuaaaugaauguu

SEQ ID NO: 2491309 - RNA, 12 nt, Human
uucuaaaugaau

SEQ ID NO: 2491310 - RNA, 20 nt, Human
uucuaaagguguugucccuu

SEQ ID NO: 2491311 - RNA, 14 nt, Human
uucuaaaugaagug

SEQ ID NO: 2491312 - RNA, 21 nt, Human
uucuaaaugaauguuuacacu

SEQ ID NO: 2491313 - RNA, 18 nt, Human
uucuaaaugaauguuuac

SEQ ID NO: 2491314 - RNA, 22 nt, Human
uucuaaagguguugucccuucu

SEQ ID NO: 2491315 - RNA, 13 nt, Human
uucuaaaugcaua

SEQ ID NO: 2491316 - RNA, 23 nt, Human
uucuaaaugcauauccugagcca

SEQ ID NO: 2491317 - RNA, 19 nt, Human
uucgcuccugugucuugca

SEQ ID NO: 2491318 - RNA, 15 nt, Human
uucgcuccugugucu

SEQ ID NO: 2491319 - RNA, 10 nt, Human
aucacuggag

SEQ ID NO: 2491320 - RNA, 17 nt, Human
aucacuggagcaccagg

SEQ ID NO: 2491321 - RNA, 19 nt, Human
aucacuggagcaccaggca

SEQ ID NO: 2491322 - RNA, 23 nt, Human
aucacuggagcaccaggcacgaa

SEQ ID NO: 2491323 - RNA, 12 nt, Human
aucacuggagcc

SEQ ID NO: 2491324 - RNA, 13 nt, Human
aucacuggagccc

SEQ ID NO: 2491325 - RNA, 14 nt, Human
aucacuggagccca

SEQ ID NO: 2491326 - RNA, 15 nt, Human
aucacuggagcccag

SEQ ID NO: 2491327 - RNA, 12 nt, Human
uucgcugcaacc

SEQ ID NO: 2491328 - RNA, 16 nt, Human
aucacuggagcccagg

SEQ ID NO: 2491329 - RNA, 17 nt, Human
aucacuggagcccagga

SEQ ID NO: 2491330 - RNA, 22 nt, Human
uucgcuucuugccucugugcug

SEQ ID NO: 2491331 - RNA, 13 nt, Human
aucacuggaugaa

SEQ ID NO: 2491332 - RNA, 12 nt, Human
uucggaaaccuu

SEQ ID NO: 2491333 - RNA, 14 nt, Human
uucggccuccaucc

SEQ ID NO: 2491334 - RNA, 18 nt, Human
uucggaaaccuuggugua

SEQ ID NO: 2491335 - RNA, 17 nt, Human
uucggauuuggggugga

SEQ ID NO: 2491336 - RNA, 20 nt, Human
uucggcagauacugucucuu

SEQ ID NO: 2491337 - RNA, 22 nt, Human
uucuuuuuugugugauuuaaga

SEQ ID NO: 2491338 - RNA, 17 nt, Human
uugaaagagaaccaguu

SEQ ID NO: 2491339 - RNA, 14 nt, Human
uugaaagagauggc

SEQ ID NO: 2491340 - RNA, 20 nt, Human
uugaaagagaaccaguuuca

SEQ ID NO: 2491341 - RNA, 14 nt, Human
uugaaagaguccua

SEQ ID NO: 2491342 - RNA, 15 nt, Human
uugaaagauucaggu

SEQ ID NO: 2491343 - RNA, 14 nt, Human
uucuuuuuuuguga

SEQ ID NO: 2491344 - RNA, 13 nt, Human
uugaaagaccuuc

SEQ ID NO: 2491345 - RNA, 14 nt, Human
uucuuuuugcuguu

SEQ ID NO: 2491346 - RNA, 13 nt, Human
uucuuuuugcugu

SEQ ID NO: 2491347 - RNA, 23 nt, Human
uucuuuuugcuguuguuucuaaa

SEQ ID NO: 2491348 - RNA, 15 nt, Human
uucuuuguaaugaaa

SEQ ID NO: 2491349 - RNA, 22 nt, Human
uucuuugggaauauuugaaucu

SEQ ID NO: 2491350 - RNA, 13 nt, Human
uucuuugggccag

SEQ ID NO: 2491351 - RNA, 22 nt, Human
uucuuugguggagauaaagauu

SEQ ID NO: 2491352 - RNA, 13 nt, Human
uucuucuguauuu

SEQ ID NO: 2491353 - RNA, 22 nt, Human
uucuucuuccaacguggcccag

SEQ ID NO: 2491354 - RNA, 13 nt, Human
uucuucuucagaa

SEQ ID NO: 2491355 - RNA, 16 nt, Human
uucuucuuuuugcugu

SEQ ID NO: 2491356 - RNA, 15 nt, Human
uucuucuuuuugcug

SEQ ID NO: 2491357 - RNA, 14 nt, Human
uucuucuuccugaa

SEQ ID NO: 2491358 - RNA, 13 nt, Human
uucuucuuccuga

SEQ ID NO: 2491359 - RNA, 13 nt, Human
uucuucuucccuc

SEQ ID NO: 2491360 - RNA, 15 nt, Human
uucuucuucagaaga

SEQ ID NO: 2491361 - RNA, 20 nt, Human
uucuucugaacucaaacuga

SEQ ID NO: 2491362 - RNA, 23 nt, Human
uucuucugaacucaaacugagga

SEQ ID NO: 2491363 - RNA, 20 nt, Human
uucuucugcuucagccuccc

SEQ ID NO: 2491364 - RNA, 17 nt, Human
uucuuugccuguucagu

SEQ ID NO: 2491365 - RNA, 20 nt, Human
uucuuugggaauauuugaau

SEQ ID NO: 2491366 - RNA, 18 nt, Human
uucuuugggaauauuuga

SEQ ID NO: 2491367 - RNA, 20 nt, Human
uucuugaacacucaugcuga

SEQ ID NO: 2491368 - RNA, 14 nt, Human
uucuuugccuguuc

SEQ ID NO: 2491369 - RNA, 18 nt, Human
uucuuugccuguucaguu

SEQ ID NO: 2491370 - RNA, 21 nt, Human
uucuugaacacucaugcugaa

SEQ ID NO: 2491371 - RNA, 15 nt, Human
uucuugaaagcugug

SEQ ID NO: 2491372 - RNA, 14 nt, Human
uucuugaaagcugu

SEQ ID NO: 2491373 - RNA, 13 nt, Human
uucuugaaagcug

SEQ ID NO: 2491374 - RNA, 21 nt, Human
uucuucuuuuugcuucaaaaa

SEQ ID NO: 2491375 - RNA, 17 nt, Human
uucuucuuuuugcuuca

SEQ ID NO: 2491376 - RNA, 23 nt, Human
aucccucauccucauacccaccc

SEQ ID NO: 2491377 - RNA, 21 nt, Human
aucccucauccucauacccac

SEQ ID NO: 2491378 - RNA, 13 nt, Human
aucccucauccuc

SEQ ID NO: 2491379 - RNA, 13 nt, Human
uucuuaaccaucu

SEQ ID NO: 2491380 - RNA, 23 nt, Human
uucuuaaccagaucauugugaaa

SEQ ID NO: 2491381 - RNA, 18 nt, Human
uucuuaagacauguauca

SEQ ID NO: 2491382 - RNA, 14 nt, Human
aucccucauccuca

SEQ ID NO: 2491383 - RNA, 18 nt, Human
aucccaugaacacacugu

SEQ ID NO: 2491384 - RNA, 16 nt, Human
aucccaugaacacacu

SEQ ID NO: 2491385 - RNA, 24 nt, Human
aucccauaugccugggcagaagga

SEQ ID NO: 2491386 - RNA, 22 nt, Human
aucccaggacaccacacccagc

SEQ ID NO: 2491387 - RNA, 21 nt, Human
aucccaggacaccacacccag

SEQ ID NO: 2491388 - RNA, 15 nt, Human
uucuucugcuucagc

SEQ ID NO: 2491389 - RNA, 13 nt, Human
uucuucugcuuca

SEQ ID NO: 2491390 - RNA, 14 nt, Human
uucuucucuagcug

SEQ ID NO: 2491391 - RNA, 18 nt, Human
uucuucuccuauguguaa

SEQ ID NO: 2491392 - RNA, 17 nt, Human
uucuucuccuaugugua

SEQ ID NO: 2491393 - RNA, 15 nt, Human
uucuucuccuaugug

SEQ ID NO: 2491394 - RNA, 14 nt, Human
uucuucucugcugc

SEQ ID NO: 2491395 - RNA, 13 nt, Human
uucuucugaacuc

SEQ ID NO: 2491396 - RNA, 14 nt, Human
uucuucucccucag

SEQ ID NO: 2491397 - RNA, 21 nt, Human
uucuuaaucuuuucacaaaua

SEQ ID NO: 2491398 - RNA, 20 nt, Human
uucuuaaucuuuucacaaau

SEQ ID NO: 2491399 - RNA, 19 nt, Human
uucuuaaucuuuucacaaa

SEQ ID NO: 2491400 - RNA, 13 nt, Human
uucuucucccuca

SEQ ID NO: 2491401 - RNA, 22 nt, Human
uucuuaaguauguuauuuucug

SEQ ID NO: 2491402 - RNA, 20 nt, Human
uucuuaaggauugugauauu

SEQ ID NO: 2491403 - RNA, 22 nt, Human
uucuuaaggauugugauauuuu

SEQ ID NO: 2491404 - RNA, 23 nt, Human
uucuuaagacgugauuuugcugu

SEQ ID NO: 2491405 - RNA, 21 nt, Human
uucuuaagacgugauuuugcu

SEQ ID NO: 2491406 - RNA, 23 nt, Human
uugaaauuauguauguuuacaua

SEQ ID NO: 2491407 - RNA, 21 nt, Human
uugaaauuauguauguuuaca

SEQ ID NO: 2491408 - RNA, 19 nt, Human
uugaaauuauguauguuua

SEQ ID NO: 2491409 - RNA, 18 nt, Human
uugaaauuauguauguuu

SEQ ID NO: 2491410 - RNA, 18 nt, Human
uugaaauuaaccucucac

SEQ ID NO: 2491411 - RNA, 19 nt, Human
uugaaauguguuucuguau

SEQ ID NO: 2491412 - RNA, 18 nt, Human
uugaaauguguuucugua

SEQ ID NO: 2491413 - RNA, 20 nt, Human
uugaaauuaagaaggcaaaa

SEQ ID NO: 2491414 - RNA, 21 nt, Human
uugaaagggguugugaagagg

SEQ ID NO: 2491415 - RNA, 22 nt, Human
uugaaagcuguggccagcuugu

SEQ ID NO: 2491416 - RNA, 19 nt, Human
uugaaaggcauucucugaa

SEQ ID NO: 2491417 - RNA, 20 nt, Human
uugaaaggcauucucugaag

SEQ ID NO: 2491418 - RNA, 21 nt, Human
uugaaaggcauucucugaaga

SEQ ID NO: 2491419 - RNA, 22 nt, Human
uugaaagauucagguauguugc

SEQ ID NO: 2491420 - RNA, 12 nt, Human
uugaaagcugug

SEQ ID NO: 2491421 - RNA, 16 nt, Human
uugaaagcauccaugu

SEQ ID NO: 2491422 - RNA, 17 nt, Human
uugaaauuguauuacaa

SEQ ID NO: 2491423 - RNA, 22 nt, Human
uugaacgcccccccccaccccu

SEQ ID NO: 2491424 - RNA, 17 nt, Human
auccgacugcuuuggac

SEQ ID NO: 2491425 - RNA, 12 nt, Human
auccgaggcagg

SEQ ID NO: 2491426 - RNA, 14 nt, Human
auccgaaucucuuu

SEQ ID NO: 2491427 - RNA, 19 nt, Human
uugaacccgggaggcagag

SEQ ID NO: 2491428 - RNA, 15 nt, Human
uugaaauuguacaua

SEQ ID NO: 2491429 - RNA, 14 nt, Human
auccuacuucucca

SEQ ID NO: 2491430 - RNA, 23 nt, Human
auccuagagauuugguguacaau

SEQ ID NO: 2491431 - RNA, 21 nt, Human
auccuagagauuugguguaca

SEQ ID NO: 2491432 - RNA, 16 nt, Human
auccuaccuguuuugu

SEQ ID NO: 2491433 - RNA, 22 nt, Human
auccuacccucgggcccaccug

SEQ ID NO: 2491434 - RNA, 21 nt, Human
auccuacccucgggcccaccu

SEQ ID NO: 2491435 - RNA, 21 nt, Human
auccuaccccaauuccuugua

SEQ ID NO: 2491436 - RNA, 18 nt, Human
auccuaccaaugcaugca

SEQ ID NO: 2491437 - RNA, 17 nt, Human
auccuaccaaugcaugc

SEQ ID NO: 2491438 - RNA, 16 nt, Human
auccuaccaaugcaug

SEQ ID NO: 2491439 - RNA, 15 nt, Human
auccuaccaaugcau

SEQ ID NO: 2491440 - RNA, 22 nt, Human
auccuacacaccuaagggacau

SEQ ID NO: 2491441 - RNA, 14 nt, Human
auccuaccaaugca

SEQ ID NO: 2491442 - RNA, 16 nt, Human
auccuccucagaucuu

SEQ ID NO: 2491443 - RNA, 11 nt, Human
auccuccuccc

SEQ ID NO: 2491444 - RNA, 22 nt, Human
auccuagccuuauccucugauc

SEQ ID NO: 2491445 - RNA, 21 nt, Human
auccuagccuuauccucugau

SEQ ID NO: 2491446 - RNA, 20 nt, Human
auccuagccuuauccucuga

SEQ ID NO: 2491447 - RNA, 19 nt, Human
auccuagccuuauccucug

SEQ ID NO: 2491448 - RNA, 16 nt, Human
auccuaggcauuugcu

SEQ ID NO: 2491449 - RNA, 18 nt, Human
auccuacaagacacagug

SEQ ID NO: 2491450 - RNA, 19 nt, Human
auccuacaagacacaguga

SEQ ID NO: 2491451 - RNA, 14 nt, Human
auccuacaagacac

SEQ ID NO: 2491452 - RNA, 14 nt, Human
auccuaaaacaaau

SEQ ID NO: 2491453 - RNA, 12 nt, Human
auccuaagcuau

SEQ ID NO: 2491454 - RNA, 15 nt, Human
auccgccagggccca

SEQ ID NO: 2491455 - RNA, 19 nt, Human
auccgccagggcccacacc

SEQ ID NO: 2491456 - RNA, 14 nt, Human
auccgccagggccc

SEQ ID NO: 2491457 - RNA, 23 nt, Human
auccgacuugaauuuucccacug

SEQ ID NO: 2491458 - RNA, 13 nt, Human
auccgccagggcc

SEQ ID NO: 2491459 - RNA, 13 nt, Human
auccgaggcaggg

SEQ ID NO: 2491460 - RNA, 20 nt, Human
auccggcccccagagcgccc

SEQ ID NO: 2491461 - RNA, 16 nt, Human
auccguaguucccuga

SEQ ID NO: 2491462 - RNA, 22 nt, Human
auccggcaacaucaacccgagu

SEQ ID NO: 2491463 - RNA, 15 nt, Human
auccggcagccugga

SEQ ID NO: 2491464 - RNA, 19 nt, Human
auccuaaaacaaaagcuca

SEQ ID NO: 2491465 - RNA, 23 nt, Human
auccuaaaacaaaagcucaucca

SEQ ID NO: 2491466 - RNA, 21 nt, Human
auccgucuuuggccuccucca

SEQ ID NO: 2491467 - RNA, 17 nt, Human
auccguaguucccugaa

SEQ ID NO: 2491468 - RNA, 17 nt, Human
uucuggcucuuccaggc

SEQ ID NO: 2491469 - RNA, 16 nt, Human
uucuggcucuuccagg

SEQ ID NO: 2491470 - RNA, 14 nt, Human
uucugggagggcag

SEQ ID NO: 2491471 - RNA, 21 nt, Human
uucugggagggcagcagggcu

SEQ ID NO: 2491472 - RNA, 20 nt, Human
uucuggcuuccuucucucaa

SEQ ID NO: 2491473 - RNA, 17 nt, Human
uucugggaaauggcuug

SEQ ID NO: 2491474 - RNA, 16 nt, Human
uucugggaggaagcag

SEQ ID NO: 2491475 - RNA, 20 nt, Human
uucuggcugccccaaccugc

SEQ ID NO: 2491476 - RNA, 11 nt, Human
uucuggcugcc

SEQ ID NO: 2491477 - RNA, 22 nt, Human
uucuggcuggagccuagaacag

SEQ ID NO: 2491478 - RNA, 14 nt, Human
uucugccuguuaua

SEQ ID NO: 2491479 - RNA, 19 nt, Human
uucuggcugaacacuggca

SEQ ID NO: 2491480 - RNA, 18 nt, Human
uucugccugcccaggccc

SEQ ID NO: 2491481 - RNA, 17 nt, Human
uucugccugcccaggcc

SEQ ID NO: 2491482 - RNA, 13 nt, Human
uucugccuguuau

SEQ ID NO: 2491483 - RNA, 16 nt, Human
uucugcccuggcugcu

SEQ ID NO: 2491484 - RNA, 14 nt, Human
uucugccuggagac

SEQ ID NO: 2491485 - RNA, 15 nt, Human
uucuggcucuuccag

SEQ ID NO: 2491486 - RNA, 21 nt, Human
uucugccugcccaggccccug

SEQ ID NO: 2491487 - RNA, 23 nt, Human
uucugaacuuggcgcugccccug

SEQ ID NO: 2491488 - RNA, 15 nt, Human
uucugccauauucug

SEQ ID NO: 2491489 - RNA, 19 nt, Human
uucugcccaauuggaggaa

SEQ ID NO: 2491490 - RNA, 14 nt, Human
uucugcccuggcug

SEQ ID NO: 2491491 - RNA, 13 nt, Human
uucugcccuggcu

SEQ ID NO: 2491492 - RNA, 15 nt, Human
uucugccagggagcu

SEQ ID NO: 2491493 - RNA, 16 nt, Human
uucugccagggagcuu

SEQ ID NO: 2491494 - RNA, 19 nt, Human
uucugcccaaaaauauggu

SEQ ID NO: 2491495 - RNA, 19 nt, Human
uucugcccacauuggaccc

SEQ ID NO: 2491496 - RNA, 22 nt, Human
uucugaacuuggcgcugccccu

SEQ ID NO: 2491497 - RNA, 19 nt, Human
uucugaacuuggcgcugcc

SEQ ID NO: 2491498 - RNA, 16 nt, Human
uucugaacucaaacug

SEQ ID NO: 2491499 - RNA, 17 nt, Human
uucugaacucaaacuga

SEQ ID NO: 2491500 - RNA, 18 nt, Human
uucugaacucaaacugag

SEQ ID NO: 2491501 - RNA, 22 nt, Human
uucugaacucaaacugaggaau

SEQ ID NO: 2491502 - RNA, 17 nt, Human
uucucuugggaacugaa

SEQ ID NO: 2491503 - RNA, 22 nt, Human
uucucuugggaacugaacucac

SEQ ID NO: 2491504 - RNA, 15 nt, Human
uucucuugggcugag

SEQ ID NO: 2491505 - RNA, 14 nt, Human
uucucuucucuguu

SEQ ID NO: 2491506 - RNA, 14 nt, Human
uucucuucuugaac

SEQ ID NO: 2491507 - RNA, 12 nt, Human
uucucuucucug

SEQ ID NO: 2491508 - RNA, 20 nt, Human
uucucuuccuuuuaucagua

SEQ ID NO: 2491509 - RNA, 12 nt, Human
uucucuuccugu

SEQ ID NO: 2491510 - RNA, 13 nt, Human
uucucuuccugua

SEQ ID NO: 2491511 - RNA, 20 nt, Human
uucucuaguuugauuaaauu

SEQ ID NO: 2491512 - RNA, 21 nt, Human
uucucuuccacucuccuugcu

SEQ ID NO: 2491513 - RNA, 15 nt, Human
uucucuaguuugauu

SEQ ID NO: 2491514 - RNA, 17 nt, Human
uucucuaguuugauuaa

SEQ ID NO: 2491515 - RNA, 12 nt, Human
uucucuaggaaa

SEQ ID NO: 2491516 - RNA, 20 nt, Human
uucuccuuagucuucucaua

SEQ ID NO: 2491517 - RNA, 21 nt, Human
uucuccuuguguuacuaaguu

SEQ ID NO: 2491518 - RNA, 20 nt, Human
uucuccuucagcccucaccc

SEQ ID NO: 2491519 - RNA, 15 nt, Human
uucuccuucagcccu

SEQ ID NO: 2491520 - RNA, 12 nt, Human
uucuccugugcu

SEQ ID NO: 2491521 - RNA, 15 nt, Human
uucuccuuagucuuc

SEQ ID NO: 2491522 - RNA, 10 nt, Human
uucuccugga

SEQ ID NO: 2491523 - RNA, 14 nt, Human
aucaguauaaacaa

SEQ ID NO: 2491524 - RNA, 15 nt, Human
aucagguuccauccc

SEQ ID NO: 2491525 - RNA, 20 nt, Human
aucaggugcccaucccugga

SEQ ID NO: 2491526 - RNA, 13 nt, Human
aucaggucuccca

SEQ ID NO: 2491527 - RNA, 13 nt, Human
aucagguggggag

SEQ ID NO: 2491528 - RNA, 15 nt, Human
aucaguaauauuuau

SEQ ID NO: 2491529 - RNA, 19 nt, Human
aucaguaagaaaaagaaga

SEQ ID NO: 2491530 - RNA, 18 nt, Human
aucaguagccagcaucug

SEQ ID NO: 2491531 - RNA, 16 nt, Human
auccagugauccuuac

SEQ ID NO: 2491532 - RNA, 21 nt, Human
auccagugauccuuacaaguu

SEQ ID NO: 2491533 - RNA, 17 nt, Human
auccagugucucacagc

SEQ ID NO: 2491534 - RNA, 16 nt, Human
auccaguucaugagaa

SEQ ID NO: 2491535 - RNA, 19 nt, Human
auccauagcaccuccacau

SEQ ID NO: 2491536 - RNA, 17 nt, Human
auccaccaccucccuca

SEQ ID NO: 2491537 - RNA, 14 nt, Human
auccaccaccuccc

SEQ ID NO: 2491538 - RNA, 19 nt, Human
auccacauuguuuuaaaaa

SEQ ID NO: 2491539 - RNA, 18 nt, Human
auccacauuguuuuaaaa

SEQ ID NO: 2491540 - RNA, 21 nt, Human
auccaguaucuugaagacuuu

SEQ ID NO: 2491541 - RNA, 20 nt, Human
auccauauugagucaaaugg

SEQ ID NO: 2491542 - RNA, 18 nt, Human
auccauauugagucaaau

SEQ ID NO: 2491543 - RNA, 16 nt, Human
auccauaguaguauga

SEQ ID NO: 2491544 - RNA, 19 nt, Human
auccauaguggacauuguu

SEQ ID NO: 2491545 - RNA, 13 nt, Human
auccaucaggcca

SEQ ID NO: 2491546 - RNA, 20 nt, Human
aucccaaacccuucagugcc

SEQ ID NO: 2491547 - RNA, 19 nt, Human
aucccaaacccuucagugc

SEQ ID NO: 2491548 - RNA, 12 nt, Human
aucccagcccca

SEQ ID NO: 2491549 - RNA, 22 nt, Human
aucccaaagccuugugucuaca

SEQ ID NO: 2491550 - RNA, 18 nt, Human
aucccauaugccugggca

SEQ ID NO: 2491551 - RNA, 17 nt, Human
aucccaggacaccacac

SEQ ID NO: 2491552 - RNA, 12 nt, Human
aucccaggacac

SEQ ID NO: 2491553 - RNA, 20 nt, Human
aucccagcuacuugggaagc

SEQ ID NO: 2491554 - RNA, 13 nt, Human
aucccagcucacg

SEQ ID NO: 2491555 - RNA, 22 nt, Human
aucccagcuacuugggaggcug

SEQ ID NO: 2491556 - RNA, 18 nt, Human
aucccagcuacuugggaa

SEQ ID NO: 2491557 - RNA, 20 nt, Human
aucccagcuacucaggaggc

SEQ ID NO: 2491558 - RNA, 15 nt, Human
aucccagccuuggca

SEQ ID NO: 2491559 - RNA, 23 nt, Human
aucccagcuacucaagaggcuga

SEQ ID NO: 2491560 - RNA, 17 nt, Human
aucccagcuacucagga

SEQ ID NO: 2491561 - RNA, 18 nt, Human
aucccagcuacucaggag

SEQ ID NO: 2491562 - RNA, 23 nt, Human
aucccagcccuuugggaggcuga

SEQ ID NO: 2491563 - RNA, 13 nt, Human
aucccagccuugg

SEQ ID NO: 2491564 - RNA, 20 nt, Human
aucccagcuacucaagaggc

SEQ ID NO: 2491565 - RNA, 16 nt, Human
uucugggcuucaucug

SEQ ID NO: 2491566 - RNA, 19 nt, Human
uucugggcaucuguucugg

SEQ ID NO: 2491567 - RNA, 21 nt, Human
uucuggggccccuuuuuacuc

SEQ ID NO: 2491568 - RNA, 14 nt, Human
uucuggggccccuu

SEQ ID NO: 2491569 - RNA, 20 nt, Human
aucauuuuaccuuugacaaa

SEQ ID NO: 2491570 - RNA, 23 nt, Human
uucuggggccccuuuuuacuccc

SEQ ID NO: 2491571 - RNA, 14 nt, Human
aucauuuuuccuuc

SEQ ID NO: 2491572 - RNA, 19 nt, Human
aucauuuugcauucaaauu

SEQ ID NO: 2491573 - RNA, 19 nt, Human
aucauuuugccucuuuucu

SEQ ID NO: 2491574 - RNA, 18 nt, Human
auccaagcaaaugugaau

SEQ ID NO: 2491575 - RNA, 17 nt, Human
aucauuuugcauucaaa

SEQ ID NO: 2491576 - RNA, 15 nt, Human
aucauuuugcauuca

SEQ ID NO: 2491577 - RNA, 13 nt, Human
aucauuuugcauu

SEQ ID NO: 2491578 - RNA, 22 nt, Human
aucauuuucuuaucuucugcaa

SEQ ID NO: 2491579 - RNA, 17 nt, Human
aucauuuuccccccacu

SEQ ID NO: 2491580 - RNA, 23 nt, Human
aucauuuuagaagacucuaccag

SEQ ID NO: 2491581 - RNA, 22 nt, Human
aucauuuuagaagacucuacca

SEQ ID NO: 2491582 - RNA, 16 nt, Human
aucauuuuagaagacu

SEQ ID NO: 2491583 - RNA, 18 nt, Human
aucauuuuauaugucaaa

SEQ ID NO: 2491584 - RNA, 17 nt, Human
aucauuuuauaugucaa

SEQ ID NO: 2491585 - RNA, 19 nt, Human
aucauuuuauaugucaaag

SEQ ID NO: 2491586 - RNA, 13 nt, Human
aucauuuuccccc

SEQ ID NO: 2491587 - RNA, 14 nt, Human
aucauuuucccccc

SEQ ID NO: 2491588 - RNA, 15 nt, Human
aucauuuucccccca

SEQ ID NO: 2491589 - RNA, 16 nt, Human
auccaguaucuugaag

SEQ ID NO: 2491590 - RNA, 15 nt, Human
auccacccaccucag

SEQ ID NO: 2491591 - RNA, 13 nt, Human
auccacccaccuc

SEQ ID NO: 2491592 - RNA, 21 nt, Human
auccaagcuggucccacucag

SEQ ID NO: 2491593 - RNA, 18 nt, Human
auccaagcuggucccacu

SEQ ID NO: 2491594 - RNA, 23 nt, Human
aucauuuuuccuucccuucucca

SEQ ID NO: 2491595 - RNA, 16 nt, Human
auguccacugguucuu

SEQ ID NO: 2491596 - RNA, 17 nt, Human
auguccacugguucuuc

SEQ ID NO: 2491597 - RNA, 13 nt, Human
augucagugugac

SEQ ID NO: 2491598 - RNA, 12 nt, Human
augucaguguga

SEQ ID NO: 2491599 - RNA, 21 nt, Human
auguccagaagaauauucagg

SEQ ID NO: 2491600 - RNA, 12 nt, Human
auguccagaaga

SEQ ID NO: 2491601 - RNA, 17 nt, Human
auguccacuguguauag

SEQ ID NO: 2491602 - RNA, 16 nt, Human
auguccacuguguaua

SEQ ID NO: 2491603 - RNA, 23 nt, Human
auguccagaagaauauucaggac

SEQ ID NO: 2491604 - RNA, 22 nt, Human
auguccagaagaauauucagga

SEQ ID NO: 2491605 - RNA, 14 nt, Human
auguccacugugua

SEQ ID NO: 2491606 - RNA, 13 nt, Human
auguccuguaaag

SEQ ID NO: 2491607 - RNA, 22 nt, Human
augucucaggucccugcagggc

SEQ ID NO: 2491608 - RNA, 17 nt, Human
augucucaggucccugc

SEQ ID NO: 2491609 - RNA, 14 nt, Human
auguccuguaaagg

SEQ ID NO: 2491610 - RNA, 14 nt, Human
augucgccucugca

SEQ ID NO: 2491611 - RNA, 13 nt, Human
augucgccucugc

SEQ ID NO: 2491612 - RNA, 16 nt, Human
augucucgugguagga

SEQ ID NO: 2491613 - RNA, 15 nt, Human
augucucgugguagg

SEQ ID NO: 2491614 - RNA, 23 nt, Human
augucucugugagacucgagaac

SEQ ID NO: 2491615 - RNA, 21 nt, Human
augucucugugagacucgaga

SEQ ID NO: 2491616 - RNA, 17 nt, Human
augucucugagcauuag

SEQ ID NO: 2491617 - RNA, 13 nt, Human
augucucucagaa

SEQ ID NO: 2491618 - RNA, 16 nt, Human
augucucucagaauuc

SEQ ID NO: 2491619 - RNA, 17 nt, Human
augucucucagaauucu

SEQ ID NO: 2491620 - RNA, 21 nt, Human
augucucucagaauucuucag

SEQ ID NO: 2491621 - RNA, 19 nt, Human
augucucgugguaggacug

SEQ ID NO: 2491622 - RNA, 18 nt, Human
auguaugagguacaaccu

SEQ ID NO: 2491623 - RNA, 19 nt, Human
auguaugaggaauuucugu

SEQ ID NO: 2491624 - RNA, 13 nt, Human
uuuggcaggugca

SEQ ID NO: 2491625 - RNA, 22 nt, Human
uuuggcaggggcagaaaacucu

SEQ ID NO: 2491626 - RNA, 17 nt, Human
uuuggcacuggggcacu

SEQ ID NO: 2491627 - RNA, 11 nt, Human
uuuggcacugg

SEQ ID NO: 2491628 - RNA, 20 nt, Human
uuuggcagagcuucuuccag

SEQ ID NO: 2491629 - RNA, 13 nt, Human
uuuggcagaguuc

SEQ ID NO: 2491630 - RNA, 15 nt, Human
auguaugcuucauac

SEQ ID NO: 2491631 - RNA, 16 nt, Human
auguaugcuucauaca

SEQ ID NO: 2491632 - RNA, 15 nt, Human
auguauguguaagua

SEQ ID NO: 2491633 - RNA, 14 nt, Human
auguaugcuucaua

SEQ ID NO: 2491634 - RNA, 17 nt, Human
auguaugcagcuaucug

SEQ ID NO: 2491635 - RNA, 14 nt, Human
auguaugcagcuau

SEQ ID NO: 2491636 - RNA, 14 nt, Human
auguaugauuacau

SEQ ID NO: 2491637 - RNA, 20 nt, Human
auguauguuuugguaucugu

SEQ ID NO: 2491638 - RNA, 17 nt, Human
auguauguuuacauauc

SEQ ID NO: 2491639 - RNA, 18 nt, Human
auguauguuuacauauca

SEQ ID NO: 2491640 - RNA, 16 nt, Human
auguauuaauauucau

SEQ ID NO: 2491641 - RNA, 17 nt, Human
auguauuaauauucauu

SEQ ID NO: 2491642 - RNA, 16 nt, Human
augucaguauguggaa

SEQ ID NO: 2491643 - RNA, 13 nt, Human
auguauuauucug

SEQ ID NO: 2491644 - RNA, 14 nt, Human
auguauuauucugc

SEQ ID NO: 2491645 - RNA, 16 nt, Human
auguauuauucugcag

SEQ ID NO: 2491646 - RNA, 17 nt, Human
auguauuauucugcagc

SEQ ID NO: 2491647 - RNA, 15 nt, Human
auguauguguguaug

SEQ ID NO: 2491648 - RNA, 14 nt, Human
auguauguguguau

SEQ ID NO: 2491649 - RNA, 16 nt, Human
auguauguguaaguau

SEQ ID NO: 2491650 - RNA, 16 nt, Human
auguauguuuacauau

SEQ ID NO: 2491651 - RNA, 13 nt, Human
auguauguuuaca

SEQ ID NO: 2491652 - RNA, 14 nt, Human
auguauguuuacau

SEQ ID NO: 2491653 - RNA, 12 nt, Human
auguauguuuac

SEQ ID NO: 2491654 - RNA, 21 nt, Human
uuuguaguguuggagaagaac

SEQ ID NO: 2491655 - RNA, 19 nt, Human
uuuguaguguuggagaaga

SEQ ID NO: 2491656 - RNA, 20 nt, Human
uuuguaauugcuuacauuuu

SEQ ID NO: 2491657 - RNA, 16 nt, Human
uuugucuucuccccag

SEQ ID NO: 2491658 - RNA, 15 nt, Human
uuugucuucucccca

SEQ ID NO: 2491659 - RNA, 12 nt, Human
uuuguauaaaag

SEQ ID NO: 2491660 - RNA, 14 nt, Human
uuuguaaugaaaac

SEQ ID NO: 2491661 - RNA, 13 nt, Human
uuuguaaugaaaa

SEQ ID NO: 2491662 - RNA, 16 nt, Human
augugcacccaugggc

SEQ ID NO: 2491663 - RNA, 18 nt, Human
uuuguaaucguuaugugu

SEQ ID NO: 2491664 - RNA, 21 nt, Human
uuuguaaucguuaugugugua

SEQ ID NO: 2491665 - RNA, 18 nt, Human
uuuguaauugcuuacauu

SEQ ID NO: 2491666 - RNA, 14 nt, Human
uuuguaauuauugu

SEQ ID NO: 2491667 - RNA, 12 nt, Human
uuuguaauuauu

SEQ ID NO: 2491668 - RNA, 23 nt, Human
uuuguaaugucaccaccuuccca

SEQ ID NO: 2491669 - RNA, 17 nt, Human
uuugugaagcaaaauuu

SEQ ID NO: 2491670 - RNA, 22 nt, Human
uuugugaacaagucccuguaau

SEQ ID NO: 2491671 - RNA, 20 nt, Human
uuugugaacucagccaagca

SEQ ID NO: 2491672 - RNA, 16 nt, Human
uuugucuugaaugucu

SEQ ID NO: 2491673 - RNA, 17 nt, Human
uuugucuuuaacuguca

SEQ ID NO: 2491674 - RNA, 22 nt, Human
uuugugaaaugauggugaaagu

SEQ ID NO: 2491675 - RNA, 21 nt, Human
uuugucuuguguuucuuuagu

SEQ ID NO: 2491676 - RNA, 14 nt, Human
uuugugacuauaua

SEQ ID NO: 2491677 - RNA, 22 nt, Human
uuugugacuaauuguauaacag

SEQ ID NO: 2491678 - RNA, 23 nt, Human
uuugugaauggauuggauuauuu

SEQ ID NO: 2491679 - RNA, 18 nt, Human
uuugugacuaauuguaua

SEQ ID NO: 2491680 - RNA, 19 nt, Human
uuugugaauggauuggauu

SEQ ID NO: 2491681 - RNA, 20 nt, Human
uuugugaagguggaaauaaa

SEQ ID NO: 2491682 - RNA, 18 nt, Human
uuugugaauagaacucug

SEQ ID NO: 2491683 - RNA, 17 nt, Human
uuugugaauggauugga

SEQ ID NO: 2491684 - RNA, 19 nt, Human
augugaugagaggaaauca

SEQ ID NO: 2491685 - RNA, 17 nt, Human
augugaugagaggaaau

SEQ ID NO: 2491686 - RNA, 23 nt, Human
augugacuugcaucguggagaca

SEQ ID NO: 2491687 - RNA, 15 nt, Human
augugaugagaggaa

SEQ ID NO: 2491688 - RNA, 16 nt, Human
augugaugagaggaaa

SEQ ID NO: 2491689 - RNA, 19 nt, Human
augugaccacucugucuug

SEQ ID NO: 2491690 - RNA, 20 nt, Human
augugacccagauccucaca

SEQ ID NO: 2491691 - RNA, 12 nt, Human
augugacucuga

SEQ ID NO: 2491692 - RNA, 13 nt, Human
augugacucugaa

SEQ ID NO: 2491693 - RNA, 23 nt, Human
augucucuuuaaugucacaggca

SEQ ID NO: 2491694 - RNA, 16 nt, Human
augucucuucugagcu

SEQ ID NO: 2491695 - RNA, 17 nt, Human
augucucuucugagcua

SEQ ID NO: 2491696 - RNA, 13 nt, Human
augucucuucuga

SEQ ID NO: 2491697 - RNA, 15 nt, Human
augugauuuuucuga

SEQ ID NO: 2491698 - RNA, 14 nt, Human
augugcaaaugcaa

SEQ ID NO: 2491699 - RNA, 16 nt, Human
augugcaaguguaugc

SEQ ID NO: 2491700 - RNA, 14 nt, Human
augugcaaaacagc

SEQ ID NO: 2491701 - RNA, 13 nt, Human
augugcaaaacag

SEQ ID NO: 2491702 - RNA, 21 nt, Human
augugauuuaauaguguuaau

SEQ ID NO: 2491703 - RNA, 14 nt, Human
augugauuuuaacu

SEQ ID NO: 2491704 - RNA, 15 nt, Human
augugauuuuaacuc

SEQ ID NO: 2491705 - RNA, 16 nt, Human
augugauuuuaacucu

SEQ ID NO: 2491706 - RNA, 18 nt, Human
augugauuuuaacucugu

SEQ ID NO: 2491707 - RNA, 19 nt, Human
augugauuuuaacucuguc

SEQ ID NO: 2491708 - RNA, 20 nt, Human
augugauuuuaacucugucu

SEQ ID NO: 2491709 - RNA, 14 nt, Human
augugauuuuucug

SEQ ID NO: 2491710 - RNA, 23 nt, Human
augugcacaugcacgugugugca

SEQ ID NO: 2491711 - RNA, 20 nt, Human
augugauuccuuugaagagg

SEQ ID NO: 2491712 - RNA, 18 nt, Human
augugacucugaagcuga

SEQ ID NO: 2491713 - RNA, 15 nt, Human
augugauucuaaugu

SEQ ID NO: 2491714 - RNA, 23 nt, Human
augugauuccuuugaagaggaaa

SEQ ID NO: 2491715 - RNA, 14 nt, Human
augugauuguggaa

SEQ ID NO: 2491716 - RNA, 15 nt, Human
augugauuguggaau

SEQ ID NO: 2491717 - RNA, 17 nt, Human
augugauuguggaaugg

SEQ ID NO: 2491718 - RNA, 20 nt, Human
augugauuuaauaguguuaa

SEQ ID NO: 2491719 - RNA, 18 nt, Human
augugauuuaauaguguu

SEQ ID NO: 2491720 - RNA, 17 nt, Human
augugauuuaauagugu

SEQ ID NO: 2491721 - RNA, 16 nt, Human
augugauuuaauagug

SEQ ID NO: 2491722 - RNA, 22 nt, Human
augugauuguggaauggagauu

SEQ ID NO: 2491723 - RNA, 13 nt, Human
augugauuuaaua

SEQ ID NO: 2491724 - RNA, 19 nt, Human
auguagccccucuccugga

SEQ ID NO: 2491725 - RNA, 22 nt, Human
auguaggaaagaccauuuuucc

SEQ ID NO: 2491726 - RNA, 14 nt, Human
auguaggaaguagg

SEQ ID NO: 2491727 - RNA, 23 nt, Human
auguaggagcugccuuggcucag

SEQ ID NO: 2491728 - RNA, 12 nt, Human
auguagccaugg

SEQ ID NO: 2491729 - RNA, 14 nt, Human
auguagcugguuuc

SEQ ID NO: 2491730 - RNA, 15 nt, Human
auguagcugguuucc

SEQ ID NO: 2491731 - RNA, 16 nt, Human
auguagauuuauuuca

SEQ ID NO: 2491732 - RNA, 17 nt, Human
auguagauuuauuucau

SEQ ID NO: 2491733 - RNA, 17 nt, Human
auguagaugugcauuuu

SEQ ID NO: 2491734 - RNA, 20 nt, Human
auguagauuuauuucaucau

SEQ ID NO: 2491735 - RNA, 17 nt, Human
auguagcaaaacgcaug

SEQ ID NO: 2491736 - RNA, 21 nt, Human
auguagcaaaauacaugacau

SEQ ID NO: 2491737 - RNA, 20 nt, Human
auguagcaaaacgcauggag

SEQ ID NO: 2491738 - RNA, 18 nt, Human
auguagcccccuggccuc

SEQ ID NO: 2491739 - RNA, 19 nt, Human
auguagcccccuggccucu

SEQ ID NO: 2491740 - RNA, 21 nt, Human
auguagcccccuggccucugu

SEQ ID NO: 2491741 - RNA, 23 nt, Human
auguagcccccuggccucugugc

SEQ ID NO: 2491742 - RNA, 16 nt, Human
auguagccaugggacc

SEQ ID NO: 2491743 - RNA, 23 nt, Human
auguagccaugaccuuacauuuc

SEQ ID NO: 2491744 - RNA, 19 nt, Human
uuugacaguguugaaaaug

SEQ ID NO: 2491745 - RNA, 18 nt, Human
uuugacaguguugaaaau

SEQ ID NO: 2491746 - RNA, 21 nt, Human
auguaguaucaaauauuagau

SEQ ID NO: 2491747 - RNA, 23 nt, Human
auguaguaucaaauauuagaugu

SEQ ID NO: 2491748 - RNA, 19 nt, Human
auguaguauaaagaaaagu

SEQ ID NO: 2491749 - RNA, 12 nt, Human
uuugaccucugc

SEQ ID NO: 2491750 - RNA, 20 nt, Human
uuugacauugcguuugaccu

SEQ ID NO: 2491751 - RNA, 13 nt, Human
uuugacaugugga

SEQ ID NO: 2491752 - RNA, 16 nt, Human
auguaguaaguaaauu

SEQ ID NO: 2491753 - RNA, 13 nt, Human
auguaguaauuga

SEQ ID NO: 2491754 - RNA, 16 nt, Human
auguaguaauugacau

SEQ ID NO: 2491755 - RNA, 17 nt, Human
auguaguaauugacaug

SEQ ID NO: 2491756 - RNA, 14 nt, Human
auguaguaguacuu

SEQ ID NO: 2491757 - RNA, 18 nt, Human
auguaguaauugacaugu

SEQ ID NO: 2491758 - RNA, 16 nt, Human
auguaguauaaagaaa

SEQ ID NO: 2491759 - RNA, 17 nt, Human
auguaguauaaagaaaa

SEQ ID NO: 2491760 - RNA, 21 nt, Human
auguaggugucugcacccagg

SEQ ID NO: 2491761 - RNA, 15 nt, Human
auguaggugucugca

SEQ ID NO: 2491762 - RNA, 17 nt, Human
auguaggcauucuggag

SEQ ID NO: 2491763 - RNA, 18 nt, Human
auguaggguaaggugccu

SEQ ID NO: 2491764 - RNA, 20 nt, Human
auguagggcauaaugaugau

SEQ ID NO: 2491765 - RNA, 16 nt, Human
auguagguaugaauaa

SEQ ID NO: 2491766 - RNA, 17 nt, Human
auguagguaugaauaag

SEQ ID NO: 2491767 - RNA, 12 nt, Human
auguagaggaga

SEQ ID NO: 2491768 - RNA, 13 nt, Human
auguagaggagaa

SEQ ID NO: 2491769 - RNA, 14 nt, Human
auguagaaaauuug

SEQ ID NO: 2491770 - RNA, 13 nt, Human
auguagaagcugc

SEQ ID NO: 2491771 - RNA, 12 nt, Human
auguagaaagcu

SEQ ID NO: 2491772 - RNA, 17 nt, Human
auguagaggagaaacug

SEQ ID NO: 2491773 - RNA, 19 nt, Human
auguagaggagaaacugga

SEQ ID NO: 2491774 - RNA, 19 nt, Human
auguagaggggaaaagaga

SEQ ID NO: 2491775 - RNA, 18 nt, Human
auguagauaaacucagaa

SEQ ID NO: 2491776 - RNA, 19 nt, Human
auguagauaaacucagaaa

SEQ ID NO: 2491777 - RNA, 19 nt, Human
auguagauaacaagaccuc

SEQ ID NO: 2491778 - RNA, 22 nt, Human
auguagauauugugaaguacau

SEQ ID NO: 2491779 - RNA, 23 nt, Human
auguagauauugugaaguacaua

SEQ ID NO: 2491780 - RNA, 22 nt, Human
auguacucuacugauaucuaaa

SEQ ID NO: 2491781 - RNA, 16 nt, Human
auguacucuacugaua

SEQ ID NO: 2491782 - RNA, 14 nt, Human
auguacugagauuu

SEQ ID NO: 2491783 - RNA, 18 nt, Human
auguacugagccuuguaa

SEQ ID NO: 2491784 - RNA, 20 nt, Human
auguacuccucuuuacacug

SEQ ID NO: 2491785 - RNA, 17 nt, Human
auguacuccucuuuaca

SEQ ID NO: 2491786 - RNA, 16 nt, Human
auguacuucaugcugu

SEQ ID NO: 2491787 - RNA, 19 nt, Human
auguacuugucaaagaagg

SEQ ID NO: 2491788 - RNA, 18 nt, Human
auguacuugucaaagaag

SEQ ID NO: 2491789 - RNA, 17 nt, Human
auguacuugucaaagaa

SEQ ID NO: 2491790 - RNA, 16 nt, Human
auguacuugucaaaga

SEQ ID NO: 2491791 - RNA, 16 nt, Human
auguacuguaguuuuu

SEQ ID NO: 2491792 - RNA, 19 nt, Human
auguacuguaguuuuucuu

SEQ ID NO: 2491793 - RNA, 22 nt, Human
auguaccauuugcauggcucca

SEQ ID NO: 2491794 - RNA, 18 nt, Human
auguaccauuugcauggc

SEQ ID NO: 2491795 - RNA, 21 nt, Human
auguaccauguacaugaagaa

SEQ ID NO: 2491796 - RNA, 15 nt, Human
auguaccauuugcau

SEQ ID NO: 2491797 - RNA, 15 nt, Human
auguaccauguacau

SEQ ID NO: 2491798 - RNA, 18 nt, Human
auguaccaugaaacaaag

SEQ ID NO: 2491799 - RNA, 21 nt, Human
auguacguuuguaugugugua

SEQ ID NO: 2491800 - RNA, 14 nt, Human
auguacguuuguau

SEQ ID NO: 2491801 - RNA, 19 nt, Human
uuugcugagcauguacuga

SEQ ID NO: 2491802 - RNA, 20 nt, Human
uuugcucuucaagaaaucug

SEQ ID NO: 2491803 - RNA, 12 nt, Human
uuugcucugcca

SEQ ID NO: 2491804 - RNA, 13 nt, Human
uuugcucuuucuu

SEQ ID NO: 2491805 - RNA, 23 nt, Human
uuuggcaaacucuccaccacacg

SEQ ID NO: 2491806 - RNA, 17 nt, Human
uuuggcaaugccaucau

SEQ ID NO: 2491807 - RNA, 15 nt, Human
uuugcuggaauaagu

SEQ ID NO: 2491808 - RNA, 10 nt, Human
uuugcugcca

SEQ ID NO: 2491809 - RNA, 18 nt, Human
uuugcucuucaagaaauc

SEQ ID NO: 2491810 - RNA, 20 nt, Human
uuugcucucccgguucuucc

SEQ ID NO: 2491811 - RNA, 11 nt, Human
uuugccugugc

SEQ ID NO: 2491812 - RNA, 13 nt, Human
uuugccucugccu

SEQ ID NO: 2491813 - RNA, 17 nt, Human
uuugccucuuccagucu

SEQ ID NO: 2491814 - RNA, 20 nt, Human
uuugccucuuuucucugugc

SEQ ID NO: 2491815 - RNA, 14 nt, Human
uuugccugagggcg

SEQ ID NO: 2491816 - RNA, 14 nt, Human
uuugcaaccucgcu

SEQ ID NO: 2491817 - RNA, 16 nt, Human
uuugauucuccuucag

SEQ ID NO: 2491818 - RNA, 14 nt, Human
uuugauucuccuuc

SEQ ID NO: 2491819 - RNA, 13 nt, Human
uuugauucuccuu

SEQ ID NO: 2491820 - RNA, 12 nt, Human
uuugauucuccu

SEQ ID NO: 2491821 - RNA, 22 nt, Human
uuugauucagacagcugccugg

SEQ ID NO: 2491822 - RNA, 15 nt, Human
uuugauucauaguaa

SEQ ID NO: 2491823 - RNA, 20 nt, Human
uuugauucauaguaacuucu

SEQ ID NO: 2491824 - RNA, 17 nt, Human
uuugauguuuguggccu

SEQ ID NO: 2491825 - RNA, 19 nt, Human
uuugauguuuguggccuca

SEQ ID NO: 2491826 - RNA, 20 nt, Human
uuugcaagggaaaagucucu

SEQ ID NO: 2491827 - RNA, 21 nt, Human
uuugcaagggaaaagucucuu

SEQ ID NO: 2491828 - RNA, 12 nt, Human
uuugcccuuuga

SEQ ID NO: 2491829 - RNA, 15 nt, Human
uuugccguuauuaaa

SEQ ID NO: 2491830 - RNA, 14 nt, Human
uuugcaagccagau

SEQ ID NO: 2491831 - RNA, 21 nt, Human
uuugcaaggaagccacagcug

SEQ ID NO: 2491832 - RNA, 14 nt, Human
uuugcaaggaagcc

SEQ ID NO: 2491833 - RNA, 12 nt, Human
uuugcaaggaag

SEQ ID NO: 2491834 - RNA, 22 nt, Human
uuugauguucuuucacccuuuu

SEQ ID NO: 2491835 - RNA, 13 nt, Human
uuugauuaaauuc

SEQ ID NO: 2491836 - RNA, 17 nt, Human
uuugauguuaacacauu

SEQ ID NO: 2491837 - RNA, 16 nt, Human
uuugauguuaacacau

SEQ ID NO: 2491838 - RNA, 15 nt, Human
uuugauguuaacaca

SEQ ID NO: 2491839 - RNA, 14 nt, Human
uuugauguuaacac

SEQ ID NO: 2491840 - RNA, 11 nt, Human
uuugauguuaa

SEQ ID NO: 2491841 - RNA, 18 nt, Human
uuugauuaaauucuugca

SEQ ID NO: 2491842 - RNA, 21 nt, Human
uuugauuaaauucuugcaaag

SEQ ID NO: 2491843 - RNA, 21 nt, Human
uuugauucagacagcugccug

SEQ ID NO: 2491844 - RNA, 23 nt, Human
uuugauuaaauucuugcaaagua

SEQ ID NO: 2491845 - RNA, 19 nt, Human
uuugacgccaucccagccc

SEQ ID NO: 2491846 - RNA, 16 nt, Human
uuugacgccaucccag

SEQ ID NO: 2491847 - RNA, 14 nt, Human
uuugacgccauccc

SEQ ID NO: 2491848 - RNA, 13 nt, Human
uuugacgccaucc

SEQ ID NO: 2491849 - RNA, 15 nt, Human
uuugacuggauauuc

SEQ ID NO: 2491850 - RNA, 19 nt, Human
uuugacugaagaugcagcu

SEQ ID NO: 2491851 - RNA, 12 nt, Human
uuugacucuuuu

SEQ ID NO: 2491852 - RNA, 15 nt, Human
uuugaugcuguuuga

SEQ ID NO: 2491853 - RNA, 19 nt, Human
uuugaugcuggagagguua

SEQ ID NO: 2491854 - RNA, 19 nt, Human
uuugacucuggcaaagcuu

SEQ ID NO: 2491855 - RNA, 20 nt, Human
uuugacucuggcaaagcuuu

SEQ ID NO: 2491856 - RNA, 18 nt, Human
uuugacucuugcaaucca

SEQ ID NO: 2491857 - RNA, 21 nt, Human
uuugacucuggcaaagcuuuu

SEQ ID NO: 2491858 - RNA, 19 nt, Human
uuugacuagaugauggaug

SEQ ID NO: 2491859 - RNA, 21 nt, Human
uuugacuagggauucaggcug

SEQ ID NO: 2491860 - RNA, 20 nt, Human
uuugacgccaucccagcccc

SEQ ID NO: 2491861 - RNA, 19 nt, Human
uuugaccuuuuauguagua

SEQ ID NO: 2491862 - RNA, 14 nt, Human
uuugacggaugauu

SEQ ID NO: 2491863 - RNA, 17 nt, Human
uuugacauguggaaagu

SEQ ID NO: 2491864 - RNA, 19 nt, Human
uuugacgggaaacaaaacu

SEQ ID NO: 2491865 - RNA, 14 nt, Human
auguacauuaauua

SEQ ID NO: 2491866 - RNA, 20 nt, Human
auguacauuuccaaauucac

SEQ ID NO: 2491867 - RNA, 19 nt, Human
auguacauuucugaaauga

SEQ ID NO: 2491868 - RNA, 14 nt, Human
auguaaaugugcau

SEQ ID NO: 2491869 - RNA, 17 nt, Human
auguacauguacugauu

SEQ ID NO: 2491870 - RNA, 12 nt, Human
auguaaaugugc

SEQ ID NO: 2491871 - RNA, 13 nt, Human
auguaaaugugca

SEQ ID NO: 2491872 - RNA, 21 nt, Human
auguaaaugcaucuguccuca

SEQ ID NO: 2491873 - RNA, 15 nt, Human
auguaaauauucuau

SEQ ID NO: 2491874 - RNA, 12 nt, Human
auguaaauauuc

SEQ ID NO: 2491875 - RNA, 18 nt, Human
auguaaaguauguaaaca

SEQ ID NO: 2491876 - RNA, 17 nt, Human
auguaaauagugcagaa

SEQ ID NO: 2491877 - RNA, 12 nt, Human
auguaaauagug

SEQ ID NO: 2491878 - RNA, 17 nt, Human
auguaaaguauguaaac

SEQ ID NO: 2491879 - RNA, 13 nt, Human
auguaaaguaugu

SEQ ID NO: 2491880 - RNA, 20 nt, Human
auguaaaggagucaaaacua

SEQ ID NO: 2491881 - RNA, 16 nt, Human
auguaaagugauauuu

SEQ ID NO: 2491882 - RNA, 21 nt, Human
auguaaagauauuuuuaucuu

SEQ ID NO: 2491883 - RNA, 19 nt, Human
auguaaagaacauaaauaa

SEQ ID NO: 2491884 - RNA, 14 nt, Human
auguaaagauauuu

SEQ ID NO: 2491885 - RNA, 14 nt, Human
auguaaacaggaga

SEQ ID NO: 2491886 - RNA, 15 nt, Human
auguaaacagugccu

SEQ ID NO: 2491887 - RNA, 16 nt, Human
auguaaacagugccug

SEQ ID NO: 2491888 - RNA, 17 nt, Human
auguaaacagugccugc

SEQ ID NO: 2491889 - RNA, 14 nt, Human
auguaaacugugca

SEQ ID NO: 2491890 - RNA, 20 nt, Human
auguaaacagugccugcuga

SEQ ID NO: 2491891 - RNA, 22 nt, Human
auguaaacagugccugcugaau

SEQ ID NO: 2491892 - RNA, 23 nt, Human
auguaaacauaauucuuguauau

SEQ ID NO: 2491893 - RNA, 17 nt, Human
auguaaaauguugaaua

SEQ ID NO: 2491894 - RNA, 16 nt, Human
auguaaaauguugaau

SEQ ID NO: 2491895 - RNA, 19 nt, Human
auguaaacaaaauuuaguu

SEQ ID NO: 2491896 - RNA, 13 nt, Human
auguaaaauguuu

SEQ ID NO: 2491897 - RNA, 18 nt, Human
auguaaacaaaauuuagu

SEQ ID NO: 2491898 - RNA, 21 nt, Human
auguaaaagguauuaaauuga

SEQ ID NO: 2491899 - RNA, 22 nt, Human
auguaaaaggccaaaccucugu

SEQ ID NO: 2491900 - RNA, 23 nt, Human
auguaaaaggccaaaccucuguu

SEQ ID NO: 2491901 - RNA, 15 nt, Human
auguaaaaggccaaa

SEQ ID NO: 2491902 - RNA, 18 nt, Human
auguaaaaggccaaaccu

SEQ ID NO: 2491903 - RNA, 21 nt, Human
auguaaaagagucaucuggua

SEQ ID NO: 2491904 - RNA, 17 nt, Human
auguaaaagacuuuuuu

SEQ ID NO: 2491905 - RNA, 14 nt, Human
augguuuucuugug

SEQ ID NO: 2491906 - RNA, 16 nt, Human
augguuuucaaaauaa

SEQ ID NO: 2491907 - RNA, 14 nt, Human
augguuuucaaaau

SEQ ID NO: 2491908 - RNA, 15 nt, Human
augguuuucaaaaua

SEQ ID NO: 2491909 - RNA, 18 nt, Human
augguuugcaaggaagcc

SEQ ID NO: 2491910 - RNA, 17 nt, Human
augguuugcaaggaagc

SEQ ID NO: 2491911 - RNA, 16 nt, Human
augguuugcaaggaag

SEQ ID NO: 2491912 - RNA, 22 nt, Human
augguuugacucccgaacauca

SEQ ID NO: 2491913 - RNA, 22 nt, Human
augguuugaauauaaacacuau

SEQ ID NO: 2491914 - RNA, 21 nt, Human
augguucccuugaugaagaag

SEQ ID NO: 2491915 - RNA, 20 nt, Human
augguuccccuguucacucu

SEQ ID NO: 2491916 - RNA, 19 nt, Human
augguuccccuguucacuc

SEQ ID NO: 2491917 - RNA, 18 nt, Human
augguucguucuguuuac

SEQ ID NO: 2491918 - RNA, 16 nt, Human
augguucguucuguuu

SEQ ID NO: 2491919 - RNA, 16 nt, Human
augguucucaggccug

SEQ ID NO: 2491920 - RNA, 13 nt, Human
augguucugugcc

SEQ ID NO: 2491921 - RNA, 19 nt, Human
augguugagaaaugaauaa

SEQ ID NO: 2491922 - RNA, 18 nt, Human
augguugccuuaaagaaa

SEQ ID NO: 2491923 - RNA, 17 nt, Human
augguugccuuaaagaa

SEQ ID NO: 2491924 - RNA, 15 nt, Human
augguugccuuaaag

SEQ ID NO: 2491925 - RNA, 16 nt, Human
augguugagaaaugaa

SEQ ID NO: 2491926 - RNA, 16 nt, Human
augguuguauuagaug

SEQ ID NO: 2491927 - RNA, 14 nt, Human
augguuguauuaga

SEQ ID NO: 2491928 - RNA, 13 nt, Human
augguuguauuag

SEQ ID NO: 2491929 - RNA, 12 nt, Human
augguuguauua

SEQ ID NO: 2491930 - RNA, 13 nt, Human
augguuguacaua

SEQ ID NO: 2491931 - RNA, 18 nt, Human
augguugucuguuuuugu

SEQ ID NO: 2491932 - RNA, 23 nt, Human
augguugguaacacaaauuuuca

SEQ ID NO: 2491933 - RNA, 21 nt, Human
augguuguauuagauguucuc

SEQ ID NO: 2491934 - RNA, 18 nt, Human
augguuguauuagauguu

SEQ ID NO: 2491935 - RNA, 13 nt, Human
augguuucaaaga

SEQ ID NO: 2491936 - RNA, 21 nt, Human
augguuugaauauaaacacua

SEQ ID NO: 2491937 - RNA, 20 nt, Human
auggugagggauacccaucc

SEQ ID NO: 2491938 - RNA, 15 nt, Human
augggugcuuggagg

SEQ ID NO: 2491939 - RNA, 14 nt, Human
auggugaugaaaug

SEQ ID NO: 2491940 - RNA, 19 nt, Human
augggucuggcugagcuga

SEQ ID NO: 2491941 - RNA, 22 nt, Human
augggugaagggagagccagcu

SEQ ID NO: 2491942 - RNA, 17 nt, Human
auggugaugaaauguaa

SEQ ID NO: 2491943 - RNA, 16 nt, Human
auggugaugaaaugua

SEQ ID NO: 2491944 - RNA, 15 nt, Human
auggugcaaugaccu

SEQ ID NO: 2491945 - RNA, 13 nt, Human
auggugcaaugac

SEQ ID NO: 2491946 - RNA, 12 nt, Human
auggugcaauga

SEQ ID NO: 2491947 - RNA, 19 nt, Human
auggugagaugcagcugga

SEQ ID NO: 2491948 - RNA, 17 nt, Human
auggugcaaugaccuuu

SEQ ID NO: 2491949 - RNA, 16 nt, Human
auggugcaaugaccuu

SEQ ID NO: 2491950 - RNA, 14 nt, Human
auggugccccagga

SEQ ID NO: 2491951 - RNA, 18 nt, Human
auggugcaguugacagca

SEQ ID NO: 2491952 - RNA, 19 nt, Human
auggugcaaugaccuuuca

SEQ ID NO: 2491953 - RNA, 15 nt, Human
auggugccccaggac

SEQ ID NO: 2491954 - RNA, 16 nt, Human
auggugccccaggacc

SEQ ID NO: 2491955 - RNA, 17 nt, Human
auggugccccaggacca

SEQ ID NO: 2491956 - RNA, 18 nt, Human
auggugccccaggaccag

SEQ ID NO: 2491957 - RNA, 19 nt, Human
auggugccccaggaccagc

SEQ ID NO: 2491958 - RNA, 20 nt, Human
auggugccccaggaccagcu

SEQ ID NO: 2491959 - RNA, 21 nt, Human
auggugccccaggaccagcuc

SEQ ID NO: 2491960 - RNA, 22 nt, Human
auggugccccaggaccagcuca

SEQ ID NO: 2491961 - RNA, 21 nt, Human
auggugccugagaggcaggca

SEQ ID NO: 2491962 - RNA, 20 nt, Human
auggugccugagaggcaggc

SEQ ID NO: 2491963 - RNA, 18 nt, Human
auggugccugagaggcag

SEQ ID NO: 2491964 - RNA, 17 nt, Human
auggugccugagaggca

SEQ ID NO: 2491965 - RNA, 16 nt, Human
auggugccugagaggc

SEQ ID NO: 2491966 - RNA, 15 nt, Human
auggugccugagagg

SEQ ID NO: 2491967 - RNA, 14 nt, Human
auggugccugagag

SEQ ID NO: 2491968 - RNA, 9 nt, Human
auggugccu

SEQ ID NO: 2491969 - RNA, 20 nt, Human
auggugcaguugacagcagg

SEQ ID NO: 2491970 - RNA, 11 nt, Human
auggugccuga

SEQ ID NO: 2491971 - RNA, 22 nt, Human
augguuccaugccugagggugg

SEQ ID NO: 2491972 - RNA, 20 nt, Human
augguuccaugccugagggu

SEQ ID NO: 2491973 - RNA, 18 nt, Human
augguuccaugccugagg

SEQ ID NO: 2491974 - RNA, 17 nt, Human
augguuccaugccugag

SEQ ID NO: 2491975 - RNA, 16 nt, Human
augguuccaugccuga

SEQ ID NO: 2491976 - RNA, 16 nt, Human
augguuauaaaaguga

SEQ ID NO: 2491977 - RNA, 14 nt, Human
augguuauaaaagu

SEQ ID NO: 2491978 - RNA, 20 nt, Human
augguuacaaucauugcuga

SEQ ID NO: 2491979 - RNA, 20 nt, Human
augguguugcccugagugga

SEQ ID NO: 2491980 - RNA, 21 nt, Human
augguguuuucuuaugcagga

SEQ ID NO: 2491981 - RNA, 16 nt, Human
augguguuucucccuc

SEQ ID NO: 2491982 - RNA, 19 nt, Human
augguuacaaucauugcug

SEQ ID NO: 2491983 - RNA, 15 nt, Human
augguuacaaucauu

SEQ ID NO: 2491984 - RNA, 18 nt, Human
augguguacauaauguau

SEQ ID NO: 2491985 - RNA, 13 nt, Human
augguguacauaa

SEQ ID NO: 2491986 - RNA, 22 nt, Human
augguguaauaagacauaacgu

SEQ ID NO: 2491987 - RNA, 20 nt, Human
augguguaauaagacauaac

SEQ ID NO: 2491988 - RNA, 18 nt, Human
augguguaauaagacaua

SEQ ID NO: 2491989 - RNA, 16 nt, Human
augguguaauaagaca

SEQ ID NO: 2491990 - RNA, 14 nt, Human
augguguaauaaga

SEQ ID NO: 2491991 - RNA, 21 nt, Human
augguggugcaugucugcaaa

SEQ ID NO: 2491992 - RNA, 22 nt, Human
auggugguaaacauucucucag

SEQ ID NO: 2491993 - RNA, 12 nt, Human
augguguaauaa

SEQ ID NO: 2491994 - RNA, 19 nt, Human
augguguucaaaaaacuug

SEQ ID NO: 2491995 - RNA, 18 nt, Human
auggugugaaagucagau

SEQ ID NO: 2491996 - RNA, 22 nt, Human
auggugugaaagucagaugccc

SEQ ID NO: 2491997 - RNA, 17 nt, Human
augguggcuggguugga

SEQ ID NO: 2491998 - RNA, 16 nt, Human
augguggcgcgcaccu

SEQ ID NO: 2491999 - RNA, 15 nt, Human
augguggcuggguug

SEQ ID NO: 2492000 - RNA, 13 nt, Human
augguggcugggu

SEQ ID NO: 2492001 - RNA, 14 nt, Human
augguggagggcca

SEQ ID NO: 2492002 - RNA, 20 nt, Human
augguggacucgccuguaau

SEQ ID NO: 2492003 - RNA, 13 nt, Human
augguggagggcc

SEQ ID NO: 2492004 - RNA, 12 nt, Human
augguggcuggg

SEQ ID NO: 2492005 - RNA, 22 nt, Human
auggugccugauucggcugucu

SEQ ID NO: 2492006 - RNA, 23 nt, Human
auggugccugagaggcaggcaua

SEQ ID NO: 2492007 - RNA, 14 nt, Human
auggugccuucauu

SEQ ID NO: 2492008 - RNA, 16 nt, Human
auggugccuucauuug

SEQ ID NO: 2492009 - RNA, 20 nt, Human
auggugcuacgccugcaugu

SEQ ID NO: 2492010 - RNA, 13 nt, Human
auggugcugagaa

SEQ ID NO: 2492011 - RNA, 14 nt, Human
auggugcugagaag

SEQ ID NO: 2492012 - RNA, 12 nt, Human
auggugcugaga

SEQ ID NO: 2492013 - RNA, 14 nt, Human
auggugcugaccuc

SEQ ID NO: 2492014 - RNA, 16 nt, Human
auggugcugagaagcu

SEQ ID NO: 2492015 - RNA, 16 nt, Human
augggagugagacaga

SEQ ID NO: 2492016 - RNA, 23 nt, Human
augggagggggcuugaagccaaa

SEQ ID NO: 2492017 - RNA, 22 nt, Human
augggagggggcuugaagccaa

SEQ ID NO: 2492018 - RNA, 15 nt, Human
augggauccuggagu

SEQ ID NO: 2492019 - RNA, 18 nt, Human
augggaugguggagggcc

SEQ ID NO: 2492020 - RNA, 23 nt, Human
augggauucagugcuucuuaaag

SEQ ID NO: 2492021 - RNA, 17 nt, Human
uuucucccagucauuua

SEQ ID NO: 2492022 - RNA, 14 nt, Human
augggcaaaacuga

SEQ ID NO: 2492023 - RNA, 17 nt, Human
augggcaaaacugaauu

SEQ ID NO: 2492024 - RNA, 18 nt, Human
uuucucccagucauuuaa

SEQ ID NO: 2492025 - RNA, 12 nt, Human
uuucuccccagg

SEQ ID NO: 2492026 - RNA, 13 nt, Human
uuucucccccugg

SEQ ID NO: 2492027 - RNA, 14 nt, Human
uuucucccccuggg

SEQ ID NO: 2492028 - RNA, 15 nt, Human
uuucucccccugggc

SEQ ID NO: 2492029 - RNA, 15 nt, Human
uuucuggcuaugcau

SEQ ID NO: 2492030 - RNA, 16 nt, Human
uuucuggcuaugcauu

SEQ ID NO: 2492031 - RNA, 18 nt, Human
uuucuggcuaugcauuug

SEQ ID NO: 2492032 - RNA, 19 nt, Human
uuucuggcuaugcauuuga

SEQ ID NO: 2492033 - RNA, 17 nt, Human
uuucuccccugccccca

SEQ ID NO: 2492034 - RNA, 16 nt, Human
uuucuccccugccccc

SEQ ID NO: 2492035 - RNA, 14 nt, Human
uuucuccccugccc

SEQ ID NO: 2492036 - RNA, 13 nt, Human
uuucuccccugcc

SEQ ID NO: 2492037 - RNA, 23 nt, Human
uuucugauuguaacguugcugug

SEQ ID NO: 2492038 - RNA, 11 nt, Human
uuucugauugu

SEQ ID NO: 2492039 - RNA, 19 nt, Human
uuucugcagccacuauugu

SEQ ID NO: 2492040 - RNA, 22 nt, Human
uuucugauuguaacguugcugu

SEQ ID NO: 2492041 - RNA, 13 nt, Human
uuucugcacugag

SEQ ID NO: 2492042 - RNA, 14 nt, Human
uuucugcagaaaca

SEQ ID NO: 2492043 - RNA, 18 nt, Human
uuucugcacugagcagag

SEQ ID NO: 2492044 - RNA, 17 nt, Human
uuucugcacugagcaga

SEQ ID NO: 2492045 - RNA, 23 nt, Human
uuucugggagacagaaaacaugu

SEQ ID NO: 2492046 - RNA, 21 nt, Human
uuucugcagccacuauuguua

SEQ ID NO: 2492047 - RNA, 19 nt, Human
uuucugggcugucuauucu

SEQ ID NO: 2492048 - RNA, 16 nt, Human
uuucugggauaaguaa

SEQ ID NO: 2492049 - RNA, 23 nt, Human
uuucugggcaccggggccucgga

SEQ ID NO: 2492050 - RNA, 19 nt, Human
uuucuggcuggagccuaga

SEQ ID NO: 2492051 - RNA, 21 nt, Human
uuucugggcugucuauucuag

SEQ ID NO: 2492052 - RNA, 20 nt, Human
uuucugguggucuguuggca

SEQ ID NO: 2492053 - RNA, 17 nt, Human
uuucugguggucuguug

SEQ ID NO: 2492054 - RNA, 15 nt, Human
uuucugguggucugu

SEQ ID NO: 2492055 - RNA, 15 nt, Human
uuucugguagauaga

SEQ ID NO: 2492056 - RNA, 17 nt, Human
uuucugguagauagaaa

SEQ ID NO: 2492057 - RNA, 15 nt, Human
uuucugucaagaaga

SEQ ID NO: 2492058 - RNA, 17 nt, Human
uuucuguauauacuuuu

SEQ ID NO: 2492059 - RNA, 19 nt, Human
uuucugguagauagaaaua

SEQ ID NO: 2492060 - RNA, 19 nt, Human
uuucuguuauauaaauggu

SEQ ID NO: 2492061 - RNA, 22 nt, Human
uuucugugugcaccuuaccaac

SEQ ID NO: 2492062 - RNA, 20 nt, Human
uuucugugugcaccuuacca

SEQ ID NO: 2492063 - RNA, 11 nt, Human
uuucugugugc

SEQ ID NO: 2492064 - RNA, 17 nt, Human
uuucugugccugaauau

SEQ ID NO: 2492065 - RNA, 15 nt, Human
uuucugucucugccu

SEQ ID NO: 2492066 - RNA, 15 nt, Human
uuucugucccuucug

SEQ ID NO: 2492067 - RNA, 23 nt, Human
uuucuguccuuuuggcacugaga

SEQ ID NO: 2492068 - RNA, 22 nt, Human
uuucuuugaaugcuuuuugaau

SEQ ID NO: 2492069 - RNA, 16 nt, Human
uuucuuugaaugcuuu

SEQ ID NO: 2492070 - RNA, 15 nt, Human
uuucuuucuuagaaa

SEQ ID NO: 2492071 - RNA, 13 nt, Human
uuucuuucuuaga

SEQ ID NO: 2492072 - RNA, 13 nt, Human
uuucuuucuagug

SEQ ID NO: 2492073 - RNA, 13 nt, Human
uuucuuuccagag

SEQ ID NO: 2492074 - RNA, 12 nt, Human
uuucuuucuagu

SEQ ID NO: 2492075 - RNA, 17 nt, Human
uuucuguucuguggaaa

SEQ ID NO: 2492076 - RNA, 16 nt, Human
uuucuguucuguggaa

SEQ ID NO: 2492077 - RNA, 15 nt, Human
uuucuguucugugga

SEQ ID NO: 2492078 - RNA, 19 nt, Human
uuucuguucuguggaaagu

SEQ ID NO: 2492079 - RNA, 18 nt, Human
uuugaaauuaaccucuca

SEQ ID NO: 2492080 - RNA, 16 nt, Human
uuugaaauguguuucu

SEQ ID NO: 2492081 - RNA, 20 nt, Human
augggccuggccaccucucu

SEQ ID NO: 2492082 - RNA, 19 nt, Human
augggccugcuuccugucu

SEQ ID NO: 2492083 - RNA, 18 nt, Human
augggccuccugugugug

SEQ ID NO: 2492084 - RNA, 20 nt, Human
augggcuggguucuacccag

SEQ ID NO: 2492085 - RNA, 21 nt, Human
augggcucugacagaaagcag

SEQ ID NO: 2492086 - RNA, 17 nt, Human
augggcuaaugaagauc

SEQ ID NO: 2492087 - RNA, 16 nt, Human
augggcuaaugaagau

SEQ ID NO: 2492088 - RNA, 19 nt, Human
augggcugcagcagaggca

SEQ ID NO: 2492089 - RNA, 19 nt, Human
auggggaucacagagacau

SEQ ID NO: 2492090 - RNA, 17 nt, Human
auggggaucacagagac

SEQ ID NO: 2492091 - RNA, 16 nt, Human
auggggaucacagaga

SEQ ID NO: 2492092 - RNA, 20 nt, Human
auggggauagauguguggac

SEQ ID NO: 2492093 - RNA, 12 nt, Human
auggggaugcag

SEQ ID NO: 2492094 - RNA, 15 nt, Human
uuugaaauauugacu

SEQ ID NO: 2492095 - RNA, 22 nt, Human
uuugaaaaauuccuauugugau

SEQ ID NO: 2492096 - RNA, 16 nt, Human
uuugaaaaauuccuau

SEQ ID NO: 2492097 - RNA, 15 nt, Human
uuugaaaacauauaa

SEQ ID NO: 2492098 - RNA, 15 nt, Human
uuugaaaucagcaua

SEQ ID NO: 2492099 - RNA, 21 nt, Human
uuucuuugggaauauuugaau

SEQ ID NO: 2492100 - RNA, 19 nt, Human
uuucuuugggaauauuuga

SEQ ID NO: 2492101 - RNA, 17 nt, Human
uuucuuugggaauauuu

SEQ ID NO: 2492102 - RNA, 21 nt, Human
uuucuuugccuguucaguuac

SEQ ID NO: 2492103 - RNA, 23 nt, Human
uuucuuugggaauauuugaaucu

SEQ ID NO: 2492104 - RNA, 19 nt, Human
uuucuuuuucuucuucccu

SEQ ID NO: 2492105 - RNA, 14 nt, Human
uuucuuuuucuucu

SEQ ID NO: 2492106 - RNA, 13 nt, Human
auggggccagauc

SEQ ID NO: 2492107 - RNA, 14 nt, Human
auggggccagaucc

SEQ ID NO: 2492108 - RNA, 15 nt, Human
auggggccagaucca

SEQ ID NO: 2492109 - RNA, 19 nt, Human
auggggccagauccagccu

SEQ ID NO: 2492110 - RNA, 12 nt, Human
auggggcugcac

SEQ ID NO: 2492111 - RNA, 16 nt, Human
augggggaaagcacag

SEQ ID NO: 2492112 - RNA, 11 nt, Human
augggggaaag

SEQ ID NO: 2492113 - RNA, 21 nt, Human
auggggccagauccagccugg

SEQ ID NO: 2492114 - RNA, 22 nt, Human
auggggccagauccagccuggg

SEQ ID NO: 2492115 - RNA, 24 nt, Human
auggggcugcaccggcuggccugg

SEQ ID NO: 2492116 - RNA, 14 nt, Human
augggggugcauuu

SEQ ID NO: 2492117 - RNA, 17 nt, Human
augggggcacugaggac

SEQ ID NO: 2492118 - RNA, 15 nt, Human
augggggccuggauu

SEQ ID NO: 2492119 - RNA, 18 nt, Human
augggggaaauggugccu

SEQ ID NO: 2492120 - RNA, 22 nt, Human
augggggaaagcacaggugggc

SEQ ID NO: 2492121 - RNA, 18 nt, Human
augggggaacucagaucc

SEQ ID NO: 2492122 - RNA, 19 nt, Human
augggggaacucagaucca

SEQ ID NO: 2492123 - RNA, 21 nt, Human
augggggaacucagauccagg

SEQ ID NO: 2492124 - RNA, 19 nt, Human
augggggaggggggaagga

SEQ ID NO: 2492125 - RNA, 19 nt, Human
augggggagucugaagcag

SEQ ID NO: 2492126 - RNA, 20 nt, Human
augggggagucugaagcaga

SEQ ID NO: 2492127 - RNA, 14 nt, Human
augggggcaagaag

SEQ ID NO: 2492128 - RNA, 15 nt, Human
augggggcaagaaga

SEQ ID NO: 2492129 - RNA, 21 nt, Human
augggggagucugaagcagau

SEQ ID NO: 2492130 - RNA, 19 nt, Human
auggggguagcagcuggac

SEQ ID NO: 2492131 - RNA, 16 nt, Human
augggguccuggccau

SEQ ID NO: 2492132 - RNA, 17 nt, Human
augggguccuggccauc

SEQ ID NO: 2492133 - RNA, 16 nt, Human
auggggucuguaaaau

SEQ ID NO: 2492134 - RNA, 18 nt, Human
auggggucuguaaaaucu

SEQ ID NO: 2492135 - RNA, 17 nt, Human
auggggucuguaaaauc

SEQ ID NO: 2492136 - RNA, 15 nt, Human
auggggugggccucu

SEQ ID NO: 2492137 - RNA, 21 nt, Human
auggggugaugcugggcuggc

SEQ ID NO: 2492138 - RNA, 15 nt, Human
augggggugcauuug

SEQ ID NO: 2492139 - RNA, 18 nt, Human
auggggguagcagcugga

SEQ ID NO: 2492140 - RNA, 17 nt, Human
auggggguagcagcugg

SEQ ID NO: 2492141 - RNA, 16 nt, Human
auggggguagcagcug

SEQ ID NO: 2492142 - RNA, 16 nt, Human
auggggggccaacacc

SEQ ID NO: 2492143 - RNA, 22 nt, Human
auggggggccaacaccagggau

SEQ ID NO: 2492144 - RNA, 17 nt, Human
auggguagagaaacacu

SEQ ID NO: 2492145 - RNA, 18 nt, Human
auggggugggccucuggu

SEQ ID NO: 2492146 - RNA, 16 nt, Human
auggggugggccucug

SEQ ID NO: 2492147 - RNA, 19 nt, Human
auggggugggguagggcug

SEQ ID NO: 2492148 - RNA, 19 nt, Human
auggggugggccucugguu

SEQ ID NO: 2492149 - RNA, 18 nt, Human
augggguuggcugggccc

SEQ ID NO: 2492150 - RNA, 18 nt, Human
auggguaauauaaagugu

SEQ ID NO: 2492151 - RNA, 21 nt, Human
augggguuggcugggcccaga

SEQ ID NO: 2492152 - RNA, 17 nt, Human
augggucuggcugagcu

SEQ ID NO: 2492153 - RNA, 15 nt, Human
augcggucuagggaa

SEQ ID NO: 2492154 - RNA, 20 nt, Human
augcgguagccagcacacag

SEQ ID NO: 2492155 - RNA, 21 nt, Human
augcgguagccagcacacagg

SEQ ID NO: 2492156 - RNA, 15 nt, Human
augcgguagccagca

SEQ ID NO: 2492157 - RNA, 18 nt, Human
augcgguagccagcacac

SEQ ID NO: 2492158 - RNA, 14 nt, Human
augcgguagccagc

SEQ ID NO: 2492159 - RNA, 19 nt, Human
augcgggcugggcagcugu

SEQ ID NO: 2492160 - RNA, 21 nt, Human
augcguacguuuccugagaag

SEQ ID NO: 2492161 - RNA, 22 nt, Human
augcuaaaccuuaguacugagu

SEQ ID NO: 2492162 - RNA, 23 nt, Human
augcuaaaccuuaguacugaguu

SEQ ID NO: 2492163 - RNA, 22 nt, Human
augcuaaagaaaaagucaucca

SEQ ID NO: 2492164 - RNA, 14 nt, Human
augcuaaagaaaaa

SEQ ID NO: 2492165 - RNA, 23 nt, Human
augcuaaagguuguauugcauau

SEQ ID NO: 2492166 - RNA, 18 nt, Human
augcgggcugggcagcug

SEQ ID NO: 2492167 - RNA, 17 nt, Human
augcgggcugggcagcu

SEQ ID NO: 2492168 - RNA, 12 nt, Human
augccuccaccg

SEQ ID NO: 2492169 - RNA, 13 nt, Human
augccuccaccgc

SEQ ID NO: 2492170 - RNA, 17 nt, Human
augccuccaccgcugcc

SEQ ID NO: 2492171 - RNA, 21 nt, Human
augccuccaccgcugccuaag

SEQ ID NO: 2492172 - RNA, 19 nt, Human
augccucaguguauuugua

SEQ ID NO: 2492173 - RNA, 16 nt, Human
augccucaguguauuu

SEQ ID NO: 2492174 - RNA, 20 nt, Human
augccucaguguauuuguau

SEQ ID NO: 2492175 - RNA, 20 nt, Human
augccuccaccccccagaac

SEQ ID NO: 2492176 - RNA, 14 nt, Human
augccucaguguau

SEQ ID NO: 2492177 - RNA, 13 nt, Human
augccucagcccu

SEQ ID NO: 2492178 - RNA, 24 nt, Human
augccucagcccugacccugugga

SEQ ID NO: 2492179 - RNA, 13 nt, Human
augcccagccccu

SEQ ID NO: 2492180 - RNA, 12 nt, Human
augcccagcccc

SEQ ID NO: 2492181 - RNA, 14 nt, Human
augcccagccccuu

SEQ ID NO: 2492182 - RNA, 15 nt, Human
augcccuccucuccc

SEQ ID NO: 2492183 - RNA, 23 nt, Human
augcccuccucucccauuguccc

SEQ ID NO: 2492184 - RNA, 14 nt, Human
augcccuccucucc

SEQ ID NO: 2492185 - RNA, 13 nt, Human
augcccuccucuc

SEQ ID NO: 2492186 - RNA, 12 nt, Human
augcccugugca

SEQ ID NO: 2492187 - RNA, 14 nt, Human
augcccuggaggug

SEQ ID NO: 2492188 - RNA, 15 nt, Human
augcccuggaggugg

SEQ ID NO: 2492189 - RNA, 13 nt, Human
augcccugugcaa

SEQ ID NO: 2492190 - RNA, 23 nt, Human
augcccugugcaaccucuuggcc

SEQ ID NO: 2492191 - RNA, 14 nt, Human
augcccuggaucca

SEQ ID NO: 2492192 - RNA, 16 nt, Human
augcccuggagguggc

SEQ ID NO: 2492193 - RNA, 15 nt, Human
augcccuuaaaucau

SEQ ID NO: 2492194 - RNA, 21 nt, Human
augccgaaugcccucagggga

SEQ ID NO: 2492195 - RNA, 16 nt, Human
augccucagccuccug

SEQ ID NO: 2492196 - RNA, 19 nt, Human
augccgauauacucuagau

SEQ ID NO: 2492197 - RNA, 20 nt, Human
augccucagcccugacccug

SEQ ID NO: 2492198 - RNA, 13 nt, Human
augcaguucugaa

SEQ ID NO: 2492199 - RNA, 14 nt, Human
augcauuugcauuu

SEQ ID NO: 2492200 - RNA, 23 nt, Human
augcauuugaggucaaguaagaa

SEQ ID NO: 2492201 - RNA, 18 nt, Human
augcagggauugcugcca

SEQ ID NO: 2492202 - RNA, 23 nt, Human
augcagugguaugaucacggcuc

SEQ ID NO: 2492203 - RNA, 13 nt, Human
augcagugcuucc

SEQ ID NO: 2492204 - RNA, 23 nt, Human
augcauuuuauuuuagacacaaa

SEQ ID NO: 2492205 - RNA, 22 nt, Human
augcauuuuguuugguauugua

SEQ ID NO: 2492206 - RNA, 19 nt, Human
augcauuuuguuugguauu

SEQ ID NO: 2492207 - RNA, 12 nt, Human
augcauuuugca

SEQ ID NO: 2492208 - RNA, 13 nt, Human
augcauuuugcag

SEQ ID NO: 2492209 - RNA, 18 nt, Human
augcauuuugcagcagug

SEQ ID NO: 2492210 - RNA, 19 nt, Human
augcauuuugcagcaguga

SEQ ID NO: 2492211 - RNA, 20 nt, Human
augccaaagaucacuuguug

SEQ ID NO: 2492212 - RNA, 18 nt, Human
augccaaagaucacuugu

SEQ ID NO: 2492213 - RNA, 16 nt, Human
augccaaagaucacuu

SEQ ID NO: 2492214 - RNA, 17 nt, Human
augccaauauuaaaucu

SEQ ID NO: 2492215 - RNA, 23 nt, Human
augcauuuuguuugguauuguau

SEQ ID NO: 2492216 - RNA, 18 nt, Human
augccaaaaaaagacagg

SEQ ID NO: 2492217 - RNA, 16 nt, Human
augccacaaggacuuc

SEQ ID NO: 2492218 - RNA, 19 nt, Human
augccacaaggacuuccug

SEQ ID NO: 2492219 - RNA, 22 nt, Human
augccaauuagcaauugacugu

SEQ ID NO: 2492220 - RNA, 23 nt, Human
augccaaagaucacuuguuguuu

SEQ ID NO: 2492221 - RNA, 21 nt, Human
augccacaccaagcugugcca

SEQ ID NO: 2492222 - RNA, 20 nt, Human
augccacaccaagcugugcc

SEQ ID NO: 2492223 - RNA, 17 nt, Human
augccacaccaagcugu

SEQ ID NO: 2492224 - RNA, 15 nt, Human
augccacaccaagcu

SEQ ID NO: 2492225 - RNA, 15 nt, Human
augccacacagagug

SEQ ID NO: 2492226 - RNA, 16 nt, Human
augccacacagagugg

SEQ ID NO: 2492227 - RNA, 16 nt, Human
augccacacaucaccc

SEQ ID NO: 2492228 - RNA, 18 nt, Human
augccacacagagugguc

SEQ ID NO: 2492229 - RNA, 23 nt, Human
augccacaccaagcugugccacc

SEQ ID NO: 2492230 - RNA, 22 nt, Human
augccacaccaagcugugccac

SEQ ID NO: 2492231 - RNA, 17 nt, Human
augccauggacagaaga

SEQ ID NO: 2492232 - RNA, 17 nt, Human
augccauuuaaagcuua

SEQ ID NO: 2492233 - RNA, 21 nt, Human
augccauuuaaagcuuauuaa

SEQ ID NO: 2492234 - RNA, 11 nt, Human
augcccagccc

SEQ ID NO: 2492235 - RNA, 15 nt, Human
augcccaagggaaag

SEQ ID NO: 2492236 - RNA, 12 nt, Human
augcccaaggga

SEQ ID NO: 2492237 - RNA, 19 nt, Human
augccauggacagaagaag

SEQ ID NO: 2492238 - RNA, 18 nt, Human
augccauggacagaagaa

SEQ ID NO: 2492239 - RNA, 15 nt, Human
augcagcccaugccc

SEQ ID NO: 2492240 - RNA, 21 nt, Human
augcagcccaugcccaccugc

SEQ ID NO: 2492241 - RNA, 16 nt, Human
augcagccgugaucaa

SEQ ID NO: 2492242 - RNA, 23 nt, Human
augcagcccaugcccaccugccc

SEQ ID NO: 2492243 - RNA, 22 nt, Human
augcagauuuugcccuugacaa

SEQ ID NO: 2492244 - RNA, 16 nt, Human
augcagcaaaauguga

SEQ ID NO: 2492245 - RNA, 17 nt, Human
augcagcaucuaaguaa

SEQ ID NO: 2492246 - RNA, 19 nt, Human
augcagcagggaugcccug

SEQ ID NO: 2492247 - RNA, 20 nt, Human
augcagcagggaugcccugg

SEQ ID NO: 2492248 - RNA, 23 nt, Human
augcagauggggcucccgcccgu

SEQ ID NO: 2492249 - RNA, 21 nt, Human
augcagcugcacccucccucc

SEQ ID NO: 2492250 - RNA, 13 nt, Human
augcagcgugaag

SEQ ID NO: 2492251 - RNA, 15 nt, Human
augcagcugcacccu

SEQ ID NO: 2492252 - RNA, 18 nt, Human
augcagccucacaguccu

SEQ ID NO: 2492253 - RNA, 14 nt, Human
augcagcuaucugg

SEQ ID NO: 2492254 - RNA, 22 nt, Human
augcagcccaugcccaccugcc

SEQ ID NO: 2492255 - RNA, 20 nt, Human
augcagcgaaccaauauuug

SEQ ID NO: 2492256 - RNA, 22 nt, Human
augcagcgaaccaauauuugua

SEQ ID NO: 2492257 - RNA, 18 nt, Human
uuuacaaaguguguauua

SEQ ID NO: 2492258 - RNA, 16 nt, Human
uuuacaaaguguguau

SEQ ID NO: 2492259 - RNA, 12 nt, Human
uuuacaaagugu

SEQ ID NO: 2492260 - RNA, 16 nt, Human
uuuacaaaaauauaaa

SEQ ID NO: 2492261 - RNA, 15 nt, Human
uuuacaaaaauauaa

SEQ ID NO: 2492262 - RNA, 19 nt, Human
uuuacaaaacuacaugaga

SEQ ID NO: 2492263 - RNA, 19 nt, Human
uuuaauuuauuuauuaaga

SEQ ID NO: 2492264 - RNA, 20 nt, Human
uuuaauuuauuuauuaagau

SEQ ID NO: 2492265 - RNA, 19 nt, Human
uuuaauuuuuuugagacag

SEQ ID NO: 2492266 - RNA, 21 nt, Human
uuuaauuuauuaauugcuuug

SEQ ID NO: 2492267 - RNA, 22 nt, Human
uuuaauuuauuaauugcuuuga

SEQ ID NO: 2492268 - RNA, 16 nt, Human
uuuaauuuauuuauua

SEQ ID NO: 2492269 - RNA, 16 nt, Human
uuuaauuuaugaguuu

SEQ ID NO: 2492270 - RNA, 22 nt, Human
uuuaauuguuguuucuuucuag

SEQ ID NO: 2492271 - RNA, 21 nt, Human
uuuaauuguuguuucuuucua

SEQ ID NO: 2492272 - RNA, 18 nt, Human
uuuaauuguuguuucuuu

SEQ ID NO: 2492273 - RNA, 16 nt, Human
uuuaauuguuguuucu

SEQ ID NO: 2492274 - RNA, 24 nt, Human
uuuaauuguuguuucuuucuagug

SEQ ID NO: 2492275 - RNA, 23 nt, Human
uuuaauuguuguuucuuucuagu

SEQ ID NO: 2492276 - RNA, 20 nt, Human
uuuaaauacgcacuacaugu

SEQ ID NO: 2492277 - RNA, 18 nt, Human
uuuaaauauaauucugua

SEQ ID NO: 2492278 - RNA, 16 nt, Human
uuuaaauauaauucug

SEQ ID NO: 2492279 - RNA, 15 nt, Human
uuuaaauauaauucu

SEQ ID NO: 2492280 - RNA, 13 nt, Human
uuuaaauauaauu

SEQ ID NO: 2492281 - RNA, 12 nt, Human
uuuaaauauaau

SEQ ID NO: 2492282 - RNA, 20 nt, Human
uuuaaauacagucuuccauu

SEQ ID NO: 2492283 - RNA, 18 nt, Human
uuuaaauauaugcuaagu

SEQ ID NO: 2492284 - RNA, 21 nt, Human
uuuaaguauugcaucuguaua

SEQ ID NO: 2492285 - RNA, 13 nt, Human
uuuaaguauuuau

SEQ ID NO: 2492286 - RNA, 14 nt, Human
uuuaaguauuuaua

SEQ ID NO: 2492287 - RNA, 15 nt, Human
uuuaaguauuuauau

SEQ ID NO: 2492288 - RNA, 20 nt, Human
uuuaaguauuuauauauuua

SEQ ID NO: 2492289 - RNA, 13 nt, Human
uuuaaguauuuag

SEQ ID NO: 2492290 - RNA, 18 nt, Human
uuuaaguauuuagguuuu

SEQ ID NO: 2492291 - RNA, 16 nt, Human
uuuaagguuuuuacug

SEQ ID NO: 2492292 - RNA, 12 nt, Human
uuuaaguauuua

SEQ ID NO: 2492293 - RNA, 21 nt, Human
uuuaagguuauuuauuuaaau

SEQ ID NO: 2492294 - RNA, 20 nt, Human
uuuaagguuauuuauuuaaa

SEQ ID NO: 2492295 - RNA, 21 nt, Human
uuuaaauauaauucuguaaau

SEQ ID NO: 2492296 - RNA, 22 nt, Human
uuuaauuagugcuaagugugaa

SEQ ID NO: 2492297 - RNA, 21 nt, Human
uuuaauuagugcuaaguguga

SEQ ID NO: 2492298 - RNA, 23 nt, Human
uuuaauuauuauucuucauaaca

SEQ ID NO: 2492299 - RNA, 14 nt, Human
uuuaauuauuauuc

SEQ ID NO: 2492300 - RNA, 23 nt, Human
uuuaauuauuauuuauauaugua

SEQ ID NO: 2492301 - RNA, 17 nt, Human
uuuaauucaccaaagua

SEQ ID NO: 2492302 - RNA, 18 nt, Human
uuuaauuguuaagauaug

SEQ ID NO: 2492303 - RNA, 20 nt, Human
uuuaauuagugcuaagugug

SEQ ID NO: 2492304 - RNA, 19 nt, Human
uuuaauuagugcuaagugu

SEQ ID NO: 2492305 - RNA, 17 nt, Human
uuuaauuagugcuaagu

SEQ ID NO: 2492306 - RNA, 15 nt, Human
uuuaauuagugcuaa

SEQ ID NO: 2492307 - RNA, 14 nt, Human
uuuaauuagugcua

SEQ ID NO: 2492308 - RNA, 22 nt, Human
uuuaauuaaugaaauaucugua

SEQ ID NO: 2492309 - RNA, 21 nt, Human
uuuaauuagggguugcuaaga

SEQ ID NO: 2492310 - RNA, 15 nt, Human
uuuaaugugcugugu

SEQ ID NO: 2492311 - RNA, 21 nt, Human
uuuaagugcguguguagaguu

SEQ ID NO: 2492312 - RNA, 20 nt, Human
uuuaagugcguguguagagu

SEQ ID NO: 2492313 - RNA, 18 nt, Human
uuuaagugcguguguaga

SEQ ID NO: 2492314 - RNA, 19 nt, Human
uuuaaugugcuguguaaag

SEQ ID NO: 2492315 - RNA, 18 nt, Human
uuuaaugugcuguguaaa

SEQ ID NO: 2492316 - RNA, 17 nt, Human
uuuaaugugcuguguaa

SEQ ID NO: 2492317 - RNA, 16 nt, Human
uuuaaugugcugugua

SEQ ID NO: 2492318 - RNA, 21 nt, Human
uuuaaugugcuguguaaaguu

SEQ ID NO: 2492319 - RNA, 20 nt, Human
uuuaaugugcuguguaaagu

SEQ ID NO: 2492320 - RNA, 22 nt, Human
uuuaaugugcuguguaaaguua

SEQ ID NO: 2492321 - RNA, 19 nt, Human
uuuaauuaaugaaauaucu

SEQ ID NO: 2492322 - RNA, 17 nt, Human
uuuaauuaaugaaauau

SEQ ID NO: 2492323 - RNA, 22 nt, Human
uuuaauuaaucaugaaugugua

SEQ ID NO: 2492324 - RNA, 19 nt, Human
uuuaauuaaucaugaaugu

SEQ ID NO: 2492325 - RNA, 20 nt, Human
uuuaauuaaaugcucaucug

SEQ ID NO: 2492326 - RNA, 15 nt, Human
uuuaauuaaaugcuc

SEQ ID NO: 2492327 - RNA, 13 nt, Human
uuuaauuaaauaa

SEQ ID NO: 2492328 - RNA, 15 nt, Human
uuguguuacuaaguu

SEQ ID NO: 2492329 - RNA, 20 nt, Human
uuguguuacuaaguuuuuau

SEQ ID NO: 2492330 - RNA, 13 nt, Human
uuguguuacuaag

SEQ ID NO: 2492331 - RNA, 22 nt, Human
uuggugccuggccuggcacaca

SEQ ID NO: 2492332 - RNA, 20 nt, Human
uuggugccuggccuggcaca

SEQ ID NO: 2492333 - RNA, 15 nt, Human
uuguucauagcccag

SEQ ID NO: 2492334 - RNA, 22 nt, Human
uuggugcuuacacaucucagac

SEQ ID NO: 2492335 - RNA, 16 nt, Human
uugguggagauaaaga

SEQ ID NO: 2492336 - RNA, 15 nt, Human
uuguucaucuguaac

SEQ ID NO: 2492337 - RNA, 17 nt, Human
uuguucauuuugagcug

SEQ ID NO: 2492338 - RNA, 16 nt, Human
uuguuccaagacauug

SEQ ID NO: 2492339 - RNA, 19 nt, Human
uuguucauuuugagcugaa

SEQ ID NO: 2492340 - RNA, 17 nt, Human
uuguuccaagacauugu

SEQ ID NO: 2492341 - RNA, 21 nt, Human
uuguuccacaaguuaaauaaa

SEQ ID NO: 2492342 - RNA, 17 nt, Human
augauaaguaaaugcua

SEQ ID NO: 2492343 - RNA, 14 nt, Human
uuguugacuuauuu

SEQ ID NO: 2492344 - RNA, 17 nt, Human
uuguugacuuauuuucu

SEQ ID NO: 2492345 - RNA, 17 nt, Human
augauacaagauuagaa

SEQ ID NO: 2492346 - RNA, 18 nt, Human
uuguugagcuauugcugu

SEQ ID NO: 2492347 - RNA, 15 nt, Human
augauaacuggaaac

SEQ ID NO: 2492348 - RNA, 21 nt, Human
uuguugacaguucugaagaau

SEQ ID NO: 2492349 - RNA, 18 nt, Human
uuguugacaguucugaag

SEQ ID NO: 2492350 - RNA, 14 nt, Human
uuguucuuuaaagu

SEQ ID NO: 2492351 - RNA, 15 nt, Human
uuguucuuuguucuu

SEQ ID NO: 2492352 - RNA, 13 nt, Human
uuguucuuuuuau

SEQ ID NO: 2492353 - RNA, 13 nt, Human
uuguuccagauuc

SEQ ID NO: 2492354 - RNA, 12 nt, Human
uuguuccagcuc

SEQ ID NO: 2492355 - RNA, 21 nt, Human
uuguuccaagacauugucaau

SEQ ID NO: 2492356 - RNA, 22 nt, Human
uuguuccaagacauugucaaua

SEQ ID NO: 2492357 - RNA, 20 nt, Human
uuguucuugguuuguaaauu

SEQ ID NO: 2492358 - RNA, 11 nt, Human
uuguucccagu

SEQ ID NO: 2492359 - RNA, 20 nt, Human
augaucuaggaagacuuugg

SEQ ID NO: 2492360 - RNA, 17 nt, Human
augaucuaggaagacuu

SEQ ID NO: 2492361 - RNA, 15 nt, Human
augaucuaggaagac

SEQ ID NO: 2492362 - RNA, 21 nt, Human
augauccaugaguuugcccug

SEQ ID NO: 2492363 - RNA, 22 nt, Human
augauccaugaguuugcccugg

SEQ ID NO: 2492364 - RNA, 14 nt, Human
augauuaaguaaug

SEQ ID NO: 2492365 - RNA, 19 nt, Human
augaucuagguuuaacuca

SEQ ID NO: 2492366 - RNA, 17 nt, Human
augaucuagguuuaacu

SEQ ID NO: 2492367 - RNA, 16 nt, Human
augaucuagguuuaac

SEQ ID NO: 2492368 - RNA, 15 nt, Human
augaucuagguuuaa

SEQ ID NO: 2492369 - RNA, 22 nt, Human
augaucuagguuuaacucagau

SEQ ID NO: 2492370 - RNA, 21 nt, Human
augaucuagguuuaacucaga

SEQ ID NO: 2492371 - RNA, 12 nt, Human
augaucucccug

SEQ ID NO: 2492372 - RNA, 14 nt, Human
augaucucccugcc

SEQ ID NO: 2492373 - RNA, 18 nt, Human
augauuaaguaaugauaa

SEQ ID NO: 2492374 - RNA, 16 nt, Human
augauuaauucaccuu

SEQ ID NO: 2492375 - RNA, 15 nt, Human
augaucucccugccg

SEQ ID NO: 2492376 - RNA, 19 nt, Human
augauuacucuuugagaua

SEQ ID NO: 2492377 - RNA, 17 nt, Human
augauaguaagaaaagu

SEQ ID NO: 2492378 - RNA, 21 nt, Human
augauacuugaaaauuaacau

SEQ ID NO: 2492379 - RNA, 17 nt, Human
augauacuugaaaauua

SEQ ID NO: 2492380 - RNA, 15 nt, Human
augauacauccaaag

SEQ ID NO: 2492381 - RNA, 22 nt, Human
augauacccugaauuuggccug

SEQ ID NO: 2492382 - RNA, 13 nt, Human
augauauguaaac

SEQ ID NO: 2492383 - RNA, 21 nt, Human
augauauguaaacauaauucu

SEQ ID NO: 2492384 - RNA, 22 nt, Human
augaucauuugcccuuaaggac

SEQ ID NO: 2492385 - RNA, 15 nt, Human
augaucaguuuuuuu

SEQ ID NO: 2492386 - RNA, 21 nt, Human
augauccaacuaaugccuuac

SEQ ID NO: 2492387 - RNA, 13 nt, Human
augaucaguuuuu

SEQ ID NO: 2492388 - RNA, 22 nt, Human
augauauguaaacauaauucuu

SEQ ID NO: 2492389 - RNA, 20 nt, Human
augcacuuuguucuggcucu

SEQ ID NO: 2492390 - RNA, 19 nt, Human
augcacuuuguucuggcuc

SEQ ID NO: 2492391 - RNA, 17 nt, Human
augcacuuuguucuggc

SEQ ID NO: 2492392 - RNA, 16 nt, Human
augcacuuuguucugg

SEQ ID NO: 2492393 - RNA, 22 nt, Human
augcaccagcccuuagcaggga

SEQ ID NO: 2492394 - RNA, 18 nt, Human
augcaaggaaggaaagaa

SEQ ID NO: 2492395 - RNA, 20 nt, Human
augcaaggaaggaaagaaag

SEQ ID NO: 2492396 - RNA, 14 nt, Human
augcaaggaccagg

SEQ ID NO: 2492397 - RNA, 15 nt, Human
augcaaggaccagga

SEQ ID NO: 2492398 - RNA, 13 nt, Human
augcaccuggaau

SEQ ID NO: 2492399 - RNA, 14 nt, Human
augcaccauuagaa

SEQ ID NO: 2492400 - RNA, 23 nt, Human
augcaagcuaguggcuucaaaau

SEQ ID NO: 2492401 - RNA, 23 nt, Human
augcaagauaguuuaucuaacuu

SEQ ID NO: 2492402 - RNA, 19 nt, Human
augcaacauguguacuuaa

SEQ ID NO: 2492403 - RNA, 21 nt, Human
augcaacaacauguauaauau

SEQ ID NO: 2492404 - RNA, 22 nt, Human
augauuggauuauucauuuaaa

SEQ ID NO: 2492405 - RNA, 21 nt, Human
augauuggauuauucauuuaa

SEQ ID NO: 2492406 - RNA, 16 nt, Human
augauuggauuauuca

SEQ ID NO: 2492407 - RNA, 15 nt, Human
augauuggauuauuc

SEQ ID NO: 2492408 - RNA, 14 nt, Human
augauuggauuauu

SEQ ID NO: 2492409 - RNA, 13 nt, Human
augauuggauuau

SEQ ID NO: 2492410 - RNA, 12 nt, Human
augcaagauauu

SEQ ID NO: 2492411 - RNA, 16 nt, Human
augcaacaggcacuca

SEQ ID NO: 2492412 - RNA, 13 nt, Human
augcaaggaagga

SEQ ID NO: 2492413 - RNA, 14 nt, Human
augcaaggaaggaa

SEQ ID NO: 2492414 - RNA, 15 nt, Human
augcaaggaaggaaa

SEQ ID NO: 2492415 - RNA, 16 nt, Human
augcaaggaaggaaag

SEQ ID NO: 2492416 - RNA, 15 nt, Human
augauucugcuuuua

SEQ ID NO: 2492417 - RNA, 22 nt, Human
augauuccuugauggagauauu

SEQ ID NO: 2492418 - RNA, 23 nt, Human
augauucugcuuuuaccaugccc

SEQ ID NO: 2492419 - RNA, 20 nt, Human
augauucuuuguuacaggca

SEQ ID NO: 2492420 - RNA, 15 nt, Human
augauuccuuccugu

SEQ ID NO: 2492421 - RNA, 22 nt, Human
augauucuauuuauauguacau

SEQ ID NO: 2492422 - RNA, 23 nt, Human
augauucuauuuauauguacaug

SEQ ID NO: 2492423 - RNA, 23 nt, Human
augauucuaauuuuuaagcaaaa

SEQ ID NO: 2492424 - RNA, 23 nt, Human
augauucgcccaaagccagacag

SEQ ID NO: 2492425 - RNA, 23 nt, Human
uuuaaaguaugaaucuaugccaa

SEQ ID NO: 2492426 - RNA, 16 nt, Human
uuuaaaguagauuaga

SEQ ID NO: 2492427 - RNA, 16 nt, Human
uuuaaaggggcagaaa

SEQ ID NO: 2492428 - RNA, 22 nt, Human
uuuaaaggggcagaaaaacucu

SEQ ID NO: 2492429 - RNA, 17 nt, Human
uuuaaagugauuaaacg

SEQ ID NO: 2492430 - RNA, 18 nt, Human
uuuaaagugauuaaacgu

SEQ ID NO: 2492431 - RNA, 19 nt, Human
uuuaaaguguuucuguuau

SEQ ID NO: 2492432 - RNA, 23 nt, Human
uuuaaauaaaagaaaaaauaucu

SEQ ID NO: 2492433 - RNA, 16 nt, Human
uuuaaauaaaacccuu

SEQ ID NO: 2492434 - RNA, 20 nt, Human
uuuaaaguguuucuguuauu

SEQ ID NO: 2492435 - RNA, 23 nt, Human
uuuaaauaaaguaucaugcauuc

SEQ ID NO: 2492436 - RNA, 22 nt, Human
uuuaaauaaaguaucaugcauu

SEQ ID NO: 2492437 - RNA, 21 nt, Human
uuuaaauaaaguaucaugcau

SEQ ID NO: 2492438 - RNA, 13 nt, Human
uuuaaauaaagua

SEQ ID NO: 2492439 - RNA, 19 nt, Human
uuuaaauaaaagugaucaa

SEQ ID NO: 2492440 - RNA, 15 nt, Human
uuuaaagagagguua

SEQ ID NO: 2492441 - RNA, 14 nt, Human
uuuaaagagagguu

SEQ ID NO: 2492442 - RNA, 13 nt, Human
uuuaaagaaugcu

SEQ ID NO: 2492443 - RNA, 18 nt, Human
uuuaaagaagaaacgucu

SEQ ID NO: 2492444 - RNA, 22 nt, Human
uuuaaaaaucuaccuucuguag

SEQ ID NO: 2492445 - RNA, 20 nt, Human
uuuaaaaaucauuguaugga

SEQ ID NO: 2492446 - RNA, 12 nt, Human
uuuaaaaaugaa

SEQ ID NO: 2492447 - RNA, 11 nt, Human
uuuaaaaauga

SEQ ID NO: 2492448 - RNA, 12 nt, Human
uuuaaaaaugca

SEQ ID NO: 2492449 - RNA, 14 nt, Human
uuuaaaaaugaaau

SEQ ID NO: 2492450 - RNA, 22 nt, Human
uuguuuuggcugaaauucuccu

SEQ ID NO: 2492451 - RNA, 17 nt, Human
uuuaaaaauagacacuc

SEQ ID NO: 2492452 - RNA, 14 nt, Human
uuuaaaaauauuuu

SEQ ID NO: 2492453 - RNA, 12 nt, Human
uuuaaaaaucau

SEQ ID NO: 2492454 - RNA, 13 nt, Human
uuuaaaaaucaua

SEQ ID NO: 2492455 - RNA, 15 nt, Human
uuuaaaaaucauaaa

SEQ ID NO: 2492456 - RNA, 16 nt, Human
uuuaaaaaucauaaac

SEQ ID NO: 2492457 - RNA, 19 nt, Human
uuuaaaaaucauaaacugu

SEQ ID NO: 2492458 - RNA, 18 nt, Human
uuguuuugccaacauugc

SEQ ID NO: 2492459 - RNA, 15 nt, Human
uuguuuugcacuuuu

SEQ ID NO: 2492460 - RNA, 14 nt, Human
uuguuuugcacuuu

SEQ ID NO: 2492461 - RNA, 20 nt, Human
uuguuuugcacacuuugcca

SEQ ID NO: 2492462 - RNA, 16 nt, Human
uuguuuugcacuuuuu

SEQ ID NO: 2492463 - RNA, 19 nt, Human
uuguuuugcuuuuucugac

SEQ ID NO: 2492464 - RNA, 18 nt, Human
uuguuuugcuuuuucuga

SEQ ID NO: 2492465 - RNA, 15 nt, Human
uuguuuugcuuuuuc

SEQ ID NO: 2492466 - RNA, 17 nt, Human
uuguuuugagcuuucca

SEQ ID NO: 2492467 - RNA, 19 nt, Human
uuguuuugacggaugauug

SEQ ID NO: 2492468 - RNA, 20 nt, Human
uuguuuucuucuguauguua

SEQ ID NO: 2492469 - RNA, 24 nt, Human
uuguuuugagcuuuccauguugcu

SEQ ID NO: 2492470 - RNA, 20 nt, Human
uuguuuugagcuuuccaugu

SEQ ID NO: 2492471 - RNA, 23 nt, Human
uuguuuugauguuuguggccuca

SEQ ID NO: 2492472 - RNA, 18 nt, Human
uuguuuucuucuguaugu

SEQ ID NO: 2492473 - RNA, 24 nt, Human
augcaccugaauguuagauaguua

SEQ ID NO: 2492474 - RNA, 15 nt, Human
uuuauuuuucuaaaa

SEQ ID NO: 2492475 - RNA, 22 nt, Human
uuuauuuuuccauuuacaacaa

SEQ ID NO: 2492476 - RNA, 17 nt, Human
uuuauuuuucauauugu

SEQ ID NO: 2492477 - RNA, 16 nt, Human
uuuauuuuucauauug

SEQ ID NO: 2492478 - RNA, 17 nt, Human
uuuauuuuucauuuagu

SEQ ID NO: 2492479 - RNA, 16 nt, Human
uuucaaaaauauaacu

SEQ ID NO: 2492480 - RNA, 20 nt, Human
uuuauuuuucauauugugcc

SEQ ID NO: 2492481 - RNA, 18 nt, Human
uuucaaaaauauaacuua

SEQ ID NO: 2492482 - RNA, 17 nt, Human
uuucaaaaauauaacuu

SEQ ID NO: 2492483 - RNA, 21 nt, Human
uuucaaaaauauaacuuaaaa

SEQ ID NO: 2492484 - RNA, 23 nt, Human
uuucaaaacacaucuuuccuguc

SEQ ID NO: 2492485 - RNA, 18 nt, Human
uuucaaaaccuuuugaaa

SEQ ID NO: 2492486 - RNA, 20 nt, Human
uuucaaaacucauuuccuau

SEQ ID NO: 2492487 - RNA, 20 nt, Human
uuuauuuuguguuuaggaac

SEQ ID NO: 2492488 - RNA, 12 nt, Human
uuuauuuuucau

SEQ ID NO: 2492489 - RNA, 15 nt, Human
uuuauuuuucauauu

SEQ ID NO: 2492490 - RNA, 16 nt, Human
uuuauuuuguguuuag

SEQ ID NO: 2492491 - RNA, 21 nt, Human
auggaaccugacguagcugca

SEQ ID NO: 2492492 - RNA, 17 nt, Human
uuucaaacauauauaac

SEQ ID NO: 2492493 - RNA, 16 nt, Human
uuucaaacuuuacuau

SEQ ID NO: 2492494 - RNA, 16 nt, Human
uuucaaacacaaaugc

SEQ ID NO: 2492495 - RNA, 17 nt, Human
uuucaaacacaaaugca

SEQ ID NO: 2492496 - RNA, 15 nt, Human
uuucaaacuuuacua

SEQ ID NO: 2492497 - RNA, 22 nt, Human
uuucaaacuuuacuauggcccu

SEQ ID NO: 2492498 - RNA, 16 nt, Human
uuucaaacauauauaa

SEQ ID NO: 2492499 - RNA, 22 nt, Human
uuucaaaauuguuacaaauugu

SEQ ID NO: 2492500 - RNA, 12 nt, Human
uuucaaaaugcu

SEQ ID NO: 2492501 - RNA, 13 nt, Human
uuucaaaaugcuu

SEQ ID NO: 2492502 - RNA, 15 nt, Human
uuucaaaaugcuuuu

SEQ ID NO: 2492503 - RNA, 20 nt, Human
uuucaaaauaaaaaccaaga

SEQ ID NO: 2492504 - RNA, 18 nt, Human
augcugugcuaugaauuu

SEQ ID NO: 2492505 - RNA, 23 nt, Human
augcugcuuuccccuguggggau

SEQ ID NO: 2492506 - RNA, 17 nt, Human
augcugugcuaugaauu

SEQ ID NO: 2492507 - RNA, 22 nt, Human
augcugugcccuaaaguguauu

SEQ ID NO: 2492508 - RNA, 20 nt, Human
augcugcuuuccccuguggg

SEQ ID NO: 2492509 - RNA, 18 nt, Human
augcugcuuuccccugug

SEQ ID NO: 2492510 - RNA, 17 nt, Human
augcugcuuuccccugu

SEQ ID NO: 2492511 - RNA, 13 nt, Human
augcugcuuuccc

SEQ ID NO: 2492512 - RNA, 23 nt, Human
augcugcucauccccaccugucu

SEQ ID NO: 2492513 - RNA, 21 nt, Human
augcugcuacuuaauuccuuu

SEQ ID NO: 2492514 - RNA, 13 nt, Human
augcugcuacuua

SEQ ID NO: 2492515 - RNA, 13 nt, Human
augcugcuggaca

SEQ ID NO: 2492516 - RNA, 14 nt, Human
augcucccuccccu

SEQ ID NO: 2492517 - RNA, 19 nt, Human
augcugcuaauucaaagcu

SEQ ID NO: 2492518 - RNA, 23 nt, Human
augcucccccauccuccccuucc

SEQ ID NO: 2492519 - RNA, 21 nt, Human
augcucccccauccuccccuu

SEQ ID NO: 2492520 - RNA, 22 nt, Human
augcucccccauccuccccuuc

SEQ ID NO: 2492521 - RNA, 24 nt, Human
augcuccagucaacaaacuauuuc

SEQ ID NO: 2492522 - RNA, 13 nt, Human
augcuccagucaa

SEQ ID NO: 2492523 - RNA, 15 nt, Human
augcucccccauccu

SEQ ID NO: 2492524 - RNA, 18 nt, Human
augcucccccauccuccc

SEQ ID NO: 2492525 - RNA, 20 nt, Human
augcucccccauccuccccu

SEQ ID NO: 2492526 - RNA, 14 nt, Human
auggaaccuccuuu

SEQ ID NO: 2492527 - RNA, 13 nt, Human
auggaaccuccuu

SEQ ID NO: 2492528 - RNA, 21 nt, Human
auggaaccuccuuucucuucu

SEQ ID NO: 2492529 - RNA, 18 nt, Human
auggaaccugacguagcu

SEQ ID NO: 2492530 - RNA, 13 nt, Human
augcuucucacug

SEQ ID NO: 2492531 - RNA, 17 nt, Human
auggaaccgcaggaagc

SEQ ID NO: 2492532 - RNA, 18 nt, Human
auggaaccgcaggaagcu

SEQ ID NO: 2492533 - RNA, 19 nt, Human
auggaaccgcaggaagcug

SEQ ID NO: 2492534 - RNA, 20 nt, Human
auggaaccgcaggaagcugc

SEQ ID NO: 2492535 - RNA, 23 nt, Human
augcuuccuagaaguuacugaau

SEQ ID NO: 2492536 - RNA, 21 nt, Human
augcuuccuagaaguuacuga

SEQ ID NO: 2492537 - RNA, 17 nt, Human
augcuuccuagaaguua

SEQ ID NO: 2492538 - RNA, 16 nt, Human
augcuuccuagaaguu

SEQ ID NO: 2492539 - RNA, 15 nt, Human
augcuuccuagaagu

SEQ ID NO: 2492540 - RNA, 15 nt, Human
augcuuccugacaau

SEQ ID NO: 2492541 - RNA, 16 nt, Human
augcuuccugacaauc

SEQ ID NO: 2492542 - RNA, 20 nt, Human
augcuuccugacaaucaacu

SEQ ID NO: 2492543 - RNA, 22 nt, Human
augcuuccugacaaucaacucu

SEQ ID NO: 2492544 - RNA, 14 nt, Human
augcugugugacuc

SEQ ID NO: 2492545 - RNA, 14 nt, Human
uuuauauuuaguua

SEQ ID NO: 2492546 - RNA, 14 nt, Human
uuuauauuuaguga

SEQ ID NO: 2492547 - RNA, 14 nt, Human
uuuauaugucaaag

SEQ ID NO: 2492548 - RNA, 16 nt, Human
uuuauauuagaagugu

SEQ ID NO: 2492549 - RNA, 16 nt, Human
augcuaagacucagug

SEQ ID NO: 2492550 - RNA, 19 nt, Human
augcuaacaucuaaaaaua

SEQ ID NO: 2492551 - RNA, 17 nt, Human
augcuaacaucuaaaaa

SEQ ID NO: 2492552 - RNA, 16 nt, Human
augcuaacaucuaaaa

SEQ ID NO: 2492553 - RNA, 14 nt, Human
augcuaacaucuaa

SEQ ID NO: 2492554 - RNA, 23 nt, Human
augcuaaagaaaaagucauccaa

SEQ ID NO: 2492555 - RNA, 15 nt, Human
uuuaucaugacaugu

SEQ ID NO: 2492556 - RNA, 14 nt, Human
uuuaucaugacaug

SEQ ID NO: 2492557 - RNA, 16 nt, Human
uuuaucaugcaugucc

SEQ ID NO: 2492558 - RNA, 22 nt, Human
uuuaucaugcauguccuguaaa

SEQ ID NO: 2492559 - RNA, 23 nt, Human
uuuaucaugcauguccuguaaag

SEQ ID NO: 2492560 - RNA, 17 nt, Human
uuuaucaugugaaauca

SEQ ID NO: 2492561 - RNA, 15 nt, Human
uuuaucauucaagug

SEQ ID NO: 2492562 - RNA, 14 nt, Human
uuuaucauucaagu

SEQ ID NO: 2492563 - RNA, 17 nt, Human
uuuaucauucaagugua

SEQ ID NO: 2492564 - RNA, 15 nt, Human
uuuauuaagauggau

SEQ ID NO: 2492565 - RNA, 18 nt, Human
uuuaucaugugaaaucau

SEQ ID NO: 2492566 - RNA, 22 nt, Human
uuuaucaaacagaauuuuaaag

SEQ ID NO: 2492567 - RNA, 12 nt, Human
uuuauauuuuua

SEQ ID NO: 2492568 - RNA, 21 nt, Human
uuuaucaaucaguauaauucu

SEQ ID NO: 2492569 - RNA, 14 nt, Human
uuuaucaaaucagu

SEQ ID NO: 2492570 - RNA, 18 nt, Human
uuuaucaaucaguauaau

SEQ ID NO: 2492571 - RNA, 15 nt, Human
uuuaucacacuucug

SEQ ID NO: 2492572 - RNA, 18 nt, Human
uuuaucacauguauguuu

SEQ ID NO: 2492573 - RNA, 16 nt, Human
uuuaucacauguaugu

SEQ ID NO: 2492574 - RNA, 14 nt, Human
uuuaucacauguau

SEQ ID NO: 2492575 - RNA, 17 nt, Human
uuuaucacacuucugug

SEQ ID NO: 2492576 - RNA, 18 nt, Human
uuuaucacacuucuguga

SEQ ID NO: 2492577 - RNA, 20 nt, Human
augcuagaacucccuuucaa

SEQ ID NO: 2492578 - RNA, 21 nt, Human
augcuagaacucccuuucaac

SEQ ID NO: 2492579 - RNA, 15 nt, Human
augcuaggucucgga

SEQ ID NO: 2492580 - RNA, 16 nt, Human
augcuagcucugagcc

SEQ ID NO: 2492581 - RNA, 22 nt, Human
augcuagaacucccuuucaaca

SEQ ID NO: 2492582 - RNA, 12 nt, Human
uuuauuaaugca

SEQ ID NO: 2492583 - RNA, 17 nt, Human
uuuauuaaugcacuuuc

SEQ ID NO: 2492584 - RNA, 17 nt, Human
uuuauuaauugcuuuga

SEQ ID NO: 2492585 - RNA, 21 nt, Human
uuuauuaauaaacauucuauc

SEQ ID NO: 2492586 - RNA, 16 nt, Human
uuuauuaauaaacauu

SEQ ID NO: 2492587 - RNA, 23 nt, Human
uuuaucaugacauguuauauauu

SEQ ID NO: 2492588 - RNA, 22 nt, Human
uuuauuaagauggauucucaga

SEQ ID NO: 2492589 - RNA, 13 nt, Human
augcuaucucugu

SEQ ID NO: 2492590 - RNA, 18 nt, Human
augcuagguuaauuccaa

SEQ ID NO: 2492591 - RNA, 12 nt, Human
augcuccagcca

SEQ ID NO: 2492592 - RNA, 17 nt, Human
augcuccagccaacccc

SEQ ID NO: 2492593 - RNA, 18 nt, Human
augcuccagccaaccccu

SEQ ID NO: 2492594 - RNA, 19 nt, Human
augcuccagccaaccccug

SEQ ID NO: 2492595 - RNA, 20 nt, Human
augcuccagccaaccccugu

SEQ ID NO: 2492596 - RNA, 21 nt, Human
augcuccagccaaccccugug

SEQ ID NO: 2492597 - RNA, 17 nt, Human
auggacacuccagugcc

SEQ ID NO: 2492598 - RNA, 15 nt, Human
auggacacuccagug

SEQ ID NO: 2492599 - RNA, 13 nt, Human
auggacacuccag

SEQ ID NO: 2492600 - RNA, 23 nt, Human
auggacaccccuuauccaggacu

SEQ ID NO: 2492601 - RNA, 11 nt, Human
auggacacucc

SEQ ID NO: 2492602 - RNA, 19 nt, Human
auggacuaacuugucuuug

SEQ ID NO: 2492603 - RNA, 23 nt, Human
auggacacuuugaaauguguuuc

SEQ ID NO: 2492604 - RNA, 15 nt, Human
auggacacuuugaaa

SEQ ID NO: 2492605 - RNA, 19 nt, Human
auggacacuccagugccag

SEQ ID NO: 2492606 - RNA, 17 nt, Human
auggacuaucugucugg

SEQ ID NO: 2492607 - RNA, 13 nt, Human
auggacuaucugu

SEQ ID NO: 2492608 - RNA, 21 nt, Human
auggacuaucugucugguggc

SEQ ID NO: 2492609 - RNA, 20 nt, Human
auggacuaucugucuggugg

SEQ ID NO: 2492610 - RNA, 22 nt, Human
auggacuaucugucugguggcc

SEQ ID NO: 2492611 - RNA, 22 nt, Human
auggacacuuugaaauguguuu

SEQ ID NO: 2492612 - RNA, 22 nt, Human
auggacaccccuuauccaggac

SEQ ID NO: 2492613 - RNA, 21 nt, Human
auggacaccccuuauccagga

SEQ ID NO: 2492614 - RNA, 22 nt, Human
uuucccgagcaaagucuaaagu

SEQ ID NO: 2492615 - RNA, 21 nt, Human
uuuccccuguggggaucucag

SEQ ID NO: 2492616 - RNA, 23 nt, Human
uuuccccuguccugauggucagc

SEQ ID NO: 2492617 - RNA, 14 nt, Human
uuuccccuguccug

SEQ ID NO: 2492618 - RNA, 16 nt, Human
uuucccguggccccag

SEQ ID NO: 2492619 - RNA, 15 nt, Human
uuucccguggcccca

SEQ ID NO: 2492620 - RNA, 13 nt, Human
uuucccgccaagc

SEQ ID NO: 2492621 - RNA, 21 nt, Human
uuucccguggccccagccugg

SEQ ID NO: 2492622 - RNA, 20 nt, Human
uuucccguggccccagccug

SEQ ID NO: 2492623 - RNA, 19 nt, Human
uuucccguggccccagccu

SEQ ID NO: 2492624 - RNA, 18 nt, Human
uuucccguggccccagcc

SEQ ID NO: 2492625 - RNA, 12 nt, Human
auggacuuuguu

SEQ ID NO: 2492626 - RNA, 11 nt, Human
auggacuuugu

SEQ ID NO: 2492627 - RNA, 22 nt, Human
auggagaagcagaaauacauau

SEQ ID NO: 2492628 - RNA, 22 nt, Human
auggacuuguauauuuguacaa

SEQ ID NO: 2492629 - RNA, 14 nt, Human
auggagaaacccug

SEQ ID NO: 2492630 - RNA, 23 nt, Human
auggacuuguauauuuguacaaa

SEQ ID NO: 2492631 - RNA, 17 nt, Human
auggacuuguauauuug

SEQ ID NO: 2492632 - RNA, 16 nt, Human
auggacuuguauauuu

SEQ ID NO: 2492633 - RNA, 16 nt, Human
auggacugaugcuuuu

SEQ ID NO: 2492634 - RNA, 17 nt, Human
auggacucuucccccac

SEQ ID NO: 2492635 - RNA, 15 nt, Human
auggacucugcacau

SEQ ID NO: 2492636 - RNA, 21 nt, Human
auggacuccagccugccuggc

SEQ ID NO: 2492637 - RNA, 14 nt, Human
auggacucuacacu

SEQ ID NO: 2492638 - RNA, 16 nt, Human
auggacucuacacugu

SEQ ID NO: 2492639 - RNA, 18 nt, Human
auggacucuacacuguga

SEQ ID NO: 2492640 - RNA, 19 nt, Human
uuucaaauagggucuaacu

SEQ ID NO: 2492641 - RNA, 20 nt, Human
uuucaaauagggucuaacuc

SEQ ID NO: 2492642 - RNA, 14 nt, Human
uuucaaaugugcug

SEQ ID NO: 2492643 - RNA, 13 nt, Human
uuucaaauaucac

SEQ ID NO: 2492644 - RNA, 21 nt, Human
uuucaaauuggagcuucaugg

SEQ ID NO: 2492645 - RNA, 16 nt, Human
uuucaaauugagagaa

SEQ ID NO: 2492646 - RNA, 14 nt, Human
uuucaaauuguauc

SEQ ID NO: 2492647 - RNA, 17 nt, Human
uuucaaagcuuuuucca

SEQ ID NO: 2492648 - RNA, 16 nt, Human
uuucaaagauucaaaa

SEQ ID NO: 2492649 - RNA, 17 nt, Human
uuucaaagggagagaga

SEQ ID NO: 2492650 - RNA, 14 nt, Human
uuucaaagaaggaa

SEQ ID NO: 2492651 - RNA, 20 nt, Human
uuucauuauguaaaauguuu

SEQ ID NO: 2492652 - RNA, 18 nt, Human
uuucauuauguaaaaugu

SEQ ID NO: 2492653 - RNA, 21 nt, Human
uuucauuaauacagggcauuu

SEQ ID NO: 2492654 - RNA, 23 nt, Human
uuucaacaaguagcuaaagucug

SEQ ID NO: 2492655 - RNA, 14 nt, Human
uuucaaauuucaca

SEQ ID NO: 2492656 - RNA, 18 nt, Human
uuuccaugaguccccugu

SEQ ID NO: 2492657 - RNA, 17 nt, Human
uuuccaugaguccccug

SEQ ID NO: 2492658 - RNA, 12 nt, Human
uuuccaucuuua

SEQ ID NO: 2492659 - RNA, 21 nt, Human
uuucauuauuaguacugcucu

SEQ ID NO: 2492660 - RNA, 13 nt, Human
uuucauuauuagu

SEQ ID NO: 2492661 - RNA, 23 nt, Human
uuucccccugcauucuuucugua

SEQ ID NO: 2492662 - RNA, 16 nt, Human
uuucccccuucuacau

SEQ ID NO: 2492663 - RNA, 23 nt, Human
uuuccccccacucuccccacacu

SEQ ID NO: 2492664 - RNA, 17 nt, Human
uuuccaugaaguuugaa

SEQ ID NO: 2492665 - RNA, 16 nt, Human
uuuccaugaaaacguu

SEQ ID NO: 2492666 - RNA, 17 nt, Human
uuuccaugaaaaugcaa

SEQ ID NO: 2492667 - RNA, 21 nt, Human
uuucccccuuuucugcauuuu

SEQ ID NO: 2492668 - RNA, 18 nt, Human
uuuccccggucccuugag

SEQ ID NO: 2492669 - RNA, 16 nt, Human
uuuccccucccugggu

SEQ ID NO: 2492670 - RNA, 13 nt, Human
uuuccccucccug

SEQ ID NO: 2492671 - RNA, 20 nt, Human
uuuccccugcccccagaccu

SEQ ID NO: 2492672 - RNA, 21 nt, Human
uuucccgagcaaagucuaaag

SEQ ID NO: 2492673 - RNA, 18 nt, Human
augggagggaggcucagg

SEQ ID NO: 2492674 - RNA, 20 nt, Human
augggagggggcuugaagcc

SEQ ID NO: 2492675 - RNA, 21 nt, Human
augggagcugguuagaaaugc

SEQ ID NO: 2492676 - RNA, 23 nt, Human
augggaggcucacccccuucucc

SEQ ID NO: 2492677 - RNA, 23 nt, Human
augggagcugaggccacacucag

SEQ ID NO: 2492678 - RNA, 15 nt, Human
augggagaguagaug

SEQ ID NO: 2492679 - RNA, 20 nt, Human
augggagcugguuagaaaug

SEQ ID NO: 2492680 - RNA, 22 nt, Human
augggagcugguuagaaaugca

SEQ ID NO: 2492681 - RNA, 19 nt, Human
augggagagaagagaaugc

SEQ ID NO: 2492682 - RNA, 15 nt, Human
augggagagaagaga

SEQ ID NO: 2492683 - RNA, 18 nt, Human
augggagacccuugacac

SEQ ID NO: 2492684 - RNA, 17 nt, Human
augggagacccuugaca

SEQ ID NO: 2492685 - RNA, 23 nt, Human
augggacuucuuuucacauucuu

SEQ ID NO: 2492686 - RNA, 20 nt, Human
augggacuucuuuucacauu

SEQ ID NO: 2492687 - RNA, 22 nt, Human
augggagaaauaguguggaaau

SEQ ID NO: 2492688 - RNA, 17 nt, Human
auggcucccacaggagu

SEQ ID NO: 2492689 - RNA, 23 nt, Human
auggcuccagucugcugcccucc

SEQ ID NO: 2492690 - RNA, 17 nt, Human
auggcuccagaaauguc

SEQ ID NO: 2492691 - RNA, 13 nt, Human
auggcuccagucu

SEQ ID NO: 2492692 - RNA, 20 nt, Human
auggcuccagucugcugccc

SEQ ID NO: 2492693 - RNA, 22 nt, Human
auggcuccagucugcugcccuc

SEQ ID NO: 2492694 - RNA, 23 nt, Human
auggcuccgaacacccucgaagc

SEQ ID NO: 2492695 - RNA, 13 nt, Human
augggacugggag

SEQ ID NO: 2492696 - RNA, 14 nt, Human
augggacugggagg

SEQ ID NO: 2492697 - RNA, 15 nt, Human
augggacugggaggg

SEQ ID NO: 2492698 - RNA, 19 nt, Human
augggacuucuuuucacau

SEQ ID NO: 2492699 - RNA, 13 nt, Human
augggacuucuuu

SEQ ID NO: 2492700 - RNA, 16 nt, Human
augggacugggagggc

SEQ ID NO: 2492701 - RNA, 17 nt, Human
augggacugggagggcc

SEQ ID NO: 2492702 - RNA, 18 nt, Human
auggcuaauguacugcau

SEQ ID NO: 2492703 - RNA, 14 nt, Human
auggcuauauggca

SEQ ID NO: 2492704 - RNA, 18 nt, Human
auggcguggucaagcacu

SEQ ID NO: 2492705 - RNA, 19 nt, Human
auggcuauauggcaagaaa

SEQ ID NO: 2492706 - RNA, 20 nt, Human
auggcucacuaugaaucuau

SEQ ID NO: 2492707 - RNA, 18 nt, Human
auggcucacuaugaaucu

SEQ ID NO: 2492708 - RNA, 16 nt, Human
auggcucacuaugaau

SEQ ID NO: 2492709 - RNA, 16 nt, Human
auggcuccagaaaugu

SEQ ID NO: 2492710 - RNA, 15 nt, Human
auggcuccagaaaug

SEQ ID NO: 2492711 - RNA, 22 nt, Human
auggcucacuauggugccaaug

SEQ ID NO: 2492712 - RNA, 19 nt, Human
auggcucacuauggugcca

SEQ ID NO: 2492713 - RNA, 18 nt, Human
auggcucacuauggugcc

SEQ ID NO: 2492714 - RNA, 19 nt, Human
auggcuaagcaaaauguga

SEQ ID NO: 2492715 - RNA, 17 nt, Human
auggcgugaucucggcu

SEQ ID NO: 2492716 - RNA, 20 nt, Human
auggcgugucccucucggaa

SEQ ID NO: 2492717 - RNA, 23 nt, Human
auggccccucugaccugcacugg

SEQ ID NO: 2492718 - RNA, 18 nt, Human
auggccccucugaccugc

SEQ ID NO: 2492719 - RNA, 11 nt, Human
auggccccucu

SEQ ID NO: 2492720 - RNA, 20 nt, Human
auggcggguggggguggaau

SEQ ID NO: 2492721 - RNA, 15 nt, Human
auggcgggugggggu

SEQ ID NO: 2492722 - RNA, 11 nt, Human
auggcccuggg

SEQ ID NO: 2492723 - RNA, 18 nt, Human
auggcaguguuccuauuu

SEQ ID NO: 2492724 - RNA, 15 nt, Human
auggcagugucuuuc

SEQ ID NO: 2492725 - RNA, 17 nt, Human
auggcauccaagagugc

SEQ ID NO: 2492726 - RNA, 15 nt, Human
auggcauccugugaa

SEQ ID NO: 2492727 - RNA, 16 nt, Human
auggcauccugugaag

SEQ ID NO: 2492728 - RNA, 15 nt, Human
auggcaucaccucca

SEQ ID NO: 2492729 - RNA, 17 nt, Human
auggcauccugugaagu

SEQ ID NO: 2492730 - RNA, 22 nt, Human
auggccagugucugucccgggg

SEQ ID NO: 2492731 - RNA, 17 nt, Human
auggccagugucugucc

SEQ ID NO: 2492732 - RNA, 16 nt, Human
auggccagugucuguc

SEQ ID NO: 2492733 - RNA, 14 nt, Human
auggcccaguguca

SEQ ID NO: 2492734 - RNA, 15 nt, Human
auggccaugguaccc

SEQ ID NO: 2492735 - RNA, 22 nt, Human
auggccauggaguguacaagua

SEQ ID NO: 2492736 - RNA, 20 nt, Human
auggccccagcacagcuuga

SEQ ID NO: 2492737 - RNA, 18 nt, Human
auggccccagcacagcuu

SEQ ID NO: 2492738 - RNA, 17 nt, Human
auggccccagcacagcu

SEQ ID NO: 2492739 - RNA, 15 nt, Human
auggccccagcacag

SEQ ID NO: 2492740 - RNA, 14 nt, Human
auggccccagcaca

SEQ ID NO: 2492741 - RNA, 16 nt, Human
auggcacuaguauuuc

SEQ ID NO: 2492742 - RNA, 14 nt, Human
auggcacuaguauu

SEQ ID NO: 2492743 - RNA, 21 nt, Human
auggagacugguccugugugc

SEQ ID NO: 2492744 - RNA, 20 nt, Human
auggagacuccugcccuguu

SEQ ID NO: 2492745 - RNA, 18 nt, Human
auggagacugucucaaga

SEQ ID NO: 2492746 - RNA, 18 nt, Human
auggagacuccugcccug

SEQ ID NO: 2492747 - RNA, 14 nt, Human
auggagacuccugc

SEQ ID NO: 2492748 - RNA, 22 nt, Human
auggagaagaaaggccaucaga

SEQ ID NO: 2492749 - RNA, 20 nt, Human
auggagacuccaugagaagc

SEQ ID NO: 2492750 - RNA, 22 nt, Human
auggcacuuagcuaucagaaga

SEQ ID NO: 2492751 - RNA, 20 nt, Human
auggcacuuagcuaucagaa

SEQ ID NO: 2492752 - RNA, 21 nt, Human
auggcaccuucagacuuugcu

SEQ ID NO: 2492753 - RNA, 17 nt, Human
auggcaccuucagacuu

SEQ ID NO: 2492754 - RNA, 13 nt, Human
auggcacccagug

SEQ ID NO: 2492755 - RNA, 14 nt, Human
auggcaccagaggc

SEQ ID NO: 2492756 - RNA, 17 nt, Human
auggcacuugcaucugu

SEQ ID NO: 2492757 - RNA, 16 nt, Human
auggcacuugcaucug

SEQ ID NO: 2492758 - RNA, 22 nt, Human
auggcaggauggccuggccagg

SEQ ID NO: 2492759 - RNA, 17 nt, Human
auggcaggauggccugg

SEQ ID NO: 2492760 - RNA, 20 nt, Human
auggcagcuguuuaaauguu

SEQ ID NO: 2492761 - RNA, 14 nt, Human
auggcagcugccac

SEQ ID NO: 2492762 - RNA, 16 nt, Human
auggcaggauggccug

SEQ ID NO: 2492763 - RNA, 19 nt, Human
auucagacagcugccuggg

SEQ ID NO: 2492764 - RNA, 19 nt, Human
auuauacccccugcaaagc

SEQ ID NO: 2492765 - RNA, 22 nt, Human
auuauacagaccgaacuguugu

SEQ ID NO: 2492766 - RNA, 14 nt, Human
auuauauuaaaaua

SEQ ID NO: 2492767 - RNA, 13 nt, Human
auuauauuaaaau

SEQ ID NO: 2492768 - RNA, 18 nt, Human
auuauacuguauuaagag

SEQ ID NO: 2492769 - RNA, 12 nt, Human
auuauacuguau

SEQ ID NO: 2492770 - RNA, 15 nt, Human
auuauacuaagaaaa

SEQ ID NO: 2492771 - RNA, 17 nt, Human
auuauacuaagaaaaga

SEQ ID NO: 2492772 - RNA, 19 nt, Human
auuauacuaagaaaagaua

SEQ ID NO: 2492773 - RNA, 15 nt, Human
auuauauuuacaaau

SEQ ID NO: 2492774 - RNA, 14 nt, Human
auuauauuaugaag

SEQ ID NO: 2492775 - RNA, 20 nt, Human
auuauauuauuaguuuugau

SEQ ID NO: 2492776 - RNA, 18 nt, Human
auuauauuguuaaucaau

SEQ ID NO: 2492777 - RNA, 12 nt, Human
uuugugcuucua

SEQ ID NO: 2492778 - RNA, 13 nt, Human
uuugugcuguggg

SEQ ID NO: 2492779 - RNA, 11 nt, Human
uuuguggaaaa

SEQ ID NO: 2492780 - RNA, 14 nt, Human
uuuguggaugucuu

SEQ ID NO: 2492781 - RNA, 12 nt, Human
uuuguggaauaa

SEQ ID NO: 2492782 - RNA, 20 nt, Human
uuuguggaaagucacagguc

SEQ ID NO: 2492783 - RNA, 14 nt, Human
uuugugcuucuaau

SEQ ID NO: 2492784 - RNA, 17 nt, Human
uuuguggcaccuuuucu

SEQ ID NO: 2492785 - RNA, 17 nt, Human
uuuguggaugucuuccu

SEQ ID NO: 2492786 - RNA, 11 nt, Human
uuuguggccaa

SEQ ID NO: 2492787 - RNA, 18 nt, Human
uuuguggccaaggagcug

SEQ ID NO: 2492788 - RNA, 20 nt, Human
uuuguggccaaggagcugcu

SEQ ID NO: 2492789 - RNA, 21 nt, Human
uuuguggccaaggagcugcua

SEQ ID NO: 2492790 - RNA, 22 nt, Human
uuuguggccaaggagcugcuau

SEQ ID NO: 2492791 - RNA, 12 nt, Human
uuuguggccuca

SEQ ID NO: 2492792 - RNA, 14 nt, Human
uuuguggccucaga

SEQ ID NO: 2492793 - RNA, 22 nt, Human
auuagugcuaagugugaacugg

SEQ ID NO: 2492794 - RNA, 20 nt, Human
auuagugcuaagugugaacu

SEQ ID NO: 2492795 - RNA, 18 nt, Human
auuagugcuaagugugaa

SEQ ID NO: 2492796 - RNA, 17 nt, Human
auuagugcuaaguguga

SEQ ID NO: 2492797 - RNA, 22 nt, Human
auuaguguaugcuuugaaugua

SEQ ID NO: 2492798 - RNA, 18 nt, Human
auuaguuuacaucauuuu

SEQ ID NO: 2492799 - RNA, 14 nt, Human
auuaguuaauauau

SEQ ID NO: 2492800 - RNA, 17 nt, Human
auuauaauuuaaugcau

SEQ ID NO: 2492801 - RNA, 23 nt, Human
auuauaauuuuuuucaauauuua

SEQ ID NO: 2492802 - RNA, 22 nt, Human
auuauaauuuuuuucaauauuu

SEQ ID NO: 2492803 - RNA, 16 nt, Human
auucuaguuuugucaa

SEQ ID NO: 2492804 - RNA, 19 nt, Human
auuauuuugguacuuuuau

SEQ ID NO: 2492805 - RNA, 17 nt, Human
auuauuuguguaauaga

SEQ ID NO: 2492806 - RNA, 16 nt, Human
auucaaacagucucag

SEQ ID NO: 2492807 - RNA, 18 nt, Human
auucaaacagucucagga

SEQ ID NO: 2492808 - RNA, 19 nt, Human
auucaaacagucucaggaa

SEQ ID NO: 2492809 - RNA, 20 nt, Human
auucaaacagucucaggaaa

SEQ ID NO: 2492810 - RNA, 17 nt, Human
auucacaucuaaccuca

SEQ ID NO: 2492811 - RNA, 20 nt, Human
auucacaucuaaccucaucu

SEQ ID NO: 2492812 - RNA, 22 nt, Human
auucacaguucuuugggccaga

SEQ ID NO: 2492813 - RNA, 20 nt, Human
auuauuuugguacuuuuaug

SEQ ID NO: 2492814 - RNA, 23 nt, Human
auucacaguucuuugggccagac

SEQ ID NO: 2492815 - RNA, 12 nt, Human
auuauuuugaug

SEQ ID NO: 2492816 - RNA, 15 nt, Human
auuauuuguguaaua

SEQ ID NO: 2492817 - RNA, 11 nt, Human
auuauuugcau

SEQ ID NO: 2492818 - RNA, 23 nt, Human
auuauuugaaaacauauaaagca

SEQ ID NO: 2492819 - RNA, 14 nt, Human
auuauuugaaaaca

SEQ ID NO: 2492820 - RNA, 15 nt, Human
auuauuauuuguguu

SEQ ID NO: 2492821 - RNA, 16 nt, Human
auuauuauucuucaua

SEQ ID NO: 2492822 - RNA, 14 nt, Human
auuauuuauuuaau

SEQ ID NO: 2492823 - RNA, 23 nt, Human
auuauuuauucagcuucauuugu

SEQ ID NO: 2492824 - RNA, 15 nt, Human
auuauuuauuuauuu

SEQ ID NO: 2492825 - RNA, 22 nt, Human
auuauuucuaggaagaauuuua

SEQ ID NO: 2492826 - RNA, 20 nt, Human
auuauuucuaggaagaauuu

SEQ ID NO: 2492827 - RNA, 16 nt, Human
auuauuucuaggaaga

SEQ ID NO: 2492828 - RNA, 18 nt, Human
auuauuucacuuuagaug

SEQ ID NO: 2492829 - RNA, 17 nt, Human
auuauuuauuuaauaac

SEQ ID NO: 2492830 - RNA, 21 nt, Human
auuauuucacuuuagaugcug

SEQ ID NO: 2492831 - RNA, 11 nt, Human
auuauuucaga

SEQ ID NO: 2492832 - RNA, 22 nt, Human
auuauguuaaacuagcauaucu

SEQ ID NO: 2492833 - RNA, 14 nt, Human
auuauguuaaacua

SEQ ID NO: 2492834 - RNA, 13 nt, Human
auuauguuaaacu

SEQ ID NO: 2492835 - RNA, 12 nt, Human
auuauguuaaac

SEQ ID NO: 2492836 - RNA, 23 nt, Human
auuauguuaaacuagcauaucug

SEQ ID NO: 2492837 - RNA, 20 nt, Human
auuauuacuuauuuuugaca

SEQ ID NO: 2492838 - RNA, 21 nt, Human
auuauuacuuauuuuugacag

SEQ ID NO: 2492839 - RNA, 13 nt, Human
auuauuacuguuu

SEQ ID NO: 2492840 - RNA, 15 nt, Human
auuauuauuuggccc

SEQ ID NO: 2492841 - RNA, 22 nt, Human
auuauuaguuuacaucauuuuu

SEQ ID NO: 2492842 - RNA, 15 nt, Human
auuauuauucuucau

SEQ ID NO: 2492843 - RNA, 17 nt, Human
auuauuauuaaaaauau

SEQ ID NO: 2492844 - RNA, 22 nt, Human
auuauuaguuuugauuuaaugu

SEQ ID NO: 2492845 - RNA, 15 nt, Human
auuauuaguacugcu

SEQ ID NO: 2492846 - RNA, 22 nt, Human
auuauuagccagguaaugugaa

SEQ ID NO: 2492847 - RNA, 21 nt, Human
auuauuaguaagaaaacauca

SEQ ID NO: 2492848 - RNA, 18 nt, Human
auuauauuuauuacugua

SEQ ID NO: 2492849 - RNA, 15 nt, Human
auuauauuuauuacu

SEQ ID NO: 2492850 - RNA, 23 nt, Human
auuaucuaaaguguguuguugcu

SEQ ID NO: 2492851 - RNA, 17 nt, Human
auuaucuaaaguguguu

SEQ ID NO: 2492852 - RNA, 19 nt, Human
auuaucuaaaaucugcuag

SEQ ID NO: 2492853 - RNA, 14 nt, Human
auuaucuagauacu

SEQ ID NO: 2492854 - RNA, 18 nt, Human
auuaucuagauacuguau

SEQ ID NO: 2492855 - RNA, 21 nt, Human
auuauguuaaaacugggacag

SEQ ID NO: 2492856 - RNA, 20 nt, Human
auuaucuauacauaucuuua

SEQ ID NO: 2492857 - RNA, 14 nt, Human
auuaucuauacaua

SEQ ID NO: 2492858 - RNA, 19 nt, Human
auuaucuauacauaucuuu

SEQ ID NO: 2492859 - RNA, 13 nt, Human
auucagacagcug

SEQ ID NO: 2492860 - RNA, 12 nt, Human
auucagacagcu

SEQ ID NO: 2492861 - RNA, 15 nt, Human
auucagaaggggagg

SEQ ID NO: 2492862 - RNA, 13 nt, Human
auucagacaagca

SEQ ID NO: 2492863 - RNA, 11 nt, Human
auucagacagc

SEQ ID NO: 2492864 - RNA, 20 nt, Human
auucacauuguauucagagu

SEQ ID NO: 2492865 - RNA, 13 nt, Human
auucacauuguau

SEQ ID NO: 2492866 - RNA, 14 nt, Human
auucagaaauugga

SEQ ID NO: 2492867 - RNA, 13 nt, Human
auucagaaauugg

SEQ ID NO: 2492868 - RNA, 17 nt, Human
auucagacagcugccug

SEQ ID NO: 2492869 - RNA, 16 nt, Human
auucagacagcugccu

SEQ ID NO: 2492870 - RNA, 15 nt, Human
auucagacagcugcc

SEQ ID NO: 2492871 - RNA, 14 nt, Human
auucagacagcugc

SEQ ID NO: 2492872 - RNA, 18 nt, Human
auucagacagcugccugg

SEQ ID NO: 2492873 - RNA, 12 nt, Human
auucagcuucau

SEQ ID NO: 2492874 - RNA, 19 nt, Human
auucaggaaaagccucugu

SEQ ID NO: 2492875 - RNA, 20 nt, Human
auucagcuucauuuguguca

SEQ ID NO: 2492876 - RNA, 22 nt, Human
auucaggaaaacugacagagga

SEQ ID NO: 2492877 - RNA, 12 nt, Human
auucaggaagcu

SEQ ID NO: 2492878 - RNA, 22 nt, Human
auucaggaagcagcuuucccca

SEQ ID NO: 2492879 - RNA, 16 nt, Human
auucaggaagaugaaa

SEQ ID NO: 2492880 - RNA, 13 nt, Human
auucaggaagcuc

SEQ ID NO: 2492881 - RNA, 19 nt, Human
auuccagagaguggcuccu

SEQ ID NO: 2492882 - RNA, 21 nt, Human
auuccagagaguggcuccucc

SEQ ID NO: 2492883 - RNA, 20 nt, Human
auuccagaucugcagucacu

SEQ ID NO: 2492884 - RNA, 12 nt, Human
auuccagaggaa

SEQ ID NO: 2492885 - RNA, 19 nt, Human
auuccagagcguguaguga

SEQ ID NO: 2492886 - RNA, 17 nt, Human
auucccagagcaaaaua

SEQ ID NO: 2492887 - RNA, 19 nt, Human
auucccagagcaaaauaau

SEQ ID NO: 2492888 - RNA, 12 nt, Human
auucccagccca

SEQ ID NO: 2492889 - RNA, 14 nt, Human
auuccagccccucu

SEQ ID NO: 2492890 - RNA, 13 nt, Human
auuccagccccuc

SEQ ID NO: 2492891 - RNA, 12 nt, Human
auucccagagac

SEQ ID NO: 2492892 - RNA, 16 nt, Human
auucccagagacagga

SEQ ID NO: 2492893 - RNA, 19 nt, Human
auucccagagacaggaaaa

SEQ ID NO: 2492894 - RNA, 23 nt, Human
auucccagagacaggaaaauccu

SEQ ID NO: 2492895 - RNA, 23 nt, Human
auucccauuuugcaaaauuucca

SEQ ID NO: 2492896 - RNA, 18 nt, Human
auucccauuuugcaaaau

SEQ ID NO: 2492897 - RNA, 20 nt, Human
auucccauuuugcaaaauuu

SEQ ID NO: 2492898 - RNA, 15 nt, Human
auucccaucugucac

SEQ ID NO: 2492899 - RNA, 15 nt, Human
auucccauuuugcaa

SEQ ID NO: 2492900 - RNA, 22 nt, Human
auucccagggaagugcucugau

SEQ ID NO: 2492901 - RNA, 20 nt, Human
auucccagggaagugcucug

SEQ ID NO: 2492902 - RNA, 17 nt, Human
auucccuagaaacuucc

SEQ ID NO: 2492903 - RNA, 20 nt, Human
auucccuagaaacuuccaaa

SEQ ID NO: 2492904 - RNA, 21 nt, Human
auucccuagaaacuuccaaau

SEQ ID NO: 2492905 - RNA, 23 nt, Human
auucccccuggccaccacccccc

SEQ ID NO: 2492906 - RNA, 23 nt, Human
auuccccgucucugguuccuccc

SEQ ID NO: 2492907 - RNA, 22 nt, Human
auuccccucugcugcugucccu

SEQ ID NO: 2492908 - RNA, 15 nt, Human
auuccccucugcugc

SEQ ID NO: 2492909 - RNA, 13 nt, Human
auuccccucugcu

SEQ ID NO: 2492910 - RNA, 20 nt, Human
auuccccggggcguuucuuu

SEQ ID NO: 2492911 - RNA, 21 nt, Human
auuccccuaucucuagaauuu

SEQ ID NO: 2492912 - RNA, 17 nt, Human
auucccuagaucuuucu

SEQ ID NO: 2492913 - RNA, 18 nt, Human
auucuaagacuaaugcuc

SEQ ID NO: 2492914 - RNA, 19 nt, Human
auucuaacuuuuuugcuau

SEQ ID NO: 2492915 - RNA, 15 nt, Human
auucuaagugaaauu

SEQ ID NO: 2492916 - RNA, 13 nt, Human
auucuaaugucuu

SEQ ID NO: 2492917 - RNA, 12 nt, Human
auucuaaugucu

SEQ ID NO: 2492918 - RNA, 13 nt, Human
auuggcagcagau

SEQ ID NO: 2492919 - RNA, 14 nt, Human
auucuuaaauaugu

SEQ ID NO: 2492920 - RNA, 17 nt, Human
auucuguagauucugug

SEQ ID NO: 2492921 - RNA, 21 nt, Human
auucuuacaaacaugugguua

SEQ ID NO: 2492922 - RNA, 16 nt, Human
auucuuacaaacaugu

SEQ ID NO: 2492923 - RNA, 22 nt, Human
auucuuaagggaacuuccacau

SEQ ID NO: 2492924 - RNA, 21 nt, Human
auucuucccuaucuuugccac

SEQ ID NO: 2492925 - RNA, 12 nt, Human
auucuuccuagu

SEQ ID NO: 2492926 - RNA, 20 nt, Human
auucuucccuaucuuugcca

SEQ ID NO: 2492927 - RNA, 17 nt, Human
auucuuccuaguuuucu

SEQ ID NO: 2492928 - RNA, 19 nt, Human
auucuuccuaguuuucucc

SEQ ID NO: 2492929 - RNA, 14 nt, Human
auucuuccaucuga

SEQ ID NO: 2492930 - RNA, 15 nt, Human
auucuuccaucugau

SEQ ID NO: 2492931 - RNA, 13 nt, Human
auucuuccaucug

SEQ ID NO: 2492932 - RNA, 17 nt, Human
auucuuacaaacaugug

SEQ ID NO: 2492933 - RNA, 23 nt, Human
auucuuccaucugauugugaugu

SEQ ID NO: 2492934 - RNA, 18 nt, Human
auugaaaucuuuuugcuu

SEQ ID NO: 2492935 - RNA, 17 nt, Human
auugaaaucuuuuugcu

SEQ ID NO: 2492936 - RNA, 20 nt, Human
auugaaaucuuuuugcuuug

SEQ ID NO: 2492937 - RNA, 16 nt, Human
auugaaaugacuaaaa

SEQ ID NO: 2492938 - RNA, 12 nt, Human
auugaaaucuuu

SEQ ID NO: 2492939 - RNA, 19 nt, Human
auugaaaaaauagagccug

SEQ ID NO: 2492940 - RNA, 22 nt, Human
auugaaaaaauagagccugagg

SEQ ID NO: 2492941 - RNA, 15 nt, Human
auugaaaaaccauuu

SEQ ID NO: 2492942 - RNA, 14 nt, Human
auugaaaaaauaga

SEQ ID NO: 2492943 - RNA, 18 nt, Human
auugaaaaaauagagccu

SEQ ID NO: 2492944 - RNA, 15 nt, Human
auugaagcccuccaa

SEQ ID NO: 2492945 - RNA, 14 nt, Human
auugacaaacucuc

SEQ ID NO: 2492946 - RNA, 22 nt, Human
auugaagcauuuuauaaaucgc

SEQ ID NO: 2492947 - RNA, 15 nt, Human
auugaacucuuugaa

SEQ ID NO: 2492948 - RNA, 23 nt, Human
auugaacucuuugaaugacaaag

SEQ ID NO: 2492949 - RNA, 19 nt, Human
auugaacuuaaauaaaugu

SEQ ID NO: 2492950 - RNA, 15 nt, Human
auugacacuuaaaaa

SEQ ID NO: 2492951 - RNA, 17 nt, Human
auugacacuuaaaaaug

SEQ ID NO: 2492952 - RNA, 15 nt, Human
auugacaagaacuga

SEQ ID NO: 2492953 - RNA, 15 nt, Human
auugacaagucauuu

SEQ ID NO: 2492954 - RNA, 17 nt, Human
auugacaauaauuucag

SEQ ID NO: 2492955 - RNA, 12 nt, Human
auugacacagaa

SEQ ID NO: 2492956 - RNA, 14 nt, Human
auugacacagaaaa

SEQ ID NO: 2492957 - RNA, 18 nt, Human
auugacaauaauuucagg

SEQ ID NO: 2492958 - RNA, 20 nt, Human
auugacaauaauuucagguu

SEQ ID NO: 2492959 - RNA, 21 nt, Human
auugacgacaagugcugaaca

SEQ ID NO: 2492960 - RNA, 22 nt, Human
auugacgacaagugcugaacag

SEQ ID NO: 2492961 - RNA, 17 nt, Human
auugacacagaaaaugu

SEQ ID NO: 2492962 - RNA, 19 nt, Human
auugacacuuaaaaauggu

SEQ ID NO: 2492963 - RNA, 17 nt, Human
auugaccugaggcccuu

SEQ ID NO: 2492964 - RNA, 22 nt, Human
auugacucaaaucuccaguauu

SEQ ID NO: 2492965 - RNA, 18 nt, Human
auugacuaucaaacugaa

SEQ ID NO: 2492966 - RNA, 21 nt, Human
auugacuaucaaacugaagcc

SEQ ID NO: 2492967 - RNA, 11 nt, Human
auugacuucuu

SEQ ID NO: 2492968 - RNA, 18 nt, Human
auugacuucaaugauagu

SEQ ID NO: 2492969 - RNA, 14 nt, Human
auugacuucaauga

SEQ ID NO: 2492970 - RNA, 14 nt, Human
auugacuuguauau

SEQ ID NO: 2492971 - RNA, 13 nt, Human
auugacuuugucu

SEQ ID NO: 2492972 - RNA, 14 nt, Human
auucuguuggccag

SEQ ID NO: 2492973 - RNA, 21 nt, Human
auucuguuggccagugugaca

SEQ ID NO: 2492974 - RNA, 19 nt, Human
auucuguuggccaguguga

SEQ ID NO: 2492975 - RNA, 15 nt, Human
auucuguagauucug

SEQ ID NO: 2492976 - RNA, 21 nt, Human
auucuguacugauuuuuguaa

SEQ ID NO: 2492977 - RNA, 15 nt, Human
auucuguacugauuu

SEQ ID NO: 2492978 - RNA, 13 nt, Human
auucuguacugau

SEQ ID NO: 2492979 - RNA, 19 nt, Human
auucuguacauagccuaua

SEQ ID NO: 2492980 - RNA, 18 nt, Human
auucuguacauagccuau

SEQ ID NO: 2492981 - RNA, 20 nt, Human
auucuguacauagccuauau

SEQ ID NO: 2492982 - RNA, 14 nt, Human
auucuguacucuua

SEQ ID NO: 2492983 - RNA, 14 nt, Human
auucuguaaaaugu

SEQ ID NO: 2492984 - RNA, 15 nt, Human
auucuguacauagcc

SEQ ID NO: 2492985 - RNA, 12 nt, Human
auucuguacaua

SEQ ID NO: 2492986 - RNA, 12 nt, Human
auucuguaaaug

SEQ ID NO: 2492987 - RNA, 20 nt, Human
auucuguaaaaugucuguua

SEQ ID NO: 2492988 - RNA, 23 nt, Human
auucugguuccagggucccucug

SEQ ID NO: 2492989 - RNA, 19 nt, Human
auucugcuaccucacuggg

SEQ ID NO: 2492990 - RNA, 22 nt, Human
auucugcgucaugcuuguguua

SEQ ID NO: 2492991 - RNA, 15 nt, Human
auucugcuaccucac

SEQ ID NO: 2492992 - RNA, 22 nt, Human
auucugcucacauaucugucau

SEQ ID NO: 2492993 - RNA, 21 nt, Human
auucugcucacauaucuguca

SEQ ID NO: 2492994 - RNA, 20 nt, Human
auucugcucacauaucuguc

SEQ ID NO: 2492995 - RNA, 19 nt, Human
auucugcucacauaucugu

SEQ ID NO: 2492996 - RNA, 21 nt, Human
auucugccugcccaggccccu

SEQ ID NO: 2492997 - RNA, 20 nt, Human
auucugccugcccaggcccc

SEQ ID NO: 2492998 - RNA, 18 nt, Human
auucugcucacauaucug

SEQ ID NO: 2492999 - RNA, 22 nt, Human
auucugccgugugcccucgggc

SEQ ID NO: 2493000 - RNA, 19 nt, Human
auucugccugcccaggccc

SEQ ID NO: 2493001 - RNA, 18 nt, Human
auucugccugcccaggcc

SEQ ID NO: 2493002 - RNA, 17 nt, Human
auucugccugcccaggc

SEQ ID NO: 2493003 - RNA, 16 nt, Human
auucugccugcccagg

SEQ ID NO: 2493004 - RNA, 15 nt, Human
auucugccugcccag

SEQ ID NO: 2493005 - RNA, 14 nt, Human
auucugccugccca

SEQ ID NO: 2493006 - RNA, 13 nt, Human
auucugccugccc

SEQ ID NO: 2493007 - RNA, 11 nt, Human
auucugccugc

SEQ ID NO: 2493008 - RNA, 12 nt, Human
auucucauguga

SEQ ID NO: 2493009 - RNA, 16 nt, Human
auucucauggagaagu

SEQ ID NO: 2493010 - RNA, 17 nt, Human
auucuagugcugcugaa

SEQ ID NO: 2493011 - RNA, 15 nt, Human
auucuagugcugcug

SEQ ID NO: 2493012 - RNA, 22 nt, Human
auucucaugccucagccuccug

SEQ ID NO: 2493013 - RNA, 15 nt, Human
auucucaugugaucc

SEQ ID NO: 2493014 - RNA, 13 nt, Human
auucuccacagca

SEQ ID NO: 2493015 - RNA, 14 nt, Human
auucuccacagcaa

SEQ ID NO: 2493016 - RNA, 17 nt, Human
auucucauuugucacac

SEQ ID NO: 2493017 - RNA, 18 nt, Human
auucuagcuaauguaaua

SEQ ID NO: 2493018 - RNA, 15 nt, Human
auucuagcuaaugua

SEQ ID NO: 2493019 - RNA, 16 nt, Human
auucuaaugucuucau

SEQ ID NO: 2493020 - RNA, 14 nt, Human
auucuaaugucuuc

SEQ ID NO: 2493021 - RNA, 15 nt, Human
auucuagcuuugagc

SEQ ID NO: 2493022 - RNA, 13 nt, Human
auucuaggcaucc

SEQ ID NO: 2493023 - RNA, 16 nt, Human
auucuaggcaucccag

SEQ ID NO: 2493024 - RNA, 20 nt, Human
auucuaggcaucccagggga

SEQ ID NO: 2493025 - RNA, 21 nt, Human
auucucaugccucagccuccu

SEQ ID NO: 2493026 - RNA, 14 nt, Human
auucuagugcugcu

SEQ ID NO: 2493027 - RNA, 12 nt, Human
auucuagugcug

SEQ ID NO: 2493028 - RNA, 20 nt, Human
auuuuuguacaguuugcugu

SEQ ID NO: 2493029 - RNA, 12 nt, Human
auuuuuguacag

SEQ ID NO: 2493030 - RNA, 11 nt, Human
auuuuuguaca

SEQ ID NO: 2493031 - RNA, 22 nt, Human
auuuuuguaagacaauccaugu

SEQ ID NO: 2493032 - RNA, 20 nt, Human
auuuuuguacccuuccuaca

SEQ ID NO: 2493033 - RNA, 12 nt, Human
auuuuuguaauu

SEQ ID NO: 2493034 - RNA, 19 nt, Human
auuuuuguagagccagggu

SEQ ID NO: 2493035 - RNA, 22 nt, Human
auuuuugugauuuugugauuga

SEQ ID NO: 2493036 - RNA, 16 nt, Human
auuuuuguuucuaccu

SEQ ID NO: 2493037 - RNA, 17 nt, Human
auuuuuguuucuuccaa

SEQ ID NO: 2493038 - RNA, 23 nt, Human
auuuuugucuuauauauauuucu

SEQ ID NO: 2493039 - RNA, 20 nt, Human
auuuuugugaaaugaaaaca

SEQ ID NO: 2493040 - RNA, 13 nt, Human
auuuuuguaucua

SEQ ID NO: 2493041 - RNA, 21 nt, Human
auuuuuguacaguuugcugua

SEQ ID NO: 2493042 - RNA, 21 nt, Human
auuuuuguaucuacaucuuuu

SEQ ID NO: 2493043 - RNA, 14 nt, Human
auuuuugucuugug

SEQ ID NO: 2493044 - RNA, 21 nt, Human
auuuuuguuuucauuaucuca

SEQ ID NO: 2493045 - RNA, 22 nt, Human
auuuuuguuucuuccaaagcac

SEQ ID NO: 2493046 - RNA, 13 nt, Human
auuuuuuaaaugc

SEQ ID NO: 2493047 - RNA, 14 nt, Human
auuuuuuaaaugca

SEQ ID NO: 2493048 - RNA, 17 nt, Human
auuuuuuaaggaaacaa

SEQ ID NO: 2493049 - RNA, 16 nt, Human
auuuuuuaaggaaaca

SEQ ID NO: 2493050 - RNA, 11 nt, Human
auuuuuuaagu

SEQ ID NO: 2493051 - RNA, 18 nt, Human
auuuuuuaaauugaauuc

SEQ ID NO: 2493052 - RNA, 20 nt, Human
auuuuuuaaaguuacuuugu

SEQ ID NO: 2493053 - RNA, 14 nt, Human
auuuuuucagaccg

SEQ ID NO: 2493054 - RNA, 13 nt, Human
auuuuuucagacc

SEQ ID NO: 2493055 - RNA, 16 nt, Human
auuuuuucagaccgaa

SEQ ID NO: 2493056 - RNA, 13 nt, Human
auuuuuucccaaa

SEQ ID NO: 2493057 - RNA, 16 nt, Human
auuuuuuaucaugcau

SEQ ID NO: 2493058 - RNA, 21 nt, Human
auuuuuuaucaugcauguccu

SEQ ID NO: 2493059 - RNA, 18 nt, Human
auuuuuuauauauacagu

SEQ ID NO: 2493060 - RNA, 13 nt, Human
auuuuuuauuguu

SEQ ID NO: 2493061 - RNA, 12 nt, Human
auuuuuuauugu

SEQ ID NO: 2493062 - RNA, 15 nt, Human
auuuuuuauuuuacu

SEQ ID NO: 2493063 - RNA, 13 nt, Human
auuuuuucagaaa

SEQ ID NO: 2493064 - RNA, 12 nt, Human
auuuuuucagac

SEQ ID NO: 2493065 - RNA, 22 nt, Human
auuuuuucagaaauaugugguu

SEQ ID NO: 2493066 - RNA, 20 nt, Human
auuuuuuaaguauuuauaua

SEQ ID NO: 2493067 - RNA, 22 nt, Human
auuuuuuaaguauuuauauauu

SEQ ID NO: 2493068 - RNA, 16 nt, Human
auuuuuuaaguauuua

SEQ ID NO: 2493069 - RNA, 17 nt, Human
auuuuuuaaguauuuau

SEQ ID NO: 2493070 - RNA, 18 nt, Human
auuuuuuaaguauuuaua

SEQ ID NO: 2493071 - RNA, 19 nt, Human
auuuuuuaaguauuuauau

SEQ ID NO: 2493072 - RNA, 20 nt, Human
auuuuuuaauuauuauuuau

SEQ ID NO: 2493073 - RNA, 15 nt, Human
auuuuuuaauuauua

SEQ ID NO: 2493074 - RNA, 19 nt, Human
auuuuuuacagcugccugc

SEQ ID NO: 2493075 - RNA, 13 nt, Human
auuuuuuauauau

SEQ ID NO: 2493076 - RNA, 23 nt, Human
auuuuuucucuaggaaauauuua

SEQ ID NO: 2493077 - RNA, 20 nt, Human
auuuuuucucuaggaaauau

SEQ ID NO: 2493078 - RNA, 13 nt, Human
auuuuuucugaau

SEQ ID NO: 2493079 - RNA, 21 nt, Human
auuuuuuuaaccaaaggugaa

SEQ ID NO: 2493080 - RNA, 19 nt, Human
auuuuuuuaaccaaaggug

SEQ ID NO: 2493081 - RNA, 18 nt, Human
auuuuuuuaaccaaaggu

SEQ ID NO: 2493082 - RNA, 16 nt, Human
auuuuuuuaaccaaag

SEQ ID NO: 2493083 - RNA, 15 nt, Human
auuuuuuuaaccaaa

SEQ ID NO: 2493084 - RNA, 18 nt, Human
auuuuuuuaaaauguuaa

SEQ ID NO: 2493085 - RNA, 18 nt, Human
auuuuuuguuaaaugauu

SEQ ID NO: 2493086 - RNA, 22 nt, Human
auuuuugcccugaguccaagag

SEQ ID NO: 2493087 - RNA, 12 nt, Human
auuuuugccucu

SEQ ID NO: 2493088 - RNA, 14 nt, Human
auuuuugcaggagc

SEQ ID NO: 2493089 - RNA, 18 nt, Human
auuuuugccucuuccagu

SEQ ID NO: 2493090 - RNA, 21 nt, Human
auuuuugccucuuccagucuu

SEQ ID NO: 2493091 - RNA, 15 nt, Human
auuuuugccuucauu

SEQ ID NO: 2493092 - RNA, 14 nt, Human
auuuuugccuucau

SEQ ID NO: 2493093 - RNA, 15 nt, Human
auuuuugaaugugau

SEQ ID NO: 2493094 - RNA, 22 nt, Human
auuuuugaauguaguaaguaaa

SEQ ID NO: 2493095 - RNA, 15 nt, Human
auuuuugacaguguu

SEQ ID NO: 2493096 - RNA, 13 nt, Human
auuuuugauuuau

SEQ ID NO: 2493097 - RNA, 23 nt, Human
auuuuugauuuaugcauggaaac

SEQ ID NO: 2493098 - RNA, 17 nt, Human
auuuuugaaugugauuu

SEQ ID NO: 2493099 - RNA, 18 nt, Human
auuuuuggucauuguaau

SEQ ID NO: 2493100 - RNA, 19 nt, Human
auuuuuggcagucugaauu

SEQ ID NO: 2493101 - RNA, 15 nt, Human
auuuuugguugaaua

SEQ ID NO: 2493102 - RNA, 19 nt, Human
auuuuugguugucaauauu

SEQ ID NO: 2493103 - RNA, 17 nt, Human
auuuuugguugaauaaa

SEQ ID NO: 2493104 - RNA, 19 nt, Human
auuuuugguugaauaaacu

SEQ ID NO: 2493105 - RNA, 23 nt, Human
auuuuuggaagaggacuccuuaa

SEQ ID NO: 2493106 - RNA, 19 nt, Human
auuuuucuuauuucauuuc

SEQ ID NO: 2493107 - RNA, 20 nt, Human
auuuuucuuauuucauuucu

SEQ ID NO: 2493108 - RNA, 15 nt, Human
auuuuucuuauuuca

SEQ ID NO: 2493109 - RNA, 22 nt, Human
auuuuucuuagggaaggauaca

SEQ ID NO: 2493110 - RNA, 21 nt, Human
auuuuucuggagguugauaac

SEQ ID NO: 2493111 - RNA, 19 nt, Human
auuuuucuggagguugaua

SEQ ID NO: 2493112 - RNA, 16 nt, Human
auuuuucugcacugag

SEQ ID NO: 2493113 - RNA, 15 nt, Human
auuuuucugcacuga

SEQ ID NO: 2493114 - RNA, 22 nt, Human
auuuuucuggagguugauaacu

SEQ ID NO: 2493115 - RNA, 17 nt, Human
auuuuugaauguaguaa

SEQ ID NO: 2493116 - RNA, 21 nt, Human
auuuuucaauaaagcauuuau

SEQ ID NO: 2493117 - RNA, 16 nt, Human
auuuuucaauaaagca

SEQ ID NO: 2493118 - RNA, 17 nt, Human
auuuuucaauaaagcau

SEQ ID NO: 2493119 - RNA, 21 nt, Human
auuuuguuuuugucuuaaaaa

SEQ ID NO: 2493120 - RNA, 19 nt, Human
auuuuguuugguauuguau

SEQ ID NO: 2493121 - RNA, 18 nt, Human
auuuuguuugguauugua

SEQ ID NO: 2493122 - RNA, 17 nt, Human
auuuuguuugguauugu

SEQ ID NO: 2493123 - RNA, 14 nt, Human
auuuuguuugguau

SEQ ID NO: 2493124 - RNA, 14 nt, Human
auuuuguuuugcuu

SEQ ID NO: 2493125 - RNA, 22 nt, Human
auuuuguuugguauuguauuua

SEQ ID NO: 2493126 - RNA, 21 nt, Human
auuuuguuugguauuguauuu

SEQ ID NO: 2493127 - RNA, 20 nt, Human
auuuuguuugguauuguauu

SEQ ID NO: 2493128 - RNA, 22 nt, Human
auuuuguuuugcuuuuucugac

SEQ ID NO: 2493129 - RNA, 21 nt, Human
auuuuguuuugcuuuuucuga

SEQ ID NO: 2493130 - RNA, 19 nt, Human
auuuuguuuugcuuuuucu

SEQ ID NO: 2493131 - RNA, 18 nt, Human
auuuuguuuugcuuuuuc

SEQ ID NO: 2493132 - RNA, 24 nt, Human
auuuuguuuugcuuuuucugacuc

SEQ ID NO: 2493133 - RNA, 23 nt, Human
auuuuguuuugcuuuuucugacu

SEQ ID NO: 2493134 - RNA, 14 nt, Human
auuuuucugcacug

SEQ ID NO: 2493135 - RNA, 12 nt, Human
auuuuucugcac

SEQ ID NO: 2493136 - RNA, 17 nt, Human
auuuuucucaaaguuuu

SEQ ID NO: 2493137 - RNA, 12 nt, Human
auuuuucucaug

SEQ ID NO: 2493138 - RNA, 21 nt, Human
auuuuucuuagggaaggauac

SEQ ID NO: 2493139 - RNA, 17 nt, Human
auuuuucuaaaaaaaga

SEQ ID NO: 2493140 - RNA, 12 nt, Human
auuuuucuaaaa

SEQ ID NO: 2493141 - RNA, 21 nt, Human
auuuuucucaaaguuuugaaa

SEQ ID NO: 2493142 - RNA, 10 nt, Human
auuuuuccua

SEQ ID NO: 2493143 - RNA, 20 nt, Human
auuuuuccuccacugaacua

SEQ ID NO: 2493144 - RNA, 22 nt, Human
auuuuucauugauaugaaaaau

SEQ ID NO: 2493145 - RNA, 19 nt, Human
auuuuucaugauuuugaaa

SEQ ID NO: 2493146 - RNA, 18 nt, Human
auuuuucauauugugcca

SEQ ID NO: 2493147 - RNA, 13 nt, Human
auuuuucauauug

SEQ ID NO: 2493148 - RNA, 15 nt, Human
auuuuuccaaaauaa

SEQ ID NO: 2493149 - RNA, 19 nt, Human
auuuuucauauugugccaa

SEQ ID NO: 2493150 - RNA, 19 nt, Human
auuuuucauugauaugaaa

SEQ ID NO: 2493151 - RNA, 16 nt, Human
auuuuucagauauaaa

SEQ ID NO: 2493152 - RNA, 18 nt, Human
auuuuucagaugcuucug

SEQ ID NO: 2493153 - RNA, 14 nt, Human
auuuuucagaugcu

SEQ ID NO: 2493154 - RNA, 15 nt, Human
auuuuucagaugcuu

SEQ ID NO: 2493155 - RNA, 20 nt, Human
auuuuguugcuuuugugaac

SEQ ID NO: 2493156 - RNA, 15 nt, Human
auuuuguuuaaauua

SEQ ID NO: 2493157 - RNA, 19 nt, Human
auuuuguugcuuuugugaa

SEQ ID NO: 2493158 - RNA, 18 nt, Human
auuuuguucuaguuuuca

SEQ ID NO: 2493159 - RNA, 23 nt, Human
auuuuguugcuguuuugauuugu

SEQ ID NO: 2493160 - RNA, 19 nt, Human
auuuuguugcuguuuugau

SEQ ID NO: 2493161 - RNA, 17 nt, Human
auuuuguguuuaggaac

SEQ ID NO: 2493162 - RNA, 20 nt, Human
auuuuguggcuuucuuucuu

SEQ ID NO: 2493163 - RNA, 19 nt, Human
auuuugugauauggagccc

SEQ ID NO: 2493164 - RNA, 19 nt, Human
auuuugugcccccauguaa

SEQ ID NO: 2493165 - RNA, 12 nt, Human
auuuugucuaaa

SEQ ID NO: 2493166 - RNA, 14 nt, Human
auuuugucgaauuu

SEQ ID NO: 2493167 - RNA, 22 nt, Human
auuuuguauuuuccaagugugc

SEQ ID NO: 2493168 - RNA, 16 nt, Human
auuuugucuaaaaugc

SEQ ID NO: 2493169 - RNA, 13 nt, Human
auuuugucuaaaa

SEQ ID NO: 2493170 - RNA, 21 nt, Human
auuuugucuaaaaugccucag

SEQ ID NO: 2493171 - RNA, 23 nt, Human
auuuugucauauaagauucauau

SEQ ID NO: 2493172 - RNA, 21 nt, Human
auuuugugaagacugggaagu

SEQ ID NO: 2493173 - RNA, 15 nt, Human
auuuugugaauggau

SEQ ID NO: 2493174 - RNA, 13 nt, Human
auuuugugaaugg

SEQ ID NO: 2493175 - RNA, 12 nt, Human
auuuugugaaug

SEQ ID NO: 2493176 - RNA, 14 nt, Human
auuuuggaaaauaa

SEQ ID NO: 2493177 - RNA, 19 nt, Human
auuuuggaaaauaaauuau

SEQ ID NO: 2493178 - RNA, 23 nt, Human
auuuuggaaagcuccuagcagag

SEQ ID NO: 2493179 - RNA, 20 nt, Human
auuuuggaaaauaaauuauu

SEQ ID NO: 2493180 - RNA, 18 nt, Human
auuuugcuuugugauuuu

SEQ ID NO: 2493181 - RNA, 20 nt, Human
auuuugcuuugugauuuuug

SEQ ID NO: 2493182 - RNA, 12 nt, Human
auuuugcuuugu

SEQ ID NO: 2493183 - RNA, 23 nt, Human
auuuugcuauuguaaauauguuu

SEQ ID NO: 2493184 - RNA, 12 nt, Human
auuuugcuguau

SEQ ID NO: 2493185 - RNA, 14 nt, Human
auuuugcuguauau

SEQ ID NO: 2493186 - RNA, 20 nt, Human
auuuugcuguagaagauggc

SEQ ID NO: 2493187 - RNA, 20 nt, Human
auuuuguauuuuccaagugu

SEQ ID NO: 2493188 - RNA, 16 nt, Human
auuuuguauuuuccaa

SEQ ID NO: 2493189 - RNA, 15 nt, Human
auuuuguauuuucca

SEQ ID NO: 2493190 - RNA, 12 nt, Human
auuuuguauuuu

SEQ ID NO: 2493191 - RNA, 19 nt, Human
auuuuguauuguuucaauu

SEQ ID NO: 2493192 - RNA, 10 nt, Human
auuuuguauu

SEQ ID NO: 2493193 - RNA, 14 nt, Human
auuuuguauauauc

SEQ ID NO: 2493194 - RNA, 20 nt, Human
auuuuguauaauuguaucgu

SEQ ID NO: 2493195 - RNA, 17 nt, Human
auuuuguauaauuguau

SEQ ID NO: 2493196 - RNA, 22 nt, Human
auuuuguaauuauugugauuuc

SEQ ID NO: 2493197 - RNA, 20 nt, Human
auuuuguacaaauuuguuau

SEQ ID NO: 2493198 - RNA, 23 nt, Human
auuuuguaucugcaggcagacac

SEQ ID NO: 2493199 - RNA, 21 nt, Human
auuuuguaucugcaggcagac

SEQ ID NO: 2493200 - RNA, 15 nt, Human
auuuuguaucugcag

SEQ ID NO: 2493201 - RNA, 14 nt, Human
auuuuguaucugca

SEQ ID NO: 2493202 - RNA, 13 nt, Human
auuuuguaucugc

SEQ ID NO: 2493203 - RNA, 18 nt, Human
auuuuguaacgaagacac

SEQ ID NO: 2493204 - RNA, 19 nt, Human
auuuuguaacgaagacaca

SEQ ID NO: 2493205 - RNA, 17 nt, Human
auuuuguaacuuucucu

SEQ ID NO: 2493206 - RNA, 19 nt, Human
auuuuguaaacucaaaaua

SEQ ID NO: 2493207 - RNA, 20 nt, Human
auuuuggaaguuuucaggac

SEQ ID NO: 2493208 - RNA, 20 nt, Human
auuuuguaaacucaaaauau

SEQ ID NO: 2493209 - RNA, 21 nt, Human
auuuuguaauuauugugauuu

SEQ ID NO: 2493210 - RNA, 16 nt, Human
auuuuguaauuauugu

SEQ ID NO: 2493211 - RNA, 21 nt, Human
auuuugcugucccuuuuccuu

SEQ ID NO: 2493212 - RNA, 22 nt, Human
auuuugcuauuguaaauauguu

SEQ ID NO: 2493213 - RNA, 21 nt, Human
auuuugcuauuguaaauaugu

SEQ ID NO: 2493214 - RNA, 14 nt, Human
auuuugcuggaaua

SEQ ID NO: 2493215 - RNA, 19 nt, Human
auuuugcuauuguaaauau

SEQ ID NO: 2493216 - RNA, 17 nt, Human
auuuugcuauuguaaau

SEQ ID NO: 2493217 - RNA, 13 nt, Human
auuuugccugugu

SEQ ID NO: 2493218 - RNA, 21 nt, Human
auuuugccucuuuucucugug

SEQ ID NO: 2493219 - RNA, 22 nt, Human
auuuugcccuuccauagccuaa

SEQ ID NO: 2493220 - RNA, 18 nt, Human
auuuugccucuuuucucu

SEQ ID NO: 2493221 - RNA, 20 nt, Human
auuuugcuaaaugugaauga

SEQ ID NO: 2493222 - RNA, 15 nt, Human
auuuugcccuugaca

SEQ ID NO: 2493223 - RNA, 23 nt, Human
auuuugcccuugacaaagucaag

SEQ ID NO: 2493224 - RNA, 18 nt, Human
auuuugccagugggaacu

SEQ ID NO: 2493225 - RNA, 15 nt, Human
auuuugcauucaaau

SEQ ID NO: 2493226 - RNA, 16 nt, Human
auuuugcauuugaaua

SEQ ID NO: 2493227 - RNA, 12 nt, Human
auuuugcagcag

SEQ ID NO: 2493228 - RNA, 14 nt, Human
auuuugcagcagug

SEQ ID NO: 2493229 - RNA, 15 nt, Human
auuuugcagcaguga

SEQ ID NO: 2493230 - RNA, 16 nt, Human
auuuugcagcagugag

SEQ ID NO: 2493231 - RNA, 14 nt, Human
auuuugcauucaaa

SEQ ID NO: 2493232 - RNA, 17 nt, Human
auuuugauguuuuaagg

SEQ ID NO: 2493233 - RNA, 22 nt, Human
auuuugauuauuguauuuauuc

SEQ ID NO: 2493234 - RNA, 18 nt, Human
auuuugauuauuguauuu

SEQ ID NO: 2493235 - RNA, 16 nt, Human
auuuugauuauuguau

SEQ ID NO: 2493236 - RNA, 14 nt, Human
auuuugauuauugu

SEQ ID NO: 2493237 - RNA, 14 nt, Human
auuuugcaaaauuu

SEQ ID NO: 2493238 - RNA, 15 nt, Human
auuuugcaaaauuuc

SEQ ID NO: 2493239 - RNA, 18 nt, Human
auuuugcaaaauuuccag

SEQ ID NO: 2493240 - RNA, 19 nt, Human
auuuugcaaaauuuccagu

SEQ ID NO: 2493241 - RNA, 15 nt, Human
auuuugauguuuuaa

SEQ ID NO: 2493242 - RNA, 23 nt, Human
auuuuccuggugccaauuucaag

SEQ ID NO: 2493243 - RNA, 19 nt, Human
auuuugauccaagcugguc

SEQ ID NO: 2493244 - RNA, 14 nt, Human
auuuugaugaacaa

SEQ ID NO: 2493245 - RNA, 12 nt, Human
auuuuccuugaa

SEQ ID NO: 2493246 - RNA, 14 nt, Human
auuuucuauaauuu

SEQ ID NO: 2493247 - RNA, 15 nt, Human
auuuucuauaauuua

SEQ ID NO: 2493248 - RNA, 18 nt, Human
auuuuccuggugccaauu

SEQ ID NO: 2493249 - RNA, 22 nt, Human
auuuuccuggugccaauuucaa

SEQ ID NO: 2493250 - RNA, 22 nt, Human
auuuucccccuuuucugcauuu

SEQ ID NO: 2493251 - RNA, 13 nt, Human
auuuucccugcua

SEQ ID NO: 2493252 - RNA, 16 nt, Human
auuuuccugccaggca

SEQ ID NO: 2493253 - RNA, 14 nt, Human
auuuuccugaaaac

SEQ ID NO: 2493254 - RNA, 19 nt, Human
auuuucccuauuagagaag

SEQ ID NO: 2493255 - RNA, 20 nt, Human
auuuucccccuuuucugcau

SEQ ID NO: 2493256 - RNA, 22 nt, Human
auuuuccccccacucuccccac

SEQ ID NO: 2493257 - RNA, 20 nt, Human
auuuuccccccacucucccc

SEQ ID NO: 2493258 - RNA, 21 nt, Human
auuuuccccccacucucccca

SEQ ID NO: 2493259 - RNA, 17 nt, Human
auuuucccacugcaccc

SEQ ID NO: 2493260 - RNA, 14 nt, Human
auuuucccacugca

SEQ ID NO: 2493261 - RNA, 14 nt, Human
auuuuccccccacu

SEQ ID NO: 2493262 - RNA, 15 nt, Human
auuuuccccccacuc

SEQ ID NO: 2493263 - RNA, 12 nt, Human
auuuuaauaaug

SEQ ID NO: 2493264 - RNA, 21 nt, Human
auuuuccauuuuuauuucaaa

SEQ ID NO: 2493265 - RNA, 13 nt, Human
auuuuaauaauau

SEQ ID NO: 2493266 - RNA, 15 nt, Human
auuuuccaugaaaau

SEQ ID NO: 2493267 - RNA, 17 nt, Human
auuuuaauaaacacucu

SEQ ID NO: 2493268 - RNA, 16 nt, Human
auuuuaauaaacacuc

SEQ ID NO: 2493269 - RNA, 15 nt, Human
auuuuaauaaacacu

SEQ ID NO: 2493270 - RNA, 20 nt, Human
auuuuaagugcuuuguaaug

SEQ ID NO: 2493271 - RNA, 19 nt, Human
auuuuaacuuuaucacauu

SEQ ID NO: 2493272 - RNA, 15 nt, Human
auuuuaacuuuauca

SEQ ID NO: 2493273 - RNA, 17 nt, Human
auuuuaacuuuaucaca

SEQ ID NO: 2493274 - RNA, 19 nt, Human
auuuuaagacguguuugug

SEQ ID NO: 2493275 - RNA, 17 nt, Human
auuuaaacccauuuuag

SEQ ID NO: 2493276 - RNA, 15 nt, Human
auuuaaacccauuuu

SEQ ID NO: 2493277 - RNA, 14 nt, Human
auuuaaacccauuu

SEQ ID NO: 2493278 - RNA, 13 nt, Human
auuuaaacccauu

SEQ ID NO: 2493279 - RNA, 20 nt, Human
auuuaaacccauuuuaguca

SEQ ID NO: 2493280 - RNA, 18 nt, Human
auuuaaacccauuuuagu

SEQ ID NO: 2493281 - RNA, 19 nt, Human
auuuaaagaacacccuaua

SEQ ID NO: 2493282 - RNA, 13 nt, Human
auuuauuuaaaag

SEQ ID NO: 2493283 - RNA, 22 nt, Human
auuuauuguuuauuuaucagug

SEQ ID NO: 2493284 - RNA, 16 nt, Human
auuuaaagacaaagac

SEQ ID NO: 2493285 - RNA, 14 nt, Human
auuuaaaagauaca

SEQ ID NO: 2493286 - RNA, 16 nt, Human
auuuaaaagauacagu

SEQ ID NO: 2493287 - RNA, 13 nt, Human
auuuaaaagauuc

SEQ ID NO: 2493288 - RNA, 22 nt, Human
auuguuuuaaaaagaaacaaga

SEQ ID NO: 2493289 - RNA, 17 nt, Human
auuuaaaagauacaguu

SEQ ID NO: 2493290 - RNA, 23 nt, Human
auuguuuuaaaaagaaacaagau

SEQ ID NO: 2493291 - RNA, 14 nt, Human
auuguuuuaaaaag

SEQ ID NO: 2493292 - RNA, 21 nt, Human
auuguuugucuuuaacuguca

SEQ ID NO: 2493293 - RNA, 13 nt, Human
auuuaaaagauac

SEQ ID NO: 2493294 - RNA, 21 nt, Human
auuguuuggggaugagaaagg

SEQ ID NO: 2493295 - RNA, 19 nt, Human
auugugguacaaucucaaa

SEQ ID NO: 2493296 - RNA, 20 nt, Human
auugugggucuauuucuagu

SEQ ID NO: 2493297 - RNA, 18 nt, Human
auugugguacaaucucaa

SEQ ID NO: 2493298 - RNA, 16 nt, Human
auuguuugucuuuaac

SEQ ID NO: 2493299 - RNA, 20 nt, Human
auuguuugucugucuucaua

SEQ ID NO: 2493300 - RNA, 14 nt, Human
auugugggaagggg

SEQ ID NO: 2493301 - RNA, 21 nt, Human
auuguggggaugaugaaauaa

SEQ ID NO: 2493302 - RNA, 20 nt, Human
auuguggggaugaugaaaua

SEQ ID NO: 2493303 - RNA, 17 nt, Human
auuguggcugucagcag

SEQ ID NO: 2493304 - RNA, 18 nt, Human
auuguggcugucagcagg

SEQ ID NO: 2493305 - RNA, 19 nt, Human
auuguggcugucagcagga

SEQ ID NO: 2493306 - RNA, 13 nt, Human
auugugggaaggg

SEQ ID NO: 2493307 - RNA, 20 nt, Human
auuguggcuccuaucugugu

SEQ ID NO: 2493308 - RNA, 19 nt, Human
auuguggcuccuaucugug

SEQ ID NO: 2493309 - RNA, 12 nt, Human
auuguggcuccu

SEQ ID NO: 2493310 - RNA, 17 nt, Human
auugucccucugcccca

SEQ ID NO: 2493311 - RNA, 23 nt, Human
auugucccucugccccauccucc

SEQ ID NO: 2493312 - RNA, 15 nt, Human
auugucauuccugua

SEQ ID NO: 2493313 - RNA, 12 nt, Human
auugucccucug

SEQ ID NO: 2493314 - RNA, 15 nt, Human
auugucauuaaaggu

SEQ ID NO: 2493315 - RNA, 13 nt, Human
auugucauuaaag

SEQ ID NO: 2493316 - RNA, 15 nt, Human
auugucaucaggaga

SEQ ID NO: 2493317 - RNA, 19 nt, Human
auugucagcuacuaaugau

SEQ ID NO: 2493318 - RNA, 13 nt, Human
auugucuagugaa

SEQ ID NO: 2493319 - RNA, 16 nt, Human
auugucaaagugguga

SEQ ID NO: 2493320 - RNA, 23 nt, Human
auugucaaaguggugagaggcau

SEQ ID NO: 2493321 - RNA, 22 nt, Human
auuguaccuuuuaacaccugau

SEQ ID NO: 2493322 - RNA, 19 nt, Human
auugucagaguucugcucu

SEQ ID NO: 2493323 - RNA, 14 nt, Human
auugucagauauuu

SEQ ID NO: 2493324 - RNA, 23 nt, Human
auugucagauauuuuuucagaaa

SEQ ID NO: 2493325 - RNA, 13 nt, Human
auugucagcuacu

SEQ ID NO: 2493326 - RNA, 17 nt, Human
auuguaccuuuuaacac

SEQ ID NO: 2493327 - RNA, 16 nt, Human
auuguaccuuuuaaca

SEQ ID NO: 2493328 - RNA, 15 nt, Human
auuguaccuuuuaac

SEQ ID NO: 2493329 - RNA, 14 nt, Human
auuguaccuuuuaa

SEQ ID NO: 2493330 - RNA, 19 nt, Human
auuguaccucucuuauaga

SEQ ID NO: 2493331 - RNA, 18 nt, Human
auuguaccucucuuauag

SEQ ID NO: 2493332 - RNA, 20 nt, Human
auuguacauauuuguggaau

SEQ ID NO: 2493333 - RNA, 15 nt, Human
auuguacauauuugu

SEQ ID NO: 2493334 - RNA, 12 nt, Human
auuguaccucuc

SEQ ID NO: 2493335 - RNA, 21 nt, Human
auuguacaguuuuuauugcuu

SEQ ID NO: 2493336 - RNA, 23 nt, Human
auuguaaaaaaaaaugccuuuga

SEQ ID NO: 2493337 - RNA, 13 nt, Human
auuguacaguuuu

SEQ ID NO: 2493338 - RNA, 22 nt, Human
auuguaaaaaaaaaugccuuug

SEQ ID NO: 2493339 - RNA, 21 nt, Human
auuguaaaaaaaaaugccuuu

SEQ ID NO: 2493340 - RNA, 20 nt, Human
auuguaaaaaaaaaugccuu

SEQ ID NO: 2493341 - RNA, 17 nt, Human
auuguaaaaaaaaaugc

SEQ ID NO: 2493342 - RNA, 15 nt, Human
auuguacaguuuuua

SEQ ID NO: 2493343 - RNA, 14 nt, Human
auuguacaguuuuu

SEQ ID NO: 2493344 - RNA, 21 nt, Human
auuuaaagacagggaagagca

SEQ ID NO: 2493345 - RNA, 22 nt, Human
auuggaggguaaaugauguggu

SEQ ID NO: 2493346 - RNA, 23 nt, Human
auuggagggugggagagcccagc

SEQ ID NO: 2493347 - RNA, 23 nt, Human
auuggaggaaagcaaccggugga

SEQ ID NO: 2493348 - RNA, 15 nt, Human
auuggaggaaagcaa

SEQ ID NO: 2493349 - RNA, 22 nt, Human
auuggagggugggagagcccag

SEQ ID NO: 2493350 - RNA, 19 nt, Human
auuggagcucgugggacag

SEQ ID NO: 2493351 - RNA, 14 nt, Human
auuggacccuucca

SEQ ID NO: 2493352 - RNA, 17 nt, Human
auuggacauuuucuuca

SEQ ID NO: 2493353 - RNA, 19 nt, Human
auuggacaguaaaauccac

SEQ ID NO: 2493354 - RNA, 20 nt, Human
auugcuuuuucuaauguggu

SEQ ID NO: 2493355 - RNA, 15 nt, Human
auugcuuuuucuaau

SEQ ID NO: 2493356 - RNA, 14 nt, Human
auuggaauuaaccu

SEQ ID NO: 2493357 - RNA, 12 nt, Human
auuggaauuaac

SEQ ID NO: 2493358 - RNA, 15 nt, Human
auuggaauuaaccug

SEQ ID NO: 2493359 - RNA, 16 nt, Human
auuggaauuaaccugg

SEQ ID NO: 2493360 - RNA, 19 nt, Human
auuggaauuaaccuggugc

SEQ ID NO: 2493361 - RNA, 20 nt, Human
auuggaauuaaccuggugcu

SEQ ID NO: 2493362 - RNA, 21 nt, Human
auugcuuugauuaauccagaa

SEQ ID NO: 2493363 - RNA, 12 nt, Human
auugcuuugagc

SEQ ID NO: 2493364 - RNA, 14 nt, Human
auugcuuuggucau

SEQ ID NO: 2493365 - RNA, 21 nt, Human
auugauuuccguuaaaauacc

SEQ ID NO: 2493366 - RNA, 18 nt, Human
auugcuuuggucauauga

SEQ ID NO: 2493367 - RNA, 13 nt, Human
auugauuucaaga

SEQ ID NO: 2493368 - RNA, 16 nt, Human
auugauuucaagaccu

SEQ ID NO: 2493369 - RNA, 22 nt, Human
auugauuauucugauuccacuu

SEQ ID NO: 2493370 - RNA, 13 nt, Human
auugacuuuuuau

SEQ ID NO: 2493371 - RNA, 20 nt, Human
auugauuauuacuggcaaaa

SEQ ID NO: 2493372 - RNA, 12 nt, Human
auugauuagaaa

SEQ ID NO: 2493373 - RNA, 16 nt, Human
auugacuucgacugug

SEQ ID NO: 2493374 - RNA, 20 nt, Human
auuggcaccuaauccaggca

SEQ ID NO: 2493375 - RNA, 11 nt, Human
auuggcagcag

SEQ ID NO: 2493376 - RNA, 12 nt, Human
auuggcagcaga

SEQ ID NO: 2493377 - RNA, 18 nt, Human
auuggauuauuuaauaac

SEQ ID NO: 2493378 - RNA, 17 nt, Human
auuggauuauuuaauaa

SEQ ID NO: 2493379 - RNA, 16 nt, Human
auuggauuauuuaaua

SEQ ID NO: 2493380 - RNA, 14 nt, Human
auuggauuauuuaa

SEQ ID NO: 2493381 - RNA, 22 nt, Human
auuggauuauucauuuaaaaug

SEQ ID NO: 2493382 - RNA, 21 nt, Human
auuggauuauucauuuaaaau

SEQ ID NO: 2493383 - RNA, 19 nt, Human
auuggauuauucauuuaaa

SEQ ID NO: 2493384 - RNA, 18 nt, Human
auuggauuauucauuuaa

SEQ ID NO: 2493385 - RNA, 19 nt, Human
auuggauucugagagcugu

SEQ ID NO: 2493386 - RNA, 22 nt, Human
auuggauucugagagcugugca

SEQ ID NO: 2493387 - RNA, 20 nt, Human
auuggauuauuuaauaacau

SEQ ID NO: 2493388 - RNA, 19 nt, Human
auuggauuauuuaauaaca

SEQ ID NO: 2493389 - RNA, 22 nt, Human
auuggauuauuuaauaacauua

SEQ ID NO: 2493390 - RNA, 17 nt, Human
auugguaucaagaaagu

SEQ ID NO: 2493391 - RNA, 18 nt, Human
auugguauucacuaaucu

SEQ ID NO: 2493392 - RNA, 18 nt, Human
auugguaucaagaaaguc

SEQ ID NO: 2493393 - RNA, 14 nt, Human
auugguccagcuug

SEQ ID NO: 2493394 - RNA, 15 nt, Human
auugguccagcuugc

SEQ ID NO: 2493395 - RNA, 16 nt, Human
auugguucuuguauua

SEQ ID NO: 2493396 - RNA, 15 nt, Human
auugguucuuguauu

SEQ ID NO: 2493397 - RNA, 18 nt, Human
auugggagcuugggaaug

SEQ ID NO: 2493398 - RNA, 23 nt, Human
auuggguggggggcuucauacac

SEQ ID NO: 2493399 - RNA, 17 nt, Human
auugggacuggggcuga

SEQ ID NO: 2493400 - RNA, 20 nt, Human
auugggaauaaauaugccuc

SEQ ID NO: 2493401 - RNA, 17 nt, Human
auugggaauaaauaugc

SEQ ID NO: 2493402 - RNA, 16 nt, Human
auugggaauaaauaug

SEQ ID NO: 2493403 - RNA, 15 nt, Human
auugggaauaaauau

SEQ ID NO: 2493404 - RNA, 13 nt, Human
auugggaaaucuu

SEQ ID NO: 2493405 - RNA, 20 nt, Human
auugggaaggggacccccgc

SEQ ID NO: 2493406 - RNA, 16 nt, Human
auugguaacauccuuu

SEQ ID NO: 2493407 - RNA, 15 nt, Human
auugguaacauccuu

SEQ ID NO: 2493408 - RNA, 18 nt, Human
auugguaaagaauggaag

SEQ ID NO: 2493409 - RNA, 17 nt, Human
auuggguuaugaauauu

SEQ ID NO: 2493410 - RNA, 13 nt, Human
auuggguuaugaa

SEQ ID NO: 2493411 - RNA, 18 nt, Human
auuggguggguaaauuca

SEQ ID NO: 2493412 - RNA, 13 nt, Human
auuggguucauua

SEQ ID NO: 2493413 - RNA, 23 nt, Human
auuucccguggccccagccuggc

SEQ ID NO: 2493414 - RNA, 21 nt, Human
auuucccguggccccagccug

SEQ ID NO: 2493415 - RNA, 20 nt, Human
auuucccguggccccagccu

SEQ ID NO: 2493416 - RNA, 22 nt, Human
auuucccguggccccagccugg

SEQ ID NO: 2493417 - RNA, 17 nt, Human
auuucccugaaggaacc

SEQ ID NO: 2493418 - RNA, 23 nt, Human
auuucccugaaggaaccaaagcg

SEQ ID NO: 2493419 - RNA, 18 nt, Human
auuucccugacuccucua

SEQ ID NO: 2493420 - RNA, 23 nt, Human
auuucuuccacaagagcccaggc

SEQ ID NO: 2493421 - RNA, 20 nt, Human
auuucuuccacaagagccca

SEQ ID NO: 2493422 - RNA, 13 nt, Human
auuugaccuacaa

SEQ ID NO: 2493423 - RNA, 18 nt, Human
auuugaaacacuuugcau

SEQ ID NO: 2493424 - RNA, 14 nt, Human
auuugaaagaaagg

SEQ ID NO: 2493425 - RNA, 11 nt, Human
auuugaaagaa

SEQ ID NO: 2493426 - RNA, 15 nt, Human
auuugaaaauuuuga

SEQ ID NO: 2493427 - RNA, 16 nt, Human
auuugaaaauuuugau

SEQ ID NO: 2493428 - RNA, 23 nt, Human
auuuauuuccuaguucuguagaa

SEQ ID NO: 2493429 - RNA, 18 nt, Human
auuuauuuccuaguucug

SEQ ID NO: 2493430 - RNA, 13 nt, Human
auuuauuuccuag

SEQ ID NO: 2493431 - RNA, 14 nt, Human
auuuauuucaucau

SEQ ID NO: 2493432 - RNA, 14 nt, Human
auuuauuuuaauaa

SEQ ID NO: 2493433 - RNA, 15 nt, Human
auuuccaaauaaaau

SEQ ID NO: 2493434 - RNA, 13 nt, Human
auuuccaaauaaa

SEQ ID NO: 2493435 - RNA, 16 nt, Human
auuuccaaagagaaaa

SEQ ID NO: 2493436 - RNA, 16 nt, Human
auuuauuuaaaagauu

SEQ ID NO: 2493437 - RNA, 14 nt, Human
auuuauuuaaaaga

SEQ ID NO: 2493438 - RNA, 20 nt, Human
auuuauuuaaaagauucauu

SEQ ID NO: 2493439 - RNA, 12 nt, Human
auuuauuuaaua

SEQ ID NO: 2493440 - RNA, 20 nt, Human
auuuauuuaauaacaauugu

SEQ ID NO: 2493441 - RNA, 13 nt, Human
auuuauuuaauaa

SEQ ID NO: 2493442 - RNA, 14 nt, Human
auuuauuuaaaugu

SEQ ID NO: 2493443 - RNA, 16 nt, Human
auuuauuuaauaacaa

SEQ ID NO: 2493444 - RNA, 14 nt, Human
auuuauuucaaaaa

SEQ ID NO: 2493445 - RNA, 12 nt, Human
auuuauuuaaau

SEQ ID NO: 2493446 - RNA, 14 nt, Human
auuuauuuaaauuu

SEQ ID NO: 2493447 - RNA, 19 nt, Human
auuucccaaagcagugcau

SEQ ID NO: 2493448 - RNA, 16 nt, Human
auuuccaagagcugag

SEQ ID NO: 2493449 - RNA, 17 nt, Human
auuuccaaaugaaugac

SEQ ID NO: 2493450 - RNA, 13 nt, Human
auuuccaaaugaa

SEQ ID NO: 2493451 - RNA, 18 nt, Human
auuuccaaauaaaaugag

SEQ ID NO: 2493452 - RNA, 17 nt, Human
auuuccaaauaaaauga

SEQ ID NO: 2493453 - RNA, 20 nt, Human
auuuccaacaccacagacac

SEQ ID NO: 2493454 - RNA, 19 nt, Human
auuuccaacaccacagaca

SEQ ID NO: 2493455 - RNA, 17 nt, Human
auuuccaaauucacaag

SEQ ID NO: 2493456 - RNA, 22 nt, Human
auuuccaacaccacagacacac

SEQ ID NO: 2493457 - RNA, 21 nt, Human
auuuccaacaccacagacaca

SEQ ID NO: 2493458 - RNA, 23 nt, Human
auuuccaacaccacagacacaca

SEQ ID NO: 2493459 - RNA, 15 nt, Human
auuuccaagagcuga

SEQ ID NO: 2493460 - RNA, 17 nt, Human
auuucccaauuaggaag

SEQ ID NO: 2493461 - RNA, 12 nt, Human
auuucccaggac

SEQ ID NO: 2493462 - RNA, 13 nt, Human
auuucccaggacc

SEQ ID NO: 2493463 - RNA, 20 nt, Human
auuucccagcacaugaaacc

SEQ ID NO: 2493464 - RNA, 23 nt, Human
auuucccacaccguguaaaccaa

SEQ ID NO: 2493465 - RNA, 14 nt, Human
auuuccacaccaag

SEQ ID NO: 2493466 - RNA, 18 nt, Human
auuucccaauuaggaagu

SEQ ID NO: 2493467 - RNA, 14 nt, Human
auuucccaggaccc

SEQ ID NO: 2493468 - RNA, 16 nt, Human
auuucccaggacccug

SEQ ID NO: 2493469 - RNA, 19 nt, Human
auuucccaggacccugaag

SEQ ID NO: 2493470 - RNA, 21 nt, Human
auuucccaggcugaauuggga

SEQ ID NO: 2493471 - RNA, 15 nt, Human
auuucccaggguuaa

SEQ ID NO: 2493472 - RNA, 15 nt, Human
auuucccguggcccc

SEQ ID NO: 2493473 - RNA, 19 nt, Human
auuucccguggccccagcc

SEQ ID NO: 2493474 - RNA, 18 nt, Human
auuucccguggccccagc

SEQ ID NO: 2493475 - RNA, 16 nt, Human
auuucccguggcccca

SEQ ID NO: 2493476 - RNA, 14 nt, Human
auuuguauaaaaua

SEQ ID NO: 2493477 - RNA, 22 nt, Human
auuuguaguguuggagaagaac

SEQ ID NO: 2493478 - RNA, 22 nt, Human
auuuguaaguuuaugucuaaag

SEQ ID NO: 2493479 - RNA, 14 nt, Human
auuuguaaguuuau

SEQ ID NO: 2493480 - RNA, 20 nt, Human
auuuguaaccucagcucugg

SEQ ID NO: 2493481 - RNA, 21 nt, Human
auuuguaaccucagcucuggg

SEQ ID NO: 2493482 - RNA, 19 nt, Human
auuuguaaccucagcucug

SEQ ID NO: 2493483 - RNA, 17 nt, Human
auuuguaaccucagcuc

SEQ ID NO: 2493484 - RNA, 19 nt, Human
auuuguaguguuggagaag

SEQ ID NO: 2493485 - RNA, 17 nt, Human
auuuguaaguuucaggu

SEQ ID NO: 2493486 - RNA, 15 nt, Human
auuuguaaguuucag

SEQ ID NO: 2493487 - RNA, 14 nt, Human
auuuguaaguuuca

SEQ ID NO: 2493488 - RNA, 23 nt, Human
auuuguaaguuuaugucuaaaga

SEQ ID NO: 2493489 - RNA, 21 nt, Human
auuuguauuuuuuugcaagug

SEQ ID NO: 2493490 - RNA, 17 nt, Human
auuuguauuuuuuugca

SEQ ID NO: 2493491 - RNA, 21 nt, Human
auuuguaaguuucaggugaca

SEQ ID NO: 2493492 - RNA, 18 nt, Human
auuuguaaguuucaggug

SEQ ID NO: 2493493 - RNA, 14 nt, Human
auuugucaaugaca

SEQ ID NO: 2493494 - RNA, 17 nt, Human
auuugucaaugacaguu

SEQ ID NO: 2493495 - RNA, 13 nt, Human
auuugucaacaaa

SEQ ID NO: 2493496 - RNA, 15 nt, Human
auuugucaacaaagu

SEQ ID NO: 2493497 - RNA, 21 nt, Human
auuugggccugcuccagaccu

SEQ ID NO: 2493498 - RNA, 22 nt, Human
auuugggccugcuccagaccug

SEQ ID NO: 2493499 - RNA, 23 nt, Human
auuugggccugcuccagaccuga

SEQ ID NO: 2493500 - RNA, 19 nt, Human
auuugggagacaugugaca

SEQ ID NO: 2493501 - RNA, 19 nt, Human
auuugggccugcuccagac

SEQ ID NO: 2493502 - RNA, 17 nt, Human
auuugggagacauguga

SEQ ID NO: 2493503 - RNA, 18 nt, Human
auuuguaaauuuauguga

SEQ ID NO: 2493504 - RNA, 16 nt, Human
auuuguaaccucagcu

SEQ ID NO: 2493505 - RNA, 19 nt, Human
auuuguaaauuuaugugau

SEQ ID NO: 2493506 - RNA, 19 nt, Human
auuugacuguuuuuaccca

SEQ ID NO: 2493507 - RNA, 19 nt, Human
auuuggcauuuauuuguga

SEQ ID NO: 2493508 - RNA, 14 nt, Human
auuugacugaagau

SEQ ID NO: 2493509 - RNA, 23 nt, Human
auuugacaaaauuuguugaaauu

SEQ ID NO: 2493510 - RNA, 18 nt, Human
auuugacuguuuuuaccc

SEQ ID NO: 2493511 - RNA, 17 nt, Human
auuugacuguuuuuacc

SEQ ID NO: 2493512 - RNA, 13 nt, Human
auuugacuguuuu

SEQ ID NO: 2493513 - RNA, 14 nt, Human
auuugggaagugaa

SEQ ID NO: 2493514 - RNA, 18 nt, Human
auuugggaagugaagacu

SEQ ID NO: 2493515 - RNA, 16 nt, Human
auuuggccugcacuaa

SEQ ID NO: 2493516 - RNA, 19 nt, Human
auuuggccugcacuaauuu

SEQ ID NO: 2493517 - RNA, 23 nt, Human
auuuuaaaagaaugauuaugaau

SEQ ID NO: 2493518 - RNA, 23 nt, Human
auuuuaaaaauguuaaaauguau

SEQ ID NO: 2493519 - RNA, 14 nt, Human
auuuuaaaaaugaa

SEQ ID NO: 2493520 - RNA, 17 nt, Human
auuuuaaaaaugaaauu

SEQ ID NO: 2493521 - RNA, 20 nt, Human
auuuuaaaagauaaauauua

SEQ ID NO: 2493522 - RNA, 20 nt, Human
auuuuaaaagaugcaaugua

SEQ ID NO: 2493523 - RNA, 14 nt, Human
auuuuaaaaugaga

SEQ ID NO: 2493524 - RNA, 14 nt, Human
auuuuaacaauaac

SEQ ID NO: 2493525 - RNA, 15 nt, Human
auuuuaacaauaacu

SEQ ID NO: 2493526 - RNA, 16 nt, Human
auuuuaacaauaacua

SEQ ID NO: 2493527 - RNA, 16 nt, Human
auuuuaacucugucuu

SEQ ID NO: 2493528 - RNA, 15 nt, Human
auuuuaacucugucu

SEQ ID NO: 2493529 - RNA, 13 nt, Human
auuuuaacucugu

SEQ ID NO: 2493530 - RNA, 14 nt, Human
auuuuaacucuguc

SEQ ID NO: 2493531 - RNA, 13 nt, Human
auuuuaacucaua

SEQ ID NO: 2493532 - RNA, 22 nt, Human
auuuuaacaauaacuacugugu

SEQ ID NO: 2493533 - RNA, 22 nt, Human
auuuuaaccuaugauauuuucu

SEQ ID NO: 2493534 - RNA, 16 nt, Human
auuuuaaccaaaacau

SEQ ID NO: 2493535 - RNA, 13 nt, Human
auuuuaaaaauga

SEQ ID NO: 2493536 - RNA, 21 nt, Human
auuuuaaaaagucuucacucu

SEQ ID NO: 2493537 - RNA, 18 nt, Human
auuuuaaaaagucuucac

SEQ ID NO: 2493538 - RNA, 21 nt, Human
auuugugaacucagccaagca

SEQ ID NO: 2493539 - RNA, 20 nt, Human
auuugugaacucagccaagc

SEQ ID NO: 2493540 - RNA, 17 nt, Human
auuugugaacucagcca

SEQ ID NO: 2493541 - RNA, 16 nt, Human
auuuuaaaagaaugau

SEQ ID NO: 2493542 - RNA, 23 nt, Human
auuugugaaaugauggugaaagu

SEQ ID NO: 2493543 - RNA, 14 nt, Human
auuuuaaaaagucu

SEQ ID NO: 2493544 - RNA, 22 nt, Human
auuuuaaaaauacagauagaua

SEQ ID NO: 2493545 - RNA, 21 nt, Human
auuugugaagguggaaauaaa

SEQ ID NO: 2493546 - RNA, 18 nt, Human
auuugugaagguggaaau

SEQ ID NO: 2493547 - RNA, 15 nt, Human
auuuguccaauucuc

SEQ ID NO: 2493548 - RNA, 15 nt, Human
auuugucuuucagga

SEQ ID NO: 2493549 - RNA, 15 nt, Human
auuugucuugccuua

SEQ ID NO: 2493550 - RNA, 17 nt, Human
auuugucuauucuccag

SEQ ID NO: 2493551 - RNA, 19 nt, Human
caaugugaaaagaaaaaug

SEQ ID NO: 2493552 - RNA, 11 nt, Human
caauaugcuua

SEQ ID NO: 2493553 - RNA, 15 nt, Human
caauaugcaguucug

SEQ ID NO: 2493554 - RNA, 18 nt, Human
caauaguaauucucaggc

SEQ ID NO: 2493555 - RNA, 21 nt, Human
caauauguaaauagugcagaa

SEQ ID NO: 2493556 - RNA, 12 nt, Human
caauaugcuuac

SEQ ID NO: 2493557 - RNA, 15 nt, Human
caauauguaaauagu

SEQ ID NO: 2493558 - RNA, 15 nt, Human
caauaggcuguuccc

SEQ ID NO: 2493559 - RNA, 21 nt, Human
caauaggaaaaacugauuuuu

SEQ ID NO: 2493560 - RNA, 22 nt, Human
caauaggcagacuggguuucua

SEQ ID NO: 2493561 - RNA, 23 nt, Human
caauaggcaaaggggggaaggga

SEQ ID NO: 2493562 - RNA, 19 nt, Human
caaguguuguuuuuuaagu

SEQ ID NO: 2493563 - RNA, 11 nt, Human
caagugugugu

SEQ ID NO: 2493564 - RNA, 18 nt, Human
caaguuaaagugaauaac

SEQ ID NO: 2493565 - RNA, 20 nt, Human
caauaggaaaaacugauuuu

SEQ ID NO: 2493566 - RNA, 20 nt, Human
caagugugugcaugugugcg

SEQ ID NO: 2493567 - RNA, 17 nt, Human
caagugugugugcgugu

SEQ ID NO: 2493568 - RNA, 16 nt, Human
caaguguaaaauauuu

SEQ ID NO: 2493569 - RNA, 15 nt, Human
caaguguaaaauauu

SEQ ID NO: 2493570 - RNA, 22 nt, Human
caagugugguagggacuuaaaa

SEQ ID NO: 2493571 - RNA, 23 nt, Human
caagugugguagggacuuaaaaa

SEQ ID NO: 2493572 - RNA, 23 nt, Human
caaguguguaugugcgugugugc

SEQ ID NO: 2493573 - RNA, 11 nt, Human
caagugugugc

SEQ ID NO: 2493574 - RNA, 14 nt, Human
caagugugugcaca

SEQ ID NO: 2493575 - RNA, 19 nt, Human
caagugugugcacaugugu

SEQ ID NO: 2493576 - RNA, 20 nt, Human
caagugugugcacaugugug

SEQ ID NO: 2493577 - RNA, 21 nt, Human
caagugugugcacaugugugc

SEQ ID NO: 2493578 - RNA, 22 nt, Human
caagugugugcacaugugugcg

SEQ ID NO: 2493579 - RNA, 16 nt, Human
caagugugugcaugug

SEQ ID NO: 2493580 - RNA, 17 nt, Human
caagugugugcaugugu

SEQ ID NO: 2493581 - RNA, 22 nt, Human
caauauuaaauacagacacuaa

SEQ ID NO: 2493582 - RNA, 21 nt, Human
caauauuaaauacagacacua

SEQ ID NO: 2493583 - RNA, 17 nt, Human
caauccuagguaggguu

SEQ ID NO: 2493584 - RNA, 21 nt, Human
caauccuaauuucuccucccu

SEQ ID NO: 2493585 - RNA, 15 nt, Human
caauccuagugcuuu

SEQ ID NO: 2493586 - RNA, 14 nt, Human
caauccuauguuuu

SEQ ID NO: 2493587 - RNA, 20 nt, Human
caauccuauguuuuuguuca

SEQ ID NO: 2493588 - RNA, 20 nt, Human
caauauuaaauacagacacu

SEQ ID NO: 2493589 - RNA, 15 nt, Human
caauauuaaauacag

SEQ ID NO: 2493590 - RNA, 14 nt, Human
caauauuaaauaca

SEQ ID NO: 2493591 - RNA, 12 nt, Human
caauauuaaaua

SEQ ID NO: 2493592 - RNA, 23 nt, Human
caauauguauuguaaacaugugu

SEQ ID NO: 2493593 - RNA, 22 nt, Human
caauauguauuguaaacaugug

SEQ ID NO: 2493594 - RNA, 21 nt, Human
caauauguauuguaaacaugu

SEQ ID NO: 2493595 - RNA, 16 nt, Human
caauauguauuguaaa

SEQ ID NO: 2493596 - RNA, 15 nt, Human
caauauguauuguaa

SEQ ID NO: 2493597 - RNA, 14 nt, Human
caauauguauugua

SEQ ID NO: 2493598 - RNA, 13 nt, Human
caauauguauugu

SEQ ID NO: 2493599 - RNA, 16 nt, Human
caauauguauuaauau

SEQ ID NO: 2493600 - RNA, 22 nt, Human
caauauguauuaauauucauug

SEQ ID NO: 2493601 - RNA, 21 nt, Human
caaugaaaugaauuaaagugg

SEQ ID NO: 2493602 - RNA, 23 nt, Human
caaugaaaugaauuaaaguggac

SEQ ID NO: 2493603 - RNA, 11 nt, Human
caauccuggac

SEQ ID NO: 2493604 - RNA, 13 nt, Human
caauccugccccc

SEQ ID NO: 2493605 - RNA, 19 nt, Human
caaugaaaugaauuaaagu

SEQ ID NO: 2493606 - RNA, 19 nt, Human
caaugaaaugcucuccuuu

SEQ ID NO: 2493607 - RNA, 21 nt, Human
caaugaaaugcucuccuuucc

SEQ ID NO: 2493608 - RNA, 14 nt, Human
caauccucacuggg

SEQ ID NO: 2493609 - RNA, 16 nt, Human
caauccucacugggug

SEQ ID NO: 2493610 - RNA, 17 nt, Human
caauccucacugggugg

SEQ ID NO: 2493611 - RNA, 13 nt, Human
caauccucuaagc

SEQ ID NO: 2493612 - RNA, 12 nt, Human
caauccugcccc

SEQ ID NO: 2493613 - RNA, 11 nt, Human
caauccugccc

SEQ ID NO: 2493614 - RNA, 18 nt, Human
caauccucacuggguggg

SEQ ID NO: 2493615 - RNA, 16 nt, Human
caaugaucuagguuua

SEQ ID NO: 2493616 - RNA, 20 nt, Human
caaugauauauggauaaugc

SEQ ID NO: 2493617 - RNA, 14 nt, Human
caaugaucuagguu

SEQ ID NO: 2493618 - RNA, 20 nt, Human
caaugauaguaagaaaagug

SEQ ID NO: 2493619 - RNA, 21 nt, Human
caaugaucuagguuuaacuca

SEQ ID NO: 2493620 - RNA, 20 nt, Human
caaugaucuagguuuaacuc

SEQ ID NO: 2493621 - RNA, 18 nt, Human
caaugaucuagguuuaac

SEQ ID NO: 2493622 - RNA, 17 nt, Human
caaugaucuagguuuaa

SEQ ID NO: 2493623 - RNA, 23 nt, Human
caaugaucuagguuuaacucaga

SEQ ID NO: 2493624 - RNA, 22 nt, Human
caaugaucuagguuuaacucag

SEQ ID NO: 2493625 - RNA, 14 nt, Human
caaugaugaaugag

SEQ ID NO: 2493626 - RNA, 18 nt, Human
caaugauaguaagaaaag

SEQ ID NO: 2493627 - RNA, 19 nt, Human
caaugaggucugaaaugga

SEQ ID NO: 2493628 - RNA, 22 nt, Human
caaugacaucucaggggccaga

SEQ ID NO: 2493629 - RNA, 19 nt, Human
caaugacaucucaggggcc

SEQ ID NO: 2493630 - RNA, 17 nt, Human
caaugacaucucagggg

SEQ ID NO: 2493631 - RNA, 16 nt, Human
caaugacaucucaggg

SEQ ID NO: 2493632 - RNA, 15 nt, Human
caaugacaucuucaa

SEQ ID NO: 2493633 - RNA, 19 nt, Human
caaugacaucuucaaagcu

SEQ ID NO: 2493634 - RNA, 22 nt, Human
caaugaaugaaugaauggcuaa

SEQ ID NO: 2493635 - RNA, 20 nt, Human
caaugaacccccaugaugua

SEQ ID NO: 2493636 - RNA, 13 nt, Human
caaugaaccccca

SEQ ID NO: 2493637 - RNA, 21 nt, Human
caaugacacagucuuggcuca

SEQ ID NO: 2493638 - RNA, 19 nt, Human
caaugacacagucuuggcu

SEQ ID NO: 2493639 - RNA, 14 nt, Human
caaugacacagucu

SEQ ID NO: 2493640 - RNA, 19 nt, Human
caaugcaaaccaucauuga

SEQ ID NO: 2493641 - RNA, 23 nt, Human
caaugcacuuuguucuggcucuu

SEQ ID NO: 2493642 - RNA, 18 nt, Human
caaugcaaaccaucauug

SEQ ID NO: 2493643 - RNA, 17 nt, Human
caaugcaaaccaucauu

SEQ ID NO: 2493644 - RNA, 13 nt, Human
caaugauggcaau

SEQ ID NO: 2493645 - RNA, 16 nt, Human
caaugauggcaauuuu

SEQ ID NO: 2493646 - RNA, 21 nt, Human
caaugaugaaugagaaucuac

SEQ ID NO: 2493647 - RNA, 24 nt, Human
caaugaucuagguuuaacucagau

SEQ ID NO: 2493648 - RNA, 10 nt, Human
caauuuuccu

SEQ ID NO: 2493649 - RNA, 11 nt, Human
caauuuuccuu

SEQ ID NO: 2493650 - RNA, 15 nt, Human
caauuuuccuugaag

SEQ ID NO: 2493651 - RNA, 14 nt, Human
caauuuuccuugaa

SEQ ID NO: 2493652 - RNA, 13 nt, Human
caauuuuccuuga

SEQ ID NO: 2493653 - RNA, 17 nt, Human
caauuuuaaugcuauuu

SEQ ID NO: 2493654 - RNA, 21 nt, Human
caauuuuaucccucaccugua

SEQ ID NO: 2493655 - RNA, 14 nt, Human
caauucagacaggc

SEQ ID NO: 2493656 - RNA, 15 nt, Human
caauucagacaggca

SEQ ID NO: 2493657 - RNA, 23 nt, Human
caauucagacaggcaaauaaaag

SEQ ID NO: 2493658 - RNA, 21 nt, Human
caauucagugcuguacuugau

SEQ ID NO: 2493659 - RNA, 13 nt, Human
caauucaugaacu

SEQ ID NO: 2493660 - RNA, 14 nt, Human
caauucaacccuuu

SEQ ID NO: 2493661 - RNA, 15 nt, Human
caauucaugaacuuc

SEQ ID NO: 2493662 - RNA, 14 nt, Human
caauucaugaacuu

SEQ ID NO: 2493663 - RNA, 21 nt, Human
caauucaugaacuucgcauca

SEQ ID NO: 2493664 - RNA, 15 nt, Human
caauuccaaaggaau

SEQ ID NO: 2493665 - RNA, 20 nt, Human
caauucacaucuaaccucau

SEQ ID NO: 2493666 - RNA, 13 nt, Human
caauucagacagg

SEQ ID NO: 2493667 - RNA, 14 nt, Human
caauucaacacucc

SEQ ID NO: 2493668 - RNA, 17 nt, Human
caauucaacccuuugcc

SEQ ID NO: 2493669 - RNA, 21 nt, Human
caauuaaggauuuuaugcuuu

SEQ ID NO: 2493670 - RNA, 22 nt, Human
caauuaaggauuuuaugcuuua

SEQ ID NO: 2493671 - RNA, 22 nt, Human
caauuaaauguagguaugaaua

SEQ ID NO: 2493672 - RNA, 23 nt, Human
caauuaaacggauuauuuuuuca

SEQ ID NO: 2493673 - RNA, 20 nt, Human
caauuaaacggauuauuuuu

SEQ ID NO: 2493674 - RNA, 12 nt, Human
caauuaaaugua

SEQ ID NO: 2493675 - RNA, 15 nt, Human
caauuaaggauuuua

SEQ ID NO: 2493676 - RNA, 20 nt, Human
caauuaaggauuuuaugcuu

SEQ ID NO: 2493677 - RNA, 13 nt, Human
caauuaaggauuu

SEQ ID NO: 2493678 - RNA, 13 nt, Human
caauuaaauguag

SEQ ID NO: 2493679 - RNA, 14 nt, Human
caauuaaauguagg

SEQ ID NO: 2493680 - RNA, 20 nt, Human
caaugucugugcuagggaaa

SEQ ID NO: 2493681 - RNA, 14 nt, Human
caaugucugugcua

SEQ ID NO: 2493682 - RNA, 11 nt, Human
caaugucuuga

SEQ ID NO: 2493683 - RNA, 21 nt, Human
caaugucuugaugcaugcacu

SEQ ID NO: 2493684 - RNA, 23 nt, Human
caaugucuugaugcaugcacugu

SEQ ID NO: 2493685 - RNA, 19 nt, Human
caauuaaacggauuauuuu

SEQ ID NO: 2493686 - RNA, 18 nt, Human
caauuaaacggauuauuu

SEQ ID NO: 2493687 - RNA, 17 nt, Human
caauuaaacggauuauu

SEQ ID NO: 2493688 - RNA, 16 nt, Human
caauuaaacggauuau

SEQ ID NO: 2493689 - RNA, 15 nt, Human
caauuaaacggauua

SEQ ID NO: 2493690 - RNA, 14 nt, Human
caauuaaacggauu

SEQ ID NO: 2493691 - RNA, 13 nt, Human
caaugucugugcu

SEQ ID NO: 2493692 - RNA, 12 nt, Human
caaugucugugc

SEQ ID NO: 2493693 - RNA, 20 nt, Human
caaugucugagugaaccugu

SEQ ID NO: 2493694 - RNA, 15 nt, Human
caaugucugagugaa

SEQ ID NO: 2493695 - RNA, 16 nt, Human
caaugucugagugaac

SEQ ID NO: 2493696 - RNA, 21 nt, Human
caaugucaggaacagaaggau

SEQ ID NO: 2493697 - RNA, 13 nt, Human
caaugcauuuugg

SEQ ID NO: 2493698 - RNA, 12 nt, Human
caaugcauuuug

SEQ ID NO: 2493699 - RNA, 20 nt, Human
caaugcaugcagccacugug

SEQ ID NO: 2493700 - RNA, 16 nt, Human
caaugcaugcagccac

SEQ ID NO: 2493701 - RNA, 21 nt, Human
caaugcauuuuggaaagcucc

SEQ ID NO: 2493702 - RNA, 22 nt, Human
caaugccaaaaaaagacagggc

SEQ ID NO: 2493703 - RNA, 22 nt, Human
cacaacacacagauuugagcuc

SEQ ID NO: 2493704 - RNA, 23 nt, Human
cacaaccaucugucccugccuca

SEQ ID NO: 2493705 - RNA, 23 nt, Human
cacaaccuucuguggcucacaga

SEQ ID NO: 2493706 - RNA, 19 nt, Human
cacaaccuucuguggcuca

SEQ ID NO: 2493707 - RNA, 18 nt, Human
cacaaccuucuguggcuc

SEQ ID NO: 2493708 - RNA, 17 nt, Human
cacaaccuucuguggcu

SEQ ID NO: 2493709 - RNA, 11 nt, Human
cacaacagauu

SEQ ID NO: 2493710 - RNA, 20 nt, Human
cacaaauuauuaaugaaaau

SEQ ID NO: 2493711 - RNA, 16 nt, Human
cacaacacacacacuc

SEQ ID NO: 2493712 - RNA, 21 nt, Human
cacaaauucugucucuggauu

SEQ ID NO: 2493713 - RNA, 17 nt, Human
cacaaauuauuaaugaa

SEQ ID NO: 2493714 - RNA, 12 nt, Human
cacaaagcccaa

SEQ ID NO: 2493715 - RNA, 14 nt, Human
cacaaagcccaagg

SEQ ID NO: 2493716 - RNA, 11 nt, Human
cacaaagccca

SEQ ID NO: 2493717 - RNA, 15 nt, Human
cacaaacuguaaaua

SEQ ID NO: 2493718 - RNA, 23 nt, Human
cacaaacuguaaauaaaaagaaa

SEQ ID NO: 2493719 - RNA, 16 nt, Human
cacaaaacccagaccu

SEQ ID NO: 2493720 - RNA, 14 nt, Human
cacaaacuguaaau

SEQ ID NO: 2493721 - RNA, 15 nt, Human
cacaaaacaacccua

SEQ ID NO: 2493722 - RNA, 18 nt, Human
cacaaaaguuagcugagc

SEQ ID NO: 2493723 - RNA, 22 nt, Human
cacaaagcacaguuugaacaaa

SEQ ID NO: 2493724 - RNA, 18 nt, Human
cacaaagcacaguuugaa

SEQ ID NO: 2493725 - RNA, 19 nt, Human
cacaaacuuuuauacucuu

SEQ ID NO: 2493726 - RNA, 18 nt, Human
cacaaaaguuucucuuuu

SEQ ID NO: 2493727 - RNA, 16 nt, Human
cacaaaaguuucucuu

SEQ ID NO: 2493728 - RNA, 19 nt, Human
caauuuuccuugaagccga

SEQ ID NO: 2493729 - RNA, 17 nt, Human
caauuuuccuugaagcc

SEQ ID NO: 2493730 - RNA, 16 nt, Human
caauuuuccuugaagc

SEQ ID NO: 2493731 - RNA, 13 nt, Human
caauuuucuccca

SEQ ID NO: 2493732 - RNA, 18 nt, Human
caauuuuccuugaagccg

SEQ ID NO: 2493733 - RNA, 19 nt, Human
caauuuucuggaauacaug

SEQ ID NO: 2493734 - RNA, 22 nt, Human
cacaaaacaaaugccacacauc

SEQ ID NO: 2493735 - RNA, 12 nt, Human
cacaaaaaugaa

SEQ ID NO: 2493736 - RNA, 17 nt, Human
caauuuucucccaggaa

SEQ ID NO: 2493737 - RNA, 13 nt, Human
cacacuugugugu

SEQ ID NO: 2493738 - RNA, 19 nt, Human
cacacuugugugugggcug

SEQ ID NO: 2493739 - RNA, 21 nt, Human
cacacuugugugugggcugug

SEQ ID NO: 2493740 - RNA, 23 nt, Human
cacacuugugugugggcugugag

SEQ ID NO: 2493741 - RNA, 15 nt, Human
cacacuuguuccagc

SEQ ID NO: 2493742 - RNA, 21 nt, Human
cacacuuggcccaaguggcag

SEQ ID NO: 2493743 - RNA, 21 nt, Human
cacacuugagaggaugaaugu

SEQ ID NO: 2493744 - RNA, 19 nt, Human
cacacuugagaggaugaau

SEQ ID NO: 2493745 - RNA, 22 nt, Human
cacacuugguuggguccucaca

SEQ ID NO: 2493746 - RNA, 22 nt, Human
cacagaccuggagccccugggu

SEQ ID NO: 2493747 - RNA, 21 nt, Human
cacagaccuggagccccuggg

SEQ ID NO: 2493748 - RNA, 20 nt, Human
cacagaccuggagccccugg

SEQ ID NO: 2493749 - RNA, 19 nt, Human
cacagaccuggagccccug

SEQ ID NO: 2493750 - RNA, 18 nt, Human
cacagaccuggagccccu

SEQ ID NO: 2493751 - RNA, 16 nt, Human
cacagaccuggagccc

SEQ ID NO: 2493752 - RNA, 15 nt, Human
cacagaccuggagcc

SEQ ID NO: 2493753 - RNA, 14 nt, Human
cacagaccuggagc

SEQ ID NO: 2493754 - RNA, 16 nt, Human
cacacuuguuccagcu

SEQ ID NO: 2493755 - RNA, 17 nt, Human
cacacuuguuccagcuc

SEQ ID NO: 2493756 - RNA, 22 nt, Human
cacagacccugcccugugggcc

SEQ ID NO: 2493757 - RNA, 21 nt, Human
cacacuugacaucaacugcau

SEQ ID NO: 2493758 - RNA, 18 nt, Human
cacacuugagaggaugaa

SEQ ID NO: 2493759 - RNA, 17 nt, Human
cacacuugagaggauga

SEQ ID NO: 2493760 - RNA, 15 nt, Human
cacacuucugugaga

SEQ ID NO: 2493761 - RNA, 22 nt, Human
cacacuucugugagacccccac

SEQ ID NO: 2493762 - RNA, 16 nt, Human
cacacuuccaccagcc

SEQ ID NO: 2493763 - RNA, 18 nt, Human
cacacuuccaccagccug

SEQ ID NO: 2493764 - RNA, 19 nt, Human
cacacuuccaccagccugc

SEQ ID NO: 2493765 - RNA, 23 nt, Human
cacacuuccuguccagagagaga

SEQ ID NO: 2493766 - RNA, 19 nt, Human
cacacuuccuguccagaga

SEQ ID NO: 2493767 - RNA, 20 nt, Human
cacacuuccuguccagagag

SEQ ID NO: 2493768 - RNA, 13 nt, Human
cacacuuccuguc

SEQ ID NO: 2493769 - RNA, 14 nt, Human
cacacuuccugucc

SEQ ID NO: 2493770 - RNA, 15 nt, Human
cacacuuccugucca

SEQ ID NO: 2493771 - RNA, 16 nt, Human
cacacuuccuguccag

SEQ ID NO: 2493772 - RNA, 16 nt, Human
cacagaguuguuacau

SEQ ID NO: 2493773 - RNA, 17 nt, Human
cacagaguuguuacauu

SEQ ID NO: 2493774 - RNA, 14 nt, Human
cacagagcaggacu

SEQ ID NO: 2493775 - RNA, 19 nt, Human
cacagagagucccacugcc

SEQ ID NO: 2493776 - RNA, 18 nt, Human
cacagagagucccacugc

SEQ ID NO: 2493777 - RNA, 16 nt, Human
cacagagagucccacu

SEQ ID NO: 2493778 - RNA, 12 nt, Human
cacagagagucc

SEQ ID NO: 2493779 - RNA, 14 nt, Human
cacagagagaguca

SEQ ID NO: 2493780 - RNA, 22 nt, Human
cacagagacccccggaacaagc

SEQ ID NO: 2493781 - RNA, 23 nt, Human
cacagagacccccggaacaagcc

SEQ ID NO: 2493782 - RNA, 22 nt, Human
cacagagagggggccaccuccc

SEQ ID NO: 2493783 - RNA, 24 nt, Human
cacagaccuggagccccugggugg

SEQ ID NO: 2493784 - RNA, 23 nt, Human
cacagaccuggagccccugggug

SEQ ID NO: 2493785 - RNA, 16 nt, Human
cacagacgucccucca

SEQ ID NO: 2493786 - RNA, 18 nt, Human
cacagacucaaaugcuca

SEQ ID NO: 2493787 - RNA, 22 nt, Human
cacagagaagacaaaauuagca

SEQ ID NO: 2493788 - RNA, 17 nt, Human
cacagagaagacaaaau

SEQ ID NO: 2493789 - RNA, 15 nt, Human
cacagagaagacaaa

SEQ ID NO: 2493790 - RNA, 16 nt, Human
cacagagacauuccuc

SEQ ID NO: 2493791 - RNA, 21 nt, Human
cacagagacauuccuccgagc

SEQ ID NO: 2493792 - RNA, 14 nt, Human
cacagagacccccg

SEQ ID NO: 2493793 - RNA, 14 nt, Human
cacagagaagacaa

SEQ ID NO: 2493794 - RNA, 24 nt, Human
cacacuguguccuggugcucucug

SEQ ID NO: 2493795 - RNA, 23 nt, Human
cacacuguguccuggugcucucu

SEQ ID NO: 2493796 - RNA, 20 nt, Human
cacacuguguccuggugcuc

SEQ ID NO: 2493797 - RNA, 19 nt, Human
cacacuguguccuggugcu

SEQ ID NO: 2493798 - RNA, 17 nt, Human
cacacuucaggcucuuc

SEQ ID NO: 2493799 - RNA, 14 nt, Human
cacacuucaggcuc

SEQ ID NO: 2493800 - RNA, 22 nt, Human
cacacuucaggcucuucuccuu

SEQ ID NO: 2493801 - RNA, 21 nt, Human
cacacuucaggcucuucuccu

SEQ ID NO: 2493802 - RNA, 20 nt, Human
cacacuucaggcucuucucc

SEQ ID NO: 2493803 - RNA, 18 nt, Human
cacacuucaggcucuucu

SEQ ID NO: 2493804 - RNA, 23 nt, Human
cacacugguguggauuaaccugc

SEQ ID NO: 2493805 - RNA, 15 nt, Human
cacacuggugacugc

SEQ ID NO: 2493806 - RNA, 21 nt, Human
cacacugggugcccaagcuca

SEQ ID NO: 2493807 - RNA, 22 nt, Human
cacacuggggugccgccugccc

SEQ ID NO: 2493808 - RNA, 19 nt, Human
cacacuggggugccgccug

SEQ ID NO: 2493809 - RNA, 19 nt, Human
cacacugggacuugcaaaa

SEQ ID NO: 2493810 - RNA, 23 nt, Human
cacacugcuaggugggccagccc

SEQ ID NO: 2493811 - RNA, 16 nt, Human
cacacuguguccuggu

SEQ ID NO: 2493812 - RNA, 23 nt, Human
cacacugugcuuucuauuguaca

SEQ ID NO: 2493813 - RNA, 22 nt, Human
cacacugugcuuucuauuguac

SEQ ID NO: 2493814 - RNA, 20 nt, Human
cacacugugcuuucuauugu

SEQ ID NO: 2493815 - RNA, 16 nt, Human
cacacugugcuuucua

SEQ ID NO: 2493816 - RNA, 15 nt, Human
cacacugugcuuucu

SEQ ID NO: 2493817 - RNA, 14 nt, Human
cacacugugcuuuc

SEQ ID NO: 2493818 - RNA, 23 nt, Human
cacacuguagcauuacagugggu

SEQ ID NO: 2493819 - RNA, 19 nt, Human
cacacucacuccugagacc

SEQ ID NO: 2493820 - RNA, 18 nt, Human
cacacucacuccugagac

SEQ ID NO: 2493821 - RNA, 17 nt, Human
cacacucacuccugaga

SEQ ID NO: 2493822 - RNA, 19 nt, Human
cacacuauuaccaugagaa

SEQ ID NO: 2493823 - RNA, 20 nt, Human
cacacuauuaccaugagaag

SEQ ID NO: 2493824 - RNA, 18 nt, Human
cacacuauuaccaugaga

SEQ ID NO: 2493825 - RNA, 17 nt, Human
cacacuauuaccaugag

SEQ ID NO: 2493826 - RNA, 14 nt, Human
cacacugaagaagc

SEQ ID NO: 2493827 - RNA, 19 nt, Human
cacacucaaaucaagaaac

SEQ ID NO: 2493828 - RNA, 17 nt, Human
cacacuagccucuccag

SEQ ID NO: 2493829 - RNA, 18 nt, Human
cacacuagccucuccagg

SEQ ID NO: 2493830 - RNA, 19 nt, Human
cacacuagccucuccagga

SEQ ID NO: 2493831 - RNA, 21 nt, Human
cacacugcaagagccuuggug

SEQ ID NO: 2493832 - RNA, 19 nt, Human
cacacugcaagagccuugg

SEQ ID NO: 2493833 - RNA, 20 nt, Human
cacacugcaagagccuuggu

SEQ ID NO: 2493834 - RNA, 16 nt, Human
cacacugcaagagccu

SEQ ID NO: 2493835 - RNA, 17 nt, Human
cacacugcaagagccuu

SEQ ID NO: 2493836 - RNA, 18 nt, Human
cacacugcaagagccuug

SEQ ID NO: 2493837 - RNA, 20 nt, Human
cacacuggacuccggcccuc

SEQ ID NO: 2493838 - RNA, 19 nt, Human
cacacuggacuccggcccu

SEQ ID NO: 2493839 - RNA, 13 nt, Human
cacacuggacucc

SEQ ID NO: 2493840 - RNA, 14 nt, Human
cacacugaugcuua

SEQ ID NO: 2493841 - RNA, 18 nt, Human
cacacugaugcuuagaug

SEQ ID NO: 2493842 - RNA, 15 nt, Human
cacacugaggcaggg

SEQ ID NO: 2493843 - RNA, 16 nt, Human
cacacugaggcaggga

SEQ ID NO: 2493844 - RNA, 17 nt, Human
cacacugaggcagggaa

SEQ ID NO: 2493845 - RNA, 18 nt, Human
cacacugaggcagggaag

SEQ ID NO: 2493846 - RNA, 12 nt, Human
cacacucacugc

SEQ ID NO: 2493847 - RNA, 13 nt, Human
cacacugaggcag

SEQ ID NO: 2493848 - RNA, 14 nt, Human
cacacugaggcagg

SEQ ID NO: 2493849 - RNA, 14 nt, Human
cacacucauccccu

SEQ ID NO: 2493850 - RNA, 12 nt, Human
cacacagccaca

SEQ ID NO: 2493851 - RNA, 13 nt, Human
cacacagccacac

SEQ ID NO: 2493852 - RNA, 14 nt, Human
cacacagccacaca

SEQ ID NO: 2493853 - RNA, 15 nt, Human
cacacagccacacac

SEQ ID NO: 2493854 - RNA, 16 nt, Human
cacacagccacacaca

SEQ ID NO: 2493855 - RNA, 17 nt, Human
cacacagccacacacac

SEQ ID NO: 2493856 - RNA, 19 nt, Human
cacacagccacacacacag

SEQ ID NO: 2493857 - RNA, 20 nt, Human
cacacagccacacacacaga

SEQ ID NO: 2493858 - RNA, 21 nt, Human
cacacagccaggugccuugga

SEQ ID NO: 2493859 - RNA, 19 nt, Human
cacacagccaggugccuug

SEQ ID NO: 2493860 - RNA, 15 nt, Human
cacacagccaggugc

SEQ ID NO: 2493861 - RNA, 14 nt, Human
cacacagccaggug

SEQ ID NO: 2493862 - RNA, 21 nt, Human
cacacagccacacacacagaa

SEQ ID NO: 2493863 - RNA, 22 nt, Human
cacacagccacacacacagaaa

SEQ ID NO: 2493864 - RNA, 12 nt, Human
cacacagcucug

SEQ ID NO: 2493865 - RNA, 19 nt, Human
cacacagaggcugccucuc

SEQ ID NO: 2493866 - RNA, 11 nt, Human
cacacagccac

SEQ ID NO: 2493867 - RNA, 18 nt, Human
cacacagaggaagagcag

SEQ ID NO: 2493868 - RNA, 22 nt, Human
cacacagaggaagagcaggcac

SEQ ID NO: 2493869 - RNA, 12 nt, Human
cacacagaggaa

SEQ ID NO: 2493870 - RNA, 15 nt, Human
cacacagaaacucuu

SEQ ID NO: 2493871 - RNA, 21 nt, Human
cacacagaaaauauacuguaa

SEQ ID NO: 2493872 - RNA, 22 nt, Human
cacacagaaaauauacuguaaa

SEQ ID NO: 2493873 - RNA, 23 nt, Human
cacacagaaaauauacuguaaag

SEQ ID NO: 2493874 - RNA, 20 nt, Human
cacacagaaaauauacugua

SEQ ID NO: 2493875 - RNA, 14 nt, Human
cacacaccagagcc

SEQ ID NO: 2493876 - RNA, 12 nt, Human
cacacacaugca

SEQ ID NO: 2493877 - RNA, 16 nt, Human
cacacacaugcauaca

SEQ ID NO: 2493878 - RNA, 17 nt, Human
cacacacaugcauacac

SEQ ID NO: 2493879 - RNA, 18 nt, Human
cacacacaugcauacaca

SEQ ID NO: 2493880 - RNA, 19 nt, Human
cacacacauacacacauau

SEQ ID NO: 2493881 - RNA, 15 nt, Human
cacacacaggagcau

SEQ ID NO: 2493882 - RNA, 13 nt, Human
cacacacaggcaa

SEQ ID NO: 2493883 - RNA, 21 nt, Human
cacacacaggcaacugaggca

SEQ ID NO: 2493884 - RNA, 19 nt, Human
cacaacuauuuuuccaaaa

SEQ ID NO: 2493885 - RNA, 14 nt, Human
cacaacuauuuuuc

SEQ ID NO: 2493886 - RNA, 17 nt, Human
cacaacccuguuuuaua

SEQ ID NO: 2493887 - RNA, 13 nt, Human
cacacacaggagc

SEQ ID NO: 2493888 - RNA, 15 nt, Human
cacacacagcugggc

SEQ ID NO: 2493889 - RNA, 12 nt, Human
cacacacaggag

SEQ ID NO: 2493890 - RNA, 13 nt, Human
cacaacuauauug

SEQ ID NO: 2493891 - RNA, 19 nt, Human
cacaacgugcauugugcuu

SEQ ID NO: 2493892 - RNA, 17 nt, Human
cacaacgugcauugugc

SEQ ID NO: 2493893 - RNA, 14 nt, Human
cacaacgugcauug

SEQ ID NO: 2493894 - RNA, 14 nt, Human
cacaaccugaaccu

SEQ ID NO: 2493895 - RNA, 13 nt, Human
cacaccagagccc

SEQ ID NO: 2493896 - RNA, 12 nt, Human
cacaccagagcc

SEQ ID NO: 2493897 - RNA, 15 nt, Human
cacaccagagcccac

SEQ ID NO: 2493898 - RNA, 13 nt, Human
cacacagcuccca

SEQ ID NO: 2493899 - RNA, 16 nt, Human
cacaccacaucuaagc

SEQ ID NO: 2493900 - RNA, 21 nt, Human
cacaccaggcugugggccuca

SEQ ID NO: 2493901 - RNA, 21 nt, Human
cacacccaccguccgcccugc

SEQ ID NO: 2493902 - RNA, 14 nt, Human
cacacccaccgucc

SEQ ID NO: 2493903 - RNA, 14 nt, Human
cacacccacucagc

SEQ ID NO: 2493904 - RNA, 15 nt, Human
cacacccacucagcu

SEQ ID NO: 2493905 - RNA, 22 nt, Human
cacacccaccguccgcccugcu

SEQ ID NO: 2493906 - RNA, 14 nt, Human
cacacccagcuacu

SEQ ID NO: 2493907 - RNA, 16 nt, Human
cacacccacucagcuc

SEQ ID NO: 2493908 - RNA, 13 nt, Human
cacacccagccca

SEQ ID NO: 2493909 - RNA, 22 nt, Human
cacaccaggcugugggccucaa

SEQ ID NO: 2493910 - RNA, 22 nt, Human
cacaccaggcuugccugcaggc

SEQ ID NO: 2493911 - RNA, 21 nt, Human
cacaccaggcuugccugcagg

SEQ ID NO: 2493912 - RNA, 23 nt, Human
cacacccccaccccuugcucuca

SEQ ID NO: 2493913 - RNA, 13 nt, Human
cacacccccaccc

SEQ ID NO: 2493914 - RNA, 18 nt, Human
cacacccucucccaggac

SEQ ID NO: 2493915 - RNA, 14 nt, Human
cacacccuguuuua

SEQ ID NO: 2493916 - RNA, 21 nt, Human
cacacccuguacuguucugug

SEQ ID NO: 2493917 - RNA, 21 nt, Human
cacacccucccccgccacucc

SEQ ID NO: 2493918 - RNA, 17 nt, Human
cacacccucucccagga

SEQ ID NO: 2493919 - RNA, 17 nt, Human
cacaccgggcacucaga

SEQ ID NO: 2493920 - RNA, 16 nt, Human
cacaccuguagcacuu

SEQ ID NO: 2493921 - RNA, 17 nt, Human
cacaccugagccagccu

SEQ ID NO: 2493922 - RNA, 22 nt, Human
cacaccuuuuauugacacagaa

SEQ ID NO: 2493923 - RNA, 16 nt, Human
cacaccuguaguccca

SEQ ID NO: 2493924 - RNA, 19 nt, Human
cacaccuguagucccagcu

SEQ ID NO: 2493925 - RNA, 23 nt, Human
cacaccuuuuauugacacagaaa

SEQ ID NO: 2493926 - RNA, 14 nt, Human
cacacgcacacaca

SEQ ID NO: 2493927 - RNA, 20 nt, Human
cacaccuguagucccagcua

SEQ ID NO: 2493928 - RNA, 15 nt, Human
cacacgcacacacac

SEQ ID NO: 2493929 - RNA, 14 nt, Human
cacaccucugccag

SEQ ID NO: 2493930 - RNA, 13 nt, Human
cacaccucugcca

SEQ ID NO: 2493931 - RNA, 12 nt, Human
cacaccucugcc

SEQ ID NO: 2493932 - RNA, 20 nt, Human
cacaccgagggcgaccccgu

SEQ ID NO: 2493933 - RNA, 11 nt, Human
cacaccugagc

SEQ ID NO: 2493934 - RNA, 16 nt, Human
cacaccugacucugaa

SEQ ID NO: 2493935 - RNA, 22 nt, Human
cacaccuguaaucccagcacuu

SEQ ID NO: 2493936 - RNA, 20 nt, Human
cacagcacgggggccaagga

SEQ ID NO: 2493937 - RNA, 12 nt, Human
cacagcagccug

SEQ ID NO: 2493938 - RNA, 16 nt, Human
cacagcagccccugca

SEQ ID NO: 2493939 - RNA, 20 nt, Human
cacagaugggugcuuggagg

SEQ ID NO: 2493940 - RNA, 19 nt, Human
cacagagugugcuggagga

SEQ ID NO: 2493941 - RNA, 14 nt, Human
cacagagcggggac

SEQ ID NO: 2493942 - RNA, 18 nt, Human
cacagaguggucuuucug

SEQ ID NO: 2493943 - RNA, 20 nt, Human
cacagauggauuugccugug

SEQ ID NO: 2493944 - RNA, 23 nt, Human
cacagauggauuugccugugcca

SEQ ID NO: 2493945 - RNA, 18 nt, Human
cacagaugggugcuugga

SEQ ID NO: 2493946 - RNA, 14 nt, Human
cacagaugggugcu

SEQ ID NO: 2493947 - RNA, 20 nt, Human
cacagaguuguuacauuuuu

SEQ ID NO: 2493948 - RNA, 19 nt, Human
cacagauggauuugccugu

SEQ ID NO: 2493949 - RNA, 13 nt, Human
cacagagcgggga

SEQ ID NO: 2493950 - RNA, 21 nt, Human
cacagagcaggacugcacagc

SEQ ID NO: 2493951 - RNA, 22 nt, Human
cacagaguggucuuucuggaga

SEQ ID NO: 2493952 - RNA, 20 nt, Human
cacagcaucauuuugcauuc

SEQ ID NO: 2493953 - RNA, 19 nt, Human
cacagcagcuucaccagag

SEQ ID NO: 2493954 - RNA, 18 nt, Human
cacagcagcuucaccaga

SEQ ID NO: 2493955 - RNA, 15 nt, Human
cacagcagcuucacc

SEQ ID NO: 2493956 - RNA, 23 nt, Human
cacagcaucauuuugcauucaaa

SEQ ID NO: 2493957 - RNA, 13 nt, Human
cacagcaugugua

SEQ ID NO: 2493958 - RNA, 22 nt, Human
cacagcaguugaaaagacucca

SEQ ID NO: 2493959 - RNA, 18 nt, Human
cacagcagcaucuucaaa

SEQ ID NO: 2493960 - RNA, 14 nt, Human
cacagcagccuggg

SEQ ID NO: 2493961 - RNA, 13 nt, Human
cacagcagcuuca

SEQ ID NO: 2493962 - RNA, 19 nt, Human
cacagcagcugaacagcca

SEQ ID NO: 2493963 - RNA, 16 nt, Human
cacagcagcugaacag

SEQ ID NO: 2493964 - RNA, 11 nt, Human
cacagccacac

SEQ ID NO: 2493965 - RNA, 12 nt, Human
cacagccacaca

SEQ ID NO: 2493966 - RNA, 10 nt, Human
cacagccaca

SEQ ID NO: 2493967 - RNA, 22 nt, Human
cacagccaacacgcaccugccu

SEQ ID NO: 2493968 - RNA, 13 nt, Human
cacagccacacac

SEQ ID NO: 2493969 - RNA, 14 nt, Human
cacagccacacaca

SEQ ID NO: 2493970 - RNA, 14 nt, Human
cacagccaaggacu

SEQ ID NO: 2493971 - RNA, 14 nt, Human
cacagccgcagccu

SEQ ID NO: 2493972 - RNA, 17 nt, Human
cacagccuccccugcca

SEQ ID NO: 2493973 - RNA, 19 nt, Human
cacagccuccccugccagg

SEQ ID NO: 2493974 - RNA, 14 nt, Human
cacagccuccccug

SEQ ID NO: 2493975 - RNA, 23 nt, Human
cacagccgcagccucccucugac

SEQ ID NO: 2493976 - RNA, 21 nt, Human
cacagccgcagccucccucug

SEQ ID NO: 2493977 - RNA, 22 nt, Human
cacagccgcagccucccucuga

SEQ ID NO: 2493978 - RNA, 19 nt, Human
cacaggaaccacaagacug

SEQ ID NO: 2493979 - RNA, 20 nt, Human
cacagccuccccugccaggg

SEQ ID NO: 2493980 - RNA, 21 nt, Human
cacagccuccccugccagggc

SEQ ID NO: 2493981 - RNA, 15 nt, Human
cacagccuccucugu

SEQ ID NO: 2493982 - RNA, 14 nt, Human
cacagccuccucug

SEQ ID NO: 2493983 - RNA, 23 nt, Human
cacagccuccccugccagggcag

SEQ ID NO: 2493984 - RNA, 20 nt, Human
cacaggaaccacaagacugc

SEQ ID NO: 2493985 - RNA, 15 nt, Human
cacaggaaguagagg

SEQ ID NO: 2493986 - RNA, 16 nt, Human
cacaggaucagucuga

SEQ ID NO: 2493987 - RNA, 15 nt, Human
cacaggaucagucug

SEQ ID NO: 2493988 - RNA, 23 nt, Human
cacagccuccucugucugcccuu

SEQ ID NO: 2493989 - RNA, 21 nt, Human
cacagccuccucugucugccc

SEQ ID NO: 2493990 - RNA, 20 nt, Human
cacagccuccucugucugcc

SEQ ID NO: 2493991 - RNA, 19 nt, Human
cacagccuccucugucugc

SEQ ID NO: 2493992 - RNA, 10 nt, Human
cacagccucu

SEQ ID NO: 2493993 - RNA, 22 nt, Human
cacaggaagccugcaguccugg

SEQ ID NO: 2493994 - RNA, 12 nt, Human
cacaggaucagu

SEQ ID NO: 2493995 - RNA, 19 nt, Human
cacaggcccggcuccaggc

SEQ ID NO: 2493996 - RNA, 18 nt, Human
cacaggcccggcuccagg

SEQ ID NO: 2493997 - RNA, 17 nt, Human
cacaggcccggcuccag

SEQ ID NO: 2493998 - RNA, 16 nt, Human
cacaggcccggcucca

SEQ ID NO: 2493999 - RNA, 12 nt, Human
cacaggcagcuu

SEQ ID NO: 2494000 - RNA, 21 nt, Human
cacaggcagcuggaugagacu

SEQ ID NO: 2494001 - RNA, 16 nt, Human
cacaggcagcuggaug

SEQ ID NO: 2494002 - RNA, 11 nt, Human
cacaggcagcu

SEQ ID NO: 2494003 - RNA, 10 nt, Human
cacaggcagg

SEQ ID NO: 2494004 - RNA, 22 nt, Human
cacaggcaacugaggcagacag

SEQ ID NO: 2494005 - RNA, 23 nt, Human
cacaggcaacugaggcagacagc

SEQ ID NO: 2494006 - RNA, 20 nt, Human
cacaggcaacugaggcagac

SEQ ID NO: 2494007 - RNA, 14 nt, Human
cacaggcagcauuu

SEQ ID NO: 2494008 - RNA, 15 nt, Human
cacaggcagcauuua

SEQ ID NO: 2494009 - RNA, 23 nt, Human
cacaggcccggcuccaggcuccu

SEQ ID NO: 2494010 - RNA, 20 nt, Human
cacaggcccggcuccaggcu

SEQ ID NO: 2494011 - RNA, 18 nt, Human
cacagugagucgaggaca

SEQ ID NO: 2494012 - RNA, 17 nt, Human
cacaguuggcuggauga

SEQ ID NO: 2494013 - RNA, 23 nt, Human
cacaguuggccuucagaaccauc

SEQ ID NO: 2494014 - RNA, 15 nt, Human
cacaguuggccuuca

SEQ ID NO: 2494015 - RNA, 12 nt, Human
cacaguuggccu

SEQ ID NO: 2494016 - RNA, 23 nt, Human
cacaguucuuugggccagacaug

SEQ ID NO: 2494017 - RNA, 13 nt, Human
cacaggcccuccc

SEQ ID NO: 2494018 - RNA, 21 nt, Human
cacaguucuuugggccagaca

SEQ ID NO: 2494019 - RNA, 20 nt, Human
cacagugagucgaggacagg

SEQ ID NO: 2494020 - RNA, 19 nt, Human
cacagugagucgaggacag

SEQ ID NO: 2494021 - RNA, 22 nt, Human
cacaguuggcuggaugaaauuu

SEQ ID NO: 2494022 - RNA, 21 nt, Human
cacaguuuccucaucugucca

SEQ ID NO: 2494023 - RNA, 15 nt, Human
cacaguuuucugaga

SEQ ID NO: 2494024 - RNA, 14 nt, Human
cacaguuuucugag

SEQ ID NO: 2494025 - RNA, 22 nt, Human
cacauaauuaaaguguccauug

SEQ ID NO: 2494026 - RNA, 18 nt, Human
cacauaauuaaagugucc

SEQ ID NO: 2494027 - RNA, 19 nt, Human
cacauaagcucagaaucca

SEQ ID NO: 2494028 - RNA, 22 nt, Human
cacauaauucaggaagcagcuu

SEQ ID NO: 2494029 - RNA, 12 nt, Human
cacaguuugaac

SEQ ID NO: 2494030 - RNA, 23 nt, Human
cacaguuuugguugcuuuaauau

SEQ ID NO: 2494031 - RNA, 22 nt, Human
cacauaguuuuuaagguuauuu

SEQ ID NO: 2494032 - RNA, 21 nt, Human
cacauauaaacaucacacaca

SEQ ID NO: 2494033 - RNA, 21 nt, Human
cacauagugaugguuccccug

SEQ ID NO: 2494034 - RNA, 17 nt, Human
cacauacacacacacgc

SEQ ID NO: 2494035 - RNA, 15 nt, Human
cacauacacacauau

SEQ ID NO: 2494036 - RNA, 14 nt, Human
cacauaauuuuucu

SEQ ID NO: 2494037 - RNA, 23 nt, Human
cacauucuuauaaauaugaagcu

SEQ ID NO: 2494038 - RNA, 16 nt, Human
cacauucuuauaaaua

SEQ ID NO: 2494039 - RNA, 15 nt, Human
cacauucuuauaaau

SEQ ID NO: 2494040 - RNA, 22 nt, Human
cacauucuuaacacauguccuu

SEQ ID NO: 2494041 - RNA, 21 nt, Human
cacauucuggcucagggaggu

SEQ ID NO: 2494042 - RNA, 20 nt, Human
cacauucuggcucagggagg

SEQ ID NO: 2494043 - RNA, 16 nt, Human
cacauucuggcucagg

SEQ ID NO: 2494044 - RNA, 21 nt, Human
cacauucggcucccuggagcc

SEQ ID NO: 2494045 - RNA, 17 nt, Human
cacauucggcucccugg

SEQ ID NO: 2494046 - RNA, 18 nt, Human
cacauucuuauaaauaug

SEQ ID NO: 2494047 - RNA, 17 nt, Human
cacauucuuauaaauau

SEQ ID NO: 2494048 - RNA, 19 nt, Human
cacauucuuauaaauauga

SEQ ID NO: 2494049 - RNA, 18 nt, Human
cacauuggagauguuuag

SEQ ID NO: 2494050 - RNA, 15 nt, Human
caccaagcccaguua

SEQ ID NO: 2494051 - RNA, 22 nt, Human
cacauugggcagcgcccuuccu

SEQ ID NO: 2494052 - RNA, 18 nt, Human
cacauugggcagcgcccu

SEQ ID NO: 2494053 - RNA, 20 nt, Human
caccaagccuggucagccca

SEQ ID NO: 2494054 - RNA, 21 nt, Human
caccaagccuggucagcccaa

SEQ ID NO: 2494055 - RNA, 19 nt, Human
caccaagccuggucagccc

SEQ ID NO: 2494056 - RNA, 17 nt, Human
caccacacccagcccac

SEQ ID NO: 2494057 - RNA, 19 nt, Human
caccacagacacacacacg

SEQ ID NO: 2494058 - RNA, 16 nt, Human
caccacagacacacac

SEQ ID NO: 2494059 - RNA, 14 nt, Human
caccacacccagcc

SEQ ID NO: 2494060 - RNA, 20 nt, Human
caccaagcucacaguuccuc

SEQ ID NO: 2494061 - RNA, 19 nt, Human
caccacagccagcaccugg

SEQ ID NO: 2494062 - RNA, 17 nt, Human
caccacagccagcaccu

SEQ ID NO: 2494063 - RNA, 21 nt, Human
caccacagacacacacacgca

SEQ ID NO: 2494064 - RNA, 20 nt, Human
caccacagacacacacacgc

SEQ ID NO: 2494065 - RNA, 13 nt, Human
caccacagccagc

SEQ ID NO: 2494066 - RNA, 17 nt, Human
caccacaguaaguuccu

SEQ ID NO: 2494067 - RNA, 23 nt, Human
caccacaggcccuuuccucaggc

SEQ ID NO: 2494068 - RNA, 21 nt, Human
caccacaggcccuuuccucag

SEQ ID NO: 2494069 - RNA, 13 nt, Human
caccacagcaggu

SEQ ID NO: 2494070 - RNA, 18 nt, Human
caccacauccuccgucca

SEQ ID NO: 2494071 - RNA, 21 nt, Human
caccacauccuccguccagcc

SEQ ID NO: 2494072 - RNA, 15 nt, Human
caccacacccagccc

SEQ ID NO: 2494073 - RNA, 13 nt, Human
caccacacccagc

SEQ ID NO: 2494074 - RNA, 22 nt, Human
caccaagccuggucagcccaaa

SEQ ID NO: 2494075 - RNA, 23 nt, Human
cacauugggcagcgcccuuccuc

SEQ ID NO: 2494076 - RNA, 13 nt, Human
caccaagcucaaa

SEQ ID NO: 2494077 - RNA, 16 nt, Human
caccaagcucaaagcg

SEQ ID NO: 2494078 - RNA, 14 nt, Human
caccaagcucacag

SEQ ID NO: 2494079 - RNA, 15 nt, Human
caccaagcucacagu

SEQ ID NO: 2494080 - RNA, 19 nt, Human
caccaagcucacaguuccu

SEQ ID NO: 2494081 - RNA, 24 nt, Human
caccaauugguuaaucuuuccuga

SEQ ID NO: 2494082 - RNA, 23 nt, Human
caccacccgcuuucuugcugguu

SEQ ID NO: 2494083 - RNA, 22 nt, Human
caccacccuagucccuuccccu

SEQ ID NO: 2494084 - RNA, 22 nt, Human
caccaccuaggccacuccucca

SEQ ID NO: 2494085 - RNA, 16 nt, Human
caccaccucacuccug

SEQ ID NO: 2494086 - RNA, 23 nt, Human
caccaccuaggccacuccuccaa

SEQ ID NO: 2494087 - RNA, 14 nt, Human
caccaccucagagu

SEQ ID NO: 2494088 - RNA, 13 nt, Human
caccaccucagag

SEQ ID NO: 2494089 - RNA, 18 nt, Human
caccaccucacuccuguu

SEQ ID NO: 2494090 - RNA, 17 nt, Human
caccaccucacuccugu

SEQ ID NO: 2494091 - RNA, 14 nt, Human
caccaccucccuca

SEQ ID NO: 2494092 - RNA, 13 nt, Human
caccaccucccuc

SEQ ID NO: 2494093 - RNA, 12 nt, Human
caccaccucucc

SEQ ID NO: 2494094 - RNA, 11 nt, Human
caccacccaaa

SEQ ID NO: 2494095 - RNA, 18 nt, Human
caccaccacuggccacca

SEQ ID NO: 2494096 - RNA, 16 nt, Human
caccaccacuggccac

SEQ ID NO: 2494097 - RNA, 23 nt, Human
caccaccacuggccaccaggcug

SEQ ID NO: 2494098 - RNA, 14 nt, Human
caccaccccagcug

SEQ ID NO: 2494099 - RNA, 22 nt, Human
caccaccccccacucugugccu

SEQ ID NO: 2494100 - RNA, 20 nt, Human
caccaccccccacucugugc

SEQ ID NO: 2494101 - RNA, 18 nt, Human
caccaccccccacucugu

SEQ ID NO: 2494102 - RNA, 16 nt, Human
caccaccccccacucu

SEQ ID NO: 2494103 - RNA, 15 nt, Human
caccaccccccacuc

SEQ ID NO: 2494104 - RNA, 14 nt, Human
caccaccccccacu

SEQ ID NO: 2494105 - RNA, 21 nt, Human
caccaccccagcugcuccccu

SEQ ID NO: 2494106 - RNA, 16 nt, Human
caccaccccagcugcu

SEQ ID NO: 2494107 - RNA, 18 nt, Human
caccacaugugcacaugc

SEQ ID NO: 2494108 - RNA, 15 nt, Human
caccacaugugcaca

SEQ ID NO: 2494109 - RNA, 15 nt, Human
caccaccacuggcca

SEQ ID NO: 2494110 - RNA, 13 nt, Human
caccaccacuggc

SEQ ID NO: 2494111 - RNA, 18 nt, Human
caccaccacgguggucac

SEQ ID NO: 2494112 - RNA, 13 nt, Human
caccaccaagcca

SEQ ID NO: 2494113 - RNA, 14 nt, Human
caccacaucuaagc

SEQ ID NO: 2494114 - RNA, 19 nt, Human
caccacaugugcacaugca

SEQ ID NO: 2494115 - RNA, 14 nt, Human
caccaccucuuugg

SEQ ID NO: 2494116 - RNA, 16 nt, Human
caccacuacauucugu

SEQ ID NO: 2494117 - RNA, 17 nt, Human
caccacuacauucuguu

SEQ ID NO: 2494118 - RNA, 18 nt, Human
caccacuacauucuguua

SEQ ID NO: 2494119 - RNA, 19 nt, Human
caccacuacauucuguuaa

SEQ ID NO: 2494120 - RNA, 20 nt, Human
caccacuacauucuguuaau

SEQ ID NO: 2494121 - RNA, 15 nt, Human
caccacgguggucac

SEQ ID NO: 2494122 - RNA, 15 nt, Human
caccacguccagcug

SEQ ID NO: 2494123 - RNA, 17 nt, Human
caccacgguagugccug

SEQ ID NO: 2494124 - RNA, 16 nt, Human
caccacggccacuggc

SEQ ID NO: 2494125 - RNA, 20 nt, Human
caccacuaggacucugaggc

SEQ ID NO: 2494126 - RNA, 18 nt, Human
cacaugccucucucaggc

SEQ ID NO: 2494127 - RNA, 17 nt, Human
cacaugccucucucagg

SEQ ID NO: 2494128 - RNA, 13 nt, Human
cacaugccucucu

SEQ ID NO: 2494129 - RNA, 19 nt, Human
cacaucagcacgauuucug

SEQ ID NO: 2494130 - RNA, 18 nt, Human
cacaucagcacgauuucu

SEQ ID NO: 2494131 - RNA, 15 nt, Human
cacauauuugauagu

SEQ ID NO: 2494132 - RNA, 12 nt, Human
cacauaucuguc

SEQ ID NO: 2494133 - RNA, 15 nt, Human
cacaugucuuaauga

SEQ ID NO: 2494134 - RNA, 14 nt, Human
cacaugucuuaaug

SEQ ID NO: 2494135 - RNA, 13 nt, Human
cacaugucuuaau

SEQ ID NO: 2494136 - RNA, 12 nt, Human
cacaugucuuaa

SEQ ID NO: 2494137 - RNA, 17 nt, Human
cacauguccuugugugu

SEQ ID NO: 2494138 - RNA, 14 nt, Human
cacauguauguuuu

SEQ ID NO: 2494139 - RNA, 23 nt, Human
cacauguccaagaagcccaggaa

SEQ ID NO: 2494140 - RNA, 17 nt, Human
cacauguaucuaugcau

SEQ ID NO: 2494141 - RNA, 22 nt, Human
cacauggugcuacgccugcaug

SEQ ID NO: 2494142 - RNA, 20 nt, Human
cacauggugcuacgccugca

SEQ ID NO: 2494143 - RNA, 22 nt, Human
cacauggugacuuuugaaaaga

SEQ ID NO: 2494144 - RNA, 20 nt, Human
cacauggggcugggcagcua

SEQ ID NO: 2494145 - RNA, 19 nt, Human
cacaugccucucucaggcc

SEQ ID NO: 2494146 - RNA, 13 nt, Human
cacaucaaagagg

SEQ ID NO: 2494147 - RNA, 19 nt, Human
cacauggggcugggcagcu

SEQ ID NO: 2494148 - RNA, 19 nt, Human
cacauggcuuccuccugcg

SEQ ID NO: 2494149 - RNA, 20 nt, Human
cacauggcuuccuccugcgc

SEQ ID NO: 2494150 - RNA, 18 nt, Human
cacauggcuuccuccugc

SEQ ID NO: 2494151 - RNA, 14 nt, Human
cacauggcuuccuc

SEQ ID NO: 2494152 - RNA, 12 nt, Human
cacauggcuucc

SEQ ID NO: 2494153 - RNA, 15 nt, Human
cacaucagaaaggaa

SEQ ID NO: 2494154 - RNA, 19 nt, Human
cacaucacccuuaccaugu

SEQ ID NO: 2494155 - RNA, 23 nt, Human
cacauggccccucccccugccag

SEQ ID NO: 2494156 - RNA, 15 nt, Human
cacauggccuaugca

SEQ ID NO: 2494157 - RNA, 18 nt, Human
cacauggcuauguuuuag

SEQ ID NO: 2494158 - RNA, 15 nt, Human
cacauguuuccucua

SEQ ID NO: 2494159 - RNA, 14 nt, Human
cacauguuuccucu

SEQ ID NO: 2494160 - RNA, 21 nt, Human
cacauguuuagaguugcaauc

SEQ ID NO: 2494161 - RNA, 18 nt, Human
cacauguuuagaguugca

SEQ ID NO: 2494162 - RNA, 12 nt, Human
cacauguuuccu

SEQ ID NO: 2494163 - RNA, 11 nt, Human
cacaugugugc

SEQ ID NO: 2494164 - RNA, 15 nt, Human
cacaugugacacaua

SEQ ID NO: 2494165 - RNA, 13 nt, Human
cacauguggacuu

SEQ ID NO: 2494166 - RNA, 17 nt, Human
cacaugugcacaugcac

SEQ ID NO: 2494167 - RNA, 22 nt, Human
cacaugucuuaaugaaguuuga

SEQ ID NO: 2494168 - RNA, 18 nt, Human
cacaugucuuaaugaagu

SEQ ID NO: 2494169 - RNA, 17 nt, Human
cacaugucuuaaugaag

SEQ ID NO: 2494170 - RNA, 16 nt, Human
cacaugucuuaaugaa

SEQ ID NO: 2494171 - RNA, 13 nt, Human
cacaugugacaca

SEQ ID NO: 2494172 - RNA, 20 nt, Human
cacaugucuuguacaugugu

SEQ ID NO: 2494173 - RNA, 23 nt, Human
cacaugucuuaaugaaguuugaa

SEQ ID NO: 2494174 - RNA, 15 nt, Human
cacaugucuuguaca

SEQ ID NO: 2494175 - RNA, 15 nt, Human
cacaugugcacaugc

SEQ ID NO: 2494176 - RNA, 14 nt, Human
cacaugugcacaug

SEQ ID NO: 2494177 - RNA, 16 nt, Human
cacauucggcucccug

SEQ ID NO: 2494178 - RNA, 19 nt, Human
cacauuccuugccugcaca

SEQ ID NO: 2494179 - RNA, 18 nt, Human
cacauuccuugccugcac

SEQ ID NO: 2494180 - RNA, 17 nt, Human
cacauucaggaagauga

SEQ ID NO: 2494181 - RNA, 16 nt, Human
cacauuccugaugcuu

SEQ ID NO: 2494182 - RNA, 14 nt, Human
cacauucaggaaga

SEQ ID NO: 2494183 - RNA, 12 nt, Human
cacauucaggaa

SEQ ID NO: 2494184 - RNA, 19 nt, Human
cacauucaacccuggagag

SEQ ID NO: 2494185 - RNA, 15 nt, Human
cacauuauuugcaug

SEQ ID NO: 2494186 - RNA, 20 nt, Human
cacauucaacccuggagagu

SEQ ID NO: 2494187 - RNA, 16 nt, Human
cacauucaauaagcau

SEQ ID NO: 2494188 - RNA, 17 nt, Human
cacauucaacccuggag

SEQ ID NO: 2494189 - RNA, 13 nt, Human
cacauuauuugca

SEQ ID NO: 2494190 - RNA, 14 nt, Human
cacauuauuugcau

SEQ ID NO: 2494191 - RNA, 23 nt, Human
cacauuaucgggagcagugucuu

SEQ ID NO: 2494192 - RNA, 22 nt, Human
cacauuaucgggagcagugucu

SEQ ID NO: 2494193 - RNA, 15 nt, Human
cacauguuuucucug

SEQ ID NO: 2494194 - RNA, 16 nt, Human
cacauuaucgggagca

SEQ ID NO: 2494195 - RNA, 17 nt, Human
cacauuaucgggagcag

SEQ ID NO: 2494196 - RNA, 20 nt, Human
cacauuaucgggagcagugu

SEQ ID NO: 2494197 - RNA, 19 nt, Human
cacauuaauauuugcugac

SEQ ID NO: 2494198 - RNA, 18 nt, Human
cacauuaauauuugcuga

SEQ ID NO: 2494199 - RNA, 23 nt, Human
cacauuaagccuuccacacucac

SEQ ID NO: 2494200 - RNA, 16 nt, Human
caaggucuucagccau

SEQ ID NO: 2494201 - RNA, 18 nt, Human
caaggucuggccucaggu

SEQ ID NO: 2494202 - RNA, 23 nt, Human
caaggugaagaugggaacgcaga

SEQ ID NO: 2494203 - RNA, 14 nt, Human
caaggucuuugguu

SEQ ID NO: 2494204 - RNA, 15 nt, Human
caaggugcaaaucaa

SEQ ID NO: 2494205 - RNA, 13 nt, Human
caaggucuggccu

SEQ ID NO: 2494206 - RNA, 20 nt, Human
caagggcuuuguuuugcaca

SEQ ID NO: 2494207 - RNA, 23 nt, Human
caagggcuucugcacccuccacc

SEQ ID NO: 2494208 - RNA, 21 nt, Human
caagggcuucugcacccucca

SEQ ID NO: 2494209 - RNA, 20 nt, Human
caagggcuucugcacccucc

SEQ ID NO: 2494210 - RNA, 19 nt, Human
caagggcuucugcacccuc

SEQ ID NO: 2494211 - RNA, 18 nt, Human
caagggcuucugcacccu

SEQ ID NO: 2494212 - RNA, 19 nt, Human
caagggcuccccacugccu

SEQ ID NO: 2494213 - RNA, 21 nt, Human
caagggcuuacacguggagga

SEQ ID NO: 2494214 - RNA, 22 nt, Human
caagggcuuacacguggaggaa

SEQ ID NO: 2494215 - RNA, 19 nt, Human
caagggccuggccugagcu

SEQ ID NO: 2494216 - RNA, 23 nt, Human
caaggaguuccaugaagaccaca

SEQ ID NO: 2494217 - RNA, 16 nt, Human
caagggcgcaagagua

SEQ ID NO: 2494218 - RNA, 17 nt, Human
caagggcuccccacugc

SEQ ID NO: 2494219 - RNA, 14 nt, Human
caagggcuccccac

SEQ ID NO: 2494220 - RNA, 16 nt, Human
caagggccuggccuga

SEQ ID NO: 2494221 - RNA, 15 nt, Human
caaggauugcuacug

SEQ ID NO: 2494222 - RNA, 19 nt, Human
caagguggcuccagcacca

SEQ ID NO: 2494223 - RNA, 19 nt, Human
caagguggccaaauuauuu

SEQ ID NO: 2494224 - RNA, 13 nt, Human
caaggugcucaca

SEQ ID NO: 2494225 - RNA, 17 nt, Human
caagguggccaaauuau

SEQ ID NO: 2494226 - RNA, 12 nt, Human
caaggugggagg

SEQ ID NO: 2494227 - RNA, 23 nt, Human
caaggugggaggauugcuugagc

SEQ ID NO: 2494228 - RNA, 22 nt, Human
caaggugggccuugcuaccuca

SEQ ID NO: 2494229 - RNA, 12 nt, Human
caaggugggcug

SEQ ID NO: 2494230 - RNA, 16 nt, Human
caaggugggcugagcc

SEQ ID NO: 2494231 - RNA, 17 nt, Human
caaggugggcugagccc

SEQ ID NO: 2494232 - RNA, 18 nt, Human
caaguccugugaauuucu

SEQ ID NO: 2494233 - RNA, 17 nt, Human
caaguccugugaauuuc

SEQ ID NO: 2494234 - RNA, 15 nt, Human
caaguccugugaauu

SEQ ID NO: 2494235 - RNA, 23 nt, Human
caaguccugaagaggcgggccag

SEQ ID NO: 2494236 - RNA, 20 nt, Human
caaguccugaagaggcgggc

SEQ ID NO: 2494237 - RNA, 19 nt, Human
caaguccugaagaggcggg

SEQ ID NO: 2494238 - RNA, 15 nt, Human
caaguccuuaccucu

SEQ ID NO: 2494239 - RNA, 18 nt, Human
caaguccuuaccucuucc

SEQ ID NO: 2494240 - RNA, 23 nt, Human
caaguccuuaccucuuccggaga

SEQ ID NO: 2494241 - RNA, 17 nt, Human
caagucgaugaacuauu

SEQ ID NO: 2494242 - RNA, 15 nt, Human
caagucuacagagug

SEQ ID NO: 2494243 - RNA, 22 nt, Human
caaguccuuaccucuuccggag

SEQ ID NO: 2494244 - RNA, 18 nt, Human
caaggugggcugagcccu

SEQ ID NO: 2494245 - RNA, 19 nt, Human
caaggugggcugagcccug

SEQ ID NO: 2494246 - RNA, 20 nt, Human
caaggugggcugagcccugg

SEQ ID NO: 2494247 - RNA, 21 nt, Human
caaggugggcugagcccuggc

SEQ ID NO: 2494248 - RNA, 23 nt, Human
caagguggucugcucgggcccag

SEQ ID NO: 2494249 - RNA, 20 nt, Human
caagguggucugcucgggcc

SEQ ID NO: 2494250 - RNA, 22 nt, Human
caagguggggggaucacaaggu

SEQ ID NO: 2494251 - RNA, 23 nt, Human
caaggugggcugagcccuggcag

SEQ ID NO: 2494252 - RNA, 24 nt, Human
caaggugggcugagcccuggcagg

SEQ ID NO: 2494253 - RNA, 20 nt, Human
caagugguagcaagaaguga

SEQ ID NO: 2494254 - RNA, 13 nt, Human
caaguggugccua

SEQ ID NO: 2494255 - RNA, 18 nt, Human
caaguggugguaacccug

SEQ ID NO: 2494256 - RNA, 19 nt, Human
caaguggugguaacccugg

SEQ ID NO: 2494257 - RNA, 20 nt, Human
caaguggugguaacccuggu

SEQ ID NO: 2494258 - RNA, 22 nt, Human
caaguggugguaacccuggugg

SEQ ID NO: 2494259 - RNA, 22 nt, Human
caagugugguagagugugccug

SEQ ID NO: 2494260 - RNA, 19 nt, Human
caaguggggugcugggagg

SEQ ID NO: 2494261 - RNA, 18 nt, Human
caaguggggugcugggag

SEQ ID NO: 2494262 - RNA, 21 nt, Human
caaguggggugcugggaggag

SEQ ID NO: 2494263 - RNA, 17 nt, Human
caaguggggugcuggga

SEQ ID NO: 2494264 - RNA, 15 nt, Human
caaguggggugcugg

SEQ ID NO: 2494265 - RNA, 14 nt, Human
caagugggggcaga

SEQ ID NO: 2494266 - RNA, 20 nt, Human
caagugggggcagagggcag

SEQ ID NO: 2494267 - RNA, 22 nt, Human
caagugggaucugucacaccag

SEQ ID NO: 2494268 - RNA, 20 nt, Human
caagugggaucugucacacc

SEQ ID NO: 2494269 - RNA, 14 nt, Human
caagugcaggcugg

SEQ ID NO: 2494270 - RNA, 20 nt, Human
caagugcaggcuggcaccgc

SEQ ID NO: 2494271 - RNA, 17 nt, Human
caaguggggcucgccau

SEQ ID NO: 2494272 - RNA, 16 nt, Human
caaguggggcucgcca

SEQ ID NO: 2494273 - RNA, 21 nt, Human
caaguggggcucgccaugccg

SEQ ID NO: 2494274 - RNA, 13 nt, Human
caagugggggcag

SEQ ID NO: 2494275 - RNA, 17 nt, Human
caagugggaucugucac

SEQ ID NO: 2494276 - RNA, 19 nt, Human
caagugauugggacagagg

SEQ ID NO: 2494277 - RNA, 18 nt, Human
caagugauugggacagag

SEQ ID NO: 2494278 - RNA, 13 nt, Human
caagugcaggcug

SEQ ID NO: 2494279 - RNA, 19 nt, Human
caagugauugaaaauagua

SEQ ID NO: 2494280 - RNA, 15 nt, Human
caagugauugaaaau

SEQ ID NO: 2494281 - RNA, 14 nt, Human
caagugauucuccu

SEQ ID NO: 2494282 - RNA, 21 nt, Human
caagugauucuccugccucag

SEQ ID NO: 2494283 - RNA, 22 nt, Human
caagugauucuccugccucagc

SEQ ID NO: 2494284 - RNA, 14 nt, Human
caagucuucccuga

SEQ ID NO: 2494285 - RNA, 15 nt, Human
caagucuucccugau

SEQ ID NO: 2494286 - RNA, 12 nt, Human
caagucugcagg

SEQ ID NO: 2494287 - RNA, 13 nt, Human
caagucugcagcc

SEQ ID NO: 2494288 - RNA, 23 nt, Human
caagucucugcuggcccagccaa

SEQ ID NO: 2494289 - RNA, 17 nt, Human
caagucugcaggugcac

SEQ ID NO: 2494290 - RNA, 13 nt, Human
caagucuggaucu

SEQ ID NO: 2494291 - RNA, 18 nt, Human
caagucuggaucugggac

SEQ ID NO: 2494292 - RNA, 19 nt, Human
caagucuggaucugggacc

SEQ ID NO: 2494293 - RNA, 23 nt, Human
caagucucaguggcuucaucugu

SEQ ID NO: 2494294 - RNA, 16 nt, Human
caagucucaguggcuu

SEQ ID NO: 2494295 - RNA, 21 nt, Human
caagucuaugaugcuguugcc

SEQ ID NO: 2494296 - RNA, 20 nt, Human
caagucuaugaugcuguugc

SEQ ID NO: 2494297 - RNA, 19 nt, Human
caagucuacagagugauag

SEQ ID NO: 2494298 - RNA, 16 nt, Human
caagucuacagaguga

SEQ ID NO: 2494299 - RNA, 18 nt, Human
caagucuaugaugcuguu

SEQ ID NO: 2494300 - RNA, 14 nt, Human
caagucuccuuccc

SEQ ID NO: 2494301 - RNA, 17 nt, Human
caagucuccuuccccuu

SEQ ID NO: 2494302 - RNA, 18 nt, Human
caagucucugcuggccca

SEQ ID NO: 2494303 - RNA, 19 nt, Human
caagucucugcuggcccag

SEQ ID NO: 2494304 - RNA, 22 nt, Human
caagucucugcuggcccagcca

SEQ ID NO: 2494305 - RNA, 22 nt, Human
caagugauucucaugccucagc

SEQ ID NO: 2494306 - RNA, 19 nt, Human
caagugaaaaaggaggaag

SEQ ID NO: 2494307 - RNA, 17 nt, Human
caagugauucuccugcc

SEQ ID NO: 2494308 - RNA, 16 nt, Human
caagugauucuccugc

SEQ ID NO: 2494309 - RNA, 21 nt, Human
caaggaugaucuaggaagacu

SEQ ID NO: 2494310 - RNA, 19 nt, Human
caaggaugccccguccccc

SEQ ID NO: 2494311 - RNA, 22 nt, Human
caaggauccugagccagauuuc

SEQ ID NO: 2494312 - RNA, 20 nt, Human
caaggauagaugcuggccca

SEQ ID NO: 2494313 - RNA, 21 nt, Human
caaggauagaugcuggcccag

SEQ ID NO: 2494314 - RNA, 22 nt, Human
caaggauagaugcuggcccagg

SEQ ID NO: 2494315 - RNA, 23 nt, Human
caaggauagaugcuggcccaggg

SEQ ID NO: 2494316 - RNA, 13 nt, Human
caaggauccugag

SEQ ID NO: 2494317 - RNA, 21 nt, Human
caaggaguuccaugaagacca

SEQ ID NO: 2494318 - RNA, 19 nt, Human
caaggaguuccaugaagac

SEQ ID NO: 2494319 - RNA, 16 nt, Human
caaggagucagacauu

SEQ ID NO: 2494320 - RNA, 21 nt, Human
caaggacuacguuaagggaag

SEQ ID NO: 2494321 - RNA, 17 nt, Human
caaggauagaaguauac

SEQ ID NO: 2494322 - RNA, 15 nt, Human
caaggauagaugcug

SEQ ID NO: 2494323 - RNA, 16 nt, Human
caaggauagaugcugg

SEQ ID NO: 2494324 - RNA, 17 nt, Human
caaggauagaugcuggc

SEQ ID NO: 2494325 - RNA, 20 nt, Human
caaggacuacguuaagggaa

SEQ ID NO: 2494326 - RNA, 22 nt, Human
caaggacccagccugagauggu

SEQ ID NO: 2494327 - RNA, 13 nt, Human
caaggaccccuca

SEQ ID NO: 2494328 - RNA, 14 nt, Human
caaggaccccucac

SEQ ID NO: 2494329 - RNA, 15 nt, Human
caaggaccccucacc

SEQ ID NO: 2494330 - RNA, 17 nt, Human
caaggaccccucaccuu

SEQ ID NO: 2494331 - RNA, 20 nt, Human
caaggaccccucaccuugca

SEQ ID NO: 2494332 - RNA, 18 nt, Human
caagcgugagccacugca

SEQ ID NO: 2494333 - RNA, 17 nt, Human
caagcgugagccacugc

SEQ ID NO: 2494334 - RNA, 14 nt, Human
caaggaaaccacag

SEQ ID NO: 2494335 - RNA, 15 nt, Human
caaggaaaaacaggu

SEQ ID NO: 2494336 - RNA, 21 nt, Human
caaggaaaccacagcugcugg

SEQ ID NO: 2494337 - RNA, 20 nt, Human
caaggaaaccacagcugcug

SEQ ID NO: 2494338 - RNA, 18 nt, Human
caaggaaaccacagcugc

SEQ ID NO: 2494339 - RNA, 17 nt, Human
caaggaaaccacagcug

SEQ ID NO: 2494340 - RNA, 22 nt, Human
caaggaaaccacagcugcugga

SEQ ID NO: 2494341 - RNA, 17 nt, Human
caaggaaagccccagca

SEQ ID NO: 2494342 - RNA, 13 nt, Human
caaggaccaggac

SEQ ID NO: 2494343 - RNA, 14 nt, Human
caaggaccaggacu

SEQ ID NO: 2494344 - RNA, 15 nt, Human
caaggaccaggacuc

SEQ ID NO: 2494345 - RNA, 16 nt, Human
caaggaccaggacucc

SEQ ID NO: 2494346 - RNA, 18 nt, Human
caaggaccaggacucccu

SEQ ID NO: 2494347 - RNA, 20 nt, Human
caaggaccaggacucccucc

SEQ ID NO: 2494348 - RNA, 21 nt, Human
caaggaccaggacucccuccu

SEQ ID NO: 2494349 - RNA, 23 nt, Human
caaggaaagggggucccaguggg

SEQ ID NO: 2494350 - RNA, 20 nt, Human
caaggaaagggggucccagu

SEQ ID NO: 2494351 - RNA, 15 nt, Human
caaggaaaggcaaau

SEQ ID NO: 2494352 - RNA, 14 nt, Human
caaggaaaggccug

SEQ ID NO: 2494353 - RNA, 20 nt, Human
caaggaaagccccagcacua

SEQ ID NO: 2494354 - RNA, 22 nt, Human
caaggaaagggggucccagugg

SEQ ID NO: 2494355 - RNA, 18 nt, Human
caaggacagccccuccuc

SEQ ID NO: 2494356 - RNA, 17 nt, Human
caagcacuaaacaaaga

SEQ ID NO: 2494357 - RNA, 17 nt, Human
caagcacugugcucagg

SEQ ID NO: 2494358 - RNA, 18 nt, Human
caagccaagcagccaagc

SEQ ID NO: 2494359 - RNA, 18 nt, Human
caagccaagggaaccugu

SEQ ID NO: 2494360 - RNA, 19 nt, Human
caagccaagcagccaagcu

SEQ ID NO: 2494361 - RNA, 21 nt, Human
caagccaagcagccaagcucc

SEQ ID NO: 2494362 - RNA, 13 nt, Human
caagcacugugcu

SEQ ID NO: 2494363 - RNA, 12 nt, Human
caagcacugugc

SEQ ID NO: 2494364 - RNA, 23 nt, Human
caagcacugcuaggcgagugcca

SEQ ID NO: 2494365 - RNA, 18 nt, Human
caagcacugcuaggcgag

SEQ ID NO: 2494366 - RNA, 15 nt, Human
caagaaagaaacccg

SEQ ID NO: 2494367 - RNA, 18 nt, Human
caagaaacugaggaauuu

SEQ ID NO: 2494368 - RNA, 15 nt, Human
caagaaacucacccc

SEQ ID NO: 2494369 - RNA, 17 nt, Human
caagaaacucaccccca

SEQ ID NO: 2494370 - RNA, 18 nt, Human
caagcaccuccugccucg

SEQ ID NO: 2494371 - RNA, 19 nt, Human
caagaaacugaggaauuuu

SEQ ID NO: 2494372 - RNA, 22 nt, Human
caagaaagaaacccgacagagg

SEQ ID NO: 2494373 - RNA, 16 nt, Human
caagaaagcugguaaa

SEQ ID NO: 2494374 - RNA, 16 nt, Human
caagccguggcuuccc

SEQ ID NO: 2494375 - RNA, 15 nt, Human
caagccguggcuucc

SEQ ID NO: 2494376 - RNA, 14 nt, Human
caagccguggcuuc

SEQ ID NO: 2494377 - RNA, 21 nt, Human
caagcccgacuugcuguuuug

SEQ ID NO: 2494378 - RNA, 21 nt, Human
caagcccuccccaucccaugu

SEQ ID NO: 2494379 - RNA, 21 nt, Human
caagcccuggagccaacugcu

SEQ ID NO: 2494380 - RNA, 16 nt, Human
caagcgugagccacug

SEQ ID NO: 2494381 - RNA, 22 nt, Human
caagccacagaagccaggagca

SEQ ID NO: 2494382 - RNA, 19 nt, Human
caagccacagaagccagga

SEQ ID NO: 2494383 - RNA, 14 nt, Human
caagccacagaagc

SEQ ID NO: 2494384 - RNA, 13 nt, Human
caagccacagaag

SEQ ID NO: 2494385 - RNA, 11 nt, Human
caagccacaga

SEQ ID NO: 2494386 - RNA, 17 nt, Human
caagccaauccccuccu

SEQ ID NO: 2494387 - RNA, 22 nt, Human
caagccaauccccuccuugggc

SEQ ID NO: 2494388 - RNA, 15 nt, Human
caagccaauccccuc

SEQ ID NO: 2494389 - RNA, 14 nt, Human
caagccaauccccu

SEQ ID NO: 2494390 - RNA, 23 nt, Human
caagccaagggaaccuguguccg

SEQ ID NO: 2494391 - RNA, 22 nt, Human
caagccaagggaaccugugucc

SEQ ID NO: 2494392 - RNA, 21 nt, Human
caagccaagggaaccuguguc

SEQ ID NO: 2494393 - RNA, 21 nt, Human
caagccaccaacauacuccca

SEQ ID NO: 2494394 - RNA, 18 nt, Human
caagccccugcccaucug

SEQ ID NO: 2494395 - RNA, 17 nt, Human
caagccccugcccaucu

SEQ ID NO: 2494396 - RNA, 21 nt, Human
caagccccugcuccagaagau

SEQ ID NO: 2494397 - RNA, 13 nt, Human
caagccccugccc

SEQ ID NO: 2494398 - RNA, 17 nt, Human
caagcccccccuuccac

SEQ ID NO: 2494399 - RNA, 18 nt, Human
caagcccccccuuccacu

SEQ ID NO: 2494400 - RNA, 15 nt, Human
caacgcagcccugcu

SEQ ID NO: 2494401 - RNA, 13 nt, Human
caacgcagcccug

SEQ ID NO: 2494402 - RNA, 15 nt, Human
caacgaggaagcccu

SEQ ID NO: 2494403 - RNA, 12 nt, Human
caacgcagcccu

SEQ ID NO: 2494404 - RNA, 19 nt, Human
caacucuccuccagaguca

SEQ ID NO: 2494405 - RNA, 18 nt, Human
caacgcagcccugcuuug

SEQ ID NO: 2494406 - RNA, 16 nt, Human
caaccugauugugucu

SEQ ID NO: 2494407 - RNA, 21 nt, Human
caaccugaccaacauggagaa

SEQ ID NO: 2494408 - RNA, 12 nt, Human
caacgaggaagc

SEQ ID NO: 2494409 - RNA, 13 nt, Human
caacgaggaagcc

SEQ ID NO: 2494410 - RNA, 20 nt, Human
caaccugaccaacauggaga

SEQ ID NO: 2494411 - RNA, 23 nt, Human
caaccugaccaacauggagaaac

SEQ ID NO: 2494412 - RNA, 13 nt, Human
caaccucuuggcc

SEQ ID NO: 2494413 - RNA, 15 nt, Human
caaccucuuggccug

SEQ ID NO: 2494414 - RNA, 17 nt, Human
caaccucuucuggcuca

SEQ ID NO: 2494415 - RNA, 18 nt, Human
caaccucuucuggcucaa

SEQ ID NO: 2494416 - RNA, 15 nt, Human
caaccugaccaacau

SEQ ID NO: 2494417 - RNA, 16 nt, Human
caaccugaaccuagga

SEQ ID NO: 2494418 - RNA, 13 nt, Human
caaccugaaccua

SEQ ID NO: 2494419 - RNA, 12 nt, Human
caaccugaaccu

SEQ ID NO: 2494420 - RNA, 15 nt, Human
caacccucaucacca

SEQ ID NO: 2494421 - RNA, 12 nt, Human
caacccucauca

SEQ ID NO: 2494422 - RNA, 16 nt, Human
caacccuguuuccuga

SEQ ID NO: 2494423 - RNA, 15 nt, Human
caacccuguuuccug

SEQ ID NO: 2494424 - RNA, 13 nt, Human
caacccuguuucc

SEQ ID NO: 2494425 - RNA, 12 nt, Human
caacccugucug

SEQ ID NO: 2494426 - RNA, 11 nt, Human
caacccugucu

SEQ ID NO: 2494427 - RNA, 17 nt, Human
caacccucccucagccc

SEQ ID NO: 2494428 - RNA, 14 nt, Human
caaccaccgcuccc

SEQ ID NO: 2494429 - RNA, 14 nt, Human
caacccucccucag

SEQ ID NO: 2494430 - RNA, 13 nt, Human
caacccuucccca

SEQ ID NO: 2494431 - RNA, 12 nt, Human
caacccuucccc

SEQ ID NO: 2494432 - RNA, 17 nt, Human
caacccuucccucaccu

SEQ ID NO: 2494433 - RNA, 22 nt, Human
caacccuuaccccuuagccucc

SEQ ID NO: 2494434 - RNA, 11 nt, Human
caacccuuccc

SEQ ID NO: 2494435 - RNA, 19 nt, Human
caacccuguuuuauacugu

SEQ ID NO: 2494436 - RNA, 17 nt, Human
caacccuguuuccugag

SEQ ID NO: 2494437 - RNA, 17 nt, Human
caacccuguuuuauacu

SEQ ID NO: 2494438 - RNA, 15 nt, Human
caacccuuaccccuu

SEQ ID NO: 2494439 - RNA, 19 nt, Human
caacccuuaccccuuagcc

SEQ ID NO: 2494440 - RNA, 20 nt, Human
caacccuuaccccuuagccu

SEQ ID NO: 2494441 - RNA, 16 nt, Human
caaccucuucuggcuc

SEQ ID NO: 2494442 - RNA, 19 nt, Human
caacccuuuugucugccuc

SEQ ID NO: 2494443 - RNA, 23 nt, Human
caacccuucuccucuuguaaaua

SEQ ID NO: 2494444 - RNA, 21 nt, Human
caacccuucuccucuuguaaa

SEQ ID NO: 2494445 - RNA, 20 nt, Human
caacccuucuccucuuguaa

SEQ ID NO: 2494446 - RNA, 18 nt, Human
caacccuucccucaccuu

SEQ ID NO: 2494447 - RNA, 10 nt, Human
caacccuucu

SEQ ID NO: 2494448 - RNA, 23 nt, Human
caacuuucuguaaacucaaaacu

SEQ ID NO: 2494449 - RNA, 12 nt, Human
caacuuuguaua

SEQ ID NO: 2494450 - RNA, 11 nt, Human
caacuuuguau

SEQ ID NO: 2494451 - RNA, 16 nt, Human
caacuuucuguaaacu

SEQ ID NO: 2494452 - RNA, 12 nt, Human
caacuuucugua

SEQ ID NO: 2494453 - RNA, 11 nt, Human
caacuuucugu

SEQ ID NO: 2494454 - RNA, 14 nt, Human
caacuuacuacuga

SEQ ID NO: 2494455 - RNA, 18 nt, Human
caacuuagaucuccagga

SEQ ID NO: 2494456 - RNA, 21 nt, Human
caacuuaauguucugaauaau

SEQ ID NO: 2494457 - RNA, 16 nt, Human
caacuucaagugcaug

SEQ ID NO: 2494458 - RNA, 17 nt, Human
caacuucaagugcaugc

SEQ ID NO: 2494459 - RNA, 18 nt, Human
caacuucaagugcaugcu

SEQ ID NO: 2494460 - RNA, 18 nt, Human
caacuucagcaguaccua

SEQ ID NO: 2494461 - RNA, 22 nt, Human
caacuucaagugcaugcucucu

SEQ ID NO: 2494462 - RNA, 22 nt, Human
caacuuuaagcagcucuugcua

SEQ ID NO: 2494463 - RNA, 22 nt, Human
caacuugucuuuuucuggacug

SEQ ID NO: 2494464 - RNA, 21 nt, Human
caacuuuaagcagcucuugcu

SEQ ID NO: 2494465 - RNA, 18 nt, Human
caacuuuaagcagcucuu

SEQ ID NO: 2494466 - RNA, 16 nt, Human
caacuuuaagaggaca

SEQ ID NO: 2494467 - RNA, 19 nt, Human
caacuucaugucaacuucu

SEQ ID NO: 2494468 - RNA, 23 nt, Human
caacuucccaguucaggaguccc

SEQ ID NO: 2494469 - RNA, 20 nt, Human
caacucuccuccagagucag

SEQ ID NO: 2494470 - RNA, 14 nt, Human
caacugccuacucc

SEQ ID NO: 2494471 - RNA, 15 nt, Human
caacugccuacucca

SEQ ID NO: 2494472 - RNA, 16 nt, Human
caacugcauuggcuuu

SEQ ID NO: 2494473 - RNA, 18 nt, Human
caacugccuacuccaaaa

SEQ ID NO: 2494474 - RNA, 22 nt, Human
caacugccuacuccaaaauguu

SEQ ID NO: 2494475 - RNA, 21 nt, Human
caacugccucgaaacacagaa

SEQ ID NO: 2494476 - RNA, 23 nt, Human
caacugccucgaaacacagaaac

SEQ ID NO: 2494477 - RNA, 14 nt, Human
caacugcugcuuuu

SEQ ID NO: 2494478 - RNA, 12 nt, Human
caacugcugcuu

SEQ ID NO: 2494479 - RNA, 19 nt, Human
caacuguuaugaaauaaag

SEQ ID NO: 2494480 - RNA, 19 nt, Human
caacuguugauugcaggaa

SEQ ID NO: 2494481 - RNA, 19 nt, Human
caacuguuguaacuaggcu

SEQ ID NO: 2494482 - RNA, 15 nt, Human
caacuuaauguucug

SEQ ID NO: 2494483 - RNA, 21 nt, Human
caacauguguacuuaauuucu

SEQ ID NO: 2494484 - RNA, 20 nt, Human
caacauguagcugaguuuaa

SEQ ID NO: 2494485 - RNA, 17 nt, Human
caacauguuacugacca

SEQ ID NO: 2494486 - RNA, 18 nt, Human
caacauguuacugaccag

SEQ ID NO: 2494487 - RNA, 20 nt, Human
caacauguuacugaccagca

SEQ ID NO: 2494488 - RNA, 23 nt, Human
caacauguauaauauuuuuaauu

SEQ ID NO: 2494489 - RNA, 19 nt, Human
caacauguauaauauuuuu

SEQ ID NO: 2494490 - RNA, 18 nt, Human
caacauguauaauauuuu

SEQ ID NO: 2494491 - RNA, 17 nt, Human
caacauguauaauauuu

SEQ ID NO: 2494492 - RNA, 22 nt, Human
caacauguugggaaacuuggcu

SEQ ID NO: 2494493 - RNA, 19 nt, Human
caacauguugggaaacuug

SEQ ID NO: 2494494 - RNA, 23 nt, Human
caacauguugggaaacuuggcuc

SEQ ID NO: 2494495 - RNA, 20 nt, Human
caacauuaaaacaauauugu

SEQ ID NO: 2494496 - RNA, 21 nt, Human
caacauuacagggaaugccug

SEQ ID NO: 2494497 - RNA, 17 nt, Human
caacauugcuugugcca

SEQ ID NO: 2494498 - RNA, 22 nt, Human
caacauugcuggcuggaaggga

SEQ ID NO: 2494499 - RNA, 15 nt, Human
caacauugccuauuu

SEQ ID NO: 2494500 - RNA, 15 nt, Human
caacaugagucaaga

SEQ ID NO: 2494501 - RNA, 14 nt, Human
caacaucugagugc

SEQ ID NO: 2494502 - RNA, 13 nt, Human
caacaucuuuucu

SEQ ID NO: 2494503 - RNA, 13 nt, Human
caacaucuagcaa

SEQ ID NO: 2494504 - RNA, 18 nt, Human
caacaucccauugcccug

SEQ ID NO: 2494505 - RNA, 19 nt, Human
caacaucccauugcccugg

SEQ ID NO: 2494506 - RNA, 20 nt, Human
caacaucccauugcccuggu

SEQ ID NO: 2494507 - RNA, 23 nt, Human
caacauggagaaacccugucucu

SEQ ID NO: 2494508 - RNA, 22 nt, Human
caacauggagaaacccugucuc

SEQ ID NO: 2494509 - RNA, 23 nt, Human
caacaugccugccccaaacaaau

SEQ ID NO: 2494510 - RNA, 13 nt, Human
caacauggagaaa

SEQ ID NO: 2494511 - RNA, 18 nt, Human
caacauggugaaaccccg

SEQ ID NO: 2494512 - RNA, 16 nt, Human
caacauggugucugga

SEQ ID NO: 2494513 - RNA, 15 nt, Human
caacauggugucugg

SEQ ID NO: 2494514 - RNA, 13 nt, Human
caacauguauaau

SEQ ID NO: 2494515 - RNA, 19 nt, Human
caaccccuucgcuccugug

SEQ ID NO: 2494516 - RNA, 18 nt, Human
caaccccuucgcuccugu

SEQ ID NO: 2494517 - RNA, 18 nt, Human
caacccucagagccaccc

SEQ ID NO: 2494518 - RNA, 21 nt, Human
caacccucagagccaccccua

SEQ ID NO: 2494519 - RNA, 21 nt, Human
caaccccuucgcuccuguguc

SEQ ID NO: 2494520 - RNA, 14 nt, Human
caacauuucucaau

SEQ ID NO: 2494521 - RNA, 17 nt, Human
caacauuucucaauaau

SEQ ID NO: 2494522 - RNA, 16 nt, Human
caacauuucucaauaa

SEQ ID NO: 2494523 - RNA, 20 nt, Human
caaccaagucaugugcauuu

SEQ ID NO: 2494524 - RNA, 18 nt, Human
caaccaagucaugugcau

SEQ ID NO: 2494525 - RNA, 16 nt, Human
caaccaauguagaaag

SEQ ID NO: 2494526 - RNA, 15 nt, Human
caacagguuuuccug

SEQ ID NO: 2494527 - RNA, 18 nt, Human
caacaggguuuuuuucca

SEQ ID NO: 2494528 - RNA, 19 nt, Human
caacagguuuuccugaaga

SEQ ID NO: 2494529 - RNA, 23 nt, Human
caacagguggcaggaccaggacu

SEQ ID NO: 2494530 - RNA, 22 nt, Human
caacagguggcaggaccaggac

SEQ ID NO: 2494531 - RNA, 13 nt, Human
caacagguuuuau

SEQ ID NO: 2494532 - RNA, 21 nt, Human
caacagguggcaggaccagga

SEQ ID NO: 2494533 - RNA, 18 nt, Human
caacagguggcaggacca

SEQ ID NO: 2494534 - RNA, 15 nt, Human
caacaucccauugcc

SEQ ID NO: 2494535 - RNA, 17 nt, Human
caacaucccauugcccu

SEQ ID NO: 2494536 - RNA, 22 nt, Human
caacaucuuggucagauuugaa

SEQ ID NO: 2494537 - RNA, 18 nt, Human
caacagucaaaacagaga

SEQ ID NO: 2494538 - RNA, 20 nt, Human
caacaguagcauaggacccu

SEQ ID NO: 2494539 - RNA, 14 nt, Human
caacagucaaaaca

SEQ ID NO: 2494540 - RNA, 18 nt, Human
caacaucaauguucauug

SEQ ID NO: 2494541 - RNA, 22 nt, Human
caacaucaauguucauuguaau

SEQ ID NO: 2494542 - RNA, 13 nt, Human
caacaucaauguu

SEQ ID NO: 2494543 - RNA, 15 nt, Human
caacaucaauguuca

SEQ ID NO: 2494544 - RNA, 16 nt, Human
caacaucaauguucau

SEQ ID NO: 2494545 - RNA, 17 nt, Human
caacaucaauguucauu

SEQ ID NO: 2494546 - RNA, 24 nt, Human
caacaggcugggcuucaguggcag

SEQ ID NO: 2494547 - RNA, 15 nt, Human
caaauuuacagagac

SEQ ID NO: 2494548 - RNA, 23 nt, Human
caacaggcugggcuucaguggca

SEQ ID NO: 2494549 - RNA, 15 nt, Human
caaauucugucucug

SEQ ID NO: 2494550 - RNA, 14 nt, Human
caaauuuacagaga

SEQ ID NO: 2494551 - RNA, 16 nt, Human
caaauucgcaaacuuu

SEQ ID NO: 2494552 - RNA, 22 nt, Human
caaauucucaaccuaccacccc

SEQ ID NO: 2494553 - RNA, 21 nt, Human
caaauucucaaccuaccaccc

SEQ ID NO: 2494554 - RNA, 15 nt, Human
caaauucucaccaaa

SEQ ID NO: 2494555 - RNA, 17 nt, Human
caacuucuacuucugcc

SEQ ID NO: 2494556 - RNA, 18 nt, Human
caaagcuaggccuggcca

SEQ ID NO: 2494557 - RNA, 17 nt, Human
caaagcuaggccuggcc

SEQ ID NO: 2494558 - RNA, 16 nt, Human
caaagcuaggccuggc

SEQ ID NO: 2494559 - RNA, 15 nt, Human
caaagcuaggccugg

SEQ ID NO: 2494560 - RNA, 21 nt, Human
caaagccaaagcuaggccugg

SEQ ID NO: 2494561 - RNA, 17 nt, Human
caaagcauugagcaaag

SEQ ID NO: 2494562 - RNA, 17 nt, Human
caaagccaaacucugcc

SEQ ID NO: 2494563 - RNA, 18 nt, Human
caaagccaaacucugcca

SEQ ID NO: 2494564 - RNA, 22 nt, Human
caaagccaaacucugccagcca

SEQ ID NO: 2494565 - RNA, 20 nt, Human
caaagccaaagcuaggccug

SEQ ID NO: 2494566 - RNA, 20 nt, Human
caaagcuucuaucccaggag

SEQ ID NO: 2494567 - RNA, 19 nt, Human
caaagcuucuaucccagga

SEQ ID NO: 2494568 - RNA, 18 nt, Human
caaagcuucuaucccagg

SEQ ID NO: 2494569 - RNA, 21 nt, Human
caaagcuucuaucccaggagg

SEQ ID NO: 2494570 - RNA, 14 nt, Human
caaagcuugaagau

SEQ ID NO: 2494571 - RNA, 19 nt, Human
caaagcuuggaagagccug

SEQ ID NO: 2494572 - RNA, 19 nt, Human
caaagcuugaagaucguua

SEQ ID NO: 2494573 - RNA, 16 nt, Human
caaagcuuagcaggag

SEQ ID NO: 2494574 - RNA, 15 nt, Human
caaagcuuagcagga

SEQ ID NO: 2494575 - RNA, 14 nt, Human
caaagcuuagcagg

SEQ ID NO: 2494576 - RNA, 18 nt, Human
caaagcuuagcaggagag

SEQ ID NO: 2494577 - RNA, 17 nt, Human
caaagcuuagcaggaga

SEQ ID NO: 2494578 - RNA, 22 nt, Human
caaagcuuagcaggagaggaga

SEQ ID NO: 2494579 - RNA, 16 nt, Human
caaagcuuuccugccc

SEQ ID NO: 2494580 - RNA, 14 nt, Human
caaagcuuuccugc

SEQ ID NO: 2494581 - RNA, 22 nt, Human
caaagcuuggaagagccugcag

SEQ ID NO: 2494582 - RNA, 13 nt, Human
caaagcuuuccug

SEQ ID NO: 2494583 - RNA, 16 nt, Human
caaagcuuguuaagau

SEQ ID NO: 2494584 - RNA, 16 nt, Human
caaagcuuuuuccaga

SEQ ID NO: 2494585 - RNA, 20 nt, Human
caaagcuuuuagaaauacug

SEQ ID NO: 2494586 - RNA, 22 nt, Human
caaagcuuuccugccccaggcc

SEQ ID NO: 2494587 - RNA, 18 nt, Human
caaagcuuuccugcccca

SEQ ID NO: 2494588 - RNA, 23 nt, Human
caaagcuuuccugccccaggccu

SEQ ID NO: 2494589 - RNA, 21 nt, Human
caaagcuuggaagagccugca

SEQ ID NO: 2494590 - RNA, 21 nt, Human
caaaggaaaaagcacaagaag

SEQ ID NO: 2494591 - RNA, 18 nt, Human
caaaggaaaaagcacaag

SEQ ID NO: 2494592 - RNA, 16 nt, Human
caaagcuuuuagaaau

SEQ ID NO: 2494593 - RNA, 22 nt, Human
caaaggaaaauaguaauguuuu

SEQ ID NO: 2494594 - RNA, 22 nt, Human
caaaggaaaaagcacaagaagc

SEQ ID NO: 2494595 - RNA, 17 nt, Human
caaaggaggcuggcagg

SEQ ID NO: 2494596 - RNA, 20 nt, Human
caaaggagggucaggaagga

SEQ ID NO: 2494597 - RNA, 16 nt, Human
caaaggaguagaaaga

SEQ ID NO: 2494598 - RNA, 18 nt, Human
caaacuuuuauacucuuu

SEQ ID NO: 2494599 - RNA, 17 nt, Human
caaacuuggauuuuuga

SEQ ID NO: 2494600 - RNA, 12 nt, Human
caaacuuuauuu

SEQ ID NO: 2494601 - RNA, 22 nt, Human
caaacuuggaauuuguaaccuc

SEQ ID NO: 2494602 - RNA, 15 nt, Human
caaacuucagacuga

SEQ ID NO: 2494603 - RNA, 19 nt, Human
caaacuuuuccccuguccu

SEQ ID NO: 2494604 - RNA, 13 nt, Human
caaagaaacccaa

SEQ ID NO: 2494605 - RNA, 13 nt, Human
caaagaggcaaga

SEQ ID NO: 2494606 - RNA, 14 nt, Human
caaagaggcaagag

SEQ ID NO: 2494607 - RNA, 20 nt, Human
caaagaggcugaggcuggca

SEQ ID NO: 2494608 - RNA, 22 nt, Human
caaagaggcugaggcuggcaca

SEQ ID NO: 2494609 - RNA, 15 nt, Human
caaagaggcaagagg

SEQ ID NO: 2494610 - RNA, 20 nt, Human
caaagaggcaagaggcugga

SEQ ID NO: 2494611 - RNA, 22 nt, Human
caaagagggcuuccucuagaag

SEQ ID NO: 2494612 - RNA, 18 nt, Human
caaagagggcuuccucua

SEQ ID NO: 2494613 - RNA, 16 nt, Human
caaagagggcuuccuc

SEQ ID NO: 2494614 - RNA, 15 nt, Human
caaagagggcuuccu

SEQ ID NO: 2494615 - RNA, 13 nt, Human
caaagagguauuu

SEQ ID NO: 2494616 - RNA, 14 nt, Human
caaagagggcuucc

SEQ ID NO: 2494617 - RNA, 18 nt, Human
auuuuuuuacuaauagac

SEQ ID NO: 2494618 - RNA, 17 nt, Human
auuuuuuuaauuuugua

SEQ ID NO: 2494619 - RNA, 16 nt, Human
auuuuuuuaauuuugu

SEQ ID NO: 2494620 - RNA, 18 nt, Human
auuuuuuuaauuuacaaa

SEQ ID NO: 2494621 - RNA, 13 nt, Human
auuuuuuuaagcu

SEQ ID NO: 2494622 - RNA, 12 nt, Human
auuuuuuuaagc

SEQ ID NO: 2494623 - RNA, 18 nt, Human
auuuuuuuaagcuguaaa

SEQ ID NO: 2494624 - RNA, 22 nt, Human
auuuuuuuauuguuuaaagcaa

SEQ ID NO: 2494625 - RNA, 18 nt, Human
auuuuuuuauuguuuaaa

SEQ ID NO: 2494626 - RNA, 16 nt, Human
auuuuuuuauuacuga

SEQ ID NO: 2494627 - RNA, 21 nt, Human
auuuuuuuaucuugggacugg

SEQ ID NO: 2494628 - RNA, 23 nt, Human
auuuuuuuagaaagcauuugaau

SEQ ID NO: 2494629 - RNA, 17 nt, Human
auuuuuuuagaaagcau

SEQ ID NO: 2494630 - RNA, 23 nt, Human
caaaaaaauauauuuaaugauaa

SEQ ID NO: 2494631 - RNA, 21 nt, Human
auuuuuuucacuggaguuaca

SEQ ID NO: 2494632 - RNA, 14 nt, Human
auuuuuuucaccuc

SEQ ID NO: 2494633 - RNA, 15 nt, Human
auuuuuuucaauauu

SEQ ID NO: 2494634 - RNA, 21 nt, Human
caaaaaaaucugcagaaggaa

SEQ ID NO: 2494635 - RNA, 17 nt, Human
caaaaaaaucugcagaa

SEQ ID NO: 2494636 - RNA, 16 nt, Human
caaaaaaaucugcaga

SEQ ID NO: 2494637 - RNA, 14 nt, Human
caaaaaacugcagu

SEQ ID NO: 2494638 - RNA, 21 nt, Human
caaaaaacucgaggacuguau

SEQ ID NO: 2494639 - RNA, 15 nt, Human
caaaaaacucgagga

SEQ ID NO: 2494640 - RNA, 14 nt, Human
caaaaaaauuaaau

SEQ ID NO: 2494641 - RNA, 15 nt, Human
caaaaaacugcagug

SEQ ID NO: 2494642 - RNA, 12 nt, Human
caaaaaaugagc

SEQ ID NO: 2494643 - RNA, 13 nt, Human
caaacuugcuuua

SEQ ID NO: 2494644 - RNA, 23 nt, Human
caaacuuccagugcaacacugaa

SEQ ID NO: 2494645 - RNA, 22 nt, Human
caaauucugcuugcuugcuuuu

SEQ ID NO: 2494646 - RNA, 16 nt, Human
caaauucauauucugu

SEQ ID NO: 2494647 - RNA, 14 nt, Human
caaauucauuuuuu

SEQ ID NO: 2494648 - RNA, 21 nt, Human
caaauguucaucaaugaauga

SEQ ID NO: 2494649 - RNA, 20 nt, Human
caaauguucaucaaugaaug

SEQ ID NO: 2494650 - RNA, 14 nt, Human
caaauguggcuccu

SEQ ID NO: 2494651 - RNA, 23 nt, Human
caaauguguacauggcagaguuu

SEQ ID NO: 2494652 - RNA, 20 nt, Human
caaauguguacauggcagag

SEQ ID NO: 2494653 - RNA, 20 nt, Human
caaauguguaucggaugcuu

SEQ ID NO: 2494654 - RNA, 17 nt, Human
caaaugugaccuguguc

SEQ ID NO: 2494655 - RNA, 13 nt, Human
caaaucagccaug

SEQ ID NO: 2494656 - RNA, 14 nt, Human
caaaugugaccugu

SEQ ID NO: 2494657 - RNA, 14 nt, Human
caaaucacugaacu

SEQ ID NO: 2494658 - RNA, 22 nt, Human
caaauauaagaauaaaauguug

SEQ ID NO: 2494659 - RNA, 18 nt, Human
caaauaugcaaagcacug

SEQ ID NO: 2494660 - RNA, 16 nt, Human
caaauaugcaaagcac

SEQ ID NO: 2494661 - RNA, 17 nt, Human
caaauaugcaaagcacu

SEQ ID NO: 2494662 - RNA, 15 nt, Human
caaaucacugaacuu

SEQ ID NO: 2494663 - RNA, 13 nt, Human
caaaucagcugcu

SEQ ID NO: 2494664 - RNA, 15 nt, Human
caaaugucuuccugg

SEQ ID NO: 2494665 - RNA, 18 nt, Human
caaaugucuuccuggauu

SEQ ID NO: 2494666 - RNA, 16 nt, Human
caaaucagcugcuacu

SEQ ID NO: 2494667 - RNA, 21 nt, Human
caaauaaaaacuaaauuguaa

SEQ ID NO: 2494668 - RNA, 19 nt, Human
caaauaaaaacuaaauugu

SEQ ID NO: 2494669 - RNA, 22 nt, Human
caaauaaaaacuaaauuguaaa

SEQ ID NO: 2494670 - RNA, 17 nt, Human
caaauaaaaacuaaauu

SEQ ID NO: 2494671 - RNA, 21 nt, Human
caaaguuuugaaaagcuauua

SEQ ID NO: 2494672 - RNA, 20 nt, Human
caaaguuuugaaaagcuauu

SEQ ID NO: 2494673 - RNA, 19 nt, Human
caaaguuuugaaaagcuau

SEQ ID NO: 2494674 - RNA, 18 nt, Human
caaaguuuugaaaagcua

SEQ ID NO: 2494675 - RNA, 17 nt, Human
caaaguuuugaaaagcu

SEQ ID NO: 2494676 - RNA, 14 nt, Human
caaaguuuugaaaa

SEQ ID NO: 2494677 - RNA, 13 nt, Human
caaaguuuugaaa

SEQ ID NO: 2494678 - RNA, 13 nt, Human
caaaggauacugu

SEQ ID NO: 2494679 - RNA, 13 nt, Human
caaaggaugugau

SEQ ID NO: 2494680 - RNA, 21 nt, Human
caaaggaugcccaaagaugca

SEQ ID NO: 2494681 - RNA, 17 nt, Human
caaaggaugugauauau

SEQ ID NO: 2494682 - RNA, 14 nt, Human
caaaggaugugaua

SEQ ID NO: 2494683 - RNA, 21 nt, Human
caaaggaugugauauauaagu

SEQ ID NO: 2494684 - RNA, 15 nt, Human
caaaggcaagcacuu

SEQ ID NO: 2494685 - RNA, 17 nt, Human
caaaguuggggcaggcu

SEQ ID NO: 2494686 - RNA, 12 nt, Human
caaauacuuuaa

SEQ ID NO: 2494687 - RNA, 21 nt, Human
caaauacuguguuucagaagc

SEQ ID NO: 2494688 - RNA, 16 nt, Human
caaauacuuuaaagga

SEQ ID NO: 2494689 - RNA, 23 nt, Human
caaauaaugucucugugagacuc

SEQ ID NO: 2494690 - RNA, 20 nt, Human
caaauaaugucucugugaga

SEQ ID NO: 2494691 - RNA, 16 nt, Human
caaauaaugucucugu

SEQ ID NO: 2494692 - RNA, 13 nt, Human
caaauaaugucuc

SEQ ID NO: 2494693 - RNA, 14 nt, Human
caaauaauaagcaa

SEQ ID NO: 2494694 - RNA, 12 nt, Human
caaauauauuca

SEQ ID NO: 2494695 - RNA, 14 nt, Human
caaauaugcaaagc

SEQ ID NO: 2494696 - RNA, 18 nt, Human
caaauauaagaauaaaau

SEQ ID NO: 2494697 - RNA, 14 nt, Human
caaauauaagaaua

SEQ ID NO: 2494698 - RNA, 15 nt, Human
caaauagugcucgcu

SEQ ID NO: 2494699 - RNA, 20 nt, Human
caaauaguuuauaaauguga

SEQ ID NO: 2494700 - RNA, 19 nt, Human
caaauacuuuaaaggaaaa

SEQ ID NO: 2494701 - RNA, 15 nt, Human
caaauagcauaaguu

SEQ ID NO: 2494702 - RNA, 22 nt, Human
cacccccacccaagggccuggc

SEQ ID NO: 2494703 - RNA, 15 nt, Human
cacccccaccaaggg

SEQ ID NO: 2494704 - RNA, 11 nt, Human
cacccccacca

SEQ ID NO: 2494705 - RNA, 12 nt, Human
cacccccacacc

SEQ ID NO: 2494706 - RNA, 17 nt, Human
caccccauuuucugugg

SEQ ID NO: 2494707 - RNA, 12 nt, Human
cacccccaaggg

SEQ ID NO: 2494708 - RNA, 19 nt, Human
cacccccaaggggcagucu

SEQ ID NO: 2494709 - RNA, 14 nt, Human
cacccccaccccuu

SEQ ID NO: 2494710 - RNA, 17 nt, Human
cacccccacccccagcu

SEQ ID NO: 2494711 - RNA, 14 nt, Human
cacccccaccccca

SEQ ID NO: 2494712 - RNA, 11 nt, Human
cacccccaccc

SEQ ID NO: 2494713 - RNA, 18 nt, Human
caccccccacacucacuc

SEQ ID NO: 2494714 - RNA, 13 nt, Human
caccccccacacu

SEQ ID NO: 2494715 - RNA, 15 nt, Human
caccccccaagcugu

SEQ ID NO: 2494716 - RNA, 16 nt, Human
caccccccacucugug

SEQ ID NO: 2494717 - RNA, 23 nt, Human
caccccccacacucacuccugag

SEQ ID NO: 2494718 - RNA, 13 nt, Human
caccccccagaac

SEQ ID NO: 2494719 - RNA, 18 nt, Human
caccccccagaaccuguc

SEQ ID NO: 2494720 - RNA, 19 nt, Human
caccccccagaaccugucc

SEQ ID NO: 2494721 - RNA, 20 nt, Human
caccccccagaaccuguccu

SEQ ID NO: 2494722 - RNA, 21 nt, Human
caccccccagaaccuguccuu

SEQ ID NO: 2494723 - RNA, 13 nt, Human
caccccccugggc

SEQ ID NO: 2494724 - RNA, 12 nt, Human
caccccccucau

SEQ ID NO: 2494725 - RNA, 17 nt, Human
cacccccagcugcuugu

SEQ ID NO: 2494726 - RNA, 13 nt, Human
cacccccagcugc

SEQ ID NO: 2494727 - RNA, 14 nt, Human
cacccccagcucaa

SEQ ID NO: 2494728 - RNA, 13 nt, Human
cacccccagcuca

SEQ ID NO: 2494729 - RNA, 12 nt, Human
cacccccagcuc

SEQ ID NO: 2494730 - RNA, 14 nt, Human
caccccccaagcug

SEQ ID NO: 2494731 - RNA, 17 nt, Human
cacccccaucucucccu

SEQ ID NO: 2494732 - RNA, 12 nt, Human
cacccccagcuu

SEQ ID NO: 2494733 - RNA, 13 nt, Human
cacccccaucucu

SEQ ID NO: 2494734 - RNA, 16 nt, Human
cacccccuccccgccc

SEQ ID NO: 2494735 - RNA, 18 nt, Human
cacccccuccccagggga

SEQ ID NO: 2494736 - RNA, 13 nt, Human
cacccccucccug

SEQ ID NO: 2494737 - RNA, 14 nt, Human
cacccccuccccag

SEQ ID NO: 2494738 - RNA, 15 nt, Human
cacccccuccccagg

SEQ ID NO: 2494739 - RNA, 16 nt, Human
cacccccuccccaggg

SEQ ID NO: 2494740 - RNA, 17 nt, Human
cacccccuccccagggg

SEQ ID NO: 2494741 - RNA, 20 nt, Human
cacccccucaagccaauccc

SEQ ID NO: 2494742 - RNA, 11 nt, Human
cacccccuccc

SEQ ID NO: 2494743 - RNA, 16 nt, Human
cacccccuccugcugc

SEQ ID NO: 2494744 - RNA, 15 nt, Human
cacccccuccugcug

SEQ ID NO: 2494745 - RNA, 17 nt, Human
cacccccuccugcugca

SEQ ID NO: 2494746 - RNA, 14 nt, Human
cacccccucccugg

SEQ ID NO: 2494747 - RNA, 16 nt, Human
cacccccucccuggcc

SEQ ID NO: 2494748 - RNA, 14 nt, Human
cacccccuccugcu

SEQ ID NO: 2494749 - RNA, 23 nt, Human
cacccccucccuggccuguucug

SEQ ID NO: 2494750 - RNA, 13 nt, Human
cacccccugcccu

SEQ ID NO: 2494751 - RNA, 16 nt, Human
cacccccugcccugca

SEQ ID NO: 2494752 - RNA, 14 nt, Human
cacccccugcccug

SEQ ID NO: 2494753 - RNA, 17 nt, Human
cacccccugcccugcac

SEQ ID NO: 2494754 - RNA, 16 nt, Human
cacccccuucagugcc

SEQ ID NO: 2494755 - RNA, 14 nt, Human
cacccccuuuccug

SEQ ID NO: 2494756 - RNA, 12 nt, Human
cacccccuuucc

SEQ ID NO: 2494757 - RNA, 14 nt, Human
caccccgcucugca

SEQ ID NO: 2494758 - RNA, 13 nt, Human
caccccgcucugc

SEQ ID NO: 2494759 - RNA, 16 nt, Human
caccccgccugcccuc

SEQ ID NO: 2494760 - RNA, 18 nt, Human
cacccccuucuccaucca

SEQ ID NO: 2494761 - RNA, 13 nt, Human
cacccccuucucu

SEQ ID NO: 2494762 - RNA, 17 nt, Human
cacccccuucagugccc

SEQ ID NO: 2494763 - RNA, 20 nt, Human
cacccccuucagugcccacc

SEQ ID NO: 2494764 - RNA, 21 nt, Human
cacccccuucagugcccacca

SEQ ID NO: 2494765 - RNA, 16 nt, Human
cacccccuucucugcu

SEQ ID NO: 2494766 - RNA, 17 nt, Human
cacccccuucucugcuc

SEQ ID NO: 2494767 - RNA, 18 nt, Human
cacccccuucucugcucc

SEQ ID NO: 2494768 - RNA, 22 nt, Human
cacccccuucucugcuccacca

SEQ ID NO: 2494769 - RNA, 17 nt, Human
caccccggccaccugcg

SEQ ID NO: 2494770 - RNA, 16 nt, Human
caccccggccaccugc

SEQ ID NO: 2494771 - RNA, 15 nt, Human
caccccggccaccug

SEQ ID NO: 2494772 - RNA, 14 nt, Human
caccccggccaccu

SEQ ID NO: 2494773 - RNA, 14 nt, Human
caccccuaaagaga

SEQ ID NO: 2494774 - RNA, 23 nt, Human
caccccgucugggguucagcccc

SEQ ID NO: 2494775 - RNA, 15 nt, Human
caccccgcucugcau

SEQ ID NO: 2494776 - RNA, 15 nt, Human
caccccgggcucucu

SEQ ID NO: 2494777 - RNA, 18 nt, Human
caccccggggacccugug

SEQ ID NO: 2494778 - RNA, 17 nt, Human
caccccggggacccugu

SEQ ID NO: 2494779 - RNA, 18 nt, Human
caccccgggcucucugcu

SEQ ID NO: 2494780 - RNA, 20 nt, Human
caccccggggacccugugac

SEQ ID NO: 2494781 - RNA, 19 nt, Human
caccccggggacccuguga

SEQ ID NO: 2494782 - RNA, 15 nt, Human
caccccguagauucc

SEQ ID NO: 2494783 - RNA, 22 nt, Human
caccccgucugggguucagccc

SEQ ID NO: 2494784 - RNA, 23 nt, Human
cacccaagggccuggccugagcu

SEQ ID NO: 2494785 - RNA, 21 nt, Human
cacccaagggccuggccugag

SEQ ID NO: 2494786 - RNA, 20 nt, Human
cacccaagggccuggccuga

SEQ ID NO: 2494787 - RNA, 19 nt, Human
cacccaagggccuggccug

SEQ ID NO: 2494788 - RNA, 19 nt, Human
cacccacaugugacacaua

SEQ ID NO: 2494789 - RNA, 13 nt, Human
cacccacauguga

SEQ ID NO: 2494790 - RNA, 12 nt, Human
cacccacaugug

SEQ ID NO: 2494791 - RNA, 21 nt, Human
cacccacaugugacacauaug

SEQ ID NO: 2494792 - RNA, 13 nt, Human
cacccacagggcu

SEQ ID NO: 2494793 - RNA, 15 nt, Human
cacccaccagggcga

SEQ ID NO: 2494794 - RNA, 23 nt, Human
cacccaauaaacauuaagauuga

SEQ ID NO: 2494795 - RNA, 12 nt, Human
caccagaauaaa

SEQ ID NO: 2494796 - RNA, 21 nt, Human
caccacuggccaccaggcugg

SEQ ID NO: 2494797 - RNA, 16 nt, Human
caccacuucuuuuaua

SEQ ID NO: 2494798 - RNA, 23 nt, Human
cacccacacacucgcccgcccac

SEQ ID NO: 2494799 - RNA, 21 nt, Human
cacccacacacucgcccgccc

SEQ ID NO: 2494800 - RNA, 17 nt, Human
cacccacacacucgccc

SEQ ID NO: 2494801 - RNA, 15 nt, Human
cacccacacacucgc

SEQ ID NO: 2494802 - RNA, 20 nt, Human
cacccacaagugccacugcc

SEQ ID NO: 2494803 - RNA, 18 nt, Human
cacccaagggccuggccu

SEQ ID NO: 2494804 - RNA, 17 nt, Human
cacccaagggccuggcc

SEQ ID NO: 2494805 - RNA, 16 nt, Human
caccagaagcccagaa

SEQ ID NO: 2494806 - RNA, 17 nt, Human
caccagaagcccagaau

SEQ ID NO: 2494807 - RNA, 16 nt, Human
cacccaagggccuggc

SEQ ID NO: 2494808 - RNA, 20 nt, Human
caccacuggccaccaggcug

SEQ ID NO: 2494809 - RNA, 19 nt, Human
caccacuggccaccaggcu

SEQ ID NO: 2494810 - RNA, 18 nt, Human
caccacuggccaccaggc

SEQ ID NO: 2494811 - RNA, 16 nt, Human
caccacuggccaccag

SEQ ID NO: 2494812 - RNA, 13 nt, Human
caccagaagccca

SEQ ID NO: 2494813 - RNA, 14 nt, Human
caccagaagcccag

SEQ ID NO: 2494814 - RNA, 15 nt, Human
caccagaagcccaga

SEQ ID NO: 2494815 - RNA, 15 nt, Human
caccacuggccacca

SEQ ID NO: 2494816 - RNA, 14 nt, Human
caccacuggccacc

SEQ ID NO: 2494817 - RNA, 13 nt, Human
caccacuggccac

SEQ ID NO: 2494818 - RNA, 13 nt, Human
caccacugcacuc

SEQ ID NO: 2494819 - RNA, 18 nt, Human
caccacugcacuccagcc

SEQ ID NO: 2494820 - RNA, 22 nt, Human
caccccaugcuguugauugcua

SEQ ID NO: 2494821 - RNA, 12 nt, Human
caccccaugcug

SEQ ID NO: 2494822 - RNA, 16 nt, Human
caccccaugcuguuga

SEQ ID NO: 2494823 - RNA, 22 nt, Human
caccccauagugaccggcugcu

SEQ ID NO: 2494824 - RNA, 12 nt, Human
caccccaugcca

SEQ ID NO: 2494825 - RNA, 15 nt, Human
caccccaugccaaag

SEQ ID NO: 2494826 - RNA, 17 nt, Human
caccccaugccaaagcu

SEQ ID NO: 2494827 - RNA, 16 nt, Human
caccccagggccugag

SEQ ID NO: 2494828 - RNA, 17 nt, Human
caccccagggccugagc

SEQ ID NO: 2494829 - RNA, 22 nt, Human
caccccagggccugagccuggc

SEQ ID NO: 2494830 - RNA, 17 nt, Human
caccccagugcacccac

SEQ ID NO: 2494831 - RNA, 18 nt, Human
caccccagugcacccacu

SEQ ID NO: 2494832 - RNA, 20 nt, Human
caccccagugcacccacucu

SEQ ID NO: 2494833 - RNA, 12 nt, Human
caccccauccca

SEQ ID NO: 2494834 - RNA, 15 nt, Human
caccccaucccacac

SEQ ID NO: 2494835 - RNA, 21 nt, Human
caccccaucccacacccugga

SEQ ID NO: 2494836 - RNA, 13 nt, Human
caccccagcccca

SEQ ID NO: 2494837 - RNA, 12 nt, Human
caccccagcccc

SEQ ID NO: 2494838 - RNA, 15 nt, Human
caccccagggccuga

SEQ ID NO: 2494839 - RNA, 13 nt, Human
caccccaggacuc

SEQ ID NO: 2494840 - RNA, 22 nt, Human
caccccagcugcuccccucccu

SEQ ID NO: 2494841 - RNA, 16 nt, Human
cacccaccguggagga

SEQ ID NO: 2494842 - RNA, 11 nt, Human
caccccagccu

SEQ ID NO: 2494843 - RNA, 19 nt, Human
caccccagccuaagaugaa

SEQ ID NO: 2494844 - RNA, 13 nt, Human
caccccagcugcu

SEQ ID NO: 2494845 - RNA, 16 nt, Human
caccccagcugcuccc

SEQ ID NO: 2494846 - RNA, 18 nt, Human
caccccagcugcuccccu

SEQ ID NO: 2494847 - RNA, 19 nt, Human
caccccagcugcuccccuc

SEQ ID NO: 2494848 - RNA, 20 nt, Human
caccccagcugcuccccucc

SEQ ID NO: 2494849 - RNA, 16 nt, Human
cacccaccucagccuc

SEQ ID NO: 2494850 - RNA, 14 nt, Human
cacccaccucagcc

SEQ ID NO: 2494851 - RNA, 13 nt, Human
cacccaccucagc

SEQ ID NO: 2494852 - RNA, 12 nt, Human
cacccaccucag

SEQ ID NO: 2494853 - RNA, 22 nt, Human
cacccaccaucaugucuggcua

SEQ ID NO: 2494854 - RNA, 20 nt, Human
cacccaccaucaugucuggc

SEQ ID NO: 2494855 - RNA, 13 nt, Human
cacccaccgugga

SEQ ID NO: 2494856 - RNA, 23 nt, Human
cacccaccguccgcccugcuccu

SEQ ID NO: 2494857 - RNA, 22 nt, Human
cacccaccguccgcccugcucc

SEQ ID NO: 2494858 - RNA, 20 nt, Human
cacccaccguccgcccugcu

SEQ ID NO: 2494859 - RNA, 14 nt, Human
cacccacccagcac

SEQ ID NO: 2494860 - RNA, 14 nt, Human
cacccacccuggga

SEQ ID NO: 2494861 - RNA, 13 nt, Human
cacccacccuggg

SEQ ID NO: 2494862 - RNA, 21 nt, Human
ccaggcccggggcuggcggcu

SEQ ID NO: 2494863 - RNA, 16 nt, Human
ccaggccaccuccaga

SEQ ID NO: 2494864 - RNA, 21 nt, Human
ccaggccaccuccccagcauu

SEQ ID NO: 2494865 - RNA, 23 nt, Human
ccaggccacuggccccugagauc

SEQ ID NO: 2494866 - RNA, 14 nt, Human
ccaggcccucugcc

SEQ ID NO: 2494867 - RNA, 13 nt, Human
ccaggcccucugc

SEQ ID NO: 2494868 - RNA, 16 nt, Human
ccaggccccugccacc

SEQ ID NO: 2494869 - RNA, 15 nt, Human
ccaggccccugccac

SEQ ID NO: 2494870 - RNA, 14 nt, Human
ccaggccccugcca

SEQ ID NO: 2494871 - RNA, 12 nt, Human
ccaggccagagg

SEQ ID NO: 2494872 - RNA, 18 nt, Human
ccaggaggccagccuuga

SEQ ID NO: 2494873 - RNA, 15 nt, Human
ccaggaggccagccu

SEQ ID NO: 2494874 - RNA, 14 nt, Human
ccagcuccuucgcu

SEQ ID NO: 2494875 - RNA, 20 nt, Human
ccagcuccuccgugcuuccu

SEQ ID NO: 2494876 - RNA, 17 nt, Human
ccagcucuagacaaccc

SEQ ID NO: 2494877 - RNA, 18 nt, Human
ccagcucuagacaacccu

SEQ ID NO: 2494878 - RNA, 15 nt, Human
ccaggccaccaggau

SEQ ID NO: 2494879 - RNA, 14 nt, Human
ccaggccaccagga

SEQ ID NO: 2494880 - RNA, 13 nt, Human
ccaggccaccucc

SEQ ID NO: 2494881 - RNA, 12 nt, Human
ccaggccaccag

SEQ ID NO: 2494882 - RNA, 19 nt, Human
ccaggccacauggggcugg

SEQ ID NO: 2494883 - RNA, 17 nt, Human
ccaggccaccuccccag

SEQ ID NO: 2494884 - RNA, 16 nt, Human
ccaggccaccucccca

SEQ ID NO: 2494885 - RNA, 16 nt, Human
ccaggccacuggcccc

SEQ ID NO: 2494886 - RNA, 20 nt, Human
ccaggaggccagccuugacc

SEQ ID NO: 2494887 - RNA, 21 nt, Human
ccaggccacaagacccuugug

SEQ ID NO: 2494888 - RNA, 19 nt, Human
ccagcucuagacaacccug

SEQ ID NO: 2494889 - RNA, 21 nt, Human
ccagcucuagacaacccugca

SEQ ID NO: 2494890 - RNA, 23 nt, Human
ccaggcugggagagccuuccagg

SEQ ID NO: 2494891 - RNA, 15 nt, Human
ccaggcccucugccc

SEQ ID NO: 2494892 - RNA, 16 nt, Human
ccaggcugggucgccc

SEQ ID NO: 2494893 - RNA, 12 nt, Human
ccaggcuggguc

SEQ ID NO: 2494894 - RNA, 24 nt, Human
ccaggcugggucgcccuggacugu

SEQ ID NO: 2494895 - RNA, 23 nt, Human
ccaggcugggucgcccuggacug

SEQ ID NO: 2494896 - RNA, 22 nt, Human
ccaggcugggucgcccuggacu

SEQ ID NO: 2494897 - RNA, 21 nt, Human
ccaggcugggucgcccuggac

SEQ ID NO: 2494898 - RNA, 23 nt, Human
ccaggcuuagucacugagacagc

SEQ ID NO: 2494899 - RNA, 22 nt, Human
ccaggcuuagucacugagacag

SEQ ID NO: 2494900 - RNA, 21 nt, Human
ccaggcuuagucacugagaca

SEQ ID NO: 2494901 - RNA, 14 nt, Human
ccaggcuggucuca

SEQ ID NO: 2494902 - RNA, 21 nt, Human
ccaggguggacuuagaaagca

SEQ ID NO: 2494903 - RNA, 20 nt, Human
ccaggguggacuuagaaagc

SEQ ID NO: 2494904 - RNA, 23 nt, Human
ccagggugagagcugcucuggaa

SEQ ID NO: 2494905 - RNA, 22 nt, Human
ccagggugagagcugcucugga

SEQ ID NO: 2494906 - RNA, 17 nt, Human
ccagggugagagcugcu

SEQ ID NO: 2494907 - RNA, 16 nt, Human
ccagggugagagcugc

SEQ ID NO: 2494908 - RNA, 15 nt, Human
ccagggugagagcug

SEQ ID NO: 2494909 - RNA, 20 nt, Human
ccagguagaggguguguaag

SEQ ID NO: 2494910 - RNA, 21 nt, Human
ccaggguguggcccugccauc

SEQ ID NO: 2494911 - RNA, 19 nt, Human
ccaggguguggcccugcca

SEQ ID NO: 2494912 - RNA, 22 nt, Human
ccaggguggacuuagaaagcag

SEQ ID NO: 2494913 - RNA, 17 nt, Human
ccagggccugagccugg

SEQ ID NO: 2494914 - RNA, 18 nt, Human
ccagggccugagccuggc

SEQ ID NO: 2494915 - RNA, 19 nt, Human
ccagggccugagccuggcc

SEQ ID NO: 2494916 - RNA, 23 nt, Human
ccagggccugcaggaccugccug

SEQ ID NO: 2494917 - RNA, 14 nt, Human
ccagggccugagcc

SEQ ID NO: 2494918 - RNA, 16 nt, Human
ccagggccugagccug

SEQ ID NO: 2494919 - RNA, 14 nt, Human
ccagggcccugcag

SEQ ID NO: 2494920 - RNA, 15 nt, Human
ccagggcccugcaga

SEQ ID NO: 2494921 - RNA, 14 nt, Human
ccagggucuucccu

SEQ ID NO: 2494922 - RNA, 14 nt, Human
ccagggugagagcu

SEQ ID NO: 2494923 - RNA, 23 nt, Human
ccagggucuucccuaccucaggc

SEQ ID NO: 2494924 - RNA, 18 nt, Human
ccagggccugagccaagc

SEQ ID NO: 2494925 - RNA, 22 nt, Human
ccagggccccucacccugccuu

SEQ ID NO: 2494926 - RNA, 21 nt, Human
ccagggccccucacccugccu

SEQ ID NO: 2494927 - RNA, 17 nt, Human
ccagggcccccaucuca

SEQ ID NO: 2494928 - RNA, 15 nt, Human
ccagggcccugagcu

SEQ ID NO: 2494929 - RNA, 18 nt, Human
ccagggcccugagcucgg

SEQ ID NO: 2494930 - RNA, 17 nt, Human
ccagggcccaggcaaau

SEQ ID NO: 2494931 - RNA, 23 nt, Human
ccagggcccagagcccagcucca

SEQ ID NO: 2494932 - RNA, 18 nt, Human
ccaggcuucacccugaau

SEQ ID NO: 2494933 - RNA, 16 nt, Human
ccaggcuucacccuga

SEQ ID NO: 2494934 - RNA, 20 nt, Human
ccaggcugggcaaggaggcc

SEQ ID NO: 2494935 - RNA, 18 nt, Human
ccaggcugggcaaggagg

SEQ ID NO: 2494936 - RNA, 22 nt, Human
ccagggagccuuugguucuggc

SEQ ID NO: 2494937 - RNA, 17 nt, Human
ccagggaguccccuccc

SEQ ID NO: 2494938 - RNA, 16 nt, Human
ccagggaguccccucc

SEQ ID NO: 2494939 - RNA, 23 nt, Human
ccagggaugccaucugugggcac

SEQ ID NO: 2494940 - RNA, 13 nt, Human
ccagggagucccc

SEQ ID NO: 2494941 - RNA, 18 nt, Human
ccagggagcggaaagcag

SEQ ID NO: 2494942 - RNA, 19 nt, Human
ccagggagcggaaagcagc

SEQ ID NO: 2494943 - RNA, 20 nt, Human
ccagggagcggaaagcagcu

SEQ ID NO: 2494944 - RNA, 23 nt, Human
ccagggagcggaaagcagcucaa

SEQ ID NO: 2494945 - RNA, 22 nt, Human
ccagggagcuugaaaguuuuca

SEQ ID NO: 2494946 - RNA, 23 nt, Human
ccagugugacaaggauugcuacu

SEQ ID NO: 2494947 - RNA, 14 nt, Human
ccagugugacaagg

SEQ ID NO: 2494948 - RNA, 13 nt, Human
ccauaugccuggg

SEQ ID NO: 2494949 - RNA, 15 nt, Human
ccagugugaucccaa

SEQ ID NO: 2494950 - RNA, 22 nt, Human
ccagugugaucccaagugccag

SEQ ID NO: 2494951 - RNA, 12 nt, Human
ccaguguggaac

SEQ ID NO: 2494952 - RNA, 12 nt, Human
ccaucaagccac

SEQ ID NO: 2494953 - RNA, 12 nt, Human
ccauaugugcuu

SEQ ID NO: 2494954 - RNA, 14 nt, Human
ccauauguuacacu

SEQ ID NO: 2494955 - RNA, 15 nt, Human
ccauaugccugggca

SEQ ID NO: 2494956 - RNA, 22 nt, Human
ccauauggauuuucuauuguua

SEQ ID NO: 2494957 - RNA, 14 nt, Human
ccaucaagccacca

SEQ ID NO: 2494958 - RNA, 13 nt, Human
ccaucaagccacc

SEQ ID NO: 2494959 - RNA, 16 nt, Human
ccaucaucccagcugc

SEQ ID NO: 2494960 - RNA, 15 nt, Human
ccaucaucccagcug

SEQ ID NO: 2494961 - RNA, 14 nt, Human
ccaucaucccagcu

SEQ ID NO: 2494962 - RNA, 16 nt, Human
ccaucaagccaccaac

SEQ ID NO: 2494963 - RNA, 12 nt, Human
ccaucauugaaa

SEQ ID NO: 2494964 - RNA, 13 nt, Human
ccaucaugucugg

SEQ ID NO: 2494965 - RNA, 13 nt, Human
ccaucaucuccug

SEQ ID NO: 2494966 - RNA, 13 nt, Human
ccaucauccuacu

SEQ ID NO: 2494967 - RNA, 12 nt, Human
ccaucaugucug

SEQ ID NO: 2494968 - RNA, 18 nt, Human
ccaucucacacaugagca

SEQ ID NO: 2494969 - RNA, 17 nt, Human
ccaucucacacaugagc

SEQ ID NO: 2494970 - RNA, 15 nt, Human
ccaucucacacauga

SEQ ID NO: 2494971 - RNA, 14 nt, Human
ccaucucacacaug

SEQ ID NO: 2494972 - RNA, 21 nt, Human
ccaucucacacaugagcauca

SEQ ID NO: 2494973 - RNA, 20 nt, Human
ccaucucacacaugagcauc

SEQ ID NO: 2494974 - RNA, 15 nt, Human
ccaucucuccuccuu

SEQ ID NO: 2494975 - RNA, 17 nt, Human
ccaucucucccuccccu

SEQ ID NO: 2494976 - RNA, 23 nt, Human
ccaucucucccuccccugccauu

SEQ ID NO: 2494977 - RNA, 14 nt, Human
ccaucucucccucc

SEQ ID NO: 2494978 - RNA, 18 nt, Human
ccauccugaggcuccacu

SEQ ID NO: 2494979 - RNA, 17 nt, Human
ccaucauugaaaucuuu

SEQ ID NO: 2494980 - RNA, 16 nt, Human
ccaucauugaaaucuu

SEQ ID NO: 2494981 - RNA, 14 nt, Human
ccaucauugaaauc

SEQ ID NO: 2494982 - RNA, 15 nt, Human
ccauccugcagccuc

SEQ ID NO: 2494983 - RNA, 17 nt, Human
ccaucauuauaaacgug

SEQ ID NO: 2494984 - RNA, 14 nt, Human
ccaucaugucccca

SEQ ID NO: 2494985 - RNA, 20 nt, Human
ccauccugaggcuccacuug

SEQ ID NO: 2494986 - RNA, 13 nt, Human
ccauccuggccca

SEQ ID NO: 2494987 - RNA, 22 nt, Human
ccauccugcagccuccuccuga

SEQ ID NO: 2494988 - RNA, 21 nt, Human
ccauccugcagccuccuccug

SEQ ID NO: 2494989 - RNA, 18 nt, Human
ccauccugcagccuccuc

SEQ ID NO: 2494990 - RNA, 16 nt, Human
ccauccugcagccucc

SEQ ID NO: 2494991 - RNA, 14 nt, Human
ccaucuaccuucca

SEQ ID NO: 2494992 - RNA, 13 nt, Human
ccaucuaccuucc

SEQ ID NO: 2494993 - RNA, 12 nt, Human
ccauccuggccc

SEQ ID NO: 2494994 - RNA, 20 nt, Human
ccaucuaugucccuugcugu

SEQ ID NO: 2494995 - RNA, 22 nt, Human
ccaucuaugucccuugcuguga

SEQ ID NO: 2494996 - RNA, 20 nt, Human
ccaguaaaugggggugcauu

SEQ ID NO: 2494997 - RNA, 22 nt, Human
ccagguuucuggucucuaggcu

SEQ ID NO: 2494998 - RNA, 17 nt, Human
ccagguuucuggucucu

SEQ ID NO: 2494999 - RNA, 16 nt, Human
ccagguuuagacagua

SEQ ID NO: 2495000 - RNA, 19 nt, Human
ccagguuuucugggugucc

SEQ ID NO: 2495001 - RNA, 16 nt, Human
ccagguuuucugggug

SEQ ID NO: 2495002 - RNA, 20 nt, Human
ccagguuuucugggugucca

SEQ ID NO: 2495003 - RNA, 21 nt, Human
ccaguaaaugggggugcauuu

SEQ ID NO: 2495004 - RNA, 22 nt, Human
ccaguaaaugggggugcauuug

SEQ ID NO: 2495005 - RNA, 23 nt, Human
ccaggugggcgggcagcacagca

SEQ ID NO: 2495006 - RNA, 22 nt, Human
ccaggugggcgggcagcacagc

SEQ ID NO: 2495007 - RNA, 20 nt, Human
ccaggugggcgggcagcaca

SEQ ID NO: 2495008 - RNA, 19 nt, Human
ccaggugggcgggcagcac

SEQ ID NO: 2495009 - RNA, 16 nt, Human
ccagguggcugaccca

SEQ ID NO: 2495010 - RNA, 17 nt, Human
ccagguggcugacccag

SEQ ID NO: 2495011 - RNA, 19 nt, Human
ccagguggcugacccaguc

SEQ ID NO: 2495012 - RNA, 20 nt, Human
ccagguggcugacccagucc

SEQ ID NO: 2495013 - RNA, 21 nt, Human
ccagguggcugacccaguccc

SEQ ID NO: 2495014 - RNA, 22 nt, Human
ccagguggcugacccagucccu

SEQ ID NO: 2495015 - RNA, 23 nt, Human
ccagguggcugacccagucccug

SEQ ID NO: 2495016 - RNA, 16 nt, Human
ccagguuucuaugugu

SEQ ID NO: 2495017 - RNA, 13 nt, Human
ccagguuuaagcu

SEQ ID NO: 2495018 - RNA, 16 nt, Human
ccaggugcacagacgu

SEQ ID NO: 2495019 - RNA, 13 nt, Human
ccaggugcacaga

SEQ ID NO: 2495020 - RNA, 19 nt, Human
ccaggugcacagacguccc

SEQ ID NO: 2495021 - RNA, 15 nt, Human
ccagguaucuccagg

SEQ ID NO: 2495022 - RNA, 18 nt, Human
ccagguaucuccaggauu

SEQ ID NO: 2495023 - RNA, 16 nt, Human
ccagguaucuccagga

SEQ ID NO: 2495024 - RNA, 14 nt, Human
ccagguagaacaca

SEQ ID NO: 2495025 - RNA, 21 nt, Human
ccagguggccacuccagaccc

SEQ ID NO: 2495026 - RNA, 16 nt, Human
ccagguggccacucca

SEQ ID NO: 2495027 - RNA, 21 nt, Human
ccaggugcuaggaacacuccu

SEQ ID NO: 2495028 - RNA, 17 nt, Human
ccagguaucuccaggau

SEQ ID NO: 2495029 - RNA, 22 nt, Human
ccaggugcaguggcucacgccu

SEQ ID NO: 2495030 - RNA, 12 nt, Human
ccaggugccagu

SEQ ID NO: 2495031 - RNA, 13 nt, Human
ccaggugccaguu

SEQ ID NO: 2495032 - RNA, 14 nt, Human
ccaggugcaguggc

SEQ ID NO: 2495033 - RNA, 17 nt, Human
ccagugacuuuuucuaa

SEQ ID NO: 2495034 - RNA, 15 nt, Human
ccagugacuccagga

SEQ ID NO: 2495035 - RNA, 13 nt, Human
ccagugacuccag

SEQ ID NO: 2495036 - RNA, 12 nt, Human
ccagugacucca

SEQ ID NO: 2495037 - RNA, 18 nt, Human
ccagugagcacucccaag

SEQ ID NO: 2495038 - RNA, 16 nt, Human
ccagugagcacuccca

SEQ ID NO: 2495039 - RNA, 21 nt, Human
ccagugagaugcauucuuggu

SEQ ID NO: 2495040 - RNA, 17 nt, Human
ccagugagaugcauucu

SEQ ID NO: 2495041 - RNA, 14 nt, Human
ccagugagaugcau

SEQ ID NO: 2495042 - RNA, 13 nt, Human
ccagugagaugca

SEQ ID NO: 2495043 - RNA, 16 nt, Human
ccagugacuccaggag

SEQ ID NO: 2495044 - RNA, 22 nt, Human
ccagugaccugcuggguaaacu

SEQ ID NO: 2495045 - RNA, 20 nt, Human
ccagugaccugcuggguaaa

SEQ ID NO: 2495046 - RNA, 17 nt, Human
ccagugaccugaggaag

SEQ ID NO: 2495047 - RNA, 18 nt, Human
ccagugaccugaggaagc

SEQ ID NO: 2495048 - RNA, 18 nt, Human
ccagugaccugcugggua

SEQ ID NO: 2495049 - RNA, 19 nt, Human
ccagugaccugaggaagcg

SEQ ID NO: 2495050 - RNA, 15 nt, Human
ccagugaccugagga

SEQ ID NO: 2495051 - RNA, 23 nt, Human
ccaguaaaugggggugcauuuga

SEQ ID NO: 2495052 - RNA, 12 nt, Human
ccagguuuuuca

SEQ ID NO: 2495053 - RNA, 23 nt, Human
ccagugaauucuugaaggaaaau

SEQ ID NO: 2495054 - RNA, 11 nt, Human
ccagugacacu

SEQ ID NO: 2495055 - RNA, 19 nt, Human
ccagugacagacaggcucu

SEQ ID NO: 2495056 - RNA, 18 nt, Human
ccagugacagacaggcuc

SEQ ID NO: 2495057 - RNA, 21 nt, Human
ccagugacagacaggcucuua

SEQ ID NO: 2495058 - RNA, 24 nt, Human
ccagugacacuucagagagcuggu

SEQ ID NO: 2495059 - RNA, 17 nt, Human
ccagugacagacaggcu

SEQ ID NO: 2495060 - RNA, 15 nt, Human
ccagugacagacagg

SEQ ID NO: 2495061 - RNA, 16 nt, Human
ccagugacacuucaga

SEQ ID NO: 2495062 - RNA, 19 nt, Human
ccagugacacuucagagag

SEQ ID NO: 2495063 - RNA, 20 nt, Human
ccagugacacuucagagagc

SEQ ID NO: 2495064 - RNA, 23 nt, Human
ccagugacacuucagagagcugg

SEQ ID NO: 2495065 - RNA, 17 nt, Human
ccagugucuuccugugg

SEQ ID NO: 2495066 - RNA, 16 nt, Human
ccagugucuuccugug

SEQ ID NO: 2495067 - RNA, 15 nt, Human
ccagugucuuccugu

SEQ ID NO: 2495068 - RNA, 14 nt, Human
ccagugucuuccug

SEQ ID NO: 2495069 - RNA, 13 nt, Human
ccagugucuuccu

SEQ ID NO: 2495070 - RNA, 18 nt, Human
ccaguggcugcugcccag

SEQ ID NO: 2495071 - RNA, 17 nt, Human
ccaguggcugcugccca

SEQ ID NO: 2495072 - RNA, 16 nt, Human
ccaguggcugcugccc

SEQ ID NO: 2495073 - RNA, 15 nt, Human
ccaguggcugcugcc

SEQ ID NO: 2495074 - RNA, 14 nt, Human
ccaguggcugcugc

SEQ ID NO: 2495075 - RNA, 13 nt, Human
ccaguggcugcug

SEQ ID NO: 2495076 - RNA, 24 nt, Human
ccaguggccucaacccucccucag

SEQ ID NO: 2495077 - RNA, 17 nt, Human
ccaguggccacucagcu

SEQ ID NO: 2495078 - RNA, 16 nt, Human
ccaguggccacucagc

SEQ ID NO: 2495079 - RNA, 15 nt, Human
ccaguggccacucag

SEQ ID NO: 2495080 - RNA, 21 nt, Human
ccaguggccacucagcuuccu

SEQ ID NO: 2495081 - RNA, 16 nt, Human
ccaguggccucaaccc

SEQ ID NO: 2495082 - RNA, 17 nt, Human
ccaguggccucaacccu

SEQ ID NO: 2495083 - RNA, 23 nt, Human
ccaguggccucaacccucccuca

SEQ ID NO: 2495084 - RNA, 22 nt, Human
ccagugcccaaagucuguguga

SEQ ID NO: 2495085 - RNA, 19 nt, Human
ccagugcccaaagucugug

SEQ ID NO: 2495086 - RNA, 14 nt, Human
ccagugcacccacu

SEQ ID NO: 2495087 - RNA, 20 nt, Human
ccagugagcacucccaaguc

SEQ ID NO: 2495088 - RNA, 19 nt, Human
ccagugagcacucccaagu

SEQ ID NO: 2495089 - RNA, 18 nt, Human
ccagugcaacagcacugg

SEQ ID NO: 2495090 - RNA, 15 nt, Human
ccagugcaacagcac

SEQ ID NO: 2495091 - RNA, 14 nt, Human
ccagugcaacagca

SEQ ID NO: 2495092 - RNA, 21 nt, Human
ccagugaugcuaaagguugua

SEQ ID NO: 2495093 - RNA, 14 nt, Human
ccagugcaacacug

SEQ ID NO: 2495094 - RNA, 13 nt, Human
ccauucugacucg

SEQ ID NO: 2495095 - RNA, 12 nt, Human
ccauucugacuc

SEQ ID NO: 2495096 - RNA, 16 nt, Human
ccauucucucuccugu

SEQ ID NO: 2495097 - RNA, 19 nt, Human
ccauucucucuccugucca

SEQ ID NO: 2495098 - RNA, 20 nt, Human
ccauucucucuccuguccaa

SEQ ID NO: 2495099 - RNA, 16 nt, Human
ccauucugaccauuuc

SEQ ID NO: 2495100 - RNA, 14 nt, Human
ccauucucucuccu

SEQ ID NO: 2495101 - RNA, 23 nt, Human
ccauucucccagguaccagcugc

SEQ ID NO: 2495102 - RNA, 13 nt, Human
ccauucuccacag

SEQ ID NO: 2495103 - RNA, 15 nt, Human
ccauucuccacagca

SEQ ID NO: 2495104 - RNA, 16 nt, Human
ccauucuccacagcaa

SEQ ID NO: 2495105 - RNA, 18 nt, Human
ccauucuccacagcaacc

SEQ ID NO: 2495106 - RNA, 18 nt, Human
ccauucucaagcccugca

SEQ ID NO: 2495107 - RNA, 17 nt, Human
ccauucucaagcccugc

SEQ ID NO: 2495108 - RNA, 22 nt, Human
ccauuaggacaaucaguccccu

SEQ ID NO: 2495109 - RNA, 13 nt, Human
ccauuaucaugug

SEQ ID NO: 2495110 - RNA, 19 nt, Human
ccauuagcuuucaauuccg

SEQ ID NO: 2495111 - RNA, 16 nt, Human
ccauuagagucagccu

SEQ ID NO: 2495112 - RNA, 16 nt, Human
ccauuaucauguguaa

SEQ ID NO: 2495113 - RNA, 15 nt, Human
ccauuaucaugugua

SEQ ID NO: 2495114 - RNA, 14 nt, Human
ccauuaucaugugu

SEQ ID NO: 2495115 - RNA, 21 nt, Human
ccauuaucccugaaucccccu

SEQ ID NO: 2495116 - RNA, 14 nt, Human
ccauuaucccugaa

SEQ ID NO: 2495117 - RNA, 17 nt, Human
ccauuaugaagaagaga

SEQ ID NO: 2495118 - RNA, 14 nt, Human
ccauucuacacaga

SEQ ID NO: 2495119 - RNA, 24 nt, Human
ccauuccugguacccagccaucug

SEQ ID NO: 2495120 - RNA, 21 nt, Human
ccauuugcguuccaugaugcu

SEQ ID NO: 2495121 - RNA, 13 nt, Human
ccauuugcuccuu

SEQ ID NO: 2495122 - RNA, 16 nt, Human
ccauuugcuuuuucac

SEQ ID NO: 2495123 - RNA, 19 nt, Human
ccauuuuagucacuuuuuu

SEQ ID NO: 2495124 - RNA, 18 nt, Human
ccauuuuagucacuuuuu

SEQ ID NO: 2495125 - RNA, 20 nt, Human
ccauuugcagaguccugcac

SEQ ID NO: 2495126 - RNA, 15 nt, Human
ccauuugaaagaaag

SEQ ID NO: 2495127 - RNA, 20 nt, Human
ccauucugccuccauucuga

SEQ ID NO: 2495128 - RNA, 21 nt, Human
ccauuccugguacccagccau

SEQ ID NO: 2495129 - RNA, 15 nt, Human
ccauucugccugccc

SEQ ID NO: 2495130 - RNA, 20 nt, Human
ccauucugacucgguuucuc

SEQ ID NO: 2495131 - RNA, 17 nt, Human
ccauucugaccauuuca

SEQ ID NO: 2495132 - RNA, 22 nt, Human
ccauuaaaacugaagucugaaa

SEQ ID NO: 2495133 - RNA, 15 nt, Human
ccauuaaaguucuca

SEQ ID NO: 2495134 - RNA, 22 nt, Human
ccauuaaagucgagcuuuucua

SEQ ID NO: 2495135 - RNA, 23 nt, Human
ccauuagaagauauuagucuugg

SEQ ID NO: 2495136 - RNA, 12 nt, Human
ccauuacccuca

SEQ ID NO: 2495137 - RNA, 14 nt, Human
ccauuaccauggag

SEQ ID NO: 2495138 - RNA, 23 nt, Human
ccauuaaaacugaagucugaaau

SEQ ID NO: 2495139 - RNA, 21 nt, Human
ccauuaaaacugaagucugaa

SEQ ID NO: 2495140 - RNA, 20 nt, Human
ccauuaaaacugaagucuga

SEQ ID NO: 2495141 - RNA, 15 nt, Human
ccauuaaaacugaag

SEQ ID NO: 2495142 - RNA, 14 nt, Human
ccauguugcugcca

SEQ ID NO: 2495143 - RNA, 13 nt, Human
ccauguugcugcc

SEQ ID NO: 2495144 - RNA, 18 nt, Human
ccauguuuuguuuacggu

SEQ ID NO: 2495145 - RNA, 23 nt, Human
ccauguucuauuucagugccaau

SEQ ID NO: 2495146 - RNA, 17 nt, Human
ccauguuccaauaaaca

SEQ ID NO: 2495147 - RNA, 22 nt, Human
ccauguucacaccgcugcacuc

SEQ ID NO: 2495148 - RNA, 18 nt, Human
ccauguuccaauaaacag

SEQ ID NO: 2495149 - RNA, 22 nt, Human
ccauguuaauuucaugugucaa

SEQ ID NO: 2495150 - RNA, 18 nt, Human
ccauguuaguuuuuacuu

SEQ ID NO: 2495151 - RNA, 19 nt, Human
ccaugugugugcaagugug

SEQ ID NO: 2495152 - RNA, 21 nt, Human
ccaucuugcuucccuaaucua

SEQ ID NO: 2495153 - RNA, 20 nt, Human
ccaucuugcuucccuaaucu

SEQ ID NO: 2495154 - RNA, 14 nt, Human
ccauguguccuggu

SEQ ID NO: 2495155 - RNA, 17 nt, Human
ccauguguccugguucc

SEQ ID NO: 2495156 - RNA, 11 nt, Human
ccaugugugag

SEQ ID NO: 2495157 - RNA, 17 nt, Human
ccaugugugagugugug

SEQ ID NO: 2495158 - RNA, 18 nt, Human
ccaugugugagugugugc

SEQ ID NO: 2495159 - RNA, 15 nt, Human
ccauguguggacuca

SEQ ID NO: 2495160 - RNA, 10 nt, Human
ccaugugugu

SEQ ID NO: 2495161 - RNA, 12 nt, Human
ccaugugugugc

SEQ ID NO: 2495162 - RNA, 16 nt, Human
ccaucuuccagguggg

SEQ ID NO: 2495163 - RNA, 15 nt, Human
ccaucuuccaggugg

SEQ ID NO: 2495164 - RNA, 13 nt, Human
ccaucuucccagc

SEQ ID NO: 2495165 - RNA, 14 nt, Human
ccaucuuccaggug

SEQ ID NO: 2495166 - RNA, 15 nt, Human
ccaucuucagcuucu

SEQ ID NO: 2495167 - RNA, 15 nt, Human
ccaucuuaguuugga

SEQ ID NO: 2495168 - RNA, 19 nt, Human
ccaucuguuuggugggggu

SEQ ID NO: 2495169 - RNA, 22 nt, Human
ccaucucuggaugccugauugc

SEQ ID NO: 2495170 - RNA, 18 nt, Human
ccaucucuggaugccuga

SEQ ID NO: 2495171 - RNA, 15 nt, Human
ccaucucuggaugcc

SEQ ID NO: 2495172 - RNA, 12 nt, Human
ccaucucuggau

SEQ ID NO: 2495173 - RNA, 23 nt, Human
ccaucucugauuuucaaagcuuu

SEQ ID NO: 2495174 - RNA, 18 nt, Human
ccaucucugauuuucaaa

SEQ ID NO: 2495175 - RNA, 16 nt, Human
ccaucucucuggcccu

SEQ ID NO: 2495176 - RNA, 14 nt, Human
ccaucucucuggcc

SEQ ID NO: 2495177 - RNA, 13 nt, Human
ccaucucucuggc

SEQ ID NO: 2495178 - RNA, 20 nt, Human
ccaucucucuacuccuaccu

SEQ ID NO: 2495179 - RNA, 14 nt, Human
ccaucugugaauaa

SEQ ID NO: 2495180 - RNA, 15 nt, Human
ccaucugugaauaag

SEQ ID NO: 2495181 - RNA, 16 nt, Human
ccaucugugcacgcag

SEQ ID NO: 2495182 - RNA, 14 nt, Human
ccaucugucccugc

SEQ ID NO: 2495183 - RNA, 22 nt, Human
ccaucugugggcacgcuguggg

SEQ ID NO: 2495184 - RNA, 12 nt, Human
ccaucugugaau

SEQ ID NO: 2495185 - RNA, 21 nt, Human
ccaucucuuccuacccaacca

SEQ ID NO: 2495186 - RNA, 13 nt, Human
ccaucucuuccua

SEQ ID NO: 2495187 - RNA, 18 nt, Human
cccacaugaggacaugau

SEQ ID NO: 2495188 - RNA, 19 nt, Human
cccaccguggaggaggaag

SEQ ID NO: 2495189 - RNA, 23 nt, Human
cccaccguccgcccugcuccucc

SEQ ID NO: 2495190 - RNA, 21 nt, Human
cccaccguccgcccugcuccu

SEQ ID NO: 2495191 - RNA, 19 nt, Human
cccaccguccgcccugcuc

SEQ ID NO: 2495192 - RNA, 15 nt, Human
cccaccgugggcagg

SEQ ID NO: 2495193 - RNA, 17 nt, Human
cccaccgugggcaggga

SEQ ID NO: 2495194 - RNA, 17 nt, Human
cccaccguccgcccugc

SEQ ID NO: 2495195 - RNA, 15 nt, Human
cccaccguccgcccu

SEQ ID NO: 2495196 - RNA, 15 nt, Human
cccaccucagccucc

SEQ ID NO: 2495197 - RNA, 14 nt, Human
cccaccucagccuc

SEQ ID NO: 2495198 - RNA, 12 nt, Human
cccaccucagcc

SEQ ID NO: 2495199 - RNA, 20 nt, Human
cccaccguggaggaggaagg

SEQ ID NO: 2495200 - RNA, 19 nt, Human
cccaccgugggcagggagc

SEQ ID NO: 2495201 - RNA, 16 nt, Human
cccaccuaugugccaa

SEQ ID NO: 2495202 - RNA, 17 nt, Human
cccaccucucucacucc

SEQ ID NO: 2495203 - RNA, 14 nt, Human
cccaccucucucac

SEQ ID NO: 2495204 - RNA, 13 nt, Human
cccaccucucuca

SEQ ID NO: 2495205 - RNA, 21 nt, Human
cccaccucagccucccaaagu

SEQ ID NO: 2495206 - RNA, 12 nt, Human
cccaccuuggcu

SEQ ID NO: 2495207 - RNA, 22 nt, Human
cccaccugucaaacaaagccag

SEQ ID NO: 2495208 - RNA, 23 nt, Human
cccaccugucaaacaaagccaga

SEQ ID NO: 2495209 - RNA, 19 nt, Human
cccaccuucaauuccuggg

SEQ ID NO: 2495210 - RNA, 20 nt, Human
cccaccuucaauuccugggc

SEQ ID NO: 2495211 - RNA, 21 nt, Human
cccaccuucaauuccugggcc

SEQ ID NO: 2495212 - RNA, 19 nt, Human
cccaccucucucacuccuu

SEQ ID NO: 2495213 - RNA, 22 nt, Human
cccaccucuccccaccuuaccc

SEQ ID NO: 2495214 - RNA, 13 nt, Human
cccaccugggacc

SEQ ID NO: 2495215 - RNA, 20 nt, Human
cccaccugguggccucugcc

SEQ ID NO: 2495216 - RNA, 15 nt, Human
cccaccuuggcugca

SEQ ID NO: 2495217 - RNA, 14 nt, Human
cccaccuuggcugc

SEQ ID NO: 2495218 - RNA, 22 nt, Human
cccaccuuggcucaaguccucu

SEQ ID NO: 2495219 - RNA, 15 nt, Human
cccaccuuggcucaa

SEQ ID NO: 2495220 - RNA, 19 nt, Human
cccacgcccccacugguga

SEQ ID NO: 2495221 - RNA, 17 nt, Human
cccacgcccccacuggu

SEQ ID NO: 2495222 - RNA, 12 nt, Human
cccaccugucuu

SEQ ID NO: 2495223 - RNA, 22 nt, Human
cccaccuucaauuccugggccc

SEQ ID NO: 2495224 - RNA, 17 nt, Human
cccacgcccuccccucc

SEQ ID NO: 2495225 - RNA, 12 nt, Human
cccacgugggag

SEQ ID NO: 2495226 - RNA, 22 nt, Human
cccacguccugucagugccgcc

SEQ ID NO: 2495227 - RNA, 19 nt, Human
cccacguccugucagugcc

SEQ ID NO: 2495228 - RNA, 22 nt, Human
cccagaauaaacuggcagcuca

SEQ ID NO: 2495229 - RNA, 22 nt, Human
cccagaaggcauaucagucucu

SEQ ID NO: 2495230 - RNA, 15 nt, Human
cccacguucucacac

SEQ ID NO: 2495231 - RNA, 19 nt, Human
cccagaauaaguuauugca

SEQ ID NO: 2495232 - RNA, 24 nt, Human
cccagaauaaacuggcagcucagc

SEQ ID NO: 2495233 - RNA, 16 nt, Human
cccagaaugaggcugc

SEQ ID NO: 2495234 - RNA, 12 nt, Human
cccagaaucaaa

SEQ ID NO: 2495235 - RNA, 22 nt, Human
cccagaauaaguuauugcaguu

SEQ ID NO: 2495236 - RNA, 21 nt, Human
cccacggccgcuccaggggug

SEQ ID NO: 2495237 - RNA, 17 nt, Human
cccacggccgcuccagg

SEQ ID NO: 2495238 - RNA, 16 nt, Human
cccacggccgcuccag

SEQ ID NO: 2495239 - RNA, 14 nt, Human
cccacggccgcucc

SEQ ID NO: 2495240 - RNA, 20 nt, Human
cccacggagucguggggugu

SEQ ID NO: 2495241 - RNA, 13 nt, Human
cccacgcuucucu

SEQ ID NO: 2495242 - RNA, 19 nt, Human
cccacggggccucgggacc

SEQ ID NO: 2495243 - RNA, 17 nt, Human
cccacguccugucagug

SEQ ID NO: 2495244 - RNA, 15 nt, Human
cccacguccugucag

SEQ ID NO: 2495245 - RNA, 13 nt, Human
cccacguccuguc

SEQ ID NO: 2495246 - RNA, 21 nt, Human
cccaacacugugcccuggugg

SEQ ID NO: 2495247 - RNA, 20 nt, Human
cccaacacugugcccuggug

SEQ ID NO: 2495248 - RNA, 19 nt, Human
cccaacacugugcccuggu

SEQ ID NO: 2495249 - RNA, 18 nt, Human
cccaacacugugcccugg

SEQ ID NO: 2495250 - RNA, 16 nt, Human
cccaacacugugcccu

SEQ ID NO: 2495251 - RNA, 15 nt, Human
cccaacacugugccc

SEQ ID NO: 2495252 - RNA, 13 nt, Human
cccaacacugugc

SEQ ID NO: 2495253 - RNA, 12 nt, Human
cccaacacugug

SEQ ID NO: 2495254 - RNA, 23 nt, Human
cccaacagcgacauagcccaucc

SEQ ID NO: 2495255 - RNA, 19 nt, Human
cccaacagcgacauagccc

SEQ ID NO: 2495256 - RNA, 19 nt, Human
cccaacagaugcuuuucug

SEQ ID NO: 2495257 - RNA, 22 nt, Human
cccaacacugugcccuggugga

SEQ ID NO: 2495258 - RNA, 17 nt, Human
cccaacaggaggacaau

SEQ ID NO: 2495259 - RNA, 16 nt, Human
cccaacaggaggacaa

SEQ ID NO: 2495260 - RNA, 16 nt, Human
cccaacagugugaagu

SEQ ID NO: 2495261 - RNA, 15 nt, Human
cccaacagugugaag

SEQ ID NO: 2495262 - RNA, 14 nt, Human
cccaacagugugaa

SEQ ID NO: 2495263 - RNA, 13 nt, Human
cccaacaguguga

SEQ ID NO: 2495264 - RNA, 12 nt, Human
cccaacagugug

SEQ ID NO: 2495265 - RNA, 20 nt, Human
cccaacaggaggacaauuca

SEQ ID NO: 2495266 - RNA, 19 nt, Human
cccaacaggaggacaauuc

SEQ ID NO: 2495267 - RNA, 18 nt, Human
cccaacaggaggacaauu

SEQ ID NO: 2495268 - RNA, 19 nt, Human
cccaacagugugaaguuag

SEQ ID NO: 2495269 - RNA, 12 nt, Human
cccaaccccagc

SEQ ID NO: 2495270 - RNA, 14 nt, Human
cccaagggccuggc

SEQ ID NO: 2495271 - RNA, 12 nt, Human
cccaagggccug

SEQ ID NO: 2495272 - RNA, 16 nt, Human
cccaaccccugaggaa

SEQ ID NO: 2495273 - RNA, 15 nt, Human
cccaaccccugagga

SEQ ID NO: 2495274 - RNA, 14 nt, Human
cccaaccccugagg

SEQ ID NO: 2495275 - RNA, 13 nt, Human
cccaaccccugag

SEQ ID NO: 2495276 - RNA, 12 nt, Human
cccaaccccuga

SEQ ID NO: 2495277 - RNA, 15 nt, Human
cccaacccccagcac

SEQ ID NO: 2495278 - RNA, 14 nt, Human
cccaacccccagca

SEQ ID NO: 2495279 - RNA, 13 nt, Human
cccaacccccagc

SEQ ID NO: 2495280 - RNA, 12 nt, Human
cccaacccccac

SEQ ID NO: 2495281 - RNA, 13 nt, Human
cccaacccccacc

SEQ ID NO: 2495282 - RNA, 12 nt, Human
cccaacccccag

SEQ ID NO: 2495283 - RNA, 22 nt, Human
cccaaccccagccgcucggagg

SEQ ID NO: 2495284 - RNA, 14 nt, Human
cccaacccccaccc

SEQ ID NO: 2495285 - RNA, 20 nt, Human
ccauuuugcugucccuuuuc

SEQ ID NO: 2495286 - RNA, 13 nt, Human
ccauuuucugugg

SEQ ID NO: 2495287 - RNA, 12 nt, Human
ccauuuucugug

SEQ ID NO: 2495288 - RNA, 14 nt, Human
ccauuuugcaaaau

SEQ ID NO: 2495289 - RNA, 17 nt, Human
ccauuuugcaaaauuuc

SEQ ID NO: 2495290 - RNA, 21 nt, Human
ccauuuugcaaaauuuccagu

SEQ ID NO: 2495291 - RNA, 16 nt, Human
ccauuuugcccuucca

SEQ ID NO: 2495292 - RNA, 21 nt, Human
ccauuuuguauuuuacuaaua

SEQ ID NO: 2495293 - RNA, 12 nt, Human
ccauuuugugaa

SEQ ID NO: 2495294 - RNA, 14 nt, Human
ccauuuugugaaug

SEQ ID NO: 2495295 - RNA, 13 nt, Human
ccauuuugugaau

SEQ ID NO: 2495296 - RNA, 19 nt, Human
ccauuuugcccuuccauag

SEQ ID NO: 2495297 - RNA, 12 nt, Human
ccauuuuuuccu

SEQ ID NO: 2495298 - RNA, 19 nt, Human
ccauuuuuuaaggaaacaa

SEQ ID NO: 2495299 - RNA, 17 nt, Human
ccauuuuuuaaggaaac

SEQ ID NO: 2495300 - RNA, 11 nt, Human
ccauuuuuccu

SEQ ID NO: 2495301 - RNA, 19 nt, Human
cccaagggcaaaauuccca

SEQ ID NO: 2495302 - RNA, 23 nt, Human
cccaagggaucugguccuaccca

SEQ ID NO: 2495303 - RNA, 13 nt, Human
cccaagggaucug

SEQ ID NO: 2495304 - RNA, 12 nt, Human
cccaaggggcag

SEQ ID NO: 2495305 - RNA, 16 nt, Human
cccaagggccuggccu

SEQ ID NO: 2495306 - RNA, 22 nt, Human
cccaagggcaaaauucccaggg

SEQ ID NO: 2495307 - RNA, 21 nt, Human
cccaagggcaaaauucccagg

SEQ ID NO: 2495308 - RNA, 15 nt, Human
cccaaggggcagucu

SEQ ID NO: 2495309 - RNA, 21 nt, Human
cccaaggggcagucuggaggg

SEQ ID NO: 2495310 - RNA, 22 nt, Human
cccaaguagggggucuaaaauu

SEQ ID NO: 2495311 - RNA, 23 nt, Human
cccaagguuuaaacuucucugaa

SEQ ID NO: 2495312 - RNA, 12 nt, Human
cccaaguccaaa

SEQ ID NO: 2495313 - RNA, 20 nt, Human
cccaaguccaaauguuuaca

SEQ ID NO: 2495314 - RNA, 18 nt, Human
cccaagucccuguuuucu

SEQ ID NO: 2495315 - RNA, 19 nt, Human
cccacacuugagaggauga

SEQ ID NO: 2495316 - RNA, 23 nt, Human
cccacagaaagacugagcucaag

SEQ ID NO: 2495317 - RNA, 19 nt, Human
cccacacuuguuccagcuc

SEQ ID NO: 2495318 - RNA, 21 nt, Human
cccacagaaagacugagcuca

SEQ ID NO: 2495319 - RNA, 19 nt, Human
cccacacuggggugccgcc

SEQ ID NO: 2495320 - RNA, 14 nt, Human
cccacacuccuaca

SEQ ID NO: 2495321 - RNA, 11 nt, Human
cccacacuccu

SEQ ID NO: 2495322 - RNA, 22 nt, Human
cccacacuggggugccgccugc

SEQ ID NO: 2495323 - RNA, 17 nt, Human
cccacacuuguuccagc

SEQ ID NO: 2495324 - RNA, 17 nt, Human
cccaaguccugaagagg

SEQ ID NO: 2495325 - RNA, 16 nt, Human
cccaaguccugaagag

SEQ ID NO: 2495326 - RNA, 13 nt, Human
cccaaguccugaa

SEQ ID NO: 2495327 - RNA, 23 nt, Human
cccaagucccuguuuucugagcc

SEQ ID NO: 2495328 - RNA, 23 nt, Human
cccaaguccugaagaggcgggcc

SEQ ID NO: 2495329 - RNA, 15 nt, Human
cccaagugccagucu

SEQ ID NO: 2495330 - RNA, 18 nt, Human
cccaagugccagucuugu

SEQ ID NO: 2495331 - RNA, 16 nt, Human
cccaaguggcagagcu

SEQ ID NO: 2495332 - RNA, 14 nt, Human
cccaagugggggca

SEQ ID NO: 2495333 - RNA, 19 nt, Human
cccaagugggggcagaggg

SEQ ID NO: 2495334 - RNA, 18 nt, Human
cccacaggcccuuccucu

SEQ ID NO: 2495335 - RNA, 16 nt, Human
cccacaggcccuuccu

SEQ ID NO: 2495336 - RNA, 15 nt, Human
cccacagugcugucu

SEQ ID NO: 2495337 - RNA, 23 nt, Human
cccacagugacucgggcuccugu

SEQ ID NO: 2495338 - RNA, 22 nt, Human
cccacagugacucgggcuccug

SEQ ID NO: 2495339 - RNA, 13 nt, Human
cccacaggcagcu

SEQ ID NO: 2495340 - RNA, 12 nt, Human
cccacaggcagc

SEQ ID NO: 2495341 - RNA, 14 nt, Human
cccacaggcagcuu

SEQ ID NO: 2495342 - RNA, 16 nt, Human
cccacaucccaggcuu

SEQ ID NO: 2495343 - RNA, 14 nt, Human
cccacaucccaggc

SEQ ID NO: 2495344 - RNA, 13 nt, Human
cccacaucccagg

SEQ ID NO: 2495345 - RNA, 20 nt, Human
cccacaucccaggcuucacc

SEQ ID NO: 2495346 - RNA, 19 nt, Human
cccacauagugaugguucc

SEQ ID NO: 2495347 - RNA, 13 nt, Human
cccacaggaucag

SEQ ID NO: 2495348 - RNA, 17 nt, Human
cccacaggaucagucug

SEQ ID NO: 2495349 - RNA, 22 nt, Human
cccacagcccacguccugucag

SEQ ID NO: 2495350 - RNA, 19 nt, Human
cccacagcccacguccugu

SEQ ID NO: 2495351 - RNA, 18 nt, Human
cccacagcccacguccug

SEQ ID NO: 2495352 - RNA, 15 nt, Human
cccacagcccacguc

SEQ ID NO: 2495353 - RNA, 11 nt, Human
cccacagccca

SEQ ID NO: 2495354 - RNA, 13 nt, Human
cccacagacucaa

SEQ ID NO: 2495355 - RNA, 23 nt, Human
cccacagacucaaaugcucagac

SEQ ID NO: 2495356 - RNA, 22 nt, Human
ccagauuggcucacacugagaa

SEQ ID NO: 2495357 - RNA, 21 nt, Human
ccagauuggcucacacugaga

SEQ ID NO: 2495358 - RNA, 20 nt, Human
ccagauuggcucacacugag

SEQ ID NO: 2495359 - RNA, 19 nt, Human
ccagauuggcucacacuga

SEQ ID NO: 2495360 - RNA, 15 nt, Human
ccagauuucacucuc

SEQ ID NO: 2495361 - RNA, 19 nt, Human
ccagauuucacucuccuug

SEQ ID NO: 2495362 - RNA, 18 nt, Human
ccagauuucacucuccuu

SEQ ID NO: 2495363 - RNA, 22 nt, Human
ccagauugcaacaggcugggcu

SEQ ID NO: 2495364 - RNA, 18 nt, Human
ccagauugcaacaggcug

SEQ ID NO: 2495365 - RNA, 19 nt, Human
ccagauugacgacaagugc

SEQ ID NO: 2495366 - RNA, 18 nt, Human
ccagauugacgacaagug

SEQ ID NO: 2495367 - RNA, 21 nt, Human
ccagauugacgacaagugcug

SEQ ID NO: 2495368 - RNA, 16 nt, Human
ccagauuggcucacac

SEQ ID NO: 2495369 - RNA, 23 nt, Human
ccagauugcaacaggcugggcuu

SEQ ID NO: 2495370 - RNA, 13 nt, Human
ccagauugacgac

SEQ ID NO: 2495371 - RNA, 19 nt, Human
ccagagcgugggagacggu

SEQ ID NO: 2495372 - RNA, 21 nt, Human
ccagagcgccccucccuagug

SEQ ID NO: 2495373 - RNA, 16 nt, Human
ccagauugcaacaggc

SEQ ID NO: 2495374 - RNA, 14 nt, Human
ccagauugcaacag

SEQ ID NO: 2495375 - RNA, 14 nt, Human
ccagagcccaccuu

SEQ ID NO: 2495376 - RNA, 17 nt, Human
ccagagcccagcuccaa

SEQ ID NO: 2495377 - RNA, 18 nt, Human
ccagagcccagcuccaag

SEQ ID NO: 2495378 - RNA, 21 nt, Human
ccagagccauggacucuacac

SEQ ID NO: 2495379 - RNA, 13 nt, Human
ccagagccaugga

SEQ ID NO: 2495380 - RNA, 15 nt, Human
ccagagccauggacu

SEQ ID NO: 2495381 - RNA, 16 nt, Human
ccagagcccagcucca

SEQ ID NO: 2495382 - RNA, 14 nt, Human
ccagagccccacac

SEQ ID NO: 2495383 - RNA, 18 nt, Human
ccagagccccacacggag

SEQ ID NO: 2495384 - RNA, 19 nt, Human
ccagagccccacacggagg

SEQ ID NO: 2495385 - RNA, 18 nt, Human
ccagcaccaucucuccuc

SEQ ID NO: 2495386 - RNA, 17 nt, Human
ccagcaccaucucuccu

SEQ ID NO: 2495387 - RNA, 20 nt, Human
ccagcacccgggcucaggga

SEQ ID NO: 2495388 - RNA, 18 nt, Human
ccagcacccgggcucagg

SEQ ID NO: 2495389 - RNA, 23 nt, Human
ccagcacccgggcucagggacca

SEQ ID NO: 2495390 - RNA, 22 nt, Human
ccagcaccauccgccagggccc

SEQ ID NO: 2495391 - RNA, 14 nt, Human
ccagcacccagcaa

SEQ ID NO: 2495392 - RNA, 14 nt, Human
ccagcacccgggcu

SEQ ID NO: 2495393 - RNA, 17 nt, Human
ccagcacccgggcucag

SEQ ID NO: 2495394 - RNA, 18 nt, Human
ccagcacccagcaacucc

SEQ ID NO: 2495395 - RNA, 18 nt, Human
ccagcaggcucucaggcc

SEQ ID NO: 2495396 - RNA, 17 nt, Human
ccagcaggcucucaggc

SEQ ID NO: 2495397 - RNA, 16 nt, Human
ccagcaggcucucagg

SEQ ID NO: 2495398 - RNA, 15 nt, Human
ccagcaccuggcauc

SEQ ID NO: 2495399 - RNA, 19 nt, Human
ccagcaagugagagcuggg

SEQ ID NO: 2495400 - RNA, 18 nt, Human
ccagcaagugagagcugg

SEQ ID NO: 2495401 - RNA, 21 nt, Human
ccagcaacacaagcuggaagc

SEQ ID NO: 2495402 - RNA, 17 nt, Human
ccagcaagugagagcug

SEQ ID NO: 2495403 - RNA, 17 nt, Human
ccagcacagcuugaccu

SEQ ID NO: 2495404 - RNA, 13 nt, Human
ccagcacagcuug

SEQ ID NO: 2495405 - RNA, 19 nt, Human
ccagcaccaacaccacggu

SEQ ID NO: 2495406 - RNA, 13 nt, Human
ccagcacaugaaa

SEQ ID NO: 2495407 - RNA, 16 nt, Human
ccagcacacagggcag

SEQ ID NO: 2495408 - RNA, 17 nt, Human
ccagcaacccuccuauc

SEQ ID NO: 2495409 - RNA, 21 nt, Human
ccagcaauucuccugccucag

SEQ ID NO: 2495410 - RNA, 15 nt, Human
ccagcaacccuccua

SEQ ID NO: 2495411 - RNA, 15 nt, Human
ccagcaacacaagcu

SEQ ID NO: 2495412 - RNA, 22 nt, Human
ccagcaaagccccaugcuggag

SEQ ID NO: 2495413 - RNA, 21 nt, Human
ccagcaaagccccaugcugga

SEQ ID NO: 2495414 - RNA, 19 nt, Human
ccagcaaagccccaugcug

SEQ ID NO: 2495415 - RNA, 14 nt, Human
ccagcaaagcccca

SEQ ID NO: 2495416 - RNA, 13 nt, Human
ccagcaaagcccc

SEQ ID NO: 2495417 - RNA, 15 nt, Human
ccagcaaaagguugu

SEQ ID NO: 2495418 - RNA, 21 nt, Human
ccagcaaagagugggcugcau

SEQ ID NO: 2495419 - RNA, 16 nt, Human
ccagauuuuuacacau

SEQ ID NO: 2495420 - RNA, 15 nt, Human
ccagauuuugcugua

SEQ ID NO: 2495421 - RNA, 24 nt, Human
ccagauuuuuuacagcugccugca

SEQ ID NO: 2495422 - RNA, 18 nt, Human
ccagauuuugcuguauau

SEQ ID NO: 2495423 - RNA, 21 nt, Human
ccagauuugcuaauuuauccu

SEQ ID NO: 2495424 - RNA, 13 nt, Human
ccagauuuacacu

SEQ ID NO: 2495425 - RNA, 22 nt, Human
ccagccgagauagccaaggcca

SEQ ID NO: 2495426 - RNA, 20 nt, Human
ccagccgagauagccaaggc

SEQ ID NO: 2495427 - RNA, 20 nt, Human
ccagcccuggucucagcagc

SEQ ID NO: 2495428 - RNA, 13 nt, Human
ccagcccuggucu

SEQ ID NO: 2495429 - RNA, 21 nt, Human
ccagcccuggcugaaggacug

SEQ ID NO: 2495430 - RNA, 17 nt, Human
ccagccgagauagccaa

SEQ ID NO: 2495431 - RNA, 22 nt, Human
ccagccggccucucuggccucc

SEQ ID NO: 2495432 - RNA, 20 nt, Human
ccagccggccucucuggccu

SEQ ID NO: 2495433 - RNA, 14 nt, Human
ccagccggccucuc

SEQ ID NO: 2495434 - RNA, 13 nt, Human
ccagccggccucu

SEQ ID NO: 2495435 - RNA, 14 nt, Human
ccagccggcauggc

SEQ ID NO: 2495436 - RNA, 13 nt, Human
ccagccggcaugg

SEQ ID NO: 2495437 - RNA, 19 nt, Human
ccagccgugaugcucaggc

SEQ ID NO: 2495438 - RNA, 18 nt, Human
ccagccgugaugcucagg

SEQ ID NO: 2495439 - RNA, 22 nt, Human
ccagccgguaccugggaagggg

SEQ ID NO: 2495440 - RNA, 23 nt, Human
ccagccggccucucuggccuccc

SEQ ID NO: 2495441 - RNA, 16 nt, Human
ccagccgcugcccggc

SEQ ID NO: 2495442 - RNA, 14 nt, Human
ccagccgcugcccg

SEQ ID NO: 2495443 - RNA, 23 nt, Human
ccagccgcugcccggcgcccucu

SEQ ID NO: 2495444 - RNA, 19 nt, Human
ccagccgcucggaggcccc

SEQ ID NO: 2495445 - RNA, 16 nt, Human
ccagccgcucggaggc

SEQ ID NO: 2495446 - RNA, 20 nt, Human
ccagccgccauugccaccag

SEQ ID NO: 2495447 - RNA, 23 nt, Human
ccagccgccauugccaccaggag

SEQ ID NO: 2495448 - RNA, 18 nt, Human
ccagcccuggcugaagga

SEQ ID NO: 2495449 - RNA, 17 nt, Human
ccagcccuggcugaagg

SEQ ID NO: 2495450 - RNA, 14 nt, Human
ccagcccuggcuga

SEQ ID NO: 2495451 - RNA, 17 nt, Human
ccagcccuggcucugca

SEQ ID NO: 2495452 - RNA, 13 nt, Human
ccagcccuggcuc

SEQ ID NO: 2495453 - RNA, 21 nt, Human
ccagcccugcuggccgccuca

SEQ ID NO: 2495454 - RNA, 18 nt, Human
ccagcccugcuggccgcc

SEQ ID NO: 2495455 - RNA, 16 nt, Human
ccagcccugcuggccg

SEQ ID NO: 2495456 - RNA, 24 nt, Human
ccagcccugcuggccgccucaccc

SEQ ID NO: 2495457 - RNA, 15 nt, Human
ccagcccugcuggcc

SEQ ID NO: 2495458 - RNA, 14 nt, Human
ccagcccugcuggc

SEQ ID NO: 2495459 - RNA, 13 nt, Human
ccagcccugcugg

SEQ ID NO: 2495460 - RNA, 11 nt, Human
ccagcccugcu

SEQ ID NO: 2495461 - RNA, 14 nt, Human
ccagcccugaguuc

SEQ ID NO: 2495462 - RNA, 18 nt, Human
ccagcccugaguuccuag

SEQ ID NO: 2495463 - RNA, 19 nt, Human
ccagccccaaaacucuccu

SEQ ID NO: 2495464 - RNA, 22 nt, Human
ccagcccauucucucuccuguc

SEQ ID NO: 2495465 - RNA, 17 nt, Human
ccagcccauucucucuc

SEQ ID NO: 2495466 - RNA, 19 nt, Human
ccagcccauucucucuccu

SEQ ID NO: 2495467 - RNA, 21 nt, Human
ccagcccauucucucuccugu

SEQ ID NO: 2495468 - RNA, 19 nt, Human
ccagcccagggcuccugca

SEQ ID NO: 2495469 - RNA, 17 nt, Human
ccagcccagggcuccug

SEQ ID NO: 2495470 - RNA, 21 nt, Human
ccagcccagggcuccugcacu

SEQ ID NO: 2495471 - RNA, 18 nt, Human
ccagcccagcccagcugg

SEQ ID NO: 2495472 - RNA, 12 nt, Human
ccagcccagggu

SEQ ID NO: 2495473 - RNA, 14 nt, Human
ccagcccagggugg

SEQ ID NO: 2495474 - RNA, 18 nt, Human
ccagcccaggguuccccc

SEQ ID NO: 2495475 - RNA, 21 nt, Human
ccagcccaggguucccccagc

SEQ ID NO: 2495476 - RNA, 14 nt, Human
ccagcccaagucca

SEQ ID NO: 2495477 - RNA, 14 nt, Human
ccagcccacccucc

SEQ ID NO: 2495478 - RNA, 13 nt, Human
ccagcccacccuc

SEQ ID NO: 2495479 - RNA, 19 nt, Human
ccagcccacccuccugucu

SEQ ID NO: 2495480 - RNA, 18 nt, Human
ccagcccacccuccuguc

SEQ ID NO: 2495481 - RNA, 22 nt, Human
ccagcccacccuccugucuucc

SEQ ID NO: 2495482 - RNA, 17 nt, Human
ccagcccacuucugcca

SEQ ID NO: 2495483 - RNA, 16 nt, Human
ccagcccacuucugcc

SEQ ID NO: 2495484 - RNA, 11 nt, Human
ccagcccagag

SEQ ID NO: 2495485 - RNA, 12 nt, Human
ccagcccagaga

SEQ ID NO: 2495486 - RNA, 13 nt, Human
ccagcccagagac

SEQ ID NO: 2495487 - RNA, 14 nt, Human
ccagcccagagaca

SEQ ID NO: 2495488 - RNA, 22 nt, Human
ccagcccagagacauacuugaa

SEQ ID NO: 2495489 - RNA, 23 nt, Human
ccagcccagagacauacuugaag

SEQ ID NO: 2495490 - RNA, 14 nt, Human
ccagcccagauguu

SEQ ID NO: 2495491 - RNA, 15 nt, Human
ccagcccagauguuu

SEQ ID NO: 2495492 - RNA, 12 nt, Human
ccagcccagccc

SEQ ID NO: 2495493 - RNA, 14 nt, Human
ccagcccagcccag

SEQ ID NO: 2495494 - RNA, 13 nt, Human
ccagcccagcugg

SEQ ID NO: 2495495 - RNA, 15 nt, Human
ccagcccagggcucc

SEQ ID NO: 2495496 - RNA, 14 nt, Human
ccagcccagggcuc

SEQ ID NO: 2495497 - RNA, 13 nt, Human
ccagcccagggcu

SEQ ID NO: 2495498 - RNA, 16 nt, Human
ccagcccagcccagcu

SEQ ID NO: 2495499 - RNA, 23 nt, Human
ccagcaggcucucaggccagcug

SEQ ID NO: 2495500 - RNA, 21 nt, Human
ccagcaggcucucaggccagc

SEQ ID NO: 2495501 - RNA, 20 nt, Human
ccagcaggcucucaggccag

SEQ ID NO: 2495502 - RNA, 19 nt, Human
ccagcaggcucucaggcca

SEQ ID NO: 2495503 - RNA, 22 nt, Human
ccagccauacuuaucucucugu

SEQ ID NO: 2495504 - RNA, 15 nt, Human
ccagccaucugccca

SEQ ID NO: 2495505 - RNA, 18 nt, Human
ccagccaucugcccaggg

SEQ ID NO: 2495506 - RNA, 17 nt, Human
ccagccaucugcccagg

SEQ ID NO: 2495507 - RNA, 16 nt, Human
ccagccaucugcccag

SEQ ID NO: 2495508 - RNA, 23 nt, Human
ccagcagggucuuuucaucuggg

SEQ ID NO: 2495509 - RNA, 22 nt, Human
ccagcagggucuuuucaucugg

SEQ ID NO: 2495510 - RNA, 21 nt, Human
ccagcagggucuuuucaucug

SEQ ID NO: 2495511 - RNA, 20 nt, Human
ccagcagggucuuuucaucu

SEQ ID NO: 2495512 - RNA, 16 nt, Human
ccagccaucaaaaugc

SEQ ID NO: 2495513 - RNA, 18 nt, Human
ccagccaucaaaaugcuu

SEQ ID NO: 2495514 - RNA, 21 nt, Human
ccagccaucugcccaggggug

SEQ ID NO: 2495515 - RNA, 20 nt, Human
ccagccaucugcccaggggu

SEQ ID NO: 2495516 - RNA, 19 nt, Human
ccagccaucugcccagggg

SEQ ID NO: 2495517 - RNA, 14 nt, Human
ccagccaugucugc

SEQ ID NO: 2495518 - RNA, 16 nt, Human
ccagccaugucugcau

SEQ ID NO: 2495519 - RNA, 17 nt, Human
ccagccaugucugcauu

SEQ ID NO: 2495520 - RNA, 18 nt, Human
ccagccaugucugcauuu

SEQ ID NO: 2495521 - RNA, 21 nt, Human
ccagccauuaccauggagaca

SEQ ID NO: 2495522 - RNA, 13 nt, Human
ccagcccaagucc

SEQ ID NO: 2495523 - RNA, 12 nt, Human
ccagcccaaguc

SEQ ID NO: 2495524 - RNA, 19 nt, Human
ccagccauuaccauggaga

SEQ ID NO: 2495525 - RNA, 19 nt, Human
ccagccugccuggcaggcu

SEQ ID NO: 2495526 - RNA, 18 nt, Human
ccagccugccuggcaggc

SEQ ID NO: 2495527 - RNA, 16 nt, Human
ccagccugccuggcag

SEQ ID NO: 2495528 - RNA, 23 nt, Human
ccagccgugaugcucaggcuuga

SEQ ID NO: 2495529 - RNA, 21 nt, Human
ccagccgugaugcucaggcuu

SEQ ID NO: 2495530 - RNA, 20 nt, Human
ccagccgugaugcucaggcu

SEQ ID NO: 2495531 - RNA, 21 nt, Human
ccagccugccuggcaggcugu

SEQ ID NO: 2495532 - RNA, 20 nt, Human
ccagccugccuggcaggcug

SEQ ID NO: 2495533 - RNA, 10 nt, Human
ccagccugcc

SEQ ID NO: 2495534 - RNA, 19 nt, Human
ccagccugagcgacaguga

SEQ ID NO: 2495535 - RNA, 17 nt, Human
ccagccuaagaugaaga

SEQ ID NO: 2495536 - RNA, 23 nt, Human
ccagccuggcucccacaggcagc

SEQ ID NO: 2495537 - RNA, 21 nt, Human
ccagccuggcucccacaggca

SEQ ID NO: 2495538 - RNA, 12 nt, Human
ccagccuggcuc

SEQ ID NO: 2495539 - RNA, 21 nt, Human
ccagccuggcuucuggagccc

SEQ ID NO: 2495540 - RNA, 19 nt, Human
ccagccuggcuucuggagc

SEQ ID NO: 2495541 - RNA, 20 nt, Human
ccagccuggcuucuggagcc

SEQ ID NO: 2495542 - RNA, 13 nt, Human
ccagccuggcuuc

SEQ ID NO: 2495543 - RNA, 15 nt, Human
ccagccuggcuucug

SEQ ID NO: 2495544 - RNA, 17 nt, Human
ccagccuggcuucugga

SEQ ID NO: 2495545 - RNA, 18 nt, Human
ccagccuggcuucuggag

SEQ ID NO: 2495546 - RNA, 19 nt, Human
ccagccugggcaacagagc

SEQ ID NO: 2495547 - RNA, 16 nt, Human
ccagccugggcagcca

SEQ ID NO: 2495548 - RNA, 18 nt, Human
ccagccugggcagccagg

SEQ ID NO: 2495549 - RNA, 22 nt, Human
ccagccugggcagccaggcugc

SEQ ID NO: 2495550 - RNA, 23 nt, Human
ccagccugggcagccaggcugcc

SEQ ID NO: 2495551 - RNA, 13 nt, Human
ccagccuggguga

SEQ ID NO: 2495552 - RNA, 19 nt, Human
ccagccugggcgacagagc

SEQ ID NO: 2495553 - RNA, 23 nt, Human
ccagccuugaccauucuccaccu

SEQ ID NO: 2495554 - RNA, 18 nt, Human
ccagccuuggcaucuaga

SEQ ID NO: 2495555 - RNA, 15 nt, Human
ccagccuuucuccca

SEQ ID NO: 2495556 - RNA, 18 nt, Human
ccagccuuucucccaggc

SEQ ID NO: 2495557 - RNA, 19 nt, Human
ccagccuuucucccaggcc

SEQ ID NO: 2495558 - RNA, 20 nt, Human
ccagccuuucucccaggcca

SEQ ID NO: 2495559 - RNA, 21 nt, Human
ccagccuuucucccaggccag

SEQ ID NO: 2495560 - RNA, 16 nt, Human
ccagccuuccucugca

SEQ ID NO: 2495561 - RNA, 15 nt, Human
ccagccuuccucugc

SEQ ID NO: 2495562 - RNA, 20 nt, Human
ccagccuguuggacccgcuc

SEQ ID NO: 2495563 - RNA, 14 nt, Human
ccagccuguuggac

SEQ ID NO: 2495564 - RNA, 23 nt, Human
ccagccugucccauggacacucc

SEQ ID NO: 2495565 - RNA, 19 nt, Human
ccagccugucccauggaca

SEQ ID NO: 2495566 - RNA, 13 nt, Human
ccagccugggguc

SEQ ID NO: 2495567 - RNA, 16 nt, Human
ccagccugggcgacag

SEQ ID NO: 2495568 - RNA, 13 nt, Human
ccagcgagcccug

SEQ ID NO: 2495569 - RNA, 16 nt, Human
ccagcucccucuauuu

SEQ ID NO: 2495570 - RNA, 20 nt, Human
ccagccuuugaucagguggg

SEQ ID NO: 2495571 - RNA, 18 nt, Human
ccagcuccggccuguccu

SEQ ID NO: 2495572 - RNA, 19 nt, Human
ccagcuccggccuguccuc

SEQ ID NO: 2495573 - RNA, 20 nt, Human
ccagcuccucccuuguucuc

SEQ ID NO: 2495574 - RNA, 14 nt, Human
ccagcuccucccuu

SEQ ID NO: 2495575 - RNA, 23 nt, Human
ccagcuccucauccagggcucug

SEQ ID NO: 2495576 - RNA, 20 nt, Human
ccagcuccggccuguccucc

SEQ ID NO: 2495577 - RNA, 12 nt, Human
ccagcuccucau

SEQ ID NO: 2495578 - RNA, 23 nt, Human
ccacccuccugucuucccagggu

SEQ ID NO: 2495579 - RNA, 22 nt, Human
ccacccuccugucuucccaggg

SEQ ID NO: 2495580 - RNA, 21 nt, Human
ccacccuccugucuucccagg

SEQ ID NO: 2495581 - RNA, 20 nt, Human
ccacccuccugucuucccag

SEQ ID NO: 2495582 - RNA, 19 nt, Human
ccacccuccugucuuccca

SEQ ID NO: 2495583 - RNA, 17 nt, Human
ccacccuccugucuucc

SEQ ID NO: 2495584 - RNA, 15 nt, Human
ccacccuccugucuu

SEQ ID NO: 2495585 - RNA, 14 nt, Human
ccacccuccugucu

SEQ ID NO: 2495586 - RNA, 14 nt, Human
ccacccuccuuuca

SEQ ID NO: 2495587 - RNA, 22 nt, Human
ccaccccugccuccacccucug

SEQ ID NO: 2495588 - RNA, 18 nt, Human
ccaccccugccuccaccc

SEQ ID NO: 2495589 - RNA, 16 nt, Human
ccaccccugccuccac

SEQ ID NO: 2495590 - RNA, 15 nt, Human
ccaccccugccucca

SEQ ID NO: 2495591 - RNA, 17 nt, Human
ccaccccugggggcucu

SEQ ID NO: 2495592 - RNA, 12 nt, Human
ccaccccugugc

SEQ ID NO: 2495593 - RNA, 20 nt, Human
ccaccccugggggcucucau

SEQ ID NO: 2495594 - RNA, 14 nt, Human
ccaccccugccucc

SEQ ID NO: 2495595 - RNA, 12 nt, Human
ccaccccugccu

SEQ ID NO: 2495596 - RNA, 22 nt, Human
ccaccccugcccccagccccgg

SEQ ID NO: 2495597 - RNA, 13 nt, Human
ccaccccugcccc

SEQ ID NO: 2495598 - RNA, 14 nt, Human
ccaccccuccccau

SEQ ID NO: 2495599 - RNA, 15 nt, Human
ccaccccuccuuccu

SEQ ID NO: 2495600 - RNA, 16 nt, Human
ccaccccuccuuccuu

SEQ ID NO: 2495601 - RNA, 13 nt, Human
ccacccuccuguc

SEQ ID NO: 2495602 - RNA, 12 nt, Human
ccacccuccugu

SEQ ID NO: 2495603 - RNA, 17 nt, Human
ccacccucccuggagug

SEQ ID NO: 2495604 - RNA, 16 nt, Human
ccacccucccuggagu

SEQ ID NO: 2495605 - RNA, 13 nt, Human
ccaccccuugcuc

SEQ ID NO: 2495606 - RNA, 15 nt, Human
ccaccccuuccuguc

SEQ ID NO: 2495607 - RNA, 14 nt, Human
ccaccccuuccugu

SEQ ID NO: 2495608 - RNA, 15 nt, Human
ccaccccugugcucc

SEQ ID NO: 2495609 - RNA, 14 nt, Human
ccaccccugugcuc

SEQ ID NO: 2495610 - RNA, 13 nt, Human
ccaccccugugcu

SEQ ID NO: 2495611 - RNA, 13 nt, Human
ccaccccuucccc

SEQ ID NO: 2495612 - RNA, 15 nt, Human
ccaccccuuccccac

SEQ ID NO: 2495613 - RNA, 13 nt, Human
ccaccccuuccug

SEQ ID NO: 2495614 - RNA, 16 nt, Human
ccaccccuuccccacu

SEQ ID NO: 2495615 - RNA, 16 nt, Human
ccacccccagcucaau

SEQ ID NO: 2495616 - RNA, 13 nt, Human
ccacccccagcuc

SEQ ID NO: 2495617 - RNA, 15 nt, Human
ccacccccaccccca

SEQ ID NO: 2495618 - RNA, 19 nt, Human
ccacccccacccaagggcc

SEQ ID NO: 2495619 - RNA, 16 nt, Human
ccacccccaggacccc

SEQ ID NO: 2495620 - RNA, 18 nt, Human
ccacccccaggaccccug

SEQ ID NO: 2495621 - RNA, 19 nt, Human
ccacccccaggaccccuga

SEQ ID NO: 2495622 - RNA, 18 nt, Human
ccaccccccacucugugc

SEQ ID NO: 2495623 - RNA, 15 nt, Human
ccacccccagcugcu

SEQ ID NO: 2495624 - RNA, 22 nt, Human
ccaccccccagaaccuguccuu

SEQ ID NO: 2495625 - RNA, 21 nt, Human
ccaccccccagaaccuguccu

SEQ ID NO: 2495626 - RNA, 15 nt, Human
ccacccccucaagcc

SEQ ID NO: 2495627 - RNA, 14 nt, Human
ccacccccucaagc

SEQ ID NO: 2495628 - RNA, 12 nt, Human
ccacccccucaa

SEQ ID NO: 2495629 - RNA, 13 nt, Human
ccaccccccucau

SEQ ID NO: 2495630 - RNA, 16 nt, Human
ccacccccuccccagg

SEQ ID NO: 2495631 - RNA, 17 nt, Human
ccacccccuccccaggg

SEQ ID NO: 2495632 - RNA, 18 nt, Human
ccacccccuccccagggg

SEQ ID NO: 2495633 - RNA, 19 nt, Human
ccacccccuccccagggga

SEQ ID NO: 2495634 - RNA, 15 nt, Human
ccacccccugcccug

SEQ ID NO: 2495635 - RNA, 14 nt, Human
ccacccccugcccu

SEQ ID NO: 2495636 - RNA, 13 nt, Human
ccacccccugccc

SEQ ID NO: 2495637 - RNA, 22 nt, Human
ccacccccucccuggccuguuc

SEQ ID NO: 2495638 - RNA, 17 nt, Human
ccacccccugcccugca

SEQ ID NO: 2495639 - RNA, 16 nt, Human
ccacccccugcccugc

SEQ ID NO: 2495640 - RNA, 18 nt, Human
ccacccccugcccugcac

SEQ ID NO: 2495641 - RNA, 12 nt, Human
ccacccccuuca

SEQ ID NO: 2495642 - RNA, 17 nt, Human
ccacccccuucagugcc

SEQ ID NO: 2495643 - RNA, 18 nt, Human
ccacccccuucagugccc

SEQ ID NO: 2495644 - RNA, 20 nt, Human
ccacccccuucagugcccac

SEQ ID NO: 2495645 - RNA, 22 nt, Human
ccacccccuucagugcccacca

SEQ ID NO: 2495646 - RNA, 13 nt, Human
ccacccccuucuc

SEQ ID NO: 2495647 - RNA, 18 nt, Human
ccacccccuucucugcuc

SEQ ID NO: 2495648 - RNA, 19 nt, Human
ccacccccuucucugcucc

SEQ ID NO: 2495649 - RNA, 22 nt, Human
ccaccugggcauauccaccacc

SEQ ID NO: 2495650 - RNA, 14 nt, Human
ccaccuggggcagu

SEQ ID NO: 2495651 - RNA, 20 nt, Human
ccaccuggggcagucaccug

SEQ ID NO: 2495652 - RNA, 15 nt, Human
ccaccuggggcaguc

SEQ ID NO: 2495653 - RNA, 16 nt, Human
ccaccuggggcaguca

SEQ ID NO: 2495654 - RNA, 17 nt, Human
ccaccuucaauuccugg

SEQ ID NO: 2495655 - RNA, 14 nt, Human
ccaccugucuucaa

SEQ ID NO: 2495656 - RNA, 18 nt, Human
ccaccuucaauuccuggg

SEQ ID NO: 2495657 - RNA, 19 nt, Human
ccaccuucaauuccugggc

SEQ ID NO: 2495658 - RNA, 20 nt, Human
ccaccuucaauuccugggcc

SEQ ID NO: 2495659 - RNA, 20 nt, Human
ccaccuggccucugcacucc

SEQ ID NO: 2495660 - RNA, 18 nt, Human
ccaccuggccucugcacu

SEQ ID NO: 2495661 - RNA, 13 nt, Human
ccaccuggccucu

SEQ ID NO: 2495662 - RNA, 21 nt, Human
ccaccuggccccaugucucuc

SEQ ID NO: 2495663 - RNA, 22 nt, Human
ccaccuggccccaugucucuca

SEQ ID NO: 2495664 - RNA, 15 nt, Human
ccaccuggccaccug

SEQ ID NO: 2495665 - RNA, 14 nt, Human
ccaccuggccaccu

SEQ ID NO: 2495666 - RNA, 18 nt, Human
ccaccuggccaccugagg

SEQ ID NO: 2495667 - RNA, 12 nt, Human
ccaccuggcccc

SEQ ID NO: 2495668 - RNA, 14 nt, Human
ccaccugccaggga

SEQ ID NO: 2495669 - RNA, 13 nt, Human
ccaccugccaggg

SEQ ID NO: 2495670 - RNA, 18 nt, Human
ccaccucugugaccucag

SEQ ID NO: 2495671 - RNA, 17 nt, Human
ccaccucugugaccuca

SEQ ID NO: 2495672 - RNA, 15 nt, Human
ccaccucugugaccu

SEQ ID NO: 2495673 - RNA, 20 nt, Human
ccaccucugcggaccccagc

SEQ ID NO: 2495674 - RNA, 19 nt, Human
ccaccucugcggaccccag

SEQ ID NO: 2495675 - RNA, 22 nt, Human
ccaccucugcggaccccagcug

SEQ ID NO: 2495676 - RNA, 23 nt, Human
ccaccucugugaccucaggcacu

SEQ ID NO: 2495677 - RNA, 22 nt, Human
ccaccucugugaccucaggcac

SEQ ID NO: 2495678 - RNA, 19 nt, Human
ccaccucugugaccucagg

SEQ ID NO: 2495679 - RNA, 18 nt, Human
ccaccucuucucuuccug

SEQ ID NO: 2495680 - RNA, 16 nt, Human
ccaccucuucucuucc

SEQ ID NO: 2495681 - RNA, 15 nt, Human
ccaccugccagggac

SEQ ID NO: 2495682 - RNA, 12 nt, Human
ccaccugccagg

SEQ ID NO: 2495683 - RNA, 13 nt, Human
ccaccuggccacc

SEQ ID NO: 2495684 - RNA, 12 nt, Human
ccaccuggccac

SEQ ID NO: 2495685 - RNA, 22 nt, Human
ccaccugcugagagacccaagg

SEQ ID NO: 2495686 - RNA, 23 nt, Human
ccaccugcugagagacccaagga

SEQ ID NO: 2495687 - RNA, 20 nt, Human
ccaccucuucucuuccugua

SEQ ID NO: 2495688 - RNA, 19 nt, Human
ccaccucuucucuuccugu

SEQ ID NO: 2495689 - RNA, 15 nt, Human
ccaccugcugagaga

SEQ ID NO: 2495690 - RNA, 14 nt, Human
ccaccucccugccu

SEQ ID NO: 2495691 - RNA, 16 nt, Human
ccaccucccugccucc

SEQ ID NO: 2495692 - RNA, 18 nt, Human
ccaccucccugccuccag

SEQ ID NO: 2495693 - RNA, 18 nt, Human
ccaccuccuucucugucu

SEQ ID NO: 2495694 - RNA, 17 nt, Human
ccaccuccuucucuguc

SEQ ID NO: 2495695 - RNA, 13 nt, Human
ccaccuccuucuc

SEQ ID NO: 2495696 - RNA, 12 nt, Human
ccaccuccuucu

SEQ ID NO: 2495697 - RNA, 12 nt, Human
ccacccugcucu

SEQ ID NO: 2495698 - RNA, 11 nt, Human
ccacccugcuc

SEQ ID NO: 2495699 - RNA, 13 nt, Human
ccaccucucccuc

SEQ ID NO: 2495700 - RNA, 12 nt, Human
ccaccucucccu

SEQ ID NO: 2495701 - RNA, 17 nt, Human
ccaccucuccccaccuu

SEQ ID NO: 2495702 - RNA, 17 nt, Human
ccaccucuccaagggcu

SEQ ID NO: 2495703 - RNA, 16 nt, Human
ccaccucuccaagggc

SEQ ID NO: 2495704 - RNA, 15 nt, Human
ccaccucuccaaggg

SEQ ID NO: 2495705 - RNA, 14 nt, Human
ccaccucuccaagg

SEQ ID NO: 2495706 - RNA, 13 nt, Human
ccaccucuccaag

SEQ ID NO: 2495707 - RNA, 12 nt, Human
ccaccucuccaa

SEQ ID NO: 2495708 - RNA, 16 nt, Human
ccaccucucucacucc

SEQ ID NO: 2495709 - RNA, 14 nt, Human
ccaccucucucacu

SEQ ID NO: 2495710 - RNA, 20 nt, Human
ccaccucucucacuccuuga

SEQ ID NO: 2495711 - RNA, 19 nt, Human
ccaccucucucacuccuug

SEQ ID NO: 2495712 - RNA, 18 nt, Human
ccaccucugcggacccca

SEQ ID NO: 2495713 - RNA, 13 nt, Human
ccaccucugcgga

SEQ ID NO: 2495714 - RNA, 11 nt, Human
ccaccucugcg

SEQ ID NO: 2495715 - RNA, 10 nt, Human
ccaccucugc

SEQ ID NO: 2495716 - RNA, 24 nt, Human
ccaccucucuccuuugcugaggcc

SEQ ID NO: 2495717 - RNA, 19 nt, Human
ccaccucucuccuuugcug

SEQ ID NO: 2495718 - RNA, 15 nt, Human
ccaccucucuuuuuc

SEQ ID NO: 2495719 - RNA, 17 nt, Human
ccaccucucuccuuugc

SEQ ID NO: 2495720 - RNA, 14 nt, Human
ccaccucucuccuu

SEQ ID NO: 2495721 - RNA, 18 nt, Human
ccaccucucccugacccu

SEQ ID NO: 2495722 - RNA, 17 nt, Human
ccaccucucccugaccc

SEQ ID NO: 2495723 - RNA, 16 nt, Human
ccaccucucccugacc

SEQ ID NO: 2495724 - RNA, 14 nt, Human
ccagacaugccaca

SEQ ID NO: 2495725 - RNA, 20 nt, Human
ccagacaugccacaaggacu

SEQ ID NO: 2495726 - RNA, 14 nt, Human
ccagacaucaacag

SEQ ID NO: 2495727 - RNA, 18 nt, Human
ccagaccccuggcuuuuc

SEQ ID NO: 2495728 - RNA, 24 nt, Human
ccagaccccuggcuuuucacugcu

SEQ ID NO: 2495729 - RNA, 19 nt, Human
ccagacauguggugggaca

SEQ ID NO: 2495730 - RNA, 23 nt, Human
ccagacauguggugggacaggga

SEQ ID NO: 2495731 - RNA, 20 nt, Human
ccagacacauguccaagaag

SEQ ID NO: 2495732 - RNA, 17 nt, Human
ccagacacauguccaag

SEQ ID NO: 2495733 - RNA, 22 nt, Human
ccagacacauguccaagaagcc

SEQ ID NO: 2495734 - RNA, 13 nt, Human
ccagacacccagg

SEQ ID NO: 2495735 - RNA, 10 nt, Human
ccagacaccc

SEQ ID NO: 2495736 - RNA, 15 nt, Human
ccagacacaggcccu

SEQ ID NO: 2495737 - RNA, 17 nt, Human
ccagacagccuguaucu

SEQ ID NO: 2495738 - RNA, 13 nt, Human
ccagacagcuccc

SEQ ID NO: 2495739 - RNA, 20 nt, Human
ccagacagcucccucugccu

SEQ ID NO: 2495740 - RNA, 15 nt, Human
ccagacccggcugcg

SEQ ID NO: 2495741 - RNA, 14 nt, Human
ccagacccggcugc

SEQ ID NO: 2495742 - RNA, 16 nt, Human
ccagagaguggcuccu

SEQ ID NO: 2495743 - RNA, 15 nt, Human
ccagagaguggcucc

SEQ ID NO: 2495744 - RNA, 14 nt, Human
ccagagaguggcuc

SEQ ID NO: 2495745 - RNA, 14 nt, Human
ccagagaguccucu

SEQ ID NO: 2495746 - RNA, 11 nt, Human
ccagagccagg

SEQ ID NO: 2495747 - RNA, 12 nt, Human
ccagagccaggg

SEQ ID NO: 2495748 - RNA, 22 nt, Human
ccagagccaggggggugaggag

SEQ ID NO: 2495749 - RNA, 23 nt, Human
ccagagccaggggggugaggagc

SEQ ID NO: 2495750 - RNA, 23 nt, Human
ccagagcauuuccaacaccacag

SEQ ID NO: 2495751 - RNA, 22 nt, Human
ccagagcauuuccaacaccaca

SEQ ID NO: 2495752 - RNA, 21 nt, Human
ccagagcauuuccaacaccac

SEQ ID NO: 2495753 - RNA, 18 nt, Human
ccagagaguccucuggau

SEQ ID NO: 2495754 - RNA, 17 nt, Human
ccagagaguccucugga

SEQ ID NO: 2495755 - RNA, 15 nt, Human
ccagagaguccucug

SEQ ID NO: 2495756 - RNA, 22 nt, Human
ccagagaguggcuccucccggu

SEQ ID NO: 2495757 - RNA, 18 nt, Human
ccagagaguggcuccucc

SEQ ID NO: 2495758 - RNA, 16 nt, Human
ccagaaugcuguacau

SEQ ID NO: 2495759 - RNA, 17 nt, Human
ccagaaugcuguacauc

SEQ ID NO: 2495760 - RNA, 19 nt, Human
ccagacacaggcccucccu

SEQ ID NO: 2495761 - RNA, 15 nt, Human
ccagaaugaggcugc

SEQ ID NO: 2495762 - RNA, 12 nt, Human
ccagaaucaaag

SEQ ID NO: 2495763 - RNA, 16 nt, Human
ccagaaucuaaagcca

SEQ ID NO: 2495764 - RNA, 21 nt, Human
ccagaauaaguuauugcaguu

SEQ ID NO: 2495765 - RNA, 19 nt, Human
ccagaauaaguuauugcag

SEQ ID NO: 2495766 - RNA, 15 nt, Human
ccagaauaaguuauu

SEQ ID NO: 2495767 - RNA, 23 nt, Human
ccagaauaaguuauugcaguuua

SEQ ID NO: 2495768 - RNA, 22 nt, Human
ccagaauaaguuauugcaguuu

SEQ ID NO: 2495769 - RNA, 15 nt, Human
ccagaagcuuccaua

SEQ ID NO: 2495770 - RNA, 20 nt, Human
ccagaagcugagcaccaggg

SEQ ID NO: 2495771 - RNA, 15 nt, Human
ccagaagccucuggc

SEQ ID NO: 2495772 - RNA, 16 nt, Human
ccagaagccucuggcu

SEQ ID NO: 2495773 - RNA, 19 nt, Human
ccagaagccucuggcuaga

SEQ ID NO: 2495774 - RNA, 20 nt, Human
ccagaagccucuggcuagag

SEQ ID NO: 2495775 - RNA, 14 nt, Human
ccagaagggguuug

SEQ ID NO: 2495776 - RNA, 22 nt, Human
ccagaaggcauaucagucucug

SEQ ID NO: 2495777 - RNA, 15 nt, Human
ccagaagggggccau

SEQ ID NO: 2495778 - RNA, 16 nt, Human
ccagaagcuuccauag

SEQ ID NO: 2495779 - RNA, 12 nt, Human
ccagaaggcagg

SEQ ID NO: 2495780 - RNA, 19 nt, Human
ccacugugcugaauucugc

SEQ ID NO: 2495781 - RNA, 17 nt, Human
ccacugugcugaauucu

SEQ ID NO: 2495782 - RNA, 12 nt, Human
ccacuguguaua

SEQ ID NO: 2495783 - RNA, 14 nt, Human
ccacuguuaucaaa

SEQ ID NO: 2495784 - RNA, 12 nt, Human
ccacuuuuuaac

SEQ ID NO: 2495785 - RNA, 16 nt, Human
ccacugugccaugugc

SEQ ID NO: 2495786 - RNA, 15 nt, Human
ccacugugccaugug

SEQ ID NO: 2495787 - RNA, 22 nt, Human
ccacuguccugggcgcccugga

SEQ ID NO: 2495788 - RNA, 16 nt, Human
ccacuguccugggcgc

SEQ ID NO: 2495789 - RNA, 15 nt, Human
ccacuguccugggcg

SEQ ID NO: 2495790 - RNA, 14 nt, Human
ccacuguccugggc

SEQ ID NO: 2495791 - RNA, 14 nt, Human
ccacugucuucuuc

SEQ ID NO: 2495792 - RNA, 19 nt, Human
ccacugugccaugugccag

SEQ ID NO: 2495793 - RNA, 18 nt, Human
ccagaaaccuuuguuugc

SEQ ID NO: 2495794 - RNA, 16 nt, Human
ccagaaaaggacagaa

SEQ ID NO: 2495795 - RNA, 15 nt, Human
ccagaaaaggacaga

SEQ ID NO: 2495796 - RNA, 14 nt, Human
ccagaaccuguccu

SEQ ID NO: 2495797 - RNA, 19 nt, Human
ccagaaaaaaaaaaacuua

SEQ ID NO: 2495798 - RNA, 15 nt, Human
ccagaaaaccccagc

SEQ ID NO: 2495799 - RNA, 14 nt, Human
ccagaaaaggacag

SEQ ID NO: 2495800 - RNA, 16 nt, Human
ccagaaaaccccagca

SEQ ID NO: 2495801 - RNA, 22 nt, Human
ccagaagaaaauagugguguga

SEQ ID NO: 2495802 - RNA, 15 nt, Human
ccagaagcccagaau

SEQ ID NO: 2495803 - RNA, 12 nt, Human
ccagaacuggac

SEQ ID NO: 2495804 - RNA, 21 nt, Human
ccagaacguggcucugcuggc

SEQ ID NO: 2495805 - RNA, 20 nt, Human
ccagaacguggcucugcugg

SEQ ID NO: 2495806 - RNA, 19 nt, Human
ccagaacucacuggggccu

SEQ ID NO: 2495807 - RNA, 19 nt, Human
ccagaacguggcucugcug

SEQ ID NO: 2495808 - RNA, 18 nt, Human
ccagaacguggcucugcu

SEQ ID NO: 2495809 - RNA, 17 nt, Human
ccagaacaguuuguaca

SEQ ID NO: 2495810 - RNA, 15 nt, Human
ccagaaccuguccuu

SEQ ID NO: 2495811 - RNA, 21 nt, Human
ccacugcaucguuucaucuuc

SEQ ID NO: 2495812 - RNA, 23 nt, Human
ccacugcaucguuucaucuucca

SEQ ID NO: 2495813 - RNA, 11 nt, Human
ccaccuuccca

SEQ ID NO: 2495814 - RNA, 12 nt, Human
ccaccuucccag

SEQ ID NO: 2495815 - RNA, 13 nt, Human
ccaccuucccagc

SEQ ID NO: 2495816 - RNA, 14 nt, Human
ccaccuucccagcu

SEQ ID NO: 2495817 - RNA, 15 nt, Human
ccaccuucccagcuc

SEQ ID NO: 2495818 - RNA, 16 nt, Human
ccaccuucccagcucu

SEQ ID NO: 2495819 - RNA, 19 nt, Human
ccaccuucccagcucuccc

SEQ ID NO: 2495820 - RNA, 14 nt, Human
ccaccuucccaugc

SEQ ID NO: 2495821 - RNA, 14 nt, Human
ccaccuugcgggga

SEQ ID NO: 2495822 - RNA, 21 nt, Human
ccaccuucccagcucucccuc

SEQ ID NO: 2495823 - RNA, 18 nt, Human
ccacugcauaccaaccug

SEQ ID NO: 2495824 - RNA, 16 nt, Human
ccacugccucuuccuc

SEQ ID NO: 2495825 - RNA, 11 nt, Human
ccacugccugc

SEQ ID NO: 2495826 - RNA, 12 nt, Human
ccacugccugcc

SEQ ID NO: 2495827 - RNA, 12 nt, Human
ccacugccuucg

SEQ ID NO: 2495828 - RNA, 17 nt, Human
ccacugccugcccaccc

SEQ ID NO: 2495829 - RNA, 23 nt, Human
ccacugccugcccacccguggag

SEQ ID NO: 2495830 - RNA, 13 nt, Human
ccacugccugccc

SEQ ID NO: 2495831 - RNA, 14 nt, Human
ccacugccugccca

SEQ ID NO: 2495832 - RNA, 15 nt, Human
ccacugccugcccac

SEQ ID NO: 2495833 - RNA, 16 nt, Human
ccacugccugcccacc

SEQ ID NO: 2495834 - RNA, 13 nt, Human
ccacugccucuuc

SEQ ID NO: 2495835 - RNA, 23 nt, Human
ccacugccacacgucugacccuc

SEQ ID NO: 2495836 - RNA, 19 nt, Human
ccacugcauaccaaccugg

SEQ ID NO: 2495837 - RNA, 14 nt, Human
ccacugugaagaga

SEQ ID NO: 2495838 - RNA, 15 nt, Human
ccacugugaagagaa

SEQ ID NO: 2495839 - RNA, 15 nt, Human
ccacuguccugggcc

SEQ ID NO: 2495840 - RNA, 19 nt, Human
ccacuguccugggccugca

SEQ ID NO: 2495841 - RNA, 20 nt, Human
ccacuguccugggccugcag

SEQ ID NO: 2495842 - RNA, 21 nt, Human
ccacuguccugggccugcaga

SEQ ID NO: 2495843 - RNA, 13 nt, Human
ccacuguccuggg

SEQ ID NO: 2495844 - RNA, 12 nt, Human
ccacuguccugg

SEQ ID NO: 2495845 - RNA, 11 nt, Human
ccacuguccug

SEQ ID NO: 2495846 - RNA, 17 nt, Human
ccacugcaggccccgcu

SEQ ID NO: 2495847 - RNA, 23 nt, Human
ccacugucacuguuucucugcug

SEQ ID NO: 2495848 - RNA, 24 nt, Human
ccacugucacuguuucucugcugu

SEQ ID NO: 2495849 - RNA, 15 nt, Human
ccacugguucuucuu

SEQ ID NO: 2495850 - RNA, 17 nt, Human
ccacugucacccuccac

SEQ ID NO: 2495851 - RNA, 19 nt, Human
ccacugucacuguuucucu

SEQ ID NO: 2495852 - RNA, 22 nt, Human
ccacugucacuguuucucugcu

SEQ ID NO: 2495853 - RNA, 23 nt, Human
ccacuggugacaugucuuuucuu

SEQ ID NO: 2495854 - RNA, 22 nt, Human
ccacugggguccagggagcagg

SEQ ID NO: 2495855 - RNA, 19 nt, Human
ccacugggguccagggagc

SEQ ID NO: 2495856 - RNA, 18 nt, Human
ccacugggguccagggag

SEQ ID NO: 2495857 - RNA, 15 nt, Human
ccacugcucugguua

SEQ ID NO: 2495858 - RNA, 13 nt, Human
ccacugcucuggu

SEQ ID NO: 2495859 - RNA, 12 nt, Human
ccacugcucugg

SEQ ID NO: 2495860 - RNA, 11 nt, Human
ccacugcucug

SEQ ID NO: 2495861 - RNA, 21 nt, Human
ccacugccuucgauacaccgg

SEQ ID NO: 2495862 - RNA, 20 nt, Human
ccacugcuuuuggucugugu

SEQ ID NO: 2495863 - RNA, 22 nt, Human
ccacugcuuuuggucuguguga

SEQ ID NO: 2495864 - RNA, 19 nt, Human
ccacugcugcuucuccaug

SEQ ID NO: 2495865 - RNA, 16 nt, Human
ccacugcugcuucucc

SEQ ID NO: 2495866 - RNA, 15 nt, Human
ccacuggaagggcag

SEQ ID NO: 2495867 - RNA, 18 nt, Human
ccuagucucccucacagc

SEQ ID NO: 2495868 - RNA, 14 nt, Human
ccguggcuucccgc

SEQ ID NO: 2495869 - RNA, 17 nt, Human
ccgugaguucucagggc

SEQ ID NO: 2495870 - RNA, 16 nt, Human
ccgugaguucucaggg

SEQ ID NO: 2495871 - RNA, 14 nt, Human
ccgugaguucucag

SEQ ID NO: 2495872 - RNA, 22 nt, Human
ccgggucaucuguaccucugcc

SEQ ID NO: 2495873 - RNA, 23 nt, Human
ccgugaguucucagggcuccugc

SEQ ID NO: 2495874 - RNA, 20 nt, Human
ccgugaguucucagggcucc

SEQ ID NO: 2495875 - RNA, 19 nt, Human
ccgugaguucucagggcuc

SEQ ID NO: 2495876 - RNA, 18 nt, Human
ccgugaguucucagggcu

SEQ ID NO: 2495877 - RNA, 17 nt, Human
ccgugaugcucaggcuu

SEQ ID NO: 2495878 - RNA, 23 nt, Human
ccgugauguaggguaaggugccu

SEQ ID NO: 2495879 - RNA, 13 nt, Human
ccgugcagacugg

SEQ ID NO: 2495880 - RNA, 14 nt, Human
ccgugcagacugga

SEQ ID NO: 2495881 - RNA, 23 nt, Human
ccguggccccagccuggcccagc

SEQ ID NO: 2495882 - RNA, 21 nt, Human
ccguggccccagccuggccca

SEQ ID NO: 2495883 - RNA, 20 nt, Human
ccguggccccagccuggccc

SEQ ID NO: 2495884 - RNA, 19 nt, Human
ccguggccccagccuggcc

SEQ ID NO: 2495885 - RNA, 15 nt, Human
ccgugccccgccucc

SEQ ID NO: 2495886 - RNA, 20 nt, Human
ccgugcccaggggcccacag

SEQ ID NO: 2495887 - RNA, 12 nt, Human
ccgugcccaggg

SEQ ID NO: 2495888 - RNA, 18 nt, Human
ccgugcagcuucuguccu

SEQ ID NO: 2495889 - RNA, 19 nt, Human
ccgugcagcuucuguccug

SEQ ID NO: 2495890 - RNA, 17 nt, Human
ccgugcagacuggaggg

SEQ ID NO: 2495891 - RNA, 19 nt, Human
ccgugcagacuggagggga

SEQ ID NO: 2495892 - RNA, 14 nt, Human
ccguucacauuuuu

SEQ ID NO: 2495893 - RNA, 20 nt, Human
ccguuauuauaauuguauca

SEQ ID NO: 2495894 - RNA, 21 nt, Human
ccguuauuauaauuguaucag

SEQ ID NO: 2495895 - RNA, 11 nt, Human
ccguggcuucc

SEQ ID NO: 2495896 - RNA, 22 nt, Human
ccguggccccagccuggcccag

SEQ ID NO: 2495897 - RNA, 14 nt, Human
ccguggcugcggca

SEQ ID NO: 2495898 - RNA, 18 nt, Human
ccguugauguuggcuggg

SEQ ID NO: 2495899 - RNA, 23 nt, Human
ccguucugcuggccuggaucucc

SEQ ID NO: 2495900 - RNA, 18 nt, Human
ccguucugcuggccugga

SEQ ID NO: 2495901 - RNA, 15 nt, Human
ccguucugcuggccu

SEQ ID NO: 2495902 - RNA, 19 nt, Human
ccguugauguuggcuggga

SEQ ID NO: 2495903 - RNA, 20 nt, Human
ccguugggccccagccuucu

SEQ ID NO: 2495904 - RNA, 11 nt, Human
ccguuggccac

SEQ ID NO: 2495905 - RNA, 23 nt, Human
ccguuggaaacauaaccauuaca

SEQ ID NO: 2495906 - RNA, 18 nt, Human
ccguugucucccuggccc

SEQ ID NO: 2495907 - RNA, 14 nt, Human
ccguugucucccug

SEQ ID NO: 2495908 - RNA, 20 nt, Human
ccguuggggauuggggaaga

SEQ ID NO: 2495909 - RNA, 21 nt, Human
ccguugucucccuggcccuca

SEQ ID NO: 2495910 - RNA, 20 nt, Human
ccguugucucccuggcccuc

SEQ ID NO: 2495911 - RNA, 19 nt, Human
ccguugucucccuggcccu

SEQ ID NO: 2495912 - RNA, 15 nt, Human
ccuaaccccuuuccu

SEQ ID NO: 2495913 - RNA, 12 nt, Human
ccuaaccccuuu

SEQ ID NO: 2495914 - RNA, 15 nt, Human
ccuaacgaaguaucc

SEQ ID NO: 2495915 - RNA, 18 nt, Human
ccuacaggagugagcacu

SEQ ID NO: 2495916 - RNA, 15 nt, Human
ccuacaguguacagu

SEQ ID NO: 2495917 - RNA, 20 nt, Human
ccuaccgagucucuucucca

SEQ ID NO: 2495918 - RNA, 19 nt, Human
ccuaccgagucucuucucc

SEQ ID NO: 2495919 - RNA, 21 nt, Human
ccuaccgagucucuucuccac

SEQ ID NO: 2495920 - RNA, 13 nt, Human
ccuacgcugaaga

SEQ ID NO: 2495921 - RNA, 20 nt, Human
ccuaccgaaaccuugccuuu

SEQ ID NO: 2495922 - RNA, 20 nt, Human
ccuacgucaaacaugaagug

SEQ ID NO: 2495923 - RNA, 16 nt, Human
ccuacuccaaaauguu

SEQ ID NO: 2495924 - RNA, 20 nt, Human
ccuacuacaucgcccuccac

SEQ ID NO: 2495925 - RNA, 21 nt, Human
ccuacgucaaacaugaagugu

SEQ ID NO: 2495926 - RNA, 17 nt, Human
ccuacuacaucgcccuc

SEQ ID NO: 2495927 - RNA, 18 nt, Human
ccuacuacaucgcccucc

SEQ ID NO: 2495928 - RNA, 17 nt, Human
ccuaccgagucucuucu

SEQ ID NO: 2495929 - RNA, 16 nt, Human
ccuaccgagucucuuc

SEQ ID NO: 2495930 - RNA, 17 nt, Human
ccuaccgaaaccuugcc

SEQ ID NO: 2495931 - RNA, 23 nt, Human
ccuacccucgggcccaccuggcc

SEQ ID NO: 2495932 - RNA, 21 nt, Human
ccuacaguugaaaaacagcug

SEQ ID NO: 2495933 - RNA, 20 nt, Human
ccuacaguguacagucuugu

SEQ ID NO: 2495934 - RNA, 16 nt, Human
ccuacaguguacaguc

SEQ ID NO: 2495935 - RNA, 23 nt, Human
ccuaggcauuugcugaauacaga

SEQ ID NO: 2495936 - RNA, 23 nt, Human
ccuaggccacaccaucuccuuuc

SEQ ID NO: 2495937 - RNA, 13 nt, Human
ccuacugaaugcu

SEQ ID NO: 2495938 - RNA, 14 nt, Human
ccuaggccacuccu

SEQ ID NO: 2495939 - RNA, 15 nt, Human
ccuaggccacuccuc

SEQ ID NO: 2495940 - RNA, 16 nt, Human
ccuaggccacuccucc

SEQ ID NO: 2495941 - RNA, 17 nt, Human
ccuaggccacuccucca

SEQ ID NO: 2495942 - RNA, 18 nt, Human
ccuaggccacuccuccaa

SEQ ID NO: 2495943 - RNA, 19 nt, Human
ccuaggccacuccuccaaa

SEQ ID NO: 2495944 - RNA, 20 nt, Human
ccuaggccacuccuccaaag

SEQ ID NO: 2495945 - RNA, 14 nt, Human
ccuaggccucagcc

SEQ ID NO: 2495946 - RNA, 18 nt, Human
ccuaguaagugccuucca

SEQ ID NO: 2495947 - RNA, 16 nt, Human
ccuaguaagugccuuc

SEQ ID NO: 2495948 - RNA, 15 nt, Human
ccuaguaagugccuu

SEQ ID NO: 2495949 - RNA, 19 nt, Human
ccuaguaagugccuuccau

SEQ ID NO: 2495950 - RNA, 16 nt, Human
ccuaguccagugaccu

SEQ ID NO: 2495951 - RNA, 18 nt, Human
ccuaggugacagagugag

SEQ ID NO: 2495952 - RNA, 14 nt, Human
ccuaggcgggcggu

SEQ ID NO: 2495953 - RNA, 19 nt, Human
ccuaggccucagccagaga

SEQ ID NO: 2495954 - RNA, 20 nt, Human
ccuaggccucagccagagaa

SEQ ID NO: 2495955 - RNA, 18 nt, Human
ccuaggccucagccagag

SEQ ID NO: 2495956 - RNA, 20 nt, Human
ccgcucuacaucuucugccu

SEQ ID NO: 2495957 - RNA, 23 nt, Human
cccuuggaaaccugcccugccug

SEQ ID NO: 2495958 - RNA, 14 nt, Human
ccgacugcuuugga

SEQ ID NO: 2495959 - RNA, 20 nt, Human
ccgacuccuggguugagcug

SEQ ID NO: 2495960 - RNA, 17 nt, Human
ccgacgcgucuccuguu

SEQ ID NO: 2495961 - RNA, 16 nt, Human
ccgacgcgucuccugu

SEQ ID NO: 2495962 - RNA, 14 nt, Human
ccgacggagccggg

SEQ ID NO: 2495963 - RNA, 23 nt, Human
ccgacggugggcauuugugaggc

SEQ ID NO: 2495964 - RNA, 19 nt, Human
cccuuggaaaccugcccug

SEQ ID NO: 2495965 - RNA, 18 nt, Human
cccuuggaaaccugcccu

SEQ ID NO: 2495966 - RNA, 22 nt, Human
cccuuggaaaccugcccugccu

SEQ ID NO: 2495967 - RNA, 23 nt, Human
ccgaccucguccucccccugcca

SEQ ID NO: 2495968 - RNA, 22 nt, Human
ccgaccucguccucccccugcc

SEQ ID NO: 2495969 - RNA, 21 nt, Human
ccgagauugcaccacugcacu

SEQ ID NO: 2495970 - RNA, 15 nt, Human
ccgagcaaagaucaa

SEQ ID NO: 2495971 - RNA, 23 nt, Human
ccgagcucguguauccuggggcu

SEQ ID NO: 2495972 - RNA, 11 nt, Human
ccgagcugggg

SEQ ID NO: 2495973 - RNA, 16 nt, Human
ccgagcugggggccau

SEQ ID NO: 2495974 - RNA, 18 nt, Human
ccgagcugggggccauga

SEQ ID NO: 2495975 - RNA, 19 nt, Human
ccgagcugggggccaugag

SEQ ID NO: 2495976 - RNA, 21 nt, Human
ccgagcugggggccaugagcu

SEQ ID NO: 2495977 - RNA, 15 nt, Human
ccgagauugcaccac

SEQ ID NO: 2495978 - RNA, 19 nt, Human
ccgagauugcaccacugca

SEQ ID NO: 2495979 - RNA, 21 nt, Human
ccgagaucacgccacugcacu

SEQ ID NO: 2495980 - RNA, 16 nt, Human
ccgagaguagccgaga

SEQ ID NO: 2495981 - RNA, 20 nt, Human
ccgagaguagccgagagccu

SEQ ID NO: 2495982 - RNA, 21 nt, Human
ccgagaguagccgagagccug

SEQ ID NO: 2495983 - RNA, 22 nt, Human
ccgagaguagccgagagccugc

SEQ ID NO: 2495984 - RNA, 17 nt, Human
ccgacugcuuuggaccu

SEQ ID NO: 2495985 - RNA, 16 nt, Human
ccgacugcuuuggacc

SEQ ID NO: 2495986 - RNA, 13 nt, Human
ccgagagccugcu

SEQ ID NO: 2495987 - RNA, 23 nt, Human
ccgacugcacagcggccccugca

SEQ ID NO: 2495988 - RNA, 14 nt, Human
ccgagagccugcuc

SEQ ID NO: 2495989 - RNA, 15 nt, Human
ccgagagccugcucc

SEQ ID NO: 2495990 - RNA, 21 nt, Human
ccgagaggugggccagucugu

SEQ ID NO: 2495991 - RNA, 19 nt, Human
ccgagaggugggccagucu

SEQ ID NO: 2495992 - RNA, 15 nt, Human
ccgagaggugggcca

SEQ ID NO: 2495993 - RNA, 13 nt, Human
ccgagagggagag

SEQ ID NO: 2495994 - RNA, 20 nt, Human
ccgagagccugcucccccac

SEQ ID NO: 2495995 - RNA, 19 nt, Human
ccgagcuuugaaaauucag

SEQ ID NO: 2495996 - RNA, 15 nt, Human
ccgaggacccagacc

SEQ ID NO: 2495997 - RNA, 13 nt, Human
ccgaggacccaga

SEQ ID NO: 2495998 - RNA, 14 nt, Human
ccgaggaaacucag

SEQ ID NO: 2495999 - RNA, 16 nt, Human
ccgagcuggugcauua

SEQ ID NO: 2496000 - RNA, 17 nt, Human
ccgagcuggugcauuac

SEQ ID NO: 2496001 - RNA, 20 nt, Human
ccgagcuggugcauuacaga

SEQ ID NO: 2496002 - RNA, 19 nt, Human
ccgaggacgcucccugcuc

SEQ ID NO: 2496003 - RNA, 17 nt, Human
ccgaggguccuggcucc

SEQ ID NO: 2496004 - RNA, 17 nt, Human
ccgaggacccagaccca

SEQ ID NO: 2496005 - RNA, 16 nt, Human
ccgaggacccagaccc

SEQ ID NO: 2496006 - RNA, 18 nt, Human
ccgaggacccagacccag

SEQ ID NO: 2496007 - RNA, 19 nt, Human
ccgaggguccuggcuccug

SEQ ID NO: 2496008 - RNA, 21 nt, Human
ccgaggguccuggcuccugag

SEQ ID NO: 2496009 - RNA, 23 nt, Human
ccgaggguccuggcuccugaggg

SEQ ID NO: 2496010 - RNA, 18 nt, Human
ccgagucucuucuccacu

SEQ ID NO: 2496011 - RNA, 16 nt, Human
ccgagucucuucucca

SEQ ID NO: 2496012 - RNA, 20 nt, Human
ccgaguagcugagauuauag

SEQ ID NO: 2496013 - RNA, 14 nt, Human
ccgagucucuucuc

SEQ ID NO: 2496014 - RNA, 16 nt, Human
ccgaguagcugggacu

SEQ ID NO: 2496015 - RNA, 14 nt, Human
ccgaguagcuggga

SEQ ID NO: 2496016 - RNA, 14 nt, Human
ccgcagacaccuug

SEQ ID NO: 2496017 - RNA, 16 nt, Human
ccgcagacaccuugga

SEQ ID NO: 2496018 - RNA, 15 nt, Human
ccgcagacaccuugg

SEQ ID NO: 2496019 - RNA, 20 nt, Human
ccgccgacuuuguacccccc

SEQ ID NO: 2496020 - RNA, 17 nt, Human
ccgccgccucgcccacc

SEQ ID NO: 2496021 - RNA, 16 nt, Human
ccgccgccucgcccac

SEQ ID NO: 2496022 - RNA, 15 nt, Human
ccgccgccucgccca

SEQ ID NO: 2496023 - RNA, 14 nt, Human
ccgccgccucgccc

SEQ ID NO: 2496024 - RNA, 18 nt, Human
ccgccgcuuuucuccucu

SEQ ID NO: 2496025 - RNA, 13 nt, Human
ccgccgcuuuucu

SEQ ID NO: 2496026 - RNA, 14 nt, Human
ccgccucccagccu

SEQ ID NO: 2496027 - RNA, 14 nt, Human
ccgcagaagcagac

SEQ ID NO: 2496028 - RNA, 15 nt, Human
ccgaguccaagcugg

SEQ ID NO: 2496029 - RNA, 22 nt, Human
ccgcagaagccuccccagcuca

SEQ ID NO: 2496030 - RNA, 20 nt, Human
ccgcagaagccuccccagcu

SEQ ID NO: 2496031 - RNA, 16 nt, Human
ccgcagaagccucccc

SEQ ID NO: 2496032 - RNA, 23 nt, Human
ccgcacugggcuuggggaccaga

SEQ ID NO: 2496033 - RNA, 20 nt, Human
ccgagucucuucuccacugg

SEQ ID NO: 2496034 - RNA, 19 nt, Human
ccgagucucuucuccacug

SEQ ID NO: 2496035 - RNA, 14 nt, Human
ccggaggggccugg

SEQ ID NO: 2496036 - RNA, 15 nt, Human
ccggagcuuucaaag

SEQ ID NO: 2496037 - RNA, 21 nt, Human
ccggagcuuucaaagaaggaa

SEQ ID NO: 2496038 - RNA, 16 nt, Human
ccggaggggccuggca

SEQ ID NO: 2496039 - RNA, 15 nt, Human
ccggaggggccuggc

SEQ ID NO: 2496040 - RNA, 14 nt, Human
ccgcuggggccagu

SEQ ID NO: 2496041 - RNA, 16 nt, Human
ccggagcuaacacugg

SEQ ID NO: 2496042 - RNA, 17 nt, Human
ccggagcuaacacuggc

SEQ ID NO: 2496043 - RNA, 19 nt, Human
ccggagcuaacacuggccc

SEQ ID NO: 2496044 - RNA, 20 nt, Human
ccggagcuaacacuggcccc

SEQ ID NO: 2496045 - RNA, 22 nt, Human
ccggagcuaacacuggccccua

SEQ ID NO: 2496046 - RNA, 11 nt, Human
ccgcuggggcc

SEQ ID NO: 2496047 - RNA, 19 nt, Human
ccgcuggagguggggccug

SEQ ID NO: 2496048 - RNA, 11 nt, Human
ccgcuggaggu

SEQ ID NO: 2496049 - RNA, 21 nt, Human
ccgcugggcugagccccuacc

SEQ ID NO: 2496050 - RNA, 19 nt, Human
ccgcugggcugagccccua

SEQ ID NO: 2496051 - RNA, 14 nt, Human
ccgcugggcugagc

SEQ ID NO: 2496052 - RNA, 23 nt, Human
ccgcucggaggccccaaaggaaa

SEQ ID NO: 2496053 - RNA, 22 nt, Human
ccgcucggaggccccaaaggaa

SEQ ID NO: 2496054 - RNA, 21 nt, Human
ccgcucggaggccccaaagga

SEQ ID NO: 2496055 - RNA, 20 nt, Human
ccgcucggaggccccaaagg

SEQ ID NO: 2496056 - RNA, 19 nt, Human
ccgcucuacaucuucugcc

SEQ ID NO: 2496057 - RNA, 18 nt, Human
ccgcucuacaucuucugc

SEQ ID NO: 2496058 - RNA, 23 nt, Human
ccgcugcccggcgcccucugucc

SEQ ID NO: 2496059 - RNA, 20 nt, Human
ccgcugccuaaguggcugcu

SEQ ID NO: 2496060 - RNA, 16 nt, Human
ccgcugcugcugcugc

SEQ ID NO: 2496061 - RNA, 14 nt, Human
ccgcugcugcugcu

SEQ ID NO: 2496062 - RNA, 11 nt, Human
ccgcugcugcu

SEQ ID NO: 2496063 - RNA, 19 nt, Human
ccgcugccuaaguggcugc

SEQ ID NO: 2496064 - RNA, 22 nt, Human
ccgccugcccgucucucuccca

SEQ ID NO: 2496065 - RNA, 21 nt, Human
ccgccugccaguccuagcugc

SEQ ID NO: 2496066 - RNA, 15 nt, Human
ccgccugccaguccu

SEQ ID NO: 2496067 - RNA, 14 nt, Human
ccgccugccagucc

SEQ ID NO: 2496068 - RNA, 22 nt, Human
ccgccugccaguccuagcugca

SEQ ID NO: 2496069 - RNA, 11 nt, Human
ccgccugccag

SEQ ID NO: 2496070 - RNA, 16 nt, Human
ccgccugaaucauucu

SEQ ID NO: 2496071 - RNA, 14 nt, Human
ccgccucugcuggc

SEQ ID NO: 2496072 - RNA, 13 nt, Human
ccgccucucccgu

SEQ ID NO: 2496073 - RNA, 21 nt, Human
ccgccucgcccaccgcaugcc

SEQ ID NO: 2496074 - RNA, 20 nt, Human
ccgccucucccgucagggcc

SEQ ID NO: 2496075 - RNA, 11 nt, Human
ccgccucugcu

SEQ ID NO: 2496076 - RNA, 17 nt, Human
ccgccuccuacagccca

SEQ ID NO: 2496077 - RNA, 18 nt, Human
ccgccucacccccucggg

SEQ ID NO: 2496078 - RNA, 23 nt, Human
ccgccucaaugugguugcaaggc

SEQ ID NO: 2496079 - RNA, 15 nt, Human
ccgccucccagccug

SEQ ID NO: 2496080 - RNA, 19 nt, Human
ccgccucgcccaccgcaug

SEQ ID NO: 2496081 - RNA, 18 nt, Human
ccgccucgcccaccgcau

SEQ ID NO: 2496082 - RNA, 17 nt, Human
ccgccucgcccaccgca

SEQ ID NO: 2496083 - RNA, 15 nt, Human
ccgccucgcccaccg

SEQ ID NO: 2496084 - RNA, 14 nt, Human
ccgccucgcccacc

SEQ ID NO: 2496085 - RNA, 23 nt, Human
ccgccuccccacggccgcuccag

SEQ ID NO: 2496086 - RNA, 20 nt, Human
ccgcucccagugucuuccug

SEQ ID NO: 2496087 - RNA, 15 nt, Human
ccgcucccagugucu

SEQ ID NO: 2496088 - RNA, 12 nt, Human
ccgcuccccagc

SEQ ID NO: 2496089 - RNA, 13 nt, Human
ccgcuccccagcc

SEQ ID NO: 2496090 - RNA, 14 nt, Human
ccgcuccccagccc

SEQ ID NO: 2496091 - RNA, 15 nt, Human
ccgcuccccagccca

SEQ ID NO: 2496092 - RNA, 14 nt, Human
ccgcuccugucugc

SEQ ID NO: 2496093 - RNA, 15 nt, Human
ccgcuccugucugcc

SEQ ID NO: 2496094 - RNA, 17 nt, Human
ccgcuccugucugccag

SEQ ID NO: 2496095 - RNA, 18 nt, Human
ccgcucggaggccccaaa

SEQ ID NO: 2496096 - RNA, 16 nt, Human
ccgcucggaggcccca

SEQ ID NO: 2496097 - RNA, 15 nt, Human
ccgcucggaggcccc

SEQ ID NO: 2496098 - RNA, 16 nt, Human
ccgcuccccagcccag

SEQ ID NO: 2496099 - RNA, 16 nt, Human
ccgccugcccucaugg

SEQ ID NO: 2496100 - RNA, 14 nt, Human
ccgccugcccucau

SEQ ID NO: 2496101 - RNA, 22 nt, Human
ccgccuggaugcggauggccgg

SEQ ID NO: 2496102 - RNA, 12 nt, Human
ccgccuggcaga

SEQ ID NO: 2496103 - RNA, 16 nt, Human
ccgccuggcagaacug

SEQ ID NO: 2496104 - RNA, 21 nt, Human
ccgccuggcagaacugagcuc

SEQ ID NO: 2496105 - RNA, 14 nt, Human
ccgcucccaguguc

SEQ ID NO: 2496106 - RNA, 12 nt, Human
ccgcucccagug

SEQ ID NO: 2496107 - RNA, 15 nt, Human
ccgggcucugccucc

SEQ ID NO: 2496108 - RNA, 14 nt, Human
ccgggcucugccuc

SEQ ID NO: 2496109 - RNA, 13 nt, Human
ccgggcucugccu

SEQ ID NO: 2496110 - RNA, 18 nt, Human
ccgggcucugccucccau

SEQ ID NO: 2496111 - RNA, 21 nt, Human
ccgggguggagcaugggccug

SEQ ID NO: 2496112 - RNA, 23 nt, Human
ccgggguccuguggcaggcagcg

SEQ ID NO: 2496113 - RNA, 20 nt, Human
ccggggugcccacaggccgc

SEQ ID NO: 2496114 - RNA, 18 nt, Human
ccgugaggccagagacac

SEQ ID NO: 2496115 - RNA, 21 nt, Human
ccgggguccuguggcaggcag

SEQ ID NO: 2496116 - RNA, 22 nt, Human
ccgggggcagcucuggaggggg

SEQ ID NO: 2496117 - RNA, 12 nt, Human
ccgggguccugu

SEQ ID NO: 2496118 - RNA, 15 nt, Human
ccggggcuggguugg

SEQ ID NO: 2496119 - RNA, 13 nt, Human
ccggggcuggguu

SEQ ID NO: 2496120 - RNA, 19 nt, Human
ccggggcuggcggcuacuc

SEQ ID NO: 2496121 - RNA, 21 nt, Human
ccggcuccaggcuccuuuagc

SEQ ID NO: 2496122 - RNA, 16 nt, Human
ccggcuccaggcuccu

SEQ ID NO: 2496123 - RNA, 12 nt, Human
ccggagggcccu

SEQ ID NO: 2496124 - RNA, 19 nt, Human
ccggcucccaccgaggcgc

SEQ ID NO: 2496125 - RNA, 16 nt, Human
ccggcuccugugcuuu

SEQ ID NO: 2496126 - RNA, 23 nt, Human
ccggcucgagcaguccugccuca

SEQ ID NO: 2496127 - RNA, 22 nt, Human
ccgggcacucagaagacacuga

SEQ ID NO: 2496128 - RNA, 13 nt, Human
ccgggccacagag

SEQ ID NO: 2496129 - RNA, 22 nt, Human
ccgggcaugguggcgcaagccu

SEQ ID NO: 2496130 - RNA, 19 nt, Human
cccucugcccagcuugggc

SEQ ID NO: 2496131 - RNA, 18 nt, Human
cccucugcccagcuuggg

SEQ ID NO: 2496132 - RNA, 23 nt, Human
cccucugcccagcuugggcccag

SEQ ID NO: 2496133 - RNA, 13 nt, Human
cccucugccccau

SEQ ID NO: 2496134 - RNA, 12 nt, Human
cccucugcccug

SEQ ID NO: 2496135 - RNA, 13 nt, Human
cccucugcccugc

SEQ ID NO: 2496136 - RNA, 14 nt, Human
cccucugcccugcg

SEQ ID NO: 2496137 - RNA, 16 nt, Human
cccucugcccagcuug

SEQ ID NO: 2496138 - RNA, 15 nt, Human
cccucugcccagcuu

SEQ ID NO: 2496139 - RNA, 14 nt, Human
cccucugcccagcu

SEQ ID NO: 2496140 - RNA, 13 nt, Human
cccucugcccagc

SEQ ID NO: 2496141 - RNA, 12 nt, Human
cccucugcccag

SEQ ID NO: 2496142 - RNA, 19 nt, Human
cccucugccaccagagacc

SEQ ID NO: 2496143 - RNA, 19 nt, Human
cccucugcccacucccugc

SEQ ID NO: 2496144 - RNA, 18 nt, Human
cccucugcccacucccug

SEQ ID NO: 2496145 - RNA, 15 nt, Human
cccucugcccacucc

SEQ ID NO: 2496146 - RNA, 14 nt, Human
cccucuccuuccug

SEQ ID NO: 2496147 - RNA, 11 nt, Human
cccucugccca

SEQ ID NO: 2496148 - RNA, 18 nt, Human
cccucuccauaaccccac

SEQ ID NO: 2496149 - RNA, 13 nt, Human
cccucucccagga

SEQ ID NO: 2496150 - RNA, 16 nt, Human
cccucuaaagcaauaa

SEQ ID NO: 2496151 - RNA, 23 nt, Human
cccucgugguccccaacagcgac

SEQ ID NO: 2496152 - RNA, 21 nt, Human
cccucucaggugaccaaaauc

SEQ ID NO: 2496153 - RNA, 22 nt, Human
cccucucaggcaugccugugug

SEQ ID NO: 2496154 - RNA, 21 nt, Human
cccucucaggcaugccugugu

SEQ ID NO: 2496155 - RNA, 20 nt, Human
cccucguggccagcccggcu

SEQ ID NO: 2496156 - RNA, 19 nt, Human
cccucguggccagcccggc

SEQ ID NO: 2496157 - RNA, 17 nt, Human
cccucguggccagcccg

SEQ ID NO: 2496158 - RNA, 16 nt, Human
cccucguggccagccc

SEQ ID NO: 2496159 - RNA, 20 nt, Human
cccucgugguccccaacagc

SEQ ID NO: 2496160 - RNA, 18 nt, Human
cccucgugguccccaaca

SEQ ID NO: 2496161 - RNA, 15 nt, Human
cccucguggccuucc

SEQ ID NO: 2496162 - RNA, 16 nt, Human
cccucguggccuuccc

SEQ ID NO: 2496163 - RNA, 13 nt, Human
cccucuccgagcu

SEQ ID NO: 2496164 - RNA, 21 nt, Human
cccucuccccccccccuccaa

SEQ ID NO: 2496165 - RNA, 19 nt, Human
cccucuccccccccccucc

SEQ ID NO: 2496166 - RNA, 11 nt, Human
cccucucccug

SEQ ID NO: 2496167 - RNA, 22 nt, Human
cccucuugccccaacccccagc

SEQ ID NO: 2496168 - RNA, 19 nt, Human
cccucuugccccaaccccc

SEQ ID NO: 2496169 - RNA, 18 nt, Human
cccucuugccccaacccc

SEQ ID NO: 2496170 - RNA, 13 nt, Human
cccucuugcccca

SEQ ID NO: 2496171 - RNA, 12 nt, Human
cccucuugcccc

SEQ ID NO: 2496172 - RNA, 19 nt, Human
cccucuugacccaucuccc

SEQ ID NO: 2496173 - RNA, 22 nt, Human
cccucuugacccaucucccccu

SEQ ID NO: 2496174 - RNA, 20 nt, Human
cccucuucucaagugccuua

SEQ ID NO: 2496175 - RNA, 16 nt, Human
cccucuucucaagugc

SEQ ID NO: 2496176 - RNA, 15 nt, Human
cccucuucucaagug

SEQ ID NO: 2496177 - RNA, 12 nt, Human
cccucuuucccu

SEQ ID NO: 2496178 - RNA, 18 nt, Human
cccucuuggucuucccag

SEQ ID NO: 2496179 - RNA, 22 nt, Human
cccucuugccccccaccccagc

SEQ ID NO: 2496180 - RNA, 23 nt, Human
cccucuugccccaacccccagca

SEQ ID NO: 2496181 - RNA, 16 nt, Human
cccucuugccccccac

SEQ ID NO: 2496182 - RNA, 21 nt, Human
cccucuuuggcuccccuguac

SEQ ID NO: 2496183 - RNA, 20 nt, Human
cccucuuuggcuccccugua

SEQ ID NO: 2496184 - RNA, 19 nt, Human
cccucuuuggcuccccugu

SEQ ID NO: 2496185 - RNA, 17 nt, Human
cccucuuuggcuccccu

SEQ ID NO: 2496186 - RNA, 17 nt, Human
cccucuuucccucccuu

SEQ ID NO: 2496187 - RNA, 20 nt, Human
cccucuuucccucccuuccu

SEQ ID NO: 2496188 - RNA, 13 nt, Human
cccucuuccauca

SEQ ID NO: 2496189 - RNA, 20 nt, Human
cccucuguuucucuuuccuu

SEQ ID NO: 2496190 - RNA, 18 nt, Human
cccucuguugccaggcua

SEQ ID NO: 2496191 - RNA, 11 nt, Human
cccucuuccau

SEQ ID NO: 2496192 - RNA, 20 nt, Human
cccucuguucugcacacagc

SEQ ID NO: 2496193 - RNA, 21 nt, Human
cccucuguucugcacacagca

SEQ ID NO: 2496194 - RNA, 20 nt, Human
cccucuguguauuugcuuuu

SEQ ID NO: 2496195 - RNA, 16 nt, Human
cccucuggcuccagcu

SEQ ID NO: 2496196 - RNA, 17 nt, Human
cccucuggcuccagcug

SEQ ID NO: 2496197 - RNA, 12 nt, Human
cccucuggcucc

SEQ ID NO: 2496198 - RNA, 18 nt, Human
cccucugccccauccucc

SEQ ID NO: 2496199 - RNA, 21 nt, Human
cccucugccugaaccuuccau

SEQ ID NO: 2496200 - RNA, 22 nt, Human
cccucuggcuccagcuggccgg

SEQ ID NO: 2496201 - RNA, 16 nt, Human
cccucuggcccugccu

SEQ ID NO: 2496202 - RNA, 13 nt, Human
cccucugggcacu

SEQ ID NO: 2496203 - RNA, 15 nt, Human
cccucugccccaucc

SEQ ID NO: 2496204 - RNA, 13 nt, Human
cccucugccuguc

SEQ ID NO: 2496205 - RNA, 13 nt, Human
cccgcucagcccu

SEQ ID NO: 2496206 - RNA, 12 nt, Human
cccgcucagccc

SEQ ID NO: 2496207 - RNA, 12 nt, Human
cccucccacagc

SEQ ID NO: 2496208 - RNA, 14 nt, Human
cccgcucagcccuc

SEQ ID NO: 2496209 - RNA, 14 nt, Human
cccucccacagcgc

SEQ ID NO: 2496210 - RNA, 12 nt, Human
cccucccaccac

SEQ ID NO: 2496211 - RNA, 14 nt, Human
cccucccaccacag

SEQ ID NO: 2496212 - RNA, 12 nt, Human
cccucccaccca

SEQ ID NO: 2496213 - RNA, 17 nt, Human
cccucccaccacagcag

SEQ ID NO: 2496214 - RNA, 15 nt, Human
cccucccacccaccg

SEQ ID NO: 2496215 - RNA, 14 nt, Human
cccucccacccacc

SEQ ID NO: 2496216 - RNA, 12 nt, Human
cccucccacccc

SEQ ID NO: 2496217 - RNA, 13 nt, Human
cccucccaccccc

SEQ ID NO: 2496218 - RNA, 20 nt, Human
cccucccagcugacaguccu

SEQ ID NO: 2496219 - RNA, 17 nt, Human
cccucccagcugacagu

SEQ ID NO: 2496220 - RNA, 13 nt, Human
cccucccagcuga

SEQ ID NO: 2496221 - RNA, 24 nt, Human
cccuccccucucuugcacccgccu

SEQ ID NO: 2496222 - RNA, 16 nt, Human
cccuccccucucuugc

SEQ ID NO: 2496223 - RNA, 13 nt, Human
cccuccccugcca

SEQ ID NO: 2496224 - RNA, 17 nt, Human
cccucccaccucuguga

SEQ ID NO: 2496225 - RNA, 15 nt, Human
cccucccaccucugu

SEQ ID NO: 2496226 - RNA, 14 nt, Human
cccucccaccucug

SEQ ID NO: 2496227 - RNA, 13 nt, Human
cccucccaccucu

SEQ ID NO: 2496228 - RNA, 19 nt, Human
cccucccaccucugugacc

SEQ ID NO: 2496229 - RNA, 12 nt, Human
cccucccagcug

SEQ ID NO: 2496230 - RNA, 15 nt, Human
cccucccgccccuuc

SEQ ID NO: 2496231 - RNA, 14 nt, Human
cccucccgccccuu

SEQ ID NO: 2496232 - RNA, 15 nt, Human
cccuccccuggggac

SEQ ID NO: 2496233 - RNA, 16 nt, Human
cccuccccugcugcag

SEQ ID NO: 2496234 - RNA, 13 nt, Human
cccuccccugccc

SEQ ID NO: 2496235 - RNA, 14 nt, Human
cccuccccugcccu

SEQ ID NO: 2496236 - RNA, 14 nt, Human
cccuccccugcugc

SEQ ID NO: 2496237 - RNA, 13 nt, Human
cccuccccugcug

SEQ ID NO: 2496238 - RNA, 16 nt, Human
cccuccccugcccuag

SEQ ID NO: 2496239 - RNA, 23 nt, Human
cccucgugccagucgcgcugccu

SEQ ID NO: 2496240 - RNA, 22 nt, Human
cccucgugccagucgcgcugcc

SEQ ID NO: 2496241 - RNA, 15 nt, Human
cccucguggccagcc

SEQ ID NO: 2496242 - RNA, 14 nt, Human
cccucguggccagc

SEQ ID NO: 2496243 - RNA, 13 nt, Human
cccucguggccag

SEQ ID NO: 2496244 - RNA, 16 nt, Human
cccucgugccagucgc

SEQ ID NO: 2496245 - RNA, 14 nt, Human
cccucgugccaguc

SEQ ID NO: 2496246 - RNA, 13 nt, Human
cccucgugccagu

SEQ ID NO: 2496247 - RNA, 16 nt, Human
cccucccuggcuccca

SEQ ID NO: 2496248 - RNA, 19 nt, Human
cccucccuggcucccauga

SEQ ID NO: 2496249 - RNA, 14 nt, Human
cccucccuggagug

SEQ ID NO: 2496250 - RNA, 13 nt, Human
cccucccuggagu

SEQ ID NO: 2496251 - RNA, 12 nt, Human
cccucccuggag

SEQ ID NO: 2496252 - RNA, 14 nt, Human
cccucccugcuuca

SEQ ID NO: 2496253 - RNA, 15 nt, Human
cccucccuggccugu

SEQ ID NO: 2496254 - RNA, 17 nt, Human
cccucccuggccuguuc

SEQ ID NO: 2496255 - RNA, 14 nt, Human
cccucccuggcucc

SEQ ID NO: 2496256 - RNA, 14 nt, Human
cccucccugccccu

SEQ ID NO: 2496257 - RNA, 22 nt, Human
cccucccgucuacucauucccc

SEQ ID NO: 2496258 - RNA, 16 nt, Human
cccucccucagccccu

SEQ ID NO: 2496259 - RNA, 19 nt, Human
cccucccugcuguccccuc

SEQ ID NO: 2496260 - RNA, 17 nt, Human
cccucccugcugucccc

SEQ ID NO: 2496261 - RNA, 15 nt, Human
cccucccugcugucc

SEQ ID NO: 2496262 - RNA, 14 nt, Human
cccucccugcuguc

SEQ ID NO: 2496263 - RNA, 13 nt, Human
cccucccugcugu

SEQ ID NO: 2496264 - RNA, 12 nt, Human
cccucccugcug

SEQ ID NO: 2496265 - RNA, 23 nt, Human
cccucccgccccuucccacucac

SEQ ID NO: 2496266 - RNA, 16 nt, Human
cccucccgccccuucc

SEQ ID NO: 2496267 - RNA, 16 nt, Human
cccucccggcauggga

SEQ ID NO: 2496268 - RNA, 13 nt, Human
cccucccucagcc

SEQ ID NO: 2496269 - RNA, 23 nt, Human
cccucccucuuucccucccuucc

SEQ ID NO: 2496270 - RNA, 16 nt, Human
cccuggugcugccaca

SEQ ID NO: 2496271 - RNA, 21 nt, Human
cccugaggcagguccccagac

SEQ ID NO: 2496272 - RNA, 18 nt, Human
cccugaggcaggucccca

SEQ ID NO: 2496273 - RNA, 20 nt, Human
cccugaggcagguccccaga

SEQ ID NO: 2496274 - RNA, 12 nt, Human
cccugaggccca

SEQ ID NO: 2496275 - RNA, 17 nt, Human
cccugaggcaggucccc

SEQ ID NO: 2496276 - RNA, 14 nt, Human
cccugaaaacccag

SEQ ID NO: 2496277 - RNA, 19 nt, Human
cccugaggagccaggccgg

SEQ ID NO: 2496278 - RNA, 22 nt, Human
cccugccucucaucaacugaau

SEQ ID NO: 2496279 - RNA, 11 nt, Human
cccugccuccu

SEQ ID NO: 2496280 - RNA, 14 nt, Human
cccugccucucugc

SEQ ID NO: 2496281 - RNA, 13 nt, Human
cccugccucucug

SEQ ID NO: 2496282 - RNA, 13 nt, Human
cccugcauccccu

SEQ ID NO: 2496283 - RNA, 16 nt, Human
cccugcaucugaccag

SEQ ID NO: 2496284 - RNA, 18 nt, Human
cccugcaucugaccagca

SEQ ID NO: 2496285 - RNA, 19 nt, Human
cccugcaucugaccagcag

SEQ ID NO: 2496286 - RNA, 12 nt, Human
cccugcaucccc

SEQ ID NO: 2496287 - RNA, 13 nt, Human
cccugccggccgg

SEQ ID NO: 2496288 - RNA, 13 nt, Human
cccugccgccuca

SEQ ID NO: 2496289 - RNA, 14 nt, Human
cccugccgccucaa

SEQ ID NO: 2496290 - RNA, 15 nt, Human
cccugccuccacccu

SEQ ID NO: 2496291 - RNA, 14 nt, Human
cccugccuccaccc

SEQ ID NO: 2496292 - RNA, 12 nt, Human
cccugccuccac

SEQ ID NO: 2496293 - RNA, 21 nt, Human
cccugccuccacccucugagc

SEQ ID NO: 2496294 - RNA, 20 nt, Human
cccugccuccacccucugag

SEQ ID NO: 2496295 - RNA, 19 nt, Human
cccugccuccacccucuga

SEQ ID NO: 2496296 - RNA, 16 nt, Human
cccugccuccacccuc

SEQ ID NO: 2496297 - RNA, 22 nt, Human
cccugccuccacccucugagcu

SEQ ID NO: 2496298 - RNA, 15 nt, Human
cccugcugcaggggc

SEQ ID NO: 2496299 - RNA, 13 nt, Human
cccugcugcaggg

SEQ ID NO: 2496300 - RNA, 21 nt, Human
cccugcuccucccuggcugcc

SEQ ID NO: 2496301 - RNA, 23 nt, Human
cccugcugagucccaggcugagc

SEQ ID NO: 2496302 - RNA, 22 nt, Human
cccugcugcaggggcucuggag

SEQ ID NO: 2496303 - RNA, 21 nt, Human
cccugcugcaggggcucugga

SEQ ID NO: 2496304 - RNA, 19 nt, Human
cccugcugcaggggcucug

SEQ ID NO: 2496305 - RNA, 16 nt, Human
cccugcugcaggggcu

SEQ ID NO: 2496306 - RNA, 19 nt, Human
cccugcugccgccucccag

SEQ ID NO: 2496307 - RNA, 14 nt, Human
cccugcugccuccc

SEQ ID NO: 2496308 - RNA, 16 nt, Human
cccugcugccucccca

SEQ ID NO: 2496309 - RNA, 20 nt, Human
cccugcugccgccucccagc

SEQ ID NO: 2496310 - RNA, 22 nt, Human
cccugcugccgccucccagccu

SEQ ID NO: 2496311 - RNA, 23 nt, Human
cccugcugccgccucccagccug

SEQ ID NO: 2496312 - RNA, 11 nt, Human
cccugcugccu

SEQ ID NO: 2496313 - RNA, 12 nt, Human
cccugcugccuc

SEQ ID NO: 2496314 - RNA, 20 nt, Human
cccugcuccucccuggcugc

SEQ ID NO: 2496315 - RNA, 19 nt, Human
cccugcuccucccuggcug

SEQ ID NO: 2496316 - RNA, 18 nt, Human
cccugcuccucccuggcu

SEQ ID NO: 2496317 - RNA, 17 nt, Human
cccugcuccucccuggc

SEQ ID NO: 2496318 - RNA, 16 nt, Human
cccugcuccucccugg

SEQ ID NO: 2496319 - RNA, 15 nt, Human
cccugcuccucccug

SEQ ID NO: 2496320 - RNA, 13 nt, Human
cccugcuccuccc

SEQ ID NO: 2496321 - RNA, 21 nt, Human
cccugcucuccgaccagacac

SEQ ID NO: 2496322 - RNA, 22 nt, Human
cccugcuccucccuggcugccc

SEQ ID NO: 2496323 - RNA, 21 nt, Human
cccugcugagucccaggcuga

SEQ ID NO: 2496324 - RNA, 22 nt, Human
cccugcucuccgaccagacacc

SEQ ID NO: 2496325 - RNA, 15 nt, Human
cccugccucucugca

SEQ ID NO: 2496326 - RNA, 23 nt, Human
cccugccuggggcgggccccuca

SEQ ID NO: 2496327 - RNA, 13 nt, Human
cccugccugguca

SEQ ID NO: 2496328 - RNA, 22 nt, Human
cccugccuuaucuugcacccca

SEQ ID NO: 2496329 - RNA, 17 nt, Human
cccugcgaaggggcccu

SEQ ID NO: 2496330 - RNA, 21 nt, Human
cccugcgaaggggcccugguc

SEQ ID NO: 2496331 - RNA, 19 nt, Human
cccugcgaaggggcccugg

SEQ ID NO: 2496332 - RNA, 20 nt, Human
cccugcgaaggggcccuggu

SEQ ID NO: 2496333 - RNA, 22 nt, Human
cccugcgggugaacaaagcagc

SEQ ID NO: 2496334 - RNA, 15 nt, Human
cccugcguggggaca

SEQ ID NO: 2496335 - RNA, 22 nt, Human
cccugcggccccgucuguggcu

SEQ ID NO: 2496336 - RNA, 17 nt, Human
cccugcgguagauggga

SEQ ID NO: 2496337 - RNA, 19 nt, Human
cccugcgggucacaggagg

SEQ ID NO: 2496338 - RNA, 21 nt, Human
cccugcgggucacaggaggga

SEQ ID NO: 2496339 - RNA, 21 nt, Human
cccugcuccacgucugcgccg

SEQ ID NO: 2496340 - RNA, 16 nt, Human
cccugcucaguaaagc

SEQ ID NO: 2496341 - RNA, 17 nt, Human
cccugcucccucccauc

SEQ ID NO: 2496342 - RNA, 19 nt, Human
cccugcuccagaagauagc

SEQ ID NO: 2496343 - RNA, 23 nt, Human
cccuugcccagggcucagccugg

SEQ ID NO: 2496344 - RNA, 21 nt, Human
cccuugcccagggcucagccu

SEQ ID NO: 2496345 - RNA, 22 nt, Human
cccuugcccagggcucagccug

SEQ ID NO: 2496346 - RNA, 14 nt, Human
cccuugcccagggc

SEQ ID NO: 2496347 - RNA, 15 nt, Human
cccuugcccagggcu

SEQ ID NO: 2496348 - RNA, 19 nt, Human
cccuugcccagggcucagc

SEQ ID NO: 2496349 - RNA, 20 nt, Human
cccuugcccagggcucagcc

SEQ ID NO: 2496350 - RNA, 12 nt, Human
cccuugcccagg

SEQ ID NO: 2496351 - RNA, 15 nt, Human
cccuugccagacaug

SEQ ID NO: 2496352 - RNA, 20 nt, Human
cccuugagcuccccaaaaac

SEQ ID NO: 2496353 - RNA, 13 nt, Human
cccuugccagaca

SEQ ID NO: 2496354 - RNA, 19 nt, Human
cccuugccuccccauuucc

SEQ ID NO: 2496355 - RNA, 18 nt, Human
cccuugccuccccauuuc

SEQ ID NO: 2496356 - RNA, 15 nt, Human
cccuugccuccccau

SEQ ID NO: 2496357 - RNA, 13 nt, Human
cccuugccucccc

SEQ ID NO: 2496358 - RNA, 23 nt, Human
cccuugccuccccauuucccauc

SEQ ID NO: 2496359 - RNA, 20 nt, Human
cccuugccuccccauuuccc

SEQ ID NO: 2496360 - RNA, 12 nt, Human
cccuugccuccc

SEQ ID NO: 2496361 - RNA, 12 nt, Human
cccuugcccuga

SEQ ID NO: 2496362 - RNA, 13 nt, Human
cccuugcccugac

SEQ ID NO: 2496363 - RNA, 18 nt, Human
cccuugcucuccccugcc

SEQ ID NO: 2496364 - RNA, 17 nt, Human
cccuuggaaaccugccc

SEQ ID NO: 2496365 - RNA, 13 nt, Human
cccuuggaaaccu

SEQ ID NO: 2496366 - RNA, 19 nt, Human
cccuugcucuccccugccc

SEQ ID NO: 2496367 - RNA, 21 nt, Human
cccuuccccuacccccuccuc

SEQ ID NO: 2496368 - RNA, 22 nt, Human
cccuuccccucccuggcuccca

SEQ ID NO: 2496369 - RNA, 13 nt, Human
cccuuccccuccu

SEQ ID NO: 2496370 - RNA, 13 nt, Human
cccuucccucacc

SEQ ID NO: 2496371 - RNA, 15 nt, Human
cccuucccugcaaac

SEQ ID NO: 2496372 - RNA, 15 nt, Human
cccuucccugucccu

SEQ ID NO: 2496373 - RNA, 14 nt, Human
cccuucccuguccc

SEQ ID NO: 2496374 - RNA, 13 nt, Human
cccuucccugucc

SEQ ID NO: 2496375 - RNA, 13 nt, Human
cccuucccugcaa

SEQ ID NO: 2496376 - RNA, 17 nt, Human
cccuuccccgagggaug

SEQ ID NO: 2496377 - RNA, 14 nt, Human
cccuuccccgaggg

SEQ ID NO: 2496378 - RNA, 12 nt, Human
cccuuccccucc

SEQ ID NO: 2496379 - RNA, 14 nt, Human
cccuuccccucccu

SEQ ID NO: 2496380 - RNA, 15 nt, Human
cccuuccccucccug

SEQ ID NO: 2496381 - RNA, 16 nt, Human
cccuuccccucccugg

SEQ ID NO: 2496382 - RNA, 17 nt, Human
cccuuccccucccuggc

SEQ ID NO: 2496383 - RNA, 19 nt, Human
cccuuccccucccuggcuc

SEQ ID NO: 2496384 - RNA, 22 nt, Human
cccuugagaaaccuuauuguac

SEQ ID NO: 2496385 - RNA, 14 nt, Human
cccuugagaaaccu

SEQ ID NO: 2496386 - RNA, 16 nt, Human
cccuucccugucccuc

SEQ ID NO: 2496387 - RNA, 17 nt, Human
cccuucccuugagcccu

SEQ ID NO: 2496388 - RNA, 23 nt, Human
cccuugacgucaagucuccuucc

SEQ ID NO: 2496389 - RNA, 13 nt, Human
cccuugagaccuc

SEQ ID NO: 2496390 - RNA, 14 nt, Human
cccuugagaccuca

SEQ ID NO: 2496391 - RNA, 15 nt, Human
cccuugagaccucag

SEQ ID NO: 2496392 - RNA, 16 nt, Human
cccuugagaccucagc

SEQ ID NO: 2496393 - RNA, 20 nt, Human
cccuugagaccucagccaug

SEQ ID NO: 2496394 - RNA, 17 nt, Human
cccuugagcccucuaug

SEQ ID NO: 2496395 - RNA, 17 nt, Human
cccuugagaccucagcc

SEQ ID NO: 2496396 - RNA, 18 nt, Human
cccuugagaccucagcca

SEQ ID NO: 2496397 - RNA, 19 nt, Human
cccuugagaccucagccau

SEQ ID NO: 2496398 - RNA, 18 nt, Human
cccuugagcuccccaaaa

SEQ ID NO: 2496399 - RNA, 22 nt, Human
cccuugaggaaacaacagcuuu

SEQ ID NO: 2496400 - RNA, 17 nt, Human
cccuuacgugaguccug

SEQ ID NO: 2496401 - RNA, 15 nt, Human
cccuuacgugagucc

SEQ ID NO: 2496402 - RNA, 20 nt, Human
cccuuagaaguuuguuguga

SEQ ID NO: 2496403 - RNA, 13 nt, Human
cccuuaccuuccc

SEQ ID NO: 2496404 - RNA, 14 nt, Human
cccuuagcagggaa

SEQ ID NO: 2496405 - RNA, 14 nt, Human
cccuuauccaggac

SEQ ID NO: 2496406 - RNA, 13 nt, Human
cccuuauccagga

SEQ ID NO: 2496407 - RNA, 12 nt, Human
cccuuauccagg

SEQ ID NO: 2496408 - RNA, 15 nt, Human
cccuuaucaccagcu

SEQ ID NO: 2496409 - RNA, 16 nt, Human
cccuuauccaggacuc

SEQ ID NO: 2496410 - RNA, 15 nt, Human
cccuuauccaggacu

SEQ ID NO: 2496411 - RNA, 17 nt, Human
cccuuagccucccugaa

SEQ ID NO: 2496412 - RNA, 22 nt, Human
cccuuagcccccacccacuucc

SEQ ID NO: 2496413 - RNA, 14 nt, Human
cccuuagccucccu

SEQ ID NO: 2496414 - RNA, 21 nt, Human
cccuuagcccccacccacuuc

SEQ ID NO: 2496415 - RNA, 19 nt, Human
cccuuagcccccacccacu

SEQ ID NO: 2496416 - RNA, 14 nt, Human
cccuuagcccccac

SEQ ID NO: 2496417 - RNA, 23 nt, Human
cccuuagcagggaaacagcuaau

SEQ ID NO: 2496418 - RNA, 16 nt, Human
cccuuaucugugcuca

SEQ ID NO: 2496419 - RNA, 20 nt, Human
cccuuaucugugcucaggac

SEQ ID NO: 2496420 - RNA, 20 nt, Human
cccuuauuacacggaaaacg

SEQ ID NO: 2496421 - RNA, 16 nt, Human
cccuuauuacacggaa

SEQ ID NO: 2496422 - RNA, 12 nt, Human
cccuuauuuccu

SEQ ID NO: 2496423 - RNA, 14 nt, Human
cccuucaaccauuc

SEQ ID NO: 2496424 - RNA, 12 nt, Human
cccuuauuuuca

SEQ ID NO: 2496425 - RNA, 13 nt, Human
cccuucacaaagc

SEQ ID NO: 2496426 - RNA, 18 nt, Human
cccuucacaaagcccaag

SEQ ID NO: 2496427 - RNA, 18 nt, Human
cccuucaaccauucccca

SEQ ID NO: 2496428 - RNA, 15 nt, Human
cccuucacauaguuu

SEQ ID NO: 2496429 - RNA, 20 nt, Human
cccuucacaaagcccaaggg

SEQ ID NO: 2496430 - RNA, 16 nt, Human
cccuucacaguguuuc

SEQ ID NO: 2496431 - RNA, 18 nt, Human
cccuucacugccuuugcu

SEQ ID NO: 2496432 - RNA, 17 nt, Human
cccuucacugccuuugc

SEQ ID NO: 2496433 - RNA, 12 nt, Human
cccuuccaugga

SEQ ID NO: 2496434 - RNA, 20 nt, Human
cccuuccaugucgccucugc

SEQ ID NO: 2496435 - RNA, 16 nt, Human
cccuuccacugagggc

SEQ ID NO: 2496436 - RNA, 17 nt, Human
cccuuccacacccccac

SEQ ID NO: 2496437 - RNA, 17 nt, Human
cccuucacuucugacca

SEQ ID NO: 2496438 - RNA, 13 nt, Human
cccuuccacugag

SEQ ID NO: 2496439 - RNA, 15 nt, Human
cccugcuggccgccu

SEQ ID NO: 2496440 - RNA, 13 nt, Human
cccugcuggccgc

SEQ ID NO: 2496441 - RNA, 12 nt, Human
cccugcuggccg

SEQ ID NO: 2496442 - RNA, 17 nt, Human
cccugcugcugacccag

SEQ ID NO: 2496443 - RNA, 13 nt, Human
cccugcugucccc

SEQ ID NO: 2496444 - RNA, 12 nt, Human
cccugcuguccc

SEQ ID NO: 2496445 - RNA, 17 nt, Human
cccugcuggccgccuca

SEQ ID NO: 2496446 - RNA, 19 nt, Human
cccugcuguccccucuugc

SEQ ID NO: 2496447 - RNA, 18 nt, Human
cccugcuguccccucuug

SEQ ID NO: 2496448 - RNA, 17 nt, Human
cccugcuguccccucuu

SEQ ID NO: 2496449 - RNA, 16 nt, Human
cccugcuguccccucu

SEQ ID NO: 2496450 - RNA, 21 nt, Human
cccugcuucaauacccaaauc

SEQ ID NO: 2496451 - RNA, 23 nt, Human
cccugcuguccccucuugcccca

SEQ ID NO: 2496452 - RNA, 15 nt, Human
cccugcuuccaggaa

SEQ ID NO: 2496453 - RNA, 14 nt, Human
cccugcuuccagga

SEQ ID NO: 2496454 - RNA, 21 nt, Human
cccugcuuccaccucacccca

SEQ ID NO: 2496455 - RNA, 18 nt, Human
cccugcuuccaccucacc

SEQ ID NO: 2496456 - RNA, 17 nt, Human
cccugcuuccaccucac

SEQ ID NO: 2496457 - RNA, 15 nt, Human
cccugcuuccaccuc

SEQ ID NO: 2496458 - RNA, 14 nt, Human
cccugcuuccaccu

SEQ ID NO: 2496459 - RNA, 16 nt, Human
cccugcuucuccagcc

SEQ ID NO: 2496460 - RNA, 15 nt, Human
cccugcuucuccagc

SEQ ID NO: 2496461 - RNA, 12 nt, Human
cccugcuucucc

SEQ ID NO: 2496462 - RNA, 11 nt, Human
cccugcuucuc

SEQ ID NO: 2496463 - RNA, 16 nt, Human
cccugcuuccaggaaa

SEQ ID NO: 2496464 - RNA, 23 nt, Human
cccugcuucuccagccuggaccc

SEQ ID NO: 2496465 - RNA, 21 nt, Human
cccugcuucuccagccuggac

SEQ ID NO: 2496466 - RNA, 18 nt, Human
cccugcuucuccagccug

SEQ ID NO: 2496467 - RNA, 17 nt, Human
cccugcuucuccagccu

SEQ ID NO: 2496468 - RNA, 20 nt, Human
cccugggcucugugggcugc

SEQ ID NO: 2496469 - RNA, 21 nt, Human
cccugggcuuggccugcugug

SEQ ID NO: 2496470 - RNA, 20 nt, Human
cccugggcuuggccugcugu

SEQ ID NO: 2496471 - RNA, 19 nt, Human
cccugggcuuggccugcug

SEQ ID NO: 2496472 - RNA, 18 nt, Human
cccugggcuuggccugcu

SEQ ID NO: 2496473 - RNA, 19 nt, Human
cccuggggacagcaagggc

SEQ ID NO: 2496474 - RNA, 22 nt, Human
cccugggcuuggccugcuguga

SEQ ID NO: 2496475 - RNA, 17 nt, Human
cccuggggacagcaagg

SEQ ID NO: 2496476 - RNA, 17 nt, Human
cccugggcuuggccugc

SEQ ID NO: 2496477 - RNA, 15 nt, Human
cccugggcugugcua

SEQ ID NO: 2496478 - RNA, 14 nt, Human
cccugggcuggaau

SEQ ID NO: 2496479 - RNA, 13 nt, Human
cccugggcuggaa

SEQ ID NO: 2496480 - RNA, 13 nt, Human
cccugggcugaga

SEQ ID NO: 2496481 - RNA, 14 nt, Human
cccugguggcagug

SEQ ID NO: 2496482 - RNA, 21 nt, Human
cccuguagagugggagcugag

SEQ ID NO: 2496483 - RNA, 21 nt, Human
cccugguggcagcucaccucu

SEQ ID NO: 2496484 - RNA, 13 nt, Human
cccugguggcagu

SEQ ID NO: 2496485 - RNA, 17 nt, Human
cccuggggccuggaccu

SEQ ID NO: 2496486 - RNA, 14 nt, Human
cccuggggccugga

SEQ ID NO: 2496487 - RNA, 20 nt, Human
cccuggggacagcaagggcu

SEQ ID NO: 2496488 - RNA, 13 nt, Human
cccuggggccugg

SEQ ID NO: 2496489 - RNA, 21 nt, Human
cccuggugaccagcaccaucu

SEQ ID NO: 2496490 - RNA, 14 nt, Human
cccuggugcugcca

SEQ ID NO: 2496491 - RNA, 13 nt, Human
cccuggugcugcc

SEQ ID NO: 2496492 - RNA, 21 nt, Human
cccuggggccuggaccugccu

SEQ ID NO: 2496493 - RNA, 18 nt, Human
cccuggggccuggaccug

SEQ ID NO: 2496494 - RNA, 23 nt, Human
cccuggggccuggaccugccucc

SEQ ID NO: 2496495 - RNA, 23 nt, Human
cccuuaccugccaggaagccagc

SEQ ID NO: 2496496 - RNA, 20 nt, Human
cccuuaccugccaggaagcc

SEQ ID NO: 2496497 - RNA, 17 nt, Human
cccuuaccugccaggaa

SEQ ID NO: 2496498 - RNA, 19 nt, Human
cccuguuuguuucugaaag

SEQ ID NO: 2496499 - RNA, 14 nt, Human
cccuguuuuauacu

SEQ ID NO: 2496500 - RNA, 18 nt, Human
cccuguuuucugagcccg

SEQ ID NO: 2496501 - RNA, 17 nt, Human
cccuguuuucugagccc

SEQ ID NO: 2496502 - RNA, 16 nt, Human
cccuguuuucugagcc

SEQ ID NO: 2496503 - RNA, 15 nt, Human
cccuguuuucugagc

SEQ ID NO: 2496504 - RNA, 14 nt, Human
cccuguuuucugag

SEQ ID NO: 2496505 - RNA, 14 nt, Human
cccuuaaaauagaa

SEQ ID NO: 2496506 - RNA, 23 nt, Human
cccuguuuucugagcccgggcug

SEQ ID NO: 2496507 - RNA, 22 nt, Human
cccuguuuucugagcccgggcu

SEQ ID NO: 2496508 - RNA, 20 nt, Human
cccuguuuucugagcccggg

SEQ ID NO: 2496509 - RNA, 14 nt, Human
cccuguucuggcag

SEQ ID NO: 2496510 - RNA, 13 nt, Human
cccuguucuggca

SEQ ID NO: 2496511 - RNA, 16 nt, Human
cccuguuccccagaga

SEQ ID NO: 2496512 - RNA, 17 nt, Human
cccuguuccccagagaa

SEQ ID NO: 2496513 - RNA, 14 nt, Human
cccuguuccccaga

SEQ ID NO: 2496514 - RNA, 22 nt, Human
cccugucagugcagcccgugug

SEQ ID NO: 2496515 - RNA, 14 nt, Human
cccugucagugcag

SEQ ID NO: 2496516 - RNA, 14 nt, Human
cccuguccaaacug

SEQ ID NO: 2496517 - RNA, 17 nt, Human
cccugucagugcagccc

SEQ ID NO: 2496518 - RNA, 21 nt, Human
cccugucagugcagcccgugu

SEQ ID NO: 2496519 - RNA, 14 nt, Human
cccuguauggcacu

SEQ ID NO: 2496520 - RNA, 20 nt, Human
cccuguauuuucuuucucua

SEQ ID NO: 2496521 - RNA, 19 nt, Human
cccugucaccaagcucaca

SEQ ID NO: 2496522 - RNA, 14 nt, Human
cccugucaccaagc

SEQ ID NO: 2496523 - RNA, 15 nt, Human
cccuggugcugccac

SEQ ID NO: 2496524 - RNA, 15 nt, Human
cccuguauauagccc

SEQ ID NO: 2496525 - RNA, 18 nt, Human
cccuguauauagcccagc

SEQ ID NO: 2496526 - RNA, 17 nt, Human
cccuguauauagcccag

SEQ ID NO: 2496527 - RNA, 13 nt, Human
cccaugccugucc

SEQ ID NO: 2496528 - RNA, 22 nt, Human
cccauucauuccauucuggaag

SEQ ID NO: 2496529 - RNA, 18 nt, Human
cccauucauuccauucug

SEQ ID NO: 2496530 - RNA, 12 nt, Human
cccauuccugaa

SEQ ID NO: 2496531 - RNA, 13 nt, Human
cccauuccugaag

SEQ ID NO: 2496532 - RNA, 22 nt, Human
ccccaagggcaaaauucccagg

SEQ ID NO: 2496533 - RNA, 22 nt, Human
cccauggacacuccagugccag

SEQ ID NO: 2496534 - RNA, 21 nt, Human
cccauucauuccauucuggaa

SEQ ID NO: 2496535 - RNA, 12 nt, Human
ccccacacacac

SEQ ID NO: 2496536 - RNA, 14 nt, Human
ccccacacacacac

SEQ ID NO: 2496537 - RNA, 11 nt, Human
ccccacacaca

SEQ ID NO: 2496538 - RNA, 15 nt, Human
ccccaauuccuugua

SEQ ID NO: 2496539 - RNA, 14 nt, Human
ccccacaccaggcc

SEQ ID NO: 2496540 - RNA, 14 nt, Human
ccccacaccucagu

SEQ ID NO: 2496541 - RNA, 16 nt, Human
ccccacaccucaguuc

SEQ ID NO: 2496542 - RNA, 15 nt, Human
ccccacacucacucc

SEQ ID NO: 2496543 - RNA, 18 nt, Human
ccccaaggggcagucugg

SEQ ID NO: 2496544 - RNA, 22 nt, Human
ccccaaggggcagucuggaggg

SEQ ID NO: 2496545 - RNA, 14 nt, Human
cccauuccucaccu

SEQ ID NO: 2496546 - RNA, 14 nt, Human
ccccaaggggcagu

SEQ ID NO: 2496547 - RNA, 15 nt, Human
ccccaaggggcaguc

SEQ ID NO: 2496548 - RNA, 16 nt, Human
ccccaaggggcagucu

SEQ ID NO: 2496549 - RNA, 15 nt, Human
ccccaauaauugcag

SEQ ID NO: 2496550 - RNA, 14 nt, Human
ccccaauuccuugu

SEQ ID NO: 2496551 - RNA, 13 nt, Human
ccccaaucccagc

SEQ ID NO: 2496552 - RNA, 16 nt, Human
ccccacccugggcucu

SEQ ID NO: 2496553 - RNA, 15 nt, Human
ccccacccugggcuc

SEQ ID NO: 2496554 - RNA, 14 nt, Human
ccccacccugggcu

SEQ ID NO: 2496555 - RNA, 20 nt, Human
ccccacccugggcccugggc

SEQ ID NO: 2496556 - RNA, 15 nt, Human
ccccacccugggccc

SEQ ID NO: 2496557 - RNA, 14 nt, Human
ccccacccugggcc

SEQ ID NO: 2496558 - RNA, 12 nt, Human
ccccacccuggg

SEQ ID NO: 2496559 - RNA, 18 nt, Human
ccccacccucccuggagu

SEQ ID NO: 2496560 - RNA, 16 nt, Human
ccccacccucccugga

SEQ ID NO: 2496561 - RNA, 15 nt, Human
ccccacccucccugg

SEQ ID NO: 2496562 - RNA, 12 nt, Human
ccccacccucau

SEQ ID NO: 2496563 - RNA, 12 nt, Human
ccccacacuccu

SEQ ID NO: 2496564 - RNA, 21 nt, Human
ccccacccaagggccuggccu

SEQ ID NO: 2496565 - RNA, 14 nt, Human
ccccaccccacacu

SEQ ID NO: 2496566 - RNA, 12 nt, Human
ccccacccagga

SEQ ID NO: 2496567 - RNA, 13 nt, Human
ccccacccaggag

SEQ ID NO: 2496568 - RNA, 20 nt, Human
ccccacccccagcucaaugg

SEQ ID NO: 2496569 - RNA, 17 nt, Human
ccccacccccagcucaa

SEQ ID NO: 2496570 - RNA, 16 nt, Human
ccccacccccagcuca

SEQ ID NO: 2496571 - RNA, 13 nt, Human
ccccacccccagc

SEQ ID NO: 2496572 - RNA, 13 nt, Human
ccccaccccagcc

SEQ ID NO: 2496573 - RNA, 16 nt, Human
ccccaccccacacuug

SEQ ID NO: 2496574 - RNA, 21 nt, Human
ccccacuugccucuuccuuga

SEQ ID NO: 2496575 - RNA, 16 nt, Human
ccccacuugccucuuc

SEQ ID NO: 2496576 - RNA, 15 nt, Human
ccccacuugccucuu

SEQ ID NO: 2496577 - RNA, 14 nt, Human
ccccacuugccucu

SEQ ID NO: 2496578 - RNA, 16 nt, Human
ccccagaaggcaggga

SEQ ID NO: 2496579 - RNA, 21 nt, Human
ccccagaaccuguccuugcac

SEQ ID NO: 2496580 - RNA, 15 nt, Human
ccccagaaccugucc

SEQ ID NO: 2496581 - RNA, 20 nt, Human
ccccagaaccuguccuugca

SEQ ID NO: 2496582 - RNA, 15 nt, Human
ccccacucucauucc

SEQ ID NO: 2496583 - RNA, 20 nt, Human
ccccacucucauuccccagg

SEQ ID NO: 2496584 - RNA, 12 nt, Human
ccccacucuccc

SEQ ID NO: 2496585 - RNA, 15 nt, Human
ccccacucuccccac

SEQ ID NO: 2496586 - RNA, 13 nt, Human
ccccacuugccuc

SEQ ID NO: 2496587 - RNA, 18 nt, Human
ccccacuuaucccucucc

SEQ ID NO: 2496588 - RNA, 18 nt, Human
ccccacucuccccacacu

SEQ ID NO: 2496589 - RNA, 21 nt, Human
ccccacucuaggggucaggcu

SEQ ID NO: 2496590 - RNA, 23 nt, Human
ccccacucccuggcucucagaag

SEQ ID NO: 2496591 - RNA, 13 nt, Human
ccccacuccagcu

SEQ ID NO: 2496592 - RNA, 14 nt, Human
ccccacuccccacc

SEQ ID NO: 2496593 - RNA, 18 nt, Human
ccccacucaccagugucc

SEQ ID NO: 2496594 - RNA, 22 nt, Human
ccccacggccgcuccaggggug

SEQ ID NO: 2496595 - RNA, 19 nt, Human
ccccacggccgcuccaggg

SEQ ID NO: 2496596 - RNA, 18 nt, Human
ccccacggccgcuccagg

SEQ ID NO: 2496597 - RNA, 22 nt, Human
ccccacggggccucgggaccuc

SEQ ID NO: 2496598 - RNA, 21 nt, Human
ccccacggggccucgggaccu

SEQ ID NO: 2496599 - RNA, 19 nt, Human
ccccacgugacagugccug

SEQ ID NO: 2496600 - RNA, 20 nt, Human
ccccacccugggcucuggga

SEQ ID NO: 2496601 - RNA, 20 nt, Human
ccccacccuggugggccaac

SEQ ID NO: 2496602 - RNA, 15 nt, Human
ccccaccgcagacag

SEQ ID NO: 2496603 - RNA, 19 nt, Human
ccccaccgcagacaggacc

SEQ ID NO: 2496604 - RNA, 14 nt, Human
ccccacccuuuggg

SEQ ID NO: 2496605 - RNA, 17 nt, Human
ccccacgagggucagga

SEQ ID NO: 2496606 - RNA, 14 nt, Human
ccccacgcccuccc

SEQ ID NO: 2496607 - RNA, 11 nt, Human
ccccaccuggg

SEQ ID NO: 2496608 - RNA, 21 nt, Human
ccccaccuucaauuccugggc

SEQ ID NO: 2496609 - RNA, 12 nt, Human
ccccaccugcca

SEQ ID NO: 2496610 - RNA, 17 nt, Human
ccccaccucucccugac

SEQ ID NO: 2496611 - RNA, 12 nt, Human
ccccaccuccac

SEQ ID NO: 2496612 - RNA, 12 nt, Human
ccccaccucucc

SEQ ID NO: 2496613 - RNA, 23 nt, Human
cccaugacccaccccugugcucc

SEQ ID NO: 2496614 - RNA, 22 nt, Human
cccaugacccaccccugugcuc

SEQ ID NO: 2496615 - RNA, 21 nt, Human
cccaugacccaccccugugcu

SEQ ID NO: 2496616 - RNA, 20 nt, Human
cccaugacccaccccugugc

SEQ ID NO: 2496617 - RNA, 18 nt, Human
cccaugacccaggcuggg

SEQ ID NO: 2496618 - RNA, 17 nt, Human
cccaugacccaggcugg

SEQ ID NO: 2496619 - RNA, 19 nt, Human
cccaugacccaggcugggc

SEQ ID NO: 2496620 - RNA, 14 nt, Human
cccaugagccucag

SEQ ID NO: 2496621 - RNA, 22 nt, Human
cccaucuggguccuugcacccc

SEQ ID NO: 2496622 - RNA, 12 nt, Human
cccaucugugaa

SEQ ID NO: 2496623 - RNA, 19 nt, Human
cccaugacccaccccugug

SEQ ID NO: 2496624 - RNA, 17 nt, Human
cccaugacccaccccug

SEQ ID NO: 2496625 - RNA, 16 nt, Human
cccaugacccaccccu

SEQ ID NO: 2496626 - RNA, 15 nt, Human
cccaugacccacccc

SEQ ID NO: 2496627 - RNA, 14 nt, Human
cccaugacccaccc

SEQ ID NO: 2496628 - RNA, 13 nt, Human
cccaugacccacc

SEQ ID NO: 2496629 - RNA, 19 nt, Human
cccaugaccauacugaggg

SEQ ID NO: 2496630 - RNA, 22 nt, Human
cccaugacuuuauauggaugau

SEQ ID NO: 2496631 - RNA, 22 nt, Human
cccaugagccucagcauccugg

SEQ ID NO: 2496632 - RNA, 21 nt, Human
cccauggacacuccagugcca

SEQ ID NO: 2496633 - RNA, 20 nt, Human
cccauggacacuccagugcc

SEQ ID NO: 2496634 - RNA, 16 nt, Human
cccauggacacuccag

SEQ ID NO: 2496635 - RNA, 15 nt, Human
cccauggacacucca

SEQ ID NO: 2496636 - RNA, 22 nt, Human
cccaugcuguugauugcuaaau

SEQ ID NO: 2496637 - RNA, 15 nt, Human
cccauggacaggcug

SEQ ID NO: 2496638 - RNA, 20 nt, Human
cccauggacaggcuggcucc

SEQ ID NO: 2496639 - RNA, 22 nt, Human
cccauggacaggcuggcuccag

SEQ ID NO: 2496640 - RNA, 18 nt, Human
cccaugcuggagccugug

SEQ ID NO: 2496641 - RNA, 17 nt, Human
cccaugcuggagccugu

SEQ ID NO: 2496642 - RNA, 16 nt, Human
cccaugcuggagccug

SEQ ID NO: 2496643 - RNA, 15 nt, Human
cccaugcuggagccu

SEQ ID NO: 2496644 - RNA, 14 nt, Human
cccaugcuggagcc

SEQ ID NO: 2496645 - RNA, 13 nt, Human
cccaugcuggagc

SEQ ID NO: 2496646 - RNA, 21 nt, Human
cccaugcuguugauugcuaaa

SEQ ID NO: 2496647 - RNA, 19 nt, Human
cccaugcuguugauugcua

SEQ ID NO: 2496648 - RNA, 14 nt, Human
cccaugcuguugau

SEQ ID NO: 2496649 - RNA, 20 nt, Human
cccaugcuggagccugugua

SEQ ID NO: 2496650 - RNA, 19 nt, Human
cccaugcuggagccugugu

SEQ ID NO: 2496651 - RNA, 21 nt, Human
cccaugcuggagccuguguaa

SEQ ID NO: 2496652 - RNA, 15 nt, Human
cccaugaucccugug

SEQ ID NO: 2496653 - RNA, 23 nt, Human
cccaugaguuggggucuggcagc

SEQ ID NO: 2496654 - RNA, 12 nt, Human
cccaugcacugu

SEQ ID NO: 2496655 - RNA, 14 nt, Human
cccaugcacuguga

SEQ ID NO: 2496656 - RNA, 16 nt, Human
cccaugcacugugaag

SEQ ID NO: 2496657 - RNA, 18 nt, Human
cccaugcacugugaagga

SEQ ID NO: 2496658 - RNA, 19 nt, Human
cccaugcacugugaaggac

SEQ ID NO: 2496659 - RNA, 20 nt, Human
cccaugcacugugaaggacc

SEQ ID NO: 2496660 - RNA, 22 nt, Human
cccaugcacugugaaggacccu

SEQ ID NO: 2496661 - RNA, 21 nt, Human
cccaugccaaagcuagggugg

SEQ ID NO: 2496662 - RNA, 14 nt, Human
cccaugcccaccug

SEQ ID NO: 2496663 - RNA, 15 nt, Human
cccaugcccaccugc

SEQ ID NO: 2496664 - RNA, 18 nt, Human
cccaugcccaccugccca

SEQ ID NO: 2496665 - RNA, 14 nt, Human
cccaucucuucugg

SEQ ID NO: 2496666 - RNA, 13 nt, Human
cccaucugcaccc

SEQ ID NO: 2496667 - RNA, 18 nt, Human
cccaucucuuccuaccca

SEQ ID NO: 2496668 - RNA, 23 nt, Human
cccaucucucccuccccugccau

SEQ ID NO: 2496669 - RNA, 13 nt, Human
cccaucucucccu

SEQ ID NO: 2496670 - RNA, 18 nt, Human
cccaucucucccuccccu

SEQ ID NO: 2496671 - RNA, 21 nt, Human
cccaucucucccuccccugcc

SEQ ID NO: 2496672 - RNA, 18 nt, Human
cccaucuggguccuugca

SEQ ID NO: 2496673 - RNA, 23 nt, Human
cccaucugggaguccccuuuucu

SEQ ID NO: 2496674 - RNA, 16 nt, Human
cccaucugggaguccc

SEQ ID NO: 2496675 - RNA, 16 nt, Human
cccaucugcccaggac

SEQ ID NO: 2496676 - RNA, 15 nt, Human
cccaucugcccagga

SEQ ID NO: 2496677 - RNA, 14 nt, Human
cccaucugcccagg

SEQ ID NO: 2496678 - RNA, 13 nt, Human
cccaucugcccag

SEQ ID NO: 2496679 - RNA, 12 nt, Human
cccaucugccca

SEQ ID NO: 2496680 - RNA, 19 nt, Human
cccaucugcaccccuucuc

SEQ ID NO: 2496681 - RNA, 17 nt, Human
cccaucugcagggcccc

SEQ ID NO: 2496682 - RNA, 21 nt, Human
cccaucugcaccccccugggc

SEQ ID NO: 2496683 - RNA, 22 nt, Human
cccaucugcaccccccugggcu

SEQ ID NO: 2496684 - RNA, 13 nt, Human
cccaucucccccu

SEQ ID NO: 2496685 - RNA, 19 nt, Human
cccaucucuacaaaaagca

SEQ ID NO: 2496686 - RNA, 22 nt, Human
cccaucucaugccccuggcugg

SEQ ID NO: 2496687 - RNA, 21 nt, Human
cccaucucaugccccuggcug

SEQ ID NO: 2496688 - RNA, 20 nt, Human
cccaucucaugccccuggcu

SEQ ID NO: 2496689 - RNA, 14 nt, Human
cccaguugggugga

SEQ ID NO: 2496690 - RNA, 17 nt, Human
cccaguugccaucugcg

SEQ ID NO: 2496691 - RNA, 22 nt, Human
cccaguucugcuccucuccagg

SEQ ID NO: 2496692 - RNA, 21 nt, Human
cccaguucugcuccucuccag

SEQ ID NO: 2496693 - RNA, 20 nt, Human
cccaguucugcuccucucca

SEQ ID NO: 2496694 - RNA, 16 nt, Human
cccaguucugcuccuc

SEQ ID NO: 2496695 - RNA, 15 nt, Human
cccaguugccaucug

SEQ ID NO: 2496696 - RNA, 23 nt, Human
cccaguucugcuccucuccaggc

SEQ ID NO: 2496697 - RNA, 15 nt, Human
cccaguucugcuccu

SEQ ID NO: 2496698 - RNA, 14 nt, Human
cccaguucugcucc

SEQ ID NO: 2496699 - RNA, 13 nt, Human
cccaguucugcuc

SEQ ID NO: 2496700 - RNA, 18 nt, Human
cccagagacauacuugaa

SEQ ID NO: 2496701 - RNA, 21 nt, Human
cccagagacauacuugaaggg

SEQ ID NO: 2496702 - RNA, 22 nt, Human
cccagagacauacuugaagggc

SEQ ID NO: 2496703 - RNA, 23 nt, Human
cccagagacauacuugaagggcc

SEQ ID NO: 2496704 - RNA, 21 nt, Human
cccagagaagccccuucccca

SEQ ID NO: 2496705 - RNA, 16 nt, Human
cccagagaagccccuu

SEQ ID NO: 2496706 - RNA, 22 nt, Human
cccagagaagccccuuccccau

SEQ ID NO: 2496707 - RNA, 13 nt, Human
cccagagacagga

SEQ ID NO: 2496708 - RNA, 14 nt, Human
cccagagacaggaa

SEQ ID NO: 2496709 - RNA, 15 nt, Human
cccagagacaggaaa

SEQ ID NO: 2496710 - RNA, 16 nt, Human
cccagagacaggaaaa

SEQ ID NO: 2496711 - RNA, 17 nt, Human
cccagagacaggaaaau

SEQ ID NO: 2496712 - RNA, 17 nt, Human
cccagaaugaggcugcu

SEQ ID NO: 2496713 - RNA, 15 nt, Human
cccagagaagccccu

SEQ ID NO: 2496714 - RNA, 14 nt, Human
cccagagaagcccc

SEQ ID NO: 2496715 - RNA, 13 nt, Human
cccagagaagcca

SEQ ID NO: 2496716 - RNA, 22 nt, Human
cccagagaaaggggagcccacu

SEQ ID NO: 2496717 - RNA, 12 nt, Human
cccagagaagcc

SEQ ID NO: 2496718 - RNA, 22 nt, Human
ccccauaauuuuuuuuuuccuu

SEQ ID NO: 2496719 - RNA, 12 nt, Human
ccccauagccac

SEQ ID NO: 2496720 - RNA, 14 nt, Human
ccccauagccaccc

SEQ ID NO: 2496721 - RNA, 14 nt, Human
ccccaucagugcuc

SEQ ID NO: 2496722 - RNA, 20 nt, Human
ccccaucagugcucccucac

SEQ ID NO: 2496723 - RNA, 13 nt, Human
ccccaucagugcu

SEQ ID NO: 2496724 - RNA, 14 nt, Human
ccccauauggucau

SEQ ID NO: 2496725 - RNA, 16 nt, Human
ccccaguucugcuccu

SEQ ID NO: 2496726 - RNA, 15 nt, Human
ccccaguucugcucc

SEQ ID NO: 2496727 - RNA, 14 nt, Human
ccccaguucugcuc

SEQ ID NO: 2496728 - RNA, 16 nt, Human
ccccagugcacccacu

SEQ ID NO: 2496729 - RNA, 20 nt, Human
ccccaguucugcuccucucc

SEQ ID NO: 2496730 - RNA, 19 nt, Human
ccccaguucugcuccucuc

SEQ ID NO: 2496731 - RNA, 18 nt, Human
ccccaguucugcuccucu

SEQ ID NO: 2496732 - RNA, 17 nt, Human
ccccaguucugcuccuc

SEQ ID NO: 2496733 - RNA, 23 nt, Human
ccccaguucugcuccucuccagg

SEQ ID NO: 2496734 - RNA, 21 nt, Human
ccccaguucugcuccucucca

SEQ ID NO: 2496735 - RNA, 23 nt, Human
ccccaguuugcagaaaagcaccu

SEQ ID NO: 2496736 - RNA, 20 nt, Human
ccccagugcccacaggauca

SEQ ID NO: 2496737 - RNA, 16 nt, Human
ccccagugcccacagg

SEQ ID NO: 2496738 - RNA, 15 nt, Human
ccccagugcccacag

SEQ ID NO: 2496739 - RNA, 14 nt, Human
ccccagugcccaca

SEQ ID NO: 2496740 - RNA, 23 nt, Human
ccccagguguguuggggccuugg

SEQ ID NO: 2496741 - RNA, 14 nt, Human
ccccaguaaaauug

SEQ ID NO: 2496742 - RNA, 13 nt, Human
ccccaguaaaauu

SEQ ID NO: 2496743 - RNA, 21 nt, Human
ccccagucagccucucuccca

SEQ ID NO: 2496744 - RNA, 17 nt, Human
ccccagucagccucucu

SEQ ID NO: 2496745 - RNA, 16 nt, Human
ccccagucagccucuc

SEQ ID NO: 2496746 - RNA, 15 nt, Human
ccccagucagccucu

SEQ ID NO: 2496747 - RNA, 18 nt, Human
ccccaguccccaccccug

SEQ ID NO: 2496748 - RNA, 23 nt, Human
ccccagucagccucucucccagu

SEQ ID NO: 2496749 - RNA, 19 nt, Human
ccccaguccccaccccugc

SEQ ID NO: 2496750 - RNA, 14 nt, Human
ccccagucagccuc

SEQ ID NO: 2496751 - RNA, 17 nt, Human
ccccaguaaaauugcca

SEQ ID NO: 2496752 - RNA, 16 nt, Human
ccccaguaagccacug

SEQ ID NO: 2496753 - RNA, 18 nt, Human
ccccaguaagccacugcc

SEQ ID NO: 2496754 - RNA, 23 nt, Human
ccccaggccugaaagaggcugag

SEQ ID NO: 2496755 - RNA, 17 nt, Human
ccccaggccucuguguc

SEQ ID NO: 2496756 - RNA, 15 nt, Human
ccccaggccucugug

SEQ ID NO: 2496757 - RNA, 21 nt, Human
ccccaggccugaaagaggcug

SEQ ID NO: 2496758 - RNA, 13 nt, Human
ccccaggcugaag

SEQ ID NO: 2496759 - RNA, 11 nt, Human
ccccagggcac

SEQ ID NO: 2496760 - RNA, 15 nt, Human
ccccagaccugagcu

SEQ ID NO: 2496761 - RNA, 18 nt, Human
ccccagacaccgccacau

SEQ ID NO: 2496762 - RNA, 19 nt, Human
ccccagaccugagcucccc

SEQ ID NO: 2496763 - RNA, 11 nt, Human
ccccaggcccc

SEQ ID NO: 2496764 - RNA, 12 nt, Human
ccccaggcccca

SEQ ID NO: 2496765 - RNA, 18 nt, Human
ccccaggccccaggaagc

SEQ ID NO: 2496766 - RNA, 20 nt, Human
ccccaggccccgaggaccca

SEQ ID NO: 2496767 - RNA, 13 nt, Human
ccccaggccccga

SEQ ID NO: 2496768 - RNA, 12 nt, Human
ccccaggccccg

SEQ ID NO: 2496769 - RNA, 19 nt, Human
ccccaggccccaggaagcc

SEQ ID NO: 2496770 - RNA, 17 nt, Human
ccccaucauugguaccc

SEQ ID NO: 2496771 - RNA, 13 nt, Human
ccccaucauucau

SEQ ID NO: 2496772 - RNA, 19 nt, Human
ccccaucaggacucuugug

SEQ ID NO: 2496773 - RNA, 12 nt, Human
ccccauccucca

SEQ ID NO: 2496774 - RNA, 16 nt, Human
ccccaucccacacccu

SEQ ID NO: 2496775 - RNA, 14 nt, Human
ccccauccucugua

SEQ ID NO: 2496776 - RNA, 16 nt, Human
ccccauccuccagcuu

SEQ ID NO: 2496777 - RNA, 15 nt, Human
ccccauccuccagcu

SEQ ID NO: 2496778 - RNA, 14 nt, Human
ccccauccuccagc

SEQ ID NO: 2496779 - RNA, 15 nt, Human
ccccauccuccagca

SEQ ID NO: 2496780 - RNA, 18 nt, Human
ccccauccuccagcuucu

SEQ ID NO: 2496781 - RNA, 17 nt, Human
ccccauccuccagcuuc

SEQ ID NO: 2496782 - RNA, 13 nt, Human
ccccauccucccc

SEQ ID NO: 2496783 - RNA, 17 nt, Human
ccccauccuccccuucc

SEQ ID NO: 2496784 - RNA, 24 nt, Human
cccccacccaagggccuggccuga

SEQ ID NO: 2496785 - RNA, 22 nt, Human
cccccaccacggccacuggcca

SEQ ID NO: 2496786 - RNA, 16 nt, Human
cccccacagugcuguc

SEQ ID NO: 2496787 - RNA, 14 nt, Human
cccccacccccagc

SEQ ID NO: 2496788 - RNA, 15 nt, Human
cccccaccacuagga

SEQ ID NO: 2496789 - RNA, 13 nt, Human
cccccacccaagg

SEQ ID NO: 2496790 - RNA, 18 nt, Human
ccccauccuccccuuccc

SEQ ID NO: 2496791 - RNA, 19 nt, Human
ccccauccuccccuucccu

SEQ ID NO: 2496792 - RNA, 17 nt, Human
cccccacaccucaguuc

SEQ ID NO: 2496793 - RNA, 13 nt, Human
cccccacugguga

SEQ ID NO: 2496794 - RNA, 11 nt, Human
cccccacuggu

SEQ ID NO: 2496795 - RNA, 15 nt, Human
cccccacuggugaca

SEQ ID NO: 2496796 - RNA, 15 nt, Human
cccccagaaccuguc

SEQ ID NO: 2496797 - RNA, 22 nt, Human
cccccacuugccucuuccuuga

SEQ ID NO: 2496798 - RNA, 22 nt, Human
cccccagaaccuguccuugcac

SEQ ID NO: 2496799 - RNA, 17 nt, Human
cccccacccccagcuca

SEQ ID NO: 2496800 - RNA, 15 nt, Human
cccccacccccagcu

SEQ ID NO: 2496801 - RNA, 20 nt, Human
cccccaccccggggacccug

SEQ ID NO: 2496802 - RNA, 13 nt, Human
cccccacccacuu

SEQ ID NO: 2496803 - RNA, 12 nt, Human
cccccacccccu

SEQ ID NO: 2496804 - RNA, 15 nt, Human
cccccaccccuuccc

SEQ ID NO: 2496805 - RNA, 17 nt, Human
cccccaccccuucccca

SEQ ID NO: 2496806 - RNA, 12 nt, Human
cccccacccuuu

SEQ ID NO: 2496807 - RNA, 14 nt, Human
cccccacugcaggc

SEQ ID NO: 2496808 - RNA, 21 nt, Human
cccccacucucauuccccagg

SEQ ID NO: 2496809 - RNA, 17 nt, Human
cccccacugccuuugac

SEQ ID NO: 2496810 - RNA, 14 nt, Human
cccccacuccagcu

SEQ ID NO: 2496811 - RNA, 22 nt, Human
cccccaccucucccugacccug

SEQ ID NO: 2496812 - RNA, 17 nt, Human
cccccugacaacacuca

SEQ ID NO: 2496813 - RNA, 16 nt, Human
cccccucugucuugug

SEQ ID NO: 2496814 - RNA, 12 nt, Human
cccccucugucc

SEQ ID NO: 2496815 - RNA, 21 nt, Human
cccccucuggcuccagcuggc

SEQ ID NO: 2496816 - RNA, 12 nt, Human
cccccucuggcu

SEQ ID NO: 2496817 - RNA, 19 nt, Human
cccccucuggcuccagcug

SEQ ID NO: 2496818 - RNA, 19 nt, Human
cccccuccgcccugccacu

SEQ ID NO: 2496819 - RNA, 12 nt, Human
cccccuccucuc

SEQ ID NO: 2496820 - RNA, 14 nt, Human
cccccucccuggcc

SEQ ID NO: 2496821 - RNA, 19 nt, Human
cccccugacaacacucauu

SEQ ID NO: 2496822 - RNA, 18 nt, Human
cccccugcaaagcccagc

SEQ ID NO: 2496823 - RNA, 19 nt, Human
cccccugcaaagcccagcu

SEQ ID NO: 2496824 - RNA, 21 nt, Human
cccccugcaaagcccagcuug

SEQ ID NO: 2496825 - RNA, 13 nt, Human
cccccucugccgc

SEQ ID NO: 2496826 - RNA, 16 nt, Human
cccccugccccccagc

SEQ ID NO: 2496827 - RNA, 14 nt, Human
cccccugccagugc

SEQ ID NO: 2496828 - RNA, 15 nt, Human
cccccagccucuggc

SEQ ID NO: 2496829 - RNA, 13 nt, Human
cccccagcuaaga

SEQ ID NO: 2496830 - RNA, 18 nt, Human
cccccagcuaagaaccug

SEQ ID NO: 2496831 - RNA, 21 nt, Human
cccccagcuaagaaccuggaa

SEQ ID NO: 2496832 - RNA, 12 nt, Human
cccccagccugc

SEQ ID NO: 2496833 - RNA, 16 nt, Human
cccccagcaacccucc

SEQ ID NO: 2496834 - RNA, 13 nt, Human
cccccuccccagg

SEQ ID NO: 2496835 - RNA, 12 nt, Human
cccccucccacc

SEQ ID NO: 2496836 - RNA, 13 nt, Human
cccccucccaggg

SEQ ID NO: 2496837 - RNA, 18 nt, Human
cccccuccaauccugccc

SEQ ID NO: 2496838 - RNA, 16 nt, Human
cccccuccaauccugc

SEQ ID NO: 2496839 - RNA, 15 nt, Human
cccccuccaauccug

SEQ ID NO: 2496840 - RNA, 19 nt, Human
cccccucaaaccuccucuu

SEQ ID NO: 2496841 - RNA, 16 nt, Human
cccccucaaaccuccu

SEQ ID NO: 2496842 - RNA, 21 nt, Human
cccccucaucucauucaaacc

SEQ ID NO: 2496843 - RNA, 12 nt, Human
cccccagcuggc

SEQ ID NO: 2496844 - RNA, 11 nt, Human
cccccagcugg

SEQ ID NO: 2496845 - RNA, 14 nt, Human
cccccagcucuggu

SEQ ID NO: 2496846 - RNA, 12 nt, Human
cccccagcucug

SEQ ID NO: 2496847 - RNA, 15 nt, Human
cccccagcuccggcc

SEQ ID NO: 2496848 - RNA, 23 nt, Human
cccccgggccgacggagccggga

SEQ ID NO: 2496849 - RNA, 18 nt, Human
cccccgggccgacggagc

SEQ ID NO: 2496850 - RNA, 22 nt, Human
cccccgggaggggcccgcuugc

SEQ ID NO: 2496851 - RNA, 20 nt, Human
cccccgggaggggcccgcuu

SEQ ID NO: 2496852 - RNA, 16 nt, Human
cccccggggcuggguu

SEQ ID NO: 2496853 - RNA, 15 nt, Human
cccccggggcugggu

SEQ ID NO: 2496854 - RNA, 24 nt, Human
cccccggguuuggcgggccaagga

SEQ ID NO: 2496855 - RNA, 23 nt, Human
ccccucaacucuccuccagaguc

SEQ ID NO: 2496856 - RNA, 16 nt, Human
ccccucaacaccucug

SEQ ID NO: 2496857 - RNA, 20 nt, Human
ccccucacagccucugaccc

SEQ ID NO: 2496858 - RNA, 18 nt, Human
ccccucacagccucugac

SEQ ID NO: 2496859 - RNA, 17 nt, Human
ccccucacagccucuga

SEQ ID NO: 2496860 - RNA, 14 nt, Human
ccccucacagccuc

SEQ ID NO: 2496861 - RNA, 17 nt, Human
ccccucaccaggggcag

SEQ ID NO: 2496862 - RNA, 16 nt, Human
ccccucaccaggggca

SEQ ID NO: 2496863 - RNA, 21 nt, Human
ccccucaaaccuccucuucug

SEQ ID NO: 2496864 - RNA, 13 nt, Human
ccccucacagccu

SEQ ID NO: 2496865 - RNA, 18 nt, Human
ccccucaaaucguccagc

SEQ ID NO: 2496866 - RNA, 21 nt, Human
ccccuauccacccagcccauu

SEQ ID NO: 2496867 - RNA, 15 nt, Human
ccccucaacaccucu

SEQ ID NO: 2496868 - RNA, 20 nt, Human
ccccuaguaagugccuucca

SEQ ID NO: 2496869 - RNA, 19 nt, Human
ccccuaguaagugccuucc

SEQ ID NO: 2496870 - RNA, 14 nt, Human
ccccuauccaccca

SEQ ID NO: 2496871 - RNA, 16 nt, Human
ccccuauccacccagc

SEQ ID NO: 2496872 - RNA, 17 nt, Human
ccccuauccacccagcc

SEQ ID NO: 2496873 - RNA, 19 nt, Human
ccccuauccacccagccca

SEQ ID NO: 2496874 - RNA, 20 nt, Human
ccccuauccacccagcccau

SEQ ID NO: 2496875 - RNA, 21 nt, Human
ccccuagcuuagagccucccu

SEQ ID NO: 2496876 - RNA, 18 nt, Human
ccccuaguaagugccuuc

SEQ ID NO: 2496877 - RNA, 20 nt, Human
ccccuagcccaggagagaga

SEQ ID NO: 2496878 - RNA, 18 nt, Human
ccccuagcccaggagaga

SEQ ID NO: 2496879 - RNA, 15 nt, Human
ccccggucccuugag

SEQ ID NO: 2496880 - RNA, 16 nt, Human
ccccggucccuugaga

SEQ ID NO: 2496881 - RNA, 24 nt, Human
ccccggucccuugagaccucagcc

SEQ ID NO: 2496882 - RNA, 19 nt, Human
cccccuguccccucagcuc

SEQ ID NO: 2496883 - RNA, 18 nt, Human
cccccuguccccucagcu

SEQ ID NO: 2496884 - RNA, 15 nt, Human
cccccuguccccuca

SEQ ID NO: 2496885 - RNA, 12 nt, Human
cccccuguccuc

SEQ ID NO: 2496886 - RNA, 21 nt, Human
cccccuguccccucagcucca

SEQ ID NO: 2496887 - RNA, 12 nt, Human
cccccugugcag

SEQ ID NO: 2496888 - RNA, 12 nt, Human
cccccugucccc

SEQ ID NO: 2496889 - RNA, 16 nt, Human
cccccuggucucuggu

SEQ ID NO: 2496890 - RNA, 21 nt, Human
cccccugguggacaguccugg

SEQ ID NO: 2496891 - RNA, 23 nt, Human
cccccugguggacaguccuggga

SEQ ID NO: 2496892 - RNA, 11 nt, Human
cccccugggcu

SEQ ID NO: 2496893 - RNA, 13 nt, Human
cccccugggcucu

SEQ ID NO: 2496894 - RNA, 21 nt, Human
cccccuggggcuucuccugac

SEQ ID NO: 2496895 - RNA, 20 nt, Human
cccccuggggcuucuccuga

SEQ ID NO: 2496896 - RNA, 19 nt, Human
cccccuggggcuucuccug

SEQ ID NO: 2496897 - RNA, 16 nt, Human
cccccugccagugccu

SEQ ID NO: 2496898 - RNA, 15 nt, Human
cccccuggucucugg

SEQ ID NO: 2496899 - RNA, 23 nt, Human
cccccuggggcuucuccugaccc

SEQ ID NO: 2496900 - RNA, 19 nt, Human
cccccugguggacaguccu

SEQ ID NO: 2496901 - RNA, 20 nt, Human
cccccugguggacaguccug

SEQ ID NO: 2496902 - RNA, 12 nt, Human
ccccggcccugg

SEQ ID NO: 2496903 - RNA, 13 nt, Human
ccccggcccuggg

SEQ ID NO: 2496904 - RNA, 21 nt, Human
cccccugugcagccgcugagc

SEQ ID NO: 2496905 - RNA, 15 nt, Human
ccccggcggcgccgg

SEQ ID NO: 2496906 - RNA, 14 nt, Human
ccccggccucagca

SEQ ID NO: 2496907 - RNA, 21 nt, Human
ccccggcccugggcucggagg

SEQ ID NO: 2496908 - RNA, 23 nt, Human
ccccgggaggggcccgcuugccu

SEQ ID NO: 2496909 - RNA, 16 nt, Human
ccccgggaggggcccg

SEQ ID NO: 2496910 - RNA, 15 nt, Human
ccccgggcucucugc

SEQ ID NO: 2496911 - RNA, 16 nt, Human
ccccgggcucucugcu

SEQ ID NO: 2496912 - RNA, 17 nt, Human
ccccgggcucucugcug

SEQ ID NO: 2496913 - RNA, 17 nt, Human
ccccggggacccuguga

SEQ ID NO: 2496914 - RNA, 18 nt, Human
ccccgggcucucugcugu

SEQ ID NO: 2496915 - RNA, 22 nt, Human
ccccggggugaguccauucucc

SEQ ID NO: 2496916 - RNA, 15 nt, Human
ccccggggcuggguu

SEQ ID NO: 2496917 - RNA, 21 nt, Human
ccccggggcguuucuuugccg

SEQ ID NO: 2496918 - RNA, 16 nt, Human
ccccggggacccugug

SEQ ID NO: 2496919 - RNA, 18 nt, Human
ccccggguuuggcgggcc

SEQ ID NO: 2496920 - RNA, 19 nt, Human
ccccggguuuggcgggcca

SEQ ID NO: 2496921 - RNA, 23 nt, Human
ccccggguuuggcgggccaagga

SEQ ID NO: 2496922 - RNA, 12 nt, Human
ccccuccaugug

SEQ ID NO: 2496923 - RNA, 15 nt, Human
ccccuccagcuugug

SEQ ID NO: 2496924 - RNA, 13 nt, Human
ccccuccagcuug

SEQ ID NO: 2496925 - RNA, 11 nt, Human
ccccuccagcu

SEQ ID NO: 2496926 - RNA, 14 nt, Human
ccccuccacuguca

SEQ ID NO: 2496927 - RNA, 11 nt, Human
ccccuccagga

SEQ ID NO: 2496928 - RNA, 22 nt, Human
ccccuccagcuuguggagcccc

SEQ ID NO: 2496929 - RNA, 11 nt, Human
ccccucccacc

SEQ ID NO: 2496930 - RNA, 13 nt, Human
ccccucccagcug

SEQ ID NO: 2496931 - RNA, 12 nt, Human
ccccucccagcu

SEQ ID NO: 2496932 - RNA, 22 nt, Human
ccccucccagcugacaguccuc

SEQ ID NO: 2496933 - RNA, 14 nt, Human
ccccucccagcuga

SEQ ID NO: 2496934 - RNA, 12 nt, Human
ccccucccaggg

SEQ ID NO: 2496935 - RNA, 16 nt, Human
ccccucccacccaccg

SEQ ID NO: 2496936 - RNA, 16 nt, Human
ccccucccaccacagc

SEQ ID NO: 2496937 - RNA, 12 nt, Human
ccccucccacca

SEQ ID NO: 2496938 - RNA, 11 nt, Human
ccccucccaga

SEQ ID NO: 2496939 - RNA, 12 nt, Human
ccccucccagaa

SEQ ID NO: 2496940 - RNA, 13 nt, Human
ccccucccagaac

SEQ ID NO: 2496941 - RNA, 12 nt, Human
ccccucccuggc

SEQ ID NO: 2496942 - RNA, 14 nt, Human
ccccucccugcuuc

SEQ ID NO: 2496943 - RNA, 15 nt, Human
ccccucccuggccug

SEQ ID NO: 2496944 - RNA, 16 nt, Human
ccccucccuggccugu

SEQ ID NO: 2496945 - RNA, 17 nt, Human
ccccucccuggccuguu

SEQ ID NO: 2496946 - RNA, 13 nt, Human
ccccucccuggcu

SEQ ID NO: 2496947 - RNA, 14 nt, Human
ccccucccuggcuc

SEQ ID NO: 2496948 - RNA, 15 nt, Human
ccccucccuggcucc

SEQ ID NO: 2496949 - RNA, 13 nt, Human
ccccucccuguca

SEQ ID NO: 2496950 - RNA, 14 nt, Human
ccccucccuggguu

SEQ ID NO: 2496951 - RNA, 12 nt, Human
ccccucccuuuc

SEQ ID NO: 2496952 - RNA, 16 nt, Human
ccccuccgcccugcca

SEQ ID NO: 2496953 - RNA, 15 nt, Human
ccccucccuuucucc

SEQ ID NO: 2496954 - RNA, 15 nt, Human
ccccucccuucaacc

SEQ ID NO: 2496955 - RNA, 13 nt, Human
ccccucccugggu

SEQ ID NO: 2496956 - RNA, 12 nt, Human
ccccucccuggg

SEQ ID NO: 2496957 - RNA, 22 nt, Human
ccccucccuggcucccaugacc

SEQ ID NO: 2496958 - RNA, 16 nt, Human
ccccucagggucccug

SEQ ID NO: 2496959 - RNA, 17 nt, Human
ccccucagcuccagacg

SEQ ID NO: 2496960 - RNA, 13 nt, Human
ccccucagcucca

SEQ ID NO: 2496961 - RNA, 12 nt, Human
ccccucagcucc

SEQ ID NO: 2496962 - RNA, 15 nt, Human
ccccucaggacugca

SEQ ID NO: 2496963 - RNA, 13 nt, Human
ccccucaccuccu

SEQ ID NO: 2496964 - RNA, 12 nt, Human
ccccucaccucc

SEQ ID NO: 2496965 - RNA, 16 nt, Human
ccccucacccugccuu

SEQ ID NO: 2496966 - RNA, 13 nt, Human
ccccucacccugc

SEQ ID NO: 2496967 - RNA, 14 nt, Human
ccccucaccuccuc

SEQ ID NO: 2496968 - RNA, 15 nt, Human
ccccucaccugggca

SEQ ID NO: 2496969 - RNA, 13 nt, Human
ccccucaccuugc

SEQ ID NO: 2496970 - RNA, 14 nt, Human
ccccucacucuggc

SEQ ID NO: 2496971 - RNA, 12 nt, Human
ccccucacucug

SEQ ID NO: 2496972 - RNA, 14 nt, Human
ccccucaccuugca

SEQ ID NO: 2496973 - RNA, 15 nt, Human
ccccucaccuugcaa

SEQ ID NO: 2496974 - RNA, 17 nt, Human
ccccuccaauccugccc

SEQ ID NO: 2496975 - RNA, 16 nt, Human
ccccuccaauccugcc

SEQ ID NO: 2496976 - RNA, 12 nt, Human
ccccuccacugu

SEQ ID NO: 2496977 - RNA, 15 nt, Human
ccccuccaauccugc

SEQ ID NO: 2496978 - RNA, 14 nt, Human
ccccuccaaccugg

SEQ ID NO: 2496979 - RNA, 13 nt, Human
ccccuccaccugc

SEQ ID NO: 2496980 - RNA, 20 nt, Human
ccccucauagcccucacccu

SEQ ID NO: 2496981 - RNA, 20 nt, Human
ccccucaucucucugcccaa

SEQ ID NO: 2496982 - RNA, 23 nt, Human
ccccuccaaucccaccaacccuc

SEQ ID NO: 2496983 - RNA, 18 nt, Human
ccccuccgcccugccacu

SEQ ID NO: 2496984 - RNA, 17 nt, Human
ccccuccgcccugccac

SEQ ID NO: 2496985 - RNA, 19 nt, Human
ccccuccgcccugccacuc

SEQ ID NO: 2496986 - RNA, 19 nt, Human
ccccuccuaccccucccag

SEQ ID NO: 2496987 - RNA, 13 nt, Human
ccccuccucacug

SEQ ID NO: 2496988 - RNA, 12 nt, Human
ccccuccucacu

SEQ ID NO: 2496989 - RNA, 23 nt, Human
ccccuccuaccccucccagcuga

SEQ ID NO: 2496990 - RNA, 15 nt, Human
ccccuccuccacucu

SEQ ID NO: 2496991 - RNA, 12 nt, Human
ccccuccuccac

SEQ ID NO: 2496992 - RNA, 13 nt, Human
ccccuccucccuu

SEQ ID NO: 2496993 - RNA, 23 nt, Human
ccccuccucacuggccaucccuc

SEQ ID NO: 2496994 - RNA, 18 nt, Human
ccccuccuccacucuccc

SEQ ID NO: 2496995 - RNA, 18 nt, Human
ccccuccuccuggacucc

SEQ ID NO: 2496996 - RNA, 19 nt, Human
ccccuccucuagcuguggg

SEQ ID NO: 2496997 - RNA, 17 nt, Human
ccccuccucuagcugug

SEQ ID NO: 2496998 - RNA, 22 nt, Human
ccccuccuccuggacuccugca

SEQ ID NO: 2496999 - RNA, 23 nt, Human
ccccuccucuccccuaccacugu

SEQ ID NO: 2497000 - RNA, 18 nt, Human
ccccuccucucccauccc

SEQ ID NO: 2497001 - RNA, 15 nt, Human
ccccuccucucccau

SEQ ID NO: 2497002 - RNA, 13 nt, Human
ccccuccucuccc

SEQ ID NO: 2497003 - RNA, 11 nt, Human
ccccuccucuc

SEQ ID NO: 2497004 - RNA, 22 nt, Human
ccccuccucccuuuuuccuugu

SEQ ID NO: 2497005 - RNA, 21 nt, Human
ccccuccucuagcuguggggg

SEQ ID NO: 2497006 - RNA, 15 nt, Human
ccccuccucucugcc

SEQ ID NO: 2497007 - RNA, 17 nt, Human
ccccuccucucugcccu

SEQ ID NO: 2497008 - RNA, 13 nt, Human
ccccuccucugcc

SEQ ID NO: 2497009 - RNA, 13 nt, Human
ccccuccucucug

SEQ ID NO: 2497010 - RNA, 11 nt, Human
ccccuccucug

SEQ ID NO: 2497011 - RNA, 15 nt, Human
ccccucggagaagag

SEQ ID NO: 2497012 - RNA, 13 nt, Human
ccccuccuugggc

SEQ ID NO: 2497013 - RNA, 14 nt, Human
ccccuccuugcucu

SEQ ID NO: 2497014 - RNA, 15 nt, Human
ccccuccuugggcac

SEQ ID NO: 2497015 - RNA, 20 nt, Human
ccccuccuuccuugaccagc

SEQ ID NO: 2497016 - RNA, 15 nt, Human
ccccuccuugccucc

SEQ ID NO: 2497017 - RNA, 18 nt, Human
ccccuccuugccuccugu

SEQ ID NO: 2497018 - RNA, 20 nt, Human
ccccuccuugccuccugugu

SEQ ID NO: 2497019 - RNA, 22 nt, Human
ccccuccugcugcagaggggca

SEQ ID NO: 2497020 - RNA, 13 nt, Human
ccccuccuucaga

SEQ ID NO: 2497021 - RNA, 13 nt, Human
ccccuccugcugc

SEQ ID NO: 2497022 - RNA, 12 nt, Human
ccccuccugcug

SEQ ID NO: 2497023 - RNA, 14 nt, Human
ccccuccucugcca

SEQ ID NO: 2497024 - RNA, 15 nt, Human
ccccuccuuccuuga

SEQ ID NO: 2497025 - RNA, 14 nt, Human
ccccuccugcugca

SEQ ID NO: 2497026 - RNA, 17 nt, Human
ccccuccuuccuugacc

SEQ ID NO: 2497027 - RNA, 12 nt, Human
ccccuccuucuc

SEQ ID NO: 2497028 - RNA, 14 nt, Human
ccccucuccuuccu

SEQ ID NO: 2497029 - RNA, 19 nt, Human
ccccucuccuuccugugug

SEQ ID NO: 2497030 - RNA, 11 nt, Human
ccccucucugc

SEQ ID NO: 2497031 - RNA, 12 nt, Human
ccccucucuccu

SEQ ID NO: 2497032 - RNA, 17 nt, Human
ccccucgugccagucgc

SEQ ID NO: 2497033 - RNA, 20 nt, Human
ccccucuccaggcgccggcg

SEQ ID NO: 2497034 - RNA, 15 nt, Human
ccccucgugccaguc

SEQ ID NO: 2497035 - RNA, 14 nt, Human
ccccucgugccagu

SEQ ID NO: 2497036 - RNA, 21 nt, Human
ccccucgcuuggacggcuggg

SEQ ID NO: 2497037 - RNA, 19 nt, Human
ccccuggaugcagccucac

SEQ ID NO: 2497038 - RNA, 18 nt, Human
ccccuggaugcagccuca

SEQ ID NO: 2497039 - RNA, 13 nt, Human
ccccuggccuccg

SEQ ID NO: 2497040 - RNA, 19 nt, Human
ccccuggccuccggcguca

SEQ ID NO: 2497041 - RNA, 12 nt, Human
ccccuggccucc

SEQ ID NO: 2497042 - RNA, 12 nt, Human
ccccuggccucu

SEQ ID NO: 2497043 - RNA, 15 nt, Human
ccccuggagagaagu

SEQ ID NO: 2497044 - RNA, 15 nt, Human
ccccuggacugggag

SEQ ID NO: 2497045 - RNA, 20 nt, Human
ccccuggaggcacugaagug

SEQ ID NO: 2497046 - RNA, 15 nt, Human
ccccuggaugcagcc

SEQ ID NO: 2497047 - RNA, 19 nt, Human
ccccugcuucuccagccug

SEQ ID NO: 2497048 - RNA, 18 nt, Human
ccccugcuucuccagccu

SEQ ID NO: 2497049 - RNA, 15 nt, Human
ccccugcuucuccag

SEQ ID NO: 2497050 - RNA, 13 nt, Human
ccccugcuucucc

SEQ ID NO: 2497051 - RNA, 11 nt, Human
ccccugcuucu

SEQ ID NO: 2497052 - RNA, 19 nt, Human
ccccugcuuccaccucacc

SEQ ID NO: 2497053 - RNA, 22 nt, Human
ccccugcuggcucuucugccca

SEQ ID NO: 2497054 - RNA, 20 nt, Human
ccccugcugguucaggguug

SEQ ID NO: 2497055 - RNA, 15 nt, Human
ccccugcugguucag

SEQ ID NO: 2497056 - RNA, 13 nt, Human
ccccugcugguuc

SEQ ID NO: 2497057 - RNA, 11 nt, Human
ccccugcuggu

SEQ ID NO: 2497058 - RNA, 17 nt, Human
ccccugcuggguguggc

SEQ ID NO: 2497059 - RNA, 14 nt, Human
ccccugcugggugu

SEQ ID NO: 2497060 - RNA, 23 nt, Human
ccccugcugcaggggcucuggag

SEQ ID NO: 2497061 - RNA, 22 nt, Human
ccccugcugcaggggcucugga

SEQ ID NO: 2497062 - RNA, 19 nt, Human
ccccugcugcaggggcucu

SEQ ID NO: 2497063 - RNA, 12 nt, Human
ccccugcugccu

SEQ ID NO: 2497064 - RNA, 13 nt, Human
ccccugcugccuc

SEQ ID NO: 2497065 - RNA, 14 nt, Human
ccccugcugccucc

SEQ ID NO: 2497066 - RNA, 18 nt, Human
ccccugcugccuccccaa

SEQ ID NO: 2497067 - RNA, 21 nt, Human
ccccugcuggcucuucugccc

SEQ ID NO: 2497068 - RNA, 14 nt, Human
ccccugcuggcucu

SEQ ID NO: 2497069 - RNA, 20 nt, Human
ccccugcugccuccccaacc

SEQ ID NO: 2497070 - RNA, 15 nt, Human
ccccugccucucugc

SEQ ID NO: 2497071 - RNA, 14 nt, Human
ccccugccucucug

SEQ ID NO: 2497072 - RNA, 15 nt, Human
ccccugccuccaccc

SEQ ID NO: 2497073 - RNA, 12 nt, Human
ccccugccucca

SEQ ID NO: 2497074 - RNA, 11 nt, Human
ccccugccucc

SEQ ID NO: 2497075 - RNA, 17 nt, Human
ccccugccggccggggc

SEQ ID NO: 2497076 - RNA, 13 nt, Human
ccccugcccuggg

SEQ ID NO: 2497077 - RNA, 14 nt, Human
ccccugcccugcug

SEQ ID NO: 2497078 - RNA, 15 nt, Human
ccccugcccugcugc

SEQ ID NO: 2497079 - RNA, 13 nt, Human
ccccugcccuggu

SEQ ID NO: 2497080 - RNA, 17 nt, Human
ccccugcccugguccag

SEQ ID NO: 2497081 - RNA, 17 nt, Human
ccccugccucucugcag

SEQ ID NO: 2497082 - RNA, 16 nt, Human
ccccugccucucugca

SEQ ID NO: 2497083 - RNA, 19 nt, Human
ccccugccucucugcaggu

SEQ ID NO: 2497084 - RNA, 21 nt, Human
ccccugccuccacccucugag

SEQ ID NO: 2497085 - RNA, 18 nt, Human
ccccugccuccacccucu

SEQ ID NO: 2497086 - RNA, 22 nt, Human
ccccugccuccacccucugagc

SEQ ID NO: 2497087 - RNA, 12 nt, Human
ccccucugccca

SEQ ID NO: 2497088 - RNA, 18 nt, Human
ccccucugaccugcacug

SEQ ID NO: 2497089 - RNA, 19 nt, Human
ccccucucugcaucugacc

SEQ ID NO: 2497090 - RNA, 15 nt, Human
ccccucugaccugca

SEQ ID NO: 2497091 - RNA, 18 nt, Human
ccccucugcccagcuugg

SEQ ID NO: 2497092 - RNA, 17 nt, Human
ccccucugcccagcuug

SEQ ID NO: 2497093 - RNA, 15 nt, Human
ccccucugcccagcu

SEQ ID NO: 2497094 - RNA, 13 nt, Human
ccccucugcccag

SEQ ID NO: 2497095 - RNA, 12 nt, Human
ccccucugcccu

SEQ ID NO: 2497096 - RNA, 13 nt, Human
ccccucugcccug

SEQ ID NO: 2497097 - RNA, 22 nt, Human
ccccucugcccagcuugggccc

SEQ ID NO: 2497098 - RNA, 14 nt, Human
ccccugccccguca

SEQ ID NO: 2497099 - RNA, 15 nt, Human
ccccugccccgucac

SEQ ID NO: 2497100 - RNA, 22 nt, Human
ccccugccccgucaccaucuca

SEQ ID NO: 2497101 - RNA, 19 nt, Human
ccccugcccggcugcggaa

SEQ ID NO: 2497102 - RNA, 17 nt, Human
ccccugcccggcugcgg

SEQ ID NO: 2497103 - RNA, 12 nt, Human
ccccugcccugc

SEQ ID NO: 2497104 - RNA, 23 nt, Human
ccccugcccucguggccagcccg

SEQ ID NO: 2497105 - RNA, 22 nt, Human
ccccugcccucguggccagccc

SEQ ID NO: 2497106 - RNA, 21 nt, Human
ccccugcccucguggccagcc

SEQ ID NO: 2497107 - RNA, 14 nt, Human
ccccugcccugcac

SEQ ID NO: 2497108 - RNA, 13 nt, Human
ccccugcccugca

SEQ ID NO: 2497109 - RNA, 13 nt, Human
ccccugcccugcu

SEQ ID NO: 2497110 - RNA, 19 nt, Human
ccccugcccucguggccag

SEQ ID NO: 2497111 - RNA, 15 nt, Human
ccccugcccucgugg

SEQ ID NO: 2497112 - RNA, 14 nt, Human
ccccugcccucgug

SEQ ID NO: 2497113 - RNA, 13 nt, Human
ccccugcccucgu

SEQ ID NO: 2497114 - RNA, 23 nt, Human
ccccugcccuccccucucugcac

SEQ ID NO: 2497115 - RNA, 20 nt, Human
ccccuguggggaucucaggg

SEQ ID NO: 2497116 - RNA, 18 nt, Human
ccccuguggggaucucag

SEQ ID NO: 2497117 - RNA, 12 nt, Human
ccccugugggga

SEQ ID NO: 2497118 - RNA, 11 nt, Human
ccccugugcuc

SEQ ID NO: 2497119 - RNA, 19 nt, Human
ccccugugcuccgugccuc

SEQ ID NO: 2497120 - RNA, 19 nt, Human
ccccugugcagccgcugag

SEQ ID NO: 2497121 - RNA, 20 nt, Human
ccccugugcagccgcugagc

SEQ ID NO: 2497122 - RNA, 16 nt, Human
ccccuuccaucccaga

SEQ ID NO: 2497123 - RNA, 14 nt, Human
ccccuuccacugag

SEQ ID NO: 2497124 - RNA, 16 nt, Human
ccccuucauccucuga

SEQ ID NO: 2497125 - RNA, 14 nt, Human
ccccuucagugccc

SEQ ID NO: 2497126 - RNA, 24 nt, Human
ccccuguggggaucucaggggcug

SEQ ID NO: 2497127 - RNA, 21 nt, Human
ccccuguggggaucucagggg

SEQ ID NO: 2497128 - RNA, 15 nt, Human
ccccuguucacucua

SEQ ID NO: 2497129 - RNA, 20 nt, Human
ccccuuccauggacuuuguu

SEQ ID NO: 2497130 - RNA, 13 nt, Human
ccccuuccaugga

SEQ ID NO: 2497131 - RNA, 14 nt, Human
ccccuuccaugugg

SEQ ID NO: 2497132 - RNA, 13 nt, Human
ccccuuccaugug

SEQ ID NO: 2497133 - RNA, 13 nt, Human
ccccuuccccacu

SEQ ID NO: 2497134 - RNA, 15 nt, Human
ccccuuccccacugc

SEQ ID NO: 2497135 - RNA, 19 nt, Human
ccccuuccccacugccugc

SEQ ID NO: 2497136 - RNA, 21 nt, Human
ccccuuccccacugccugccc

SEQ ID NO: 2497137 - RNA, 14 nt, Human
cccgacagccuggc

SEQ ID NO: 2497138 - RNA, 22 nt, Human
cccgaauagcugggacuacagg

SEQ ID NO: 2497139 - RNA, 23 nt, Human
ccccugggugggugguggggagg

SEQ ID NO: 2497140 - RNA, 21 nt, Human
ccccuggguggguggugggga

SEQ ID NO: 2497141 - RNA, 20 nt, Human
ccccuggguggguggugggg

SEQ ID NO: 2497142 - RNA, 21 nt, Human
ccccugggucagucugguggg

SEQ ID NO: 2497143 - RNA, 20 nt, Human
ccccugggucagucuggugg

SEQ ID NO: 2497144 - RNA, 20 nt, Human
ccccuggcuuuucacugcug

SEQ ID NO: 2497145 - RNA, 14 nt, Human
ccccuggccucugu

SEQ ID NO: 2497146 - RNA, 20 nt, Human
ccccuggcuccaggccaggg

SEQ ID NO: 2497147 - RNA, 22 nt, Human
ccccuggcugggacguggcuca

SEQ ID NO: 2497148 - RNA, 23 nt, Human
ccccuggcugggacguggcucag

SEQ ID NO: 2497149 - RNA, 18 nt, Human
ccccuggcuuuucacugc

SEQ ID NO: 2497150 - RNA, 11 nt, Human
ccccugugcag

SEQ ID NO: 2497151 - RNA, 23 nt, Human
ccccugguggacaguccugggag

SEQ ID NO: 2497152 - RNA, 18 nt, Human
ccccugucuagagaggga

SEQ ID NO: 2497153 - RNA, 12 nt, Human
ccccuggugguu

SEQ ID NO: 2497154 - RNA, 21 nt, Human
ccccugguggacaguccuggg

SEQ ID NO: 2497155 - RNA, 22 nt, Human
ccccugguggacaguccuggga

SEQ ID NO: 2497156 - RNA, 15 nt, Human
ccccuggucucuggu

SEQ ID NO: 2497157 - RNA, 15 nt, Human
ccccugguggacagu

SEQ ID NO: 2497158 - RNA, 19 nt, Human
ccccugguggacaguccug

SEQ ID NO: 2497159 - RNA, 20 nt, Human
ccccugguggacaguccugg

SEQ ID NO: 2497160 - RNA, 13 nt, Human
cccgacuugcugu

SEQ ID NO: 2497161 - RNA, 12 nt, Human
cccgacuccuca

SEQ ID NO: 2497162 - RNA, 14 nt, Human
cccgacuccucaaa

SEQ ID NO: 2497163 - RNA, 18 nt, Human
cccgacagccuggcacag

SEQ ID NO: 2497164 - RNA, 15 nt, Human
cccgacagccuggca

SEQ ID NO: 2497165 - RNA, 20 nt, Human
cccgacauggacccggagcu

SEQ ID NO: 2497166 - RNA, 12 nt, Human
cccgacagaggg

SEQ ID NO: 2497167 - RNA, 15 nt, Human
cccgacagagggaag

SEQ ID NO: 2497168 - RNA, 23 nt, Human
cccgacauggacccggagcuaac

SEQ ID NO: 2497169 - RNA, 13 nt, Human
cccgagccuggcu

SEQ ID NO: 2497170 - RNA, 15 nt, Human
cccgagccuggcucc

SEQ ID NO: 2497171 - RNA, 11 nt, Human
cccgagcuggg

SEQ ID NO: 2497172 - RNA, 20 nt, Human
cccgagcugggggccaugag

SEQ ID NO: 2497173 - RNA, 22 nt, Human
cccgagcugggggccaugagcu

SEQ ID NO: 2497174 - RNA, 23 nt, Human
cccgagcugggggccaugagcuc

SEQ ID NO: 2497175 - RNA, 12 nt, Human
cccgagcuggug

SEQ ID NO: 2497176 - RNA, 14 nt, Human
cccgagcuggugca

SEQ ID NO: 2497177 - RNA, 20 nt, Human
cccgcagaccuccccagccc

SEQ ID NO: 2497178 - RNA, 19 nt, Human
cccgcagaccuccccagcc

SEQ ID NO: 2497179 - RNA, 18 nt, Human
cccgcagaccuccccagc

SEQ ID NO: 2497180 - RNA, 14 nt, Human
cccgcagaccuccc

SEQ ID NO: 2497181 - RNA, 12 nt, Human
cccgcagaccuc

SEQ ID NO: 2497182 - RNA, 17 nt, Human
cccgaggacccagaccc

SEQ ID NO: 2497183 - RNA, 16 nt, Human
cccgcagacaccuugg

SEQ ID NO: 2497184 - RNA, 15 nt, Human
cccgcagacaccuug

SEQ ID NO: 2497185 - RNA, 16 nt, Human
cccgaggacccagacc

SEQ ID NO: 2497186 - RNA, 15 nt, Human
cccgaggacccagac

SEQ ID NO: 2497187 - RNA, 22 nt, Human
cccgagcuggugcauuacagag

SEQ ID NO: 2497188 - RNA, 22 nt, Human
cccgcccaggcuggccagcccc

SEQ ID NO: 2497189 - RNA, 20 nt, Human
cccgcccaggcuggccagcc

SEQ ID NO: 2497190 - RNA, 18 nt, Human
cccgcccaggcuggccag

SEQ ID NO: 2497191 - RNA, 17 nt, Human
cccgcccaggcuggcca

SEQ ID NO: 2497192 - RNA, 15 nt, Human
cccgcccaggcuggc

SEQ ID NO: 2497193 - RNA, 23 nt, Human
cccgcuaagagggagggagggcu

SEQ ID NO: 2497194 - RNA, 22 nt, Human
cccgcccaggcuuagucacuga

SEQ ID NO: 2497195 - RNA, 20 nt, Human
cccgcccaggcuuagucacu

SEQ ID NO: 2497196 - RNA, 21 nt, Human
cccgcagaccuccccagcccc

SEQ ID NO: 2497197 - RNA, 19 nt, Human
cccgcagugugcacuaagg

SEQ ID NO: 2497198 - RNA, 22 nt, Human
cccgcagugugcacuaaggggc

SEQ ID NO: 2497199 - RNA, 20 nt, Human
cccgcccacuguccugggcg

SEQ ID NO: 2497200 - RNA, 19 nt, Human
cccgcccacuguccugggc

SEQ ID NO: 2497201 - RNA, 18 nt, Human
cccgcccacuguccuggg

SEQ ID NO: 2497202 - RNA, 17 nt, Human
cccgcccacuguccugg

SEQ ID NO: 2497203 - RNA, 14 nt, Human
cccgcccaggcugg

SEQ ID NO: 2497204 - RNA, 12 nt, Human
cccgcccaggcu

SEQ ID NO: 2497205 - RNA, 13 nt, Human
cccgcccagcugc

SEQ ID NO: 2497206 - RNA, 16 nt, Human
cccgcccacuguccug

SEQ ID NO: 2497207 - RNA, 12 nt, Human
cccgcccacugu

SEQ ID NO: 2497208 - RNA, 23 nt, Human
cccgccaccuaucucgugggaga

SEQ ID NO: 2497209 - RNA, 15 nt, Human
cccgccaaaagcugc

SEQ ID NO: 2497210 - RNA, 13 nt, Human
cuccacuggaugg

SEQ ID NO: 2497211 - RNA, 16 nt, Human
cuccacugccuucgau

SEQ ID NO: 2497212 - RNA, 15 nt, Human
cuccacugccuucga

SEQ ID NO: 2497213 - RNA, 14 nt, Human
cuccacugccuucg

SEQ ID NO: 2497214 - RNA, 14 nt, Human
cuccacucuccucu

SEQ ID NO: 2497215 - RNA, 13 nt, Human
cuccacugccuuc

SEQ ID NO: 2497216 - RNA, 15 nt, Human
cuccacucuccccca

SEQ ID NO: 2497217 - RNA, 13 nt, Human
cuccacucucccc

SEQ ID NO: 2497218 - RNA, 12 nt, Human
cuccacuccuuc

SEQ ID NO: 2497219 - RNA, 14 nt, Human
cuccacuccuuccu

SEQ ID NO: 2497220 - RNA, 15 nt, Human
cuccacuccuuccug

SEQ ID NO: 2497221 - RNA, 19 nt, Human
cuccacuccuuccugccac

SEQ ID NO: 2497222 - RNA, 20 nt, Human
cuccacguucugcucaucau

SEQ ID NO: 2497223 - RNA, 14 nt, Human
cuccacucccacuu

SEQ ID NO: 2497224 - RNA, 13 nt, Human
cuccacucccacu

SEQ ID NO: 2497225 - RNA, 13 nt, Human
cuccaccucagcc

SEQ ID NO: 2497226 - RNA, 14 nt, Human
cuccaccucagccu

SEQ ID NO: 2497227 - RNA, 16 nt, Human
cuccaccgccauggcu

SEQ ID NO: 2497228 - RNA, 20 nt, Human
cuccaccgccauggcuucca

SEQ ID NO: 2497229 - RNA, 14 nt, Human
cuccaccgcugccu

SEQ ID NO: 2497230 - RNA, 15 nt, Human
cuccaccgcugccua

SEQ ID NO: 2497231 - RNA, 16 nt, Human
cuccaccgcugccuaa

SEQ ID NO: 2497232 - RNA, 19 nt, Human
cuccaccgcugccuaagug

SEQ ID NO: 2497233 - RNA, 20 nt, Human
cuccaccuaguggcugucca

SEQ ID NO: 2497234 - RNA, 15 nt, Human
cuccaccuaguggcu

SEQ ID NO: 2497235 - RNA, 15 nt, Human
cuccaccuagacugu

SEQ ID NO: 2497236 - RNA, 22 nt, Human
cuccaccuaguggcuguccagu

SEQ ID NO: 2497237 - RNA, 21 nt, Human
cuccaccuaguggcuguccag

SEQ ID NO: 2497238 - RNA, 23 nt, Human
cuccaccuaguggcuguccagug

SEQ ID NO: 2497239 - RNA, 12 nt, Human
cuccaccucagc

SEQ ID NO: 2497240 - RNA, 13 nt, Human
cuccaccaggaac

SEQ ID NO: 2497241 - RNA, 14 nt, Human
cuccaccaggaacc

SEQ ID NO: 2497242 - RNA, 15 nt, Human
cuccaccaggaaccu

SEQ ID NO: 2497243 - RNA, 13 nt, Human
cuccaccacccaa

SEQ ID NO: 2497244 - RNA, 14 nt, Human
cuccaccacccaaa

SEQ ID NO: 2497245 - RNA, 21 nt, Human
cuccaccaccacuggccacca

SEQ ID NO: 2497246 - RNA, 19 nt, Human
cuccaccaccacuggccac

SEQ ID NO: 2497247 - RNA, 23 nt, Human
cuccaccaccacuggccaccagg

SEQ ID NO: 2497248 - RNA, 12 nt, Human
cuccaccaccca

SEQ ID NO: 2497249 - RNA, 16 nt, Human
cuccaccacccaaaag

SEQ ID NO: 2497250 - RNA, 23 nt, Human
cuccaagggcuucugcacccucc

SEQ ID NO: 2497251 - RNA, 22 nt, Human
cuccaagggcuucugcacccuc

SEQ ID NO: 2497252 - RNA, 20 nt, Human
cuccaagggcuucugcaccc

SEQ ID NO: 2497253 - RNA, 19 nt, Human
cuccaagggcuucugcacc

SEQ ID NO: 2497254 - RNA, 18 nt, Human
cuccaagggcuucugcac

SEQ ID NO: 2497255 - RNA, 20 nt, Human
cuccaaggggaaucagaacu

SEQ ID NO: 2497256 - RNA, 15 nt, Human
cuccaaggugggguc

SEQ ID NO: 2497257 - RNA, 17 nt, Human
cuccaccaccacuggcc

SEQ ID NO: 2497258 - RNA, 17 nt, Human
cuccacccuuggccugu

SEQ ID NO: 2497259 - RNA, 21 nt, Human
cuccacccuuggccugucuca

SEQ ID NO: 2497260 - RNA, 13 nt, Human
cuccacccuuggc

SEQ ID NO: 2497261 - RNA, 18 nt, Human
cuccacccccagcugcuu

SEQ ID NO: 2497262 - RNA, 14 nt, Human
cuccacccuuggcc

SEQ ID NO: 2497263 - RNA, 15 nt, Human
cuccacccuuggccu

SEQ ID NO: 2497264 - RNA, 16 nt, Human
cuccacccuuggccug

SEQ ID NO: 2497265 - RNA, 17 nt, Human
cuccacccccagcugcu

SEQ ID NO: 2497266 - RNA, 15 nt, Human
cuccacccccagcug

SEQ ID NO: 2497267 - RNA, 14 nt, Human
cuccacccccagcu

SEQ ID NO: 2497268 - RNA, 13 nt, Human
cuccacccccagc

SEQ ID NO: 2497269 - RNA, 23 nt, Human
cuccacccauccuaucagccugu

SEQ ID NO: 2497270 - RNA, 21 nt, Human
cuccacccauccuaucagccu

SEQ ID NO: 2497271 - RNA, 14 nt, Human
cuccacccauccua

SEQ ID NO: 2497272 - RNA, 18 nt, Human
cuccagcucaccagcccc

SEQ ID NO: 2497273 - RNA, 16 nt, Human
cuccagcucaccagcc

SEQ ID NO: 2497274 - RNA, 15 nt, Human
cuccagcucaccagc

SEQ ID NO: 2497275 - RNA, 14 nt, Human
cuccagccccugga

SEQ ID NO: 2497276 - RNA, 13 nt, Human
cuccagccccugg

SEQ ID NO: 2497277 - RNA, 11 nt, Human
cuccagccccu

SEQ ID NO: 2497278 - RNA, 19 nt, Human
cuccagauguuuccagacu

SEQ ID NO: 2497279 - RNA, 16 nt, Human
cuccacucucccccac

SEQ ID NO: 2497280 - RNA, 11 nt, Human
cuccagaccug

SEQ ID NO: 2497281 - RNA, 12 nt, Human
cuccagaccuga

SEQ ID NO: 2497282 - RNA, 14 nt, Human
cuccagaccugauc

SEQ ID NO: 2497283 - RNA, 14 nt, Human
cuccacuggaugga

SEQ ID NO: 2497284 - RNA, 21 nt, Human
cuccagaccccuggcuuuuca

SEQ ID NO: 2497285 - RNA, 19 nt, Human
cuccagaccugauccugga

SEQ ID NO: 2497286 - RNA, 23 nt, Human
cuccagaccugauccuggaggcc

SEQ ID NO: 2497287 - RNA, 13 nt, Human
cuccagacucucu

SEQ ID NO: 2497288 - RNA, 20 nt, Human
cuccagacguaggggagggg

SEQ ID NO: 2497289 - RNA, 19 nt, Human
cuccagacguaggggaggg

SEQ ID NO: 2497290 - RNA, 22 nt, Human
cuccacuccuuccugccaccug

SEQ ID NO: 2497291 - RNA, 18 nt, Human
cuccagacucucugugaa

SEQ ID NO: 2497292 - RNA, 16 nt, Human
cuccagacucucugug

SEQ ID NO: 2497293 - RNA, 15 nt, Human
cuccagacucucugu

SEQ ID NO: 2497294 - RNA, 14 nt, Human
cuccagacucucug

SEQ ID NO: 2497295 - RNA, 13 nt, Human
cuccagagggcac

SEQ ID NO: 2497296 - RNA, 20 nt, Human
cuccagagggcacucugcuu

SEQ ID NO: 2497297 - RNA, 21 nt, Human
cuccagagggcacucugcuug

SEQ ID NO: 2497298 - RNA, 16 nt, Human
cuccagagucagaagu

SEQ ID NO: 2497299 - RNA, 17 nt, Human
cuccagaugcagggcag

SEQ ID NO: 2497300 - RNA, 18 nt, Human
cuccagaugcagggcagu

SEQ ID NO: 2497301 - RNA, 21 nt, Human
cuccagaugcagggcagucau

SEQ ID NO: 2497302 - RNA, 17 nt, Human
cuccagauguuuccaga

SEQ ID NO: 2497303 - RNA, 16 nt, Human
cuccagaugcagggca

SEQ ID NO: 2497304 - RNA, 21 nt, Human
cuccagauagcucauuucauu

SEQ ID NO: 2497305 - RNA, 20 nt, Human
cuccagaguggggaugacau

SEQ ID NO: 2497306 - RNA, 14 nt, Human
cucauuuccaagca

SEQ ID NO: 2497307 - RNA, 13 nt, Human
cucauuuccaagc

SEQ ID NO: 2497308 - RNA, 12 nt, Human
cucauuuccaag

SEQ ID NO: 2497309 - RNA, 13 nt, Human
cucauuucaggau

SEQ ID NO: 2497310 - RNA, 12 nt, Human
cucauuucagga

SEQ ID NO: 2497311 - RNA, 23 nt, Human
cucauuucaccccucccuuucuc

SEQ ID NO: 2497312 - RNA, 17 nt, Human
cucauuuccaagcaagu

SEQ ID NO: 2497313 - RNA, 18 nt, Human
cucauuugucacacacuu

SEQ ID NO: 2497314 - RNA, 16 nt, Human
cucauuucaggagcag

SEQ ID NO: 2497315 - RNA, 21 nt, Human
cucauuucaggagcagccuca

SEQ ID NO: 2497316 - RNA, 21 nt, Human
cucauuugucacacacuuugg

SEQ ID NO: 2497317 - RNA, 22 nt, Human
cuccaaaauguuggucauuuua

SEQ ID NO: 2497318 - RNA, 15 nt, Human
cuccaaacccucgag

SEQ ID NO: 2497319 - RNA, 17 nt, Human
cuccaaacccucgaggc

SEQ ID NO: 2497320 - RNA, 18 nt, Human
cuccaaaauaaaacuuuu

SEQ ID NO: 2497321 - RNA, 19 nt, Human
cuccaaggaggggcuguaa

SEQ ID NO: 2497322 - RNA, 20 nt, Human
cuccaaggaggggcuguaaa

SEQ ID NO: 2497323 - RNA, 21 nt, Human
cuccaaggaggggcuguaaaa

SEQ ID NO: 2497324 - RNA, 22 nt, Human
cuccaaggaggggcuguaaaau

SEQ ID NO: 2497325 - RNA, 22 nt, Human
cuccaaacugaagcagccucuc

SEQ ID NO: 2497326 - RNA, 15 nt, Human
cuccaaggaccaggu

SEQ ID NO: 2497327 - RNA, 14 nt, Human
cuccaaggaccagg

SEQ ID NO: 2497328 - RNA, 12 nt, Human
cuccaaggacca

SEQ ID NO: 2497329 - RNA, 21 nt, Human
cuccaaacccucgaggcggau

SEQ ID NO: 2497330 - RNA, 22 nt, Human
cuccaaaccuccuguuagcugu

SEQ ID NO: 2497331 - RNA, 17 nt, Human
cuccaagcucccaggca

SEQ ID NO: 2497332 - RNA, 18 nt, Human
cuccaaacugaagcagcc

SEQ ID NO: 2497333 - RNA, 18 nt, Human
cucauucuccuuguguua

SEQ ID NO: 2497334 - RNA, 22 nt, Human
cucauucuccuuguguuacuaa

SEQ ID NO: 2497335 - RNA, 17 nt, Human
cucauugaccugaggcc

SEQ ID NO: 2497336 - RNA, 17 nt, Human
cucauucugaaggagcc

SEQ ID NO: 2497337 - RNA, 19 nt, Human
cucauucugaaggagcccc

SEQ ID NO: 2497338 - RNA, 21 nt, Human
cucauugaccugaggcccuuc

SEQ ID NO: 2497339 - RNA, 19 nt, Human
cucauugaccugaggcccu

SEQ ID NO: 2497340 - RNA, 22 nt, Human
cucauuucaccccucccuuucu

SEQ ID NO: 2497341 - RNA, 19 nt, Human
cucauuucaccccucccuu

SEQ ID NO: 2497342 - RNA, 17 nt, Human
cucauuucaccccuccc

SEQ ID NO: 2497343 - RNA, 14 nt, Human
cucauuucaccccu

SEQ ID NO: 2497344 - RNA, 15 nt, Human
cucauugcugagccu

SEQ ID NO: 2497345 - RNA, 16 nt, Human
cucauugcugagccuc

SEQ ID NO: 2497346 - RNA, 16 nt, Human
cucaguucucuucacu

SEQ ID NO: 2497347 - RNA, 17 nt, Human
cucaguucucuucacuc

SEQ ID NO: 2497348 - RNA, 22 nt, Human
cucaguuccgauuucccaggcu

SEQ ID NO: 2497349 - RNA, 20 nt, Human
cucaguuccgauuucccagg

SEQ ID NO: 2497350 - RNA, 22 nt, Human
cucaguucccuuggccucagaa

SEQ ID NO: 2497351 - RNA, 21 nt, Human
cucaguucuagucucucuggg

SEQ ID NO: 2497352 - RNA, 20 nt, Human
cucaguucuagucucucugg

SEQ ID NO: 2497353 - RNA, 19 nt, Human
cucaguucuagucucucug

SEQ ID NO: 2497354 - RNA, 15 nt, Human
cucaguucuagucuc

SEQ ID NO: 2497355 - RNA, 15 nt, Human
cucaguuuaauccuu

SEQ ID NO: 2497356 - RNA, 21 nt, Human
cucaguuguagaauguauugu

SEQ ID NO: 2497357 - RNA, 16 nt, Human
cucaguuguagaaugu

SEQ ID NO: 2497358 - RNA, 14 nt, Human
cucaguuguagaau

SEQ ID NO: 2497359 - RNA, 11 nt, Human
cucaguuguag

SEQ ID NO: 2497360 - RNA, 22 nt, Human
cucaguuugugugucuuaauua

SEQ ID NO: 2497361 - RNA, 17 nt, Human
cucaguuuuaucauuuu

SEQ ID NO: 2497362 - RNA, 13 nt, Human
cucaguuuucaua

SEQ ID NO: 2497363 - RNA, 18 nt, Human
cucaguuuuaucauuuuc

SEQ ID NO: 2497364 - RNA, 13 nt, Human
cucaguuugucag

SEQ ID NO: 2497365 - RNA, 13 nt, Human
cucaguuucccua

SEQ ID NO: 2497366 - RNA, 16 nt, Human
cucaguuucccuaucu

SEQ ID NO: 2497367 - RNA, 18 nt, Human
cucaguuuaauccuucua

SEQ ID NO: 2497368 - RNA, 17 nt, Human
cucaguuuaauccuucu

SEQ ID NO: 2497369 - RNA, 21 nt, Human
cucaguuuaauccuucuaguu

SEQ ID NO: 2497370 - RNA, 12 nt, Human
cucaguuucccu

SEQ ID NO: 2497371 - RNA, 21 nt, Human
cucauaaaaagccugcaauuu

SEQ ID NO: 2497372 - RNA, 14 nt, Human
cucaguuuucauaa

SEQ ID NO: 2497373 - RNA, 20 nt, Human
cucauuccugccugucuccu

SEQ ID NO: 2497374 - RNA, 17 nt, Human
cucauaaaaagcaaaac

SEQ ID NO: 2497375 - RNA, 14 nt, Human
cucauaaaaagcaa

SEQ ID NO: 2497376 - RNA, 12 nt, Human
cucauuccugua

SEQ ID NO: 2497377 - RNA, 21 nt, Human
cucccuauuuuuuuucuguua

SEQ ID NO: 2497378 - RNA, 22 nt, Human
cucccuauuuuuuuucuguuau

SEQ ID NO: 2497379 - RNA, 15 nt, Human
cucccucaaagcaca

SEQ ID NO: 2497380 - RNA, 15 nt, Human
cucccucacccugag

SEQ ID NO: 2497381 - RNA, 17 nt, Human
cucccucaauucccccu

SEQ ID NO: 2497382 - RNA, 18 nt, Human
cucccucacccugagccc

SEQ ID NO: 2497383 - RNA, 13 nt, Human
cucccucacccug

SEQ ID NO: 2497384 - RNA, 14 nt, Human
cucccucaacccca

SEQ ID NO: 2497385 - RNA, 22 nt, Human
cuccccuggaacugucucucau

SEQ ID NO: 2497386 - RNA, 23 nt, Human
cuccccuggggacagcaagggcu

SEQ ID NO: 2497387 - RNA, 14 nt, Human
cuccccuguaccuu

SEQ ID NO: 2497388 - RNA, 19 nt, Human
cuccccugugcaguccugg

SEQ ID NO: 2497389 - RNA, 19 nt, Human
cucccgaauagcugggacu

SEQ ID NO: 2497390 - RNA, 23 nt, Human
cucccgaauagcugggacuacag

SEQ ID NO: 2497391 - RNA, 20 nt, Human
cucccgaauagcugggacua

SEQ ID NO: 2497392 - RNA, 23 nt, Human
cucccuggaguguggcugaggag

SEQ ID NO: 2497393 - RNA, 21 nt, Human
cucccuucaaccauuccccau

SEQ ID NO: 2497394 - RNA, 15 nt, Human
cucccuggcccucaa

SEQ ID NO: 2497395 - RNA, 14 nt, Human
cucccuggcccuca

SEQ ID NO: 2497396 - RNA, 13 nt, Human
cucccuggcccuc

SEQ ID NO: 2497397 - RNA, 12 nt, Human
cucccuggcccu

SEQ ID NO: 2497398 - RNA, 15 nt, Human
cucccuucauccuuc

SEQ ID NO: 2497399 - RNA, 23 nt, Human
cucccuucaaccauuccccaugg

SEQ ID NO: 2497400 - RNA, 22 nt, Human
cucccuucaaccauuccccaug

SEQ ID NO: 2497401 - RNA, 22 nt, Human
cucccuggaguguggcugagga

SEQ ID NO: 2497402 - RNA, 22 nt, Human
cucccuggagugcaguuuccaa

SEQ ID NO: 2497403 - RNA, 12 nt, Human
cucccuggagug

SEQ ID NO: 2497404 - RNA, 11 nt, Human
cucccuggagu

SEQ ID NO: 2497405 - RNA, 21 nt, Human
cucccuggagccagacucugg

SEQ ID NO: 2497406 - RNA, 19 nt, Human
cucccuggagccagacucu

SEQ ID NO: 2497407 - RNA, 18 nt, Human
cucccuggagccagacuc

SEQ ID NO: 2497408 - RNA, 18 nt, Human
cucccugcuguccccucu

SEQ ID NO: 2497409 - RNA, 16 nt, Human
cucccugcuguccccu

SEQ ID NO: 2497410 - RNA, 14 nt, Human
cucccugcuguccc

SEQ ID NO: 2497411 - RNA, 11 nt, Human
cucccugcugu

SEQ ID NO: 2497412 - RNA, 20 nt, Human
cucccugcuguccccucuug

SEQ ID NO: 2497413 - RNA, 19 nt, Human
cucccugcuguccccucuu

SEQ ID NO: 2497414 - RNA, 12 nt, Human
cucccuggagcc

SEQ ID NO: 2497415 - RNA, 18 nt, Human
cucccucagucuggcccu

SEQ ID NO: 2497416 - RNA, 12 nt, Human
cucccucagccc

SEQ ID NO: 2497417 - RNA, 13 nt, Human
cucccucagcccc

SEQ ID NO: 2497418 - RNA, 14 nt, Human
cucccucagccccu

SEQ ID NO: 2497419 - RNA, 15 nt, Human
cucccucagccccuc

SEQ ID NO: 2497420 - RNA, 16 nt, Human
cucccucagccccucu

SEQ ID NO: 2497421 - RNA, 18 nt, Human
cucccucagccccucuug

SEQ ID NO: 2497422 - RNA, 14 nt, Human
cuccccagcccaga

SEQ ID NO: 2497423 - RNA, 15 nt, Human
cuccccagcccagag

SEQ ID NO: 2497424 - RNA, 16 nt, Human
cuccccagcccagaga

SEQ ID NO: 2497425 - RNA, 17 nt, Human
cuccccagcccagagac

SEQ ID NO: 2497426 - RNA, 16 nt, Human
cuccccuccuugccuc

SEQ ID NO: 2497427 - RNA, 18 nt, Human
cuccccagcccagagaca

SEQ ID NO: 2497428 - RNA, 11 nt, Human
cuccccagccc

SEQ ID NO: 2497429 - RNA, 15 nt, Human
cuccccagcccaggg

SEQ ID NO: 2497430 - RNA, 14 nt, Human
cuccccucggagaa

SEQ ID NO: 2497431 - RNA, 16 nt, Human
cuccccucuccuuccu

SEQ ID NO: 2497432 - RNA, 16 nt, Human
cuccccagcccagggu

SEQ ID NO: 2497433 - RNA, 22 nt, Human
cuccccagcccaggguuccccc

SEQ ID NO: 2497434 - RNA, 19 nt, Human
cuccccuccuugccuccug

SEQ ID NO: 2497435 - RNA, 20 nt, Human
cuccccuccuugccuccugu

SEQ ID NO: 2497436 - RNA, 12 nt, Human
cuccccacucua

SEQ ID NO: 2497437 - RNA, 23 nt, Human
cuccccacggggccucgggaccu

SEQ ID NO: 2497438 - RNA, 22 nt, Human
cuccccacggccgcuccagggg

SEQ ID NO: 2497439 - RNA, 21 nt, Human
cuccccacggccgcuccaggg

SEQ ID NO: 2497440 - RNA, 13 nt, Human
cuccccacucuag

SEQ ID NO: 2497441 - RNA, 20 nt, Human
cuccccacggccgcuccagg

SEQ ID NO: 2497442 - RNA, 17 nt, Human
cuccccacggccgcucc

SEQ ID NO: 2497443 - RNA, 15 nt, Human
cuccccacgcccucc

SEQ ID NO: 2497444 - RNA, 23 nt, Human
cuccccagcauuccagccccucu

SEQ ID NO: 2497445 - RNA, 22 nt, Human
cuccccagcauuccagccccuc

SEQ ID NO: 2497446 - RNA, 21 nt, Human
cuccccagcauuccagccccu

SEQ ID NO: 2497447 - RNA, 13 nt, Human
cuccccagcccag

SEQ ID NO: 2497448 - RNA, 23 nt, Human
cuccccugcuggguguggcgcag

SEQ ID NO: 2497449 - RNA, 21 nt, Human
cuccccugcuggguguggcgc

SEQ ID NO: 2497450 - RNA, 23 nt, Human
cuccccugccaccaggccaccuc

SEQ ID NO: 2497451 - RNA, 18 nt, Human
cuccccugccaccaggcc

SEQ ID NO: 2497452 - RNA, 13 nt, Human
cuccccugccacc

SEQ ID NO: 2497453 - RNA, 12 nt, Human
cuccccugccac

SEQ ID NO: 2497454 - RNA, 15 nt, Human
cuccccugccagggc

SEQ ID NO: 2497455 - RNA, 16 nt, Human
cuccccugccagggca

SEQ ID NO: 2497456 - RNA, 14 nt, Human
cuccccugcugggu

SEQ ID NO: 2497457 - RNA, 17 nt, Human
cuccccugaccugugag

SEQ ID NO: 2497458 - RNA, 22 nt, Human
cuccccugaccugugagcccag

SEQ ID NO: 2497459 - RNA, 16 nt, Human
cuccccugaccuguga

SEQ ID NO: 2497460 - RNA, 22 nt, Human
cuccccuccuugccuccugugu

SEQ ID NO: 2497461 - RNA, 10 nt, Human
cuccccucua

SEQ ID NO: 2497462 - RNA, 12 nt, Human
cuccccucucuu

SEQ ID NO: 2497463 - RNA, 21 nt, Human
cuccccucuauuuagcaugac

SEQ ID NO: 2497464 - RNA, 17 nt, Human
cuccccucucuugcacc

SEQ ID NO: 2497465 - RNA, 21 nt, Human
cuccccugcacuggaguccag

SEQ ID NO: 2497466 - RNA, 22 nt, Human
cuccccugaggcucagggaaag

SEQ ID NO: 2497467 - RNA, 13 nt, Human
cuccccugaggcu

SEQ ID NO: 2497468 - RNA, 15 nt, Human
cuccccucucuugca

SEQ ID NO: 2497469 - RNA, 22 nt, Human
cuccccugauuacaccagccuc

SEQ ID NO: 2497470 - RNA, 15 nt, Human
cuccccugcacugga

SEQ ID NO: 2497471 - RNA, 15 nt, Human
cuccauuuaguucuu

SEQ ID NO: 2497472 - RNA, 23 nt, Human
cucccaaagugcugggauuacag

SEQ ID NO: 2497473 - RNA, 16 nt, Human
cucccaaagugcuggg

SEQ ID NO: 2497474 - RNA, 15 nt, Human
cucccaacucacccc

SEQ ID NO: 2497475 - RNA, 14 nt, Human
cucccaacucaccc

SEQ ID NO: 2497476 - RNA, 20 nt, Human
cucccaaguuuuaggacaaa

SEQ ID NO: 2497477 - RNA, 15 nt, Human
cucccaaaugagcca

SEQ ID NO: 2497478 - RNA, 15 nt, Human
cucccacaaaggaga

SEQ ID NO: 2497479 - RNA, 21 nt, Human
cuccaugcuuagucacugccu

SEQ ID NO: 2497480 - RNA, 20 nt, Human
cuccaugcuuagucacugcc

SEQ ID NO: 2497481 - RNA, 17 nt, Human
cuccaugcugccuccag

SEQ ID NO: 2497482 - RNA, 16 nt, Human
cuccaugcugccucca

SEQ ID NO: 2497483 - RNA, 15 nt, Human
cuccaugcugccucc

SEQ ID NO: 2497484 - RNA, 14 nt, Human
cuccaugcugccuc

SEQ ID NO: 2497485 - RNA, 13 nt, Human
cuccaugcugccu

SEQ ID NO: 2497486 - RNA, 20 nt, Human
cuccagcugggcucugcaau

SEQ ID NO: 2497487 - RNA, 19 nt, Human
cuccagcugggcucugcaa

SEQ ID NO: 2497488 - RNA, 15 nt, Human
cuccagcugggcucu

SEQ ID NO: 2497489 - RNA, 22 nt, Human
cuccagcuggccgggagccuga

SEQ ID NO: 2497490 - RNA, 23 nt, Human
cuccagcuggccgggagccugau

SEQ ID NO: 2497491 - RNA, 15 nt, Human
cuccagcucuuuccu

SEQ ID NO: 2497492 - RNA, 20 nt, Human
cuccagcugcucugucuucu

SEQ ID NO: 2497493 - RNA, 21 nt, Human
cucccauggcuuaaugcuucu

SEQ ID NO: 2497494 - RNA, 20 nt, Human
cucccauggcuuaaugcuuc

SEQ ID NO: 2497495 - RNA, 14 nt, Human
cucccauggcaccu

SEQ ID NO: 2497496 - RNA, 23 nt, Human
cucccauggagccccagcccccu

SEQ ID NO: 2497497 - RNA, 20 nt, Human
cucccauggagccccagccc

SEQ ID NO: 2497498 - RNA, 19 nt, Human
cucccauggagccccagcc

SEQ ID NO: 2497499 - RNA, 18 nt, Human
cucccauggagccccagc

SEQ ID NO: 2497500 - RNA, 17 nt, Human
cucccauggagccccag

SEQ ID NO: 2497501 - RNA, 16 nt, Human
cucccauggagcccca

SEQ ID NO: 2497502 - RNA, 15 nt, Human
cucccauggagcccc

SEQ ID NO: 2497503 - RNA, 14 nt, Human
cucccauggagccc

SEQ ID NO: 2497504 - RNA, 16 nt, Human
cucccauccccuggac

SEQ ID NO: 2497505 - RNA, 15 nt, Human
cucccauccccugga

SEQ ID NO: 2497506 - RNA, 13 nt, Human
cucccauccccug

SEQ ID NO: 2497507 - RNA, 24 nt, Human
cucccaucccccugcccucguggc

SEQ ID NO: 2497508 - RNA, 19 nt, Human
cucccaucccccugcccuc

SEQ ID NO: 2497509 - RNA, 18 nt, Human
cucccaucccccugcccu

SEQ ID NO: 2497510 - RNA, 17 nt, Human
cucccaucccccugccc

SEQ ID NO: 2497511 - RNA, 16 nt, Human
cucccaucccccugcc

SEQ ID NO: 2497512 - RNA, 14 nt, Human
cucccaucccccug

SEQ ID NO: 2497513 - RNA, 12 nt, Human
cucccauccccc

SEQ ID NO: 2497514 - RNA, 14 nt, Human
cucccauccagggc

SEQ ID NO: 2497515 - RNA, 15 nt, Human
cucccauccagggcc

SEQ ID NO: 2497516 - RNA, 22 nt, Human
cucccauccagggcccccaucu

SEQ ID NO: 2497517 - RNA, 20 nt, Human
cucccauucacucuuccaga

SEQ ID NO: 2497518 - RNA, 19 nt, Human
cucccauuaggacaaucag

SEQ ID NO: 2497519 - RNA, 19 nt, Human
cucccauucacucuuccag

SEQ ID NO: 2497520 - RNA, 14 nt, Human
cucccauuccugaa

SEQ ID NO: 2497521 - RNA, 15 nt, Human
cucccauuccugaag

SEQ ID NO: 2497522 - RNA, 16 nt, Human
cucccauuccugaaga

SEQ ID NO: 2497523 - RNA, 17 nt, Human
cucccauuccugaagaa

SEQ ID NO: 2497524 - RNA, 19 nt, Human
cucccauuccugaagaacc

SEQ ID NO: 2497525 - RNA, 17 nt, Human
cucccauugucccucug

SEQ ID NO: 2497526 - RNA, 19 nt, Human
cucccauugucccucugcc

SEQ ID NO: 2497527 - RNA, 18 nt, Human
cuccccacaggagcccug

SEQ ID NO: 2497528 - RNA, 22 nt, Human
cucccauugucccucugcccca

SEQ ID NO: 2497529 - RNA, 19 nt, Human
cuccccaccaccccagcug

SEQ ID NO: 2497530 - RNA, 14 nt, Human
cuccccacccgccc

SEQ ID NO: 2497531 - RNA, 20 nt, Human
cuccccaccaccccagcugc

SEQ ID NO: 2497532 - RNA, 12 nt, Human
cuccccacgccc

SEQ ID NO: 2497533 - RNA, 21 nt, Human
cuccccaccuucaauuccugg

SEQ ID NO: 2497534 - RNA, 23 nt, Human
cuccccaccuucaauuccugggc

SEQ ID NO: 2497535 - RNA, 19 nt, Human
cucccaggcgccccuuccc

SEQ ID NO: 2497536 - RNA, 17 nt, Human
cucccaggcgccccuuc

SEQ ID NO: 2497537 - RNA, 17 nt, Human
cucccacaggcagcuuu

SEQ ID NO: 2497538 - RNA, 16 nt, Human
cucccacaggcagcuu

SEQ ID NO: 2497539 - RNA, 15 nt, Human
cucccacaggcagcu

SEQ ID NO: 2497540 - RNA, 14 nt, Human
cucccacaggcagc

SEQ ID NO: 2497541 - RNA, 15 nt, Human
cucccacacugcuag

SEQ ID NO: 2497542 - RNA, 21 nt, Human
cucccaauuucagacucccau

SEQ ID NO: 2497543 - RNA, 19 nt, Human
cucccaauuucagacuccc

SEQ ID NO: 2497544 - RNA, 14 nt, Human
cucccacacugcua

SEQ ID NO: 2497545 - RNA, 14 nt, Human
cucccaucacccgc

SEQ ID NO: 2497546 - RNA, 19 nt, Human
cucccagggccagggcccu

SEQ ID NO: 2497547 - RNA, 16 nt, Human
cucccaucacuucccu

SEQ ID NO: 2497548 - RNA, 22 nt, Human
cucccaggcgccccuucccccu

SEQ ID NO: 2497549 - RNA, 20 nt, Human
cucccaggcgccccuucccc

SEQ ID NO: 2497550 - RNA, 18 nt, Human
cucccacaggcagcuuua

SEQ ID NO: 2497551 - RNA, 16 nt, Human
cucccagggccagggc

SEQ ID NO: 2497552 - RNA, 12 nt, Human
cucccaggcucu

SEQ ID NO: 2497553 - RNA, 13 nt, Human
cucccaggcucuc

SEQ ID NO: 2497554 - RNA, 19 nt, Human
cucacuguugcccaggcug

SEQ ID NO: 2497555 - RNA, 18 nt, Human
cucacuguugcccaggcu

SEQ ID NO: 2497556 - RNA, 17 nt, Human
cucacuguugcccaggc

SEQ ID NO: 2497557 - RNA, 16 nt, Human
cucacuguugcccagg

SEQ ID NO: 2497558 - RNA, 23 nt, Human
cucagagagggugggagugggcc

SEQ ID NO: 2497559 - RNA, 15 nt, Human
cucagagccaccccu

SEQ ID NO: 2497560 - RNA, 20 nt, Human
cucagagaugugcacccaug

SEQ ID NO: 2497561 - RNA, 21 nt, Human
cucacuguugaauuuucucua

SEQ ID NO: 2497562 - RNA, 19 nt, Human
cucagagagggugggagug

SEQ ID NO: 2497563 - RNA, 18 nt, Human
cucagagagggugggagu

SEQ ID NO: 2497564 - RNA, 21 nt, Human
cucacuguucuauucaucuca

SEQ ID NO: 2497565 - RNA, 21 nt, Human
cucacuguucccucugcuccu

SEQ ID NO: 2497566 - RNA, 15 nt, Human
cucacuguugaauuu

SEQ ID NO: 2497567 - RNA, 16 nt, Human
cucagaucuucugugg

SEQ ID NO: 2497568 - RNA, 16 nt, Human
cucagauggaaccgca

SEQ ID NO: 2497569 - RNA, 20 nt, Human
cucagauggaaccgcaggaa

SEQ ID NO: 2497570 - RNA, 23 nt, Human
cucagauggaaccgcaggaagcu

SEQ ID NO: 2497571 - RNA, 21 nt, Human
cucagauggaaccgcaggaag

SEQ ID NO: 2497572 - RNA, 22 nt, Human
cucagauggaaccgcaggaagc

SEQ ID NO: 2497573 - RNA, 17 nt, Human
cucagaggcgcacugug

SEQ ID NO: 2497574 - RNA, 18 nt, Human
cucagaggcgcacuguga

SEQ ID NO: 2497575 - RNA, 19 nt, Human
cucagagcuacuugggcca

SEQ ID NO: 2497576 - RNA, 12 nt, Human
cucagagccagu

SEQ ID NO: 2497577 - RNA, 22 nt, Human
cucagagaugugcacccauggg

SEQ ID NO: 2497578 - RNA, 15 nt, Human
cucagagccagucuu

SEQ ID NO: 2497579 - RNA, 18 nt, Human
cucagagcuacuugggcc

SEQ ID NO: 2497580 - RNA, 16 nt, Human
cucagaggcuguucuu

SEQ ID NO: 2497581 - RNA, 19 nt, Human
cucagaggcgcacugugac

SEQ ID NO: 2497582 - RNA, 18 nt, Human
cucagaggguuguucucc

SEQ ID NO: 2497583 - RNA, 21 nt, Human
cucagaggguuguucuccuag

SEQ ID NO: 2497584 - RNA, 19 nt, Human
cucagagguagggcugcca

SEQ ID NO: 2497585 - RNA, 17 nt, Human
cucagaguauggagcuc

SEQ ID NO: 2497586 - RNA, 16 nt, Human
cucagaguauggagcu

SEQ ID NO: 2497587 - RNA, 18 nt, Human
cucagaguauggagcuca

SEQ ID NO: 2497588 - RNA, 14 nt, Human
cucagaguccaggc

SEQ ID NO: 2497589 - RNA, 23 nt, Human
cucacagaccuggagccccuggg

SEQ ID NO: 2497590 - RNA, 22 nt, Human
cucacagaccuggagccccugg

SEQ ID NO: 2497591 - RNA, 20 nt, Human
cucacagaccuggagccccu

SEQ ID NO: 2497592 - RNA, 17 nt, Human
cucacagaccuggagcc

SEQ ID NO: 2497593 - RNA, 14 nt, Human
cucacagaccugga

SEQ ID NO: 2497594 - RNA, 15 nt, Human
cucacagcacagaga

SEQ ID NO: 2497595 - RNA, 16 nt, Human
cucacugcagccucaa

SEQ ID NO: 2497596 - RNA, 15 nt, Human
cucacugcagccuca

SEQ ID NO: 2497597 - RNA, 20 nt, Human
cucacugcuaagaauauuug

SEQ ID NO: 2497598 - RNA, 21 nt, Human
cucacugcuaagaauauuuga

SEQ ID NO: 2497599 - RNA, 22 nt, Human
cucacugcuaagaauauuugaa

SEQ ID NO: 2497600 - RNA, 23 nt, Human
cucacugcuaagaauauuugaau

SEQ ID NO: 2497601 - RNA, 20 nt, Human
cucacugcauccuccgccuc

SEQ ID NO: 2497602 - RNA, 12 nt, Human
cucacugccagg

SEQ ID NO: 2497603 - RNA, 11 nt, Human
cucacugccag

SEQ ID NO: 2497604 - RNA, 22 nt, Human
cucacugcggagaaccuugugc

SEQ ID NO: 2497605 - RNA, 14 nt, Human
cucacugcagccuc

SEQ ID NO: 2497606 - RNA, 14 nt, Human
cucacagcacagag

SEQ ID NO: 2497607 - RNA, 13 nt, Human
cucacagcacaga

SEQ ID NO: 2497608 - RNA, 20 nt, Human
cucacuguucccucugcucc

SEQ ID NO: 2497609 - RNA, 18 nt, Human
cucacuguucccucugcu

SEQ ID NO: 2497610 - RNA, 12 nt, Human
cucacuguuccc

SEQ ID NO: 2497611 - RNA, 24 nt, Human
cucacugugggaaggccagcugcc

SEQ ID NO: 2497612 - RNA, 20 nt, Human
cucacuguggugucuguguu

SEQ ID NO: 2497613 - RNA, 23 nt, Human
cucacugugggaaggccagcugc

SEQ ID NO: 2497614 - RNA, 12 nt, Human
cucacugucuga

SEQ ID NO: 2497615 - RNA, 13 nt, Human
cucacugucugag

SEQ ID NO: 2497616 - RNA, 22 nt, Human
cucacugggguccuggggccuc

SEQ ID NO: 2497617 - RNA, 12 nt, Human
cucacugggugg

SEQ ID NO: 2497618 - RNA, 13 nt, Human
cucacuggguggg

SEQ ID NO: 2497619 - RNA, 15 nt, Human
cucacuguugcccag

SEQ ID NO: 2497620 - RNA, 14 nt, Human
cucacuguugccca

SEQ ID NO: 2497621 - RNA, 21 nt, Human
cucacuggccaucccucgugg

SEQ ID NO: 2497622 - RNA, 16 nt, Human
cucacuggccaucccu

SEQ ID NO: 2497623 - RNA, 13 nt, Human
cucacuggggccu

SEQ ID NO: 2497624 - RNA, 16 nt, Human
cucacuggggccuaca

SEQ ID NO: 2497625 - RNA, 18 nt, Human
cucacuggggccuacagc

SEQ ID NO: 2497626 - RNA, 17 nt, Human
cucacugggguccuggg

SEQ ID NO: 2497627 - RNA, 20 nt, Human
cucacugggguccuggggcc

SEQ ID NO: 2497628 - RNA, 17 nt, Human
cucacugcucccugaag

SEQ ID NO: 2497629 - RNA, 15 nt, Human
cucacugcucccuga

SEQ ID NO: 2497630 - RNA, 21 nt, Human
cucacugcucaagaagacaug

SEQ ID NO: 2497631 - RNA, 20 nt, Human
cucacugcucaagaagacau

SEQ ID NO: 2497632 - RNA, 19 nt, Human
cucacugcucaagaagaca

SEQ ID NO: 2497633 - RNA, 16 nt, Human
cucacugcucaagaag

SEQ ID NO: 2497634 - RNA, 14 nt, Human
cucacugcucaaga

SEQ ID NO: 2497635 - RNA, 12 nt, Human
cucacugcucaa

SEQ ID NO: 2497636 - RNA, 20 nt, Human
cucacugcucccugaagcca

SEQ ID NO: 2497637 - RNA, 19 nt, Human
cucacugcucccugaagcc

SEQ ID NO: 2497638 - RNA, 23 nt, Human
cucacugcucccugaagccagcc

SEQ ID NO: 2497639 - RNA, 14 nt, Human
cucacuggccaucc

SEQ ID NO: 2497640 - RNA, 22 nt, Human
cucagcauccuggcacccggcc

SEQ ID NO: 2497641 - RNA, 21 nt, Human
cucagcauccuggcacccggc

SEQ ID NO: 2497642 - RNA, 13 nt, Human
cucagcauccugg

SEQ ID NO: 2497643 - RNA, 18 nt, Human
cucagcauauuuguauag

SEQ ID NO: 2497644 - RNA, 16 nt, Human
cucagcauauuuguau

SEQ ID NO: 2497645 - RNA, 14 nt, Human
cucagcauauuugu

SEQ ID NO: 2497646 - RNA, 16 nt, Human
cucagcauaccugcug

SEQ ID NO: 2497647 - RNA, 12 nt, Human
cucagcauaccu

SEQ ID NO: 2497648 - RNA, 20 nt, Human
cucagcagcugguaaucuug

SEQ ID NO: 2497649 - RNA, 19 nt, Human
cucagcaaaagaugcuucu

SEQ ID NO: 2497650 - RNA, 20 nt, Human
cucagcaaaagaugcuucuc

SEQ ID NO: 2497651 - RNA, 16 nt, Human
cucagcaggggagggu

SEQ ID NO: 2497652 - RNA, 21 nt, Human
cucagcaaaagaugcuucuca

SEQ ID NO: 2497653 - RNA, 21 nt, Human
cucagcccucccugccccucc

SEQ ID NO: 2497654 - RNA, 20 nt, Human
cucagcccucccugccccuc

SEQ ID NO: 2497655 - RNA, 19 nt, Human
cucagcccucccugccccu

SEQ ID NO: 2497656 - RNA, 14 nt, Human
cucagcccucccug

SEQ ID NO: 2497657 - RNA, 17 nt, Human
cucagccccaccccagg

SEQ ID NO: 2497658 - RNA, 11 nt, Human
cucagccccuc

SEQ ID NO: 2497659 - RNA, 13 nt, Human
cucagccccucuu

SEQ ID NO: 2497660 - RNA, 16 nt, Human
cucagccccucuugcc

SEQ ID NO: 2497661 - RNA, 23 nt, Human
cucagccccugauccugugaagu

SEQ ID NO: 2497662 - RNA, 22 nt, Human
cucagccccugauccugugaag

SEQ ID NO: 2497663 - RNA, 20 nt, Human
cucagccccugauccuguga

SEQ ID NO: 2497664 - RNA, 18 nt, Human
cucagccccucuugcccc

SEQ ID NO: 2497665 - RNA, 19 nt, Human
cucagccccucuugccccc

SEQ ID NO: 2497666 - RNA, 15 nt, Human
cucagccaagcacag

SEQ ID NO: 2497667 - RNA, 14 nt, Human
cucagccaagcaca

SEQ ID NO: 2497668 - RNA, 13 nt, Human
cucagccaagcac

SEQ ID NO: 2497669 - RNA, 16 nt, Human
cucagcaugcauccuu

SEQ ID NO: 2497670 - RNA, 13 nt, Human
cucagcaugcauc

SEQ ID NO: 2497671 - RNA, 23 nt, Human
cucagcauauuuguauaguugcu

SEQ ID NO: 2497672 - RNA, 19 nt, Human
cucagcauauuuguauagu

SEQ ID NO: 2497673 - RNA, 15 nt, Human
cucagcauccuggca

SEQ ID NO: 2497674 - RNA, 17 nt, Human
cucagccaagcacagug

SEQ ID NO: 2497675 - RNA, 21 nt, Human
cucagcccacauagugauggu

SEQ ID NO: 2497676 - RNA, 16 nt, Human
cucagccaagcacagu

SEQ ID NO: 2497677 - RNA, 11 nt, Human
cucagcccacc

SEQ ID NO: 2497678 - RNA, 16 nt, Human
cucagcccaccccccu

SEQ ID NO: 2497679 - RNA, 17 nt, Human
cucagcccaccccccuc

SEQ ID NO: 2497680 - RNA, 19 nt, Human
cucagcccaccccccucau

SEQ ID NO: 2497681 - RNA, 21 nt, Human
cucagcggggacagcuccuuc

SEQ ID NO: 2497682 - RNA, 20 nt, Human
cucagcggggacagcuccuu

SEQ ID NO: 2497683 - RNA, 19 nt, Human
cucagcggggacagcuccu

SEQ ID NO: 2497684 - RNA, 18 nt, Human
cucagcggggacagcucc

SEQ ID NO: 2497685 - RNA, 16 nt, Human
cucagcggggacagcu

SEQ ID NO: 2497686 - RNA, 15 nt, Human
cucagcggggacagc

SEQ ID NO: 2497687 - RNA, 14 nt, Human
cucagcggggacag

SEQ ID NO: 2497688 - RNA, 11 nt, Human
cucagcccuga

SEQ ID NO: 2497689 - RNA, 13 nt, Human
cucagcccugacc

SEQ ID NO: 2497690 - RNA, 15 nt, Human
cucagcccugacccu

SEQ ID NO: 2497691 - RNA, 14 nt, Human
cucagcccugaccc

SEQ ID NO: 2497692 - RNA, 17 nt, Human
cucagcucccccugucc

SEQ ID NO: 2497693 - RNA, 16 nt, Human
cucagcucccccuguc

SEQ ID NO: 2497694 - RNA, 15 nt, Human
cucagcucccccugu

SEQ ID NO: 2497695 - RNA, 14 nt, Human
cucagcucccccug

SEQ ID NO: 2497696 - RNA, 12 nt, Human
cucagcuccccc

SEQ ID NO: 2497697 - RNA, 19 nt, Human
cucagcuccccagaguccu

SEQ ID NO: 2497698 - RNA, 16 nt, Human
cucagcuccccagagu

SEQ ID NO: 2497699 - RNA, 14 nt, Human
cucagcuccccaga

SEQ ID NO: 2497700 - RNA, 12 nt, Human
cucagcucccca

SEQ ID NO: 2497701 - RNA, 11 nt, Human
cucagcucccc

SEQ ID NO: 2497702 - RNA, 21 nt, Human
cucagcucccauuucuacucu

SEQ ID NO: 2497703 - RNA, 18 nt, Human
cucagcucccauuucuac

SEQ ID NO: 2497704 - RNA, 17 nt, Human
cucagcucccauuucua

SEQ ID NO: 2497705 - RNA, 16 nt, Human
cucagcucccauuucu

SEQ ID NO: 2497706 - RNA, 20 nt, Human
cucagcuccagguggcucug

SEQ ID NO: 2497707 - RNA, 19 nt, Human
cucagcuccagguggcucu

SEQ ID NO: 2497708 - RNA, 15 nt, Human
cucagcucccaaggc

SEQ ID NO: 2497709 - RNA, 10 nt, Human
cucagcuccc

SEQ ID NO: 2497710 - RNA, 19 nt, Human
cucagcucccaaggcucug

SEQ ID NO: 2497711 - RNA, 13 nt, Human
cucagcucagcgc

SEQ ID NO: 2497712 - RNA, 15 nt, Human
cucagcucagcgcca

SEQ ID NO: 2497713 - RNA, 17 nt, Human
cucagcucagcgccagc

SEQ ID NO: 2497714 - RNA, 16 nt, Human
cucagcucagcgccag

SEQ ID NO: 2497715 - RNA, 22 nt, Human
cucagcuccagacguaggggag

SEQ ID NO: 2497716 - RNA, 23 nt, Human
cucagcggggacagcuccuucug

SEQ ID NO: 2497717 - RNA, 23 nt, Human
cucagcguuuuuuuguuuuuaau

SEQ ID NO: 2497718 - RNA, 17 nt, Human
cucagcccugacccugu

SEQ ID NO: 2497719 - RNA, 22 nt, Human
cucaggagcacaggcagcugga

SEQ ID NO: 2497720 - RNA, 16 nt, Human
cucaggaggcaggacc

SEQ ID NO: 2497721 - RNA, 17 nt, Human
cucaggaggcaggaccu

SEQ ID NO: 2497722 - RNA, 18 nt, Human
cucaggaggcaggaccuu

SEQ ID NO: 2497723 - RNA, 18 nt, Human
cucaggagcacaggcagc

SEQ ID NO: 2497724 - RNA, 17 nt, Human
cucaggagcacaggcag

SEQ ID NO: 2497725 - RNA, 15 nt, Human
cucaggagcacaggc

SEQ ID NO: 2497726 - RNA, 14 nt, Human
cucaggagcacagg

SEQ ID NO: 2497727 - RNA, 16 nt, Human
cucaggagccucugcu

SEQ ID NO: 2497728 - RNA, 24 nt, Human
cucaggagcccugggaggcucugg

SEQ ID NO: 2497729 - RNA, 15 nt, Human
cucaggcagguggga

SEQ ID NO: 2497730 - RNA, 14 nt, Human
cucaggaggcugag

SEQ ID NO: 2497731 - RNA, 15 nt, Human
cucaggaggcugagg

SEQ ID NO: 2497732 - RNA, 17 nt, Human
cucaggaggcugaggca

SEQ ID NO: 2497733 - RNA, 18 nt, Human
cucaggcaggugggaugg

SEQ ID NO: 2497734 - RNA, 18 nt, Human
cucaggaggcugaggcag

SEQ ID NO: 2497735 - RNA, 13 nt, Human
cucaggaggcuga

SEQ ID NO: 2497736 - RNA, 16 nt, Human
cucaggcauaggccug

SEQ ID NO: 2497737 - RNA, 17 nt, Human
cucaggcauaggccugg

SEQ ID NO: 2497738 - RNA, 20 nt, Human
cucaggcauaggccugggug

SEQ ID NO: 2497739 - RNA, 21 nt, Human
cucaggcauaggccugggugc

SEQ ID NO: 2497740 - RNA, 20 nt, Human
cucagggccuggcucaggug

SEQ ID NO: 2497741 - RNA, 19 nt, Human
cucagggccuggcucaggu

SEQ ID NO: 2497742 - RNA, 18 nt, Human
cucagggccuggcucagg

SEQ ID NO: 2497743 - RNA, 18 nt, Human
cucagggccccagcacua

SEQ ID NO: 2497744 - RNA, 14 nt, Human
cucagggccccagc

SEQ ID NO: 2497745 - RNA, 16 nt, Human
cucagggccccagcac

SEQ ID NO: 2497746 - RNA, 13 nt, Human
cucagggccaugc

SEQ ID NO: 2497747 - RNA, 20 nt, Human
cucagggcagcgccaggcug

SEQ ID NO: 2497748 - RNA, 18 nt, Human
cucaggcaugccugugug

SEQ ID NO: 2497749 - RNA, 22 nt, Human
cucaggcauaggccugggugcu

SEQ ID NO: 2497750 - RNA, 23 nt, Human
cucaggcauaggccugggugcug

SEQ ID NO: 2497751 - RNA, 15 nt, Human
cucaggcaugccugu

SEQ ID NO: 2497752 - RNA, 16 nt, Human
cucaggcaugccugug

SEQ ID NO: 2497753 - RNA, 17 nt, Human
cucaggcaugccugugu

SEQ ID NO: 2497754 - RNA, 18 nt, Human
cucagggccaugcugagg

SEQ ID NO: 2497755 - RNA, 17 nt, Human
cucagggccaugcugag

SEQ ID NO: 2497756 - RNA, 15 nt, Human
cucagggccaugcug

SEQ ID NO: 2497757 - RNA, 20 nt, Human
cucagggccaugccugcccc

SEQ ID NO: 2497758 - RNA, 20 nt, Human
cucagggccaugcugaggcc

SEQ ID NO: 2497759 - RNA, 19 nt, Human
cucagggccaugcugaggc

SEQ ID NO: 2497760 - RNA, 12 nt, Human
cucagggcccca

SEQ ID NO: 2497761 - RNA, 13 nt, Human
cucagggccccag

SEQ ID NO: 2497762 - RNA, 17 nt, Human
cucagggucucugcugc

SEQ ID NO: 2497763 - RNA, 16 nt, Human
cucagggucucugcug

SEQ ID NO: 2497764 - RNA, 14 nt, Human
cucagggucucugc

SEQ ID NO: 2497765 - RNA, 13 nt, Human
cucagggucucug

SEQ ID NO: 2497766 - RNA, 24 nt, Human
cucagggucccugguggcagcuca

SEQ ID NO: 2497767 - RNA, 18 nt, Human
cucagggucucugcugcc

SEQ ID NO: 2497768 - RNA, 19 nt, Human
cucagggucucugcugccg

SEQ ID NO: 2497769 - RNA, 20 nt, Human
cucagguaaucgaccugccu

SEQ ID NO: 2497770 - RNA, 22 nt, Human
cucagguaaucgaccugccucg

SEQ ID NO: 2497771 - RNA, 24 nt, Human
cucagguaaucgaccugccucggc

SEQ ID NO: 2497772 - RNA, 22 nt, Human
cucagggucccugguggcagcu

SEQ ID NO: 2497773 - RNA, 21 nt, Human
cucagggucccugguggcagc

SEQ ID NO: 2497774 - RNA, 20 nt, Human
cucagggucccugguggcag

SEQ ID NO: 2497775 - RNA, 14 nt, Human
cucagggccugguc

SEQ ID NO: 2497776 - RNA, 20 nt, Human
cucagguggggucacucugg

SEQ ID NO: 2497777 - RNA, 19 nt, Human
cucagguggggucacucug

SEQ ID NO: 2497778 - RNA, 21 nt, Human
cucagguggggucacucuggc

SEQ ID NO: 2497779 - RNA, 20 nt, Human
cucaguucccuuggccucag

SEQ ID NO: 2497780 - RNA, 21 nt, Human
cucaguucccuuggccucaga

SEQ ID NO: 2497781 - RNA, 13 nt, Human
cucaggugggcgu

SEQ ID NO: 2497782 - RNA, 21 nt, Human
cucagguggccaugccucagc

SEQ ID NO: 2497783 - RNA, 23 nt, Human
cucaggugauccacccaccucag

SEQ ID NO: 2497784 - RNA, 20 nt, Human
cucaggugaucuaccugccu

SEQ ID NO: 2497785 - RNA, 20 nt, Human
cucaggugauccaccugccu

SEQ ID NO: 2497786 - RNA, 22 nt, Human
cucaggugauccacccaccuca

SEQ ID NO: 2497787 - RNA, 20 nt, Human
cucagguggccaugccucag

SEQ ID NO: 2497788 - RNA, 19 nt, Human
cucagguggccaugccuca

SEQ ID NO: 2497789 - RNA, 18 nt, Human
cucagguggccaugccuc

SEQ ID NO: 2497790 - RNA, 15 nt, Human
cucagguggccaugc

SEQ ID NO: 2497791 - RNA, 22 nt, Human
cucagguggccagccuggaucu

SEQ ID NO: 2497792 - RNA, 21 nt, Human
cucagguggccagccuggauc

SEQ ID NO: 2497793 - RNA, 13 nt, Human
cucagguggccau

SEQ ID NO: 2497794 - RNA, 20 nt, Human
cucagguggccagccuggau

SEQ ID NO: 2497795 - RNA, 12 nt, Human
cucagguggcca

SEQ ID NO: 2497796 - RNA, 23 nt, Human
cucaggagcccugggaggcucug

SEQ ID NO: 2497797 - RNA, 22 nt, Human
cucaggagcccugggaggcucu

SEQ ID NO: 2497798 - RNA, 21 nt, Human
cucaggagcccugggaggcuc

SEQ ID NO: 2497799 - RNA, 20 nt, Human
cucaggagcccugggaggcu

SEQ ID NO: 2497800 - RNA, 17 nt, Human
cucaggagcccugggag

SEQ ID NO: 2497801 - RNA, 16 nt, Human
cucaggagcccuggga

SEQ ID NO: 2497802 - RNA, 15 nt, Human
cucaggagcccuggg

SEQ ID NO: 2497803 - RNA, 14 nt, Human
cucaggagcccugg

SEQ ID NO: 2497804 - RNA, 13 nt, Human
cucaggagcccug

SEQ ID NO: 2497805 - RNA, 12 nt, Human
cucaggagcccu

SEQ ID NO: 2497806 - RNA, 12 nt, Human
cucaggagcaca

SEQ ID NO: 2497807 - RNA, 19 nt, Human
cucaggacugcaacaggcu

SEQ ID NO: 2497808 - RNA, 17 nt, Human
cucaggacugcaacagg

SEQ ID NO: 2497809 - RNA, 14 nt, Human
cucaggacugcgac

SEQ ID NO: 2497810 - RNA, 15 nt, Human
cucaggacuccucuc

SEQ ID NO: 2497811 - RNA, 16 nt, Human
cucaggacugcaacag

SEQ ID NO: 2497812 - RNA, 22 nt, Human
cucaggaccugggaccuccccu

SEQ ID NO: 2497813 - RNA, 16 nt, Human
cucaggacuccucucc

SEQ ID NO: 2497814 - RNA, 21 nt, Human
cucaggaccaaagcuuucaug

SEQ ID NO: 2497815 - RNA, 22 nt, Human
cucaggaccaaagcuuucaugu

SEQ ID NO: 2497816 - RNA, 20 nt, Human
cucaggaccaaagcuuucau

SEQ ID NO: 2497817 - RNA, 19 nt, Human
cucaggacagaugccacac

SEQ ID NO: 2497818 - RNA, 12 nt, Human
cucaggacagau

SEQ ID NO: 2497819 - RNA, 14 nt, Human
cucaggacagaugc

SEQ ID NO: 2497820 - RNA, 16 nt, Human
cucaggacagaugcca

SEQ ID NO: 2497821 - RNA, 18 nt, Human
cucaggacagaugccaca

SEQ ID NO: 2497822 - RNA, 16 nt, Human
cucaggaccugggacc

SEQ ID NO: 2497823 - RNA, 15 nt, Human
cucaggaccaggcaa

SEQ ID NO: 2497824 - RNA, 14 nt, Human
cucaggacucagaa

SEQ ID NO: 2497825 - RNA, 16 nt, Human
cucaggacucagaagc

SEQ ID NO: 2497826 - RNA, 21 nt, Human
cucaggacucagaagccucug

SEQ ID NO: 2497827 - RNA, 14 nt, Human
cucaggaccaggca

SEQ ID NO: 2497828 - RNA, 12 nt, Human
cucaggaccagg

SEQ ID NO: 2497829 - RNA, 12 nt, Human
cucaggaccuag

SEQ ID NO: 2497830 - RNA, 22 nt, Human
cucaggaaaucaaauaugcaaa

SEQ ID NO: 2497831 - RNA, 12 nt, Human
cucaggaaaacg

SEQ ID NO: 2497832 - RNA, 17 nt, Human
cucaggaaaacgggacc

SEQ ID NO: 2497833 - RNA, 14 nt, Human
cucagcuuccuacc

SEQ ID NO: 2497834 - RNA, 22 nt, Human
cucagcuuccuacccacaccuc

SEQ ID NO: 2497835 - RNA, 16 nt, Human
cucagcuuccuaccca

SEQ ID NO: 2497836 - RNA, 16 nt, Human
cucagcuucuccugug

SEQ ID NO: 2497837 - RNA, 17 nt, Human
cucagcuuuuugucuuu

SEQ ID NO: 2497838 - RNA, 21 nt, Human
cucagcuuuuugucuuuucug

SEQ ID NO: 2497839 - RNA, 16 nt, Human
cucaggaaugggcugu

SEQ ID NO: 2497840 - RNA, 15 nt, Human
cucaggaaugggcug

SEQ ID NO: 2497841 - RNA, 19 nt, Human
cucaggaagcccccaaguu

SEQ ID NO: 2497842 - RNA, 15 nt, Human
cucaggaagccccca

SEQ ID NO: 2497843 - RNA, 13 nt, Human
cucaggaagaaca

SEQ ID NO: 2497844 - RNA, 14 nt, Human
cucaggaagaacac

SEQ ID NO: 2497845 - RNA, 12 nt, Human
cucaggaagaac

SEQ ID NO: 2497846 - RNA, 19 nt, Human
cucagcucccccugucccc

SEQ ID NO: 2497847 - RNA, 18 nt, Human
cucagcucccccuguccc

SEQ ID NO: 2497848 - RNA, 20 nt, Human
cucagcucccccuguccccu

SEQ ID NO: 2497849 - RNA, 12 nt, Human
cucagcucuggg

SEQ ID NO: 2497850 - RNA, 22 nt, Human
cucagcucugggagaggauuuu

SEQ ID NO: 2497851 - RNA, 18 nt, Human
cucagcucugggagagga

SEQ ID NO: 2497852 - RNA, 16 nt, Human
cucagcucugggagag

SEQ ID NO: 2497853 - RNA, 15 nt, Human
cucagcucugggaga

SEQ ID NO: 2497854 - RNA, 14 nt, Human
cucagcucugggag

SEQ ID NO: 2497855 - RNA, 13 nt, Human
cucagcucuggga

SEQ ID NO: 2497856 - RNA, 14 nt, Human
cucagcucugggcc

SEQ ID NO: 2497857 - RNA, 23 nt, Human
cucagcucugggccauucuccac

SEQ ID NO: 2497858 - RNA, 17 nt, Human
cucagcucuuggcucca

SEQ ID NO: 2497859 - RNA, 18 nt, Human
cucagcucuuggcuccac

SEQ ID NO: 2497860 - RNA, 17 nt, Human
cucagcugcuucuccca

SEQ ID NO: 2497861 - RNA, 16 nt, Human
cucagcugcuucuccc

SEQ ID NO: 2497862 - RNA, 15 nt, Human
cucagcugcuucucc

SEQ ID NO: 2497863 - RNA, 13 nt, Human
cucagcugcuucu

SEQ ID NO: 2497864 - RNA, 12 nt, Human
cucagcugcuuc

SEQ ID NO: 2497865 - RNA, 16 nt, Human
cucagcucuucugacu

SEQ ID NO: 2497866 - RNA, 18 nt, Human
cucagcugccucacuucc

SEQ ID NO: 2497867 - RNA, 14 nt, Human
cucagcugccucac

SEQ ID NO: 2497868 - RNA, 16 nt, Human
cucagcugccucacuu

SEQ ID NO: 2497869 - RNA, 12 nt, Human
cucagcugccuc

SEQ ID NO: 2497870 - RNA, 20 nt, Human
cucagcucuuggcuccacug

SEQ ID NO: 2497871 - RNA, 23 nt, Human
cucagcuggaugauggucuucag

SEQ ID NO: 2497872 - RNA, 21 nt, Human
cucagcugcuucucccacuug

SEQ ID NO: 2497873 - RNA, 12 nt, Human
cuauugcccagg

SEQ ID NO: 2497874 - RNA, 22 nt, Human
cuauugcaaagguuccaacugu

SEQ ID NO: 2497875 - RNA, 21 nt, Human
cuauugcaaagguuccaacug

SEQ ID NO: 2497876 - RNA, 18 nt, Human
cuauugcaguuauagaaa

SEQ ID NO: 2497877 - RNA, 16 nt, Human
cuauugcugcuugagg

SEQ ID NO: 2497878 - RNA, 21 nt, Human
cuauuguuucuuuaagaaagu

SEQ ID NO: 2497879 - RNA, 22 nt, Human
cuauuguuuauucuuuuuaaag

SEQ ID NO: 2497880 - RNA, 14 nt, Human
cuauuguuuauucu

SEQ ID NO: 2497881 - RNA, 14 nt, Human
cuauuguaaauaug

SEQ ID NO: 2497882 - RNA, 18 nt, Human
cuauuguuagucucuuga

SEQ ID NO: 2497883 - RNA, 11 nt, Human
cuauugguaaa

SEQ ID NO: 2497884 - RNA, 15 nt, Human
cuauuggguucauua

SEQ ID NO: 2497885 - RNA, 16 nt, Human
cuauuggguucauuau

SEQ ID NO: 2497886 - RNA, 13 nt, Human
cuauuguaaauau

SEQ ID NO: 2497887 - RNA, 23 nt, Human
cuauuggguucauuauuggaauu

SEQ ID NO: 2497888 - RNA, 17 nt, Human
cuauuuaaaacuuguaa

SEQ ID NO: 2497889 - RNA, 16 nt, Human
cuauuuaaaacuugua

SEQ ID NO: 2497890 - RNA, 15 nt, Human
cuauuuaaagccucc

SEQ ID NO: 2497891 - RNA, 15 nt, Human
cuauuuaaaaaagag

SEQ ID NO: 2497892 - RNA, 15 nt, Human
cuauuuaacuugagg

SEQ ID NO: 2497893 - RNA, 14 nt, Human
cuauuuaacuugag

SEQ ID NO: 2497894 - RNA, 22 nt, Human
cuauuuaacuggcuucagccuc

SEQ ID NO: 2497895 - RNA, 15 nt, Human
cuauuuaauauuuau

SEQ ID NO: 2497896 - RNA, 22 nt, Human
cuauuuaugugauccuuuugga

SEQ ID NO: 2497897 - RNA, 14 nt, Human
cuauuuaauauuua

SEQ ID NO: 2497898 - RNA, 12 nt, Human
cuauuuaauauu

SEQ ID NO: 2497899 - RNA, 9 nt, Human
cuauuuaag

SEQ ID NO: 2497900 - RNA, 13 nt, Human
cucacagaaauga

SEQ ID NO: 2497901 - RNA, 17 nt, Human
cucacagaacccuugga

SEQ ID NO: 2497902 - RNA, 13 nt, Human
cucacagaagaau

SEQ ID NO: 2497903 - RNA, 20 nt, Human
cucacacugagaauguaaga

SEQ ID NO: 2497904 - RNA, 14 nt, Human
cucacacugagaau

SEQ ID NO: 2497905 - RNA, 13 nt, Human
cucacacugagaa

SEQ ID NO: 2497906 - RNA, 12 nt, Human
cucacacugaga

SEQ ID NO: 2497907 - RNA, 23 nt, Human
cucacacggacacucaaaagcug

SEQ ID NO: 2497908 - RNA, 13 nt, Human
cucacacucaccc

SEQ ID NO: 2497909 - RNA, 20 nt, Human
cucaagucacucccaagccc

SEQ ID NO: 2497910 - RNA, 21 nt, Human
cucacaccgcgucuggugaca

SEQ ID NO: 2497911 - RNA, 18 nt, Human
cucaagggggacugucuu

SEQ ID NO: 2497912 - RNA, 19 nt, Human
cucaaggugggccuugcua

SEQ ID NO: 2497913 - RNA, 14 nt, Human
cucaaguccucuuu

SEQ ID NO: 2497914 - RNA, 19 nt, Human
cucaagucacucccaagcc

SEQ ID NO: 2497915 - RNA, 20 nt, Human
cucaaggccucccacaguga

SEQ ID NO: 2497916 - RNA, 19 nt, Human
cucaaggccucccacagug

SEQ ID NO: 2497917 - RNA, 13 nt, Human
cucaagcccugca

SEQ ID NO: 2497918 - RNA, 12 nt, Human
cucaagcccugc

SEQ ID NO: 2497919 - RNA, 23 nt, Human
cucaaggggccauccugucccac

SEQ ID NO: 2497920 - RNA, 22 nt, Human
cucaaggggccauccuguccca

SEQ ID NO: 2497921 - RNA, 20 nt, Human
cucaaggggccauccugucc

SEQ ID NO: 2497922 - RNA, 21 nt, Human
cucaagggcuagcaucccuga

SEQ ID NO: 2497923 - RNA, 15 nt, Human
cucaaggcgugagga

SEQ ID NO: 2497924 - RNA, 16 nt, Human
cucaaggcgugaggau

SEQ ID NO: 2497925 - RNA, 23 nt, Human
cucaagcagcgaccgcccccucc

SEQ ID NO: 2497926 - RNA, 14 nt, Human
cucaagcagucuac

SEQ ID NO: 2497927 - RNA, 23 nt, Human
cucaagcagucuacccaccucag

SEQ ID NO: 2497928 - RNA, 16 nt, Human
cucaagccaagcagcc

SEQ ID NO: 2497929 - RNA, 18 nt, Human
cucaagccaagcagccaa

SEQ ID NO: 2497930 - RNA, 21 nt, Human
cucaagccaagcagccaagcu

SEQ ID NO: 2497931 - RNA, 22 nt, Human
cucaagccaagcagccaagcuc

SEQ ID NO: 2497932 - RNA, 20 nt, Human
cucaagccaauccccuccuu

SEQ ID NO: 2497933 - RNA, 18 nt, Human
cucaagccaauccccucc

SEQ ID NO: 2497934 - RNA, 17 nt, Human
cucaagcccgcggggac

SEQ ID NO: 2497935 - RNA, 18 nt, Human
cucaacucuccuccagag

SEQ ID NO: 2497936 - RNA, 16 nt, Human
cucaacucuccuccag

SEQ ID NO: 2497937 - RNA, 17 nt, Human
cucaacucaccuaaugu

SEQ ID NO: 2497938 - RNA, 16 nt, Human
cucaagaugaaggcaa

SEQ ID NO: 2497939 - RNA, 22 nt, Human
cucaagcagcgaccgcccccuc

SEQ ID NO: 2497940 - RNA, 15 nt, Human
cuauuucuaugagaa

SEQ ID NO: 2497941 - RNA, 18 nt, Human
cuauuuauuuacugagcu

SEQ ID NO: 2497942 - RNA, 15 nt, Human
cuauuuauuuacuga

SEQ ID NO: 2497943 - RNA, 14 nt, Human
cuauuuauuuacug

SEQ ID NO: 2497944 - RNA, 21 nt, Human
cuauuucugcugaauuuucac

SEQ ID NO: 2497945 - RNA, 20 nt, Human
cuauuucugcugaauuuuca

SEQ ID NO: 2497946 - RNA, 13 nt, Human
cuauuucugcuga

SEQ ID NO: 2497947 - RNA, 12 nt, Human
cuauuucugcug

SEQ ID NO: 2497948 - RNA, 23 nt, Human
cuauuucugagaagguccuuaau

SEQ ID NO: 2497949 - RNA, 15 nt, Human
cuauuucuccuccau

SEQ ID NO: 2497950 - RNA, 16 nt, Human
cuauuucuccuccaug

SEQ ID NO: 2497951 - RNA, 13 nt, Human
cuauuucugagaa

SEQ ID NO: 2497952 - RNA, 14 nt, Human
cucaaauuucuaaa

SEQ ID NO: 2497953 - RNA, 14 nt, Human
cucaacucuccucc

SEQ ID NO: 2497954 - RNA, 20 nt, Human
cucaaccuaccaccccuucc

SEQ ID NO: 2497955 - RNA, 18 nt, Human
cucaacuagcagauacag

SEQ ID NO: 2497956 - RNA, 13 nt, Human
cucaacccucuca

SEQ ID NO: 2497957 - RNA, 18 nt, Human
cucaacccucccucagcc

SEQ ID NO: 2497958 - RNA, 19 nt, Human
cucaacccucccucagccc

SEQ ID NO: 2497959 - RNA, 21 nt, Human
cucaacccucccucagccccu

SEQ ID NO: 2497960 - RNA, 22 nt, Human
cucaacccucccucagccccuc

SEQ ID NO: 2497961 - RNA, 18 nt, Human
cucaaccaccuuucagau

SEQ ID NO: 2497962 - RNA, 15 nt, Human
cucaaccauccccuc

SEQ ID NO: 2497963 - RNA, 20 nt, Human
cucaaccauccccuccgugg

SEQ ID NO: 2497964 - RNA, 18 nt, Human
cucaaccccaccacuucu

SEQ ID NO: 2497965 - RNA, 22 nt, Human
cucaacccccauuucuauuuau

SEQ ID NO: 2497966 - RNA, 19 nt, Human
cucaacccccauuucuauu

SEQ ID NO: 2497967 - RNA, 16 nt, Human
cucaacccucccucag

SEQ ID NO: 2497968 - RNA, 15 nt, Human
cucaaauuucuaaau

SEQ ID NO: 2497969 - RNA, 17 nt, Human
cucaaauuucuaaaucu

SEQ ID NO: 2497970 - RNA, 18 nt, Human
cucaacaugagucaagag

SEQ ID NO: 2497971 - RNA, 15 nt, Human
cucaacaugagucaa

SEQ ID NO: 2497972 - RNA, 20 nt, Human
cucaacaugagucaagagca

SEQ ID NO: 2497973 - RNA, 16 nt, Human
cucaacauguuacuga

SEQ ID NO: 2497974 - RNA, 20 nt, Human
cucaacauguuacugaccag

SEQ ID NO: 2497975 - RNA, 12 nt, Human
cucaaauuugga

SEQ ID NO: 2497976 - RNA, 13 nt, Human
cucaaauuucuaa

SEQ ID NO: 2497977 - RNA, 19 nt, Human
cuauacugcauacuuuuua

SEQ ID NO: 2497978 - RNA, 21 nt, Human
cuauacugcauacuuuuuaaa

SEQ ID NO: 2497979 - RNA, 17 nt, Human
cuauacugcauacuuuu

SEQ ID NO: 2497980 - RNA, 19 nt, Human
cuauacgcagcgugcuuua

SEQ ID NO: 2497981 - RNA, 21 nt, Human
cuauaccugggcauacuaaua

SEQ ID NO: 2497982 - RNA, 19 nt, Human
cuauaccugugccucggcu

SEQ ID NO: 2497983 - RNA, 22 nt, Human
cuauaauucccuaucuuuuagu

SEQ ID NO: 2497984 - RNA, 14 nt, Human
cuauaccugugccu

SEQ ID NO: 2497985 - RNA, 15 nt, Human
cuauaccugugccuc

SEQ ID NO: 2497986 - RNA, 20 nt, Human
cuauaccugggcauacuaau

SEQ ID NO: 2497987 - RNA, 21 nt, Human
cuauagccuaggugacagagu

SEQ ID NO: 2497988 - RNA, 20 nt, Human
cuauagccuaggugacagag

SEQ ID NO: 2497989 - RNA, 18 nt, Human
cuauagccuaggugacag

SEQ ID NO: 2497990 - RNA, 19 nt, Human
cuauagccuaggugacaga

SEQ ID NO: 2497991 - RNA, 12 nt, Human
cuauaauuuaaa

SEQ ID NO: 2497992 - RNA, 13 nt, Human
cuauaauuuaaau

SEQ ID NO: 2497993 - RNA, 22 nt, Human
cuaggaagaauuuuaaaaauga

SEQ ID NO: 2497994 - RNA, 21 nt, Human
cuaggaagaauuuuaaaaaug

SEQ ID NO: 2497995 - RNA, 23 nt, Human
cuaggaagaauuuuaaaaaugaa

SEQ ID NO: 2497996 - RNA, 20 nt, Human
cuauaauucccuaucuuuua

SEQ ID NO: 2497997 - RNA, 17 nt, Human
cuaggaagacuuuggaa

SEQ ID NO: 2497998 - RNA, 15 nt, Human
cuaggaagacuuugg

SEQ ID NO: 2497999 - RNA, 20 nt, Human
cuaggaacacuccuucacag

SEQ ID NO: 2498000 - RNA, 20 nt, Human
cuaggaagaauuuuaaaaau

SEQ ID NO: 2498001 - RNA, 19 nt, Human
cuaggaagaauuuuaaaaa

SEQ ID NO: 2498002 - RNA, 15 nt, Human
cuaggaagaauuuua

SEQ ID NO: 2498003 - RNA, 14 nt, Human
cuaggaagaauuuu

SEQ ID NO: 2498004 - RNA, 11 nt, Human
cuaggaagaau

SEQ ID NO: 2498005 - RNA, 17 nt, Human
cuaugaacuucucucag

SEQ ID NO: 2498006 - RNA, 13 nt, Human
cuaugaaggcugu

SEQ ID NO: 2498007 - RNA, 15 nt, Human
cuauauagagauguu

SEQ ID NO: 2498008 - RNA, 19 nt, Human
cuaugaacucuguuuucuu

SEQ ID NO: 2498009 - RNA, 22 nt, Human
cuaugaaguuuuuuuuauacag

SEQ ID NO: 2498010 - RNA, 16 nt, Human
cuaugaugcuguugcc

SEQ ID NO: 2498011 - RNA, 17 nt, Human
cuaugaucucagguucu

SEQ ID NO: 2498012 - RNA, 14 nt, Human
cuaugaucucaggu

SEQ ID NO: 2498013 - RNA, 20 nt, Human
cuaugaaucuauuauacugu

SEQ ID NO: 2498014 - RNA, 23 nt, Human
cuaugaaguauauaaugguuuca

SEQ ID NO: 2498015 - RNA, 18 nt, Human
cuaugaaguauauaaugg

SEQ ID NO: 2498016 - RNA, 13 nt, Human
cuaugaacuacaa

SEQ ID NO: 2498017 - RNA, 15 nt, Human
cuaugauuuggaaaa

SEQ ID NO: 2498018 - RNA, 12 nt, Human
cuaugcacauau

SEQ ID NO: 2498019 - RNA, 20 nt, Human
cuaugcaauauaucuaaauu

SEQ ID NO: 2498020 - RNA, 19 nt, Human
cuaugauuuggaaaauaaa

SEQ ID NO: 2498021 - RNA, 18 nt, Human
cuaugccaaagaucacuu

SEQ ID NO: 2498022 - RNA, 17 nt, Human
cuaugccaaagaucacu

SEQ ID NO: 2498023 - RNA, 22 nt, Human
cuaugcaauauaucuaaauuga

SEQ ID NO: 2498024 - RNA, 15 nt, Human
cuaugccaaagauca

SEQ ID NO: 2498025 - RNA, 21 nt, Human
cuaugcauuugaaaauuuuga

SEQ ID NO: 2498026 - RNA, 22 nt, Human
cuaugccaaagaucacuuguug

SEQ ID NO: 2498027 - RNA, 14 nt, Human
cuaugccugugucu

SEQ ID NO: 2498028 - RNA, 19 nt, Human
cuaugccagcucaguccca

SEQ ID NO: 2498029 - RNA, 20 nt, Human
cuaugccagcucagucccau

SEQ ID NO: 2498030 - RNA, 21 nt, Human
cuauauacucacuuucuagau

SEQ ID NO: 2498031 - RNA, 19 nt, Human
cuaugaaauauuauguuaa

SEQ ID NO: 2498032 - RNA, 14 nt, Human
cuauauagagaugu

SEQ ID NO: 2498033 - RNA, 23 nt, Human
cuauauaggcaucacauuuuugu

SEQ ID NO: 2498034 - RNA, 17 nt, Human
cuauaggcuggagaagc

SEQ ID NO: 2498035 - RNA, 16 nt, Human
cuauaggcuggagaag

SEQ ID NO: 2498036 - RNA, 15 nt, Human
cuauaggcuggagaa

SEQ ID NO: 2498037 - RNA, 22 nt, Human
cuauaggcuggagaagcucacc

SEQ ID NO: 2498038 - RNA, 18 nt, Human
cuauaggcuggagaagcu

SEQ ID NO: 2498039 - RNA, 19 nt, Human
cuauaggucauacaaucca

SEQ ID NO: 2498040 - RNA, 21 nt, Human
cuauaguccagcuuuguucuu

SEQ ID NO: 2498041 - RNA, 23 nt, Human
cuauagcucaggaccugggaccu

SEQ ID NO: 2498042 - RNA, 16 nt, Human
cuauagcucaggaccu

SEQ ID NO: 2498043 - RNA, 14 nt, Human
cuauagcucaggac

SEQ ID NO: 2498044 - RNA, 21 nt, Human
cuauagccuggggugggguca

SEQ ID NO: 2498045 - RNA, 12 nt, Human
cuauagccuggg

SEQ ID NO: 2498046 - RNA, 13 nt, Human
cuauagccugggg

SEQ ID NO: 2498047 - RNA, 14 nt, Human
cuauagccuggggu

SEQ ID NO: 2498048 - RNA, 18 nt, Human
cuauagccuggggugggg

SEQ ID NO: 2498049 - RNA, 22 nt, Human
cuauguaacauguaggaaguag

SEQ ID NO: 2498050 - RNA, 15 nt, Human
cuauguaacugcauu

SEQ ID NO: 2498051 - RNA, 21 nt, Human
cuauggggauagaugugugga

SEQ ID NO: 2498052 - RNA, 15 nt, Human
cuauggggauggucc

SEQ ID NO: 2498053 - RNA, 18 nt, Human
cuauggggaugguccacu

SEQ ID NO: 2498054 - RNA, 23 nt, Human
cuauguaggaaagaccauuuuuc

SEQ ID NO: 2498055 - RNA, 20 nt, Human
cuauguaguccgugcugaca

SEQ ID NO: 2498056 - RNA, 22 nt, Human
cuauguaggaaagaccauuuuu

SEQ ID NO: 2498057 - RNA, 21 nt, Human
cuauguaacugcauugagaac

SEQ ID NO: 2498058 - RNA, 19 nt, Human
cuauggggauagaugugug

SEQ ID NO: 2498059 - RNA, 20 nt, Human
cuauggggauagaugugugg

SEQ ID NO: 2498060 - RNA, 19 nt, Human
cuaugggagccccaggguc

SEQ ID NO: 2498061 - RNA, 17 nt, Human
cuauggggagaaaagac

SEQ ID NO: 2498062 - RNA, 21 nt, Human
cuauggggagaaaagacauga

SEQ ID NO: 2498063 - RNA, 13 nt, Human
cuaugcguuuuua

SEQ ID NO: 2498064 - RNA, 13 nt, Human
cuauguaucaaug

SEQ ID NO: 2498065 - RNA, 15 nt, Human
cuauuauaauuuaau

SEQ ID NO: 2498066 - RNA, 14 nt, Human
cuauuauauuaaaa

SEQ ID NO: 2498067 - RNA, 18 nt, Human
cuauuauagccacauccc

SEQ ID NO: 2498068 - RNA, 16 nt, Human
cuauuauccccauuuc

SEQ ID NO: 2498069 - RNA, 17 nt, Human
cuauuauccccauuucu

SEQ ID NO: 2498070 - RNA, 16 nt, Human
cuauuauaauuuaaug

SEQ ID NO: 2498071 - RNA, 17 nt, Human
cuauuauaauuuaaugc

SEQ ID NO: 2498072 - RNA, 14 nt, Human
cuauuauagccaca

SEQ ID NO: 2498073 - RNA, 16 nt, Human
cuauuauacuguauua

SEQ ID NO: 2498074 - RNA, 21 nt, Human
cuauuauaauuuaaugcaugu

SEQ ID NO: 2498075 - RNA, 20 nt, Human
cuauuauuuucacuguagaa

SEQ ID NO: 2498076 - RNA, 22 nt, Human
cuauuauuuucacuguagaaug

SEQ ID NO: 2498077 - RNA, 15 nt, Human
cuauucagacaagca

SEQ ID NO: 2498078 - RNA, 14 nt, Human
cuauucagacaagc

SEQ ID NO: 2498079 - RNA, 17 nt, Human
cuauucagacaagcaac

SEQ ID NO: 2498080 - RNA, 21 nt, Human
cuauucaggagaguagaacag

SEQ ID NO: 2498081 - RNA, 17 nt, Human
cuauucaguaauaacuc

SEQ ID NO: 2498082 - RNA, 23 nt, Human
cuauucaguaauaacucuacccu

SEQ ID NO: 2498083 - RNA, 23 nt, Human
cuauucagcuucguuuauuuuca

SEQ ID NO: 2498084 - RNA, 15 nt, Human
cuauucuccagcuga

SEQ ID NO: 2498085 - RNA, 14 nt, Human
cuauucuccagcug

SEQ ID NO: 2498086 - RNA, 14 nt, Human
cuauucucuccaaa

SEQ ID NO: 2498087 - RNA, 21 nt, Human
cuauucucuccaaaaaugcac

SEQ ID NO: 2498088 - RNA, 12 nt, Human
cuauucucucuu

SEQ ID NO: 2498089 - RNA, 13 nt, Human
cuauugacuucaa

SEQ ID NO: 2498090 - RNA, 16 nt, Human
cuauugacaagucauu

SEQ ID NO: 2498091 - RNA, 23 nt, Human
cuauugauguacagucugucaug

SEQ ID NO: 2498092 - RNA, 21 nt, Human
cuauugauguacagucuguca

SEQ ID NO: 2498093 - RNA, 20 nt, Human
cuauugauguacagucuguc

SEQ ID NO: 2498094 - RNA, 19 nt, Human
cuauugauguacagucugu

SEQ ID NO: 2498095 - RNA, 17 nt, Human
cuauugauguacagucu

SEQ ID NO: 2498096 - RNA, 15 nt, Human
cuauugauguacagu

SEQ ID NO: 2498097 - RNA, 16 nt, Human
cuauugacuucaauga

SEQ ID NO: 2498098 - RNA, 14 nt, Human
cuauugacuucaau

SEQ ID NO: 2498099 - RNA, 17 nt, Human
cuauugacaagucauuu

SEQ ID NO: 2498100 - RNA, 21 nt, Human
cuauugauauaaauaaaacau

SEQ ID NO: 2498101 - RNA, 15 nt, Human
cuauaggugcuacaa

SEQ ID NO: 2498102 - RNA, 16 nt, Human
cuagcuagaaauauga

SEQ ID NO: 2498103 - RNA, 15 nt, Human
cuagcuagaaauaug

SEQ ID NO: 2498104 - RNA, 14 nt, Human
cuagcuagaaauau

SEQ ID NO: 2498105 - RNA, 22 nt, Human
cuagcuaauguaauaacuguga

SEQ ID NO: 2498106 - RNA, 16 nt, Human
cuagcgcugccgcacc

SEQ ID NO: 2498107 - RNA, 23 nt, Human
cuagccuuuggcucuggagacag

SEQ ID NO: 2498108 - RNA, 21 nt, Human
cuagccuuuggcucuggagac

SEQ ID NO: 2498109 - RNA, 20 nt, Human
cuagccuuuggcucuggaga

SEQ ID NO: 2498110 - RNA, 19 nt, Human
cuagccuuuggcucuggag

SEQ ID NO: 2498111 - RNA, 18 nt, Human
cuagccuuuggcucugga

SEQ ID NO: 2498112 - RNA, 17 nt, Human
cuagccuuuggcucugg

SEQ ID NO: 2498113 - RNA, 12 nt, Human
cuagcgcugccg

SEQ ID NO: 2498114 - RNA, 22 nt, Human
cuagcgcugccgcaccccagag

SEQ ID NO: 2498115 - RNA, 23 nt, Human
cuagccuuagaagucacacagua

SEQ ID NO: 2498116 - RNA, 22 nt, Human
cuagccuuagaagucacacagu

SEQ ID NO: 2498117 - RNA, 22 nt, Human
cuagccuuauccucugaucucc

SEQ ID NO: 2498118 - RNA, 21 nt, Human
cuagccuuauccucugaucuc

SEQ ID NO: 2498119 - RNA, 19 nt, Human
cuagccuuauccucugauc

SEQ ID NO: 2498120 - RNA, 18 nt, Human
cuagccuuauccucugau

SEQ ID NO: 2498121 - RNA, 22 nt, Human
cuagccuuaaucagguccucag

SEQ ID NO: 2498122 - RNA, 17 nt, Human
cuagccuuauccucuga

SEQ ID NO: 2498123 - RNA, 16 nt, Human
cuagccuuuggcucug

SEQ ID NO: 2498124 - RNA, 15 nt, Human
cuagccuuuggcucu

SEQ ID NO: 2498125 - RNA, 19 nt, Human
cuagccuugaggaguguga

SEQ ID NO: 2498126 - RNA, 21 nt, Human
cuagccuuagaagucacacag

SEQ ID NO: 2498127 - RNA, 22 nt, Human
cuagccugugccucugggacug

SEQ ID NO: 2498128 - RNA, 21 nt, Human
cuagccugugccucugggacu

SEQ ID NO: 2498129 - RNA, 19 nt, Human
cuagccugugccucuggga

SEQ ID NO: 2498130 - RNA, 13 nt, Human
cuagauacuguau

SEQ ID NO: 2498131 - RNA, 16 nt, Human
cuagauacuguaucau

SEQ ID NO: 2498132 - RNA, 24 nt, Human
cuagauacuguaucaugacaaaga

SEQ ID NO: 2498133 - RNA, 21 nt, Human
cuagauaucgacuuguuuuug

SEQ ID NO: 2498134 - RNA, 14 nt, Human
cuagauaucgacuu

SEQ ID NO: 2498135 - RNA, 14 nt, Human
cuagcucgugauug

SEQ ID NO: 2498136 - RNA, 23 nt, Human
cuagcuccccuccucuccccuac

SEQ ID NO: 2498137 - RNA, 19 nt, Human
cuagcucuauguuuacaaa

SEQ ID NO: 2498138 - RNA, 20 nt, Human
cuagcucuauguuuacaaau

SEQ ID NO: 2498139 - RNA, 19 nt, Human
cuagcucugagccaguuca

SEQ ID NO: 2498140 - RNA, 14 nt, Human
cuagcucugagcca

SEQ ID NO: 2498141 - RNA, 23 nt, Human
cuagcucuauguuuacaaaugga

SEQ ID NO: 2498142 - RNA, 16 nt, Human
cuagcugcacagggca

SEQ ID NO: 2498143 - RNA, 20 nt, Human
cuagcucugagccaguucag

SEQ ID NO: 2498144 - RNA, 21 nt, Human
cuagcuagaaauaugauuuua

SEQ ID NO: 2498145 - RNA, 17 nt, Human
cuagcuagaaauaugau

SEQ ID NO: 2498146 - RNA, 19 nt, Human
cuagcuagaagugggccag

SEQ ID NO: 2498147 - RNA, 23 nt, Human
cuagcuagaagugggccaggaca

SEQ ID NO: 2498148 - RNA, 21 nt, Human
cuagcuccccuccucuccccu

SEQ ID NO: 2498149 - RNA, 19 nt, Human
cuagcuccccuccucuccc

SEQ ID NO: 2498150 - RNA, 16 nt, Human
cuagcuccccuccucu

SEQ ID NO: 2498151 - RNA, 15 nt, Human
cuagcuccccuccuc

SEQ ID NO: 2498152 - RNA, 14 nt, Human
cuagcuccccuccu

SEQ ID NO: 2498153 - RNA, 13 nt, Human
cuagcuccccucc

SEQ ID NO: 2498154 - RNA, 10 nt, Human
cuagcucccc

SEQ ID NO: 2498155 - RNA, 22 nt, Human
cuagcuccacacccucucccag

SEQ ID NO: 2498156 - RNA, 14 nt, Human
cuagcugugggggu

SEQ ID NO: 2498157 - RNA, 22 nt, Human
cuagcuggugguuucacggugc

SEQ ID NO: 2498158 - RNA, 17 nt, Human
cuagcuggugguuucac

SEQ ID NO: 2498159 - RNA, 15 nt, Human
cuagcuggugguuuc

SEQ ID NO: 2498160 - RNA, 21 nt, Human
cuagcugggggugggccaggc

SEQ ID NO: 2498161 - RNA, 22 nt, Human
cuagcugggggugggccaggcu

SEQ ID NO: 2498162 - RNA, 18 nt, Human
cuagcugggggugggcca

SEQ ID NO: 2498163 - RNA, 19 nt, Human
cuagcugggggugggccag

SEQ ID NO: 2498164 - RNA, 20 nt, Human
cuagcugggggugggccagg

SEQ ID NO: 2498165 - RNA, 12 nt, Human
cuagcugggggu

SEQ ID NO: 2498166 - RNA, 18 nt, Human
cuagcugcuacaaagaag

SEQ ID NO: 2498167 - RNA, 16 nt, Human
cuagcugcuacaaaga

SEQ ID NO: 2498168 - RNA, 15 nt, Human
cuagcugcuacaaag

SEQ ID NO: 2498169 - RNA, 14 nt, Human
cuagcugcuacaaa

SEQ ID NO: 2498170 - RNA, 21 nt, Human
cuagcugcacagggcagcugg

SEQ ID NO: 2498171 - RNA, 20 nt, Human
cuagcugcacagggcagcug

SEQ ID NO: 2498172 - RNA, 17 nt, Human
cuagcugcacagggcag

SEQ ID NO: 2498173 - RNA, 23 nt, Human
cuagcugcuacaaagaagacaug

SEQ ID NO: 2498174 - RNA, 21 nt, Human
cuagcugcuacaaagaagaca

SEQ ID NO: 2498175 - RNA, 20 nt, Human
cuaggaaauauuuauuuuaa

SEQ ID NO: 2498176 - RNA, 19 nt, Human
cuaggaaauauuuauuuua

SEQ ID NO: 2498177 - RNA, 15 nt, Human
cuaggaaauauuuau

SEQ ID NO: 2498178 - RNA, 14 nt, Human
cuaggaaauauuua

SEQ ID NO: 2498179 - RNA, 12 nt, Human
cuaggaaaauac

SEQ ID NO: 2498180 - RNA, 18 nt, Human
cuagcuuuagacccuggg

SEQ ID NO: 2498181 - RNA, 19 nt, Human
cuagcuuuagacccugggu

SEQ ID NO: 2498182 - RNA, 15 nt, Human
cuagcuuuagacccu

SEQ ID NO: 2498183 - RNA, 23 nt, Human
cuagcuucugcuuuucugcccug

SEQ ID NO: 2498184 - RNA, 20 nt, Human
cuagcuugggaggcuucccc

SEQ ID NO: 2498185 - RNA, 22 nt, Human
cuagcuucugcuuuucugcccu

SEQ ID NO: 2498186 - RNA, 21 nt, Human
cuagcuucugcuuuucugccc

SEQ ID NO: 2498187 - RNA, 18 nt, Human
cuagcuucugcuuuucug

SEQ ID NO: 2498188 - RNA, 16 nt, Human
cuagcuucugcuuuuc

SEQ ID NO: 2498189 - RNA, 15 nt, Human
cuagcuucugcuuuu

SEQ ID NO: 2498190 - RNA, 14 nt, Human
cuagcuucugcuuu

SEQ ID NO: 2498191 - RNA, 13 nt, Human
cuagcuucugcuu

SEQ ID NO: 2498192 - RNA, 22 nt, Human
cuagcuuagagccucccucaau

SEQ ID NO: 2498193 - RNA, 18 nt, Human
cuagcuguugagcuguuu

SEQ ID NO: 2498194 - RNA, 20 nt, Human
cuagcuuagagccucccuca

SEQ ID NO: 2498195 - RNA, 19 nt, Human
cuagcuuagagccucccuc

SEQ ID NO: 2498196 - RNA, 15 nt, Human
cuagcuuagagccuc

SEQ ID NO: 2498197 - RNA, 17 nt, Human
cuaccucagguugcugg

SEQ ID NO: 2498198 - RNA, 15 nt, Human
cuaccucagguugcu

SEQ ID NO: 2498199 - RNA, 14 nt, Human
cuaccucagguugc

SEQ ID NO: 2498200 - RNA, 13 nt, Human
cuaccucagguug

SEQ ID NO: 2498201 - RNA, 12 nt, Human
cuaccucagguu

SEQ ID NO: 2498202 - RNA, 23 nt, Human
cuaccucaggcaggaagggcagg

SEQ ID NO: 2498203 - RNA, 18 nt, Human
cuaccucaggcagcucaa

SEQ ID NO: 2498204 - RNA, 17 nt, Human
cuaccucaggcagcuca

SEQ ID NO: 2498205 - RNA, 14 nt, Human
cuaccucaggcagg

SEQ ID NO: 2498206 - RNA, 20 nt, Human
cuaccucaggcaggaagggc

SEQ ID NO: 2498207 - RNA, 15 nt, Human
cuaccgcucuuggga

SEQ ID NO: 2498208 - RNA, 22 nt, Human
cuaccucacuauucaaguauua

SEQ ID NO: 2498209 - RNA, 17 nt, Human
cuaccucacuggggucc

SEQ ID NO: 2498210 - RNA, 11 nt, Human
cuaccucagcc

SEQ ID NO: 2498211 - RNA, 12 nt, Human
cuaccucagccu

SEQ ID NO: 2498212 - RNA, 14 nt, Human
cuaccucagccuag

SEQ ID NO: 2498213 - RNA, 15 nt, Human
cuaccucagccuaga

SEQ ID NO: 2498214 - RNA, 13 nt, Human
cuaccucaggcag

SEQ ID NO: 2498215 - RNA, 22 nt, Human
cuaccgagucucuucuccacug

SEQ ID NO: 2498216 - RNA, 21 nt, Human
cuaccgagucucuucuccacu

SEQ ID NO: 2498217 - RNA, 23 nt, Human
cuaccgagucucuucuccacugg

SEQ ID NO: 2498218 - RNA, 19 nt, Human
cuacccuuuuucuccagcu

SEQ ID NO: 2498219 - RNA, 18 nt, Human
cuacccuuuuucuccagc

SEQ ID NO: 2498220 - RNA, 18 nt, Human
cuaccgaaaccuugccuu

SEQ ID NO: 2498221 - RNA, 19 nt, Human
cuaccgagucucuucucca

SEQ ID NO: 2498222 - RNA, 17 nt, Human
cuaccgagucucuucuc

SEQ ID NO: 2498223 - RNA, 19 nt, Human
cuacucgaguuacagacaa

SEQ ID NO: 2498224 - RNA, 16 nt, Human
cuacucgaguuacaga

SEQ ID NO: 2498225 - RNA, 15 nt, Human
cuacucgaguuacag

SEQ ID NO: 2498226 - RNA, 18 nt, Human
cuacuccuguaauuccua

SEQ ID NO: 2498227 - RNA, 20 nt, Human
cuacuccucugcagugccuu

SEQ ID NO: 2498228 - RNA, 21 nt, Human
cuacuccucugcagugccuug

SEQ ID NO: 2498229 - RNA, 22 nt, Human
cuaccucagguugcugguugcu

SEQ ID NO: 2498230 - RNA, 20 nt, Human
cuaccucagguugcugguug

SEQ ID NO: 2498231 - RNA, 19 nt, Human
cuaccucagguugcugguu

SEQ ID NO: 2498232 - RNA, 18 nt, Human
cuaccucagguugcuggu

SEQ ID NO: 2498233 - RNA, 14 nt, Human
cuaccuccucaggg

SEQ ID NO: 2498234 - RNA, 15 nt, Human
cuacucccagacacc

SEQ ID NO: 2498235 - RNA, 17 nt, Human
cuacucccagacaccca

SEQ ID NO: 2498236 - RNA, 16 nt, Human
cuacucauuccccggg

SEQ ID NO: 2498237 - RNA, 15 nt, Human
cuaccucagucagua

SEQ ID NO: 2498238 - RNA, 16 nt, Human
cuacuccggagacagg

SEQ ID NO: 2498239 - RNA, 15 nt, Human
cuacuccuaccucag

SEQ ID NO: 2498240 - RNA, 16 nt, Human
cuacuccuaccucagc

SEQ ID NO: 2498241 - RNA, 17 nt, Human
cuacuccuaccucagcc

SEQ ID NO: 2498242 - RNA, 18 nt, Human
cuacuccuaccucagccu

SEQ ID NO: 2498243 - RNA, 15 nt, Human
cuacuccucugcagu

SEQ ID NO: 2498244 - RNA, 14 nt, Human
cuacuccucugcag

SEQ ID NO: 2498245 - RNA, 21 nt, Human
cuacuccuaccucagccuaga

SEQ ID NO: 2498246 - RNA, 18 nt, Human
cuacugggagccuaccca

SEQ ID NO: 2498247 - RNA, 21 nt, Human
cuacuguaauuugugauacaa

SEQ ID NO: 2498248 - RNA, 16 nt, Human
cuacuguaauuuuaua

SEQ ID NO: 2498249 - RNA, 19 nt, Human
cuacuguccuacccacccu

SEQ ID NO: 2498250 - RNA, 17 nt, Human
cuacugcagcuuuacau

SEQ ID NO: 2498251 - RNA, 14 nt, Human
cuacugggagccua

SEQ ID NO: 2498252 - RNA, 15 nt, Human
cuacugggagccuac

SEQ ID NO: 2498253 - RNA, 14 nt, Human
cuacucugugccag

SEQ ID NO: 2498254 - RNA, 17 nt, Human
cuacucuccucggcccc

SEQ ID NO: 2498255 - RNA, 17 nt, Human
cuacucuccucaucucu

SEQ ID NO: 2498256 - RNA, 12 nt, Human
cuacucuccuca

SEQ ID NO: 2498257 - RNA, 13 nt, Human
cuacucuccucau

SEQ ID NO: 2498258 - RNA, 22 nt, Human
cuacucuggagguuuguuuaga

SEQ ID NO: 2498259 - RNA, 18 nt, Human
cuacucucccauggcuua

SEQ ID NO: 2498260 - RNA, 22 nt, Human
cuacucucaggaucaagaaagu

SEQ ID NO: 2498261 - RNA, 12 nt, Human
cuacucuguguc

SEQ ID NO: 2498262 - RNA, 16 nt, Human
cuacugauuguuucau

SEQ ID NO: 2498263 - RNA, 16 nt, Human
cuacugauuuuuguga

SEQ ID NO: 2498264 - RNA, 16 nt, Human
cuacugauuuccuuug

SEQ ID NO: 2498265 - RNA, 17 nt, Human
cuacugauaaagaaaga

SEQ ID NO: 2498266 - RNA, 17 nt, Human
cuacugauuguuucauu

SEQ ID NO: 2498267 - RNA, 14 nt, Human
cuacugcagcuuua

SEQ ID NO: 2498268 - RNA, 22 nt, Human
cuagagaucugguuuugcuauu

SEQ ID NO: 2498269 - RNA, 21 nt, Human
cuagagaucugguuuugcuau

SEQ ID NO: 2498270 - RNA, 15 nt, Human
cuagagcagcccugg

SEQ ID NO: 2498271 - RNA, 13 nt, Human
cuagagagggagg

SEQ ID NO: 2498272 - RNA, 21 nt, Human
cuagagagggaggcaagcccu

SEQ ID NO: 2498273 - RNA, 22 nt, Human
cuagagagggaggcaagcccug

SEQ ID NO: 2498274 - RNA, 23 nt, Human
cuagagagggaggcaagcccugu

SEQ ID NO: 2498275 - RNA, 17 nt, Human
cuagagaucugguuuug

SEQ ID NO: 2498276 - RNA, 17 nt, Human
cuagagauauggcagcg

SEQ ID NO: 2498277 - RNA, 19 nt, Human
cuagagaagaggcuggugc

SEQ ID NO: 2498278 - RNA, 17 nt, Human
cuagagaagaggcuggu

SEQ ID NO: 2498279 - RNA, 20 nt, Human
cuagagacagaagcaggcug

SEQ ID NO: 2498280 - RNA, 15 nt, Human
cuagagacagaagca

SEQ ID NO: 2498281 - RNA, 19 nt, Human
cuagagaauguuagaggau

SEQ ID NO: 2498282 - RNA, 23 nt, Human
cuagagacagaagcaggcuggag

SEQ ID NO: 2498283 - RNA, 22 nt, Human
cuagagacagaagcaggcugga

SEQ ID NO: 2498284 - RNA, 12 nt, Human
cuagagagggag

SEQ ID NO: 2498285 - RNA, 18 nt, Human
cuagaggcuuccuucauu

SEQ ID NO: 2498286 - RNA, 19 nt, Human
cuagaggcuuccuucauuu

SEQ ID NO: 2498287 - RNA, 21 nt, Human
cuagaggcuuccuucauuucc

SEQ ID NO: 2498288 - RNA, 23 nt, Human
cuagaggcuuccuucauuuccuc

SEQ ID NO: 2498289 - RNA, 22 nt, Human
cuagaggccugaggaugagcug

SEQ ID NO: 2498290 - RNA, 20 nt, Human
cuagaggccugaggaugagc

SEQ ID NO: 2498291 - RNA, 18 nt, Human
cuagaggccugaggauga

SEQ ID NO: 2498292 - RNA, 16 nt, Human
cuagaggccugaggau

SEQ ID NO: 2498293 - RNA, 15 nt, Human
cuagaggccugagga

SEQ ID NO: 2498294 - RNA, 13 nt, Human
cuagaggccugag

SEQ ID NO: 2498295 - RNA, 13 nt, Human
cuagagccugccu

SEQ ID NO: 2498296 - RNA, 12 nt, Human
cuagagccugcc

SEQ ID NO: 2498297 - RNA, 11 nt, Human
cuagagccugc

SEQ ID NO: 2498298 - RNA, 17 nt, Human
cuagagcagcccuggag

SEQ ID NO: 2498299 - RNA, 15 nt, Human
cuagagcagggauua

SEQ ID NO: 2498300 - RNA, 14 nt, Human
cuagagcagggauu

SEQ ID NO: 2498301 - RNA, 12 nt, Human
cuagaggccuga

SEQ ID NO: 2498302 - RNA, 23 nt, Human
cuagaggccagccccacccagga

SEQ ID NO: 2498303 - RNA, 14 nt, Human
cuagagccugccug

SEQ ID NO: 2498304 - RNA, 22 nt, Human
cuagaggccagccccacccagg

SEQ ID NO: 2498305 - RNA, 19 nt, Human
cuagaguuuagcuggaaaa

SEQ ID NO: 2498306 - RNA, 18 nt, Human
cuagagugagggccugag

SEQ ID NO: 2498307 - RNA, 17 nt, Human
cuagagugagggccuga

SEQ ID NO: 2498308 - RNA, 16 nt, Human
cuagagugagggccug

SEQ ID NO: 2498309 - RNA, 18 nt, Human
cuagaguuuagcuggaaa

SEQ ID NO: 2498310 - RNA, 15 nt, Human
cuagagguucaaaga

SEQ ID NO: 2498311 - RNA, 18 nt, Human
cuagagguucaaagauau

SEQ ID NO: 2498312 - RNA, 21 nt, Human
cuagagguucaaagauauuuu

SEQ ID NO: 2498313 - RNA, 17 nt, Human
cuagagguucaaagaua

SEQ ID NO: 2498314 - RNA, 22 nt, Human
cuagaggcuugcauaauaagcu

SEQ ID NO: 2498315 - RNA, 14 nt, Human
cuagagggaccucu

SEQ ID NO: 2498316 - RNA, 15 nt, Human
cuagagggaccucuc

SEQ ID NO: 2498317 - RNA, 16 nt, Human
cuagagggaccucucc

SEQ ID NO: 2498318 - RNA, 12 nt, Human
cuagacuuucug

SEQ ID NO: 2498319 - RNA, 15 nt, Human
cuagagaagaggcug

SEQ ID NO: 2498320 - RNA, 12 nt, Human
cuagagaagagg

SEQ ID NO: 2498321 - RNA, 18 nt, Human
cuagagaacgcagcccua

SEQ ID NO: 2498322 - RNA, 17 nt, Human
cuagagaacgcagcccu

SEQ ID NO: 2498323 - RNA, 16 nt, Human
cuagagaacgcagccc

SEQ ID NO: 2498324 - RNA, 15 nt, Human
cuagagaacgcagcc

SEQ ID NO: 2498325 - RNA, 14 nt, Human
cuagacuuucuguu

SEQ ID NO: 2498326 - RNA, 13 nt, Human
cuagacuuucugu

SEQ ID NO: 2498327 - RNA, 17 nt, Human
cuagaaauaugauuuua

SEQ ID NO: 2498328 - RNA, 15 nt, Human
cuagaaauaugauuu

SEQ ID NO: 2498329 - RNA, 13 nt, Human
cuagaaauaugau

SEQ ID NO: 2498330 - RNA, 18 nt, Human
cuagacucccaagcugga

SEQ ID NO: 2498331 - RNA, 14 nt, Human
cuagaaacuuccaa

SEQ ID NO: 2498332 - RNA, 16 nt, Human
cuagaaacuuccaaau

SEQ ID NO: 2498333 - RNA, 22 nt, Human
cuagaaagccuguuccccucac

SEQ ID NO: 2498334 - RNA, 16 nt, Human
cuagaaacagaucuug

SEQ ID NO: 2498335 - RNA, 18 nt, Human
cuacuuuugcaugaaaau

SEQ ID NO: 2498336 - RNA, 17 nt, Human
cuacuuuugcaugaaaa

SEQ ID NO: 2498337 - RNA, 18 nt, Human
cuacuuugucuaaaaaua

SEQ ID NO: 2498338 - RNA, 19 nt, Human
cuacuuaccauaugugcuu

SEQ ID NO: 2498339 - RNA, 17 nt, Human
cuacuuagcaugucccu

SEQ ID NO: 2498340 - RNA, 19 nt, Human
cuacuguaauuuuauauga

SEQ ID NO: 2498341 - RNA, 20 nt, Human
cuacugucucacugaaacau

SEQ ID NO: 2498342 - RNA, 17 nt, Human
cuacuguaauuuuauau

SEQ ID NO: 2498343 - RNA, 20 nt, Human
cuacuguccuacccacccuc

SEQ ID NO: 2498344 - RNA, 22 nt, Human
cuacuuacaugcauuacugcau

SEQ ID NO: 2498345 - RNA, 21 nt, Human
cuacuuaccuaccacaugcca

SEQ ID NO: 2498346 - RNA, 19 nt, Human
cuacuuaauuccuuucuca

SEQ ID NO: 2498347 - RNA, 15 nt, Human
cuacuuaauuccuuu

SEQ ID NO: 2498348 - RNA, 22 nt, Human
cuacuuaauuccuuucucaucc

SEQ ID NO: 2498349 - RNA, 15 nt, Human
cuaaugcgcaggcug

SEQ ID NO: 2498350 - RNA, 16 nt, Human
cuaaugcgcaggcugg

SEQ ID NO: 2498351 - RNA, 19 nt, Human
cuaaugcgcaggcuggccc

SEQ ID NO: 2498352 - RNA, 20 nt, Human
cuaaugcgcaggcuggcccu

SEQ ID NO: 2498353 - RNA, 20 nt, Human
cuaaucagugucucacacug

SEQ ID NO: 2498354 - RNA, 18 nt, Human
cuaaucagugucucacac

SEQ ID NO: 2498355 - RNA, 17 nt, Human
cuaaucagugucucaca

SEQ ID NO: 2498356 - RNA, 16 nt, Human
cuaaucagugucucac

SEQ ID NO: 2498357 - RNA, 15 nt, Human
cuaaucagugucuca

SEQ ID NO: 2498358 - RNA, 13 nt, Human
cuaaucagugucu

SEQ ID NO: 2498359 - RNA, 12 nt, Human
cuaaucaguguc

SEQ ID NO: 2498360 - RNA, 20 nt, Human
cuaaucaggcugaggugucu

SEQ ID NO: 2498361 - RNA, 13 nt, Human
cuaauccaaccca

SEQ ID NO: 2498362 - RNA, 21 nt, Human
cuaaucagugucucacacugg

SEQ ID NO: 2498363 - RNA, 16 nt, Human
cuaaucauccaaugcu

SEQ ID NO: 2498364 - RNA, 15 nt, Human
cuaauccaacccaug

SEQ ID NO: 2498365 - RNA, 21 nt, Human
cuaaucagggaggucauuuug

SEQ ID NO: 2498366 - RNA, 20 nt, Human
cuaaucagggaggucauuuu

SEQ ID NO: 2498367 - RNA, 19 nt, Human
cuaaucagggaggucauuu

SEQ ID NO: 2498368 - RNA, 20 nt, Human
cuaauauggccacaguaguc

SEQ ID NO: 2498369 - RNA, 21 nt, Human
cuaaucagcauucucacuccu

SEQ ID NO: 2498370 - RNA, 20 nt, Human
cuaaucagcauucucacucc

SEQ ID NO: 2498371 - RNA, 13 nt, Human
cuaauauggcaaa

SEQ ID NO: 2498372 - RNA, 18 nt, Human
cuaauauguaacaagcca

SEQ ID NO: 2498373 - RNA, 13 nt, Human
cuaaugggacacu

SEQ ID NO: 2498374 - RNA, 12 nt, Human
cuaaugggacac

SEQ ID NO: 2498375 - RNA, 22 nt, Human
cuaaugcgcaggcuggcccugc

SEQ ID NO: 2498376 - RNA, 23 nt, Human
cuaaugcgcaggcuggcccugcc

SEQ ID NO: 2498377 - RNA, 18 nt, Human
cuaaugccuuacucuucu

SEQ ID NO: 2498378 - RNA, 12 nt, Human
cuaaugcuccuu

SEQ ID NO: 2498379 - RNA, 18 nt, Human
cuaaugcuccuuguuccu

SEQ ID NO: 2498380 - RNA, 23 nt, Human
cuaaugcugcagauuugggcugg

SEQ ID NO: 2498381 - RNA, 19 nt, Human
cuaaugcuccuuguuccua

SEQ ID NO: 2498382 - RNA, 18 nt, Human
cuaauuauauaauauuuu

SEQ ID NO: 2498383 - RNA, 16 nt, Human
cuaauuauauaauauu

SEQ ID NO: 2498384 - RNA, 19 nt, Human
cuaauggguauuuaaacaa

SEQ ID NO: 2498385 - RNA, 22 nt, Human
cuaauuauacccccugcaaagc

SEQ ID NO: 2498386 - RNA, 14 nt, Human
cuaauuagagcaga

SEQ ID NO: 2498387 - RNA, 13 nt, Human
cuaauucauuuau

SEQ ID NO: 2498388 - RNA, 15 nt, Human
cuaauuccacaccuu

SEQ ID NO: 2498389 - RNA, 17 nt, Human
cuaauuccacaccuuuu

SEQ ID NO: 2498390 - RNA, 14 nt, Human
cuaauuccacagcu

SEQ ID NO: 2498391 - RNA, 15 nt, Human
cuaauuccacagcug

SEQ ID NO: 2498392 - RNA, 16 nt, Human
cuaauuccacagcugc

SEQ ID NO: 2498393 - RNA, 14 nt, Human
cuaauucccagagu

SEQ ID NO: 2498394 - RNA, 16 nt, Human
cuaauucccagagugu

SEQ ID NO: 2498395 - RNA, 17 nt, Human
cuaauucccauuuugca

SEQ ID NO: 2498396 - RNA, 18 nt, Human
cuaauucccauuuugcaa

SEQ ID NO: 2498397 - RNA, 19 nt, Human
cuaauucccauuuugcaaa

SEQ ID NO: 2498398 - RNA, 20 nt, Human
cuaauucccauuuugcaaaa

SEQ ID NO: 2498399 - RNA, 21 nt, Human
cuaauucccauuuugcaaaau

SEQ ID NO: 2498400 - RNA, 23 nt, Human
cuacacagucugcaagauucuga

SEQ ID NO: 2498401 - RNA, 21 nt, Human
cuacacagggauguacaaggc

SEQ ID NO: 2498402 - RNA, 14 nt, Human
cuacacagggaugu

SEQ ID NO: 2498403 - RNA, 21 nt, Human
cuacacauauguauuccugau

SEQ ID NO: 2498404 - RNA, 21 nt, Human
cuacacaggggaaaagaggag

SEQ ID NO: 2498405 - RNA, 15 nt, Human
cuaauuccuuucuau

SEQ ID NO: 2498406 - RNA, 21 nt, Human
cuacacacugcauguuuguga

SEQ ID NO: 2498407 - RNA, 22 nt, Human
cuacaccccuccccugcccuag

SEQ ID NO: 2498408 - RNA, 20 nt, Human
cuacacccuuggacuugagg

SEQ ID NO: 2498409 - RNA, 16 nt, Human
cuacacccuuggacuu

SEQ ID NO: 2498410 - RNA, 16 nt, Human
cuacacccuuuuccag

SEQ ID NO: 2498411 - RNA, 14 nt, Human
cuacaccuaacuca

SEQ ID NO: 2498412 - RNA, 13 nt, Human
cuacaccuaacuc

SEQ ID NO: 2498413 - RNA, 18 nt, Human
cuacacccuuuuccagcu

SEQ ID NO: 2498414 - RNA, 12 nt, Human
cuacaccuggcu

SEQ ID NO: 2498415 - RNA, 15 nt, Human
cuacaccuggcugag

SEQ ID NO: 2498416 - RNA, 13 nt, Human
cuacaccuggcug

SEQ ID NO: 2498417 - RNA, 15 nt, Human
cuacaccuuucuccu

SEQ ID NO: 2498418 - RNA, 23 nt, Human
cuacacgagauacagaauuuuau

SEQ ID NO: 2498419 - RNA, 14 nt, Human
cuacacuaagagag

SEQ ID NO: 2498420 - RNA, 13 nt, Human
cuacaccuugagg

SEQ ID NO: 2498421 - RNA, 14 nt, Human
cuacacuccagccu

SEQ ID NO: 2498422 - RNA, 20 nt, Human
cuacaccuuucuccuuugua

SEQ ID NO: 2498423 - RNA, 18 nt, Human
cuacaccuuucuccuuug

SEQ ID NO: 2498424 - RNA, 14 nt, Human
cuaaggacacacua

SEQ ID NO: 2498425 - RNA, 13 nt, Human
cuaaggacacacu

SEQ ID NO: 2498426 - RNA, 12 nt, Human
cuaaggacacac

SEQ ID NO: 2498427 - RNA, 11 nt, Human
cuaaggacaca

SEQ ID NO: 2498428 - RNA, 16 nt, Human
cuaaggacacacuaau

SEQ ID NO: 2498429 - RNA, 16 nt, Human
cuaaggacauuuccca

SEQ ID NO: 2498430 - RNA, 17 nt, Human
cuaaggacauuucccag

SEQ ID NO: 2498431 - RNA, 19 nt, Human
cuaaggacauuucccaggg

SEQ ID NO: 2498432 - RNA, 14 nt, Human
cuaagguucucaua

SEQ ID NO: 2498433 - RNA, 20 nt, Human
cuaaggcguggagcugccug

SEQ ID NO: 2498434 - RNA, 19 nt, Human
cuaaggcguggagcugccu

SEQ ID NO: 2498435 - RNA, 18 nt, Human
cuaaggcguggagcugcc

SEQ ID NO: 2498436 - RNA, 17 nt, Human
cuaaggcguggagcugc

SEQ ID NO: 2498437 - RNA, 22 nt, Human
cuaaggcguggagcugccugau

SEQ ID NO: 2498438 - RNA, 21 nt, Human
cuaaggcguggagcugccuga

SEQ ID NO: 2498439 - RNA, 16 nt, Human
cuaaggcguggagcug

SEQ ID NO: 2498440 - RNA, 19 nt, Human
cuaaggccgaagaaggguc

SEQ ID NO: 2498441 - RNA, 20 nt, Human
cuaagaugacauugcuaaga

SEQ ID NO: 2498442 - RNA, 19 nt, Human
cuaagaugacauugcuaag

SEQ ID NO: 2498443 - RNA, 18 nt, Human
cuaagaugacauugcuaa

SEQ ID NO: 2498444 - RNA, 15 nt, Human
cuaagaugacauugc

SEQ ID NO: 2498445 - RNA, 11 nt, Human
cuaagaugcuc

SEQ ID NO: 2498446 - RNA, 22 nt, Human
cuaagcuauucaguaauaacuc

SEQ ID NO: 2498447 - RNA, 21 nt, Human
cuaagcuucacuguaaaauaa

SEQ ID NO: 2498448 - RNA, 22 nt, Human
cuaagcuuugccagcugcugcu

SEQ ID NO: 2498449 - RNA, 20 nt, Human
cuaagcuuugccagcugcug

SEQ ID NO: 2498450 - RNA, 19 nt, Human
cuaagcuuugccagcugcu

SEQ ID NO: 2498451 - RNA, 22 nt, Human
cuaagcucaaggcgugaggaug

SEQ ID NO: 2498452 - RNA, 14 nt, Human
cuaaguaaaaccac

SEQ ID NO: 2498453 - RNA, 18 nt, Human
cuaaguaaaaccacagca

SEQ ID NO: 2498454 - RNA, 19 nt, Human
cuaaguaaaaccacagcag

SEQ ID NO: 2498455 - RNA, 14 nt, Human
cuaauaaagcugug

SEQ ID NO: 2498456 - RNA, 17 nt, Human
cuaauaccucugugugc

SEQ ID NO: 2498457 - RNA, 16 nt, Human
cuaauaccucugugug

SEQ ID NO: 2498458 - RNA, 15 nt, Human
cuaauaccucugugu

SEQ ID NO: 2498459 - RNA, 13 nt, Human
cuaauaccucugu

SEQ ID NO: 2498460 - RNA, 19 nt, Human
cuaauacagcaacaauuua

SEQ ID NO: 2498461 - RNA, 23 nt, Human
cuaauacagcaacaauuuaugaa

SEQ ID NO: 2498462 - RNA, 18 nt, Human
cuaauaaucauuggauuc

SEQ ID NO: 2498463 - RNA, 12 nt, Human
cuaauacaccag

SEQ ID NO: 2498464 - RNA, 19 nt, Human
cuaauagacaauuuauuau

SEQ ID NO: 2498465 - RNA, 23 nt, Human
cuaauagacaauuuauuauggca

SEQ ID NO: 2498466 - RNA, 17 nt, Human
cuaauagacaauuuauu

SEQ ID NO: 2498467 - RNA, 20 nt, Human
cuaauagaacucaguuuuaa

SEQ ID NO: 2498468 - RNA, 13 nt, Human
cuaauagaacuca

SEQ ID NO: 2498469 - RNA, 11 nt, Human
cuaauauauuu

SEQ ID NO: 2498470 - RNA, 21 nt, Human
cuaauauauuuuuauauuuag

SEQ ID NO: 2498471 - RNA, 12 nt, Human
cuaauauauuuu

SEQ ID NO: 2498472 - RNA, 12 nt, Human
cuaauaucagca

SEQ ID NO: 2498473 - RNA, 15 nt, Human
cuaauauauuuuuau

SEQ ID NO: 2498474 - RNA, 23 nt, Human
cuaauaguuuuauuaauaaacau

SEQ ID NO: 2498475 - RNA, 22 nt, Human
cuaauauaaguuucuuugcuuc

SEQ ID NO: 2498476 - RNA, 17 nt, Human
cuaauauacaggguagc

SEQ ID NO: 2498477 - RNA, 23 nt, Human
cuaauagcggguuacuuucacau

SEQ ID NO: 2498478 - RNA, 13 nt, Human
cguuuucaaaauu

SEQ ID NO: 2498479 - RNA, 14 nt, Human
cuaaauugaauaau

SEQ ID NO: 2498480 - RNA, 13 nt, Human
cuaaauugaauaa

SEQ ID NO: 2498481 - RNA, 12 nt, Human
cuaaauugaaua

SEQ ID NO: 2498482 - RNA, 17 nt, Human
cuaaauugaaaccugga

SEQ ID NO: 2498483 - RNA, 19 nt, Human
cuaaauugacacuuaaaaa

SEQ ID NO: 2498484 - RNA, 16 nt, Human
cuaaauucaugcugcu

SEQ ID NO: 2498485 - RNA, 14 nt, Human
cuaaauuccacacu

SEQ ID NO: 2498486 - RNA, 14 nt, Human
cuaaaugaauguuu

SEQ ID NO: 2498487 - RNA, 12 nt, Human
cuaaaugaaugu

SEQ ID NO: 2498488 - RNA, 13 nt, Human
cuaaaugaagugc

SEQ ID NO: 2498489 - RNA, 17 nt, Human
cuaacagcucaggaucu

SEQ ID NO: 2498490 - RNA, 23 nt, Human
cuaacauauaauguuguuauuua

SEQ ID NO: 2498491 - RNA, 22 nt, Human
cuaacauauaauguuguuauuu

SEQ ID NO: 2498492 - RNA, 12 nt, Human
cuaacauauaau

SEQ ID NO: 2498493 - RNA, 22 nt, Human
cuaacaagucauagguuaauau

SEQ ID NO: 2498494 - RNA, 17 nt, Human
cuaacacuggccccuag

SEQ ID NO: 2498495 - RNA, 18 nt, Human
cuaacagauaagcaagag

SEQ ID NO: 2498496 - RNA, 16 nt, Human
cuaacacuggccccua

SEQ ID NO: 2498497 - RNA, 17 nt, Human
cuaacagauaagcaaga

SEQ ID NO: 2498498 - RNA, 21 nt, Human
cuaacauuuuaaauaaaagaa

SEQ ID NO: 2498499 - RNA, 18 nt, Human
cuaacauuuuaaauaaaa

SEQ ID NO: 2498500 - RNA, 12 nt, Human
cuaacaucagaa

SEQ ID NO: 2498501 - RNA, 14 nt, Human
cuaaccacgcugga

SEQ ID NO: 2498502 - RNA, 12 nt, Human
cuaaccacgcug

SEQ ID NO: 2498503 - RNA, 15 nt, Human
cuaaccccaggcccc

SEQ ID NO: 2498504 - RNA, 13 nt, Human
cuaaccccaggcc

SEQ ID NO: 2498505 - RNA, 13 nt, Human
cuaaccacaucaa

SEQ ID NO: 2498506 - RNA, 16 nt, Human
cuaaccccaggccccg

SEQ ID NO: 2498507 - RNA, 16 nt, Human
cuaaccccgggcgggu

SEQ ID NO: 2498508 - RNA, 13 nt, Human
cuaaccccuuucc

SEQ ID NO: 2498509 - RNA, 14 nt, Human
cuaaccccuuuccu

SEQ ID NO: 2498510 - RNA, 16 nt, Human
cuaaccccuuuccugc

SEQ ID NO: 2498511 - RNA, 15 nt, Human
cuaaccucaucuucu

SEQ ID NO: 2498512 - RNA, 19 nt, Human
cuaacccuuaucaccagcu

SEQ ID NO: 2498513 - RNA, 20 nt, Human
cuaacccucccauggcaccu

SEQ ID NO: 2498514 - RNA, 21 nt, Human
cuaacccucagaaacacuggg

SEQ ID NO: 2498515 - RNA, 12 nt, Human
cuaaccucaucu

SEQ ID NO: 2498516 - RNA, 15 nt, Human
cuaagagagaaugag

SEQ ID NO: 2498517 - RNA, 14 nt, Human
cuaagagagaauga

SEQ ID NO: 2498518 - RNA, 14 nt, Human
cuaagagagagaga

SEQ ID NO: 2498519 - RNA, 22 nt, Human
cuaagagaaguuauuuucuaca

SEQ ID NO: 2498520 - RNA, 21 nt, Human
cuaaccugaccgugggcgggg

SEQ ID NO: 2498521 - RNA, 11 nt, Human
cuaaccugacc

SEQ ID NO: 2498522 - RNA, 19 nt, Human
cuaagagaaguuauuuucu

SEQ ID NO: 2498523 - RNA, 11 nt, Human
cuaagagccau

SEQ ID NO: 2498524 - RNA, 20 nt, Human
cuaagagccauuuaggggcc

SEQ ID NO: 2498525 - RNA, 16 nt, Human
cuaagagcuagcgcug

SEQ ID NO: 2498526 - RNA, 18 nt, Human
cuaagagcuagcgcugcc

SEQ ID NO: 2498527 - RNA, 22 nt, Human
cuaagagggagggagggcucca

SEQ ID NO: 2498528 - RNA, 15 nt, Human
cuaagagggagggag

SEQ ID NO: 2498529 - RNA, 13 nt, Human
cuaagagggaggg

SEQ ID NO: 2498530 - RNA, 13 nt, Human
cuaagagcucccg

SEQ ID NO: 2498531 - RNA, 19 nt, Human
cuaagagcuagcgcugccg

SEQ ID NO: 2498532 - RNA, 20 nt, Human
cuaagagcuagcgcugccgc

SEQ ID NO: 2498533 - RNA, 23 nt, Human
cuaagagggagggagggcuccag

SEQ ID NO: 2498534 - RNA, 16 nt, Human
cuaagauaguaacaau

SEQ ID NO: 2498535 - RNA, 22 nt, Human
cuaagagugcugggcauuuuua

SEQ ID NO: 2498536 - RNA, 12 nt, Human
cuaagagugucc

SEQ ID NO: 2498537 - RNA, 12 nt, Human
cuaagaugacau

SEQ ID NO: 2498538 - RNA, 21 nt, Human
cuaagaguugagcucucggaa

SEQ ID NO: 2498539 - RNA, 18 nt, Human
cuaagaguugagcucucg

SEQ ID NO: 2498540 - RNA, 18 nt, Human
cuaagaguguccuaggag

SEQ ID NO: 2498541 - RNA, 24 nt, Human
cuaaaguuuacaguaaauaaauug

SEQ ID NO: 2498542 - RNA, 11 nt, Human
cuaaacugcau

SEQ ID NO: 2498543 - RNA, 21 nt, Human
cuaaacugcccccucugcccu

SEQ ID NO: 2498544 - RNA, 21 nt, Human
cuaaaguuuacaguaaauaaa

SEQ ID NO: 2498545 - RNA, 20 nt, Human
cuaaauaaaauuuguugcau

SEQ ID NO: 2498546 - RNA, 15 nt, Human
cuaaauaaaauuugu

SEQ ID NO: 2498547 - RNA, 23 nt, Human
cuaaauaaagcuugcaacaaaau

SEQ ID NO: 2498548 - RNA, 14 nt, Human
cuaaauagcaugua

SEQ ID NO: 2498549 - RNA, 24 nt, Human
cuaaauaccugcccugacaugcac

SEQ ID NO: 2498550 - RNA, 21 nt, Human
cuaaaucuccaaaauaaaacu

SEQ ID NO: 2498551 - RNA, 22 nt, Human
cuaaaugaaaaucgugacaaca

SEQ ID NO: 2498552 - RNA, 22 nt, Human
cuaaauagcauguauugugucu

SEQ ID NO: 2498553 - RNA, 20 nt, Human
cuaaauagcauguauugugu

SEQ ID NO: 2498554 - RNA, 17 nt, Human
cuaaauagcauguauug

SEQ ID NO: 2498555 - RNA, 15 nt, Human
cuaaauagcauguau

SEQ ID NO: 2498556 - RNA, 15 nt, Human
cuaaaucucuaauau

SEQ ID NO: 2498557 - RNA, 23 nt, Human
cuaaauagcauguauugugucuu

SEQ ID NO: 2498558 - RNA, 15 nt, Human
cuaaacuaucuuuuu

SEQ ID NO: 2498559 - RNA, 14 nt, Human
cuaaacuaucuuuu

SEQ ID NO: 2498560 - RNA, 14 nt, Human
cuaaacucauuuau

SEQ ID NO: 2498561 - RNA, 15 nt, Human
cuaaacucauuuaua

SEQ ID NO: 2498562 - RNA, 22 nt, Human
cuaaacucucuuugggaauguu

SEQ ID NO: 2498563 - RNA, 17 nt, Human
cuaaacucauuuauaaa

SEQ ID NO: 2498564 - RNA, 22 nt, Human
cuaaacucauuuauaaagcuaa

SEQ ID NO: 2498565 - RNA, 12 nt, Human
cuaaacugcccc

SEQ ID NO: 2498566 - RNA, 13 nt, Human
cuaaacugccccc

SEQ ID NO: 2498567 - RNA, 22 nt, Human
cuaaaaugccucaguguauuug

SEQ ID NO: 2498568 - RNA, 23 nt, Human
cuaaaaugauuuuaucugugaau

SEQ ID NO: 2498569 - RNA, 14 nt, Human
cuaaaaugauuuua

SEQ ID NO: 2498570 - RNA, 15 nt, Human
cuaaaauauuuauuu

SEQ ID NO: 2498571 - RNA, 23 nt, Human
cuaaaauauuuauuuuuuuuaag

SEQ ID NO: 2498572 - RNA, 14 nt, Human
cuaaaauauuuauu

SEQ ID NO: 2498573 - RNA, 19 nt, Human
cuaaaauagccacuuaccu

SEQ ID NO: 2498574 - RNA, 13 nt, Human
cuaaaauagccac

SEQ ID NO: 2498575 - RNA, 18 nt, Human
cgggacaccugcccugcc

SEQ ID NO: 2498576 - RNA, 14 nt, Human
cgggaccuguggcu

SEQ ID NO: 2498577 - RNA, 13 nt, Human
cgggaccuguggc

SEQ ID NO: 2498578 - RNA, 13 nt, Human
cgggaccuggugc

SEQ ID NO: 2498579 - RNA, 23 nt, Human
cgggaccccgagccuggcuccaa

SEQ ID NO: 2498580 - RNA, 20 nt, Human
cgggaggcagagguugcagu

SEQ ID NO: 2498581 - RNA, 15 nt, Human
cguuuguaugugugu

SEQ ID NO: 2498582 - RNA, 14 nt, Human
cguuuguaugugug

SEQ ID NO: 2498583 - RNA, 20 nt, Human
cguuuguuccccaagacauu

SEQ ID NO: 2498584 - RNA, 21 nt, Human
cgggacgagacccuacaggag

SEQ ID NO: 2498585 - RNA, 22 nt, Human
cgggaggcagagguugcagugu

SEQ ID NO: 2498586 - RNA, 21 nt, Human
cgggaggauguucugggacac

SEQ ID NO: 2498587 - RNA, 23 nt, Human
cgggaggauguucugggacacag

SEQ ID NO: 2498588 - RNA, 12 nt, Human
cguuuuauugug

SEQ ID NO: 2498589 - RNA, 18 nt, Human
cuaaaaaaaaaaaaguau

SEQ ID NO: 2498590 - RNA, 20 nt, Human
cuaaaaaaaaaaaaguauua

SEQ ID NO: 2498591 - RNA, 14 nt, Human
cguuuuauuguguu

SEQ ID NO: 2498592 - RNA, 18 nt, Human
cguuuuauuguguuuuua

SEQ ID NO: 2498593 - RNA, 11 nt, Human
cuaaaaaacag

SEQ ID NO: 2498594 - RNA, 21 nt, Human
cuaaaaagaaggaaaaugauc

SEQ ID NO: 2498595 - RNA, 22 nt, Human
cuaaaaaagauauauuaaaaau

SEQ ID NO: 2498596 - RNA, 21 nt, Human
cguuugagaagaaaacaucua

SEQ ID NO: 2498597 - RNA, 19 nt, Human
cuaaaaaagauauauuaaa

SEQ ID NO: 2498598 - RNA, 15 nt, Human
cuaaaaaagauauau

SEQ ID NO: 2498599 - RNA, 13 nt, Human
cuaaaaaagauau

SEQ ID NO: 2498600 - RNA, 11 nt, Human
cuaaaaaagau

SEQ ID NO: 2498601 - RNA, 17 nt, Human
cuaaaaaacagaggcca

SEQ ID NO: 2498602 - RNA, 22 nt, Human
cuaaaaaacauaaauuucuuua

SEQ ID NO: 2498603 - RNA, 22 nt, Human
cuaaaauaagggcagagucaca

SEQ ID NO: 2498604 - RNA, 20 nt, Human
cuaaaagugggcuugauucu

SEQ ID NO: 2498605 - RNA, 11 nt, Human
cuaaaaauaaa

SEQ ID NO: 2498606 - RNA, 23 nt, Human
cuaaaagugggcuugauucugca

SEQ ID NO: 2498607 - RNA, 21 nt, Human
cuaaaaauagacuuaaaucuc

SEQ ID NO: 2498608 - RNA, 22 nt, Human
cuaggaaauauuuauuuuaaua

SEQ ID NO: 2498609 - RNA, 18 nt, Human
cuaccaauagauucccca

SEQ ID NO: 2498610 - RNA, 15 nt, Human
cuaccaaagcaccuu

SEQ ID NO: 2498611 - RNA, 19 nt, Human
cuaccaagcuauccuggcu

SEQ ID NO: 2498612 - RNA, 13 nt, Human
cuaccaaugcaug

SEQ ID NO: 2498613 - RNA, 15 nt, Human
cuaccaaugcaugca

SEQ ID NO: 2498614 - RNA, 14 nt, Human
cuaccaaugcaugc

SEQ ID NO: 2498615 - RNA, 13 nt, Human
cuaccacaguguc

SEQ ID NO: 2498616 - RNA, 14 nt, Human
cuaccacagugucu

SEQ ID NO: 2498617 - RNA, 14 nt, Human
cuaccaccccuucc

SEQ ID NO: 2498618 - RNA, 18 nt, Human
cuaccacaugccaagcac

SEQ ID NO: 2498619 - RNA, 15 nt, Human
cuaccacagugucug

SEQ ID NO: 2498620 - RNA, 18 nt, Human
cuaccauccccuguagag

SEQ ID NO: 2498621 - RNA, 18 nt, Human
cuaccaccccuuccuguc

SEQ ID NO: 2498622 - RNA, 17 nt, Human
cuaccaccccuuccugu

SEQ ID NO: 2498623 - RNA, 16 nt, Human
cuaccaccccuuccug

SEQ ID NO: 2498624 - RNA, 22 nt, Human
cuaccaccccuuccugucccac

SEQ ID NO: 2498625 - RNA, 11 nt, Human
cuaccaccucc

SEQ ID NO: 2498626 - RNA, 14 nt, Human
cuaccaccucccca

SEQ ID NO: 2498627 - RNA, 15 nt, Human
cuaccaccuccccag

SEQ ID NO: 2498628 - RNA, 12 nt, Human
cuaccauuucag

SEQ ID NO: 2498629 - RNA, 13 nt, Human
cuaccauuucaga

SEQ ID NO: 2498630 - RNA, 20 nt, Human
cuaccauuugcagaguccug

SEQ ID NO: 2498631 - RNA, 12 nt, Human
cuacccaaagga

SEQ ID NO: 2498632 - RNA, 16 nt, Human
cuaccaccuccccagc

SEQ ID NO: 2498633 - RNA, 17 nt, Human
cuaccaccuccccagcc

SEQ ID NO: 2498634 - RNA, 13 nt, Human
cuaccauucagug

SEQ ID NO: 2498635 - RNA, 19 nt, Human
cuaccaugaacagaaaaca

SEQ ID NO: 2498636 - RNA, 13 nt, Human
cuacauucuguua

SEQ ID NO: 2498637 - RNA, 14 nt, Human
cuacauucuguuaa

SEQ ID NO: 2498638 - RNA, 14 nt, Human
cuaccaaagcaccu

SEQ ID NO: 2498639 - RNA, 12 nt, Human
cuacauucauuu

SEQ ID NO: 2498640 - RNA, 22 nt, Human
cuacauuauaaaugucucuuua

SEQ ID NO: 2498641 - RNA, 17 nt, Human
cuacaugugggagcuuu

SEQ ID NO: 2498642 - RNA, 13 nt, Human
cuacauguauugc

SEQ ID NO: 2498643 - RNA, 23 nt, Human
cuacaugguugaaaccccaucuc

SEQ ID NO: 2498644 - RNA, 17 nt, Human
cuacaugcuuugugaac

SEQ ID NO: 2498645 - RNA, 21 nt, Human
cuacauguauugcacauugua

SEQ ID NO: 2498646 - RNA, 18 nt, Human
cuacauguauugcacauu

SEQ ID NO: 2498647 - RNA, 22 nt, Human
cuacauguauugcacauuguaa

SEQ ID NO: 2498648 - RNA, 16 nt, Human
cuacaugugggagcuu

SEQ ID NO: 2498649 - RNA, 17 nt, Human
cuacccagcgagcccug

SEQ ID NO: 2498650 - RNA, 15 nt, Human
cuacccagcgagccc

SEQ ID NO: 2498651 - RNA, 20 nt, Human
cuacccacaccucugccaga

SEQ ID NO: 2498652 - RNA, 19 nt, Human
cuacccacaccucugccag

SEQ ID NO: 2498653 - RNA, 18 nt, Human
cuacccacaccucugcca

SEQ ID NO: 2498654 - RNA, 16 nt, Human
cuacccacaccucugc

SEQ ID NO: 2498655 - RNA, 16 nt, Human
cuacccaaccacucaa

SEQ ID NO: 2498656 - RNA, 15 nt, Human
cuacccaaccacuca

SEQ ID NO: 2498657 - RNA, 14 nt, Human
cuacccaaccacuc

SEQ ID NO: 2498658 - RNA, 13 nt, Human
cuacccaaccacu

SEQ ID NO: 2498659 - RNA, 13 nt, Human
cuacccacccucc

SEQ ID NO: 2498660 - RNA, 21 nt, Human
cuacccagagaagccccuucc

SEQ ID NO: 2498661 - RNA, 13 nt, Human
cuacccaggugcu

SEQ ID NO: 2498662 - RNA, 18 nt, Human
cuacccagcgagcccugg

SEQ ID NO: 2498663 - RNA, 15 nt, Human
cuacccauccccgca

SEQ ID NO: 2498664 - RNA, 16 nt, Human
cuaccccaauuccuug

SEQ ID NO: 2498665 - RNA, 13 nt, Human
cuacccauccccg

SEQ ID NO: 2498666 - RNA, 21 nt, Human
cuaccccacaccaggccgucc

SEQ ID NO: 2498667 - RNA, 17 nt, Human
cuaccccacaccaggcc

SEQ ID NO: 2498668 - RNA, 12 nt, Human
cuaccccacacc

SEQ ID NO: 2498669 - RNA, 17 nt, Human
cuaccccaauuccuugu

SEQ ID NO: 2498670 - RNA, 13 nt, Human
cuaccccaccacg

SEQ ID NO: 2498671 - RNA, 14 nt, Human
cuaccccaccacga

SEQ ID NO: 2498672 - RNA, 16 nt, Human
cuacccuuuuucucca

SEQ ID NO: 2498673 - RNA, 18 nt, Human
cuacccugagcugaggca

SEQ ID NO: 2498674 - RNA, 23 nt, Human
cuacccucgggcccaccuggcca

SEQ ID NO: 2498675 - RNA, 12 nt, Human
cuacccugagcu

SEQ ID NO: 2498676 - RNA, 17 nt, Human
cuacccugagcugaggc

SEQ ID NO: 2498677 - RNA, 22 nt, Human
cuacccucgggcccaccuggcc

SEQ ID NO: 2498678 - RNA, 20 nt, Human
cuacccucgggcccaccugg

SEQ ID NO: 2498679 - RNA, 19 nt, Human
cuacccucgggcccaccug

SEQ ID NO: 2498680 - RNA, 17 nt, Human
cuacccucgggcccacc

SEQ ID NO: 2498681 - RNA, 16 nt, Human
cuacccucgggcccac

SEQ ID NO: 2498682 - RNA, 15 nt, Human
cuacccucgggccca

SEQ ID NO: 2498683 - RNA, 23 nt, Human
cuacccucccugcuguccccucu

SEQ ID NO: 2498684 - RNA, 17 nt, Human
cuacccucuuagaaaaa

SEQ ID NO: 2498685 - RNA, 13 nt, Human
cuacccucccacc

SEQ ID NO: 2498686 - RNA, 14 nt, Human
cuacccucccaccc

SEQ ID NO: 2498687 - RNA, 16 nt, Human
cuacccucccaccccc

SEQ ID NO: 2498688 - RNA, 19 nt, Human
cuacccucccacccccuuc

SEQ ID NO: 2498689 - RNA, 20 nt, Human
cuacccucccugcugucccc

SEQ ID NO: 2498690 - RNA, 18 nt, Human
cuacccucccugcugucc

SEQ ID NO: 2498691 - RNA, 16 nt, Human
cuacccucccugcugu

SEQ ID NO: 2498692 - RNA, 15 nt, Human
cuacccucccugcug

SEQ ID NO: 2498693 - RNA, 14 nt, Human
cuacccucccugcu

SEQ ID NO: 2498694 - RNA, 13 nt, Human
cuacccucccugc

SEQ ID NO: 2498695 - RNA, 14 nt, Human
cuacccucccccag

SEQ ID NO: 2498696 - RNA, 19 nt, Human
cuacccccuccucucugcc

SEQ ID NO: 2498697 - RNA, 17 nt, Human
cuacccccuccucucug

SEQ ID NO: 2498698 - RNA, 15 nt, Human
cuacccccuccucuc

SEQ ID NO: 2498699 - RNA, 19 nt, Human
cuacccccaggguugaggg

SEQ ID NO: 2498700 - RNA, 17 nt, Human
cuacccccuaagagcca

SEQ ID NO: 2498701 - RNA, 18 nt, Human
cuacccuagccauuccug

SEQ ID NO: 2498702 - RNA, 12 nt, Human
cuacccucccac

SEQ ID NO: 2498703 - RNA, 19 nt, Human
cuacccuagccauuccugg

SEQ ID NO: 2498704 - RNA, 20 nt, Human
cuacagaggccaugggccuc

SEQ ID NO: 2498705 - RNA, 18 nt, Human
cuacagaggccaugggcc

SEQ ID NO: 2498706 - RNA, 22 nt, Human
cuacagaggccaugggccuccu

SEQ ID NO: 2498707 - RNA, 20 nt, Human
cuacagaggucucugccggc

SEQ ID NO: 2498708 - RNA, 20 nt, Human
cuacacugugaacuugggga

SEQ ID NO: 2498709 - RNA, 16 nt, Human
cuacacugacacuggu

SEQ ID NO: 2498710 - RNA, 15 nt, Human
cuacacugacacugg

SEQ ID NO: 2498711 - RNA, 14 nt, Human
cuacacugugcuga

SEQ ID NO: 2498712 - RNA, 13 nt, Human
cuacacugugcug

SEQ ID NO: 2498713 - RNA, 17 nt, Human
cuacacugugcugaguc

SEQ ID NO: 2498714 - RNA, 17 nt, Human
cuacagaggccaugggc

SEQ ID NO: 2498715 - RNA, 22 nt, Human
cuacagcuugaccgugaggcca

SEQ ID NO: 2498716 - RNA, 19 nt, Human
cuacagcuugaccgugagg

SEQ ID NO: 2498717 - RNA, 18 nt, Human
cuacagcuuugugacugu

SEQ ID NO: 2498718 - RNA, 19 nt, Human
cuacagcuuugaucccuga

SEQ ID NO: 2498719 - RNA, 23 nt, Human
cuacagcuugaccgugaggccag

SEQ ID NO: 2498720 - RNA, 19 nt, Human
cuacagcuaaucagcauuc

SEQ ID NO: 2498721 - RNA, 18 nt, Human
cuacagcuaaucagcauu

SEQ ID NO: 2498722 - RNA, 14 nt, Human
cuacagauagucaa

SEQ ID NO: 2498723 - RNA, 23 nt, Human
cuacagaggucucugccggcucu

SEQ ID NO: 2498724 - RNA, 15 nt, Human
cuacagauagucaaa

SEQ ID NO: 2498725 - RNA, 22 nt, Human
cuacagcuaaucagcauucuca

SEQ ID NO: 2498726 - RNA, 21 nt, Human
cuacagcuaaucagcauucuc

SEQ ID NO: 2498727 - RNA, 16 nt, Human
cuacaggagugagcac

SEQ ID NO: 2498728 - RNA, 15 nt, Human
cuacaggagugagca

SEQ ID NO: 2498729 - RNA, 14 nt, Human
cuacaggagugagc

SEQ ID NO: 2498730 - RNA, 18 nt, Human
cuacaggaagcaccccau

SEQ ID NO: 2498731 - RNA, 20 nt, Human
cuacaggaagcaccccaugc

SEQ ID NO: 2498732 - RNA, 22 nt, Human
cuacaggaagcaccccaugcca

SEQ ID NO: 2498733 - RNA, 22 nt, Human
cuacagcuuugugacuguauau

SEQ ID NO: 2498734 - RNA, 18 nt, Human
cuacaggagagggaagag

SEQ ID NO: 2498735 - RNA, 17 nt, Human
cuacaggcacccaccau

SEQ ID NO: 2498736 - RNA, 15 nt, Human
cuacaggcacccacc

SEQ ID NO: 2498737 - RNA, 22 nt, Human
cuacaggcacacgccaccucgc

SEQ ID NO: 2498738 - RNA, 21 nt, Human
cuacaggagagggaagagugc

SEQ ID NO: 2498739 - RNA, 18 nt, Human
cuacaggggaagguggcc

SEQ ID NO: 2498740 - RNA, 22 nt, Human
cuacaggggaagguggccucug

SEQ ID NO: 2498741 - RNA, 14 nt, Human
cuacagucaggaaa

SEQ ID NO: 2498742 - RNA, 15 nt, Human
cuacagucaggaaag

SEQ ID NO: 2498743 - RNA, 18 nt, Human
cuacagucaggaaaggaa

SEQ ID NO: 2498744 - RNA, 21 nt, Human
cuacagucaggaaaggaauca

SEQ ID NO: 2498745 - RNA, 13 nt, Human
cuacaguccuccc

SEQ ID NO: 2498746 - RNA, 18 nt, Human
cuacauggaguauauguc

SEQ ID NO: 2498747 - RNA, 20 nt, Human
cuacauggaguauaugucaa

SEQ ID NO: 2498748 - RNA, 14 nt, Human
cuacaggugugagu

SEQ ID NO: 2498749 - RNA, 16 nt, Human
cuacaggugugaguca

SEQ ID NO: 2498750 - RNA, 18 nt, Human
cuacagguuacaacagau

SEQ ID NO: 2498751 - RNA, 17 nt, Human
cuacagguuacaacaga

SEQ ID NO: 2498752 - RNA, 14 nt, Human
cuacagguuacaac

SEQ ID NO: 2498753 - RNA, 11 nt, Human
cuacagguuac

SEQ ID NO: 2498754 - RNA, 20 nt, Human
cuacagguuacaacagauuu

SEQ ID NO: 2498755 - RNA, 22 nt, Human
ccugccuguugggccaggagcc

SEQ ID NO: 2498756 - RNA, 14 nt, Human
ccugccuguugggc

SEQ ID NO: 2498757 - RNA, 22 nt, Human
ccugccuguucccauucuugca

SEQ ID NO: 2498758 - RNA, 22 nt, Human
ccugccugucugucucuccauc

SEQ ID NO: 2498759 - RNA, 16 nt, Human
ccugccuguagcccac

SEQ ID NO: 2498760 - RNA, 17 nt, Human
ccugccgcagagcuggc

SEQ ID NO: 2498761 - RNA, 18 nt, Human
ccugccugucugucucuc

SEQ ID NO: 2498762 - RNA, 17 nt, Human
ccugccugucugucucu

SEQ ID NO: 2498763 - RNA, 13 nt, Human
ccugccugucugu

SEQ ID NO: 2498764 - RNA, 13 nt, Human
ccugccugucucc

SEQ ID NO: 2498765 - RNA, 14 nt, Human
ccugccugucuccu

SEQ ID NO: 2498766 - RNA, 12 nt, Human
ccugccugucug

SEQ ID NO: 2498767 - RNA, 15 nt, Human
ccugccugucuccuu

SEQ ID NO: 2498768 - RNA, 16 nt, Human
ccugccgcagagcugg

SEQ ID NO: 2498769 - RNA, 15 nt, Human
ccugccgcagagcug

SEQ ID NO: 2498770 - RNA, 14 nt, Human
ccugccgcagagcu

SEQ ID NO: 2498771 - RNA, 13 nt, Human
ccugccgcagagc

SEQ ID NO: 2498772 - RNA, 12 nt, Human
ccugccucagcc

SEQ ID NO: 2498773 - RNA, 14 nt, Human
ccugccucagccuc

SEQ ID NO: 2498774 - RNA, 13 nt, Human
ccugccucagccu

SEQ ID NO: 2498775 - RNA, 22 nt, Human
ccugcccuuaccugccaggaag

SEQ ID NO: 2498776 - RNA, 21 nt, Human
ccugcccuuaccugccaggaa

SEQ ID NO: 2498777 - RNA, 19 nt, Human
ccugcccuuaccugccagg

SEQ ID NO: 2498778 - RNA, 15 nt, Human
ccugcccugugggcc

SEQ ID NO: 2498779 - RNA, 16 nt, Human
ccugccgacuccuggg

SEQ ID NO: 2498780 - RNA, 14 nt, Human
ccugccgacuccug

SEQ ID NO: 2498781 - RNA, 17 nt, Human
ccugcccuugucugaga

SEQ ID NO: 2498782 - RNA, 16 nt, Human
ccugcccuugucugag

SEQ ID NO: 2498783 - RNA, 18 nt, Human
ccugccgaccucguccuc

SEQ ID NO: 2498784 - RNA, 15 nt, Human
ccugcccuuguccca

SEQ ID NO: 2498785 - RNA, 16 nt, Human
ccugcccuugucccac

SEQ ID NO: 2498786 - RNA, 13 nt, Human
ccugcccuugucu

SEQ ID NO: 2498787 - RNA, 19 nt, Human
ccugcccuugucccacuca

SEQ ID NO: 2498788 - RNA, 21 nt, Human
ccugcccuguuguguauagau

SEQ ID NO: 2498789 - RNA, 19 nt, Human
ccugcccugguuuccugcc

SEQ ID NO: 2498790 - RNA, 20 nt, Human
ccugcccugguuuccugccc

SEQ ID NO: 2498791 - RNA, 21 nt, Human
ccugcccugguuuccugcccu

SEQ ID NO: 2498792 - RNA, 22 nt, Human
ccugcccugguuuccugcccug

SEQ ID NO: 2498793 - RNA, 20 nt, Human
ccugcccugggaggcaguga

SEQ ID NO: 2498794 - RNA, 22 nt, Human
ccugcccugggaggcagugaug

SEQ ID NO: 2498795 - RNA, 14 nt, Human
ccugcccugguuuc

SEQ ID NO: 2498796 - RNA, 20 nt, Human
ccugcccugcugccgccucc

SEQ ID NO: 2498797 - RNA, 12 nt, Human
ccugcccugguc

SEQ ID NO: 2498798 - RNA, 14 nt, Human
ccugcccugugggc

SEQ ID NO: 2498799 - RNA, 12 nt, Human
ccugcccugugg

SEQ ID NO: 2498800 - RNA, 11 nt, Human
ccugcccugug

SEQ ID NO: 2498801 - RNA, 23 nt, Human
ccugcccugguuuccugcccugg

SEQ ID NO: 2498802 - RNA, 15 nt, Human
ccugcccugguccag

SEQ ID NO: 2498803 - RNA, 10 nt, Human
ccugcccugg

SEQ ID NO: 2498804 - RNA, 12 nt, Human
ccugcccuggga

SEQ ID NO: 2498805 - RNA, 14 nt, Human
ccugcccugggagg

SEQ ID NO: 2498806 - RNA, 15 nt, Human
ccugcccugggaggc

SEQ ID NO: 2498807 - RNA, 15 nt, Human
ccugcccugccccca

SEQ ID NO: 2498808 - RNA, 13 nt, Human
ccugcccugccug

SEQ ID NO: 2498809 - RNA, 15 nt, Human
ccugcccugccugag

SEQ ID NO: 2498810 - RNA, 14 nt, Human
ccugcccugccuga

SEQ ID NO: 2498811 - RNA, 13 nt, Human
ccugcccugcugc

SEQ ID NO: 2498812 - RNA, 23 nt, Human
ccugcccucguggccagcccggc

SEQ ID NO: 2498813 - RNA, 22 nt, Human
ccugcccucguggccagcccgg

SEQ ID NO: 2498814 - RNA, 20 nt, Human
ccugcccucguggccagccc

SEQ ID NO: 2498815 - RNA, 19 nt, Human
ccugcccucguggccagcc

SEQ ID NO: 2498816 - RNA, 13 nt, Human
ccugcccugcacg

SEQ ID NO: 2498817 - RNA, 11 nt, Human
ccugcccugca

SEQ ID NO: 2498818 - RNA, 18 nt, Human
ccugcccucguggccagc

SEQ ID NO: 2498819 - RNA, 17 nt, Human
ccugcccucguggccag

SEQ ID NO: 2498820 - RNA, 16 nt, Human
ccugcccucguggcca

SEQ ID NO: 2498821 - RNA, 15 nt, Human
ccugcccucguggcc

SEQ ID NO: 2498822 - RNA, 14 nt, Human
ccugcccucguggc

SEQ ID NO: 2498823 - RNA, 13 nt, Human
ccugcccucgugg

SEQ ID NO: 2498824 - RNA, 12 nt, Human
ccugcccucgug

SEQ ID NO: 2498825 - RNA, 22 nt, Human
ccugcccuccccagagcacugg

SEQ ID NO: 2498826 - RNA, 19 nt, Human
ccugcccuccccagagcac

SEQ ID NO: 2498827 - RNA, 16 nt, Human
ccugcccuccccagag

SEQ ID NO: 2498828 - RNA, 15 nt, Human
ccugcccuccccaga

SEQ ID NO: 2498829 - RNA, 14 nt, Human
ccugcccuccccag

SEQ ID NO: 2498830 - RNA, 21 nt, Human
ccugcccuccccagagcacug

SEQ ID NO: 2498831 - RNA, 20 nt, Human
ccugcccuccccagagcacu

SEQ ID NO: 2498832 - RNA, 13 nt, Human
ccugcccuccccu

SEQ ID NO: 2498833 - RNA, 15 nt, Human
ccugcccguaaacac

SEQ ID NO: 2498834 - RNA, 20 nt, Human
ccugcccguaaacacgccug

SEQ ID NO: 2498835 - RNA, 21 nt, Human
ccugcccguaaacacgccugc

SEQ ID NO: 2498836 - RNA, 22 nt, Human
ccugcccguaaacacgccugca

SEQ ID NO: 2498837 - RNA, 14 nt, Human
ccugccccuguucu

SEQ ID NO: 2498838 - RNA, 10 nt, Human
ccugcccggg

SEQ ID NO: 2498839 - RNA, 16 nt, Human
ccugcccggcugcgga

SEQ ID NO: 2498840 - RNA, 14 nt, Human
ccugcccggcugcg

SEQ ID NO: 2498841 - RNA, 20 nt, Human
ccugcccgucucucucccau

SEQ ID NO: 2498842 - RNA, 19 nt, Human
ccugcccgucucucuccca

SEQ ID NO: 2498843 - RNA, 17 nt, Human
ccugcccgucucucucc

SEQ ID NO: 2498844 - RNA, 13 nt, Human
ccugcccgucucu

SEQ ID NO: 2498845 - RNA, 12 nt, Human
ccugcccgucuc

SEQ ID NO: 2498846 - RNA, 22 nt, Human
ccugcccgggcgcggccagccc

SEQ ID NO: 2498847 - RNA, 23 nt, Human
ccugcccguaaacacgccugcaa

SEQ ID NO: 2498848 - RNA, 22 nt, Human
ccugcccgucucucucccaugg

SEQ ID NO: 2498849 - RNA, 23 nt, Human
ccugcccgucucucucccaugga

SEQ ID NO: 2498850 - RNA, 23 nt, Human
ccugcccuacagaggucucugcc

SEQ ID NO: 2498851 - RNA, 20 nt, Human
ccugcccuacagaggucucu

SEQ ID NO: 2498852 - RNA, 18 nt, Human
ccugcccuagagcacacu

SEQ ID NO: 2498853 - RNA, 23 nt, Human
ccugcccucauggccccucugac

SEQ ID NO: 2498854 - RNA, 21 nt, Human
ccugcccucauggccccucug

SEQ ID NO: 2498855 - RNA, 19 nt, Human
ccugcccucaucucucucc

SEQ ID NO: 2498856 - RNA, 15 nt, Human
ccugcccucagggau

SEQ ID NO: 2498857 - RNA, 14 nt, Human
ccugcccucaggga

SEQ ID NO: 2498858 - RNA, 14 nt, Human
ccugcccuagcucc

SEQ ID NO: 2498859 - RNA, 19 nt, Human
ccugcccuagagcacacug

SEQ ID NO: 2498860 - RNA, 22 nt, Human
ccugcccuagagcacacuguag

SEQ ID NO: 2498861 - RNA, 24 nt, Human
ccugcccuagagcacacuguagca

SEQ ID NO: 2498862 - RNA, 16 nt, Human
ccugcccuagcuccac

SEQ ID NO: 2498863 - RNA, 14 nt, Human
ccugccccucccuu

SEQ ID NO: 2498864 - RNA, 12 nt, Human
ccugcccccuuc

SEQ ID NO: 2498865 - RNA, 13 nt, Human
ccugcccccuucu

SEQ ID NO: 2498866 - RNA, 13 nt, Human
ccugcccccuggu

SEQ ID NO: 2498867 - RNA, 14 nt, Human
ccugcccccuggug

SEQ ID NO: 2498868 - RNA, 15 nt, Human
ccugcccccuggugg

SEQ ID NO: 2498869 - RNA, 16 nt, Human
ccugcccccuggugga

SEQ ID NO: 2498870 - RNA, 18 nt, Human
ccugccccuccucucugc

SEQ ID NO: 2498871 - RNA, 18 nt, Human
ccugccccucccuucaac

SEQ ID NO: 2498872 - RNA, 16 nt, Human
ccugccccucccuuca

SEQ ID NO: 2498873 - RNA, 15 nt, Human
ccugccccucccuuc

SEQ ID NO: 2498874 - RNA, 19 nt, Human
ccugccccuccucucugcc

SEQ ID NO: 2498875 - RNA, 20 nt, Human
ccugccccuccucucugccc

SEQ ID NO: 2498876 - RNA, 21 nt, Human
ccugccccuccucucugcccu

SEQ ID NO: 2498877 - RNA, 22 nt, Human
ccugccccuccucucugcccua

SEQ ID NO: 2498878 - RNA, 17 nt, Human
ccugccccugagcccau

SEQ ID NO: 2498879 - RNA, 16 nt, Human
ccugccccucucccgc

SEQ ID NO: 2498880 - RNA, 15 nt, Human
ccugccccucucccg

SEQ ID NO: 2498881 - RNA, 11 nt, Human
ccugccccugc

SEQ ID NO: 2498882 - RNA, 17 nt, Human
ccugccccugccccguc

SEQ ID NO: 2498883 - RNA, 18 nt, Human
ccugccacucacuaggcc

SEQ ID NO: 2498884 - RNA, 16 nt, Human
ccugccacucacuagg

SEQ ID NO: 2498885 - RNA, 15 nt, Human
ccugccacucacuag

SEQ ID NO: 2498886 - RNA, 13 nt, Human
ccugccacucacu

SEQ ID NO: 2498887 - RNA, 22 nt, Human
ccugccacucacuaggccccca

SEQ ID NO: 2498888 - RNA, 21 nt, Human
ccugccacucacuaggccccc

SEQ ID NO: 2498889 - RNA, 12 nt, Human
ccugccaggcau

SEQ ID NO: 2498890 - RNA, 23 nt, Human
ccugccacucacacagccaggug

SEQ ID NO: 2498891 - RNA, 22 nt, Human
ccugccacucacacagccaggu

SEQ ID NO: 2498892 - RNA, 21 nt, Human
ccugccacucacacagccagg

SEQ ID NO: 2498893 - RNA, 20 nt, Human
ccugccacucacacagccag

SEQ ID NO: 2498894 - RNA, 17 nt, Human
ccugccacucacacagc

SEQ ID NO: 2498895 - RNA, 16 nt, Human
ccugccacucacacag

SEQ ID NO: 2498896 - RNA, 14 nt, Human
ccugccacucacac

SEQ ID NO: 2498897 - RNA, 13 nt, Human
ccugccacucaca

SEQ ID NO: 2498898 - RNA, 12 nt, Human
ccugccacucac

SEQ ID NO: 2498899 - RNA, 16 nt, Human
ccugccaccuggggca

SEQ ID NO: 2498900 - RNA, 13 nt, Human
ccugccaccuggg

SEQ ID NO: 2498901 - RNA, 21 nt, Human
ccugccaguccuagcugcaca

SEQ ID NO: 2498902 - RNA, 20 nt, Human
ccugccaguccuagcugcac

SEQ ID NO: 2498903 - RNA, 19 nt, Human
ccugccaguccuagcugca

SEQ ID NO: 2498904 - RNA, 16 nt, Human
ccugccaguccuagcu

SEQ ID NO: 2498905 - RNA, 15 nt, Human
ccugccaguccuagc

SEQ ID NO: 2498906 - RNA, 14 nt, Human
ccugccaguccuag

SEQ ID NO: 2498907 - RNA, 12 nt, Human
ccugccaguccu

SEQ ID NO: 2498908 - RNA, 20 nt, Human
ccugccagggagacagagcu

SEQ ID NO: 2498909 - RNA, 19 nt, Human
ccugccagggagacagagc

SEQ ID NO: 2498910 - RNA, 17 nt, Human
ccugccagggagacaga

SEQ ID NO: 2498911 - RNA, 13 nt, Human
ccugccagggcag

SEQ ID NO: 2498912 - RNA, 17 nt, Human
ccugccagggcagggcc

SEQ ID NO: 2498913 - RNA, 19 nt, Human
ccugccagggcagggcccc

SEQ ID NO: 2498914 - RNA, 16 nt, Human
ccugccagggagacag

SEQ ID NO: 2498915 - RNA, 22 nt, Human
ccugccaggcaggggugggggu

SEQ ID NO: 2498916 - RNA, 19 nt, Human
ccugccaggcagggguggg

SEQ ID NO: 2498917 - RNA, 15 nt, Human
ccugccaggcagggg

SEQ ID NO: 2498918 - RNA, 22 nt, Human
ccugccagggacagagggggug

SEQ ID NO: 2498919 - RNA, 14 nt, Human
ccugccaggcaggg

SEQ ID NO: 2498920 - RNA, 13 nt, Human
ccugccaggcagg

SEQ ID NO: 2498921 - RNA, 15 nt, Human
ccugccaggcauggu

SEQ ID NO: 2498922 - RNA, 17 nt, Human
ccugccccccagccucu

SEQ ID NO: 2498923 - RNA, 15 nt, Human
ccugccccccagccu

SEQ ID NO: 2498924 - RNA, 14 nt, Human
ccugccccccagcc

SEQ ID NO: 2498925 - RNA, 22 nt, Human
ccugccaguccuagcugcacag

SEQ ID NO: 2498926 - RNA, 13 nt, Human
ccugccagugccu

SEQ ID NO: 2498927 - RNA, 14 nt, Human
ccugccagugccuu

SEQ ID NO: 2498928 - RNA, 17 nt, Human
ccugccagugccuuacc

SEQ ID NO: 2498929 - RNA, 18 nt, Human
ccugccagugccuuaccu

SEQ ID NO: 2498930 - RNA, 20 nt, Human
ccugccagugccuuaccucc

SEQ ID NO: 2498931 - RNA, 21 nt, Human
ccugccagugccuuaccuccu

SEQ ID NO: 2498932 - RNA, 22 nt, Human
ccugccagugccuuaccuccug

SEQ ID NO: 2498933 - RNA, 22 nt, Human
ccugccccccagccucuggcau

SEQ ID NO: 2498934 - RNA, 18 nt, Human
ccugccccccagccucug

SEQ ID NO: 2498935 - RNA, 12 nt, Human
ccugcccccugg

SEQ ID NO: 2498936 - RNA, 18 nt, Human
ccugcccccugaaacuua

SEQ ID NO: 2498937 - RNA, 15 nt, Human
ccugcccccugaaac

SEQ ID NO: 2498938 - RNA, 15 nt, Human
ccugagcugggauga

SEQ ID NO: 2498939 - RNA, 13 nt, Human
ccuaucuuugcca

SEQ ID NO: 2498940 - RNA, 15 nt, Human
ccuaucuuugccacc

SEQ ID NO: 2498941 - RNA, 19 nt, Human
ccuaucuuugccacccuca

SEQ ID NO: 2498942 - RNA, 20 nt, Human
ccuaucuuugccacccucau

SEQ ID NO: 2498943 - RNA, 18 nt, Human
ccuaucuuuuaguuuuag

SEQ ID NO: 2498944 - RNA, 12 nt, Human
ccuaucuuugcc

SEQ ID NO: 2498945 - RNA, 21 nt, Human
ccuagucccuuccccucccug

SEQ ID NO: 2498946 - RNA, 16 nt, Human
ccuagucccuuccccu

SEQ ID NO: 2498947 - RNA, 19 nt, Human
ccuagucccuuccccuccc

SEQ ID NO: 2498948 - RNA, 19 nt, Human
ccuagucccuuccacaccc

SEQ ID NO: 2498949 - RNA, 18 nt, Human
ccuagucccuuccacacc

SEQ ID NO: 2498950 - RNA, 13 nt, Human
ccuagucccuucc

SEQ ID NO: 2498951 - RNA, 14 nt, Human
ccuaguagucauuu

SEQ ID NO: 2498952 - RNA, 14 nt, Human
ccuagucccuuccc

SEQ ID NO: 2498953 - RNA, 15 nt, Human
ccuagucccuucccc

SEQ ID NO: 2498954 - RNA, 16 nt, Human
ccucuucagaggcccu

SEQ ID NO: 2498955 - RNA, 18 nt, Human
ccucuucauggauggggg

SEQ ID NO: 2498956 - RNA, 15 nt, Human
ccucuuccaggcccc

SEQ ID NO: 2498957 - RNA, 12 nt, Human
ccucuuccaguc

SEQ ID NO: 2498958 - RNA, 14 nt, Human
ccucuuccagucuu

SEQ ID NO: 2498959 - RNA, 11 nt, Human
ccucuucccca

SEQ ID NO: 2498960 - RNA, 12 nt, Human
ccucuuccccac

SEQ ID NO: 2498961 - RNA, 13 nt, Human
ccucuucagaggc

SEQ ID NO: 2498962 - RNA, 14 nt, Human
ccucuucagaggcc

SEQ ID NO: 2498963 - RNA, 17 nt, Human
ccuaugauauuuucugu

SEQ ID NO: 2498964 - RNA, 13 nt, Human
ccuaugaucccag

SEQ ID NO: 2498965 - RNA, 14 nt, Human
ccuaugaucccagc

SEQ ID NO: 2498966 - RNA, 15 nt, Human
ccuaugaucccagca

SEQ ID NO: 2498967 - RNA, 16 nt, Human
ccucuucucaagugcc

SEQ ID NO: 2498968 - RNA, 15 nt, Human
ccucuucucaagugc

SEQ ID NO: 2498969 - RNA, 14 nt, Human
ccucuucucaagug

SEQ ID NO: 2498970 - RNA, 18 nt, Human
ccucuucucaagugccuu

SEQ ID NO: 2498971 - RNA, 17 nt, Human
ccucuucucaagugccu

SEQ ID NO: 2498972 - RNA, 18 nt, Human
ccugaaaacacugugcac

SEQ ID NO: 2498973 - RNA, 17 nt, Human
ccucuucuauuuuguaa

SEQ ID NO: 2498974 - RNA, 18 nt, Human
ccucuucuauuuuguaaa

SEQ ID NO: 2498975 - RNA, 15 nt, Human
ccucuuccuuuagga

SEQ ID NO: 2498976 - RNA, 22 nt, Human
ccugaaaaguaacuuggcuuuc

SEQ ID NO: 2498977 - RNA, 19 nt, Human
ccucuucucaagugccuua

SEQ ID NO: 2498978 - RNA, 13 nt, Human
ccugaaaacccag

SEQ ID NO: 2498979 - RNA, 16 nt, Human
ccugaaaacccagaga

SEQ ID NO: 2498980 - RNA, 17 nt, Human
ccugaaaacccagagag

SEQ ID NO: 2498981 - RNA, 15 nt, Human
ccugaaacaacuugg

SEQ ID NO: 2498982 - RNA, 23 nt, Human
ccugaaaauguuuuucugccagg

SEQ ID NO: 2498983 - RNA, 21 nt, Human
ccugaaaauguuuuucugcca

SEQ ID NO: 2498984 - RNA, 22 nt, Human
ccugaaaauguuuuucugccag

SEQ ID NO: 2498985 - RNA, 15 nt, Human
ccucuuccucugagg

SEQ ID NO: 2498986 - RNA, 14 nt, Human
ccucuuccucugag

SEQ ID NO: 2498987 - RNA, 15 nt, Human
ccucuuccccuugcc

SEQ ID NO: 2498988 - RNA, 15 nt, Human
ccucuucccccugcu

SEQ ID NO: 2498989 - RNA, 18 nt, Human
ccucuuccaucauguccc

SEQ ID NO: 2498990 - RNA, 13 nt, Human
ccucuuccccaga

SEQ ID NO: 2498991 - RNA, 14 nt, Human
ccucuuccccagaa

SEQ ID NO: 2498992 - RNA, 22 nt, Human
ccucuuccccagaaaggagacu

SEQ ID NO: 2498993 - RNA, 22 nt, Human
ccucuuccucugaggcuggauc

SEQ ID NO: 2498994 - RNA, 16 nt, Human
ccucuuccuugcugug

SEQ ID NO: 2498995 - RNA, 11 nt, Human
ccucuuccuga

SEQ ID NO: 2498996 - RNA, 21 nt, Human
ccugaaggccccgcccaggcu

SEQ ID NO: 2498997 - RNA, 20 nt, Human
ccugaaggccccgcccaggc

SEQ ID NO: 2498998 - RNA, 20 nt, Human
ccugaaggggccaugauggc

SEQ ID NO: 2498999 - RNA, 14 nt, Human
ccugaaggggcguc

SEQ ID NO: 2499000 - RNA, 16 nt, Human
ccugaaggggcgucug

SEQ ID NO: 2499001 - RNA, 22 nt, Human
ccugaaggggcgucuguucccc

SEQ ID NO: 2499002 - RNA, 22 nt, Human
ccugaaggccccgcccaggcuu

SEQ ID NO: 2499003 - RNA, 19 nt, Human
ccugaaggccccgcccagg

SEQ ID NO: 2499004 - RNA, 18 nt, Human
ccugaaggccccgcccag

SEQ ID NO: 2499005 - RNA, 16 nt, Human
ccugaagccagccuuc

SEQ ID NO: 2499006 - RNA, 15 nt, Human
ccugaagccagccuu

SEQ ID NO: 2499007 - RNA, 14 nt, Human
ccugaagccagccu

SEQ ID NO: 2499008 - RNA, 12 nt, Human
ccugaagccagc

SEQ ID NO: 2499009 - RNA, 18 nt, Human
ccugaagccagccuucuu

SEQ ID NO: 2499010 - RNA, 17 nt, Human
ccugaagccagccuucu

SEQ ID NO: 2499011 - RNA, 21 nt, Human
ccugaagccaggccauggcua

SEQ ID NO: 2499012 - RNA, 14 nt, Human
ccugaaggccccgc

SEQ ID NO: 2499013 - RNA, 13 nt, Human
ccugaaagaggaa

SEQ ID NO: 2499014 - RNA, 22 nt, Human
ccugaaacuuauuuuuuucuga

SEQ ID NO: 2499015 - RNA, 16 nt, Human
ccugaaacuuauuuuu

SEQ ID NO: 2499016 - RNA, 15 nt, Human
ccugaaacuuauuuu

SEQ ID NO: 2499017 - RNA, 18 nt, Human
ccugaaacuuacacacaa

SEQ ID NO: 2499018 - RNA, 13 nt, Human
ccugaaagcccug

SEQ ID NO: 2499019 - RNA, 14 nt, Human
ccugaaagcccuga

SEQ ID NO: 2499020 - RNA, 18 nt, Human
ccugaaagcccugagcuu

SEQ ID NO: 2499021 - RNA, 19 nt, Human
ccugaagagaagggcaggg

SEQ ID NO: 2499022 - RNA, 17 nt, Human
ccugaagaggcgggcca

SEQ ID NO: 2499023 - RNA, 22 nt, Human
ccugaaagaggcugaggccugg

SEQ ID NO: 2499024 - RNA, 21 nt, Human
ccugaagaggcgggccagcca

SEQ ID NO: 2499025 - RNA, 20 nt, Human
ccugaagaggcgggccagcc

SEQ ID NO: 2499026 - RNA, 19 nt, Human
ccugaagaggcgggccagc

SEQ ID NO: 2499027 - RNA, 18 nt, Human
ccugaagaggcgggccag

SEQ ID NO: 2499028 - RNA, 23 nt, Human
ccugaagaggcgggccagccagg

SEQ ID NO: 2499029 - RNA, 22 nt, Human
ccugaagaggcgggccagccag

SEQ ID NO: 2499030 - RNA, 21 nt, Human
ccugaagaguccucugaauga

SEQ ID NO: 2499031 - RNA, 18 nt, Human
ccugagccagauuucacu

SEQ ID NO: 2499032 - RNA, 16 nt, Human
ccugagccagauuuca

SEQ ID NO: 2499033 - RNA, 12 nt, Human
ccugaaucauuc

SEQ ID NO: 2499034 - RNA, 15 nt, Human
ccugagccagauuuc

SEQ ID NO: 2499035 - RNA, 19 nt, Human
ccugaagucacacagugag

SEQ ID NO: 2499036 - RNA, 20 nt, Human
ccugaagucacacagugagu

SEQ ID NO: 2499037 - RNA, 22 nt, Human
ccugaagucuuuguacagacaa

SEQ ID NO: 2499038 - RNA, 17 nt, Human
ccugaaguucaccauua

SEQ ID NO: 2499039 - RNA, 19 nt, Human
ccugaaguaagcaaagacu

SEQ ID NO: 2499040 - RNA, 20 nt, Human
ccugagccccuuccuugcuc

SEQ ID NO: 2499041 - RNA, 23 nt, Human
ccugagccccuuccuugcucugc

SEQ ID NO: 2499042 - RNA, 16 nt, Human
ccugagccccuuccuu

SEQ ID NO: 2499043 - RNA, 15 nt, Human
ccugagccccuuccu

SEQ ID NO: 2499044 - RNA, 14 nt, Human
ccugagccccuucc

SEQ ID NO: 2499045 - RNA, 13 nt, Human
ccugagccccuuc

SEQ ID NO: 2499046 - RNA, 12 nt, Human
ccugagccccuu

SEQ ID NO: 2499047 - RNA, 12 nt, Human
ccugagccuggc

SEQ ID NO: 2499048 - RNA, 13 nt, Human
ccugagccuggcc

SEQ ID NO: 2499049 - RNA, 14 nt, Human
ccugagccuggcca

SEQ ID NO: 2499050 - RNA, 15 nt, Human
ccugagccuggccag

SEQ ID NO: 2499051 - RNA, 16 nt, Human
ccugagccuggccagc

SEQ ID NO: 2499052 - RNA, 13 nt, Human
ccugagcucacuc

SEQ ID NO: 2499053 - RNA, 21 nt, Human
ccugagcuagaagcuggagga

SEQ ID NO: 2499054 - RNA, 18 nt, Human
ccugagcuagaagcugga

SEQ ID NO: 2499055 - RNA, 11 nt, Human
ccugagcuaga

SEQ ID NO: 2499056 - RNA, 23 nt, Human
ccugagcgcuccugccgcagagc

SEQ ID NO: 2499057 - RNA, 21 nt, Human
ccugagcgcuccugccgcaga

SEQ ID NO: 2499058 - RNA, 16 nt, Human
ccugagcgcuccugcc

SEQ ID NO: 2499059 - RNA, 12 nt, Human
ccugagcgcucc

SEQ ID NO: 2499060 - RNA, 18 nt, Human
ccugaggcccagagggcc

SEQ ID NO: 2499061 - RNA, 17 nt, Human
ccugaggcccagagggc

SEQ ID NO: 2499062 - RNA, 16 nt, Human
ccugaggcccagaggg

SEQ ID NO: 2499063 - RNA, 15 nt, Human
ccugaggcccagagg

SEQ ID NO: 2499064 - RNA, 12 nt, Human
ccugagcuggga

SEQ ID NO: 2499065 - RNA, 15 nt, Human
ccugagcugaggcag

SEQ ID NO: 2499066 - RNA, 16 nt, Human
ccugagcugaggcagc

SEQ ID NO: 2499067 - RNA, 14 nt, Human
ccugagcucugaua

SEQ ID NO: 2499068 - RNA, 15 nt, Human
ccugagcuccccacc

SEQ ID NO: 2499069 - RNA, 12 nt, Human
ccugagcucccc

SEQ ID NO: 2499070 - RNA, 15 nt, Human
ccugagcucggugga

SEQ ID NO: 2499071 - RNA, 16 nt, Human
ccugagcucgguggac

SEQ ID NO: 2499072 - RNA, 18 nt, Human
ccugagcucgguggaccc

SEQ ID NO: 2499073 - RNA, 19 nt, Human
ccugagcucgguggaccca

SEQ ID NO: 2499074 - RNA, 20 nt, Human
ccugagcucgguggacccag

SEQ ID NO: 2499075 - RNA, 21 nt, Human
ccugagcucgguggacccagg

SEQ ID NO: 2499076 - RNA, 22 nt, Human
ccugagcucgguggacccaggg

SEQ ID NO: 2499077 - RNA, 14 nt, Human
ccugaggcugggcu

SEQ ID NO: 2499078 - RNA, 13 nt, Human
ccugaggcugggc

SEQ ID NO: 2499079 - RNA, 15 nt, Human
ccugaggcugggcuc

SEQ ID NO: 2499080 - RNA, 17 nt, Human
ccugaggcucagggaaa

SEQ ID NO: 2499081 - RNA, 14 nt, Human
ccugaucaaugaca

SEQ ID NO: 2499082 - RNA, 20 nt, Human
ccugaucaagucaccggagc

SEQ ID NO: 2499083 - RNA, 13 nt, Human
ccugaggcuccac

SEQ ID NO: 2499084 - RNA, 14 nt, Human
ccugaggcuccacu

SEQ ID NO: 2499085 - RNA, 17 nt, Human
ccugaggcuccacuugg

SEQ ID NO: 2499086 - RNA, 18 nt, Human
ccugagcugaggcagcag

SEQ ID NO: 2499087 - RNA, 17 nt, Human
ccugagcugccauccag

SEQ ID NO: 2499088 - RNA, 21 nt, Human
ccugaggcugagacugcggga

SEQ ID NO: 2499089 - RNA, 15 nt, Human
ccugaggcucaggga

SEQ ID NO: 2499090 - RNA, 14 nt, Human
ccugcaccuccccc

SEQ ID NO: 2499091 - RNA, 17 nt, Human
ccugcaccuccccccac

SEQ ID NO: 2499092 - RNA, 18 nt, Human
ccugcaccuccccccacu

SEQ ID NO: 2499093 - RNA, 19 nt, Human
ccugcaccuccccccacug

SEQ ID NO: 2499094 - RNA, 21 nt, Human
ccugcacuggggagcccgucu

SEQ ID NO: 2499095 - RNA, 14 nt, Human
ccugcacuggggag

SEQ ID NO: 2499096 - RNA, 20 nt, Human
ccugcaccuccccccacugc

SEQ ID NO: 2499097 - RNA, 15 nt, Human
ccugcacuggagucc

SEQ ID NO: 2499098 - RNA, 17 nt, Human
ccugcacuggaguccag

SEQ ID NO: 2499099 - RNA, 20 nt, Human
ccugcacuggaguccagucu

SEQ ID NO: 2499100 - RNA, 23 nt, Human
ccugcacuggaguccagucucuu

SEQ ID NO: 2499101 - RNA, 19 nt, Human
ccugcacaauaaaaauguu

SEQ ID NO: 2499102 - RNA, 20 nt, Human
ccugcacaauaaaaauguuu

SEQ ID NO: 2499103 - RNA, 21 nt, Human
ccugcacacgcuccuuccucu

SEQ ID NO: 2499104 - RNA, 23 nt, Human
ccugcacaaagcccuuccauguc

SEQ ID NO: 2499105 - RNA, 15 nt, Human
ccugcaaagcccagc

SEQ ID NO: 2499106 - RNA, 16 nt, Human
ccugcaaagcccagcu

SEQ ID NO: 2499107 - RNA, 14 nt, Human
ccugcaaagcccag

SEQ ID NO: 2499108 - RNA, 17 nt, Human
ccugcaaagcccagcuu

SEQ ID NO: 2499109 - RNA, 18 nt, Human
ccugcaaagcccagcuug

SEQ ID NO: 2499110 - RNA, 20 nt, Human
ccugcacaaagcccuuccau

SEQ ID NO: 2499111 - RNA, 22 nt, Human
ccugcacaaagcccuuccaugu

SEQ ID NO: 2499112 - RNA, 19 nt, Human
ccugauccuggaggcccag

SEQ ID NO: 2499113 - RNA, 20 nt, Human
ccugauccuggaggcccagu

SEQ ID NO: 2499114 - RNA, 22 nt, Human
ccugcaaacucacugcucaaga

SEQ ID NO: 2499115 - RNA, 15 nt, Human
ccugauccugugaag

SEQ ID NO: 2499116 - RNA, 15 nt, Human
ccugauccuggaggc

SEQ ID NO: 2499117 - RNA, 18 nt, Human
ccugauccuggaggccca

SEQ ID NO: 2499118 - RNA, 13 nt, Human
ccugauccuggag

SEQ ID NO: 2499119 - RNA, 17 nt, Human
ccugaucaaugacagag

SEQ ID NO: 2499120 - RNA, 15 nt, Human
ccugaucaaugacag

SEQ ID NO: 2499121 - RNA, 14 nt, Human
ccugaucagaccac

SEQ ID NO: 2499122 - RNA, 18 nt, Human
ccugaucagaccacggcu

SEQ ID NO: 2499123 - RNA, 19 nt, Human
ccugaucagaccacggcuc

SEQ ID NO: 2499124 - RNA, 13 nt, Human
ccugaucagagcc

SEQ ID NO: 2499125 - RNA, 15 nt, Human
ccugauccagccucu

SEQ ID NO: 2499126 - RNA, 14 nt, Human
ccugccaccaguca

SEQ ID NO: 2499127 - RNA, 16 nt, Human
ccugcauuucugaguu

SEQ ID NO: 2499128 - RNA, 19 nt, Human
ccugccaccaggccaccuc

SEQ ID NO: 2499129 - RNA, 18 nt, Human
ccugccaccaggccaccu

SEQ ID NO: 2499130 - RNA, 15 nt, Human
ccugccaccaggcca

SEQ ID NO: 2499131 - RNA, 14 nt, Human
ccugccaccaggcc

SEQ ID NO: 2499132 - RNA, 13 nt, Human
ccugccaccaggc

SEQ ID NO: 2499133 - RNA, 12 nt, Human
ccugccaccagg

SEQ ID NO: 2499134 - RNA, 12 nt, Human
ccugccacagcc

SEQ ID NO: 2499135 - RNA, 19 nt, Human
ccugccaauggacuaacuu

SEQ ID NO: 2499136 - RNA, 15 nt, Human
ccugccaccacgccc

SEQ ID NO: 2499137 - RNA, 19 nt, Human
ccugccaccacgcccggcu

SEQ ID NO: 2499138 - RNA, 23 nt, Human
ccugcacuguccugcuccacagu

SEQ ID NO: 2499139 - RNA, 21 nt, Human
ccugcacuguccugcuccaca

SEQ ID NO: 2499140 - RNA, 20 nt, Human
ccugcacuguccugcuccac

SEQ ID NO: 2499141 - RNA, 19 nt, Human
ccugcacuguccugcucca

SEQ ID NO: 2499142 - RNA, 17 nt, Human
ccugcacuuacuugcuu

SEQ ID NO: 2499143 - RNA, 14 nt, Human
ccugcacuuacuug

SEQ ID NO: 2499144 - RNA, 17 nt, Human
ccugcacuguccugcuc

SEQ ID NO: 2499145 - RNA, 16 nt, Human
ccugcacuguccugcu

SEQ ID NO: 2499146 - RNA, 15 nt, Human
ccugcacuguccugc

SEQ ID NO: 2499147 - RNA, 14 nt, Human
ccugcacuguccug

SEQ ID NO: 2499148 - RNA, 12 nt, Human
ccugcacugucc

SEQ ID NO: 2499149 - RNA, 13 nt, Human
ccugcacuguccu

SEQ ID NO: 2499150 - RNA, 18 nt, Human
ccugcauucuuucuguau

SEQ ID NO: 2499151 - RNA, 14 nt, Human
ccugcauuucugag

SEQ ID NO: 2499152 - RNA, 23 nt, Human
ccugcauuugugaaaugauggug

SEQ ID NO: 2499153 - RNA, 13 nt, Human
ccugccacccugg

SEQ ID NO: 2499154 - RNA, 12 nt, Human
ccugccacccug

SEQ ID NO: 2499155 - RNA, 14 nt, Human
ccugccacccuggg

SEQ ID NO: 2499156 - RNA, 19 nt, Human
ccugccaccagucacuguc

SEQ ID NO: 2499157 - RNA, 22 nt, Human
ccugccacccuggggagaaagu

SEQ ID NO: 2499158 - RNA, 16 nt, Human
ccugccacccugggga

SEQ ID NO: 2499159 - RNA, 16 nt, Human
ccugccaccugcugcu

SEQ ID NO: 2499160 - RNA, 16 nt, Human
ccugccaccucccuga

SEQ ID NO: 2499161 - RNA, 14 nt, Human
ccugccaccucccu

SEQ ID NO: 2499162 - RNA, 13 nt, Human
ccugccaccuccc

SEQ ID NO: 2499163 - RNA, 18 nt, Human
ccuguggauguaaaguga

SEQ ID NO: 2499164 - RNA, 18 nt, Human
ccugguggcagcugcggu

SEQ ID NO: 2499165 - RNA, 17 nt, Human
ccugguggcagcugcgg

SEQ ID NO: 2499166 - RNA, 16 nt, Human
ccugguggcagcugcg

SEQ ID NO: 2499167 - RNA, 15 nt, Human
ccugguggcagcugc

SEQ ID NO: 2499168 - RNA, 21 nt, Human
ccugguggcagcucaccucuc

SEQ ID NO: 2499169 - RNA, 19 nt, Human
ccugguggcagcucaccuc

SEQ ID NO: 2499170 - RNA, 22 nt, Human
ccugguggcagcucaccucucc

SEQ ID NO: 2499171 - RNA, 14 nt, Human
ccugguggcagcug

SEQ ID NO: 2499172 - RNA, 23 nt, Human
ccugguccugaggguccccaccu

SEQ ID NO: 2499173 - RNA, 19 nt, Human
ccugguccuuccaggcccc

SEQ ID NO: 2499174 - RNA, 14 nt, Human
ccuggucucugguc

SEQ ID NO: 2499175 - RNA, 23 nt, Human
ccuggucucagcagcgaccaccc

SEQ ID NO: 2499176 - RNA, 13 nt, Human
ccuggucucuggu

SEQ ID NO: 2499177 - RNA, 20 nt, Human
ccugguccucacacucaccc

SEQ ID NO: 2499178 - RNA, 23 nt, Human
ccuggguucagaaaugcugccug

SEQ ID NO: 2499179 - RNA, 22 nt, Human
ccuggguucagaaaugcugccu

SEQ ID NO: 2499180 - RNA, 14 nt, Human
ccugguccugaggg

SEQ ID NO: 2499181 - RNA, 14 nt, Human
ccuggucccuggga

SEQ ID NO: 2499182 - RNA, 16 nt, Human
ccuggucccugggagg

SEQ ID NO: 2499183 - RNA, 15 nt, Human
ccugguccuuccagg

SEQ ID NO: 2499184 - RNA, 18 nt, Human
ccugguccuuccaggccc

SEQ ID NO: 2499185 - RNA, 19 nt, Human
ccuggguucagaaaugcug

SEQ ID NO: 2499186 - RNA, 21 nt, Human
ccuggguggucugcaggcagg

SEQ ID NO: 2499187 - RNA, 23 nt, Human
ccugggugggugguggggagggg

SEQ ID NO: 2499188 - RNA, 22 nt, Human
ccugggugggugguggggaggg

SEQ ID NO: 2499189 - RNA, 14 nt, Human
ccuggguggucugc

SEQ ID NO: 2499190 - RNA, 18 nt, Human
ccuggguggucugcaggc

SEQ ID NO: 2499191 - RNA, 19 nt, Human
ccuggguggucugcaggca

SEQ ID NO: 2499192 - RNA, 20 nt, Human
ccuggguggucugcaggcag

SEQ ID NO: 2499193 - RNA, 22 nt, Human
ccuggguggucugcaggcaggg

SEQ ID NO: 2499194 - RNA, 21 nt, Human
ccugggugggugguggggagg

SEQ ID NO: 2499195 - RNA, 20 nt, Human
ccugggugggugguggggag

SEQ ID NO: 2499196 - RNA, 19 nt, Human
ccuggguggguggugggga

SEQ ID NO: 2499197 - RNA, 17 nt, Human
ccugggugggugguggg

SEQ ID NO: 2499198 - RNA, 21 nt, Human
ccuggguggggcugcuccucc

SEQ ID NO: 2499199 - RNA, 22 nt, Human
ccuggguggggcugcuccucca

SEQ ID NO: 2499200 - RNA, 13 nt, Human
ccugggugggugg

SEQ ID NO: 2499201 - RNA, 23 nt, Human
ccuggguggggcugcuccuccag

SEQ ID NO: 2499202 - RNA, 20 nt, Human
ccuggguccaaauaaaaacu

SEQ ID NO: 2499203 - RNA, 17 nt, Human
ccuggguggggcugcuc

SEQ ID NO: 2499204 - RNA, 19 nt, Human
ccuggguggggcugcuccu

SEQ ID NO: 2499205 - RNA, 20 nt, Human
ccuggguggggcugcuccuc

SEQ ID NO: 2499206 - RNA, 17 nt, Human
ccuggguccaaauaaaa

SEQ ID NO: 2499207 - RNA, 15 nt, Human
ccuggguccaaauaa

SEQ ID NO: 2499208 - RNA, 21 nt, Human
ccuguagcaucuucuggaguc

SEQ ID NO: 2499209 - RNA, 16 nt, Human
ccuguagccuucugua

SEQ ID NO: 2499210 - RNA, 20 nt, Human
ccuguaguugcguggacucu

SEQ ID NO: 2499211 - RNA, 19 nt, Human
ccuguagccuucuguagga

SEQ ID NO: 2499212 - RNA, 21 nt, Human
ccuguaguugcguggacucug

SEQ ID NO: 2499213 - RNA, 16 nt, Human
ccuguauaaguggagg

SEQ ID NO: 2499214 - RNA, 18 nt, Human
ccuguauaaguggaggca

SEQ ID NO: 2499215 - RNA, 23 nt, Human
ccuguaguugcguggacucugca

SEQ ID NO: 2499216 - RNA, 19 nt, Human
ccuguagcccacucugcuc

SEQ ID NO: 2499217 - RNA, 22 nt, Human
ccuguagcccacucugcucgcc

SEQ ID NO: 2499218 - RNA, 23 nt, Human
ccuguagcccacucugcucgccu

SEQ ID NO: 2499219 - RNA, 24 nt, Human
ccuguagcccacucugcucgccuu

SEQ ID NO: 2499220 - RNA, 13 nt, Human
ccuguagcccuaa

SEQ ID NO: 2499221 - RNA, 15 nt, Human
ccuguagagugggag

SEQ ID NO: 2499222 - RNA, 16 nt, Human
ccuguagagugggagc

SEQ ID NO: 2499223 - RNA, 18 nt, Human
ccuguagcaucuucugga

SEQ ID NO: 2499224 - RNA, 15 nt, Human
ccuguagcaucuucu

SEQ ID NO: 2499225 - RNA, 13 nt, Human
ccuguagcaucuu

SEQ ID NO: 2499226 - RNA, 21 nt, Human
ccuguagcagugagaaaaagc

SEQ ID NO: 2499227 - RNA, 12 nt, Human
ccuguagcccac

SEQ ID NO: 2499228 - RNA, 16 nt, Human
ccuguagcccacucug

SEQ ID NO: 2499229 - RNA, 13 nt, Human
ccuguagcaguga

SEQ ID NO: 2499230 - RNA, 14 nt, Human
ccuguagagcuaga

SEQ ID NO: 2499231 - RNA, 17 nt, Human
ccuguagcacuuacugg

SEQ ID NO: 2499232 - RNA, 22 nt, Human
ccuguagaccuagggaggaccu

SEQ ID NO: 2499233 - RNA, 23 nt, Human
ccuguagaccuagggaggaccuu

SEQ ID NO: 2499234 - RNA, 14 nt, Human
ccugguggcagugg

SEQ ID NO: 2499235 - RNA, 13 nt, Human
ccugguggcagug

SEQ ID NO: 2499236 - RNA, 21 nt, Human
ccuguacaguagauuuuccaa

SEQ ID NO: 2499237 - RNA, 20 nt, Human
ccuguacaguagauuuucca

SEQ ID NO: 2499238 - RNA, 14 nt, Human
ccuguacaguagau

SEQ ID NO: 2499239 - RNA, 21 nt, Human
ccuguacacugaauauuuaua

SEQ ID NO: 2499240 - RNA, 14 nt, Human
ccuggucuguagaa

SEQ ID NO: 2499241 - RNA, 16 nt, Human
ccuggucuuuccucug

SEQ ID NO: 2499242 - RNA, 16 nt, Human
ccuggucuugagaugu

SEQ ID NO: 2499243 - RNA, 16 nt, Human
ccuguacauuguggga

SEQ ID NO: 2499244 - RNA, 22 nt, Human
ccuguacaguagauuuuccaaa

SEQ ID NO: 2499245 - RNA, 10 nt, Human
ccuguaccuc

SEQ ID NO: 2499246 - RNA, 14 nt, Human
ccuguaccccagca

SEQ ID NO: 2499247 - RNA, 17 nt, Human
ccuguaccccagcacuu

SEQ ID NO: 2499248 - RNA, 12 nt, Human
ccuguaccucuu

SEQ ID NO: 2499249 - RNA, 20 nt, Human
ccuguacuguucugugucuu

SEQ ID NO: 2499250 - RNA, 12 nt, Human
ccuguacuuuuu

SEQ ID NO: 2499251 - RNA, 13 nt, Human
ccuguagaccuag

SEQ ID NO: 2499252 - RNA, 18 nt, Human
ccuguagaccuagggagg

SEQ ID NO: 2499253 - RNA, 15 nt, Human
ccugucccucccacc

SEQ ID NO: 2499254 - RNA, 14 nt, Human
ccugucccucccac

SEQ ID NO: 2499255 - RNA, 19 nt, Human
ccugucccccagcucuggu

SEQ ID NO: 2499256 - RNA, 17 nt, Human
ccugucccccagcucug

SEQ ID NO: 2499257 - RNA, 13 nt, Human
ccugucccuccca

SEQ ID NO: 2499258 - RNA, 15 nt, Human
ccugucccccugaca

SEQ ID NO: 2499259 - RNA, 14 nt, Human
ccugucccccugac

SEQ ID NO: 2499260 - RNA, 13 nt, Human
ccugucccccuga

SEQ ID NO: 2499261 - RNA, 16 nt, Human
ccugucccccagcucu

SEQ ID NO: 2499262 - RNA, 15 nt, Human
ccugucccccagcuc

SEQ ID NO: 2499263 - RNA, 14 nt, Human
ccugucccccagcu

SEQ ID NO: 2499264 - RNA, 13 nt, Human
ccugucccccagc

SEQ ID NO: 2499265 - RNA, 12 nt, Human
ccugucccccug

SEQ ID NO: 2499266 - RNA, 18 nt, Human
ccugucccacccccaccc

SEQ ID NO: 2499267 - RNA, 17 nt, Human
ccugucccacccccacc

SEQ ID NO: 2499268 - RNA, 15 nt, Human
ccugucccaccccca

SEQ ID NO: 2499269 - RNA, 16 nt, Human
ccugucccaccucuuc

SEQ ID NO: 2499270 - RNA, 13 nt, Human
ccugucccaccuc

SEQ ID NO: 2499271 - RNA, 23 nt, Human
ccugucccauggacacuccagug

SEQ ID NO: 2499272 - RNA, 19 nt, Human
ccugucccauggacacucc

SEQ ID NO: 2499273 - RNA, 16 nt, Human
ccugucccauggacac

SEQ ID NO: 2499274 - RNA, 14 nt, Human
ccugucccaccucu

SEQ ID NO: 2499275 - RNA, 19 nt, Human
ccugucaugccccccucaa

SEQ ID NO: 2499276 - RNA, 18 nt, Human
ccugucaugccccccuca

SEQ ID NO: 2499277 - RNA, 16 nt, Human
ccugucaugccccccu

SEQ ID NO: 2499278 - RNA, 15 nt, Human
ccugucaugcccccc

SEQ ID NO: 2499279 - RNA, 14 nt, Human
ccugucaugccccc

SEQ ID NO: 2499280 - RNA, 12 nt, Human
ccugucaugccc

SEQ ID NO: 2499281 - RNA, 13 nt, Human
ccugucccacccc

SEQ ID NO: 2499282 - RNA, 11 nt, Human
ccugucccacc

SEQ ID NO: 2499283 - RNA, 22 nt, Human
ccugucauucccaccacccuga

SEQ ID NO: 2499284 - RNA, 21 nt, Human
ccugucaugccccccucaaac

SEQ ID NO: 2499285 - RNA, 14 nt, Human
ccugucagugcagc

SEQ ID NO: 2499286 - RNA, 16 nt, Human
ccugucagugcagccc

SEQ ID NO: 2499287 - RNA, 19 nt, Human
ccugucagugccgccgccu

SEQ ID NO: 2499288 - RNA, 15 nt, Human
ccugucagugccgcc

SEQ ID NO: 2499289 - RNA, 14 nt, Human
ccugucagugccgc

SEQ ID NO: 2499290 - RNA, 13 nt, Human
ccugucagugccg

SEQ ID NO: 2499291 - RNA, 12 nt, Human
ccugucagugcc

SEQ ID NO: 2499292 - RNA, 19 nt, Human
ccugucagugcagcccgug

SEQ ID NO: 2499293 - RNA, 22 nt, Human
ccuguauaaguggaggcacuuu

SEQ ID NO: 2499294 - RNA, 23 nt, Human
ccuguauaaguggaggcacuuua

SEQ ID NO: 2499295 - RNA, 21 nt, Human
ccuguauauagcccagccagg

SEQ ID NO: 2499296 - RNA, 16 nt, Human
ccuguauauagcccag

SEQ ID NO: 2499297 - RNA, 22 nt, Human
ccuguauaguuaggauagcauu

SEQ ID NO: 2499298 - RNA, 12 nt, Human
ccuguauaguua

SEQ ID NO: 2499299 - RNA, 13 nt, Human
ccuguauauagcc

SEQ ID NO: 2499300 - RNA, 19 nt, Human
ccuguaugcaacaggcacu

SEQ ID NO: 2499301 - RNA, 14 nt, Human
ccugucaccaagcu

SEQ ID NO: 2499302 - RNA, 23 nt, Human
ccuguauauagcccagccaggcc

SEQ ID NO: 2499303 - RNA, 14 nt, Human
ccuggcaugggaau

SEQ ID NO: 2499304 - RNA, 13 nt, Human
ccuggccacgccc

SEQ ID NO: 2499305 - RNA, 17 nt, Human
ccuggccaucccacaag

SEQ ID NO: 2499306 - RNA, 19 nt, Human
ccuggccaucccacaagug

SEQ ID NO: 2499307 - RNA, 21 nt, Human
ccuggcccacagcaggugcug

SEQ ID NO: 2499308 - RNA, 15 nt, Human
ccuggccagccuaca

SEQ ID NO: 2499309 - RNA, 13 nt, Human
ccuggccaggagc

SEQ ID NO: 2499310 - RNA, 13 nt, Human
ccuggcccacugc

SEQ ID NO: 2499311 - RNA, 14 nt, Human
ccuggcccacugca

SEQ ID NO: 2499312 - RNA, 16 nt, Human
ccuggccaccugaggu

SEQ ID NO: 2499313 - RNA, 13 nt, Human
ccuggccaccuga

SEQ ID NO: 2499314 - RNA, 12 nt, Human
ccuggccaccug

SEQ ID NO: 2499315 - RNA, 18 nt, Human
ccuggccaccucucuccu

SEQ ID NO: 2499316 - RNA, 18 nt, Human
ccuggccaccugaggugg

SEQ ID NO: 2499317 - RNA, 17 nt, Human
ccuggccaccugaggug

SEQ ID NO: 2499318 - RNA, 20 nt, Human
ccuggccagaugcaccagcc

SEQ ID NO: 2499319 - RNA, 23 nt, Human
ccuggccagaugcaccagcccuu

SEQ ID NO: 2499320 - RNA, 21 nt, Human
ccuggccagaugcaccagccc

SEQ ID NO: 2499321 - RNA, 16 nt, Human
ccuggcacugcuucca

SEQ ID NO: 2499322 - RNA, 13 nt, Human
ccuggcacugcuu

SEQ ID NO: 2499323 - RNA, 17 nt, Human
ccuggcacugcugugcu

SEQ ID NO: 2499324 - RNA, 15 nt, Human
ccuggcacugcugug

SEQ ID NO: 2499325 - RNA, 11 nt, Human
ccuggagaagc

SEQ ID NO: 2499326 - RNA, 22 nt, Human
ccuggcaggaugacccugcgaa

SEQ ID NO: 2499327 - RNA, 21 nt, Human
ccuggcaggcugucuggccag

SEQ ID NO: 2499328 - RNA, 23 nt, Human
ccuggcaucgcaccauucugacu

SEQ ID NO: 2499329 - RNA, 21 nt, Human
ccuggcaucgcaccauucuga

SEQ ID NO: 2499330 - RNA, 20 nt, Human
ccuggcagguuagaaccuag

SEQ ID NO: 2499331 - RNA, 19 nt, Human
ccuggcagguuagaaccua

SEQ ID NO: 2499332 - RNA, 21 nt, Human
ccuggcagguuagaaccuaga

SEQ ID NO: 2499333 - RNA, 13 nt, Human
ccuggcaugggaa

SEQ ID NO: 2499334 - RNA, 19 nt, Human
ccuggcauuauguccacug

SEQ ID NO: 2499335 - RNA, 23 nt, Human
ccuggcaugggaaugaaugucag

SEQ ID NO: 2499336 - RNA, 15 nt, Human
ccuggccaccucucu

SEQ ID NO: 2499337 - RNA, 14 nt, Human
ccuggccaccucuc

SEQ ID NO: 2499338 - RNA, 13 nt, Human
ccuggccaccucu

SEQ ID NO: 2499339 - RNA, 21 nt, Human
ccuggccaccaccccccacuc

SEQ ID NO: 2499340 - RNA, 17 nt, Human
ccuggccaccacccccc

SEQ ID NO: 2499341 - RNA, 15 nt, Human
ccuggccaccacccc

SEQ ID NO: 2499342 - RNA, 22 nt, Human
ccuggcacuauaauguaagcuc

SEQ ID NO: 2499343 - RNA, 18 nt, Human
ccuggcacccggccccug

SEQ ID NO: 2499344 - RNA, 12 nt, Human
ccuggcacugcu

SEQ ID NO: 2499345 - RNA, 21 nt, Human
ccuggcacccggccccugcug

SEQ ID NO: 2499346 - RNA, 20 nt, Human
ccuggcacccggccccugcu

SEQ ID NO: 2499347 - RNA, 19 nt, Human
ccuggacuuuccugcaacu

SEQ ID NO: 2499348 - RNA, 17 nt, Human
ccuggacuuuccugcaa

SEQ ID NO: 2499349 - RNA, 16 nt, Human
ccuggacuuuccugca

SEQ ID NO: 2499350 - RNA, 15 nt, Human
ccuggacuuuccugc

SEQ ID NO: 2499351 - RNA, 13 nt, Human
ccuggagaacuag

SEQ ID NO: 2499352 - RNA, 12 nt, Human
ccuggagaacua

SEQ ID NO: 2499353 - RNA, 17 nt, Human
ccuggagaagcugaugc

SEQ ID NO: 2499354 - RNA, 23 nt, Human
ccuggagaacuagaaccuggagg

SEQ ID NO: 2499355 - RNA, 16 nt, Human
ccuggagaacuagaga

SEQ ID NO: 2499356 - RNA, 19 nt, Human
ccuggcacccggccccugc

SEQ ID NO: 2499357 - RNA, 17 nt, Human
ccugcuaauuccccaga

SEQ ID NO: 2499358 - RNA, 20 nt, Human
ccugcuacaacuucagcagu

SEQ ID NO: 2499359 - RNA, 19 nt, Human
ccugcuacaacuucagcag

SEQ ID NO: 2499360 - RNA, 23 nt, Human
ccugccuguggcgccgucuccag

SEQ ID NO: 2499361 - RNA, 16 nt, Human
ccugcuacucuguucc

SEQ ID NO: 2499362 - RNA, 13 nt, Human
ccugcuacucugu

SEQ ID NO: 2499363 - RNA, 14 nt, Human
ccuggacuuuccug

SEQ ID NO: 2499364 - RNA, 13 nt, Human
ccuggacuuuccu

SEQ ID NO: 2499365 - RNA, 18 nt, Human
ccugcuagacacauuuuu

SEQ ID NO: 2499366 - RNA, 19 nt, Human
ccugccuguugggccagga

SEQ ID NO: 2499367 - RNA, 18 nt, Human
ccugccuguugggccagg

SEQ ID NO: 2499368 - RNA, 20 nt, Human
ccugccuguugggccaggag

SEQ ID NO: 2499369 - RNA, 21 nt, Human
ccugcuaauuccccagauugc

SEQ ID NO: 2499370 - RNA, 14 nt, Human
ccugggaauguauu

SEQ ID NO: 2499371 - RNA, 17 nt, Human
ccugggaaauauucccu

SEQ ID NO: 2499372 - RNA, 18 nt, Human
ccugggaaauauucccua

SEQ ID NO: 2499373 - RNA, 12 nt, Human
ccugggaagggg

SEQ ID NO: 2499374 - RNA, 16 nt, Human
ccuggcuuuucacugc

SEQ ID NO: 2499375 - RNA, 17 nt, Human
ccuggcuuuucacugcu

SEQ ID NO: 2499376 - RNA, 18 nt, Human
ccuggcuuguaacuccac

SEQ ID NO: 2499377 - RNA, 20 nt, Human
ccuggcuuguaacuccacca

SEQ ID NO: 2499378 - RNA, 22 nt, Human
ccuggcuuguaacuccaccaac

SEQ ID NO: 2499379 - RNA, 20 nt, Human
ccuggcuucuggagcccuug

SEQ ID NO: 2499380 - RNA, 21 nt, Human
ccuggcuucuggagcccuugg

SEQ ID NO: 2499381 - RNA, 22 nt, Human
ccuggcuucuggagcccuuggg

SEQ ID NO: 2499382 - RNA, 23 nt, Human
ccuggcuucuggagcccuugggu

SEQ ID NO: 2499383 - RNA, 21 nt, Human
ccuggcuccguccaggagccu

SEQ ID NO: 2499384 - RNA, 18 nt, Human
ccuggcuccuacccaccg

SEQ ID NO: 2499385 - RNA, 15 nt, Human
ccuggcuccugaggg

SEQ ID NO: 2499386 - RNA, 23 nt, Human
ccuggcuccugaggggcaucugc

SEQ ID NO: 2499387 - RNA, 21 nt, Human
ccuggcucccaugaccauacu

SEQ ID NO: 2499388 - RNA, 14 nt, Human
ccuggcucccauga

SEQ ID NO: 2499389 - RNA, 15 nt, Human
ccuggcucccaugac

SEQ ID NO: 2499390 - RNA, 22 nt, Human
ccuggcucccaugaccauacug

SEQ ID NO: 2499391 - RNA, 20 nt, Human
ccuggcccaucaguguaccc

SEQ ID NO: 2499392 - RNA, 18 nt, Human
ccuggcccaucaguguac

SEQ ID NO: 2499393 - RNA, 17 nt, Human
ccuggcccaucagugua

SEQ ID NO: 2499394 - RNA, 12 nt, Human
ccuggccccagg

SEQ ID NO: 2499395 - RNA, 13 nt, Human
ccuggccccagga

SEQ ID NO: 2499396 - RNA, 12 nt, Human
ccuggccccaug

SEQ ID NO: 2499397 - RNA, 16 nt, Human
ccuggcccagcucccc

SEQ ID NO: 2499398 - RNA, 20 nt, Human
ccuggcccagcucccccggg

SEQ ID NO: 2499399 - RNA, 15 nt, Human
ccuggcccagcuccc

SEQ ID NO: 2499400 - RNA, 14 nt, Human
ccuggcccagcucc

SEQ ID NO: 2499401 - RNA, 13 nt, Human
ccuggcccagcuc

SEQ ID NO: 2499402 - RNA, 12 nt, Human
ccuggcccagcu

SEQ ID NO: 2499403 - RNA, 21 nt, Human
ccuggcccagcggccccuccc

SEQ ID NO: 2499404 - RNA, 20 nt, Human
ccuggcccagcggccccucc

SEQ ID NO: 2499405 - RNA, 15 nt, Human
ccuggcccagcggcc

SEQ ID NO: 2499406 - RNA, 16 nt, Human
ccuggcccacugcauc

SEQ ID NO: 2499407 - RNA, 15 nt, Human
ccugggcagaaggaa

SEQ ID NO: 2499408 - RNA, 18 nt, Human
ccugggagugagcugguu

SEQ ID NO: 2499409 - RNA, 16 nt, Human
ccugggcagaaggaag

SEQ ID NO: 2499410 - RNA, 23 nt, Human
ccugggagguggagguugcagug

SEQ ID NO: 2499411 - RNA, 17 nt, Human
ccugggcagccaggcug

SEQ ID NO: 2499412 - RNA, 18 nt, Human
ccugggcagccaggcugc

SEQ ID NO: 2499413 - RNA, 19 nt, Human
ccugggcagccaggcugcc

SEQ ID NO: 2499414 - RNA, 16 nt, Human
ccugggagugagcugg

SEQ ID NO: 2499415 - RNA, 22 nt, Human
ccugggaggucaaggcugcagu

SEQ ID NO: 2499416 - RNA, 19 nt, Human
ccugggaggaaauuugaau

SEQ ID NO: 2499417 - RNA, 18 nt, Human
ccugggagaaccucaggc

SEQ ID NO: 2499418 - RNA, 19 nt, Human
ccugggagaaccucaggcu

SEQ ID NO: 2499419 - RNA, 19 nt, Human
ccugggaccuccccugagg

SEQ ID NO: 2499420 - RNA, 17 nt, Human
ccugggaccuccccuga

SEQ ID NO: 2499421 - RNA, 17 nt, Human
ccugggagaaccucagg

SEQ ID NO: 2499422 - RNA, 20 nt, Human
ccugggaccuccccugaggc

SEQ ID NO: 2499423 - RNA, 17 nt, Human
ccugggacugcugcuuc

SEQ ID NO: 2499424 - RNA, 19 nt, Human
ccugggggcugggcagagg

SEQ ID NO: 2499425 - RNA, 21 nt, Human
ccugggggcugggcagaggaa

SEQ ID NO: 2499426 - RNA, 20 nt, Human
ccugggggcugggcagagga

SEQ ID NO: 2499427 - RNA, 14 nt, Human
ccuggggucuggag

SEQ ID NO: 2499428 - RNA, 22 nt, Human
ccugggguauaaaacuuuccuc

SEQ ID NO: 2499429 - RNA, 23 nt, Human
ccugggaguuuuguauucaucuu

SEQ ID NO: 2499430 - RNA, 18 nt, Human
ccugggggcugggcagag

SEQ ID NO: 2499431 - RNA, 21 nt, Human
ccugggguauaaaacuuuccu

SEQ ID NO: 2499432 - RNA, 23 nt, Human
ccugggcagccaggcugccaagg

SEQ ID NO: 2499433 - RNA, 22 nt, Human
ccugggucagucuggugggagg

SEQ ID NO: 2499434 - RNA, 21 nt, Human
ccugggucagucuggugggag

SEQ ID NO: 2499435 - RNA, 19 nt, Human
ccugggucagucugguggg

SEQ ID NO: 2499436 - RNA, 15 nt, Human
ccugggucagucugg

SEQ ID NO: 2499437 - RNA, 14 nt, Human
ccugggucagucug

SEQ ID NO: 2499438 - RNA, 22 nt, Human
ccuggguaaaugcagcgugaag

SEQ ID NO: 2499439 - RNA, 20 nt, Human
ccuggguaaaugcagcguga

SEQ ID NO: 2499440 - RNA, 15 nt, Human
ccuggggugggguca

SEQ ID NO: 2499441 - RNA, 20 nt, Human
ccuggggugugggaggcccg

SEQ ID NO: 2499442 - RNA, 21 nt, Human
ccugggguggggauagggagc

SEQ ID NO: 2499443 - RNA, 18 nt, Human
cgcccacaggaagccugc

SEQ ID NO: 2499444 - RNA, 16 nt, Human
cgcacgcacacacaca

SEQ ID NO: 2499445 - RNA, 15 nt, Human
cgcacgcacacacac

SEQ ID NO: 2499446 - RNA, 14 nt, Human
cgcacgcacacaca

SEQ ID NO: 2499447 - RNA, 13 nt, Human
cgcacgcacacac

SEQ ID NO: 2499448 - RNA, 16 nt, Human
cgcaccugccucagga

SEQ ID NO: 2499449 - RNA, 11 nt, Human
cgcacgcacac

SEQ ID NO: 2499450 - RNA, 18 nt, Human
cgcaccucccauccuaau

SEQ ID NO: 2499451 - RNA, 14 nt, Human
cgcaccugccucag

SEQ ID NO: 2499452 - RNA, 15 nt, Human
cgcaccugccucagg

SEQ ID NO: 2499453 - RNA, 16 nt, Human
cgcaccugcccccugg

SEQ ID NO: 2499454 - RNA, 17 nt, Human
cgcaccugcccccuggu

SEQ ID NO: 2499455 - RNA, 13 nt, Human
cgcacugggcuug

SEQ ID NO: 2499456 - RNA, 17 nt, Human
cgcacuccaugagcacc

SEQ ID NO: 2499457 - RNA, 16 nt, Human
cgcacuccaugagcac

SEQ ID NO: 2499458 - RNA, 18 nt, Human
cgcacucacccaugugcc

SEQ ID NO: 2499459 - RNA, 22 nt, Human
cgcacuacaugugguuuauaga

SEQ ID NO: 2499460 - RNA, 18 nt, Human
cgcacgugggucuucagg

SEQ ID NO: 2499461 - RNA, 14 nt, Human
cgaugcuccagcca

SEQ ID NO: 2499462 - RNA, 21 nt, Human
cgaugcugcuuuccccugugg

SEQ ID NO: 2499463 - RNA, 20 nt, Human
cgaugcugcuuuccccugug

SEQ ID NO: 2499464 - RNA, 18 nt, Human
cgaugcugcuuuccccug

SEQ ID NO: 2499465 - RNA, 12 nt, Human
cgaugcugcuuu

SEQ ID NO: 2499466 - RNA, 18 nt, Human
cgaugcuccagccaaccc

SEQ ID NO: 2499467 - RNA, 20 nt, Human
cgaugcuccagccaaccccu

SEQ ID NO: 2499468 - RNA, 22 nt, Human
cgaugcuccagccaaccccugu

SEQ ID NO: 2499469 - RNA, 23 nt, Human
cgaugcuccagccaaccccugug

SEQ ID NO: 2499470 - RNA, 19 nt, Human
cgcaccuaccaucagggac

SEQ ID NO: 2499471 - RNA, 12 nt, Human
cgcaccucccau

SEQ ID NO: 2499472 - RNA, 16 nt, Human
cgcaccucccauccua

SEQ ID NO: 2499473 - RNA, 16 nt, Human
cgcaccuaccaucagg

SEQ ID NO: 2499474 - RNA, 22 nt, Human
cgaugcugcuuuccccuguggg

SEQ ID NO: 2499475 - RNA, 18 nt, Human
cgauggauauauguuuuu

SEQ ID NO: 2499476 - RNA, 18 nt, Human
cgauggcuuugccagcuu

SEQ ID NO: 2499477 - RNA, 21 nt, Human
cgaugggcccaauucuuacaa

SEQ ID NO: 2499478 - RNA, 17 nt, Human
cgcagcccugcagaggg

SEQ ID NO: 2499479 - RNA, 15 nt, Human
cgcagcccugcagag

SEQ ID NO: 2499480 - RNA, 20 nt, Human
cgcagcauauucaggaagcu

SEQ ID NO: 2499481 - RNA, 19 nt, Human
cgcagcauauucaggaagc

SEQ ID NO: 2499482 - RNA, 17 nt, Human
cgcagcaggaggccagg

SEQ ID NO: 2499483 - RNA, 18 nt, Human
cgcagcaggaggccaggc

SEQ ID NO: 2499484 - RNA, 16 nt, Human
cgcagcaggaggccag

SEQ ID NO: 2499485 - RNA, 14 nt, Human
cgcagagcuggccg

SEQ ID NO: 2499486 - RNA, 22 nt, Human
cgcacugugacccccagcuccg

SEQ ID NO: 2499487 - RNA, 14 nt, Human
cgcagaugauccau

SEQ ID NO: 2499488 - RNA, 17 nt, Human
cgcacugggcuugggga

SEQ ID NO: 2499489 - RNA, 23 nt, Human
cgcacuucgggaggucgaggcag

SEQ ID NO: 2499490 - RNA, 17 nt, Human
cgcacugugacccccag

SEQ ID NO: 2499491 - RNA, 14 nt, Human
cgagagggagagag

SEQ ID NO: 2499492 - RNA, 13 nt, Human
cgagagggagaga

SEQ ID NO: 2499493 - RNA, 15 nt, Human
cgagaggcagagaaa

SEQ ID NO: 2499494 - RNA, 14 nt, Human
cgagaggcagagaa

SEQ ID NO: 2499495 - RNA, 15 nt, Human
cgagaggaggggccc

SEQ ID NO: 2499496 - RNA, 14 nt, Human
cgagaggaggggcc

SEQ ID NO: 2499497 - RNA, 21 nt, Human
cgagagccugcucccccaccc

SEQ ID NO: 2499498 - RNA, 19 nt, Human
cgagcccugguggcagugg

SEQ ID NO: 2499499 - RNA, 21 nt, Human
cgagagagcaccccucucugc

SEQ ID NO: 2499500 - RNA, 21 nt, Human
cgagagacuuguggccuggga

SEQ ID NO: 2499501 - RNA, 13 nt, Human
cgagagccugcuc

SEQ ID NO: 2499502 - RNA, 14 nt, Human
cgagagccugcucc

SEQ ID NO: 2499503 - RNA, 15 nt, Human
cgagagccugcuccc

SEQ ID NO: 2499504 - RNA, 19 nt, Human
cgagagccugcucccccac

SEQ ID NO: 2499505 - RNA, 20 nt, Human
cgagagccugcucccccacc

SEQ ID NO: 2499506 - RNA, 23 nt, Human
cgagccucugucacugcaggcac

SEQ ID NO: 2499507 - RNA, 20 nt, Human
cgagccucugucacugcagg

SEQ ID NO: 2499508 - RNA, 19 nt, Human
cgagccucugucacugcag

SEQ ID NO: 2499509 - RNA, 22 nt, Human
cgagccggggaguuucuuuccu

SEQ ID NO: 2499510 - RNA, 18 nt, Human
cgagccggggaguuucuu

SEQ ID NO: 2499511 - RNA, 17 nt, Human
cgagccgggccuggggc

SEQ ID NO: 2499512 - RNA, 15 nt, Human
cgagccgggccuggg

SEQ ID NO: 2499513 - RNA, 14 nt, Human
cgagccgggccugg

SEQ ID NO: 2499514 - RNA, 23 nt, Human
cgagcccuguggaugagcccuca

SEQ ID NO: 2499515 - RNA, 16 nt, Human
cgagagggagagagag

SEQ ID NO: 2499516 - RNA, 18 nt, Human
cgagcccugguggcagug

SEQ ID NO: 2499517 - RNA, 13 nt, Human
cgagccuggcucc

SEQ ID NO: 2499518 - RNA, 14 nt, Human
cgaggacagggagg

SEQ ID NO: 2499519 - RNA, 12 nt, Human
cgaggcagagga

SEQ ID NO: 2499520 - RNA, 15 nt, Human
cgaggcagaggacag

SEQ ID NO: 2499521 - RNA, 13 nt, Human
cgaggcagaggac

SEQ ID NO: 2499522 - RNA, 14 nt, Human
cgaggcagggucag

SEQ ID NO: 2499523 - RNA, 19 nt, Human
cgaggccaguaccuuucca

SEQ ID NO: 2499524 - RNA, 11 nt, Human
cgaggccagua

SEQ ID NO: 2499525 - RNA, 22 nt, Human
cgaggcagggucaggagagggg

SEQ ID NO: 2499526 - RNA, 21 nt, Human
cgaggcccucgggcccagccc

SEQ ID NO: 2499527 - RNA, 17 nt, Human
cgaggccuaccccgcag

SEQ ID NO: 2499528 - RNA, 20 nt, Human
cgaggcccucgggcccagcc

SEQ ID NO: 2499529 - RNA, 19 nt, Human
cgaggcccucgggcccagc

SEQ ID NO: 2499530 - RNA, 13 nt, Human
cgaggcccgcaug

SEQ ID NO: 2499531 - RNA, 23 nt, Human
cgaggccuaccccgcagacaccu

SEQ ID NO: 2499532 - RNA, 23 nt, Human
cgaugaauuuggagacucugugg

SEQ ID NO: 2499533 - RNA, 15 nt, Human
cgaugcaaugaacac

SEQ ID NO: 2499534 - RNA, 14 nt, Human
cgaggacccagacc

SEQ ID NO: 2499535 - RNA, 13 nt, Human
cgaggacccagac

SEQ ID NO: 2499536 - RNA, 12 nt, Human
cgaggacccaga

SEQ ID NO: 2499537 - RNA, 21 nt, Human
cgaggacaugaaacuccaccu

SEQ ID NO: 2499538 - RNA, 20 nt, Human
cgaggacccagacccagugg

SEQ ID NO: 2499539 - RNA, 17 nt, Human
cgaggacccagacccag

SEQ ID NO: 2499540 - RNA, 18 nt, Human
cgaggacuguauuuguga

SEQ ID NO: 2499541 - RNA, 16 nt, Human
cgaggacagggaggug

SEQ ID NO: 2499542 - RNA, 21 nt, Human
cgaggacuguauuugugacua

SEQ ID NO: 2499543 - RNA, 20 nt, Human
cgaggacuguauuugugacu

SEQ ID NO: 2499544 - RNA, 19 nt, Human
cgaggacuguauuugugac

SEQ ID NO: 2499545 - RNA, 19 nt, Human
cgaggaggcuccagagggc

SEQ ID NO: 2499546 - RNA, 20 nt, Human
cgaggaggcuccagagggca

SEQ ID NO: 2499547 - RNA, 17 nt, Human
cgaggagguaaugaauu

SEQ ID NO: 2499548 - RNA, 17 nt, Human
cgcuuaaaggugucuuc

SEQ ID NO: 2499549 - RNA, 14 nt, Human
cgcuguucacccac

SEQ ID NO: 2499550 - RNA, 13 nt, Human
cgcuucccccaua

SEQ ID NO: 2499551 - RNA, 16 nt, Human
cgcuucccccauagcc

SEQ ID NO: 2499552 - RNA, 17 nt, Human
cgcuguugcugaauagg

SEQ ID NO: 2499553 - RNA, 14 nt, Human
cgcuguugcugaau

SEQ ID NO: 2499554 - RNA, 13 nt, Human
cgcuguugcugaa

SEQ ID NO: 2499555 - RNA, 20 nt, Human
cgcuguguguuaguucccaa

SEQ ID NO: 2499556 - RNA, 14 nt, Human
cgcugugggcaggu

SEQ ID NO: 2499557 - RNA, 20 nt, Human
cgcuuccggcuccugugcuu

SEQ ID NO: 2499558 - RNA, 17 nt, Human
cgcuuccggcuccugug

SEQ ID NO: 2499559 - RNA, 18 nt, Human
cgcuucccccauagccac

SEQ ID NO: 2499560 - RNA, 20 nt, Human
cgcuucccccauagccaccc

SEQ ID NO: 2499561 - RNA, 14 nt, Human
cgcuucugccugca

SEQ ID NO: 2499562 - RNA, 15 nt, Human
cgcuucuugccucug

SEQ ID NO: 2499563 - RNA, 12 nt, Human
cgcuucugacug

SEQ ID NO: 2499564 - RNA, 23 nt, Human
cgcugugcugcccugcccaccug

SEQ ID NO: 2499565 - RNA, 21 nt, Human
cgcugugcugcccugcccacc

SEQ ID NO: 2499566 - RNA, 19 nt, Human
cgcugugcugcccugccca

SEQ ID NO: 2499567 - RNA, 19 nt, Human
cgcugugagccccuggucc

SEQ ID NO: 2499568 - RNA, 16 nt, Human
cgcugugagccccugg

SEQ ID NO: 2499569 - RNA, 20 nt, Human
cgcugucuccagacccccac

SEQ ID NO: 2499570 - RNA, 22 nt, Human
cgcugucuccagacccccaccc

SEQ ID NO: 2499571 - RNA, 14 nt, Human
cgcugugcugcccu

SEQ ID NO: 2499572 - RNA, 13 nt, Human
cgcugugcugccc

SEQ ID NO: 2499573 - RNA, 11 nt, Human
cgcugugcugc

SEQ ID NO: 2499574 - RNA, 16 nt, Human
cgcugucuccagaccc

SEQ ID NO: 2499575 - RNA, 14 nt, Human
cgcuccugucugcc

SEQ ID NO: 2499576 - RNA, 18 nt, Human
cgcuccccgccuguuccc

SEQ ID NO: 2499577 - RNA, 17 nt, Human
cgcuccccgccuguucc

SEQ ID NO: 2499578 - RNA, 16 nt, Human
cgcuccccgccuguuc

SEQ ID NO: 2499579 - RNA, 14 nt, Human
cgcuccccgccugu

SEQ ID NO: 2499580 - RNA, 22 nt, Human
cgcucccagugucuuccugugg

SEQ ID NO: 2499581 - RNA, 21 nt, Human
cgcucccagugucuuccugug

SEQ ID NO: 2499582 - RNA, 14 nt, Human
cgcucccagugucu

SEQ ID NO: 2499583 - RNA, 20 nt, Human
cgcuccugccgcagagcugg

SEQ ID NO: 2499584 - RNA, 19 nt, Human
cgcuccugccgcagagcug

SEQ ID NO: 2499585 - RNA, 22 nt, Human
cgcuccucccucugaggcugua

SEQ ID NO: 2499586 - RNA, 18 nt, Human
cgcuccugccgcagagcu

SEQ ID NO: 2499587 - RNA, 19 nt, Human
cgcuccccgccuguucccc

SEQ ID NO: 2499588 - RNA, 22 nt, Human
cgcuugugcagaaaacauuguu

SEQ ID NO: 2499589 - RNA, 17 nt, Human
cgcuucuugccucugug

SEQ ID NO: 2499590 - RNA, 16 nt, Human
cgcuucuugccucugu

SEQ ID NO: 2499591 - RNA, 14 nt, Human
cgcuuucuacccag

SEQ ID NO: 2499592 - RNA, 16 nt, Human
cgcuuucuacccagcg

SEQ ID NO: 2499593 - RNA, 22 nt, Human
cgcuuucuagcuguugagcugu

SEQ ID NO: 2499594 - RNA, 16 nt, Human
cgcuuucuagcuguug

SEQ ID NO: 2499595 - RNA, 14 nt, Human
cgcuuuccugaauc

SEQ ID NO: 2499596 - RNA, 20 nt, Human
cgcuugugcagaaaacauug

SEQ ID NO: 2499597 - RNA, 17 nt, Human
cgcuucugaaugcugcu

SEQ ID NO: 2499598 - RNA, 17 nt, Human
cggaauaguuggcuagg

SEQ ID NO: 2499599 - RNA, 16 nt, Human
cggaauaguuggcuag

SEQ ID NO: 2499600 - RNA, 21 nt, Human
cggaaucacucuguccuugga

SEQ ID NO: 2499601 - RNA, 20 nt, Human
cggacagccacggccaggcc

SEQ ID NO: 2499602 - RNA, 22 nt, Human
cgcuuucuggaaaagaggaguu

SEQ ID NO: 2499603 - RNA, 13 nt, Human
cgcuuucuaugua

SEQ ID NO: 2499604 - RNA, 15 nt, Human
cggaauccuguccuc

SEQ ID NO: 2499605 - RNA, 14 nt, Human
cggagugaagaggg

SEQ ID NO: 2499606 - RNA, 23 nt, Human
cggagucguggggugugcuggga

SEQ ID NO: 2499607 - RNA, 22 nt, Human
cggagucguggggugugcuggg

SEQ ID NO: 2499608 - RNA, 16 nt, Human
cggacuuuucugcaaa

SEQ ID NO: 2499609 - RNA, 17 nt, Human
cggagaaaggaagggcu

SEQ ID NO: 2499610 - RNA, 15 nt, Human
cggagaaaggaaggg

SEQ ID NO: 2499611 - RNA, 15 nt, Human
cggacuuuucugcaa

SEQ ID NO: 2499612 - RNA, 14 nt, Human
cggacuuuucugca

SEQ ID NO: 2499613 - RNA, 17 nt, Human
cggacuuagcugggaga

SEQ ID NO: 2499614 - RNA, 22 nt, Human
cggacagccacggccaggccag

SEQ ID NO: 2499615 - RNA, 21 nt, Human
cggacagccacggccaggcca

SEQ ID NO: 2499616 - RNA, 16 nt, Human
cggacuuagcugggag

SEQ ID NO: 2499617 - RNA, 17 nt, Human
cggaauccuguccucag

SEQ ID NO: 2499618 - RNA, 18 nt, Human
cgcaggaacucccagcaa

SEQ ID NO: 2499619 - RNA, 17 nt, Human
cgcaggaacucccagca

SEQ ID NO: 2499620 - RNA, 15 nt, Human
cgcaggaacucccag

SEQ ID NO: 2499621 - RNA, 20 nt, Human
cgcagcucuugcccuucccu

SEQ ID NO: 2499622 - RNA, 23 nt, Human
cgcagcucuugcccuucccuguc

SEQ ID NO: 2499623 - RNA, 19 nt, Human
cgcagcucuugcccuuccc

SEQ ID NO: 2499624 - RNA, 18 nt, Human
cgcagcucuugcccuucc

SEQ ID NO: 2499625 - RNA, 17 nt, Human
cgcagcucuugcccuuc

SEQ ID NO: 2499626 - RNA, 13 nt, Human
cgcagcucuugcc

SEQ ID NO: 2499627 - RNA, 16 nt, Human
cgcagccucccucuga

SEQ ID NO: 2499628 - RNA, 19 nt, Human
cgccauugcacuccagccu

SEQ ID NO: 2499629 - RNA, 18 nt, Human
cgccauugccaccaggag

SEQ ID NO: 2499630 - RNA, 16 nt, Human
cgccauugccaccagg

SEQ ID NO: 2499631 - RNA, 17 nt, Human
cgccauugccaccagga

SEQ ID NO: 2499632 - RNA, 20 nt, Human
cgccauggcuuccaaggugg

SEQ ID NO: 2499633 - RNA, 15 nt, Human
cgccauugcacucca

SEQ ID NO: 2499634 - RNA, 14 nt, Human
cgccauugccacca

SEQ ID NO: 2499635 - RNA, 18 nt, Human
cgccauucucaagcccug

SEQ ID NO: 2499636 - RNA, 12 nt, Human
cgcaggaagcug

SEQ ID NO: 2499637 - RNA, 19 nt, Human
cgcagcccugcagagggca

SEQ ID NO: 2499638 - RNA, 18 nt, Human
cgcagcccugcagagggc

SEQ ID NO: 2499639 - RNA, 24 nt, Human
cgcagcccugcuuugggcugcccu

SEQ ID NO: 2499640 - RNA, 15 nt, Human
cgcagcccugcuuug

SEQ ID NO: 2499641 - RNA, 13 nt, Human
cgcagcccugcuu

SEQ ID NO: 2499642 - RNA, 13 nt, Human
cgcagccaaggcc

SEQ ID NO: 2499643 - RNA, 12 nt, Human
cgcagccaaggc

SEQ ID NO: 2499644 - RNA, 23 nt, Human
cgcccgcugggcugagccccuac

SEQ ID NO: 2499645 - RNA, 16 nt, Human
cgcccgcugggcugag

SEQ ID NO: 2499646 - RNA, 14 nt, Human
cgcccgcugggcug

SEQ ID NO: 2499647 - RNA, 13 nt, Human
cgcccgcugggcu

SEQ ID NO: 2499648 - RNA, 18 nt, Human
cgcccggcuaauuuuugu

SEQ ID NO: 2499649 - RNA, 12 nt, Human
cgcccgcgcccu

SEQ ID NO: 2499650 - RNA, 13 nt, Human
cgcccgcgcccgc

SEQ ID NO: 2499651 - RNA, 21 nt, Human
cgcccgcccacuguccugggc

SEQ ID NO: 2499652 - RNA, 19 nt, Human
cgcccgcccacuguccugg

SEQ ID NO: 2499653 - RNA, 18 nt, Human
cgcccgcccacuguccug

SEQ ID NO: 2499654 - RNA, 16 nt, Human
cgcccgcccacugucc

SEQ ID NO: 2499655 - RNA, 14 nt, Human
cgcccgcccacugu

SEQ ID NO: 2499656 - RNA, 13 nt, Human
cgccccuuccccc

SEQ ID NO: 2499657 - RNA, 21 nt, Human
cgcccagucuggaaugcagug

SEQ ID NO: 2499658 - RNA, 19 nt, Human
cgcccagucuggaaugcag

SEQ ID NO: 2499659 - RNA, 13 nt, Human
cgcccagucugga

SEQ ID NO: 2499660 - RNA, 16 nt, Human
cgcccaacccuucccc

SEQ ID NO: 2499661 - RNA, 15 nt, Human
cgcccaacccuuccc

SEQ ID NO: 2499662 - RNA, 14 nt, Human
cgcccaacccuucc

SEQ ID NO: 2499663 - RNA, 17 nt, Human
cgcccaaagccagacag

SEQ ID NO: 2499664 - RNA, 18 nt, Human
cgcccaacuaauuuuugu

SEQ ID NO: 2499665 - RNA, 12 nt, Human
cgcccaaggccc

SEQ ID NO: 2499666 - RNA, 15 nt, Human
cgcccguccugccug

SEQ ID NO: 2499667 - RNA, 21 nt, Human
cgccuucucccccccggggcu

SEQ ID NO: 2499668 - RNA, 13 nt, Human
cgccuucuccccc

SEQ ID NO: 2499669 - RNA, 14 nt, Human
cgcccguccugccu

SEQ ID NO: 2499670 - RNA, 12 nt, Human
cgcccguccugc

SEQ ID NO: 2499671 - RNA, 14 nt, Human
cgcgacaaugcaaa

SEQ ID NO: 2499672 - RNA, 19 nt, Human
cgccuucucccccccgggg

SEQ ID NO: 2499673 - RNA, 14 nt, Human
cgccuuucccaacu

SEQ ID NO: 2499674 - RNA, 12 nt, Human
cgccuuguucuu

SEQ ID NO: 2499675 - RNA, 13 nt, Human
cgccuuucccagg

SEQ ID NO: 2499676 - RNA, 15 nt, Human
cgcgacaaugcaaac

SEQ ID NO: 2499677 - RNA, 23 nt, Human
cgcgggagccaugcgcccccucc

SEQ ID NO: 2499678 - RNA, 19 nt, Human
cgcgguggcucacgccugu

SEQ ID NO: 2499679 - RNA, 24 nt, Human
cgcuacccgggaagggggcuggga

SEQ ID NO: 2499680 - RNA, 21 nt, Human
cgcuacccgggaagggggcug

SEQ ID NO: 2499681 - RNA, 17 nt, Human
cgcuacccgggaagggg

SEQ ID NO: 2499682 - RNA, 22 nt, Human
cgcuaaagagcccuugccuccc

SEQ ID NO: 2499683 - RNA, 18 nt, Human
cgcuacccgggaaggggg

SEQ ID NO: 2499684 - RNA, 21 nt, Human
cgcuaaagagcccuugccucc

SEQ ID NO: 2499685 - RNA, 19 nt, Human
cgcuaaagagcccuugccu

SEQ ID NO: 2499686 - RNA, 15 nt, Human
cgcuaaagagcccuu

SEQ ID NO: 2499687 - RNA, 17 nt, Human
cgcguuguaaaauauag

SEQ ID NO: 2499688 - RNA, 16 nt, Human
cgcguuguaaaauaua

SEQ ID NO: 2499689 - RNA, 22 nt, Human
cgcgaaaguaucaccagggugc

SEQ ID NO: 2499690 - RNA, 15 nt, Human
cgcggggacauuggg

SEQ ID NO: 2499691 - RNA, 16 nt, Human
cggcuucaugccagcu

SEQ ID NO: 2499692 - RNA, 15 nt, Human
cggcuucaugccagc

SEQ ID NO: 2499693 - RNA, 23 nt, Human
cggcuuagacuucgacucaggau

SEQ ID NO: 2499694 - RNA, 20 nt, Human
cggccucucuggccucccac

SEQ ID NO: 2499695 - RNA, 13 nt, Human
cggcuggccuggc

SEQ ID NO: 2499696 - RNA, 23 nt, Human
cggcuggcagcccaccccucaac

SEQ ID NO: 2499697 - RNA, 14 nt, Human
cgggaagagaggag

SEQ ID NO: 2499698 - RNA, 12 nt, Human
cgggaagagagg

SEQ ID NO: 2499699 - RNA, 20 nt, Human
cgggaaccucacucuugcca

SEQ ID NO: 2499700 - RNA, 14 nt, Human
cgggaaccucacuc

SEQ ID NO: 2499701 - RNA, 20 nt, Human
cgggaacaguguuucccaua

SEQ ID NO: 2499702 - RNA, 22 nt, Human
cgggaaagccagugacuccagg

SEQ ID NO: 2499703 - RNA, 13 nt, Human
cgggaacaguguu

SEQ ID NO: 2499704 - RNA, 22 nt, Human
cgggaacaguguuucccauaau

SEQ ID NO: 2499705 - RNA, 19 nt, Human
cggcuucaugccagcuacu

SEQ ID NO: 2499706 - RNA, 16 nt, Human
cggcuuuucucagcug

SEQ ID NO: 2499707 - RNA, 23 nt, Human
cgggaaaagcagcccuuggccag

SEQ ID NO: 2499708 - RNA, 22 nt, Human
cgggaaaagcagcccuuggcca

SEQ ID NO: 2499709 - RNA, 20 nt, Human
cgggaaagccagugacucca

SEQ ID NO: 2499710 - RNA, 14 nt, Human
cgggaaagaagagc

SEQ ID NO: 2499711 - RNA, 15 nt, Human
cgggaacagacaaca

SEQ ID NO: 2499712 - RNA, 20 nt, Human
cgggaaggucaccagcacca

SEQ ID NO: 2499713 - RNA, 15 nt, Human
cgggacaccugcccu

SEQ ID NO: 2499714 - RNA, 17 nt, Human
cgggaaggucaccagca

SEQ ID NO: 2499715 - RNA, 20 nt, Human
cgggaauuuucaucuaggau

SEQ ID NO: 2499716 - RNA, 18 nt, Human
cgggaauuuucaucuagg

SEQ ID NO: 2499717 - RNA, 12 nt, Human
cgggaaggaggg

SEQ ID NO: 2499718 - RNA, 14 nt, Human
cgggaaggaggguu

SEQ ID NO: 2499719 - RNA, 16 nt, Human
cgggaaggucaccagc

SEQ ID NO: 2499720 - RNA, 23 nt, Human
cgggaagcaucuuccagaagugu

SEQ ID NO: 2499721 - RNA, 23 nt, Human
cgggaaggaggguuagggagggg

SEQ ID NO: 2499722 - RNA, 20 nt, Human
cgggaagggggcugggacau

SEQ ID NO: 2499723 - RNA, 19 nt, Human
cgggaagggggcugggaca

SEQ ID NO: 2499724 - RNA, 16 nt, Human
cgggaagggggcuggg

SEQ ID NO: 2499725 - RNA, 22 nt, Human
cgggaagagaggaguucaauga

SEQ ID NO: 2499726 - RNA, 20 nt, Human
cgggaagagaggaguucaau

SEQ ID NO: 2499727 - RNA, 19 nt, Human
cgggaagagaggaguucaa

SEQ ID NO: 2499728 - RNA, 18 nt, Human
cgggaagagaggaguuca

SEQ ID NO: 2499729 - RNA, 24 nt, Human
cgggaagagaggaguucaaugauc

SEQ ID NO: 2499730 - RNA, 23 nt, Human
cgggaagagaggaguucaaugau

SEQ ID NO: 2499731 - RNA, 12 nt, Human
cgggaagcggag

SEQ ID NO: 2499732 - RNA, 20 nt, Human
cggccaggccagagggagug

SEQ ID NO: 2499733 - RNA, 12 nt, Human
cggccaggccag

SEQ ID NO: 2499734 - RNA, 14 nt, Human
cggcccuaugcaug

SEQ ID NO: 2499735 - RNA, 20 nt, Human
cggcccuaccagcgcccgcu

SEQ ID NO: 2499736 - RNA, 21 nt, Human
cggcccuaccagcgcccgcug

SEQ ID NO: 2499737 - RNA, 18 nt, Human
cggcccuaccagcgcccg

SEQ ID NO: 2499738 - RNA, 22 nt, Human
cggccagccccuggccccagga

SEQ ID NO: 2499739 - RNA, 22 nt, Human
cggccagccccggcccugggcu

SEQ ID NO: 2499740 - RNA, 11 nt, Human
cggccaggcca

SEQ ID NO: 2499741 - RNA, 22 nt, Human
cggagugaagaggggcagcccu

SEQ ID NO: 2499742 - RNA, 20 nt, Human
cggagugaagaggggcagcc

SEQ ID NO: 2499743 - RNA, 19 nt, Human
cggagugaagaggggcagc

SEQ ID NO: 2499744 - RNA, 18 nt, Human
cggagugaagaggggcag

SEQ ID NO: 2499745 - RNA, 23 nt, Human
cggagugaagaggggcagcccuu

SEQ ID NO: 2499746 - RNA, 19 nt, Human
cggagugagaagcuuugcc

SEQ ID NO: 2499747 - RNA, 13 nt, Human
cggaguugggggu

SEQ ID NO: 2499748 - RNA, 18 nt, Human
cggaucaccgagaguagc

SEQ ID NO: 2499749 - RNA, 23 nt, Human
cggaucaccgagaguagccgaga

SEQ ID NO: 2499750 - RNA, 19 nt, Human
cggccucucuggccuccca

SEQ ID NO: 2499751 - RNA, 18 nt, Human
cggccucucuggccuccc

SEQ ID NO: 2499752 - RNA, 16 nt, Human
cggccucucuggccuc

SEQ ID NO: 2499753 - RNA, 15 nt, Human
cggccucucuggccu

SEQ ID NO: 2499754 - RNA, 14 nt, Human
cggccucucuggcc

SEQ ID NO: 2499755 - RNA, 13 nt, Human
cggccucucuggc

SEQ ID NO: 2499756 - RNA, 22 nt, Human
cggccucuaaccccaggccccg

SEQ ID NO: 2499757 - RNA, 21 nt, Human
cggccucuaaccccaggcccc

SEQ ID NO: 2499758 - RNA, 20 nt, Human
cggccucuaaccccaggccc

SEQ ID NO: 2499759 - RNA, 19 nt, Human
cggccucuaaccccaggcc

SEQ ID NO: 2499760 - RNA, 18 nt, Human
cggccucuaaccccaggc

SEQ ID NO: 2499761 - RNA, 17 nt, Human
cggccucuaaccccagg

SEQ ID NO: 2499762 - RNA, 15 nt, Human
cggccucuaacccca

SEQ ID NO: 2499763 - RNA, 13 nt, Human
cggccucuaaccc

SEQ ID NO: 2499764 - RNA, 14 nt, Human
cggcuggcagccca

SEQ ID NO: 2499765 - RNA, 21 nt, Human
cggccucucuggccucccacc

SEQ ID NO: 2499766 - RNA, 15 nt, Human
cggccugaugcuccc

SEQ ID NO: 2499767 - RNA, 16 nt, Human
cggccugaugcucccu

SEQ ID NO: 2499768 - RNA, 22 nt, Human
cggccuccguccaggagccugg

SEQ ID NO: 2499769 - RNA, 21 nt, Human
cggccuccguccaggagccug

SEQ ID NO: 2499770 - RNA, 15 nt, Human
cggccucccaaagug

SEQ ID NO: 2499771 - RNA, 12 nt, Human
cggccgcuccag

SEQ ID NO: 2499772 - RNA, 16 nt, Human
cggccgcauucccuga

SEQ ID NO: 2499773 - RNA, 13 nt, Human
cggccgcauuccc

SEQ ID NO: 2499774 - RNA, 15 nt, Human
cggccgcauucccug

SEQ ID NO: 2499775 - RNA, 18 nt, Human
cggccgcauucccugagu

SEQ ID NO: 2499776 - RNA, 22 nt, Human
cggcccugggcucggaggcugc

SEQ ID NO: 2499777 - RNA, 11 nt, Human
cggcccugggg

SEQ ID NO: 2499778 - RNA, 12 nt, Human
cggcccuggggc

SEQ ID NO: 2499779 - RNA, 18 nt, Human
cggcccugggcucggagg

SEQ ID NO: 2499780 - RNA, 13 nt, Human
cggcccugggcuc

SEQ ID NO: 2499781 - RNA, 22 nt, Human
cggcccuccuacccugcgccca

SEQ ID NO: 2499782 - RNA, 23 nt, Human
cggcccuccuacccugcgcccag

SEQ ID NO: 2499783 - RNA, 20 nt, Human
cggcccuccuacccugcgcc

SEQ ID NO: 2499784 - RNA, 23 nt, Human
ccuuugugaggaagccgcugggg

SEQ ID NO: 2499785 - RNA, 17 nt, Human
ccuuugugaggaagccg

SEQ ID NO: 2499786 - RNA, 16 nt, Human
ccuuugugaggaagcc

SEQ ID NO: 2499787 - RNA, 15 nt, Human
ccuuugugaggaagc

SEQ ID NO: 2499788 - RNA, 23 nt, Human
ccuuuguccccaccgcagacagg

SEQ ID NO: 2499789 - RNA, 22 nt, Human
ccuuuguccccaccgcagacag

SEQ ID NO: 2499790 - RNA, 14 nt, Human
ccuuugugaggaag

SEQ ID NO: 2499791 - RNA, 14 nt, Human
ccuuugucuuguca

SEQ ID NO: 2499792 - RNA, 23 nt, Human
ccuuugucaucuuucuucuauuu

SEQ ID NO: 2499793 - RNA, 13 nt, Human
ccuuuuuugauca

SEQ ID NO: 2499794 - RNA, 12 nt, Human
ccuuuuuugauc

SEQ ID NO: 2499795 - RNA, 15 nt, Human
ccuuuuuuggcugcu

SEQ ID NO: 2499796 - RNA, 22 nt, Human
ccuuuuuucacggaaguuuuca

SEQ ID NO: 2499797 - RNA, 22 nt, Human
ccuuuuuuauuuuuuuaagcug

SEQ ID NO: 2499798 - RNA, 20 nt, Human
ccuuuguuuuuaugaagaaa

SEQ ID NO: 2499799 - RNA, 19 nt, Human
ccuuuuuuauacauaaaca

SEQ ID NO: 2499800 - RNA, 18 nt, Human
ccuuuuaacaccugaugu

SEQ ID NO: 2499801 - RNA, 13 nt, Human
ccuuugugcugug

SEQ ID NO: 2499802 - RNA, 12 nt, Human
ccuuugugcugu

SEQ ID NO: 2499803 - RNA, 13 nt, Human
ccuuuguguuucu

SEQ ID NO: 2499804 - RNA, 23 nt, Human
ccuuuguuuugauguuuguggcc

SEQ ID NO: 2499805 - RNA, 19 nt, Human
ccuuuguuuuuaugaagaa

SEQ ID NO: 2499806 - RNA, 19 nt, Human
ccuuuguuuuuuuuuccug

SEQ ID NO: 2499807 - RNA, 22 nt, Human
ccuuuguauucucuccuguacc

SEQ ID NO: 2499808 - RNA, 23 nt, Human
ccuuuguauucucuccuguaccu

SEQ ID NO: 2499809 - RNA, 24 nt, Human
ccuuuguauucucuccuguaccuc

SEQ ID NO: 2499810 - RNA, 16 nt, Human
ccuuugguuuuuuucu

SEQ ID NO: 2499811 - RNA, 18 nt, Human
ccuuuguccccaccgcag

SEQ ID NO: 2499812 - RNA, 16 nt, Human
ccuuuguccccaccgc

SEQ ID NO: 2499813 - RNA, 14 nt, Human
ccuuuguccccacc

SEQ ID NO: 2499814 - RNA, 14 nt, Human
ccuuugucccagaa

SEQ ID NO: 2499815 - RNA, 23 nt, Human
ccuuugucaucauuguauauaug

SEQ ID NO: 2499816 - RNA, 19 nt, Human
ccuuugucaucauuguaua

SEQ ID NO: 2499817 - RNA, 18 nt, Human
ccuuugucaucuuucuuc

SEQ ID NO: 2499818 - RNA, 17 nt, Human
ccuuugggcccagggac

SEQ ID NO: 2499819 - RNA, 16 nt, Human
ccuuugggcccaggga

SEQ ID NO: 2499820 - RNA, 14 nt, Human
ccuuugggcccagg

SEQ ID NO: 2499821 - RNA, 14 nt, Human
ccuuugggaagggg

SEQ ID NO: 2499822 - RNA, 19 nt, Human
ccuuugggaggcugaggcg

SEQ ID NO: 2499823 - RNA, 15 nt, Human
ccuuugguucuggcc

SEQ ID NO: 2499824 - RNA, 20 nt, Human
ccuuugguucuggccagaau

SEQ ID NO: 2499825 - RNA, 21 nt, Human
ccuuuguaaauugucagaugc

SEQ ID NO: 2499826 - RNA, 14 nt, Human
ccuuugguucuggc

SEQ ID NO: 2499827 - RNA, 18 nt, Human
ccuuuggggggggcccgc

SEQ ID NO: 2499828 - RNA, 16 nt, Human
ccuugugccuggcuca

SEQ ID NO: 2499829 - RNA, 11 nt, Human
ccuugugccug

SEQ ID NO: 2499830 - RNA, 23 nt, Human
ccuugugauguggcaauaaauuu

SEQ ID NO: 2499831 - RNA, 22 nt, Human
ccuuguggccugggccuccuca

SEQ ID NO: 2499832 - RNA, 17 nt, Human
ccuugggcccuuugagu

SEQ ID NO: 2499833 - RNA, 16 nt, Human
ccuuguggccugggcc

SEQ ID NO: 2499834 - RNA, 17 nt, Human
ccuugugccuggcucag

SEQ ID NO: 2499835 - RNA, 18 nt, Human
ccuugugccuggcucaga

SEQ ID NO: 2499836 - RNA, 13 nt, Human
ccuugucugagau

SEQ ID NO: 2499837 - RNA, 16 nt, Human
ccuuguauuuaaauau

SEQ ID NO: 2499838 - RNA, 21 nt, Human
ccuuguauuuaaauauuaaau

SEQ ID NO: 2499839 - RNA, 21 nt, Human
ccuugucguugacuuuaggga

SEQ ID NO: 2499840 - RNA, 22 nt, Human
ccuuuuuuggcugcugaaggcu

SEQ ID NO: 2499841 - RNA, 20 nt, Human
ccuuuuuuggcugcugaagg

SEQ ID NO: 2499842 - RNA, 18 nt, Human
ccuuuuuuggcugcugaa

SEQ ID NO: 2499843 - RNA, 17 nt, Human
ccuuuuuuggcugcuga

SEQ ID NO: 2499844 - RNA, 20 nt, Human
cgaaauaacaauguuaagga

SEQ ID NO: 2499845 - RNA, 17 nt, Human
cgaaauaacaauguuaa

SEQ ID NO: 2499846 - RNA, 16 nt, Human
cgaaauaacaauguua

SEQ ID NO: 2499847 - RNA, 11 nt, Human
cgaaauaacaa

SEQ ID NO: 2499848 - RNA, 20 nt, Human
ccuuuuuuggcuuuagacac

SEQ ID NO: 2499849 - RNA, 23 nt, Human
ccuuuuuugauaaaguuucucag

SEQ ID NO: 2499850 - RNA, 23 nt, Human
cgaaagggacuuggaagcuccgc

SEQ ID NO: 2499851 - RNA, 21 nt, Human
cgaacauguuuuucuucuccc

SEQ ID NO: 2499852 - RNA, 23 nt, Human
cgaacauguuuuucuucucccuc

SEQ ID NO: 2499853 - RNA, 22 nt, Human
cgaaauguuauuuuuuaauuau

SEQ ID NO: 2499854 - RNA, 14 nt, Human
cgaaauguuauuuu

SEQ ID NO: 2499855 - RNA, 13 nt, Human
cgaaauguuauuu

SEQ ID NO: 2499856 - RNA, 19 nt, Human
cgaacauccaaccuuccca

SEQ ID NO: 2499857 - RNA, 22 nt, Human
cgaacacccucgaagcgcgcca

SEQ ID NO: 2499858 - RNA, 18 nt, Human
cgaacacccucgaagcgc

SEQ ID NO: 2499859 - RNA, 21 nt, Human
cgaacacccucgaagcgcgcc

SEQ ID NO: 2499860 - RNA, 11 nt, Human
cgaagcgcgcc

SEQ ID NO: 2499861 - RNA, 14 nt, Human
cgaagcccaggccc

SEQ ID NO: 2499862 - RNA, 16 nt, Human
cgaagcgcgccacucg

SEQ ID NO: 2499863 - RNA, 20 nt, Human
cgaacauggaacucauuccu

SEQ ID NO: 2499864 - RNA, 22 nt, Human
cgaacauggaacucauuccugc

SEQ ID NO: 2499865 - RNA, 15 nt, Human
cgaauagcugggacu

SEQ ID NO: 2499866 - RNA, 13 nt, Human
cgaaggggcccug

SEQ ID NO: 2499867 - RNA, 13 nt, Human
cgaaggugcugga

SEQ ID NO: 2499868 - RNA, 16 nt, Human
cgaaggugcuggaggu

SEQ ID NO: 2499869 - RNA, 18 nt, Human
cgaagcuuugaaggccga

SEQ ID NO: 2499870 - RNA, 20 nt, Human
cgaagcucuggcugaacccu

SEQ ID NO: 2499871 - RNA, 23 nt, Human
cgaaggcagugcaagagacucug

SEQ ID NO: 2499872 - RNA, 15 nt, Human
cgaagcucuggcuga

SEQ ID NO: 2499873 - RNA, 14 nt, Human
cgaagcucuggcug

SEQ ID NO: 2499874 - RNA, 12 nt, Human
cgaagcucuggc

SEQ ID NO: 2499875 - RNA, 18 nt, Human
cgaagcucagcccacccc

SEQ ID NO: 2499876 - RNA, 13 nt, Human
cgaagcucagccc

SEQ ID NO: 2499877 - RNA, 23 nt, Human
cgaagcgcgccacucgcuucccc

SEQ ID NO: 2499878 - RNA, 15 nt, Human
cgaagcucagcccac

SEQ ID NO: 2499879 - RNA, 16 nt, Human
cgaagcucagcccacc

SEQ ID NO: 2499880 - RNA, 17 nt, Human
cgaagcucagcccaccc

SEQ ID NO: 2499881 - RNA, 14 nt, Human
cgaauauugcugau

SEQ ID NO: 2499882 - RNA, 12 nt, Human
cgaauauugcug

SEQ ID NO: 2499883 - RNA, 11 nt, Human
cgaauauugcu

SEQ ID NO: 2499884 - RNA, 16 nt, Human
cgaauagcugggacua

SEQ ID NO: 2499885 - RNA, 17 nt, Human
cgaauauugcugauggu

SEQ ID NO: 2499886 - RNA, 15 nt, Human
cgaauauugcugaug

SEQ ID NO: 2499887 - RNA, 18 nt, Human
cgaauccccucccuguca

SEQ ID NO: 2499888 - RNA, 17 nt, Human
cgaaucuacuaauucca

SEQ ID NO: 2499889 - RNA, 14 nt, Human
cgaaucauuuguuc

SEQ ID NO: 2499890 - RNA, 17 nt, Human
cgaaucauuuguucaaa

SEQ ID NO: 2499891 - RNA, 19 nt, Human
cgaaguggacuggccccug

SEQ ID NO: 2499892 - RNA, 21 nt, Human
cgaauauuaugcccaguuucu

SEQ ID NO: 2499893 - RNA, 18 nt, Human
cgaaucagcuauuuacug

SEQ ID NO: 2499894 - RNA, 14 nt, Human
cgaauuaauagcuu

SEQ ID NO: 2499895 - RNA, 23 nt, Human
cgaauguguacaacuuaaguugg

SEQ ID NO: 2499896 - RNA, 15 nt, Human
cgaauguguacaacu

SEQ ID NO: 2499897 - RNA, 16 nt, Human
cgaauuaauagcuuuu

SEQ ID NO: 2499898 - RNA, 18 nt, Human
cgagacuugguuucaaaa

SEQ ID NO: 2499899 - RNA, 21 nt, Human
cgaaugugcagguuuguuaca

SEQ ID NO: 2499900 - RNA, 13 nt, Human
cgaaugugcaggu

SEQ ID NO: 2499901 - RNA, 15 nt, Human
cgaaugaucuuucuu

SEQ ID NO: 2499902 - RNA, 16 nt, Human
cgaaucucugugccuu

SEQ ID NO: 2499903 - RNA, 12 nt, Human
cgaaucucugug

SEQ ID NO: 2499904 - RNA, 22 nt, Human
cgaaucucuuuuugcuuucgaa

SEQ ID NO: 2499905 - RNA, 19 nt, Human
cgaauccccucccugucaa

SEQ ID NO: 2499906 - RNA, 22 nt, Human
ccuuccuguuuuucacauuuuc

SEQ ID NO: 2499907 - RNA, 13 nt, Human
ccuuccuucccac

SEQ ID NO: 2499908 - RNA, 17 nt, Human
ccuuccuguucugaacu

SEQ ID NO: 2499909 - RNA, 14 nt, Human
ccuucgggcugugc

SEQ ID NO: 2499910 - RNA, 18 nt, Human
ccuucggccuccauccug

SEQ ID NO: 2499911 - RNA, 15 nt, Human
ccuucgggcugugcc

SEQ ID NO: 2499912 - RNA, 16 nt, Human
ccuucgggcugugccc

SEQ ID NO: 2499913 - RNA, 17 nt, Human
ccuucgucuuucccaug

SEQ ID NO: 2499914 - RNA, 16 nt, Human
ccuucgucuuucccau

SEQ ID NO: 2499915 - RNA, 14 nt, Human
ccuuccuucccugg

SEQ ID NO: 2499916 - RNA, 16 nt, Human
ccuucggccuccaucc

SEQ ID NO: 2499917 - RNA, 17 nt, Human
ccuucggccuccauccu

SEQ ID NO: 2499918 - RNA, 19 nt, Human
ccuuccugucccaccucuu

SEQ ID NO: 2499919 - RNA, 16 nt, Human
ccuuccugucccaccu

SEQ ID NO: 2499920 - RNA, 19 nt, Human
ccuuccuggggcaucuggc

SEQ ID NO: 2499921 - RNA, 17 nt, Human
ccuuccuguuuuucaca

SEQ ID NO: 2499922 - RNA, 19 nt, Human
ccuuccuguuuuucacauu

SEQ ID NO: 2499923 - RNA, 15 nt, Human
ccuuccuguucugaa

SEQ ID NO: 2499924 - RNA, 19 nt, Human
ccuuccugucuuccugcau

SEQ ID NO: 2499925 - RNA, 17 nt, Human
ccuuccugucuuccugc

SEQ ID NO: 2499926 - RNA, 20 nt, Human
ccuuccuggagacugcccag

SEQ ID NO: 2499927 - RNA, 21 nt, Human
ccuuccuggagcccagaggag

SEQ ID NO: 2499928 - RNA, 18 nt, Human
ccuuccaugucgccucug

SEQ ID NO: 2499929 - RNA, 17 nt, Human
ccuuccauggacuuugu

SEQ ID NO: 2499930 - RNA, 23 nt, Human
ccuuccauggugugaucgucuga

SEQ ID NO: 2499931 - RNA, 17 nt, Human
ccuuccaucucgccacc

SEQ ID NO: 2499932 - RNA, 12 nt, Human
ccuuccaucccu

SEQ ID NO: 2499933 - RNA, 19 nt, Human
ccuuccaucccuacccccu

SEQ ID NO: 2499934 - RNA, 16 nt, Human
ccuuccagcuccugua

SEQ ID NO: 2499935 - RNA, 15 nt, Human
ccuuccagcuccugu

SEQ ID NO: 2499936 - RNA, 13 nt, Human
ccuuccagcuccu

SEQ ID NO: 2499937 - RNA, 12 nt, Human
ccuuccagcucc

SEQ ID NO: 2499938 - RNA, 13 nt, Human
ccuuccaggggug

SEQ ID NO: 2499939 - RNA, 16 nt, Human
ccuuccagucaggaug

SEQ ID NO: 2499940 - RNA, 22 nt, Human
ccuuccaguguccuuagaacau

SEQ ID NO: 2499941 - RNA, 11 nt, Human
ccuuccauaau

SEQ ID NO: 2499942 - RNA, 12 nt, Human
ccuuccauaauu

SEQ ID NO: 2499943 - RNA, 15 nt, Human
ccuuccauaauuaug

SEQ ID NO: 2499944 - RNA, 15 nt, Human
ccuuccaucccagag

SEQ ID NO: 2499945 - RNA, 23 nt, Human
ccuuccauagccuaaucccuggg

SEQ ID NO: 2499946 - RNA, 17 nt, Human
ccuuccagcuccuguaa

SEQ ID NO: 2499947 - RNA, 13 nt, Human
ccuuccaggcccc

SEQ ID NO: 2499948 - RNA, 20 nt, Human
ccuucguuuacuaugccugu

SEQ ID NO: 2499949 - RNA, 22 nt, Human
ccuucguuuacuaugccugugu

SEQ ID NO: 2499950 - RNA, 23 nt, Human
ccuucguuuacuaugccuguguc

SEQ ID NO: 2499951 - RNA, 13 nt, Human
ccuucuaaaggug

SEQ ID NO: 2499952 - RNA, 14 nt, Human
ccuucuaaaggugu

SEQ ID NO: 2499953 - RNA, 17 nt, Human
ccuucguuuacuaugcc

SEQ ID NO: 2499954 - RNA, 19 nt, Human
ccuucguuuacuaugccug

SEQ ID NO: 2499955 - RNA, 22 nt, Human
ccuucuaaagguguugucccuu

SEQ ID NO: 2499956 - RNA, 14 nt, Human
ccuucucagaaucu

SEQ ID NO: 2499957 - RNA, 17 nt, Human
ccuucucaucacucccc

SEQ ID NO: 2499958 - RNA, 13 nt, Human
ccuucucaucacu

SEQ ID NO: 2499959 - RNA, 15 nt, Human
ccuucuccaaaugag

SEQ ID NO: 2499960 - RNA, 11 nt, Human
ccuucuccauc

SEQ ID NO: 2499961 - RNA, 13 nt, Human
ccuucuccaucca

SEQ ID NO: 2499962 - RNA, 16 nt, Human
ccuucuccauccacau

SEQ ID NO: 2499963 - RNA, 22 nt, Human
ccuucuccauccacaugggagc

SEQ ID NO: 2499964 - RNA, 21 nt, Human
ccuucuccaucucucuggccc

SEQ ID NO: 2499965 - RNA, 17 nt, Human
ccuucuccaucucucug

SEQ ID NO: 2499966 - RNA, 14 nt, Human
ccuucuccaucucu

SEQ ID NO: 2499967 - RNA, 21 nt, Human
ccuucucaucacuccccucca

SEQ ID NO: 2499968 - RNA, 14 nt, Human
ccuucucccacacu

SEQ ID NO: 2499969 - RNA, 14 nt, Human
ccuucucccaugag

SEQ ID NO: 2499970 - RNA, 16 nt, Human
ccuucucccaccccug

SEQ ID NO: 2499971 - RNA, 22 nt, Human
ccuucuccaucucucuggcccu

SEQ ID NO: 2499972 - RNA, 16 nt, Human
ccuucucccacacugc

SEQ ID NO: 2499973 - RNA, 16 nt, Human
ccuucucuccagcccc

SEQ ID NO: 2499974 - RNA, 15 nt, Human
ccuucucuccagccc

SEQ ID NO: 2499975 - RNA, 13 nt, Human
ccuucucuccagc

SEQ ID NO: 2499976 - RNA, 12 nt, Human
ccuucucuccag

SEQ ID NO: 2499977 - RNA, 22 nt, Human
ccuucucccccccggggcuggg

SEQ ID NO: 2499978 - RNA, 16 nt, Human
ccuucucccccccggg

SEQ ID NO: 2499979 - RNA, 14 nt, Human
ccuucucccccccg

SEQ ID NO: 2499980 - RNA, 23 nt, Human
ccuucucccccccggggcugggu

SEQ ID NO: 2499981 - RNA, 16 nt, Human
ccuucucccucauuuc

SEQ ID NO: 2499982 - RNA, 21 nt, Human
ccuucuccuccccacccgccc

SEQ ID NO: 2499983 - RNA, 16 nt, Human
ccuucuccucuuguaa

SEQ ID NO: 2499984 - RNA, 15 nt, Human
ccuucuccucuugua

SEQ ID NO: 2499985 - RNA, 21 nt, Human
ccuucucucaucucuuagcuc

SEQ ID NO: 2499986 - RNA, 17 nt, Human
ccuucucucaucucuua

SEQ ID NO: 2499987 - RNA, 16 nt, Human
ccuucucucaucucuu

SEQ ID NO: 2499988 - RNA, 15 nt, Human
ccuucucucaucucu

SEQ ID NO: 2499989 - RNA, 12 nt, Human
ccuguccucacu

SEQ ID NO: 2499990 - RNA, 15 nt, Human
ccuguccucacugcu

SEQ ID NO: 2499991 - RNA, 14 nt, Human
ccuguccucacugc

SEQ ID NO: 2499992 - RNA, 13 nt, Human
ccuguccucacug

SEQ ID NO: 2499993 - RNA, 20 nt, Human
ccugugccucugggacugga

SEQ ID NO: 2499994 - RNA, 22 nt, Human
ccugucccucucaggcaugccu

SEQ ID NO: 2499995 - RNA, 23 nt, Human
ccugucccuucucuuaauuuaau

SEQ ID NO: 2499996 - RNA, 19 nt, Human
ccugucccucccaccucug

SEQ ID NO: 2499997 - RNA, 18 nt, Human
ccugucccucccaccucu

SEQ ID NO: 2499998 - RNA, 17 nt, Human
ccugucccucccaccuc

SEQ ID NO: 2499999 - RNA, 16 nt, Human
ccugucccucccaccu

SEQ ID NO: 2500000 - RNA, 21 nt, Human
ccugucccucccaccucugug

SEQ ID NO: 2500001 - RNA, 20 nt, Human
ccugucccucccaccucugu

SEQ ID NO: 2500002 - RNA, 15 nt, Human
ccugucccucucagg

SEQ ID NO: 2500003 - RNA, 16 nt, Human
ccugucccucucaggc

SEQ ID NO: 2500004 - RNA, 19 nt, Human
ccugugcuacuuugccuuu

SEQ ID NO: 2500005 - RNA, 17 nt, Human
ccugugcuacuuugccu

SEQ ID NO: 2500006 - RNA, 15 nt, Human
ccugugcuacuuugc

SEQ ID NO: 2500007 - RNA, 16 nt, Human
ccuguccucacugcuc

SEQ ID NO: 2500008 - RNA, 23 nt, Human
ccugugcuacuuugccuuuugca

SEQ ID NO: 2500009 - RNA, 21 nt, Human
ccuguccucacugcucccuga

SEQ ID NO: 2500010 - RNA, 15 nt, Human
ccugugccugacccu

SEQ ID NO: 2500011 - RNA, 17 nt, Human
ccugugccuuuugccau

SEQ ID NO: 2500012 - RNA, 18 nt, Human
ccugugcugacggaagcc

SEQ ID NO: 2500013 - RNA, 22 nt, Human
ccugugcuccgugccuccacca

SEQ ID NO: 2500014 - RNA, 21 nt, Human
ccugugcuccgugccuccacc

SEQ ID NO: 2500015 - RNA, 20 nt, Human
ccugugcuccgugccuccac

SEQ ID NO: 2500016 - RNA, 19 nt, Human
ccugugcuccgugccucca

SEQ ID NO: 2500017 - RNA, 18 nt, Human
ccugugcuccgugccucc

SEQ ID NO: 2500018 - RNA, 17 nt, Human
ccugugcuccgugccuc

SEQ ID NO: 2500019 - RNA, 11 nt, Human
ccuguggagac

SEQ ID NO: 2500020 - RNA, 14 nt, Human
ccuguggagacugg

SEQ ID NO: 2500021 - RNA, 15 nt, Human
ccuguggagcccgca

SEQ ID NO: 2500022 - RNA, 18 nt, Human
ccuguggagcccgcaccc

SEQ ID NO: 2500023 - RNA, 18 nt, Human
ccuguggccuguguccca

SEQ ID NO: 2500024 - RNA, 15 nt, Human
ccuguggccuguguc

SEQ ID NO: 2500025 - RNA, 14 nt, Human
ccuguggccugugu

SEQ ID NO: 2500026 - RNA, 13 nt, Human
ccuguggccugug

SEQ ID NO: 2500027 - RNA, 21 nt, Human
ccuguggccugugucccauga

SEQ ID NO: 2500028 - RNA, 19 nt, Human
ccuguggccugugucccau

SEQ ID NO: 2500029 - RNA, 21 nt, Human
ccuguggcgccgucuccaggg

SEQ ID NO: 2500030 - RNA, 20 nt, Human
ccuguggaugagcccucaga

SEQ ID NO: 2500031 - RNA, 17 nt, Human
ccuguggagcccgcacc

SEQ ID NO: 2500032 - RNA, 18 nt, Human
ccuguggaucaaauccag

SEQ ID NO: 2500033 - RNA, 20 nt, Human
ccuguggaugauaaaacaca

SEQ ID NO: 2500034 - RNA, 22 nt, Human
ccuguggggaucucaggggcug

SEQ ID NO: 2500035 - RNA, 20 nt, Human
ccuguggggaucucaggggc

SEQ ID NO: 2500036 - RNA, 18 nt, Human
ccuguggggaucucaggg

SEQ ID NO: 2500037 - RNA, 15 nt, Human
ccugugggagccugc

SEQ ID NO: 2500038 - RNA, 14 nt, Human
ccugugggagccug

SEQ ID NO: 2500039 - RNA, 20 nt, Human
ccugugggcccccaaaugga

SEQ ID NO: 2500040 - RNA, 22 nt, Human
ccuguggcgccgucuccagggg

SEQ ID NO: 2500041 - RNA, 23 nt, Human
ccuguggccugugucccaugacc

SEQ ID NO: 2500042 - RNA, 15 nt, Human
ccuguggcggugccu

SEQ ID NO: 2500043 - RNA, 16 nt, Human
ccuguggcggugccug

SEQ ID NO: 2500044 - RNA, 17 nt, Human
ccuguggcggugccugg

SEQ ID NO: 2500045 - RNA, 18 nt, Human
ccuguggcggugccuggg

SEQ ID NO: 2500046 - RNA, 19 nt, Human
ccuguggcggugccugggu

SEQ ID NO: 2500047 - RNA, 23 nt, Human
ccuguggcucuacaacugagucc

SEQ ID NO: 2500048 - RNA, 11 nt, Human
ccuguggcucu

SEQ ID NO: 2500049 - RNA, 20 nt, Human
ccuguggcggugccugggug

SEQ ID NO: 2500050 - RNA, 21 nt, Human
ccuguguaaucauuucuuggg

SEQ ID NO: 2500051 - RNA, 12 nt, Human
ccuucaugcaug

SEQ ID NO: 2500052 - RNA, 21 nt, Human
ccuucaugcauggaaauuccc

SEQ ID NO: 2500053 - RNA, 18 nt, Human
ccuguguaacagcuccuu

SEQ ID NO: 2500054 - RNA, 17 nt, Human
ccuguguaacagcuccu

SEQ ID NO: 2500055 - RNA, 16 nt, Human
ccuguguaacagcucc

SEQ ID NO: 2500056 - RNA, 15 nt, Human
ccuguguaacagcuc

SEQ ID NO: 2500057 - RNA, 21 nt, Human
ccuguguaacagcuccuuggg

SEQ ID NO: 2500058 - RNA, 20 nt, Human
ccuguguaacagcuccuugg

SEQ ID NO: 2500059 - RNA, 22 nt, Human
ccuguguaacagcuccuuggga

SEQ ID NO: 2500060 - RNA, 12 nt, Human
ccuguggugcaa

SEQ ID NO: 2500061 - RNA, 13 nt, Human
ccuguguaacagc

SEQ ID NO: 2500062 - RNA, 22 nt, Human
ccugugggggaagagcacagcc

SEQ ID NO: 2500063 - RNA, 21 nt, Human
ccugugggggaagagcacagc

SEQ ID NO: 2500064 - RNA, 23 nt, Human
ccugugggggaagagcacagccc

SEQ ID NO: 2500065 - RNA, 19 nt, Human
ccuguggggauuucuccca

SEQ ID NO: 2500066 - RNA, 20 nt, Human
ccuguggggauuucucccag

SEQ ID NO: 2500067 - RNA, 20 nt, Human
ccugugggggaagagcacag

SEQ ID NO: 2500068 - RNA, 22 nt, Human
ccuguggggauuucucccagcu

SEQ ID NO: 2500069 - RNA, 21 nt, Human
ccuucauuaccuuuuuugaua

SEQ ID NO: 2500070 - RNA, 15 nt, Human
ccuucaugcauggaa

SEQ ID NO: 2500071 - RNA, 20 nt, Human
ccuucauugccuuaacugga

SEQ ID NO: 2500072 - RNA, 12 nt, Human
ccuucauuuccu

SEQ ID NO: 2500073 - RNA, 13 nt, Human
ccuucauuuccuc

SEQ ID NO: 2500074 - RNA, 19 nt, Human
ccuucauuucaggagggau

SEQ ID NO: 2500075 - RNA, 18 nt, Human
ccuucauuucaggaggga

SEQ ID NO: 2500076 - RNA, 23 nt, Human
ccuucauugccuuaacuggagcc

SEQ ID NO: 2500077 - RNA, 14 nt, Human
ccuucauuuccucc

SEQ ID NO: 2500078 - RNA, 15 nt, Human
ccuucauuuccuccg

SEQ ID NO: 2500079 - RNA, 17 nt, Human
ccuuccagcacccugca

SEQ ID NO: 2500080 - RNA, 16 nt, Human
ccuuccagcacccugc

SEQ ID NO: 2500081 - RNA, 19 nt, Human
ccuucucuccagccccugg

SEQ ID NO: 2500082 - RNA, 19 nt, Human
ccuuguaauucuaaaugaa

SEQ ID NO: 2500083 - RNA, 16 nt, Human
ccuuguaauucuaaau

SEQ ID NO: 2500084 - RNA, 13 nt, Human
ccuuguauuuaaa

SEQ ID NO: 2500085 - RNA, 14 nt, Human
ccuuguauuuaaau

SEQ ID NO: 2500086 - RNA, 16 nt, Human
ccuugguucccccacu

SEQ ID NO: 2500087 - RNA, 17 nt, Human
ccuugguucccuugugu

SEQ ID NO: 2500088 - RNA, 20 nt, Human
ccuuggugucgggcaugaca

SEQ ID NO: 2500089 - RNA, 19 nt, Human
ccuuggugucgggcaugac

SEQ ID NO: 2500090 - RNA, 23 nt, Human
ccuuggggaauuuccucuauuga

SEQ ID NO: 2500091 - RNA, 22 nt, Human
ccuuggggaauuuccucuauug

SEQ ID NO: 2500092 - RNA, 17 nt, Human
ccuuggggaauuuccuc

SEQ ID NO: 2500093 - RNA, 18 nt, Human
ccuugggcugcuccucau

SEQ ID NO: 2500094 - RNA, 18 nt, Human
ccuugguguaguugaacu

SEQ ID NO: 2500095 - RNA, 15 nt, Human
ccuugguguccaccu

SEQ ID NO: 2500096 - RNA, 16 nt, Human
ccuugguguccaccug

SEQ ID NO: 2500097 - RNA, 17 nt, Human
ccuugguguccaccugg

SEQ ID NO: 2500098 - RNA, 18 nt, Human
ccuugguguccaccuggc

SEQ ID NO: 2500099 - RNA, 19 nt, Human
ccuugguguccaccuggcc

SEQ ID NO: 2500100 - RNA, 20 nt, Human
ccuugguguccaccuggccc

SEQ ID NO: 2500101 - RNA, 21 nt, Human
ccuugguguccaccuggcccc

SEQ ID NO: 2500102 - RNA, 16 nt, Human
ccuuggcugcagggag

SEQ ID NO: 2500103 - RNA, 22 nt, Human
ccuuggccugucucauccccag

SEQ ID NO: 2500104 - RNA, 23 nt, Human
ccuuggccugucucauccccagg

SEQ ID NO: 2500105 - RNA, 14 nt, Human
ccuuggcugcaggg

SEQ ID NO: 2500106 - RNA, 21 nt, Human
ccuuggcuguuggcagugagu

SEQ ID NO: 2500107 - RNA, 21 nt, Human
ccuuggcugugaggccccugg

SEQ ID NO: 2500108 - RNA, 14 nt, Human
ccuuggcuggugca

SEQ ID NO: 2500109 - RNA, 13 nt, Human
ccuuggcuggugc

SEQ ID NO: 2500110 - RNA, 12 nt, Human
ccuuggcuggug

SEQ ID NO: 2500111 - RNA, 15 nt, Human
ccuuggcuugcccac

SEQ ID NO: 2500112 - RNA, 16 nt, Human
ccuuggcuugcccacg

SEQ ID NO: 2500113 - RNA, 13 nt, Human
ccuuggcuugccc

SEQ ID NO: 2500114 - RNA, 20 nt, Human
ccuuggcuucaggggagucc

SEQ ID NO: 2500115 - RNA, 17 nt, Human
ccuugggcggcugagag

SEQ ID NO: 2500116 - RNA, 14 nt, Human
ccuugggcggcuga

SEQ ID NO: 2500117 - RNA, 12 nt, Human
ccuugggcuccc

SEQ ID NO: 2500118 - RNA, 18 nt, Human
ccuuggcuugcccacgug

SEQ ID NO: 2500119 - RNA, 18 nt, Human
ccuugggcggcugagagc

SEQ ID NO: 2500120 - RNA, 13 nt, Human
ccuugggcucccu

SEQ ID NO: 2500121 - RNA, 14 nt, Human
ccuuggggagcagg

SEQ ID NO: 2500122 - RNA, 14 nt, Human
ccuugggcugcucc

SEQ ID NO: 2500123 - RNA, 15 nt, Human
ccuugggcugcuccu

SEQ ID NO: 2500124 - RNA, 17 nt, Human
ccuugggcugcuccuca

SEQ ID NO: 2500125 - RNA, 18 nt, Human
ccuucucuccagccccug

SEQ ID NO: 2500126 - RNA, 17 nt, Human
ccuucucuccagccccu

SEQ ID NO: 2500127 - RNA, 21 nt, Human
ccuugacagggcacaccgggc

SEQ ID NO: 2500128 - RNA, 18 nt, Human
ccuugacagggcacaccg

SEQ ID NO: 2500129 - RNA, 11 nt, Human
ccuugagacca

SEQ ID NO: 2500130 - RNA, 16 nt, Human
ccuugagaccacaggg

SEQ ID NO: 2500131 - RNA, 14 nt, Human
ccuugagaccucag

SEQ ID NO: 2500132 - RNA, 16 nt, Human
ccuugagaccucagcc

SEQ ID NO: 2500133 - RNA, 17 nt, Human
ccuugagaccucagcca

SEQ ID NO: 2500134 - RNA, 18 nt, Human
ccuugagaccucagccau

SEQ ID NO: 2500135 - RNA, 16 nt, Human
ccuugagagaccaggc

SEQ ID NO: 2500136 - RNA, 19 nt, Human
ccuugagaccucagccaug

SEQ ID NO: 2500137 - RNA, 21 nt, Human
ccuugagaguaucaggucucc

SEQ ID NO: 2500138 - RNA, 20 nt, Human
ccuugagagaccaggcaaag

SEQ ID NO: 2500139 - RNA, 18 nt, Human
ccuugagagaccaggcaa

SEQ ID NO: 2500140 - RNA, 21 nt, Human
ccuugagagaccaggcaaagc

SEQ ID NO: 2500141 - RNA, 17 nt, Human
ccuugagcuccccaaaa

SEQ ID NO: 2500142 - RNA, 23 nt, Human
ccuugacauuguagagcuucugg

SEQ ID NO: 2500143 - RNA, 12 nt, Human
ccuugaccagca

SEQ ID NO: 2500144 - RNA, 20 nt, Human
ccuugaccagcagaucccag

SEQ ID NO: 2500145 - RNA, 21 nt, Human
ccuugaccagcagaucccagc

SEQ ID NO: 2500146 - RNA, 14 nt, Human
ccuugagaaaccuu

SEQ ID NO: 2500147 - RNA, 12 nt, Human
ccuugaccaggc

SEQ ID NO: 2500148 - RNA, 23 nt, Human
ccuugaccagcagaucccagcuc

SEQ ID NO: 2500149 - RNA, 19 nt, Human
ccuugagaaaccuuauugu

SEQ ID NO: 2500150 - RNA, 14 nt, Human
ccuugagacagcuu

SEQ ID NO: 2500151 - RNA, 22 nt, Human
ccuuggcucaaguccucuuuuc

SEQ ID NO: 2500152 - RNA, 15 nt, Human
ccuuggccugucuca

SEQ ID NO: 2500153 - RNA, 19 nt, Human
ccuuggccugucucauccc

SEQ ID NO: 2500154 - RNA, 14 nt, Human
ccuuggccucagaa

SEQ ID NO: 2500155 - RNA, 11 nt, Human
ccuuggccuca

SEQ ID NO: 2500156 - RNA, 13 nt, Human
ccuuggccucaga

SEQ ID NO: 2500157 - RNA, 15 nt, Human
ccuuggauugucccc

SEQ ID NO: 2500158 - RNA, 13 nt, Human
ccuuggacuugag

SEQ ID NO: 2500159 - RNA, 12 nt, Human
ccuuggaggcca

SEQ ID NO: 2500160 - RNA, 16 nt, Human
ccuuggaggccagcca

SEQ ID NO: 2500161 - RNA, 18 nt, Human
ccuuggaggcugucuucu

SEQ ID NO: 2500162 - RNA, 23 nt, Human
ccuuggagggucccaagcugggc

SEQ ID NO: 2500163 - RNA, 18 nt, Human
ccuuggauaaugcuguug

SEQ ID NO: 2500164 - RNA, 22 nt, Human
ccuuggauaaugcuguugccuc

SEQ ID NO: 2500165 - RNA, 23 nt, Human
ccuuggauaaugcuguugccuca

SEQ ID NO: 2500166 - RNA, 15 nt, Human
ccuuggacucauuuu

SEQ ID NO: 2500167 - RNA, 12 nt, Human
ccuugagcugag

SEQ ID NO: 2500168 - RNA, 14 nt, Human
ccuugagcugagau

SEQ ID NO: 2500169 - RNA, 18 nt, Human
ccuugaggaaacaacagc

SEQ ID NO: 2500170 - RNA, 15 nt, Human
ccuuggacuugagga

SEQ ID NO: 2500171 - RNA, 18 nt, Human
gaaaaucuuauaauuuaa

SEQ ID NO: 2500172 - RNA, 13 nt, Human
gaaaaugaauaau

SEQ ID NO: 2500173 - RNA, 23 nt, Human
gaaaaucuaauauuaaaaauaug

SEQ ID NO: 2500174 - RNA, 21 nt, Human
gaaaaucuaauauuaaaaaua

SEQ ID NO: 2500175 - RNA, 20 nt, Human
gaaaaucuaauauuaaaaau

SEQ ID NO: 2500176 - RNA, 14 nt, Human
gaaaaucuaauauu

SEQ ID NO: 2500177 - RNA, 14 nt, Human
gaaaauccucuggc

SEQ ID NO: 2500178 - RNA, 15 nt, Human
gaaaauccucuggcu

SEQ ID NO: 2500179 - RNA, 22 nt, Human
gaaaaucuacacuccagugaga

SEQ ID NO: 2500180 - RNA, 13 nt, Human
gaaaauccucugg

SEQ ID NO: 2500181 - RNA, 14 nt, Human
gaaaaucauauugc

SEQ ID NO: 2500182 - RNA, 20 nt, Human
gaaaaucagccugcuccagc

SEQ ID NO: 2500183 - RNA, 22 nt, Human
gaaaaucagccugcuccagcug

SEQ ID NO: 2500184 - RNA, 12 nt, Human
gaaaauaaaaag

SEQ ID NO: 2500185 - RNA, 13 nt, Human
gaaaauaaaaagu

SEQ ID NO: 2500186 - RNA, 22 nt, Human
gaaaauaaaaaaaagaaaaaag

SEQ ID NO: 2500187 - RNA, 17 nt, Human
gaaaauaaaaaaaagaa

SEQ ID NO: 2500188 - RNA, 18 nt, Human
gaaaauaaaaaaaagaaa

SEQ ID NO: 2500189 - RNA, 19 nt, Human
gaaaauaaaaaaaagaaaa

SEQ ID NO: 2500190 - RNA, 21 nt, Human
gaaaauaaaaaaaagaaaaaa

SEQ ID NO: 2500191 - RNA, 12 nt, Human
gaaaaguucaua

SEQ ID NO: 2500192 - RNA, 11 nt, Human
gaaaauaaaaa

SEQ ID NO: 2500193 - RNA, 16 nt, Human
gaaaauaaaaaaaaga

SEQ ID NO: 2500194 - RNA, 14 nt, Human
gaaaauaaaaaguu

SEQ ID NO: 2500195 - RNA, 21 nt, Human
gaaaauauuauguguuuccau

SEQ ID NO: 2500196 - RNA, 18 nt, Human
gaaaauauuuguaucaca

SEQ ID NO: 2500197 - RNA, 13 nt, Human
gaaaauauuuaaa

SEQ ID NO: 2500198 - RNA, 21 nt, Human
gaaaauauuuugucuaaaaug

SEQ ID NO: 2500199 - RNA, 20 nt, Human
gaaaauauuuugucuaaaau

SEQ ID NO: 2500200 - RNA, 19 nt, Human
gaaaauauuuugucuaaaa

SEQ ID NO: 2500201 - RNA, 18 nt, Human
gaaaauauuuugucuaaa

SEQ ID NO: 2500202 - RNA, 17 nt, Human
gaaaauauuuugucuaa

SEQ ID NO: 2500203 - RNA, 22 nt, Human
gaaaacguggcugcuucaagga

SEQ ID NO: 2500204 - RNA, 20 nt, Human
gaaaacguggcugcuucaag

SEQ ID NO: 2500205 - RNA, 19 nt, Human
gaaaacguggcugcuucaa

SEQ ID NO: 2500206 - RNA, 14 nt, Human
gaaaacguuuuauu

SEQ ID NO: 2500207 - RNA, 16 nt, Human
gaaaacguuuuauugu

SEQ ID NO: 2500208 - RNA, 18 nt, Human
gaaaacguuuuauugugu

SEQ ID NO: 2500209 - RNA, 19 nt, Human
gaaaagcugcugacagugu

SEQ ID NO: 2500210 - RNA, 24 nt, Human
gaaaacacuguucucugcccucca

SEQ ID NO: 2500211 - RNA, 22 nt, Human
gaaaacacuguucucugcccuc

SEQ ID NO: 2500212 - RNA, 21 nt, Human
gaaaacagaacaucauuagaa

SEQ ID NO: 2500213 - RNA, 13 nt, Human
gaaaacagaccua

SEQ ID NO: 2500214 - RNA, 21 nt, Human
gaaaacagaccuaaugcuccu

SEQ ID NO: 2500215 - RNA, 17 nt, Human
gaaaacagacucagguu

SEQ ID NO: 2500216 - RNA, 16 nt, Human
gaaaagugaaugcuca

SEQ ID NO: 2500217 - RNA, 20 nt, Human
gaaaaggaagacuagaggcu

SEQ ID NO: 2500218 - RNA, 13 nt, Human
gaaaaggaagacu

SEQ ID NO: 2500219 - RNA, 15 nt, Human
gaaaaggaagacuag

SEQ ID NO: 2500220 - RNA, 19 nt, Human
gaaaacguuuuauuguguu

SEQ ID NO: 2500221 - RNA, 20 nt, Human
gaaaacguuuuauuguguuu

SEQ ID NO: 2500222 - RNA, 11 nt, Human
gaaaaggcagg

SEQ ID NO: 2500223 - RNA, 11 nt, Human
cuuuuguucuu

SEQ ID NO: 2500224 - RNA, 12 nt, Human
cuuuuguucuug

SEQ ID NO: 2500225 - RNA, 22 nt, Human
cuuuguuauuuuuguuucuucc

SEQ ID NO: 2500226 - RNA, 20 nt, Human
cuuuguuauuuuuguuucuu

SEQ ID NO: 2500227 - RNA, 22 nt, Human
cuuuuguucagggcugugaucg

SEQ ID NO: 2500228 - RNA, 15 nt, Human
cuuuguuacaggcac

SEQ ID NO: 2500229 - RNA, 18 nt, Human
cuuuguuaguuucuccaa

SEQ ID NO: 2500230 - RNA, 23 nt, Human
cuuuguguuucuauugacuucaa

SEQ ID NO: 2500231 - RNA, 14 nt, Human
cuuuguguuucuau

SEQ ID NO: 2500232 - RNA, 20 nt, Human
cuuuguggaugucuuccuug

SEQ ID NO: 2500233 - RNA, 17 nt, Human
cuuuguggaugucuucc

SEQ ID NO: 2500234 - RNA, 16 nt, Human
cuuuguggaugucuuc

SEQ ID NO: 2500235 - RNA, 17 nt, Human
cuuugugcuguggggcu

SEQ ID NO: 2500236 - RNA, 15 nt, Human
cuuugugugauugaa

SEQ ID NO: 2500237 - RNA, 19 nt, Human
cuuuuucuucuucccuccc

SEQ ID NO: 2500238 - RNA, 15 nt, Human
cuuuuucuucuuccc

SEQ ID NO: 2500239 - RNA, 12 nt, Human
cuuuuucuuuau

SEQ ID NO: 2500240 - RNA, 16 nt, Human
cuuuuucuuuauaaac

SEQ ID NO: 2500241 - RNA, 22 nt, Human
cuuuuucuggacugaagccugc

SEQ ID NO: 2500242 - RNA, 17 nt, Human
cuuuuucugacuccagu

SEQ ID NO: 2500243 - RNA, 11 nt, Human
cuuuuucugac

SEQ ID NO: 2500244 - RNA, 19 nt, Human
cuuuuuauugaaucuauuu

SEQ ID NO: 2500245 - RNA, 17 nt, Human
cuuuuuauggccuguga

SEQ ID NO: 2500246 - RNA, 13 nt, Human
cuuuuguucgcau

SEQ ID NO: 2500247 - RNA, 14 nt, Human
cuuuuuauugaauc

SEQ ID NO: 2500248 - RNA, 13 nt, Human
cuuuuuauugaau

SEQ ID NO: 2500249 - RNA, 22 nt, Human
cuuuuuauguugccaguuuaau

SEQ ID NO: 2500250 - RNA, 17 nt, Human
cuuuuuauugaaucuau

SEQ ID NO: 2500251 - RNA, 15 nt, Human
cuuuuuauugaaucu

SEQ ID NO: 2500252 - RNA, 19 nt, Human
gaaaacacauuuuucuuag

SEQ ID NO: 2500253 - RNA, 14 nt, Human
gaaaacacugugca

SEQ ID NO: 2500254 - RNA, 21 nt, Human
gaaaacacugugcacaucugu

SEQ ID NO: 2500255 - RNA, 18 nt, Human
gaaaacacuguucucugc

SEQ ID NO: 2500256 - RNA, 18 nt, Human
gaaaacacauuuuucuua

SEQ ID NO: 2500257 - RNA, 14 nt, Human
gaaaacacauuuuu

SEQ ID NO: 2500258 - RNA, 21 nt, Human
gaaaaagcuccuguccuccca

SEQ ID NO: 2500259 - RNA, 22 nt, Human
gaaaaagcauguacaguguucu

SEQ ID NO: 2500260 - RNA, 17 nt, Human
gaaaaagcauguacagu

SEQ ID NO: 2500261 - RNA, 16 nt, Human
gaaaaagcauguacag

SEQ ID NO: 2500262 - RNA, 15 nt, Human
gaaaaagcauguaca

SEQ ID NO: 2500263 - RNA, 14 nt, Human
gaaaaagcauguac

SEQ ID NO: 2500264 - RNA, 20 nt, Human
gaaaaagcauguacaguguu

SEQ ID NO: 2500265 - RNA, 18 nt, Human
gaaaaagcauguacagug

SEQ ID NO: 2500266 - RNA, 13 nt, Human
gaaaaagcaugua

SEQ ID NO: 2500267 - RNA, 16 nt, Human
cuuuuuuggcugcuga

SEQ ID NO: 2500268 - RNA, 12 nt, Human
gaaaaaggagga

SEQ ID NO: 2500269 - RNA, 15 nt, Human
gaaaaaggaggaaga

SEQ ID NO: 2500270 - RNA, 22 nt, Human
cuuuuuuggcugcugaaggcuc

SEQ ID NO: 2500271 - RNA, 20 nt, Human
cuuuuuuggcugcugaaggc

SEQ ID NO: 2500272 - RNA, 11 nt, Human
cuuuuuguagg

SEQ ID NO: 2500273 - RNA, 16 nt, Human
cuuuuuguaccuggug

SEQ ID NO: 2500274 - RNA, 14 nt, Human
cuuuuuguaccugg

SEQ ID NO: 2500275 - RNA, 17 nt, Human
cuuuuuuggcugcugaa

SEQ ID NO: 2500276 - RNA, 21 nt, Human
cuuuuuggaggugcuuaagca

SEQ ID NO: 2500277 - RNA, 15 nt, Human
cuuuuugaaaucagc

SEQ ID NO: 2500278 - RNA, 17 nt, Human
cuuuuugguuugcagau

SEQ ID NO: 2500279 - RNA, 18 nt, Human
cuuuuugaaaucagcaua

SEQ ID NO: 2500280 - RNA, 18 nt, Human
cuuuuucuuuauaaacuu

SEQ ID NO: 2500281 - RNA, 21 nt, Human
gaaagaggaaugaaguacuca

SEQ ID NO: 2500282 - RNA, 21 nt, Human
gaaacucuuaucucagucaug

SEQ ID NO: 2500283 - RNA, 15 nt, Human
gaaagagaagguggg

SEQ ID NO: 2500284 - RNA, 14 nt, Human
gaaagagaaggugg

SEQ ID NO: 2500285 - RNA, 23 nt, Human
gaaagagcacuuaagagaauauu

SEQ ID NO: 2500286 - RNA, 20 nt, Human
gaaagaggcagcuugaaacu

SEQ ID NO: 2500287 - RNA, 17 nt, Human
gaaagaggagugcuugu

SEQ ID NO: 2500288 - RNA, 17 nt, Human
gaaagagaacuuccaga

SEQ ID NO: 2500289 - RNA, 19 nt, Human
gaaagacuuuuccaacccu

SEQ ID NO: 2500290 - RNA, 20 nt, Human
gaaacucuuaucucagucau

SEQ ID NO: 2500291 - RNA, 16 nt, Human
gaaacucuuaucucag

SEQ ID NO: 2500292 - RNA, 15 nt, Human
gaaacucuuaucuca

SEQ ID NO: 2500293 - RNA, 14 nt, Human
gaaacucuuaucuc

SEQ ID NO: 2500294 - RNA, 22 nt, Human
gaaacuccgucuuagaagugga

SEQ ID NO: 2500295 - RNA, 21 nt, Human
gaaacuccaccuugcggggau

SEQ ID NO: 2500296 - RNA, 18 nt, Human
gaaacuccgucuuagaag

SEQ ID NO: 2500297 - RNA, 23 nt, Human
gaaacucuuaucucagucaugca

SEQ ID NO: 2500298 - RNA, 17 nt, Human
gaaagacuguacaaagu

SEQ ID NO: 2500299 - RNA, 16 nt, Human
gaaagaguaggaagac

SEQ ID NO: 2500300 - RNA, 15 nt, Human
gaaagaguaggaaga

SEQ ID NO: 2500301 - RNA, 21 nt, Human
gaaagaguacucuuguuuccu

SEQ ID NO: 2500302 - RNA, 22 nt, Human
gaaagaggcugaggccuggacu

SEQ ID NO: 2500303 - RNA, 21 nt, Human
gaaagaggcugaggccuggac

SEQ ID NO: 2500304 - RNA, 20 nt, Human
gaaagaggcugaggccugga

SEQ ID NO: 2500305 - RNA, 17 nt, Human
gaaagcagaacagugau

SEQ ID NO: 2500306 - RNA, 22 nt, Human
gaaagcagaacagugauuacca

SEQ ID NO: 2500307 - RNA, 15 nt, Human
gaaagaguaaaggaa

SEQ ID NO: 2500308 - RNA, 20 nt, Human
gaaagcagauaccucacccu

SEQ ID NO: 2500309 - RNA, 22 nt, Human
gaaagcagauaccucacccugc

SEQ ID NO: 2500310 - RNA, 19 nt, Human
gaaagcagcucaaaggcac

SEQ ID NO: 2500311 - RNA, 14 nt, Human
gaaagcagggacuu

SEQ ID NO: 2500312 - RNA, 23 nt, Human
gaaagcaggggcuacaagaggga

SEQ ID NO: 2500313 - RNA, 19 nt, Human
gaaagcaggggcuacaaga

SEQ ID NO: 2500314 - RNA, 14 nt, Human
gaaagcaggggcua

SEQ ID NO: 2500315 - RNA, 13 nt, Human
gaaagcaggggcu

SEQ ID NO: 2500316 - RNA, 12 nt, Human
gaaagcaggggc

SEQ ID NO: 2500317 - RNA, 14 nt, Human
gaaagcagcugaac

SEQ ID NO: 2500318 - RNA, 20 nt, Human
gaaagcagcucaaaggcaca

SEQ ID NO: 2500319 - RNA, 16 nt, Human
gaaagcaucaccucag

SEQ ID NO: 2500320 - RNA, 17 nt, Human
gaaagcaucaccucagg

SEQ ID NO: 2500321 - RNA, 18 nt, Human
gaaagcaucaccucaggc

SEQ ID NO: 2500322 - RNA, 19 nt, Human
gaaagcaucaccucaggcc

SEQ ID NO: 2500323 - RNA, 21 nt, Human
gaaagcccagaaaaggacaga

SEQ ID NO: 2500324 - RNA, 20 nt, Human
gaaagcccagaaaaggacag

SEQ ID NO: 2500325 - RNA, 15 nt, Human
gaaagcauccaugug

SEQ ID NO: 2500326 - RNA, 14 nt, Human
gaaagccauuuguu

SEQ ID NO: 2500327 - RNA, 21 nt, Human
gaaagcccugagcuuucugcu

SEQ ID NO: 2500328 - RNA, 22 nt, Human
gaaagcccugagcuuucugcua

SEQ ID NO: 2500329 - RNA, 17 nt, Human
gaaagcccugagcuuuc

SEQ ID NO: 2500330 - RNA, 14 nt, Human
gaaagccccagcac

SEQ ID NO: 2500331 - RNA, 18 nt, Human
gaaagccccagcacuaac

SEQ ID NO: 2500332 - RNA, 17 nt, Human
gaaagcuucaaacugca

SEQ ID NO: 2500333 - RNA, 16 nt, Human
gaaaggcauucucuga

SEQ ID NO: 2500334 - RNA, 21 nt, Human
gaaagcugguaaacuauuugu

SEQ ID NO: 2500335 - RNA, 17 nt, Human
gaaagcugccugguaua

SEQ ID NO: 2500336 - RNA, 22 nt, Human
gaaagcuccucgagggcaggga

SEQ ID NO: 2500337 - RNA, 20 nt, Human
gaaagcuccuagcagagaga

SEQ ID NO: 2500338 - RNA, 18 nt, Human
gaaagcuccuagcagaga

SEQ ID NO: 2500339 - RNA, 16 nt, Human
gaaagcuagagauaug

SEQ ID NO: 2500340 - RNA, 16 nt, Human
gaaagccuaucaaaga

SEQ ID NO: 2500341 - RNA, 15 nt, Human
gaaagccucugcugc

SEQ ID NO: 2500342 - RNA, 21 nt, Human
gaaagccuguuccccucacug

SEQ ID NO: 2500343 - RNA, 20 nt, Human
gaaagccuguuccccucacu

SEQ ID NO: 2500344 - RNA, 18 nt, Human
gaaagccuguuccccuca

SEQ ID NO: 2500345 - RNA, 16 nt, Human
gaaagccucugcugcc

SEQ ID NO: 2500346 - RNA, 24 nt, Human
gaaagccuguuccccucacuggau

SEQ ID NO: 2500347 - RNA, 13 nt, Human
gaaagcuagagau

SEQ ID NO: 2500348 - RNA, 19 nt, Human
gaaacccagcucuggucca

SEQ ID NO: 2500349 - RNA, 18 nt, Human
gaaacccagcucuggucc

SEQ ID NO: 2500350 - RNA, 16 nt, Human
gaaacccagcucuggu

SEQ ID NO: 2500351 - RNA, 15 nt, Human
gaaacccagcucugg

SEQ ID NO: 2500352 - RNA, 14 nt, Human
gaaacccagcucug

SEQ ID NO: 2500353 - RNA, 13 nt, Human
gaaacccagcucu

SEQ ID NO: 2500354 - RNA, 18 nt, Human
gaaaccagugcaacagca

SEQ ID NO: 2500355 - RNA, 20 nt, Human
gaaaccagggccugagccaa

SEQ ID NO: 2500356 - RNA, 14 nt, Human
gaaaccagggccug

SEQ ID NO: 2500357 - RNA, 18 nt, Human
gaaaccacagcugcugga

SEQ ID NO: 2500358 - RNA, 17 nt, Human
gaaaccacagcugcugg

SEQ ID NO: 2500359 - RNA, 20 nt, Human
gaaaccacagcugcuggaga

SEQ ID NO: 2500360 - RNA, 15 nt, Human
gaaaccacagcugcu

SEQ ID NO: 2500361 - RNA, 14 nt, Human
gaaaccacagcugc

SEQ ID NO: 2500362 - RNA, 11 nt, Human
gaaacauuugg

SEQ ID NO: 2500363 - RNA, 13 nt, Human
gaaacauuuucau

SEQ ID NO: 2500364 - RNA, 15 nt, Human
gaaaccaaagaagaa

SEQ ID NO: 2500365 - RNA, 22 nt, Human
gaaaccaaagauauauacacag

SEQ ID NO: 2500366 - RNA, 16 nt, Human
gaaaccaaagaagaaa

SEQ ID NO: 2500367 - RNA, 13 nt, Human
gaaacacagaaac

SEQ ID NO: 2500368 - RNA, 21 nt, Human
gaaacacacugaggcagggaa

SEQ ID NO: 2500369 - RNA, 23 nt, Human
gaaacacacugaggcagggaagu

SEQ ID NO: 2500370 - RNA, 16 nt, Human
gaaacacaacuauauu

SEQ ID NO: 2500371 - RNA, 14 nt, Human
gaaacacaauauuu

SEQ ID NO: 2500372 - RNA, 15 nt, Human
gaaacacaauauuuu

SEQ ID NO: 2500373 - RNA, 16 nt, Human
gaaacacaccaggcug

SEQ ID NO: 2500374 - RNA, 17 nt, Human
gaaacacaccaggcugu

SEQ ID NO: 2500375 - RNA, 23 nt, Human
gaaacacaccaggcugugggccu

SEQ ID NO: 2500376 - RNA, 16 nt, Human
gaaacacacugaggca

SEQ ID NO: 2500377 - RNA, 19 nt, Human
gaaacacacugaggcaggg

SEQ ID NO: 2500378 - RNA, 20 nt, Human
gaaacacacugaggcaggga

SEQ ID NO: 2500379 - RNA, 20 nt, Human
gaaaaugauacgcaacauaa

SEQ ID NO: 2500380 - RNA, 12 nt, Human
gaaaaugaauaa

SEQ ID NO: 2500381 - RNA, 23 nt, Human
gaaaaugaguuuuuauggggcug

SEQ ID NO: 2500382 - RNA, 16 nt, Human
gaaaaugaaucccucu

SEQ ID NO: 2500383 - RNA, 14 nt, Human
gaaaaugcagcagg

SEQ ID NO: 2500384 - RNA, 21 nt, Human
gaaacaauacucauaauguga

SEQ ID NO: 2500385 - RNA, 15 nt, Human
gaaacaauaaagaga

SEQ ID NO: 2500386 - RNA, 22 nt, Human
gaaacaauacucauaaugugaa

SEQ ID NO: 2500387 - RNA, 16 nt, Human
gaaaaugaucugaguc

SEQ ID NO: 2500388 - RNA, 14 nt, Human
gaaaaugaucugag

SEQ ID NO: 2500389 - RNA, 22 nt, Human
gaaaaugaucugagucccagga

SEQ ID NO: 2500390 - RNA, 23 nt, Human
gaaaaugauguguacccaaacgu

SEQ ID NO: 2500391 - RNA, 20 nt, Human
gaaaaugcaacaacauguau

SEQ ID NO: 2500392 - RNA, 18 nt, Human
gaaaaugcaacaacaugu

SEQ ID NO: 2500393 - RNA, 23 nt, Human
gaaacucguuaauuuguaguguu

SEQ ID NO: 2500394 - RNA, 20 nt, Human
gaaacuccaccuugcgggga

SEQ ID NO: 2500395 - RNA, 20 nt, Human
gaaacuccacaucugccuua

SEQ ID NO: 2500396 - RNA, 18 nt, Human
gaaacuaggucugauauu

SEQ ID NO: 2500397 - RNA, 19 nt, Human
gaaacuccacaucugccuu

SEQ ID NO: 2500398 - RNA, 13 nt, Human
gaaacuaggucug

SEQ ID NO: 2500399 - RNA, 18 nt, Human
gaaacuccacaucugccu

SEQ ID NO: 2500400 - RNA, 22 nt, Human
gaaaccuuauuuuuucccaaag

SEQ ID NO: 2500401 - RNA, 12 nt, Human
gaaacuaacaga

SEQ ID NO: 2500402 - RNA, 17 nt, Human
gaaaccugcccugccug

SEQ ID NO: 2500403 - RNA, 14 nt, Human
gaaaccugcccugc

SEQ ID NO: 2500404 - RNA, 18 nt, Human
gaaaccugcccugccuga

SEQ ID NO: 2500405 - RNA, 19 nt, Human
gaaaccuuauuguaccucu

SEQ ID NO: 2500406 - RNA, 17 nt, Human
gaaaccuuauuguaccu

SEQ ID NO: 2500407 - RNA, 13 nt, Human
gaaaccuuauuuu

SEQ ID NO: 2500408 - RNA, 13 nt, Human
gaaaccuuaauau

SEQ ID NO: 2500409 - RNA, 20 nt, Human
gaaaccuuauuguaccucuc

SEQ ID NO: 2500410 - RNA, 16 nt, Human
gaaacgucuucuaaac

SEQ ID NO: 2500411 - RNA, 15 nt, Human
gaaacuaacagauaa

SEQ ID NO: 2500412 - RNA, 14 nt, Human
gaaacccugucucu

SEQ ID NO: 2500413 - RNA, 14 nt, Human
gaaacccuggacca

SEQ ID NO: 2500414 - RNA, 21 nt, Human
gaaacccuggaccaguggucu

SEQ ID NO: 2500415 - RNA, 17 nt, Human
gaaacccuugaaaagac

SEQ ID NO: 2500416 - RNA, 13 nt, Human
gaaaccugcccug

SEQ ID NO: 2500417 - RNA, 12 nt, Human
gaaaccugcccu

SEQ ID NO: 2500418 - RNA, 18 nt, Human
gaaaccugaaaaaaaguu

SEQ ID NO: 2500419 - RNA, 13 nt, Human
gaaaccugaaaaa

SEQ ID NO: 2500420 - RNA, 16 nt, Human
gaaaccugggauucag

SEQ ID NO: 2500421 - RNA, 20 nt, Human
gaaaccucuacuaaaaagaa

SEQ ID NO: 2500422 - RNA, 23 nt, Human
gaaacccccacacacacacacau

SEQ ID NO: 2500423 - RNA, 15 nt, Human
gaaacccuauuuccc

SEQ ID NO: 2500424 - RNA, 16 nt, Human
gaaacccgacagaggg

SEQ ID NO: 2500425 - RNA, 16 nt, Human
gaaacccccacacaca

SEQ ID NO: 2500426 - RNA, 17 nt, Human
gaaacccccacacacac

SEQ ID NO: 2500427 - RNA, 15 nt, Human
gaaacccccacacac

SEQ ID NO: 2500428 - RNA, 21 nt, Human
gaaacccagacugaacuuacc

SEQ ID NO: 2500429 - RNA, 17 nt, Human
gaaaccccaucucuacu

SEQ ID NO: 2500430 - RNA, 23 nt, Human
gaaacccagcucugguccauaga

SEQ ID NO: 2500431 - RNA, 19 nt, Human
gaaaccaguguagccuugc

SEQ ID NO: 2500432 - RNA, 21 nt, Human
gaaaccauuaugaagaagaga

SEQ ID NO: 2500433 - RNA, 19 nt, Human
cuuuggcuaugagggccuu

SEQ ID NO: 2500434 - RNA, 19 nt, Human
cuuuggcuauuagagauca

SEQ ID NO: 2500435 - RNA, 23 nt, Human
cuuugccuugggcugcuccucau

SEQ ID NO: 2500436 - RNA, 14 nt, Human
cuuugccuuuugca

SEQ ID NO: 2500437 - RNA, 17 nt, Human
cuuuggccauuccaaca

SEQ ID NO: 2500438 - RNA, 14 nt, Human
cuuuggcugcaugc

SEQ ID NO: 2500439 - RNA, 15 nt, Human
cuuuggcuccccugu

SEQ ID NO: 2500440 - RNA, 13 nt, Human
cuuuggcuccccu

SEQ ID NO: 2500441 - RNA, 15 nt, Human
cuuuggcucuggaga

SEQ ID NO: 2500442 - RNA, 14 nt, Human
cuuuggcucuggag

SEQ ID NO: 2500443 - RNA, 13 nt, Human
cuuuggcucugga

SEQ ID NO: 2500444 - RNA, 14 nt, Human
cuuuguccccaccg

SEQ ID NO: 2500445 - RNA, 23 nt, Human
cuuuguauuuuuacuuuuaaaug

SEQ ID NO: 2500446 - RNA, 20 nt, Human
cuuuguauuuuuacuuuuaa

SEQ ID NO: 2500447 - RNA, 18 nt, Human
cuuugucaucuuucuucu

SEQ ID NO: 2500448 - RNA, 16 nt, Human
cuuugucaaaaggaag

SEQ ID NO: 2500449 - RNA, 15 nt, Human
cuuugugaggaagcc

SEQ ID NO: 2500450 - RNA, 13 nt, Human
cuuugugcugugg

SEQ ID NO: 2500451 - RNA, 15 nt, Human
cuuugucugaaaaau

SEQ ID NO: 2500452 - RNA, 22 nt, Human
cuuugugaauagaacucugaaa

SEQ ID NO: 2500453 - RNA, 15 nt, Human
cuuugugacuguaua

SEQ ID NO: 2500454 - RNA, 23 nt, Human
cuuugugacuguauauaaaggaa

SEQ ID NO: 2500455 - RNA, 19 nt, Human
cuuugugagagugagcugu

SEQ ID NO: 2500456 - RNA, 15 nt, Human
cuuuguccccaccgc

SEQ ID NO: 2500457 - RNA, 14 nt, Human
cuuugucccauuuc

SEQ ID NO: 2500458 - RNA, 20 nt, Human
cuuugcagacaggcaagcac

SEQ ID NO: 2500459 - RNA, 22 nt, Human
cuuugcagccggcacagggucu

SEQ ID NO: 2500460 - RNA, 13 nt, Human
cuuugcaggcuca

SEQ ID NO: 2500461 - RNA, 14 nt, Human
cuuugaccugccuc

SEQ ID NO: 2500462 - RNA, 15 nt, Human
cuuugaccugccucc

SEQ ID NO: 2500463 - RNA, 13 nt, Human
cuuugaccucugc

SEQ ID NO: 2500464 - RNA, 16 nt, Human
cuuugcagacaggcaa

SEQ ID NO: 2500465 - RNA, 15 nt, Human
cuuugcagguugcuu

SEQ ID NO: 2500466 - RNA, 12 nt, Human
cuuugcaggcau

SEQ ID NO: 2500467 - RNA, 17 nt, Human
cuuugcagguugcuuug

SEQ ID NO: 2500468 - RNA, 14 nt, Human
cuuugccuguucag

SEQ ID NO: 2500469 - RNA, 11 nt, Human
cuuugccuggu

SEQ ID NO: 2500470 - RNA, 13 nt, Human
cuuugccuccccg

SEQ ID NO: 2500471 - RNA, 16 nt, Human
cuuugccuguucaguu

SEQ ID NO: 2500472 - RNA, 15 nt, Human
cuuugccuguucagu

SEQ ID NO: 2500473 - RNA, 22 nt, Human
cuuugccuguucaguuacagaa

SEQ ID NO: 2500474 - RNA, 22 nt, Human
cuuugccuuccacgcugucucc

SEQ ID NO: 2500475 - RNA, 23 nt, Human
cuuugccuuccacgcugucucca

SEQ ID NO: 2500476 - RNA, 13 nt, Human
cuuugccuugggc

SEQ ID NO: 2500477 - RNA, 16 nt, Human
cuuugccuugggcugc

SEQ ID NO: 2500478 - RNA, 18 nt, Human
cuuugccuugggcugcuc

SEQ ID NO: 2500479 - RNA, 19 nt, Human
cuuugccuugggcugcucc

SEQ ID NO: 2500480 - RNA, 22 nt, Human
cuuugccuugggcugcuccuca

SEQ ID NO: 2500481 - RNA, 17 nt, Human
cuuugaccucugcagca

SEQ ID NO: 2500482 - RNA, 18 nt, Human
cuuugaccucugcagcaa

SEQ ID NO: 2500483 - RNA, 20 nt, Human
cuuugaccucugcagcaaua

SEQ ID NO: 2500484 - RNA, 24 nt, Human
cuuugaccucugcagcaauaaagc

SEQ ID NO: 2500485 - RNA, 14 nt, Human
cuuugaccucugca

SEQ ID NO: 2500486 - RNA, 15 nt, Human
cuuugaccucugcag

SEQ ID NO: 2500487 - RNA, 15 nt, Human
cuuucuuccucugcu

SEQ ID NO: 2500488 - RNA, 14 nt, Human
cuuucuuccucugc

SEQ ID NO: 2500489 - RNA, 13 nt, Human
cuuucuuccucug

SEQ ID NO: 2500490 - RNA, 12 nt, Human
cuuucuuccucu

SEQ ID NO: 2500491 - RNA, 17 nt, Human
cuuucuggcuaugcauu

SEQ ID NO: 2500492 - RNA, 18 nt, Human
cuuucuggcuaugcauuu

SEQ ID NO: 2500493 - RNA, 19 nt, Human
cuuucuggcuaugcauuug

SEQ ID NO: 2500494 - RNA, 20 nt, Human
cuuucuggcuaugcauuuga

SEQ ID NO: 2500495 - RNA, 13 nt, Human
cuuucuggcucuc

SEQ ID NO: 2500496 - RNA, 16 nt, Human
cuuucuguaaccauaa

SEQ ID NO: 2500497 - RNA, 20 nt, Human
cuuucugggcaccggggccu

SEQ ID NO: 2500498 - RNA, 14 nt, Human
cuuucugggccaag

SEQ ID NO: 2500499 - RNA, 11 nt, Human
cuuucuuccuc

SEQ ID NO: 2500500 - RNA, 13 nt, Human
cuuucuguauaua

SEQ ID NO: 2500501 - RNA, 13 nt, Human
cuuucuguaaacu

SEQ ID NO: 2500502 - RNA, 15 nt, Human
cuuuccugaggcugg

SEQ ID NO: 2500503 - RNA, 13 nt, Human
cuuuccugaggcu

SEQ ID NO: 2500504 - RNA, 16 nt, Human
cuuucucuacuuugag

SEQ ID NO: 2500505 - RNA, 15 nt, Human
cuuuccugaauccaa

SEQ ID NO: 2500506 - RNA, 22 nt, Human
cuuuccugaauccaaacuaauc

SEQ ID NO: 2500507 - RNA, 16 nt, Human
cuuucucuccuuucuu

SEQ ID NO: 2500508 - RNA, 17 nt, Human
cuuucucuccuuucuuu

SEQ ID NO: 2500509 - RNA, 15 nt, Human
cuuucucuccuuucu

SEQ ID NO: 2500510 - RNA, 14 nt, Human
cuuucucugccagu

SEQ ID NO: 2500511 - RNA, 13 nt, Human
cuuucucugccag

SEQ ID NO: 2500512 - RNA, 18 nt, Human
cuuucucugccagugaca

SEQ ID NO: 2500513 - RNA, 16 nt, Human
cuuucucugccaguga

SEQ ID NO: 2500514 - RNA, 15 nt, Human
cuuucucuucucugu

SEQ ID NO: 2500515 - RNA, 17 nt, Human
cuuucucuucucuguuc

SEQ ID NO: 2500516 - RNA, 16 nt, Human
cuuucugcuuguguua

SEQ ID NO: 2500517 - RNA, 19 nt, Human
cuuucugcucagcuucucc

SEQ ID NO: 2500518 - RNA, 17 nt, Human
cuuucugcucagcuucu

SEQ ID NO: 2500519 - RNA, 11 nt, Human
cuuucccuccc

SEQ ID NO: 2500520 - RNA, 13 nt, Human
cuuucccucccuu

SEQ ID NO: 2500521 - RNA, 14 nt, Human
cuuucccucccuuc

SEQ ID NO: 2500522 - RNA, 16 nt, Human
cuuucccucccuuccu

SEQ ID NO: 2500523 - RNA, 12 nt, Human
cuuuccugaggc

SEQ ID NO: 2500524 - RNA, 13 nt, Human
cuuucccugccuc

SEQ ID NO: 2500525 - RNA, 13 nt, Human
cuuucccugaacu

SEQ ID NO: 2500526 - RNA, 13 nt, Human
cuuucccuccacu

SEQ ID NO: 2500527 - RNA, 17 nt, Human
cuuucccuucaguaccc

SEQ ID NO: 2500528 - RNA, 20 nt, Human
cuuucccugaacugggaccu

SEQ ID NO: 2500529 - RNA, 15 nt, Human
cuuucccuuaucaaa

SEQ ID NO: 2500530 - RNA, 19 nt, Human
cuuucccugcuuaaugaaa

SEQ ID NO: 2500531 - RNA, 18 nt, Human
cuuuccauguugcugcca

SEQ ID NO: 2500532 - RNA, 17 nt, Human
cuuuccauguugcugcc

SEQ ID NO: 2500533 - RNA, 14 nt, Human
cuuuccauguugcu

SEQ ID NO: 2500534 - RNA, 18 nt, Human
cuuuccauuggaucucau

SEQ ID NO: 2500535 - RNA, 18 nt, Human
cuuucccggacugcaagc

SEQ ID NO: 2500536 - RNA, 17 nt, Human
cuuuccccuguggggau

SEQ ID NO: 2500537 - RNA, 15 nt, Human
cuuuccccugugggg

SEQ ID NO: 2500538 - RNA, 14 nt, Human
cuuuccccuguggg

SEQ ID NO: 2500539 - RNA, 15 nt, Human
cuuuccaggaaggcu

SEQ ID NO: 2500540 - RNA, 15 nt, Human
cuuuccaucuacccu

SEQ ID NO: 2500541 - RNA, 16 nt, Human
cuuuaugguaaagaug

SEQ ID NO: 2500542 - RNA, 12 nt, Human
cuuuaugcugaa

SEQ ID NO: 2500543 - RNA, 15 nt, Human
cuuuaugcugaaaca

SEQ ID NO: 2500544 - RNA, 13 nt, Human
cuuuaugguuucu

SEQ ID NO: 2500545 - RNA, 16 nt, Human
cuuuauguaauaaugu

SEQ ID NO: 2500546 - RNA, 19 nt, Human
cuuguacauaaugcgugca

SEQ ID NO: 2500547 - RNA, 21 nt, Human
cuuguacauaaugcgugcaua

SEQ ID NO: 2500548 - RNA, 22 nt, Human
cuuguacauaaugcgugcauac

SEQ ID NO: 2500549 - RNA, 13 nt, Human
cuuguacaugugu

SEQ ID NO: 2500550 - RNA, 15 nt, Human
cuuguacauaaugcg

SEQ ID NO: 2500551 - RNA, 12 nt, Human
cuuguacauaau

SEQ ID NO: 2500552 - RNA, 18 nt, Human
cuuguaaauagcucaggu

SEQ ID NO: 2500553 - RNA, 17 nt, Human
cuuguaaauagcucagg

SEQ ID NO: 2500554 - RNA, 19 nt, Human
cuugaguuuaaauuguaau

SEQ ID NO: 2500555 - RNA, 12 nt, Human
cuugaguuuguc

SEQ ID NO: 2500556 - RNA, 23 nt, Human
cuuggggggcugaggugggagga

SEQ ID NO: 2500557 - RNA, 22 nt, Human
cuuggggggguggccgcugagu

SEQ ID NO: 2500558 - RNA, 19 nt, Human
cuuggggggguggccgcug

SEQ ID NO: 2500559 - RNA, 18 nt, Human
cuuggggggguggccgcu

SEQ ID NO: 2500560 - RNA, 16 nt, Human
cuuggggggguggccg

SEQ ID NO: 2500561 - RNA, 14 nt, Human
cuuggggggguggc

SEQ ID NO: 2500562 - RNA, 13 nt, Human
cuugaguuugucg

SEQ ID NO: 2500563 - RNA, 23 nt, Human
cuugggggguuuuuacuccagug

SEQ ID NO: 2500564 - RNA, 22 nt, Human
cuugggggguuuuuacuccagu

SEQ ID NO: 2500565 - RNA, 16 nt, Human
cuuguaaauagcucag

SEQ ID NO: 2500566 - RNA, 22 nt, Human
cuugucaauauuuaaacauggu

SEQ ID NO: 2500567 - RNA, 20 nt, Human
cuuguccaacccgaggcccg

SEQ ID NO: 2500568 - RNA, 15 nt, Human
cuuguccacccaccu

SEQ ID NO: 2500569 - RNA, 14 nt, Human
cuuguccagcgccu

SEQ ID NO: 2500570 - RNA, 18 nt, Human
cuuguccagcgccuagug

SEQ ID NO: 2500571 - RNA, 19 nt, Human
cuugucaauauuuaaacau

SEQ ID NO: 2500572 - RNA, 15 nt, Human
cuugucaauauuuaa

SEQ ID NO: 2500573 - RNA, 14 nt, Human
cuuguguauccauu

SEQ ID NO: 2500574 - RNA, 14 nt, Human
cuugugguuuaugu

SEQ ID NO: 2500575 - RNA, 12 nt, Human
cuuguccagcug

SEQ ID NO: 2500576 - RNA, 13 nt, Human
cuuguccagcuga

SEQ ID NO: 2500577 - RNA, 18 nt, Human
cuugucccacuaucuggg

SEQ ID NO: 2500578 - RNA, 16 nt, Human
cuugucccacucaagc

SEQ ID NO: 2500579 - RNA, 18 nt, Human
cuugucccacucaagcca

SEQ ID NO: 2500580 - RNA, 19 nt, Human
cuugucccacucaagccaa

SEQ ID NO: 2500581 - RNA, 19 nt, Human
cuugucccagaggcugccc

SEQ ID NO: 2500582 - RNA, 14 nt, Human
cuuguccccaaauc

SEQ ID NO: 2500583 - RNA, 15 nt, Human
cuugucccagaggcu

SEQ ID NO: 2500584 - RNA, 21 nt, Human
cuugucccacucaagccaagc

SEQ ID NO: 2500585 - RNA, 22 nt, Human
cuuguacauguguagccugugc

SEQ ID NO: 2500586 - RNA, 20 nt, Human
cuuguacauguguagccugu

SEQ ID NO: 2500587 - RNA, 19 nt, Human
cuuguacauguguagccug

SEQ ID NO: 2500588 - RNA, 14 nt, Human
cuuguacaugugua

SEQ ID NO: 2500589 - RNA, 23 nt, Human
cuuguacauguguagccugugca

SEQ ID NO: 2500590 - RNA, 17 nt, Human
cuuguagggaugccuuu

SEQ ID NO: 2500591 - RNA, 21 nt, Human
cuuguaguuuaccucuuuaaa

SEQ ID NO: 2500592 - RNA, 15 nt, Human
cuugucaaagaaggu

SEQ ID NO: 2500593 - RNA, 19 nt, Human
cuuguauauuuguacaaaa

SEQ ID NO: 2500594 - RNA, 14 nt, Human
cuugucaaagaagg

SEQ ID NO: 2500595 - RNA, 18 nt, Human
cuuguauauuuguacaaa

SEQ ID NO: 2500596 - RNA, 17 nt, Human
cuuguauauuuguacaa

SEQ ID NO: 2500597 - RNA, 17 nt, Human
cuuguauauuuuaagaa

SEQ ID NO: 2500598 - RNA, 23 nt, Human
cuugucaauaaaauccauacauu

SEQ ID NO: 2500599 - RNA, 16 nt, Human
cuuguauauuuguaca

SEQ ID NO: 2500600 - RNA, 14 nt, Human
cuuguauauuugua

SEQ ID NO: 2500601 - RNA, 12 nt, Human
cuuguauauuug

SEQ ID NO: 2500602 - RNA, 11 nt, Human
cuuguauauuu

SEQ ID NO: 2500603 - RNA, 17 nt, Human
cuuguauaucuuguuuu

SEQ ID NO: 2500604 - RNA, 20 nt, Human
cuuguauauacgcaucuaua

SEQ ID NO: 2500605 - RNA, 17 nt, Human
cuuguauaguguaaaau

SEQ ID NO: 2500606 - RNA, 16 nt, Human
cuuguauaguguaaaa

SEQ ID NO: 2500607 - RNA, 15 nt, Human
cuuguauaguguaaa

SEQ ID NO: 2500608 - RNA, 22 nt, Human
cuuguauagguuuuaaagaccu

SEQ ID NO: 2500609 - RNA, 21 nt, Human
cuuuaucuugaauaauguaag

SEQ ID NO: 2500610 - RNA, 18 nt, Human
cuuuaucuugaauaaugu

SEQ ID NO: 2500611 - RNA, 16 nt, Human
cuuuauccucuuuaga

SEQ ID NO: 2500612 - RNA, 14 nt, Human
cuuuauccucuuua

SEQ ID NO: 2500613 - RNA, 22 nt, Human
cuuuaucuaauaccucugugug

SEQ ID NO: 2500614 - RNA, 21 nt, Human
cuuuaucuaauaccucugugu

SEQ ID NO: 2500615 - RNA, 12 nt, Human
cuuuauauuuag

SEQ ID NO: 2500616 - RNA, 13 nt, Human
cuuuauauuuagu

SEQ ID NO: 2500617 - RNA, 19 nt, Human
cuuuaucacauuauuugca

SEQ ID NO: 2500618 - RNA, 23 nt, Human
cuuuaucuugaauaauguaagac

SEQ ID NO: 2500619 - RNA, 18 nt, Human
cuuuaucuguucuugcua

SEQ ID NO: 2500620 - RNA, 13 nt, Human
cuuuaucuguucu

SEQ ID NO: 2500621 - RNA, 22 nt, Human
cuuuaugaaugaaaaaacaguc

SEQ ID NO: 2500622 - RNA, 15 nt, Human
cuuuaugcacaaaau

SEQ ID NO: 2500623 - RNA, 23 nt, Human
cuuuaugacuguuuuuguagugg

SEQ ID NO: 2500624 - RNA, 14 nt, Human
cuuuaucuugacau

SEQ ID NO: 2500625 - RNA, 22 nt, Human
cuuuaugccggaugugcuuuuc

SEQ ID NO: 2500626 - RNA, 20 nt, Human
cuuuaugccggaugugcuuu

SEQ ID NO: 2500627 - RNA, 19 nt, Human
cuuuaugccggaugugcuu

SEQ ID NO: 2500628 - RNA, 15 nt, Human
cuuuagcgcccaguu

SEQ ID NO: 2500629 - RNA, 14 nt, Human
cuuuagcgcccagu

SEQ ID NO: 2500630 - RNA, 13 nt, Human
cuuuauaauucua

SEQ ID NO: 2500631 - RNA, 19 nt, Human
cuuuauaauucuacuuuga

SEQ ID NO: 2500632 - RNA, 22 nt, Human
cuuuauaugaagaaaaucacuu

SEQ ID NO: 2500633 - RNA, 20 nt, Human
cuuuauauggccucaagauc

SEQ ID NO: 2500634 - RNA, 13 nt, Human
cuuuauaugaaga

SEQ ID NO: 2500635 - RNA, 19 nt, Human
cuuuauacguguagcuaua

SEQ ID NO: 2500636 - RNA, 18 nt, Human
cuuuauacaacagugcua

SEQ ID NO: 2500637 - RNA, 17 nt, Human
cuuuauacaacagugcu

SEQ ID NO: 2500638 - RNA, 15 nt, Human
cuuuauacaacagug

SEQ ID NO: 2500639 - RNA, 13 nt, Human
cuuuauacaacag

SEQ ID NO: 2500640 - RNA, 23 nt, Human
cuuuauacaacagugcuaaaaau

SEQ ID NO: 2500641 - RNA, 20 nt, Human
cuuuauacaacagugcuaaa

SEQ ID NO: 2500642 - RNA, 18 nt, Human
cuuuauacguguagcuau

SEQ ID NO: 2500643 - RNA, 23 nt, Human
cuuguguauccauuaucaugugu

SEQ ID NO: 2500644 - RNA, 22 nt, Human
cuuguguauccauuaucaugug

SEQ ID NO: 2500645 - RNA, 16 nt, Human
cuuguguauccauuau

SEQ ID NO: 2500646 - RNA, 15 nt, Human
cuuguguauccauua

SEQ ID NO: 2500647 - RNA, 14 nt, Human
cuugugucccauga

SEQ ID NO: 2500648 - RNA, 16 nt, Human
cuugugucaaacagua

SEQ ID NO: 2500649 - RNA, 15 nt, Human
cuugugucuacagag

SEQ ID NO: 2500650 - RNA, 22 nt, Human
cuugugucccuccugggaucug

SEQ ID NO: 2500651 - RNA, 20 nt, Human
cuuguucaaaauauguucuu

SEQ ID NO: 2500652 - RNA, 15 nt, Human
cuuguuauuuauaac

SEQ ID NO: 2500653 - RNA, 13 nt, Human
cuuguuauuuaua

SEQ ID NO: 2500654 - RNA, 16 nt, Human
cuuguucacacucuca

SEQ ID NO: 2500655 - RNA, 13 nt, Human
cuuguuccagcuc

SEQ ID NO: 2500656 - RNA, 21 nt, Human
cuuguucgugggucaucggga

SEQ ID NO: 2500657 - RNA, 12 nt, Human
cuuguuccuaga

SEQ ID NO: 2500658 - RNA, 14 nt, Human
cuuguucccucucc

SEQ ID NO: 2500659 - RNA, 16 nt, Human
cuuguuccagcucuuu

SEQ ID NO: 2500660 - RNA, 21 nt, Human
cuuguuccccacugacagccu

SEQ ID NO: 2500661 - RNA, 21 nt, Human
cuuguucucuaaguuccacug

SEQ ID NO: 2500662 - RNA, 13 nt, Human
cuuguucuacuca

SEQ ID NO: 2500663 - RNA, 22 nt, Human
cuuguucuacucauauauaucu

SEQ ID NO: 2500664 - RNA, 14 nt, Human
cuuuagaugcugau

SEQ ID NO: 2500665 - RNA, 13 nt, Human
cuuuagaugcuga

SEQ ID NO: 2500666 - RNA, 12 nt, Human
cuuuagaugcug

SEQ ID NO: 2500667 - RNA, 16 nt, Human
cuuuagccaaacccuu

SEQ ID NO: 2500668 - RNA, 17 nt, Human
cuuuagaugcugaugau

SEQ ID NO: 2500669 - RNA, 15 nt, Human
cuuuagccaaacccu

SEQ ID NO: 2500670 - RNA, 16 nt, Human
cuuuaccuuuuuucuu

SEQ ID NO: 2500671 - RNA, 18 nt, Human
cuuuacuaagaugacauu

SEQ ID NO: 2500672 - RNA, 15 nt, Human
cuuuacugucaaaau

SEQ ID NO: 2500673 - RNA, 22 nt, Human
cuuuacuaagaugacauugcua

SEQ ID NO: 2500674 - RNA, 19 nt, Human
cuuuacugucaaaauaauu

SEQ ID NO: 2500675 - RNA, 20 nt, Human
cuuuagaguuagacuguugg

SEQ ID NO: 2500676 - RNA, 22 nt, Human
cuuuaccuuuuuuauacauaaa

SEQ ID NO: 2500677 - RNA, 23 nt, Human
cuuuaaaauuuuuuuagaaagca

SEQ ID NO: 2500678 - RNA, 21 nt, Human
cuuuaaaauuuuuuuagaaag

SEQ ID NO: 2500679 - RNA, 18 nt, Human
cuuuaaaauuuuuuuaga

SEQ ID NO: 2500680 - RNA, 13 nt, Human
cuuuacuauggcc

SEQ ID NO: 2500681 - RNA, 21 nt, Human
cuuuaaacauugguucuugua

SEQ ID NO: 2500682 - RNA, 18 nt, Human
cuuuacggacacccccuc

SEQ ID NO: 2500683 - RNA, 21 nt, Human
cuucugggcaucuguucuggu

SEQ ID NO: 2500684 - RNA, 21 nt, Human
cuucugggcuucaucuggcaa

SEQ ID NO: 2500685 - RNA, 22 nt, Human
cuucugggcuucaucuggcaac

SEQ ID NO: 2500686 - RNA, 22 nt, Human
cuucugggagggcagcagggcu

SEQ ID NO: 2500687 - RNA, 18 nt, Human
cuucugcuuaggagagac

SEQ ID NO: 2500688 - RNA, 19 nt, Human
cuucugggagggcagcagg

SEQ ID NO: 2500689 - RNA, 20 nt, Human
cuucugggcaucuguucugg

SEQ ID NO: 2500690 - RNA, 19 nt, Human
cuucugggcaucuguucug

SEQ ID NO: 2500691 - RNA, 23 nt, Human
cuucugggagggcagcagggcua

SEQ ID NO: 2500692 - RNA, 15 nt, Human
cuucuggguggggca

SEQ ID NO: 2500693 - RNA, 18 nt, Human
cuucuggugaccuuccaa

SEQ ID NO: 2500694 - RNA, 20 nt, Human
cuucuggugaccuuccaaga

SEQ ID NO: 2500695 - RNA, 21 nt, Human
cuucuggugaccuuccaagag

SEQ ID NO: 2500696 - RNA, 14 nt, Human
cuucugguugaugc

SEQ ID NO: 2500697 - RNA, 16 nt, Human
cuucuggguuccuucc

SEQ ID NO: 2500698 - RNA, 17 nt, Human
cuucuggguuccuuccu

SEQ ID NO: 2500699 - RNA, 18 nt, Human
cuucugguacucuccuag

SEQ ID NO: 2500700 - RNA, 17 nt, Human
cuucugguacucuccua

SEQ ID NO: 2500701 - RNA, 16 nt, Human
cuucugguacucuccu

SEQ ID NO: 2500702 - RNA, 15 nt, Human
cuucugguacucucc

SEQ ID NO: 2500703 - RNA, 23 nt, Human
cuucuggguuccuuccucugagc

SEQ ID NO: 2500704 - RNA, 16 nt, Human
cuucugccuggagacu

SEQ ID NO: 2500705 - RNA, 15 nt, Human
cuucugccuggagac

SEQ ID NO: 2500706 - RNA, 14 nt, Human
cuucugccuggaga

SEQ ID NO: 2500707 - RNA, 13 nt, Human
cuucugccuggag

SEQ ID NO: 2500708 - RNA, 18 nt, Human
cuucugccuuagucucag

SEQ ID NO: 2500709 - RNA, 18 nt, Human
cuucugccuguggaacug

SEQ ID NO: 2500710 - RNA, 15 nt, Human
cuucugcuccacccu

SEQ ID NO: 2500711 - RNA, 17 nt, Human
cuucugcuccacccuug

SEQ ID NO: 2500712 - RNA, 15 nt, Human
cuucugccugagcuu

SEQ ID NO: 2500713 - RNA, 14 nt, Human
cuucugccugagcu

SEQ ID NO: 2500714 - RNA, 12 nt, Human
cuucugccugca

SEQ ID NO: 2500715 - RNA, 15 nt, Human
cuucugcccuugcca

SEQ ID NO: 2500716 - RNA, 17 nt, Human
cuucugccggcccuggg

SEQ ID NO: 2500717 - RNA, 18 nt, Human
cuucugccggcccugggg

SEQ ID NO: 2500718 - RNA, 19 nt, Human
cuucugccggcccuggggc

SEQ ID NO: 2500719 - RNA, 23 nt, Human
cuucugcccaauuggaggaaagc

SEQ ID NO: 2500720 - RNA, 17 nt, Human
cuucucugaagggaggu

SEQ ID NO: 2500721 - RNA, 21 nt, Human
cuucucugacuucugccugga

SEQ ID NO: 2500722 - RNA, 16 nt, Human
cuucugcuuaggagag

SEQ ID NO: 2500723 - RNA, 15 nt, Human
cuucugcuuaggaga

SEQ ID NO: 2500724 - RNA, 19 nt, Human
cuucugcugggcuggggcc

SEQ ID NO: 2500725 - RNA, 13 nt, Human
cuucugcuucagc

SEQ ID NO: 2500726 - RNA, 19 nt, Human
cuucugcuccacccuuggc

SEQ ID NO: 2500727 - RNA, 21 nt, Human
cuucugcuccacccuuggccu

SEQ ID NO: 2500728 - RNA, 23 nt, Human
cuucugcuccacccuuggccugu

SEQ ID NO: 2500729 - RNA, 14 nt, Human
cuucugccuguuau

SEQ ID NO: 2500730 - RNA, 15 nt, Human
cuucugcuggauaaa

SEQ ID NO: 2500731 - RNA, 17 nt, Human
cuucugcugggcugggg

SEQ ID NO: 2500732 - RNA, 16 nt, Human
cuucugcugggcuggg

SEQ ID NO: 2500733 - RNA, 15 nt, Human
cuucugcugggcugg

SEQ ID NO: 2500734 - RNA, 14 nt, Human
cuucugcugggcug

SEQ ID NO: 2500735 - RNA, 13 nt, Human
cuucugcugggcu

SEQ ID NO: 2500736 - RNA, 11 nt, Human
cuucugcuggg

SEQ ID NO: 2500737 - RNA, 17 nt, Human
cuucugcuggauaaaau

SEQ ID NO: 2500738 - RNA, 19 nt, Human
cuucugcuggauaaaauga

SEQ ID NO: 2500739 - RNA, 21 nt, Human
cuucugucuucacaacagauu

SEQ ID NO: 2500740 - RNA, 22 nt, Human
cuucugucuucacaacagauua

SEQ ID NO: 2500741 - RNA, 18 nt, Human
cuucugucuucacaacag

SEQ ID NO: 2500742 - RNA, 21 nt, Human
cuucuguccuacucuguguca

SEQ ID NO: 2500743 - RNA, 19 nt, Human
cuucuguccuacucugugu

SEQ ID NO: 2500744 - RNA, 18 nt, Human
cuucuguccuacucugug

SEQ ID NO: 2500745 - RNA, 17 nt, Human
cuucuguccuacucugu

SEQ ID NO: 2500746 - RNA, 16 nt, Human
cuucuguccuacucug

SEQ ID NO: 2500747 - RNA, 20 nt, Human
cuucuguacgucugacaggc

SEQ ID NO: 2500748 - RNA, 18 nt, Human
cuucuguacgucugacag

SEQ ID NO: 2500749 - RNA, 15 nt, Human
cuucuguacgucuga

SEQ ID NO: 2500750 - RNA, 14 nt, Human
cuucuguacgucug

SEQ ID NO: 2500751 - RNA, 21 nt, Human
cuucuguacgucugacaggca

SEQ ID NO: 2500752 - RNA, 20 nt, Human
cuucugguacucuccuagag

SEQ ID NO: 2500753 - RNA, 19 nt, Human
cuucugguacucuccuaga

SEQ ID NO: 2500754 - RNA, 18 nt, Human
cuucuguaggaauucuuu

SEQ ID NO: 2500755 - RNA, 11 nt, Human
cuucuguaguu

SEQ ID NO: 2500756 - RNA, 14 nt, Human
cuucugucccucac

SEQ ID NO: 2500757 - RNA, 15 nt, Human
cuucugucccucaca

SEQ ID NO: 2500758 - RNA, 20 nt, Human
cuucuguauuuuuuuuucua

SEQ ID NO: 2500759 - RNA, 19 nt, Human
cuucuguauucacuuauau

SEQ ID NO: 2500760 - RNA, 22 nt, Human
cuucuguauuuuuuuuucuaag

SEQ ID NO: 2500761 - RNA, 15 nt, Human
cuucuguauucacuu

SEQ ID NO: 2500762 - RNA, 21 nt, Human
cuucuguaguuuuaucacaug

SEQ ID NO: 2500763 - RNA, 17 nt, Human
cuucuguaguuuuauca

SEQ ID NO: 2500764 - RNA, 14 nt, Human
cuucuguaguuuua

SEQ ID NO: 2500765 - RNA, 18 nt, Human
cuucuguauacuguggag

SEQ ID NO: 2500766 - RNA, 24 nt, Human
cuucuccgccagccuccucuggac

SEQ ID NO: 2500767 - RNA, 23 nt, Human
cuucuccgccagccuccucugga

SEQ ID NO: 2500768 - RNA, 21 nt, Human
cuucuccgccagccuccucug

SEQ ID NO: 2500769 - RNA, 19 nt, Human
cuucuccgccagccuccuc

SEQ ID NO: 2500770 - RNA, 18 nt, Human
cuucuccgccagccuccu

SEQ ID NO: 2500771 - RNA, 17 nt, Human
cuucuccgccagccucc

SEQ ID NO: 2500772 - RNA, 16 nt, Human
cuucuccgccagccuc

SEQ ID NO: 2500773 - RNA, 15 nt, Human
cuucuccgccagccu

SEQ ID NO: 2500774 - RNA, 14 nt, Human
cuucuccgccagcc

SEQ ID NO: 2500775 - RNA, 13 nt, Human
cuucuccgccagc

SEQ ID NO: 2500776 - RNA, 12 nt, Human
cuucuccgccag

SEQ ID NO: 2500777 - RNA, 22 nt, Human
cuucucccucauuucaggagca

SEQ ID NO: 2500778 - RNA, 22 nt, Human
cuucucccccccggggcugggu

SEQ ID NO: 2500779 - RNA, 20 nt, Human
cuucucccccccggggcugg

SEQ ID NO: 2500780 - RNA, 18 nt, Human
cuucucccccccggggcu

SEQ ID NO: 2500781 - RNA, 15 nt, Human
cuucuccagccuaga

SEQ ID NO: 2500782 - RNA, 13 nt, Human
cuucuccaggcug

SEQ ID NO: 2500783 - RNA, 17 nt, Human
cuucuccacuggaugga

SEQ ID NO: 2500784 - RNA, 23 nt, Human
cuucuccagacaaaccagaagca

SEQ ID NO: 2500785 - RNA, 12 nt, Human
cuucuccagccu

SEQ ID NO: 2500786 - RNA, 17 nt, Human
cuucuccagacaaacca

SEQ ID NO: 2500787 - RNA, 12 nt, Human
cuucuccaggcu

SEQ ID NO: 2500788 - RNA, 20 nt, Human
cuuccuggggcaucuggcga

SEQ ID NO: 2500789 - RNA, 23 nt, Human
cuuccuggggcaucuggcgaauc

SEQ ID NO: 2500790 - RNA, 22 nt, Human
cuuccuguaacacaagccacag

SEQ ID NO: 2500791 - RNA, 23 nt, Human
cuuccuguaacacaagccacaga

SEQ ID NO: 2500792 - RNA, 15 nt, Human
cuuccuguccagaga

SEQ ID NO: 2500793 - RNA, 16 nt, Human
cuuccuguccagagag

SEQ ID NO: 2500794 - RNA, 22 nt, Human
cuuccuggagcccagaggaggg

SEQ ID NO: 2500795 - RNA, 17 nt, Human
cuuccuggagcccagag

SEQ ID NO: 2500796 - RNA, 16 nt, Human
cuuccuggagcccaga

SEQ ID NO: 2500797 - RNA, 20 nt, Human
cuucuccacuuucuagccag

SEQ ID NO: 2500798 - RNA, 11 nt, Human
cuucuccacuu

SEQ ID NO: 2500799 - RNA, 15 nt, Human
cuucuccacuggaug

SEQ ID NO: 2500800 - RNA, 14 nt, Human
cuucuccacuggau

SEQ ID NO: 2500801 - RNA, 13 nt, Human
cuucuccacugga

SEQ ID NO: 2500802 - RNA, 16 nt, Human
cuuccuguccagcucc

SEQ ID NO: 2500803 - RNA, 17 nt, Human
cuuccuguccagagaga

SEQ ID NO: 2500804 - RNA, 19 nt, Human
cuuccuguccagagagaga

SEQ ID NO: 2500805 - RNA, 19 nt, Human
cuucucuccagccccugga

SEQ ID NO: 2500806 - RNA, 17 nt, Human
cuucucuccagccccug

SEQ ID NO: 2500807 - RNA, 15 nt, Human
cuucucuccagcccc

SEQ ID NO: 2500808 - RNA, 13 nt, Human
cuucucuccagcc

SEQ ID NO: 2500809 - RNA, 12 nt, Human
cuucucuccagc

SEQ ID NO: 2500810 - RNA, 19 nt, Human
cuucuccuucaccuuuguc

SEQ ID NO: 2500811 - RNA, 23 nt, Human
cuucuccucuuguaaauaaagcc

SEQ ID NO: 2500812 - RNA, 18 nt, Human
cuucuccucuuguaaaua

SEQ ID NO: 2500813 - RNA, 17 nt, Human
cuucuccucuuguaaau

SEQ ID NO: 2500814 - RNA, 15 nt, Human
cuucuccucuuguaa

SEQ ID NO: 2500815 - RNA, 16 nt, Human
cuucuccuauguguaa

SEQ ID NO: 2500816 - RNA, 15 nt, Human
cuucuccuaugugua

SEQ ID NO: 2500817 - RNA, 14 nt, Human
cuucuccuaugugu

SEQ ID NO: 2500818 - RNA, 18 nt, Human
cuucuccuccccacccgc

SEQ ID NO: 2500819 - RNA, 22 nt, Human
cuucuccuauguguaaggugaa

SEQ ID NO: 2500820 - RNA, 14 nt, Human
cuucuccucuugua

SEQ ID NO: 2500821 - RNA, 20 nt, Human
cuucucugacuucugccugg

SEQ ID NO: 2500822 - RNA, 17 nt, Human
cuucucugacuucugcc

SEQ ID NO: 2500823 - RNA, 20 nt, Human
cuucugccauuucugagauc

SEQ ID NO: 2500824 - RNA, 16 nt, Human
cuucucugacuucugc

SEQ ID NO: 2500825 - RNA, 15 nt, Human
cuucucugacuucug

SEQ ID NO: 2500826 - RNA, 14 nt, Human
cuucucugacuucu

SEQ ID NO: 2500827 - RNA, 12 nt, Human
cuucucugacuu

SEQ ID NO: 2500828 - RNA, 16 nt, Human
cuucucugaagggagg

SEQ ID NO: 2500829 - RNA, 13 nt, Human
cuucucugaaggg

SEQ ID NO: 2500830 - RNA, 12 nt, Human
cuucucugaagg

SEQ ID NO: 2500831 - RNA, 11 nt, Human
cuucucugaag

SEQ ID NO: 2500832 - RNA, 13 nt, Human
cuucucucugugg

SEQ ID NO: 2500833 - RNA, 13 nt, Human
cuucucugaagga

SEQ ID NO: 2500834 - RNA, 16 nt, Human
cuucucucugugggau

SEQ ID NO: 2500835 - RNA, 15 nt, Human
cuucucucucaccag

SEQ ID NO: 2500836 - RNA, 13 nt, Human
cuucucucucacc

SEQ ID NO: 2500837 - RNA, 15 nt, Human
cuucucuccucccca

SEQ ID NO: 2500838 - RNA, 13 nt, Human
cuucucuccuccc

SEQ ID NO: 2500839 - RNA, 18 nt, Human
cuucucucucuaaaauga

SEQ ID NO: 2500840 - RNA, 19 nt, Human
cuucuccugacccaguccc

SEQ ID NO: 2500841 - RNA, 15 nt, Human
cuucuugccucugug

SEQ ID NO: 2500842 - RNA, 13 nt, Human
cuucuugccucug

SEQ ID NO: 2500843 - RNA, 21 nt, Human
cuucugugggugacccagguc

SEQ ID NO: 2500844 - RNA, 14 nt, Human
cuucuguucugccu

SEQ ID NO: 2500845 - RNA, 18 nt, Human
cuucuugccucugugcug

SEQ ID NO: 2500846 - RNA, 17 nt, Human
cuucuugccucugugcu

SEQ ID NO: 2500847 - RNA, 16 nt, Human
cuucuugccucugugc

SEQ ID NO: 2500848 - RNA, 13 nt, Human
cuucuuguucccc

SEQ ID NO: 2500849 - RNA, 20 nt, Human
cuucuuggucuuauuuauua

SEQ ID NO: 2500850 - RNA, 23 nt, Human
cuucuuggugcuuacacaucuca

SEQ ID NO: 2500851 - RNA, 16 nt, Human
cuucuuggucuuauuu

SEQ ID NO: 2500852 - RNA, 14 nt, Human
cuucugugaaagua

SEQ ID NO: 2500853 - RNA, 17 nt, Human
cuucuguccugguguca

SEQ ID NO: 2500854 - RNA, 19 nt, Human
cuucugugagacccccaca

SEQ ID NO: 2500855 - RNA, 22 nt, Human
cuucugugagacccccacaccu

SEQ ID NO: 2500856 - RNA, 20 nt, Human
cuucugugagacccccacac

SEQ ID NO: 2500857 - RNA, 21 nt, Human
cuucugugagacccccacacc

SEQ ID NO: 2500858 - RNA, 13 nt, Human
cuucuguggcuca

SEQ ID NO: 2500859 - RNA, 21 nt, Human
cuucuguggguuucuaaagcu

SEQ ID NO: 2500860 - RNA, 14 nt, Human
cuucuguggguuuc

SEQ ID NO: 2500861 - RNA, 13 nt, Human
cuucuguggguuu

SEQ ID NO: 2500862 - RNA, 22 nt, Human
cuucuguggcucacagaacccu

SEQ ID NO: 2500863 - RNA, 15 nt, Human
cuucuguggcucaca

SEQ ID NO: 2500864 - RNA, 16 nt, Human
cuugaaaauaagaaua

SEQ ID NO: 2500865 - RNA, 15 nt, Human
cuugaaaaggguguu

SEQ ID NO: 2500866 - RNA, 22 nt, Human
cuugaaaaaugugcaaaacagc

SEQ ID NO: 2500867 - RNA, 21 nt, Human
cuugaaaaaugugcaaaacag

SEQ ID NO: 2500868 - RNA, 23 nt, Human
cuugaaaacacuguucucugccc

SEQ ID NO: 2500869 - RNA, 18 nt, Human
cuugaaaaaugugcaaaa

SEQ ID NO: 2500870 - RNA, 13 nt, Human
cuugaaaaaugug

SEQ ID NO: 2500871 - RNA, 12 nt, Human
cuugaaaaaugu

SEQ ID NO: 2500872 - RNA, 14 nt, Human
cuugaaaacacugu

SEQ ID NO: 2500873 - RNA, 18 nt, Human
cuugaaaaaugcauguug

SEQ ID NO: 2500874 - RNA, 12 nt, Human
cuugaaaaaugc

SEQ ID NO: 2500875 - RNA, 17 nt, Human
cuucuuuuuuugugaug

SEQ ID NO: 2500876 - RNA, 17 nt, Human
cuucuuuaauugaucua

SEQ ID NO: 2500877 - RNA, 16 nt, Human
cuucuuuuuuuucauu

SEQ ID NO: 2500878 - RNA, 13 nt, Human
cuugaaaauuaac

SEQ ID NO: 2500879 - RNA, 12 nt, Human
cuugaaaauuaa

SEQ ID NO: 2500880 - RNA, 18 nt, Human
cuugaaaauuaacaugaa

SEQ ID NO: 2500881 - RNA, 20 nt, Human
cuugaaaauuuuauuaaaaa

SEQ ID NO: 2500882 - RNA, 22 nt, Human
cuugaaaauaagaauagaaaua

SEQ ID NO: 2500883 - RNA, 23 nt, Human
cuugaaaauauuuuuuauauaua

SEQ ID NO: 2500884 - RNA, 13 nt, Human
cuugaaagaaaau

SEQ ID NO: 2500885 - RNA, 13 nt, Human
cuugaaagcugug

SEQ ID NO: 2500886 - RNA, 17 nt, Human
cuugaaagcauccaugu

SEQ ID NO: 2500887 - RNA, 18 nt, Human
cuugaaagcauccaugug

SEQ ID NO: 2500888 - RNA, 16 nt, Human
cuugaaagcauccaug

SEQ ID NO: 2500889 - RNA, 15 nt, Human
cuugaaauuuuaacc

SEQ ID NO: 2500890 - RNA, 16 nt, Human
cuugaaauuuuaaccu

SEQ ID NO: 2500891 - RNA, 17 nt, Human
cuugaaauaccagugaa

SEQ ID NO: 2500892 - RNA, 22 nt, Human
cuugaaauaccagugaaccaaa

SEQ ID NO: 2500893 - RNA, 14 nt, Human
cuugaaauuuuaac

SEQ ID NO: 2500894 - RNA, 20 nt, Human
cuugaaagcauccaugugug

SEQ ID NO: 2500895 - RNA, 17 nt, Human
cuugaaauuuuaaccua

SEQ ID NO: 2500896 - RNA, 23 nt, Human
cuugaacacucaugcugaaagcc

SEQ ID NO: 2500897 - RNA, 20 nt, Human
cuugaacacucaugcugaaa

SEQ ID NO: 2500898 - RNA, 19 nt, Human
cuugaacacucaugcugaa

SEQ ID NO: 2500899 - RNA, 13 nt, Human
cuugaacacuggg

SEQ ID NO: 2500900 - RNA, 15 nt, Human
cuugaacacuggggg

SEQ ID NO: 2500901 - RNA, 18 nt, Human
cuugaacauguuuuguau

SEQ ID NO: 2500902 - RNA, 16 nt, Human
cuugaacacuggggga

SEQ ID NO: 2500903 - RNA, 17 nt, Human
cuugaacuuugaccucu

SEQ ID NO: 2500904 - RNA, 21 nt, Human
cuugaacuuugaccucugcag

SEQ ID NO: 2500905 - RNA, 22 nt, Human
cuugaagaacugcaggcccugg

SEQ ID NO: 2500906 - RNA, 20 nt, Human
cuugaagaacugcaggcccu

SEQ ID NO: 2500907 - RNA, 18 nt, Human
cuugaagaacugcaggcc

SEQ ID NO: 2500908 - RNA, 17 nt, Human
cuugaagaacugcaggc

SEQ ID NO: 2500909 - RNA, 12 nt, Human
cuugaagaacug

SEQ ID NO: 2500910 - RNA, 18 nt, Human
cuugaacuccugaccuca

SEQ ID NO: 2500911 - RNA, 13 nt, Human
cuugaacuccuga

SEQ ID NO: 2500912 - RNA, 16 nt, Human
cuugaacuccugaccu

SEQ ID NO: 2500913 - RNA, 13 nt, Human
cuugaacuccugg

SEQ ID NO: 2500914 - RNA, 15 nt, Human
cuugaaccacuuccc

SEQ ID NO: 2500915 - RNA, 14 nt, Human
cuugaaccacuucc

SEQ ID NO: 2500916 - RNA, 15 nt, Human
cuugaacccaggaga

SEQ ID NO: 2500917 - RNA, 23 nt, Human
cuugaccauucuccaccugccag

SEQ ID NO: 2500918 - RNA, 22 nt, Human
cuugaccauucuccaccugcca

SEQ ID NO: 2500919 - RNA, 17 nt, Human
cuugaccgugaggccag

SEQ ID NO: 2500920 - RNA, 13 nt, Human
cuugacccaucuc

SEQ ID NO: 2500921 - RNA, 16 nt, Human
cuugacccaucucccc

SEQ ID NO: 2500922 - RNA, 20 nt, Human
cuugaccgugaggccagaga

SEQ ID NO: 2500923 - RNA, 18 nt, Human
cuugaccgugaggccaga

SEQ ID NO: 2500924 - RNA, 21 nt, Human
cuugaccgugaggccagagac

SEQ ID NO: 2500925 - RNA, 13 nt, Human
cuugaccucaggu

SEQ ID NO: 2500926 - RNA, 20 nt, Human
cuugaccugaggcugugguc

SEQ ID NO: 2500927 - RNA, 17 nt, Human
cuugaccugaggcugug

SEQ ID NO: 2500928 - RNA, 23 nt, Human
cuugaccugaggcuguggucaca

SEQ ID NO: 2500929 - RNA, 14 nt, Human
cuugaccugaggcu

SEQ ID NO: 2500930 - RNA, 12 nt, Human
cuugaccuccua

SEQ ID NO: 2500931 - RNA, 16 nt, Human
cuugagccugggaggu

SEQ ID NO: 2500932 - RNA, 17 nt, Human
cuugagccuugaacuuu

SEQ ID NO: 2500933 - RNA, 18 nt, Human
cuugagccuugaacuuug

SEQ ID NO: 2500934 - RNA, 15 nt, Human
cuugagccuugaacu

SEQ ID NO: 2500935 - RNA, 20 nt, Human
cuugacuuuagucugcaaaa

SEQ ID NO: 2500936 - RNA, 22 nt, Human
cuugacuugcaauuucuaccua

SEQ ID NO: 2500937 - RNA, 13 nt, Human
cuugacuccuugu

SEQ ID NO: 2500938 - RNA, 20 nt, Human
cuugacuaaaaaaaaaagaa

SEQ ID NO: 2500939 - RNA, 14 nt, Human
cuugagcuccccaa

SEQ ID NO: 2500940 - RNA, 10 nt, Human
cuugagcuga

SEQ ID NO: 2500941 - RNA, 16 nt, Human
cuugagcugagaugga

SEQ ID NO: 2500942 - RNA, 13 nt, Human
cuugagcugagau

SEQ ID NO: 2500943 - RNA, 12 nt, Human
cuugagcuuggc

SEQ ID NO: 2500944 - RNA, 20 nt, Human
cuugagcuuggcagcugaac

SEQ ID NO: 2500945 - RNA, 21 nt, Human
cuugagcuuggcagcugaacu

SEQ ID NO: 2500946 - RNA, 13 nt, Human
cuugaggaaacaa

SEQ ID NO: 2500947 - RNA, 18 nt, Human
cuugaggaaacaacagcu

SEQ ID NO: 2500948 - RNA, 20 nt, Human
cuugaggaaacaacagcuuu

SEQ ID NO: 2500949 - RNA, 20 nt, Human
cuugaggguugggcuggugu

SEQ ID NO: 2500950 - RNA, 19 nt, Human
cuugaggguugggcuggug

SEQ ID NO: 2500951 - RNA, 21 nt, Human
cuugaggguugggcugguguc

SEQ ID NO: 2500952 - RNA, 21 nt, Human
cuugaggaaacaacagcuuua

SEQ ID NO: 2500953 - RNA, 16 nt, Human
cuguucuggcagaguu

SEQ ID NO: 2500954 - RNA, 21 nt, Human
cuguucucuugggaacugaac

SEQ ID NO: 2500955 - RNA, 16 nt, Human
cuguucugcacacagc

SEQ ID NO: 2500956 - RNA, 20 nt, Human
cuuagaugcaguucugaaga

SEQ ID NO: 2500957 - RNA, 11 nt, Human
cuguucuggaa

SEQ ID NO: 2500958 - RNA, 16 nt, Human
cuuagucacugagaca

SEQ ID NO: 2500959 - RNA, 11 nt, Human
cuguucugugg

SEQ ID NO: 2500960 - RNA, 19 nt, Human
cuguucugucccuuggagc

SEQ ID NO: 2500961 - RNA, 22 nt, Human
cuguucugguuuuuaaccauug

SEQ ID NO: 2500962 - RNA, 22 nt, Human
cuuagaugcaguucugaagaag

SEQ ID NO: 2500963 - RNA, 13 nt, Human
cuuagauguauau

SEQ ID NO: 2500964 - RNA, 19 nt, Human
cuuagucucaguuugugug

SEQ ID NO: 2500965 - RNA, 18 nt, Human
cuuagucucaguuugugu

SEQ ID NO: 2500966 - RNA, 13 nt, Human
cuuagucucaguu

SEQ ID NO: 2500967 - RNA, 12 nt, Human
cuuagucucagu

SEQ ID NO: 2500968 - RNA, 16 nt, Human
cuuagauggauucucc

SEQ ID NO: 2500969 - RNA, 14 nt, Human
cuuagucacugaga

SEQ ID NO: 2500970 - RNA, 19 nt, Human
cuuagucacugagacagcc

SEQ ID NO: 2500971 - RNA, 18 nt, Human
cuuagucacugagacagc

SEQ ID NO: 2500972 - RNA, 13 nt, Human
cuuaguggcuuuu

SEQ ID NO: 2500973 - RNA, 17 nt, Human
cuuagugguuccccacc

SEQ ID NO: 2500974 - RNA, 22 nt, Human
cuuaguggcuuuuuuccuccug

SEQ ID NO: 2500975 - RNA, 22 nt, Human
cuuagugcggacaaguuuuaau

SEQ ID NO: 2500976 - RNA, 21 nt, Human
cuuagucuucucauagcauua

SEQ ID NO: 2500977 - RNA, 20 nt, Human
cuuagugcggacaaguuuua

SEQ ID NO: 2500978 - RNA, 19 nt, Human
cuuagugcggacaaguuuu

SEQ ID NO: 2500979 - RNA, 17 nt, Human
cuuagugaaauuacuuc

SEQ ID NO: 2500980 - RNA, 23 nt, Human
cuuagucucaguuugugugucuu

SEQ ID NO: 2500981 - RNA, 20 nt, Human
cuuagucucaguuugugugu

SEQ ID NO: 2500982 - RNA, 15 nt, Human
cuuagucuucucaua

SEQ ID NO: 2500983 - RNA, 16 nt, Human
cuuagucuucucauag

SEQ ID NO: 2500984 - RNA, 20 nt, Human
cuuagucuucucauagcauu

SEQ ID NO: 2500985 - RNA, 23 nt, Human
cuuaguuuguguguugucucuug

SEQ ID NO: 2500986 - RNA, 19 nt, Human
cuuaguuuggauucuuaug

SEQ ID NO: 2500987 - RNA, 14 nt, Human
cuuauacccaugaa

SEQ ID NO: 2500988 - RNA, 22 nt, Human
cuuaguuuggauucuuauguag

SEQ ID NO: 2500989 - RNA, 16 nt, Human
cuuaguucucacuguu

SEQ ID NO: 2500990 - RNA, 15 nt, Human
cuuaguucucacugu

SEQ ID NO: 2500991 - RNA, 22 nt, Human
cuuaguuuguguguugucucuu

SEQ ID NO: 2500992 - RNA, 17 nt, Human
cuuaguuuguguguugu

SEQ ID NO: 2500993 - RNA, 18 nt, Human
cuuaguguuucugugcau

SEQ ID NO: 2500994 - RNA, 17 nt, Human
cuuaguguuucugugca

SEQ ID NO: 2500995 - RNA, 16 nt, Human
cuuaguguuucugugc

SEQ ID NO: 2500996 - RNA, 13 nt, Human
cuuaguguuucug

SEQ ID NO: 2500997 - RNA, 16 nt, Human
cuuaguuaucagcuuu

SEQ ID NO: 2500998 - RNA, 19 nt, Human
cuuaguguuucugugcaug

SEQ ID NO: 2500999 - RNA, 14 nt, Human
cuuaguucucacug

SEQ ID NO: 2501000 - RNA, 14 nt, Human
cuuauagacaacau

SEQ ID NO: 2501001 - RNA, 16 nt, Human
cuuauagaauauuuau

SEQ ID NO: 2501002 - RNA, 15 nt, Human
cuuauagaauauuua

SEQ ID NO: 2501003 - RNA, 14 nt, Human
cuuauagaauauuu

SEQ ID NO: 2501004 - RNA, 13 nt, Human
cuuauagaauauu

SEQ ID NO: 2501005 - RNA, 20 nt, Human
cuuauagaauauuuauuacc

SEQ ID NO: 2501006 - RNA, 20 nt, Human
cuuauauaguuuacuauuuu

SEQ ID NO: 2501007 - RNA, 18 nt, Human
cuuauauaguuuacuauu

SEQ ID NO: 2501008 - RNA, 14 nt, Human
cuuaucauggucuc

SEQ ID NO: 2501009 - RNA, 15 nt, Human
cuuaucauggucuca

SEQ ID NO: 2501010 - RNA, 15 nt, Human
cuuaucauucauucu

SEQ ID NO: 2501011 - RNA, 19 nt, Human
cuuaucauccacauuguuu

SEQ ID NO: 2501012 - RNA, 15 nt, Human
cuuaucauccacauu

SEQ ID NO: 2501013 - RNA, 21 nt, Human
cuuaucauccacauuguuuua

SEQ ID NO: 2501014 - RNA, 20 nt, Human
cuuaucaugcugucuuuaca

SEQ ID NO: 2501015 - RNA, 22 nt, Human
cuuaucaccagcugccucuucu

SEQ ID NO: 2501016 - RNA, 19 nt, Human
cuuaucaccagcugccucu

SEQ ID NO: 2501017 - RNA, 17 nt, Human
cuuaucaccagcugccu

SEQ ID NO: 2501018 - RNA, 16 nt, Human
cuuaucaccagcugcc

SEQ ID NO: 2501019 - RNA, 18 nt, Human
cuuaucacugacacaaaa

SEQ ID NO: 2501020 - RNA, 12 nt, Human
cuuaucccucuc

SEQ ID NO: 2501021 - RNA, 19 nt, Human
cuuauccaggacucuguca

SEQ ID NO: 2501022 - RNA, 13 nt, Human
cuuauccaggacu

SEQ ID NO: 2501023 - RNA, 12 nt, Human
cuuauccaggac

SEQ ID NO: 2501024 - RNA, 15 nt, Human
cuuauccagcuggug

SEQ ID NO: 2501025 - RNA, 21 nt, Human
cuuauccuaaaacaaauaguu

SEQ ID NO: 2501026 - RNA, 15 nt, Human
cuuauccaggacucu

SEQ ID NO: 2501027 - RNA, 18 nt, Human
cuuauauguguauugcua

SEQ ID NO: 2501028 - RNA, 21 nt, Human
cuuauauuaauauuccucagu

SEQ ID NO: 2501029 - RNA, 21 nt, Human
cuuauaucaucagcauaccuu

SEQ ID NO: 2501030 - RNA, 17 nt, Human
cuuauauaugugaacau

SEQ ID NO: 2501031 - RNA, 14 nt, Human
cuuauauaugugaa

SEQ ID NO: 2501032 - RNA, 19 nt, Human
cuuauauaguuuacuauuu

SEQ ID NO: 2501033 - RNA, 13 nt, Human
cuuauauuaugga

SEQ ID NO: 2501034 - RNA, 19 nt, Human
cuuaucaagugucuuccau

SEQ ID NO: 2501035 - RNA, 13 nt, Human
cuuaucaccagcu

SEQ ID NO: 2501036 - RNA, 23 nt, Human
cuuaucaccacaguaaguuccua

SEQ ID NO: 2501037 - RNA, 22 nt, Human
cuuaucaccacaguaaguuccu

SEQ ID NO: 2501038 - RNA, 17 nt, Human
cuuauuuaaugaaagac

SEQ ID NO: 2501039 - RNA, 14 nt, Human
cuuauccucugauc

SEQ ID NO: 2501040 - RNA, 13 nt, Human
cuuauccucugau

SEQ ID NO: 2501041 - RNA, 22 nt, Human
cuuauccucugaucuccauggc

SEQ ID NO: 2501042 - RNA, 16 nt, Human
cuuauccucugaucuc

SEQ ID NO: 2501043 - RNA, 15 nt, Human
cuuauccucugaucu

SEQ ID NO: 2501044 - RNA, 18 nt, Human
cuuauccucugaucucca

SEQ ID NO: 2501045 - RNA, 14 nt, Human
cuuauuucauuucu

SEQ ID NO: 2501046 - RNA, 21 nt, Human
cuuauuuauucauauuuucuu

SEQ ID NO: 2501047 - RNA, 20 nt, Human
cuuaucucagucaugcauaa

SEQ ID NO: 2501048 - RNA, 19 nt, Human
cuuaucucagucaugcaua

SEQ ID NO: 2501049 - RNA, 13 nt, Human
cuuauuuauuauu

SEQ ID NO: 2501050 - RNA, 17 nt, Human
cuuaucaagugucuucc

SEQ ID NO: 2501051 - RNA, 18 nt, Human
cuuauuuaaugaaagacu

SEQ ID NO: 2501052 - RNA, 21 nt, Human
cuucaaaaguauuuuccugua

SEQ ID NO: 2501053 - RNA, 17 nt, Human
cuucaaaaguauuuucc

SEQ ID NO: 2501054 - RNA, 16 nt, Human
cuucaaaaguauuuuc

SEQ ID NO: 2501055 - RNA, 15 nt, Human
cuucaaaaguauuuu

SEQ ID NO: 2501056 - RNA, 23 nt, Human
cuuauuugcugccacaccugagc

SEQ ID NO: 2501057 - RNA, 13 nt, Human
cuuauuugaguga

SEQ ID NO: 2501058 - RNA, 12 nt, Human
cuuauuugagug

SEQ ID NO: 2501059 - RNA, 23 nt, Human
cuuauuuuaaaauuuuaucucuu

SEQ ID NO: 2501060 - RNA, 15 nt, Human
cuuauuucauuucuu

SEQ ID NO: 2501061 - RNA, 17 nt, Human
cuuauuucaugaaaauu

SEQ ID NO: 2501062 - RNA, 11 nt, Human
cuuauuugagu

SEQ ID NO: 2501063 - RNA, 17 nt, Human
cuucaacagcuccccau

SEQ ID NO: 2501064 - RNA, 16 nt, Human
cuucaacagcucccca

SEQ ID NO: 2501065 - RNA, 24 nt, Human
cuucaacagacccccucuagaaau

SEQ ID NO: 2501066 - RNA, 16 nt, Human
cuucaacaucaauguu

SEQ ID NO: 2501067 - RNA, 18 nt, Human
cuucaacaucaauguuca

SEQ ID NO: 2501068 - RNA, 19 nt, Human
cuucaacaucaauguucau

SEQ ID NO: 2501069 - RNA, 20 nt, Human
cuucaacaucaauguucauu

SEQ ID NO: 2501070 - RNA, 16 nt, Human
cuucaaagcuugaaga

SEQ ID NO: 2501071 - RNA, 18 nt, Human
cuucaaagcuugaagauc

SEQ ID NO: 2501072 - RNA, 22 nt, Human
cuucaaacagaacugcagucag

SEQ ID NO: 2501073 - RNA, 17 nt, Human
cuucaaagcaaaugucu

SEQ ID NO: 2501074 - RNA, 23 nt, Human
cuucaaacuagggccaagcccag

SEQ ID NO: 2501075 - RNA, 22 nt, Human
cuucaauacccaaauccucucc

SEQ ID NO: 2501076 - RNA, 21 nt, Human
cuucaauaaaugguauagcaa

SEQ ID NO: 2501077 - RNA, 12 nt, Human
cuucaauaaagu

SEQ ID NO: 2501078 - RNA, 20 nt, Human
cuucaaguuagcucaggagg

SEQ ID NO: 2501079 - RNA, 14 nt, Human
cuucaauaaaguau

SEQ ID NO: 2501080 - RNA, 16 nt, Human
cuucaaguuagcucag

SEQ ID NO: 2501081 - RNA, 17 nt, Human
cuucaaguuagcucagg

SEQ ID NO: 2501082 - RNA, 18 nt, Human
cuucaaguuagcucagga

SEQ ID NO: 2501083 - RNA, 19 nt, Human
cuucaaguuagcucaggag

SEQ ID NO: 2501084 - RNA, 15 nt, Human
cuucaauuccugggc

SEQ ID NO: 2501085 - RNA, 16 nt, Human
cuucaauuccugggcc

SEQ ID NO: 2501086 - RNA, 21 nt, Human
cuucacacacaggcaacugag

SEQ ID NO: 2501087 - RNA, 15 nt, Human
cuucaauuaauaaaa

SEQ ID NO: 2501088 - RNA, 22 nt, Human
cuucacacacaggcaacugagg

SEQ ID NO: 2501089 - RNA, 23 nt, Human
cuucacagaugggugcuuggagg

SEQ ID NO: 2501090 - RNA, 12 nt, Human
cuucacacugca

SEQ ID NO: 2501091 - RNA, 13 nt, Human
cuucacacugcaa

SEQ ID NO: 2501092 - RNA, 15 nt, Human
cuucacacugcaaga

SEQ ID NO: 2501093 - RNA, 18 nt, Human
cuucacacugcaagagcc

SEQ ID NO: 2501094 - RNA, 20 nt, Human
cuucacacugcaagagccuu

SEQ ID NO: 2501095 - RNA, 11 nt, Human
cuucacagagu

SEQ ID NO: 2501096 - RNA, 21 nt, Human
cuucacacugcaagagccuug

SEQ ID NO: 2501097 - RNA, 22 nt, Human
cuucaccagaggaaucacucuu

SEQ ID NO: 2501098 - RNA, 17 nt, Human
cuucaccauuuggcaau

SEQ ID NO: 2501099 - RNA, 21 nt, Human
cuucacauccuguguuucuag

SEQ ID NO: 2501100 - RNA, 22 nt, Human
cuucacagagugugcuggagga

SEQ ID NO: 2501101 - RNA, 20 nt, Human
cuucacagagugugcuggag

SEQ ID NO: 2501102 - RNA, 17 nt, Human
cuucacagagugugcug

SEQ ID NO: 2501103 - RNA, 13 nt, Human
cuucacagagugu

SEQ ID NO: 2501104 - RNA, 23 nt, Human
cuucacagagugugcuggaggac

SEQ ID NO: 2501105 - RNA, 16 nt, Human
cuucacagcucugugu

SEQ ID NO: 2501106 - RNA, 15 nt, Human
cuucaaggauccuga

SEQ ID NO: 2501107 - RNA, 13 nt, Human
cuucaaggauccu

SEQ ID NO: 2501108 - RNA, 16 nt, Human
cuucaaggauccugag

SEQ ID NO: 2501109 - RNA, 22 nt, Human
cuucaagugcaugcucucugca

SEQ ID NO: 2501110 - RNA, 18 nt, Human
cuucaaguuaaagugaau

SEQ ID NO: 2501111 - RNA, 16 nt, Human
cuucaaccauucccca

SEQ ID NO: 2501112 - RNA, 22 nt, Human
cuucaacaucaauguucauugu

SEQ ID NO: 2501113 - RNA, 20 nt, Human
cuucaaccauuccccauggg

SEQ ID NO: 2501114 - RNA, 17 nt, Human
cuucaaccuugagacag

SEQ ID NO: 2501115 - RNA, 15 nt, Human
cuucaacauuuacau

SEQ ID NO: 2501116 - RNA, 10 nt, Human
cuucaaggau

SEQ ID NO: 2501117 - RNA, 13 nt, Human
cuuccuaauucca

SEQ ID NO: 2501118 - RNA, 17 nt, Human
cuuccuaauuccacagc

SEQ ID NO: 2501119 - RNA, 18 nt, Human
cuuccuaauuccacagcu

SEQ ID NO: 2501120 - RNA, 19 nt, Human
cuuccuaauuccacagcug

SEQ ID NO: 2501121 - RNA, 23 nt, Human
cuuccguaacccaacucuccugg

SEQ ID NO: 2501122 - RNA, 17 nt, Human
cuuccguaacccaacuc

SEQ ID NO: 2501123 - RNA, 15 nt, Human
cuucccuugagcccu

SEQ ID NO: 2501124 - RNA, 20 nt, Human
cuuccucaguuuaauccuuc

SEQ ID NO: 2501125 - RNA, 18 nt, Human
cuuccucaguuuaauccu

SEQ ID NO: 2501126 - RNA, 17 nt, Human
cuuccucaguuacacaa

SEQ ID NO: 2501127 - RNA, 22 nt, Human
cuuccucauccaccccaucccu

SEQ ID NO: 2501128 - RNA, 18 nt, Human
cuuccucauccaccccau

SEQ ID NO: 2501129 - RNA, 23 nt, Human
cuuccucauccaccccaucccuc

SEQ ID NO: 2501130 - RNA, 21 nt, Human
cuuccuccacauccuuucuaa

SEQ ID NO: 2501131 - RNA, 15 nt, Human
cuuccuccacauccu

SEQ ID NO: 2501132 - RNA, 23 nt, Human
cuuccucccaaguggugccuaaa

SEQ ID NO: 2501133 - RNA, 21 nt, Human
cuuccucccaaguggugccua

SEQ ID NO: 2501134 - RNA, 20 nt, Human
cuuccucccaaguggugccu

SEQ ID NO: 2501135 - RNA, 12 nt, Human
cuuccucccaag

SEQ ID NO: 2501136 - RNA, 13 nt, Human
cuuccucccucau

SEQ ID NO: 2501137 - RNA, 14 nt, Human
cuucccugucccuc

SEQ ID NO: 2501138 - RNA, 13 nt, Human
cuucccugucccu

SEQ ID NO: 2501139 - RNA, 12 nt, Human
cuucccuguccc

SEQ ID NO: 2501140 - RNA, 22 nt, Human
cuucccuguauuuucuuucucu

SEQ ID NO: 2501141 - RNA, 12 nt, Human
cuucccuaaucu

SEQ ID NO: 2501142 - RNA, 22 nt, Human
cuucccuguaugauuccuugau

SEQ ID NO: 2501143 - RNA, 16 nt, Human
cuucccugucccucua

SEQ ID NO: 2501144 - RNA, 15 nt, Human
cuucccugucccucu

SEQ ID NO: 2501145 - RNA, 13 nt, Human
cuucccuuucugc

SEQ ID NO: 2501146 - RNA, 16 nt, Human
cuucccuucuccaucu

SEQ ID NO: 2501147 - RNA, 16 nt, Human
cuucccuugagcccuc

SEQ ID NO: 2501148 - RNA, 12 nt, Human
cuuccccuugcc

SEQ ID NO: 2501149 - RNA, 13 nt, Human
cuuccccuugccc

SEQ ID NO: 2501150 - RNA, 19 nt, Human
cuucccgcucagcccuccc

SEQ ID NO: 2501151 - RNA, 14 nt, Human
cuucccgucccaua

SEQ ID NO: 2501152 - RNA, 18 nt, Human
cuucccgcucagcccucc

SEQ ID NO: 2501153 - RNA, 23 nt, Human
cuucccgcucagcccucccugcc

SEQ ID NO: 2501154 - RNA, 16 nt, Human
cuucccuaaaaucagg

SEQ ID NO: 2501155 - RNA, 23 nt, Human
cuucccgucccauauccugccuc

SEQ ID NO: 2501156 - RNA, 22 nt, Human
cuucccgucccauauccugccu

SEQ ID NO: 2501157 - RNA, 21 nt, Human
cuucccgucccauauccugcc

SEQ ID NO: 2501158 - RNA, 20 nt, Human
cuucccgucccauauccugc

SEQ ID NO: 2501159 - RNA, 19 nt, Human
cuucccgucccauauccug

SEQ ID NO: 2501160 - RNA, 15 nt, Human
cuucccgucccauau

SEQ ID NO: 2501161 - RNA, 17 nt, Human
cuucccuacaguugaaa

SEQ ID NO: 2501162 - RNA, 22 nt, Human
cuuccccgagggaugaugccac

SEQ ID NO: 2501163 - RNA, 18 nt, Human
cuucccccugcuuccacc

SEQ ID NO: 2501164 - RNA, 23 nt, Human
cuuccccgagggaugaugccaca

SEQ ID NO: 2501165 - RNA, 12 nt, Human
cuuccccucacu

SEQ ID NO: 2501166 - RNA, 14 nt, Human
cuuccccucccugg

SEQ ID NO: 2501167 - RNA, 16 nt, Human
cuuccccucccuggcu

SEQ ID NO: 2501168 - RNA, 14 nt, Human
cuuccccugggccc

SEQ ID NO: 2501169 - RNA, 23 nt, Human
cuuccccuccuaccccucccagc

SEQ ID NO: 2501170 - RNA, 22 nt, Human
cuuccccuccuaccccucccag

SEQ ID NO: 2501171 - RNA, 13 nt, Human
cuuccccuccuac

SEQ ID NO: 2501172 - RNA, 15 nt, Human
cuuccccugggcccu

SEQ ID NO: 2501173 - RNA, 18 nt, Human
cuuccccucccuggcucc

SEQ ID NO: 2501174 - RNA, 20 nt, Human
cuuccccucccuggcuccca

SEQ ID NO: 2501175 - RNA, 20 nt, Human
cuuccccucucuccuccugc

SEQ ID NO: 2501176 - RNA, 22 nt, Human
cuucccaugacccaggcugggc

SEQ ID NO: 2501177 - RNA, 21 nt, Human
cuucccaugacccaggcuggg

SEQ ID NO: 2501178 - RNA, 20 nt, Human
cuucccaugacccaggcugg

SEQ ID NO: 2501179 - RNA, 19 nt, Human
cuucccaugacccaggcug

SEQ ID NO: 2501180 - RNA, 17 nt, Human
cuucccaugacccaggc

SEQ ID NO: 2501181 - RNA, 15 nt, Human
cuucccaugacccag

SEQ ID NO: 2501182 - RNA, 15 nt, Human
cuucccaucgcuguc

SEQ ID NO: 2501183 - RNA, 19 nt, Human
cuucccauccuacccucgg

SEQ ID NO: 2501184 - RNA, 16 nt, Human
cuucccauccuacccu

SEQ ID NO: 2501185 - RNA, 15 nt, Human
cuucccauccuaccc

SEQ ID NO: 2501186 - RNA, 12 nt, Human
cuucccauccua

SEQ ID NO: 2501187 - RNA, 11 nt, Human
cuucccauccu

SEQ ID NO: 2501188 - RNA, 17 nt, Human
cuucccaguggcugcug

SEQ ID NO: 2501189 - RNA, 15 nt, Human
cuucccaguggcugc

SEQ ID NO: 2501190 - RNA, 19 nt, Human
cuucccaguggcugcugcc

SEQ ID NO: 2501191 - RNA, 18 nt, Human
cuucccaguggcugcugc

SEQ ID NO: 2501192 - RNA, 22 nt, Human
cuucccaguucaggagucccaa

SEQ ID NO: 2501193 - RNA, 20 nt, Human
cuucccauaccacccaaugc

SEQ ID NO: 2501194 - RNA, 20 nt, Human
cuucccaguggcugcugccc

SEQ ID NO: 2501195 - RNA, 23 nt, Human
cuucccaguucaggagucccaag

SEQ ID NO: 2501196 - RNA, 11 nt, Human
cuucccaucac

SEQ ID NO: 2501197 - RNA, 16 nt, Human
cuucccaucacuggag

SEQ ID NO: 2501198 - RNA, 17 nt, Human
cuucccaucacuggagc

SEQ ID NO: 2501199 - RNA, 18 nt, Human
cuucccaucacuggagca

SEQ ID NO: 2501200 - RNA, 16 nt, Human
cuuccaggcugggaga

SEQ ID NO: 2501201 - RNA, 15 nt, Human
cuuccaggcugggag

SEQ ID NO: 2501202 - RNA, 19 nt, Human
cuuccaggcugggagagcc

SEQ ID NO: 2501203 - RNA, 16 nt, Human
cuuccaggcccccacc

SEQ ID NO: 2501204 - RNA, 19 nt, Human
cuuccaggcccccaccacu

SEQ ID NO: 2501205 - RNA, 15 nt, Human
cuuccagggguggga

SEQ ID NO: 2501206 - RNA, 14 nt, Human
cuuccagggguggg

SEQ ID NO: 2501207 - RNA, 17 nt, Human
cuuccaggggugggaca

SEQ ID NO: 2501208 - RNA, 21 nt, Human
cuuccaggggugggacacccu

SEQ ID NO: 2501209 - RNA, 17 nt, Human
cuucaguggcagcugcu

SEQ ID NO: 2501210 - RNA, 20 nt, Human
cuucauucaacccaccugcg

SEQ ID NO: 2501211 - RNA, 21 nt, Human
cuucauugagaguuuugucuu

SEQ ID NO: 2501212 - RNA, 17 nt, Human
cuucaguggagaauuau

SEQ ID NO: 2501213 - RNA, 14 nt, Human
cuucauugagaguu

SEQ ID NO: 2501214 - RNA, 21 nt, Human
cuucauucuugaaagcugugg

SEQ ID NO: 2501215 - RNA, 20 nt, Human
cuucauucuugaaagcugug

SEQ ID NO: 2501216 - RNA, 22 nt, Human
cuucauucaagucuaugaugcu

SEQ ID NO: 2501217 - RNA, 21 nt, Human
cuuccacaagagcccaggccu

SEQ ID NO: 2501218 - RNA, 19 nt, Human
cuuccacaagagcccaggc

SEQ ID NO: 2501219 - RNA, 17 nt, Human
cuuccacaagagcccag

SEQ ID NO: 2501220 - RNA, 23 nt, Human
cuucauugagaguuuugucuuga

SEQ ID NO: 2501221 - RNA, 19 nt, Human
cuucauugccuuaacugga

SEQ ID NO: 2501222 - RNA, 15 nt, Human
cuuccaccucccucc

SEQ ID NO: 2501223 - RNA, 14 nt, Human
cuuccaccucccuc

SEQ ID NO: 2501224 - RNA, 13 nt, Human
cuuccaccucccu

SEQ ID NO: 2501225 - RNA, 20 nt, Human
cuuccaccucaccccacuua

SEQ ID NO: 2501226 - RNA, 17 nt, Human
cuuccacgcugucucca

SEQ ID NO: 2501227 - RNA, 16 nt, Human
cuuccacgcugucucc

SEQ ID NO: 2501228 - RNA, 18 nt, Human
cuuccacgcugucuccag

SEQ ID NO: 2501229 - RNA, 20 nt, Human
cuuccacgcugucuccagac

SEQ ID NO: 2501230 - RNA, 21 nt, Human
cuuccacgcugucuccagacc

SEQ ID NO: 2501231 - RNA, 22 nt, Human
cuuccacgcugucuccagaccc

SEQ ID NO: 2501232 - RNA, 18 nt, Human
cuuccaccucaccccacu

SEQ ID NO: 2501233 - RNA, 17 nt, Human
cuuccaccucaccccac

SEQ ID NO: 2501234 - RNA, 16 nt, Human
cuuccaccucacccca

SEQ ID NO: 2501235 - RNA, 14 nt, Human
cuuccaccucaccc

SEQ ID NO: 2501236 - RNA, 16 nt, Human
cuuccacaagagccca

SEQ ID NO: 2501237 - RNA, 21 nt, Human
cuuccaccagccugcacuacu

SEQ ID NO: 2501238 - RNA, 17 nt, Human
cuuccaccagccugcac

SEQ ID NO: 2501239 - RNA, 14 nt, Human
cuuccaggcuggga

SEQ ID NO: 2501240 - RNA, 12 nt, Human
cuuccaggcugg

SEQ ID NO: 2501241 - RNA, 21 nt, Human
cuuccaggaaacuccacaucu

SEQ ID NO: 2501242 - RNA, 19 nt, Human
cuuccaggaaacuccacau

SEQ ID NO: 2501243 - RNA, 18 nt, Human
cuuccaggaaacuccaca

SEQ ID NO: 2501244 - RNA, 17 nt, Human
cuuccaggaaacuccac

SEQ ID NO: 2501245 - RNA, 23 nt, Human
cuuccaggaaacuccacaucugc

SEQ ID NO: 2501246 - RNA, 22 nt, Human
cuuccaggaaacuccacaucug

SEQ ID NO: 2501247 - RNA, 14 nt, Human
cuuccacugagggc

SEQ ID NO: 2501248 - RNA, 13 nt, Human
cuuccaggaaacu

SEQ ID NO: 2501249 - RNA, 16 nt, Human
cuucaguggcagcugc

SEQ ID NO: 2501250 - RNA, 15 nt, Human
cuucaguggcagcug

SEQ ID NO: 2501251 - RNA, 14 nt, Human
cuucaguggcagcu

SEQ ID NO: 2501252 - RNA, 13 nt, Human
cuucaguggcagc

SEQ ID NO: 2501253 - RNA, 22 nt, Human
cuucagugccuuauggaacacu

SEQ ID NO: 2501254 - RNA, 18 nt, Human
cuucagugccuuauggaa

SEQ ID NO: 2501255 - RNA, 18 nt, Human
cuucaguauguugucaaa

SEQ ID NO: 2501256 - RNA, 15 nt, Human
cuucaguauguuguc

SEQ ID NO: 2501257 - RNA, 14 nt, Human
cuucaguauguugu

SEQ ID NO: 2501258 - RNA, 23 nt, Human
cuucaguacccucucagcuccag

SEQ ID NO: 2501259 - RNA, 22 nt, Human
cuucaguacccucucagcucca

SEQ ID NO: 2501260 - RNA, 19 nt, Human
cuucaguacccucucagcu

SEQ ID NO: 2501261 - RNA, 18 nt, Human
cuucagggcagggcucug

SEQ ID NO: 2501262 - RNA, 19 nt, Human
cuucagggcagggcucuga

SEQ ID NO: 2501263 - RNA, 16 nt, Human
cuucagggcagggcuc

SEQ ID NO: 2501264 - RNA, 17 nt, Human
cuucagggcagggcucu

SEQ ID NO: 2501265 - RNA, 20 nt, Human
cuucagggcagggcucugau

SEQ ID NO: 2501266 - RNA, 15 nt, Human
cuucagggagugagg

SEQ ID NO: 2501267 - RNA, 19 nt, Human
cuucagggcacugcugcug

SEQ ID NO: 2501268 - RNA, 16 nt, Human
cuucaguaagccguga

SEQ ID NO: 2501269 - RNA, 23 nt, Human
cuucaguaagccgugauuuucau

SEQ ID NO: 2501270 - RNA, 22 nt, Human
cuucaggcucuucuccuuucac

SEQ ID NO: 2501271 - RNA, 19 nt, Human
cuucaggcucuucuccuuu

SEQ ID NO: 2501272 - RNA, 15 nt, Human
cuucacccuggagcc

SEQ ID NO: 2501273 - RNA, 21 nt, Human
cuucacccugaaugguuccau

SEQ ID NO: 2501274 - RNA, 23 nt, Human
cuucaccccaguggccacucagc

SEQ ID NO: 2501275 - RNA, 19 nt, Human
cuucaccccaguggccacu

SEQ ID NO: 2501276 - RNA, 14 nt, Human
cuucaccccagugg

SEQ ID NO: 2501277 - RNA, 15 nt, Human
cuucaccccccacuc

SEQ ID NO: 2501278 - RNA, 22 nt, Human
cuucacccagcuaaucuguagg

SEQ ID NO: 2501279 - RNA, 19 nt, Human
cuucaccagagcauuucca

SEQ ID NO: 2501280 - RNA, 21 nt, Human
cuucaccauuuggcaaugcca

SEQ ID NO: 2501281 - RNA, 24 nt, Human
cuucacccagcuaaucuguagggc

SEQ ID NO: 2501282 - RNA, 18 nt, Human
cuucaccccaaucccagc

SEQ ID NO: 2501283 - RNA, 21 nt, Human
cugugggcgugagaccugccc

SEQ ID NO: 2501284 - RNA, 22 nt, Human
cugugggcgugagaccugcccc

SEQ ID NO: 2501285 - RNA, 14 nt, Human
cuguggcggugccu

SEQ ID NO: 2501286 - RNA, 15 nt, Human
cuguggcggugccug

SEQ ID NO: 2501287 - RNA, 17 nt, Human
cuguggcugcuagcacu

SEQ ID NO: 2501288 - RNA, 14 nt, Human
cugugggccucaag

SEQ ID NO: 2501289 - RNA, 20 nt, Human
cugugggccucaaggacuug

SEQ ID NO: 2501290 - RNA, 14 nt, Human
cugugggcccccaa

SEQ ID NO: 2501291 - RNA, 24 nt, Human
cuguggcgccgucuccaggggcug

SEQ ID NO: 2501292 - RNA, 21 nt, Human
cuguggcgccgucuccagggg

SEQ ID NO: 2501293 - RNA, 18 nt, Human
cuguggcggugccugggu

SEQ ID NO: 2501294 - RNA, 20 nt, Human
cuguggcgccgucuccaggg

SEQ ID NO: 2501295 - RNA, 19 nt, Human
cuguggcgccgucuccagg

SEQ ID NO: 2501296 - RNA, 23 nt, Human
cuguggccugugucccaugaccc

SEQ ID NO: 2501297 - RNA, 17 nt, Human
cuguggcgccgucucca

SEQ ID NO: 2501298 - RNA, 17 nt, Human
cuguggccuguguccca

SEQ ID NO: 2501299 - RNA, 14 nt, Human
cuguggccuguguc

SEQ ID NO: 2501300 - RNA, 16 nt, Human
cuguggccugggcaag

SEQ ID NO: 2501301 - RNA, 22 nt, Human
cuguggccugugucccaugacc

SEQ ID NO: 2501302 - RNA, 20 nt, Human
cuguggccugugucccauga

SEQ ID NO: 2501303 - RNA, 23 nt, Human
cuguggccagcuuguuauuuaua

SEQ ID NO: 2501304 - RNA, 13 nt, Human
cuguggccaaagg

SEQ ID NO: 2501305 - RNA, 13 nt, Human
cuguggccugggc

SEQ ID NO: 2501306 - RNA, 14 nt, Human
cuguggccugggca

SEQ ID NO: 2501307 - RNA, 22 nt, Human
cuguggccagcuuguuauuuau

SEQ ID NO: 2501308 - RNA, 18 nt, Human
cuguggccaaguucuuag

SEQ ID NO: 2501309 - RNA, 13 nt, Human
cuguggcaggcag

SEQ ID NO: 2501310 - RNA, 21 nt, Human
cuguggcaggcagcgccaagc

SEQ ID NO: 2501311 - RNA, 18 nt, Human
cuguggcaggcagcgcca

SEQ ID NO: 2501312 - RNA, 17 nt, Human
cuguggcaggcagcgcc

SEQ ID NO: 2501313 - RNA, 14 nt, Human
cuguggcaggcagc

SEQ ID NO: 2501314 - RNA, 23 nt, Human
cuguggcaggcagcgccaagcaa

SEQ ID NO: 2501315 - RNA, 17 nt, Human
cuguggcaucuuugccu

SEQ ID NO: 2501316 - RNA, 16 nt, Human
cuguggccaaguucuu

SEQ ID NO: 2501317 - RNA, 19 nt, Human
cuguggaugagcccucaga

SEQ ID NO: 2501318 - RNA, 21 nt, Human
cuguggaaaguguaaagcauu

SEQ ID NO: 2501319 - RNA, 20 nt, Human
cuguggaaaguguaaagcau

SEQ ID NO: 2501320 - RNA, 18 nt, Human
cuguggaaaguguaaagc

SEQ ID NO: 2501321 - RNA, 20 nt, Human
cuguggaugagcccucagaa

SEQ ID NO: 2501322 - RNA, 17 nt, Human
cuguggaugauaaaaca

SEQ ID NO: 2501323 - RNA, 17 nt, Human
cuguggaaaguguaaag

SEQ ID NO: 2501324 - RNA, 16 nt, Human
cuguggaaaguguaaa

SEQ ID NO: 2501325 - RNA, 15 nt, Human
cuguggaaaguguaa

SEQ ID NO: 2501326 - RNA, 14 nt, Human
cuguggaaagugua

SEQ ID NO: 2501327 - RNA, 13 nt, Human
cuguggaaagugu

SEQ ID NO: 2501328 - RNA, 19 nt, Human
cuguggaaaaauauuuaag

SEQ ID NO: 2501329 - RNA, 22 nt, Human
cuguggaaaagaaacacgcacu

SEQ ID NO: 2501330 - RNA, 13 nt, Human
cugugccucggcu

SEQ ID NO: 2501331 - RNA, 22 nt, Human
cugugccucggcuuuucucagc

SEQ ID NO: 2501332 - RNA, 23 nt, Human
cugugccucggcuuuucucagcu

SEQ ID NO: 2501333 - RNA, 14 nt, Human
cugugccucuggga

SEQ ID NO: 2501334 - RNA, 16 nt, Human
cugugccucugggacu

SEQ ID NO: 2501335 - RNA, 15 nt, Human
cugugcuggagccac

SEQ ID NO: 2501336 - RNA, 14 nt, Human
cugugcuggagcca

SEQ ID NO: 2501337 - RNA, 13 nt, Human
cugugcuggagcc

SEQ ID NO: 2501338 - RNA, 21 nt, Human
cugugcuggagccacuaacua

SEQ ID NO: 2501339 - RNA, 16 nt, Human
cugugcuggagccacu

SEQ ID NO: 2501340 - RNA, 22 nt, Human
cugugcugcccugcccaccugg

SEQ ID NO: 2501341 - RNA, 17 nt, Human
cugugccucugggacug

SEQ ID NO: 2501342 - RNA, 18 nt, Human
cugugccucugggacugg

SEQ ID NO: 2501343 - RNA, 21 nt, Human
cugugcugcccugcccaccug

SEQ ID NO: 2501344 - RNA, 17 nt, Human
cugugcuucaauuaaua

SEQ ID NO: 2501345 - RNA, 18 nt, Human
cugugcugugugugacgu

SEQ ID NO: 2501346 - RNA, 21 nt, Human
cugugcuguggaagcaacagg

SEQ ID NO: 2501347 - RNA, 18 nt, Human
cugugcuucaauuaauaa

SEQ ID NO: 2501348 - RNA, 17 nt, Human
cugugcuucgggcccuu

SEQ ID NO: 2501349 - RNA, 19 nt, Human
cugugcuucgggcccuucc

SEQ ID NO: 2501350 - RNA, 15 nt, Human
cugugcuguggaagc

SEQ ID NO: 2501351 - RNA, 12 nt, Human
cugugcugugga

SEQ ID NO: 2501352 - RNA, 18 nt, Human
cugugcugugcccaaguu

SEQ ID NO: 2501353 - RNA, 23 nt, Human
cugugcugguguccugaccaccc

SEQ ID NO: 2501354 - RNA, 13 nt, Human
cugugcugugugu

SEQ ID NO: 2501355 - RNA, 11 nt, Human
cugugcugugu

SEQ ID NO: 2501356 - RNA, 21 nt, Human
cugugcugguguccugaccac

SEQ ID NO: 2501357 - RNA, 20 nt, Human
cugugcugguguccugacca

SEQ ID NO: 2501358 - RNA, 19 nt, Human
cugugcugguguccugacc

SEQ ID NO: 2501359 - RNA, 18 nt, Human
cugugcugguguccugac

SEQ ID NO: 2501360 - RNA, 17 nt, Human
cugugcugguguccuga

SEQ ID NO: 2501361 - RNA, 12 nt, Human
cugugcuggugu

SEQ ID NO: 2501362 - RNA, 19 nt, Human
cugugcuuucccugaacug

SEQ ID NO: 2501363 - RNA, 14 nt, Human
cugugcuuucccug

SEQ ID NO: 2501364 - RNA, 22 nt, Human
cugugcuuuccagcucaccccc

SEQ ID NO: 2501365 - RNA, 21 nt, Human
cugugcuuuccagcucacccc

SEQ ID NO: 2501366 - RNA, 20 nt, Human
cugugcuuuccagcucaccc

SEQ ID NO: 2501367 - RNA, 17 nt, Human
cugugcuuuccagcuca

SEQ ID NO: 2501368 - RNA, 16 nt, Human
cugugcuuuccagcuc

SEQ ID NO: 2501369 - RNA, 20 nt, Human
cugugcuucgggcccuuccc

SEQ ID NO: 2501370 - RNA, 21 nt, Human
cugugcuucgggcccuuccca

SEQ ID NO: 2501371 - RNA, 15 nt, Human
cugugcuuuccagcu

SEQ ID NO: 2501372 - RNA, 18 nt, Human
cugugcuuugacucaccu

SEQ ID NO: 2501373 - RNA, 16 nt, Human
cugugcuuugacucac

SEQ ID NO: 2501374 - RNA, 22 nt, Human
cugugcuuucuauuguacagaa

SEQ ID NO: 2501375 - RNA, 20 nt, Human
cugugcuuucuauuguacag

SEQ ID NO: 2501376 - RNA, 16 nt, Human
cugugcuuucuauugu

SEQ ID NO: 2501377 - RNA, 15 nt, Human
cugugcuuucuauug

SEQ ID NO: 2501378 - RNA, 13 nt, Human
cugugcuuucuau

SEQ ID NO: 2501379 - RNA, 12 nt, Human
cugugcuuucua

SEQ ID NO: 2501380 - RNA, 21 nt, Human
cugugcuuugacucaccuguu

SEQ ID NO: 2501381 - RNA, 19 nt, Human
cugugcuuugacucaccug

SEQ ID NO: 2501382 - RNA, 17 nt, Human
cugugcuuuuaaaugca

SEQ ID NO: 2501383 - RNA, 14 nt, Human
cuguggaaaaauau

SEQ ID NO: 2501384 - RNA, 18 nt, Human
cuguggaaaaauauuuaa

SEQ ID NO: 2501385 - RNA, 19 nt, Human
cuguggaaaagaaacacgc

SEQ ID NO: 2501386 - RNA, 17 nt, Human
cugugauggggcccugc

SEQ ID NO: 2501387 - RNA, 18 nt, Human
cugugauggggcccugcc

SEQ ID NO: 2501388 - RNA, 17 nt, Human
cugugaguuuaaagcaa

SEQ ID NO: 2501389 - RNA, 21 nt, Human
cugugaguguaagugugagua

SEQ ID NO: 2501390 - RNA, 19 nt, Human
cugugaguguaagugugag

SEQ ID NO: 2501391 - RNA, 20 nt, Human
cugugaguguaagugugagu

SEQ ID NO: 2501392 - RNA, 21 nt, Human
cugugaguacuacaguccucc

SEQ ID NO: 2501393 - RNA, 20 nt, Human
cugugaguacuacaguccuc

SEQ ID NO: 2501394 - RNA, 23 nt, Human
cugugaguacuacaguccuccca

SEQ ID NO: 2501395 - RNA, 22 nt, Human
cugugaggugcagagugcccag

SEQ ID NO: 2501396 - RNA, 17 nt, Human
cugugaggcuguccugu

SEQ ID NO: 2501397 - RNA, 14 nt, Human
cugugaguguaagu

SEQ ID NO: 2501398 - RNA, 18 nt, Human
cugucuccauguuugaug

SEQ ID NO: 2501399 - RNA, 20 nt, Human
cugucuccauggcccugcaa

SEQ ID NO: 2501400 - RNA, 19 nt, Human
cugucuccagacccccacc

SEQ ID NO: 2501401 - RNA, 22 nt, Human
cugucuccagacccccaccccu

SEQ ID NO: 2501402 - RNA, 19 nt, Human
cugugaggggcucucucau

SEQ ID NO: 2501403 - RNA, 23 nt, Human
cugugaggugcagagugcccaga

SEQ ID NO: 2501404 - RNA, 13 nt, Human
cugucuccuagga

SEQ ID NO: 2501405 - RNA, 23 nt, Human
cugucucaagagggcacuggugg

SEQ ID NO: 2501406 - RNA, 13 nt, Human
cugucucagacuc

SEQ ID NO: 2501407 - RNA, 12 nt, Human
cugucucagccu

SEQ ID NO: 2501408 - RNA, 14 nt, Human
cugucucagccucc

SEQ ID NO: 2501409 - RNA, 15 nt, Human
cugucucagccuccc

SEQ ID NO: 2501410 - RNA, 16 nt, Human
cugucucagccuccca

SEQ ID NO: 2501411 - RNA, 17 nt, Human
cugucucagccucccag

SEQ ID NO: 2501412 - RNA, 13 nt, Human
cugucucagccuc

SEQ ID NO: 2501413 - RNA, 15 nt, Human
cugucuccagacccc

SEQ ID NO: 2501414 - RNA, 16 nt, Human
cugucuccagaccccc

SEQ ID NO: 2501415 - RNA, 18 nt, Human
cugucuccagacccccac

SEQ ID NO: 2501416 - RNA, 13 nt, Human
cugucuccagacc

SEQ ID NO: 2501417 - RNA, 13 nt, Human
cugucucagggug

SEQ ID NO: 2501418 - RNA, 19 nt, Human
cugugcacaaaacccagac

SEQ ID NO: 2501419 - RNA, 20 nt, Human
cugugcacaaaacccagacc

SEQ ID NO: 2501420 - RNA, 21 nt, Human
cugugcaaccucuuggccuga

SEQ ID NO: 2501421 - RNA, 20 nt, Human
cugugauggggcccugccuc

SEQ ID NO: 2501422 - RNA, 19 nt, Human
cugugauggggcccugccu

SEQ ID NO: 2501423 - RNA, 16 nt, Human
cugugcauguaugucu

SEQ ID NO: 2501424 - RNA, 15 nt, Human
cugugcauguauguc

SEQ ID NO: 2501425 - RNA, 14 nt, Human
cugugcauggguga

SEQ ID NO: 2501426 - RNA, 17 nt, Human
cugugcaugggugaagg

SEQ ID NO: 2501427 - RNA, 20 nt, Human
cugugcaugggugaagggag

SEQ ID NO: 2501428 - RNA, 22 nt, Human
cugugcaugggugaagggagag

SEQ ID NO: 2501429 - RNA, 20 nt, Human
cugugcacaucugugucuug

SEQ ID NO: 2501430 - RNA, 18 nt, Human
cugugcagucacuggagg

SEQ ID NO: 2501431 - RNA, 23 nt, Human
cugugcaguggcccccacagaaa

SEQ ID NO: 2501432 - RNA, 18 nt, Human
cugugcacaucugugucu

SEQ ID NO: 2501433 - RNA, 19 nt, Human
cugugcacaucugugucuu

SEQ ID NO: 2501434 - RNA, 22 nt, Human
cugugcacaaaacccagaccug

SEQ ID NO: 2501435 - RNA, 18 nt, Human
cugugccaugugccaggu

SEQ ID NO: 2501436 - RNA, 16 nt, Human
cugugccaugugccag

SEQ ID NO: 2501437 - RNA, 11 nt, Human
cugugccaccc

SEQ ID NO: 2501438 - RNA, 17 nt, Human
cugugcauguaugucuu

SEQ ID NO: 2501439 - RNA, 18 nt, Human
cugugccacccugggcuc

SEQ ID NO: 2501440 - RNA, 17 nt, Human
cugugccacccugggcu

SEQ ID NO: 2501441 - RNA, 16 nt, Human
cugugccacccugggc

SEQ ID NO: 2501442 - RNA, 15 nt, Human
cugugccacccuggg

SEQ ID NO: 2501443 - RNA, 17 nt, Human
cugugcaugguggcacc

SEQ ID NO: 2501444 - RNA, 13 nt, Human
cugugccacccac

SEQ ID NO: 2501445 - RNA, 13 nt, Human
cugugccacccug

SEQ ID NO: 2501446 - RNA, 18 nt, Human
cugugccacccaccaggg

SEQ ID NO: 2501447 - RNA, 20 nt, Human
cugugccacccugggcucug

SEQ ID NO: 2501448 - RNA, 14 nt, Human
cugugccauuuugu

SEQ ID NO: 2501449 - RNA, 15 nt, Human
cugugccuccucacc

SEQ ID NO: 2501450 - RNA, 16 nt, Human
cugugccuccucaccc

SEQ ID NO: 2501451 - RNA, 14 nt, Human
cugugccucccaaa

SEQ ID NO: 2501452 - RNA, 13 nt, Human
cugugccuccuca

SEQ ID NO: 2501453 - RNA, 17 nt, Human
cuguucucugcccucca

SEQ ID NO: 2501454 - RNA, 16 nt, Human
cuguucucugcccucc

SEQ ID NO: 2501455 - RNA, 15 nt, Human
cuguucucugcccuc

SEQ ID NO: 2501456 - RNA, 14 nt, Human
cuguucucugcccu

SEQ ID NO: 2501457 - RNA, 19 nt, Human
cuguucucugcccuccaag

SEQ ID NO: 2501458 - RNA, 18 nt, Human
cuguucucugcccuccaa

SEQ ID NO: 2501459 - RNA, 19 nt, Human
cuguucuacauagaugcuu

SEQ ID NO: 2501460 - RNA, 15 nt, Human
cuguucucuugggaa

SEQ ID NO: 2501461 - RNA, 20 nt, Human
cuguucucugcccuccaaga

SEQ ID NO: 2501462 - RNA, 14 nt, Human
cuguucccucugcu

SEQ ID NO: 2501463 - RNA, 17 nt, Human
cuguuccccucacugga

SEQ ID NO: 2501464 - RNA, 15 nt, Human
cuguuccccucacug

SEQ ID NO: 2501465 - RNA, 14 nt, Human
cuguuccccucacu

SEQ ID NO: 2501466 - RNA, 22 nt, Human
cuguuccccucacuggaugaaa

SEQ ID NO: 2501467 - RNA, 19 nt, Human
cuguucccucugcuccugg

SEQ ID NO: 2501468 - RNA, 17 nt, Human
cuguucccucugcuccu

SEQ ID NO: 2501469 - RNA, 20 nt, Human
cuguucccucugcuccugga

SEQ ID NO: 2501470 - RNA, 12 nt, Human
cuguucccccug

SEQ ID NO: 2501471 - RNA, 15 nt, Human
cuguucccccugugc

SEQ ID NO: 2501472 - RNA, 16 nt, Human
cuguucccccugugca

SEQ ID NO: 2501473 - RNA, 17 nt, Human
cuguucccccugugcag

SEQ ID NO: 2501474 - RNA, 14 nt, Human
cuguucccccuuca

SEQ ID NO: 2501475 - RNA, 15 nt, Human
cuguucccccuucac

SEQ ID NO: 2501476 - RNA, 16 nt, Human
cuguucccccuucaca

SEQ ID NO: 2501477 - RNA, 17 nt, Human
cuguucccccuucacaa

SEQ ID NO: 2501478 - RNA, 12 nt, Human
cuguuccccuca

SEQ ID NO: 2501479 - RNA, 23 nt, Human
cuguuccccuaguaagugccuuc

SEQ ID NO: 2501480 - RNA, 22 nt, Human
cuguuccccuaguaagugccuu

SEQ ID NO: 2501481 - RNA, 23 nt, Human
cuguucccccuucacaaagccca

SEQ ID NO: 2501482 - RNA, 20 nt, Human
cuguucuacauagaugcuua

SEQ ID NO: 2501483 - RNA, 13 nt, Human
cuguucucugccc

SEQ ID NO: 2501484 - RNA, 16 nt, Human
cuguuccuuagaccuu

SEQ ID NO: 2501485 - RNA, 15 nt, Human
cuguuccuuagaccu

SEQ ID NO: 2501486 - RNA, 15 nt, Human
cuguuccuucacauc

SEQ ID NO: 2501487 - RNA, 18 nt, Human
cuguuccuucacauccug

SEQ ID NO: 2501488 - RNA, 21 nt, Human
cuguuccuucacauccugugu

SEQ ID NO: 2501489 - RNA, 13 nt, Human
cuguuacacugga

SEQ ID NO: 2501490 - RNA, 19 nt, Human
cuguuaccaugucacugug

SEQ ID NO: 2501491 - RNA, 18 nt, Human
cuguuaccaugucacugu

SEQ ID NO: 2501492 - RNA, 16 nt, Human
cuguuaccaugucacu

SEQ ID NO: 2501493 - RNA, 15 nt, Human
cuguuaccaugucac

SEQ ID NO: 2501494 - RNA, 16 nt, Human
cuguuacacuggagga

SEQ ID NO: 2501495 - RNA, 20 nt, Human
cuguuaccaugucacugugg

SEQ ID NO: 2501496 - RNA, 18 nt, Human
cuguuacccagagaauau

SEQ ID NO: 2501497 - RNA, 21 nt, Human
cuguuaccugaucaaugacag

SEQ ID NO: 2501498 - RNA, 20 nt, Human
cuguuaccugaucaaugaca

SEQ ID NO: 2501499 - RNA, 13 nt, Human
cuguuacugucuu

SEQ ID NO: 2501500 - RNA, 15 nt, Human
cuguucaguuacaga

SEQ ID NO: 2501501 - RNA, 14 nt, Human
cuguucaguuacag

SEQ ID NO: 2501502 - RNA, 13 nt, Human
cuguucaguuaca

SEQ ID NO: 2501503 - RNA, 12 nt, Human
cuguucaguuac

SEQ ID NO: 2501504 - RNA, 20 nt, Human
cuguucagugucccgggccc

SEQ ID NO: 2501505 - RNA, 16 nt, Human
cuguucagugucccgg

SEQ ID NO: 2501506 - RNA, 18 nt, Human
cuguucagcugguugagg

SEQ ID NO: 2501507 - RNA, 19 nt, Human
cuguucagcugguugaggu

SEQ ID NO: 2501508 - RNA, 21 nt, Human
cuguucagcugguugagguuu

SEQ ID NO: 2501509 - RNA, 21 nt, Human
cuguucaguuacagaaagugg

SEQ ID NO: 2501510 - RNA, 19 nt, Human
cuguucaguuacagaaagu

SEQ ID NO: 2501511 - RNA, 18 nt, Human
cuguucaguuacagaaag

SEQ ID NO: 2501512 - RNA, 17 nt, Human
cuguucaguuacagaaa

SEQ ID NO: 2501513 - RNA, 14 nt, Human
cuguucauuuccuc

SEQ ID NO: 2501514 - RNA, 17 nt, Human
cuguucauuuccucaaa

SEQ ID NO: 2501515 - RNA, 14 nt, Human
cuguuccccagaga

SEQ ID NO: 2501516 - RNA, 15 nt, Human
cuguuccccagagaa

SEQ ID NO: 2501517 - RNA, 23 nt, Human
cuguucccccgccgcuuuucucc

SEQ ID NO: 2501518 - RNA, 12 nt, Human
cuguucccccgc

SEQ ID NO: 2501519 - RNA, 16 nt, Human
cuguuccccagagaaa

SEQ ID NO: 2501520 - RNA, 13 nt, Human
cuguuccccagag

SEQ ID NO: 2501521 - RNA, 20 nt, Human
cuguucccauguagcccccu

SEQ ID NO: 2501522 - RNA, 18 nt, Human
cuguucccauucuugcau

SEQ ID NO: 2501523 - RNA, 23 nt, Human
cuguuccagccugcccucuucau

SEQ ID NO: 2501524 - RNA, 17 nt, Human
cuguuccagccugcccu

SEQ ID NO: 2501525 - RNA, 14 nt, Human
cuguuccagccugc

SEQ ID NO: 2501526 - RNA, 18 nt, Human
cuguucccaaauuuucua

SEQ ID NO: 2501527 - RNA, 17 nt, Human
cuguucccaccugcugg

SEQ ID NO: 2501528 - RNA, 21 nt, Human
cuguuaaaagaugaaaauauu

SEQ ID NO: 2501529 - RNA, 23 nt, Human
cuguuaaaagaugaaaauauuug

SEQ ID NO: 2501530 - RNA, 14 nt, Human
cuguguuuguuccu

SEQ ID NO: 2501531 - RNA, 15 nt, Human
cuguguuuguuccua

SEQ ID NO: 2501532 - RNA, 13 nt, Human
cuguguuuuaaua

SEQ ID NO: 2501533 - RNA, 20 nt, Human
cuguuaaaagaugaaaauau

SEQ ID NO: 2501534 - RNA, 22 nt, Human
cuguguuugagcucugcagccc

SEQ ID NO: 2501535 - RNA, 19 nt, Human
cuguguuucaaguggggcu

SEQ ID NO: 2501536 - RNA, 19 nt, Human
cuguguuucuuuugguucc

SEQ ID NO: 2501537 - RNA, 20 nt, Human
cuguguuugagcucugcagc

SEQ ID NO: 2501538 - RNA, 12 nt, Human
cuguguguuagu

SEQ ID NO: 2501539 - RNA, 21 nt, Human
cugugugugugaaugaacacu

SEQ ID NO: 2501540 - RNA, 21 nt, Human
cuguguguuaguucccaacau

SEQ ID NO: 2501541 - RNA, 18 nt, Human
cuguguguuaguucccaa

SEQ ID NO: 2501542 - RNA, 16 nt, Human
cuguguguuaguuccc

SEQ ID NO: 2501543 - RNA, 19 nt, Human
cuguguguuaguucccaac

SEQ ID NO: 2501544 - RNA, 13 nt, Human
cuguguguugcca

SEQ ID NO: 2501545 - RNA, 19 nt, Human
cuguguguugccacaggac

SEQ ID NO: 2501546 - RNA, 20 nt, Human
cuguguguugccacaggaca

SEQ ID NO: 2501547 - RNA, 22 nt, Human
cuguguugucucuagagcaggg

SEQ ID NO: 2501548 - RNA, 21 nt, Human
cuguguguugccacaggacac

SEQ ID NO: 2501549 - RNA, 22 nt, Human
cuguguguugccacaggacaca

SEQ ID NO: 2501550 - RNA, 16 nt, Human
cuguguguuuaugugu

SEQ ID NO: 2501551 - RNA, 17 nt, Human
cuguguguuuaugugug

SEQ ID NO: 2501552 - RNA, 20 nt, Human
cugugugugcgccuacagga

SEQ ID NO: 2501553 - RNA, 22 nt, Human
cuguguggugucgcgccuucuc

SEQ ID NO: 2501554 - RNA, 12 nt, Human
cugugugguuug

SEQ ID NO: 2501555 - RNA, 18 nt, Human
cugugugugcgccuacag

SEQ ID NO: 2501556 - RNA, 17 nt, Human
cugugugugugaaugaa

SEQ ID NO: 2501557 - RNA, 18 nt, Human
cugugugugugaaugaac

SEQ ID NO: 2501558 - RNA, 23 nt, Human
cugugugugugaaugaacacucu

SEQ ID NO: 2501559 - RNA, 14 nt, Human
cugugugugugaau

SEQ ID NO: 2501560 - RNA, 16 nt, Human
cugugugugugaauga

SEQ ID NO: 2501561 - RNA, 12 nt, Human
cuguguguguga

SEQ ID NO: 2501562 - RNA, 21 nt, Human
cugugugguuugguguguucc

SEQ ID NO: 2501563 - RNA, 21 nt, Human
cugugugcucaggagcccugg

SEQ ID NO: 2501564 - RNA, 20 nt, Human
cugugugcucaggagcccug

SEQ ID NO: 2501565 - RNA, 16 nt, Human
cugugugcucaggagc

SEQ ID NO: 2501566 - RNA, 19 nt, Human
cugugugcucaggagcccu

SEQ ID NO: 2501567 - RNA, 23 nt, Human
cugugugcucaggagcccuggga

SEQ ID NO: 2501568 - RNA, 23 nt, Human
cugugugcuccuccuuggugccu

SEQ ID NO: 2501569 - RNA, 18 nt, Human
cugugugcuccuccuugg

SEQ ID NO: 2501570 - RNA, 23 nt, Human
cugugggggaagagcacagcccu

SEQ ID NO: 2501571 - RNA, 15 nt, Human
cuguguggcagucug

SEQ ID NO: 2501572 - RNA, 18 nt, Human
cuguguggacugugaugc

SEQ ID NO: 2501573 - RNA, 16 nt, Human
cuguguggacugugau

SEQ ID NO: 2501574 - RNA, 23 nt, Human
cugugucuugcaauggcagccuu

SEQ ID NO: 2501575 - RNA, 22 nt, Human
cugugucuugcaauggcagccu

SEQ ID NO: 2501576 - RNA, 22 nt, Human
cugugggggaagagcacagccc

SEQ ID NO: 2501577 - RNA, 21 nt, Human
cugugggggaagagcacagcc

SEQ ID NO: 2501578 - RNA, 20 nt, Human
cugugggggaagagcacagc

SEQ ID NO: 2501579 - RNA, 19 nt, Human
cugugggggaagagcacag

SEQ ID NO: 2501580 - RNA, 20 nt, Human
cugugucuugcaauggcagc

SEQ ID NO: 2501581 - RNA, 21 nt, Human
cugugucuugcaauggcagcc

SEQ ID NO: 2501582 - RNA, 22 nt, Human
cuguggggcugguagcucaggu

SEQ ID NO: 2501583 - RNA, 21 nt, Human
cuguggggcugguagcucagg

SEQ ID NO: 2501584 - RNA, 17 nt, Human
cuguggggcugguagcu

SEQ ID NO: 2501585 - RNA, 14 nt, Human
cuguggggcuggua

SEQ ID NO: 2501586 - RNA, 19 nt, Human
cuguggggccuugguuccc

SEQ ID NO: 2501587 - RNA, 20 nt, Human
cuguggggauuucucccagc

SEQ ID NO: 2501588 - RNA, 21 nt, Human
cuguggggauuucucccagcu

SEQ ID NO: 2501589 - RNA, 20 nt, Human
cuguggggaucucaggggcu

SEQ ID NO: 2501590 - RNA, 17 nt, Human
cuguggggaucucaggg

SEQ ID NO: 2501591 - RNA, 16 nt, Human
cuguggggaucucagg

SEQ ID NO: 2501592 - RNA, 21 nt, Human
cuguggggaucucaggggcug

SEQ ID NO: 2501593 - RNA, 17 nt, Human
cuguggggauuucuccc

SEQ ID NO: 2501594 - RNA, 18 nt, Human
cuguggggauuucuccca

SEQ ID NO: 2501595 - RNA, 19 nt, Human
cuguggggauuucucccag

SEQ ID NO: 2501596 - RNA, 23 nt, Human
cugugggcgugagaccugccccu

SEQ ID NO: 2501597 - RNA, 14 nt, Human
cugugggcugcacu

SEQ ID NO: 2501598 - RNA, 15 nt, Human
cugugggcugcacuc

SEQ ID NO: 2501599 - RNA, 19 nt, Human
cugugggccucaaggacuu

SEQ ID NO: 2501600 - RNA, 22 nt, Human
cugugggcugcacucugugccc

SEQ ID NO: 2501601 - RNA, 21 nt, Human
cugugggcugcacucugugcc

SEQ ID NO: 2501602 - RNA, 20 nt, Human
cugugggcugcacucugugc

SEQ ID NO: 2501603 - RNA, 18 nt, Human
cugugggcugcacucugu

SEQ ID NO: 2501604 - RNA, 15 nt, Human
cugugggcuggcagu

SEQ ID NO: 2501605 - RNA, 23 nt, Human
cugugggcugcacucugugccca

SEQ ID NO: 2501606 - RNA, 22 nt, Human
cugucccuuacgugaguccugg

SEQ ID NO: 2501607 - RNA, 15 nt, Human
cugucccugucacca

SEQ ID NO: 2501608 - RNA, 15 nt, Human
cuguccgagcuuuga

SEQ ID NO: 2501609 - RNA, 14 nt, Human
cuguccuacccacc

SEQ ID NO: 2501610 - RNA, 13 nt, Human
cuguccucagccu

SEQ ID NO: 2501611 - RNA, 17 nt, Human
cugucccugucaccaag

SEQ ID NO: 2501612 - RNA, 18 nt, Human
cuguccguuuacuccaag

SEQ ID NO: 2501613 - RNA, 14 nt, Human
cuguccucagccuu

SEQ ID NO: 2501614 - RNA, 18 nt, Human
cuguccucagccuugcca

SEQ ID NO: 2501615 - RNA, 20 nt, Human
cuguccucagccuugccaga

SEQ ID NO: 2501616 - RNA, 21 nt, Human
cuguccucagccuugccagag

SEQ ID NO: 2501617 - RNA, 22 nt, Human
cuguccucagccuugccagaga

SEQ ID NO: 2501618 - RNA, 15 nt, Human
cuguccucagcuucu

SEQ ID NO: 2501619 - RNA, 17 nt, Human
cuguccucagcuucuua

SEQ ID NO: 2501620 - RNA, 12 nt, Human
cuguccucaggu

SEQ ID NO: 2501621 - RNA, 20 nt, Human
cugucuacacuaagagagaa

SEQ ID NO: 2501622 - RNA, 18 nt, Human
cuguccucagguggccau

SEQ ID NO: 2501623 - RNA, 17 nt, Human
cuguccucagguggcca

SEQ ID NO: 2501624 - RNA, 16 nt, Human
cuguccucagguggcc

SEQ ID NO: 2501625 - RNA, 15 nt, Human
cuguccucagguggc

SEQ ID NO: 2501626 - RNA, 23 nt, Human
cugucucaaaaaaacacaaaagu

SEQ ID NO: 2501627 - RNA, 16 nt, Human
cugucucaaaaaaaga

SEQ ID NO: 2501628 - RNA, 19 nt, Human
cugucuauuucugcugaau

SEQ ID NO: 2501629 - RNA, 18 nt, Human
cugucuauuucugcugaa

SEQ ID NO: 2501630 - RNA, 17 nt, Human
cugucuauuucugcuga

SEQ ID NO: 2501631 - RNA, 16 nt, Human
cugucuauuucugcug

SEQ ID NO: 2501632 - RNA, 22 nt, Human
cugucucaagagggcacuggug

SEQ ID NO: 2501633 - RNA, 18 nt, Human
cugucucaaaaaaagaaa

SEQ ID NO: 2501634 - RNA, 12 nt, Human
cugucuagagua

SEQ ID NO: 2501635 - RNA, 18 nt, Human
cugucuagagagggaggc

SEQ ID NO: 2501636 - RNA, 15 nt, Human
cugucuauuucugcu

SEQ ID NO: 2501637 - RNA, 14 nt, Human
cugucuauuucugc

SEQ ID NO: 2501638 - RNA, 13 nt, Human
cugucuauucuag

SEQ ID NO: 2501639 - RNA, 14 nt, Human
cugucuagagaggg

SEQ ID NO: 2501640 - RNA, 16 nt, Human
cugucuagagagggag

SEQ ID NO: 2501641 - RNA, 17 nt, Human
cugucuagagagggagg

SEQ ID NO: 2501642 - RNA, 13 nt, Human
cugucuagagagg

SEQ ID NO: 2501643 - RNA, 15 nt, Human
cuguccuccaacacc

SEQ ID NO: 2501644 - RNA, 23 nt, Human
cuguccuccaacaccaagcacag

SEQ ID NO: 2501645 - RNA, 12 nt, Human
cuguccuccaag

SEQ ID NO: 2501646 - RNA, 12 nt, Human
cuguccccucuu

SEQ ID NO: 2501647 - RNA, 20 nt, Human
cuguccccucagcuccagac

SEQ ID NO: 2501648 - RNA, 17 nt, Human
cuguccccucagcucca

SEQ ID NO: 2501649 - RNA, 16 nt, Human
cuguccccucagcucc

SEQ ID NO: 2501650 - RNA, 15 nt, Human
cuguccccucagcuc

SEQ ID NO: 2501651 - RNA, 14 nt, Human
cuguccccucagcu

SEQ ID NO: 2501652 - RNA, 18 nt, Human
cuguccccucuugcccca

SEQ ID NO: 2501653 - RNA, 17 nt, Human
cuguccccucuugcccc

SEQ ID NO: 2501654 - RNA, 16 nt, Human
cuguccccucuugccc

SEQ ID NO: 2501655 - RNA, 15 nt, Human
cuguccccucuugcc

SEQ ID NO: 2501656 - RNA, 20 nt, Human
cuguccccucuugccccaac

SEQ ID NO: 2501657 - RNA, 19 nt, Human
cuguccccucuugccccaa

SEQ ID NO: 2501658 - RNA, 18 nt, Human
cugucccgggguccugug

SEQ ID NO: 2501659 - RNA, 17 nt, Human
cugucccgggguccugu

SEQ ID NO: 2501660 - RNA, 23 nt, Human
cuguccccuucucucaucucuua

SEQ ID NO: 2501661 - RNA, 22 nt, Human
cuguccccuucucucaucucuu

SEQ ID NO: 2501662 - RNA, 21 nt, Human
cuguccccuucucucaucucu

SEQ ID NO: 2501663 - RNA, 20 nt, Human
cuguccccuucucucaucuc

SEQ ID NO: 2501664 - RNA, 19 nt, Human
cuguccccuucucucaucu

SEQ ID NO: 2501665 - RNA, 16 nt, Human
cuguccccuucucuca

SEQ ID NO: 2501666 - RNA, 14 nt, Human
cuguccccuucucu

SEQ ID NO: 2501667 - RNA, 14 nt, Human
cugucccugccuca

SEQ ID NO: 2501668 - RNA, 16 nt, Human
cugucccucucaggca

SEQ ID NO: 2501669 - RNA, 12 nt, Human
cugucccuguca

SEQ ID NO: 2501670 - RNA, 21 nt, Human
cugucccuccgggaccuggug

SEQ ID NO: 2501671 - RNA, 17 nt, Human
cugucccuccgggaccu

SEQ ID NO: 2501672 - RNA, 21 nt, Human
cugucccgggguccuguggca

SEQ ID NO: 2501673 - RNA, 15 nt, Human
cugucccucucaggc

SEQ ID NO: 2501674 - RNA, 20 nt, Human
cugucccuuacgugaguccu

SEQ ID NO: 2501675 - RNA, 14 nt, Human
cuguccgagcuuug

SEQ ID NO: 2501676 - RNA, 20 nt, Human
cuguccaguucccagaaggc

SEQ ID NO: 2501677 - RNA, 19 nt, Human
cuguccaguucccagaagg

SEQ ID NO: 2501678 - RNA, 18 nt, Human
cuguccaguucccagaag

SEQ ID NO: 2501679 - RNA, 21 nt, Human
cuguccaguucccagaaggca

SEQ ID NO: 2501680 - RNA, 22 nt, Human
cuguccccgcacugggcuuggg

SEQ ID NO: 2501681 - RNA, 19 nt, Human
cuguccccgcacugggcuu

SEQ ID NO: 2501682 - RNA, 18 nt, Human
cuguccccgcacugggcu

SEQ ID NO: 2501683 - RNA, 16 nt, Human
cuguccaguucccaga

SEQ ID NO: 2501684 - RNA, 15 nt, Human
cuguccaguucccag

SEQ ID NO: 2501685 - RNA, 14 nt, Human
cuguccaguuccca

SEQ ID NO: 2501686 - RNA, 14 nt, Human
cuguccagugggua

SEQ ID NO: 2501687 - RNA, 18 nt, Human
cuguccagugcccauucc

SEQ ID NO: 2501688 - RNA, 15 nt, Human
cuguccagugcccau

SEQ ID NO: 2501689 - RNA, 14 nt, Human
cuguccagugccca

SEQ ID NO: 2501690 - RNA, 13 nt, Human
cuguccagugccc

SEQ ID NO: 2501691 - RNA, 17 nt, Human
cuguccccgcacugggc

SEQ ID NO: 2501692 - RNA, 19 nt, Human
cuguccagggcccugagcu

SEQ ID NO: 2501693 - RNA, 20 nt, Human
cuguccagggcccugagcuc

SEQ ID NO: 2501694 - RNA, 22 nt, Human
cuguccagggcccugagcucgg

SEQ ID NO: 2501695 - RNA, 23 nt, Human
cuguccagggcccugagcucggu

SEQ ID NO: 2501696 - RNA, 18 nt, Human
cuguccagggcccugagc

SEQ ID NO: 2501697 - RNA, 19 nt, Human
cuguccaggcacugagaua

SEQ ID NO: 2501698 - RNA, 16 nt, Human
cuguccaggcacugag

SEQ ID NO: 2501699 - RNA, 21 nt, Human
cuguccagcuccaaccugcaa

SEQ ID NO: 2501700 - RNA, 17 nt, Human
cuguccagcuccaaccu

SEQ ID NO: 2501701 - RNA, 18 nt, Human
cuguccagcuccaaccug

SEQ ID NO: 2501702 - RNA, 23 nt, Human
cuguccaggcacugcugcccagc

SEQ ID NO: 2501703 - RNA, 13 nt, Human
cuguccagcucca

SEQ ID NO: 2501704 - RNA, 14 nt, Human
cuguccagcuccaa

SEQ ID NO: 2501705 - RNA, 12 nt, Human
cuguccagcucc

SEQ ID NO: 2501706 - RNA, 18 nt, Human
cuguccagccugggcagc

SEQ ID NO: 2501707 - RNA, 18 nt, Human
cuguccagagagagaagu

SEQ ID NO: 2501708 - RNA, 13 nt, Human
cuguccagccugg

SEQ ID NO: 2501709 - RNA, 15 nt, Human
cuguccagccugggc

SEQ ID NO: 2501710 - RNA, 17 nt, Human
cuguccagccugggcag

SEQ ID NO: 2501711 - RNA, 14 nt, Human
cugucaagaagaug

SEQ ID NO: 2501712 - RNA, 12 nt, Human
cugucaagaaga

SEQ ID NO: 2501713 - RNA, 11 nt, Human
cuguccagaga

SEQ ID NO: 2501714 - RNA, 21 nt, Human
cuguccagacagccuguaucu

SEQ ID NO: 2501715 - RNA, 17 nt, Human
cuguccagacagccugu

SEQ ID NO: 2501716 - RNA, 16 nt, Human
cuguccagacagccug

SEQ ID NO: 2501717 - RNA, 19 nt, Human
cugucaaggcugcuuagaa

SEQ ID NO: 2501718 - RNA, 20 nt, Human
cugucaaggcugcuuagaau

SEQ ID NO: 2501719 - RNA, 17 nt, Human
cugucaaggcugcuuag

SEQ ID NO: 2501720 - RNA, 19 nt, Human
cugucaaguuccuuugggu

SEQ ID NO: 2501721 - RNA, 21 nt, Human
cugucaagugggaucugucac

SEQ ID NO: 2501722 - RNA, 19 nt, Human
cuguauuuuaaaagaauga

SEQ ID NO: 2501723 - RNA, 20 nt, Human
cuguauuuuaaaagaaugau

SEQ ID NO: 2501724 - RNA, 22 nt, Human
cuguauuuuaaaagaaugauua

SEQ ID NO: 2501725 - RNA, 22 nt, Human
cuguauuuuauuuagacaagag

SEQ ID NO: 2501726 - RNA, 21 nt, Human
cuguauuuuauuuagacaaga

SEQ ID NO: 2501727 - RNA, 18 nt, Human
cugucaaacaaagccaga

SEQ ID NO: 2501728 - RNA, 19 nt, Human
cugucaaacaaagccagaa

SEQ ID NO: 2501729 - RNA, 22 nt, Human
cugucaaacaaagccagaagcu

SEQ ID NO: 2501730 - RNA, 22 nt, Human
cuguaucuugggggacagggcu

SEQ ID NO: 2501731 - RNA, 17 nt, Human
cuguaucuguagugaga

SEQ ID NO: 2501732 - RNA, 18 nt, Human
cuguaucggagacaguga

SEQ ID NO: 2501733 - RNA, 23 nt, Human
cuguaucuguagugagauagcau

SEQ ID NO: 2501734 - RNA, 18 nt, Human
cuguaucuuguuuuucca

SEQ ID NO: 2501735 - RNA, 23 nt, Human
cuguaucccaugagccucagcau

SEQ ID NO: 2501736 - RNA, 17 nt, Human
cuguaucggagacagug

SEQ ID NO: 2501737 - RNA, 15 nt, Human
cuguacaaugacuuu

SEQ ID NO: 2501738 - RNA, 21 nt, Human
cuguacaauauuuaaaauuua

SEQ ID NO: 2501739 - RNA, 19 nt, Human
cuguacaaauauaagaaua

SEQ ID NO: 2501740 - RNA, 17 nt, Human
cuguacaaauauaagaa

SEQ ID NO: 2501741 - RNA, 20 nt, Human
cuguacaaauauaagaauaa

SEQ ID NO: 2501742 - RNA, 14 nt, Human
cuguacaauauuua

SEQ ID NO: 2501743 - RNA, 15 nt, Human
cuguacaauauuuaa

SEQ ID NO: 2501744 - RNA, 16 nt, Human
cuguacaauauuuaaa

SEQ ID NO: 2501745 - RNA, 17 nt, Human
cuguacaauauuuaaaa

SEQ ID NO: 2501746 - RNA, 18 nt, Human
cuguacaauauuuaaaau

SEQ ID NO: 2501747 - RNA, 13 nt, Human
cuguacagagccc

SEQ ID NO: 2501748 - RNA, 17 nt, Human
cuguacacguguccugu

SEQ ID NO: 2501749 - RNA, 16 nt, Human
cuguacacguguccug

SEQ ID NO: 2501750 - RNA, 18 nt, Human
cuguacacguguccugua

SEQ ID NO: 2501751 - RNA, 19 nt, Human
cuguacacugaauauuuau

SEQ ID NO: 2501752 - RNA, 13 nt, Human
cuguaguuaggaa

SEQ ID NO: 2501753 - RNA, 14 nt, Human
cuguaguuaggaaa

SEQ ID NO: 2501754 - RNA, 15 nt, Human
cuguaguuaggaaau

SEQ ID NO: 2501755 - RNA, 23 nt, Human
cuguaguccuagccacucaggag

SEQ ID NO: 2501756 - RNA, 14 nt, Human
cuguagucucagga

SEQ ID NO: 2501757 - RNA, 15 nt, Human
cuguagucucaggac

SEQ ID NO: 2501758 - RNA, 22 nt, Human
cuguagugagauagcauuguga

SEQ ID NO: 2501759 - RNA, 20 nt, Human
cuguagugagauagcauugu

SEQ ID NO: 2501760 - RNA, 18 nt, Human
cuguagugagauagcauu

SEQ ID NO: 2501761 - RNA, 20 nt, Human
cuguagucucaggaccuagg

SEQ ID NO: 2501762 - RNA, 13 nt, Human
cuguacacugcac

SEQ ID NO: 2501763 - RNA, 15 nt, Human
cuguacacugcacga

SEQ ID NO: 2501764 - RNA, 14 nt, Human
cuguagucccagcu

SEQ ID NO: 2501765 - RNA, 15 nt, Human
cuguagucccagcua

SEQ ID NO: 2501766 - RNA, 18 nt, Human
cuguagucccagcuacuc

SEQ ID NO: 2501767 - RNA, 22 nt, Human
cuguagucccagcuacucagga

SEQ ID NO: 2501768 - RNA, 23 nt, Human
cuguagucccagcuacucaggag

SEQ ID NO: 2501769 - RNA, 22 nt, Human
cuguagucccagcuacucggga

SEQ ID NO: 2501770 - RNA, 20 nt, Human
cuguaguccuagccacucag

SEQ ID NO: 2501771 - RNA, 22 nt, Human
cuguaguccuagccacucagga

SEQ ID NO: 2501772 - RNA, 19 nt, Human
cuguauacaacccuggcau

SEQ ID NO: 2501773 - RNA, 22 nt, Human
cuguauaaguggaggcacuuua

SEQ ID NO: 2501774 - RNA, 19 nt, Human
cuguauaaguaagaaaaua

SEQ ID NO: 2501775 - RNA, 18 nt, Human
cuguauaaguaagaaaau

SEQ ID NO: 2501776 - RNA, 21 nt, Human
cuguauaaguaagaaaauauu

SEQ ID NO: 2501777 - RNA, 21 nt, Human
cuguauaaguggaggcacuuu

SEQ ID NO: 2501778 - RNA, 23 nt, Human
cuggugcuauaggcuggagaagc

SEQ ID NO: 2501779 - RNA, 17 nt, Human
cuguauaaguaagaaaa

SEQ ID NO: 2501780 - RNA, 16 nt, Human
cuguauaaguaagaaa

SEQ ID NO: 2501781 - RNA, 15 nt, Human
cuguauaaguaagaa

SEQ ID NO: 2501782 - RNA, 14 nt, Human
cuguauaaguaaga

SEQ ID NO: 2501783 - RNA, 13 nt, Human
cuguauaaguaag

SEQ ID NO: 2501784 - RNA, 12 nt, Human
cuguauaaguaa

SEQ ID NO: 2501785 - RNA, 21 nt, Human
cuguauaaauaggagaggaug

SEQ ID NO: 2501786 - RNA, 17 nt, Human
cuguaguuaggaaauaa

SEQ ID NO: 2501787 - RNA, 18 nt, Human
cuguaguuaggaaauaaa

SEQ ID NO: 2501788 - RNA, 22 nt, Human
cuguauauuugugauagcacuu

SEQ ID NO: 2501789 - RNA, 23 nt, Human
cuguauauuugugauagcacuuu

SEQ ID NO: 2501790 - RNA, 16 nt, Human
cuguaucaggacccag

SEQ ID NO: 2501791 - RNA, 22 nt, Human
cuguaucaggacccagaggaag

SEQ ID NO: 2501792 - RNA, 23 nt, Human
cuguaucaggacccagaggaagg

SEQ ID NO: 2501793 - RNA, 14 nt, Human
cuguauauacuuuu

SEQ ID NO: 2501794 - RNA, 15 nt, Human
cuguauauacuuuuu

SEQ ID NO: 2501795 - RNA, 16 nt, Human
cuguauauagcccagc

SEQ ID NO: 2501796 - RNA, 14 nt, Human
cuguaaucuaugaa

SEQ ID NO: 2501797 - RNA, 20 nt, Human
cuguaaucgcccuacuauuc

SEQ ID NO: 2501798 - RNA, 22 nt, Human
cuguaaucucguuucaaaaaca

SEQ ID NO: 2501799 - RNA, 20 nt, Human
cuguaaucucguuucaaaaa

SEQ ID NO: 2501800 - RNA, 19 nt, Human
cuguaaucucguuucaaaa

SEQ ID NO: 2501801 - RNA, 15 nt, Human
cuguaaugaaucuaa

SEQ ID NO: 2501802 - RNA, 21 nt, Human
cuguaaugaaccgcugaauau

SEQ ID NO: 2501803 - RNA, 20 nt, Human
cuguaaugaaccgcugaaua

SEQ ID NO: 2501804 - RNA, 21 nt, Human
cuguaaugaaacaccuucucu

SEQ ID NO: 2501805 - RNA, 21 nt, Human
cuguaaugaaucuaagcagca

SEQ ID NO: 2501806 - RNA, 19 nt, Human
cuguaaucauauaauaaau

SEQ ID NO: 2501807 - RNA, 20 nt, Human
cuguaauccuagcacuuugg

SEQ ID NO: 2501808 - RNA, 13 nt, Human
cuguacaaaguag

SEQ ID NO: 2501809 - RNA, 15 nt, Human
cuguacaaaguagaa

SEQ ID NO: 2501810 - RNA, 13 nt, Human
cuguaauuuuaua

SEQ ID NO: 2501811 - RNA, 16 nt, Human
cuguacaaauauaaga

SEQ ID NO: 2501812 - RNA, 15 nt, Human
cuguacaaauauaag

SEQ ID NO: 2501813 - RNA, 20 nt, Human
cuguaauuuuuuucuuauau

SEQ ID NO: 2501814 - RNA, 17 nt, Human
cuguaauaaauaugagu

SEQ ID NO: 2501815 - RNA, 16 nt, Human
cuguaauaaauaugag

SEQ ID NO: 2501816 - RNA, 15 nt, Human
cuguaauaaauauga

SEQ ID NO: 2501817 - RNA, 14 nt, Human
cuguaauaaauaug

SEQ ID NO: 2501818 - RNA, 13 nt, Human
cuguaauaaauau

SEQ ID NO: 2501819 - RNA, 12 nt, Human
cuguaauaaaua

SEQ ID NO: 2501820 - RNA, 23 nt, Human
cuguaaucacagcuacuugggag

SEQ ID NO: 2501821 - RNA, 23 nt, Human
cugguucggauuugggguggauu

SEQ ID NO: 2501822 - RNA, 21 nt, Human
cugguucggauuuggggugga

SEQ ID NO: 2501823 - RNA, 13 nt, Human
cugguuccucccc

SEQ ID NO: 2501824 - RNA, 18 nt, Human
cugguucuauuuaaugga

SEQ ID NO: 2501825 - RNA, 17 nt, Human
cugguucuauuuaaugg

SEQ ID NO: 2501826 - RNA, 20 nt, Human
cuguaauaaagaugauugug

SEQ ID NO: 2501827 - RNA, 16 nt, Human
cugguucuauuuaaug

SEQ ID NO: 2501828 - RNA, 12 nt, Human
cuggugcugcug

SEQ ID NO: 2501829 - RNA, 14 nt, Human
cugguggccucugc

SEQ ID NO: 2501830 - RNA, 16 nt, Human
cugguuccauggccuc

SEQ ID NO: 2501831 - RNA, 22 nt, Human
cuggugggaggggcgcccaccu

SEQ ID NO: 2501832 - RNA, 23 nt, Human
cugguggcucccggagggcccug

SEQ ID NO: 2501833 - RNA, 15 nt, Human
cugguggcucccgga

SEQ ID NO: 2501834 - RNA, 15 nt, Human
cugguggccucugcc

SEQ ID NO: 2501835 - RNA, 18 nt, Human
cugguucccguuucucca

SEQ ID NO: 2501836 - RNA, 23 nt, Human
cuggugggaggggcgcccaccuc

SEQ ID NO: 2501837 - RNA, 21 nt, Human
cugguucccguuucuccaccu

SEQ ID NO: 2501838 - RNA, 17 nt, Human
cugguuccggaauccug

SEQ ID NO: 2501839 - RNA, 12 nt, Human
cugguuccuccc

SEQ ID NO: 2501840 - RNA, 18 nt, Human
cugguuccggaauccugu

SEQ ID NO: 2501841 - RNA, 23 nt, Human
cugguggcccgacagccuggcac

SEQ ID NO: 2501842 - RNA, 22 nt, Human
cugguggcccgacagccuggca

SEQ ID NO: 2501843 - RNA, 21 nt, Human
cugguggcccgacagccuggc

SEQ ID NO: 2501844 - RNA, 20 nt, Human
cugguggcccgacagccugg

SEQ ID NO: 2501845 - RNA, 14 nt, Human
cugguggcagcugc

SEQ ID NO: 2501846 - RNA, 13 nt, Human
cugguggcagcug

SEQ ID NO: 2501847 - RNA, 23 nt, Human
cugguggcagcucaccucucccu

SEQ ID NO: 2501848 - RNA, 14 nt, Human
cuggugcugccucu

SEQ ID NO: 2501849 - RNA, 19 nt, Human
cuggugcugccucuaccug

SEQ ID NO: 2501850 - RNA, 21 nt, Human
cugguggcagcucaccucucc

SEQ ID NO: 2501851 - RNA, 22 nt, Human
cuggugcugccacacuucaggc

SEQ ID NO: 2501852 - RNA, 20 nt, Human
cuggugcugccacacuucag

SEQ ID NO: 2501853 - RNA, 13 nt, Human
cuggugcugccac

SEQ ID NO: 2501854 - RNA, 12 nt, Human
cuggugcugcca

SEQ ID NO: 2501855 - RNA, 21 nt, Human
cugguccgugggacggugccc

SEQ ID NO: 2501856 - RNA, 19 nt, Human
cugguccgugggacggugc

SEQ ID NO: 2501857 - RNA, 13 nt, Human
cugguccuaccca

SEQ ID NO: 2501858 - RNA, 16 nt, Human
cugguccuacccaucc

SEQ ID NO: 2501859 - RNA, 22 nt, Human
cugguccuacccauccccgcag

SEQ ID NO: 2501860 - RNA, 18 nt, Human
cuggugcucucugccacu

SEQ ID NO: 2501861 - RNA, 16 nt, Human
cuggugcucucugcca

SEQ ID NO: 2501862 - RNA, 14 nt, Human
cuggugcucucugc

SEQ ID NO: 2501863 - RNA, 19 nt, Human
cugguccugagggucccca

SEQ ID NO: 2501864 - RNA, 16 nt, Human
cugguccugagggucc

SEQ ID NO: 2501865 - RNA, 17 nt, Human
cugguccuacccauccc

SEQ ID NO: 2501866 - RNA, 16 nt, Human
cugguccgugggacgg

SEQ ID NO: 2501867 - RNA, 15 nt, Human
cugguccgugggacg

SEQ ID NO: 2501868 - RNA, 22 nt, Human
cugguccggacacuccuagaga

SEQ ID NO: 2501869 - RNA, 21 nt, Human
cugguccggacacuccuagag

SEQ ID NO: 2501870 - RNA, 20 nt, Human
cugguccggacacuccuaga

SEQ ID NO: 2501871 - RNA, 16 nt, Human
cugguccggacacucc

SEQ ID NO: 2501872 - RNA, 19 nt, Human
cuggucacagccuccucug

SEQ ID NO: 2501873 - RNA, 17 nt, Human
cuggucccuugcagcua

SEQ ID NO: 2501874 - RNA, 21 nt, Human
cuggucccuugcagcuaguuu

SEQ ID NO: 2501875 - RNA, 18 nt, Human
cuggucacaggacucugc

SEQ ID NO: 2501876 - RNA, 15 nt, Human
cuggucccugggagg

SEQ ID NO: 2501877 - RNA, 18 nt, Human
cuggucacagccuccucu

SEQ ID NO: 2501878 - RNA, 17 nt, Human
cuggucacagccuccuc

SEQ ID NO: 2501879 - RNA, 16 nt, Human
cuggucacagccuccu

SEQ ID NO: 2501880 - RNA, 15 nt, Human
cuggucacagccucc

SEQ ID NO: 2501881 - RNA, 19 nt, Human
cuggucaaccuccuggaca

SEQ ID NO: 2501882 - RNA, 17 nt, Human
cuggucaaccuccugga

SEQ ID NO: 2501883 - RNA, 16 nt, Human
cuggucaaccuccugg

SEQ ID NO: 2501884 - RNA, 15 nt, Human
cuggucaaccuccug

SEQ ID NO: 2501885 - RNA, 18 nt, Human
cuggucaaacaaacucuc

SEQ ID NO: 2501886 - RNA, 23 nt, Human
cuggucaaacaaacucucugaac

SEQ ID NO: 2501887 - RNA, 16 nt, Human
cugguacucuccuaga

SEQ ID NO: 2501888 - RNA, 13 nt, Human
cugguacucuccu

SEQ ID NO: 2501889 - RNA, 14 nt, Human
cugguauuuuaucu

SEQ ID NO: 2501890 - RNA, 17 nt, Human
cuggucaaacaaacucu

SEQ ID NO: 2501891 - RNA, 14 nt, Human
cugggggaguggaa

SEQ ID NO: 2501892 - RNA, 13 nt, Human
cugggggagugga

SEQ ID NO: 2501893 - RNA, 16 nt, Human
cugggggaagcccugg

SEQ ID NO: 2501894 - RNA, 12 nt, Human
cugggggcagga

SEQ ID NO: 2501895 - RNA, 14 nt, Human
cugggggcaggagg

SEQ ID NO: 2501896 - RNA, 19 nt, Human
cugggggcaggagggcccu

SEQ ID NO: 2501897 - RNA, 15 nt, Human
cugggggaagaagcu

SEQ ID NO: 2501898 - RNA, 20 nt, Human
cugggggacccaauguagga

SEQ ID NO: 2501899 - RNA, 17 nt, Human
cugggggaagcccugga

SEQ ID NO: 2501900 - RNA, 19 nt, Human
cuggggcuucuccugaccc

SEQ ID NO: 2501901 - RNA, 16 nt, Human
cuggggcuucuccuga

SEQ ID NO: 2501902 - RNA, 20 nt, Human
cuggggcuucuccugaccca

SEQ ID NO: 2501903 - RNA, 14 nt, Human
cugggggaagcccu

SEQ ID NO: 2501904 - RNA, 13 nt, Human
cuggggggcagug

SEQ ID NO: 2501905 - RNA, 16 nt, Human
cuggggggcaguggug

SEQ ID NO: 2501906 - RNA, 22 nt, Human
cugggggggauuguaaaauggu

SEQ ID NO: 2501907 - RNA, 19 nt, Human
cugggggcugggcagagga

SEQ ID NO: 2501908 - RNA, 14 nt, Human
cugggggccaugag

SEQ ID NO: 2501909 - RNA, 16 nt, Human
cugggggccaugagcu

SEQ ID NO: 2501910 - RNA, 17 nt, Human
cugggggccaugagcuc

SEQ ID NO: 2501911 - RNA, 18 nt, Human
cugggggccaugagcucc

SEQ ID NO: 2501912 - RNA, 18 nt, Human
cugggcuuggccugcugu

SEQ ID NO: 2501913 - RNA, 17 nt, Human
cugggcuuggccugcug

SEQ ID NO: 2501914 - RNA, 12 nt, Human
cuggggcugcug

SEQ ID NO: 2501915 - RNA, 16 nt, Human
cugggcuuggccugcu

SEQ ID NO: 2501916 - RNA, 15 nt, Human
cugggcuuggccugc

SEQ ID NO: 2501917 - RNA, 14 nt, Human
cugggcuuggccug

SEQ ID NO: 2501918 - RNA, 16 nt, Human
cuggggcugcuggccu

SEQ ID NO: 2501919 - RNA, 15 nt, Human
cuggggcugcuggcc

SEQ ID NO: 2501920 - RNA, 14 nt, Human
cuggggcugcuggc

SEQ ID NO: 2501921 - RNA, 20 nt, Human
cugggcuuggccugcuguga

SEQ ID NO: 2501922 - RNA, 14 nt, Human
cuggggcuggccuc

SEQ ID NO: 2501923 - RNA, 15 nt, Human
cuggggcuggcacaa

SEQ ID NO: 2501924 - RNA, 15 nt, Human
cuggggcuucuccug

SEQ ID NO: 2501925 - RNA, 15 nt, Human
cuggggcuggccucc

SEQ ID NO: 2501926 - RNA, 18 nt, Human
cuggggcuggccucccaa

SEQ ID NO: 2501927 - RNA, 13 nt, Human
cugggggaagaag

SEQ ID NO: 2501928 - RNA, 13 nt, Human
cugggcuuggccu

SEQ ID NO: 2501929 - RNA, 21 nt, Human
cuggcugccccaaccugcuga

SEQ ID NO: 2501930 - RNA, 20 nt, Human
cuggcugccccaaccugcug

SEQ ID NO: 2501931 - RNA, 19 nt, Human
cuggcugccccaaccugcu

SEQ ID NO: 2501932 - RNA, 15 nt, Human
cugggcuucaucugg

SEQ ID NO: 2501933 - RNA, 19 nt, Human
cugggcuucaucuggcaac

SEQ ID NO: 2501934 - RNA, 24 nt, Human
cugggcuucaguggcagcugcuuu

SEQ ID NO: 2501935 - RNA, 13 nt, Human
cuggcugcaguga

SEQ ID NO: 2501936 - RNA, 16 nt, Human
cuggcugccagcuauu

SEQ ID NO: 2501937 - RNA, 12 nt, Human
cuggcugcccag

SEQ ID NO: 2501938 - RNA, 18 nt, Human
cuggcugccccaaccugc

SEQ ID NO: 2501939 - RNA, 16 nt, Human
cuggcugccccaaccu

SEQ ID NO: 2501940 - RNA, 13 nt, Human
cuggcugcccaga

SEQ ID NO: 2501941 - RNA, 18 nt, Human
cuggcugcccagaccccu

SEQ ID NO: 2501942 - RNA, 22 nt, Human
cuggguaacuagggaagauaau

SEQ ID NO: 2501943 - RNA, 20 nt, Human
cuggguaacuagggaagaua

SEQ ID NO: 2501944 - RNA, 15 nt, Human
cuggguacuucuuga

SEQ ID NO: 2501945 - RNA, 17 nt, Human
cuggguacuucuugaag

SEQ ID NO: 2501946 - RNA, 20 nt, Human
cuggguacuucuugaaggug

SEQ ID NO: 2501947 - RNA, 23 nt, Human
cuggguacuucuugaaggugcug

SEQ ID NO: 2501948 - RNA, 17 nt, Human
cuggcugagccuggcug

SEQ ID NO: 2501949 - RNA, 13 nt, Human
cugggguccccca

SEQ ID NO: 2501950 - RNA, 22 nt, Human
cuggggucuggaguugaucugg

SEQ ID NO: 2501951 - RNA, 15 nt, Human
cuggggugccgccug

SEQ ID NO: 2501952 - RNA, 13 nt, Human
cuggggucuggag

SEQ ID NO: 2501953 - RNA, 19 nt, Human
cugggguccuggggccucg

SEQ ID NO: 2501954 - RNA, 15 nt, Human
cugggguccuggggc

SEQ ID NO: 2501955 - RNA, 18 nt, Human
cugggguccuggggccuc

SEQ ID NO: 2501956 - RNA, 20 nt, Human
cugggguauaaaacuuuccu

SEQ ID NO: 2501957 - RNA, 16 nt, Human
cugggguccagggagc

SEQ ID NO: 2501958 - RNA, 15 nt, Human
cugggguccagggag

SEQ ID NO: 2501959 - RNA, 17 nt, Human
cuggguucuacccaggu

SEQ ID NO: 2501960 - RNA, 16 nt, Human
cuggguucuacccagg

SEQ ID NO: 2501961 - RNA, 15 nt, Human
cuggguucuacccag

SEQ ID NO: 2501962 - RNA, 14 nt, Human
cuggguucuaccca

SEQ ID NO: 2501963 - RNA, 18 nt, Human
cugguaauuuguaucuga

SEQ ID NO: 2501964 - RNA, 21 nt, Human
cugguaauuuguaucugaagg

SEQ ID NO: 2501965 - RNA, 22 nt, Human
cugguaauuuguaucugaagga

SEQ ID NO: 2501966 - RNA, 17 nt, Human
cugguacccagccaucu

SEQ ID NO: 2501967 - RNA, 16 nt, Human
cugguacccagccauc

SEQ ID NO: 2501968 - RNA, 14 nt, Human
cugguacccagcca

SEQ ID NO: 2501969 - RNA, 13 nt, Human
cugguacccagcc

SEQ ID NO: 2501970 - RNA, 22 nt, Human
cugguacccagccaucugccca

SEQ ID NO: 2501971 - RNA, 21 nt, Human
cugguacccagccaucugccc

SEQ ID NO: 2501972 - RNA, 19 nt, Human
cugguacccagccaucugc

SEQ ID NO: 2501973 - RNA, 18 nt, Human
cugguacccagccaucug

SEQ ID NO: 2501974 - RNA, 15 nt, Human
cugguacccuccugg

SEQ ID NO: 2501975 - RNA, 14 nt, Human
cugguacccuccug

SEQ ID NO: 2501976 - RNA, 23 nt, Human
cugguacccagccaucugcccag

SEQ ID NO: 2501977 - RNA, 16 nt, Human
cugguacccuccuggc

SEQ ID NO: 2501978 - RNA, 14 nt, Human
cugguacucaagcc

SEQ ID NO: 2501979 - RNA, 21 nt, Human
cuggcacuuggagacuuguau

SEQ ID NO: 2501980 - RNA, 23 nt, Human
cuggcagaaagcaaaugugaccu

SEQ ID NO: 2501981 - RNA, 21 nt, Human
cuggcagaaagcaaaugugac

SEQ ID NO: 2501982 - RNA, 13 nt, Human
cuggcagaacuga

SEQ ID NO: 2501983 - RNA, 16 nt, Human
cuggcagaacugagcu

SEQ ID NO: 2501984 - RNA, 17 nt, Human
cuggcagaacugagcuc

SEQ ID NO: 2501985 - RNA, 18 nt, Human
cuggcagaacugagcucc

SEQ ID NO: 2501986 - RNA, 19 nt, Human
cuggcagaacugagcuccu

SEQ ID NO: 2501987 - RNA, 20 nt, Human
cuggcagaacugagcuccuc

SEQ ID NO: 2501988 - RNA, 21 nt, Human
cuggcagaacugagcuccucu

SEQ ID NO: 2501989 - RNA, 18 nt, Human
cuggcacugcuuccagug

SEQ ID NO: 2501990 - RNA, 14 nt, Human
cuggcacuuggaga

SEQ ID NO: 2501991 - RNA, 21 nt, Human
cuggcacuggaugcagaaaca

SEQ ID NO: 2501992 - RNA, 23 nt, Human
cuggcacugcuuccagugaggcu

SEQ ID NO: 2501993 - RNA, 20 nt, Human
cuggcacugcuuccagugag

SEQ ID NO: 2501994 - RNA, 19 nt, Human
cuggcacugcuuccaguga

SEQ ID NO: 2501995 - RNA, 17 nt, Human
cuggcacauuuccccag

SEQ ID NO: 2501996 - RNA, 19 nt, Human
cuggcacauuuccccagac

SEQ ID NO: 2501997 - RNA, 22 nt, Human
cuggcacauuuccccagaccug

SEQ ID NO: 2501998 - RNA, 23 nt, Human
cuggcacauuuccccagaccuga

SEQ ID NO: 2501999 - RNA, 21 nt, Human
cuggcacaguuuucugagaaa

SEQ ID NO: 2502000 - RNA, 22 nt, Human
cuggcacaguuuucugagaaag

SEQ ID NO: 2502001 - RNA, 20 nt, Human
cuggcacaguuuucugagaa

SEQ ID NO: 2502002 - RNA, 20 nt, Human
cuggagugcagugagccgag

SEQ ID NO: 2502003 - RNA, 19 nt, Human
cuggcacaucagaaaggaa

SEQ ID NO: 2502004 - RNA, 14 nt, Human
cuggcacaucagaa

SEQ ID NO: 2502005 - RNA, 13 nt, Human
cuggagugcaguu

SEQ ID NO: 2502006 - RNA, 14 nt, Human
cuggagugcagugg

SEQ ID NO: 2502007 - RNA, 19 nt, Human
cuggcacccggccccugcu

SEQ ID NO: 2502008 - RNA, 21 nt, Human
cuggcacccggccccugcugg

SEQ ID NO: 2502009 - RNA, 20 nt, Human
cuggcacccggccccugcug

SEQ ID NO: 2502010 - RNA, 21 nt, Human
cuggccacugcacagagcucu

SEQ ID NO: 2502011 - RNA, 20 nt, Human
cuggccacugcacagagcuc

SEQ ID NO: 2502012 - RNA, 19 nt, Human
cuggccacugcacagagcu

SEQ ID NO: 2502013 - RNA, 18 nt, Human
cuggccacugcacagagc

SEQ ID NO: 2502014 - RNA, 13 nt, Human
cuggccagacaca

SEQ ID NO: 2502015 - RNA, 13 nt, Human
cuggccagaaugc

SEQ ID NO: 2502016 - RNA, 15 nt, Human
cuggccagacacagg

SEQ ID NO: 2502017 - RNA, 17 nt, Human
cuggccagacacaggcc

SEQ ID NO: 2502018 - RNA, 18 nt, Human
cuggccagacacaggccc

SEQ ID NO: 2502019 - RNA, 19 nt, Human
cuggccagacacaggcccu

SEQ ID NO: 2502020 - RNA, 14 nt, Human
cuggccagaugcac

SEQ ID NO: 2502021 - RNA, 21 nt, Human
cuggccaguccaggcugccgu

SEQ ID NO: 2502022 - RNA, 19 nt, Human
cuggccaguccaggcugcc

SEQ ID NO: 2502023 - RNA, 21 nt, Human
cuggccagacacaggcccucc

SEQ ID NO: 2502024 - RNA, 22 nt, Human
cuggccacugcacagagcucuc

SEQ ID NO: 2502025 - RNA, 13 nt, Human
cuggccagaggcu

SEQ ID NO: 2502026 - RNA, 19 nt, Human
cuggcaucgcaccauucug

SEQ ID NO: 2502027 - RNA, 18 nt, Human
cuggcaucgcaccauucu

SEQ ID NO: 2502028 - RNA, 17 nt, Human
cuggcaucgcaccauuc

SEQ ID NO: 2502029 - RNA, 22 nt, Human
cuggcaucgcaccauucugacu

SEQ ID NO: 2502030 - RNA, 20 nt, Human
cuggcaucgcaccauucuga

SEQ ID NO: 2502031 - RNA, 12 nt, Human
cuggccacugca

SEQ ID NO: 2502032 - RNA, 15 nt, Human
cuggccacugcacag

SEQ ID NO: 2502033 - RNA, 19 nt, Human
cuggcaguuuaaaaaaauu

SEQ ID NO: 2502034 - RNA, 15 nt, Human
cuggcaguuuaaaaa

SEQ ID NO: 2502035 - RNA, 15 nt, Human
cuggcaguuuuccau

SEQ ID NO: 2502036 - RNA, 13 nt, Human
cuggcagaaggga

SEQ ID NO: 2502037 - RNA, 22 nt, Human
cuggcaguccuggaagccagcu

SEQ ID NO: 2502038 - RNA, 19 nt, Human
cuggcaguggaacuaagaa

SEQ ID NO: 2502039 - RNA, 22 nt, Human
cuggcccagcccugcuggccgc

SEQ ID NO: 2502040 - RNA, 20 nt, Human
cuggcccagcccugcuggcc

SEQ ID NO: 2502041 - RNA, 19 nt, Human
cuggcccagcccugcuggc

SEQ ID NO: 2502042 - RNA, 18 nt, Human
cuggcccagcccugcugg

SEQ ID NO: 2502043 - RNA, 17 nt, Human
cuggcccagcccugcug

SEQ ID NO: 2502044 - RNA, 16 nt, Human
cuggcccagcccugcu

SEQ ID NO: 2502045 - RNA, 15 nt, Human
cuggcccagcccugc

SEQ ID NO: 2502046 - RNA, 14 nt, Human
cuggcccagcccug

SEQ ID NO: 2502047 - RNA, 15 nt, Human
cuggcccagccggcc

SEQ ID NO: 2502048 - RNA, 14 nt, Human
cuggcccagccggc

SEQ ID NO: 2502049 - RNA, 13 nt, Human
cuggcccagccgg

SEQ ID NO: 2502050 - RNA, 12 nt, Human
cuggcccagccg

SEQ ID NO: 2502051 - RNA, 18 nt, Human
cuggcccagccggccucu

SEQ ID NO: 2502052 - RNA, 16 nt, Human
cuggcccagccggccu

SEQ ID NO: 2502053 - RNA, 16 nt, Human
cuggcccagggcccag

SEQ ID NO: 2502054 - RNA, 11 nt, Human
cuggcccagcc

SEQ ID NO: 2502055 - RNA, 13 nt, Human
cuggcccagccaa

SEQ ID NO: 2502056 - RNA, 17 nt, Human
cuggcccagccaaaccc

SEQ ID NO: 2502057 - RNA, 20 nt, Human
cuggcccagccaaacccugu

SEQ ID NO: 2502058 - RNA, 13 nt, Human
cuggcccagcccu

SEQ ID NO: 2502059 - RNA, 10 nt, Human
cuggcccagc

SEQ ID NO: 2502060 - RNA, 23 nt, Human
cuggcccagccaaacccugucug

SEQ ID NO: 2502061 - RNA, 23 nt, Human
cuggccaguccaggcugccgugg

SEQ ID NO: 2502062 - RNA, 22 nt, Human
cuggccaguccaggcugccgug

SEQ ID NO: 2502063 - RNA, 21 nt, Human
cuggccaguggcuggaucugu

SEQ ID NO: 2502064 - RNA, 15 nt, Human
cuggcccacugcauc

SEQ ID NO: 2502065 - RNA, 17 nt, Human
cuggccaucccucgugg

SEQ ID NO: 2502066 - RNA, 18 nt, Human
cuggccaucccacaagug

SEQ ID NO: 2502067 - RNA, 16 nt, Human
cuggccaucuccaccc

SEQ ID NO: 2502068 - RNA, 23 nt, Human
cuggccaucccucguggucccca

SEQ ID NO: 2502069 - RNA, 17 nt, Human
cuggcccagggcccaga

SEQ ID NO: 2502070 - RNA, 18 nt, Human
cuggcccagggcccagag

SEQ ID NO: 2502071 - RNA, 19 nt, Human
cuggcccagggcccagagc

SEQ ID NO: 2502072 - RNA, 20 nt, Human
cuggcccagggcccagagcc

SEQ ID NO: 2502073 - RNA, 21 nt, Human
cuggcccagggcccagagccc

SEQ ID NO: 2502074 - RNA, 22 nt, Human
cuggcccagggcccagagccca

SEQ ID NO: 2502075 - RNA, 23 nt, Human
cuggcccagggcccagagcccag

SEQ ID NO: 2502076 - RNA, 16 nt, Human
cuggcccaucagugua

SEQ ID NO: 2502077 - RNA, 20 nt, Human
cuggccucugcacuccccug

SEQ ID NO: 2502078 - RNA, 18 nt, Human
cuggccucugcacucccc

SEQ ID NO: 2502079 - RNA, 21 nt, Human
cuggccucugcacuccccugc

SEQ ID NO: 2502080 - RNA, 18 nt, Human
cuggccuggacuguuuuc

SEQ ID NO: 2502081 - RNA, 14 nt, Human
cuggccuggacugu

SEQ ID NO: 2502082 - RNA, 16 nt, Human
cuggccucugcacucc

SEQ ID NO: 2502083 - RNA, 22 nt, Human
cuggccuucggccuccauccug

SEQ ID NO: 2502084 - RNA, 17 nt, Human
cuggccuggcuucuccu

SEQ ID NO: 2502085 - RNA, 14 nt, Human
cuggccuggcuucu

SEQ ID NO: 2502086 - RNA, 13 nt, Human
cuggccuggcuuc

SEQ ID NO: 2502087 - RNA, 14 nt, Human
cuggccuggccggc

SEQ ID NO: 2502088 - RNA, 15 nt, Human
cuggccuggccggca

SEQ ID NO: 2502089 - RNA, 24 nt, Human
cuggccuggccccucagggucccu

SEQ ID NO: 2502090 - RNA, 22 nt, Human
cuggccuggaucuccccacucu

SEQ ID NO: 2502091 - RNA, 21 nt, Human
cuggccuggaucuccccacuc

SEQ ID NO: 2502092 - RNA, 15 nt, Human
cuggccuggaucucc

SEQ ID NO: 2502093 - RNA, 14 nt, Human
cuggccuggaucuc

SEQ ID NO: 2502094 - RNA, 12 nt, Human
cuggccuggauc

SEQ ID NO: 2502095 - RNA, 22 nt, Human
cuggccuggacuguuuucucuc

SEQ ID NO: 2502096 - RNA, 17 nt, Human
cuggccuggcacacauc

SEQ ID NO: 2502097 - RNA, 16 nt, Human
cuggccuggcacacau

SEQ ID NO: 2502098 - RNA, 14 nt, Human
cuggccuggcacac

SEQ ID NO: 2502099 - RNA, 13 nt, Human
cuggccuggcaca

SEQ ID NO: 2502100 - RNA, 22 nt, Human
cuggccuggcacacaucaggag

SEQ ID NO: 2502101 - RNA, 18 nt, Human
cuggccuggcacacauca

SEQ ID NO: 2502102 - RNA, 19 nt, Human
cuggccuggccccucaggg

SEQ ID NO: 2502103 - RNA, 22 nt, Human
cuggcucuuccaggcugggaga

SEQ ID NO: 2502104 - RNA, 21 nt, Human
cuggcucuuccaggcugggag

SEQ ID NO: 2502105 - RNA, 13 nt, Human
cuggcgugugggu

SEQ ID NO: 2502106 - RNA, 15 nt, Human
cuggcgucugucuuc

SEQ ID NO: 2502107 - RNA, 22 nt, Human
cuggcgucugucuucaagggcu

SEQ ID NO: 2502108 - RNA, 23 nt, Human
cuggcgucugucuucaagggcuu

SEQ ID NO: 2502109 - RNA, 16 nt, Human
cuggcuaacuggaagc

SEQ ID NO: 2502110 - RNA, 20 nt, Human
cuggcuagaggccagcccca

SEQ ID NO: 2502111 - RNA, 21 nt, Human
cuggcuagaggccagccccac

SEQ ID NO: 2502112 - RNA, 22 nt, Human
cuggcuagaggccagccccacc

SEQ ID NO: 2502113 - RNA, 24 nt, Human
cuggcucuuccaggcugggagagc

SEQ ID NO: 2502114 - RNA, 13 nt, Human
cuggcugagcuga

SEQ ID NO: 2502115 - RNA, 18 nt, Human
cuggcugagccuggcugg

SEQ ID NO: 2502116 - RNA, 17 nt, Human
cuggcucuucugcccaa

SEQ ID NO: 2502117 - RNA, 16 nt, Human
cuggcucuucugccca

SEQ ID NO: 2502118 - RNA, 15 nt, Human
cuggcucuucugccc

SEQ ID NO: 2502119 - RNA, 17 nt, Human
cuggcuaacuggaagca

SEQ ID NO: 2502120 - RNA, 23 nt, Human
cuggcugagguuccucugccugc

SEQ ID NO: 2502121 - RNA, 22 nt, Human
cuggcugagguuccucugccug

SEQ ID NO: 2502122 - RNA, 21 nt, Human
cuggcugagguuccucugccu

SEQ ID NO: 2502123 - RNA, 20 nt, Human
cuggcugagguuccucugcc

SEQ ID NO: 2502124 - RNA, 23 nt, Human
cuggcugcagagcagugggccug

SEQ ID NO: 2502125 - RNA, 19 nt, Human
cuggcugagguuccucugc

SEQ ID NO: 2502126 - RNA, 17 nt, Human
cuggcugagguuccucu

SEQ ID NO: 2502127 - RNA, 21 nt, Human
cuggcugaggauuucaagccu

SEQ ID NO: 2502128 - RNA, 22 nt, Human
cuggcugaggauuucaagccug

SEQ ID NO: 2502129 - RNA, 15 nt, Human
cuggcgugcaguggu

SEQ ID NO: 2502130 - RNA, 14 nt, Human
cuggcgugcagugg

SEQ ID NO: 2502131 - RNA, 20 nt, Human
cuggcgggaugggccaccgc

SEQ ID NO: 2502132 - RNA, 19 nt, Human
cuggcgggaugggccaccg

SEQ ID NO: 2502133 - RNA, 16 nt, Human
cuggcgggaugggcca

SEQ ID NO: 2502134 - RNA, 13 nt, Human
cuggcgggauggg

SEQ ID NO: 2502135 - RNA, 22 nt, Human
cuggcguagaaguuuuuguacu

SEQ ID NO: 2502136 - RNA, 21 nt, Human
cuggcguagaaguuuuuguac

SEQ ID NO: 2502137 - RNA, 19 nt, Human
cuggcgucaugcaaaguca

SEQ ID NO: 2502138 - RNA, 18 nt, Human
cuggcgucaugcaaaguc

SEQ ID NO: 2502139 - RNA, 13 nt, Human
cuggcgucugucu

SEQ ID NO: 2502140 - RNA, 14 nt, Human
cuggcgucugucuu

SEQ ID NO: 2502141 - RNA, 23 nt, Human
cuggccuucggccuccauccuga

SEQ ID NO: 2502142 - RNA, 14 nt, Human
cuggccugugucua

SEQ ID NO: 2502143 - RNA, 19 nt, Human
cuggccuugaaaccaccuu

SEQ ID NO: 2502144 - RNA, 20 nt, Human
cuggcgccucugcaagggca

SEQ ID NO: 2502145 - RNA, 16 nt, Human
cuggcggcuacucagc

SEQ ID NO: 2502146 - RNA, 17 nt, Human
cuggcggcuacucagca

SEQ ID NO: 2502147 - RNA, 18 nt, Human
cuggcggcuacucagcag

SEQ ID NO: 2502148 - RNA, 20 nt, Human
cuggcggcuacucagcagcc

SEQ ID NO: 2502149 - RNA, 22 nt, Human
cuggcggcuacucagcagcccu

SEQ ID NO: 2502150 - RNA, 23 nt, Human
cuggcggcuacucagcagcccuc

SEQ ID NO: 2502151 - RNA, 15 nt, Human
cuggcgccucugcaa

SEQ ID NO: 2502152 - RNA, 14 nt, Human
cuggcgccucugca

SEQ ID NO: 2502153 - RNA, 13 nt, Human
cuggcgccucugc

SEQ ID NO: 2502154 - RNA, 12 nt, Human
cuggcgccucug

SEQ ID NO: 2502155 - RNA, 12 nt, Human
cuggagcucugc

SEQ ID NO: 2502156 - RNA, 13 nt, Human
cuggagcucugcc

SEQ ID NO: 2502157 - RNA, 16 nt, Human
cuggagcucugcccau

SEQ ID NO: 2502158 - RNA, 12 nt, Human
cuggaggcaggg

SEQ ID NO: 2502159 - RNA, 11 nt, Human
cuggagccugu

SEQ ID NO: 2502160 - RNA, 13 nt, Human
cuggaggcagggc

SEQ ID NO: 2502161 - RNA, 14 nt, Human
cuggaggcagggcc

SEQ ID NO: 2502162 - RNA, 15 nt, Human
cuggaggcagggccu

SEQ ID NO: 2502163 - RNA, 13 nt, Human
cuggaggcccagu

SEQ ID NO: 2502164 - RNA, 14 nt, Human
cuggaggcccaguu

SEQ ID NO: 2502165 - RNA, 15 nt, Human
cuggaggcccaguuc

SEQ ID NO: 2502166 - RNA, 20 nt, Human
cuggagggcuggaaucugga

SEQ ID NO: 2502167 - RNA, 19 nt, Human
cuggagggcuggaaucugg

SEQ ID NO: 2502168 - RNA, 21 nt, Human
cuggaggcccaguucacccug

SEQ ID NO: 2502169 - RNA, 22 nt, Human
cuggagggcuggaaucuggaga

SEQ ID NO: 2502170 - RNA, 15 nt, Human
cuggaggggacgcug

SEQ ID NO: 2502171 - RNA, 16 nt, Human
cuggaggggacgcugg

SEQ ID NO: 2502172 - RNA, 21 nt, Human
cuggaggggacgcugguagag

SEQ ID NO: 2502173 - RNA, 12 nt, Human
cuggaggcccag

SEQ ID NO: 2502174 - RNA, 23 nt, Human
cuggaggcagggccuugcccaga

SEQ ID NO: 2502175 - RNA, 16 nt, Human
cuggaggcagggccuu

SEQ ID NO: 2502176 - RNA, 19 nt, Human
cuggaggcagggccuugcc

SEQ ID NO: 2502177 - RNA, 20 nt, Human
cuggaggcagggccuugccc

SEQ ID NO: 2502178 - RNA, 22 nt, Human
cuggaggcagggccuugcccag

SEQ ID NO: 2502179 - RNA, 17 nt, Human
cuggagauccuccugca

SEQ ID NO: 2502180 - RNA, 16 nt, Human
cuggagauccuccugc

SEQ ID NO: 2502181 - RNA, 15 nt, Human
cuggagauccuccug

SEQ ID NO: 2502182 - RNA, 14 nt, Human
cuggagauccuccu

SEQ ID NO: 2502183 - RNA, 20 nt, Human
cuggagauccuccugcagac

SEQ ID NO: 2502184 - RNA, 18 nt, Human
cuggagauccuccugcag

SEQ ID NO: 2502185 - RNA, 23 nt, Human
cuggagauccuccugcagaccac

SEQ ID NO: 2502186 - RNA, 18 nt, Human
cuggagauguuuuagagu

SEQ ID NO: 2502187 - RNA, 23 nt, Human
cuggagcccagaggagggcagca

SEQ ID NO: 2502188 - RNA, 21 nt, Human
cuggagcccagaggagggcag

SEQ ID NO: 2502189 - RNA, 12 nt, Human
cuggagcccagg

SEQ ID NO: 2502190 - RNA, 13 nt, Human
cuggagcccagga

SEQ ID NO: 2502191 - RNA, 13 nt, Human
cuggagccccauc

SEQ ID NO: 2502192 - RNA, 14 nt, Human
cuggagcccaggga

SEQ ID NO: 2502193 - RNA, 13 nt, Human
cuggagcccaggg

SEQ ID NO: 2502194 - RNA, 17 nt, Human
cuggagcccagaggagg

SEQ ID NO: 2502195 - RNA, 15 nt, Human
cuggagcccaggagu

SEQ ID NO: 2502196 - RNA, 17 nt, Human
cuggagccuggugcccu

SEQ ID NO: 2502197 - RNA, 16 nt, Human
cuggagccuggugccc

SEQ ID NO: 2502198 - RNA, 15 nt, Human
cuggagccuggugcc

SEQ ID NO: 2502199 - RNA, 15 nt, Human
cuggagcccuugggu

SEQ ID NO: 2502200 - RNA, 16 nt, Human
cuggagccccugggug

SEQ ID NO: 2502201 - RNA, 15 nt, Human
cuggagccccugggu

SEQ ID NO: 2502202 - RNA, 14 nt, Human
cuggagccccuggg

SEQ ID NO: 2502203 - RNA, 12 nt, Human
cuggagccccug

SEQ ID NO: 2502204 - RNA, 18 nt, Human
cuggagccccuggguggg

SEQ ID NO: 2502205 - RNA, 17 nt, Human
cuggagccccugggugg

SEQ ID NO: 2502206 - RNA, 16 nt, Human
cuggagguugaagcca

SEQ ID NO: 2502207 - RNA, 22 nt, Human
cuggaggugggguugggauugg

SEQ ID NO: 2502208 - RNA, 20 nt, Human
cuggaggugggguugggauu

SEQ ID NO: 2502209 - RNA, 15 nt, Human
cuggaggugggguug

SEQ ID NO: 2502210 - RNA, 22 nt, Human
cuggagguggggccuggagcag

SEQ ID NO: 2502211 - RNA, 18 nt, Human
cuggagguggggccugga

SEQ ID NO: 2502212 - RNA, 22 nt, Human
cuggaggugggagcaggagauu

SEQ ID NO: 2502213 - RNA, 21 nt, Human
cuggaggugggagcaggagau

SEQ ID NO: 2502214 - RNA, 20 nt, Human
cuggaggugggagcaggaga

SEQ ID NO: 2502215 - RNA, 19 nt, Human
cuggaggugggagcaggag

SEQ ID NO: 2502216 - RNA, 18 nt, Human
cuggaggugggagcagga

SEQ ID NO: 2502217 - RNA, 17 nt, Human
cuggaggugggagcagg

SEQ ID NO: 2502218 - RNA, 16 nt, Human
cuggaggugggagcag

SEQ ID NO: 2502219 - RNA, 14 nt, Human
cuggaggugggagc

SEQ ID NO: 2502220 - RNA, 20 nt, Human
cuggagguggcugagccccu

SEQ ID NO: 2502221 - RNA, 23 nt, Human
cuggaggugccagcaaagcccca

SEQ ID NO: 2502222 - RNA, 22 nt, Human
cuggaggugccagcaaagcccc

SEQ ID NO: 2502223 - RNA, 19 nt, Human
cuggaggugccagcaaagc

SEQ ID NO: 2502224 - RNA, 16 nt, Human
cuggaggugccagcaa

SEQ ID NO: 2502225 - RNA, 21 nt, Human
cuggaggucacauucaggaag

SEQ ID NO: 2502226 - RNA, 19 nt, Human
cuggaggucacauucagga

SEQ ID NO: 2502227 - RNA, 22 nt, Human
cuggaggucacauucaggaaga

SEQ ID NO: 2502228 - RNA, 13 nt, Human
cuggaggugccag

SEQ ID NO: 2502229 - RNA, 22 nt, Human
cuggagguacgaaaagagggga

SEQ ID NO: 2502230 - RNA, 20 nt, Human
cuggagguaaggccuuugag

SEQ ID NO: 2502231 - RNA, 16 nt, Human
cuggagguaaggccuu

SEQ ID NO: 2502232 - RNA, 20 nt, Human
cuggagggguguggcuccuu

SEQ ID NO: 2502233 - RNA, 16 nt, Human
cuggagggguguggcu

SEQ ID NO: 2502234 - RNA, 17 nt, Human
cuggagguacgaaaaga

SEQ ID NO: 2502235 - RNA, 23 nt, Human
cuggaggggccccugcuucucca

SEQ ID NO: 2502236 - RNA, 17 nt, Human
cuggaggggccccugcu

SEQ ID NO: 2502237 - RNA, 16 nt, Human
cuggaggggccccugc

SEQ ID NO: 2502238 - RNA, 15 nt, Human
cuggaggggccccug

SEQ ID NO: 2502239 - RNA, 21 nt, Human
cuggaggggcuagaaccuaga

SEQ ID NO: 2502240 - RNA, 13 nt, Human
cuggaggggaggg

SEQ ID NO: 2502241 - RNA, 14 nt, Human
cuggaggggcaugg

SEQ ID NO: 2502242 - RNA, 14 nt, Human
cuggaggggccccu

SEQ ID NO: 2502243 - RNA, 12 nt, Human
cuggaggggccc

SEQ ID NO: 2502244 - RNA, 22 nt, Human
cuggaggggcauggccagcagc

SEQ ID NO: 2502245 - RNA, 23 nt, Human
cuggaggggcauggccagcagcu

SEQ ID NO: 2502246 - RNA, 17 nt, Human
cuggagugcagugagcc

SEQ ID NO: 2502247 - RNA, 16 nt, Human
cuggagugcagugagc

SEQ ID NO: 2502248 - RNA, 15 nt, Human
cuggagugcagugag

SEQ ID NO: 2502249 - RNA, 14 nt, Human
cuggagugcaguga

SEQ ID NO: 2502250 - RNA, 22 nt, Human
cuggagguugauaacuuugcuu

SEQ ID NO: 2502251 - RNA, 21 nt, Human
cuggagguugauaacuuugcu

SEQ ID NO: 2502252 - RNA, 19 nt, Human
cuggagguugauaacuuug

SEQ ID NO: 2502253 - RNA, 18 nt, Human
cuggagguugauaacuuu

SEQ ID NO: 2502254 - RNA, 17 nt, Human
cuggagguugauaacuu

SEQ ID NO: 2502255 - RNA, 15 nt, Human
cuggagguugauaac

SEQ ID NO: 2502256 - RNA, 19 nt, Human
cuggagguugaagccaagu

SEQ ID NO: 2502257 - RNA, 17 nt, Human
cuggagguugaagccaa

SEQ ID NO: 2502258 - RNA, 12 nt, Human
cuggagguuugu

SEQ ID NO: 2502259 - RNA, 17 nt, Human
cuggagguuuguuuaga

SEQ ID NO: 2502260 - RNA, 16 nt, Human
cuggagugcagggagg

SEQ ID NO: 2502261 - RNA, 12 nt, Human
cuggagugcagg

SEQ ID NO: 2502262 - RNA, 14 nt, Human
cuggagugaggggu

SEQ ID NO: 2502263 - RNA, 16 nt, Human
cuggaguccagucucu

SEQ ID NO: 2502264 - RNA, 14 nt, Human
cuggagucuccagu

SEQ ID NO: 2502265 - RNA, 15 nt, Human
cuggagugaggaaaa

SEQ ID NO: 2502266 - RNA, 15 nt, Human
cuggagucuccagug

SEQ ID NO: 2502267 - RNA, 15 nt, Human
cuggaguccagucuc

SEQ ID NO: 2502268 - RNA, 20 nt, Human
cuggagucaugccaagcauu

SEQ ID NO: 2502269 - RNA, 19 nt, Human
cuggaccccaucugugaau

SEQ ID NO: 2502270 - RNA, 20 nt, Human
cuggaccccaucugugaaua

SEQ ID NO: 2502271 - RNA, 22 nt, Human
cuggaccccaucugugaauaag

SEQ ID NO: 2502272 - RNA, 14 nt, Human
cuggacccccagcu

SEQ ID NO: 2502273 - RNA, 14 nt, Human
cuggacccuguugc

SEQ ID NO: 2502274 - RNA, 15 nt, Human
cuggacccuguggau

SEQ ID NO: 2502275 - RNA, 18 nt, Human
cuggacccuguugcuaag

SEQ ID NO: 2502276 - RNA, 17 nt, Human
cuggacccuguugcuaa

SEQ ID NO: 2502277 - RNA, 16 nt, Human
cuggacccuguugcua

SEQ ID NO: 2502278 - RNA, 15 nt, Human
cuggacccuguugcu

SEQ ID NO: 2502279 - RNA, 20 nt, Human
cuggaccuauguccuaagga

SEQ ID NO: 2502280 - RNA, 19 nt, Human
cuggaccuauguccuaagg

SEQ ID NO: 2502281 - RNA, 15 nt, Human
cuggaccuauguccu

SEQ ID NO: 2502282 - RNA, 16 nt, Human
cuggaccuugaacugg

SEQ ID NO: 2502283 - RNA, 12 nt, Human
cuggaccugccu

SEQ ID NO: 2502284 - RNA, 13 nt, Human
cuggacggcaggc

SEQ ID NO: 2502285 - RNA, 20 nt, Human
cuggaccugccuccugccug

SEQ ID NO: 2502286 - RNA, 21 nt, Human
cuggaccugccuccugccugc

SEQ ID NO: 2502287 - RNA, 17 nt, Human
cuggaccugccuccugc

SEQ ID NO: 2502288 - RNA, 15 nt, Human
cuggaccugccuccu

SEQ ID NO: 2502289 - RNA, 21 nt, Human
cuggaccuugaacuggguacu

SEQ ID NO: 2502290 - RNA, 20 nt, Human
cuggaccuugaacuggguac

SEQ ID NO: 2502291 - RNA, 17 nt, Human
cuggaccuugaacuggg

SEQ ID NO: 2502292 - RNA, 19 nt, Human
cuggacuccucuguccagg

SEQ ID NO: 2502293 - RNA, 18 nt, Human
cuggacuccucuguccag

SEQ ID NO: 2502294 - RNA, 18 nt, Human
cuggacuccggcccuccu

SEQ ID NO: 2502295 - RNA, 17 nt, Human
cuggacuccucugucca

SEQ ID NO: 2502296 - RNA, 14 nt, Human
cuggacuccucugu

SEQ ID NO: 2502297 - RNA, 22 nt, Human
cuggacggcaggcucacugcca

SEQ ID NO: 2502298 - RNA, 21 nt, Human
cuggacggcaggcucacugcc

SEQ ID NO: 2502299 - RNA, 20 nt, Human
cuggacggcaggcucacugc

SEQ ID NO: 2502300 - RNA, 14 nt, Human
cuggacggcaggcu

SEQ ID NO: 2502301 - RNA, 15 nt, Human
cuggacuccggcccu

SEQ ID NO: 2502302 - RNA, 13 nt, Human
cuggacuccggcc

SEQ ID NO: 2502303 - RNA, 17 nt, Human
cuggaccccaucuguga

SEQ ID NO: 2502304 - RNA, 18 nt, Human
cuggaccccaucugugaa

SEQ ID NO: 2502305 - RNA, 21 nt, Human
cuggaccaguggucucacaug

SEQ ID NO: 2502306 - RNA, 17 nt, Human
cuggacaggcauguucu

SEQ ID NO: 2502307 - RNA, 14 nt, Human
cuggacaggcaugu

SEQ ID NO: 2502308 - RNA, 16 nt, Human
cuggacacucagaccu

SEQ ID NO: 2502309 - RNA, 15 nt, Human
cuggacacucagacc

SEQ ID NO: 2502310 - RNA, 23 nt, Human
cuggacaggcauguucucugagg

SEQ ID NO: 2502311 - RNA, 14 nt, Human
cugcuuccuccugg

SEQ ID NO: 2502312 - RNA, 13 nt, Human
cugcuuccuccug

SEQ ID NO: 2502313 - RNA, 12 nt, Human
cugcuuccuccu

SEQ ID NO: 2502314 - RNA, 22 nt, Human
cugcuucccucugccugucccu

SEQ ID NO: 2502315 - RNA, 23 nt, Human
cugcuucccucugccugucccuc

SEQ ID NO: 2502316 - RNA, 14 nt, Human
cugcuucccauccu

SEQ ID NO: 2502317 - RNA, 13 nt, Human
cugcuucccaucc

SEQ ID NO: 2502318 - RNA, 12 nt, Human
cugcuucccauc

SEQ ID NO: 2502319 - RNA, 11 nt, Human
cugcuucccau

SEQ ID NO: 2502320 - RNA, 24 nt, Human
cugcuucccauccuacccucgggc

SEQ ID NO: 2502321 - RNA, 19 nt, Human
cugcuucccauccuacccu

SEQ ID NO: 2502322 - RNA, 18 nt, Human
cugcuucccauccuaccc

SEQ ID NO: 2502323 - RNA, 15 nt, Human
cugcuucccauccua

SEQ ID NO: 2502324 - RNA, 14 nt, Human
cugcuucccucugc

SEQ ID NO: 2502325 - RNA, 18 nt, Human
cugcuucccucugccugu

SEQ ID NO: 2502326 - RNA, 20 nt, Human
cugcuucccucugccugucc

SEQ ID NO: 2502327 - RNA, 21 nt, Human
cugcuucccucugccuguccc

SEQ ID NO: 2502328 - RNA, 23 nt, Human
cuggaauuugcaagucauggcug

SEQ ID NO: 2502329 - RNA, 22 nt, Human
cuggaauuugcaagucauggcu

SEQ ID NO: 2502330 - RNA, 21 nt, Human
cuggaauuugcaagucauggc

SEQ ID NO: 2502331 - RNA, 16 nt, Human
cugcuuccuccuggaa

SEQ ID NO: 2502332 - RNA, 15 nt, Human
cugcuuccuccugga

SEQ ID NO: 2502333 - RNA, 13 nt, Human
cuggaauuugaaa

SEQ ID NO: 2502334 - RNA, 21 nt, Human
cuggacaagccaacuuguaaa

SEQ ID NO: 2502335 - RNA, 15 nt, Human
cuggacaagccaacu

SEQ ID NO: 2502336 - RNA, 11 nt, Human
cuggacaagcc

SEQ ID NO: 2502337 - RNA, 18 nt, Human
cuggacaagcagaggugg

SEQ ID NO: 2502338 - RNA, 15 nt, Human
cuggacaagcagagg

SEQ ID NO: 2502339 - RNA, 22 nt, Human
cuggacaccgggccaguaucua

SEQ ID NO: 2502340 - RNA, 23 nt, Human
cuggacaagccaacuuguaaaua

SEQ ID NO: 2502341 - RNA, 17 nt, Human
cuggacaccgggccagu

SEQ ID NO: 2502342 - RNA, 14 nt, Human
cugcugcugucccu

SEQ ID NO: 2502343 - RNA, 15 nt, Human
cugcugcuggcuggu

SEQ ID NO: 2502344 - RNA, 21 nt, Human
cugcugcuaaucuucagggca

SEQ ID NO: 2502345 - RNA, 19 nt, Human
cugcugccgccccacccag

SEQ ID NO: 2502346 - RNA, 14 nt, Human
cugcugccgccucc

SEQ ID NO: 2502347 - RNA, 17 nt, Human
cugcugccgccucccag

SEQ ID NO: 2502348 - RNA, 19 nt, Human
cugcugccgccucccagcc

SEQ ID NO: 2502349 - RNA, 21 nt, Human
cugcugcgcccuuaccuuccc

SEQ ID NO: 2502350 - RNA, 20 nt, Human
cugcugcgcccuuaccuucc

SEQ ID NO: 2502351 - RNA, 17 nt, Human
cugcugcgcccuuaccu

SEQ ID NO: 2502352 - RNA, 18 nt, Human
cugcugcgcccugggcuc

SEQ ID NO: 2502353 - RNA, 17 nt, Human
cugcugcgcccugggcu

SEQ ID NO: 2502354 - RNA, 20 nt, Human
cugcugccgccccacccaga

SEQ ID NO: 2502355 - RNA, 16 nt, Human
cugcugcgcccugggc

SEQ ID NO: 2502356 - RNA, 15 nt, Human
cugcuggccuggauc

SEQ ID NO: 2502357 - RNA, 14 nt, Human
cugcuggccuggau

SEQ ID NO: 2502358 - RNA, 13 nt, Human
cugcuggccugga

SEQ ID NO: 2502359 - RNA, 12 nt, Human
cugcuggccugg

SEQ ID NO: 2502360 - RNA, 18 nt, Human
cugcuggccgccucaccc

SEQ ID NO: 2502361 - RNA, 15 nt, Human
cugcuggccgccuca

SEQ ID NO: 2502362 - RNA, 20 nt, Human
cugcuggccgccucaccccc

SEQ ID NO: 2502363 - RNA, 16 nt, Human
cugcuggccggagcaa

SEQ ID NO: 2502364 - RNA, 15 nt, Human
cugcuggccggagca

SEQ ID NO: 2502365 - RNA, 11 nt, Human
cugcuggcccc

SEQ ID NO: 2502366 - RNA, 14 nt, Human
cugcuggccccuca

SEQ ID NO: 2502367 - RNA, 15 nt, Human
cugcuggccccucac

SEQ ID NO: 2502368 - RNA, 16 nt, Human
cugcuggccccucacc

SEQ ID NO: 2502369 - RNA, 17 nt, Human
cugcuggccccucaccu

SEQ ID NO: 2502370 - RNA, 13 nt, Human
cugcuggccgccu

SEQ ID NO: 2502371 - RNA, 23 nt, Human
cugcuggccccucaccugggcac

SEQ ID NO: 2502372 - RNA, 17 nt, Human
cugcuggcacccaccgu

SEQ ID NO: 2502373 - RNA, 16 nt, Human
cugcuggcacccaccg

SEQ ID NO: 2502374 - RNA, 15 nt, Human
cugcuggcccagcca

SEQ ID NO: 2502375 - RNA, 16 nt, Human
cugcuggcccagccaa

SEQ ID NO: 2502376 - RNA, 22 nt, Human
cugcuggcccagccaaacccug

SEQ ID NO: 2502377 - RNA, 21 nt, Human
cugcuggaucacagcugcuuu

SEQ ID NO: 2502378 - RNA, 21 nt, Human
cugcuggaguuucauguacaa

SEQ ID NO: 2502379 - RNA, 14 nt, Human
cugcuggcacccac

SEQ ID NO: 2502380 - RNA, 23 nt, Human
cugcuggaucacagcugcuuucu

SEQ ID NO: 2502381 - RNA, 21 nt, Human
cugcuggcacauuuccccaga

SEQ ID NO: 2502382 - RNA, 20 nt, Human
cugcuggaguuucauguaca

SEQ ID NO: 2502383 - RNA, 11 nt, Human
cugcuggagga

SEQ ID NO: 2502384 - RNA, 13 nt, Human
cugcugcuguguu

SEQ ID NO: 2502385 - RNA, 13 nt, Human
cugcugcuucuua

SEQ ID NO: 2502386 - RNA, 15 nt, Human
cugcuggacaguauc

SEQ ID NO: 2502387 - RNA, 20 nt, Human
cugcuggacaguaucacugu

SEQ ID NO: 2502388 - RNA, 22 nt, Human
cugcuggacaguaucacugucu

SEQ ID NO: 2502389 - RNA, 22 nt, Human
cugcugcuuuuugagguggcac

SEQ ID NO: 2502390 - RNA, 20 nt, Human
cugcugcuuuuugagguggc

SEQ ID NO: 2502391 - RNA, 15 nt, Human
cugcuggaaacagac

SEQ ID NO: 2502392 - RNA, 23 nt, Human
cugcugguucaggguuggccccu

SEQ ID NO: 2502393 - RNA, 15 nt, Human
cugcugguucagggu

SEQ ID NO: 2502394 - RNA, 19 nt, Human
cugcugggcuggggccuga

SEQ ID NO: 2502395 - RNA, 18 nt, Human
cugcugggcuggggccug

SEQ ID NO: 2502396 - RNA, 21 nt, Human
cugcugggcuggggccugaug

SEQ ID NO: 2502397 - RNA, 13 nt, Human
cugcugguucagg

SEQ ID NO: 2502398 - RNA, 17 nt, Human
cugcuggcgccucugca

SEQ ID NO: 2502399 - RNA, 16 nt, Human
cugcuggcgccucugc

SEQ ID NO: 2502400 - RNA, 15 nt, Human
cugcuggcgccucug

SEQ ID NO: 2502401 - RNA, 14 nt, Human
cugcuggcgccucu

SEQ ID NO: 2502402 - RNA, 20 nt, Human
cugcuggccuggccggcaac

SEQ ID NO: 2502403 - RNA, 16 nt, Human
cugcuggccuggccgg

SEQ ID NO: 2502404 - RNA, 13 nt, Human
cugcuggccuggc

SEQ ID NO: 2502405 - RNA, 16 nt, Human
cugcuggccuggaucu

SEQ ID NO: 2502406 - RNA, 19 nt, Human
cugcuggcucuucugccca

SEQ ID NO: 2502407 - RNA, 12 nt, Human
cugcuggcucuu

SEQ ID NO: 2502408 - RNA, 20 nt, Human
cugcuggcgccucugcaagg

SEQ ID NO: 2502409 - RNA, 18 nt, Human
cugcuggcgccucugcaa

SEQ ID NO: 2502410 - RNA, 15 nt, Human
cugcugggcucucca

SEQ ID NO: 2502411 - RNA, 17 nt, Human
cugcugggcuggggccu

SEQ ID NO: 2502412 - RNA, 15 nt, Human
cugcugggcuggggc

SEQ ID NO: 2502413 - RNA, 14 nt, Human
cugcugggcugggg

SEQ ID NO: 2502414 - RNA, 13 nt, Human
cugcugggcuggg

SEQ ID NO: 2502415 - RNA, 11 nt, Human
cugcugggcuu

SEQ ID NO: 2502416 - RNA, 16 nt, Human
cugcugggcucuccac

SEQ ID NO: 2502417 - RNA, 17 nt, Human
cugcugggcucuccacc

SEQ ID NO: 2502418 - RNA, 18 nt, Human
cugcugggcucuccaccu

SEQ ID NO: 2502419 - RNA, 19 nt, Human
cugcugggcucuccaccuc

SEQ ID NO: 2502420 - RNA, 21 nt, Human
cugcugggcucuccaccucag

SEQ ID NO: 2502421 - RNA, 22 nt, Human
cugcugggcucuccaccucagc

SEQ ID NO: 2502422 - RNA, 12 nt, Human
cugcugggcugg

SEQ ID NO: 2502423 - RNA, 23 nt, Human
cugcugggcucuccaccucagcc

SEQ ID NO: 2502424 - RNA, 23 nt, Human
cugcuuccagugaggcucugccc

SEQ ID NO: 2502425 - RNA, 21 nt, Human
cugcuuccagugaggcucugc

SEQ ID NO: 2502426 - RNA, 20 nt, Human
cugcuuccagugaggcucug

SEQ ID NO: 2502427 - RNA, 19 nt, Human
cugcuuccagugaggcucu

SEQ ID NO: 2502428 - RNA, 18 nt, Human
cugcuuccagugaggcuc

SEQ ID NO: 2502429 - RNA, 16 nt, Human
cugcuuccagugaggc

SEQ ID NO: 2502430 - RNA, 15 nt, Human
cugcuuccagugagg

SEQ ID NO: 2502431 - RNA, 21 nt, Human
cugcugguuaacuuguuuggc

SEQ ID NO: 2502432 - RNA, 18 nt, Human
cugcugcaggggcucugg

SEQ ID NO: 2502433 - RNA, 17 nt, Human
cugcugcaggggcucug

SEQ ID NO: 2502434 - RNA, 16 nt, Human
cugcugcaggggcucu

SEQ ID NO: 2502435 - RNA, 14 nt, Human
cugcugcaggggcu

SEQ ID NO: 2502436 - RNA, 13 nt, Human
cugcugcaggggc

SEQ ID NO: 2502437 - RNA, 12 nt, Human
cugcugcagggg

SEQ ID NO: 2502438 - RNA, 11 nt, Human
cugcugcaggg

SEQ ID NO: 2502439 - RNA, 23 nt, Human
cugcugcagaggggcaggcccug

SEQ ID NO: 2502440 - RNA, 20 nt, Human
cugcugcaggggcucuggag

SEQ ID NO: 2502441 - RNA, 19 nt, Human
cugcugcaggggcucugga

SEQ ID NO: 2502442 - RNA, 22 nt, Human
cugcugccauggcgugucccuc

SEQ ID NO: 2502443 - RNA, 16 nt, Human
cugcugcauggggugg

SEQ ID NO: 2502444 - RNA, 21 nt, Human
cugcugcccccaccccgggga

SEQ ID NO: 2502445 - RNA, 22 nt, Human
cugcugcccccaccccggggac

SEQ ID NO: 2502446 - RNA, 12 nt, Human
cugcugcccagg

SEQ ID NO: 2502447 - RNA, 15 nt, Human
cugcugcccccaccc

SEQ ID NO: 2502448 - RNA, 12 nt, Human
cugcugcccucc

SEQ ID NO: 2502449 - RNA, 17 nt, Human
cugcugcccuccauccc

SEQ ID NO: 2502450 - RNA, 13 nt, Human
cugcugcccucca

SEQ ID NO: 2502451 - RNA, 14 nt, Human
cugcugcccuccau

SEQ ID NO: 2502452 - RNA, 22 nt, Human
cugcugcccagccuccaagcuc

SEQ ID NO: 2502453 - RNA, 14 nt, Human
cugcugcccccacc

SEQ ID NO: 2502454 - RNA, 15 nt, Human
cugcugcccagccuc

SEQ ID NO: 2502455 - RNA, 12 nt, Human
cugcugcccagc

SEQ ID NO: 2502456 - RNA, 21 nt, Human
cugcugcaaggccuuucugug

SEQ ID NO: 2502457 - RNA, 19 nt, Human
cugcugcaaggccuuucug

SEQ ID NO: 2502458 - RNA, 16 nt, Human
cugcugcaaggccuuu

SEQ ID NO: 2502459 - RNA, 15 nt, Human
cugcugcaaggccuu

SEQ ID NO: 2502460 - RNA, 13 nt, Human
cugcugcaaggcc

SEQ ID NO: 2502461 - RNA, 11 nt, Human
cugcugaaggc

SEQ ID NO: 2502462 - RNA, 23 nt, Human
cugcugcaccaacccagccgcug

SEQ ID NO: 2502463 - RNA, 20 nt, Human
cugcugcaccaacccagccg

SEQ ID NO: 2502464 - RNA, 19 nt, Human
cugcugcaccaacccagcc

SEQ ID NO: 2502465 - RNA, 18 nt, Human
cugcugcaccaacccagc

SEQ ID NO: 2502466 - RNA, 17 nt, Human
cugcugcaccaacccag

SEQ ID NO: 2502467 - RNA, 15 nt, Human
cugcugcaccaaccc

SEQ ID NO: 2502468 - RNA, 23 nt, Human
cugcugcaaggccuuucugugug

SEQ ID NO: 2502469 - RNA, 22 nt, Human
cugcugcaaggccuuucugugu

SEQ ID NO: 2502470 - RNA, 22 nt, Human
cugcugcagaggggcaggcccu

SEQ ID NO: 2502471 - RNA, 21 nt, Human
cugcugcagaggggcaggccc

SEQ ID NO: 2502472 - RNA, 18 nt, Human
cugcugcagaggggcagg

SEQ ID NO: 2502473 - RNA, 17 nt, Human
cugcugcagaggggcag

SEQ ID NO: 2502474 - RNA, 16 nt, Human
cugcugcagaggggca

SEQ ID NO: 2502475 - RNA, 20 nt, Human
cugcugaagcugccugcuuu

SEQ ID NO: 2502476 - RNA, 19 nt, Human
cugcugaagcugccugcuu

SEQ ID NO: 2502477 - RNA, 16 nt, Human
cugcugaagcugccug

SEQ ID NO: 2502478 - RNA, 15 nt, Human
cugcugaagcugccu

SEQ ID NO: 2502479 - RNA, 21 nt, Human
cugcugaagaugaaucaaugg

SEQ ID NO: 2502480 - RNA, 15 nt, Human
cugcucuccuuccug

SEQ ID NO: 2502481 - RNA, 18 nt, Human
cugcugaaggaauaaauu

SEQ ID NO: 2502482 - RNA, 17 nt, Human
cugcugaaggaauaaau

SEQ ID NO: 2502483 - RNA, 13 nt, Human
cugcucuccuucc

SEQ ID NO: 2502484 - RNA, 12 nt, Human
cugcucuccuuc

SEQ ID NO: 2502485 - RNA, 21 nt, Human
cugcucuccucuugccacugc

SEQ ID NO: 2502486 - RNA, 18 nt, Human
cugcugaaacaacaaaua

SEQ ID NO: 2502487 - RNA, 23 nt, Human
cugcuccucccuggcugcccugg

SEQ ID NO: 2502488 - RNA, 22 nt, Human
cugcuccucccuggcugcccug

SEQ ID NO: 2502489 - RNA, 13 nt, Human
cugcuccucucca

SEQ ID NO: 2502490 - RNA, 20 nt, Human
cugcucuccucuugccacug

SEQ ID NO: 2502491 - RNA, 14 nt, Human
cugcucuccucuug

SEQ ID NO: 2502492 - RNA, 21 nt, Human
cugcuccucccuggcugcccu

SEQ ID NO: 2502493 - RNA, 20 nt, Human
cugcuccucccuggcugccc

SEQ ID NO: 2502494 - RNA, 19 nt, Human
cugcuccucccuggcugcc

SEQ ID NO: 2502495 - RNA, 18 nt, Human
cugcuccucccuggcugc

SEQ ID NO: 2502496 - RNA, 17 nt, Human
cugcuccucccuggcug

SEQ ID NO: 2502497 - RNA, 16 nt, Human
cugcuccucccuggcu

SEQ ID NO: 2502498 - RNA, 15 nt, Human
cugcuccucccuggc

SEQ ID NO: 2502499 - RNA, 14 nt, Human
cugcuccucccugg

SEQ ID NO: 2502500 - RNA, 19 nt, Human
cugcucuccgaccagacac

SEQ ID NO: 2502501 - RNA, 20 nt, Human
cugcgaucuucagagcaggg

SEQ ID NO: 2502502 - RNA, 14 nt, Human
cugcuccuagaggg

SEQ ID NO: 2502503 - RNA, 15 nt, Human
cugcuccuagaggga

SEQ ID NO: 2502504 - RNA, 17 nt, Human
cugcuccuagagggagg

SEQ ID NO: 2502505 - RNA, 21 nt, Human
cugcuccuagagggaggggcc

SEQ ID NO: 2502506 - RNA, 22 nt, Human
cugcuccuagagggaggggccu

SEQ ID NO: 2502507 - RNA, 12 nt, Human
cugcuccuccag

SEQ ID NO: 2502508 - RNA, 11 nt, Human
cugcuccucca

SEQ ID NO: 2502509 - RNA, 13 nt, Human
cugcuccucaugg

SEQ ID NO: 2502510 - RNA, 14 nt, Human
cugcuccucauggu

SEQ ID NO: 2502511 - RNA, 13 nt, Human
cugcuccuccagg

SEQ ID NO: 2502512 - RNA, 14 nt, Human
cugcuccuccaggg

SEQ ID NO: 2502513 - RNA, 16 nt, Human
cugcuccuccagggcc

SEQ ID NO: 2502514 - RNA, 17 nt, Human
cugcuccuccagggcca

SEQ ID NO: 2502515 - RNA, 13 nt, Human
cugcuccucccug

SEQ ID NO: 2502516 - RNA, 12 nt, Human
cugcuccucccu

SEQ ID NO: 2502517 - RNA, 22 nt, Human
cugcuccuccagggccacgugc

SEQ ID NO: 2502518 - RNA, 24 nt, Human
cugcuccuccagggccacgugcca

SEQ ID NO: 2502519 - RNA, 18 nt, Human
cugccuuuauuguguuug

SEQ ID NO: 2502520 - RNA, 17 nt, Human
cugccuuuauuguguuu

SEQ ID NO: 2502521 - RNA, 15 nt, Human
cugccuuuauugugu

SEQ ID NO: 2502522 - RNA, 17 nt, Human
cugcgacuuucugccug

SEQ ID NO: 2502523 - RNA, 16 nt, Human
cugcgacuuucugccu

SEQ ID NO: 2502524 - RNA, 14 nt, Human
cugcgacuuucugc

SEQ ID NO: 2502525 - RNA, 19 nt, Human
cugcgaccacaagaaggau

SEQ ID NO: 2502526 - RNA, 14 nt, Human
cugccuuguguaca

SEQ ID NO: 2502527 - RNA, 12 nt, Human
cugccuuuauug

SEQ ID NO: 2502528 - RNA, 20 nt, Human
cugccuuuagucgcugagga

SEQ ID NO: 2502529 - RNA, 17 nt, Human
cugcgauuuugccugug

SEQ ID NO: 2502530 - RNA, 19 nt, Human
cugcgaucuucagagcagg

SEQ ID NO: 2502531 - RNA, 17 nt, Human
cugcgaucuucagagca

SEQ ID NO: 2502532 - RNA, 14 nt, Human
cugcgaucuucaga

SEQ ID NO: 2502533 - RNA, 20 nt, Human
cugcuccagcuguucagcug

SEQ ID NO: 2502534 - RNA, 19 nt, Human
cugcuccagcuguucagcu

SEQ ID NO: 2502535 - RNA, 19 nt, Human
cugcgacuuucugccugga

SEQ ID NO: 2502536 - RNA, 18 nt, Human
cugcgacuuucugccugg

SEQ ID NO: 2502537 - RNA, 20 nt, Human
cugcgacuuucugccuggag

SEQ ID NO: 2502538 - RNA, 15 nt, Human
cugccgaccagagcc

SEQ ID NO: 2502539 - RNA, 16 nt, Human
cugccgaccagagccc

SEQ ID NO: 2502540 - RNA, 16 nt, Human
cugccgaccgaggcug

SEQ ID NO: 2502541 - RNA, 21 nt, Human
cugccgaccgaggcuggagcu

SEQ ID NO: 2502542 - RNA, 22 nt, Human
cugccgaccgaggcuggagcug

SEQ ID NO: 2502543 - RNA, 13 nt, Human
cugccgaccagag

SEQ ID NO: 2502544 - RNA, 21 nt, Human
cugcccuuucugggcaccggg

SEQ ID NO: 2502545 - RNA, 16 nt, Human
cugcccuugucugaga

SEQ ID NO: 2502546 - RNA, 23 nt, Human
cugcccuugucccacucaagcca

SEQ ID NO: 2502547 - RNA, 22 nt, Human
cugcccuuccucaguuuaaucc

SEQ ID NO: 2502548 - RNA, 15 nt, Human
cugcccuugucccac

SEQ ID NO: 2502549 - RNA, 17 nt, Human
cugcccuugucccacuc

SEQ ID NO: 2502550 - RNA, 18 nt, Human
cugcccuugucccacuca

SEQ ID NO: 2502551 - RNA, 15 nt, Human
cugccgcagcccugc

SEQ ID NO: 2502552 - RNA, 17 nt, Human
cugccgcaacaguuuuu

SEQ ID NO: 2502553 - RNA, 14 nt, Human
cugccgcagcccug

SEQ ID NO: 2502554 - RNA, 15 nt, Human
cugccgacuccuggg

SEQ ID NO: 2502555 - RNA, 14 nt, Human
cugccgacuccugg

SEQ ID NO: 2502556 - RNA, 19 nt, Human
cugccgacuccuggguuga

SEQ ID NO: 2502557 - RNA, 23 nt, Human
cugccgaccgaggcuggagcugg

SEQ ID NO: 2502558 - RNA, 15 nt, Human
cugccgaccucgucc

SEQ ID NO: 2502559 - RNA, 17 nt, Human
cugccgaccucguccuc

SEQ ID NO: 2502560 - RNA, 19 nt, Human
cugccgaccucguccuccc

SEQ ID NO: 2502561 - RNA, 18 nt, Human
cugccgcagcccugcaga

SEQ ID NO: 2502562 - RNA, 17 nt, Human
cugccgcagcccugcag

SEQ ID NO: 2502563 - RNA, 14 nt, Human
cugccggguucuag

SEQ ID NO: 2502564 - RNA, 18 nt, Human
cugccgcaauacaggaac

SEQ ID NO: 2502565 - RNA, 17 nt, Human
cugccgcaauacaggaa

SEQ ID NO: 2502566 - RNA, 19 nt, Human
cugccgcaauacaggaacc

SEQ ID NO: 2502567 - RNA, 22 nt, Human
cugccggcucuuuccuugcuca

SEQ ID NO: 2502568 - RNA, 20 nt, Human
cugccggcucuuuccuugcu

SEQ ID NO: 2502569 - RNA, 14 nt, Human
cugccggcucuuuc

SEQ ID NO: 2502570 - RNA, 21 nt, Human
cugccguggggccgccgccuc

SEQ ID NO: 2502571 - RNA, 20 nt, Human
cugccguggggccgccgccu

SEQ ID NO: 2502572 - RNA, 13 nt, Human
cugccguggggcc

SEQ ID NO: 2502573 - RNA, 23 nt, Human
cugccggguucuagucuccuuug

SEQ ID NO: 2502574 - RNA, 21 nt, Human
cugccggguucuagucuccuu

SEQ ID NO: 2502575 - RNA, 20 nt, Human
cugccggguucuagucuccu

SEQ ID NO: 2502576 - RNA, 19 nt, Human
cugccggguucuagucucc

SEQ ID NO: 2502577 - RNA, 18 nt, Human
cugccgguaaacacgccu

SEQ ID NO: 2502578 - RNA, 21 nt, Human
cugccgguaaacacgccugca

SEQ ID NO: 2502579 - RNA, 12 nt, Human
cugcccucaugg

SEQ ID NO: 2502580 - RNA, 20 nt, Human
cugcccugcgggucacagga

SEQ ID NO: 2502581 - RNA, 13 nt, Human
cugcccucaggga

SEQ ID NO: 2502582 - RNA, 11 nt, Human
cugcccugcug

SEQ ID NO: 2502583 - RNA, 15 nt, Human
cugcccuggcccuga

SEQ ID NO: 2502584 - RNA, 14 nt, Human
cugcccuggcccug

SEQ ID NO: 2502585 - RNA, 13 nt, Human
cugcccuggcccu

SEQ ID NO: 2502586 - RNA, 12 nt, Human
cugcccuggccc

SEQ ID NO: 2502587 - RNA, 16 nt, Human
cugcccugccugaggg

SEQ ID NO: 2502588 - RNA, 22 nt, Human
cugcccugcugagucccaggcu

SEQ ID NO: 2502589 - RNA, 21 nt, Human
cugcccugcugccgccuccca

SEQ ID NO: 2502590 - RNA, 22 nt, Human
cugcccugcugccgccucccag

SEQ ID NO: 2502591 - RNA, 22 nt, Human
cugcccuggcccugaggugugg

SEQ ID NO: 2502592 - RNA, 18 nt, Human
cugcccuggcccugaggu

SEQ ID NO: 2502593 - RNA, 17 nt, Human
cugcccuggcccugagg

SEQ ID NO: 2502594 - RNA, 16 nt, Human
cugcccuggcccugag

SEQ ID NO: 2502595 - RNA, 14 nt, Human
cugcccuggcugcu

SEQ ID NO: 2502596 - RNA, 23 nt, Human
cugcccuggcccugagguguggg

SEQ ID NO: 2502597 - RNA, 12 nt, Human
cugcccuggcug

SEQ ID NO: 2502598 - RNA, 15 nt, Human
cugcccuuccucagu

SEQ ID NO: 2502599 - RNA, 14 nt, Human
cugcccuuccucag

SEQ ID NO: 2502600 - RNA, 17 nt, Human
cugcccuggcugcugcc

SEQ ID NO: 2502601 - RNA, 16 nt, Human
cugcccuggcugcugc

SEQ ID NO: 2502602 - RNA, 12 nt, Human
cugcccuuccuc

SEQ ID NO: 2502603 - RNA, 17 nt, Human
cucccuucccaccucuc

SEQ ID NO: 2502604 - RNA, 16 nt, Human
cucccuucccaccucu

SEQ ID NO: 2502605 - RNA, 15 nt, Human
cucccuucccaccuc

SEQ ID NO: 2502606 - RNA, 14 nt, Human
cucccuucccaccu

SEQ ID NO: 2502607 - RNA, 12 nt, Human
cugcccuccaag

SEQ ID NO: 2502608 - RNA, 19 nt, Human
cugcccucauggccccucu

SEQ ID NO: 2502609 - RNA, 12 nt, Human
cugcccucaggg

SEQ ID NO: 2502610 - RNA, 18 nt, Human
cugcccuaggcuccguca

SEQ ID NO: 2502611 - RNA, 15 nt, Human
cugcccuagagcaca

SEQ ID NO: 2502612 - RNA, 19 nt, Human
cucccuucaugcauggaaa

SEQ ID NO: 2502613 - RNA, 19 nt, Human
cugcccuagagcacacugu

SEQ ID NO: 2502614 - RNA, 21 nt, Human
cugcccuagagcacacuguag

SEQ ID NO: 2502615 - RNA, 15 nt, Human
cugcccuagcuccac

SEQ ID NO: 2502616 - RNA, 16 nt, Human
cugcccuagcuccaca

SEQ ID NO: 2502617 - RNA, 22 nt, Human
cugcccuagcuccacacccucu

SEQ ID NO: 2502618 - RNA, 12 nt, Human
cugcccuaggcu

SEQ ID NO: 2502619 - RNA, 19 nt, Human
cugccucucugcagguccc

SEQ ID NO: 2502620 - RNA, 15 nt, Human
cugccucugagggaa

SEQ ID NO: 2502621 - RNA, 14 nt, Human
cugccucugaggga

SEQ ID NO: 2502622 - RNA, 22 nt, Human
cugccuccccaacccugccccu

SEQ ID NO: 2502623 - RNA, 21 nt, Human
cugccucugagggaaagccca

SEQ ID NO: 2502624 - RNA, 14 nt, Human
cugccucugccugc

SEQ ID NO: 2502625 - RNA, 17 nt, Human
cugccucugccugcauu

SEQ ID NO: 2502626 - RNA, 20 nt, Human
cugccucugccugcauucug

SEQ ID NO: 2502627 - RNA, 16 nt, Human
cugccucuucugggag

SEQ ID NO: 2502628 - RNA, 17 nt, Human
cugccucuucugggagg

SEQ ID NO: 2502629 - RNA, 15 nt, Human
cugccucuucucuac

SEQ ID NO: 2502630 - RNA, 17 nt, Human
cugccugcccaggcccc

SEQ ID NO: 2502631 - RNA, 16 nt, Human
cugccugcccaggccc

SEQ ID NO: 2502632 - RNA, 16 nt, Human
cugccucuucuguggg

SEQ ID NO: 2502633 - RNA, 22 nt, Human
cugccucuucugggagggcagc

SEQ ID NO: 2502634 - RNA, 15 nt, Human
cugccugaagucaca

SEQ ID NO: 2502635 - RNA, 20 nt, Human
cugccugcccaggccccugc

SEQ ID NO: 2502636 - RNA, 18 nt, Human
cugccucugccugcauuc

SEQ ID NO: 2502637 - RNA, 17 nt, Human
cugccugaaccuuccau

SEQ ID NO: 2502638 - RNA, 12 nt, Human
cugccuggccag

SEQ ID NO: 2502639 - RNA, 13 nt, Human
cugccuggccagg

SEQ ID NO: 2502640 - RNA, 15 nt, Human
cugccuggccaggca

SEQ ID NO: 2502641 - RNA, 21 nt, Human
cugccuggccaggcagaucug

SEQ ID NO: 2502642 - RNA, 16 nt, Human
cugccuggccaggcag

SEQ ID NO: 2502643 - RNA, 17 nt, Human
cugccuggccaggcaga

SEQ ID NO: 2502644 - RNA, 18 nt, Human
cugccuggcccccugucc

SEQ ID NO: 2502645 - RNA, 14 nt, Human
cugccuggccccca

SEQ ID NO: 2502646 - RNA, 16 nt, Human
cugccuggcccccagc

SEQ ID NO: 2502647 - RNA, 20 nt, Human
cugccuggcccccagcugug

SEQ ID NO: 2502648 - RNA, 21 nt, Human
cugccugggaucccucauccu

SEQ ID NO: 2502649 - RNA, 15 nt, Human
cugccuuggcucaga

SEQ ID NO: 2502650 - RNA, 17 nt, Human
cugccuuggcucagaca

SEQ ID NO: 2502651 - RNA, 18 nt, Human
cugccuuggcucagacau

SEQ ID NO: 2502652 - RNA, 22 nt, Human
cugccuuggcucagacauguuu

SEQ ID NO: 2502653 - RNA, 14 nt, Human
cugccuuggcucag

SEQ ID NO: 2502654 - RNA, 19 nt, Human
cugccucccaucacccgcu

SEQ ID NO: 2502655 - RNA, 16 nt, Human
cugccucccaucaccc

SEQ ID NO: 2502656 - RNA, 14 nt, Human
cugccucccaucac

SEQ ID NO: 2502657 - RNA, 12 nt, Human
cugccucccauc

SEQ ID NO: 2502658 - RNA, 14 nt, Human
cugccgugugcccu

SEQ ID NO: 2502659 - RNA, 11 nt, Human
cugccucccau

SEQ ID NO: 2502660 - RNA, 13 nt, Human
cugccuaagcccu

SEQ ID NO: 2502661 - RNA, 23 nt, Human
cugccucugacacacagcucugu

SEQ ID NO: 2502662 - RNA, 22 nt, Human
cugccucugacacacagcucug

SEQ ID NO: 2502663 - RNA, 22 nt, Human
cugccucucugcaggucccuaa

SEQ ID NO: 2502664 - RNA, 15 nt, Human
cugccucugacacac

SEQ ID NO: 2502665 - RNA, 21 nt, Human
cugccucucugcaggucccua

SEQ ID NO: 2502666 - RNA, 20 nt, Human
cugccucucugcaggucccu

SEQ ID NO: 2502667 - RNA, 15 nt, Human
cugccuccccaaccc

SEQ ID NO: 2502668 - RNA, 16 nt, Human
cugccuccccaacccu

SEQ ID NO: 2502669 - RNA, 18 nt, Human
cugccuccccaacccugc

SEQ ID NO: 2502670 - RNA, 19 nt, Human
cugccuccccaacccugcc

SEQ ID NO: 2502671 - RNA, 16 nt, Human
cugccucccauucuga

SEQ ID NO: 2502672 - RNA, 18 nt, Human
cugccuccauucugacca

SEQ ID NO: 2502673 - RNA, 12 nt, Human
cugccuccccaa

SEQ ID NO: 2502674 - RNA, 14 nt, Human
cugccuccccaacc

SEQ ID NO: 2502675 - RNA, 23 nt, Human
gagcaggaagcauucagagagca

SEQ ID NO: 2502676 - RNA, 16 nt, Human
gagcaggaagcauuca

SEQ ID NO: 2502677 - RNA, 23 nt, Human
gagcagcuuuaaacucagggaca

SEQ ID NO: 2502678 - RNA, 22 nt, Human
gagcagcuuuaaacucagggac

SEQ ID NO: 2502679 - RNA, 21 nt, Human
gagcagcuuuaaacucaggga

SEQ ID NO: 2502680 - RNA, 18 nt, Human
gagcagcuuuaaacucag

SEQ ID NO: 2502681 - RNA, 17 nt, Human
gagcagcuuuaaacuca

SEQ ID NO: 2502682 - RNA, 21 nt, Human
gagcagcuucugccacuuccc

SEQ ID NO: 2502683 - RNA, 20 nt, Human
gagcagcuucugccacuucc

SEQ ID NO: 2502684 - RNA, 17 nt, Human
gagcagcuucugccacu

SEQ ID NO: 2502685 - RNA, 16 nt, Human
gagcagcuucugccac

SEQ ID NO: 2502686 - RNA, 15 nt, Human
gagcagcuucaguug

SEQ ID NO: 2502687 - RNA, 22 nt, Human
gagcaggaagcauucagagagc

SEQ ID NO: 2502688 - RNA, 22 nt, Human
gagcaggaccucugaaacccug

SEQ ID NO: 2502689 - RNA, 17 nt, Human
gagcauuacgugagcca

SEQ ID NO: 2502690 - RNA, 12 nt, Human
gagcagagacca

SEQ ID NO: 2502691 - RNA, 18 nt, Human
gagcagcgguuuggggag

SEQ ID NO: 2502692 - RNA, 16 nt, Human
gagcagagaauucucu

SEQ ID NO: 2502693 - RNA, 23 nt, Human
gagcagacuggugagcagacugg

SEQ ID NO: 2502694 - RNA, 15 nt, Human
gagcagacugguggg

SEQ ID NO: 2502695 - RNA, 12 nt, Human
gagcagagacac

SEQ ID NO: 2502696 - RNA, 13 nt, Human
gagcagagacacu

SEQ ID NO: 2502697 - RNA, 21 nt, Human
gagcagagacacuaacgacuu

SEQ ID NO: 2502698 - RNA, 24 nt, Human
gagcagagacaugacucagccugu

SEQ ID NO: 2502699 - RNA, 19 nt, Human
gagccaauuuaaagaaaac

SEQ ID NO: 2502700 - RNA, 19 nt, Human
gagccaaggguucagagac

SEQ ID NO: 2502701 - RNA, 20 nt, Human
gagccagauuucacucuccu

SEQ ID NO: 2502702 - RNA, 23 nt, Human
gagccaaggguucagagacucag

SEQ ID NO: 2502703 - RNA, 14 nt, Human
gagccaaguccaga

SEQ ID NO: 2502704 - RNA, 15 nt, Human
gagcauuagauuucu

SEQ ID NO: 2502705 - RNA, 21 nt, Human
gagcauuagauuucucauuug

SEQ ID NO: 2502706 - RNA, 20 nt, Human
gagcauuacgugagccaggu

SEQ ID NO: 2502707 - RNA, 18 nt, Human
gagcauuacgugagccag

SEQ ID NO: 2502708 - RNA, 21 nt, Human
gagcauuacgugagccaggua

SEQ ID NO: 2502709 - RNA, 17 nt, Human
gagcauugccauucccu

SEQ ID NO: 2502710 - RNA, 23 nt, Human
gagcauuuccaacaccacagaca

SEQ ID NO: 2502711 - RNA, 15 nt, Human
gagcauuggcugaga

SEQ ID NO: 2502712 - RNA, 19 nt, Human
gagcauuguggcugucagc

SEQ ID NO: 2502713 - RNA, 17 nt, Human
gagcauuuagggcaagg

SEQ ID NO: 2502714 - RNA, 21 nt, Human
gagccaagaucgcgccacugc

SEQ ID NO: 2502715 - RNA, 15 nt, Human
gagccaacugcugcu

SEQ ID NO: 2502716 - RNA, 14 nt, Human
gagccaacugcugc

SEQ ID NO: 2502717 - RNA, 20 nt, Human
gagccaacagaagcuuccau

SEQ ID NO: 2502718 - RNA, 23 nt, Human
gagcccaggaguucgaggcugca

SEQ ID NO: 2502719 - RNA, 18 nt, Human
gagcccugguggcagugg

SEQ ID NO: 2502720 - RNA, 13 nt, Human
gagcccagcuggg

SEQ ID NO: 2502721 - RNA, 19 nt, Human
gagcccagcugggucaggc

SEQ ID NO: 2502722 - RNA, 21 nt, Human
gagcccagcugggucaggcag

SEQ ID NO: 2502723 - RNA, 22 nt, Human
gagcccagcugggucaggcagg

SEQ ID NO: 2502724 - RNA, 11 nt, Human
gagcccaggag

SEQ ID NO: 2502725 - RNA, 12 nt, Human
gagcccaggagu

SEQ ID NO: 2502726 - RNA, 22 nt, Human
gagcccagagguaacagaacag

SEQ ID NO: 2502727 - RNA, 21 nt, Human
gagcccagagguaacagaaca

SEQ ID NO: 2502728 - RNA, 22 nt, Human
gagcccagaggagggcagcaga

SEQ ID NO: 2502729 - RNA, 14 nt, Human
gagcccagaggagg

SEQ ID NO: 2502730 - RNA, 23 nt, Human
gagcccagagguaacagaacagc

SEQ ID NO: 2502731 - RNA, 15 nt, Human
gagcccagcccuccc

SEQ ID NO: 2502732 - RNA, 22 nt, Human
gagcccagccauuaccauggag

SEQ ID NO: 2502733 - RNA, 14 nt, Human
gagcccagcucuga

SEQ ID NO: 2502734 - RNA, 21 nt, Human
gagcccagcucugaaaccagu

SEQ ID NO: 2502735 - RNA, 12 nt, Human
gagcccagcucu

SEQ ID NO: 2502736 - RNA, 14 nt, Human
gagcccagcuccaa

SEQ ID NO: 2502737 - RNA, 12 nt, Human
gagcccagcucc

SEQ ID NO: 2502738 - RNA, 13 nt, Human
gagcccagcucca

SEQ ID NO: 2502739 - RNA, 18 nt, Human
gagcccagcccuccccau

SEQ ID NO: 2502740 - RNA, 19 nt, Human
gagccagggucucacuaug

SEQ ID NO: 2502741 - RNA, 18 nt, Human
gagccaguaaacagagga

SEQ ID NO: 2502742 - RNA, 22 nt, Human
gagccagguaaugagggacugg

SEQ ID NO: 2502743 - RNA, 19 nt, Human
gagccagguaaugagggac

SEQ ID NO: 2502744 - RNA, 18 nt, Human
gagccagguaaugaggga

SEQ ID NO: 2502745 - RNA, 15 nt, Human
gagccagcccucccu

SEQ ID NO: 2502746 - RNA, 19 nt, Human
gagcccacuguccugggcc

SEQ ID NO: 2502747 - RNA, 24 nt, Human
gagcccacuguccugggccugcag

SEQ ID NO: 2502748 - RNA, 23 nt, Human
gagcccacuguacuugcucuuga

SEQ ID NO: 2502749 - RNA, 23 nt, Human
gagccaguucaguaccuggagga

SEQ ID NO: 2502750 - RNA, 22 nt, Human
gagccaguucaguaccuggagg

SEQ ID NO: 2502751 - RNA, 19 nt, Human
gagccauauaaguuugaag

SEQ ID NO: 2502752 - RNA, 15 nt, Human
gagccagucccaggg

SEQ ID NO: 2502753 - RNA, 13 nt, Human
gagccagucccag

SEQ ID NO: 2502754 - RNA, 21 nt, Human
gagccaguucaguaccuggag

SEQ ID NO: 2502755 - RNA, 19 nt, Human
gagccaguucaguaccugg

SEQ ID NO: 2502756 - RNA, 23 nt, Human
gagccagcagacauugucagcaa

SEQ ID NO: 2502757 - RNA, 22 nt, Human
gagccagcagacauugucagca

SEQ ID NO: 2502758 - RNA, 20 nt, Human
gagccagcagacauugucag

SEQ ID NO: 2502759 - RNA, 17 nt, Human
gagccagcagacauugu

SEQ ID NO: 2502760 - RNA, 15 nt, Human
gagccagcagacauu

SEQ ID NO: 2502761 - RNA, 12 nt, Human
gagccagcagac

SEQ ID NO: 2502762 - RNA, 23 nt, Human
gagccagauuucacucuccuugg

SEQ ID NO: 2502763 - RNA, 14 nt, Human
gagccagggucuca

SEQ ID NO: 2502764 - RNA, 12 nt, Human
gagccagcccuc

SEQ ID NO: 2502765 - RNA, 13 nt, Human
gagccagcccucc

SEQ ID NO: 2502766 - RNA, 14 nt, Human
gagccagcccuccc

SEQ ID NO: 2502767 - RNA, 21 nt, Human
gagccagcagccuggcucucc

SEQ ID NO: 2502768 - RNA, 16 nt, Human
gagauagccaaggcca

SEQ ID NO: 2502769 - RNA, 23 nt, Human
gagaucaaccccuucgcuccugu

SEQ ID NO: 2502770 - RNA, 14 nt, Human
gagauagccaaggc

SEQ ID NO: 2502771 - RNA, 23 nt, Human
gagauagcauugugaacugacag

SEQ ID NO: 2502772 - RNA, 20 nt, Human
gagauagcauugugaacuga

SEQ ID NO: 2502773 - RNA, 16 nt, Human
gagauagcauugugaa

SEQ ID NO: 2502774 - RNA, 15 nt, Human
gagauagcauuguga

SEQ ID NO: 2502775 - RNA, 12 nt, Human
gagauagcauug

SEQ ID NO: 2502776 - RNA, 16 nt, Human
gagauagaagaacugc

SEQ ID NO: 2502777 - RNA, 19 nt, Human
gagaucacgccacugcacu

SEQ ID NO: 2502778 - RNA, 21 nt, Human
gagauccaaaagaagccccca

SEQ ID NO: 2502779 - RNA, 22 nt, Human
gagauccaaaagaagcccccag

SEQ ID NO: 2502780 - RNA, 20 nt, Human
gagaucauccuuuccagcau

SEQ ID NO: 2502781 - RNA, 16 nt, Human
gagaucauccuuucca

SEQ ID NO: 2502782 - RNA, 18 nt, Human
gagaucaggcucugccuc

SEQ ID NO: 2502783 - RNA, 13 nt, Human
gagaucaggcucu

SEQ ID NO: 2502784 - RNA, 18 nt, Human
gagaucacgccacugcac

SEQ ID NO: 2502785 - RNA, 16 nt, Human
gagaucacgccacugc

SEQ ID NO: 2502786 - RNA, 22 nt, Human
gagaugauacauccaaagcaga

SEQ ID NO: 2502787 - RNA, 17 nt, Human
gagaugaggccgccaug

SEQ ID NO: 2502788 - RNA, 21 nt, Human
gagaugacugaguccucguag

SEQ ID NO: 2502789 - RNA, 16 nt, Human
gagcaaaggcugagaa

SEQ ID NO: 2502790 - RNA, 13 nt, Human
gagcaaaggcuga

SEQ ID NO: 2502791 - RNA, 18 nt, Human
gagaugaugaaaauauuu

SEQ ID NO: 2502792 - RNA, 14 nt, Human
gagcaaagucuaaa

SEQ ID NO: 2502793 - RNA, 22 nt, Human
gagcaaaggcugagaacacugu

SEQ ID NO: 2502794 - RNA, 22 nt, Human
gagcaaaggggucccauagagg

SEQ ID NO: 2502795 - RNA, 19 nt, Human
gagcaaagucuaaaguuua

SEQ ID NO: 2502796 - RNA, 16 nt, Human
gagcaaagucuaaagu

SEQ ID NO: 2502797 - RNA, 14 nt, Human
gagcaaagugaggg

SEQ ID NO: 2502798 - RNA, 20 nt, Human
gagcaaagugaagacacugg

SEQ ID NO: 2502799 - RNA, 12 nt, Human
gagauccuccug

SEQ ID NO: 2502800 - RNA, 17 nt, Human
gagaucccgccucuucu

SEQ ID NO: 2502801 - RNA, 15 nt, Human
gagaugaagcaaaca

SEQ ID NO: 2502802 - RNA, 18 nt, Human
gagaugaagcaaacacau

SEQ ID NO: 2502803 - RNA, 13 nt, Human
gagaugacugagu

SEQ ID NO: 2502804 - RNA, 16 nt, Human
gagaugacugaguccu

SEQ ID NO: 2502805 - RNA, 16 nt, Human
gagaugaauuaaauuu

SEQ ID NO: 2502806 - RNA, 21 nt, Human
gagaugaagagugagagggca

SEQ ID NO: 2502807 - RNA, 20 nt, Human
gagaugaagcaaacacauua

SEQ ID NO: 2502808 - RNA, 22 nt, Human
gagcaccuuagacagucccugc

SEQ ID NO: 2502809 - RNA, 21 nt, Human
gagcaccuuagacagucccug

SEQ ID NO: 2502810 - RNA, 16 nt, Human
gagcaccuuccucacu

SEQ ID NO: 2502811 - RNA, 15 nt, Human
gagcacuaaggugug

SEQ ID NO: 2502812 - RNA, 20 nt, Human
gagcacggccaacaaagcug

SEQ ID NO: 2502813 - RNA, 20 nt, Human
gagcaccuuccucacuucca

SEQ ID NO: 2502814 - RNA, 19 nt, Human
gagcaccuuccucacuucc

SEQ ID NO: 2502815 - RNA, 17 nt, Human
gagcaccuuccucacuu

SEQ ID NO: 2502816 - RNA, 15 nt, Human
gagcacucccaaguc

SEQ ID NO: 2502817 - RNA, 21 nt, Human
gagcacuaaggugugcucuga

SEQ ID NO: 2502818 - RNA, 18 nt, Human
gagcagacuggugagcag

SEQ ID NO: 2502819 - RNA, 19 nt, Human
gagcagacuggugagcaga

SEQ ID NO: 2502820 - RNA, 20 nt, Human
gagcagacuggugagcagac

SEQ ID NO: 2502821 - RNA, 20 nt, Human
gagcacucccaagucuacag

SEQ ID NO: 2502822 - RNA, 13 nt, Human
gagcaagagcugg

SEQ ID NO: 2502823 - RNA, 12 nt, Human
gagcaagagcug

SEQ ID NO: 2502824 - RNA, 14 nt, Human
gagcaagacucugu

SEQ ID NO: 2502825 - RNA, 12 nt, Human
gagcaagacucu

SEQ ID NO: 2502826 - RNA, 19 nt, Human
gagcaaauguuucugcagu

SEQ ID NO: 2502827 - RNA, 16 nt, Human
gagcaaauguuucugc

SEQ ID NO: 2502828 - RNA, 15 nt, Human
gagcaaauguuucug

SEQ ID NO: 2502829 - RNA, 14 nt, Human
gagcaaauguuucu

SEQ ID NO: 2502830 - RNA, 20 nt, Human
gagcaacagagugagacccu

SEQ ID NO: 2502831 - RNA, 13 nt, Human
gagcaacauuuua

SEQ ID NO: 2502832 - RNA, 20 nt, Human
gagcaccuuagacagucccu

SEQ ID NO: 2502833 - RNA, 17 nt, Human
gagcaaugucugugcua

SEQ ID NO: 2502834 - RNA, 16 nt, Human
gagcaaugucugugcu

SEQ ID NO: 2502835 - RNA, 15 nt, Human
gagcaaugucugugc

SEQ ID NO: 2502836 - RNA, 14 nt, Human
gagcaagagcuggc

SEQ ID NO: 2502837 - RNA, 20 nt, Human
gagcaagcauuuauguuuau

SEQ ID NO: 2502838 - RNA, 18 nt, Human
gagcaaguuccuucuggu

SEQ ID NO: 2502839 - RNA, 21 nt, Human
gagcaagucugcaggugcacc

SEQ ID NO: 2502840 - RNA, 16 nt, Human
gagcaagucugcaggu

SEQ ID NO: 2502841 - RNA, 15 nt, Human
gagcaagucugcagg

SEQ ID NO: 2502842 - RNA, 13 nt, Human
gagcaagucugca

SEQ ID NO: 2502843 - RNA, 20 nt, Human
gagcaaggguucccucaaga

SEQ ID NO: 2502844 - RNA, 18 nt, Human
gagagucccagagcagga

SEQ ID NO: 2502845 - RNA, 17 nt, Human
gagagucccagagcagg

SEQ ID NO: 2502846 - RNA, 15 nt, Human
gagagucccagagca

SEQ ID NO: 2502847 - RNA, 22 nt, Human
gagagucccacugccucagguu

SEQ ID NO: 2502848 - RNA, 15 nt, Human
gagaguccucuggau

SEQ ID NO: 2502849 - RNA, 19 nt, Human
gagagucccagagcaggag

SEQ ID NO: 2502850 - RNA, 13 nt, Human
gagaguggcuccu

SEQ ID NO: 2502851 - RNA, 21 nt, Human
gagagucccacugccucaggu

SEQ ID NO: 2502852 - RNA, 20 nt, Human
gagagucccacugccucagg

SEQ ID NO: 2502853 - RNA, 15 nt, Human
gagagucccacugcc

SEQ ID NO: 2502854 - RNA, 15 nt, Human
gagaguauauuaugu

SEQ ID NO: 2502855 - RNA, 17 nt, Human
gagagucauauuuugau

SEQ ID NO: 2502856 - RNA, 15 nt, Human
gagaguagaacagau

SEQ ID NO: 2502857 - RNA, 18 nt, Human
gagaguagccgagagccu

SEQ ID NO: 2502858 - RNA, 20 nt, Human
gagaguagccgagagccugc

SEQ ID NO: 2502859 - RNA, 21 nt, Human
gagaguagccgagagccugcu

SEQ ID NO: 2502860 - RNA, 22 nt, Human
gagaguagccgagagccugcuc

SEQ ID NO: 2502861 - RNA, 22 nt, Human
gagaguucaauggcugcugaag

SEQ ID NO: 2502862 - RNA, 21 nt, Human
gagaguucaauggcugcugaa

SEQ ID NO: 2502863 - RNA, 15 nt, Human
gagauaccagcgagg

SEQ ID NO: 2502864 - RNA, 20 nt, Human
gagaguucaauggcugcuga

SEQ ID NO: 2502865 - RNA, 21 nt, Human
gagagugucuucacggcagga

SEQ ID NO: 2502866 - RNA, 20 nt, Human
gagagugugaaauagacauu

SEQ ID NO: 2502867 - RNA, 21 nt, Human
gagaguggcuccucccggugc

SEQ ID NO: 2502868 - RNA, 16 nt, Human
gagaguggcuccuccc

SEQ ID NO: 2502869 - RNA, 19 nt, Human
gagaggggaacagacugga

SEQ ID NO: 2502870 - RNA, 17 nt, Human
gagaggggaagggccag

SEQ ID NO: 2502871 - RNA, 16 nt, Human
gagaggggaagggcca

SEQ ID NO: 2502872 - RNA, 22 nt, Human
gagaggggaagaguguacuggg

SEQ ID NO: 2502873 - RNA, 21 nt, Human
gagaggggaagaguguacugg

SEQ ID NO: 2502874 - RNA, 20 nt, Human
gagaggggaagaguguacug

SEQ ID NO: 2502875 - RNA, 18 nt, Human
gagaggggaagaguguac

SEQ ID NO: 2502876 - RNA, 22 nt, Human
gagagccugcucccccaccccc

SEQ ID NO: 2502877 - RNA, 22 nt, Human
gagaggggacaaaacccaccuu

SEQ ID NO: 2502878 - RNA, 21 nt, Human
gagaggggacaaaacccaccu

SEQ ID NO: 2502879 - RNA, 18 nt, Human
gagaggggaagggccagu

SEQ ID NO: 2502880 - RNA, 21 nt, Human
gagaggggaauaauagaagaa

SEQ ID NO: 2502881 - RNA, 13 nt, Human
gagaggggcacag

SEQ ID NO: 2502882 - RNA, 16 nt, Human
gagagggugggagugg

SEQ ID NO: 2502883 - RNA, 20 nt, Human
gagagggugggagugggccc

SEQ ID NO: 2502884 - RNA, 16 nt, Human
gagaguacagugagcc

SEQ ID NO: 2502885 - RNA, 19 nt, Human
gagaguacagugagccaag

SEQ ID NO: 2502886 - RNA, 14 nt, Human
gagagggugggagu

SEQ ID NO: 2502887 - RNA, 13 nt, Human
gagagggucugga

SEQ ID NO: 2502888 - RNA, 13 nt, Human
gagagggugacaa

SEQ ID NO: 2502889 - RNA, 18 nt, Human
gagagggucuggagaagc

SEQ ID NO: 2502890 - RNA, 18 nt, Human
gagagggggccaccuccc

SEQ ID NO: 2502891 - RNA, 18 nt, Human
gagagaccucaucaggau

SEQ ID NO: 2502892 - RNA, 17 nt, Human
gagagaccucaucagga

SEQ ID NO: 2502893 - RNA, 15 nt, Human
gagagaccucaucag

SEQ ID NO: 2502894 - RNA, 20 nt, Human
gagagacguguacauagugu

SEQ ID NO: 2502895 - RNA, 17 nt, Human
gagagacguguacauag

SEQ ID NO: 2502896 - RNA, 16 nt, Human
gagagacguguacaua

SEQ ID NO: 2502897 - RNA, 19 nt, Human
gagagacguguacauagug

SEQ ID NO: 2502898 - RNA, 16 nt, Human
gagagaccaggcaaag

SEQ ID NO: 2502899 - RNA, 14 nt, Human
gagagaccaggcaa

SEQ ID NO: 2502900 - RNA, 14 nt, Human
gagagacccaagga

SEQ ID NO: 2502901 - RNA, 15 nt, Human
gagagacccaaggag

SEQ ID NO: 2502902 - RNA, 19 nt, Human
gagagacccaaggaggaaa

SEQ ID NO: 2502903 - RNA, 20 nt, Human
gagagacccaaggaggaaaa

SEQ ID NO: 2502904 - RNA, 18 nt, Human
gagagagaaagccaggca

SEQ ID NO: 2502905 - RNA, 15 nt, Human
gagagagaaagccag

SEQ ID NO: 2502906 - RNA, 12 nt, Human
gagagagaaagc

SEQ ID NO: 2502907 - RNA, 23 nt, Human
gagagagaagugccccugcugcc

SEQ ID NO: 2502908 - RNA, 13 nt, Human
gagagagagagga

SEQ ID NO: 2502909 - RNA, 14 nt, Human
gagagagagagagg

SEQ ID NO: 2502910 - RNA, 14 nt, Human
gagagagagagaga

SEQ ID NO: 2502911 - RNA, 13 nt, Human
gagagagaggaca

SEQ ID NO: 2502912 - RNA, 12 nt, Human
gagagagaggac

SEQ ID NO: 2502913 - RNA, 14 nt, Human
gagagagagaggac

SEQ ID NO: 2502914 - RNA, 13 nt, Human
gagagagagaggu

SEQ ID NO: 2502915 - RNA, 22 nt, Human
gagagagcuucuguugcugccu

SEQ ID NO: 2502916 - RNA, 19 nt, Human
gagagagcuucuguugcug

SEQ ID NO: 2502917 - RNA, 15 nt, Human
gagagagcagcuucu

SEQ ID NO: 2502918 - RNA, 21 nt, Human
gagagcaggcuggcagcucuc

SEQ ID NO: 2502919 - RNA, 17 nt, Human
gagagcaggcuggcagc

SEQ ID NO: 2502920 - RNA, 14 nt, Human
gagagcaggcuggc

SEQ ID NO: 2502921 - RNA, 13 nt, Human
gagagcaggcugg

SEQ ID NO: 2502922 - RNA, 23 nt, Human
gagagcagcuuuaaacucaggga

SEQ ID NO: 2502923 - RNA, 21 nt, Human
gagagcagcuuuaaacucagg

SEQ ID NO: 2502924 - RNA, 22 nt, Human
gagagcagcuucugccacuucc

SEQ ID NO: 2502925 - RNA, 19 nt, Human
gagagcagcuucugccacu

SEQ ID NO: 2502926 - RNA, 18 nt, Human
gagagcagcuucugccac

SEQ ID NO: 2502927 - RNA, 16 nt, Human
gagagcagcuucugcc

SEQ ID NO: 2502928 - RNA, 20 nt, Human
gagagcaacucugagaucua

SEQ ID NO: 2502929 - RNA, 17 nt, Human
gagagcaacucugagau

SEQ ID NO: 2502930 - RNA, 13 nt, Human
gagagcaacucug

SEQ ID NO: 2502931 - RNA, 18 nt, Human
gagagaugggagcuccuc

SEQ ID NO: 2502932 - RNA, 19 nt, Human
gagagagcagcuucugcca

SEQ ID NO: 2502933 - RNA, 13 nt, Human
gagagagcuggag

SEQ ID NO: 2502934 - RNA, 15 nt, Human
gagagcaacauuuua

SEQ ID NO: 2502935 - RNA, 16 nt, Human
gagagcccuucauuug

SEQ ID NO: 2502936 - RNA, 14 nt, Human
gagagccugcuccc

SEQ ID NO: 2502937 - RNA, 17 nt, Human
gagagccugcuccccca

SEQ ID NO: 2502938 - RNA, 21 nt, Human
gagagccugcucccccacccc

SEQ ID NO: 2502939 - RNA, 15 nt, Human
gagagccccagcuga

SEQ ID NO: 2502940 - RNA, 14 nt, Human
gagagccccagcug

SEQ ID NO: 2502941 - RNA, 13 nt, Human
gagagccccagcu

SEQ ID NO: 2502942 - RNA, 13 nt, Human
gagagcccagcca

SEQ ID NO: 2502943 - RNA, 20 nt, Human
gagagcccggcgccccugcc

SEQ ID NO: 2502944 - RNA, 15 nt, Human
gagagcccgggagcu

SEQ ID NO: 2502945 - RNA, 18 nt, Human
gagagccccucacacagc

SEQ ID NO: 2502946 - RNA, 18 nt, Human
gagagaaaauaaaaaguu

SEQ ID NO: 2502947 - RNA, 19 nt, Human
gagagaaaauaaaaaguua

SEQ ID NO: 2502948 - RNA, 20 nt, Human
gagagaaaauaaaaaguuaa

SEQ ID NO: 2502949 - RNA, 21 nt, Human
gagagaaaauaaaaaguuaaa

SEQ ID NO: 2502950 - RNA, 16 nt, Human
gagagaaaauaaaaag

SEQ ID NO: 2502951 - RNA, 17 nt, Human
gagagaaaauaaaaagu

SEQ ID NO: 2502952 - RNA, 19 nt, Human
gagagaaagccaggcaggu

SEQ ID NO: 2502953 - RNA, 18 nt, Human
gagagaaagccaggcagg

SEQ ID NO: 2502954 - RNA, 21 nt, Human
gagagaaagccaggcagguag

SEQ ID NO: 2502955 - RNA, 16 nt, Human
gagagaaagccaggca

SEQ ID NO: 2502956 - RNA, 11 nt, Human
gagagaaagaa

SEQ ID NO: 2502957 - RNA, 18 nt, Human
gagagaaagugggugaga

SEQ ID NO: 2502958 - RNA, 17 nt, Human
gagagaaagugggugag

SEQ ID NO: 2502959 - RNA, 15 nt, Human
gagagaaagugggug

SEQ ID NO: 2502960 - RNA, 22 nt, Human
gagagaaagugggugagaugcu

SEQ ID NO: 2502961 - RNA, 20 nt, Human
gagagaaagugggugagaug

SEQ ID NO: 2502962 - RNA, 22 nt, Human
gagagaaagugugagcaaacua

SEQ ID NO: 2502963 - RNA, 19 nt, Human
gagacuggggggcuugaaa

SEQ ID NO: 2502964 - RNA, 18 nt, Human
gagacuggggggcuugaa

SEQ ID NO: 2502965 - RNA, 16 nt, Human
gagacuggggggcuug

SEQ ID NO: 2502966 - RNA, 14 nt, Human
gagacuggggggcu

SEQ ID NO: 2502967 - RNA, 23 nt, Human
gagacugguccugugugcaguga

SEQ ID NO: 2502968 - RNA, 16 nt, Human
gagacugguccugugu

SEQ ID NO: 2502969 - RNA, 15 nt, Human
gagacugggcugagg

SEQ ID NO: 2502970 - RNA, 17 nt, Human
gagacugggcugaggga

SEQ ID NO: 2502971 - RNA, 20 nt, Human
gagacugggcugagggagcc

SEQ ID NO: 2502972 - RNA, 21 nt, Human
gagacugggcugagggagccu

SEQ ID NO: 2502973 - RNA, 13 nt, Human
gagacugggcuga

SEQ ID NO: 2502974 - RNA, 14 nt, Human
gagacugggcugag

SEQ ID NO: 2502975 - RNA, 21 nt, Human
gagacugggaagauaggcucu

SEQ ID NO: 2502976 - RNA, 14 nt, Human
gagacucuggccuc

SEQ ID NO: 2502977 - RNA, 13 nt, Human
gagacucuggccu

SEQ ID NO: 2502978 - RNA, 12 nt, Human
gagacucuggcc

SEQ ID NO: 2502979 - RNA, 19 nt, Human
gagacucucuuaggagcag

SEQ ID NO: 2502980 - RNA, 20 nt, Human
gagacuggagcaucugacuc

SEQ ID NO: 2502981 - RNA, 13 nt, Human
gagacugggaaga

SEQ ID NO: 2502982 - RNA, 21 nt, Human
gagacuccugcaggcagccag

SEQ ID NO: 2502983 - RNA, 20 nt, Human
gagacuccugcaggcagcca

SEQ ID NO: 2502984 - RNA, 18 nt, Human
gagaccaugcagagcgcc

SEQ ID NO: 2502985 - RNA, 16 nt, Human
gagacaguuucuuagc

SEQ ID NO: 2502986 - RNA, 23 nt, Human
gagacaguugggugagaacaacc

SEQ ID NO: 2502987 - RNA, 19 nt, Human
gagacuccugcaggcagcc

SEQ ID NO: 2502988 - RNA, 21 nt, Human
gagacucgcgacaaugcaaac

SEQ ID NO: 2502989 - RNA, 20 nt, Human
gagacucgcgacaaugcaaa

SEQ ID NO: 2502990 - RNA, 17 nt, Human
gagaccaugcagagcgc

SEQ ID NO: 2502991 - RNA, 13 nt, Human
gagacucugucuc

SEQ ID NO: 2502992 - RNA, 21 nt, Human
gagaaugagagacacacugaa

SEQ ID NO: 2502993 - RNA, 20 nt, Human
gagaaugagagacacacuga

SEQ ID NO: 2502994 - RNA, 23 nt, Human
gagaaugcacaaacagaggccgc

SEQ ID NO: 2502995 - RNA, 15 nt, Human
gagaauggaaaacag

SEQ ID NO: 2502996 - RNA, 20 nt, Human
gagacagcucugcauacuca

SEQ ID NO: 2502997 - RNA, 16 nt, Human
gagaauguaagaacua

SEQ ID NO: 2502998 - RNA, 15 nt, Human
gagaauguaagaacu

SEQ ID NO: 2502999 - RNA, 20 nt, Human
gagaauggcgugaacccggg

SEQ ID NO: 2503000 - RNA, 21 nt, Human
gagaauguagauauugugaag

SEQ ID NO: 2503001 - RNA, 19 nt, Human
gagacaggaaaauccucug

SEQ ID NO: 2503002 - RNA, 20 nt, Human
gagacaggaaaauccucugg

SEQ ID NO: 2503003 - RNA, 21 nt, Human
gagacaggaaaauccucuggc

SEQ ID NO: 2503004 - RNA, 15 nt, Human
gagacaggagggcaa

SEQ ID NO: 2503005 - RNA, 12 nt, Human
gagacaggaagg

SEQ ID NO: 2503006 - RNA, 16 nt, Human
gagacaggaccugacu

SEQ ID NO: 2503007 - RNA, 17 nt, Human
gagaaugucaguaugug

SEQ ID NO: 2503008 - RNA, 19 nt, Human
gagacagcuugaucaaagg

SEQ ID NO: 2503009 - RNA, 21 nt, Human
gagaccaucccugaaggcccc

SEQ ID NO: 2503010 - RNA, 18 nt, Human
gagaccaucccugaaggc

SEQ ID NO: 2503011 - RNA, 18 nt, Human
gagacaguucaagaaagc

SEQ ID NO: 2503012 - RNA, 15 nt, Human
gagacagugggaaau

SEQ ID NO: 2503013 - RNA, 22 nt, Human
gagacaguugggugagaacaac

SEQ ID NO: 2503014 - RNA, 14 nt, Human
gagaccaucccuga

SEQ ID NO: 2503015 - RNA, 17 nt, Human
gagacaguccagccugg

SEQ ID NO: 2503016 - RNA, 22 nt, Human
gagacaggguuuggcugugucu

SEQ ID NO: 2503017 - RNA, 13 nt, Human
gagacaggguuug

SEQ ID NO: 2503018 - RNA, 19 nt, Human
gagacaggguuucaccaug

SEQ ID NO: 2503019 - RNA, 12 nt, Human
gagacaggguuu

SEQ ID NO: 2503020 - RNA, 16 nt, Human
gagacagugggaaaua

SEQ ID NO: 2503021 - RNA, 16 nt, Human
gagacaguucaagaaa

SEQ ID NO: 2503022 - RNA, 14 nt, Human
gagacagugggaaa

SEQ ID NO: 2503023 - RNA, 16 nt, Human
gagacagucaccccag

SEQ ID NO: 2503024 - RNA, 17 nt, Human
gagacagugaucuccau

SEQ ID NO: 2503025 - RNA, 22 nt, Human
gagacaggguuuugccauguug

SEQ ID NO: 2503026 - RNA, 16 nt, Human
gagaagagaaugcaca

SEQ ID NO: 2503027 - RNA, 20 nt, Human
gagaagaaaggugaguuuga

SEQ ID NO: 2503028 - RNA, 21 nt, Human
gagaagaauuuucagacccca

SEQ ID NO: 2503029 - RNA, 12 nt, Human
gagaagagagga

SEQ ID NO: 2503030 - RNA, 15 nt, Human
gagaagacaaaauua

SEQ ID NO: 2503031 - RNA, 19 nt, Human
gagaagagagaaauagccu

SEQ ID NO: 2503032 - RNA, 13 nt, Human
gagaagagcuguu

SEQ ID NO: 2503033 - RNA, 16 nt, Human
gagaagagaggagagg

SEQ ID NO: 2503034 - RNA, 15 nt, Human
gagaagagaggagag

SEQ ID NO: 2503035 - RNA, 16 nt, Human
gagaagcagaggaagg

SEQ ID NO: 2503036 - RNA, 12 nt, Human
gagaagcacugu

SEQ ID NO: 2503037 - RNA, 14 nt, Human
gagaagcagugagc

SEQ ID NO: 2503038 - RNA, 18 nt, Human
gagaagcagugagccgca

SEQ ID NO: 2503039 - RNA, 21 nt, Human
gagaagcaucggagggaauug

SEQ ID NO: 2503040 - RNA, 18 nt, Human
gagaagccacaggccuga

SEQ ID NO: 2503041 - RNA, 17 nt, Human
gagaagccacaggccug

SEQ ID NO: 2503042 - RNA, 13 nt, Human
gagaagccacagg

SEQ ID NO: 2503043 - RNA, 18 nt, Human
gagaagccaaaagauugg

SEQ ID NO: 2503044 - RNA, 17 nt, Human
gagaaugagagacacac

SEQ ID NO: 2503045 - RNA, 22 nt, Human
gagaagccacaggccugagauu

SEQ ID NO: 2503046 - RNA, 20 nt, Human
gagaagccacaggccugaga

SEQ ID NO: 2503047 - RNA, 13 nt, Human
gagaagcaugaaa

SEQ ID NO: 2503048 - RNA, 23 nt, Human
gagaacuuccagauccuggaaau

SEQ ID NO: 2503049 - RNA, 22 nt, Human
gagaacuuccagauccuggaaa

SEQ ID NO: 2503050 - RNA, 19 nt, Human
gagaacuagaaccuggagg

SEQ ID NO: 2503051 - RNA, 24 nt, Human
gagaacgcagcccuagagccugcc

SEQ ID NO: 2503052 - RNA, 16 nt, Human
gagaacgcagcccuag

SEQ ID NO: 2503053 - RNA, 15 nt, Human
gagaacgcagcccua

SEQ ID NO: 2503054 - RNA, 14 nt, Human
gagaacgcagcccu

SEQ ID NO: 2503055 - RNA, 23 nt, Human
gagaacucaucccuaaugcugca

SEQ ID NO: 2503056 - RNA, 15 nt, Human
gagaacuccuagggu

SEQ ID NO: 2503057 - RNA, 18 nt, Human
gagaacugcauauguuuc

SEQ ID NO: 2503058 - RNA, 14 nt, Human
gagaagagaaugca

SEQ ID NO: 2503059 - RNA, 20 nt, Human
gagaagaauuuucagacccc

SEQ ID NO: 2503060 - RNA, 15 nt, Human
gagaacuguggccgu

SEQ ID NO: 2503061 - RNA, 19 nt, Human
gagaacugcauauguuucg

SEQ ID NO: 2503062 - RNA, 23 nt, Human
gagaacugcauauguuucgcuga

SEQ ID NO: 2503063 - RNA, 16 nt, Human
gagaacuuucauuuuu

SEQ ID NO: 2503064 - RNA, 15 nt, Human
gagaacuuucauuuu

SEQ ID NO: 2503065 - RNA, 17 nt, Human
gagaacuuucauuuuuu

SEQ ID NO: 2503066 - RNA, 12 nt, Human
gagaaaugcaua

SEQ ID NO: 2503067 - RNA, 11 nt, Human
gagaaauuauu

SEQ ID NO: 2503068 - RNA, 13 nt, Human
gagaaaugggacu

SEQ ID NO: 2503069 - RNA, 12 nt, Human
gagaaaugaaaa

SEQ ID NO: 2503070 - RNA, 14 nt, Human
gagaaaugagcuug

SEQ ID NO: 2503071 - RNA, 21 nt, Human
gagaaaugaaaaaauauauau

SEQ ID NO: 2503072 - RNA, 22 nt, Human
gagaaccuagggugauauuaac

SEQ ID NO: 2503073 - RNA, 21 nt, Human
gagaaccuagggugauauuaa

SEQ ID NO: 2503074 - RNA, 19 nt, Human
gagaaccuggaguuccuga

SEQ ID NO: 2503075 - RNA, 13 nt, Human
gagaacgcagccc

SEQ ID NO: 2503076 - RNA, 18 nt, Human
gagaaccuaaguuucagu

SEQ ID NO: 2503077 - RNA, 14 nt, Human
gagaaauugacaga

SEQ ID NO: 2503078 - RNA, 22 nt, Human
gagaaccucacgcaccucccau

SEQ ID NO: 2503079 - RNA, 14 nt, Human
gagaaccucaggcu

SEQ ID NO: 2503080 - RNA, 10 nt, Human
gagaaaagaa

SEQ ID NO: 2503081 - RNA, 11 nt, Human
gagaaaagaaa

SEQ ID NO: 2503082 - RNA, 12 nt, Human
gagaaaagaaaa

SEQ ID NO: 2503083 - RNA, 13 nt, Human
gagaaaagaaaaa

SEQ ID NO: 2503084 - RNA, 14 nt, Human
gagaaaagaaaaaa

SEQ ID NO: 2503085 - RNA, 15 nt, Human
gagaaaagaaaaaaa

SEQ ID NO: 2503086 - RNA, 19 nt, Human
gagaaaagaaaaaaaaaga

SEQ ID NO: 2503087 - RNA, 20 nt, Human
gagaaaagaaaaaaaaagaa

SEQ ID NO: 2503088 - RNA, 13 nt, Human
gagaaaauaaaaa

SEQ ID NO: 2503089 - RNA, 14 nt, Human
gagaaaauaaaaag

SEQ ID NO: 2503090 - RNA, 15 nt, Human
gagaaaauaaaaagu

SEQ ID NO: 2503091 - RNA, 16 nt, Human
gagaaaauaaaaaguu

SEQ ID NO: 2503092 - RNA, 11 nt, Human
gagaaaauaaa

SEQ ID NO: 2503093 - RNA, 12 nt, Human
gagaaaauaaaa

SEQ ID NO: 2503094 - RNA, 13 nt, Human
gagaaaagacaug

SEQ ID NO: 2503095 - RNA, 16 nt, Human
gagaaagguugaagca

SEQ ID NO: 2503096 - RNA, 17 nt, Human
gagaaaggggagcccac

SEQ ID NO: 2503097 - RNA, 18 nt, Human
gagaaaggggagcccacu

SEQ ID NO: 2503098 - RNA, 22 nt, Human
gagaaaguacuucuccacccug

SEQ ID NO: 2503099 - RNA, 22 nt, Human
gagaaaacuuauuugagugauu

SEQ ID NO: 2503100 - RNA, 17 nt, Human
gagaaaauaaaaaguua

SEQ ID NO: 2503101 - RNA, 16 nt, Human
gagaaagccaggcagg

SEQ ID NO: 2503102 - RNA, 15 nt, Human
gagaaagccaggcag

SEQ ID NO: 2503103 - RNA, 20 nt, Human
gagaaagccaggcagguagc

SEQ ID NO: 2503104 - RNA, 20 nt, Human
gacuucugucuucacaacag

SEQ ID NO: 2503105 - RNA, 23 nt, Human
gacuucugucuucacaacagauu

SEQ ID NO: 2503106 - RNA, 14 nt, Human
gacuucugccugga

SEQ ID NO: 2503107 - RNA, 13 nt, Human
gacuucugccugg

SEQ ID NO: 2503108 - RNA, 22 nt, Human
gacuucuccaggucucacgggc

SEQ ID NO: 2503109 - RNA, 16 nt, Human
gacuucugccuggaga

SEQ ID NO: 2503110 - RNA, 15 nt, Human
gacuucugccuggag

SEQ ID NO: 2503111 - RNA, 17 nt, Human
gacuucugccuggagac

SEQ ID NO: 2503112 - RNA, 19 nt, Human
gacuucuaaguaaaaccac

SEQ ID NO: 2503113 - RNA, 23 nt, Human
gacuucuaaguaaaaccacagca

SEQ ID NO: 2503114 - RNA, 24 nt, Human
gacuucuaaguaaaaccacagcag

SEQ ID NO: 2503115 - RNA, 14 nt, Human
gacuucuccagguc

SEQ ID NO: 2503116 - RNA, 16 nt, Human
gacuucgacucaggau

SEQ ID NO: 2503117 - RNA, 15 nt, Human
gacuucgacucagga

SEQ ID NO: 2503118 - RNA, 18 nt, Human
gacuuccuugcucucccu

SEQ ID NO: 2503119 - RNA, 18 nt, Human
gacuucgacugugaccug

SEQ ID NO: 2503120 - RNA, 17 nt, Human
gacuucuaaguaaaacc

SEQ ID NO: 2503121 - RNA, 18 nt, Human
gacuucuaaguaaaacca

SEQ ID NO: 2503122 - RNA, 16 nt, Human
gacuucuaaguaaaac

SEQ ID NO: 2503123 - RNA, 17 nt, Human
gacuuccuugcucuccc

SEQ ID NO: 2503124 - RNA, 16 nt, Human
gacuuccuugcucucc

SEQ ID NO: 2503125 - RNA, 14 nt, Human
gacuuccuugcucu

SEQ ID NO: 2503126 - RNA, 16 nt, Human
gacuuccuugagacac

SEQ ID NO: 2503127 - RNA, 20 nt, Human
gacuuccuugagacacggag

SEQ ID NO: 2503128 - RNA, 19 nt, Human
gacuuaagugugcaaaaua

SEQ ID NO: 2503129 - RNA, 15 nt, Human
gacuuccuugagaca

SEQ ID NO: 2503130 - RNA, 19 nt, Human
gacuuaagcacacuugaca

SEQ ID NO: 2503131 - RNA, 14 nt, Human
gacugggggccaga

SEQ ID NO: 2503132 - RNA, 13 nt, Human
gacuuaaagcaga

SEQ ID NO: 2503133 - RNA, 19 nt, Human
gacuuaaaauauuccugca

SEQ ID NO: 2503134 - RNA, 16 nt, Human
gacuuaacggcuccag

SEQ ID NO: 2503135 - RNA, 14 nt, Human
gacuuaacggcucc

SEQ ID NO: 2503136 - RNA, 19 nt, Human
gacuuaacggcuccaggau

SEQ ID NO: 2503137 - RNA, 16 nt, Human
gacuuaacuccuucca

SEQ ID NO: 2503138 - RNA, 20 nt, Human
gacuuaacugcauuuuuaga

SEQ ID NO: 2503139 - RNA, 19 nt, Human
gacuuggucaccagcuccu

SEQ ID NO: 2503140 - RNA, 16 nt, Human
gacuuggucaccagcu

SEQ ID NO: 2503141 - RNA, 20 nt, Human
gacuugggucucauuuagaa

SEQ ID NO: 2503142 - RNA, 20 nt, Human
gacuuggggagauggaguuc

SEQ ID NO: 2503143 - RNA, 18 nt, Human
gagaaaacuuauuugagu

SEQ ID NO: 2503144 - RNA, 16 nt, Human
gagaaaacuuauuuga

SEQ ID NO: 2503145 - RNA, 9 nt, Human
gagaaaaga

SEQ ID NO: 2503146 - RNA, 18 nt, Human
gacuuguauauuuguaca

SEQ ID NO: 2503147 - RNA, 21 nt, Human
gagaaaacgucuugcuuggga

SEQ ID NO: 2503148 - RNA, 16 nt, Human
gacuuguauauuugua

SEQ ID NO: 2503149 - RNA, 19 nt, Human
gacuuguagggaugccuuu

SEQ ID NO: 2503150 - RNA, 14 nt, Human
gacuuggucugauu

SEQ ID NO: 2503151 - RNA, 23 nt, Human
gacuugguguccuuucccuccac

SEQ ID NO: 2503152 - RNA, 15 nt, Human
gacuugcaucgugga

SEQ ID NO: 2503153 - RNA, 18 nt, Human
gacuugcaauuucuaccu

SEQ ID NO: 2503154 - RNA, 13 nt, Human
gacuugcauuuuu

SEQ ID NO: 2503155 - RNA, 15 nt, Human
gacuugcauuuuugc

SEQ ID NO: 2503156 - RNA, 23 nt, Human
gacuugaggauuuugaguaucuc

SEQ ID NO: 2503157 - RNA, 19 nt, Human
gacuugaggauuuugagua

SEQ ID NO: 2503158 - RNA, 19 nt, Human
gacuugacuuuagucugca

SEQ ID NO: 2503159 - RNA, 19 nt, Human
gacuugagaaacaaauaau

SEQ ID NO: 2503160 - RNA, 23 nt, Human
gacuugagaaacaaauaauuugu

SEQ ID NO: 2503161 - RNA, 19 nt, Human
gacuuggcaacagaagcag

SEQ ID NO: 2503162 - RNA, 17 nt, Human
gacuuggcaacagaagc

SEQ ID NO: 2503163 - RNA, 22 nt, Human
gacuugcuguuuuguucugugg

SEQ ID NO: 2503164 - RNA, 20 nt, Human
gacuugcuguuuuguucugu

SEQ ID NO: 2503165 - RNA, 19 nt, Human
gacuugcuguuuuguucug

SEQ ID NO: 2503166 - RNA, 21 nt, Human
gacuuggaggguugguccucu

SEQ ID NO: 2503167 - RNA, 17 nt, Human
gacuucugcuuuccaca

SEQ ID NO: 2503168 - RNA, 21 nt, Human
gacuucuuucaaauugagaga

SEQ ID NO: 2503169 - RNA, 22 nt, Human
gacuucuuucaaauugagagaa

SEQ ID NO: 2503170 - RNA, 18 nt, Human
gacuucuuuucacauucu

SEQ ID NO: 2503171 - RNA, 16 nt, Human
gacuucuuuucacauu

SEQ ID NO: 2503172 - RNA, 15 nt, Human
gacuucuuuucacau

SEQ ID NO: 2503173 - RNA, 12 nt, Human
gacuucuuuuca

SEQ ID NO: 2503174 - RNA, 21 nt, Human
gacuucuuuucacauucuuau

SEQ ID NO: 2503175 - RNA, 19 nt, Human
gacuucuuuucacauucuu

SEQ ID NO: 2503176 - RNA, 22 nt, Human
gacuucuuuucacauucuuaua

SEQ ID NO: 2503177 - RNA, 13 nt, Human
gacuugaaagcau

SEQ ID NO: 2503178 - RNA, 14 nt, Human
gacuugaaagcauc

SEQ ID NO: 2503179 - RNA, 16 nt, Human
gacuugaaagcaucca

SEQ ID NO: 2503180 - RNA, 13 nt, Human
gacuugaaguugu

SEQ ID NO: 2503181 - RNA, 12 nt, Human
gacuugaaguug

SEQ ID NO: 2503182 - RNA, 11 nt, Human
gacuugaaguu

SEQ ID NO: 2503183 - RNA, 17 nt, Human
gacuugaaagcauccau

SEQ ID NO: 2503184 - RNA, 19 nt, Human
gacuugaaagcauccaugu

SEQ ID NO: 2503185 - RNA, 21 nt, Human
gacuugaaagcauccaugugu

SEQ ID NO: 2503186 - RNA, 21 nt, Human
gacuugaauuuucccacugca

SEQ ID NO: 2503187 - RNA, 20 nt, Human
gacuugaauuuucccacugc

SEQ ID NO: 2503188 - RNA, 19 nt, Human
gacuugaauuuucccacug

SEQ ID NO: 2503189 - RNA, 15 nt, Human
gacuugaaguuguua

SEQ ID NO: 2503190 - RNA, 18 nt, Human
gacuugacagaacacugu

SEQ ID NO: 2503191 - RNA, 16 nt, Human
gacuugacagaacacu

SEQ ID NO: 2503192 - RNA, 16 nt, Human
gacugcauuauauuua

SEQ ID NO: 2503193 - RNA, 14 nt, Human
gacugcauuauauu

SEQ ID NO: 2503194 - RNA, 23 nt, Human
gacugaguacguugugcauuugg

SEQ ID NO: 2503195 - RNA, 22 nt, Human
gacugaguccucguagccaucu

SEQ ID NO: 2503196 - RNA, 13 nt, Human
gacugcccggcag

SEQ ID NO: 2503197 - RNA, 23 nt, Human
gacugcauguaccauuugcaugg

SEQ ID NO: 2503198 - RNA, 21 nt, Human
gacugcauguaccauuugcau

SEQ ID NO: 2503199 - RNA, 15 nt, Human
gacugccccgugcag

SEQ ID NO: 2503200 - RNA, 15 nt, Human
gacugcccggcaggg

SEQ ID NO: 2503201 - RNA, 17 nt, Human
gacugccccgugcagac

SEQ ID NO: 2503202 - RNA, 19 nt, Human
gacugccccgugcagacug

SEQ ID NO: 2503203 - RNA, 20 nt, Human
gacugccccgugcagacugg

SEQ ID NO: 2503204 - RNA, 21 nt, Human
gacugccccgugcagacugga

SEQ ID NO: 2503205 - RNA, 23 nt, Human
gacugccccgugcagacuggagg

SEQ ID NO: 2503206 - RNA, 16 nt, Human
gacugccgaccgaggc

SEQ ID NO: 2503207 - RNA, 19 nt, Human
gacugccgaccgaggcugg

SEQ ID NO: 2503208 - RNA, 20 nt, Human
gacugccgaccgaggcugga

SEQ ID NO: 2503209 - RNA, 21 nt, Human
gacugaguacguugugcauuu

SEQ ID NO: 2503210 - RNA, 22 nt, Human
gacugaguacguugugcauuug

SEQ ID NO: 2503211 - RNA, 16 nt, Human
gacucucagucucuga

SEQ ID NO: 2503212 - RNA, 18 nt, Human
gacucucagucucugagc

SEQ ID NO: 2503213 - RNA, 14 nt, Human
gacucucagucucu

SEQ ID NO: 2503214 - RNA, 20 nt, Human
gacucucagucucugagcag

SEQ ID NO: 2503215 - RNA, 12 nt, Human
gacucucuguga

SEQ ID NO: 2503216 - RNA, 13 nt, Human
gacucucugugac

SEQ ID NO: 2503217 - RNA, 14 nt, Human
gacucucaaaucuu

SEQ ID NO: 2503218 - RNA, 17 nt, Human
gacucuaggugcccuug

SEQ ID NO: 2503219 - RNA, 19 nt, Human
gacucuaggugcccuugga

SEQ ID NO: 2503220 - RNA, 20 nt, Human
gacucuaccagacuguguau

SEQ ID NO: 2503221 - RNA, 19 nt, Human
gacucuaccucauaucagu

SEQ ID NO: 2503222 - RNA, 23 nt, Human
gacucuaccucauaucaguuugc

SEQ ID NO: 2503223 - RNA, 17 nt, Human
gacucgcgacaaugcaa

SEQ ID NO: 2503224 - RNA, 14 nt, Human
gacucuaccagacu

SEQ ID NO: 2503225 - RNA, 19 nt, Human
gacucgagaacuuucauuu

SEQ ID NO: 2503226 - RNA, 16 nt, Human
gacucgagaacuuuca

SEQ ID NO: 2503227 - RNA, 18 nt, Human
gacuggggaugugggagg

SEQ ID NO: 2503228 - RNA, 17 nt, Human
gacuggggaugugggag

SEQ ID NO: 2503229 - RNA, 16 nt, Human
gacuggggauguggga

SEQ ID NO: 2503230 - RNA, 17 nt, Human
gacugggcccugccucu

SEQ ID NO: 2503231 - RNA, 23 nt, Human
gacuggggaugugggagggagca

SEQ ID NO: 2503232 - RNA, 20 nt, Human
gacuggggaugugggaggga

SEQ ID NO: 2503233 - RNA, 14 nt, Human
gacuggggggcuug

SEQ ID NO: 2503234 - RNA, 21 nt, Human
gacuguuuuuuccugagcuug

SEQ ID NO: 2503235 - RNA, 14 nt, Human
gacugggcugaggg

SEQ ID NO: 2503236 - RNA, 15 nt, Human
gacugggcugaggga

SEQ ID NO: 2503237 - RNA, 16 nt, Human
gacugggcugagggag

SEQ ID NO: 2503238 - RNA, 21 nt, Human
gacugggcugagggagccugg

SEQ ID NO: 2503239 - RNA, 23 nt, Human
gacugggagccgcagcagcuccc

SEQ ID NO: 2503240 - RNA, 18 nt, Human
gacugggagccgcagcag

SEQ ID NO: 2503241 - RNA, 14 nt, Human
gacugggcccugcc

SEQ ID NO: 2503242 - RNA, 13 nt, Human
gacugggagguag

SEQ ID NO: 2503243 - RNA, 15 nt, Human
gacugggagggccca

SEQ ID NO: 2503244 - RNA, 18 nt, Human
gacuggaagcacagcuuc

SEQ ID NO: 2503245 - RNA, 21 nt, Human
gacuggaagcuaauuugcauu

SEQ ID NO: 2503246 - RNA, 20 nt, Human
gacuggaagcuaauuugcau

SEQ ID NO: 2503247 - RNA, 17 nt, Human
gacuggaaccagggaga

SEQ ID NO: 2503248 - RNA, 22 nt, Human
gacuggauacugcccggggcag

SEQ ID NO: 2503249 - RNA, 15 nt, Human
gacuggauacugccc

SEQ ID NO: 2503250 - RNA, 14 nt, Human
gacuggagcaucug

SEQ ID NO: 2503251 - RNA, 20 nt, Human
gacugcuucccauccuaccc

SEQ ID NO: 2503252 - RNA, 17 nt, Human
gacugcuucccauccua

SEQ ID NO: 2503253 - RNA, 22 nt, Human
gacugcuucccauccuacccuc

SEQ ID NO: 2503254 - RNA, 12 nt, Human
gacugcuuccca

SEQ ID NO: 2503255 - RNA, 16 nt, Human
gacugcuucccauccu

SEQ ID NO: 2503256 - RNA, 15 nt, Human
gacugcuucccaucc

SEQ ID NO: 2503257 - RNA, 13 nt, Human
gacugcuucccau

SEQ ID NO: 2503258 - RNA, 19 nt, Human
gacugcugggacuggccag

SEQ ID NO: 2503259 - RNA, 23 nt, Human
gacugccgaccgaggcuggagcu

SEQ ID NO: 2503260 - RNA, 12 nt, Human
gacugcugggac

SEQ ID NO: 2503261 - RNA, 14 nt, Human
gacugcugggacug

SEQ ID NO: 2503262 - RNA, 16 nt, Human
gacuggaagcacagcu

SEQ ID NO: 2503263 - RNA, 15 nt, Human
gacuggaagcacagc

SEQ ID NO: 2503264 - RNA, 21 nt, Human
gacugcuuuggaccuaaaugg

SEQ ID NO: 2503265 - RNA, 15 nt, Human
gacuggaaccaggga

SEQ ID NO: 2503266 - RNA, 14 nt, Human
gacuggaagcacag

SEQ ID NO: 2503267 - RNA, 15 nt, Human
gacucauucuucugu

SEQ ID NO: 2503268 - RNA, 14 nt, Human
gacucauucuucug

SEQ ID NO: 2503269 - RNA, 14 nt, Human
gacucagccuucag

SEQ ID NO: 2503270 - RNA, 12 nt, Human
gacucagccuuc

SEQ ID NO: 2503271 - RNA, 15 nt, Human
gacucagcccugagg

SEQ ID NO: 2503272 - RNA, 16 nt, Human
gacucagcccugaggu

SEQ ID NO: 2503273 - RNA, 19 nt, Human
gacucagccuucagacaga

SEQ ID NO: 2503274 - RNA, 15 nt, Human
gacucagccuucaga

SEQ ID NO: 2503275 - RNA, 20 nt, Human
gacucagccuucagacagag

SEQ ID NO: 2503276 - RNA, 14 nt, Human
gacucagcucccca

SEQ ID NO: 2503277 - RNA, 18 nt, Human
gacucagacauuggcacc

SEQ ID NO: 2503278 - RNA, 16 nt, Human
gacucagacuccauuu

SEQ ID NO: 2503279 - RNA, 11 nt, Human
gacucagcccu

SEQ ID NO: 2503280 - RNA, 13 nt, Human
gacucagcccuga

SEQ ID NO: 2503281 - RNA, 19 nt, Human
gacucagaagccucugggu

SEQ ID NO: 2503282 - RNA, 17 nt, Human
gacucagacaggaaagg

SEQ ID NO: 2503283 - RNA, 23 nt, Human
gacucagacaggaaagggaaggc

SEQ ID NO: 2503284 - RNA, 14 nt, Human
gacuagaugaugga

SEQ ID NO: 2503285 - RNA, 16 nt, Human
gacuagaugauggaug

SEQ ID NO: 2503286 - RNA, 21 nt, Human
gacuagaugauggaugccaau

SEQ ID NO: 2503287 - RNA, 16 nt, Human
gacuagaggcuugcau

SEQ ID NO: 2503288 - RNA, 17 nt, Human
gacuagagggaccucuc

SEQ ID NO: 2503289 - RNA, 19 nt, Human
gacuagagggaccucuccc

SEQ ID NO: 2503290 - RNA, 20 nt, Human
gacuagagggaccucuccca

SEQ ID NO: 2503291 - RNA, 23 nt, Human
gacuagagggaccucucccaggg

SEQ ID NO: 2503292 - RNA, 21 nt, Human
gacuacaggugugagucacca

SEQ ID NO: 2503293 - RNA, 18 nt, Human
gacuacaggugugaguca

SEQ ID NO: 2503294 - RNA, 22 nt, Human
gacuacccacguucucacaccc

SEQ ID NO: 2503295 - RNA, 14 nt, Human
gacuacauuuagag

SEQ ID NO: 2503296 - RNA, 18 nt, Human
gacuacagucaggaaagg

SEQ ID NO: 2503297 - RNA, 13 nt, Human
gaccucaaccugu

SEQ ID NO: 2503298 - RNA, 16 nt, Human
gacuagaggcagggag

SEQ ID NO: 2503299 - RNA, 17 nt, Human
gacuagaggcagggagg

SEQ ID NO: 2503300 - RNA, 20 nt, Human
gacuagaggcagggagggga

SEQ ID NO: 2503301 - RNA, 22 nt, Human
gacuagaggcagggaggggacu

SEQ ID NO: 2503302 - RNA, 15 nt, Human
gacuagaggcaggga

SEQ ID NO: 2503303 - RNA, 23 nt, Human
gaccuauguccuaaggacacacu

SEQ ID NO: 2503304 - RNA, 22 nt, Human
gaccuauguccuaaggacacac

SEQ ID NO: 2503305 - RNA, 21 nt, Human
gaccuauguccuaaggacaca

SEQ ID NO: 2503306 - RNA, 17 nt, Human
gaccuauuccuccuggg

SEQ ID NO: 2503307 - RNA, 16 nt, Human
gaccuauuccuccugg

SEQ ID NO: 2503308 - RNA, 13 nt, Human
gacuacaggugug

SEQ ID NO: 2503309 - RNA, 13 nt, Human
gaccuacucucau

SEQ ID NO: 2503310 - RNA, 18 nt, Human
gaccuaggauaucuucuc

SEQ ID NO: 2503311 - RNA, 20 nt, Human
gaccuaggauaucuucucca

SEQ ID NO: 2503312 - RNA, 17 nt, Human
gaccuagggaggaccuu

SEQ ID NO: 2503313 - RNA, 21 nt, Human
gaccuagggaggaccuuaucu

SEQ ID NO: 2503314 - RNA, 20 nt, Human
gaccuagggauguucuggcc

SEQ ID NO: 2503315 - RNA, 21 nt, Human
gaccuagggauguucuggccc

SEQ ID NO: 2503316 - RNA, 22 nt, Human
gaccuagggauguucuggcccu

SEQ ID NO: 2503317 - RNA, 15 nt, Human
gaccuaucacuucca

SEQ ID NO: 2503318 - RNA, 23 nt, Human
gaccuagggauguucuggcccuc

SEQ ID NO: 2503319 - RNA, 15 nt, Human
gacuccuaugaucuc

SEQ ID NO: 2503320 - RNA, 15 nt, Human
gacuccucggccugg

SEQ ID NO: 2503321 - RNA, 23 nt, Human
gacuccuaggcaggacaugcuga

SEQ ID NO: 2503322 - RNA, 20 nt, Human
gacuccucggccuggcuccu

SEQ ID NO: 2503323 - RNA, 18 nt, Human
gacuccucggccuggcuc

SEQ ID NO: 2503324 - RNA, 17 nt, Human
gacuccucggccuggcu

SEQ ID NO: 2503325 - RNA, 11 nt, Human
gacuccucugu

SEQ ID NO: 2503326 - RNA, 12 nt, Human
gacuccugcagg

SEQ ID NO: 2503327 - RNA, 21 nt, Human
gacuccugaggacagcugucc

SEQ ID NO: 2503328 - RNA, 20 nt, Human
gacuccugaggacagcuguc

SEQ ID NO: 2503329 - RNA, 19 nt, Human
gacuccugaggacagcugu

SEQ ID NO: 2503330 - RNA, 18 nt, Human
gacuccugaggacagcug

SEQ ID NO: 2503331 - RNA, 14 nt, Human
gacuccucugucca

SEQ ID NO: 2503332 - RNA, 13 nt, Human
gacuccugcaggc

SEQ ID NO: 2503333 - RNA, 23 nt, Human
gacuccugcacacgcuccuuccu

SEQ ID NO: 2503334 - RNA, 13 nt, Human
gacucgcgacaau

SEQ ID NO: 2503335 - RNA, 17 nt, Human
gacuccuggguugagcu

SEQ ID NO: 2503336 - RNA, 11 nt, Human
gacuccugggu

SEQ ID NO: 2503337 - RNA, 14 nt, Human
gacuccugcccugu

SEQ ID NO: 2503338 - RNA, 13 nt, Human
gacuccugcccug

SEQ ID NO: 2503339 - RNA, 16 nt, Human
gacuccugugcaacuu

SEQ ID NO: 2503340 - RNA, 22 nt, Human
gacuccuugagagaccaggcaa

SEQ ID NO: 2503341 - RNA, 21 nt, Human
gacucauuuuaaaaaauggaa

SEQ ID NO: 2503342 - RNA, 11 nt, Human
gacuccaaaga

SEQ ID NO: 2503343 - RNA, 12 nt, Human
gacuccaaagaa

SEQ ID NO: 2503344 - RNA, 15 nt, Human
gacuccaaagaaaug

SEQ ID NO: 2503345 - RNA, 19 nt, Human
gacuccuaggcaggacaug

SEQ ID NO: 2503346 - RNA, 17 nt, Human
gacuccuaggcaggaca

SEQ ID NO: 2503347 - RNA, 20 nt, Human
gacucagcuccccagagucc

SEQ ID NO: 2503348 - RNA, 16 nt, Human
gacuccguuggccacu

SEQ ID NO: 2503349 - RNA, 17 nt, Human
gacuccguuggccacuc

SEQ ID NO: 2503350 - RNA, 23 nt, Human
gacuccggguuugagauggacac

SEQ ID NO: 2503351 - RNA, 22 nt, Human
gacuccggcccuccuacccugc

SEQ ID NO: 2503352 - RNA, 16 nt, Human
gacuccaaagaaaugu

SEQ ID NO: 2503353 - RNA, 18 nt, Human
gacuccaaagaaauguaa

SEQ ID NO: 2503354 - RNA, 18 nt, Human
gacucagcuccccagagu

SEQ ID NO: 2503355 - RNA, 17 nt, Human
gacucagcuccccagag

SEQ ID NO: 2503356 - RNA, 15 nt, Human
gacuccggcccuccu

SEQ ID NO: 2503357 - RNA, 13 nt, Human
gacccaaagacca

SEQ ID NO: 2503358 - RNA, 11 nt, Human
gacccaaagac

SEQ ID NO: 2503359 - RNA, 16 nt, Human
gacccaaaaggcagaa

SEQ ID NO: 2503360 - RNA, 15 nt, Human
gacccacaagaaaug

SEQ ID NO: 2503361 - RNA, 22 nt, Human
gacccacaagaaaugaaagcag

SEQ ID NO: 2503362 - RNA, 12 nt, Human
gacccccaacca

SEQ ID NO: 2503363 - RNA, 18 nt, Human
gacccaauguaggagcug

SEQ ID NO: 2503364 - RNA, 12 nt, Human
gacccaaagacc

SEQ ID NO: 2503365 - RNA, 13 nt, Human
gacccaaggagga

SEQ ID NO: 2503366 - RNA, 21 nt, Human
gacccccaaccaaguggcucc

SEQ ID NO: 2503367 - RNA, 19 nt, Human
gacccaauguaggagcugc

SEQ ID NO: 2503368 - RNA, 13 nt, Human
gacccccacaccu

SEQ ID NO: 2503369 - RNA, 15 nt, Human
gacccccacaccuca

SEQ ID NO: 2503370 - RNA, 14 nt, Human
gacccaaggaggaa

SEQ ID NO: 2503371 - RNA, 12 nt, Human
gacccccacccc

SEQ ID NO: 2503372 - RNA, 13 nt, Human
gacccccaccccu

SEQ ID NO: 2503373 - RNA, 14 nt, Human
gacccccaccccuu

SEQ ID NO: 2503374 - RNA, 15 nt, Human
gacccccaccccuuc

SEQ ID NO: 2503375 - RNA, 16 nt, Human
gacccccaccccuucc

SEQ ID NO: 2503376 - RNA, 17 nt, Human
gacccccaccccuuccc

SEQ ID NO: 2503377 - RNA, 18 nt, Human
gacccccaccccuucccc

SEQ ID NO: 2503378 - RNA, 19 nt, Human
gacccccaccccuucccca

SEQ ID NO: 2503379 - RNA, 21 nt, Human
gacccccaccccuuccccacu

SEQ ID NO: 2503380 - RNA, 22 nt, Human
gacccccaccccuuccccacug

SEQ ID NO: 2503381 - RNA, 18 nt, Human
gacccccacucucauucc

SEQ ID NO: 2503382 - RNA, 19 nt, Human
gacccccacucucauuccc

SEQ ID NO: 2503383 - RNA, 23 nt, Human
gacccccacucucauuccccagg

SEQ ID NO: 2503384 - RNA, 22 nt, Human
gacccugaggcccagagggccu

SEQ ID NO: 2503385 - RNA, 21 nt, Human
gaccccuccaugugggcuagu

SEQ ID NO: 2503386 - RNA, 18 nt, Human
gaccccuccaugugggcu

SEQ ID NO: 2503387 - RNA, 14 nt, Human
gaccccuccaugug

SEQ ID NO: 2503388 - RNA, 23 nt, Human
gacccugaggcccagagggccug

SEQ ID NO: 2503389 - RNA, 20 nt, Human
gacccccagcaacccuccua

SEQ ID NO: 2503390 - RNA, 19 nt, Human
gaccccuccccuaaugccu

SEQ ID NO: 2503391 - RNA, 17 nt, Human
gaccggacuuuucugca

SEQ ID NO: 2503392 - RNA, 16 nt, Human
gaccgcccccuccucu

SEQ ID NO: 2503393 - RNA, 15 nt, Human
gaccgcccccuccuc

SEQ ID NO: 2503394 - RNA, 19 nt, Human
gaccgaacuguuguauaaa

SEQ ID NO: 2503395 - RNA, 17 nt, Human
gaccgaggcuggagcug

SEQ ID NO: 2503396 - RNA, 22 nt, Human
gacccuuuccuuccuucccugg

SEQ ID NO: 2503397 - RNA, 23 nt, Human
gacccuuuccuuccuucccuggc

SEQ ID NO: 2503398 - RNA, 14 nt, Human
gaccgcccccuccu

SEQ ID NO: 2503399 - RNA, 12 nt, Human
gaccgcccccuc

SEQ ID NO: 2503400 - RNA, 22 nt, Human
gaccgccagauggggccucugu

SEQ ID NO: 2503401 - RNA, 20 nt, Human
gaccgccagauggggccucu

SEQ ID NO: 2503402 - RNA, 16 nt, Human
gaccgccagauggggc

SEQ ID NO: 2503403 - RNA, 17 nt, Human
gaccgugaggccagaga

SEQ ID NO: 2503404 - RNA, 16 nt, Human
gaccgugaggccagag

SEQ ID NO: 2503405 - RNA, 18 nt, Human
gaccgugaggccagagac

SEQ ID NO: 2503406 - RNA, 16 nt, Human
gaccuaccucagguug

SEQ ID NO: 2503407 - RNA, 19 nt, Human
gaccuaccucagguugcug

SEQ ID NO: 2503408 - RNA, 20 nt, Human
gacccuuguggucccacccc

SEQ ID NO: 2503409 - RNA, 19 nt, Human
gacccuuguggucccaccc

SEQ ID NO: 2503410 - RNA, 21 nt, Human
gacccuuguggucccacccca

SEQ ID NO: 2503411 - RNA, 23 nt, Human
gacccuuuagccaaacccuuguc

SEQ ID NO: 2503412 - RNA, 14 nt, Human
gacccuuuccuucc

SEQ ID NO: 2503413 - RNA, 20 nt, Human
gacccuuuccuuccuucccu

SEQ ID NO: 2503414 - RNA, 21 nt, Human
gacccuuuccuuccuucccug

SEQ ID NO: 2503415 - RNA, 15 nt, Human
gacccuugugguccc

SEQ ID NO: 2503416 - RNA, 22 nt, Human
gacccugggugggcucugugca

SEQ ID NO: 2503417 - RNA, 19 nt, Human
gacccugggugggcucugu

SEQ ID NO: 2503418 - RNA, 18 nt, Human
gacccugggugggcucug

SEQ ID NO: 2503419 - RNA, 17 nt, Human
gacccugggugggcucu

SEQ ID NO: 2503420 - RNA, 17 nt, Human
gacccugggcagggacu

SEQ ID NO: 2503421 - RNA, 22 nt, Human
gacccugcgaaggggcccuggu

SEQ ID NO: 2503422 - RNA, 12 nt, Human
gacccugucuca

SEQ ID NO: 2503423 - RNA, 21 nt, Human
gacccugggugggcucugugc

SEQ ID NO: 2503424 - RNA, 11 nt, Human
gacccuguaua

SEQ ID NO: 2503425 - RNA, 19 nt, Human
gacccuguauauagcccag

SEQ ID NO: 2503426 - RNA, 17 nt, Human
gacccuguauauagccc

SEQ ID NO: 2503427 - RNA, 11 nt, Human
gaccagagcug

SEQ ID NO: 2503428 - RNA, 24 nt, Human
gaccagacaccuugacagggcaca

SEQ ID NO: 2503429 - RNA, 14 nt, Human
gaccacuguuauca

SEQ ID NO: 2503430 - RNA, 12 nt, Human
gaccacugcaug

SEQ ID NO: 2503431 - RNA, 17 nt, Human
gaccacgugcuaccccc

SEQ ID NO: 2503432 - RNA, 17 nt, Human
gaccacgggaagcaucu

SEQ ID NO: 2503433 - RNA, 21 nt, Human
gaccacugcaugagcuuuuau

SEQ ID NO: 2503434 - RNA, 16 nt, Human
gaccagaagccaaaga

SEQ ID NO: 2503435 - RNA, 22 nt, Human
gaccacggacguuuccaucagg

SEQ ID NO: 2503436 - RNA, 21 nt, Human
gaccacggacguuuccaucag

SEQ ID NO: 2503437 - RNA, 13 nt, Human
gaccacggcucga

SEQ ID NO: 2503438 - RNA, 21 nt, Human
gaccacugcagaagacaguau

SEQ ID NO: 2503439 - RNA, 14 nt, Human
gaccacguuucuaa

SEQ ID NO: 2503440 - RNA, 20 nt, Human
gaccacggacguuuccauca

SEQ ID NO: 2503441 - RNA, 21 nt, Human
gaccacgcuuucuagcuguug

SEQ ID NO: 2503442 - RNA, 22 nt, Human
gaccacgcccguccugccugug

SEQ ID NO: 2503443 - RNA, 14 nt, Human
gaccacgcuuucua

SEQ ID NO: 2503444 - RNA, 20 nt, Human
gaccaccccgccugcccuca

SEQ ID NO: 2503445 - RNA, 19 nt, Human
gaccaccccgccugcccuc

SEQ ID NO: 2503446 - RNA, 21 nt, Human
gacauggcuugccacagcucu

SEQ ID NO: 2503447 - RNA, 18 nt, Human
gaccaccccgccugcccu

SEQ ID NO: 2503448 - RNA, 16 nt, Human
gacaugcgguagccag

SEQ ID NO: 2503449 - RNA, 17 nt, Human
gacaugcgguagccagc

SEQ ID NO: 2503450 - RNA, 16 nt, Human
gacaugggacauuugc

SEQ ID NO: 2503451 - RNA, 18 nt, Human
gacaugggaaaggggaag

SEQ ID NO: 2503452 - RNA, 18 nt, Human
gaccacccuccccucucu

SEQ ID NO: 2503453 - RNA, 17 nt, Human
gaccacccuccccucuc

SEQ ID NO: 2503454 - RNA, 16 nt, Human
gaccacccuccccucu

SEQ ID NO: 2503455 - RNA, 15 nt, Human
gaccacccuccccuc

SEQ ID NO: 2503456 - RNA, 19 nt, Human
gaccacccuccccucucuu

SEQ ID NO: 2503457 - RNA, 20 nt, Human
gaccaccccugccuccaccc

SEQ ID NO: 2503458 - RNA, 19 nt, Human
gaccaccccugccuccacc

SEQ ID NO: 2503459 - RNA, 17 nt, Human
gaccaccccugccucca

SEQ ID NO: 2503460 - RNA, 14 nt, Human
gaccaccccugccu

SEQ ID NO: 2503461 - RNA, 14 nt, Human
gaccacccuccccu

SEQ ID NO: 2503462 - RNA, 22 nt, Human
gaccaccccugccuccacccuc

SEQ ID NO: 2503463 - RNA, 21 nt, Human
gaccacgcccguccugccugu

SEQ ID NO: 2503464 - RNA, 19 nt, Human
gaccacgcccguccugccu

SEQ ID NO: 2503465 - RNA, 17 nt, Human
gaccacgcccguccugc

SEQ ID NO: 2503466 - RNA, 14 nt, Human
gaccaccugcccaa

SEQ ID NO: 2503467 - RNA, 13 nt, Human
gaccaccugccca

SEQ ID NO: 2503468 - RNA, 17 nt, Human
gaccagagcugccaccu

SEQ ID NO: 2503469 - RNA, 15 nt, Human
gaccagagcugccac

SEQ ID NO: 2503470 - RNA, 14 nt, Human
gaccagagcugcca

SEQ ID NO: 2503471 - RNA, 13 nt, Human
gaccagagcugcc

SEQ ID NO: 2503472 - RNA, 19 nt, Human
gaccagagcugccaccugc

SEQ ID NO: 2503473 - RNA, 18 nt, Human
gaccagagcugccaccug

SEQ ID NO: 2503474 - RNA, 11 nt, Human
gaccagacuaa

SEQ ID NO: 2503475 - RNA, 21 nt, Human
gaccagagccccacacggagg

SEQ ID NO: 2503476 - RNA, 20 nt, Human
gaccagccuccaugcugccu

SEQ ID NO: 2503477 - RNA, 22 nt, Human
gaccagccuccaugcugccucc

SEQ ID NO: 2503478 - RNA, 21 nt, Human
gaccagccuccaugcugccuc

SEQ ID NO: 2503479 - RNA, 22 nt, Human
gaccauucuccaccugccaggg

SEQ ID NO: 2503480 - RNA, 21 nt, Human
gaccauucuccaccugccagg

SEQ ID NO: 2503481 - RNA, 17 nt, Human
gaccauucuccaccugc

SEQ ID NO: 2503482 - RNA, 15 nt, Human
gaccauuucaggggu

SEQ ID NO: 2503483 - RNA, 20 nt, Human
gaccauucuccaccugccag

SEQ ID NO: 2503484 - RNA, 19 nt, Human
gaccauucuccaccugcca

SEQ ID NO: 2503485 - RNA, 14 nt, Human
gaccagccucccug

SEQ ID NO: 2503486 - RNA, 11 nt, Human
gaccagccugg

SEQ ID NO: 2503487 - RNA, 12 nt, Human
gaccagccuggc

SEQ ID NO: 2503488 - RNA, 13 nt, Human
gaccagccuggcc

SEQ ID NO: 2503489 - RNA, 22 nt, Human
gaccagccucccugucggccug

SEQ ID NO: 2503490 - RNA, 19 nt, Human
gacagccacggccaggcca

SEQ ID NO: 2503491 - RNA, 18 nt, Human
gacagccacggccaggcc

SEQ ID NO: 2503492 - RNA, 17 nt, Human
gacagccacggccaggc

SEQ ID NO: 2503493 - RNA, 14 nt, Human
gacagccacggcca

SEQ ID NO: 2503494 - RNA, 22 nt, Human
gacagagugagacucugucuca

SEQ ID NO: 2503495 - RNA, 20 nt, Human
gacagagugagacucugucu

SEQ ID NO: 2503496 - RNA, 13 nt, Human
gacagagggggug

SEQ ID NO: 2503497 - RNA, 13 nt, Human
gacagauaacucu

SEQ ID NO: 2503498 - RNA, 20 nt, Human
gacagaucaagcugugagac

SEQ ID NO: 2503499 - RNA, 16 nt, Human
gacagaguaugaacac

SEQ ID NO: 2503500 - RNA, 14 nt, Human
gacagaucaagcug

SEQ ID NO: 2503501 - RNA, 21 nt, Human
gacagaguucacuauaaaugg

SEQ ID NO: 2503502 - RNA, 17 nt, Human
gacagcugccugggauc

SEQ ID NO: 2503503 - RNA, 16 nt, Human
gacagcugccugggau

SEQ ID NO: 2503504 - RNA, 21 nt, Human
gacagccacggccaggccaga

SEQ ID NO: 2503505 - RNA, 20 nt, Human
gacagccacggccaggccag

SEQ ID NO: 2503506 - RNA, 21 nt, Human
gacagcugccugggaucccuc

SEQ ID NO: 2503507 - RNA, 18 nt, Human
gacagcugccugggaucc

SEQ ID NO: 2503508 - RNA, 17 nt, Human
gacagaucaagcuguga

SEQ ID NO: 2503509 - RNA, 16 nt, Human
gacagaucaagcugug

SEQ ID NO: 2503510 - RNA, 19 nt, Human
gacagaucaagcugugaga

SEQ ID NO: 2503511 - RNA, 22 nt, Human
gacagcuugagccgggccccug

SEQ ID NO: 2503512 - RNA, 12 nt, Human
gacagcuuugcu

SEQ ID NO: 2503513 - RNA, 16 nt, Human
gacagcuuugcugcug

SEQ ID NO: 2503514 - RNA, 15 nt, Human
gacagcuuugcugcu

SEQ ID NO: 2503515 - RNA, 18 nt, Human
gacaggaaaauccucugg

SEQ ID NO: 2503516 - RNA, 22 nt, Human
gacagaggggguggccucccaa

SEQ ID NO: 2503517 - RNA, 21 nt, Human
gacagaggggguggccuccca

SEQ ID NO: 2503518 - RNA, 23 nt, Human
gacagaggggguggccucccaac

SEQ ID NO: 2503519 - RNA, 14 nt, Human
gacagagucucacu

SEQ ID NO: 2503520 - RNA, 19 nt, Human
gacagaggggguggccucc

SEQ ID NO: 2503521 - RNA, 18 nt, Human
gacagaggggguggccuc

SEQ ID NO: 2503522 - RNA, 15 nt, Human
gacagaggggguggc

SEQ ID NO: 2503523 - RNA, 17 nt, Human
gacagaggcagccccau

SEQ ID NO: 2503524 - RNA, 19 nt, Human
gacagagccaugcugggaa

SEQ ID NO: 2503525 - RNA, 13 nt, Human
gacagagccaugc

SEQ ID NO: 2503526 - RNA, 19 nt, Human
gacagagaggacuguaggg

SEQ ID NO: 2503527 - RNA, 16 nt, Human
gacagaggcagcccca

SEQ ID NO: 2503528 - RNA, 14 nt, Human
gacagaggcagccc

SEQ ID NO: 2503529 - RNA, 13 nt, Human
gacacccaggacu

SEQ ID NO: 2503530 - RNA, 14 nt, Human
gacacccaggacuu

SEQ ID NO: 2503531 - RNA, 15 nt, Human
gacacccauuuucac

SEQ ID NO: 2503532 - RNA, 19 nt, Human
gacacccauguuucucugg

SEQ ID NO: 2503533 - RNA, 14 nt, Human
gacacccaaagggu

SEQ ID NO: 2503534 - RNA, 22 nt, Human
gacaccaucuuuugugagaugu

SEQ ID NO: 2503535 - RNA, 22 nt, Human
gacaccagccuuucucccaggc

SEQ ID NO: 2503536 - RNA, 19 nt, Human
gacaccaggagucccuggu

SEQ ID NO: 2503537 - RNA, 20 nt, Human
gacaccaggagucccuggua

SEQ ID NO: 2503538 - RNA, 21 nt, Human
gacagagcaagugagacccug

SEQ ID NO: 2503539 - RNA, 16 nt, Human
gacagagaggacugua

SEQ ID NO: 2503540 - RNA, 15 nt, Human
gacagagaggacugu

SEQ ID NO: 2503541 - RNA, 19 nt, Human
gacagagaggacgugggcg

SEQ ID NO: 2503542 - RNA, 18 nt, Human
gacagagaggacgugggc

SEQ ID NO: 2503543 - RNA, 13 nt, Human
gacaucucugcac

SEQ ID NO: 2503544 - RNA, 20 nt, Human
gacaucucaggggccagagg

SEQ ID NO: 2503545 - RNA, 22 nt, Human
gacaucucaggggccagaggaa

SEQ ID NO: 2503546 - RNA, 19 nt, Human
gacaugagugcgugcucag

SEQ ID NO: 2503547 - RNA, 16 nt, Human
gacaugaaugcacacu

SEQ ID NO: 2503548 - RNA, 14 nt, Human
gacaugaucuucuu

SEQ ID NO: 2503549 - RNA, 16 nt, Human
gacaugauuuccuuga

SEQ ID NO: 2503550 - RNA, 17 nt, Human
gacaugauuuccuugaa

SEQ ID NO: 2503551 - RNA, 19 nt, Human
gacaugauuuccuugaaug

SEQ ID NO: 2503552 - RNA, 20 nt, Human
gacaugauuuccuugaaugu

SEQ ID NO: 2503553 - RNA, 14 nt, Human
gacaugauuuccuu

SEQ ID NO: 2503554 - RNA, 14 nt, Human
gacaugauuccuuc

SEQ ID NO: 2503555 - RNA, 16 nt, Human
gacaugauuccuuccu

SEQ ID NO: 2503556 - RNA, 21 nt, Human
gacaugauggagcgcaccugc

SEQ ID NO: 2503557 - RNA, 14 nt, Human
gacaugggaaaggg

SEQ ID NO: 2503558 - RNA, 22 nt, Human
gacaugcgggcugggcagcugu

SEQ ID NO: 2503559 - RNA, 21 nt, Human
gacaugcgggcugggcagcug

SEQ ID NO: 2503560 - RNA, 20 nt, Human
gacaugcgggcugggcagcu

SEQ ID NO: 2503561 - RNA, 18 nt, Human
gacaugcgggcugggcag

SEQ ID NO: 2503562 - RNA, 22 nt, Human
gacaugauuccuuccuguucug

SEQ ID NO: 2503563 - RNA, 15 nt, Human
gacaugcgggcuggg

SEQ ID NO: 2503564 - RNA, 14 nt, Human
gacaugcgggcugg

SEQ ID NO: 2503565 - RNA, 22 nt, Human
gacaugauuuccuugaaugugg

SEQ ID NO: 2503566 - RNA, 24 nt, Human
gacaugauuuccuugaauguggcu

SEQ ID NO: 2503567 - RNA, 14 nt, Human
gacaugcacucagc

SEQ ID NO: 2503568 - RNA, 17 nt, Human
gacauacuugaagggcc

SEQ ID NO: 2503569 - RNA, 18 nt, Human
gacauacuugaagggcca

SEQ ID NO: 2503570 - RNA, 19 nt, Human
gacauacuugaagggccag

SEQ ID NO: 2503571 - RNA, 20 nt, Human
gacauacuugaagggccaga

SEQ ID NO: 2503572 - RNA, 20 nt, Human
gacauagaauuaacacauga

SEQ ID NO: 2503573 - RNA, 22 nt, Human
gacaguuaagagaaaugagcuu

SEQ ID NO: 2503574 - RNA, 14 nt, Human
gacauacuugaagg

SEQ ID NO: 2503575 - RNA, 15 nt, Human
gacauacuugaaggg

SEQ ID NO: 2503576 - RNA, 23 nt, Human
gacaguguugaaaauguucagaa

SEQ ID NO: 2503577 - RNA, 22 nt, Human
gacauacuccuuccaucaaaua

SEQ ID NO: 2503578 - RNA, 16 nt, Human
gacauccucuucugcu

SEQ ID NO: 2503579 - RNA, 13 nt, Human
gacauccucuucu

SEQ ID NO: 2503580 - RNA, 18 nt, Human
gacauccuccucccaccc

SEQ ID NO: 2503581 - RNA, 23 nt, Human
gacauccucuucugcuuaggaga

SEQ ID NO: 2503582 - RNA, 18 nt, Human
gacaucucaggggccaga

SEQ ID NO: 2503583 - RNA, 17 nt, Human
gacaucucaggggccag

SEQ ID NO: 2503584 - RNA, 16 nt, Human
gacaucucaggggcca

SEQ ID NO: 2503585 - RNA, 15 nt, Human
gacaucucaggggcc

SEQ ID NO: 2503586 - RNA, 13 nt, Human
gacaucucagggg

SEQ ID NO: 2503587 - RNA, 22 nt, Human
gacauacuugaagggccagagc

SEQ ID NO: 2503588 - RNA, 23 nt, Human
gacauacuugaagggccagagcc

SEQ ID NO: 2503589 - RNA, 23 nt, Human
gacauccauguuuguaaaacuac

SEQ ID NO: 2503590 - RNA, 22 nt, Human
gacauccauguuuguaaaacua

SEQ ID NO: 2503591 - RNA, 15 nt, Human
gacauccuccuccca

SEQ ID NO: 2503592 - RNA, 16 nt, Human
gacauccguugugcuu

SEQ ID NO: 2503593 - RNA, 23 nt, Human
gacauccccccgccaaaagcugc

SEQ ID NO: 2503594 - RNA, 23 nt, Human
gacaggaccagggauuuccauga

SEQ ID NO: 2503595 - RNA, 15 nt, Human
gacaggaccagggau

SEQ ID NO: 2503596 - RNA, 14 nt, Human
gacaggaccaggga

SEQ ID NO: 2503597 - RNA, 19 nt, Human
gacaggaaaauccucuggc

SEQ ID NO: 2503598 - RNA, 12 nt, Human
gacaggaaaggg

SEQ ID NO: 2503599 - RNA, 17 nt, Human
gacaggaaagggaaggc

SEQ ID NO: 2503600 - RNA, 14 nt, Human
gacaggacagugcu

SEQ ID NO: 2503601 - RNA, 22 nt, Human
gacaggacagugcuucagccug

SEQ ID NO: 2503602 - RNA, 23 nt, Human
gacaggacagugcuucagccuga

SEQ ID NO: 2503603 - RNA, 17 nt, Human
gacagggaggacgcucu

SEQ ID NO: 2503604 - RNA, 14 nt, Human
gacagggaagcuac

SEQ ID NO: 2503605 - RNA, 14 nt, Human
gacaggaccuagga

SEQ ID NO: 2503606 - RNA, 13 nt, Human
gacaggaccugac

SEQ ID NO: 2503607 - RNA, 16 nt, Human
gacagggaagagcaga

SEQ ID NO: 2503608 - RNA, 18 nt, Human
gacagggaggacgcucuc

SEQ ID NO: 2503609 - RNA, 16 nt, Human
gacagggaggugaccc

SEQ ID NO: 2503610 - RNA, 23 nt, Human
gacagggcacaccgggcacucag

SEQ ID NO: 2503611 - RNA, 23 nt, Human
gacagggaugagcauggagcugg

SEQ ID NO: 2503612 - RNA, 21 nt, Human
gacagggaugagcauggagcu

SEQ ID NO: 2503613 - RNA, 14 nt, Human
gacagggaugagca

SEQ ID NO: 2503614 - RNA, 17 nt, Human
gacagggaagcuacagg

SEQ ID NO: 2503615 - RNA, 13 nt, Human
gacagggacccac

SEQ ID NO: 2503616 - RNA, 19 nt, Human
gacagggacccacuucaca

SEQ ID NO: 2503617 - RNA, 24 nt, Human
gacagggcacaccgggcacucaga

SEQ ID NO: 2503618 - RNA, 20 nt, Human
gacaguggauugcauuucuu

SEQ ID NO: 2503619 - RNA, 20 nt, Human
gacagugcuucagccugagg

SEQ ID NO: 2503620 - RNA, 18 nt, Human
gacagugcuucagccuga

SEQ ID NO: 2503621 - RNA, 19 nt, Human
gacagugcuucagccugag

SEQ ID NO: 2503622 - RNA, 14 nt, Human
gacaguuaagagaa

SEQ ID NO: 2503623 - RNA, 13 nt, Human
gacagugggaaau

SEQ ID NO: 2503624 - RNA, 17 nt, Human
gacagugcuucagccug

SEQ ID NO: 2503625 - RNA, 15 nt, Human
gacagugggaaauau

SEQ ID NO: 2503626 - RNA, 22 nt, Human
gaauuggguggggggcuucaua

SEQ ID NO: 2503627 - RNA, 23 nt, Human
gaauuggguggggggcuucauac

SEQ ID NO: 2503628 - RNA, 15 nt, Human
gaauuguaaggaaug

SEQ ID NO: 2503629 - RNA, 17 nt, Human
gaauugggagcuuggga

SEQ ID NO: 2503630 - RNA, 20 nt, Human
gaauuggguggggggcuuca

SEQ ID NO: 2503631 - RNA, 16 nt, Human
gaauugggagcuuggg

SEQ ID NO: 2503632 - RNA, 22 nt, Human
gaauuggaccauccuauuuaac

SEQ ID NO: 2503633 - RNA, 22 nt, Human
gaauugccugcagagagaagcc

SEQ ID NO: 2503634 - RNA, 21 nt, Human
gaauugccugcagagagaagc

SEQ ID NO: 2503635 - RNA, 17 nt, Human
gaauugcuugaaccugg

SEQ ID NO: 2503636 - RNA, 13 nt, Human
gaauuuccucuau

SEQ ID NO: 2503637 - RNA, 12 nt, Human
gaauuucuaaaa

SEQ ID NO: 2503638 - RNA, 16 nt, Human
gaauuguaacuguucu

SEQ ID NO: 2503639 - RNA, 17 nt, Human
gaauuucuaaaaaacag

SEQ ID NO: 2503640 - RNA, 21 nt, Human
gaauuuccucuauugauguac

SEQ ID NO: 2503641 - RNA, 21 nt, Human
gaauuuguaaccucagcucug

SEQ ID NO: 2503642 - RNA, 19 nt, Human
gaauuuguaaccucagcuc

SEQ ID NO: 2503643 - RNA, 18 nt, Human
gaauuuguaaccucagcu

SEQ ID NO: 2503644 - RNA, 17 nt, Human
gaauuuguaaccucagc

SEQ ID NO: 2503645 - RNA, 16 nt, Human
gaauuuguaaccucag

SEQ ID NO: 2503646 - RNA, 22 nt, Human
gaauuuguaaguuuaugucuaa

SEQ ID NO: 2503647 - RNA, 14 nt, Human
gaauuuguaaguuu

SEQ ID NO: 2503648 - RNA, 19 nt, Human
gaauuugcaagucauggcu

SEQ ID NO: 2503649 - RNA, 17 nt, Human
gaauuugagugcucuga

SEQ ID NO: 2503650 - RNA, 19 nt, Human
gaauuugaaugaaaaauuu

SEQ ID NO: 2503651 - RNA, 23 nt, Human
gaauuugaucguuccaguuccca

SEQ ID NO: 2503652 - RNA, 13 nt, Human
gaauuugcugggg

SEQ ID NO: 2503653 - RNA, 19 nt, Human
gaauuuggagacucugugg

SEQ ID NO: 2503654 - RNA, 19 nt, Human
gaauuuggccugcacuaau

SEQ ID NO: 2503655 - RNA, 22 nt, Human
gaauuucuuuugccguuauuaa

SEQ ID NO: 2503656 - RNA, 21 nt, Human
gaauuucuucaacucccugcc

SEQ ID NO: 2503657 - RNA, 14 nt, Human
gaauuugaaugaaa

SEQ ID NO: 2503658 - RNA, 16 nt, Human
gaauuugaaugaaaaa

SEQ ID NO: 2503659 - RNA, 17 nt, Human
gaauuugaaugaaaaau

SEQ ID NO: 2503660 - RNA, 19 nt, Human
gaauuucuucacuguugaa

SEQ ID NO: 2503661 - RNA, 12 nt, Human
gaauuucuuggu

SEQ ID NO: 2503662 - RNA, 20 nt, Human
gaauuucuucacuguugaaa

SEQ ID NO: 2503663 - RNA, 21 nt, Human
gaauuucuugguaagaagccg

SEQ ID NO: 2503664 - RNA, 20 nt, Human
gacaaauucuguuucuugag

SEQ ID NO: 2503665 - RNA, 16 nt, Human
gacaaauucuguuucu

SEQ ID NO: 2503666 - RNA, 17 nt, Human
gacaaauucuguuucuu

SEQ ID NO: 2503667 - RNA, 22 nt, Human
gacaaauguguaucggaugcuu

SEQ ID NO: 2503668 - RNA, 12 nt, Human
gacaaauucugu

SEQ ID NO: 2503669 - RNA, 14 nt, Human
gacaaauucuguuu

SEQ ID NO: 2503670 - RNA, 15 nt, Human
gacaaauucuguuuc

SEQ ID NO: 2503671 - RNA, 21 nt, Human
gacaaaugcugcgcccuuccc

SEQ ID NO: 2503672 - RNA, 22 nt, Human
gacaaaugcugcgcccuucccc

SEQ ID NO: 2503673 - RNA, 17 nt, Human
gacaaaucaagcuucag

SEQ ID NO: 2503674 - RNA, 23 nt, Human
gacaacacucauugaccugaggc

SEQ ID NO: 2503675 - RNA, 22 nt, Human
gacaacacucauugaccugagg

SEQ ID NO: 2503676 - RNA, 12 nt, Human
gacaacagaagu

SEQ ID NO: 2503677 - RNA, 14 nt, Human
gacaacagaaguca

SEQ ID NO: 2503678 - RNA, 17 nt, Human
gacaacagaagucauga

SEQ ID NO: 2503679 - RNA, 22 nt, Human
gacaacagaagucaugaagccc

SEQ ID NO: 2503680 - RNA, 23 nt, Human
gacaacaaauuagguuuuguaca

SEQ ID NO: 2503681 - RNA, 21 nt, Human
gacaacaaauuagguuuugua

SEQ ID NO: 2503682 - RNA, 19 nt, Human
gacaacacugggaaacaga

SEQ ID NO: 2503683 - RNA, 11 nt, Human
gacaacaucug

SEQ ID NO: 2503684 - RNA, 12 nt, Human
gacaacagaagc

SEQ ID NO: 2503685 - RNA, 16 nt, Human
gacaacagacuucuga

SEQ ID NO: 2503686 - RNA, 18 nt, Human
gacaaccaccgcucccca

SEQ ID NO: 2503687 - RNA, 19 nt, Human
gacaaccaccgcuccccag

SEQ ID NO: 2503688 - RNA, 22 nt, Human
gacaaccaccgcuccccagccc

SEQ ID NO: 2503689 - RNA, 17 nt, Human
gacaaccaccgcucccc

SEQ ID NO: 2503690 - RNA, 12 nt, Human
gacaacauuaaa

SEQ ID NO: 2503691 - RNA, 17 nt, Human
gacaaccacuggucugu

SEQ ID NO: 2503692 - RNA, 15 nt, Human
gacaaccacuggucu

SEQ ID NO: 2503693 - RNA, 12 nt, Human
gacaaccaugac

SEQ ID NO: 2503694 - RNA, 19 nt, Human
gacaaccacuggucuguag

SEQ ID NO: 2503695 - RNA, 23 nt, Human
gacaaccaccgcuccccagccca

SEQ ID NO: 2503696 - RNA, 13 nt, Human
gacaacccugcaa

SEQ ID NO: 2503697 - RNA, 20 nt, Human
gacaacccugcaaaggacug

SEQ ID NO: 2503698 - RNA, 18 nt, Human
gacaaccgaugcuccagc

SEQ ID NO: 2503699 - RNA, 19 nt, Human
gacaaccgaugcuccagcc

SEQ ID NO: 2503700 - RNA, 20 nt, Human
gacaaccgaugcuccagcca

SEQ ID NO: 2503701 - RNA, 15 nt, Human
gacaagacuucagua

SEQ ID NO: 2503702 - RNA, 18 nt, Human
gacaacuuugccagcuuu

SEQ ID NO: 2503703 - RNA, 14 nt, Human
gacaacgaggaagc

SEQ ID NO: 2503704 - RNA, 21 nt, Human
gacaaccgaugcuccagccaa

SEQ ID NO: 2503705 - RNA, 17 nt, Human
gacaacguuucagcgac

SEQ ID NO: 2503706 - RNA, 15 nt, Human
gacaacgaggaagcc

SEQ ID NO: 2503707 - RNA, 16 nt, Human
gacaacgaggaagccc

SEQ ID NO: 2503708 - RNA, 16 nt, Human
gacacaagccuucggc

SEQ ID NO: 2503709 - RNA, 14 nt, Human
gacacaaaccugcc

SEQ ID NO: 2503710 - RNA, 17 nt, Human
gacacaaaccugccugg

SEQ ID NO: 2503711 - RNA, 20 nt, Human
gacacaaaccugccuggguu

SEQ ID NO: 2503712 - RNA, 18 nt, Human
gacacaaaccugccuggg

SEQ ID NO: 2503713 - RNA, 13 nt, Human
gacacaacuauuu

SEQ ID NO: 2503714 - RNA, 19 nt, Human
gacacaggcccggcuccag

SEQ ID NO: 2503715 - RNA, 21 nt, Human
gacacaggcccggcuccaggc

SEQ ID NO: 2503716 - RNA, 20 nt, Human
gacacaggcccggcuccagg

SEQ ID NO: 2503717 - RNA, 14 nt, Human
gacacaugcaaggu

SEQ ID NO: 2503718 - RNA, 13 nt, Human
gacacaggcccuc

SEQ ID NO: 2503719 - RNA, 14 nt, Human
gacacaacaacucc

SEQ ID NO: 2503720 - RNA, 23 nt, Human
gacacauguccaagaagcccagg

SEQ ID NO: 2503721 - RNA, 20 nt, Human
gacacauguccaagaagccc

SEQ ID NO: 2503722 - RNA, 15 nt, Human
gacacauguccaaga

SEQ ID NO: 2503723 - RNA, 19 nt, Human
gacacaugcaaggucauuu

SEQ ID NO: 2503724 - RNA, 18 nt, Human
gacaccacacccagccuc

SEQ ID NO: 2503725 - RNA, 17 nt, Human
gacaccacacccagccu

SEQ ID NO: 2503726 - RNA, 16 nt, Human
gacaccacacccagcc

SEQ ID NO: 2503727 - RNA, 15 nt, Human
gacaccacacccagc

SEQ ID NO: 2503728 - RNA, 14 nt, Human
gacaccacacccag

SEQ ID NO: 2503729 - RNA, 21 nt, Human
gacacauucaacccuggagag

SEQ ID NO: 2503730 - RNA, 20 nt, Human
gacacauucaacccuggaga

SEQ ID NO: 2503731 - RNA, 18 nt, Human
gacaccagagcagaugca

SEQ ID NO: 2503732 - RNA, 15 nt, Human
gacaccagagcagau

SEQ ID NO: 2503733 - RNA, 14 nt, Human
gacaccagagcaga

SEQ ID NO: 2503734 - RNA, 13 nt, Human
gacaccagagcag

SEQ ID NO: 2503735 - RNA, 12 nt, Human
gacaccagagca

SEQ ID NO: 2503736 - RNA, 21 nt, Human
gacaccacacccagccucagu

SEQ ID NO: 2503737 - RNA, 20 nt, Human
gacaccacacccagccucag

SEQ ID NO: 2503738 - RNA, 19 nt, Human
gacaccacacccagccuca

SEQ ID NO: 2503739 - RNA, 15 nt, Human
gacaccagccaggcu

SEQ ID NO: 2503740 - RNA, 14 nt, Human
gacaccagccaggc

SEQ ID NO: 2503741 - RNA, 22 nt, Human
gacaccagagcagaugcagaga

SEQ ID NO: 2503742 - RNA, 19 nt, Human
gacaccagagcagaugcag

SEQ ID NO: 2503743 - RNA, 19 nt, Human
gacaccagccaggcucugu

SEQ ID NO: 2503744 - RNA, 17 nt, Human
gacaccagccaggcucu

SEQ ID NO: 2503745 - RNA, 23 nt, Human
gacaccagccaggcucugugcug

SEQ ID NO: 2503746 - RNA, 20 nt, Human
gacaccagccuuucucccag

SEQ ID NO: 2503747 - RNA, 13 nt, Human
gacaauucaugaa

SEQ ID NO: 2503748 - RNA, 16 nt, Human
gacaauucaugaacuu

SEQ ID NO: 2503749 - RNA, 16 nt, Human
gacacaaaaaguagau

SEQ ID NO: 2503750 - RNA, 22 nt, Human
gacaauucuuuauacaacagug

SEQ ID NO: 2503751 - RNA, 15 nt, Human
gacaauucuuuauac

SEQ ID NO: 2503752 - RNA, 13 nt, Human
gacaauucuuuau

SEQ ID NO: 2503753 - RNA, 19 nt, Human
gacaaugugaaaagaaaaa

SEQ ID NO: 2503754 - RNA, 20 nt, Human
gacaaugugaaaagaaaaau

SEQ ID NO: 2503755 - RNA, 12 nt, Human
gacaaugugaaa

SEQ ID NO: 2503756 - RNA, 18 nt, Human
gacaaugugaaaagaaaa

SEQ ID NO: 2503757 - RNA, 22 nt, Human
gacaaugcaaaccaucauugaa

SEQ ID NO: 2503758 - RNA, 14 nt, Human
gacaaugucugaac

SEQ ID NO: 2503759 - RNA, 21 nt, Human
gacaaggauugcuacuguccu

SEQ ID NO: 2503760 - RNA, 19 nt, Human
gacaaggauugcuacuguc

SEQ ID NO: 2503761 - RNA, 21 nt, Human
gacaaggaugaucuaggaaga

SEQ ID NO: 2503762 - RNA, 18 nt, Human
gacaaggauugcuacugu

SEQ ID NO: 2503763 - RNA, 16 nt, Human
gacaaggaaaaaauaa

SEQ ID NO: 2503764 - RNA, 15 nt, Human
gacaagaaaucccug

SEQ ID NO: 2503765 - RNA, 16 nt, Human
gacaagaaaucccugu

SEQ ID NO: 2503766 - RNA, 19 nt, Human
gacaaggaaaggcaaaugc

SEQ ID NO: 2503767 - RNA, 17 nt, Human
gacaaggaaaggcaaau

SEQ ID NO: 2503768 - RNA, 19 nt, Human
gacaaggagaagagcaagg

SEQ ID NO: 2503769 - RNA, 14 nt, Human
gaaugcuguguuaa

SEQ ID NO: 2503770 - RNA, 18 nt, Human
gaaugcuuauagguggcc

SEQ ID NO: 2503771 - RNA, 16 nt, Human
gaaugcuuccuagaag

SEQ ID NO: 2503772 - RNA, 22 nt, Human
gaaugcuuauagguggccucuc

SEQ ID NO: 2503773 - RNA, 18 nt, Human
gaaugcuucugacuucau

SEQ ID NO: 2503774 - RNA, 21 nt, Human
gaaugcuucugacuucauaga

SEQ ID NO: 2503775 - RNA, 17 nt, Human
gaaugcuugaaaaaugu

SEQ ID NO: 2503776 - RNA, 16 nt, Human
gaaugcuugaaaaaug

SEQ ID NO: 2503777 - RNA, 13 nt, Human
gaaugcuugaaaa

SEQ ID NO: 2503778 - RNA, 15 nt, Human
gaaugcuucuucuca

SEQ ID NO: 2503779 - RNA, 17 nt, Human
gaauggcacagcccaaa

SEQ ID NO: 2503780 - RNA, 22 nt, Human
gaauggcacagcccaaagaagg

SEQ ID NO: 2503781 - RNA, 13 nt, Human
gaauggcagcugc

SEQ ID NO: 2503782 - RNA, 20 nt, Human
gaaugcuugaaaaaugugca

SEQ ID NO: 2503783 - RNA, 16 nt, Human
gaauggcagcugccac

SEQ ID NO: 2503784 - RNA, 21 nt, Human
gaaugcacaaacagaggccgc

SEQ ID NO: 2503785 - RNA, 20 nt, Human
gaaugcacacuagccucucc

SEQ ID NO: 2503786 - RNA, 22 nt, Human
gaaugcacacuagccucuccag

SEQ ID NO: 2503787 - RNA, 13 nt, Human
gaaugcuguguua

SEQ ID NO: 2503788 - RNA, 15 nt, Human
gaaugcuguauaugu

SEQ ID NO: 2503789 - RNA, 23 nt, Human
gaaugaaauccugcuucagugua

SEQ ID NO: 2503790 - RNA, 19 nt, Human
gaaugaaauacuguuugag

SEQ ID NO: 2503791 - RNA, 15 nt, Human
gaaugaaauacuguu

SEQ ID NO: 2503792 - RNA, 18 nt, Human
gaaugaaauacuguuuga

SEQ ID NO: 2503793 - RNA, 22 nt, Human
gaaucuggaccccaucugugaa

SEQ ID NO: 2503794 - RNA, 23 nt, Human
gaaucuggaccccaucugugaau

SEQ ID NO: 2503795 - RNA, 12 nt, Human
gaaucuggagac

SEQ ID NO: 2503796 - RNA, 20 nt, Human
gaaugcacaaacagaggccg

SEQ ID NO: 2503797 - RNA, 16 nt, Human
gaaugaaauugcugaa

SEQ ID NO: 2503798 - RNA, 20 nt, Human
gaaugaacacucuuuugcuu

SEQ ID NO: 2503799 - RNA, 13 nt, Human
gaaugaacaaauu

SEQ ID NO: 2503800 - RNA, 21 nt, Human
gaaucuggaccccaucuguga

SEQ ID NO: 2503801 - RNA, 21 nt, Human
gaaugaaagggcccagagagg

SEQ ID NO: 2503802 - RNA, 14 nt, Human
gaaucucugugccu

SEQ ID NO: 2503803 - RNA, 13 nt, Human
gaaucucugugcc

SEQ ID NO: 2503804 - RNA, 15 nt, Human
gaaucucugugccuu

SEQ ID NO: 2503805 - RNA, 18 nt, Human
gaaucucuuuuugcuuuc

SEQ ID NO: 2503806 - RNA, 18 nt, Human
gaaucucugaauuugaga

SEQ ID NO: 2503807 - RNA, 12 nt, Human
gaaaggcuccag

SEQ ID NO: 2503808 - RNA, 12 nt, Human
gaaucagcuucu

SEQ ID NO: 2503809 - RNA, 21 nt, Human
gaaaggcucagucucaggagc

SEQ ID NO: 2503810 - RNA, 22 nt, Human
gaaaggcucagucucaggagca

SEQ ID NO: 2503811 - RNA, 18 nt, Human
gaaaggccuuuaaaauuu

SEQ ID NO: 2503812 - RNA, 14 nt, Human
gaaaggcucagucu

SEQ ID NO: 2503813 - RNA, 18 nt, Human
gaaaggcucagucucagg

SEQ ID NO: 2503814 - RNA, 19 nt, Human
gaaaggcucagucucagga

SEQ ID NO: 2503815 - RNA, 15 nt, Human
gaaaggccuuuaaaa

SEQ ID NO: 2503816 - RNA, 14 nt, Human
gaaaggccuuuaaa

SEQ ID NO: 2503817 - RNA, 19 nt, Human
gaaaggccagcuggcagca

SEQ ID NO: 2503818 - RNA, 21 nt, Human
gaaaggccagcuggcagcaga

SEQ ID NO: 2503819 - RNA, 22 nt, Human
gaaaggccagcuggcagcagag

SEQ ID NO: 2503820 - RNA, 17 nt, Human
gaaaggcauucucugaa

SEQ ID NO: 2503821 - RNA, 12 nt, Human
gaaaggccagcu

SEQ ID NO: 2503822 - RNA, 14 nt, Human
gaaaggccagcugg

SEQ ID NO: 2503823 - RNA, 16 nt, Human
gaaaggccagcuggca

SEQ ID NO: 2503824 - RNA, 17 nt, Human
gaaucauucucgauuua

SEQ ID NO: 2503825 - RNA, 19 nt, Human
gaaucaugugaacccggga

SEQ ID NO: 2503826 - RNA, 21 nt, Human
gaaucaugucaggccugugug

SEQ ID NO: 2503827 - RNA, 20 nt, Human
gaaucaugucaggccugugu

SEQ ID NO: 2503828 - RNA, 17 nt, Human
gaaucaugucaggccug

SEQ ID NO: 2503829 - RNA, 14 nt, Human
gaaucauguaguau

SEQ ID NO: 2503830 - RNA, 13 nt, Human
gaaucauguagua

SEQ ID NO: 2503831 - RNA, 19 nt, Human
gaaucauaugauucugcuu

SEQ ID NO: 2503832 - RNA, 15 nt, Human
gaaucagugcaaaga

SEQ ID NO: 2503833 - RNA, 23 nt, Human
gaaucaggaauauuuuccaaaga

SEQ ID NO: 2503834 - RNA, 21 nt, Human
gaaucaggaauauuuuccaaa

SEQ ID NO: 2503835 - RNA, 20 nt, Human
gaaucaguauugggagccgg

SEQ ID NO: 2503836 - RNA, 19 nt, Human
gaaucaguauaaacaaagu

SEQ ID NO: 2503837 - RNA, 21 nt, Human
gaaucaguauaaacaaaguua

SEQ ID NO: 2503838 - RNA, 11 nt, Human
gaaucauguag

SEQ ID NO: 2503839 - RNA, 19 nt, Human
gaaucauacuuagcaaagu

SEQ ID NO: 2503840 - RNA, 20 nt, Human
gaauccagacccggcugcgu

SEQ ID NO: 2503841 - RNA, 18 nt, Human
gaauccagacccggcugc

SEQ ID NO: 2503842 - RNA, 17 nt, Human
gaaucccaaauuugauu

SEQ ID NO: 2503843 - RNA, 19 nt, Human
gaaucccaaauuugauuga

SEQ ID NO: 2503844 - RNA, 16 nt, Human
gaaucccaaauuugau

SEQ ID NO: 2503845 - RNA, 13 nt, Human
gaauccaugcuug

SEQ ID NO: 2503846 - RNA, 14 nt, Human
gaauccaugcuugg

SEQ ID NO: 2503847 - RNA, 22 nt, Human
gaaucccacccacaugugacac

SEQ ID NO: 2503848 - RNA, 18 nt, Human
gaaucccacccacaugug

SEQ ID NO: 2503849 - RNA, 15 nt, Human
gaaucccaagaccca

SEQ ID NO: 2503850 - RNA, 18 nt, Human
gaaucuacccccagaucc

SEQ ID NO: 2503851 - RNA, 22 nt, Human
gaaucuacccccagauccaagc

SEQ ID NO: 2503852 - RNA, 14 nt, Human
gaaucgcuucucuu

SEQ ID NO: 2503853 - RNA, 16 nt, Human
gaaucuacccaaagga

SEQ ID NO: 2503854 - RNA, 12 nt, Human
gaaucuaccaac

SEQ ID NO: 2503855 - RNA, 14 nt, Human
gaaucgaggaacca

SEQ ID NO: 2503856 - RNA, 16 nt, Human
gaaucgaggaaccaga

SEQ ID NO: 2503857 - RNA, 18 nt, Human
gaaucgaggaaccagagc

SEQ ID NO: 2503858 - RNA, 19 nt, Human
gaaucgaggaaccagagcc

SEQ ID NO: 2503859 - RNA, 15 nt, Human
gaaucuacuaauucc

SEQ ID NO: 2503860 - RNA, 17 nt, Human
gaaucuacccaaaggau

SEQ ID NO: 2503861 - RNA, 13 nt, Human
gaaucuauauuua

SEQ ID NO: 2503862 - RNA, 19 nt, Human
gaauguaaucaauguuucu

SEQ ID NO: 2503863 - RNA, 18 nt, Human
gaauguaaucaauguuuc

SEQ ID NO: 2503864 - RNA, 16 nt, Human
gaauguaaucaauguu

SEQ ID NO: 2503865 - RNA, 13 nt, Human
gaauguaaucaau

SEQ ID NO: 2503866 - RNA, 11 nt, Human
gaauguaauca

SEQ ID NO: 2503867 - RNA, 18 nt, Human
gaauggccuccucccuua

SEQ ID NO: 2503868 - RNA, 17 nt, Human
gaauggccugccuugaa

SEQ ID NO: 2503869 - RNA, 21 nt, Human
gaauggccugccuugaagcca

SEQ ID NO: 2503870 - RNA, 14 nt, Human
gaauguacucuguu

SEQ ID NO: 2503871 - RNA, 20 nt, Human
gaauguagcugguuuccuca

SEQ ID NO: 2503872 - RNA, 15 nt, Human
gaauguagcugguuu

SEQ ID NO: 2503873 - RNA, 16 nt, Human
gaaugucaguaugugg

SEQ ID NO: 2503874 - RNA, 18 nt, Human
gaaugucaguauguggaa

SEQ ID NO: 2503875 - RNA, 13 nt, Human
gaaugucaguaug

SEQ ID NO: 2503876 - RNA, 21 nt, Human
gaauguauauguuuuguggga

SEQ ID NO: 2503877 - RNA, 15 nt, Human
gaauguaucaggaaa

SEQ ID NO: 2503878 - RNA, 17 nt, Human
gaauguaucaggaaaua

SEQ ID NO: 2503879 - RNA, 13 nt, Human
gaaugucagugug

SEQ ID NO: 2503880 - RNA, 19 nt, Human
gaaugucaguauguggaag

SEQ ID NO: 2503881 - RNA, 16 nt, Human
gaauguaucaggaaau

SEQ ID NO: 2503882 - RNA, 14 nt, Human
gaaugugauuuuaa

SEQ ID NO: 2503883 - RNA, 15 nt, Human
gaaugugcagguuug

SEQ ID NO: 2503884 - RNA, 19 nt, Human
gaaugugauuuuaaagagu

SEQ ID NO: 2503885 - RNA, 17 nt, Human
gaaugugauuuuaaaga

SEQ ID NO: 2503886 - RNA, 14 nt, Human
gaaugugaaagcac

SEQ ID NO: 2503887 - RNA, 16 nt, Human
gaaugucuuuugaaua

SEQ ID NO: 2503888 - RNA, 22 nt, Human
gaaugucuuuguuggaaaagaa

SEQ ID NO: 2503889 - RNA, 18 nt, Human
gaauguguacaaagugua

SEQ ID NO: 2503890 - RNA, 21 nt, Human
gaaugugcagguuuguuacau

SEQ ID NO: 2503891 - RNA, 22 nt, Human
gaauguggccccugaacaagaa

SEQ ID NO: 2503892 - RNA, 18 nt, Human
gaauguggcuugagaaau

SEQ ID NO: 2503893 - RNA, 14 nt, Human
gaauguuaagcaga

SEQ ID NO: 2503894 - RNA, 14 nt, Human
gaauguuaaauaaa

SEQ ID NO: 2503895 - RNA, 13 nt, Human
gaauguuaaauaa

SEQ ID NO: 2503896 - RNA, 16 nt, Human
gaauguuaaagucagu

SEQ ID NO: 2503897 - RNA, 11 nt, Human
gaauguucuga

SEQ ID NO: 2503898 - RNA, 15 nt, Human
gaauguucugacauu

SEQ ID NO: 2503899 - RNA, 16 nt, Human
gaauguucugacauua

SEQ ID NO: 2503900 - RNA, 17 nt, Human
gaauguucugacauuaa

SEQ ID NO: 2503901 - RNA, 19 nt, Human
gaauguucugacauuaaca

SEQ ID NO: 2503902 - RNA, 23 nt, Human
gaauguugggacugcuaaauaaa

SEQ ID NO: 2503903 - RNA, 20 nt, Human
gaauguucugacauuaacag

SEQ ID NO: 2503904 - RNA, 15 nt, Human
gaauguuaagcagau

SEQ ID NO: 2503905 - RNA, 18 nt, Human
gaauguuaaauaaauugu

SEQ ID NO: 2503906 - RNA, 16 nt, Human
gaauguuaaauaaauu

SEQ ID NO: 2503907 - RNA, 21 nt, Human
gaauguuaaauaaauuguaua

SEQ ID NO: 2503908 - RNA, 17 nt, Human
gaauguuacauuguuug

SEQ ID NO: 2503909 - RNA, 20 nt, Human
gaauguuacauuguuugucu

SEQ ID NO: 2503910 - RNA, 14 nt, Human
gaauguuuauuccu

SEQ ID NO: 2503911 - RNA, 21 nt, Human
gaauguuuacacucuuuguaa

SEQ ID NO: 2503912 - RNA, 14 nt, Human
gaauguugggacug

SEQ ID NO: 2503913 - RNA, 20 nt, Human
gaauguuuacacucuuugua

SEQ ID NO: 2503914 - RNA, 16 nt, Human
gaauguuuauagcaaa

SEQ ID NO: 2503915 - RNA, 18 nt, Human
gaauucuuacauguuuuc

SEQ ID NO: 2503916 - RNA, 16 nt, Human
gaauugacccacaaga

SEQ ID NO: 2503917 - RNA, 21 nt, Human
gaauugacccacaagaaauga

SEQ ID NO: 2503918 - RNA, 21 nt, Human
gaauucuuaugcuuauaauau

SEQ ID NO: 2503919 - RNA, 18 nt, Human
gaauucuugaaggaaaau

SEQ ID NO: 2503920 - RNA, 19 nt, Human
gaauucuuacauguuuucu

SEQ ID NO: 2503921 - RNA, 22 nt, Human
gaauucuuacauguuuucuuug

SEQ ID NO: 2503922 - RNA, 16 nt, Human
gaauuggagcucgugg

SEQ ID NO: 2503923 - RNA, 20 nt, Human
gaauugccugcagagagaag

SEQ ID NO: 2503924 - RNA, 16 nt, Human
gaauugccugcagaga

SEQ ID NO: 2503925 - RNA, 22 nt, Human
gaauugauuugcauugaacaca

SEQ ID NO: 2503926 - RNA, 18 nt, Human
gaauugauuugcauugaa

SEQ ID NO: 2503927 - RNA, 12 nt, Human
gaauugcauuga

SEQ ID NO: 2503928 - RNA, 13 nt, Human
gaauugcauugac

SEQ ID NO: 2503929 - RNA, 14 nt, Human
gaauugcagaguac

SEQ ID NO: 2503930 - RNA, 15 nt, Human
gauugauaauugcau

SEQ ID NO: 2503931 - RNA, 22 nt, Human
gauugaucggagccuccucucu

SEQ ID NO: 2503932 - RNA, 19 nt, Human
gauugauagaguguuauca

SEQ ID NO: 2503933 - RNA, 15 nt, Human
gauugauuugaagaa

SEQ ID NO: 2503934 - RNA, 17 nt, Human
gauugauuugaagaaca

SEQ ID NO: 2503935 - RNA, 22 nt, Human
gauugaggccugcccucaggga

SEQ ID NO: 2503936 - RNA, 19 nt, Human
gauugagaaggagagaaag

SEQ ID NO: 2503937 - RNA, 16 nt, Human
gauugagucugugcca

SEQ ID NO: 2503938 - RNA, 13 nt, Human
gauugaggccugc

SEQ ID NO: 2503939 - RNA, 18 nt, Human
gauugagaaggagagaaa

SEQ ID NO: 2503940 - RNA, 17 nt, Human
gauugagaaggagagaa

SEQ ID NO: 2503941 - RNA, 16 nt, Human
gauugagaaggagaga

SEQ ID NO: 2503942 - RNA, 13 nt, Human
gauugagaaggag

SEQ ID NO: 2503943 - RNA, 16 nt, Human
gauucucaugccucag

SEQ ID NO: 2503944 - RNA, 14 nt, Human
gauucuccugccuc

SEQ ID NO: 2503945 - RNA, 23 nt, Human
gauugcaggagucccugccauca

SEQ ID NO: 2503946 - RNA, 19 nt, Human
gauugcagguggaacucag

SEQ ID NO: 2503947 - RNA, 17 nt, Human
gauugcaugugacucug

SEQ ID NO: 2503948 - RNA, 22 nt, Human
gauugcauuagaaauagacagu

SEQ ID NO: 2503949 - RNA, 22 nt, Human
gauucacaaugaaaugcucucc

SEQ ID NO: 2503950 - RNA, 18 nt, Human
gauucacaaugaaaugcu

SEQ ID NO: 2503951 - RNA, 15 nt, Human
gauucuauuuauaug

SEQ ID NO: 2503952 - RNA, 20 nt, Human
gauucuauuuauauguacau

SEQ ID NO: 2503953 - RNA, 21 nt, Human
gauucuauuuauauguacaug

SEQ ID NO: 2503954 - RNA, 22 nt, Human
gauucucagggucucugcugcc

SEQ ID NO: 2503955 - RNA, 21 nt, Human
gauucucagggucucugcugc

SEQ ID NO: 2503956 - RNA, 23 nt, Human
gauucucagggucucugcugccg

SEQ ID NO: 2503957 - RNA, 19 nt, Human
gauucucagggucucugcu

SEQ ID NO: 2503958 - RNA, 17 nt, Human
gauucucagggucucug

SEQ ID NO: 2503959 - RNA, 12 nt, Human
gauucucagggu

SEQ ID NO: 2503960 - RNA, 11 nt, Human
gauucucagau

SEQ ID NO: 2503961 - RNA, 21 nt, Human
gauucaaucuguaaacugugu

SEQ ID NO: 2503962 - RNA, 22 nt, Human
gauucaaucuguaaacugugua

SEQ ID NO: 2503963 - RNA, 20 nt, Human
gauucaaucuguaaacugug

SEQ ID NO: 2503964 - RNA, 19 nt, Human
gauucaaucuguaaacugu

SEQ ID NO: 2503965 - RNA, 18 nt, Human
gauuacaggcuccugcca

SEQ ID NO: 2503966 - RNA, 21 nt, Human
gauuacaggcuccugccacca

SEQ ID NO: 2503967 - RNA, 20 nt, Human
gauuacagggaugagccacc

SEQ ID NO: 2503968 - RNA, 18 nt, Human
gauuacagggaugagcca

SEQ ID NO: 2503969 - RNA, 22 nt, Human
gauuuccugcuuugggaagccg

SEQ ID NO: 2503970 - RNA, 17 nt, Human
gauuuccuugaaugugg

SEQ ID NO: 2503971 - RNA, 22 nt, Human
gauuuccuugaauguggcuuga

SEQ ID NO: 2503972 - RNA, 13 nt, Human
gauuuccuugaau

SEQ ID NO: 2503973 - RNA, 15 nt, Human
gauuuaacagaaaug

SEQ ID NO: 2503974 - RNA, 22 nt, Human
gauuuccguuaaaauaccagcc

SEQ ID NO: 2503975 - RNA, 19 nt, Human
gauuugaagaacaugugag

SEQ ID NO: 2503976 - RNA, 20 nt, Human
gauuugaagaacaugugaga

SEQ ID NO: 2503977 - RNA, 13 nt, Human
gauuugacauugc

SEQ ID NO: 2503978 - RNA, 23 nt, Human
gauuucuagaaagccuguucccc

SEQ ID NO: 2503979 - RNA, 19 nt, Human
gauuucgugggucuguuuu

SEQ ID NO: 2503980 - RNA, 20 nt, Human
gauuucgugggucuguuuuc

SEQ ID NO: 2503981 - RNA, 18 nt, Human
gauuugaagaacauguga

SEQ ID NO: 2503982 - RNA, 18 nt, Human
gauuugaugcuguuugac

SEQ ID NO: 2503983 - RNA, 21 nt, Human
gauuugaugcuggagagguua

SEQ ID NO: 2503984 - RNA, 15 nt, Human
gauuugaugcuggag

SEQ ID NO: 2503985 - RNA, 23 nt, Human
gauuugaggagcagcuucaguug

SEQ ID NO: 2503986 - RNA, 22 nt, Human
gauuugaggagcagcuucaguu

SEQ ID NO: 2503987 - RNA, 21 nt, Human
gauuugacuguuuuuacccau

SEQ ID NO: 2503988 - RNA, 18 nt, Human
gauuugacuguuuuuacc

SEQ ID NO: 2503989 - RNA, 14 nt, Human
gauuugacuguuuu

SEQ ID NO: 2503990 - RNA, 16 nt, Human
gauuugagcucagccc

SEQ ID NO: 2503991 - RNA, 13 nt, Human
gauuugacuguuu

SEQ ID NO: 2503992 - RNA, 12 nt, Human
gauuugacuguu

SEQ ID NO: 2503993 - RNA, 16 nt, Human
gauuugaagcaaagca

SEQ ID NO: 2503994 - RNA, 13 nt, Human
gauuuaacagaaa

SEQ ID NO: 2503995 - RNA, 14 nt, Human
gauuuaacagaaau

SEQ ID NO: 2503996 - RNA, 18 nt, Human
gauuguaacguugcugug

SEQ ID NO: 2503997 - RNA, 23 nt, Human
gauuguaaaauagcuuguauagu

SEQ ID NO: 2503998 - RNA, 20 nt, Human
gauuguaaaauagcuuguau

SEQ ID NO: 2503999 - RNA, 12 nt, Human
gauuguaaaaua

SEQ ID NO: 2504000 - RNA, 22 nt, Human
gauuguaaaaaaaaaugccuuu

SEQ ID NO: 2504001 - RNA, 18 nt, Human
gauuguaaaaaaaaaugc

SEQ ID NO: 2504002 - RNA, 12 nt, Human
gauuuaaaucag

SEQ ID NO: 2504003 - RNA, 12 nt, Human
gauugggucuag

SEQ ID NO: 2504004 - RNA, 18 nt, Human
gauugggggcuggugcca

SEQ ID NO: 2504005 - RNA, 17 nt, Human
gauugggggcuggugcc

SEQ ID NO: 2504006 - RNA, 14 nt, Human
gauugggggcuggu

SEQ ID NO: 2504007 - RNA, 18 nt, Human
gauuggguuaugaauauu

SEQ ID NO: 2504008 - RNA, 19 nt, Human
gauugggugggcaggaaaa

SEQ ID NO: 2504009 - RNA, 20 nt, Human
gauugggugggcaggaaaag

SEQ ID NO: 2504010 - RNA, 13 nt, Human
gauuguaaaaaaa

SEQ ID NO: 2504011 - RNA, 17 nt, Human
gauugggccccugccag

SEQ ID NO: 2504012 - RNA, 20 nt, Human
gauuggggaagacuguggcu

SEQ ID NO: 2504013 - RNA, 14 nt, Human
gauugcuaaaugua

SEQ ID NO: 2504014 - RNA, 13 nt, Human
gauugcuaaaugu

SEQ ID NO: 2504015 - RNA, 22 nt, Human
gauugcguggaauugugcugag

SEQ ID NO: 2504016 - RNA, 22 nt, Human
gauuuuaucuuucgcacagcag

SEQ ID NO: 2504017 - RNA, 20 nt, Human
gauuuuaucugugaauucag

SEQ ID NO: 2504018 - RNA, 20 nt, Human
gauuuucuuuaaaagaaugg

SEQ ID NO: 2504019 - RNA, 21 nt, Human
gauuuugaaaucaugaagaua

SEQ ID NO: 2504020 - RNA, 21 nt, Human
gauuuugaaaccaugaagaga

SEQ ID NO: 2504021 - RNA, 24 nt, Human
gauuuucuuuaaaagaaugggcag

SEQ ID NO: 2504022 - RNA, 19 nt, Human
gauuuugauccaagcuggu

SEQ ID NO: 2504023 - RNA, 21 nt, Human
gauuuugaaauuuuuauuaaa

SEQ ID NO: 2504024 - RNA, 17 nt, Human
gauuuuaaucaaguuga

SEQ ID NO: 2504025 - RNA, 19 nt, Human
gauuuuacaauugaaauga

SEQ ID NO: 2504026 - RNA, 15 nt, Human
gauuuuaauuuugaa

SEQ ID NO: 2504027 - RNA, 18 nt, Human
gauuuuacaauugaaaug

SEQ ID NO: 2504028 - RNA, 18 nt, Human
gauuuuacauguggccca

SEQ ID NO: 2504029 - RNA, 14 nt, Human
gauuuuaacucugu

SEQ ID NO: 2504030 - RNA, 16 nt, Human
gauuuuaacucugucu

SEQ ID NO: 2504031 - RNA, 14 nt, Human
gauuugcaaaaaaa

SEQ ID NO: 2504032 - RNA, 15 nt, Human
gauuugcauugaaca

SEQ ID NO: 2504033 - RNA, 18 nt, Human
gauuuuaaucaaguugaa

SEQ ID NO: 2504034 - RNA, 13 nt, Human
gauuuuaauuuug

SEQ ID NO: 2504035 - RNA, 21 nt, Human
gauuuugguauuacacuguau

SEQ ID NO: 2504036 - RNA, 19 nt, Human
gauuuuggccucauuacuu

SEQ ID NO: 2504037 - RNA, 21 nt, Human
gauuuugggguuguguuguca

SEQ ID NO: 2504038 - RNA, 22 nt, Human
gauuuugguuuuguuccccucc

SEQ ID NO: 2504039 - RNA, 19 nt, Human
gauuuugguuuuguucccc

SEQ ID NO: 2504040 - RNA, 16 nt, Human
gauuuuguaacccaga

SEQ ID NO: 2504041 - RNA, 23 nt, Human
gauuuuguaucugcaggcagaca

SEQ ID NO: 2504042 - RNA, 13 nt, Human
gauuuuguaaccc

SEQ ID NO: 2504043 - RNA, 14 nt, Human
gauuuuguuuugcu

SEQ ID NO: 2504044 - RNA, 13 nt, Human
gauuuuguuuugc

SEQ ID NO: 2504045 - RNA, 14 nt, Human
gauuuugaguaucu

SEQ ID NO: 2504046 - RNA, 18 nt, Human
gauuuugauagcaaagcg

SEQ ID NO: 2504047 - RNA, 13 nt, Human
gauuuugccugug

SEQ ID NO: 2504048 - RNA, 15 nt, Human
gauuuugcuguauau

SEQ ID NO: 2504049 - RNA, 18 nt, Human
gauuuugcuguauauuug

SEQ ID NO: 2504050 - RNA, 16 nt, Human
gauuuugcuguagaag

SEQ ID NO: 2504051 - RNA, 22 nt, Human
gauuuuguuuugcuuuuucuga

SEQ ID NO: 2504052 - RNA, 15 nt, Human
gauuuuguuuugcuu

SEQ ID NO: 2504053 - RNA, 14 nt, Human
gauuuuuacacaug

SEQ ID NO: 2504054 - RNA, 21 nt, Human
gcaaacaugggguuggcuggg

SEQ ID NO: 2504055 - RNA, 12 nt, Human
gcaaaccaucau

SEQ ID NO: 2504056 - RNA, 20 nt, Human
gcaaaccacacuggacuccg

SEQ ID NO: 2504057 - RNA, 18 nt, Human
gcaaaccacacuggacuc

SEQ ID NO: 2504058 - RNA, 17 nt, Human
gcaaaccacacuggacu

SEQ ID NO: 2504059 - RNA, 15 nt, Human
gcaaaccacacugga

SEQ ID NO: 2504060 - RNA, 15 nt, Human
gcaaauguggcuccu

SEQ ID NO: 2504061 - RNA, 18 nt, Human
gcaaagggagcagaacug

SEQ ID NO: 2504062 - RNA, 17 nt, Human
gcaaagggagcagaacu

SEQ ID NO: 2504063 - RNA, 16 nt, Human
gcaaaugugaccugug

SEQ ID NO: 2504064 - RNA, 23 nt, Human
gcaaaugugaaucauuuuaccuu

SEQ ID NO: 2504065 - RNA, 18 nt, Human
gcaaagggagcacugggu

SEQ ID NO: 2504066 - RNA, 20 nt, Human
gcaaagggagcacuggguug

SEQ ID NO: 2504067 - RNA, 16 nt, Human
gcaaauugucacagga

SEQ ID NO: 2504068 - RNA, 12 nt, Human
gcaaauguguac

SEQ ID NO: 2504069 - RNA, 22 nt, Human
gcaacaagaccaccacuucgaa

SEQ ID NO: 2504070 - RNA, 21 nt, Human
gcaaauuaauuggcagcagau

SEQ ID NO: 2504071 - RNA, 22 nt, Human
gcaacaauacaugcugcuaauu

SEQ ID NO: 2504072 - RNA, 20 nt, Human
gcaacaagguccucugucag

SEQ ID NO: 2504073 - RNA, 14 nt, Human
gcaacaauuuauga

SEQ ID NO: 2504074 - RNA, 16 nt, Human
gcaacacaagcuggaa

SEQ ID NO: 2504075 - RNA, 19 nt, Human
gcaacacaagcuggaagca

SEQ ID NO: 2504076 - RNA, 17 nt, Human
gcaacacaagcuggaag

SEQ ID NO: 2504077 - RNA, 23 nt, Human
gcaacacaagcuggaagcacaug

SEQ ID NO: 2504078 - RNA, 12 nt, Human
gcaacacacaga

SEQ ID NO: 2504079 - RNA, 21 nt, Human
gcaaagcaccagcuucuccag

SEQ ID NO: 2504080 - RNA, 13 nt, Human
gcaaagcaccagc

SEQ ID NO: 2504081 - RNA, 23 nt, Human
gcaaagcaccagcuucuccaggc

SEQ ID NO: 2504082 - RNA, 22 nt, Human
gcaaagcaccagcuucuccagg

SEQ ID NO: 2504083 - RNA, 21 nt, Human
gcaaagcugaugacaacuucc

SEQ ID NO: 2504084 - RNA, 14 nt, Human
gcaaagcgacguua

SEQ ID NO: 2504085 - RNA, 15 nt, Human
gcaaaggaaggugga

SEQ ID NO: 2504086 - RNA, 14 nt, Human
gcaaaggaaauacc

SEQ ID NO: 2504087 - RNA, 20 nt, Human
gcaaaggaagguggauggcc

SEQ ID NO: 2504088 - RNA, 20 nt, Human
gcaaaggacuguuuuuuccu

SEQ ID NO: 2504089 - RNA, 13 nt, Human
gcaaaggcuggga

SEQ ID NO: 2504090 - RNA, 23 nt, Human
gcaaaggacuguuuuuuccugag

SEQ ID NO: 2504091 - RNA, 17 nt, Human
gcaaaggaguagaaaga

SEQ ID NO: 2504092 - RNA, 18 nt, Human
gcaaagaucaaaauaaaa

SEQ ID NO: 2504093 - RNA, 16 nt, Human
gcaaagaucaaaauaa

SEQ ID NO: 2504094 - RNA, 19 nt, Human
gcaaagaucuguccucagc

SEQ ID NO: 2504095 - RNA, 20 nt, Human
gcaaagaucuguccucagcc

SEQ ID NO: 2504096 - RNA, 21 nt, Human
gcaaagaucuguccucagccu

SEQ ID NO: 2504097 - RNA, 22 nt, Human
gcaaagaucuguccucagccuu

SEQ ID NO: 2504098 - RNA, 15 nt, Human
gcaaaccaucauuga

SEQ ID NO: 2504099 - RNA, 15 nt, Human
gcaaagaucaaaaua

SEQ ID NO: 2504100 - RNA, 14 nt, Human
gcaaagaucaaaau

SEQ ID NO: 2504101 - RNA, 12 nt, Human
gcaaagaucaaa

SEQ ID NO: 2504102 - RNA, 18 nt, Human
gcaaagaggcaagaggcu

SEQ ID NO: 2504103 - RNA, 16 nt, Human
gcaaagauaucucauc

SEQ ID NO: 2504104 - RNA, 22 nt, Human
gcaaaccacacuggacuccggc

SEQ ID NO: 2504105 - RNA, 14 nt, Human
gauguucauuuaga

SEQ ID NO: 2504106 - RNA, 23 nt, Human
gauguucaguguaauuucuuugc

SEQ ID NO: 2504107 - RNA, 20 nt, Human
gauguucaguguaauuucuu

SEQ ID NO: 2504108 - RNA, 15 nt, Human
gauguucaguguaau

SEQ ID NO: 2504109 - RNA, 14 nt, Human
gauguucaguguaa

SEQ ID NO: 2504110 - RNA, 13 nt, Human
gauguucagugua

SEQ ID NO: 2504111 - RNA, 22 nt, Human
gauguucagcacugucccuugc

SEQ ID NO: 2504112 - RNA, 23 nt, Human
gauguugaaugcccacaggcaaa

SEQ ID NO: 2504113 - RNA, 20 nt, Human
gauguuauguaaaaggccaa

SEQ ID NO: 2504114 - RNA, 20 nt, Human
gauguucagcacugucccuu

SEQ ID NO: 2504115 - RNA, 19 nt, Human
gauguucagcacugucccu

SEQ ID NO: 2504116 - RNA, 17 nt, Human
gauguucagcacugucc

SEQ ID NO: 2504117 - RNA, 20 nt, Human
gauguucagauugcuuugau

SEQ ID NO: 2504118 - RNA, 19 nt, Human
gauguucagauugcuuuga

SEQ ID NO: 2504119 - RNA, 14 nt, Human
gauguuggcuggga

SEQ ID NO: 2504120 - RNA, 15 nt, Human
gauguuggcugggaa

SEQ ID NO: 2504121 - RNA, 11 nt, Human
gauguuaacac

SEQ ID NO: 2504122 - RNA, 16 nt, Human
gauguuuaguaaucau

SEQ ID NO: 2504123 - RNA, 18 nt, Human
gauguuuuuaaaaguuuc

SEQ ID NO: 2504124 - RNA, 18 nt, Human
gauguuuaacuuaaucaa

SEQ ID NO: 2504125 - RNA, 23 nt, Human
gauguuuacagguggacacacaa

SEQ ID NO: 2504126 - RNA, 15 nt, Human
gauuaaacuuaaucu

SEQ ID NO: 2504127 - RNA, 21 nt, Human
gauguuuuuaaaaguuucaau

SEQ ID NO: 2504128 - RNA, 20 nt, Human
gauguuuuuaaaaguuucaa

SEQ ID NO: 2504129 - RNA, 22 nt, Human
gauguuuuuaaaaguuucaaug

SEQ ID NO: 2504130 - RNA, 16 nt, Human
gauguuuuucaugaaa

SEQ ID NO: 2504131 - RNA, 16 nt, Human
gauuaaacgugcagac

SEQ ID NO: 2504132 - RNA, 22 nt, Human
gauuacaagcgugagccacugc

SEQ ID NO: 2504133 - RNA, 13 nt, Human
gauuacagaggaa

SEQ ID NO: 2504134 - RNA, 23 nt, Human
gauuacaagcgugagccacugca

SEQ ID NO: 2504135 - RNA, 20 nt, Human
gauuacaggcgugagccacc

SEQ ID NO: 2504136 - RNA, 17 nt, Human
gauuacaggcuccugcc

SEQ ID NO: 2504137 - RNA, 18 nt, Human
gauuacaggcaugugcca

SEQ ID NO: 2504138 - RNA, 16 nt, Human
gauggugcaaugaccu

SEQ ID NO: 2504139 - RNA, 15 nt, Human
gauggugcaaugacc

SEQ ID NO: 2504140 - RNA, 15 nt, Human
gauggucagcucccu

SEQ ID NO: 2504141 - RNA, 24 nt, Human
gaugguguucaaaaaacuuguaaa

SEQ ID NO: 2504142 - RNA, 17 nt, Human
gauggugcaaugaccuu

SEQ ID NO: 2504143 - RNA, 14 nt, Human
gauggugcaaugac

SEQ ID NO: 2504144 - RNA, 12 nt, Human
gauggugcaaug

SEQ ID NO: 2504145 - RNA, 13 nt, Human
gaugguccugggg

SEQ ID NO: 2504146 - RNA, 15 nt, Human
gaugguccuggggcu

SEQ ID NO: 2504147 - RNA, 21 nt, Human
gaugguccuggggcucugugc

SEQ ID NO: 2504148 - RNA, 24 nt, Human
gaugguccuggggcucugugcagg

SEQ ID NO: 2504149 - RNA, 14 nt, Human
gauggucagcuccc

SEQ ID NO: 2504150 - RNA, 23 nt, Human
gauggguucuaauuuuggaugga

SEQ ID NO: 2504151 - RNA, 21 nt, Human
gaugguuccccuguucacucu

SEQ ID NO: 2504152 - RNA, 18 nt, Human
gaugguuccccuguucac

SEQ ID NO: 2504153 - RNA, 13 nt, Human
gaugguuccccug

SEQ ID NO: 2504154 - RNA, 17 nt, Human
gaugguuauuuucuuuu

SEQ ID NO: 2504155 - RNA, 23 nt, Human
gaugguuauuuucuuuucuuuca

SEQ ID NO: 2504156 - RNA, 17 nt, Human
gaugguguuuuggggau

SEQ ID NO: 2504157 - RNA, 17 nt, Human
gauguggaguggggcag

SEQ ID NO: 2504158 - RNA, 12 nt, Human
gauguggcccug

SEQ ID NO: 2504159 - RNA, 13 nt, Human
gauguggcccugg

SEQ ID NO: 2504160 - RNA, 14 nt, Human
gauguggcccuggc

SEQ ID NO: 2504161 - RNA, 21 nt, Human
gauguggcccuggccugcugg

SEQ ID NO: 2504162 - RNA, 19 nt, Human
gauguuaacacauuuugua

SEQ ID NO: 2504163 - RNA, 18 nt, Human
gauguuaacacauuuugu

SEQ ID NO: 2504164 - RNA, 22 nt, Human
gauguggugccugaggucugua

SEQ ID NO: 2504165 - RNA, 20 nt, Human
gauguggugccugaggucug

SEQ ID NO: 2504166 - RNA, 15 nt, Human
gauguggugccugag

SEQ ID NO: 2504167 - RNA, 22 nt, Human
gauguggugaggcaggcuuugu

SEQ ID NO: 2504168 - RNA, 15 nt, Human
gauguggugaggcag

SEQ ID NO: 2504169 - RNA, 23 nt, Human
gauguuacaucacaguguuugca

SEQ ID NO: 2504170 - RNA, 20 nt, Human
gauguuacaucacaguguuu

SEQ ID NO: 2504171 - RNA, 22 nt, Human
gauguuaacacauuuuguauaa

SEQ ID NO: 2504172 - RNA, 21 nt, Human
gauguuaacacauuuuguaua

SEQ ID NO: 2504173 - RNA, 14 nt, Human
gauguuaaccagaa

SEQ ID NO: 2504174 - RNA, 23 nt, Human
gaugugggagggagcagacagga

SEQ ID NO: 2504175 - RNA, 16 nt, Human
gaugugggggaagacc

SEQ ID NO: 2504176 - RNA, 22 nt, Human
gaugugggagggagcagacagg

SEQ ID NO: 2504177 - RNA, 18 nt, Human
gauguggcugcagcagcg

SEQ ID NO: 2504178 - RNA, 16 nt, Human
gauguggcugcagcag

SEQ ID NO: 2504179 - RNA, 20 nt, Human
gauguggcccuggccugcug

SEQ ID NO: 2504180 - RNA, 20 nt, Human
gaugugggggaagaccuggc

SEQ ID NO: 2504181 - RNA, 17 nt, Human
gaugugggucaaggaau

SEQ ID NO: 2504182 - RNA, 13 nt, Human
gaugcuccuuggg

SEQ ID NO: 2504183 - RNA, 23 nt, Human
gaugcucccuccccugcccuggu

SEQ ID NO: 2504184 - RNA, 14 nt, Human
gaugcuccuugggc

SEQ ID NO: 2504185 - RNA, 16 nt, Human
gaugcuccuugggccc

SEQ ID NO: 2504186 - RNA, 21 nt, Human
gaugcuccuugggcccuuuga

SEQ ID NO: 2504187 - RNA, 15 nt, Human
gaugcucuucugugg

SEQ ID NO: 2504188 - RNA, 20 nt, Human
gaugcugacuguacuccucc

SEQ ID NO: 2504189 - RNA, 17 nt, Human
gaugcugacuguacucc

SEQ ID NO: 2504190 - RNA, 20 nt, Human
gaugcugacauucaccugcc

SEQ ID NO: 2504191 - RNA, 21 nt, Human
gaugcugacauucaccugccc

SEQ ID NO: 2504192 - RNA, 20 nt, Human
gaugcugaaacaggagagaa

SEQ ID NO: 2504193 - RNA, 20 nt, Human
gaugcuagaacucccuuuca

SEQ ID NO: 2504194 - RNA, 22 nt, Human
gaugcuagaacucccuuucaac

SEQ ID NO: 2504195 - RNA, 18 nt, Human
gaugcuagaacucccuuu

SEQ ID NO: 2504196 - RNA, 16 nt, Human
gaugccccgucccccu

SEQ ID NO: 2504197 - RNA, 12 nt, Human
gaugccccagag

SEQ ID NO: 2504198 - RNA, 16 nt, Human
gaugccccagagcugu

SEQ ID NO: 2504199 - RNA, 16 nt, Human
gaucagagccgugguc

SEQ ID NO: 2504200 - RNA, 23 nt, Human
gaucagagccgugguccuuuggg

SEQ ID NO: 2504201 - RNA, 22 nt, Human
gaucagaccuuggaucagauga

SEQ ID NO: 2504202 - RNA, 14 nt, Human
gaucagaucugaca

SEQ ID NO: 2504203 - RNA, 14 nt, Human
gaucagagcagcag

SEQ ID NO: 2504204 - RNA, 16 nt, Human
gaucagaccauaaugu

SEQ ID NO: 2504205 - RNA, 15 nt, Human
gaucagaacagcaga

SEQ ID NO: 2504206 - RNA, 19 nt, Human
gaugcccaaagaugcagcc

SEQ ID NO: 2504207 - RNA, 14 nt, Human
gaugccagguucua

SEQ ID NO: 2504208 - RNA, 11 nt, Human
gaugccaggac

SEQ ID NO: 2504209 - RNA, 21 nt, Human
gaugccaguaggcucaacuag

SEQ ID NO: 2504210 - RNA, 22 nt, Human
gaugccagguucuauuuggaau

SEQ ID NO: 2504211 - RNA, 18 nt, Human
gaugccaucugugggcac

SEQ ID NO: 2504212 - RNA, 20 nt, Human
gaugcccaaagaugcagccg

SEQ ID NO: 2504213 - RNA, 15 nt, Human
gaugcccacugagga

SEQ ID NO: 2504214 - RNA, 20 nt, Human
gaugcccagggccacucugc

SEQ ID NO: 2504215 - RNA, 21 nt, Human
gaugcccagggccacucugcc

SEQ ID NO: 2504216 - RNA, 22 nt, Human
gaugcccagggccacucugccu

SEQ ID NO: 2504217 - RNA, 22 nt, Human
gaugcccagagggcccaggcag

SEQ ID NO: 2504218 - RNA, 23 nt, Human
gaugcccagagggcccaggcagg

SEQ ID NO: 2504219 - RNA, 19 nt, Human
gaugcccagagggcccagg

SEQ ID NO: 2504220 - RNA, 20 nt, Human
gaugcccagagggcccaggc

SEQ ID NO: 2504221 - RNA, 18 nt, Human
gaugcccagagggcccag

SEQ ID NO: 2504222 - RNA, 17 nt, Human
gaugcccacugaggaau

SEQ ID NO: 2504223 - RNA, 22 nt, Human
gauggccgggcgcgguggcuca

SEQ ID NO: 2504224 - RNA, 15 nt, Human
gauggccccagcaca

SEQ ID NO: 2504225 - RNA, 14 nt, Human
gauggccccagcac

SEQ ID NO: 2504226 - RNA, 22 nt, Human
gauggcccuucccacuggaggu

SEQ ID NO: 2504227 - RNA, 15 nt, Human
gauggcccuucccac

SEQ ID NO: 2504228 - RNA, 21 nt, Human
gauggcauccugugaaguccu

SEQ ID NO: 2504229 - RNA, 15 nt, Human
gauggcauccuguga

SEQ ID NO: 2504230 - RNA, 22 nt, Human
gauggcaggauggccuggccag

SEQ ID NO: 2504231 - RNA, 21 nt, Human
gauggcaggauggccuggcca

SEQ ID NO: 2504232 - RNA, 15 nt, Human
gaugcugacuaguga

SEQ ID NO: 2504233 - RNA, 21 nt, Human
gaugcugaaacaggagagaaa

SEQ ID NO: 2504234 - RNA, 12 nt, Human
gauggccccagc

SEQ ID NO: 2504235 - RNA, 12 nt, Human
gauggccagugu

SEQ ID NO: 2504236 - RNA, 24 nt, Human
gauggggcccugccuccuuuguga

SEQ ID NO: 2504237 - RNA, 21 nt, Human
gaugggcaacccccagccugc

SEQ ID NO: 2504238 - RNA, 20 nt, Human
gaugggcaacccccagccug

SEQ ID NO: 2504239 - RNA, 20 nt, Human
gaugggagggaggcucaggu

SEQ ID NO: 2504240 - RNA, 15 nt, Human
gaugggagugagaca

SEQ ID NO: 2504241 - RNA, 18 nt, Human
gauggccggagaggaccg

SEQ ID NO: 2504242 - RNA, 13 nt, Human
gauggggcugcac

SEQ ID NO: 2504243 - RNA, 19 nt, Human
gaugggaugguggagggcc

SEQ ID NO: 2504244 - RNA, 20 nt, Human
gaugggaugguggagggcca

SEQ ID NO: 2504245 - RNA, 13 nt, Human
gauggggccucug

SEQ ID NO: 2504246 - RNA, 15 nt, Human
gauggggcugcaccg

SEQ ID NO: 2504247 - RNA, 19 nt, Human
gauggggcugcaccggcug

SEQ ID NO: 2504248 - RNA, 19 nt, Human
gauggggcucccgcccgug

SEQ ID NO: 2504249 - RNA, 16 nt, Human
gauggggucuguaaaa

SEQ ID NO: 2504250 - RNA, 22 nt, Human
gauggggugggguggagaacuc

SEQ ID NO: 2504251 - RNA, 19 nt, Human
gaugggugcuuggaggaag

SEQ ID NO: 2504252 - RNA, 18 nt, Human
gauggguuugacaagguu

SEQ ID NO: 2504253 - RNA, 22 nt, Human
gauggguucuaauuuuggaugg

SEQ ID NO: 2504254 - RNA, 21 nt, Human
gauggguucuaauuuuggaug

SEQ ID NO: 2504255 - RNA, 23 nt, Human
gaugggucugguuugcagagcuu

SEQ ID NO: 2504256 - RNA, 15 nt, Human
gaugggucaguugua

SEQ ID NO: 2504257 - RNA, 21 nt, Human
gaugggucaguuguaucagca

SEQ ID NO: 2504258 - RNA, 21 nt, Human
gaugggucuggcugagcugaa

SEQ ID NO: 2504259 - RNA, 22 nt, Human
gaugggucugguuugcagagcu

SEQ ID NO: 2504260 - RNA, 17 nt, Human
gcacagacccugcccug

SEQ ID NO: 2504261 - RNA, 16 nt, Human
gcacagacccugcccu

SEQ ID NO: 2504262 - RNA, 15 nt, Human
gcacagacccugccc

SEQ ID NO: 2504263 - RNA, 14 nt, Human
gcacagacccugcc

SEQ ID NO: 2504264 - RNA, 22 nt, Human
gcacagaaaauggaagacagcu

SEQ ID NO: 2504265 - RNA, 21 nt, Human
gcacagaaaauggaagacagc

SEQ ID NO: 2504266 - RNA, 23 nt, Human
gcacagaaaauggaagacagcuc

SEQ ID NO: 2504267 - RNA, 21 nt, Human
gcacagaaaccucuacuaaaa

SEQ ID NO: 2504268 - RNA, 20 nt, Human
gcacagaaacacaauauuuu

SEQ ID NO: 2504269 - RNA, 12 nt, Human
gcacagaaggag

SEQ ID NO: 2504270 - RNA, 21 nt, Human
gcacagacccugcccuguggg

SEQ ID NO: 2504271 - RNA, 20 nt, Human
gcacagacccugcccugugg

SEQ ID NO: 2504272 - RNA, 19 nt, Human
gcacagacccugcccugug

SEQ ID NO: 2504273 - RNA, 18 nt, Human
gcacagacccugcccugu

SEQ ID NO: 2504274 - RNA, 22 nt, Human
gcacagacccugcccugugggc

SEQ ID NO: 2504275 - RNA, 17 nt, Human
gcacagagagggggcca

SEQ ID NO: 2504276 - RNA, 15 nt, Human
gcacagagagggggc

SEQ ID NO: 2504277 - RNA, 16 nt, Human
gcacagagaagacaaa

SEQ ID NO: 2504278 - RNA, 18 nt, Human
gcacagacgucccuccac

SEQ ID NO: 2504279 - RNA, 15 nt, Human
gcacagaguuguuac

SEQ ID NO: 2504280 - RNA, 19 nt, Human
gcacagagcucuccagcuc

SEQ ID NO: 2504281 - RNA, 18 nt, Human
gcacagagcucuccagcu

SEQ ID NO: 2504282 - RNA, 17 nt, Human
gcacagagcucuccagc

SEQ ID NO: 2504283 - RNA, 23 nt, Human
gcacagagagggggccaccuccc

SEQ ID NO: 2504284 - RNA, 19 nt, Human
gcacagagagggggccacc

SEQ ID NO: 2504285 - RNA, 20 nt, Human
gcacagaaaauggaagacag

SEQ ID NO: 2504286 - RNA, 22 nt, Human
gcacacuuugccauauuuucac

SEQ ID NO: 2504287 - RNA, 20 nt, Human
gcacacuuggcccaaguggc

SEQ ID NO: 2504288 - RNA, 14 nt, Human
gcacacuuggccca

SEQ ID NO: 2504289 - RNA, 20 nt, Human
gcacacuuugcacugauaua

SEQ ID NO: 2504290 - RNA, 13 nt, Human
gcacacuuugcca

SEQ ID NO: 2504291 - RNA, 14 nt, Human
gcacacuuugccau

SEQ ID NO: 2504292 - RNA, 20 nt, Human
gcacacuccccugcacugga

SEQ ID NO: 2504293 - RNA, 12 nt, Human
gcacacuguagc

SEQ ID NO: 2504294 - RNA, 23 nt, Human
gcacacggggugcgucuccccgg

SEQ ID NO: 2504295 - RNA, 17 nt, Human
gcacacgucauguuucu

SEQ ID NO: 2504296 - RNA, 21 nt, Human
gcacacuccccugcacuggag

SEQ ID NO: 2504297 - RNA, 15 nt, Human
gcacacuccccugca

SEQ ID NO: 2504298 - RNA, 20 nt, Human
gcacacucauccccucacuu

SEQ ID NO: 2504299 - RNA, 20 nt, Human
gcacaccgggcacucagaag

SEQ ID NO: 2504300 - RNA, 19 nt, Human
gcacacgccucccacuggg

SEQ ID NO: 2504301 - RNA, 17 nt, Human
gcacacgccucccacug

SEQ ID NO: 2504302 - RNA, 14 nt, Human
gcacacgccuccca

SEQ ID NO: 2504303 - RNA, 17 nt, Human
gcacaagcuccaagcuc

SEQ ID NO: 2504304 - RNA, 15 nt, Human
gcacaagcuccaagc

SEQ ID NO: 2504305 - RNA, 18 nt, Human
gcacaagcuccaagcucc

SEQ ID NO: 2504306 - RNA, 23 nt, Human
gcacaagcaaaagggugucugag

SEQ ID NO: 2504307 - RNA, 17 nt, Human
gcacaagaagcgugaga

SEQ ID NO: 2504308 - RNA, 24 nt, Human
gcacaagaagcgugagacgccacc

SEQ ID NO: 2504309 - RNA, 11 nt, Human
gcacaagaagc

SEQ ID NO: 2504310 - RNA, 19 nt, Human
gcacaacuuuaagaggaca

SEQ ID NO: 2504311 - RNA, 23 nt, Human
gcacaaauucugucucuggauua

SEQ ID NO: 2504312 - RNA, 14 nt, Human
gcacaaauauuuau

SEQ ID NO: 2504313 - RNA, 15 nt, Human
gcacaaauauuuauu

SEQ ID NO: 2504314 - RNA, 16 nt, Human
gcacaaauauuuauuu

SEQ ID NO: 2504315 - RNA, 19 nt, Human
gcaaugggagcugaggcca

SEQ ID NO: 2504316 - RNA, 20 nt, Human
gcaaugggagcugaggccac

SEQ ID NO: 2504317 - RNA, 16 nt, Human
gcaaugggcacuggga

SEQ ID NO: 2504318 - RNA, 14 nt, Human
gcaaugggcacugg

SEQ ID NO: 2504319 - RNA, 23 nt, Human
gcaaugguguugcccugagugga

SEQ ID NO: 2504320 - RNA, 20 nt, Human
gcaaugguguugcccugagu

SEQ ID NO: 2504321 - RNA, 15 nt, Human
gcaauggcagccuug

SEQ ID NO: 2504322 - RNA, 13 nt, Human
gcaacacacagac

SEQ ID NO: 2504323 - RNA, 18 nt, Human
gcaacggggaggccaagu

SEQ ID NO: 2504324 - RNA, 22 nt, Human
gcaacucaaggacuuugcagcc

SEQ ID NO: 2504325 - RNA, 14 nt, Human
gcaacucaucuuag

SEQ ID NO: 2504326 - RNA, 14 nt, Human
gcaaugugauaaaa

SEQ ID NO: 2504327 - RNA, 22 nt, Human
gcaauguagaggggaaaagaga

SEQ ID NO: 2504328 - RNA, 20 nt, Human
gcaaugucaggaacagaagg

SEQ ID NO: 2504329 - RNA, 15 nt, Human
gcaaugugggcagag

SEQ ID NO: 2504330 - RNA, 19 nt, Human
gcaaugucugagugaaccu

SEQ ID NO: 2504331 - RNA, 22 nt, Human
gcaaugucaggaacagaaggau

SEQ ID NO: 2504332 - RNA, 15 nt, Human
gcaaugucugugcua

SEQ ID NO: 2504333 - RNA, 14 nt, Human
gcaaugucugugcu

SEQ ID NO: 2504334 - RNA, 14 nt, Human
gcaaugugcuacug

SEQ ID NO: 2504335 - RNA, 18 nt, Human
gcaauuccccucugcugc

SEQ ID NO: 2504336 - RNA, 14 nt, Human
gcaauuccccucug

SEQ ID NO: 2504337 - RNA, 21 nt, Human
gcaauuccccucugcugcugu

SEQ ID NO: 2504338 - RNA, 15 nt, Human
gcaauuccgcauuua

SEQ ID NO: 2504339 - RNA, 21 nt, Human
gcaauuaaagugauacugaaa

SEQ ID NO: 2504340 - RNA, 14 nt, Human
gcaauguuuuccuu

SEQ ID NO: 2504341 - RNA, 14 nt, Human
gcaauucuccugcc

SEQ ID NO: 2504342 - RNA, 15 nt, Human
gcaauucuccugccu

SEQ ID NO: 2504343 - RNA, 16 nt, Human
gcaauucuccugccuc

SEQ ID NO: 2504344 - RNA, 17 nt, Human
gcaauucuccugccuca

SEQ ID NO: 2504345 - RNA, 18 nt, Human
gcaauucuccugccucag

SEQ ID NO: 2504346 - RNA, 19 nt, Human
gcaauucuccugccucagc

SEQ ID NO: 2504347 - RNA, 20 nt, Human
gcaauucuccugccucagcc

SEQ ID NO: 2504348 - RNA, 18 nt, Human
gcaauugaauuaaauuag

SEQ ID NO: 2504349 - RNA, 17 nt, Human
gcaauuccgcauuuaau

SEQ ID NO: 2504350 - RNA, 23 nt, Human
gcaauuuaauauuuugcacaguu

SEQ ID NO: 2504351 - RNA, 19 nt, Human
gcaauuuauacaauaucau

SEQ ID NO: 2504352 - RNA, 16 nt, Human
gcaauuuauacaauau

SEQ ID NO: 2504353 - RNA, 14 nt, Human
gcaauugggauggc

SEQ ID NO: 2504354 - RNA, 15 nt, Human
gcaauugcuuaggau

SEQ ID NO: 2504355 - RNA, 20 nt, Human
gcaauuuguuugugcuucua

SEQ ID NO: 2504356 - RNA, 18 nt, Human
gcaauuuguuugugcuuc

SEQ ID NO: 2504357 - RNA, 18 nt, Human
gcaauuuccuuuuuuguu

SEQ ID NO: 2504358 - RNA, 14 nt, Human
gcaauuucauaugc

SEQ ID NO: 2504359 - RNA, 17 nt, Human
gcaauuuauuaaaauga

SEQ ID NO: 2504360 - RNA, 13 nt, Human
gcacaaaacccag

SEQ ID NO: 2504361 - RNA, 23 nt, Human
gcacaaaacccagaccuguuagc

SEQ ID NO: 2504362 - RNA, 23 nt, Human
gcaauuuuuccaugaaguuugaa

SEQ ID NO: 2504363 - RNA, 14 nt, Human
gcacaaacagaggc

SEQ ID NO: 2504364 - RNA, 15 nt, Human
gcaauuuuccuugaa

SEQ ID NO: 2504365 - RNA, 14 nt, Human
gcaauuuuccuuga

SEQ ID NO: 2504366 - RNA, 13 nt, Human
gcaauuuuccuug

SEQ ID NO: 2504367 - RNA, 11 nt, Human
gcaauuuuccu

SEQ ID NO: 2504368 - RNA, 10 nt, Human
gcaauuuucc

SEQ ID NO: 2504369 - RNA, 19 nt, Human
gcaauuuuaauugauuauu

SEQ ID NO: 2504370 - RNA, 20 nt, Human
gcaauuuuccuugaagccga

SEQ ID NO: 2504371 - RNA, 14 nt, Human
gcaauuuuguaacg

SEQ ID NO: 2504372 - RNA, 19 nt, Human
gcaauuuuccuugaagccg

SEQ ID NO: 2504373 - RNA, 17 nt, Human
gcaauuuuccuugaagc

SEQ ID NO: 2504374 - RNA, 18 nt, Human
gcaauuuugcauuugaau

SEQ ID NO: 2504375 - RNA, 16 nt, Human
gcacaaacagaggccg

SEQ ID NO: 2504376 - RNA, 15 nt, Human
gcacaaacagaggcc

SEQ ID NO: 2504377 - RNA, 18 nt, Human
gcacaaacucaccaucug

SEQ ID NO: 2504378 - RNA, 23 nt, Human
gcacaaaauucgaccugauuuac

SEQ ID NO: 2504379 - RNA, 23 nt, Human
gcacaaaaugauggacccaaugc

SEQ ID NO: 2504380 - RNA, 13 nt, Human
gcacaaauauuua

SEQ ID NO: 2504381 - RNA, 22 nt, Human
gcacaaaauucgaccugauuua

SEQ ID NO: 2504382 - RNA, 13 nt, Human
gcacgauuucugu

SEQ ID NO: 2504383 - RNA, 15 nt, Human
gcacgauuucuguuu

SEQ ID NO: 2504384 - RNA, 14 nt, Human
gcaccuucagacuu

SEQ ID NO: 2504385 - RNA, 16 nt, Human
gcaccuuaguggcuuu

SEQ ID NO: 2504386 - RNA, 13 nt, Human
gcaccuuaguggc

SEQ ID NO: 2504387 - RNA, 19 nt, Human
gcaccuuaccaacuuucug

SEQ ID NO: 2504388 - RNA, 19 nt, Human
gcaccuuagacagucccug

SEQ ID NO: 2504389 - RNA, 15 nt, Human
gcaccuuccucacuu

SEQ ID NO: 2504390 - RNA, 14 nt, Human
gcaccuugugucug

SEQ ID NO: 2504391 - RNA, 16 nt, Human
gcaccuuccucacuuc

SEQ ID NO: 2504392 - RNA, 21 nt, Human
gcaccuuagacagucccugcc

SEQ ID NO: 2504393 - RNA, 20 nt, Human
gcaccuuagacagucccugc

SEQ ID NO: 2504394 - RNA, 15 nt, Human
gcaccugucccagaa

SEQ ID NO: 2504395 - RNA, 19 nt, Human
gcaccugucccagaaaaag

SEQ ID NO: 2504396 - RNA, 22 nt, Human
gcaccugucccagaaaaagcau

SEQ ID NO: 2504397 - RNA, 18 nt, Human
gcaccuuaccaacuuucu

SEQ ID NO: 2504398 - RNA, 15 nt, Human
gcaccccaugcuguu

SEQ ID NO: 2504399 - RNA, 14 nt, Human
gcaccaucccuuuu

SEQ ID NO: 2504400 - RNA, 17 nt, Human
gcaccccaugcuguuga

SEQ ID NO: 2504401 - RNA, 13 nt, Human
gcacccccacccu

SEQ ID NO: 2504402 - RNA, 14 nt, Human
gcacccccacccuu

SEQ ID NO: 2504403 - RNA, 15 nt, Human
gcacccccacccuuu

SEQ ID NO: 2504404 - RNA, 18 nt, Human
gcacccccacccuuuggg

SEQ ID NO: 2504405 - RNA, 22 nt, Human
gcaccccagcuggggccaggcu

SEQ ID NO: 2504406 - RNA, 12 nt, Human
gcaccauaacuu

SEQ ID NO: 2504407 - RNA, 21 nt, Human
gcaccuguaaucccagcuacu

SEQ ID NO: 2504408 - RNA, 17 nt, Human
gcaccuggggaguggga

SEQ ID NO: 2504409 - RNA, 15 nt, Human
gcaccuggggagugg

SEQ ID NO: 2504410 - RNA, 19 nt, Human
gcaccuguacucaggaggc

SEQ ID NO: 2504411 - RNA, 21 nt, Human
gcaccuguacucaggaggcug

SEQ ID NO: 2504412 - RNA, 14 nt, Human
gcaccccccaagcu

SEQ ID NO: 2504413 - RNA, 13 nt, Human
gcaccccccuggg

SEQ ID NO: 2504414 - RNA, 14 nt, Human
gcaccccccugggc

SEQ ID NO: 2504415 - RNA, 21 nt, Human
gcaccccccugggcugagaga

SEQ ID NO: 2504416 - RNA, 17 nt, Human
gcaccaaaauaagaaaa

SEQ ID NO: 2504417 - RNA, 18 nt, Human
gcaccaaaauaagaaaag

SEQ ID NO: 2504418 - RNA, 20 nt, Human
gcaccaggcacgaacccacc

SEQ ID NO: 2504419 - RNA, 19 nt, Human
gcacauuuccccagaccug

SEQ ID NO: 2504420 - RNA, 22 nt, Human
gcacauuuccccagaccugagc

SEQ ID NO: 2504421 - RNA, 21 nt, Human
gcacauuuaagagacagucac

SEQ ID NO: 2504422 - RNA, 17 nt, Human
gcacauuuaagagacag

SEQ ID NO: 2504423 - RNA, 23 nt, Human
gcacauuuaagagacagucaccc

SEQ ID NO: 2504424 - RNA, 16 nt, Human
gcacauuuccccagac

SEQ ID NO: 2504425 - RNA, 19 nt, Human
gcaccagggguuucucgca

SEQ ID NO: 2504426 - RNA, 23 nt, Human
gcaccaggguugaccccagagga

SEQ ID NO: 2504427 - RNA, 20 nt, Human
gcaccagggacuaugaaugg

SEQ ID NO: 2504428 - RNA, 18 nt, Human
gcaccagggguuucucgc

SEQ ID NO: 2504429 - RNA, 16 nt, Human
gcaccagggguuucuc

SEQ ID NO: 2504430 - RNA, 21 nt, Human
gcaccaggcacgaacccaccu

SEQ ID NO: 2504431 - RNA, 23 nt, Human
gcaccaggcacgaacccaccugc

SEQ ID NO: 2504432 - RNA, 17 nt, Human
gcacauucuuagaguua

SEQ ID NO: 2504433 - RNA, 12 nt, Human
gcacaugugugc

SEQ ID NO: 2504434 - RNA, 12 nt, Human
gcacauguuucc

SEQ ID NO: 2504435 - RNA, 12 nt, Human
gcacagugauuu

SEQ ID NO: 2504436 - RNA, 13 nt, Human
gcacagugcaucu

SEQ ID NO: 2504437 - RNA, 18 nt, Human
gcacagugcaucucagcc

SEQ ID NO: 2504438 - RNA, 15 nt, Human
gcacagugcaucuca

SEQ ID NO: 2504439 - RNA, 16 nt, Human
gcacagaguuguuaca

SEQ ID NO: 2504440 - RNA, 18 nt, Human
gcacagaguuguuacauu

SEQ ID NO: 2504441 - RNA, 19 nt, Human
gcacagaguuguuacauuu

SEQ ID NO: 2504442 - RNA, 21 nt, Human
gcacagaguuguuacauuuuu

SEQ ID NO: 2504443 - RNA, 22 nt, Human
gcacagaguuguuacauuuuua

SEQ ID NO: 2504444 - RNA, 23 nt, Human
gcacagagcucuccagcuccaag

SEQ ID NO: 2504445 - RNA, 13 nt, Human
gcacagauggauu

SEQ ID NO: 2504446 - RNA, 15 nt, Human
gcacagauggauuug

SEQ ID NO: 2504447 - RNA, 16 nt, Human
gcacagugaagugcug

SEQ ID NO: 2504448 - RNA, 21 nt, Human
gcacaggugggcuucccagug

SEQ ID NO: 2504449 - RNA, 24 nt, Human
gcacagauggauuugccugugcca

SEQ ID NO: 2504450 - RNA, 18 nt, Human
gcacagauggauuugccu

SEQ ID NO: 2504451 - RNA, 19 nt, Human
gcacagauggauuugccug

SEQ ID NO: 2504452 - RNA, 20 nt, Human
gcacaggugggcuucccagu

SEQ ID NO: 2504453 - RNA, 22 nt, Human
gcacagauggauuugccugugc

SEQ ID NO: 2504454 - RNA, 15 nt, Human
gcacugacuucuaag

SEQ ID NO: 2504455 - RNA, 16 nt, Human
gcacgauuucuguuua

SEQ ID NO: 2504456 - RNA, 18 nt, Human
gcacugacuucuaaguaa

SEQ ID NO: 2504457 - RNA, 13 nt, Human
gcacgcacacaca

SEQ ID NO: 2504458 - RNA, 12 nt, Human
gcacgcacacac

SEQ ID NO: 2504459 - RNA, 11 nt, Human
gcacgcacaca

SEQ ID NO: 2504460 - RNA, 10 nt, Human
gcacgcacac

SEQ ID NO: 2504461 - RNA, 15 nt, Human
gcacgcacacacaca

SEQ ID NO: 2504462 - RNA, 14 nt, Human
gcacgcacacacac

SEQ ID NO: 2504463 - RNA, 17 nt, Human
gcacugacugggcauag

SEQ ID NO: 2504464 - RNA, 20 nt, Human
gcacugcugcccagccucca

SEQ ID NO: 2504465 - RNA, 18 nt, Human
gcacugcugcccagccuc

SEQ ID NO: 2504466 - RNA, 15 nt, Human
gcacugcugcccagc

SEQ ID NO: 2504467 - RNA, 14 nt, Human
gcacugcugcccag

SEQ ID NO: 2504468 - RNA, 12 nt, Human
gcacugcugccc

SEQ ID NO: 2504469 - RNA, 13 nt, Human
gcacugaggaaga

SEQ ID NO: 2504470 - RNA, 14 nt, Human
gcacugagcccccc

SEQ ID NO: 2504471 - RNA, 13 nt, Human
gcacugagccccc

SEQ ID NO: 2504472 - RNA, 11 nt, Human
gcacugaggaa

SEQ ID NO: 2504473 - RNA, 21 nt, Human
gcacugagauaccagcgagga

SEQ ID NO: 2504474 - RNA, 15 nt, Human
gcacugagauauuua

SEQ ID NO: 2504475 - RNA, 12 nt, Human
gcacugagcccc

SEQ ID NO: 2504476 - RNA, 11 nt, Human
gcacugagccc

SEQ ID NO: 2504477 - RNA, 13 nt, Human
gcacugagcagag

SEQ ID NO: 2504478 - RNA, 21 nt, Human
gcacugagauauuuauuguuu

SEQ ID NO: 2504479 - RNA, 20 nt, Human
gcacuggcauugucccugug

SEQ ID NO: 2504480 - RNA, 19 nt, Human
gcacuggcauugucccugu

SEQ ID NO: 2504481 - RNA, 21 nt, Human
gcacuguccugcuccacagug

SEQ ID NO: 2504482 - RNA, 14 nt, Human
gcacugguggcccg

SEQ ID NO: 2504483 - RNA, 18 nt, Human
gcacuggguugcagggga

SEQ ID NO: 2504484 - RNA, 16 nt, Human
gcacugggggcagcgg

SEQ ID NO: 2504485 - RNA, 18 nt, Human
gcacuggguugacuuuca

SEQ ID NO: 2504486 - RNA, 22 nt, Human
gcacugcuggguggcccauccc

SEQ ID NO: 2504487 - RNA, 21 nt, Human
gcacugcuggguggcccaucc

SEQ ID NO: 2504488 - RNA, 19 nt, Human
gcacugcuggguggcccau

SEQ ID NO: 2504489 - RNA, 18 nt, Human
gcacugcuggguggccca

SEQ ID NO: 2504490 - RNA, 17 nt, Human
gcacugcuggguggccc

SEQ ID NO: 2504491 - RNA, 15 nt, Human
gcacugcuggguggc

SEQ ID NO: 2504492 - RNA, 14 nt, Human
gcacugcugggugg

SEQ ID NO: 2504493 - RNA, 13 nt, Human
gcacugcugggug

SEQ ID NO: 2504494 - RNA, 23 nt, Human
gcacugcuuccagugaggcucug

SEQ ID NO: 2504495 - RNA, 15 nt, Human
gcacugcugugcugu

SEQ ID NO: 2504496 - RNA, 16 nt, Human
gcacugcuugaggaaa

SEQ ID NO: 2504497 - RNA, 17 nt, Human
gcacugcuugaggaaaa

SEQ ID NO: 2504498 - RNA, 16 nt, Human
gcacuggagugcaggg

SEQ ID NO: 2504499 - RNA, 15 nt, Human
gcacuggagugcagg

SEQ ID NO: 2504500 - RNA, 14 nt, Human
gcacuggagugcag

SEQ ID NO: 2504501 - RNA, 11 nt, Human
gcacugcugug

SEQ ID NO: 2504502 - RNA, 14 nt, Human
gcacuggaguccag

SEQ ID NO: 2504503 - RNA, 17 nt, Human
gcacuggaguccagucu

SEQ ID NO: 2504504 - RNA, 18 nt, Human
gcacuggaguccagucuc

SEQ ID NO: 2504505 - RNA, 16 nt, Human
gcagacacggaucuga

SEQ ID NO: 2504506 - RNA, 23 nt, Human
gcagacacggaucugagaaucuu

SEQ ID NO: 2504507 - RNA, 15 nt, Human
gcagacaccuuggac

SEQ ID NO: 2504508 - RNA, 13 nt, Human
gcagaauaaagca

SEQ ID NO: 2504509 - RNA, 12 nt, Human
gcagaauaaagc

SEQ ID NO: 2504510 - RNA, 23 nt, Human
gcagacacagggacuugaaguug

SEQ ID NO: 2504511 - RNA, 13 nt, Human
gcagacagcagcu

SEQ ID NO: 2504512 - RNA, 14 nt, Human
gcagacagcagcuc

SEQ ID NO: 2504513 - RNA, 16 nt, Human
gcagacagcagcucag

SEQ ID NO: 2504514 - RNA, 17 nt, Human
gcagacagcagcucagg

SEQ ID NO: 2504515 - RNA, 18 nt, Human
gcagacagcagcucaggc

SEQ ID NO: 2504516 - RNA, 19 nt, Human
gcagacagcagcucaggca

SEQ ID NO: 2504517 - RNA, 20 nt, Human
gcagacagcagcucaggcac

SEQ ID NO: 2504518 - RNA, 14 nt, Human
gcagacaggcaagc

SEQ ID NO: 2504519 - RNA, 13 nt, Human
gcagacaggcaag

SEQ ID NO: 2504520 - RNA, 12 nt, Human
gcagacaggcaa

SEQ ID NO: 2504521 - RNA, 14 nt, Human
gcagacaggaggaa

SEQ ID NO: 2504522 - RNA, 21 nt, Human
gcagacagcagcucaggcaca

SEQ ID NO: 2504523 - RNA, 19 nt, Human
gcacuguggguagacacac

SEQ ID NO: 2504524 - RNA, 18 nt, Human
gcagaaggaagacuucau

SEQ ID NO: 2504525 - RNA, 18 nt, Human
gcacugugcucagggcua

SEQ ID NO: 2504526 - RNA, 16 nt, Human
gcacugugcucagggc

SEQ ID NO: 2504527 - RNA, 14 nt, Human
gcacugugcucagg

SEQ ID NO: 2504528 - RNA, 13 nt, Human
gcacugugcucag

SEQ ID NO: 2504529 - RNA, 14 nt, Human
gcacugugcuaaua

SEQ ID NO: 2504530 - RNA, 11 nt, Human
gcacugugcua

SEQ ID NO: 2504531 - RNA, 19 nt, Human
gcacugugacccccagcuc

SEQ ID NO: 2504532 - RNA, 14 nt, Human
gcacugugaaggac

SEQ ID NO: 2504533 - RNA, 16 nt, Human
gcacugugaaggaccc

SEQ ID NO: 2504534 - RNA, 17 nt, Human
gcacugugaaggacccu

SEQ ID NO: 2504535 - RNA, 18 nt, Human
gcacugugaaggacccuu

SEQ ID NO: 2504536 - RNA, 11 nt, Human
gcacugugaag

SEQ ID NO: 2504537 - RNA, 20 nt, Human
gcacugucucaguuucacuu

SEQ ID NO: 2504538 - RNA, 21 nt, Human
gcacuggguugcaggggauug

SEQ ID NO: 2504539 - RNA, 22 nt, Human
gcacuguccugcuccacagugu

SEQ ID NO: 2504540 - RNA, 19 nt, Human
gcacugucucaguuucacu

SEQ ID NO: 2504541 - RNA, 22 nt, Human
gcagaaggggguggugucucca

SEQ ID NO: 2504542 - RNA, 15 nt, Human
gcagaaggggguggu

SEQ ID NO: 2504543 - RNA, 11 nt, Human
gcagaauaaag

SEQ ID NO: 2504544 - RNA, 15 nt, Human
gcagaagggagaagg

SEQ ID NO: 2504545 - RNA, 13 nt, Human
gcagaagggagaa

SEQ ID NO: 2504546 - RNA, 14 nt, Human
gcagaagggggugg

SEQ ID NO: 2504547 - RNA, 22 nt, Human
gcagaaggaagggcauccuucu

SEQ ID NO: 2504548 - RNA, 15 nt, Human
gcagaaggccaagaa

SEQ ID NO: 2504549 - RNA, 14 nt, Human
gcagaaggccaaga

SEQ ID NO: 2504550 - RNA, 20 nt, Human
gaggucagagccugcaguua

SEQ ID NO: 2504551 - RNA, 17 nt, Human
gaggucagagccugcag

SEQ ID NO: 2504552 - RNA, 20 nt, Human
gaggucacuggaaaggggag

SEQ ID NO: 2504553 - RNA, 18 nt, Human
gaggucacuggaaagggg

SEQ ID NO: 2504554 - RNA, 21 nt, Human
gaggucacuggaaaggggaga

SEQ ID NO: 2504555 - RNA, 21 nt, Human
gaggugggccagucuguggau

SEQ ID NO: 2504556 - RNA, 23 nt, Human
gaggucagcaugucuauucagcu

SEQ ID NO: 2504557 - RNA, 23 nt, Human
gaggugggcccaggaccagcugg

SEQ ID NO: 2504558 - RNA, 22 nt, Human
gaggugggcccaggaccagcug

SEQ ID NO: 2504559 - RNA, 15 nt, Human
gaggugggcccagga

SEQ ID NO: 2504560 - RNA, 14 nt, Human
gaggugggcccagg

SEQ ID NO: 2504561 - RNA, 12 nt, Human
gaggugggccca

SEQ ID NO: 2504562 - RNA, 16 nt, Human
gagguguggagccgag

SEQ ID NO: 2504563 - RNA, 17 nt, Human
gagguuccucugccugc

SEQ ID NO: 2504564 - RNA, 16 nt, Human
gagguuccucugccug

SEQ ID NO: 2504565 - RNA, 15 nt, Human
gaggugugggggcug

SEQ ID NO: 2504566 - RNA, 19 nt, Human
gagguuccucugccugccc

SEQ ID NO: 2504567 - RNA, 18 nt, Human
gagguuccucugccugcc

SEQ ID NO: 2504568 - RNA, 22 nt, Human
gaggugucaggcugcuggcgcc

SEQ ID NO: 2504569 - RNA, 18 nt, Human
gaggugucaggcugcugg

SEQ ID NO: 2504570 - RNA, 15 nt, Human
gaggugucaggcugc

SEQ ID NO: 2504571 - RNA, 14 nt, Human
gaggugucaggcug

SEQ ID NO: 2504572 - RNA, 20 nt, Human
gagguguauggagagaaaac

SEQ ID NO: 2504573 - RNA, 19 nt, Human
gagguggucugaauguucu

SEQ ID NO: 2504574 - RNA, 15 nt, Human
gaggugggguuggga

SEQ ID NO: 2504575 - RNA, 13 nt, Human
gagguggucugaa

SEQ ID NO: 2504576 - RNA, 16 nt, Human
gagguggucugaaugu

SEQ ID NO: 2504577 - RNA, 17 nt, Human
gagguggucugaauguu

SEQ ID NO: 2504578 - RNA, 20 nt, Human
gagguggucugaauguucug

SEQ ID NO: 2504579 - RNA, 17 nt, Human
gagguugggaggccauu

SEQ ID NO: 2504580 - RNA, 15 nt, Human
gagguugggaggcca

SEQ ID NO: 2504581 - RNA, 20 nt, Human
gagguugaucagaucugaca

SEQ ID NO: 2504582 - RNA, 19 nt, Human
gagguugcagugagccaag

SEQ ID NO: 2504583 - RNA, 13 nt, Human
gagguugcagugu

SEQ ID NO: 2504584 - RNA, 19 nt, Human
gagguugcagggagccgag

SEQ ID NO: 2504585 - RNA, 15 nt, Human
gagguugcagugagc

SEQ ID NO: 2504586 - RNA, 15 nt, Human
gagguugauaacuuu

SEQ ID NO: 2504587 - RNA, 15 nt, Human
gagguugaagccaag

SEQ ID NO: 2504588 - RNA, 13 nt, Human
gagguugaagcca

SEQ ID NO: 2504589 - RNA, 19 nt, Human
gagguugauaacuuugcuu

SEQ ID NO: 2504590 - RNA, 18 nt, Human
gagguugauaacuuugcu

SEQ ID NO: 2504591 - RNA, 13 nt, Human
gagguugcaggga

SEQ ID NO: 2504592 - RNA, 16 nt, Human
gagguuucaaaccucc

SEQ ID NO: 2504593 - RNA, 14 nt, Human
gagguugggugggc

SEQ ID NO: 2504594 - RNA, 19 nt, Human
gagguugcagugagcugag

SEQ ID NO: 2504595 - RNA, 17 nt, Human
gagguugggguguacua

SEQ ID NO: 2504596 - RNA, 19 nt, Human
gagguuuaggucaagaaga

SEQ ID NO: 2504597 - RNA, 13 nt, Human
gagguuucaguga

SEQ ID NO: 2504598 - RNA, 20 nt, Human
gaguacuacaguccucccau

SEQ ID NO: 2504599 - RNA, 22 nt, Human
gaguaauggguuucauauuucu

SEQ ID NO: 2504600 - RNA, 22 nt, Human
gaguaaucuguguacaaagaaa

SEQ ID NO: 2504601 - RNA, 22 nt, Human
gaguaauccaagcaaaugugaa

SEQ ID NO: 2504602 - RNA, 12 nt, Human
gaguaagagcug

SEQ ID NO: 2504603 - RNA, 13 nt, Human
gaguaaucugugu

SEQ ID NO: 2504604 - RNA, 23 nt, Human
gaguacuacaguccucccaucuc

SEQ ID NO: 2504605 - RNA, 21 nt, Human
gaguacuacaguccucccauc

SEQ ID NO: 2504606 - RNA, 14 nt, Human
gaguaauuuauugu

SEQ ID NO: 2504607 - RNA, 16 nt, Human
gaguaauuuauuguuu

SEQ ID NO: 2504608 - RNA, 19 nt, Human
gaguagaaacugcagggaa

SEQ ID NO: 2504609 - RNA, 20 nt, Human
gaguagaaagacagagcugg

SEQ ID NO: 2504610 - RNA, 17 nt, Human
gaguagaaagacagagc

SEQ ID NO: 2504611 - RNA, 17 nt, Human
gaguaggaagacuuugg

SEQ ID NO: 2504612 - RNA, 13 nt, Human
gaguaggaagacu

SEQ ID NO: 2504613 - RNA, 12 nt, Human
gaguaggaagac

SEQ ID NO: 2504614 - RNA, 22 nt, Human
gaguagcugggacuacaggcac

SEQ ID NO: 2504615 - RNA, 22 nt, Human
gaguagcaaguucuagagaaga

SEQ ID NO: 2504616 - RNA, 18 nt, Human
gaguagauggugaaauuu

SEQ ID NO: 2504617 - RNA, 17 nt, Human
gaguagccgagagccug

SEQ ID NO: 2504618 - RNA, 19 nt, Human
gaguagcugggacuacagg

SEQ ID NO: 2504619 - RNA, 17 nt, Human
gaguagaauugcauuga

SEQ ID NO: 2504620 - RNA, 14 nt, Human
gaguagaauugcau

SEQ ID NO: 2504621 - RNA, 23 nt, Human
gaguagaaaggccuuuaaaauuu

SEQ ID NO: 2504622 - RNA, 17 nt, Human
gaguagaaaggccuuua

SEQ ID NO: 2504623 - RNA, 15 nt, Human
gaguagaaaggccuu

SEQ ID NO: 2504624 - RNA, 22 nt, Human
gaguagaaagacagagcuggga

SEQ ID NO: 2504625 - RNA, 16 nt, Human
gagugacagaggcagc

SEQ ID NO: 2504626 - RNA, 15 nt, Human
gagugacagaggcag

SEQ ID NO: 2504627 - RNA, 20 nt, Human
gagugaagaggggcagcccu

SEQ ID NO: 2504628 - RNA, 19 nt, Human
gagugaagaggggcagccc

SEQ ID NO: 2504629 - RNA, 18 nt, Human
gagugaagaggggcagcc

SEQ ID NO: 2504630 - RNA, 17 nt, Human
gagugaagaggggcagc

SEQ ID NO: 2504631 - RNA, 15 nt, Human
gagugaauaaauguc

SEQ ID NO: 2504632 - RNA, 14 nt, Human
gagugaauaaaugu

SEQ ID NO: 2504633 - RNA, 14 nt, Human
gagugacagaggca

SEQ ID NO: 2504634 - RNA, 17 nt, Human
gagugaagcugggagaa

SEQ ID NO: 2504635 - RNA, 16 nt, Human
gagugaagaggggcag

SEQ ID NO: 2504636 - RNA, 15 nt, Human
gagugaagaggggca

SEQ ID NO: 2504637 - RNA, 16 nt, Human
gagugaaccuaccuuc

SEQ ID NO: 2504638 - RNA, 14 nt, Human
gagugaagaggggc

SEQ ID NO: 2504639 - RNA, 23 nt, Human
gagugaaaccuuuagggcagcuu

SEQ ID NO: 2504640 - RNA, 22 nt, Human
gagugaaaccuuuagggcagcu

SEQ ID NO: 2504641 - RNA, 15 nt, Human
gagugaaccaucauu

SEQ ID NO: 2504642 - RNA, 21 nt, Human
gagugaaaccuuuagggcagc

SEQ ID NO: 2504643 - RNA, 20 nt, Human
gagugaaaccuuuagggcag

SEQ ID NO: 2504644 - RNA, 21 nt, Human
gagucuuggcggcagcagcca

SEQ ID NO: 2504645 - RNA, 20 nt, Human
gagucuugcuaccucaguca

SEQ ID NO: 2504646 - RNA, 15 nt, Human
gagucugaagcagau

SEQ ID NO: 2504647 - RNA, 15 nt, Human
gagucuaucaaucaa

SEQ ID NO: 2504648 - RNA, 13 nt, Human
gagucugaaggcu

SEQ ID NO: 2504649 - RNA, 12 nt, Human
gagucugaaggc

SEQ ID NO: 2504650 - RNA, 14 nt, Human
gagucugaaggcug

SEQ ID NO: 2504651 - RNA, 15 nt, Human
gagucugaaggcugg

SEQ ID NO: 2504652 - RNA, 23 nt, Human
gagucuggugaagcucacuucug

SEQ ID NO: 2504653 - RNA, 23 nt, Human
gagucugaagcagaugcaaagag

SEQ ID NO: 2504654 - RNA, 18 nt, Human
gagucugucucugucaug

SEQ ID NO: 2504655 - RNA, 15 nt, Human
gagucugucucuguc

SEQ ID NO: 2504656 - RNA, 12 nt, Human
gagucugucucu

SEQ ID NO: 2504657 - RNA, 12 nt, Human
gagucugucuca

SEQ ID NO: 2504658 - RNA, 22 nt, Human
gagucuugcuaccucagucagu

SEQ ID NO: 2504659 - RNA, 20 nt, Human
gagucuuggcggcagcagcc

SEQ ID NO: 2504660 - RNA, 19 nt, Human
gaguaggaagacuuuggaa

SEQ ID NO: 2504661 - RNA, 18 nt, Human
gaguaggaagacuuugga

SEQ ID NO: 2504662 - RNA, 21 nt, Human
gaguagccaggguguggcccu

SEQ ID NO: 2504663 - RNA, 21 nt, Human
gaguaguugauguugcauuuu

SEQ ID NO: 2504664 - RNA, 14 nt, Human
gaguauaugcacuu

SEQ ID NO: 2504665 - RNA, 12 nt, Human
gaguauaugcac

SEQ ID NO: 2504666 - RNA, 16 nt, Human
gaguauaggccggucu

SEQ ID NO: 2504667 - RNA, 20 nt, Human
gaguaguugauguugcauuu

SEQ ID NO: 2504668 - RNA, 17 nt, Human
gaguaucaggucuccca

SEQ ID NO: 2504669 - RNA, 23 nt, Human
gaguaucuccucgcaagcugggu

SEQ ID NO: 2504670 - RNA, 22 nt, Human
gaguauguuaagcucuuuauga

SEQ ID NO: 2504671 - RNA, 19 nt, Human
gaguauguguuugugugug

SEQ ID NO: 2504672 - RNA, 23 nt, Human
gaguaucucggaccuuucagcug

SEQ ID NO: 2504673 - RNA, 16 nt, Human
gaguaucugggaacug

SEQ ID NO: 2504674 - RNA, 11 nt, Human
gaguauauguc

SEQ ID NO: 2504675 - RNA, 16 nt, Human
gagucgaggacaggga

SEQ ID NO: 2504676 - RNA, 15 nt, Human
gagucgaggacaggg

SEQ ID NO: 2504677 - RNA, 20 nt, Human
gagucuagaaguuguuuguc

SEQ ID NO: 2504678 - RNA, 22 nt, Human
gagucguggggugugcugggag

SEQ ID NO: 2504679 - RNA, 18 nt, Human
gaguccuuaaacagggca

SEQ ID NO: 2504680 - RNA, 14 nt, Human
gagucgaggacagg

SEQ ID NO: 2504681 - RNA, 12 nt, Human
gaguccucugga

SEQ ID NO: 2504682 - RNA, 13 nt, Human
gaguccucugaau

SEQ ID NO: 2504683 - RNA, 19 nt, Human
gaguccgaaagggacuugg

SEQ ID NO: 2504684 - RNA, 16 nt, Human
gaguccucacucccag

SEQ ID NO: 2504685 - RNA, 17 nt, Human
gaguccucacucccagu

SEQ ID NO: 2504686 - RNA, 14 nt, Human
gaguauuggucucc

SEQ ID NO: 2504687 - RNA, 21 nt, Human
gaguuaagaagcuguuguaca

SEQ ID NO: 2504688 - RNA, 16 nt, Human
gaguuaagaagcuguu

SEQ ID NO: 2504689 - RNA, 12 nt, Human
gaguuaagaccu

SEQ ID NO: 2504690 - RNA, 13 nt, Human
gaguuaagaccug

SEQ ID NO: 2504691 - RNA, 14 nt, Human
gaguuaagaccugg

SEQ ID NO: 2504692 - RNA, 12 nt, Human
gaguuacagaca

SEQ ID NO: 2504693 - RNA, 14 nt, Human
gaguuaagaagcug

SEQ ID NO: 2504694 - RNA, 13 nt, Human
gaguuaagaagcu

SEQ ID NO: 2504695 - RNA, 18 nt, Human
gaguuaacgggugaauaa

SEQ ID NO: 2504696 - RNA, 22 nt, Human
gaguuaaauagaguauaugcac

SEQ ID NO: 2504697 - RNA, 17 nt, Human
gaguuaaaaagggcagg

SEQ ID NO: 2504698 - RNA, 19 nt, Human
gagugucuuaauuaaaaga

SEQ ID NO: 2504699 - RNA, 20 nt, Human
gagugugccugaagucccag

SEQ ID NO: 2504700 - RNA, 13 nt, Human
gaguguguaauuu

SEQ ID NO: 2504701 - RNA, 12 nt, Human
gagugugggaag

SEQ ID NO: 2504702 - RNA, 18 nt, Human
gagugugggaagggagag

SEQ ID NO: 2504703 - RNA, 17 nt, Human
gaguguggaagccggag

SEQ ID NO: 2504704 - RNA, 18 nt, Human
gagugugcuggaggacug

SEQ ID NO: 2504705 - RNA, 15 nt, Human
gagugugcuggagga

SEQ ID NO: 2504706 - RNA, 14 nt, Human
gagugugcuggagg

SEQ ID NO: 2504707 - RNA, 16 nt, Human
gaguguggcuccccuc

SEQ ID NO: 2504708 - RNA, 16 nt, Human
gaguguggcugaggag

SEQ ID NO: 2504709 - RNA, 17 nt, Human
gaguguggcuccccucu

SEQ ID NO: 2504710 - RNA, 21 nt, Human
gagugggguuaucucuguguu

SEQ ID NO: 2504711 - RNA, 21 nt, Human
gagugaagaggggcagcccuu

SEQ ID NO: 2504712 - RNA, 17 nt, Human
gagugacagaggcagcc

SEQ ID NO: 2504713 - RNA, 13 nt, Human
gagugggugaaua

SEQ ID NO: 2504714 - RNA, 15 nt, Human
gaguggguugauuuc

SEQ ID NO: 2504715 - RNA, 18 nt, Human
gaguguacuuaacuauuc

SEQ ID NO: 2504716 - RNA, 17 nt, Human
gaguguaagugugagua

SEQ ID NO: 2504717 - RNA, 20 nt, Human
gaguguaagugugaguaaga

SEQ ID NO: 2504718 - RNA, 16 nt, Human
gaguggucagaacaga

SEQ ID NO: 2504719 - RNA, 21 nt, Human
gaguggucuuucuggagaggu

SEQ ID NO: 2504720 - RNA, 19 nt, Human
gagugguggcucaugccug

SEQ ID NO: 2504721 - RNA, 14 nt, Human
gaguggucuuucug

SEQ ID NO: 2504722 - RNA, 14 nt, Human
gaguguaaguguga

SEQ ID NO: 2504723 - RNA, 20 nt, Human
gaguguagaagcauuccuuc

SEQ ID NO: 2504724 - RNA, 11 nt, Human
gaguguaguga

SEQ ID NO: 2504725 - RNA, 21 nt, Human
gaguguauguagggcauaaug

SEQ ID NO: 2504726 - RNA, 23 nt, Human
gaguguccuaggaguauccucau

SEQ ID NO: 2504727 - RNA, 16 nt, Human
gaguguagaagcauuc

SEQ ID NO: 2504728 - RNA, 15 nt, Human
gaguguagaagcauu

SEQ ID NO: 2504729 - RNA, 14 nt, Human
gaguguagaagcau

SEQ ID NO: 2504730 - RNA, 13 nt, Human
gaguguagaagca

SEQ ID NO: 2504731 - RNA, 13 nt, Human
gaguguacaagua

SEQ ID NO: 2504732 - RNA, 11 nt, Human
gaguguagaag

SEQ ID NO: 2504733 - RNA, 17 nt, Human
gaguuaagaccuggcag

SEQ ID NO: 2504734 - RNA, 21 nt, Human
gaguuaagaccuggcagcucu

SEQ ID NO: 2504735 - RNA, 19 nt, Human
gaguuacagcgagaggcag

SEQ ID NO: 2504736 - RNA, 18 nt, Human
gaguuacagcgagaggca

SEQ ID NO: 2504737 - RNA, 15 nt, Human
gaguuacagacaaag

SEQ ID NO: 2504738 - RNA, 13 nt, Human
gaguuacagacaa

SEQ ID NO: 2504739 - RNA, 20 nt, Human
gaguucaucuugaauuguaa

SEQ ID NO: 2504740 - RNA, 19 nt, Human
gaguucaucuugaauugua

SEQ ID NO: 2504741 - RNA, 14 nt, Human
gaguucaucuugaa

SEQ ID NO: 2504742 - RNA, 20 nt, Human
gaguucauacccuguuacca

SEQ ID NO: 2504743 - RNA, 22 nt, Human
gauaaauggcuuccuggcaaua

SEQ ID NO: 2504744 - RNA, 19 nt, Human
gauaacuagauggugcuga

SEQ ID NO: 2504745 - RNA, 18 nt, Human
gauaaaucagugguuauu

SEQ ID NO: 2504746 - RNA, 17 nt, Human
gaguugaagacagagcu

SEQ ID NO: 2504747 - RNA, 15 nt, Human
gaguugaagacagag

SEQ ID NO: 2504748 - RNA, 21 nt, Human
gaguugaagacagagcuacac

SEQ ID NO: 2504749 - RNA, 20 nt, Human
gaguuacagcgagaggcaga

SEQ ID NO: 2504750 - RNA, 23 nt, Human
gaguugacuugacagaacacugu

SEQ ID NO: 2504751 - RNA, 16 nt, Human
gaucacggcucacugc

SEQ ID NO: 2504752 - RNA, 15 nt, Human
gaucacggcucacug

SEQ ID NO: 2504753 - RNA, 23 nt, Human
gaucacaacgugcauugugcuuc

SEQ ID NO: 2504754 - RNA, 22 nt, Human
gaucacaacgugcauugugcuu

SEQ ID NO: 2504755 - RNA, 21 nt, Human
gaucacaacgugcauugugcu

SEQ ID NO: 2504756 - RNA, 20 nt, Human
gaucacaacgugcauugugc

SEQ ID NO: 2504757 - RNA, 19 nt, Human
gaucacagagacauuccuc

SEQ ID NO: 2504758 - RNA, 17 nt, Human
gaucacagagacauucc

SEQ ID NO: 2504759 - RNA, 16 nt, Human
gaucacagcagcuucu

SEQ ID NO: 2504760 - RNA, 13 nt, Human
gaucacagaggcu

SEQ ID NO: 2504761 - RNA, 22 nt, Human
gaucacuuucucaguuuucaua

SEQ ID NO: 2504762 - RNA, 15 nt, Human
gaucacuuguuguuu

SEQ ID NO: 2504763 - RNA, 18 nt, Human
gaucacuggagcccagga

SEQ ID NO: 2504764 - RNA, 15 nt, Human
gaucagaaauacaga

SEQ ID NO: 2504765 - RNA, 14 nt, Human
gaucagaaauacag

SEQ ID NO: 2504766 - RNA, 17 nt, Human
gaucacuuguuguuuua

SEQ ID NO: 2504767 - RNA, 18 nt, Human
gaucacggcucacugcag

SEQ ID NO: 2504768 - RNA, 17 nt, Human
gaucacuggagcccagg

SEQ ID NO: 2504769 - RNA, 22 nt, Human
gauauaagugcuguauaaaauc

SEQ ID NO: 2504770 - RNA, 21 nt, Human
gauauaagugcuguauaaaau

SEQ ID NO: 2504771 - RNA, 19 nt, Human
gauauaagugcuguauaaa

SEQ ID NO: 2504772 - RNA, 18 nt, Human
gauauaagugcuguauaa

SEQ ID NO: 2504773 - RNA, 15 nt, Human
gauauaagugugugu

SEQ ID NO: 2504774 - RNA, 23 nt, Human
gauauaagugcuguauaaaauca

SEQ ID NO: 2504775 - RNA, 15 nt, Human
gauaucuugaaauga

SEQ ID NO: 2504776 - RNA, 14 nt, Human
gauaugaaaaauau

SEQ ID NO: 2504777 - RNA, 17 nt, Human
gauaucuugaaaugaaa

SEQ ID NO: 2504778 - RNA, 15 nt, Human
gauaugaaaaauaug

SEQ ID NO: 2504779 - RNA, 18 nt, Human
gaucacaacgugcauugu

SEQ ID NO: 2504780 - RNA, 17 nt, Human
gaucacaacgugcauug

SEQ ID NO: 2504781 - RNA, 16 nt, Human
gaucacaacgugcauu

SEQ ID NO: 2504782 - RNA, 15 nt, Human
gaucacaacgugcau

SEQ ID NO: 2504783 - RNA, 13 nt, Human
gaucacaaaaaca

SEQ ID NO: 2504784 - RNA, 17 nt, Human
gauaacuagauggugcu

SEQ ID NO: 2504785 - RNA, 21 nt, Human
gauaugaguuguuuucagacu

SEQ ID NO: 2504786 - RNA, 21 nt, Human
gauaacuuagguggcaagcug

SEQ ID NO: 2504787 - RNA, 21 nt, Human
gauaacugcaauuuuaauuga

SEQ ID NO: 2504788 - RNA, 18 nt, Human
gauaacuguuauuuauaa

SEQ ID NO: 2504789 - RNA, 17 nt, Human
gauaagaaugcugguuu

SEQ ID NO: 2504790 - RNA, 20 nt, Human
gauacaggaaaagcugcuga

SEQ ID NO: 2504791 - RNA, 22 nt, Human
gauaagaaccuuuugagugccu

SEQ ID NO: 2504792 - RNA, 18 nt, Human
gauaacugcaauuuuaau

SEQ ID NO: 2504793 - RNA, 17 nt, Human
gauaacuguuauuuaua

SEQ ID NO: 2504794 - RNA, 20 nt, Human
gauaacuagauggugcugag

SEQ ID NO: 2504795 - RNA, 11 nt, Human
gauaacucucc

SEQ ID NO: 2504796 - RNA, 23 nt, Human
gauacaggaaaagcugcugacag

SEQ ID NO: 2504797 - RNA, 21 nt, Human
gauacaggaaaagcugcugac

SEQ ID NO: 2504798 - RNA, 14 nt, Human
gauagaugugugga

SEQ ID NO: 2504799 - RNA, 22 nt, Human
gauagauguguggacacauugg

SEQ ID NO: 2504800 - RNA, 17 nt, Human
gauaagaccaccaccuc

SEQ ID NO: 2504801 - RNA, 22 nt, Human
gauaagaaugcugguuuuccua

SEQ ID NO: 2504802 - RNA, 22 nt, Human
gauagccaaggccaaaggaagc

SEQ ID NO: 2504803 - RNA, 14 nt, Human
gauagccaaggcca

SEQ ID NO: 2504804 - RNA, 15 nt, Human
gauagcacagacccu

SEQ ID NO: 2504805 - RNA, 16 nt, Human
gauagcacagacccug

SEQ ID NO: 2504806 - RNA, 23 nt, Human
gauagcaaagcgacguuagucgu

SEQ ID NO: 2504807 - RNA, 20 nt, Human
gauagcaagugaauuuuucu

SEQ ID NO: 2504808 - RNA, 16 nt, Human
gauauaaauggcuggu

SEQ ID NO: 2504809 - RNA, 21 nt, Human
gauauaaaugcaauauuaaug

SEQ ID NO: 2504810 - RNA, 22 nt, Human
gauauaaauauauauaaauaua

SEQ ID NO: 2504811 - RNA, 17 nt, Human
gauauaaauauauauaa

SEQ ID NO: 2504812 - RNA, 16 nt, Human
gauauaaauauauaua

SEQ ID NO: 2504813 - RNA, 15 nt, Human
gauauaaauauauau

SEQ ID NO: 2504814 - RNA, 13 nt, Human
gauauaaauauau

SEQ ID NO: 2504815 - RNA, 19 nt, Human
gauauaacuauugcccagg

SEQ ID NO: 2504816 - RNA, 15 nt, Human
gauauaaauggcugg

SEQ ID NO: 2504817 - RNA, 16 nt, Human
gauauaagugcuguau

SEQ ID NO: 2504818 - RNA, 14 nt, Human
gauauaagugcugu

SEQ ID NO: 2504819 - RNA, 20 nt, Human
gauagcuaacauuuuaaaua

SEQ ID NO: 2504820 - RNA, 18 nt, Human
gauagcuaacauuuuaaa

SEQ ID NO: 2504821 - RNA, 20 nt, Human
gauagccuuccguaacccaa

SEQ ID NO: 2504822 - RNA, 16 nt, Human
gauagcuaacauuuua

SEQ ID NO: 2504823 - RNA, 22 nt, Human
gauagcuaacauuuuaaauaaa

SEQ ID NO: 2504824 - RNA, 20 nt, Human
gauagcuuuauuuuuuaagu

SEQ ID NO: 2504825 - RNA, 23 nt, Human
gauagcuucaccccaaucccagc

SEQ ID NO: 2504826 - RNA, 17 nt, Human
gaggggguggccuccca

SEQ ID NO: 2504827 - RNA, 14 nt, Human
gagggguaggcaga

SEQ ID NO: 2504828 - RNA, 18 nt, Human
gagggggcuugaagccaa

SEQ ID NO: 2504829 - RNA, 18 nt, Human
gagggguaggcagagccu

SEQ ID NO: 2504830 - RNA, 21 nt, Human
gagggggcuugaagccaaaga

SEQ ID NO: 2504831 - RNA, 16 nt, Human
gagggguaaaagcuga

SEQ ID NO: 2504832 - RNA, 20 nt, Human
gagggggccaccuccccagg

SEQ ID NO: 2504833 - RNA, 18 nt, Human
gagggggccaccucccca

SEQ ID NO: 2504834 - RNA, 17 nt, Human
gagggggcuugaagcca

SEQ ID NO: 2504835 - RNA, 21 nt, Human
gagggggcuauagcuacagga

SEQ ID NO: 2504836 - RNA, 22 nt, Human
gagggggccaccuccccaggcc

SEQ ID NO: 2504837 - RNA, 16 nt, Human
gaggguaauaaacuua

SEQ ID NO: 2504838 - RNA, 23 nt, Human
gagggguugccacaggccucccu

SEQ ID NO: 2504839 - RNA, 22 nt, Human
gagggguugccacaggccuccc

SEQ ID NO: 2504840 - RNA, 18 nt, Human
gagggguugccacaggcc

SEQ ID NO: 2504841 - RNA, 17 nt, Human
gagggguugccacaggc

SEQ ID NO: 2504842 - RNA, 13 nt, Human
gaggguaaggcug

SEQ ID NO: 2504843 - RNA, 18 nt, Human
gagggguguggcaguggu

SEQ ID NO: 2504844 - RNA, 17 nt, Human
gagggguguggcagugg

SEQ ID NO: 2504845 - RNA, 21 nt, Human
gagggguguggcuccuuccca

SEQ ID NO: 2504846 - RNA, 14 nt, Human
gagggguguggcag

SEQ ID NO: 2504847 - RNA, 18 nt, Human
gaggggucuccaggagga

SEQ ID NO: 2504848 - RNA, 15 nt, Human
gagggcacacacugu

SEQ ID NO: 2504849 - RNA, 12 nt, Human
gagggcagcagg

SEQ ID NO: 2504850 - RNA, 14 nt, Human
gagggcagcagggc

SEQ ID NO: 2504851 - RNA, 15 nt, Human
gagggcagcagggcu

SEQ ID NO: 2504852 - RNA, 12 nt, Human
gagggcacacac

SEQ ID NO: 2504853 - RNA, 22 nt, Human
gagggcaagggccaugcugaag

SEQ ID NO: 2504854 - RNA, 18 nt, Human
gagggcaagggccaugcu

SEQ ID NO: 2504855 - RNA, 19 nt, Human
gagggauuggccgcuuggc

SEQ ID NO: 2504856 - RNA, 21 nt, Human
gagggauucugguuccagggu

SEQ ID NO: 2504857 - RNA, 18 nt, Human
gagggauucugguuccag

SEQ ID NO: 2504858 - RNA, 20 nt, Human
gagggaugcugccugaguca

SEQ ID NO: 2504859 - RNA, 14 nt, Human
gagggauggacuga

SEQ ID NO: 2504860 - RNA, 22 nt, Human
gagggaugaggugcugggaggg

SEQ ID NO: 2504861 - RNA, 19 nt, Human
gagggauggcggguggggg

SEQ ID NO: 2504862 - RNA, 18 nt, Human
gagggauggcgggugggg

SEQ ID NO: 2504863 - RNA, 13 nt, Human
gagggagaagaag

SEQ ID NO: 2504864 - RNA, 17 nt, Human
gaggggcugugggcgug

SEQ ID NO: 2504865 - RNA, 16 nt, Human
gagggccacaugggag

SEQ ID NO: 2504866 - RNA, 18 nt, Human
gagggcaugcgcacaagg

SEQ ID NO: 2504867 - RNA, 22 nt, Human
gagggcaugcgcacaaggcuga

SEQ ID NO: 2504868 - RNA, 23 nt, Human
gaggggcucucagcucagcgcca

SEQ ID NO: 2504869 - RNA, 18 nt, Human
gagggccaagacuuggca

SEQ ID NO: 2504870 - RNA, 17 nt, Human
gaggggcuuucuggaga

SEQ ID NO: 2504871 - RNA, 11 nt, Human
gagggcaggga

SEQ ID NO: 2504872 - RNA, 16 nt, Human
gagggcaguguuuccu

SEQ ID NO: 2504873 - RNA, 16 nt, Human
gagggcagcagggcua

SEQ ID NO: 2504874 - RNA, 19 nt, Human
gagggcagcagggcuaccc

SEQ ID NO: 2504875 - RNA, 20 nt, Human
gagggagggcuccagacaca

SEQ ID NO: 2504876 - RNA, 17 nt, Human
gagggaggaggccaccu

SEQ ID NO: 2504877 - RNA, 20 nt, Human
gagggagggggaaggcaggg

SEQ ID NO: 2504878 - RNA, 16 nt, Human
gagggagugacagagg

SEQ ID NO: 2504879 - RNA, 18 nt, Human
gagggagugacagaggca

SEQ ID NO: 2504880 - RNA, 22 nt, Human
gagggagugacagaggcagccc

SEQ ID NO: 2504881 - RNA, 21 nt, Human
gagggagugacagaggcagcc

SEQ ID NO: 2504882 - RNA, 12 nt, Human
gagggaggggcc

SEQ ID NO: 2504883 - RNA, 13 nt, Human
gagggagggggcu

SEQ ID NO: 2504884 - RNA, 14 nt, Human
gagggaucacaggg

SEQ ID NO: 2504885 - RNA, 15 nt, Human
gagggaucacagggc

SEQ ID NO: 2504886 - RNA, 17 nt, Human
gagggaugaugccacac

SEQ ID NO: 2504887 - RNA, 23 nt, Human
gagggaucacagggccccagaag

SEQ ID NO: 2504888 - RNA, 18 nt, Human
gagggaugaggugcuggg

SEQ ID NO: 2504889 - RNA, 15 nt, Human
gagggaugcugccug

SEQ ID NO: 2504890 - RNA, 17 nt, Human
gagggaugcugccugag

SEQ ID NO: 2504891 - RNA, 22 nt, Human
gaggcuggugcuguggccaggg

SEQ ID NO: 2504892 - RNA, 20 nt, Human
gaggcuggugcuguggccag

SEQ ID NO: 2504893 - RNA, 20 nt, Human
gaggcugggcucccuuccca

SEQ ID NO: 2504894 - RNA, 23 nt, Human
gaggcuguaggacucgcagucag

SEQ ID NO: 2504895 - RNA, 12 nt, Human
gaggcuguagga

SEQ ID NO: 2504896 - RNA, 12 nt, Human
gaggcuguccug

SEQ ID NO: 2504897 - RNA, 14 nt, Human
gaggcuguccugua

SEQ ID NO: 2504898 - RNA, 20 nt, Human
gaggcugucuucucaggcuc

SEQ ID NO: 2504899 - RNA, 21 nt, Human
gaggcugucuucucaggcucu

SEQ ID NO: 2504900 - RNA, 23 nt, Human
gaggcuguggucacagcggaggu

SEQ ID NO: 2504901 - RNA, 22 nt, Human
gaggcugucuucucaggcucug

SEQ ID NO: 2504902 - RNA, 21 nt, Human
gagggagacacuggccccuca

SEQ ID NO: 2504903 - RNA, 13 nt, Human
gagggagaaggga

SEQ ID NO: 2504904 - RNA, 23 nt, Human
gagggagagguggagcaaaguga

SEQ ID NO: 2504905 - RNA, 14 nt, Human
gagggagaggugga

SEQ ID NO: 2504906 - RNA, 13 nt, Human
gagggagagggag

SEQ ID NO: 2504907 - RNA, 22 nt, Human
gagggagagagagagagagagg

SEQ ID NO: 2504908 - RNA, 16 nt, Human
gagggagagagagaga

SEQ ID NO: 2504909 - RNA, 15 nt, Human
gagggagagagagag

SEQ ID NO: 2504910 - RNA, 13 nt, Human
gagggagagagag

SEQ ID NO: 2504911 - RNA, 14 nt, Human
gagggagaagcaug

SEQ ID NO: 2504912 - RNA, 20 nt, Human
gagggagcauagaaggcagg

SEQ ID NO: 2504913 - RNA, 20 nt, Human
gagggagcagacaggaggaa

SEQ ID NO: 2504914 - RNA, 12 nt, Human
gagggagcagac

SEQ ID NO: 2504915 - RNA, 12 nt, Human
gagggagaugga

SEQ ID NO: 2504916 - RNA, 22 nt, Human
gagggagcaaguccuucccuuu

SEQ ID NO: 2504917 - RNA, 19 nt, Human
gagggagggcuccagacac

SEQ ID NO: 2504918 - RNA, 13 nt, Human
gagggaggaggcc

SEQ ID NO: 2504919 - RNA, 12 nt, Human
gagggaggaggc

SEQ ID NO: 2504920 - RNA, 13 nt, Human
gagggaggaaucg

SEQ ID NO: 2504921 - RNA, 24 nt, Human
gagggagcauagaaggcaggugag

SEQ ID NO: 2504922 - RNA, 15 nt, Human
gagggagcuuagcca

SEQ ID NO: 2504923 - RNA, 21 nt, Human
gagguaaggaauaccuguccc

SEQ ID NO: 2504924 - RNA, 16 nt, Human
gagguaacagaacagc

SEQ ID NO: 2504925 - RNA, 15 nt, Human
gagguaacagaacag

SEQ ID NO: 2504926 - RNA, 14 nt, Human
gagguaacagaaca

SEQ ID NO: 2504927 - RNA, 13 nt, Human
gagguaacagaac

SEQ ID NO: 2504928 - RNA, 21 nt, Human
gaggguuuccaugggguagga

SEQ ID NO: 2504929 - RNA, 22 nt, Human
gagguaaaagugugagcaguga

SEQ ID NO: 2504930 - RNA, 21 nt, Human
gagguaacagaacagcuucag

SEQ ID NO: 2504931 - RNA, 18 nt, Human
gagguaacagaacagcuu

SEQ ID NO: 2504932 - RNA, 17 nt, Human
gagguaacagaacagcu

SEQ ID NO: 2504933 - RNA, 24 nt, Human
gagguaaggaauaccugucccccu

SEQ ID NO: 2504934 - RNA, 12 nt, Human
gaggguuccugu

SEQ ID NO: 2504935 - RNA, 20 nt, Human
gaggguuggguucaucugag

SEQ ID NO: 2504936 - RNA, 17 nt, Human
gaggguuguucuccuag

SEQ ID NO: 2504937 - RNA, 18 nt, Human
gaggguuguucuccuaga

SEQ ID NO: 2504938 - RNA, 15 nt, Human
gaggguugggcuggu

SEQ ID NO: 2504939 - RNA, 14 nt, Human
gaggguugggcugg

SEQ ID NO: 2504940 - RNA, 15 nt, Human
gaggguuagggaggg

SEQ ID NO: 2504941 - RNA, 13 nt, Human
gaggucagagccu

SEQ ID NO: 2504942 - RNA, 12 nt, Human
gaggucagagcc

SEQ ID NO: 2504943 - RNA, 23 nt, Human
gaggucaacagagaaggcaggaa

SEQ ID NO: 2504944 - RNA, 15 nt, Human
gaggucaagcccagg

SEQ ID NO: 2504945 - RNA, 16 nt, Human
gaggucaagcccagga

SEQ ID NO: 2504946 - RNA, 17 nt, Human
gaggucaagcccaggag

SEQ ID NO: 2504947 - RNA, 19 nt, Human
gaggucaagcccaggagga

SEQ ID NO: 2504948 - RNA, 20 nt, Human
gaggucaagcccaggaggac

SEQ ID NO: 2504949 - RNA, 19 nt, Human
gaggucaaggcugcaguga

SEQ ID NO: 2504950 - RNA, 24 nt, Human
gaggucaagcccaggaggacugcc

SEQ ID NO: 2504951 - RNA, 17 nt, Human
gaggucacuggaaaggg

SEQ ID NO: 2504952 - RNA, 16 nt, Human
gaggucacuggaaagg

SEQ ID NO: 2504953 - RNA, 15 nt, Human
gaggucacuggaaag

SEQ ID NO: 2504954 - RNA, 22 nt, Human
gaggucacauucaggaagauga

SEQ ID NO: 2504955 - RNA, 21 nt, Human
gaggucacauucaggaagaug

SEQ ID NO: 2504956 - RNA, 19 nt, Human
gaggucacauucaggaaga

SEQ ID NO: 2504957 - RNA, 16 nt, Human
gaggucacauucagga

SEQ ID NO: 2504958 - RNA, 16 nt, Human
gaggucaaguaagaag

SEQ ID NO: 2504959 - RNA, 21 nt, Human
gagguagcuuugagguggaag

SEQ ID NO: 2504960 - RNA, 21 nt, Human
gagguagguggaucaccugag

SEQ ID NO: 2504961 - RNA, 13 nt, Human
gagguaugagguc

SEQ ID NO: 2504962 - RNA, 23 nt, Human
gagguagaguuugaaggagguga

SEQ ID NO: 2504963 - RNA, 19 nt, Human
gagguagaguuugaaggag

SEQ ID NO: 2504964 - RNA, 18 nt, Human
gagguagaguuugaagga

SEQ ID NO: 2504965 - RNA, 17 nt, Human
gagguagaaaagauugg

SEQ ID NO: 2504966 - RNA, 17 nt, Human
gaggucaaggcugcagu

SEQ ID NO: 2504967 - RNA, 15 nt, Human
gaggucaacagagaa

SEQ ID NO: 2504968 - RNA, 16 nt, Human
gaggucaacagagaag

SEQ ID NO: 2504969 - RNA, 22 nt, Human
gaggucaacagagaaggcagga

SEQ ID NO: 2504970 - RNA, 19 nt, Human
gagguauuuaucuuuacuu

SEQ ID NO: 2504971 - RNA, 22 nt, Human
gagguauucaauauccuuugcc

SEQ ID NO: 2504972 - RNA, 22 nt, Human
gagggugucccaaaaagaaagg

SEQ ID NO: 2504973 - RNA, 21 nt, Human
gaggguggugaccucugccug

SEQ ID NO: 2504974 - RNA, 15 nt, Human
gagggugggaguggg

SEQ ID NO: 2504975 - RNA, 14 nt, Human
gaggguggugaccu

SEQ ID NO: 2504976 - RNA, 12 nt, Human
gaggguggaaua

SEQ ID NO: 2504977 - RNA, 20 nt, Human
gaggguggagacuaagcccu

SEQ ID NO: 2504978 - RNA, 13 nt, Human
gaggguggagacu

SEQ ID NO: 2504979 - RNA, 13 nt, Human
gaggguggcaggu

SEQ ID NO: 2504980 - RNA, 18 nt, Human
gagggugggagagcccag

SEQ ID NO: 2504981 - RNA, 19 nt, Human
gagggugggagagcccagc

SEQ ID NO: 2504982 - RNA, 21 nt, Human
gagggugaagugaagacaaug

SEQ ID NO: 2504983 - RNA, 15 nt, Human
gagggugagugcaag

SEQ ID NO: 2504984 - RNA, 14 nt, Human
gagggucugaggaa

SEQ ID NO: 2504985 - RNA, 13 nt, Human
gagggucugagga

SEQ ID NO: 2504986 - RNA, 23 nt, Human
gagggucuugguuccagccugcc

SEQ ID NO: 2504987 - RNA, 24 nt, Human
gagggucuggagaagcagugagcc

SEQ ID NO: 2504988 - RNA, 17 nt, Human
gaggguccuggcuccug

SEQ ID NO: 2504989 - RNA, 15 nt, Human
gagggucuggagaag

SEQ ID NO: 2504990 - RNA, 21 nt, Human
gaggguccuggcuccugaggg

SEQ ID NO: 2504991 - RNA, 15 nt, Human
gaggguccuggcucc

SEQ ID NO: 2504992 - RNA, 19 nt, Human
gaggguccccaccugggac

SEQ ID NO: 2504993 - RNA, 23 nt, Human
gagggucccaagcugggccccag

SEQ ID NO: 2504994 - RNA, 20 nt, Human
gagggucccaagcugggccc

SEQ ID NO: 2504995 - RNA, 19 nt, Human
gagggucccaagcugggcc

SEQ ID NO: 2504996 - RNA, 19 nt, Human
gagggucaggacugugacu

SEQ ID NO: 2504997 - RNA, 18 nt, Human
gagggucccaagcugggc

SEQ ID NO: 2504998 - RNA, 16 nt, Human
gagggucaggaaggau

SEQ ID NO: 2504999 - RNA, 13 nt, Human
gagggucagagag

SEQ ID NO: 2505000 - RNA, 15 nt, Human
gagggucagagagga

SEQ ID NO: 2505001 - RNA, 13 nt, Human
gagggucaggaag

SEQ ID NO: 2505002 - RNA, 15 nt, Human
gagggucaggaagga

SEQ ID NO: 2505003 - RNA, 18 nt, Human
gagcccuguggaugagcc

SEQ ID NO: 2505004 - RNA, 21 nt, Human
gagcccuguggaugagcccuc

SEQ ID NO: 2505005 - RNA, 22 nt, Human
gagcccuguggaugagcccuca

SEQ ID NO: 2505006 - RNA, 18 nt, Human
gagcccuuaucugugcuc

SEQ ID NO: 2505007 - RNA, 22 nt, Human
gagcccuguccugccuaaggcu

SEQ ID NO: 2505008 - RNA, 19 nt, Human
gagcccuuaucugugcuca

SEQ ID NO: 2505009 - RNA, 13 nt, Human
gaggaucucuuga

SEQ ID NO: 2505010 - RNA, 22 nt, Human
gaggaucucuugagccugggag

SEQ ID NO: 2505011 - RNA, 20 nt, Human
gaggaucacuggagcccagg

SEQ ID NO: 2505012 - RNA, 19 nt, Human
gaggaucacuggagcccag

SEQ ID NO: 2505013 - RNA, 21 nt, Human
gaggaugaauguaugugcacu

SEQ ID NO: 2505014 - RNA, 13 nt, Human
gaggaucuggaga

SEQ ID NO: 2505015 - RNA, 17 nt, Human
gaggaucccucucugga

SEQ ID NO: 2505016 - RNA, 16 nt, Human
gaggaucucuugagcc

SEQ ID NO: 2505017 - RNA, 19 nt, Human
gaggaucucuugagccugg

SEQ ID NO: 2505018 - RNA, 19 nt, Human
gaggauggccagugucugu

SEQ ID NO: 2505019 - RNA, 16 nt, Human
gaggauggccaguguc

SEQ ID NO: 2505020 - RNA, 15 nt, Human
gaggauggccagugu

SEQ ID NO: 2505021 - RNA, 20 nt, Human
gaggauuuaagggauggaaa

SEQ ID NO: 2505022 - RNA, 22 nt, Human
gaggauuuaagggauggaaaag

SEQ ID NO: 2505023 - RNA, 20 nt, Human
gaggauugcuugagcucagg

SEQ ID NO: 2505024 - RNA, 17 nt, Human
gaggaugagagcccaga

SEQ ID NO: 2505025 - RNA, 16 nt, Human
gaggaugagagcccag

SEQ ID NO: 2505026 - RNA, 15 nt, Human
gaggaugagagccca

SEQ ID NO: 2505027 - RNA, 14 nt, Human
gaggaugagagccc

SEQ ID NO: 2505028 - RNA, 20 nt, Human
gaggaugagagcccagaggu

SEQ ID NO: 2505029 - RNA, 18 nt, Human
gaggaugagagcccagag

SEQ ID NO: 2505030 - RNA, 22 nt, Human
gaggaugagcucuacccagggc

SEQ ID NO: 2505031 - RNA, 21 nt, Human
gaggaugcagagucagcagaa

SEQ ID NO: 2505032 - RNA, 13 nt, Human
gaggaugagcugg

SEQ ID NO: 2505033 - RNA, 12 nt, Human
gaggauggagag

SEQ ID NO: 2505034 - RNA, 13 nt, Human
gaggauggagaga

SEQ ID NO: 2505035 - RNA, 14 nt, Human
gaggauggagagag

SEQ ID NO: 2505036 - RNA, 14 nt, Human
gaggauggccagug

SEQ ID NO: 2505037 - RNA, 15 nt, Human
gaggauggagagagg

SEQ ID NO: 2505038 - RNA, 19 nt, Human
gaggcagagaaagaagaga

SEQ ID NO: 2505039 - RNA, 17 nt, Human
gaggcagagaaagaaga

SEQ ID NO: 2505040 - RNA, 16 nt, Human
gaggcagagaaagaag

SEQ ID NO: 2505041 - RNA, 22 nt, Human
gaggcagacuucccugaaugua

SEQ ID NO: 2505042 - RNA, 19 nt, Human
gaggcagacagcagcucag

SEQ ID NO: 2505043 - RNA, 20 nt, Human
gaggcagacagcagcucagg

SEQ ID NO: 2505044 - RNA, 21 nt, Human
gaggcagacagcagcucaggc

SEQ ID NO: 2505045 - RNA, 22 nt, Human
gaggcagacagcagcucaggca

SEQ ID NO: 2505046 - RNA, 13 nt, Human
gaggcaagagaau

SEQ ID NO: 2505047 - RNA, 17 nt, Human
gaggauuuuuuucugag

SEQ ID NO: 2505048 - RNA, 13 nt, Human
gaggauuuugagu

SEQ ID NO: 2505049 - RNA, 15 nt, Human
gaggauuucaagccu

SEQ ID NO: 2505050 - RNA, 17 nt, Human
gaggauuucaagccugc

SEQ ID NO: 2505051 - RNA, 22 nt, Human
gaggcaaugggagcugaggcca

SEQ ID NO: 2505052 - RNA, 19 nt, Human
gaggcaaugucaggaacag

SEQ ID NO: 2505053 - RNA, 13 nt, Human
gaggcaagcccug

SEQ ID NO: 2505054 - RNA, 15 nt, Human
gaggcagagagcggu

SEQ ID NO: 2505055 - RNA, 13 nt, Human
gaggcagagagcg

SEQ ID NO: 2505056 - RNA, 12 nt, Human
gaggcagagagc

SEQ ID NO: 2505057 - RNA, 21 nt, Human
gaggcagagaaagaagagaca

SEQ ID NO: 2505058 - RNA, 11 nt, Human
gaggcagagag

SEQ ID NO: 2505059 - RNA, 14 nt, Human
gaggcagaggacag

SEQ ID NO: 2505060 - RNA, 13 nt, Human
gaggcagaggaca

SEQ ID NO: 2505061 - RNA, 11 nt, Human
gaggcagagga

SEQ ID NO: 2505062 - RNA, 22 nt, Human
gaggcagagagcggucucaggc

SEQ ID NO: 2505063 - RNA, 18 nt, Human
gaggcagccccauucugc

SEQ ID NO: 2505064 - RNA, 19 nt, Human
gaggcagccccauucugcc

SEQ ID NO: 2505065 - RNA, 9 nt, Human
gaggcaggg

SEQ ID NO: 2505066 - RNA, 20 nt, Human
gaggcagccccauucugccu

SEQ ID NO: 2505067 - RNA, 21 nt, Human
gaggcagccccauucugccug

SEQ ID NO: 2505068 - RNA, 14 nt, Human
gaggcaggcuccag

SEQ ID NO: 2505069 - RNA, 22 nt, Human
gaggcagggaaguccccaggcc

SEQ ID NO: 2505070 - RNA, 14 nt, Human
gaggcagggaaguc

SEQ ID NO: 2505071 - RNA, 15 nt, Human
gaggcagggagggga

SEQ ID NO: 2505072 - RNA, 17 nt, Human
gaggcagggaggggacu

SEQ ID NO: 2505073 - RNA, 23 nt, Human
gaggccaugggccuccugugugu

SEQ ID NO: 2505074 - RNA, 21 nt, Human
gaggccaugggccuccugugu

SEQ ID NO: 2505075 - RNA, 20 nt, Human
gaggccaugggccuccugug

SEQ ID NO: 2505076 - RNA, 18 nt, Human
gaggccaugggccuccug

SEQ ID NO: 2505077 - RNA, 17 nt, Human
gaggccaugggccuccu

SEQ ID NO: 2505078 - RNA, 14 nt, Human
gaggccaugggccu

SEQ ID NO: 2505079 - RNA, 16 nt, Human
gaggcagggaggggac

SEQ ID NO: 2505080 - RNA, 15 nt, Human
gaggcagggccuugc

SEQ ID NO: 2505081 - RNA, 17 nt, Human
gaggcagggccuugccc

SEQ ID NO: 2505082 - RNA, 18 nt, Human
gaggcagggccuugccca

SEQ ID NO: 2505083 - RNA, 20 nt, Human
gaggcagggccuugcccaga

SEQ ID NO: 2505084 - RNA, 21 nt, Human
gaggcagggccuugcccagag

SEQ ID NO: 2505085 - RNA, 16 nt, Human
gaggcccagagggccu

SEQ ID NO: 2505086 - RNA, 15 nt, Human
gaggcccagagggcc

SEQ ID NO: 2505087 - RNA, 23 nt, Human
gaggccauguuccaauaaacagg

SEQ ID NO: 2505088 - RNA, 19 nt, Human
gaggcccagagggccugca

SEQ ID NO: 2505089 - RNA, 14 nt, Human
gaggcccagagggc

SEQ ID NO: 2505090 - RNA, 13 nt, Human
gaggcccagaggg

SEQ ID NO: 2505091 - RNA, 11 nt, Human
gaggcccagag

SEQ ID NO: 2505092 - RNA, 19 nt, Human
gaggccauugugugagccu

SEQ ID NO: 2505093 - RNA, 20 nt, Human
gaggccaugauucgcccaaa

SEQ ID NO: 2505094 - RNA, 23 nt, Human
gaggccaugauucgcccaaagcc

SEQ ID NO: 2505095 - RNA, 14 nt, Human
gaggcccccagccc

SEQ ID NO: 2505096 - RNA, 19 nt, Human
gaggccccagccucccuga

SEQ ID NO: 2505097 - RNA, 22 nt, Human
gaggccccagccucccugaagc

SEQ ID NO: 2505098 - RNA, 12 nt, Human
gaggccccagcc

SEQ ID NO: 2505099 - RNA, 13 nt, Human
gaggccccagccu

SEQ ID NO: 2505100 - RNA, 14 nt, Human
gaggccccacuggg

SEQ ID NO: 2505101 - RNA, 18 nt, Human
gaggcccaguucacccug

SEQ ID NO: 2505102 - RNA, 20 nt, Human
gaggcccaguucacccugau

SEQ ID NO: 2505103 - RNA, 19 nt, Human
gaggccccaaaggaaaaag

SEQ ID NO: 2505104 - RNA, 14 nt, Human
gaggccccaaagga

SEQ ID NO: 2505105 - RNA, 13 nt, Human
gaggccccaaagg

SEQ ID NO: 2505106 - RNA, 13 nt, Human
gaggcccagggag

SEQ ID NO: 2505107 - RNA, 13 nt, Human
gaggcccaguuca

SEQ ID NO: 2505108 - RNA, 12 nt, Human
gaggcccaggga

SEQ ID NO: 2505109 - RNA, 20 nt, Human
gaggcccuucucuccagccc

SEQ ID NO: 2505110 - RNA, 15 nt, Human
gaggcccuucucucc

SEQ ID NO: 2505111 - RNA, 21 nt, Human
gaggcccuucucuccagcccc

SEQ ID NO: 2505112 - RNA, 23 nt, Human
gaggccccagccucccugaagcc

SEQ ID NO: 2505113 - RNA, 16 nt, Human
gaggcugggcucccuu

SEQ ID NO: 2505114 - RNA, 16 nt, Human
gaggcuggcuggggcc

SEQ ID NO: 2505115 - RNA, 13 nt, Human
gaggcuggcuggg

SEQ ID NO: 2505116 - RNA, 12 nt, Human
gaggcuggcugg

SEQ ID NO: 2505117 - RNA, 12 nt, Human
gaggcuggcagg

SEQ ID NO: 2505118 - RNA, 13 nt, Human
gaggcuggcaggu

SEQ ID NO: 2505119 - RNA, 13 nt, Human
gaggcuggcacag

SEQ ID NO: 2505120 - RNA, 23 nt, Human
gaggcuggauccuagccuuaucc

SEQ ID NO: 2505121 - RNA, 16 nt, Human
gaggcuggaggcaggg

SEQ ID NO: 2505122 - RNA, 17 nt, Human
gaggcuggaggcagggc

SEQ ID NO: 2505123 - RNA, 18 nt, Human
gaggcuggaggcagggcc

SEQ ID NO: 2505124 - RNA, 19 nt, Human
gaggcuggaggcagggccu

SEQ ID NO: 2505125 - RNA, 15 nt, Human
gaggcuggagcuggc

SEQ ID NO: 2505126 - RNA, 15 nt, Human
gaggcuggaggcagg

SEQ ID NO: 2505127 - RNA, 14 nt, Human
gaggcuggaggcag

SEQ ID NO: 2505128 - RNA, 19 nt, Human
gaggcggacguuccagccg

SEQ ID NO: 2505129 - RNA, 14 nt, Human
gaggcgcgggggcc

SEQ ID NO: 2505130 - RNA, 18 nt, Human
gaggcggacguuccagcc

SEQ ID NO: 2505131 - RNA, 21 nt, Human
gaggcgcaugaauuugugaag

SEQ ID NO: 2505132 - RNA, 22 nt, Human
gaggcgcacuuuccuccuggca

SEQ ID NO: 2505133 - RNA, 24 nt, Human
gaggccucuuggaccucugcucug

SEQ ID NO: 2505134 - RNA, 15 nt, Human
gaggccuugagaggc

SEQ ID NO: 2505135 - RNA, 12 nt, Human
gaggccuugcuc

SEQ ID NO: 2505136 - RNA, 19 nt, Human
gaggccuucucugaaggac

SEQ ID NO: 2505137 - RNA, 18 nt, Human
gaggccuucucugaagga

SEQ ID NO: 2505138 - RNA, 18 nt, Human
gaggccuaccccgcagac

SEQ ID NO: 2505139 - RNA, 19 nt, Human
gaggccuaaaaguaaacau

SEQ ID NO: 2505140 - RNA, 18 nt, Human
gaggccuacucuuccauc

SEQ ID NO: 2505141 - RNA, 23 nt, Human
gaggccuauaaugaagcuuuaua

SEQ ID NO: 2505142 - RNA, 22 nt, Human
gaggccucucauuccagaggaa

SEQ ID NO: 2505143 - RNA, 16 nt, Human
gaggccucaguggacu

SEQ ID NO: 2505144 - RNA, 16 nt, Human
gaggccuucucugaag

SEQ ID NO: 2505145 - RNA, 22 nt, Human
gaggccucuuggaccucugcuc

SEQ ID NO: 2505146 - RNA, 21 nt, Human
gaggccucuuggaccucugcu

SEQ ID NO: 2505147 - RNA, 19 nt, Human
gaggccucuuggaccucug

SEQ ID NO: 2505148 - RNA, 18 nt, Human
gaggccucuuggaccucu

SEQ ID NO: 2505149 - RNA, 21 nt, Human
gaggccucaguggacuuucca

SEQ ID NO: 2505150 - RNA, 17 nt, Human
ggaucccucauccucau

SEQ ID NO: 2505151 - RNA, 13 nt, Human
ggaucccucaucc

SEQ ID NO: 2505152 - RNA, 13 nt, Human
ggaucccucaucu

SEQ ID NO: 2505153 - RNA, 18 nt, Human
ggaucccucaucuguccc

SEQ ID NO: 2505154 - RNA, 22 nt, Human
ggaucccucaucugucccuccg

SEQ ID NO: 2505155 - RNA, 17 nt, Human
ggaucccucccccccau

SEQ ID NO: 2505156 - RNA, 22 nt, Human
ggaucccucauccucauaccca

SEQ ID NO: 2505157 - RNA, 15 nt, Human
ggauauaggagagga

SEQ ID NO: 2505158 - RNA, 14 nt, Human
ggauauaaauauau

SEQ ID NO: 2505159 - RNA, 16 nt, Human
ggauauaguuuuacuu

SEQ ID NO: 2505160 - RNA, 20 nt, Human
ggauauaguuuuacuuuuaa

SEQ ID NO: 2505161 - RNA, 13 nt, Human
ggauauaaauaua

SEQ ID NO: 2505162 - RNA, 18 nt, Human
ggauaguugcuccgccuc

SEQ ID NO: 2505163 - RNA, 16 nt, Human
ggauaugcuuaguaau

SEQ ID NO: 2505164 - RNA, 13 nt, Human
ggauauuuucaaa

SEQ ID NO: 2505165 - RNA, 22 nt, Human
ggaucaaaccccgaccaccugc

SEQ ID NO: 2505166 - RNA, 18 nt, Human
ggauacaaaagcauguga

SEQ ID NO: 2505167 - RNA, 21 nt, Human
ggauacgcaucagacagaugg

SEQ ID NO: 2505168 - RNA, 21 nt, Human
ggauacugcagggccaggacu

SEQ ID NO: 2505169 - RNA, 16 nt, Human
ggauacugcagggcca

SEQ ID NO: 2505170 - RNA, 15 nt, Human
ggauacugcagggcc

SEQ ID NO: 2505171 - RNA, 18 nt, Human
ggauacucugucagaugg

SEQ ID NO: 2505172 - RNA, 13 nt, Human
ggauagaugcugg

SEQ ID NO: 2505173 - RNA, 14 nt, Human
ggauagaugcuggc

SEQ ID NO: 2505174 - RNA, 21 nt, Human
ggauaggaguucacuucaucu

SEQ ID NO: 2505175 - RNA, 16 nt, Human
ggauacugcccggggc

SEQ ID NO: 2505176 - RNA, 23 nt, Human
ggagugaguugauagcacagacc

SEQ ID NO: 2505177 - RNA, 12 nt, Human
ggagugcaguga

SEQ ID NO: 2505178 - RNA, 14 nt, Human
ggagugcagugagc

SEQ ID NO: 2505179 - RNA, 18 nt, Human
ggagugcagggaggagag

SEQ ID NO: 2505180 - RNA, 15 nt, Human
ggagugcagggagga

SEQ ID NO: 2505181 - RNA, 20 nt, Human
ggagugcaaugacacagucu

SEQ ID NO: 2505182 - RNA, 13 nt, Human
ggauccuccaggu

SEQ ID NO: 2505183 - RNA, 20 nt, Human
ggauccuauucucaccagga

SEQ ID NO: 2505184 - RNA, 14 nt, Human
ggauccuauucuca

SEQ ID NO: 2505185 - RNA, 20 nt, Human
ggauccuagccuuauccucu

SEQ ID NO: 2505186 - RNA, 18 nt, Human
ggauccuagccuuauccu

SEQ ID NO: 2505187 - RNA, 23 nt, Human
ggauccuauucucaccaggaagg

SEQ ID NO: 2505188 - RNA, 21 nt, Human
ggauccuauucucaccaggaa

SEQ ID NO: 2505189 - RNA, 12 nt, Human
ggauccuccagg

SEQ ID NO: 2505190 - RNA, 21 nt, Human
ggauccgacugcuuuggaccu

SEQ ID NO: 2505191 - RNA, 19 nt, Human
ggauccgacugcuuuggac

SEQ ID NO: 2505192 - RNA, 17 nt, Human
ggauccgacugcuuugg

SEQ ID NO: 2505193 - RNA, 18 nt, Human
ggaucccucugggcacug

SEQ ID NO: 2505194 - RNA, 17 nt, Human
ggaugcagccucacagu

SEQ ID NO: 2505195 - RNA, 16 nt, Human
ggaugcagccucacag

SEQ ID NO: 2505196 - RNA, 21 nt, Human
ggaugauuggaggggggaggu

SEQ ID NO: 2505197 - RNA, 23 nt, Human
ggaugcacagaguuguuacauuu

SEQ ID NO: 2505198 - RNA, 19 nt, Human
ggauuacaagcgugagcca

SEQ ID NO: 2505199 - RNA, 17 nt, Human
ggauggaaugauggguc

SEQ ID NO: 2505200 - RNA, 16 nt, Human
ggauggagagagggga

SEQ ID NO: 2505201 - RNA, 21 nt, Human
ggaugcuccucccuucucuac

SEQ ID NO: 2505202 - RNA, 19 nt, Human
ggauggaaaaggaagacua

SEQ ID NO: 2505203 - RNA, 15 nt, Human
ggaugcuuguacaua

SEQ ID NO: 2505204 - RNA, 16 nt, Human
ggaugcuaacaucuaa

SEQ ID NO: 2505205 - RNA, 16 nt, Human
ggaugcggauggccgg

SEQ ID NO: 2505206 - RNA, 14 nt, Human
ggaugcugccugag

SEQ ID NO: 2505207 - RNA, 21 nt, Human
ggaugcuugccuagggccugg

SEQ ID NO: 2505208 - RNA, 22 nt, Human
ggaugcagugcucgcuguugcu

SEQ ID NO: 2505209 - RNA, 14 nt, Human
ggaugcagugcucg

SEQ ID NO: 2505210 - RNA, 16 nt, Human
ggaugcauggagauag

SEQ ID NO: 2505211 - RNA, 21 nt, Human
ggaugccuuccccugggcccu

SEQ ID NO: 2505212 - RNA, 15 nt, Human
ggaugcauuucucug

SEQ ID NO: 2505213 - RNA, 21 nt, Human
ggaugcauguuuuccagcucc

SEQ ID NO: 2505214 - RNA, 19 nt, Human
ggaugccaagaaguuuaag

SEQ ID NO: 2505215 - RNA, 19 nt, Human
ggaugcagccucacagucc

SEQ ID NO: 2505216 - RNA, 17 nt, Human
ggaugauuggauuauuc

SEQ ID NO: 2505217 - RNA, 16 nt, Human
ggaugcagagucagca

SEQ ID NO: 2505218 - RNA, 18 nt, Human
ggaugcagagucagcaga

SEQ ID NO: 2505219 - RNA, 13 nt, Human
ggaugcagcauua

SEQ ID NO: 2505220 - RNA, 17 nt, Human
ggauuagggagagaaga

SEQ ID NO: 2505221 - RNA, 22 nt, Human
ggauuaaugguccugugaugcu

SEQ ID NO: 2505222 - RNA, 21 nt, Human
ggauggagcccaggcgggagc

SEQ ID NO: 2505223 - RNA, 19 nt, Human
ggauuacaggcuccugcca

SEQ ID NO: 2505224 - RNA, 23 nt, Human
ggauuacaagcgugagccacugc

SEQ ID NO: 2505225 - RNA, 16 nt, Human
ggauucuuccaucuga

SEQ ID NO: 2505226 - RNA, 15 nt, Human
ggauuacccaagcaa

SEQ ID NO: 2505227 - RNA, 16 nt, Human
ggauucuuauggacaa

SEQ ID NO: 2505228 - RNA, 18 nt, Human
ggauugcacguggccucu

SEQ ID NO: 2505229 - RNA, 17 nt, Human
ggauugcacguggccuc

SEQ ID NO: 2505230 - RNA, 15 nt, Human
ggauugcacguggcc

SEQ ID NO: 2505231 - RNA, 18 nt, Human
ggauugauuaugcagaau

SEQ ID NO: 2505232 - RNA, 16 nt, Human
ggauucuuccucccuc

SEQ ID NO: 2505233 - RNA, 17 nt, Human
ggcaacccccagccugc

SEQ ID NO: 2505234 - RNA, 16 nt, Human
ggcaacccccagccug

SEQ ID NO: 2505235 - RNA, 15 nt, Human
ggauuguaaaauggu

SEQ ID NO: 2505236 - RNA, 18 nt, Human
ggauugggggcuggugcc

SEQ ID NO: 2505237 - RNA, 14 nt, Human
ggauugggggcugg

SEQ ID NO: 2505238 - RNA, 16 nt, Human
ggauuggggucccucu

SEQ ID NO: 2505239 - RNA, 17 nt, Human
ggauuggggucccucua

SEQ ID NO: 2505240 - RNA, 18 nt, Human
ggauuggggaagacugug

SEQ ID NO: 2505241 - RNA, 19 nt, Human
ggauuggggaagacugugg

SEQ ID NO: 2505242 - RNA, 17 nt, Human
ggauugcuacuguccua

SEQ ID NO: 2505243 - RNA, 16 nt, Human
ggauugcuaugaauga

SEQ ID NO: 2505244 - RNA, 14 nt, Human
ggauugcugccacu

SEQ ID NO: 2505245 - RNA, 17 nt, Human
ggauugcuugagcccag

SEQ ID NO: 2505246 - RNA, 22 nt, Human
ggauuggauuauuuaauaacau

SEQ ID NO: 2505247 - RNA, 16 nt, Human
ggauuggauuauuuaa

SEQ ID NO: 2505248 - RNA, 15 nt, Human
ggauugcugccacuu

SEQ ID NO: 2505249 - RNA, 17 nt, Human
ggauugggccccugcca

SEQ ID NO: 2505250 - RNA, 18 nt, Human
ggauugggccccugccag

SEQ ID NO: 2505251 - RNA, 20 nt, Human
ggauuggcuuguguguuuca

SEQ ID NO: 2505252 - RNA, 18 nt, Human
ggauuggauuauuuaaua

SEQ ID NO: 2505253 - RNA, 12 nt, Human
ggauuggggaag

SEQ ID NO: 2505254 - RNA, 23 nt, Human
ggcaaugcuggcuguuggcuggg

SEQ ID NO: 2505255 - RNA, 15 nt, Human
ggcaaugcuggcugu

SEQ ID NO: 2505256 - RNA, 18 nt, Human
ggcaaucuauuaauagcu

SEQ ID NO: 2505257 - RNA, 15 nt, Human
ggcaaugauggcaau

SEQ ID NO: 2505258 - RNA, 14 nt, Human
ggcaaugcuggcug

SEQ ID NO: 2505259 - RNA, 23 nt, Human
ggcaaccccaguucugcuccucu

SEQ ID NO: 2505260 - RNA, 22 nt, Human
ggcaaccccaguucugcuccuc

SEQ ID NO: 2505261 - RNA, 23 nt, Human
ggauuguaaaaaaaaaugccuuu

SEQ ID NO: 2505262 - RNA, 22 nt, Human
ggauuguaaaaaaaaaugccuu

SEQ ID NO: 2505263 - RNA, 18 nt, Human
ggcaacccccagccugcu

SEQ ID NO: 2505264 - RNA, 19 nt, Human
ggcaaucauggugcucaga

SEQ ID NO: 2505265 - RNA, 18 nt, Human
ggcaauaguguguucuga

SEQ ID NO: 2505266 - RNA, 21 nt, Human
ggcaauauagcaagaucccau

SEQ ID NO: 2505267 - RNA, 22 nt, Human
ggcacccuucuuuccucuuccc

SEQ ID NO: 2505268 - RNA, 20 nt, Human
ggcacccuucuuuccucuuc

SEQ ID NO: 2505269 - RNA, 17 nt, Human
ggcacccuucuuuccuc

SEQ ID NO: 2505270 - RNA, 12 nt, Human
ggcacccuucuu

SEQ ID NO: 2505271 - RNA, 18 nt, Human
ggcaccggggccucggac

SEQ ID NO: 2505272 - RNA, 14 nt, Human
ggcaccgagaaugu

SEQ ID NO: 2505273 - RNA, 22 nt, Human
ggcacccggccccugcugguuc

SEQ ID NO: 2505274 - RNA, 20 nt, Human
ggcaaugggagcugaggcca

SEQ ID NO: 2505275 - RNA, 21 nt, Human
ggcaaugggagcugaggccac

SEQ ID NO: 2505276 - RNA, 23 nt, Human
ggcacccaccaucaugucuggcu

SEQ ID NO: 2505277 - RNA, 20 nt, Human
ggcacccagugagcacuccc

SEQ ID NO: 2505278 - RNA, 21 nt, Human
ggcacccaccguggaggagga

SEQ ID NO: 2505279 - RNA, 20 nt, Human
ggcacccaccguggaggagg

SEQ ID NO: 2505280 - RNA, 16 nt, Human
ggcacccacccagcac

SEQ ID NO: 2505281 - RNA, 18 nt, Human
ggcaaugucaggaacaga

SEQ ID NO: 2505282 - RNA, 14 nt, Human
ggcacccacccugg

SEQ ID NO: 2505283 - RNA, 13 nt, Human
ggcacccacccug

SEQ ID NO: 2505284 - RNA, 15 nt, Human
ggcaugaagacagau

SEQ ID NO: 2505285 - RNA, 18 nt, Human
ggcaugacacgaauauug

SEQ ID NO: 2505286 - RNA, 22 nt, Human
ggcaugaaguuuccuuggcugg

SEQ ID NO: 2505287 - RNA, 18 nt, Human
ggcaugaacauguacugu

SEQ ID NO: 2505288 - RNA, 14 nt, Human
ggcaugaacaugua

SEQ ID NO: 2505289 - RNA, 13 nt, Human
ggcaugccugugu

SEQ ID NO: 2505290 - RNA, 23 nt, Human
ggcaugaaguuuccuuggcuggu

SEQ ID NO: 2505291 - RNA, 14 nt, Human
ggcaugccugugug

SEQ ID NO: 2505292 - RNA, 16 nt, Human
ggcaugcuggggcaag

SEQ ID NO: 2505293 - RNA, 13 nt, Human
ggcaugcuggggc

SEQ ID NO: 2505294 - RNA, 14 nt, Human
ggcaugcuggggca

SEQ ID NO: 2505295 - RNA, 16 nt, Human
ggcaugccugugugac

SEQ ID NO: 2505296 - RNA, 19 nt, Human
ggcaugcgcacaaggcuga

SEQ ID NO: 2505297 - RNA, 12 nt, Human
ggcaugcugggg

SEQ ID NO: 2505298 - RNA, 18 nt, Human
ggcauggccagguggcca

SEQ ID NO: 2505299 - RNA, 17 nt, Human
ggcauggccagguggcc

SEQ ID NO: 2505300 - RNA, 16 nt, Human
ggcauggcccuggggu

SEQ ID NO: 2505301 - RNA, 13 nt, Human
ggcauggcccugg

SEQ ID NO: 2505302 - RNA, 17 nt, Human
ggcauggcccugggguc

SEQ ID NO: 2505303 - RNA, 16 nt, Human
ggcauggcuccagucu

SEQ ID NO: 2505304 - RNA, 12 nt, Human
ggcauggcccug

SEQ ID NO: 2505305 - RNA, 21 nt, Human
ggcagugggacagggcauggc

SEQ ID NO: 2505306 - RNA, 22 nt, Human
ggcaucuuugccuugggcugcu

SEQ ID NO: 2505307 - RNA, 23 nt, Human
ggcaucuuugccuugggcugcuc

SEQ ID NO: 2505308 - RNA, 16 nt, Human
ggcagugggagcugcc

SEQ ID NO: 2505309 - RNA, 14 nt, Human
ggcagugggagcug

SEQ ID NO: 2505310 - RNA, 13 nt, Human
ggcagugggagcu

SEQ ID NO: 2505311 - RNA, 20 nt, Human
ggcagggucucacucugucg

SEQ ID NO: 2505312 - RNA, 19 nt, Human
ggcagggucucacucuguc

SEQ ID NO: 2505313 - RNA, 23 nt, Human
ggcagggugggauggaggagaag

SEQ ID NO: 2505314 - RNA, 16 nt, Human
ggcagggugggaugga

SEQ ID NO: 2505315 - RNA, 21 nt, Human
ggcagggugggauggaggaga

SEQ ID NO: 2505316 - RNA, 20 nt, Human
ggcagguagccagggggacu

SEQ ID NO: 2505317 - RNA, 15 nt, Human
ggcagguagccaggg

SEQ ID NO: 2505318 - RNA, 14 nt, Human
ggcagguagccagg

SEQ ID NO: 2505319 - RNA, 17 nt, Human
ggcagguaaacuccugu

SEQ ID NO: 2505320 - RNA, 14 nt, Human
ggcagggugacccu

SEQ ID NO: 2505321 - RNA, 13 nt, Human
ggcagcucuccag

SEQ ID NO: 2505322 - RNA, 11 nt, Human
ggcagcucucc

SEQ ID NO: 2505323 - RNA, 16 nt, Human
ggcagcucuccaguca

SEQ ID NO: 2505324 - RNA, 14 nt, Human
ggcagcucuccagu

SEQ ID NO: 2505325 - RNA, 15 nt, Human
ggcagcucuggacag

SEQ ID NO: 2505326 - RNA, 15 nt, Human
ggcagcucaucucug

SEQ ID NO: 2505327 - RNA, 12 nt, Human
ggcagcucagcu

SEQ ID NO: 2505328 - RNA, 21 nt, Human
ggcagcucagagaggguggga

SEQ ID NO: 2505329 - RNA, 13 nt, Human
ggcagcucagaga

SEQ ID NO: 2505330 - RNA, 20 nt, Human
ggcagcuucuauuagccagu

SEQ ID NO: 2505331 - RNA, 19 nt, Human
ggcagcugggcccaacccu

SEQ ID NO: 2505332 - RNA, 18 nt, Human
ggcagcugggcccaaccc

SEQ ID NO: 2505333 - RNA, 22 nt, Human
ggcagcugggcccaacccuguc

SEQ ID NO: 2505334 - RNA, 17 nt, Human
ggcagcuugaggguugg

SEQ ID NO: 2505335 - RNA, 22 nt, Human
ggcagcugcuuuugucuauggg

SEQ ID NO: 2505336 - RNA, 14 nt, Human
ggcagcugggccca

SEQ ID NO: 2505337 - RNA, 13 nt, Human
ggcagcugggccc

SEQ ID NO: 2505338 - RNA, 12 nt, Human
ggcagcugggcc

SEQ ID NO: 2505339 - RNA, 16 nt, Human
ggcagcuggaugagac

SEQ ID NO: 2505340 - RNA, 20 nt, Human
ggcagcucuggacagcccca

SEQ ID NO: 2505341 - RNA, 21 nt, Human
ggcagcucuccagucaggagg

SEQ ID NO: 2505342 - RNA, 23 nt, Human
ggcacuaacguugagccccugga

SEQ ID NO: 2505343 - RNA, 14 nt, Human
ggcacuagccuuug

SEQ ID NO: 2505344 - RNA, 18 nt, Human
ggcacgucaucuaguuuu

SEQ ID NO: 2505345 - RNA, 21 nt, Human
ggcacgcuugcguaugucugu

SEQ ID NO: 2505346 - RNA, 15 nt, Human
ggcacgggcccguga

SEQ ID NO: 2505347 - RNA, 17 nt, Human
ggcacgaacccaccugc

SEQ ID NO: 2505348 - RNA, 18 nt, Human
ggcacgaacccaccugcu

SEQ ID NO: 2505349 - RNA, 19 nt, Human
ggcacgaacccaccugcug

SEQ ID NO: 2505350 - RNA, 20 nt, Human
ggcacgaacccaccugcuga

SEQ ID NO: 2505351 - RNA, 20 nt, Human
ggcacgagcaaagugaagac

SEQ ID NO: 2505352 - RNA, 13 nt, Human
ggcacgcuguggg

SEQ ID NO: 2505353 - RNA, 18 nt, Human
ggcacgcugugggcaggu

SEQ ID NO: 2505354 - RNA, 17 nt, Human
ggcaccuuaguggcuuu

SEQ ID NO: 2505355 - RNA, 17 nt, Human
ggcaccuggggaguggg

SEQ ID NO: 2505356 - RNA, 16 nt, Human
ggcaccuaauccaggc

SEQ ID NO: 2505357 - RNA, 14 nt, Human
ggcaccuggggagu

SEQ ID NO: 2505358 - RNA, 15 nt, Human
ggcaccuaauccagg

SEQ ID NO: 2505359 - RNA, 15 nt, Human
ggcaccgagaauguu

SEQ ID NO: 2505360 - RNA, 14 nt, Human
ggcagcucaccucu

SEQ ID NO: 2505361 - RNA, 12 nt, Human
ggcagcucaccu

SEQ ID NO: 2505362 - RNA, 21 nt, Human
ggcacuagccuuuggcucugg

SEQ ID NO: 2505363 - RNA, 20 nt, Human
ggcacuagccuuuggcucug

SEQ ID NO: 2505364 - RNA, 15 nt, Human
ggcacuagccuuugg

SEQ ID NO: 2505365 - RNA, 16 nt, Human
ggcagcgcccuuccuc

SEQ ID NO: 2505366 - RNA, 21 nt, Human
ggcagcgccaggcugaccaca

SEQ ID NO: 2505367 - RNA, 22 nt, Human
ggcagcgccaggcugaccacag

SEQ ID NO: 2505368 - RNA, 21 nt, Human
ggcagcgcccuuccucuccac

SEQ ID NO: 2505369 - RNA, 20 nt, Human
ggcagcgcccuuccucucca

SEQ ID NO: 2505370 - RNA, 19 nt, Human
ggcagcgcccuuccucucc

SEQ ID NO: 2505371 - RNA, 17 nt, Human
ggcagcgcccuuccucu

SEQ ID NO: 2505372 - RNA, 18 nt, Human
ggcagcgcggggagcccg

SEQ ID NO: 2505373 - RNA, 21 nt, Human
ggcagcguacucaucaucaac

SEQ ID NO: 2505374 - RNA, 17 nt, Human
ggccagcugcuugggcu

SEQ ID NO: 2505375 - RNA, 22 nt, Human
ggccagccuugaccauucucca

SEQ ID NO: 2505376 - RNA, 20 nt, Human
ggccagccuugaccauucuc

SEQ ID NO: 2505377 - RNA, 23 nt, Human
ggccagcugcuugggcuucaucc

SEQ ID NO: 2505378 - RNA, 20 nt, Human
ggccagcugccccagccaga

SEQ ID NO: 2505379 - RNA, 19 nt, Human
ggccagcugccccagccag

SEQ ID NO: 2505380 - RNA, 18 nt, Human
ggccaggcccucugccca

SEQ ID NO: 2505381 - RNA, 18 nt, Human
ggccagcuggcagcagag

SEQ ID NO: 2505382 - RNA, 14 nt, Human
ggccagcuggcagc

SEQ ID NO: 2505383 - RNA, 16 nt, Human
ggccagcuggcagcag

SEQ ID NO: 2505384 - RNA, 17 nt, Human
ggccagcuggcagcaga

SEQ ID NO: 2505385 - RNA, 14 nt, Human
ggccaggcugcucu

SEQ ID NO: 2505386 - RNA, 15 nt, Human
ggccaggcugcucuu

SEQ ID NO: 2505387 - RNA, 11 nt, Human
ggccaggcugc

SEQ ID NO: 2505388 - RNA, 11 nt, Human
ggccaggcucc

SEQ ID NO: 2505389 - RNA, 16 nt, Human
ggccaugggccuccug

SEQ ID NO: 2505390 - RNA, 19 nt, Human
ggccaugguacccccuucu

SEQ ID NO: 2505391 - RNA, 21 nt, Human
ggccaggcugaugggacagaa

SEQ ID NO: 2505392 - RNA, 16 nt, Human
ggccaggcuccuuccu

SEQ ID NO: 2505393 - RNA, 17 nt, Human
ggccauguuccaauaaa

SEQ ID NO: 2505394 - RNA, 13 nt, Human
ggccauguuccaa

SEQ ID NO: 2505395 - RNA, 13 nt, Human
ggccauguccuua

SEQ ID NO: 2505396 - RNA, 20 nt, Human
ggccaugguacccccuucug

SEQ ID NO: 2505397 - RNA, 20 nt, Human
ggccauucuauuguggcaag

SEQ ID NO: 2505398 - RNA, 23 nt, Human
ggccauguuccaauaaacaggag

SEQ ID NO: 2505399 - RNA, 20 nt, Human
ggccauucuccacagcaacc

SEQ ID NO: 2505400 - RNA, 12 nt, Human
ggccauucagca

SEQ ID NO: 2505401 - RNA, 17 nt, Human
ggccacauggggcuggg

SEQ ID NO: 2505402 - RNA, 19 nt, Human
ggccacauggggcugggca

SEQ ID NO: 2505403 - RNA, 13 nt, Human
ggccaccaggcug

SEQ ID NO: 2505404 - RNA, 12 nt, Human
ggccaccaggcu

SEQ ID NO: 2505405 - RNA, 14 nt, Human
ggccaccaggaugg

SEQ ID NO: 2505406 - RNA, 11 nt, Human
ggccaccagga

SEQ ID NO: 2505407 - RNA, 17 nt, Human
ggccaccaccccccacu

SEQ ID NO: 2505408 - RNA, 14 nt, Human
ggccaccacccccc

SEQ ID NO: 2505409 - RNA, 18 nt, Human
ggccaccaccccccacuc

SEQ ID NO: 2505410 - RNA, 24 nt, Human
ggccacccguucugcuggccugga

SEQ ID NO: 2505411 - RNA, 23 nt, Human
ggccacccguucugcuggccugg

SEQ ID NO: 2505412 - RNA, 21 nt, Human
ggccacccguucugcuggccu

SEQ ID NO: 2505413 - RNA, 21 nt, Human
ggccaccaggcuggcgcagcc

SEQ ID NO: 2505414 - RNA, 19 nt, Human
ggccaccaggcuggcgcag

SEQ ID NO: 2505415 - RNA, 16 nt, Human
ggccaccaggcuggcg

SEQ ID NO: 2505416 - RNA, 15 nt, Human
ggccaccaggcuggc

SEQ ID NO: 2505417 - RNA, 14 nt, Human
ggccaccaggcugg

SEQ ID NO: 2505418 - RNA, 19 nt, Human
ggccacgucuuccuucugc

SEQ ID NO: 2505419 - RNA, 18 nt, Human
ggccacgugauguggagg

SEQ ID NO: 2505420 - RNA, 11 nt, Human
ggccacgugcc

SEQ ID NO: 2505421 - RNA, 12 nt, Human
ggccacgugcca

SEQ ID NO: 2505422 - RNA, 17 nt, Human
ggccacuccagaccccu

SEQ ID NO: 2505423 - RNA, 13 nt, Human
ggccacuccgaga

SEQ ID NO: 2505424 - RNA, 23 nt, Human
ggccacucccggcacuccaugcu

SEQ ID NO: 2505425 - RNA, 12 nt, Human
ggccacuccucc

SEQ ID NO: 2505426 - RNA, 20 nt, Human
ggccacuaagcagaggaggg

SEQ ID NO: 2505427 - RNA, 21 nt, Human
ggccacuaagcagaggagggg

SEQ ID NO: 2505428 - RNA, 11 nt, Human
ggccacuaagc

SEQ ID NO: 2505429 - RNA, 18 nt, Human
ggccacgugccaggcccg

SEQ ID NO: 2505430 - RNA, 23 nt, Human
ggccacgugggcaaacaggcagu

SEQ ID NO: 2505431 - RNA, 16 nt, Human
ggccacgugccaggcc

SEQ ID NO: 2505432 - RNA, 17 nt, Human
ggccacgugccaggccc

SEQ ID NO: 2505433 - RNA, 13 nt, Human
ggccagccuggau

SEQ ID NO: 2505434 - RNA, 13 nt, Human
ggccacuccucca

SEQ ID NO: 2505435 - RNA, 22 nt, Human
ggccagccuccgagagggagag

SEQ ID NO: 2505436 - RNA, 14 nt, Human
ggcauggcugggaa

SEQ ID NO: 2505437 - RNA, 18 nt, Human
ggcaugggaaugaauguc

SEQ ID NO: 2505438 - RNA, 17 nt, Human
ggcauuccccaggaggc

SEQ ID NO: 2505439 - RNA, 22 nt, Human
ggcaugggaaugaaugucagug

SEQ ID NO: 2505440 - RNA, 19 nt, Human
ggcauuccccaggaggcca

SEQ ID NO: 2505441 - RNA, 18 nt, Human
ggcauuccccaggaggcc

SEQ ID NO: 2505442 - RNA, 20 nt, Human
ggccacaugagucccagugg

SEQ ID NO: 2505443 - RNA, 18 nt, Human
ggccacaugggaggcuca

SEQ ID NO: 2505444 - RNA, 16 nt, Human
ggccacauggggcugg

SEQ ID NO: 2505445 - RNA, 16 nt, Human
ggccacaugaguccca

SEQ ID NO: 2505446 - RNA, 19 nt, Human
ggccacaugggaggcucac

SEQ ID NO: 2505447 - RNA, 16 nt, Human
ggcauuccccaggagg

SEQ ID NO: 2505448 - RNA, 21 nt, Human
ggcaugggaaagccaccucuc

SEQ ID NO: 2505449 - RNA, 19 nt, Human
ggccacaucaaagaggcug

SEQ ID NO: 2505450 - RNA, 14 nt, Human
ggcccaaggcggcc

SEQ ID NO: 2505451 - RNA, 13 nt, Human
ggcccaaggcggc

SEQ ID NO: 2505452 - RNA, 16 nt, Human
ggcccaacccugucug

SEQ ID NO: 2505453 - RNA, 13 nt, Human
ggcccaacccugu

SEQ ID NO: 2505454 - RNA, 17 nt, Human
ggcccaacccugucugu

SEQ ID NO: 2505455 - RNA, 19 nt, Human
ggcccaagagaugaagagu

SEQ ID NO: 2505456 - RNA, 23 nt, Human
ggcccaacacaauucuucuucca

SEQ ID NO: 2505457 - RNA, 21 nt, Human
ggcccaaaggccuuggacaac

SEQ ID NO: 2505458 - RNA, 15 nt, Human
ggcccaagucccugu

SEQ ID NO: 2505459 - RNA, 14 nt, Human
ggcccaagucccug

SEQ ID NO: 2505460 - RNA, 21 nt, Human
ggcccaaggcggccccucccg

SEQ ID NO: 2505461 - RNA, 17 nt, Human
ggcccaaggcggccccu

SEQ ID NO: 2505462 - RNA, 17 nt, Human
ggcccaccuggccaccu

SEQ ID NO: 2505463 - RNA, 22 nt, Human
ggcccaagucccuguuuucuga

SEQ ID NO: 2505464 - RNA, 21 nt, Human
ggcccaccuuccccagaacca

SEQ ID NO: 2505465 - RNA, 22 nt, Human
ggcccaccuggccaccugaggu

SEQ ID NO: 2505466 - RNA, 19 nt, Human
ggcccaccuggccaccuga

SEQ ID NO: 2505467 - RNA, 18 nt, Human
ggcccaccuggccaccug

SEQ ID NO: 2505468 - RNA, 22 nt, Human
ggcccacguagggcggcacuca

SEQ ID NO: 2505469 - RNA, 22 nt, Human
ggcccacgccuguaaucccagc

SEQ ID NO: 2505470 - RNA, 14 nt, Human
ggcccucucugcuc

SEQ ID NO: 2505471 - RNA, 15 nt, Human
ggcccucucugcucu

SEQ ID NO: 2505472 - RNA, 12 nt, Human
ggcccagagagg

SEQ ID NO: 2505473 - RNA, 15 nt, Human
ggcccagagaagcca

SEQ ID NO: 2505474 - RNA, 11 nt, Human
ggcccagagag

SEQ ID NO: 2505475 - RNA, 17 nt, Human
ggcccucugcccacucc

SEQ ID NO: 2505476 - RNA, 16 nt, Human
ggcccucugcccacuc

SEQ ID NO: 2505477 - RNA, 15 nt, Human
ggcccucugcccacu

SEQ ID NO: 2505478 - RNA, 13 nt, Human
ggcccucugccca

SEQ ID NO: 2505479 - RNA, 20 nt, Human
ggcccucugcccacucccug

SEQ ID NO: 2505480 - RNA, 19 nt, Human
ggcccucugcccacucccu

SEQ ID NO: 2505481 - RNA, 21 nt, Human
ggcccucugcccacucccugc

SEQ ID NO: 2505482 - RNA, 21 nt, Human
ggcccucucugcucugcgugu

SEQ ID NO: 2505483 - RNA, 14 nt, Human
ggcccucuggagug

SEQ ID NO: 2505484 - RNA, 18 nt, Human
ggcccucuggaguggcca

SEQ ID NO: 2505485 - RNA, 19 nt, Human
ggcccucuggaguggccac

SEQ ID NO: 2505486 - RNA, 19 nt, Human
ggcccugacauuggagccu

SEQ ID NO: 2505487 - RNA, 13 nt, Human
ggcccugccuccu

SEQ ID NO: 2505488 - RNA, 13 nt, Human
ggcccugcccugg

SEQ ID NO: 2505489 - RNA, 20 nt, Human
ggcccugcccugguuuccug

SEQ ID NO: 2505490 - RNA, 11 nt, Human
ggcccugcccu

SEQ ID NO: 2505491 - RNA, 22 nt, Human
ggcccugcacuguccugcucca

SEQ ID NO: 2505492 - RNA, 18 nt, Human
ggcccugccaucuuccca

SEQ ID NO: 2505493 - RNA, 20 nt, Human
ggcccugccaucuucccagc

SEQ ID NO: 2505494 - RNA, 12 nt, Human
ggcccugcccug

SEQ ID NO: 2505495 - RNA, 23 nt, Human
ggcccugcacuguccugcuccac

SEQ ID NO: 2505496 - RNA, 21 nt, Human
ggcccugcacuguccugcucc

SEQ ID NO: 2505497 - RNA, 20 nt, Human
ggcccugcacuguccugcuc

SEQ ID NO: 2505498 - RNA, 19 nt, Human
ggcccugcacuguccugcu

SEQ ID NO: 2505499 - RNA, 18 nt, Human
ggcccugcacuguccugc

SEQ ID NO: 2505500 - RNA, 17 nt, Human
ggcccugcacuguccug

SEQ ID NO: 2505501 - RNA, 16 nt, Human
ggcccugcacuguccu

SEQ ID NO: 2505502 - RNA, 15 nt, Human
ggcccugcacugucc

SEQ ID NO: 2505503 - RNA, 14 nt, Human
ggcccugcacuguc

SEQ ID NO: 2505504 - RNA, 18 nt, Human
ggcccugcaccugugcag

SEQ ID NO: 2505505 - RNA, 21 nt, Human
ggcccugaggugugggggcug

SEQ ID NO: 2505506 - RNA, 19 nt, Human
ggcccugcaaaaggacucu

SEQ ID NO: 2505507 - RNA, 22 nt, Human
ggcccugcaaaaggacucucag

SEQ ID NO: 2505508 - RNA, 22 nt, Human
ggcccugaggugugggggcugc

SEQ ID NO: 2505509 - RNA, 19 nt, Human
ggcccugaggugugggggc

SEQ ID NO: 2505510 - RNA, 18 nt, Human
ggcccugagguguggggg

SEQ ID NO: 2505511 - RNA, 17 nt, Human
ggcccugaggugugggg

SEQ ID NO: 2505512 - RNA, 16 nt, Human
ggcccugagguguggg

SEQ ID NO: 2505513 - RNA, 15 nt, Human
ggcccugaggugugg

SEQ ID NO: 2505514 - RNA, 14 nt, Human
ggcccugagcugag

SEQ ID NO: 2505515 - RNA, 14 nt, Human
ggcccugagcucgg

SEQ ID NO: 2505516 - RNA, 19 nt, Human
ggcccugagcucgguggac

SEQ ID NO: 2505517 - RNA, 13 nt, Human
ggcccugagcuga

SEQ ID NO: 2505518 - RNA, 21 nt, Human
ggcccugagcucgguggaccc

SEQ ID NO: 2505519 - RNA, 15 nt, Human
ggcccugccuccuuu

SEQ ID NO: 2505520 - RNA, 14 nt, Human
ggcccugccuccuu

SEQ ID NO: 2505521 - RNA, 14 nt, Human
ggcccugccuucuu

SEQ ID NO: 2505522 - RNA, 22 nt, Human
ggcccugcccugguuuccugcc

SEQ ID NO: 2505523 - RNA, 13 nt, Human
ggcccugccucug

SEQ ID NO: 2505524 - RNA, 10 nt, Human
ggcccugccu

SEQ ID NO: 2505525 - RNA, 16 nt, Human
ggcccaccuggccacc

SEQ ID NO: 2505526 - RNA, 14 nt, Human
ggcccuggccuccc

SEQ ID NO: 2505527 - RNA, 13 nt, Human
ggcccuggccucc

SEQ ID NO: 2505528 - RNA, 17 nt, Human
ggcccuggccuccccug

SEQ ID NO: 2505529 - RNA, 12 nt, Human
ggcccuggccug

SEQ ID NO: 2505530 - RNA, 13 nt, Human
ggcccuggcuccc

SEQ ID NO: 2505531 - RNA, 14 nt, Human
ggcccuggccugcu

SEQ ID NO: 2505532 - RNA, 15 nt, Human
ggcccuggccugcug

SEQ ID NO: 2505533 - RNA, 16 nt, Human
ggcccuggccugcugg

SEQ ID NO: 2505534 - RNA, 17 nt, Human
ggcccuggccugcuggg

SEQ ID NO: 2505535 - RNA, 22 nt, Human
ggcccuggcucccacaggcccu

SEQ ID NO: 2505536 - RNA, 22 nt, Human
ggcccuggccugcugggcucuc

SEQ ID NO: 2505537 - RNA, 20 nt, Human
ggccuagcugcuacaaagaa

SEQ ID NO: 2505538 - RNA, 19 nt, Human
ggccuagcugcuacaaaga

SEQ ID NO: 2505539 - RNA, 16 nt, Human
ggccuagcugcuacaa

SEQ ID NO: 2505540 - RNA, 21 nt, Human
ggccuagcugcuacaaagaag

SEQ ID NO: 2505541 - RNA, 14 nt, Human
ggccuaggccucag

SEQ ID NO: 2505542 - RNA, 24 nt, Human
ggccuacuagagucugaacagcug

SEQ ID NO: 2505543 - RNA, 23 nt, Human
ggccuaccccgcagacaccuugg

SEQ ID NO: 2505544 - RNA, 23 nt, Human
ggccuagcauacguacacauuuu

SEQ ID NO: 2505545 - RNA, 20 nt, Human
ggccuaccccgcagacaccu

SEQ ID NO: 2505546 - RNA, 16 nt, Human
ggccuaccccgcagac

SEQ ID NO: 2505547 - RNA, 18 nt, Human
ggccuacaugcuuuguga

SEQ ID NO: 2505548 - RNA, 23 nt, Human
ggccuacaugcuuugugaacaag

SEQ ID NO: 2505549 - RNA, 19 nt, Human
ggccuaagaguugagcucu

SEQ ID NO: 2505550 - RNA, 20 nt, Human
ggccuacagcuuugaucccu

SEQ ID NO: 2505551 - RNA, 23 nt, Human
ggccuacagcuuugaucccugac

SEQ ID NO: 2505552 - RNA, 17 nt, Human
ggccuacaugcuuugug

SEQ ID NO: 2505553 - RNA, 13 nt, Human
ggccgugcccagg

SEQ ID NO: 2505554 - RNA, 18 nt, Human
ggccguccucccgggccc

SEQ ID NO: 2505555 - RNA, 15 nt, Human
ggccguccucccggg

SEQ ID NO: 2505556 - RNA, 14 nt, Human
ggccguccucccgg

SEQ ID NO: 2505557 - RNA, 13 nt, Human
ggccguccucccg

SEQ ID NO: 2505558 - RNA, 21 nt, Human
ggccguccucccgggcccucc

SEQ ID NO: 2505559 - RNA, 20 nt, Human
ggccguccucccgggcccuc

SEQ ID NO: 2505560 - RNA, 22 nt, Human
ggccguccucccgggcccuccc

SEQ ID NO: 2505561 - RNA, 20 nt, Human
ggccgucuucacucgccccc

SEQ ID NO: 2505562 - RNA, 21 nt, Human
ggccggucugcaagucagagg

SEQ ID NO: 2505563 - RNA, 20 nt, Human
ggccggucugcaagucagag

SEQ ID NO: 2505564 - RNA, 18 nt, Human
ggccggucugcaagucag

SEQ ID NO: 2505565 - RNA, 17 nt, Human
ggccggucugcaaguca

SEQ ID NO: 2505566 - RNA, 13 nt, Human
ggccggggcugag

SEQ ID NO: 2505567 - RNA, 23 nt, Human
ggcccugucccucccaccucugu

SEQ ID NO: 2505568 - RNA, 22 nt, Human
ggcccugucccucccaccucug

SEQ ID NO: 2505569 - RNA, 21 nt, Human
ggcccugucccucccaccucu

SEQ ID NO: 2505570 - RNA, 20 nt, Human
ggcccugucccucccaccuc

SEQ ID NO: 2505571 - RNA, 18 nt, Human
ggcccugucccucccacc

SEQ ID NO: 2505572 - RNA, 17 nt, Human
ggcccugucccucccac

SEQ ID NO: 2505573 - RNA, 16 nt, Human
ggcccugucccuccca

SEQ ID NO: 2505574 - RNA, 12 nt, Human
ggcccugugccu

SEQ ID NO: 2505575 - RNA, 19 nt, Human
ggccgucacuugugggggu

SEQ ID NO: 2505576 - RNA, 12 nt, Human
ggccgucaggac

SEQ ID NO: 2505577 - RNA, 19 nt, Human
ggccgucaggacccaccau

SEQ ID NO: 2505578 - RNA, 17 nt, Human
ggccguaccccacccuc

SEQ ID NO: 2505579 - RNA, 14 nt, Human
ggccguaccccacc

SEQ ID NO: 2505580 - RNA, 22 nt, Human
ggccguaccccacccucagcac

SEQ ID NO: 2505581 - RNA, 23 nt, Human
ggccgguuucgaaguugaugcaa

SEQ ID NO: 2505582 - RNA, 23 nt, Human
ggccggucugcaagucagaggau

SEQ ID NO: 2505583 - RNA, 15 nt, Human
ggccggugugggcug

SEQ ID NO: 2505584 - RNA, 13 nt, Human
ggcccugggcugg

SEQ ID NO: 2505585 - RNA, 12 nt, Human
ggcccugggcug

SEQ ID NO: 2505586 - RNA, 18 nt, Human
ggcccugggcucggaggc

SEQ ID NO: 2505587 - RNA, 16 nt, Human
ggcccugggcucggag

SEQ ID NO: 2505588 - RNA, 15 nt, Human
ggcccugggcuggaa

SEQ ID NO: 2505589 - RNA, 14 nt, Human
ggcccugggcugga

SEQ ID NO: 2505590 - RNA, 21 nt, Human
ggcccugggcucggaggcugc

SEQ ID NO: 2505591 - RNA, 11 nt, Human
ggcccuggggc

SEQ ID NO: 2505592 - RNA, 15 nt, Human
ggcccugggguccca

SEQ ID NO: 2505593 - RNA, 12 nt, Human
ggcccugguccu

SEQ ID NO: 2505594 - RNA, 15 nt, Human
ggcccugucccuccc

SEQ ID NO: 2505595 - RNA, 19 nt, Human
ggcccugguguuucuagca

SEQ ID NO: 2505596 - RNA, 15 nt, Human
ggcccugguccuucc

SEQ ID NO: 2505597 - RNA, 17 nt, Human
ggcccugguccuuccag

SEQ ID NO: 2505598 - RNA, 20 nt, Human
ggccucggacuuagcuggga

SEQ ID NO: 2505599 - RNA, 17 nt, Human
ggccucggacuuagcug

SEQ ID NO: 2505600 - RNA, 19 nt, Human
ggccucaacccucccucag

SEQ ID NO: 2505601 - RNA, 13 nt, Human
ggccggggccggg

SEQ ID NO: 2505602 - RNA, 20 nt, Human
ggccucaaaggcccgcucua

SEQ ID NO: 2505603 - RNA, 15 nt, Human
ggccucaacccuccc

SEQ ID NO: 2505604 - RNA, 22 nt, Human
ggccucaaaguuggggcaggcu

SEQ ID NO: 2505605 - RNA, 16 nt, Human
ggccucaacccucccu

SEQ ID NO: 2505606 - RNA, 17 nt, Human
ggccucaacccucccuc

SEQ ID NO: 2505607 - RNA, 18 nt, Human
ggccucaacccucccuca

SEQ ID NO: 2505608 - RNA, 22 nt, Human
ggccucggacuuagcugggaga

SEQ ID NO: 2505609 - RNA, 13 nt, Human
ggccucggagccu

SEQ ID NO: 2505610 - RNA, 15 nt, Human
ggccucggagccuca

SEQ ID NO: 2505611 - RNA, 16 nt, Human
ggccucgggaccucag

SEQ ID NO: 2505612 - RNA, 23 nt, Human
ggccucgggacaccugcccugcc

SEQ ID NO: 2505613 - RNA, 22 nt, Human
ggccucgggacaccugcccugc

SEQ ID NO: 2505614 - RNA, 16 nt, Human
ggccucgggacaccug

SEQ ID NO: 2505615 - RNA, 19 nt, Human
ggccucggagccucauccg

SEQ ID NO: 2505616 - RNA, 22 nt, Human
ggccucggagccucauccgagg

SEQ ID NO: 2505617 - RNA, 19 nt, Human
ggccucaaaggcccgcucu

SEQ ID NO: 2505618 - RNA, 18 nt, Human
ggccucaaaggcccgcuc

SEQ ID NO: 2505619 - RNA, 19 nt, Human
ggccuauuauauuaaaaua

SEQ ID NO: 2505620 - RNA, 21 nt, Human
ggccuaugcacauauggacuc

SEQ ID NO: 2505621 - RNA, 23 nt, Human
ggccuaucagugugccccccauc

SEQ ID NO: 2505622 - RNA, 20 nt, Human
ggccuaucagugugcccccc

SEQ ID NO: 2505623 - RNA, 18 nt, Human
ggccuaucagugugcccc

SEQ ID NO: 2505624 - RNA, 17 nt, Human
ggccuaucagugugccc

SEQ ID NO: 2505625 - RNA, 16 nt, Human
ggccuaucuaaacugg

SEQ ID NO: 2505626 - RNA, 20 nt, Human
ggccuaugcacauauggacu

SEQ ID NO: 2505627 - RNA, 16 nt, Human
ggccuaucagugugcc

SEQ ID NO: 2505628 - RNA, 15 nt, Human
ggccuaucagugugc

SEQ ID NO: 2505629 - RNA, 20 nt, Human
ggccuauaaugaagcuuuau

SEQ ID NO: 2505630 - RNA, 20 nt, Human
ggccuaggccucagccagag

SEQ ID NO: 2505631 - RNA, 15 nt, Human
ggccuagucccuucc

SEQ ID NO: 2505632 - RNA, 16 nt, Human
ggccucugcacucccc

SEQ ID NO: 2505633 - RNA, 15 nt, Human
ggccucugcacuccc

SEQ ID NO: 2505634 - RNA, 14 nt, Human
ggccucugcacucc

SEQ ID NO: 2505635 - RNA, 13 nt, Human
ggccucugcacuc

SEQ ID NO: 2505636 - RNA, 17 nt, Human
ggccucuuaugggcugg

SEQ ID NO: 2505637 - RNA, 16 nt, Human
ggccucugugccuucu

SEQ ID NO: 2505638 - RNA, 21 nt, Human
ggccucugcaaaggaaauacc

SEQ ID NO: 2505639 - RNA, 21 nt, Human
ggccucucuggccucccaccc

SEQ ID NO: 2505640 - RNA, 18 nt, Human
ggccucuuaugggcuggg

SEQ ID NO: 2505641 - RNA, 19 nt, Human
ggccucuuccgugacguca

SEQ ID NO: 2505642 - RNA, 18 nt, Human
ggccucuucaaauuagaa

SEQ ID NO: 2505643 - RNA, 20 nt, Human
ggccucuguguccuucccug

SEQ ID NO: 2505644 - RNA, 14 nt, Human
ggccucuguguccu

SEQ ID NO: 2505645 - RNA, 18 nt, Human
ggcggcccaagcccgacu

SEQ ID NO: 2505646 - RNA, 17 nt, Human
ggcggccaugauggugc

SEQ ID NO: 2505647 - RNA, 18 nt, Human
ggcggcaggggccuggag

SEQ ID NO: 2505648 - RNA, 16 nt, Human
ggcggcagcagccauc

SEQ ID NO: 2505649 - RNA, 14 nt, Human
ggcggcagcagcca

SEQ ID NO: 2505650 - RNA, 17 nt, Human
ggcggcaggggccugga

SEQ ID NO: 2505651 - RNA, 17 nt, Human
ggcggccccucccgccc

SEQ ID NO: 2505652 - RNA, 11 nt, Human
ggcggcgccgg

SEQ ID NO: 2505653 - RNA, 20 nt, Human
ggcggcuacucagcagcccu

SEQ ID NO: 2505654 - RNA, 21 nt, Human
ggcggcuacucagcagcccuc

SEQ ID NO: 2505655 - RNA, 22 nt, Human
ggcggcuacucagcagcccucc

SEQ ID NO: 2505656 - RNA, 23 nt, Human
ggcggcuacucagcagcccuccu

SEQ ID NO: 2505657 - RNA, 12 nt, Human
ggcggcagcagc

SEQ ID NO: 2505658 - RNA, 15 nt, Human
ggcggcacagccuuc

SEQ ID NO: 2505659 - RNA, 14 nt, Human
ggcggcacagccuu

SEQ ID NO: 2505660 - RNA, 20 nt, Human
ggcggauguugaagugagcu

SEQ ID NO: 2505661 - RNA, 21 nt, Human
ggcggagcuugcagugagccg

SEQ ID NO: 2505662 - RNA, 20 nt, Human
ggcggagcuugcagugagcc

SEQ ID NO: 2505663 - RNA, 23 nt, Human
ggcggagcuggccccgccgccug

SEQ ID NO: 2505664 - RNA, 20 nt, Human
ggcggagcuggccccgccgc

SEQ ID NO: 2505665 - RNA, 17 nt, Human
ggcggagcuggccccgc

SEQ ID NO: 2505666 - RNA, 20 nt, Human
ggcgcuggcccagccggccu

SEQ ID NO: 2505667 - RNA, 18 nt, Human
ggcgcuggcccagccggc

SEQ ID NO: 2505668 - RNA, 16 nt, Human
ggcgcuggcccagccg

SEQ ID NO: 2505669 - RNA, 15 nt, Human
ggcgcuggcccagcc

SEQ ID NO: 2505670 - RNA, 14 nt, Human
ggcgcuggcccagc

SEQ ID NO: 2505671 - RNA, 13 nt, Human
ggcgcuggcccag

SEQ ID NO: 2505672 - RNA, 12 nt, Human
ggcgcuggccca

SEQ ID NO: 2505673 - RNA, 11 nt, Human
ggcgcuggccc

SEQ ID NO: 2505674 - RNA, 16 nt, Human
ggcgcggccagccccg

SEQ ID NO: 2505675 - RNA, 19 nt, Human
ggcggagaguacagugagc

SEQ ID NO: 2505676 - RNA, 17 nt, Human
ggcggacguuccagccg

SEQ ID NO: 2505677 - RNA, 16 nt, Human
ggcggacguuccagcc

SEQ ID NO: 2505678 - RNA, 15 nt, Human
ggcggacguuccagc

SEQ ID NO: 2505679 - RNA, 19 nt, Human
ggcgcuggcccagccggcc

SEQ ID NO: 2505680 - RNA, 20 nt, Human
ggcggacaccuggcccccga

SEQ ID NO: 2505681 - RNA, 15 nt, Human
ggcggagcuggcccc

SEQ ID NO: 2505682 - RNA, 14 nt, Human
ggcggagcuggccc

SEQ ID NO: 2505683 - RNA, 21 nt, Human
ggcggagaguacagugagcca

SEQ ID NO: 2505684 - RNA, 20 nt, Human
ggcggagaguacagugagcc

SEQ ID NO: 2505685 - RNA, 13 nt, Human
ggcggagcuggcc

SEQ ID NO: 2505686 - RNA, 23 nt, Human
ggcgcugccccuggcagccccug

SEQ ID NO: 2505687 - RNA, 21 nt, Human
ggcgcugccccuggcagcccc

SEQ ID NO: 2505688 - RNA, 19 nt, Human
ggcgcugccccuggcagcc

SEQ ID NO: 2505689 - RNA, 18 nt, Human
ggcgcugccccuggcagc

SEQ ID NO: 2505690 - RNA, 18 nt, Human
ggcgccuguagucccagc

SEQ ID NO: 2505691 - RNA, 19 nt, Human
ggcgccggcgggcgggccg

SEQ ID NO: 2505692 - RNA, 13 nt, Human
ggcgccucugcaa

SEQ ID NO: 2505693 - RNA, 21 nt, Human
ggcgccgucuccaggggcugc

SEQ ID NO: 2505694 - RNA, 14 nt, Human
ggcgcggccagccc

SEQ ID NO: 2505695 - RNA, 20 nt, Human
ggcgccuguagucccagcca

SEQ ID NO: 2505696 - RNA, 22 nt, Human
ggcgcgcaccuguaaucccagc

SEQ ID NO: 2505697 - RNA, 23 nt, Human
ggccugucucauccccagggguc

SEQ ID NO: 2505698 - RNA, 20 nt, Human
ggcgccgucuccaggggcug

SEQ ID NO: 2505699 - RNA, 22 nt, Human
ggcgccgcaaaccacacuggac

SEQ ID NO: 2505700 - RNA, 20 nt, Human
ggcgccgcaaaccacacugg

SEQ ID NO: 2505701 - RNA, 19 nt, Human
ggcgccgcaaaccacacug

SEQ ID NO: 2505702 - RNA, 22 nt, Human
ggccugggggcugggcagagga

SEQ ID NO: 2505703 - RNA, 20 nt, Human
ggccugggggcugggcagag

SEQ ID NO: 2505704 - RNA, 14 nt, Human
ggccugggggcugg

SEQ ID NO: 2505705 - RNA, 11 nt, Human
ggccugugagc

SEQ ID NO: 2505706 - RNA, 17 nt, Human
ggccugucucaucccca

SEQ ID NO: 2505707 - RNA, 18 nt, Human
ggccugucucauccccag

SEQ ID NO: 2505708 - RNA, 19 nt, Human
ggccugucucauccccagg

SEQ ID NO: 2505709 - RNA, 20 nt, Human
ggccugucucauccccaggg

SEQ ID NO: 2505710 - RNA, 23 nt, Human
ggccuggggcuccuuucuccagc

SEQ ID NO: 2505711 - RNA, 18 nt, Human
ggccuggggcuccuuucu

SEQ ID NO: 2505712 - RNA, 16 nt, Human
ggccuggggcuccuuu

SEQ ID NO: 2505713 - RNA, 14 nt, Human
ggccuggggcuccu

SEQ ID NO: 2505714 - RNA, 18 nt, Human
ggccugggggcagggaga

SEQ ID NO: 2505715 - RNA, 14 nt, Human
ggccuguccuccaa

SEQ ID NO: 2505716 - RNA, 22 nt, Human
ggccucuugagcaguggcuggu

SEQ ID NO: 2505717 - RNA, 18 nt, Human
ggccucuugagcaguggc

SEQ ID NO: 2505718 - RNA, 16 nt, Human
ggccucuugagcagug

SEQ ID NO: 2505719 - RNA, 13 nt, Human
ggccucuugagca

SEQ ID NO: 2505720 - RNA, 17 nt, Human
ggccugaaagaggcuga

SEQ ID NO: 2505721 - RNA, 23 nt, Human
ggccucuuugucuaaaacaauaa

SEQ ID NO: 2505722 - RNA, 22 nt, Human
ggccucuuggaccucugcucug

SEQ ID NO: 2505723 - RNA, 17 nt, Human
ggccucuuggaccucug

SEQ ID NO: 2505724 - RNA, 13 nt, Human
ggccucuuggcag

SEQ ID NO: 2505725 - RNA, 19 nt, Human
ggccucuugggucccccac

SEQ ID NO: 2505726 - RNA, 23 nt, Human
ggccugaaagaggcugaggccug

SEQ ID NO: 2505727 - RNA, 16 nt, Human
ggccugaaaggagccc

SEQ ID NO: 2505728 - RNA, 22 nt, Human
ggccugaaaggagcccuuaucu

SEQ ID NO: 2505729 - RNA, 13 nt, Human
ggccugaagaguc

SEQ ID NO: 2505730 - RNA, 19 nt, Human
ggccugaagaguccucuga

SEQ ID NO: 2505731 - RNA, 15 nt, Human
ggccuggcuucuccu

SEQ ID NO: 2505732 - RNA, 12 nt, Human
ggccuggcuccu

SEQ ID NO: 2505733 - RNA, 19 nt, Human
ggccuggccugagcuggga

SEQ ID NO: 2505734 - RNA, 23 nt, Human
ggccuggcgggaugggccaccgc

SEQ ID NO: 2505735 - RNA, 22 nt, Human
ggccugaaugcuuauagguggc

SEQ ID NO: 2505736 - RNA, 23 nt, Human
ggccugaagaguccucugaauga

SEQ ID NO: 2505737 - RNA, 23 nt, Human
ggcuagugugguguuuccuggca

SEQ ID NO: 2505738 - RNA, 15 nt, Human
ggcuaguugggcuuc

SEQ ID NO: 2505739 - RNA, 16 nt, Human
ggcuaguugggcuucc

SEQ ID NO: 2505740 - RNA, 22 nt, Human
ggcuagcuucugcuuuucugcc

SEQ ID NO: 2505741 - RNA, 19 nt, Human
ggcuauagcuacaggaagc

SEQ ID NO: 2505742 - RNA, 15 nt, Human
ggcuaugcauuugaa

SEQ ID NO: 2505743 - RNA, 21 nt, Human
ggcuauggggauagaugugug

SEQ ID NO: 2505744 - RNA, 19 nt, Human
ggcuaugggggcacugagg

SEQ ID NO: 2505745 - RNA, 14 nt, Human
ggcucaagcagucu

SEQ ID NO: 2505746 - RNA, 19 nt, Human
ggcucaagcgauucuccug

SEQ ID NO: 2505747 - RNA, 23 nt, Human
ggcucaagcagucuacccaccuc

SEQ ID NO: 2505748 - RNA, 19 nt, Human
ggcuauguauggaauacag

SEQ ID NO: 2505749 - RNA, 13 nt, Human
ggcuauucacaac

SEQ ID NO: 2505750 - RNA, 16 nt, Human
ggcuaggaccccucca

SEQ ID NO: 2505751 - RNA, 15 nt, Human
ggcuagaucaugaag

SEQ ID NO: 2505752 - RNA, 20 nt, Human
ggcuagagugcaguggcaug

SEQ ID NO: 2505753 - RNA, 23 nt, Human
ggcggcugagagccccagcugac

SEQ ID NO: 2505754 - RNA, 20 nt, Human
ggcuagaguccucacuccca

SEQ ID NO: 2505755 - RNA, 14 nt, Human
ggcuagggggagcc

SEQ ID NO: 2505756 - RNA, 20 nt, Human
ggcuagcuucugcuuuucug

SEQ ID NO: 2505757 - RNA, 22 nt, Human
ggcuaggaccccuccauguggg

SEQ ID NO: 2505758 - RNA, 18 nt, Human
ggcggcugagagccccag

SEQ ID NO: 2505759 - RNA, 14 nt, Human
ggcggcugagagcc

SEQ ID NO: 2505760 - RNA, 18 nt, Human
ggcggcucggaggaagcc

SEQ ID NO: 2505761 - RNA, 17 nt, Human
ggcuagagguucaaaga

SEQ ID NO: 2505762 - RNA, 22 nt, Human
ggcuagagguucaaagauauuu

SEQ ID NO: 2505763 - RNA, 13 nt, Human
ggcuagaguccuc

SEQ ID NO: 2505764 - RNA, 14 nt, Human
ggcuagaguccuca

SEQ ID NO: 2505765 - RNA, 18 nt, Human
ggcuagaguccucacucc

SEQ ID NO: 2505766 - RNA, 19 nt, Human
ggcuagaguccucacuccc

SEQ ID NO: 2505767 - RNA, 19 nt, Human
ggcucccacaggcccuucc

SEQ ID NO: 2505768 - RNA, 18 nt, Human
ggcucccacaggcccuuc

SEQ ID NO: 2505769 - RNA, 16 nt, Human
ggcucccacaggcagc

SEQ ID NO: 2505770 - RNA, 17 nt, Human
ggcucccacaggcccuu

SEQ ID NO: 2505771 - RNA, 24 nt, Human
ggcuccagucugcugcccuccauc

SEQ ID NO: 2505772 - RNA, 15 nt, Human
ggcuccagucugcug

SEQ ID NO: 2505773 - RNA, 18 nt, Human
ggcuccagucugcugccc

SEQ ID NO: 2505774 - RNA, 22 nt, Human
ggcuccagucugcugcccucca

SEQ ID NO: 2505775 - RNA, 16 nt, Human
ggcuccaggcuccuuu

SEQ ID NO: 2505776 - RNA, 14 nt, Human
ggcuccaggccagg

SEQ ID NO: 2505777 - RNA, 16 nt, Human
ggcuccaggccagggg

SEQ ID NO: 2505778 - RNA, 11 nt, Human
ggcuccaggcu

SEQ ID NO: 2505779 - RNA, 18 nt, Human
ggcuccaggccagggggc

SEQ ID NO: 2505780 - RNA, 15 nt, Human
ggcuccaggcuccuu

SEQ ID NO: 2505781 - RNA, 19 nt, Human
ggcuccaggagcagccaca

SEQ ID NO: 2505782 - RNA, 13 nt, Human
ggcuccaggagca

SEQ ID NO: 2505783 - RNA, 12 nt, Human
ggcuccaggagc

SEQ ID NO: 2505784 - RNA, 12 nt, Human
ggcuccagcugg

SEQ ID NO: 2505785 - RNA, 21 nt, Human
ggcucaaguccucuuuucuga

SEQ ID NO: 2505786 - RNA, 15 nt, Human
ggcucaaguccucuu

SEQ ID NO: 2505787 - RNA, 16 nt, Human
ggcuccagaugcaggg

SEQ ID NO: 2505788 - RNA, 17 nt, Human
ggcuccagaugcagggc

SEQ ID NO: 2505789 - RNA, 18 nt, Human
ggcuccagaugcagggca

SEQ ID NO: 2505790 - RNA, 19 nt, Human
ggcuccagaugcagggcag

SEQ ID NO: 2505791 - RNA, 22 nt, Human
ggcuccagagggcacucugcuu

SEQ ID NO: 2505792 - RNA, 12 nt, Human
ggcucacacuga

SEQ ID NO: 2505793 - RNA, 18 nt, Human
ggcucacacaccuguagc

SEQ ID NO: 2505794 - RNA, 16 nt, Human
ggcucacaccuguaau

SEQ ID NO: 2505795 - RNA, 24 nt, Human
ggaaugauuaauuaaaacacaaca

SEQ ID NO: 2505796 - RNA, 12 nt, Human
ggaaugcagugg

SEQ ID NO: 2505797 - RNA, 19 nt, Human
ggaaugccugagugccugg

SEQ ID NO: 2505798 - RNA, 18 nt, Human
ggaaugccugagugccug

SEQ ID NO: 2505799 - RNA, 14 nt, Human
ggaaugccugagug

SEQ ID NO: 2505800 - RNA, 19 nt, Human
ggaaguguaacagcugagg

SEQ ID NO: 2505801 - RNA, 23 nt, Human
ggaaugccugagugccuggccaa

SEQ ID NO: 2505802 - RNA, 14 nt, Human
ggaaugcggcaaga

SEQ ID NO: 2505803 - RNA, 16 nt, Human
ggaaugcggcaagaag

SEQ ID NO: 2505804 - RNA, 22 nt, Human
ggaaugcggccgcauucccuga

SEQ ID NO: 2505805 - RNA, 23 nt, Human
ggaaugcggccgcauucccugag

SEQ ID NO: 2505806 - RNA, 13 nt, Human
ggaaugcuccccc

SEQ ID NO: 2505807 - RNA, 23 nt, Human
ggaaugcugcccgcucugcagac

SEQ ID NO: 2505808 - RNA, 23 nt, Human
ggaaugcucccccauccuccccu

SEQ ID NO: 2505809 - RNA, 18 nt, Human
ggaaugcuugaaaaaugu

SEQ ID NO: 2505810 - RNA, 16 nt, Human
ggaaugcuuccuagaa

SEQ ID NO: 2505811 - RNA, 14 nt, Human
ggaaugcuguguua

SEQ ID NO: 2505812 - RNA, 21 nt, Human
ggaauggaaaaagcagaaggc

SEQ ID NO: 2505813 - RNA, 20 nt, Human
ggaauguaacugcugaaaac

SEQ ID NO: 2505814 - RNA, 16 nt, Human
ggaaugggggccucuu

SEQ ID NO: 2505815 - RNA, 15 nt, Human
ggaauguguggccug

SEQ ID NO: 2505816 - RNA, 12 nt, Human
ggaaugggcugu

SEQ ID NO: 2505817 - RNA, 15 nt, Human
ggaauggcacagccc

SEQ ID NO: 2505818 - RNA, 19 nt, Human
ggaauguuugccucugccu

SEQ ID NO: 2505819 - RNA, 21 nt, Human
ggaauguuugggcagaaggga

SEQ ID NO: 2505820 - RNA, 19 nt, Human
ggaauguuugggcagaagg

SEQ ID NO: 2505821 - RNA, 16 nt, Human
ggaauguuaaagucag

SEQ ID NO: 2505822 - RNA, 14 nt, Human
ggaauuaaccuggu

SEQ ID NO: 2505823 - RNA, 16 nt, Human
ggaauuaaccuggugc

SEQ ID NO: 2505824 - RNA, 17 nt, Human
ggaauuaaccuggugcu

SEQ ID NO: 2505825 - RNA, 14 nt, Human
ggaauuauuuuaaa

SEQ ID NO: 2505826 - RNA, 15 nt, Human
ggaauuauuuuaaaa

SEQ ID NO: 2505827 - RNA, 19 nt, Human
ggaauuacauguaaaacau

SEQ ID NO: 2505828 - RNA, 22 nt, Human
ggaauuaaguuaucuuuaaaau

SEQ ID NO: 2505829 - RNA, 20 nt, Human
ggaauuaaccuggugcugga

SEQ ID NO: 2505830 - RNA, 16 nt, Human
ggaauuauuuuaaaag

SEQ ID NO: 2505831 - RNA, 17 nt, Human
ggaauuauuuuaaaaga

SEQ ID NO: 2505832 - RNA, 15 nt, Human
ggaauugauuugcau

SEQ ID NO: 2505833 - RNA, 17 nt, Human
ggaauugauuugcauug

SEQ ID NO: 2505834 - RNA, 18 nt, Human
ggaauugauuugcauuga

SEQ ID NO: 2505835 - RNA, 19 nt, Human
ggaauugauuugcauugaa

SEQ ID NO: 2505836 - RNA, 20 nt, Human
ggaauugacuucgacuguga

SEQ ID NO: 2505837 - RNA, 20 nt, Human
ggaauucaucucucuuuaau

SEQ ID NO: 2505838 - RNA, 22 nt, Human
ggaauuggagcucgugggacag

SEQ ID NO: 2505839 - RNA, 16 nt, Human
ggaauuggagcucgug

SEQ ID NO: 2505840 - RNA, 12 nt, Human
ggaauuguguuu

SEQ ID NO: 2505841 - RNA, 23 nt, Human
ggaauuggguggggggcuucaua

SEQ ID NO: 2505842 - RNA, 14 nt, Human
ggaauugugugaug

SEQ ID NO: 2505843 - RNA, 23 nt, Human
ggaauuucucccagucauuuaau

SEQ ID NO: 2505844 - RNA, 14 nt, Human
ggaauuucccagga

SEQ ID NO: 2505845 - RNA, 15 nt, Human
ggaauuucccaggac

SEQ ID NO: 2505846 - RNA, 16 nt, Human
ggaauuucccaggacc

SEQ ID NO: 2505847 - RNA, 17 nt, Human
ggaauuucccaggaccc

SEQ ID NO: 2505848 - RNA, 18 nt, Human
ggaauuucccaggacccu

SEQ ID NO: 2505849 - RNA, 19 nt, Human
ggaauuucccaggacccug

SEQ ID NO: 2505850 - RNA, 12 nt, Human
ggaauuuguaag

SEQ ID NO: 2505851 - RNA, 18 nt, Human
ggaauuuguaaccucagc

SEQ ID NO: 2505852 - RNA, 17 nt, Human
ggaauuuguaaccucag

SEQ ID NO: 2505853 - RNA, 16 nt, Human
ggaauuuguaaccuca

SEQ ID NO: 2505854 - RNA, 21 nt, Human
ggaauuugcaagucauggcug

SEQ ID NO: 2505855 - RNA, 23 nt, Human
ggacaaaucaagcuucaguuucc

SEQ ID NO: 2505856 - RNA, 18 nt, Human
ggacaaaacccaccuugu

SEQ ID NO: 2505857 - RNA, 15 nt, Human
ggacaaacagcucag

SEQ ID NO: 2505858 - RNA, 19 nt, Human
ggaauuuucaucuaggauu

SEQ ID NO: 2505859 - RNA, 15 nt, Human
ggacaaaacccaccu

SEQ ID NO: 2505860 - RNA, 22 nt, Human
ggacaaaaaugaacugaaguuu

SEQ ID NO: 2505861 - RNA, 19 nt, Human
ggaauuuguaaguuuaugu

SEQ ID NO: 2505862 - RNA, 14 nt, Human
ggaaggcagggagg

SEQ ID NO: 2505863 - RNA, 16 nt, Human
ggaaggcaggaagaga

SEQ ID NO: 2505864 - RNA, 23 nt, Human
ggaaggauuguaaaaaaaaaugc

SEQ ID NO: 2505865 - RNA, 16 nt, Human
ggaaggauuguaaaaa

SEQ ID NO: 2505866 - RNA, 13 nt, Human
ggaaggauuguaa

SEQ ID NO: 2505867 - RNA, 12 nt, Human
ggaaccuccuuu

SEQ ID NO: 2505868 - RNA, 18 nt, Human
ggaaccugacguagcugc

SEQ ID NO: 2505869 - RNA, 13 nt, Human
ggaaccugacccc

SEQ ID NO: 2505870 - RNA, 14 nt, Human
ggaacgagagggga

SEQ ID NO: 2505871 - RNA, 14 nt, Human
ggaacgacugggca

SEQ ID NO: 2505872 - RNA, 13 nt, Human
ggaacgcagauga

SEQ ID NO: 2505873 - RNA, 21 nt, Human
ggaaggcucuucuccccagag

SEQ ID NO: 2505874 - RNA, 19 nt, Human
ggaaggcggggcuucaacc

SEQ ID NO: 2505875 - RNA, 23 nt, Human
ggaagggacaccaagccuuggcu

SEQ ID NO: 2505876 - RNA, 17 nt, Human
ggaaggcugagaggaga

SEQ ID NO: 2505877 - RNA, 14 nt, Human
ggaaggcuggcugg

SEQ ID NO: 2505878 - RNA, 17 nt, Human
ggaaggcuggcugggca

SEQ ID NO: 2505879 - RNA, 22 nt, Human
ggaagggaccaaggcaaggcag

SEQ ID NO: 2505880 - RNA, 20 nt, Human
ggaagggaccaaggcaaggc

SEQ ID NO: 2505881 - RNA, 16 nt, Human
ggaagggaccaaggca

SEQ ID NO: 2505882 - RNA, 15 nt, Human
ggaagggaccaaggc

SEQ ID NO: 2505883 - RNA, 23 nt, Human
ggaagggaccaaggcaaggcagg

SEQ ID NO: 2505884 - RNA, 16 nt, Human
ggaagggacuaggagc

SEQ ID NO: 2505885 - RNA, 14 nt, Human
ggaagggcaaaacc

SEQ ID NO: 2505886 - RNA, 12 nt, Human
ggaagggcagga

SEQ ID NO: 2505887 - RNA, 15 nt, Human
ggaagggcaggaagg

SEQ ID NO: 2505888 - RNA, 23 nt, Human
ggaaggggagauaaggguaucug

SEQ ID NO: 2505889 - RNA, 11 nt, Human
ggaagggccag

SEQ ID NO: 2505890 - RNA, 17 nt, Human
ggaagggcauccuucug

SEQ ID NO: 2505891 - RNA, 21 nt, Human
ggaagggcaggaaggagagcc

SEQ ID NO: 2505892 - RNA, 21 nt, Human
ggaagggccagucugggcugc

SEQ ID NO: 2505893 - RNA, 12 nt, Human
ggaagggccagu

SEQ ID NO: 2505894 - RNA, 16 nt, Human
ggaaggggacccccgc

SEQ ID NO: 2505895 - RNA, 18 nt, Human
ggaagugcuaauuuugaa

SEQ ID NO: 2505896 - RNA, 14 nt, Human
ggaaugauuaauua

SEQ ID NO: 2505897 - RNA, 16 nt, Human
ggaaguguaacagcug

SEQ ID NO: 2505898 - RNA, 17 nt, Human
ggaaguguaacagcuga

SEQ ID NO: 2505899 - RNA, 20 nt, Human
ggaagugacgguuuaauggg

SEQ ID NO: 2505900 - RNA, 18 nt, Human
ggaagugacaaggcccca

SEQ ID NO: 2505901 - RNA, 19 nt, Human
ggaagugacaaggccccag

SEQ ID NO: 2505902 - RNA, 22 nt, Human
ggaagugacaaggccccagaga

SEQ ID NO: 2505903 - RNA, 14 nt, Human
ggaagugaggaagc

SEQ ID NO: 2505904 - RNA, 21 nt, Human
ggaagugacaaggccccagag

SEQ ID NO: 2505905 - RNA, 16 nt, Human
ggaagugaggaagcca

SEQ ID NO: 2505906 - RNA, 21 nt, Human
ggaagugagggucagagagga

SEQ ID NO: 2505907 - RNA, 13 nt, Human
ggaagucaaagca

SEQ ID NO: 2505908 - RNA, 15 nt, Human
ggaaguccaaugugg

SEQ ID NO: 2505909 - RNA, 16 nt, Human
ggaaguccaauguggc

SEQ ID NO: 2505910 - RNA, 17 nt, Human
ggaaguccaauguggca

SEQ ID NO: 2505911 - RNA, 18 nt, Human
ggaagucauccugccaac

SEQ ID NO: 2505912 - RNA, 18 nt, Human
ggaaguccccaggcccca

SEQ ID NO: 2505913 - RNA, 14 nt, Human
ggaaguccucuggg

SEQ ID NO: 2505914 - RNA, 13 nt, Human
ggaaguccucugg

SEQ ID NO: 2505915 - RNA, 21 nt, Human
ggaaguccccaggccccagga

SEQ ID NO: 2505916 - RNA, 23 nt, Human
ggaaguccccaggccccaggaag

SEQ ID NO: 2505917 - RNA, 20 nt, Human
ggaagugaagacuggaagcu

SEQ ID NO: 2505918 - RNA, 14 nt, Human
ggaagucuaggagc

SEQ ID NO: 2505919 - RNA, 23 nt, Human
ggaagugaagagggagaagggau

SEQ ID NO: 2505920 - RNA, 17 nt, Human
ggaagucuaggagcugg

SEQ ID NO: 2505921 - RNA, 17 nt, Human
ggaagugacaaggcccc

SEQ ID NO: 2505922 - RNA, 16 nt, Human
ggaaguacuggagaaa

SEQ ID NO: 2505923 - RNA, 12 nt, Human
ggaaguacugga

SEQ ID NO: 2505924 - RNA, 18 nt, Human
ggaaguacuggagaaaau

SEQ ID NO: 2505925 - RNA, 16 nt, Human
ggaaguaggaaguaaa

SEQ ID NO: 2505926 - RNA, 18 nt, Human
ggaagguuuguauauugu

SEQ ID NO: 2505927 - RNA, 13 nt, Human
ggaaggguggugg

SEQ ID NO: 2505928 - RNA, 18 nt, Human
ggaaggguuuguggcugg

SEQ ID NO: 2505929 - RNA, 23 nt, Human
ggaaguaacaguaacgcagggga

SEQ ID NO: 2505930 - RNA, 19 nt, Human
ggaagguuuggugugugga

SEQ ID NO: 2505931 - RNA, 16 nt, Human
ggaagguggggacagg

SEQ ID NO: 2505932 - RNA, 19 nt, Human
ggaaggucccuuguuucca

SEQ ID NO: 2505933 - RNA, 11 nt, Human
ggaaggugggg

SEQ ID NO: 2505934 - RNA, 16 nt, Human
ggaaggggguccaccc

SEQ ID NO: 2505935 - RNA, 21 nt, Human
ggaaggggcccgugggaguca

SEQ ID NO: 2505936 - RNA, 18 nt, Human
ggaaggggcccgugggag

SEQ ID NO: 2505937 - RNA, 15 nt, Human
ggaaggggccagagg

SEQ ID NO: 2505938 - RNA, 17 nt, Human
ggaaggggccagaggcu

SEQ ID NO: 2505939 - RNA, 22 nt, Human
ggaaggggacccccgcccccug

SEQ ID NO: 2505940 - RNA, 17 nt, Human
ggaaggggacccccgcc

SEQ ID NO: 2505941 - RNA, 17 nt, Human
ggaccuucgggcugugc

SEQ ID NO: 2505942 - RNA, 18 nt, Human
ggaccuucgggcugugcc

SEQ ID NO: 2505943 - RNA, 19 nt, Human
ggaccuucgggcugugccc

SEQ ID NO: 2505944 - RNA, 20 nt, Human
ggaccuucgggcugugcccg

SEQ ID NO: 2505945 - RNA, 17 nt, Human
ggaccuugaacugggua

SEQ ID NO: 2505946 - RNA, 15 nt, Human
ggaccuugaacuggg

SEQ ID NO: 2505947 - RNA, 20 nt, Human
ggacgcuacccgggaagggg

SEQ ID NO: 2505948 - RNA, 19 nt, Human
ggacgcuacccgggaaggg

SEQ ID NO: 2505949 - RNA, 17 nt, Human
ggacgcuacccgggaag

SEQ ID NO: 2505950 - RNA, 14 nt, Human
ggacgccugggggu

SEQ ID NO: 2505951 - RNA, 19 nt, Human
ggacgccugggggugccag

SEQ ID NO: 2505952 - RNA, 14 nt, Human
ggaccuccugagcg

SEQ ID NO: 2505953 - RNA, 15 nt, Human
ggacgccacccagca

SEQ ID NO: 2505954 - RNA, 21 nt, Human
ggaccacugcaugagcuuuua

SEQ ID NO: 2505955 - RNA, 13 nt, Human
ggaccagagcugc

SEQ ID NO: 2505956 - RNA, 14 nt, Human
ggaccacauuuuau

SEQ ID NO: 2505957 - RNA, 13 nt, Human
ggaccacauuuua

SEQ ID NO: 2505958 - RNA, 20 nt, Human
ggaccacagcaaggcaccug

SEQ ID NO: 2505959 - RNA, 21 nt, Human
ggaccacaccucccugaacca

SEQ ID NO: 2505960 - RNA, 22 nt, Human
ggaccaaggcaaggcaggugcc

SEQ ID NO: 2505961 - RNA, 20 nt, Human
ggaccaaggcaaggcaggug

SEQ ID NO: 2505962 - RNA, 19 nt, Human
ggaccaaggcaaggcaggu

SEQ ID NO: 2505963 - RNA, 17 nt, Human
ggaccaaggcaaggcag

SEQ ID NO: 2505964 - RNA, 13 nt, Human
ggaccacaccucc

SEQ ID NO: 2505965 - RNA, 23 nt, Human
ggaccaaggcaaggcaggugccu

SEQ ID NO: 2505966 - RNA, 22 nt, Human
ggaccacaaaaaugaaagcaug

SEQ ID NO: 2505967 - RNA, 19 nt, Human
ggaccagaagccaaagacu

SEQ ID NO: 2505968 - RNA, 19 nt, Human
ggaccucaggugagaagca

SEQ ID NO: 2505969 - RNA, 23 nt, Human
ggaccucaggugagaagcagagg

SEQ ID NO: 2505970 - RNA, 17 nt, Human
ggaccuccccugaggcu

SEQ ID NO: 2505971 - RNA, 14 nt, Human
ggaccuccccugag

SEQ ID NO: 2505972 - RNA, 13 nt, Human
ggaccuccugagc

SEQ ID NO: 2505973 - RNA, 21 nt, Human
ggacagccacggccaggccag

SEQ ID NO: 2505974 - RNA, 20 nt, Human
ggacagccacggccaggcca

SEQ ID NO: 2505975 - RNA, 19 nt, Human
ggacagccacggccaggcc

SEQ ID NO: 2505976 - RNA, 15 nt, Human
ggacagccacggcca

SEQ ID NO: 2505977 - RNA, 17 nt, Human
ggacacucaaaagcugg

SEQ ID NO: 2505978 - RNA, 22 nt, Human
ggacacucaaaagcugggcagg

SEQ ID NO: 2505979 - RNA, 23 nt, Human
ggacagaucaauggcgcagugcc

SEQ ID NO: 2505980 - RNA, 19 nt, Human
ggacagaucaauggcgcag

SEQ ID NO: 2505981 - RNA, 18 nt, Human
ggacagaucaauggcgca

SEQ ID NO: 2505982 - RNA, 15 nt, Human
ggacagaucaauggc

SEQ ID NO: 2505983 - RNA, 16 nt, Human
ggacagaguaugaaca

SEQ ID NO: 2505984 - RNA, 21 nt, Human
ggacagagguuaucuguccca

SEQ ID NO: 2505985 - RNA, 23 nt, Human
ggacagauccagggacugaagcc

SEQ ID NO: 2505986 - RNA, 19 nt, Human
ggacagauccagggacuga

SEQ ID NO: 2505987 - RNA, 20 nt, Human
ggacauugcggacagccacg

SEQ ID NO: 2505988 - RNA, 21 nt, Human
ggacauguuuuuguuuucuuu

SEQ ID NO: 2505989 - RNA, 16 nt, Human
ggacauguuuugauaa

SEQ ID NO: 2505990 - RNA, 16 nt, Human
ggacauuccaagacag

SEQ ID NO: 2505991 - RNA, 17 nt, Human
ggacauguuuugauaaa

SEQ ID NO: 2505992 - RNA, 17 nt, Human
ggacauuccaagacagu

SEQ ID NO: 2505993 - RNA, 18 nt, Human
ggacauggccccugugag

SEQ ID NO: 2505994 - RNA, 21 nt, Human
ggacagcagaagggggagacc

SEQ ID NO: 2505995 - RNA, 14 nt, Human
ggacauggacaagg

SEQ ID NO: 2505996 - RNA, 16 nt, Human
ggacauuugcucaugg

SEQ ID NO: 2505997 - RNA, 14 nt, Human
ggacauuucucuaa

SEQ ID NO: 2505998 - RNA, 20 nt, Human
ggaccaacccuguuuccuga

SEQ ID NO: 2505999 - RNA, 18 nt, Human
ggaccaacccuguuuccu

SEQ ID NO: 2506000 - RNA, 17 nt, Human
ggaccaacccuguuucc

SEQ ID NO: 2506001 - RNA, 16 nt, Human
ggaccaagcaucuugg

SEQ ID NO: 2506002 - RNA, 22 nt, Human
ggaccaacccuguuuccugagu

SEQ ID NO: 2506003 - RNA, 15 nt, Human
ggaccaaggaccccu

SEQ ID NO: 2506004 - RNA, 15 nt, Human
ggaccaaggcaaggc

SEQ ID NO: 2506005 - RNA, 11 nt, Human
ggaccaaggca

SEQ ID NO: 2506006 - RNA, 17 nt, Human
ggaccaaggagaugaag

SEQ ID NO: 2506007 - RNA, 13 nt, Human
ggacgcucucugg

SEQ ID NO: 2506008 - RNA, 14 nt, Human
ggacgcucucuggc

SEQ ID NO: 2506009 - RNA, 22 nt, Human
ggacuggaaccagggagaccga

SEQ ID NO: 2506010 - RNA, 17 nt, Human
ggacuggaaccagggag

SEQ ID NO: 2506011 - RNA, 15 nt, Human
ggacuggaaccaggg

SEQ ID NO: 2506012 - RNA, 14 nt, Human
ggacuggaaccagg

SEQ ID NO: 2506013 - RNA, 17 nt, Human
ggacgcucccugcucca

SEQ ID NO: 2506014 - RNA, 20 nt, Human
ggacgccugggggugccagg

SEQ ID NO: 2506015 - RNA, 21 nt, Human
ggacugugacaggcagcagag

SEQ ID NO: 2506016 - RNA, 20 nt, Human
ggacugugacaggcagcaga

SEQ ID NO: 2506017 - RNA, 19 nt, Human
ggacugugacaggcagcag

SEQ ID NO: 2506018 - RNA, 20 nt, Human
ggacugucuuucagauacau

SEQ ID NO: 2506019 - RNA, 23 nt, Human
ggacuggcuagaguccucacucc

SEQ ID NO: 2506020 - RNA, 22 nt, Human
ggacuggcgaguccagagagga

SEQ ID NO: 2506021 - RNA, 18 nt, Human
ggacuggccucugcugau

SEQ ID NO: 2506022 - RNA, 15 nt, Human
ggacuggccccuggg

SEQ ID NO: 2506023 - RNA, 14 nt, Human
ggacuggccccugg

SEQ ID NO: 2506024 - RNA, 18 nt, Human
ggacuggaaccagggaga

SEQ ID NO: 2506025 - RNA, 15 nt, Human
ggacuggaguggagc

SEQ ID NO: 2506026 - RNA, 17 nt, Human
ggacuggccccuggguc

SEQ ID NO: 2506027 - RNA, 16 nt, Human
ggacuggccccugggu

SEQ ID NO: 2506028 - RNA, 19 nt, Human
ggacuggcuagaguccuca

SEQ ID NO: 2506029 - RNA, 20 nt, Human
ggacuggcuagaguccucac

SEQ ID NO: 2506030 - RNA, 22 nt, Human
ggacuggcuagaguccucacuc

SEQ ID NO: 2506031 - RNA, 16 nt, Human
ggagaagccauugucu

SEQ ID NO: 2506032 - RNA, 12 nt, Human
ggagaagccauu

SEQ ID NO: 2506033 - RNA, 11 nt, Human
ggagaagccau

SEQ ID NO: 2506034 - RNA, 20 nt, Human
ggagaagccacaggccugag

SEQ ID NO: 2506035 - RNA, 13 nt, Human
ggagaagccagga

SEQ ID NO: 2506036 - RNA, 15 nt, Human
ggagaagccaggaau

SEQ ID NO: 2506037 - RNA, 12 nt, Human
ggagaagccagg

SEQ ID NO: 2506038 - RNA, 17 nt, Human
ggacugugugcucagga

SEQ ID NO: 2506039 - RNA, 15 nt, Human
ggagaaucacuugaa

SEQ ID NO: 2506040 - RNA, 19 nt, Human
ggagaaucacuugaacccg

SEQ ID NO: 2506041 - RNA, 17 nt, Human
ggagaagcggcuggcag

SEQ ID NO: 2506042 - RNA, 18 nt, Human
ggagaagcggcuggcagc

SEQ ID NO: 2506043 - RNA, 15 nt, Human
ggagacagccccaga

SEQ ID NO: 2506044 - RNA, 14 nt, Human
ggagacagccccag

SEQ ID NO: 2506045 - RNA, 18 nt, Human
ggagacagcaucaggguu

SEQ ID NO: 2506046 - RNA, 17 nt, Human
ggagacagcaucagggu

SEQ ID NO: 2506047 - RNA, 14 nt, Human
ggagacagcaucag

SEQ ID NO: 2506048 - RNA, 17 nt, Human
ggagaggaaaaguaagg

SEQ ID NO: 2506049 - RNA, 17 nt, Human
ggagacagccccagagc

SEQ ID NO: 2506050 - RNA, 19 nt, Human
ggagacagccccagagcag

SEQ ID NO: 2506051 - RNA, 12 nt, Human
ggagaggaaaga

SEQ ID NO: 2506052 - RNA, 12 nt, Human
ggagaggagaga

SEQ ID NO: 2506053 - RNA, 15 nt, Human
ggagaggagagccag

SEQ ID NO: 2506054 - RNA, 14 nt, Human
ggagaggagagcca

SEQ ID NO: 2506055 - RNA, 13 nt, Human
ggagaggagagcc

SEQ ID NO: 2506056 - RNA, 12 nt, Human
ggagaggagagc

SEQ ID NO: 2506057 - RNA, 18 nt, Human
ggagaggagagaggcaga

SEQ ID NO: 2506058 - RNA, 15 nt, Human
ggagaggagagaggc

SEQ ID NO: 2506059 - RNA, 14 nt, Human
ggagaggagagagg

SEQ ID NO: 2506060 - RNA, 13 nt, Human
ggagaggagagag

SEQ ID NO: 2506061 - RNA, 20 nt, Human
ggagaggagagccagagaag

SEQ ID NO: 2506062 - RNA, 16 nt, Human
ggagaggagagccaga

SEQ ID NO: 2506063 - RNA, 20 nt, Human
ggagaggaugagagcccaga

SEQ ID NO: 2506064 - RNA, 13 nt, Human
ggagaggaugaga

SEQ ID NO: 2506065 - RNA, 20 nt, Human
ggagaggagugacugagcuu

SEQ ID NO: 2506066 - RNA, 18 nt, Human
ggagaagcccgugugaga

SEQ ID NO: 2506067 - RNA, 14 nt, Human
ggagaaucauguga

SEQ ID NO: 2506068 - RNA, 17 nt, Human
ggagaaucaugugaacc

SEQ ID NO: 2506069 - RNA, 17 nt, Human
ggagaagccauugucuu

SEQ ID NO: 2506070 - RNA, 19 nt, Human
ggagaaucaugugaacccg

SEQ ID NO: 2506071 - RNA, 22 nt, Human
ggagaaugucaguauguggaag

SEQ ID NO: 2506072 - RNA, 21 nt, Human
ggagacacaacaacuccuagg

SEQ ID NO: 2506073 - RNA, 17 nt, Human
ggagacacuggccccuc

SEQ ID NO: 2506074 - RNA, 20 nt, Human
ggagacacuggccccucaaa

SEQ ID NO: 2506075 - RNA, 16 nt, Human
ggagaauuuuacugug

SEQ ID NO: 2506076 - RNA, 22 nt, Human
ggagaauuuagguuuuuauuag

SEQ ID NO: 2506077 - RNA, 18 nt, Human
ggagacaagaaaucccug

SEQ ID NO: 2506078 - RNA, 15 nt, Human
ggagacaagaaaucc

SEQ ID NO: 2506079 - RNA, 22 nt, Human
ggagaggcccucuggaguggcc

SEQ ID NO: 2506080 - RNA, 21 nt, Human
ggagaggcuagaaccaagaag

SEQ ID NO: 2506081 - RNA, 21 nt, Human
ggagagggucuggagaagcag

SEQ ID NO: 2506082 - RNA, 23 nt, Human
ggagagggucuggagaagcagug

SEQ ID NO: 2506083 - RNA, 22 nt, Human
ggagaggaugagagcccagagg

SEQ ID NO: 2506084 - RNA, 21 nt, Human
ggagaggaugagagcccagag

SEQ ID NO: 2506085 - RNA, 13 nt, Human
ggagaggccauga

SEQ ID NO: 2506086 - RNA, 11 nt, Human
ggagaggucuu

SEQ ID NO: 2506087 - RNA, 18 nt, Human
ggagaggucuuuuuuaaa

SEQ ID NO: 2506088 - RNA, 14 nt, Human
ggagaggugccagc

SEQ ID NO: 2506089 - RNA, 23 nt, Human
ggagaggucuuuuuuaaaaggaa

SEQ ID NO: 2506090 - RNA, 16 nt, Human
ggagaggugccagcaa

SEQ ID NO: 2506091 - RNA, 15 nt, Human
ggagaggugccagca

SEQ ID NO: 2506092 - RNA, 13 nt, Human
ggagagguggagc

SEQ ID NO: 2506093 - RNA, 21 nt, Human
ggagagguuauaggucacucc

SEQ ID NO: 2506094 - RNA, 18 nt, Human
ggagaguuuccugaaaca

SEQ ID NO: 2506095 - RNA, 22 nt, Human
ggagagucccagagcaggaggc

SEQ ID NO: 2506096 - RNA, 21 nt, Human
ggagaguccccugaaggucug

SEQ ID NO: 2506097 - RNA, 21 nt, Human
ggagagucccagagcaggagg

SEQ ID NO: 2506098 - RNA, 20 nt, Human
ggagagucccagagcaggag

SEQ ID NO: 2506099 - RNA, 17 nt, Human
ggagagucccagagcag

SEQ ID NO: 2506100 - RNA, 17 nt, Human
ggagaguacagugagcc

SEQ ID NO: 2506101 - RNA, 20 nt, Human
ggagaguacagugagccaag

SEQ ID NO: 2506102 - RNA, 23 nt, Human
ggagagguuauaggucacuccug

SEQ ID NO: 2506103 - RNA, 20 nt, Human
ggagauagccccacaggagg

SEQ ID NO: 2506104 - RNA, 21 nt, Human
ggagauagccccacaggaggu

SEQ ID NO: 2506105 - RNA, 23 nt, Human
ggagaguucaauggcugcugaag

SEQ ID NO: 2506106 - RNA, 14 nt, Human
ggagauagggaaag

SEQ ID NO: 2506107 - RNA, 20 nt, Human
ggagaucaaggagaggaggc

SEQ ID NO: 2506108 - RNA, 22 nt, Human
ggagauaucugagggaggaggc

SEQ ID NO: 2506109 - RNA, 22 nt, Human
ggagauauuuauggggggagaa

SEQ ID NO: 2506110 - RNA, 15 nt, Human
ggagauccuccugca

SEQ ID NO: 2506111 - RNA, 13 nt, Human
ggagauccuccug

SEQ ID NO: 2506112 - RNA, 23 nt, Human
ggagauauuuauggggggagaac

SEQ ID NO: 2506113 - RNA, 23 nt, Human
ggagaugaaaucuuacagcuggg

SEQ ID NO: 2506114 - RNA, 19 nt, Human
ggagaugaagcaaacacau

SEQ ID NO: 2506115 - RNA, 18 nt, Human
gcuuuucacugcuggcug

SEQ ID NO: 2506116 - RNA, 14 nt, Human
gcuuuucacugcug

SEQ ID NO: 2506117 - RNA, 23 nt, Human
gcuuuguuuugcacacuuugcca

SEQ ID NO: 2506118 - RNA, 13 nt, Human
gcuuuucacugcu

SEQ ID NO: 2506119 - RNA, 14 nt, Human
gcuuuguuuugcac

SEQ ID NO: 2506120 - RNA, 21 nt, Human
gcuuuguuuguugucagcuga

SEQ ID NO: 2506121 - RNA, 23 nt, Human
gcuuuucacugcuggcugccuua

SEQ ID NO: 2506122 - RNA, 22 nt, Human
gcuuuucacugcuggcugccuu

SEQ ID NO: 2506123 - RNA, 17 nt, Human
gcuuuucacugcugcaa

SEQ ID NO: 2506124 - RNA, 16 nt, Human
gcuuuucacugcugca

SEQ ID NO: 2506125 - RNA, 13 nt, Human
ggaaaaauauuua

SEQ ID NO: 2506126 - RNA, 14 nt, Human
ggaaaaauauuuaa

SEQ ID NO: 2506127 - RNA, 15 nt, Human
ggaaaaauauuuaag

SEQ ID NO: 2506128 - RNA, 18 nt, Human
ggaaaacaugcuacacac

SEQ ID NO: 2506129 - RNA, 12 nt, Human
ggaaaaaugugu

SEQ ID NO: 2506130 - RNA, 15 nt, Human
ggaaaaaugaguaau

SEQ ID NO: 2506131 - RNA, 17 nt, Human
ggaaaaaugagagaagg

SEQ ID NO: 2506132 - RNA, 15 nt, Human
ggaaaaauccagaaa

SEQ ID NO: 2506133 - RNA, 15 nt, Human
ggaaaacauuccauc

SEQ ID NO: 2506134 - RNA, 22 nt, Human
ggaaaacagaacaucauuagaa

SEQ ID NO: 2506135 - RNA, 18 nt, Human
ggaaaacagacucagguu

SEQ ID NO: 2506136 - RNA, 21 nt, Human
ggaaaagaggaguuucgaggu

SEQ ID NO: 2506137 - RNA, 14 nt, Human
ggaaaagcagcucu

SEQ ID NO: 2506138 - RNA, 18 nt, Human
ggaaaagcagcucucccc

SEQ ID NO: 2506139 - RNA, 14 nt, Human
ggaaaagcugcuga

SEQ ID NO: 2506140 - RNA, 20 nt, Human
ggaaaagccaagaggcugca

SEQ ID NO: 2506141 - RNA, 14 nt, Human
ggaaaagccucugu

SEQ ID NO: 2506142 - RNA, 19 nt, Human
ggaaaagcggacaucagcu

SEQ ID NO: 2506143 - RNA, 20 nt, Human
ggaaaagcugcugacagugu

SEQ ID NO: 2506144 - RNA, 18 nt, Human
ggaaaagcugcugacagu

SEQ ID NO: 2506145 - RNA, 21 nt, Human
ggaaaagggucuugggaaaua

SEQ ID NO: 2506146 - RNA, 20 nt, Human
ggaaaagggucuugggaaau

SEQ ID NO: 2506147 - RNA, 20 nt, Human
ggaaaaggcagggagcgagg

SEQ ID NO: 2506148 - RNA, 15 nt, Human
gcuuugugauuuuug

SEQ ID NO: 2506149 - RNA, 15 nt, Human
gcuuucagccucugg

SEQ ID NO: 2506150 - RNA, 16 nt, Human
gcuuugugugauugaa

SEQ ID NO: 2506151 - RNA, 15 nt, Human
gcuuugugugauuga

SEQ ID NO: 2506152 - RNA, 15 nt, Human
gcuuuguaugcacuu

SEQ ID NO: 2506153 - RNA, 19 nt, Human
gcuuucacuauuuccuuua

SEQ ID NO: 2506154 - RNA, 17 nt, Human
gcuuucacuauuuccuu

SEQ ID NO: 2506155 - RNA, 16 nt, Human
gcuuucaauuccguag

SEQ ID NO: 2506156 - RNA, 16 nt, Human
gcuuuagacccugggu

SEQ ID NO: 2506157 - RNA, 15 nt, Human
gcuuuagacccuggg

SEQ ID NO: 2506158 - RNA, 17 nt, Human
gcuuuagacccugggug

SEQ ID NO: 2506159 - RNA, 23 nt, Human
gcuuuaguccuagaggaccugag

SEQ ID NO: 2506160 - RNA, 10 nt, Human
gcuuuauaaa

SEQ ID NO: 2506161 - RNA, 14 nt, Human
gcuuuauaaauaaa

SEQ ID NO: 2506162 - RNA, 23 nt, Human
gcuuuauuuuuuaaguauuuaua

SEQ ID NO: 2506163 - RNA, 21 nt, Human
gcuuucaauuccguagccagc

SEQ ID NO: 2506164 - RNA, 20 nt, Human
gcuuuauacguguagcuaua

SEQ ID NO: 2506165 - RNA, 19 nt, Human
gcuuuauuuuuuaaguauu

SEQ ID NO: 2506166 - RNA, 21 nt, Human
gcuuuauuuuuuaaguauuua

SEQ ID NO: 2506167 - RNA, 20 nt, Human
gcuugaggguugggcuggug

SEQ ID NO: 2506168 - RNA, 18 nt, Human
gcuugaggguugggcugg

SEQ ID NO: 2506169 - RNA, 16 nt, Human
gcuuuacuguuuguua

SEQ ID NO: 2506170 - RNA, 23 nt, Human
gcuuuacugucaaaauaauuuua

SEQ ID NO: 2506171 - RNA, 14 nt, Human
gcuuuagacccugg

SEQ ID NO: 2506172 - RNA, 21 nt, Human
gcuuuagacacuggcugccag

SEQ ID NO: 2506173 - RNA, 23 nt, Human
ggaaaaucagccugcuccagcug

SEQ ID NO: 2506174 - RNA, 14 nt, Human
ggaaaaugaauaau

SEQ ID NO: 2506175 - RNA, 19 nt, Human
ggaaaaucucuuuuugacu

SEQ ID NO: 2506176 - RNA, 14 nt, Human
ggaaaaugcauugu

SEQ ID NO: 2506177 - RNA, 20 nt, Human
ggaaaaugcagcagggaugc

SEQ ID NO: 2506178 - RNA, 16 nt, Human
ggaaaaugcauuguau

SEQ ID NO: 2506179 - RNA, 15 nt, Human
ggaaaaguacauuua

SEQ ID NO: 2506180 - RNA, 18 nt, Human
ggaaaagguuuuauuuug

SEQ ID NO: 2506181 - RNA, 19 nt, Human
ggaaaaucagccugcucca

SEQ ID NO: 2506182 - RNA, 14 nt, Human
ggaaaggcuccagg

SEQ ID NO: 2506183 - RNA, 13 nt, Human
ggaaaggcuccag

SEQ ID NO: 2506184 - RNA, 12 nt, Human
ggaaaggcucca

SEQ ID NO: 2506185 - RNA, 12 nt, Human
ggaaaauuauuu

SEQ ID NO: 2506186 - RNA, 20 nt, Human
ggaaaggcucagucucagga

SEQ ID NO: 2506187 - RNA, 19 nt, Human
ggaaaggcucagucucagg

SEQ ID NO: 2506188 - RNA, 21 nt, Human
ggaaaggcuccaggagcagcc

SEQ ID NO: 2506189 - RNA, 20 nt, Human
ggaaaggcuccaggagcagc

SEQ ID NO: 2506190 - RNA, 19 nt, Human
ggaaaggcuccaggagcag

SEQ ID NO: 2506191 - RNA, 17 nt, Human
ggaaaggcuccaggagc

SEQ ID NO: 2506192 - RNA, 22 nt, Human
ggaaaggcuccaggagcagcca

SEQ ID NO: 2506193 - RNA, 23 nt, Human
ggaaaggcucagucucaggagca

SEQ ID NO: 2506194 - RNA, 15 nt, Human
ggaaaggcucugaaa

SEQ ID NO: 2506195 - RNA, 20 nt, Human
ggaaaggcucugaaagccag

SEQ ID NO: 2506196 - RNA, 19 nt, Human
ggaaaggggagagccugcu

SEQ ID NO: 2506197 - RNA, 18 nt, Human
ggaaaggggagagccugc

SEQ ID NO: 2506198 - RNA, 14 nt, Human
ggaaaggggagagc

SEQ ID NO: 2506199 - RNA, 13 nt, Human
ggaaaggggagag

SEQ ID NO: 2506200 - RNA, 12 nt, Human
ggaaaggggaga

SEQ ID NO: 2506201 - RNA, 19 nt, Human
ggaaaguguaaagcauucc

SEQ ID NO: 2506202 - RNA, 18 nt, Human
ggaaaggggggagcuggg

SEQ ID NO: 2506203 - RNA, 18 nt, Human
ggaaaguguaaagcauuc

SEQ ID NO: 2506204 - RNA, 14 nt, Human
ggaaaggggggagc

SEQ ID NO: 2506205 - RNA, 21 nt, Human
ggaaaggggagagccugcugg

SEQ ID NO: 2506206 - RNA, 21 nt, Human
ggaaaggggcaggccagagcu

SEQ ID NO: 2506207 - RNA, 15 nt, Human
ggaaauaaaaccuuu

SEQ ID NO: 2506208 - RNA, 16 nt, Human
ggaaauaaaaccuuuc

SEQ ID NO: 2506209 - RNA, 18 nt, Human
ggaaauaaaaccuuucaa

SEQ ID NO: 2506210 - RNA, 19 nt, Human
ggaaauaaaaccuuucaaa

SEQ ID NO: 2506211 - RNA, 20 nt, Human
ggaaauaaaaccuuucaaau

SEQ ID NO: 2506212 - RNA, 17 nt, Human
ggaaauaagaaaaauca

SEQ ID NO: 2506213 - RNA, 22 nt, Human
ggaaauaaaaccuuucaaauuu

SEQ ID NO: 2506214 - RNA, 16 nt, Human
ggaaauaccaguucug

SEQ ID NO: 2506215 - RNA, 20 nt, Human
ggaaauaauaaagaugcucu

SEQ ID NO: 2506216 - RNA, 14 nt, Human
ggaaauauauaugu

SEQ ID NO: 2506217 - RNA, 16 nt, Human
ggaaauaucaguuacu

SEQ ID NO: 2506218 - RNA, 17 nt, Human
ggaaaucaaauaugcaa

SEQ ID NO: 2506219 - RNA, 14 nt, Human
ggaaaucaccgaaa

SEQ ID NO: 2506220 - RNA, 21 nt, Human
ggaaaucaccgaaaacguggc

SEQ ID NO: 2506221 - RNA, 14 nt, Human
ggaaauaugaaugc

SEQ ID NO: 2506222 - RNA, 22 nt, Human
ggaaauaucaguuacucagccc

SEQ ID NO: 2506223 - RNA, 23 nt, Human
ggaacagcuaugggagccccagg

SEQ ID NO: 2506224 - RNA, 23 nt, Human
ggaacaucaucaaggcacugccu

SEQ ID NO: 2506225 - RNA, 22 nt, Human
ggaacaucaucaaggcacugcc

SEQ ID NO: 2506226 - RNA, 15 nt, Human
ggaacaucaucaagg

SEQ ID NO: 2506227 - RNA, 21 nt, Human
ggaaccaaagcgaauuuuaaa

SEQ ID NO: 2506228 - RNA, 16 nt, Human
ggaacaggaaacugau

SEQ ID NO: 2506229 - RNA, 23 nt, Human
ggaacaguguuucccauaauuuu

SEQ ID NO: 2506230 - RNA, 23 nt, Human
ggaacaggcucagaucucauggg

SEQ ID NO: 2506231 - RNA, 18 nt, Human
ggaacaguguuucccaua

SEQ ID NO: 2506232 - RNA, 21 nt, Human
ggaaccccccucccacccacc

SEQ ID NO: 2506233 - RNA, 17 nt, Human
ggaaccccccucccacc

SEQ ID NO: 2506234 - RNA, 22 nt, Human
ggaaccccccucccacccaccg

SEQ ID NO: 2506235 - RNA, 15 nt, Human
ggaaccccccuccca

SEQ ID NO: 2506236 - RNA, 18 nt, Human
ggaaccaugaagacagga

SEQ ID NO: 2506237 - RNA, 15 nt, Human
ggaacccagacucag

SEQ ID NO: 2506238 - RNA, 13 nt, Human
ggaacccagacuc

SEQ ID NO: 2506239 - RNA, 14 nt, Human
ggaacccagacuca

SEQ ID NO: 2506240 - RNA, 11 nt, Human
ggaacccagac

SEQ ID NO: 2506241 - RNA, 17 nt, Human
ggaaccagggagaccga

SEQ ID NO: 2506242 - RNA, 19 nt, Human
ggaaccagagccauggacu

SEQ ID NO: 2506243 - RNA, 22 nt, Human
ggaaccaaagcgaauuuuaaaa

SEQ ID NO: 2506244 - RNA, 12 nt, Human
ggaaccagagcc

SEQ ID NO: 2506245 - RNA, 13 nt, Human
ggaaccagagcca

SEQ ID NO: 2506246 - RNA, 13 nt, Human
ggaaccagggaga

SEQ ID NO: 2506247 - RNA, 23 nt, Human
gcuuaguaaugcuacgugugauu

SEQ ID NO: 2506248 - RNA, 18 nt, Human
gcuuaggcagggcucucu

SEQ ID NO: 2506249 - RNA, 22 nt, Human
gcuuaggaugugugcaugugug

SEQ ID NO: 2506250 - RNA, 13 nt, Human
gcuuaggagagac

SEQ ID NO: 2506251 - RNA, 12 nt, Human
gcuuaggagaga

SEQ ID NO: 2506252 - RNA, 19 nt, Human
gcuuagcuuugcucugcca

SEQ ID NO: 2506253 - RNA, 13 nt, Human
gcuuaggcagggc

SEQ ID NO: 2506254 - RNA, 12 nt, Human
gcuuaggauguu

SEQ ID NO: 2506255 - RNA, 17 nt, Human
gcuuagucacugagaca

SEQ ID NO: 2506256 - RNA, 15 nt, Human
gcuuagucacugaga

SEQ ID NO: 2506257 - RNA, 20 nt, Human
gcuuagucacugagacagcc

SEQ ID NO: 2506258 - RNA, 19 nt, Human
gcuuagucacugagacagc

SEQ ID NO: 2506259 - RNA, 16 nt, Human
gcuuaguuuguguguu

SEQ ID NO: 2506260 - RNA, 14 nt, Human
gcuuaguuugugug

SEQ ID NO: 2506261 - RNA, 17 nt, Human
gcuuagucacugccugc

SEQ ID NO: 2506262 - RNA, 15 nt, Human
gcuuagucacugccu

SEQ ID NO: 2506263 - RNA, 12 nt, Human
gcuuaguuugug

SEQ ID NO: 2506264 - RNA, 21 nt, Human
gcuuagucacugagacagccc

SEQ ID NO: 2506265 - RNA, 13 nt, Human
gcuguugcaguga

SEQ ID NO: 2506266 - RNA, 18 nt, Human
gcuguugauuucuuucca

SEQ ID NO: 2506267 - RNA, 20 nt, Human
gcuguugauugcuaaaugua

SEQ ID NO: 2506268 - RNA, 19 nt, Human
gcuguugauugcuaaaugu

SEQ ID NO: 2506269 - RNA, 16 nt, Human
gcuguugauugcuaaa

SEQ ID NO: 2506270 - RNA, 15 nt, Human
gcuguugauugcuaa

SEQ ID NO: 2506271 - RNA, 21 nt, Human
gcuguugaugaggccucuugg

SEQ ID NO: 2506272 - RNA, 12 nt, Human
gcuguugcugaa

SEQ ID NO: 2506273 - RNA, 23 nt, Human
gcuguugcguaacuggcuguguu

SEQ ID NO: 2506274 - RNA, 21 nt, Human
gcuguugcguaacuggcugug

SEQ ID NO: 2506275 - RNA, 13 nt, Human
gcuguugccucau

SEQ ID NO: 2506276 - RNA, 15 nt, Human
gcuguugccucaucu

SEQ ID NO: 2506277 - RNA, 18 nt, Human
gcuguugagcuguuuucc

SEQ ID NO: 2506278 - RNA, 16 nt, Human
gcuguugagcuguuuu

SEQ ID NO: 2506279 - RNA, 15 nt, Human
gcuguugagcuguuu

SEQ ID NO: 2506280 - RNA, 12 nt, Human
gcuguugagcug

SEQ ID NO: 2506281 - RNA, 23 nt, Human
gcuuagcaggagaggagagccag

SEQ ID NO: 2506282 - RNA, 22 nt, Human
gcuuagcaggagaggagagcca

SEQ ID NO: 2506283 - RNA, 21 nt, Human
gcuuagcaggagaggagagcc

SEQ ID NO: 2506284 - RNA, 18 nt, Human
gcuuagcaggagaggaga

SEQ ID NO: 2506285 - RNA, 16 nt, Human
gcuuagcaggagagga

SEQ ID NO: 2506286 - RNA, 11 nt, Human
gcuuagcagga

SEQ ID NO: 2506287 - RNA, 17 nt, Human
gcuuagcuuugcucugc

SEQ ID NO: 2506288 - RNA, 22 nt, Human
gcuuagccuccugaccugaggc

SEQ ID NO: 2506289 - RNA, 18 nt, Human
gcuuagcuuugcucugcc

SEQ ID NO: 2506290 - RNA, 16 nt, Human
gcuuagagccucccuc

SEQ ID NO: 2506291 - RNA, 12 nt, Human
gcuuagagcagu

SEQ ID NO: 2506292 - RNA, 13 nt, Human
gcuuagagacagu

SEQ ID NO: 2506293 - RNA, 18 nt, Human
gcuuagagaauguucucc

SEQ ID NO: 2506294 - RNA, 16 nt, Human
gcuuagagaauguucu

SEQ ID NO: 2506295 - RNA, 23 nt, Human
gcuuagacuucgacucaggaucc

SEQ ID NO: 2506296 - RNA, 21 nt, Human
gcuuagacuucgacucaggau

SEQ ID NO: 2506297 - RNA, 19 nt, Human
gcuuagaccucagccugug

SEQ ID NO: 2506298 - RNA, 23 nt, Human
gcuuagaccucagccugugcugc

SEQ ID NO: 2506299 - RNA, 21 nt, Human
gcugugggcgugagaccugcc

SEQ ID NO: 2506300 - RNA, 22 nt, Human
gcugugggcgugagaccugccc

SEQ ID NO: 2506301 - RNA, 20 nt, Human
gcugugggcgugagaccugc

SEQ ID NO: 2506302 - RNA, 15 nt, Human
gcugucuccagaccc

SEQ ID NO: 2506303 - RNA, 22 nt, Human
gcugucuccagacccccacccc

SEQ ID NO: 2506304 - RNA, 17 nt, Human
gcugugggcagguggga

SEQ ID NO: 2506305 - RNA, 23 nt, Human
gcuguggugugucccccucuguc

SEQ ID NO: 2506306 - RNA, 22 nt, Human
gcuguggggcugguagcucagg

SEQ ID NO: 2506307 - RNA, 18 nt, Human
gcuguggguacagagagg

SEQ ID NO: 2506308 - RNA, 23 nt, Human
gcugugguagggggugucucagg

SEQ ID NO: 2506309 - RNA, 16 nt, Human
gcuguggggcugguag

SEQ ID NO: 2506310 - RNA, 23 nt, Human
gcugugggcaggugggagcuuga

SEQ ID NO: 2506311 - RNA, 18 nt, Human
gcugugggccucaaggac

SEQ ID NO: 2506312 - RNA, 21 nt, Human
gcuguggggcugguagcucag

SEQ ID NO: 2506313 - RNA, 19 nt, Human
gcugugggccucaaggacu

SEQ ID NO: 2506314 - RNA, 22 nt, Human
gcuguucccauguagcccccug

SEQ ID NO: 2506315 - RNA, 14 nt, Human
gcuguucagcuggu

SEQ ID NO: 2506316 - RNA, 13 nt, Human
gcuguucagcugg

SEQ ID NO: 2506317 - RNA, 19 nt, Human
gcugccaaugggagcucau

SEQ ID NO: 2506318 - RNA, 16 nt, Human
gcugccaaugggagcu

SEQ ID NO: 2506319 - RNA, 15 nt, Human
gcugccaaugggagc

SEQ ID NO: 2506320 - RNA, 20 nt, Human
gcugucuacacuaagagaga

SEQ ID NO: 2506321 - RNA, 22 nt, Human
gcugucgauguaggcauucugg

SEQ ID NO: 2506322 - RNA, 13 nt, Human
gcugucuccagac

SEQ ID NO: 2506323 - RNA, 14 nt, Human
gcugucuccagacc

SEQ ID NO: 2506324 - RNA, 20 nt, Human
gcuguccucagguggccaug

SEQ ID NO: 2506325 - RNA, 17 nt, Human
gcuguccuuacccaucu

SEQ ID NO: 2506326 - RNA, 22 nt, Human
gcuguccuuacccaucugcacc

SEQ ID NO: 2506327 - RNA, 21 nt, Human
gcuguccucagguggccaugc

SEQ ID NO: 2506328 - RNA, 15 nt, Human
gcuucauccuccuca

SEQ ID NO: 2506329 - RNA, 12 nt, Human
gcuucauccucc

SEQ ID NO: 2506330 - RNA, 16 nt, Human
gcuucauuuccugugu

SEQ ID NO: 2506331 - RNA, 13 nt, Human
gcuucauuuccug

SEQ ID NO: 2506332 - RNA, 11 nt, Human
gcuucauacag

SEQ ID NO: 2506333 - RNA, 22 nt, Human
gcuucauacagggaugguguuc

SEQ ID NO: 2506334 - RNA, 23 nt, Human
gcuucauacuucaugaaauccug

SEQ ID NO: 2506335 - RNA, 18 nt, Human
gcuucaguggcagcugcu

SEQ ID NO: 2506336 - RNA, 17 nt, Human
gcuucaguggcagcugc

SEQ ID NO: 2506337 - RNA, 18 nt, Human
gcuuaugacaucacuugu

SEQ ID NO: 2506338 - RNA, 22 nt, Human
gcuuaugacaucacuuguacaa

SEQ ID NO: 2506339 - RNA, 23 nt, Human
gcuuaugacaucacuuguacaaa

SEQ ID NO: 2506340 - RNA, 16 nt, Human
gcuucaguggcagcug

SEQ ID NO: 2506341 - RNA, 21 nt, Human
gcuuaguuuguguguugucuc

SEQ ID NO: 2506342 - RNA, 20 nt, Human
gcuuaguuuguguguugucu

SEQ ID NO: 2506343 - RNA, 18 nt, Human
gcuuagucacugccugca

SEQ ID NO: 2506344 - RNA, 12 nt, Human
gcuuauacacuu

SEQ ID NO: 2506345 - RNA, 13 nt, Human
gcuuaucucaggg

SEQ ID NO: 2506346 - RNA, 19 nt, Human
gcuuaucucaggggugugc

SEQ ID NO: 2506347 - RNA, 16 nt, Human
gcuugaggguugggcu

SEQ ID NO: 2506348 - RNA, 12 nt, Human
gcuucugccugc

SEQ ID NO: 2506349 - RNA, 21 nt, Human
gcuucugcacccuccacccug

SEQ ID NO: 2506350 - RNA, 19 nt, Human
gcuucugcacccuccaccc

SEQ ID NO: 2506351 - RNA, 18 nt, Human
gcuucugcacccuccacc

SEQ ID NO: 2506352 - RNA, 17 nt, Human
gcuucugcacccuccac

SEQ ID NO: 2506353 - RNA, 15 nt, Human
gcuucugcacccucc

SEQ ID NO: 2506354 - RNA, 14 nt, Human
gcuucugcacccuc

SEQ ID NO: 2506355 - RNA, 13 nt, Human
gcuucugcacccu

SEQ ID NO: 2506356 - RNA, 21 nt, Human
gcuucugccacuucccaggua

SEQ ID NO: 2506357 - RNA, 19 nt, Human
gcuucugccacuucccagg

SEQ ID NO: 2506358 - RNA, 18 nt, Human
gcuucugccacuucccag

SEQ ID NO: 2506359 - RNA, 16 nt, Human
gcuucugccacuuccc

SEQ ID NO: 2506360 - RNA, 14 nt, Human
gcuucugccacuuc

SEQ ID NO: 2506361 - RNA, 13 nt, Human
gcuucugccacuu

SEQ ID NO: 2506362 - RNA, 12 nt, Human
gcuucugccacu

SEQ ID NO: 2506363 - RNA, 19 nt, Human
gcuucuccgccagccuccu

SEQ ID NO: 2506364 - RNA, 18 nt, Human
gcuucuccgccagccucc

SEQ ID NO: 2506365 - RNA, 17 nt, Human
gcuucuccgccagccuc

SEQ ID NO: 2506366 - RNA, 16 nt, Human
gcuucuccgccagccu

SEQ ID NO: 2506367 - RNA, 15 nt, Human
gcuucuccgccagcc

SEQ ID NO: 2506368 - RNA, 14 nt, Human
gcuucuccgccagc

SEQ ID NO: 2506369 - RNA, 21 nt, Human
gcuucuccgccagccuccucu

SEQ ID NO: 2506370 - RNA, 20 nt, Human
gcuucuccgccagccuccuc

SEQ ID NO: 2506371 - RNA, 22 nt, Human
gcuucucugugaacgauuuaga

SEQ ID NO: 2506372 - RNA, 19 nt, Human
gcuucugaaugcugcuacu

SEQ ID NO: 2506373 - RNA, 19 nt, Human
gcuucucugugaacgauuu

SEQ ID NO: 2506374 - RNA, 12 nt, Human
gcuucugcaccc

SEQ ID NO: 2506375 - RNA, 15 nt, Human
gcuuccagugaggcu

SEQ ID NO: 2506376 - RNA, 19 nt, Human
gcuuccaggaaacuccaca

SEQ ID NO: 2506377 - RNA, 17 nt, Human
gcuucauuuccuguguc

SEQ ID NO: 2506378 - RNA, 23 nt, Human
gcuuccagauugacgacaagugc

SEQ ID NO: 2506379 - RNA, 20 nt, Human
gcuuccagguaucuccagga

SEQ ID NO: 2506380 - RNA, 19 nt, Human
gcuuccagguaucuccagg

SEQ ID NO: 2506381 - RNA, 21 nt, Human
gcuuccaggaaacuccacauc

SEQ ID NO: 2506382 - RNA, 16 nt, Human
gcuuccagugaggcuc

SEQ ID NO: 2506383 - RNA, 18 nt, Human
gcuucucccacuuggcca

SEQ ID NO: 2506384 - RNA, 12 nt, Human
gcuucuccaggc

SEQ ID NO: 2506385 - RNA, 17 nt, Human
gcuucuccagccuggac

SEQ ID NO: 2506386 - RNA, 14 nt, Human
gcuucuccagccug

SEQ ID NO: 2506387 - RNA, 19 nt, Human
gcuucucccacuuggccaa

SEQ ID NO: 2506388 - RNA, 22 nt, Human
gcuuccagguaucuccaggauu

SEQ ID NO: 2506389 - RNA, 21 nt, Human
gcuuccagguaucuccaggau

SEQ ID NO: 2506390 - RNA, 13 nt, Human
gcuucuccagccu

SEQ ID NO: 2506391 - RNA, 22 nt, Human
gcuucucauccugcaggcagcu

SEQ ID NO: 2506392 - RNA, 21 nt, Human
gccucaagugauucuccugcc

SEQ ID NO: 2506393 - RNA, 20 nt, Human
gccucaagugauucuccugc

SEQ ID NO: 2506394 - RNA, 19 nt, Human
gccucaagugauucuccug

SEQ ID NO: 2506395 - RNA, 17 nt, Human
gccucaacccucccuca

SEQ ID NO: 2506396 - RNA, 18 nt, Human
gccucaacccucccucag

SEQ ID NO: 2506397 - RNA, 19 nt, Human
gccucaacccucccucagc

SEQ ID NO: 2506398 - RNA, 21 nt, Human
gccucaacccucccucagccc

SEQ ID NO: 2506399 - RNA, 16 nt, Human
gccucaagucacuccc

SEQ ID NO: 2506400 - RNA, 19 nt, Human
gccuaucagugugcccccc

SEQ ID NO: 2506401 - RNA, 18 nt, Human
gccuaucagugugccccc

SEQ ID NO: 2506402 - RNA, 16 nt, Human
gccuaucagugugccc

SEQ ID NO: 2506403 - RNA, 15 nt, Human
gccuaucagugugcc

SEQ ID NO: 2506404 - RNA, 14 nt, Human
gccuaucagugugc

SEQ ID NO: 2506405 - RNA, 13 nt, Human
gccuaucagugug

SEQ ID NO: 2506406 - RNA, 20 nt, Human
gccuaucagaguugcugcaa

SEQ ID NO: 2506407 - RNA, 23 nt, Human
gccuaucagugugccccccaucc

SEQ ID NO: 2506408 - RNA, 16 nt, Human
gccucaaccuccuggg

SEQ ID NO: 2506409 - RNA, 14 nt, Human
gccucaaccuccug

SEQ ID NO: 2506410 - RNA, 17 nt, Human
gccuaagugcagccccg

SEQ ID NO: 2506411 - RNA, 23 nt, Human
gccgagcucguguauccuggggc

SEQ ID NO: 2506412 - RNA, 21 nt, Human
gccgagcucguguauccuggg

SEQ ID NO: 2506413 - RNA, 20 nt, Human
gccgagccgggccuggggcu

SEQ ID NO: 2506414 - RNA, 16 nt, Human
gccuaaggcugaacuu

SEQ ID NO: 2506415 - RNA, 19 nt, Human
gccgagauagccaaggcca

SEQ ID NO: 2506416 - RNA, 19 nt, Human
gccgagccgggccuggggc

SEQ ID NO: 2506417 - RNA, 17 nt, Human
gccgagccgggccuggg

SEQ ID NO: 2506418 - RNA, 16 nt, Human
gccgagccgggccugg

SEQ ID NO: 2506419 - RNA, 15 nt, Human
gccgagccgggccug

SEQ ID NO: 2506420 - RNA, 22 nt, Human
gccuauauuuuuuguuaaauga

SEQ ID NO: 2506421 - RNA, 16 nt, Human
gccuauaaugaagcuu

SEQ ID NO: 2506422 - RNA, 23 nt, Human
gccuaucaaagaccuugugugua

SEQ ID NO: 2506423 - RNA, 21 nt, Human
gccuauaaugaagcuuuauac

SEQ ID NO: 2506424 - RNA, 14 nt, Human
gccuaaggcugaac

SEQ ID NO: 2506425 - RNA, 22 nt, Human
gccgagcucguguauccugggg

SEQ ID NO: 2506426 - RNA, 16 nt, Human
gccuaaguggcugcug

SEQ ID NO: 2506427 - RNA, 17 nt, Human
gccuaaguggcugcuga

SEQ ID NO: 2506428 - RNA, 15 nt, Human
gccucacccccucgg

SEQ ID NO: 2506429 - RNA, 18 nt, Human
gccucaagucacucccaa

SEQ ID NO: 2506430 - RNA, 22 nt, Human
gccucaacccucccucagcccc

SEQ ID NO: 2506431 - RNA, 23 nt, Human
gccucaacccucccucagccccu

SEQ ID NO: 2506432 - RNA, 21 nt, Human
gccucacaguccuuaccagca

SEQ ID NO: 2506433 - RNA, 18 nt, Human
gccucacuugaauguguc

SEQ ID NO: 2506434 - RNA, 20 nt, Human
gccucacuugaaugugucac

SEQ ID NO: 2506435 - RNA, 22 nt, Human
gccucaccuuggggcuugacuu

SEQ ID NO: 2506436 - RNA, 16 nt, Human
gccucacuugaaugug

SEQ ID NO: 2506437 - RNA, 23 nt, Human
gccucacccccucgggucuccuc

SEQ ID NO: 2506438 - RNA, 22 nt, Human
gccucacccccucgggucuccu

SEQ ID NO: 2506439 - RNA, 16 nt, Human
gccucacccccucggg

SEQ ID NO: 2506440 - RNA, 23 nt, Human
gccucagccucccaaagugcugg

SEQ ID NO: 2506441 - RNA, 16 nt, Human
gccucagccucccaag

SEQ ID NO: 2506442 - RNA, 23 nt, Human
gccucagaauugaucauuuuccc

SEQ ID NO: 2506443 - RNA, 18 nt, Human
gccucagccuccugagua

SEQ ID NO: 2506444 - RNA, 14 nt, Human
gccucagccucccg

SEQ ID NO: 2506445 - RNA, 16 nt, Human
gccucagccuccugag

SEQ ID NO: 2506446 - RNA, 23 nt, Human
gccucaguccuccccucacagcc

SEQ ID NO: 2506447 - RNA, 22 nt, Human
gccucaguccuccccucacagc

SEQ ID NO: 2506448 - RNA, 18 nt, Human
gccucaguccuccccuca

SEQ ID NO: 2506449 - RNA, 16 nt, Human
gccucaguccuccccu

SEQ ID NO: 2506450 - RNA, 15 nt, Human
gccucaguccucccc

SEQ ID NO: 2506451 - RNA, 20 nt, Human
gccucaguaagacgacaagg

SEQ ID NO: 2506452 - RNA, 22 nt, Human
gccucaguaaguaucuggagga

SEQ ID NO: 2506453 - RNA, 15 nt, Human
gccucagucucccuc

SEQ ID NO: 2506454 - RNA, 18 nt, Human
gccucagucucccucccu

SEQ ID NO: 2506455 - RNA, 14 nt, Human
gccucagugccacu

SEQ ID NO: 2506456 - RNA, 12 nt, Human
gccucagugcca

SEQ ID NO: 2506457 - RNA, 20 nt, Human
gccucagcugccucacuucc

SEQ ID NO: 2506458 - RNA, 16 nt, Human
gccucagcugccucac

SEQ ID NO: 2506459 - RNA, 19 nt, Human
gccucagcugccucacuuc

SEQ ID NO: 2506460 - RNA, 14 nt, Human
gccucagcugccuc

SEQ ID NO: 2506461 - RNA, 15 nt, Human
gccucagcugccuca

SEQ ID NO: 2506462 - RNA, 14 nt, Human
gccucagguuccua

SEQ ID NO: 2506463 - RNA, 13 nt, Human
gccucagguuccu

SEQ ID NO: 2506464 - RNA, 16 nt, Human
gccucaggugggccgc

SEQ ID NO: 2506465 - RNA, 15 nt, Human
gccucccgaguagcu

SEQ ID NO: 2506466 - RNA, 23 nt, Human
gccucccgaauagcugggacuac

SEQ ID NO: 2506467 - RNA, 20 nt, Human
gccucggacuuagcugggag

SEQ ID NO: 2506468 - RNA, 21 nt, Human
gccucggacuuagcugggaga

SEQ ID NO: 2506469 - RNA, 16 nt, Human
gccuccccugugcagu

SEQ ID NO: 2506470 - RNA, 20 nt, Human
gccuccccugcugaaggugg

SEQ ID NO: 2506471 - RNA, 15 nt, Human
gccuccccugcugaa

SEQ ID NO: 2506472 - RNA, 23 nt, Human
gccucccacccgaugcugcuuuc

SEQ ID NO: 2506473 - RNA, 18 nt, Human
gccucggcuccugcugca

SEQ ID NO: 2506474 - RNA, 16 nt, Human
gccucggcuccugcug

SEQ ID NO: 2506475 - RNA, 15 nt, Human
gccucggcuccugcu

SEQ ID NO: 2506476 - RNA, 18 nt, Human
gccucggcuuuucucagc

SEQ ID NO: 2506477 - RNA, 21 nt, Human
gccucgggacaccugcccugc

SEQ ID NO: 2506478 - RNA, 23 nt, Human
gccucgggaaccucacucuugcc

SEQ ID NO: 2506479 - RNA, 18 nt, Human
gccucgggaaccucacuc

SEQ ID NO: 2506480 - RNA, 17 nt, Human
gccucggcuccugcugc

SEQ ID NO: 2506481 - RNA, 19 nt, Human
gccucggcuuuucucagcu

SEQ ID NO: 2506482 - RNA, 20 nt, Human
gccucggcuuuucucagcug

SEQ ID NO: 2506483 - RNA, 14 nt, Human
gccucggcuccugc

SEQ ID NO: 2506484 - RNA, 17 nt, Human
gccucggccucccaaag

SEQ ID NO: 2506485 - RNA, 14 nt, Human
gccucggagccuca

SEQ ID NO: 2506486 - RNA, 15 nt, Human
gccucggagccucau

SEQ ID NO: 2506487 - RNA, 17 nt, Human
gccucggagccucaucc

SEQ ID NO: 2506488 - RNA, 23 nt, Human
gccucggagccucauccgaggca

SEQ ID NO: 2506489 - RNA, 21 nt, Human
gccucuaaccccaggccccga

SEQ ID NO: 2506490 - RNA, 20 nt, Human
gccucuaaccccaggccccg

SEQ ID NO: 2506491 - RNA, 23 nt, Human
gccucuaccugacacucccuugg

SEQ ID NO: 2506492 - RNA, 19 nt, Human
gccucuaaccccaggcccc

SEQ ID NO: 2506493 - RNA, 18 nt, Human
gccucuaaccccaggccc

SEQ ID NO: 2506494 - RNA, 17 nt, Human
gccucuaaccccaggcc

SEQ ID NO: 2506495 - RNA, 16 nt, Human
gccucuaaccccaggc

SEQ ID NO: 2506496 - RNA, 13 nt, Human
gccucgggaccuc

SEQ ID NO: 2506497 - RNA, 22 nt, Human
gccucgggacaccugcccugcc

SEQ ID NO: 2506498 - RNA, 15 nt, Human
gccucuaaccccagg

SEQ ID NO: 2506499 - RNA, 23 nt, Human
gccucuagggaccccuccucccu

SEQ ID NO: 2506500 - RNA, 20 nt, Human
gccucuagggaccccuccuc

SEQ ID NO: 2506501 - RNA, 19 nt, Human
gccucuagggaccccuccu

SEQ ID NO: 2506502 - RNA, 18 nt, Human
gccucuagggaccccucc

SEQ ID NO: 2506503 - RNA, 17 nt, Human
gccucuagggaccccuc

SEQ ID NO: 2506504 - RNA, 13 nt, Human
gccucuagggacc

SEQ ID NO: 2506505 - RNA, 15 nt, Human
gccucuccuuuguau

SEQ ID NO: 2506506 - RNA, 14 nt, Human
gccucuccuuugua

SEQ ID NO: 2506507 - RNA, 12 nt, Human
gccucuccuuug

SEQ ID NO: 2506508 - RNA, 22 nt, Human
gccucuccuuguggccugggcc

SEQ ID NO: 2506509 - RNA, 17 nt, Human
gccucuccuuuguauau

SEQ ID NO: 2506510 - RNA, 16 nt, Human
gccucuccuuuguaua

SEQ ID NO: 2506511 - RNA, 23 nt, Human
gccucuccuuuguauauuauuuc

SEQ ID NO: 2506512 - RNA, 19 nt, Human
gccucucugcaggucccua

SEQ ID NO: 2506513 - RNA, 21 nt, Human
gccucuccuuguggccugggc

SEQ ID NO: 2506514 - RNA, 20 nt, Human
gccucuccuuguggccuggg

SEQ ID NO: 2506515 - RNA, 14 nt, Human
gccucucccuggcc

SEQ ID NO: 2506516 - RNA, 15 nt, Human
gccucucccuggccc

SEQ ID NO: 2506517 - RNA, 16 nt, Human
gccucucccuggcccu

SEQ ID NO: 2506518 - RNA, 15 nt, Human
gccucagugccacua

SEQ ID NO: 2506519 - RNA, 21 nt, Human
gccucagucucccuucuccca

SEQ ID NO: 2506520 - RNA, 24 nt, Human
gccucaguccuccccucacagccu

SEQ ID NO: 2506521 - RNA, 22 nt, Human
gccucagucucccuucucccau

SEQ ID NO: 2506522 - RNA, 11 nt, Human
gccucagugga

SEQ ID NO: 2506523 - RNA, 21 nt, Human
gccucaguggacuuuccaccc

SEQ ID NO: 2506524 - RNA, 22 nt, Human
gccucaguggacuuuccacccc

SEQ ID NO: 2506525 - RNA, 21 nt, Human
gccucccaacucaccccagcc

SEQ ID NO: 2506526 - RNA, 22 nt, Human
gccucauauuuaaagacaggga

SEQ ID NO: 2506527 - RNA, 15 nt, Human
gccucauauuuaaag

SEQ ID NO: 2506528 - RNA, 13 nt, Human
gccucauauuuaa

SEQ ID NO: 2506529 - RNA, 14 nt, Human
gccucaguguauuu

SEQ ID NO: 2506530 - RNA, 16 nt, Human
gccucauccgaggcag

SEQ ID NO: 2506531 - RNA, 17 nt, Human
gccucauccgaggcagg

SEQ ID NO: 2506532 - RNA, 23 nt, Human
gccucccaacucaccccagcccc

SEQ ID NO: 2506533 - RNA, 22 nt, Human
gccucccaacucaccccagccc

SEQ ID NO: 2506534 - RNA, 16 nt, Human
gccucccacagugacu

SEQ ID NO: 2506535 - RNA, 14 nt, Human
gccucccacaguga

SEQ ID NO: 2506536 - RNA, 13 nt, Human
gccucccacagug

SEQ ID NO: 2506537 - RNA, 12 nt, Human
gccucccacagu

SEQ ID NO: 2506538 - RNA, 23 nt, Human
gccucccacagugacucgggcuc

SEQ ID NO: 2506539 - RNA, 12 nt, Human
gccucccacccc

SEQ ID NO: 2506540 - RNA, 18 nt, Human
gccucauccgaggcaggg

SEQ ID NO: 2506541 - RNA, 19 nt, Human
gccucauccgaggcagggu

SEQ ID NO: 2506542 - RNA, 13 nt, Human
gccucccacagac

SEQ ID NO: 2506543 - RNA, 19 nt, Human
gccuccccugccaccaggc

SEQ ID NO: 2506544 - RNA, 16 nt, Human
gccuccccugccacca

SEQ ID NO: 2506545 - RNA, 15 nt, Human
gccuccccugccacc

SEQ ID NO: 2506546 - RNA, 14 nt, Human
gccuccccugccac

SEQ ID NO: 2506547 - RNA, 19 nt, Human
gccuccccucuccuuccug

SEQ ID NO: 2506548 - RNA, 21 nt, Human
gccuccccucuccuuccugug

SEQ ID NO: 2506549 - RNA, 14 nt, Human
gccuccccugccag

SEQ ID NO: 2506550 - RNA, 15 nt, Human
gccuccccugccagg

SEQ ID NO: 2506551 - RNA, 17 nt, Human
gccuccccugccagggc

SEQ ID NO: 2506552 - RNA, 18 nt, Human
gccuccccugccagggca

SEQ ID NO: 2506553 - RNA, 21 nt, Human
gccucccgaauagcugggacu

SEQ ID NO: 2506554 - RNA, 21 nt, Human
gccucccacccgaugcugcuu

SEQ ID NO: 2506555 - RNA, 20 nt, Human
gccucccacccgaugcugcu

SEQ ID NO: 2506556 - RNA, 19 nt, Human
gccucccacccgaugcugc

SEQ ID NO: 2506557 - RNA, 18 nt, Human
gccucccacccgaugcug

SEQ ID NO: 2506558 - RNA, 12 nt, Human
gccucccacccg

SEQ ID NO: 2506559 - RNA, 17 nt, Human
gccucccacccccaucu

SEQ ID NO: 2506560 - RNA, 14 nt, Human
gccucccacgacug

SEQ ID NO: 2506561 - RNA, 21 nt, Human
gccucccacgacugcccggca

SEQ ID NO: 2506562 - RNA, 18 nt, Human
gccuccccucuccuuccu

SEQ ID NO: 2506563 - RNA, 12 nt, Human
gccucccacugg

SEQ ID NO: 2506564 - RNA, 14 nt, Human
gccugcagagagaa

SEQ ID NO: 2506565 - RNA, 12 nt, Human
gccugcagagag

SEQ ID NO: 2506566 - RNA, 11 nt, Human
gccugcagaga

SEQ ID NO: 2506567 - RNA, 16 nt, Human
gccugcagacucacug

SEQ ID NO: 2506568 - RNA, 16 nt, Human
gccugcagaauuuggg

SEQ ID NO: 2506569 - RNA, 22 nt, Human
gccugcacggugggccuugcug

SEQ ID NO: 2506570 - RNA, 21 nt, Human
gccugcacggugggccuugcu

SEQ ID NO: 2506571 - RNA, 12 nt, Human
gccugcagagcu

SEQ ID NO: 2506572 - RNA, 15 nt, Human
gccugcagagcugcg

SEQ ID NO: 2506573 - RNA, 15 nt, Human
gccugcuccagcugu

SEQ ID NO: 2506574 - RNA, 21 nt, Human
gccugauugccaagcucagga

SEQ ID NO: 2506575 - RNA, 20 nt, Human
gccugauugccaagcucagg

SEQ ID NO: 2506576 - RNA, 16 nt, Human
gccugcaaacgcugcc

SEQ ID NO: 2506577 - RNA, 17 nt, Human
gccugcaaacgcugccu

SEQ ID NO: 2506578 - RNA, 18 nt, Human
gccugcaaacgcugccug

SEQ ID NO: 2506579 - RNA, 16 nt, Human
gccugcacaauaaaaa

SEQ ID NO: 2506580 - RNA, 19 nt, Human
gccugauugccaagcucag

SEQ ID NO: 2506581 - RNA, 20 nt, Human
gccugauucggcugucucag

SEQ ID NO: 2506582 - RNA, 17 nt, Human
gccugauucggcugucu

SEQ ID NO: 2506583 - RNA, 17 nt, Human
gccugauggggaggguc

SEQ ID NO: 2506584 - RNA, 14 nt, Human
gccugauggaccug

SEQ ID NO: 2506585 - RNA, 13 nt, Human
gccugauggaccu

SEQ ID NO: 2506586 - RNA, 20 nt, Human
gccugaugcucccuccccug

SEQ ID NO: 2506587 - RNA, 22 nt, Human
gccugcuuuucacugcugcaag

SEQ ID NO: 2506588 - RNA, 21 nt, Human
gccugcuuuucacugcugcaa

SEQ ID NO: 2506589 - RNA, 20 nt, Human
gccugcuuuucacugcugca

SEQ ID NO: 2506590 - RNA, 18 nt, Human
gccugcuuuucacugcug

SEQ ID NO: 2506591 - RNA, 22 nt, Human
gccugcuuuuuauggccuguga

SEQ ID NO: 2506592 - RNA, 19 nt, Human
gccugcuuuuuauggccug

SEQ ID NO: 2506593 - RNA, 18 nt, Human
gccugcuuuuuauggccu

SEQ ID NO: 2506594 - RNA, 22 nt, Human
gccugcuggucacagccuccuc

SEQ ID NO: 2506595 - RNA, 16 nt, Human
gccugcucccagcagc

SEQ ID NO: 2506596 - RNA, 15 nt, Human
gccugcucccagcag

SEQ ID NO: 2506597 - RNA, 13 nt, Human
gccugcucccagc

SEQ ID NO: 2506598 - RNA, 18 nt, Human
gccugcagagagaagccu

SEQ ID NO: 2506599 - RNA, 17 nt, Human
gccugcagagagaagcc

SEQ ID NO: 2506600 - RNA, 16 nt, Human
gccugcagagagaagc

SEQ ID NO: 2506601 - RNA, 22 nt, Human
gccugcugugauuccacuacac

SEQ ID NO: 2506602 - RNA, 16 nt, Human
gccugcuuccugucuu

SEQ ID NO: 2506603 - RNA, 17 nt, Human
gccugcucccagcagcc

SEQ ID NO: 2506604 - RNA, 16 nt, Human
gccugcuccagcuguu

SEQ ID NO: 2506605 - RNA, 18 nt, Human
gccugcuccagcuguuca

SEQ ID NO: 2506606 - RNA, 18 nt, Human
gccucugcugauccuccc

SEQ ID NO: 2506607 - RNA, 13 nt, Human
gccucugccuguc

SEQ ID NO: 2506608 - RNA, 19 nt, Human
gccucucgguggccagcag

SEQ ID NO: 2506609 - RNA, 19 nt, Human
gccucugcugauccuccca

SEQ ID NO: 2506610 - RNA, 11 nt, Human
gccucugcugc

SEQ ID NO: 2506611 - RNA, 18 nt, Human
gccugaaguuggagugag

SEQ ID NO: 2506612 - RNA, 22 nt, Human
gccugaagucacacagugaguc

SEQ ID NO: 2506613 - RNA, 21 nt, Human
gccucucugcaggucccuaau

SEQ ID NO: 2506614 - RNA, 20 nt, Human
gccucucugcaggucccuaa

SEQ ID NO: 2506615 - RNA, 18 nt, Human
gccucucugcaggucccu

SEQ ID NO: 2506616 - RNA, 23 nt, Human
gccucucugcaggucccuaauaa

SEQ ID NO: 2506617 - RNA, 12 nt, Human
gccucugccugu

SEQ ID NO: 2506618 - RNA, 18 nt, Human
gccucugccucugacaca

SEQ ID NO: 2506619 - RNA, 15 nt, Human
gccugagucuccugu

SEQ ID NO: 2506620 - RNA, 13 nt, Human
gccugagucuccu

SEQ ID NO: 2506621 - RNA, 23 nt, Human
gccugacccuacuucuuuugcuc

SEQ ID NO: 2506622 - RNA, 13 nt, Human
gccugagucaccu

SEQ ID NO: 2506623 - RNA, 21 nt, Human
gccugacaaccacuggucugu

SEQ ID NO: 2506624 - RNA, 20 nt, Human
gccugacaaccacuggucug

SEQ ID NO: 2506625 - RNA, 22 nt, Human
gccugaaugcuuauagguggcc

SEQ ID NO: 2506626 - RNA, 22 nt, Human
gccugacauuuggaguguuccc

SEQ ID NO: 2506627 - RNA, 21 nt, Human
gccugauccagccucuccccu

SEQ ID NO: 2506628 - RNA, 18 nt, Human
gccugauccagccucucc

SEQ ID NO: 2506629 - RNA, 17 nt, Human
gccugaugacagagcga

SEQ ID NO: 2506630 - RNA, 12 nt, Human
gccugaugacag

SEQ ID NO: 2506631 - RNA, 14 nt, Human
gccugaugcucccu

SEQ ID NO: 2506632 - RNA, 16 nt, Human
gccugaugcucccucc

SEQ ID NO: 2506633 - RNA, 17 nt, Human
gccugaugcucccuccc

SEQ ID NO: 2506634 - RNA, 19 nt, Human
gccugaugcucccuccccu

SEQ ID NO: 2506635 - RNA, 22 nt, Human
gccugauccagccucuccccug

SEQ ID NO: 2506636 - RNA, 16 nt, Human
gccugaucagaccacg

SEQ ID NO: 2506637 - RNA, 20 nt, Human
gccugaucagaccacggcuc

SEQ ID NO: 2506638 - RNA, 15 nt, Human
gccugagugccuggc

SEQ ID NO: 2506639 - RNA, 16 nt, Human
gccugagucuccugug

SEQ ID NO: 2506640 - RNA, 15 nt, Human
gccugauauaaaugc

SEQ ID NO: 2506641 - RNA, 14 nt, Human
gccugauauaaaug

SEQ ID NO: 2506642 - RNA, 17 nt, Human
gccugggcagaaggaag

SEQ ID NO: 2506643 - RNA, 16 nt, Human
gccugggcagaaggaa

SEQ ID NO: 2506644 - RNA, 22 nt, Human
gccuggcccacagcaggugcug

SEQ ID NO: 2506645 - RNA, 21 nt, Human
gccuggcccacagcaggugcu

SEQ ID NO: 2506646 - RNA, 23 nt, Human
gccuggggcuccuuucuccagcc

SEQ ID NO: 2506647 - RNA, 18 nt, Human
gccugggcagaaggaaga

SEQ ID NO: 2506648 - RNA, 17 nt, Human
gccuggggcuggccucc

SEQ ID NO: 2506649 - RNA, 22 nt, Human
gccugggggcagggagaggagu

SEQ ID NO: 2506650 - RNA, 14 nt, Human
gccuggggcuggcc

SEQ ID NO: 2506651 - RNA, 20 nt, Human
gccugggggcugggcagagg

SEQ ID NO: 2506652 - RNA, 21 nt, Human
gccugggggcugggcagagga

SEQ ID NO: 2506653 - RNA, 19 nt, Human
gccuguagucccagccacu

SEQ ID NO: 2506654 - RNA, 19 nt, Human
gccuguagcccacucugcu

SEQ ID NO: 2506655 - RNA, 22 nt, Human
gccuguagcccacucugcucgc

SEQ ID NO: 2506656 - RNA, 14 nt, Human
gccuguagcaguga

SEQ ID NO: 2506657 - RNA, 13 nt, Human
gccuguagcccac

SEQ ID NO: 2506658 - RNA, 14 nt, Human
gccuguaguuagga

SEQ ID NO: 2506659 - RNA, 16 nt, Human
gccuguaguuaggaaa

SEQ ID NO: 2506660 - RNA, 17 nt, Human
gccuguaguuaggaaau

SEQ ID NO: 2506661 - RNA, 18 nt, Human
gccuguaguuaggaaaua

SEQ ID NO: 2506662 - RNA, 19 nt, Human
gccuguaguuaggaaauaa

SEQ ID NO: 2506663 - RNA, 22 nt, Human
gccuguaguuaggaaauaaaac

SEQ ID NO: 2506664 - RNA, 23 nt, Human
gccuguaguuaggaaauaaaacc

SEQ ID NO: 2506665 - RNA, 18 nt, Human
gccuggguggggcugcuc

SEQ ID NO: 2506666 - RNA, 19 nt, Human
gccuggguggggcugcucc

SEQ ID NO: 2506667 - RNA, 20 nt, Human
gccuggguggggcugcuccu

SEQ ID NO: 2506668 - RNA, 15 nt, Human
gccugggugcuggcu

SEQ ID NO: 2506669 - RNA, 17 nt, Human
gccugggugcuggcugc

SEQ ID NO: 2506670 - RNA, 20 nt, Human
gccugggugcuggcugccca

SEQ ID NO: 2506671 - RNA, 21 nt, Human
gccugggugcuggcugcccag

SEQ ID NO: 2506672 - RNA, 15 nt, Human
gccuggguggacaug

SEQ ID NO: 2506673 - RNA, 15 nt, Human
gccuggguggggcug

SEQ ID NO: 2506674 - RNA, 16 nt, Human
gccuggguggggcugc

SEQ ID NO: 2506675 - RNA, 14 nt, Human
gccugggucugugu

SEQ ID NO: 2506676 - RNA, 16 nt, Human
gccugggucugugucu

SEQ ID NO: 2506677 - RNA, 19 nt, Human
gccugggucugugucucuu

SEQ ID NO: 2506678 - RNA, 23 nt, Human
gccugggucugugucucuuuucu

SEQ ID NO: 2506679 - RNA, 23 nt, Human
gccugggugacaaagugagacuc

SEQ ID NO: 2506680 - RNA, 23 nt, Human
gccugggugacagagugagacuc

SEQ ID NO: 2506681 - RNA, 13 nt, Human
gccugggugacag

SEQ ID NO: 2506682 - RNA, 12 nt, Human
gccugggugcug

SEQ ID NO: 2506683 - RNA, 14 nt, Human
gccugggugcuggc

SEQ ID NO: 2506684 - RNA, 20 nt, Human
gccugggugacagagcaaga

SEQ ID NO: 2506685 - RNA, 20 nt, Human
gccugggugacagagugaga

SEQ ID NO: 2506686 - RNA, 20 nt, Human
gccuggccagacacaggccc

SEQ ID NO: 2506687 - RNA, 21 nt, Human
gccuggccagacacaggcccu

SEQ ID NO: 2506688 - RNA, 23 nt, Human
gccuggccagcagguccccagcu

SEQ ID NO: 2506689 - RNA, 15 nt, Human
gccuggccagaugca

SEQ ID NO: 2506690 - RNA, 14 nt, Human
gccuggccagaugc

SEQ ID NO: 2506691 - RNA, 15 nt, Human
gccugggcagaagga

SEQ ID NO: 2506692 - RNA, 17 nt, Human
gccuggccagggccugg

SEQ ID NO: 2506693 - RNA, 23 nt, Human
gccuggccaggcagaucugugcc

SEQ ID NO: 2506694 - RNA, 15 nt, Human
gccuggccaggcaga

SEQ ID NO: 2506695 - RNA, 17 nt, Human
gccuggccaggcagauc

SEQ ID NO: 2506696 - RNA, 16 nt, Human
gccuggccagccuaca

SEQ ID NO: 2506697 - RNA, 21 nt, Human
gccuggccagccuacaauggg

SEQ ID NO: 2506698 - RNA, 14 nt, Human
gccuggccaggagc

SEQ ID NO: 2506699 - RNA, 15 nt, Human
gccuggccaggagcu

SEQ ID NO: 2506700 - RNA, 12 nt, Human
gccuggccaggc

SEQ ID NO: 2506701 - RNA, 19 nt, Human
gccuggccaggagcucuuc

SEQ ID NO: 2506702 - RNA, 15 nt, Human
gccuggccaggcacc

SEQ ID NO: 2506703 - RNA, 13 nt, Human
gccuggccaggca

SEQ ID NO: 2506704 - RNA, 14 nt, Human
gccuggccaggcag

SEQ ID NO: 2506705 - RNA, 14 nt, Human
gccuggauggggcu

SEQ ID NO: 2506706 - RNA, 24 nt, Human
gccuggaguguaugacugcacaug

SEQ ID NO: 2506707 - RNA, 22 nt, Human
gccuggaggccgggugcucagg

SEQ ID NO: 2506708 - RNA, 15 nt, Human
gccuggauggggcug

SEQ ID NO: 2506709 - RNA, 12 nt, Human
gccuggaucucc

SEQ ID NO: 2506710 - RNA, 21 nt, Human
gccuggauauuauucuuguag

SEQ ID NO: 2506711 - RNA, 20 nt, Human
gccuggaugcggauggccgg

SEQ ID NO: 2506712 - RNA, 14 nt, Human
gccuggcaggcugu

SEQ ID NO: 2506713 - RNA, 13 nt, Human
gccuggccagaca

SEQ ID NO: 2506714 - RNA, 14 nt, Human
gccuggccagacac

SEQ ID NO: 2506715 - RNA, 16 nt, Human
gccuggccagacacag

SEQ ID NO: 2506716 - RNA, 17 nt, Human
gccuggccagacacagg

SEQ ID NO: 2506717 - RNA, 13 nt, Human
gccuggccacgcc

SEQ ID NO: 2506718 - RNA, 19 nt, Human
gccuggccaccucucuccu

SEQ ID NO: 2506719 - RNA, 18 nt, Human
gccuggccaccucucucc

SEQ ID NO: 2506720 - RNA, 17 nt, Human
gccuggccaccucucuc

SEQ ID NO: 2506721 - RNA, 16 nt, Human
gccuggccaccucucu

SEQ ID NO: 2506722 - RNA, 15 nt, Human
gccuggccaaaggga

SEQ ID NO: 2506723 - RNA, 14 nt, Human
gccuggccaccucu

SEQ ID NO: 2506724 - RNA, 14 nt, Human
gcccucuccgagcu

SEQ ID NO: 2506725 - RNA, 16 nt, Human
gcccucucugcucugc

SEQ ID NO: 2506726 - RNA, 12 nt, Human
gcccucugccca

SEQ ID NO: 2506727 - RNA, 16 nt, Human
gcccugagcuuucugc

SEQ ID NO: 2506728 - RNA, 19 nt, Human
gcccuccuuguccacccac

SEQ ID NO: 2506729 - RNA, 16 nt, Human
gcccucgcccccgccc

SEQ ID NO: 2506730 - RNA, 17 nt, Human
gcccuccuuguccaccc

SEQ ID NO: 2506731 - RNA, 14 nt, Human
gcccucgcugccag

SEQ ID NO: 2506732 - RNA, 15 nt, Human
gcccucgcugccagc

SEQ ID NO: 2506733 - RNA, 16 nt, Human
gcccucgcugcuucug

SEQ ID NO: 2506734 - RNA, 15 nt, Human
gcccucgcugcuucu

SEQ ID NO: 2506735 - RNA, 17 nt, Human
gcccucgcugccagcuc

SEQ ID NO: 2506736 - RNA, 18 nt, Human
gcccggcuccaggcuccu

SEQ ID NO: 2506737 - RNA, 17 nt, Human
gcccggcuccaggcucc

SEQ ID NO: 2506738 - RNA, 17 nt, Human
gcccucuagggagggac

SEQ ID NO: 2506739 - RNA, 18 nt, Human
gcccucguggccagcccg

SEQ ID NO: 2506740 - RNA, 17 nt, Human
gcccucguggccagccc

SEQ ID NO: 2506741 - RNA, 16 nt, Human
gcccucguggccagcc

SEQ ID NO: 2506742 - RNA, 15 nt, Human
gcccucguggccagc

SEQ ID NO: 2506743 - RNA, 20 nt, Human
gcccucguggccagcccggc

SEQ ID NO: 2506744 - RNA, 19 nt, Human
gcccucguggccagcccgg

SEQ ID NO: 2506745 - RNA, 13 nt, Human
gcccucuaccccu

SEQ ID NO: 2506746 - RNA, 18 nt, Human
gcccucgggcccagcccc

SEQ ID NO: 2506747 - RNA, 17 nt, Human
gcccucgggcccagccc

SEQ ID NO: 2506748 - RNA, 16 nt, Human
gcccucgggcccagcc

SEQ ID NO: 2506749 - RNA, 15 nt, Human
gcccucgggcccagc

SEQ ID NO: 2506750 - RNA, 22 nt, Human
gcccucgggcccagcccccaca

SEQ ID NO: 2506751 - RNA, 20 nt, Human
gcccucgggcccagccccca

SEQ ID NO: 2506752 - RNA, 14 nt, Human
gcccucguggccag

SEQ ID NO: 2506753 - RNA, 18 nt, Human
gcccucgggcgagucacu

SEQ ID NO: 2506754 - RNA, 22 nt, Human
gcccugcacuguccugcuccac

SEQ ID NO: 2506755 - RNA, 21 nt, Human
gcccugcacuguccugcucca

SEQ ID NO: 2506756 - RNA, 20 nt, Human
gcccugcacuguccugcucc

SEQ ID NO: 2506757 - RNA, 19 nt, Human
gcccugcacuguccugcuc

SEQ ID NO: 2506758 - RNA, 18 nt, Human
gcccugcacuguccugcu

SEQ ID NO: 2506759 - RNA, 17 nt, Human
gcccugcacuguccugc

SEQ ID NO: 2506760 - RNA, 16 nt, Human
gcccugcacuguccug

SEQ ID NO: 2506761 - RNA, 15 nt, Human
gcccugcacuguccu

SEQ ID NO: 2506762 - RNA, 14 nt, Human
gcccugcacugucc

SEQ ID NO: 2506763 - RNA, 17 nt, Human
gcccugcaccugugcag

SEQ ID NO: 2506764 - RNA, 16 nt, Human
gcccugcaccugugca

SEQ ID NO: 2506765 - RNA, 21 nt, Human
gcccugcaaaaggacucucag

SEQ ID NO: 2506766 - RNA, 23 nt, Human
gcccugcacuguccugcuccaca

SEQ ID NO: 2506767 - RNA, 19 nt, Human
gcccugcuuugggcugccc

SEQ ID NO: 2506768 - RNA, 21 nt, Human
gcccugcuuugggcugcccug

SEQ ID NO: 2506769 - RNA, 20 nt, Human
gcccugcuuugggcugcccu

SEQ ID NO: 2506770 - RNA, 16 nt, Human
gcccugaguuccuagc

SEQ ID NO: 2506771 - RNA, 18 nt, Human
gcccugaguuccuagcca

SEQ ID NO: 2506772 - RNA, 14 nt, Human
gcccugcaaaagga

SEQ ID NO: 2506773 - RNA, 18 nt, Human
gcccugcaaaaggacucu

SEQ ID NO: 2506774 - RNA, 14 nt, Human
gcccugauuugcug

SEQ ID NO: 2506775 - RNA, 23 nt, Human
gcccugaguggaucuccaaggac

SEQ ID NO: 2506776 - RNA, 22 nt, Human
gcccugaguggaucuccaagga

SEQ ID NO: 2506777 - RNA, 21 nt, Human
gcccugaguggaucuccaagg

SEQ ID NO: 2506778 - RNA, 22 nt, Human
gcccugaguaaucgcuuaaaga

SEQ ID NO: 2506779 - RNA, 24 nt, Human
gcccugaggugugggggcugcagc

SEQ ID NO: 2506780 - RNA, 23 nt, Human
gcccugaggugugggggcugcag

SEQ ID NO: 2506781 - RNA, 22 nt, Human
gcccugaggugugggggcugca

SEQ ID NO: 2506782 - RNA, 21 nt, Human
gcccugaggugugggggcugc

SEQ ID NO: 2506783 - RNA, 15 nt, Human
gcccugagguguggg

SEQ ID NO: 2506784 - RNA, 14 nt, Human
gcccugaggugugg

SEQ ID NO: 2506785 - RNA, 13 nt, Human
gcccugaggugug

SEQ ID NO: 2506786 - RNA, 21 nt, Human
gcccugaggugaaagggagcu

SEQ ID NO: 2506787 - RNA, 22 nt, Human
gcccugaggugaaagggagcua

SEQ ID NO: 2506788 - RNA, 22 nt, Human
gcccuggacugugugcucagga

SEQ ID NO: 2506789 - RNA, 16 nt, Human
gcccuggacugugugc

SEQ ID NO: 2506790 - RNA, 12 nt, Human
gcccuggacugu

SEQ ID NO: 2506791 - RNA, 23 nt, Human
gcccugcuuugggcugcccuggu

SEQ ID NO: 2506792 - RNA, 22 nt, Human
gcccugcuuugggcugcccugg

SEQ ID NO: 2506793 - RNA, 23 nt, Human
gcccuggagccaacugcugcuuu

SEQ ID NO: 2506794 - RNA, 20 nt, Human
gcccuggagccaacugcugc

SEQ ID NO: 2506795 - RNA, 19 nt, Human
gcccuggagccaacugcug

SEQ ID NO: 2506796 - RNA, 20 nt, Human
gcccuggaagccggcggccc

SEQ ID NO: 2506797 - RNA, 18 nt, Human
gcccuggagccaacugcu

SEQ ID NO: 2506798 - RNA, 20 nt, Human
gcccuggaggugccagcaaa

SEQ ID NO: 2506799 - RNA, 18 nt, Human
gcccuggaggugccagca

SEQ ID NO: 2506800 - RNA, 17 nt, Human
gcccuggaggugccagc

SEQ ID NO: 2506801 - RNA, 21 nt, Human
gcccuggagccaacugcugcu

SEQ ID NO: 2506802 - RNA, 23 nt, Human
gcccuggaggugccagcaaagcc

SEQ ID NO: 2506803 - RNA, 22 nt, Human
gcccuggaggugccagcaaagc

SEQ ID NO: 2506804 - RNA, 24 nt, Human
gcccuggaggugccagcaaagccc

SEQ ID NO: 2506805 - RNA, 13 nt, Human
gcccuggaggugg

SEQ ID NO: 2506806 - RNA, 19 nt, Human
gcccuggagucaugccaag

SEQ ID NO: 2506807 - RNA, 15 nt, Human
gcccuggagucaugc

SEQ ID NO: 2506808 - RNA, 20 nt, Human
gcccuggagucaugccaagc

SEQ ID NO: 2506809 - RNA, 14 nt, Human
gcccuggagguggc

SEQ ID NO: 2506810 - RNA, 15 nt, Human
gcccuggagguggcu

SEQ ID NO: 2506811 - RNA, 18 nt, Human
gcccuggagguggcugag

SEQ ID NO: 2506812 - RNA, 20 nt, Human
gcccuggagguggcugagcc

SEQ ID NO: 2506813 - RNA, 18 nt, Human
gcccuggauuucagaaag

SEQ ID NO: 2506814 - RNA, 19 nt, Human
gcccgcccacuguccuggg

SEQ ID NO: 2506815 - RNA, 18 nt, Human
gcccgcccacuguccugg

SEQ ID NO: 2506816 - RNA, 17 nt, Human
gcccgcccacuguccug

SEQ ID NO: 2506817 - RNA, 15 nt, Human
gcccgcccacugucc

SEQ ID NO: 2506818 - RNA, 14 nt, Human
gcccgcccacuguc

SEQ ID NO: 2506819 - RNA, 13 nt, Human
gcccgcccacugu

SEQ ID NO: 2506820 - RNA, 21 nt, Human
gcccgccaagguagccauccc

SEQ ID NO: 2506821 - RNA, 19 nt, Human
gcccgcaugcggcccagga

SEQ ID NO: 2506822 - RNA, 17 nt, Human
gcccgcaugcggcccag

SEQ ID NO: 2506823 - RNA, 13 nt, Human
gcccgagcuggug

SEQ ID NO: 2506824 - RNA, 14 nt, Human
gcccgagcuggugc

SEQ ID NO: 2506825 - RNA, 18 nt, Human
gcccgacuugcuguuuug

SEQ ID NO: 2506826 - RNA, 13 nt, Human
gcccgacuugcug

SEQ ID NO: 2506827 - RNA, 23 nt, Human
gcccgacuugcuguuuuguucug

SEQ ID NO: 2506828 - RNA, 12 nt, Human
gcccgagcuggu

SEQ ID NO: 2506829 - RNA, 19 nt, Human
gcccgacagccuggcacag

SEQ ID NO: 2506830 - RNA, 17 nt, Human
gcccgacagccuggcac

SEQ ID NO: 2506831 - RNA, 16 nt, Human
gcccgacagccuggca

SEQ ID NO: 2506832 - RNA, 12 nt, Human
gccccuuccccc

SEQ ID NO: 2506833 - RNA, 22 nt, Human
gccccuuagcccccacccacuu

SEQ ID NO: 2506834 - RNA, 17 nt, Human
gccccuuagcccccacc

SEQ ID NO: 2506835 - RNA, 20 nt, Human
gccccugcauccccuuggcu

SEQ ID NO: 2506836 - RNA, 14 nt, Human
gccccugcaucccc

SEQ ID NO: 2506837 - RNA, 23 nt, Human
gccccugcauccccuuggcugug

SEQ ID NO: 2506838 - RNA, 16 nt, Human
gccccuuccccauggg

SEQ ID NO: 2506839 - RNA, 15 nt, Human
gccccuuccccaugg

SEQ ID NO: 2506840 - RNA, 15 nt, Human
gccccuucccaucuc

SEQ ID NO: 2506841 - RNA, 19 nt, Human
gccccuucccacucacccc

SEQ ID NO: 2506842 - RNA, 20 nt, Human
gccccuucacuucugaccac

SEQ ID NO: 2506843 - RNA, 21 nt, Human
gccccuucacuucugaccaca

SEQ ID NO: 2506844 - RNA, 23 nt, Human
gccccuucacuucugaccacacu

SEQ ID NO: 2506845 - RNA, 20 nt, Human
gcccggcgcccucuguccug

SEQ ID NO: 2506846 - RNA, 17 nt, Human
gcccggcgcccucuguc

SEQ ID NO: 2506847 - RNA, 15 nt, Human
gcccggcgcccucug

SEQ ID NO: 2506848 - RNA, 14 nt, Human
gcccggcgcccucu

SEQ ID NO: 2506849 - RNA, 17 nt, Human
gcccggcgccccugcca

SEQ ID NO: 2506850 - RNA, 22 nt, Human
gcccggccugcucccagcagcc

SEQ ID NO: 2506851 - RNA, 18 nt, Human
gcccggccugcucccagc

SEQ ID NO: 2506852 - RNA, 15 nt, Human
gcccggccugcuccc

SEQ ID NO: 2506853 - RNA, 14 nt, Human
gcccggccugcucc

SEQ ID NO: 2506854 - RNA, 12 nt, Human
gcccggccagcc

SEQ ID NO: 2506855 - RNA, 18 nt, Human
gcccggccagccaugucu

SEQ ID NO: 2506856 - RNA, 16 nt, Human
gcccggcuccaggcuc

SEQ ID NO: 2506857 - RNA, 18 nt, Human
gcccggcuaauuuuugua

SEQ ID NO: 2506858 - RNA, 18 nt, Human
gcccggcgcccucugucc

SEQ ID NO: 2506859 - RNA, 21 nt, Human
gcccggcgcgguggcucacgc

SEQ ID NO: 2506860 - RNA, 14 nt, Human
gcccggaugcuucu

SEQ ID NO: 2506861 - RNA, 14 nt, Human
gcccgccuggcaga

SEQ ID NO: 2506862 - RNA, 18 nt, Human
gcccgccuggcagaacug

SEQ ID NO: 2506863 - RNA, 17 nt, Human
gcccggauucugggagg

SEQ ID NO: 2506864 - RNA, 15 nt, Human
gcccggauucuggga

SEQ ID NO: 2506865 - RNA, 16 nt, Human
gcccggauucugggag

SEQ ID NO: 2506866 - RNA, 16 nt, Human
gcccgccugccagucc

SEQ ID NO: 2506867 - RNA, 15 nt, Human
gcccgccugccaguc

SEQ ID NO: 2506868 - RNA, 14 nt, Human
gcccgccugccagu

SEQ ID NO: 2506869 - RNA, 13 nt, Human
gcccgccugccag

SEQ ID NO: 2506870 - RNA, 12 nt, Human
gcccgccugcca

SEQ ID NO: 2506871 - RNA, 20 nt, Human
gcccgcccacuguccugggc

SEQ ID NO: 2506872 - RNA, 22 nt, Human
gcccgcccacuguccugggcgc

SEQ ID NO: 2506873 - RNA, 23 nt, Human
gcccgccugccaguccuagcugc

SEQ ID NO: 2506874 - RNA, 18 nt, Human
gcccgccugccaguccua

SEQ ID NO: 2506875 - RNA, 17 nt, Human
gcccgccugccaguccu

SEQ ID NO: 2506876 - RNA, 22 nt, Human
gcccgccugccaguccuagcug

SEQ ID NO: 2506877 - RNA, 13 nt, Human
gcccgccuggcag

SEQ ID NO: 2506878 - RNA, 18 nt, Human
gccccucugcccagcuug

SEQ ID NO: 2506879 - RNA, 16 nt, Human
gccccucugcccagcu

SEQ ID NO: 2506880 - RNA, 15 nt, Human
gccccucugcccagc

SEQ ID NO: 2506881 - RNA, 14 nt, Human
gccccucugcccag

SEQ ID NO: 2506882 - RNA, 21 nt, Human
gccccuguucuggcagaguug

SEQ ID NO: 2506883 - RNA, 15 nt, Human
gccccugccacccug

SEQ ID NO: 2506884 - RNA, 14 nt, Human
gccccugccacccu

SEQ ID NO: 2506885 - RNA, 21 nt, Human
gccccucucccgccagacugu

SEQ ID NO: 2506886 - RNA, 23 nt, Human
gccccuccucugccaccuccccu

SEQ ID NO: 2506887 - RNA, 22 nt, Human
gccccuccucugccaccucccc

SEQ ID NO: 2506888 - RNA, 13 nt, Human
gccccugccaccc

SEQ ID NO: 2506889 - RNA, 12 nt, Human
gccccucugccc

SEQ ID NO: 2506890 - RNA, 11 nt, Human
gccccucugcc

SEQ ID NO: 2506891 - RNA, 19 nt, Human
gccccuccucucugcccua

SEQ ID NO: 2506892 - RNA, 18 nt, Human
gcagacucaguuugucag

SEQ ID NO: 2506893 - RNA, 12 nt, Human
gccccuccucug

SEQ ID NO: 2506894 - RNA, 13 nt, Human
gccccuccucugc

SEQ ID NO: 2506895 - RNA, 14 nt, Human
gccccuccucugcc

SEQ ID NO: 2506896 - RNA, 15 nt, Human
gccccuccucugcca

SEQ ID NO: 2506897 - RNA, 16 nt, Human
gccccuccucugccac

SEQ ID NO: 2506898 - RNA, 17 nt, Human
gccccuccucugccacc

SEQ ID NO: 2506899 - RNA, 18 nt, Human
gccccuccucugccaccu

SEQ ID NO: 2506900 - RNA, 20 nt, Human
gccccuccucugccaccucc

SEQ ID NO: 2506901 - RNA, 21 nt, Human
gccccuccucugccaccuccc

SEQ ID NO: 2506902 - RNA, 18 nt, Human
gccccuccucucugcccu

SEQ ID NO: 2506903 - RNA, 15 nt, Human
gccccucccuucaac

SEQ ID NO: 2506904 - RNA, 14 nt, Human
gccccucccuucaa

SEQ ID NO: 2506905 - RNA, 12 nt, Human
gccccucccuuc

SEQ ID NO: 2506906 - RNA, 15 nt, Human
gcagacucuacagag

SEQ ID NO: 2506907 - RNA, 17 nt, Human
gcagacucaguuuguca

SEQ ID NO: 2506908 - RNA, 13 nt, Human
gcagacucacugu

SEQ ID NO: 2506909 - RNA, 20 nt, Human
gcagacucaauaaaaucaug

SEQ ID NO: 2506910 - RNA, 20 nt, Human
gcagaccuguccuccuggug

SEQ ID NO: 2506911 - RNA, 19 nt, Human
gcagaccuguccuccuggu

SEQ ID NO: 2506912 - RNA, 16 nt, Human
gcagaccuguccuccu

SEQ ID NO: 2506913 - RNA, 14 nt, Human
gcagaccuguccuc

SEQ ID NO: 2506914 - RNA, 23 nt, Human
gcagaccuccccagccccuagcc

SEQ ID NO: 2506915 - RNA, 22 nt, Human
gcagaccuccccagccccuagc

SEQ ID NO: 2506916 - RNA, 17 nt, Human
gcagacaggaggaauca

SEQ ID NO: 2506917 - RNA, 15 nt, Human
gcagacuaugcaaac

SEQ ID NO: 2506918 - RNA, 21 nt, Human
gcagacuagaauucuagugcu

SEQ ID NO: 2506919 - RNA, 14 nt, Human
gcagacgccgggga

SEQ ID NO: 2506920 - RNA, 14 nt, Human
gcccuuuuuaagga

SEQ ID NO: 2506921 - RNA, 21 nt, Human
gcccuuugggaggcugaggcg

SEQ ID NO: 2506922 - RNA, 16 nt, Human
gccgagaucacgccac

SEQ ID NO: 2506923 - RNA, 13 nt, Human
gcccuuucugugu

SEQ ID NO: 2506924 - RNA, 18 nt, Human
gcccuuugagugcagucc

SEQ ID NO: 2506925 - RNA, 12 nt, Human
gcccuuucugug

SEQ ID NO: 2506926 - RNA, 17 nt, Human
gcccuuugggaggcuga

SEQ ID NO: 2506927 - RNA, 14 nt, Human
gcccuuuccucagg

SEQ ID NO: 2506928 - RNA, 13 nt, Human
gcccuuuccucag

SEQ ID NO: 2506929 - RNA, 19 nt, Human
gccgagaucacgccacugc

SEQ ID NO: 2506930 - RNA, 18 nt, Human
gccgagaucacgccacug

SEQ ID NO: 2506931 - RNA, 18 nt, Human
gccgagauugcaccacug

SEQ ID NO: 2506932 - RNA, 17 nt, Human
gccgagauugcaccacu

SEQ ID NO: 2506933 - RNA, 22 nt, Human
gcccuucucuccagccccugga

SEQ ID NO: 2506934 - RNA, 21 nt, Human
gcccuucucuccagccccugg

SEQ ID NO: 2506935 - RNA, 20 nt, Human
gcccuuccucuccacugccu

SEQ ID NO: 2506936 - RNA, 19 nt, Human
gcccuuccucuccacugcc

SEQ ID NO: 2506937 - RNA, 18 nt, Human
gcccuuccucuccacugc

SEQ ID NO: 2506938 - RNA, 16 nt, Human
gcccuuccucuccacu

SEQ ID NO: 2506939 - RNA, 17 nt, Human
gcccuuccucuccacug

SEQ ID NO: 2506940 - RNA, 19 nt, Human
gcccuucucuccagccccu

SEQ ID NO: 2506941 - RNA, 21 nt, Human
gcccuuccucuccacugccuu

SEQ ID NO: 2506942 - RNA, 18 nt, Human
gcccugguggagaaagca

SEQ ID NO: 2506943 - RNA, 14 nt, Human
gcccugguggagaa

SEQ ID NO: 2506944 - RNA, 13 nt, Human
gcccugguggaga

SEQ ID NO: 2506945 - RNA, 17 nt, Human
gcccuggucucagcagc

SEQ ID NO: 2506946 - RNA, 21 nt, Human
gcccugguggagaaagcacug

SEQ ID NO: 2506947 - RNA, 18 nt, Human
gcccugguguuucuagca

SEQ ID NO: 2506948 - RNA, 14 nt, Human
gcccugguuuccug

SEQ ID NO: 2506949 - RNA, 15 nt, Human
gcccugguuuccugc

SEQ ID NO: 2506950 - RNA, 16 nt, Human
gcccugguuucacugg

SEQ ID NO: 2506951 - RNA, 18 nt, Human
gcccugguuucacuggcc

SEQ ID NO: 2506952 - RNA, 20 nt, Human
gcccugguuucacuggccca

SEQ ID NO: 2506953 - RNA, 22 nt, Human
gcccugguuucacuggcccaag

SEQ ID NO: 2506954 - RNA, 17 nt, Human
gcccugguuuccugccc

SEQ ID NO: 2506955 - RNA, 18 nt, Human
gcccugguuuccugcccu

SEQ ID NO: 2506956 - RNA, 19 nt, Human
gcccugguuuccugcccug

SEQ ID NO: 2506957 - RNA, 20 nt, Human
gcccugguuuccugcccugg

SEQ ID NO: 2506958 - RNA, 21 nt, Human
gcccugguuuccugcccuggg

SEQ ID NO: 2506959 - RNA, 23 nt, Human
gcccugguuuccugcccugggag

SEQ ID NO: 2506960 - RNA, 14 nt, Human
gcccugucagugca

SEQ ID NO: 2506961 - RNA, 23 nt, Human
gcccugguggcagugggagcugc

SEQ ID NO: 2506962 - RNA, 22 nt, Human
gcccugguggcagugggagcug

SEQ ID NO: 2506963 - RNA, 21 nt, Human
gcccugguggcagugggagcu

SEQ ID NO: 2506964 - RNA, 20 nt, Human
gcccugguggcagugggagc

SEQ ID NO: 2506965 - RNA, 19 nt, Human
gcccugguggcagugggag

SEQ ID NO: 2506966 - RNA, 18 nt, Human
gcccugguggcaguggga

SEQ ID NO: 2506967 - RNA, 17 nt, Human
gcccugguggcaguggg

SEQ ID NO: 2506968 - RNA, 14 nt, Human
gcccugguggcagu

SEQ ID NO: 2506969 - RNA, 21 nt, Human
gcccuggugcugccacacuuc

SEQ ID NO: 2506970 - RNA, 17 nt, Human
gcccuggugcugccaca

SEQ ID NO: 2506971 - RNA, 16 nt, Human
gcccuggugcugccac

SEQ ID NO: 2506972 - RNA, 15 nt, Human
gcccuggugcugcca

SEQ ID NO: 2506973 - RNA, 16 nt, Human
gcccugguccagggaa

SEQ ID NO: 2506974 - RNA, 17 nt, Human
gcccugguccagggaag

SEQ ID NO: 2506975 - RNA, 18 nt, Human
gcccugguccagggaagc

SEQ ID NO: 2506976 - RNA, 20 nt, Human
gcccugguccagggaagcug

SEQ ID NO: 2506977 - RNA, 23 nt, Human
gcccugguccagggaagcuggcc

SEQ ID NO: 2506978 - RNA, 15 nt, Human
gcccugguccuucca

SEQ ID NO: 2506979 - RNA, 16 nt, Human
gcccuggucucagcag

SEQ ID NO: 2506980 - RNA, 14 nt, Human
gcccuggucucagc

SEQ ID NO: 2506981 - RNA, 18 nt, Human
gcccugguccuuccaggc

SEQ ID NO: 2506982 - RNA, 14 nt, Human
gcccugggcuggaa

SEQ ID NO: 2506983 - RNA, 13 nt, Human
gcccugggcugga

SEQ ID NO: 2506984 - RNA, 12 nt, Human
gcccugggcugg

SEQ ID NO: 2506985 - RNA, 11 nt, Human
gcccugggcug

SEQ ID NO: 2506986 - RNA, 18 nt, Human
gcccugggcuggaaucag

SEQ ID NO: 2506987 - RNA, 16 nt, Human
gcccugggcuggaauc

SEQ ID NO: 2506988 - RNA, 23 nt, Human
gcccugggcucggaggcugcccc

SEQ ID NO: 2506989 - RNA, 16 nt, Human
gcccugguagggcagu

SEQ ID NO: 2506990 - RNA, 21 nt, Human
gcccugggucuaagggguugg

SEQ ID NO: 2506991 - RNA, 13 nt, Human
gcccugguccagg

SEQ ID NO: 2506992 - RNA, 14 nt, Human
gcccugguccaggg

SEQ ID NO: 2506993 - RNA, 21 nt, Human
gcccugggaggcucuggagcc

SEQ ID NO: 2506994 - RNA, 19 nt, Human
gcccugggaggcucuggag

SEQ ID NO: 2506995 - RNA, 18 nt, Human
gcccugggaggcucugga

SEQ ID NO: 2506996 - RNA, 17 nt, Human
gcccugggaggcucugg

SEQ ID NO: 2506997 - RNA, 21 nt, Human
gcccugggcucggaggcugcc

SEQ ID NO: 2506998 - RNA, 19 nt, Human
gcccugggcucggaggcug

SEQ ID NO: 2506999 - RNA, 17 nt, Human
gcccugggcucggaggc

SEQ ID NO: 2507000 - RNA, 16 nt, Human
gcccugggcucggagg

SEQ ID NO: 2507001 - RNA, 15 nt, Human
gcccugggcucggag

SEQ ID NO: 2507002 - RNA, 20 nt, Human
gcccugggccccaccaccua

SEQ ID NO: 2507003 - RNA, 22 nt, Human
gcccugggccccaccaccuagg

SEQ ID NO: 2507004 - RNA, 17 nt, Human
gcccugggccacacuga

SEQ ID NO: 2507005 - RNA, 15 nt, Human
gcccugggccccacc

SEQ ID NO: 2507006 - RNA, 18 nt, Human
gcccugggccccaccacc

SEQ ID NO: 2507007 - RNA, 19 nt, Human
gcccugggccccaccaccu

SEQ ID NO: 2507008 - RNA, 23 nt, Human
gcccugggaggcucuggagccca

SEQ ID NO: 2507009 - RNA, 16 nt, Human
gcccugggaggcagug

SEQ ID NO: 2507010 - RNA, 17 nt, Human
gcccugggaucacugug

SEQ ID NO: 2507011 - RNA, 16 nt, Human
gcccugggaggcucug

SEQ ID NO: 2507012 - RNA, 15 nt, Human
gcccugggaggcucu

SEQ ID NO: 2507013 - RNA, 14 nt, Human
gcccugggaggcuc

SEQ ID NO: 2507014 - RNA, 13 nt, Human
gcccugggaggcu

SEQ ID NO: 2507015 - RNA, 16 nt, Human
gcccuggcugcugccc

SEQ ID NO: 2507016 - RNA, 15 nt, Human
gcccuggcugcugcc

SEQ ID NO: 2507017 - RNA, 14 nt, Human
gcccuggcugcugc

SEQ ID NO: 2507018 - RNA, 12 nt, Human
gcccuggcugcu

SEQ ID NO: 2507019 - RNA, 11 nt, Human
gcccuggcugc

SEQ ID NO: 2507020 - RNA, 12 nt, Human
gcccuggcugac

SEQ ID NO: 2507021 - RNA, 21 nt, Human
gcccuggcugaaggacuguga

SEQ ID NO: 2507022 - RNA, 20 nt, Human
gcccuggcugaaggacugug

SEQ ID NO: 2507023 - RNA, 19 nt, Human
gcccuggcugaaggacugu

SEQ ID NO: 2507024 - RNA, 18 nt, Human
gcccuggcugaaggacug

SEQ ID NO: 2507025 - RNA, 17 nt, Human
gcccuggcugaaggacu

SEQ ID NO: 2507026 - RNA, 16 nt, Human
gcccuggcugaaggac

SEQ ID NO: 2507027 - RNA, 15 nt, Human
gcccuggcugaagga

SEQ ID NO: 2507028 - RNA, 14 nt, Human
gcccuggcugaagg

SEQ ID NO: 2507029 - RNA, 13 nt, Human
gcccuggcugaag

SEQ ID NO: 2507030 - RNA, 22 nt, Human
gcccuggcugcugcccccaccc

SEQ ID NO: 2507031 - RNA, 19 nt, Human
gcccuggcugcugccccca

SEQ ID NO: 2507032 - RNA, 17 nt, Human
gcccuggcugcugcccc

SEQ ID NO: 2507033 - RNA, 11 nt, Human
gcccugggagg

SEQ ID NO: 2507034 - RNA, 14 nt, Human
gcccugggaggcag

SEQ ID NO: 2507035 - RNA, 17 nt, Human
gcccuggccuccccugc

SEQ ID NO: 2507036 - RNA, 16 nt, Human
gcccuggccuccccug

SEQ ID NO: 2507037 - RNA, 14 nt, Human
gcccuggccucccc

SEQ ID NO: 2507038 - RNA, 12 nt, Human
gcccuggccucc

SEQ ID NO: 2507039 - RNA, 17 nt, Human
gcccuggcccugaggug

SEQ ID NO: 2507040 - RNA, 13 nt, Human
gcccuggcccuga

SEQ ID NO: 2507041 - RNA, 12 nt, Human
gcccuggcccug

SEQ ID NO: 2507042 - RNA, 16 nt, Human
gcccuggccagaggcu

SEQ ID NO: 2507043 - RNA, 13 nt, Human
gcccuggccagag

SEQ ID NO: 2507044 - RNA, 14 nt, Human
gcccuggccagagg

SEQ ID NO: 2507045 - RNA, 15 nt, Human
gcccuggccagaggc

SEQ ID NO: 2507046 - RNA, 19 nt, Human
gcccuggcaggaugacccu

SEQ ID NO: 2507047 - RNA, 12 nt, Human
gcccuggcagga

SEQ ID NO: 2507048 - RNA, 10 nt, Human
gcccuggcug

SEQ ID NO: 2507049 - RNA, 12 nt, Human
gcccuggcucug

SEQ ID NO: 2507050 - RNA, 14 nt, Human
gcccuggcucugca

SEQ ID NO: 2507051 - RNA, 20 nt, Human
gcccuggcucccacaggccc

SEQ ID NO: 2507052 - RNA, 19 nt, Human
gcccuggcucccacaggcc

SEQ ID NO: 2507053 - RNA, 15 nt, Human
gcccuggcucccaca

SEQ ID NO: 2507054 - RNA, 24 nt, Human
gcccuggccuccccugccaccagg

SEQ ID NO: 2507055 - RNA, 21 nt, Human
gcccuggccuccccugccacc

SEQ ID NO: 2507056 - RNA, 20 nt, Human
gcccuggccuccccugccac

SEQ ID NO: 2507057 - RNA, 19 nt, Human
gcccuggccuccccugcca

SEQ ID NO: 2507058 - RNA, 18 nt, Human
gcccuggcccugaggugu

SEQ ID NO: 2507059 - RNA, 12 nt, Human
gcccuggccugc

SEQ ID NO: 2507060 - RNA, 13 nt, Human
gcccuggccugcu

SEQ ID NO: 2507061 - RNA, 14 nt, Human
gcccuggccugcug

SEQ ID NO: 2507062 - RNA, 15 nt, Human
gcccuggccugcugg

SEQ ID NO: 2507063 - RNA, 16 nt, Human
gcccuggccugcuggg

SEQ ID NO: 2507064 - RNA, 17 nt, Human
gcccuggccugcugggc

SEQ ID NO: 2507065 - RNA, 23 nt, Human
gccugugagcuaggaauuguguu

SEQ ID NO: 2507066 - RNA, 17 nt, Human
gccugugaacugaacuc

SEQ ID NO: 2507067 - RNA, 19 nt, Human
gccugugcauguaugucuu

SEQ ID NO: 2507068 - RNA, 19 nt, Human
gccugugccacccaccagg

SEQ ID NO: 2507069 - RNA, 12 nt, Human
gccugugcagug

SEQ ID NO: 2507070 - RNA, 14 nt, Human
gccugugaggcagg

SEQ ID NO: 2507071 - RNA, 18 nt, Human
gccugugaggcaggggcg

SEQ ID NO: 2507072 - RNA, 17 nt, Human
gccugugaggugcagag

SEQ ID NO: 2507073 - RNA, 23 nt, Human
gccugugaggugcagagugccca

SEQ ID NO: 2507074 - RNA, 24 nt, Human
gccugugaggugcagagugcccag

SEQ ID NO: 2507075 - RNA, 16 nt, Human
gcgguccacccaggag

SEQ ID NO: 2507076 - RNA, 13 nt, Human
gcggggacagcuc

SEQ ID NO: 2507077 - RNA, 15 nt, Human
gcgggcuuccuccug

SEQ ID NO: 2507078 - RNA, 12 nt, Human
gcggggacagcu

SEQ ID NO: 2507079 - RNA, 19 nt, Human
gcgguccacccaggagccc

SEQ ID NO: 2507080 - RNA, 18 nt, Human
gcgguccacccaggagcc

SEQ ID NO: 2507081 - RNA, 16 nt, Human
gcgggcugggcagcug

SEQ ID NO: 2507082 - RNA, 14 nt, Human
gcgggcucaaggaa

SEQ ID NO: 2507083 - RNA, 14 nt, Human
gcgggcugggcagc

SEQ ID NO: 2507084 - RNA, 21 nt, Human
gcguagaucaccagaauaaac

SEQ ID NO: 2507085 - RNA, 16 nt, Human
gcgucaguauuuuccc

SEQ ID NO: 2507086 - RNA, 21 nt, Human
gcgucagccuccagccucugu

SEQ ID NO: 2507087 - RNA, 18 nt, Human
gcgucagccuccagccuc

SEQ ID NO: 2507088 - RNA, 17 nt, Human
gcgucagccuccagccu

SEQ ID NO: 2507089 - RNA, 16 nt, Human
gcgucagccuccagcc

SEQ ID NO: 2507090 - RNA, 15 nt, Human
gcgucagccuccagc

SEQ ID NO: 2507091 - RNA, 12 nt, Human
gcgucagccucc

SEQ ID NO: 2507092 - RNA, 21 nt, Human
gcguaugucuguuaccauguc

SEQ ID NO: 2507093 - RNA, 11 nt, Human
gcgucagccuc

SEQ ID NO: 2507094 - RNA, 13 nt, Human
gcguaugucuguu

SEQ ID NO: 2507095 - RNA, 18 nt, Human
gcgucccccugccggccg

SEQ ID NO: 2507096 - RNA, 14 nt, Human
gcgucccccugccg

SEQ ID NO: 2507097 - RNA, 19 nt, Human
gcgucccagucucuggcag

SEQ ID NO: 2507098 - RNA, 12 nt, Human
gcgucuuccuga

SEQ ID NO: 2507099 - RNA, 20 nt, Human
gcgucagccuccagccucug

SEQ ID NO: 2507100 - RNA, 18 nt, Human
gcgugagccacugcaccg

SEQ ID NO: 2507101 - RNA, 16 nt, Human
gcgugagccacugcac

SEQ ID NO: 2507102 - RNA, 14 nt, Human
gcgucuuccugagu

SEQ ID NO: 2507103 - RNA, 13 nt, Human
gcgucuuccugag

SEQ ID NO: 2507104 - RNA, 21 nt, Human
gcgucuuccugaguggugcca

SEQ ID NO: 2507105 - RNA, 11 nt, Human
gcgugaaacac

SEQ ID NO: 2507106 - RNA, 12 nt, Human
gcgugaaacaca

SEQ ID NO: 2507107 - RNA, 19 nt, Human
gcgugaaacacaccaggcu

SEQ ID NO: 2507108 - RNA, 20 nt, Human
gcgugaaacacaccaggcug

SEQ ID NO: 2507109 - RNA, 23 nt, Human
gcgugaaacacaccaggcugugg

SEQ ID NO: 2507110 - RNA, 23 nt, Human
gcgugaacccgggaggcggagcu

SEQ ID NO: 2507111 - RNA, 13 nt, Human
gcgugaaggccga

SEQ ID NO: 2507112 - RNA, 15 nt, Human
gcgugaaggccgaga

SEQ ID NO: 2507113 - RNA, 23 nt, Human
gcgugagccacugcaccgggcca

SEQ ID NO: 2507114 - RNA, 13 nt, Human
gcgugacaauaaa

SEQ ID NO: 2507115 - RNA, 16 nt, Human
gcgugaaggccgagaa

SEQ ID NO: 2507116 - RNA, 16 nt, Human
gcgugacucacccaag

SEQ ID NO: 2507117 - RNA, 13 nt, Human
gcgugacucaccc

SEQ ID NO: 2507118 - RNA, 14 nt, Human
gcgugacucaccca

SEQ ID NO: 2507119 - RNA, 18 nt, Human
gcgugaggaugggaagga

SEQ ID NO: 2507120 - RNA, 15 nt, Human
gcgugaucaaagcca

SEQ ID NO: 2507121 - RNA, 15 nt, Human
gcuaaagcccagaga

SEQ ID NO: 2507122 - RNA, 16 nt, Human
gcuaaagcccagagac

SEQ ID NO: 2507123 - RNA, 20 nt, Human
gcuaaauaaaauuuguugca

SEQ ID NO: 2507124 - RNA, 19 nt, Human
gcuaaauaaaauuuguugc

SEQ ID NO: 2507125 - RNA, 13 nt, Human
gcuaaaugugaau

SEQ ID NO: 2507126 - RNA, 21 nt, Human
gcuaaauaaaauuuguugcau

SEQ ID NO: 2507127 - RNA, 19 nt, Human
gcuaaauccuuuacuguua

SEQ ID NO: 2507128 - RNA, 19 nt, Human
gcuaaauggucgcccagga

SEQ ID NO: 2507129 - RNA, 23 nt, Human
gcuaaauggucgcccaggagaca

SEQ ID NO: 2507130 - RNA, 16 nt, Human
gcuaaaugugaaugau

SEQ ID NO: 2507131 - RNA, 18 nt, Human
gcuaaauuacaauuguca

SEQ ID NO: 2507132 - RNA, 22 nt, Human
gcuaaauuacucaggaagaaca

SEQ ID NO: 2507133 - RNA, 14 nt, Human
gcuaaauguaacag

SEQ ID NO: 2507134 - RNA, 17 nt, Human
gcuaaauguaacagucu

SEQ ID NO: 2507135 - RNA, 22 nt, Human
gcuaagagggagggagggcucc

SEQ ID NO: 2507136 - RNA, 21 nt, Human
gcuaagagggagggagggcuc

SEQ ID NO: 2507137 - RNA, 20 nt, Human
gcuaacacacagcucccaua

SEQ ID NO: 2507138 - RNA, 15 nt, Human
gcuaacacuggcccc

SEQ ID NO: 2507139 - RNA, 16 nt, Human
gcuaacacuggccccu

SEQ ID NO: 2507140 - RNA, 17 nt, Human
gcuaacacuggccccua

SEQ ID NO: 2507141 - RNA, 16 nt, Human
gcuaacaccagacaga

SEQ ID NO: 2507142 - RNA, 19 nt, Human
gcuagagguucaaagauau

SEQ ID NO: 2507143 - RNA, 21 nt, Human
gcuagagguucaaagauauuu

SEQ ID NO: 2507144 - RNA, 18 nt, Human
gcuagagguucaaagaua

SEQ ID NO: 2507145 - RNA, 16 nt, Human
gcuacucaagaggcug

SEQ ID NO: 2507146 - RNA, 17 nt, Human
gcuacucaagaggcuga

SEQ ID NO: 2507147 - RNA, 20 nt, Human
gcuacucaagaggcugaggc

SEQ ID NO: 2507148 - RNA, 21 nt, Human
gcuacucaagaggcugaggca

SEQ ID NO: 2507149 - RNA, 19 nt, Human
gcuacguuccuauugucau

SEQ ID NO: 2507150 - RNA, 20 nt, Human
gcuacgugugauuuuucugg

SEQ ID NO: 2507151 - RNA, 19 nt, Human
gcuacgugugauuuuucug

SEQ ID NO: 2507152 - RNA, 17 nt, Human
gcuacgugugauuuuuc

SEQ ID NO: 2507153 - RNA, 18 nt, Human
gcuacguacaugugaggc

SEQ ID NO: 2507154 - RNA, 15 nt, Human
gcuacgugugauuuu

SEQ ID NO: 2507155 - RNA, 14 nt, Human
gcuacuaaugaugu

SEQ ID NO: 2507156 - RNA, 16 nt, Human
gcuacuaaugauguuu

SEQ ID NO: 2507157 - RNA, 18 nt, Human
gcuacuaaugauguuuuc

SEQ ID NO: 2507158 - RNA, 21 nt, Human
gcuacccgggaagggggcugg

SEQ ID NO: 2507159 - RNA, 12 nt, Human
gcuacgccugca

SEQ ID NO: 2507160 - RNA, 13 nt, Human
gcuacccucccug

SEQ ID NO: 2507161 - RNA, 22 nt, Human
gcuacccgcagaguucucagaa

SEQ ID NO: 2507162 - RNA, 17 nt, Human
gcuaagcaaaaugugau

SEQ ID NO: 2507163 - RNA, 23 nt, Human
gcuaagagggagggagggcucca

SEQ ID NO: 2507164 - RNA, 14 nt, Human
gcuaagcauuccaa

SEQ ID NO: 2507165 - RNA, 18 nt, Human
gcuaagauuaucugggga

SEQ ID NO: 2507166 - RNA, 12 nt, Human
gcuaagaugcuc

SEQ ID NO: 2507167 - RNA, 17 nt, Human
gcuaagccccagcaagc

SEQ ID NO: 2507168 - RNA, 19 nt, Human
gcuaagaguguccuaggag

SEQ ID NO: 2507169 - RNA, 15 nt, Human
gcuacccgggaaggg

SEQ ID NO: 2507170 - RNA, 14 nt, Human
gcuacccgggaagg

SEQ ID NO: 2507171 - RNA, 15 nt, Human
gcuaagcuaggaaug

SEQ ID NO: 2507172 - RNA, 19 nt, Human
gcuaagcuaggaaugaaau

SEQ ID NO: 2507173 - RNA, 20 nt, Human
gcuaagccccagcaagcaau

SEQ ID NO: 2507174 - RNA, 18 nt, Human
gcuaagccccagcaagca

SEQ ID NO: 2507175 - RNA, 17 nt, Human
gcuaaggacauuuccca

SEQ ID NO: 2507176 - RNA, 20 nt, Human
gcuaaggacauuucccaggg

SEQ ID NO: 2507177 - RNA, 16 nt, Human
gcuacccgcagaguuc

SEQ ID NO: 2507178 - RNA, 22 nt, Human
gcuaucucccccagccccaucc

SEQ ID NO: 2507179 - RNA, 21 nt, Human
gcuaucucccccagccccauc

SEQ ID NO: 2507180 - RNA, 20 nt, Human
gcuaucucccccagccccau

SEQ ID NO: 2507181 - RNA, 19 nt, Human
gcuaucucccccagcccca

SEQ ID NO: 2507182 - RNA, 23 nt, Human
gcuaucucccccagccccauccu

SEQ ID NO: 2507183 - RNA, 12 nt, Human
gcuagcuucugc

SEQ ID NO: 2507184 - RNA, 16 nt, Human
gcuagcugcagagcca

SEQ ID NO: 2507185 - RNA, 23 nt, Human
gcuaucucucagugaacugugag

SEQ ID NO: 2507186 - RNA, 13 nt, Human
gcuaucucugugu

SEQ ID NO: 2507187 - RNA, 16 nt, Human
gcuaucucugugugca

SEQ ID NO: 2507188 - RNA, 12 nt, Human
gcuaucuuaauu

SEQ ID NO: 2507189 - RNA, 17 nt, Human
gcuaucuggucaaccuc

SEQ ID NO: 2507190 - RNA, 20 nt, Human
gcuaucucugugugcacaaa

SEQ ID NO: 2507191 - RNA, 16 nt, Human
gcuaucuuaauuuugg

SEQ ID NO: 2507192 - RNA, 15 nt, Human
gcuaucuuaauuuug

SEQ ID NO: 2507193 - RNA, 14 nt, Human
gcuaucuuaauuuu

SEQ ID NO: 2507194 - RNA, 12 nt, Human
gcuaugaauuuu

SEQ ID NO: 2507195 - RNA, 18 nt, Human
gcuaucucccccagcccc

SEQ ID NO: 2507196 - RNA, 17 nt, Human
gcuaucucccccagccc

SEQ ID NO: 2507197 - RNA, 16 nt, Human
gcuaucucccccagcc

SEQ ID NO: 2507198 - RNA, 22 nt, Human
gcuagcuccccuccucuccccu

SEQ ID NO: 2507199 - RNA, 21 nt, Human
gcuagcuccccuccucucccc

SEQ ID NO: 2507200 - RNA, 18 nt, Human
gcuagcuccccuccucuc

SEQ ID NO: 2507201 - RNA, 16 nt, Human
gcuagcuccccuccuc

SEQ ID NO: 2507202 - RNA, 16 nt, Human
gcuagaggccugagga

SEQ ID NO: 2507203 - RNA, 18 nt, Human
gcuagaguccucacuccc

SEQ ID NO: 2507204 - RNA, 13 nt, Human
gcuagaggccuga

SEQ ID NO: 2507205 - RNA, 13 nt, Human
gcuagaguccuca

SEQ ID NO: 2507206 - RNA, 16 nt, Human
gcuagaguccucacuc

SEQ ID NO: 2507207 - RNA, 20 nt, Human
gcuagcgcugccgcacccca

SEQ ID NO: 2507208 - RNA, 21 nt, Human
gcuagcgcugccgcaccccag

SEQ ID NO: 2507209 - RNA, 22 nt, Human
gcuagcgcugccgcaccccaga

SEQ ID NO: 2507210 - RNA, 23 nt, Human
gcuagcgcugccgcaccccagag

SEQ ID NO: 2507211 - RNA, 14 nt, Human
gcuagcgcugccgc

SEQ ID NO: 2507212 - RNA, 15 nt, Human
gcuagcgcugccgca

SEQ ID NO: 2507213 - RNA, 14 nt, Human
gcuagcaucccuga

SEQ ID NO: 2507214 - RNA, 18 nt, Human
gcucaggugucccugcac

SEQ ID NO: 2507215 - RNA, 19 nt, Human
gcucagccuggugggccuc

SEQ ID NO: 2507216 - RNA, 20 nt, Human
gcucagccuggugggccucc

SEQ ID NO: 2507217 - RNA, 22 nt, Human
gcucagcggggacagcuccuuc

SEQ ID NO: 2507218 - RNA, 21 nt, Human
gcucagcggggacagcuccuu

SEQ ID NO: 2507219 - RNA, 20 nt, Human
gcucagcggggacagcuccu

SEQ ID NO: 2507220 - RNA, 15 nt, Human
gcucagcggggacag

SEQ ID NO: 2507221 - RNA, 14 nt, Human
gcucagccuggugg

SEQ ID NO: 2507222 - RNA, 15 nt, Human
gcucagccugguggg

SEQ ID NO: 2507223 - RNA, 17 nt, Human
gcucagccuggugggcc

SEQ ID NO: 2507224 - RNA, 18 nt, Human
gcucagccuggugggccu

SEQ ID NO: 2507225 - RNA, 19 nt, Human
gcucaggugucccugcacu

SEQ ID NO: 2507226 - RNA, 15 nt, Human
gcucagcgccagccu

SEQ ID NO: 2507227 - RNA, 16 nt, Human
gcucaguaauuugagg

SEQ ID NO: 2507228 - RNA, 21 nt, Human
gcucaguaauuugaggacaac

SEQ ID NO: 2507229 - RNA, 12 nt, Human
gcucagucccau

SEQ ID NO: 2507230 - RNA, 19 nt, Human
gcucagucucccuuucccu

SEQ ID NO: 2507231 - RNA, 16 nt, Human
gcucagucucccuuuc

SEQ ID NO: 2507232 - RNA, 14 nt, Human
gcucagucucccuu

SEQ ID NO: 2507233 - RNA, 21 nt, Human
gcucagucucaggagcauggg

SEQ ID NO: 2507234 - RNA, 23 nt, Human
gcucagucccaucagagagcgag

SEQ ID NO: 2507235 - RNA, 14 nt, Human
gcucagucucagga

SEQ ID NO: 2507236 - RNA, 17 nt, Human
gcucagucucaggagca

SEQ ID NO: 2507237 - RNA, 20 nt, Human
gcucagucucaggagcaugg

SEQ ID NO: 2507238 - RNA, 17 nt, Human
gcucaguuguagaaugu

SEQ ID NO: 2507239 - RNA, 12 nt, Human
gcucaguuguag

SEQ ID NO: 2507240 - RNA, 16 nt, Human
gcucaguucuagucuc

SEQ ID NO: 2507241 - RNA, 17 nt, Human
gcucaguucagaaucac

SEQ ID NO: 2507242 - RNA, 20 nt, Human
gcucauacaggaaugaagcc

SEQ ID NO: 2507243 - RNA, 23 nt, Human
gcucaguuguagaauguauugua

SEQ ID NO: 2507244 - RNA, 18 nt, Human
gcucauaacggaucagaa

SEQ ID NO: 2507245 - RNA, 22 nt, Human
gcucagugucuggcugcagagc

SEQ ID NO: 2507246 - RNA, 16 nt, Human
gcucaguucagaauca

SEQ ID NO: 2507247 - RNA, 17 nt, Human
gcuccaaacccucgagg

SEQ ID NO: 2507248 - RNA, 18 nt, Human
gcuccaaacccucgaggc

SEQ ID NO: 2507249 - RNA, 16 nt, Human
gcuccaaacccucgag

SEQ ID NO: 2507250 - RNA, 19 nt, Human
gcucauauggggcugggag

SEQ ID NO: 2507251 - RNA, 16 nt, Human
gcucauauuccugcag

SEQ ID NO: 2507252 - RNA, 22 nt, Human
gcucacccccuucuccauccac

SEQ ID NO: 2507253 - RNA, 15 nt, Human
gcucaccccuggagg

SEQ ID NO: 2507254 - RNA, 18 nt, Human
gcucacccccuucuccau

SEQ ID NO: 2507255 - RNA, 20 nt, Human
gcucacccccuucuccaucc

SEQ ID NO: 2507256 - RNA, 16 nt, Human
gcucaccccccacacu

SEQ ID NO: 2507257 - RNA, 19 nt, Human
gcucaccccccacacucac

SEQ ID NO: 2507258 - RNA, 17 nt, Human
gcucaccccccacacuc

SEQ ID NO: 2507259 - RNA, 16 nt, Human
gcucacccccuucucc

SEQ ID NO: 2507260 - RNA, 18 nt, Human
gcucacccagccccaggg

SEQ ID NO: 2507261 - RNA, 20 nt, Human
gcucacccaauaaacauuaa

SEQ ID NO: 2507262 - RNA, 19 nt, Human
gcucaccagccccagugcc

SEQ ID NO: 2507263 - RNA, 17 nt, Human
gcuaugagcuggggaug

SEQ ID NO: 2507264 - RNA, 18 nt, Human
gcucaccagccccagugc

SEQ ID NO: 2507265 - RNA, 23 nt, Human
gcucaccagccccagugcccaca

SEQ ID NO: 2507266 - RNA, 20 nt, Human
gcucaccagccccagugccc

SEQ ID NO: 2507267 - RNA, 17 nt, Human
gcucagcaaaagaugcu

SEQ ID NO: 2507268 - RNA, 20 nt, Human
gcucagcaaaagaugcuucu

SEQ ID NO: 2507269 - RNA, 22 nt, Human
gcucagcaaaagaugcuucuca

SEQ ID NO: 2507270 - RNA, 23 nt, Human
gcucagcaaaagaugcuucucac

SEQ ID NO: 2507271 - RNA, 20 nt, Human
gcucaccccccacacucacu

SEQ ID NO: 2507272 - RNA, 23 nt, Human
gcucagaggguuguucuccuaga

SEQ ID NO: 2507273 - RNA, 12 nt, Human
gcucagccagca

SEQ ID NO: 2507274 - RNA, 13 nt, Human
gcucagccagcac

SEQ ID NO: 2507275 - RNA, 11 nt, Human
gcucagcagcu

SEQ ID NO: 2507276 - RNA, 15 nt, Human
gcucagcccuggagg

SEQ ID NO: 2507277 - RNA, 14 nt, Human
gcucagcccuggag

SEQ ID NO: 2507278 - RNA, 14 nt, Human
gcucagccagcacu

SEQ ID NO: 2507279 - RNA, 20 nt, Human
gcucagcccuggaggugcca

SEQ ID NO: 2507280 - RNA, 16 nt, Human
gcucagcccuggaggu

SEQ ID NO: 2507281 - RNA, 11 nt, Human
gcucagccugg

SEQ ID NO: 2507282 - RNA, 20 nt, Human
gcucccugaagccagccuuc

SEQ ID NO: 2507283 - RNA, 18 nt, Human
gcucccugaagccagccu

SEQ ID NO: 2507284 - RNA, 17 nt, Human
gcucccugaagccagcc

SEQ ID NO: 2507285 - RNA, 16 nt, Human
gcucccugaagccagc

SEQ ID NO: 2507286 - RNA, 15 nt, Human
gcucccugaagccag

SEQ ID NO: 2507287 - RNA, 14 nt, Human
gcucccugaagcca

SEQ ID NO: 2507288 - RNA, 13 nt, Human
gcucccugaagcc

SEQ ID NO: 2507289 - RNA, 12 nt, Human
gcucccugaagc

SEQ ID NO: 2507290 - RNA, 18 nt, Human
gcucccugacugggaguu

SEQ ID NO: 2507291 - RNA, 16 nt, Human
gcucccugacugggag

SEQ ID NO: 2507292 - RNA, 24 nt, Human
gcucccugaagccagccuucuucc

SEQ ID NO: 2507293 - RNA, 19 nt, Human
gcucccucuuggucuuccc

SEQ ID NO: 2507294 - RNA, 17 nt, Human
gcucccucuuggucuuc

SEQ ID NO: 2507295 - RNA, 13 nt, Human
gcucccucugccu

SEQ ID NO: 2507296 - RNA, 23 nt, Human
gcucccucugccugaaccuucca

SEQ ID NO: 2507297 - RNA, 23 nt, Human
gcucccuccccugcccuggucca

SEQ ID NO: 2507298 - RNA, 19 nt, Human
gcucccuccccugcccugg

SEQ ID NO: 2507299 - RNA, 20 nt, Human
gcucccuccccugcccuggu

SEQ ID NO: 2507300 - RNA, 16 nt, Human
gcucccucccaucccu

SEQ ID NO: 2507301 - RNA, 17 nt, Human
gcucccuccccugcccu

SEQ ID NO: 2507302 - RNA, 20 nt, Human
gcuccauuuuuagugaaaua

SEQ ID NO: 2507303 - RNA, 16 nt, Human
gcucccuaccaccucc

SEQ ID NO: 2507304 - RNA, 20 nt, Human
gcucccuaccaccuccccag

SEQ ID NO: 2507305 - RNA, 15 nt, Human
gcucccuaccaccuc

SEQ ID NO: 2507306 - RNA, 20 nt, Human
gcuccaugugcccccucuac

SEQ ID NO: 2507307 - RNA, 18 nt, Human
gcuccaugugcccccucu

SEQ ID NO: 2507308 - RNA, 14 nt, Human
gcuccaucuccacu

SEQ ID NO: 2507309 - RNA, 21 nt, Human
gcuccagcugcucugucuucu

SEQ ID NO: 2507310 - RNA, 20 nt, Human
gcuccagcuguucagcuggu

SEQ ID NO: 2507311 - RNA, 23 nt, Human
gcuccaggcuccuuuagcgccca

SEQ ID NO: 2507312 - RNA, 16 nt, Human
gcuccaggcuccuuua

SEQ ID NO: 2507313 - RNA, 13 nt, Human
gcuccaggcuccu

SEQ ID NO: 2507314 - RNA, 11 nt, Human
gcuccagcugu

SEQ ID NO: 2507315 - RNA, 19 nt, Human
gcuccaagcucccaggcau

SEQ ID NO: 2507316 - RNA, 18 nt, Human
gcuccaagcucccaggca

SEQ ID NO: 2507317 - RNA, 17 nt, Human
gcuccaagcucccaggc

SEQ ID NO: 2507318 - RNA, 16 nt, Human
gcuccaagcucccagg

SEQ ID NO: 2507319 - RNA, 20 nt, Human
gcuccaaggggaaucagaac

SEQ ID NO: 2507320 - RNA, 21 nt, Human
gcuccaaggggaaucagaacu

SEQ ID NO: 2507321 - RNA, 23 nt, Human
gcuccaaggggaaucagaacuca

SEQ ID NO: 2507322 - RNA, 21 nt, Human
gcuccaagcucccaggcauuc

SEQ ID NO: 2507323 - RNA, 17 nt, Human
gcuccagcuggccggga

SEQ ID NO: 2507324 - RNA, 23 nt, Human
gcuccagcuggccgggagccuga

SEQ ID NO: 2507325 - RNA, 16 nt, Human
gcuccacacccucucc

SEQ ID NO: 2507326 - RNA, 19 nt, Human
gcuccacacccucucccag

SEQ ID NO: 2507327 - RNA, 20 nt, Human
gcuccagcugcucugucuuc

SEQ ID NO: 2507328 - RNA, 15 nt, Human
gcuccaagcucccag

SEQ ID NO: 2507329 - RNA, 14 nt, Human
gcuccaagcuccca

SEQ ID NO: 2507330 - RNA, 19 nt, Human
gcuccaagccccaucuucu

SEQ ID NO: 2507331 - RNA, 16 nt, Human
gcuccaagccccaucu

SEQ ID NO: 2507332 - RNA, 13 nt, Human
gcuccaagcuccc

SEQ ID NO: 2507333 - RNA, 15 nt, Human
gcuccaaccugcaaa

SEQ ID NO: 2507334 - RNA, 18 nt, Human
gcuccaaccugcaaagau

SEQ ID NO: 2507335 - RNA, 21 nt, Human
gcuccaaccugcaaagaucug

SEQ ID NO: 2507336 - RNA, 22 nt, Human
gcuccaagaccuguugguucca

SEQ ID NO: 2507337 - RNA, 18 nt, Human
gcuccaagaccuguuggu

SEQ ID NO: 2507338 - RNA, 16 nt, Human
gcuccaagaccuguug

SEQ ID NO: 2507339 - RNA, 16 nt, Human
gcuccaaaugcagcuu

SEQ ID NO: 2507340 - RNA, 19 nt, Human
gcuccaaacccucgaggcg

SEQ ID NO: 2507341 - RNA, 17 nt, Human
gcucgagcaugccugga

SEQ ID NO: 2507342 - RNA, 20 nt, Human
gcucgagcaguccugccuca

SEQ ID NO: 2507343 - RNA, 21 nt, Human
gcucgagcaguccugccucag

SEQ ID NO: 2507344 - RNA, 20 nt, Human
gcucuccaagugccagaggu

SEQ ID NO: 2507345 - RNA, 13 nt, Human
gcucuccaccuca

SEQ ID NO: 2507346 - RNA, 14 nt, Human
gcucuccaccucag

SEQ ID NO: 2507347 - RNA, 15 nt, Human
gcucuccaccucagc

SEQ ID NO: 2507348 - RNA, 16 nt, Human
gcucuccaccucagcc

SEQ ID NO: 2507349 - RNA, 17 nt, Human
gcucuccaccucagccu

SEQ ID NO: 2507350 - RNA, 18 nt, Human
gcucuccaccucagccuu

SEQ ID NO: 2507351 - RNA, 19 nt, Human
gcucuccaccucagccuug

SEQ ID NO: 2507352 - RNA, 17 nt, Human
gcucucccauuuccuga

SEQ ID NO: 2507353 - RNA, 16 nt, Human
gcucuccccugcccug

SEQ ID NO: 2507354 - RNA, 19 nt, Human
gcucuccagucaggaggca

SEQ ID NO: 2507355 - RNA, 15 nt, Human
gcucuccagcuccaa

SEQ ID NO: 2507356 - RNA, 20 nt, Human
gcucuccagucaggaggcau

SEQ ID NO: 2507357 - RNA, 21 nt, Human
gcucuccaccucagccuugga

SEQ ID NO: 2507358 - RNA, 13 nt, Human
gcucuccagcucc

SEQ ID NO: 2507359 - RNA, 20 nt, Human
gcucuccaccucagccuugg

SEQ ID NO: 2507360 - RNA, 14 nt, Human
gcucgaaaacaauu

SEQ ID NO: 2507361 - RNA, 20 nt, Human
gcuccuuuuucucccucugg

SEQ ID NO: 2507362 - RNA, 19 nt, Human
gcuccuuuuucucccucug

SEQ ID NO: 2507363 - RNA, 18 nt, Human
gcuccuuuuucucccucu

SEQ ID NO: 2507364 - RNA, 16 nt, Human
gcuccuuuuucucccu

SEQ ID NO: 2507365 - RNA, 14 nt, Human
gcuccuuuuucucc

SEQ ID NO: 2507366 - RNA, 11 nt, Human
gcuccuugggc

SEQ ID NO: 2507367 - RNA, 21 nt, Human
gcuccuugggaggccccacug

SEQ ID NO: 2507368 - RNA, 22 nt, Human
gcuccuugggaggccccacugg

SEQ ID NO: 2507369 - RNA, 22 nt, Human
gcuccuugggaggaagcagaau

SEQ ID NO: 2507370 - RNA, 21 nt, Human
gcuccuugggaggaagcagaa

SEQ ID NO: 2507371 - RNA, 23 nt, Human
gcuccuugggaggaagcagaaua

SEQ ID NO: 2507372 - RNA, 14 nt, Human
gcuccuugggaggc

SEQ ID NO: 2507373 - RNA, 16 nt, Human
gcucgagcaugccugg

SEQ ID NO: 2507374 - RNA, 16 nt, Human
gcucgaaucucugugc

SEQ ID NO: 2507375 - RNA, 15 nt, Human
gcucgaaucucugug

SEQ ID NO: 2507376 - RNA, 19 nt, Human
gcucgaaucucugugccuu

SEQ ID NO: 2507377 - RNA, 17 nt, Human
gcucgagcaguccugcc

SEQ ID NO: 2507378 - RNA, 18 nt, Human
gcucccuucccaccucuc

SEQ ID NO: 2507379 - RNA, 16 nt, Human
gcucccuucccaccuc

SEQ ID NO: 2507380 - RNA, 21 nt, Human
gcucccuguaaccucuucaga

SEQ ID NO: 2507381 - RNA, 15 nt, Human
gcucccuucccaccu

SEQ ID NO: 2507382 - RNA, 21 nt, Human
gcuccuucuguccuacucugu

SEQ ID NO: 2507383 - RNA, 20 nt, Human
gcuccuugggaggaagcaga

SEQ ID NO: 2507384 - RNA, 19 nt, Human
gcuccuugggaggaagcag

SEQ ID NO: 2507385 - RNA, 18 nt, Human
gcuccuugggaggaagca

SEQ ID NO: 2507386 - RNA, 17 nt, Human
gcuccuugggaggaagc

SEQ ID NO: 2507387 - RNA, 15 nt, Human
gcuccuugacuccuu

SEQ ID NO: 2507388 - RNA, 18 nt, Human
gcucccuuccaccuguca

SEQ ID NO: 2507389 - RNA, 16 nt, Human
gcuccuugggaggaag

SEQ ID NO: 2507390 - RNA, 13 nt, Human
gcuccuugggagg

SEQ ID NO: 2507391 - RNA, 19 nt, Human
gcucccuucccaccucucu

SEQ ID NO: 2507392 - RNA, 21 nt, Human
gcucccuucaucuccagggag

SEQ ID NO: 2507393 - RNA, 13 nt, Human
gcucccuggagcc

SEQ ID NO: 2507394 - RNA, 15 nt, Human
gcuccuucuguccua

SEQ ID NO: 2507395 - RNA, 17 nt, Human
gcucuccgaccagacac

SEQ ID NO: 2507396 - RNA, 13 nt, Human
gcucuccgaccag

SEQ ID NO: 2507397 - RNA, 18 nt, Human
gcucucccgguucuucca

SEQ ID NO: 2507398 - RNA, 19 nt, Human
gcucuccccugcccugcug

SEQ ID NO: 2507399 - RNA, 20 nt, Human
gcucucccgguucuuccagu

SEQ ID NO: 2507400 - RNA, 19 nt, Human
gcucucccgguucuuccag

SEQ ID NO: 2507401 - RNA, 11 nt, Human
gcucucccucu

SEQ ID NO: 2507402 - RNA, 14 nt, Human
gcucucccucuggc

SEQ ID NO: 2507403 - RNA, 15 nt, Human
gcucucccucuggcc

SEQ ID NO: 2507404 - RNA, 17 nt, Human
gcucucccucuggcccu

SEQ ID NO: 2507405 - RNA, 18 nt, Human
gcucucccucuggcccug

SEQ ID NO: 2507406 - RNA, 19 nt, Human
gcucucccucuggcccugc

SEQ ID NO: 2507407 - RNA, 20 nt, Human
gcucucccucuggcccugcc

SEQ ID NO: 2507408 - RNA, 21 nt, Human
gcucucccucuggcccugccu

SEQ ID NO: 2507409 - RNA, 14 nt, Human
gcucucccucuucu

SEQ ID NO: 2507410 - RNA, 23 nt, Human
gcucucccucuggcccugccuuc

SEQ ID NO: 2507411 - RNA, 15 nt, Human
gcucuccucuugcca

SEQ ID NO: 2507412 - RNA, 22 nt, Human
gcucuccucuugccacugccuc

SEQ ID NO: 2507413 - RNA, 19 nt, Human
gcucuccucuugccacugc

SEQ ID NO: 2507414 - RNA, 23 nt, Human
gcucucccucuucucaagugccu

SEQ ID NO: 2507415 - RNA, 21 nt, Human
gcucucccucuucucaagugc

SEQ ID NO: 2507416 - RNA, 16 nt, Human
gcucucccucuucuca

SEQ ID NO: 2507417 - RNA, 15 nt, Human
gcucucccucuucuc

SEQ ID NO: 2507418 - RNA, 24 nt, Human
gcucucccucuucucaagugccuu

SEQ ID NO: 2507419 - RNA, 19 nt, Human
gcucuccucagaagaaaga

SEQ ID NO: 2507420 - RNA, 19 nt, Human
gcucuccgaccagacaccu

SEQ ID NO: 2507421 - RNA, 12 nt, Human
gcucucuggccu

SEQ ID NO: 2507422 - RNA, 13 nt, Human
gcucucuggccuu

SEQ ID NO: 2507423 - RNA, 11 nt, Human
gcucucuggcc

SEQ ID NO: 2507424 - RNA, 17 nt, Human
gcucucugcagccagcc

SEQ ID NO: 2507425 - RNA, 18 nt, Human
gcucucugcagccagccc

SEQ ID NO: 2507426 - RNA, 19 nt, Human
gcucucugcagccagccca

SEQ ID NO: 2507427 - RNA, 20 nt, Human
gcucucugcagccagcccag

SEQ ID NO: 2507428 - RNA, 11 nt, Human
gcucucugcca

SEQ ID NO: 2507429 - RNA, 20 nt, Human
gcucucugcaucuacuccca

SEQ ID NO: 2507430 - RNA, 21 nt, Human
gcucucugcagccagcccagc

SEQ ID NO: 2507431 - RNA, 22 nt, Human
gcucucugcagccagcccagcc

SEQ ID NO: 2507432 - RNA, 19 nt, Human
gcucucggguugugugucu

SEQ ID NO: 2507433 - RNA, 19 nt, Human
gcucucggaacugcaugcu

SEQ ID NO: 2507434 - RNA, 19 nt, Human
gcucucucauugucugugu

SEQ ID NO: 2507435 - RNA, 12 nt, Human
gcucucuccagg

SEQ ID NO: 2507436 - RNA, 21 nt, Human
gcucucggaacugcaugcugc

SEQ ID NO: 2507437 - RNA, 13 nt, Human
gcucucuccagga

SEQ ID NO: 2507438 - RNA, 13 nt, Human
gcucucugcagcc

SEQ ID NO: 2507439 - RNA, 14 nt, Human
gcucucugcagcca

SEQ ID NO: 2507440 - RNA, 15 nt, Human
gcucucugcagccag

SEQ ID NO: 2507441 - RNA, 12 nt, Human
gcucuccuuccu

SEQ ID NO: 2507442 - RNA, 11 nt, Human
gcucuccuucc

SEQ ID NO: 2507443 - RNA, 22 nt, Human
gcucuccuuccuggagcccaga

SEQ ID NO: 2507444 - RNA, 16 nt, Human
gcucuccuuucuuucu

SEQ ID NO: 2507445 - RNA, 14 nt, Human
gcucucuggccuuc

SEQ ID NO: 2507446 - RNA, 15 nt, Human
gcucucuggccuucg

SEQ ID NO: 2507447 - RNA, 19 nt, Human
gcucucuggccuucggccu

SEQ ID NO: 2507448 - RNA, 20 nt, Human
gcucucuggccuucggccuc

SEQ ID NO: 2507449 - RNA, 11 nt, Human
gcucugccucc

SEQ ID NO: 2507450 - RNA, 23 nt, Human
gcucugcccuugguuaggcauug

SEQ ID NO: 2507451 - RNA, 14 nt, Human
gcucugcccuuggu

SEQ ID NO: 2507452 - RNA, 18 nt, Human
gcucucuggccuuuuccu

SEQ ID NO: 2507453 - RNA, 11 nt, Human
gcucucugcug

SEQ ID NO: 2507454 - RNA, 22 nt, Human
gcucugccucccaucacccgcu

SEQ ID NO: 2507455 - RNA, 15 nt, Human
gcucugccucccauc

SEQ ID NO: 2507456 - RNA, 14 nt, Human
gcucugccucccau

SEQ ID NO: 2507457 - RNA, 13 nt, Human
gcucugccuccca

SEQ ID NO: 2507458 - RNA, 18 nt, Human
gcucugcccuuguucccu

SEQ ID NO: 2507459 - RNA, 21 nt, Human
gcucugcccuuguucccuagg

SEQ ID NO: 2507460 - RNA, 13 nt, Human
gcucucugcugua

SEQ ID NO: 2507461 - RNA, 17 nt, Human
gcucugcgugucaccug

SEQ ID NO: 2507462 - RNA, 14 nt, Human
gcucugcuccucuc

SEQ ID NO: 2507463 - RNA, 13 nt, Human
gcucugcuccucu

SEQ ID NO: 2507464 - RNA, 23 nt, Human
gcucugcugacagacacaggccc

SEQ ID NO: 2507465 - RNA, 20 nt, Human
gcucugcugacagacacagg

SEQ ID NO: 2507466 - RNA, 19 nt, Human
gcucugcugacagacacag

SEQ ID NO: 2507467 - RNA, 18 nt, Human
gcucugcugacagacaca

SEQ ID NO: 2507468 - RNA, 14 nt, Human
gcucugcugacaga

SEQ ID NO: 2507469 - RNA, 13 nt, Human
gcucugcugacag

SEQ ID NO: 2507470 - RNA, 21 nt, Human
gcucugcuccucuccccagca

SEQ ID NO: 2507471 - RNA, 19 nt, Human
gcucugcuccucuccccag

SEQ ID NO: 2507472 - RNA, 22 nt, Human
gcucuggacaggcauguucucu

SEQ ID NO: 2507473 - RNA, 21 nt, Human
gcucuggacaggcauguucuc

SEQ ID NO: 2507474 - RNA, 16 nt, Human
gcucuggacaggcaug

SEQ ID NO: 2507475 - RNA, 15 nt, Human
gcucuggacaggcau

SEQ ID NO: 2507476 - RNA, 19 nt, Human
gcucugcuggccuggccgg

SEQ ID NO: 2507477 - RNA, 18 nt, Human
gcucugcuggccuggccg

SEQ ID NO: 2507478 - RNA, 17 nt, Human
gcucugcuggccuggcc

SEQ ID NO: 2507479 - RNA, 15 nt, Human
gcucugcuggccugg

SEQ ID NO: 2507480 - RNA, 14 nt, Human
gcucugcuugacaa

SEQ ID NO: 2507481 - RNA, 21 nt, Human
gcucugcuugacaacaucuga

SEQ ID NO: 2507482 - RNA, 21 nt, Human
gcucugcuggccuggccggca

SEQ ID NO: 2507483 - RNA, 22 nt, Human
gcucugcgugucaccugugcuu

SEQ ID NO: 2507484 - RNA, 13 nt, Human
gcucugcuggccu

SEQ ID NO: 2507485 - RNA, 14 nt, Human
gcucuggacaggca

SEQ ID NO: 2507486 - RNA, 16 nt, Human
gcucuggacagcccca

SEQ ID NO: 2507487 - RNA, 19 nt, Human
gcucuggacagccccaccc

SEQ ID NO: 2507488 - RNA, 21 nt, Human
gcucuggaaaaugugacccag

SEQ ID NO: 2507489 - RNA, 22 nt, Human
gcucuggaaaaugugacccaga

SEQ ID NO: 2507490 - RNA, 14 nt, Human
gcucuggaagagag

SEQ ID NO: 2507491 - RNA, 15 nt, Human
gcucuuucucugcca

SEQ ID NO: 2507492 - RNA, 14 nt, Human
gcucuuucucugcc

SEQ ID NO: 2507493 - RNA, 17 nt, Human
gcucuuucuacucugaa

SEQ ID NO: 2507494 - RNA, 18 nt, Human
gcucuuuccuugcucaac

SEQ ID NO: 2507495 - RNA, 16 nt, Human
gcucuuuccuugcuca

SEQ ID NO: 2507496 - RNA, 15 nt, Human
gcucuuuccuugcuc

SEQ ID NO: 2507497 - RNA, 15 nt, Human
gcucuuuccuccuuc

SEQ ID NO: 2507498 - RNA, 17 nt, Human
gcucuuuccuccuucca

SEQ ID NO: 2507499 - RNA, 14 nt, Human
gcucuuuccuccuu

SEQ ID NO: 2507500 - RNA, 16 nt, Human
gcucuuucucugccag

SEQ ID NO: 2507501 - RNA, 13 nt, Human
gcugacagcugcu

SEQ ID NO: 2507502 - RNA, 14 nt, Human
gcugacagcugcuc

SEQ ID NO: 2507503 - RNA, 17 nt, Human
gcugacagacagcccuc

SEQ ID NO: 2507504 - RNA, 21 nt, Human
gcugacagacacaggcccggc

SEQ ID NO: 2507505 - RNA, 23 nt, Human
gcucuugauaccccccucugucu

SEQ ID NO: 2507506 - RNA, 22 nt, Human
gcucuugauaccccccucuguc

SEQ ID NO: 2507507 - RNA, 21 nt, Human
gcucuucugacuacugggcaa

SEQ ID NO: 2507508 - RNA, 16 nt, Human
gcucuugugaggaaag

SEQ ID NO: 2507509 - RNA, 17 nt, Human
gcucuugaugccuggcg

SEQ ID NO: 2507510 - RNA, 22 nt, Human
gcucuugugguacacacagauu

SEQ ID NO: 2507511 - RNA, 22 nt, Human
gcucuugugcuggauggagccc

SEQ ID NO: 2507512 - RNA, 20 nt, Human
gcucuugugaggaaagucau

SEQ ID NO: 2507513 - RNA, 19 nt, Human
gcucuugugaggaaaguca

SEQ ID NO: 2507514 - RNA, 17 nt, Human
gcucuugugaggaaagu

SEQ ID NO: 2507515 - RNA, 12 nt, Human
gcucuuucaggg

SEQ ID NO: 2507516 - RNA, 14 nt, Human
gcucuuuagccagu

SEQ ID NO: 2507517 - RNA, 13 nt, Human
gcucuuucagggg

SEQ ID NO: 2507518 - RNA, 21 nt, Human
gcucuuuaugaaugaaaaaac

SEQ ID NO: 2507519 - RNA, 19 nt, Human
gcugaccccaaagagccug

SEQ ID NO: 2507520 - RNA, 18 nt, Human
gcugaccccaaagagccu

SEQ ID NO: 2507521 - RNA, 14 nt, Human
gcugacccuccugu

SEQ ID NO: 2507522 - RNA, 17 nt, Human
gcugacccagucccugg

SEQ ID NO: 2507523 - RNA, 19 nt, Human
gcugacccagucccugggg

SEQ ID NO: 2507524 - RNA, 13 nt, Human
gcugacccagccu

SEQ ID NO: 2507525 - RNA, 13 nt, Human
gcugacccagucc

SEQ ID NO: 2507526 - RNA, 15 nt, Human
gcugacccagucccu

SEQ ID NO: 2507527 - RNA, 16 nt, Human
gcugacccagucccug

SEQ ID NO: 2507528 - RNA, 13 nt, Human
gcugacaucugug

SEQ ID NO: 2507529 - RNA, 19 nt, Human
gcugacaguccucuccacc

SEQ ID NO: 2507530 - RNA, 16 nt, Human
gcugacaguccucucc

SEQ ID NO: 2507531 - RNA, 14 nt, Human
gcugacaguccucu

SEQ ID NO: 2507532 - RNA, 15 nt, Human
gcugacagcugcucc

SEQ ID NO: 2507533 - RNA, 17 nt, Human
gcugacagcugcuccua

SEQ ID NO: 2507534 - RNA, 12 nt, Human
gcugacaguccu

SEQ ID NO: 2507535 - RNA, 18 nt, Human
gcugacagcugcuccuag

SEQ ID NO: 2507536 - RNA, 19 nt, Human
gcugacaucuguguuucaa

SEQ ID NO: 2507537 - RNA, 16 nt, Human
gcugacaucuguguuu

SEQ ID NO: 2507538 - RNA, 21 nt, Human
gcugaccaugcucaucugcug

SEQ ID NO: 2507539 - RNA, 22 nt, Human
gcugaccaugcucaucugcugg

SEQ ID NO: 2507540 - RNA, 22 nt, Human
gcugacccagccccuugagaaa

SEQ ID NO: 2507541 - RNA, 14 nt, Human
gcugaccucuguug

SEQ ID NO: 2507542 - RNA, 16 nt, Human
gcugaccucugguggc

SEQ ID NO: 2507543 - RNA, 15 nt, Human
gcugacuagaagggc

SEQ ID NO: 2507544 - RNA, 23 nt, Human
gcugacuagaagggccaguccug

SEQ ID NO: 2507545 - RNA, 22 nt, Human
gcugacccuccuguugcaccca

SEQ ID NO: 2507546 - RNA, 15 nt, Human
gcugacccuccuguu

SEQ ID NO: 2507547 - RNA, 14 nt, Human
gcugaccuccacag

SEQ ID NO: 2507548 - RNA, 15 nt, Human
gcugaccuccacagc

SEQ ID NO: 2507549 - RNA, 16 nt, Human
gcugaccuccacagcu

SEQ ID NO: 2507550 - RNA, 17 nt, Human
gcugaccuccacagcuu

SEQ ID NO: 2507551 - RNA, 13 nt, Human
gcugaccucuggu

SEQ ID NO: 2507552 - RNA, 19 nt, Human
gcugacuguacuccuccca

SEQ ID NO: 2507553 - RNA, 18 nt, Human
gcugacuguacuccuccc

SEQ ID NO: 2507554 - RNA, 23 nt, Human
gcugacucuaggugcccuuggag

SEQ ID NO: 2507555 - RNA, 20 nt, Human
gcugacugauguugagggaa

SEQ ID NO: 2507556 - RNA, 16 nt, Human
gcucuucuccaggcug

SEQ ID NO: 2507557 - RNA, 14 nt, Human
gcucuucuccaggc

SEQ ID NO: 2507558 - RNA, 21 nt, Human
gcucuucuccuuucacaaccu

SEQ ID NO: 2507559 - RNA, 17 nt, Human
gcucuucuccuuucaca

SEQ ID NO: 2507560 - RNA, 23 nt, Human
gcucuucucauuucaccccuccc

SEQ ID NO: 2507561 - RNA, 22 nt, Human
gcucuucucauuucaccccucc

SEQ ID NO: 2507562 - RNA, 13 nt, Human
gcucuucuccuuu

SEQ ID NO: 2507563 - RNA, 16 nt, Human
gcucuugaugccuggc

SEQ ID NO: 2507564 - RNA, 15 nt, Human
gcucuugaugccugg

SEQ ID NO: 2507565 - RNA, 14 nt, Human
gcucuugaugccug

SEQ ID NO: 2507566 - RNA, 23 nt, Human
gcucuucugcccaauuggaggaa

SEQ ID NO: 2507567 - RNA, 13 nt, Human
gcucuucugacua

SEQ ID NO: 2507568 - RNA, 23 nt, Human
gcucuucuccuuucacaaccuuc

SEQ ID NO: 2507569 - RNA, 18 nt, Human
gcucuuccaggcugggag

SEQ ID NO: 2507570 - RNA, 19 nt, Human
gcucuuccaggcugggaga

SEQ ID NO: 2507571 - RNA, 20 nt, Human
gcucuggacagccccacccu

SEQ ID NO: 2507572 - RNA, 22 nt, Human
gcucuggacagccccacccugg

SEQ ID NO: 2507573 - RNA, 16 nt, Human
gcucuggaccagccug

SEQ ID NO: 2507574 - RNA, 22 nt, Human
gcucuggaccaacccuguuucc

SEQ ID NO: 2507575 - RNA, 11 nt, Human
gcucuggacca

SEQ ID NO: 2507576 - RNA, 15 nt, Human
gcucuggaagagagg

SEQ ID NO: 2507577 - RNA, 17 nt, Human
gcucuggaccagccugu

SEQ ID NO: 2507578 - RNA, 20 nt, Human
gcucuucucauuucaccccu

SEQ ID NO: 2507579 - RNA, 16 nt, Human
gcucuucucauuucac

SEQ ID NO: 2507580 - RNA, 15 nt, Human
gcucuucucauuuca

SEQ ID NO: 2507581 - RNA, 14 nt, Human
gcucuucucauuuc

SEQ ID NO: 2507582 - RNA, 12 nt, Human
gcucuucuccag

SEQ ID NO: 2507583 - RNA, 22 nt, Human
gcucuuccaggcugggagagcc

SEQ ID NO: 2507584 - RNA, 12 nt, Human
gcucuucucauu

SEQ ID NO: 2507585 - RNA, 20 nt, Human
gcucuuccgaaaaccaggcc

SEQ ID NO: 2507586 - RNA, 21 nt, Human
gcugagucccaggcugagccu

SEQ ID NO: 2507587 - RNA, 22 nt, Human
gcugagucccaggcugagccuc

SEQ ID NO: 2507588 - RNA, 17 nt, Human
gcugagucccaggcuga

SEQ ID NO: 2507589 - RNA, 21 nt, Human
gcugacuguacuccucccagg

SEQ ID NO: 2507590 - RNA, 15 nt, Human
gcugagucugaaggc

SEQ ID NO: 2507591 - RNA, 16 nt, Human
gcugagucucccaagg

SEQ ID NO: 2507592 - RNA, 15 nt, Human
gcugagucucccaag

SEQ ID NO: 2507593 - RNA, 14 nt, Human
gcugagucucccaa

SEQ ID NO: 2507594 - RNA, 13 nt, Human
gcugagucuccca

SEQ ID NO: 2507595 - RNA, 18 nt, Human
gcugacugauguugaggg

SEQ ID NO: 2507596 - RNA, 18 nt, Human
gcugagucugaaggcugg

SEQ ID NO: 2507597 - RNA, 16 nt, Human
gcugagucugaaggcu

SEQ ID NO: 2507598 - RNA, 19 nt, Human
gcugagucugaaggcuggg

SEQ ID NO: 2507599 - RNA, 17 nt, Human
gcugagucucccaaggc

SEQ ID NO: 2507600 - RNA, 19 nt, Human
gcugaguggcaggggacag

SEQ ID NO: 2507601 - RNA, 17 nt, Human
gcugaguggcaggggac

SEQ ID NO: 2507602 - RNA, 22 nt, Human
gcugagugggggaucacagccu

SEQ ID NO: 2507603 - RNA, 23 nt, Human
gcugagugggggaucacagccuc

SEQ ID NO: 2507604 - RNA, 21 nt, Human
gcugaguggcaggggacagga

SEQ ID NO: 2507605 - RNA, 13 nt, Human
gcugaguuggugu

SEQ ID NO: 2507606 - RNA, 16 nt, Human
gcugauggugcaauga

SEQ ID NO: 2507607 - RNA, 15 nt, Human
gcugauggugcaaug

SEQ ID NO: 2507608 - RNA, 20 nt, Human
gcugaugcugggcugggugc

SEQ ID NO: 2507609 - RNA, 19 nt, Human
gcugaugcugggcugggug

SEQ ID NO: 2507610 - RNA, 16 nt, Human
gcugaugcugggcugg

SEQ ID NO: 2507611 - RNA, 15 nt, Human
gcugaugcugggcug

SEQ ID NO: 2507612 - RNA, 14 nt, Human
gcugaugcugggcu

SEQ ID NO: 2507613 - RNA, 20 nt, Human
gcugaugauuuguuuuugua

SEQ ID NO: 2507614 - RNA, 20 nt, Human
gcugcaguugccagucaccc

SEQ ID NO: 2507615 - RNA, 18 nt, Human
gcugcaguugccagucac

SEQ ID NO: 2507616 - RNA, 20 nt, Human
gcugauguucaguguaauuu

SEQ ID NO: 2507617 - RNA, 21 nt, Human
gcugcaguugccagucacccc

SEQ ID NO: 2507618 - RNA, 17 nt, Human
gcugauguucaguguaa

SEQ ID NO: 2507619 - RNA, 16 nt, Human
gcugauguucagugua

SEQ ID NO: 2507620 - RNA, 15 nt, Human
gcugauguucagugu

SEQ ID NO: 2507621 - RNA, 14 nt, Human
gcugauguucagug

SEQ ID NO: 2507622 - RNA, 13 nt, Human
gcugauguucagu

SEQ ID NO: 2507623 - RNA, 20 nt, Human
gcugauguccucaccacaug

SEQ ID NO: 2507624 - RNA, 23 nt, Human
gcugaugucaauuucuguguugc

SEQ ID NO: 2507625 - RNA, 20 nt, Human
gcugaugucaauuucugugu

SEQ ID NO: 2507626 - RNA, 17 nt, Human
gcugaugucaauuucug

SEQ ID NO: 2507627 - RNA, 23 nt, Human
gcugauggauaaccuauaugauu

SEQ ID NO: 2507628 - RNA, 21 nt, Human
gcugauggugcaaugaccuuu

SEQ ID NO: 2507629 - RNA, 18 nt, Human
gcugauggugcaaugacc

SEQ ID NO: 2507630 - RNA, 18 nt, Human
gcugccaaggccagagug

SEQ ID NO: 2507631 - RNA, 22 nt, Human
gcugccaaggccagaguggccu

SEQ ID NO: 2507632 - RNA, 23 nt, Human
gcugccaaggccagaguggccug

SEQ ID NO: 2507633 - RNA, 22 nt, Human
gcugcauccuccaagaaucuau

SEQ ID NO: 2507634 - RNA, 18 nt, Human
gcugcaugccuggucuuu

SEQ ID NO: 2507635 - RNA, 14 nt, Human
gcugcaugccuggu

SEQ ID NO: 2507636 - RNA, 20 nt, Human
gcugcaugccuggucuuucc

SEQ ID NO: 2507637 - RNA, 22 nt, Human
gcugcauggggugggguagggc

SEQ ID NO: 2507638 - RNA, 18 nt, Human
gcugcauccuccaagaau

SEQ ID NO: 2507639 - RNA, 22 nt, Human
gcugcaucugggauucccacca

SEQ ID NO: 2507640 - RNA, 18 nt, Human
gcugauguucaguguaau

SEQ ID NO: 2507641 - RNA, 22 nt, Human
gcugcaucccccccaccucucc

SEQ ID NO: 2507642 - RNA, 19 nt, Human
guacuucuccacccugcuc

SEQ ID NO: 2507643 - RNA, 18 nt, Human
guacuucuccacccugcu

SEQ ID NO: 2507644 - RNA, 17 nt, Human
guacuucuccacccugc

SEQ ID NO: 2507645 - RNA, 16 nt, Human
guacuucuccacccug

SEQ ID NO: 2507646 - RNA, 22 nt, Human
guacuugaaaucuaggauuauu

SEQ ID NO: 2507647 - RNA, 22 nt, Human
guacuugccuuauuagaguguc

SEQ ID NO: 2507648 - RNA, 14 nt, Human
guacuugcucuuga

SEQ ID NO: 2507649 - RNA, 21 nt, Human
guacuucuccacccugcucuc

SEQ ID NO: 2507650 - RNA, 20 nt, Human
guacuucuccacccugcucu

SEQ ID NO: 2507651 - RNA, 19 nt, Human
guacuugcucuugaugccu

SEQ ID NO: 2507652 - RNA, 18 nt, Human
guacuugcucuugaugcc

SEQ ID NO: 2507653 - RNA, 16 nt, Human
guacuugcucuugaug

SEQ ID NO: 2507654 - RNA, 15 nt, Human
guacuugcucuugau

SEQ ID NO: 2507655 - RNA, 20 nt, Human
guacuuguggacacagcucu

SEQ ID NO: 2507656 - RNA, 16 nt, Human
guacuuguggacacag

SEQ ID NO: 2507657 - RNA, 22 nt, Human
guacuugcucuugaugccuggc

SEQ ID NO: 2507658 - RNA, 21 nt, Human
guacuuggaguauuggggucu

SEQ ID NO: 2507659 - RNA, 11 nt, Human
guacuugucaa

SEQ ID NO: 2507660 - RNA, 14 nt, Human
guacuugucaaaga

SEQ ID NO: 2507661 - RNA, 17 nt, Human
guagaaaggccuuuaaa

SEQ ID NO: 2507662 - RNA, 16 nt, Human
guagaaaggccuuuaa

SEQ ID NO: 2507663 - RNA, 14 nt, Human
guagaaaggccuuu

SEQ ID NO: 2507664 - RNA, 16 nt, Human
guagagcggagaaagg

SEQ ID NO: 2507665 - RNA, 15 nt, Human
guagaggagaaacug

SEQ ID NO: 2507666 - RNA, 21 nt, Human
guagagcuagaacauggagag

SEQ ID NO: 2507667 - RNA, 13 nt, Human
guagaaaagcuau

SEQ ID NO: 2507668 - RNA, 22 nt, Human
guacuuuuaugauguauauuua

SEQ ID NO: 2507669 - RNA, 20 nt, Human
guagaaaagggaacugaaca

SEQ ID NO: 2507670 - RNA, 15 nt, Human
guagaaacugcaggg

SEQ ID NO: 2507671 - RNA, 19 nt, Human
guagaaacugcagggaaaa

SEQ ID NO: 2507672 - RNA, 21 nt, Human
guagaaagacagagcugggau

SEQ ID NO: 2507673 - RNA, 18 nt, Human
guagaaagacagagcugg

SEQ ID NO: 2507674 - RNA, 23 nt, Human
guacuuuauuuucuauaauuuaa

SEQ ID NO: 2507675 - RNA, 16 nt, Human
guacuugucaaagaag

SEQ ID NO: 2507676 - RNA, 15 nt, Human
guacuugucaaagaa

SEQ ID NO: 2507677 - RNA, 17 nt, Human
guacuugucaaagaagg

SEQ ID NO: 2507678 - RNA, 21 nt, Human
guacuuguggacacagcucuu

SEQ ID NO: 2507679 - RNA, 14 nt, Human
guacuuuggaggcc

SEQ ID NO: 2507680 - RNA, 20 nt, Human
guacuuuuaugauguauauu

SEQ ID NO: 2507681 - RNA, 10 nt, Human
guacuuugug

SEQ ID NO: 2507682 - RNA, 19 nt, Human
guaccuuuuaacaccugau

SEQ ID NO: 2507683 - RNA, 23 nt, Human
guaccuuuugaggagccccagcu

SEQ ID NO: 2507684 - RNA, 21 nt, Human
guaccuuuugaggagccccag

SEQ ID NO: 2507685 - RNA, 13 nt, Human
guaccuuuuaaca

SEQ ID NO: 2507686 - RNA, 13 nt, Human
guaccuuugucac

SEQ ID NO: 2507687 - RNA, 15 nt, Human
guacgucugacaggc

SEQ ID NO: 2507688 - RNA, 14 nt, Human
guacgucugacagg

SEQ ID NO: 2507689 - RNA, 15 nt, Human
guacguugugcauuu

SEQ ID NO: 2507690 - RNA, 16 nt, Human
guacguugugcauuug

SEQ ID NO: 2507691 - RNA, 14 nt, Human
guacguugugcauu

SEQ ID NO: 2507692 - RNA, 17 nt, Human
guacgucugacaggcaa

SEQ ID NO: 2507693 - RNA, 17 nt, Human
guacguugugcauuugg

SEQ ID NO: 2507694 - RNA, 17 nt, Human
guacguuuguaugugug

SEQ ID NO: 2507695 - RNA, 14 nt, Human
guacguuuguaugu

SEQ ID NO: 2507696 - RNA, 21 nt, Human
guacguuauuguugacuuauu

SEQ ID NO: 2507697 - RNA, 15 nt, Human
guacguggagaggga

SEQ ID NO: 2507698 - RNA, 15 nt, Human
guacuaaggaaucuu

SEQ ID NO: 2507699 - RNA, 23 nt, Human
guacuaaggaaucuuucugcuuu

SEQ ID NO: 2507700 - RNA, 15 nt, Human
guacuucuccacccu

SEQ ID NO: 2507701 - RNA, 14 nt, Human
guacuucuccaccc

SEQ ID NO: 2507702 - RNA, 22 nt, Human
guacuaacuccuaggaaaauac

SEQ ID NO: 2507703 - RNA, 12 nt, Human
guacuacaauuu

SEQ ID NO: 2507704 - RNA, 15 nt, Human
guacuacaauuuaaa

SEQ ID NO: 2507705 - RNA, 19 nt, Human
guacccucucagcuccagg

SEQ ID NO: 2507706 - RNA, 18 nt, Human
guacccucucagcuccag

SEQ ID NO: 2507707 - RNA, 17 nt, Human
guacccucucagcucca

SEQ ID NO: 2507708 - RNA, 17 nt, Human
guacccuccuggcucuu

SEQ ID NO: 2507709 - RNA, 23 nt, Human
guacccccgcccaggcuggccag

SEQ ID NO: 2507710 - RNA, 20 nt, Human
guacccccgcccaggcuggc

SEQ ID NO: 2507711 - RNA, 19 nt, Human
guacccccgcccaggcugg

SEQ ID NO: 2507712 - RNA, 18 nt, Human
guacccccgcccaggcug

SEQ ID NO: 2507713 - RNA, 14 nt, Human
guacccccuucugg

SEQ ID NO: 2507714 - RNA, 12 nt, Human
guacccccuucu

SEQ ID NO: 2507715 - RNA, 15 nt, Human
guacccccuucuggg

SEQ ID NO: 2507716 - RNA, 23 nt, Human
guaccgccuugcacacucagaag

SEQ ID NO: 2507717 - RNA, 13 nt, Human
guaccuauaaagu

SEQ ID NO: 2507718 - RNA, 15 nt, Human
guacccucuggaggg

SEQ ID NO: 2507719 - RNA, 15 nt, Human
guaccgcaaugugac

SEQ ID NO: 2507720 - RNA, 16 nt, Human
guacccacugcucugg

SEQ ID NO: 2507721 - RNA, 20 nt, Human
guacccagccaucugcccag

SEQ ID NO: 2507722 - RNA, 18 nt, Human
guacccagccaucugccc

SEQ ID NO: 2507723 - RNA, 15 nt, Human
guacccagccaucug

SEQ ID NO: 2507724 - RNA, 12 nt, Human
guacccagccau

SEQ ID NO: 2507725 - RNA, 17 nt, Human
guacauauuuguggaau

SEQ ID NO: 2507726 - RNA, 19 nt, Human
guacauauuuguggaauaa

SEQ ID NO: 2507727 - RNA, 17 nt, Human
guacccccgcccaggcu

SEQ ID NO: 2507728 - RNA, 13 nt, Human
guacccccgccca

SEQ ID NO: 2507729 - RNA, 21 nt, Human
guaccccccaaccccugagga

SEQ ID NO: 2507730 - RNA, 14 nt, Human
guaccccccaaccc

SEQ ID NO: 2507731 - RNA, 14 nt, Human
guaccccacccuca

SEQ ID NO: 2507732 - RNA, 13 nt, Human
guaccccacccuc

SEQ ID NO: 2507733 - RNA, 12 nt, Human
guaccccacccu

SEQ ID NO: 2507734 - RNA, 21 nt, Human
guacccagccaucugcccagg

SEQ ID NO: 2507735 - RNA, 22 nt, Human
guaccccacccucagcaccccu

SEQ ID NO: 2507736 - RNA, 19 nt, Human
guaccccacccucagcacc

SEQ ID NO: 2507737 - RNA, 23 nt, Human
guaccccacccucagcaccccuu

SEQ ID NO: 2507738 - RNA, 18 nt, Human
guaccuauuuucauugua

SEQ ID NO: 2507739 - RNA, 13 nt, Human
guaccucuugagc

SEQ ID NO: 2507740 - RNA, 21 nt, Human
guaccucuugagccuugaacu

SEQ ID NO: 2507741 - RNA, 22 nt, Human
guaccucuugagccuugaacuu

SEQ ID NO: 2507742 - RNA, 14 nt, Human
guaccugaaaagua

SEQ ID NO: 2507743 - RNA, 12 nt, Human
guaccugaaaag

SEQ ID NO: 2507744 - RNA, 14 nt, Human
guaccuauuuucau

SEQ ID NO: 2507745 - RNA, 21 nt, Human
guaccuauaaaguaaagcuaa

SEQ ID NO: 2507746 - RNA, 20 nt, Human
guaccuauaaaguaaagcua

SEQ ID NO: 2507747 - RNA, 19 nt, Human
guaccuauaaaguaaagcu

SEQ ID NO: 2507748 - RNA, 14 nt, Human
guaccuauaaagua

SEQ ID NO: 2507749 - RNA, 23 nt, Human
guaccugaaaaguaacuuggcuu

SEQ ID NO: 2507750 - RNA, 18 nt, Human
guaccugaaaaguaacuu

SEQ ID NO: 2507751 - RNA, 17 nt, Human
guaccugcccccaaucc

SEQ ID NO: 2507752 - RNA, 15 nt, Human
guaccuggaggagga

SEQ ID NO: 2507753 - RNA, 19 nt, Human
guaccuguuccuuagaccu

SEQ ID NO: 2507754 - RNA, 17 nt, Human
guaccuggugaccccuu

SEQ ID NO: 2507755 - RNA, 14 nt, Human
guaccuugaacacu

SEQ ID NO: 2507756 - RNA, 18 nt, Human
guaccuugaacacugggg

SEQ ID NO: 2507757 - RNA, 23 nt, Human
guaccuugaacacugggggaggg

SEQ ID NO: 2507758 - RNA, 16 nt, Human
guacauaugugcugga

SEQ ID NO: 2507759 - RNA, 14 nt, Human
guacauaugugcug

SEQ ID NO: 2507760 - RNA, 18 nt, Human
guacauauguaaaauaaa

SEQ ID NO: 2507761 - RNA, 15 nt, Human
guacccacugcucug

SEQ ID NO: 2507762 - RNA, 22 nt, Human
guacauagccuauauuuacagu

SEQ ID NO: 2507763 - RNA, 15 nt, Human
guacauagccuauau

SEQ ID NO: 2507764 - RNA, 14 nt, Human
guacauagccuaua

SEQ ID NO: 2507765 - RNA, 13 nt, Human
guacauagccuau

SEQ ID NO: 2507766 - RNA, 17 nt, Human
guacauaguuauuuauu

SEQ ID NO: 2507767 - RNA, 18 nt, Human
guacauaguuauuuauuu

SEQ ID NO: 2507768 - RNA, 12 nt, Human
guacauagccua

SEQ ID NO: 2507769 - RNA, 20 nt, Human
guacauaaugcgugcauacc

SEQ ID NO: 2507770 - RNA, 22 nt, Human
guacauacccuggccgcccccu

SEQ ID NO: 2507771 - RNA, 19 nt, Human
guacauacccuggccgccc

SEQ ID NO: 2507772 - RNA, 14 nt, Human
guacauaacugaaa

SEQ ID NO: 2507773 - RNA, 22 nt, Human
guacauaaaggugguaugugug

SEQ ID NO: 2507774 - RNA, 23 nt, Human
guacauaaaggugguaugugugu

SEQ ID NO: 2507775 - RNA, 13 nt, Human
guacaguuuuuau

SEQ ID NO: 2507776 - RNA, 12 nt, Human
guacaguuuuua

SEQ ID NO: 2507777 - RNA, 14 nt, Human
guacagucugucau

SEQ ID NO: 2507778 - RNA, 15 nt, Human
guacagguaagguga

SEQ ID NO: 2507779 - RNA, 15 nt, Human
guacaggcagcacag

SEQ ID NO: 2507780 - RNA, 17 nt, Human
guacaggcagcacagag

SEQ ID NO: 2507781 - RNA, 14 nt, Human
guacagucuuguau

SEQ ID NO: 2507782 - RNA, 13 nt, Human
guacagucuugua

SEQ ID NO: 2507783 - RNA, 19 nt, Human
guacagucuugcagcagga

SEQ ID NO: 2507784 - RNA, 12 nt, Human
guacagucuguc

SEQ ID NO: 2507785 - RNA, 16 nt, Human
guacagucuuguauua

SEQ ID NO: 2507786 - RNA, 19 nt, Human
guacaguucaguuccucuu

SEQ ID NO: 2507787 - RNA, 16 nt, Human
guacaguucaguuccu

SEQ ID NO: 2507788 - RNA, 14 nt, Human
guacaguucaguuc

SEQ ID NO: 2507789 - RNA, 21 nt, Human
guacaguuauuuaugccucug

SEQ ID NO: 2507790 - RNA, 17 nt, Human
guacaguguucuguuua

SEQ ID NO: 2507791 - RNA, 16 nt, Human
guacaguguucuguuu

SEQ ID NO: 2507792 - RNA, 14 nt, Human
guacaguguucugu

SEQ ID NO: 2507793 - RNA, 16 nt, Human
guacaguguguaaagu

SEQ ID NO: 2507794 - RNA, 16 nt, Human
guacaguucuucggga

SEQ ID NO: 2507795 - RNA, 12 nt, Human
guacaguucuuc

SEQ ID NO: 2507796 - RNA, 23 nt, Human
guacaguucaguuccucuuugca

SEQ ID NO: 2507797 - RNA, 22 nt, Human
guacaguucaguuccucuuugc

SEQ ID NO: 2507798 - RNA, 14 nt, Human
guacaguuugcugu

SEQ ID NO: 2507799 - RNA, 16 nt, Human
guacaguuugcuguac

SEQ ID NO: 2507800 - RNA, 15 nt, Human
guacaguuugcugua

SEQ ID NO: 2507801 - RNA, 23 nt, Human
guacaguucuucgggaagagagg

SEQ ID NO: 2507802 - RNA, 22 nt, Human
guacaguucuucgggaagagag

SEQ ID NO: 2507803 - RNA, 18 nt, Human
guacaguuuguuuacaca

SEQ ID NO: 2507804 - RNA, 16 nt, Human
guacaguuuguuuaca

SEQ ID NO: 2507805 - RNA, 19 nt, Human
guacaguuuguuuacacac

SEQ ID NO: 2507806 - RNA, 16 nt, Human
guacagacaacaaacc

SEQ ID NO: 2507807 - RNA, 13 nt, Human
guacagaaagcug

SEQ ID NO: 2507808 - RNA, 20 nt, Human
guacagaauucugcuaccuc

SEQ ID NO: 2507809 - RNA, 15 nt, Human
guacagacagaaaaa

SEQ ID NO: 2507810 - RNA, 12 nt, Human
guacacuuuuuu

SEQ ID NO: 2507811 - RNA, 14 nt, Human
guacagaaagcugc

SEQ ID NO: 2507812 - RNA, 21 nt, Human
guacagagaacuaacacuauu

SEQ ID NO: 2507813 - RNA, 20 nt, Human
guacagagaacuaacacuau

SEQ ID NO: 2507814 - RNA, 17 nt, Human
guacagacguaugcuua

SEQ ID NO: 2507815 - RNA, 19 nt, Human
guacacuguuucaaacuuu

SEQ ID NO: 2507816 - RNA, 20 nt, Human
guacacuguuucaaacuuua

SEQ ID NO: 2507817 - RNA, 21 nt, Human
guacacuguuucaaacuuuac

SEQ ID NO: 2507818 - RNA, 14 nt, Human
guaauugugaaaaa

SEQ ID NO: 2507819 - RNA, 22 nt, Human
guacagagcccacgcccccacu

SEQ ID NO: 2507820 - RNA, 18 nt, Human
guacagagcccacgcccc

SEQ ID NO: 2507821 - RNA, 12 nt, Human
guacagagccca

SEQ ID NO: 2507822 - RNA, 20 nt, Human
guacagcaaggagauuuaca

SEQ ID NO: 2507823 - RNA, 19 nt, Human
guacagaugaaugauaaac

SEQ ID NO: 2507824 - RNA, 18 nt, Human
guacagcuguuuaagaug

SEQ ID NO: 2507825 - RNA, 12 nt, Human
guacaggcagca

SEQ ID NO: 2507826 - RNA, 12 nt, Human
guaaugucacca

SEQ ID NO: 2507827 - RNA, 19 nt, Human
guaaugucaccaccuuccc

SEQ ID NO: 2507828 - RNA, 20 nt, Human
guaaugucaccaccuuccca

SEQ ID NO: 2507829 - RNA, 22 nt, Human
guaaugucaccaccuucccagc

SEQ ID NO: 2507830 - RNA, 13 nt, Human
guaauguuacuga

SEQ ID NO: 2507831 - RNA, 14 nt, Human
guaauguuacugau

SEQ ID NO: 2507832 - RNA, 17 nt, Human
guaauguuacugaucau

SEQ ID NO: 2507833 - RNA, 20 nt, Human
guaauguuacugaucaugca

SEQ ID NO: 2507834 - RNA, 21 nt, Human
guaauguuacugaucaugcau

SEQ ID NO: 2507835 - RNA, 14 nt, Human
guaaugugaauaaa

SEQ ID NO: 2507836 - RNA, 16 nt, Human
guaaugugaauaaauu

SEQ ID NO: 2507837 - RNA, 20 nt, Human
guaaugauauagccagaaaa

SEQ ID NO: 2507838 - RNA, 15 nt, Human
guaaugagggacugg

SEQ ID NO: 2507839 - RNA, 20 nt, Human
guaaugcuacgugugauuuu

SEQ ID NO: 2507840 - RNA, 21 nt, Human
guaaugauauagccagaaaaa

SEQ ID NO: 2507841 - RNA, 18 nt, Human
guaaugcuacgugugauu

SEQ ID NO: 2507842 - RNA, 16 nt, Human
guaaugcuucaaucag

SEQ ID NO: 2507843 - RNA, 20 nt, Human
guaaugcuuagagaauguuc

SEQ ID NO: 2507844 - RNA, 22 nt, Human
guaaugcuacgugugauuuuuc

SEQ ID NO: 2507845 - RNA, 19 nt, Human
guaaugauaacuggaaacu

SEQ ID NO: 2507846 - RNA, 18 nt, Human
guaaugaugucguuugaa

SEQ ID NO: 2507847 - RNA, 14 nt, Human
guaaugagggacug

SEQ ID NO: 2507848 - RNA, 21 nt, Human
guaaugaauuuuuaugauauu

SEQ ID NO: 2507849 - RNA, 15 nt, Human
guaaugaaacuugga

SEQ ID NO: 2507850 - RNA, 20 nt, Human
guaaucuguguacaaagaaa

SEQ ID NO: 2507851 - RNA, 19 nt, Human
guaaugaaccgcugaauau

SEQ ID NO: 2507852 - RNA, 17 nt, Human
guaaugaaccgcugaau

SEQ ID NO: 2507853 - RNA, 22 nt, Human
guaaugaaacaccuucucugga

SEQ ID NO: 2507854 - RNA, 10 nt, Human
guaaugaaac

SEQ ID NO: 2507855 - RNA, 16 nt, Human
guaaugaaacuuggau

SEQ ID NO: 2507856 - RNA, 13 nt, Human
guaaugaaaacca

SEQ ID NO: 2507857 - RNA, 11 nt, Human
guaaugaaaac

SEQ ID NO: 2507858 - RNA, 21 nt, Human
guaagugggguugcaaccacu

SEQ ID NO: 2507859 - RNA, 14 nt, Human
guaagugccuucca

SEQ ID NO: 2507860 - RNA, 13 nt, Human
guaagugccuucc

SEQ ID NO: 2507861 - RNA, 15 nt, Human
guaaucguguccccu

SEQ ID NO: 2507862 - RNA, 22 nt, Human
guaaucuaugaauucuaaguga

SEQ ID NO: 2507863 - RNA, 22 nt, Human
guaaucuccacagucaaagaag

SEQ ID NO: 2507864 - RNA, 18 nt, Human
guaaucguuaugugugua

SEQ ID NO: 2507865 - RNA, 22 nt, Human
guaagugggguugcaaccacug

SEQ ID NO: 2507866 - RNA, 17 nt, Human
guaaucgcuuaaagaug

SEQ ID NO: 2507867 - RNA, 16 nt, Human
guaaucguuaugugug

SEQ ID NO: 2507868 - RNA, 16 nt, Human
guaaucugauggcuuc

SEQ ID NO: 2507869 - RNA, 16 nt, Human
guaaucuguguacaaa

SEQ ID NO: 2507870 - RNA, 12 nt, Human
guaaucugugua

SEQ ID NO: 2507871 - RNA, 20 nt, Human
guaaucucguuucaaaaaca

SEQ ID NO: 2507872 - RNA, 18 nt, Human
guaaucucguuucaaaaa

SEQ ID NO: 2507873 - RNA, 16 nt, Human
guaaucucguuucaaa

SEQ ID NO: 2507874 - RNA, 23 nt, Human
guaauuaguaacauguguuaagu

SEQ ID NO: 2507875 - RNA, 20 nt, Human
guaauuaucgggaacagugu

SEQ ID NO: 2507876 - RNA, 12 nt, Human
guaauuauugug

SEQ ID NO: 2507877 - RNA, 22 nt, Human
guaauuaucgggaacaguguuu

SEQ ID NO: 2507878 - RNA, 19 nt, Human
guaauuaaaagaauuuucc

SEQ ID NO: 2507879 - RNA, 15 nt, Human
guaauuaguaacaug

SEQ ID NO: 2507880 - RNA, 21 nt, Human
guaauuaaguacuauguauca

SEQ ID NO: 2507881 - RNA, 22 nt, Human
guaauguuacugaucaugcauu

SEQ ID NO: 2507882 - RNA, 23 nt, Human
guaauguuacugaucaugcauug

SEQ ID NO: 2507883 - RNA, 14 nt, Human
guaauuaaguacua

SEQ ID NO: 2507884 - RNA, 17 nt, Human
guaauuaaguacuaugu

SEQ ID NO: 2507885 - RNA, 20 nt, Human
guaauuaaguacuauguauc

SEQ ID NO: 2507886 - RNA, 15 nt, Human
guaauucuaaaugaa

SEQ ID NO: 2507887 - RNA, 14 nt, Human
guaauucuaaauga

SEQ ID NO: 2507888 - RNA, 21 nt, Human
guaauuccucucacuaaacuu

SEQ ID NO: 2507889 - RNA, 12 nt, Human
guaauucuaaau

SEQ ID NO: 2507890 - RNA, 22 nt, Human
guaauucuaaaugaauguuuac

SEQ ID NO: 2507891 - RNA, 18 nt, Human
guaauucuaaaugaaugu

SEQ ID NO: 2507892 - RNA, 14 nt, Human
guaauucaagaaaa

SEQ ID NO: 2507893 - RNA, 13 nt, Human
guaauucaagaaa

SEQ ID NO: 2507894 - RNA, 17 nt, Human
guaauuauuuugguacu

SEQ ID NO: 2507895 - RNA, 23 nt, Human
guaauuauugugauuucccgugg

SEQ ID NO: 2507896 - RNA, 21 nt, Human
guaauuaucgggaacaguguu

SEQ ID NO: 2507897 - RNA, 18 nt, Human
guacacuguuucaaacuu

SEQ ID NO: 2507898 - RNA, 22 nt, Human
guaauugcuuacauuuuuacaa

SEQ ID NO: 2507899 - RNA, 17 nt, Human
guaauugcuuacauuuu

SEQ ID NO: 2507900 - RNA, 16 nt, Human
guaauugcuuacauuu

SEQ ID NO: 2507901 - RNA, 15 nt, Human
guaauugcuuacauu

SEQ ID NO: 2507902 - RNA, 23 nt, Human
guaauugcuuacauuuuuacaau

SEQ ID NO: 2507903 - RNA, 13 nt, Human
guaauugugaaaa

SEQ ID NO: 2507904 - RNA, 15 nt, Human
guaauuggaaaggca

SEQ ID NO: 2507905 - RNA, 15 nt, Human
guaauugacaugugc

SEQ ID NO: 2507906 - RNA, 12 nt, Human
guaauugcuuac

SEQ ID NO: 2507907 - RNA, 16 nt, Human
guaauugaauaaaguu

SEQ ID NO: 2507908 - RNA, 15 nt, Human
guaauugaacuuauc

SEQ ID NO: 2507909 - RNA, 23 nt, Human
gguggcccugucccucccaccuc

SEQ ID NO: 2507910 - RNA, 13 nt, Human
gguggcccugucc

SEQ ID NO: 2507911 - RNA, 20 nt, Human
gguggcccgacagccuggca

SEQ ID NO: 2507912 - RNA, 19 nt, Human
gguggcccgacagccuggc

SEQ ID NO: 2507913 - RNA, 18 nt, Human
gguggcccgacagccugg

SEQ ID NO: 2507914 - RNA, 17 nt, Human
gguggcccgacagccug

SEQ ID NO: 2507915 - RNA, 16 nt, Human
gguggcccgacagccu

SEQ ID NO: 2507916 - RNA, 22 nt, Human
gguggcccauccccccucacca

SEQ ID NO: 2507917 - RNA, 13 nt, Human
gguggcccauccc

SEQ ID NO: 2507918 - RNA, 19 nt, Human
gguggcccacgccuguaau

SEQ ID NO: 2507919 - RNA, 20 nt, Human
gguggccgcugaguggcagg

SEQ ID NO: 2507920 - RNA, 21 nt, Human
gguggccgcugaguggcaggg

SEQ ID NO: 2507921 - RNA, 19 nt, Human
gguggccuaagaguugagc

SEQ ID NO: 2507922 - RNA, 13 nt, Human
gguggccucccaa

SEQ ID NO: 2507923 - RNA, 17 nt, Human
gguggccucccaacuca

SEQ ID NO: 2507924 - RNA, 21 nt, Human
gguucaagcgauucuucugcu

SEQ ID NO: 2507925 - RNA, 18 nt, Human
gguucuuucuuccucugc

SEQ ID NO: 2507926 - RNA, 17 nt, Human
gguucuuuggaaggagu

SEQ ID NO: 2507927 - RNA, 15 nt, Human
gguucuuuggaagga

SEQ ID NO: 2507928 - RNA, 21 nt, Human
gguucagccccuccucugcca

SEQ ID NO: 2507929 - RNA, 22 nt, Human
gguucagccccuccucugccac

SEQ ID NO: 2507930 - RNA, 14 nt, Human
gguugaagcaccaa

SEQ ID NO: 2507931 - RNA, 17 nt, Human
gguucuuucuuccucug

SEQ ID NO: 2507932 - RNA, 12 nt, Human
gguucagcuugu

SEQ ID NO: 2507933 - RNA, 16 nt, Human
gguucagagacucagg

SEQ ID NO: 2507934 - RNA, 14 nt, Human
gguucagccccucc

SEQ ID NO: 2507935 - RNA, 16 nt, Human
gguucagccccuccuc

SEQ ID NO: 2507936 - RNA, 17 nt, Human
gguucagccccuccucu

SEQ ID NO: 2507937 - RNA, 18 nt, Human
gguucagccccuccucug

SEQ ID NO: 2507938 - RNA, 19 nt, Human
gguucagccccuccucugc

SEQ ID NO: 2507939 - RNA, 20 nt, Human
gguucagccccuccucugcc

SEQ ID NO: 2507940 - RNA, 23 nt, Human
gguucaagcgauucuucugcuuc

SEQ ID NO: 2507941 - RNA, 22 nt, Human
gguucaagcgauucuucugcuu

SEQ ID NO: 2507942 - RNA, 20 nt, Human
gguucacugcaaccuccgcc

SEQ ID NO: 2507943 - RNA, 19 nt, Human
gguucagaaaugcugccug

SEQ ID NO: 2507944 - RNA, 18 nt, Human
gguucagaaaugcugccu

SEQ ID NO: 2507945 - RNA, 22 nt, Human
gguucagaaaugcugccugccu

SEQ ID NO: 2507946 - RNA, 16 nt, Human
gguucagaaaugcugc

SEQ ID NO: 2507947 - RNA, 14 nt, Human
gguuguauucuuug

SEQ ID NO: 2507948 - RNA, 17 nt, Human
gguuggugcacagugau

SEQ ID NO: 2507949 - RNA, 19 nt, Human
gguuguauuagauguucuc

SEQ ID NO: 2507950 - RNA, 16 nt, Human
gguuggugcacaguga

SEQ ID NO: 2507951 - RNA, 14 nt, Human
gguuggugcacagu

SEQ ID NO: 2507952 - RNA, 18 nt, Human
gguuguauuagauguucu

SEQ ID NO: 2507953 - RNA, 13 nt, Human
gguuggugggggc

SEQ ID NO: 2507954 - RNA, 21 nt, Human
gguugugaggccuggccaggc

SEQ ID NO: 2507955 - RNA, 16 nt, Human
gguugugaggccuggc

SEQ ID NO: 2507956 - RNA, 14 nt, Human
gguugugaggccug

SEQ ID NO: 2507957 - RNA, 13 nt, Human
gguugugaggccu

SEQ ID NO: 2507958 - RNA, 21 nt, Human
gguugucuguuuuuguaacuu

SEQ ID NO: 2507959 - RNA, 20 nt, Human
gguuguauucuuugauguua

SEQ ID NO: 2507960 - RNA, 19 nt, Human
gguuguauucuuugauguu

SEQ ID NO: 2507961 - RNA, 16 nt, Human
gguuguauucuuugau

SEQ ID NO: 2507962 - RNA, 15 nt, Human
gguuguauucuuuga

SEQ ID NO: 2507963 - RNA, 10 nt, Human
gguugucaau

SEQ ID NO: 2507964 - RNA, 22 nt, Human
gguuguauucuuugauguuaac

SEQ ID NO: 2507965 - RNA, 13 nt, Human
gguugucaauauu

SEQ ID NO: 2507966 - RNA, 13 nt, Human
gguuuaacucaga

SEQ ID NO: 2507967 - RNA, 19 nt, Human
gguuuaaacuucucugaag

SEQ ID NO: 2507968 - RNA, 22 nt, Human
gguugugaggccuggccaggca

SEQ ID NO: 2507969 - RNA, 23 nt, Human
gguuuaacucagaucacuacugc

SEQ ID NO: 2507970 - RNA, 20 nt, Human
gguuuaacucagaucacuac

SEQ ID NO: 2507971 - RNA, 18 nt, Human
gguuuaacucagaucacu

SEQ ID NO: 2507972 - RNA, 17 nt, Human
gguuuaacucagaucac

SEQ ID NO: 2507973 - RNA, 14 nt, Human
gguuuaacucagau

SEQ ID NO: 2507974 - RNA, 13 nt, Human
gguuuaagcuguu

SEQ ID NO: 2507975 - RNA, 18 nt, Human
gguuggcaaaaaggcagg

SEQ ID NO: 2507976 - RNA, 19 nt, Human
gguugcuguuuuccucccu

SEQ ID NO: 2507977 - RNA, 20 nt, Human
gguugcuguuuuccucccuu

SEQ ID NO: 2507978 - RNA, 21 nt, Human
gguugcuguuuuccucccuuc

SEQ ID NO: 2507979 - RNA, 21 nt, Human
gguuggaagcuagcuccccuc

SEQ ID NO: 2507980 - RNA, 22 nt, Human
gguuggaagugagggucagaga

SEQ ID NO: 2507981 - RNA, 14 nt, Human
gguugggcuggugu

SEQ ID NO: 2507982 - RNA, 19 nt, Human
gguugguccucuugccucc

SEQ ID NO: 2507983 - RNA, 15 nt, Human
gguuggagagcuaga

SEQ ID NO: 2507984 - RNA, 23 nt, Human
gguugggauugggggcuggugcc

SEQ ID NO: 2507985 - RNA, 17 nt, Human
gguugggcccagaucug

SEQ ID NO: 2507986 - RNA, 19 nt, Human
gguugaagaggugagcacg

SEQ ID NO: 2507987 - RNA, 15 nt, Human
gguucuuuguuuuaa

SEQ ID NO: 2507988 - RNA, 11 nt, Human
gguugaauaaa

SEQ ID NO: 2507989 - RNA, 15 nt, Human
gguugaccccagagg

SEQ ID NO: 2507990 - RNA, 16 nt, Human
gguugaccccagagga

SEQ ID NO: 2507991 - RNA, 18 nt, Human
gguugcagugagccaaga

SEQ ID NO: 2507992 - RNA, 12 nt, Human
gguugccacagg

SEQ ID NO: 2507993 - RNA, 16 nt, Human
gguugcugguugcugu

SEQ ID NO: 2507994 - RNA, 18 nt, Human
gguugcugguugcugugu

SEQ ID NO: 2507995 - RNA, 17 nt, Human
gguugcugguugcugug

SEQ ID NO: 2507996 - RNA, 22 nt, Human
gguugcuguugaugaggccucu

SEQ ID NO: 2507997 - RNA, 18 nt, Human
gguugcuguuuuccuccc

SEQ ID NO: 2507998 - RNA, 18 nt, Human
gguugccacaggccuccc

SEQ ID NO: 2507999 - RNA, 14 nt, Human
gguugccacaggcc

SEQ ID NO: 2508000 - RNA, 13 nt, Human
gguugccacaggc

SEQ ID NO: 2508001 - RNA, 16 nt, Human
gguugcggggggaggg

SEQ ID NO: 2508002 - RNA, 20 nt, Human
gguugccacaggccucccug

SEQ ID NO: 2508003 - RNA, 14 nt, Human
guaaaaccacagca

SEQ ID NO: 2508004 - RNA, 15 nt, Human
guaaaaccacagcag

SEQ ID NO: 2508005 - RNA, 16 nt, Human
guaaaaccacagcagu

SEQ ID NO: 2508006 - RNA, 18 nt, Human
guaaaaccacagcaguug

SEQ ID NO: 2508007 - RNA, 23 nt, Human
guaaaaccacagcaguugaaaag

SEQ ID NO: 2508008 - RNA, 17 nt, Human
guaaaagauaacaagau

SEQ ID NO: 2508009 - RNA, 15 nt, Human
guaaaagacuuuuuu

SEQ ID NO: 2508010 - RNA, 21 nt, Human
guaaaacuacacaucccuaau

SEQ ID NO: 2508011 - RNA, 13 nt, Human
guaaaacugaggc

SEQ ID NO: 2508012 - RNA, 15 nt, Human
guaaaacugaggcac

SEQ ID NO: 2508013 - RNA, 18 nt, Human
guaaaagaacaguaaaca

SEQ ID NO: 2508014 - RNA, 19 nt, Human
guaaaaaaaaaugccuuug

SEQ ID NO: 2508015 - RNA, 13 nt, Human
guaaaaaaaaaug

SEQ ID NO: 2508016 - RNA, 18 nt, Human
guaaaaaaaaaaaaguua

SEQ ID NO: 2508017 - RNA, 18 nt, Human
guaaaaacaaagaaauua

SEQ ID NO: 2508018 - RNA, 20 nt, Human
guaaaaacaaagaaauuaug

SEQ ID NO: 2508019 - RNA, 23 nt, Human
guaaaaaaaaaugccuuugagac

SEQ ID NO: 2508020 - RNA, 20 nt, Human
guaaaaaaaaaugccuuuga

SEQ ID NO: 2508021 - RNA, 18 nt, Human
guaaaaacagcauugcuu

SEQ ID NO: 2508022 - RNA, 23 nt, Human
guaaaaacagcauugcuuucuga

SEQ ID NO: 2508023 - RNA, 19 nt, Human
guaaaaacagcauugcuuu

SEQ ID NO: 2508024 - RNA, 21 nt, Human
guaaaaacagcauugcuuucu

SEQ ID NO: 2508025 - RNA, 13 nt, Human
guaaaaauaaaau

SEQ ID NO: 2508026 - RNA, 14 nt, Human
guaaaaauuaaaaa

SEQ ID NO: 2508027 - RNA, 20 nt, Human
guaaaacaaaaauguaauga

SEQ ID NO: 2508028 - RNA, 14 nt, Human
guaaaaauaaaauu

SEQ ID NO: 2508029 - RNA, 12 nt, Human
guaaaaauacaa

SEQ ID NO: 2508030 - RNA, 20 nt, Human
gguuuuucaauuaaacggau

SEQ ID NO: 2508031 - RNA, 19 nt, Human
gguuuuucaauuaaacgga

SEQ ID NO: 2508032 - RNA, 18 nt, Human
gguuuuucaauuaaacgg

SEQ ID NO: 2508033 - RNA, 17 nt, Human
gguuuuucaauuaaacg

SEQ ID NO: 2508034 - RNA, 12 nt, Human
gguuuuucccug

SEQ ID NO: 2508035 - RNA, 23 nt, Human
gguuuuuguuuguuuccuuuguu

SEQ ID NO: 2508036 - RNA, 16 nt, Human
guaaaaaaaaaaaagu

SEQ ID NO: 2508037 - RNA, 21 nt, Human
gguuuuuuuguacuuuguaca

SEQ ID NO: 2508038 - RNA, 14 nt, Human
gguuuuuuaauaua

SEQ ID NO: 2508039 - RNA, 20 nt, Human
gguuuuuuguguacuuuuug

SEQ ID NO: 2508040 - RNA, 15 nt, Human
gguuuuguuugcuau

SEQ ID NO: 2508041 - RNA, 12 nt, Human
gguuuuguuugc

SEQ ID NO: 2508042 - RNA, 14 nt, Human
gguuuuuacuguua

SEQ ID NO: 2508043 - RNA, 15 nt, Human
gguuuuuauuaguac

SEQ ID NO: 2508044 - RNA, 16 nt, Human
gguuuuucaauuaaac

SEQ ID NO: 2508045 - RNA, 15 nt, Human
gguuuuucaauuaaa

SEQ ID NO: 2508046 - RNA, 14 nt, Human
gguuuuucaauuaa

SEQ ID NO: 2508047 - RNA, 13 nt, Human
gguuuuucaauua

SEQ ID NO: 2508048 - RNA, 12 nt, Human
gguuuuucaauu

SEQ ID NO: 2508049 - RNA, 17 nt, Human
gguuuuguauucucuga

SEQ ID NO: 2508050 - RNA, 18 nt, Human
gguuuuguauucucugag

SEQ ID NO: 2508051 - RNA, 19 nt, Human
gguuuuguauucucugagc

SEQ ID NO: 2508052 - RNA, 14 nt, Human
gguuuuguuccccu

SEQ ID NO: 2508053 - RNA, 16 nt, Human
gguuuuuaaaacccag

SEQ ID NO: 2508054 - RNA, 22 nt, Human
gguuuuguuccccuccuccacu

SEQ ID NO: 2508055 - RNA, 19 nt, Human
gguuuuguuccccuccucc

SEQ ID NO: 2508056 - RNA, 23 nt, Human
gguuuugccauguuggccaggcu

SEQ ID NO: 2508057 - RNA, 17 nt, Human
gguuuuguaagaugcug

SEQ ID NO: 2508058 - RNA, 19 nt, Human
gguuuugcuauuagacugu

SEQ ID NO: 2508059 - RNA, 21 nt, Human
gguuuuggcaaacgcuaaaga

SEQ ID NO: 2508060 - RNA, 20 nt, Human
gguuuuguaagaugcugggu

SEQ ID NO: 2508061 - RNA, 19 nt, Human
gguuuuguaagaugcuggg

SEQ ID NO: 2508062 - RNA, 11 nt, Human
gguuuuguaca

SEQ ID NO: 2508063 - RNA, 13 nt, Human
gguuuuguacaau

SEQ ID NO: 2508064 - RNA, 17 nt, Human
gguuuacaauuuacaaa

SEQ ID NO: 2508065 - RNA, 21 nt, Human
gguuuacaauuuacaaagugu

SEQ ID NO: 2508066 - RNA, 22 nt, Human
gguuuaauccccaguaaaauug

SEQ ID NO: 2508067 - RNA, 19 nt, Human
gguuuaauccccaguaaaa

SEQ ID NO: 2508068 - RNA, 22 nt, Human
gguuuacauucaucucauucca

SEQ ID NO: 2508069 - RNA, 19 nt, Human
gguuuacauucaucucauu

SEQ ID NO: 2508070 - RNA, 23 nt, Human
gguuuacucuguggccaaaggag

SEQ ID NO: 2508071 - RNA, 14 nt, Human
gguuuucuggaugg

SEQ ID NO: 2508072 - RNA, 15 nt, Human
gguuuucuggguguc

SEQ ID NO: 2508073 - RNA, 19 nt, Human
gguuuucgaagcucagccc

SEQ ID NO: 2508074 - RNA, 18 nt, Human
gguuuuccccucccuggg

SEQ ID NO: 2508075 - RNA, 13 nt, Human
gguuuuccccucc

SEQ ID NO: 2508076 - RNA, 12 nt, Human
gguuuucuguuc

SEQ ID NO: 2508077 - RNA, 13 nt, Human
gguuuucuguucu

SEQ ID NO: 2508078 - RNA, 15 nt, Human
gguuuucuguucuuu

SEQ ID NO: 2508079 - RNA, 13 nt, Human
gguuuugacugga

SEQ ID NO: 2508080 - RNA, 14 nt, Human
gguuuucuucccau

SEQ ID NO: 2508081 - RNA, 17 nt, Human
gguuuucuuaaccaucu

SEQ ID NO: 2508082 - RNA, 18 nt, Human
gguuuucuuaaccaucuu

SEQ ID NO: 2508083 - RNA, 13 nt, Human
guaaggaaugauu

SEQ ID NO: 2508084 - RNA, 23 nt, Human
guaaggaauaccugucccccuga

SEQ ID NO: 2508085 - RNA, 21 nt, Human
guaaggaauaccugucccccu

SEQ ID NO: 2508086 - RNA, 20 nt, Human
guaaggaauaccuguccccc

SEQ ID NO: 2508087 - RNA, 13 nt, Human
guaagcucuggcu

SEQ ID NO: 2508088 - RNA, 18 nt, Human
guaaggaauaccuguccc

SEQ ID NO: 2508089 - RNA, 19 nt, Human
guaagcuguuuauuuuaua

SEQ ID NO: 2508090 - RNA, 12 nt, Human
guaagcuguuua

SEQ ID NO: 2508091 - RNA, 17 nt, Human
guaagcucuggcuuucu

SEQ ID NO: 2508092 - RNA, 17 nt, Human
guaagcugcucuauugu

SEQ ID NO: 2508093 - RNA, 15 nt, Human
guaagggaaauagaa

SEQ ID NO: 2508094 - RNA, 20 nt, Human
guaaggcuguguacacugac

SEQ ID NO: 2508095 - RNA, 18 nt, Human
guaagggaaacugccagc

SEQ ID NO: 2508096 - RNA, 17 nt, Human
guaagggaaacugccag

SEQ ID NO: 2508097 - RNA, 23 nt, Human
guaaggcagggucccauuucuca

SEQ ID NO: 2508098 - RNA, 14 nt, Human
guaaggcaugaagg

SEQ ID NO: 2508099 - RNA, 16 nt, Human
guaaggugcaguuccc

SEQ ID NO: 2508100 - RNA, 13 nt, Human
guaaggugcaguu

SEQ ID NO: 2508101 - RNA, 14 nt, Human
guaaggugagggaa

SEQ ID NO: 2508102 - RNA, 12 nt, Human
guaaggugccuu

SEQ ID NO: 2508103 - RNA, 13 nt, Human
guaaguaauuauc

SEQ ID NO: 2508104 - RNA, 23 nt, Human
guaaguaauuaucgggaacagug

SEQ ID NO: 2508105 - RNA, 12 nt, Human
guaagucuuuuu

SEQ ID NO: 2508106 - RNA, 12 nt, Human
guaagugccuuc

SEQ ID NO: 2508107 - RNA, 18 nt, Human
guaaguaccacucaggcc

SEQ ID NO: 2508108 - RNA, 22 nt, Human
guaaguauucuuauuuaaugaa

SEQ ID NO: 2508109 - RNA, 20 nt, Human
guaacuucuuauggaauuga

SEQ ID NO: 2508110 - RNA, 21 nt, Human
guaacuucuuauggaauugau

SEQ ID NO: 2508111 - RNA, 18 nt, Human
guaacuucuuauggaauu

SEQ ID NO: 2508112 - RNA, 13 nt, Human
guaacuguucuug

SEQ ID NO: 2508113 - RNA, 23 nt, Human
guaaauuaacuuuuauaaacuuu

SEQ ID NO: 2508114 - RNA, 19 nt, Human
guaacuguuaaauugcugu

SEQ ID NO: 2508115 - RNA, 14 nt, Human
guaacugugucaug

SEQ ID NO: 2508116 - RNA, 22 nt, Human
guaacuguuaaauugcugugua

SEQ ID NO: 2508117 - RNA, 14 nt, Human
guaacuuuuguaag

SEQ ID NO: 2508118 - RNA, 15 nt, Human
guaacuuuuguaaga

SEQ ID NO: 2508119 - RNA, 17 nt, Human
guaacuuuuguaagaca

SEQ ID NO: 2508120 - RNA, 22 nt, Human
guaagaaaauauuuugucuaaa

SEQ ID NO: 2508121 - RNA, 14 nt, Human
guaagaaaauauuu

SEQ ID NO: 2508122 - RNA, 13 nt, Human
guaagaaaauauu

SEQ ID NO: 2508123 - RNA, 17 nt, Human
guaagaaaagugguugu

SEQ ID NO: 2508124 - RNA, 20 nt, Human
guaagaaagugaagcaaauc

SEQ ID NO: 2508125 - RNA, 23 nt, Human
guaagaaaauauuuugucuaaaa

SEQ ID NO: 2508126 - RNA, 20 nt, Human
guaagaaacacacugaggca

SEQ ID NO: 2508127 - RNA, 12 nt, Human
guaacuuuaugu

SEQ ID NO: 2508128 - RNA, 15 nt, Human
guaacuuuaugugua

SEQ ID NO: 2508129 - RNA, 14 nt, Human
guaacuuuaugugu

SEQ ID NO: 2508130 - RNA, 18 nt, Human
guaacuuggauguagcca

SEQ ID NO: 2508131 - RNA, 16 nt, Human
guaacuuuauguguaa

SEQ ID NO: 2508132 - RNA, 19 nt, Human
guaacuuuuguaaauacac

SEQ ID NO: 2508133 - RNA, 12 nt, Human
guaagaaauacu

SEQ ID NO: 2508134 - RNA, 13 nt, Human
guaagaaauacug

SEQ ID NO: 2508135 - RNA, 17 nt, Human
guaagaaccuugccuga

SEQ ID NO: 2508136 - RNA, 16 nt, Human
guaagaaccuugccug

SEQ ID NO: 2508137 - RNA, 15 nt, Human
guaagaaccuugccu

SEQ ID NO: 2508138 - RNA, 17 nt, Human
guaagaaauacuguaca

SEQ ID NO: 2508139 - RNA, 17 nt, Human
guaagagcaccuuccuc

SEQ ID NO: 2508140 - RNA, 15 nt, Human
guaagacaaagguuu

SEQ ID NO: 2508141 - RNA, 16 nt, Human
guaagacaauccaugu

SEQ ID NO: 2508142 - RNA, 15 nt, Human
guaagaagacaugaa

SEQ ID NO: 2508143 - RNA, 13 nt, Human
guaagaagagacu

SEQ ID NO: 2508144 - RNA, 11 nt, Human
guaagaagccg

SEQ ID NO: 2508145 - RNA, 15 nt, Human
guaagaagagacugg

SEQ ID NO: 2508146 - RNA, 16 nt, Human
guaagaugcuggguug

SEQ ID NO: 2508147 - RNA, 12 nt, Human
guaagaugcugg

SEQ ID NO: 2508148 - RNA, 20 nt, Human
guaagaugcuggguuggugc

SEQ ID NO: 2508149 - RNA, 11 nt, Human
guaagaugcug

SEQ ID NO: 2508150 - RNA, 21 nt, Human
guaagagcaccuuccucacuu

SEQ ID NO: 2508151 - RNA, 20 nt, Human
guaagagcaccuuccucacu

SEQ ID NO: 2508152 - RNA, 14 nt, Human
guaagagcuggugu

SEQ ID NO: 2508153 - RNA, 16 nt, Human
guaagagcuggugucu

SEQ ID NO: 2508154 - RNA, 17 nt, Human
guaagaguguagaagca

SEQ ID NO: 2508155 - RNA, 15 nt, Human
guaagaguguagaag

SEQ ID NO: 2508156 - RNA, 14 nt, Human
guaagaguguagaa

SEQ ID NO: 2508157 - RNA, 22 nt, Human
guaagaguguagaagcauuccu

SEQ ID NO: 2508158 - RNA, 18 nt, Human
guaagaguguagaagcau

SEQ ID NO: 2508159 - RNA, 19 nt, Human
guaagaucguucucugccu

SEQ ID NO: 2508160 - RNA, 14 nt, Human
guaaaucuuuuaca

SEQ ID NO: 2508161 - RNA, 18 nt, Human
guaaaugggggugcauuu

SEQ ID NO: 2508162 - RNA, 19 nt, Human
guaaaugggggugcauuug

SEQ ID NO: 2508163 - RNA, 20 nt, Human
guaaaugggggugcauuuga

SEQ ID NO: 2508164 - RNA, 15 nt, Human
guaaauccuuuuucu

SEQ ID NO: 2508165 - RNA, 16 nt, Human
guaaauccuuuuucuu

SEQ ID NO: 2508166 - RNA, 22 nt, Human
guaaauccuuuuucuuuauaaa

SEQ ID NO: 2508167 - RNA, 16 nt, Human
guaaauuaacuuuuau

SEQ ID NO: 2508168 - RNA, 17 nt, Human
guaaauuaacuuuuaua

SEQ ID NO: 2508169 - RNA, 21 nt, Human
guaaauuaacuuuuauaaacu

SEQ ID NO: 2508170 - RNA, 22 nt, Human
guaaauuaacuuuuauaaacuu

SEQ ID NO: 2508171 - RNA, 24 nt, Human
guaaaugcaucuguccucaugugu

SEQ ID NO: 2508172 - RNA, 17 nt, Human
guaaaugcagcgugaag

SEQ ID NO: 2508173 - RNA, 12 nt, Human
guaaaugaugug

SEQ ID NO: 2508174 - RNA, 20 nt, Human
guaaaugguguacauaaugu

SEQ ID NO: 2508175 - RNA, 16 nt, Human
guaaaugguguacaua

SEQ ID NO: 2508176 - RNA, 22 nt, Human
guaaauggcuuauccagcuggu

SEQ ID NO: 2508177 - RNA, 15 nt, Human
guaaauuaacuuuua

SEQ ID NO: 2508178 - RNA, 17 nt, Human
guaaauguuuagguuuu

SEQ ID NO: 2508179 - RNA, 20 nt, Human
guaaauauauaaauauauau

SEQ ID NO: 2508180 - RNA, 13 nt, Human
guaaauauucuau

SEQ ID NO: 2508181 - RNA, 19 nt, Human
guaaauauauaaauauaua

SEQ ID NO: 2508182 - RNA, 16 nt, Human
guaaauauauaaauau

SEQ ID NO: 2508183 - RNA, 20 nt, Human
guaaauaguuacuccagugc

SEQ ID NO: 2508184 - RNA, 12 nt, Human
guaaauauuuau

SEQ ID NO: 2508185 - RNA, 15 nt, Human
guaaauauucuauau

SEQ ID NO: 2508186 - RNA, 14 nt, Human
guaaauauucuaua

SEQ ID NO: 2508187 - RNA, 11 nt, Human
guaaauauuua

SEQ ID NO: 2508188 - RNA, 17 nt, Human
guaaauaguauuugaga

SEQ ID NO: 2508189 - RNA, 16 nt, Human
guaaauaguauuugag

SEQ ID NO: 2508190 - RNA, 15 nt, Human
guaaauaguauuuga

SEQ ID NO: 2508191 - RNA, 12 nt, Human
guaaauacacca

SEQ ID NO: 2508192 - RNA, 19 nt, Human
guaaauacacaacacacac

SEQ ID NO: 2508193 - RNA, 16 nt, Human
guaaauaaaggaacca

SEQ ID NO: 2508194 - RNA, 14 nt, Human
guaaauaaauuguu

SEQ ID NO: 2508195 - RNA, 18 nt, Human
guaaauaaauuguuugac

SEQ ID NO: 2508196 - RNA, 15 nt, Human
guaaauaaagcccug

SEQ ID NO: 2508197 - RNA, 14 nt, Human
guaaauaaagcccu

SEQ ID NO: 2508198 - RNA, 13 nt, Human
guaaauaaagccc

SEQ ID NO: 2508199 - RNA, 17 nt, Human
guaaagugauaauuucu

SEQ ID NO: 2508200 - RNA, 18 nt, Human
guaaagugauaauuucug

SEQ ID NO: 2508201 - RNA, 23 nt, Human
guaaagugauaauuucuggaauu

SEQ ID NO: 2508202 - RNA, 18 nt, Human
guaaaguuagucuacucu

SEQ ID NO: 2508203 - RNA, 14 nt, Human
guaaaguuagucua

SEQ ID NO: 2508204 - RNA, 13 nt, Human
guaaauaaaaaga

SEQ ID NO: 2508205 - RNA, 22 nt, Human
guaaaguguggucccaacagga

SEQ ID NO: 2508206 - RNA, 21 nt, Human
guaaaguguggucccaacagg

SEQ ID NO: 2508207 - RNA, 11 nt, Human
guaaagugugg

SEQ ID NO: 2508208 - RNA, 17 nt, Human
guaaaagguauuaaauu

SEQ ID NO: 2508209 - RNA, 20 nt, Human
guaaaaggccaaaccucugu

SEQ ID NO: 2508210 - RNA, 16 nt, Human
guaaaauaaaaggucg

SEQ ID NO: 2508211 - RNA, 15 nt, Human
guaaaagugugagca

SEQ ID NO: 2508212 - RNA, 22 nt, Human
guaaaaggccaaaccucuguuc

SEQ ID NO: 2508213 - RNA, 14 nt, Human
guaaaauaaaauua

SEQ ID NO: 2508214 - RNA, 20 nt, Human
ggugaguuugagcugccuuc

SEQ ID NO: 2508215 - RNA, 23 nt, Human
ggugagucuuggcggcagcagcc

SEQ ID NO: 2508216 - RNA, 19 nt, Human
ggugaguuugagcugccuu

SEQ ID NO: 2508217 - RNA, 20 nt, Human
ggugagucuuggcggcagca

SEQ ID NO: 2508218 - RNA, 17 nt, Human
ggugagucuuggcggca

SEQ ID NO: 2508219 - RNA, 18 nt, Human
ggugaguccauucuccca

SEQ ID NO: 2508220 - RNA, 13 nt, Human
ggugagggaugug

SEQ ID NO: 2508221 - RNA, 12 nt, Human
ggugagggaugu

SEQ ID NO: 2508222 - RNA, 15 nt, Human
ggugaggccuugcuc

SEQ ID NO: 2508223 - RNA, 17 nt, Human
ggugaggggcuggcacu

SEQ ID NO: 2508224 - RNA, 20 nt, Human
ggugaggcagugggucccac

SEQ ID NO: 2508225 - RNA, 14 nt, Human
ggugaggcaggcuu

SEQ ID NO: 2508226 - RNA, 15 nt, Human
ggugaggcaauaaaa

SEQ ID NO: 2508227 - RNA, 16 nt, Human
ggugaccucugccuga

SEQ ID NO: 2508228 - RNA, 21 nt, Human
ggugaccccuuuucagcuucu

SEQ ID NO: 2508229 - RNA, 14 nt, Human
ggugaccucugccu

SEQ ID NO: 2508230 - RNA, 13 nt, Human
ggugacaccagcc

SEQ ID NO: 2508231 - RNA, 15 nt, Human
ggucucccucuccug

SEQ ID NO: 2508232 - RNA, 17 nt, Human
ggugacaagauagagag

SEQ ID NO: 2508233 - RNA, 18 nt, Human
ggugacaagauagagagc

SEQ ID NO: 2508234 - RNA, 16 nt, Human
ggugacaccagccuuu

SEQ ID NO: 2508235 - RNA, 13 nt, Human
ggugccccaggac

SEQ ID NO: 2508236 - RNA, 14 nt, Human
ggugccccaggacc

SEQ ID NO: 2508237 - RNA, 15 nt, Human
ggugccccaggacca

SEQ ID NO: 2508238 - RNA, 16 nt, Human
ggugccccaggaccag

SEQ ID NO: 2508239 - RNA, 17 nt, Human
ggugccccaggaccagc

SEQ ID NO: 2508240 - RNA, 20 nt, Human
ggugccccaggaccagcuca

SEQ ID NO: 2508241 - RNA, 21 nt, Human
ggugccccaggaccagcucag

SEQ ID NO: 2508242 - RNA, 22 nt, Human
ggugccccaggaccagcucagg

SEQ ID NO: 2508243 - RNA, 22 nt, Human
ggugcccagcuauaccugugcc

SEQ ID NO: 2508244 - RNA, 15 nt, Human
ggugauauccauucu

SEQ ID NO: 2508245 - RNA, 22 nt, Human
ggugauagguauaaguggugug

SEQ ID NO: 2508246 - RNA, 21 nt, Human
ggugaguuugagcugccuucc

SEQ ID NO: 2508247 - RNA, 23 nt, Human
ggugcccccuccucucccauccc

SEQ ID NO: 2508248 - RNA, 22 nt, Human
ggugcccccuccucucccaucc

SEQ ID NO: 2508249 - RNA, 20 nt, Human
ggugcccccuccucucccau

SEQ ID NO: 2508250 - RNA, 19 nt, Human
ggugcccccuccucuccca

SEQ ID NO: 2508251 - RNA, 17 nt, Human
ggugcccccuccucucc

SEQ ID NO: 2508252 - RNA, 12 nt, Human
ggugcccccucc

SEQ ID NO: 2508253 - RNA, 23 nt, Human
ggugccccaggaccagcucagga

SEQ ID NO: 2508254 - RNA, 22 nt, Human
ggugccccccuugccagacaug

SEQ ID NO: 2508255 - RNA, 19 nt, Human
ggugcccuguucucuacca

SEQ ID NO: 2508256 - RNA, 21 nt, Human
ggugccuaggauugugccugu

SEQ ID NO: 2508257 - RNA, 14 nt, Human
ggugccgccugccc

SEQ ID NO: 2508258 - RNA, 17 nt, Human
ggugcccuuggaggcca

SEQ ID NO: 2508259 - RNA, 18 nt, Human
ggugcccuuggaggccag

SEQ ID NO: 2508260 - RNA, 22 nt, Human
ggugcccuuggaggccagccag

SEQ ID NO: 2508261 - RNA, 13 nt, Human
gguggcagcugcg

SEQ ID NO: 2508262 - RNA, 12 nt, Human
gguggcagcugc

SEQ ID NO: 2508263 - RNA, 13 nt, Human
gguggcagcucac

SEQ ID NO: 2508264 - RNA, 11 nt, Human
gguggcagcug

SEQ ID NO: 2508265 - RNA, 23 nt, Human
gguggcagcugcgguccacccag

SEQ ID NO: 2508266 - RNA, 15 nt, Human
gguggcagcugcggu

SEQ ID NO: 2508267 - RNA, 18 nt, Human
gguggccauuuagccacc

SEQ ID NO: 2508268 - RNA, 17 nt, Human
gguggcaggaccaggac

SEQ ID NO: 2508269 - RNA, 15 nt, Human
gguggcaggaccagg

SEQ ID NO: 2508270 - RNA, 18 nt, Human
gguggcaggaccaggacu

SEQ ID NO: 2508271 - RNA, 16 nt, Human
ggugcucucugccacu

SEQ ID NO: 2508272 - RNA, 14 nt, Human
ggugcucucugcca

SEQ ID NO: 2508273 - RNA, 14 nt, Human
gguggcaggaccag

SEQ ID NO: 2508274 - RNA, 15 nt, Human
ggugcuccaggcagg

SEQ ID NO: 2508275 - RNA, 16 nt, Human
ggugcucagggcugac

SEQ ID NO: 2508276 - RNA, 18 nt, Human
ggugccugagaggcaggc

SEQ ID NO: 2508277 - RNA, 17 nt, Human
ggugccugagaggcagg

SEQ ID NO: 2508278 - RNA, 15 nt, Human
ggugccugagaggca

SEQ ID NO: 2508279 - RNA, 17 nt, Human
ggugccuccaggugugc

SEQ ID NO: 2508280 - RNA, 16 nt, Human
ggugccuccaggugug

SEQ ID NO: 2508281 - RNA, 14 nt, Human
ggugccuccaggug

SEQ ID NO: 2508282 - RNA, 13 nt, Human
ggugccuccaggu

SEQ ID NO: 2508283 - RNA, 15 nt, Human
ggugcgaucuggguu

SEQ ID NO: 2508284 - RNA, 19 nt, Human
ggugcuacaaaaacacagc

SEQ ID NO: 2508285 - RNA, 12 nt, Human
ggugcggcugug

SEQ ID NO: 2508286 - RNA, 22 nt, Human
ggugcggcugugcagccugucc

SEQ ID NO: 2508287 - RNA, 20 nt, Human
ggugcuaaauggucgcccag

SEQ ID NO: 2508288 - RNA, 23 nt, Human
ggugcuaucucccccagccccau

SEQ ID NO: 2508289 - RNA, 21 nt, Human
ggugcuaucucccccagcccc

SEQ ID NO: 2508290 - RNA, 19 nt, Human
ggugcucacaccccauugg

SEQ ID NO: 2508291 - RNA, 15 nt, Human
ggugcucagggcuga

SEQ ID NO: 2508292 - RNA, 22 nt, Human
ggugcuaucucccccagcccca

SEQ ID NO: 2508293 - RNA, 21 nt, Human
ggugcuacaaaaacacagcaa

SEQ ID NO: 2508294 - RNA, 23 nt, Human
ggugcuaaauggucgcccaggag

SEQ ID NO: 2508295 - RNA, 21 nt, Human
ggugcuaaauggucgcccagg

SEQ ID NO: 2508296 - RNA, 22 nt, Human
ggugcuaaauggucgcccagga

SEQ ID NO: 2508297 - RNA, 17 nt, Human
ggucccuaauaaagcug

SEQ ID NO: 2508298 - RNA, 16 nt, Human
ggucccuaauaaagcu

SEQ ID NO: 2508299 - RNA, 13 nt, Human
ggucccuaauaaa

SEQ ID NO: 2508300 - RNA, 12 nt, Human
ggucccuaauaa

SEQ ID NO: 2508301 - RNA, 18 nt, Human
ggucccugcuguguuccc

SEQ ID NO: 2508302 - RNA, 22 nt, Human
ggucccugauaacaaccuggag

SEQ ID NO: 2508303 - RNA, 23 nt, Human
ggucccugauaacaaccuggaga

SEQ ID NO: 2508304 - RNA, 20 nt, Human
ggucccugauaacaaccugg

SEQ ID NO: 2508305 - RNA, 14 nt, Human
ggucccucugugua

SEQ ID NO: 2508306 - RNA, 14 nt, Human
ggucccugguggca

SEQ ID NO: 2508307 - RNA, 18 nt, Human
ggucccuaauaaagcugu

SEQ ID NO: 2508308 - RNA, 21 nt, Human
ggucccgugcagcuucugucc

SEQ ID NO: 2508309 - RNA, 22 nt, Human
ggucucacuauguugcccaggc

SEQ ID NO: 2508310 - RNA, 23 nt, Human
gguccuagaaauuccccacccug

SEQ ID NO: 2508311 - RNA, 13 nt, Human
gguccgugggacg

SEQ ID NO: 2508312 - RNA, 17 nt, Human
gguccuacccauccccg

SEQ ID NO: 2508313 - RNA, 20 nt, Human
gguccuacccauccccgcag

SEQ ID NO: 2508314 - RNA, 22 nt, Human
gguccuaccaauagauucccca

SEQ ID NO: 2508315 - RNA, 21 nt, Human
gguccggacacuccuagagaa

SEQ ID NO: 2508316 - RNA, 20 nt, Human
gguccggacacuccuagaga

SEQ ID NO: 2508317 - RNA, 18 nt, Human
gguccggacacuccuaga

SEQ ID NO: 2508318 - RNA, 17 nt, Human
gguccggacacuccuag

SEQ ID NO: 2508319 - RNA, 23 nt, Human
ggucccuugcagcuaguuuucua

SEQ ID NO: 2508320 - RNA, 17 nt, Human
gguccgguguccuuuuc

SEQ ID NO: 2508321 - RNA, 22 nt, Human
ggucccugguggcagcucaccu

SEQ ID NO: 2508322 - RNA, 13 nt, Human
ggucccugggagg

SEQ ID NO: 2508323 - RNA, 23 nt, Human
ggucccugggaggaaauuugaau

SEQ ID NO: 2508324 - RNA, 21 nt, Human
ggucccuucuuacucacacac

SEQ ID NO: 2508325 - RNA, 19 nt, Human
ggucccuugagaccucagc

SEQ ID NO: 2508326 - RNA, 20 nt, Human
ggucccuugagaccucagcc

SEQ ID NO: 2508327 - RNA, 21 nt, Human
ggucccuugagaccucagcca

SEQ ID NO: 2508328 - RNA, 19 nt, Human
ggucucgaacuccugaccu

SEQ ID NO: 2508329 - RNA, 14 nt, Human
ggucuccuccaccg

SEQ ID NO: 2508330 - RNA, 20 nt, Human
ggucucgaacuccugaccuu

SEQ ID NO: 2508331 - RNA, 22 nt, Human
ggucuccuccaccgccauggcu

SEQ ID NO: 2508332 - RNA, 19 nt, Human
ggucucgcugaugcugggc

SEQ ID NO: 2508333 - RNA, 16 nt, Human
ggucuccuuggaaauc

SEQ ID NO: 2508334 - RNA, 16 nt, Human
ggucugacccacugcu

SEQ ID NO: 2508335 - RNA, 15 nt, Human
ggucugacccacugc

SEQ ID NO: 2508336 - RNA, 16 nt, Human
ggucucacucugucgc

SEQ ID NO: 2508337 - RNA, 12 nt, Human
ggucucacucug

SEQ ID NO: 2508338 - RNA, 19 nt, Human
ggucuccucacucccuucu

SEQ ID NO: 2508339 - RNA, 19 nt, Human
ggucucccucuccugccua

SEQ ID NO: 2508340 - RNA, 17 nt, Human
ggucucccucuccugcc

SEQ ID NO: 2508341 - RNA, 18 nt, Human
ggucucccucuccugccu

SEQ ID NO: 2508342 - RNA, 21 nt, Human
ggucucacuauguugcccagg

SEQ ID NO: 2508343 - RNA, 22 nt, Human
ggucucccucuccugccuacuc

SEQ ID NO: 2508344 - RNA, 16 nt, Human
ggugaacuugguuccc

SEQ ID NO: 2508345 - RNA, 16 nt, Human
ggugaagaaaacuccu

SEQ ID NO: 2508346 - RNA, 23 nt, Human
ggugaaccaugucagcaaaaagc

SEQ ID NO: 2508347 - RNA, 22 nt, Human
ggucugaggggcaacugagucu

SEQ ID NO: 2508348 - RNA, 19 nt, Human
ggugaagaugggaacgcag

SEQ ID NO: 2508349 - RNA, 20 nt, Human
ggugaagagaaccgagcaaa

SEQ ID NO: 2508350 - RNA, 17 nt, Human
ggugaagcuauuuaucu

SEQ ID NO: 2508351 - RNA, 19 nt, Human
ggucugaggaauccagacc

SEQ ID NO: 2508352 - RNA, 21 nt, Human
ggucucgcugaugcugggcug

SEQ ID NO: 2508353 - RNA, 20 nt, Human
ggucucgcugaugcugggcu

SEQ ID NO: 2508354 - RNA, 18 nt, Human
ggugaagugaagacaaug

SEQ ID NO: 2508355 - RNA, 21 nt, Human
ggugaagcucacuucugggcu

SEQ ID NO: 2508356 - RNA, 14 nt, Human
ggugaaggaauaua

SEQ ID NO: 2508357 - RNA, 18 nt, Human
ggugaagcuauuuaucug

SEQ ID NO: 2508358 - RNA, 16 nt, Human
ggugaagggagagcca

SEQ ID NO: 2508359 - RNA, 18 nt, Human
ggugaagggagagccagc

SEQ ID NO: 2508360 - RNA, 14 nt, Human
ggguucuuucuucc

SEQ ID NO: 2508361 - RNA, 20 nt, Human
ggguuggcgcacccuccccu

SEQ ID NO: 2508362 - RNA, 22 nt, Human
ggguuggcgcacccuccccucc

SEQ ID NO: 2508363 - RNA, 20 nt, Human
ggguuggcugggcccagaag

SEQ ID NO: 2508364 - RNA, 19 nt, Human
ggguuggccccugcccggc

SEQ ID NO: 2508365 - RNA, 16 nt, Human
ggguuggccccugccc

SEQ ID NO: 2508366 - RNA, 21 nt, Human
ggguucugccugccagcugca

SEQ ID NO: 2508367 - RNA, 20 nt, Human
ggguucugccugccagcugc

SEQ ID NO: 2508368 - RNA, 16 nt, Human
ggguucuccucucccc

SEQ ID NO: 2508369 - RNA, 18 nt, Human
ggguucuccucuccccuc

SEQ ID NO: 2508370 - RNA, 23 nt, Human
ggguucccuuuuuuggcugcuga

SEQ ID NO: 2508371 - RNA, 14 nt, Human
ggguucccccagcc

SEQ ID NO: 2508372 - RNA, 18 nt, Human
ggguucccuuuccuucca

SEQ ID NO: 2508373 - RNA, 21 nt, Human
ggguucccuuuccuuccaucc

SEQ ID NO: 2508374 - RNA, 22 nt, Human
ggguucuacccaggugcuagga

SEQ ID NO: 2508375 - RNA, 17 nt, Human
ggguucuacccaggugc

SEQ ID NO: 2508376 - RNA, 15 nt, Human
ggguucucacagugg

SEQ ID NO: 2508377 - RNA, 22 nt, Human
gggugcuuuuauagaggcuagc

SEQ ID NO: 2508378 - RNA, 21 nt, Human
gggugcuuuuauagaggcuag

SEQ ID NO: 2508379 - RNA, 20 nt, Human
gggugcuuuuauagaggcua

SEQ ID NO: 2508380 - RNA, 13 nt, Human
ggguggagaagcc

SEQ ID NO: 2508381 - RNA, 12 nt, Human
ggguggagaagc

SEQ ID NO: 2508382 - RNA, 20 nt, Human
ggguggagaacuccuagggu

SEQ ID NO: 2508383 - RNA, 22 nt, Human
ggguggagacugcuucccaucc

SEQ ID NO: 2508384 - RNA, 16 nt, Human
ggguggagaagccauu

SEQ ID NO: 2508385 - RNA, 15 nt, Human
ggguggagaagccau

SEQ ID NO: 2508386 - RNA, 14 nt, Human
ggguggagaagcca

SEQ ID NO: 2508387 - RNA, 14 nt, Human
ggguggaggggugu

SEQ ID NO: 2508388 - RNA, 23 nt, Human
ggguggagacugcuucccauccu

SEQ ID NO: 2508389 - RNA, 16 nt, Human
ggguggaggcuuccug

SEQ ID NO: 2508390 - RNA, 21 nt, Human
ggguggauauaaauauauaua

SEQ ID NO: 2508391 - RNA, 14 nt, Human
ggguggauauaaau

SEQ ID NO: 2508392 - RNA, 13 nt, Human
ggguucauuugug

SEQ ID NO: 2508393 - RNA, 22 nt, Human
ggguuccagcaauucuccugcc

SEQ ID NO: 2508394 - RNA, 19 nt, Human
ggguuccagcaccacacuc

SEQ ID NO: 2508395 - RNA, 14 nt, Human
ggguucauuugugu

SEQ ID NO: 2508396 - RNA, 15 nt, Human
ggguucccccagccc

SEQ ID NO: 2508397 - RNA, 14 nt, Human
ggguagcagcugga

SEQ ID NO: 2508398 - RNA, 13 nt, Human
ggguagcagcugg

SEQ ID NO: 2508399 - RNA, 14 nt, Human
ggguagagcugauc

SEQ ID NO: 2508400 - RNA, 17 nt, Human
ggguagcagcuggacua

SEQ ID NO: 2508401 - RNA, 15 nt, Human
ggguagcagcuggac

SEQ ID NO: 2508402 - RNA, 22 nt, Human
ggguagcagcuggacuacccac

SEQ ID NO: 2508403 - RNA, 22 nt, Human
ggguagcagguaccacugauuu

SEQ ID NO: 2508404 - RNA, 21 nt, Human
ggguagcccgccugccagucc

SEQ ID NO: 2508405 - RNA, 18 nt, Human
ggguagcccgccugccag

SEQ ID NO: 2508406 - RNA, 14 nt, Human
ggguagcccgccug

SEQ ID NO: 2508407 - RNA, 12 nt, Human
ggguagcccgcc

SEQ ID NO: 2508408 - RNA, 19 nt, Human
gggugcugggccccugccu

SEQ ID NO: 2508409 - RNA, 18 nt, Human
gggugcugggccccugcc

SEQ ID NO: 2508410 - RNA, 15 nt, Human
ggguagcuagaggaa

SEQ ID NO: 2508411 - RNA, 22 nt, Human
ggguagcccgccugccaguccu

SEQ ID NO: 2508412 - RNA, 16 nt, Human
ggguagcuagaggaac

SEQ ID NO: 2508413 - RNA, 14 nt, Human
gguacucuccuaga

SEQ ID NO: 2508414 - RNA, 12 nt, Human
gguacucuccua

SEQ ID NO: 2508415 - RNA, 19 nt, Human
gguacuauucugauuacac

SEQ ID NO: 2508416 - RNA, 16 nt, Human
gguacucuccuagaga

SEQ ID NO: 2508417 - RNA, 18 nt, Human
gguaccuugaacacuggg

SEQ ID NO: 2508418 - RNA, 13 nt, Human
gguacccucugga

SEQ ID NO: 2508419 - RNA, 14 nt, Human
gguacccuccuggc

SEQ ID NO: 2508420 - RNA, 14 nt, Human
gguaccuauuuuca

SEQ ID NO: 2508421 - RNA, 12 nt, Human
gguaccuugaac

SEQ ID NO: 2508422 - RNA, 22 nt, Human
gguacuucaaauccuugaagau

SEQ ID NO: 2508423 - RNA, 21 nt, Human
gguacuuguggacacagcucu

SEQ ID NO: 2508424 - RNA, 22 nt, Human
gguacuuuuaugauguauauuu

SEQ ID NO: 2508425 - RNA, 21 nt, Human
gguacuuuuaugauguauauu

SEQ ID NO: 2508426 - RNA, 20 nt, Human
gguacuucaggggcacuuca

SEQ ID NO: 2508427 - RNA, 20 nt, Human
gguacuuguggacacagcuc

SEQ ID NO: 2508428 - RNA, 22 nt, Human
gguacuuguggacacagcucuu

SEQ ID NO: 2508429 - RNA, 19 nt, Human
ggguuggugcacagugauu

SEQ ID NO: 2508430 - RNA, 21 nt, Human
ggguuggguucaucugagcaa

SEQ ID NO: 2508431 - RNA, 21 nt, Human
ggguugugaggccuggccagg

SEQ ID NO: 2508432 - RNA, 18 nt, Human
ggguugguccucuugccu

SEQ ID NO: 2508433 - RNA, 14 nt, Human
ggguugugaggccu

SEQ ID NO: 2508434 - RNA, 15 nt, Human
ggguugugugucugu

SEQ ID NO: 2508435 - RNA, 19 nt, Human
ggguuuaauccccaguaaa

SEQ ID NO: 2508436 - RNA, 23 nt, Human
ggguuuaauccccaguaaaauug

SEQ ID NO: 2508437 - RNA, 22 nt, Human
ggguuuaauccccaguaaaauu

SEQ ID NO: 2508438 - RNA, 12 nt, Human
ggguugggccca

SEQ ID NO: 2508439 - RNA, 14 nt, Human
ggguugggcccaga

SEQ ID NO: 2508440 - RNA, 22 nt, Human
ggguugggcccagaucuggucc

SEQ ID NO: 2508441 - RNA, 15 nt, Human
ggguugggcuggugu

SEQ ID NO: 2508442 - RNA, 16 nt, Human
gguacccccuucuggg

SEQ ID NO: 2508443 - RNA, 21 nt, Human
gguacccagccaucugcccag

SEQ ID NO: 2508444 - RNA, 20 nt, Human
gguacccagccaucugccca

SEQ ID NO: 2508445 - RNA, 12 nt, Human
gguacccagcca

SEQ ID NO: 2508446 - RNA, 19 nt, Human
gguaccccuuucuggcucu

SEQ ID NO: 2508447 - RNA, 17 nt, Human
gguacccacugcucugg

SEQ ID NO: 2508448 - RNA, 16 nt, Human
gguacccacugcucug

SEQ ID NO: 2508449 - RNA, 23 nt, Human
ggguugugaggccuggccaggca

SEQ ID NO: 2508450 - RNA, 20 nt, Human
ggguuucacuguguuagcca

SEQ ID NO: 2508451 - RNA, 20 nt, Human
ggguuucaccauguuggcca

SEQ ID NO: 2508452 - RNA, 23 nt, Human
ggucccccuuccauggacuuugu

SEQ ID NO: 2508453 - RNA, 18 nt, Human
ggucccccuuccauggac

SEQ ID NO: 2508454 - RNA, 13 nt, Human
ggucccccuucca

SEQ ID NO: 2508455 - RNA, 21 nt, Human
gguccccaucaucccagcugc

SEQ ID NO: 2508456 - RNA, 18 nt, Human
gguccccaucaucccagc

SEQ ID NO: 2508457 - RNA, 16 nt, Human
gguccccaucauccca

SEQ ID NO: 2508458 - RNA, 22 nt, Human
ggucccagugggaggggcaggc

SEQ ID NO: 2508459 - RNA, 21 nt, Human
ggucccagugggaggggcagg

SEQ ID NO: 2508460 - RNA, 20 nt, Human
ggucccagugggaggggcag

SEQ ID NO: 2508461 - RNA, 19 nt, Human
ggucccagugggaggggca

SEQ ID NO: 2508462 - RNA, 13 nt, Human
ggucccauccagg

SEQ ID NO: 2508463 - RNA, 12 nt, Human
ggucccauccag

SEQ ID NO: 2508464 - RNA, 23 nt, Human
ggucccagugggaggggcaggcu

SEQ ID NO: 2508465 - RNA, 11 nt, Human
ggucccaucca

SEQ ID NO: 2508466 - RNA, 20 nt, Human
ggucccaucugcagggcccc

SEQ ID NO: 2508467 - RNA, 16 nt, Human
ggucccauccaggcag

SEQ ID NO: 2508468 - RNA, 14 nt, Human
ggucccauccaggc

SEQ ID NO: 2508469 - RNA, 17 nt, Human
ggucccauuucucacug

SEQ ID NO: 2508470 - RNA, 17 nt, Human
ggucccauccaggcagu

SEQ ID NO: 2508471 - RNA, 16 nt, Human
gguccccaccugggac

SEQ ID NO: 2508472 - RNA, 18 nt, Human
ggucccagugggaggggc

SEQ ID NO: 2508473 - RNA, 15 nt, Human
ggucccagugggagg

SEQ ID NO: 2508474 - RNA, 11 nt, Human
ggucccagugg

SEQ ID NO: 2508475 - RNA, 14 nt, Human
ggucccaggcagag

SEQ ID NO: 2508476 - RNA, 15 nt, Human
ggucccagccacccc

SEQ ID NO: 2508477 - RNA, 14 nt, Human
ggucccacucaguc

SEQ ID NO: 2508478 - RNA, 12 nt, Human
ggucccacucag

SEQ ID NO: 2508479 - RNA, 13 nt, Human
ggucccacuuccc

SEQ ID NO: 2508480 - RNA, 12 nt, Human
ggucccacuucc

SEQ ID NO: 2508481 - RNA, 22 nt, Human
ggucccacgaauuugcugggga

SEQ ID NO: 2508482 - RNA, 17 nt, Human
ggucccacuuccccucc

SEQ ID NO: 2508483 - RNA, 14 nt, Human
ggucccagccaccc

SEQ ID NO: 2508484 - RNA, 22 nt, Human
ggucccacucaguccauagcag

SEQ ID NO: 2508485 - RNA, 16 nt, Human
ggucagcguugcaugu

SEQ ID NO: 2508486 - RNA, 23 nt, Human
ggucagcccaaaccaccagaagc

SEQ ID NO: 2508487 - RNA, 22 nt, Human
ggucccaccccacacacgccag

SEQ ID NO: 2508488 - RNA, 22 nt, Human
ggucacucuuccugcaaggacu

SEQ ID NO: 2508489 - RNA, 21 nt, Human
ggucacucuuccugcaaggac

SEQ ID NO: 2508490 - RNA, 15 nt, Human
ggucagccagggcca

SEQ ID NO: 2508491 - RNA, 12 nt, Human
ggucagccaggg

SEQ ID NO: 2508492 - RNA, 18 nt, Human
ggucagccagggccaggg

SEQ ID NO: 2508493 - RNA, 21 nt, Human
ggucagcaugucuauucagcu

SEQ ID NO: 2508494 - RNA, 13 nt, Human
ggucagccagggc

SEQ ID NO: 2508495 - RNA, 16 nt, Human
ggucagagccugcagu

SEQ ID NO: 2508496 - RNA, 15 nt, Human
ggucagagccugcag

SEQ ID NO: 2508497 - RNA, 14 nt, Human
ggucagagccugca

SEQ ID NO: 2508498 - RNA, 13 nt, Human
ggucagagccugc

SEQ ID NO: 2508499 - RNA, 20 nt, Human
ggucacucuggcagcucaga

SEQ ID NO: 2508500 - RNA, 16 nt, Human
ggucacucuggcagcu

SEQ ID NO: 2508501 - RNA, 22 nt, Human
ggucacucuggcagcucagaga

SEQ ID NO: 2508502 - RNA, 12 nt, Human
ggucagagccug

SEQ ID NO: 2508503 - RNA, 12 nt, Human
ggucacucuggc

SEQ ID NO: 2508504 - RNA, 17 nt, Human
ggucacagccuccucug

SEQ ID NO: 2508505 - RNA, 16 nt, Human
ggucacagccuccucu

SEQ ID NO: 2508506 - RNA, 15 nt, Human
ggucacagcggaggu

SEQ ID NO: 2508507 - RNA, 15 nt, Human
ggucacagccuccuc

SEQ ID NO: 2508508 - RNA, 13 nt, Human
ggucacagccucc

SEQ ID NO: 2508509 - RNA, 14 nt, Human
ggucacacacugau

SEQ ID NO: 2508510 - RNA, 20 nt, Human
ggucaaguaagaagacauga

SEQ ID NO: 2508511 - RNA, 22 nt, Human
ggucacaaauccuaaaagaagc

SEQ ID NO: 2508512 - RNA, 17 nt, Human
ggucaauccugugggug

SEQ ID NO: 2508513 - RNA, 20 nt, Human
ggucaauacaguacaggcag

SEQ ID NO: 2508514 - RNA, 17 nt, Human
gguagagauggaggagg

SEQ ID NO: 2508515 - RNA, 20 nt, Human
ggucaagauuuugaaugcuu

SEQ ID NO: 2508516 - RNA, 13 nt, Human
ggucaagcccagg

SEQ ID NO: 2508517 - RNA, 15 nt, Human
ggucaagcccaggag

SEQ ID NO: 2508518 - RNA, 19 nt, Human
ggucaagcccaggaggacu

SEQ ID NO: 2508519 - RNA, 17 nt, Human
ggucaagcccaggagga

SEQ ID NO: 2508520 - RNA, 15 nt, Human
gguagacacacauga

SEQ ID NO: 2508521 - RNA, 23 nt, Human
gguacuuuuaugauguauauuua

SEQ ID NO: 2508522 - RNA, 22 nt, Human
gguagacacacaugaaguccaa

SEQ ID NO: 2508523 - RNA, 23 nt, Human
ggguagagcggagaaaggaaggg

SEQ ID NO: 2508524 - RNA, 23 nt, Human
ggguacuuguggacacagcucuu

SEQ ID NO: 2508525 - RNA, 22 nt, Human
ggguacuuguggacacagcucu

SEQ ID NO: 2508526 - RNA, 19 nt, Human
ggguacuuguggacacagc

SEQ ID NO: 2508527 - RNA, 15 nt, Human
ggguacccacugcuc

SEQ ID NO: 2508528 - RNA, 13 nt, Human
ggguacccacugc

SEQ ID NO: 2508529 - RNA, 20 nt, Human
gggguugccacaggccuccc

SEQ ID NO: 2508530 - RNA, 19 nt, Human
ggguacauuucccugugcu

SEQ ID NO: 2508531 - RNA, 23 nt, Human
ggguaccuugaacacugggggag

SEQ ID NO: 2508532 - RNA, 18 nt, Human
ggguacccacugcucugg

SEQ ID NO: 2508533 - RNA, 21 nt, Human
gggguucgagaccagucuggc

SEQ ID NO: 2508534 - RNA, 23 nt, Human
gggguucagccccuccucugcca

SEQ ID NO: 2508535 - RNA, 20 nt, Human
gggguucauaggucacuggc

SEQ ID NO: 2508536 - RNA, 17 nt, Human
gggguucagccccuccu

SEQ ID NO: 2508537 - RNA, 22 nt, Human
gggguucagccccuccucugcc

SEQ ID NO: 2508538 - RNA, 22 nt, Human
gggguucuuucuuccucugcug

SEQ ID NO: 2508539 - RNA, 20 nt, Human
gggguucuuucuuccucugc

SEQ ID NO: 2508540 - RNA, 23 nt, Human
gggguucccuuuuuuggcugcug

SEQ ID NO: 2508541 - RNA, 14 nt, Human
ggggugccgccugc

SEQ ID NO: 2508542 - RNA, 13 nt, Human
ggggugccgccug

SEQ ID NO: 2508543 - RNA, 17 nt, Human
ggggugccgccugcccg

SEQ ID NO: 2508544 - RNA, 16 nt, Human
gggguucagccccucc

SEQ ID NO: 2508545 - RNA, 19 nt, Human
gggggaagagcacagcccu

SEQ ID NO: 2508546 - RNA, 17 nt, Human
gggggaagagcacagcc

SEQ ID NO: 2508547 - RNA, 22 nt, Human
ggggucuuugugagagugagcu

SEQ ID NO: 2508548 - RNA, 14 nt, Human
ggggugaggagcug

SEQ ID NO: 2508549 - RNA, 15 nt, Human
ggggugaggagcugg

SEQ ID NO: 2508550 - RNA, 18 nt, Human
ggggugacgccugcccuc

SEQ ID NO: 2508551 - RNA, 13 nt, Human
ggggugaggacca

SEQ ID NO: 2508552 - RNA, 18 nt, Human
ggggugauuucagagagg

SEQ ID NO: 2508553 - RNA, 17 nt, Human
ggggugauuucagagag

SEQ ID NO: 2508554 - RNA, 23 nt, Human
ggggugcccccuccucucccauc

SEQ ID NO: 2508555 - RNA, 20 nt, Human
ggggugcccccuccucuccc

SEQ ID NO: 2508556 - RNA, 13 nt, Human
ggggugcccccuc

SEQ ID NO: 2508557 - RNA, 16 nt, Human
ggggugcccacaggcc

SEQ ID NO: 2508558 - RNA, 17 nt, Human
ggggcugggcagaggaa

SEQ ID NO: 2508559 - RNA, 16 nt, Human
ggggcugggcagagga

SEQ ID NO: 2508560 - RNA, 13 nt, Human
ggggcugggacau

SEQ ID NO: 2508561 - RNA, 12 nt, Human
ggggcuggccua

SEQ ID NO: 2508562 - RNA, 17 nt, Human
ggggcuggcacugacug

SEQ ID NO: 2508563 - RNA, 22 nt, Human
ggggcuucaaccuugagacagc

SEQ ID NO: 2508564 - RNA, 12 nt, Human
ggggcuuauuuu

SEQ ID NO: 2508565 - RNA, 17 nt, Human
gggggaacucagaucca

SEQ ID NO: 2508566 - RNA, 17 nt, Human
ggggcuugaagccaaag

SEQ ID NO: 2508567 - RNA, 12 nt, Human
gggggaaagcac

SEQ ID NO: 2508568 - RNA, 15 nt, Human
ggggcuuucuggaga

SEQ ID NO: 2508569 - RNA, 23 nt, Human
ggggcuggguuggcgcacccucc

SEQ ID NO: 2508570 - RNA, 22 nt, Human
ggggcuggguuggcgcacccuc

SEQ ID NO: 2508571 - RNA, 19 nt, Human
ggggcugguagcucaggug

SEQ ID NO: 2508572 - RNA, 22 nt, Human
ggggcuuagggucggaacccaa

SEQ ID NO: 2508573 - RNA, 19 nt, Human
ggggcuggccuuccugccc

SEQ ID NO: 2508574 - RNA, 16 nt, Human
ggggcuggccuuccug

SEQ ID NO: 2508575 - RNA, 19 nt, Human
ggggcuggcggcuacucag

SEQ ID NO: 2508576 - RNA, 19 nt, Human
ggggcuggguuggcgcacc

SEQ ID NO: 2508577 - RNA, 13 nt, Human
ggggcuggguugg

SEQ ID NO: 2508578 - RNA, 10 nt, Human
ggggcugggu

SEQ ID NO: 2508579 - RNA, 12 nt, Human
ggggcaggcuga

SEQ ID NO: 2508580 - RNA, 23 nt, Human
ggggcaggcccugcacuguccug

SEQ ID NO: 2508581 - RNA, 22 nt, Human
ggggcaggcccugcacuguccu

SEQ ID NO: 2508582 - RNA, 21 nt, Human
ggggcaggcccugcacugucc

SEQ ID NO: 2508583 - RNA, 18 nt, Human
ggggcaggcccugcacug

SEQ ID NO: 2508584 - RNA, 16 nt, Human
ggggcaggcccugcac

SEQ ID NO: 2508585 - RNA, 15 nt, Human
ggggcaggcccugca

SEQ ID NO: 2508586 - RNA, 13 nt, Human
ggggcaggcccug

SEQ ID NO: 2508587 - RNA, 23 nt, Human
ggggcagcuucuauuagccaguc

SEQ ID NO: 2508588 - RNA, 19 nt, Human
ggggcagcugccagagaag

SEQ ID NO: 2508589 - RNA, 16 nt, Human
ggggcaggagggcccu

SEQ ID NO: 2508590 - RNA, 14 nt, Human
ggggcaggcacagc

SEQ ID NO: 2508591 - RNA, 13 nt, Human
ggggcaggcacag

SEQ ID NO: 2508592 - RNA, 10 nt, Human
ggggcaggca

SEQ ID NO: 2508593 - RNA, 17 nt, Human
ggggcaggcacagcaca

SEQ ID NO: 2508594 - RNA, 15 nt, Human
ggggcaggcacagca

SEQ ID NO: 2508595 - RNA, 11 nt, Human
ggggcaggcag

SEQ ID NO: 2508596 - RNA, 12 nt, Human
ggggcaggcagu

SEQ ID NO: 2508597 - RNA, 19 nt, Human
ggggcugcuuccuccugga

SEQ ID NO: 2508598 - RNA, 18 nt, Human
ggggcugcuuccuccugg

SEQ ID NO: 2508599 - RNA, 16 nt, Human
ggggcugcuuccuccu

SEQ ID NO: 2508600 - RNA, 15 nt, Human
ggggcugcuggccug

SEQ ID NO: 2508601 - RNA, 20 nt, Human
ggggcugcuccuccagggcc

SEQ ID NO: 2508602 - RNA, 21 nt, Human
ggggcugcugaccuccacagc

SEQ ID NO: 2508603 - RNA, 14 nt, Human
ggggcugcuccucc

SEQ ID NO: 2508604 - RNA, 15 nt, Human
ggggcugcuccucca

SEQ ID NO: 2508605 - RNA, 16 nt, Human
ggggcugcuccuccag

SEQ ID NO: 2508606 - RNA, 14 nt, Human
ggggcagucaccug

SEQ ID NO: 2508607 - RNA, 21 nt, Human
ggggcagggaaggggaggcag

SEQ ID NO: 2508608 - RNA, 13 nt, Human
ggggcugcagcau

SEQ ID NO: 2508609 - RNA, 11 nt, Human
ggggcagucug

SEQ ID NO: 2508610 - RNA, 23 nt, Human
ggggcugcccgcucccagugucu

SEQ ID NO: 2508611 - RNA, 16 nt, Human
ggggcugcccgcuccc

SEQ ID NO: 2508612 - RNA, 15 nt, Human
ggggcugcccgcucc

SEQ ID NO: 2508613 - RNA, 13 nt, Human
ggggcugcccgcu

SEQ ID NO: 2508614 - RNA, 18 nt, Human
gggcuucaguggcagcug

SEQ ID NO: 2508615 - RNA, 17 nt, Human
gggcuucaguggcagcu

SEQ ID NO: 2508616 - RNA, 16 nt, Human
gggcuucaguggcagc

SEQ ID NO: 2508617 - RNA, 15 nt, Human
gggcuucaguggcag

SEQ ID NO: 2508618 - RNA, 16 nt, Human
gggcuucacuguauaa

SEQ ID NO: 2508619 - RNA, 13 nt, Human
gggcuucauacac

SEQ ID NO: 2508620 - RNA, 19 nt, Human
gggcuucauccuccucaga

SEQ ID NO: 2508621 - RNA, 20 nt, Human
gggcuucaguggcagcugcu

SEQ ID NO: 2508622 - RNA, 19 nt, Human
gggcuucaguggcagcugc

SEQ ID NO: 2508623 - RNA, 14 nt, Human
gggcuucugcaccc

SEQ ID NO: 2508624 - RNA, 16 nt, Human
gggcuucuccugaccc

SEQ ID NO: 2508625 - RNA, 13 nt, Human
gggcuucuccuga

SEQ ID NO: 2508626 - RNA, 23 nt, Human
gggcuucccaguggcugcugccc

SEQ ID NO: 2508627 - RNA, 22 nt, Human
gggcuucccaguggcugcugcc

SEQ ID NO: 2508628 - RNA, 21 nt, Human
gggcuucccaguggcugcugc

SEQ ID NO: 2508629 - RNA, 19 nt, Human
gggcuuccucuagaagcca

SEQ ID NO: 2508630 - RNA, 20 nt, Human
gggcuucauccuccucagau

SEQ ID NO: 2508631 - RNA, 19 nt, Human
gggcuucauacacaugaga

SEQ ID NO: 2508632 - RNA, 20 nt, Human
gggcuucccaguggcugcug

SEQ ID NO: 2508633 - RNA, 23 nt, Human
gggcuuccauuugugugugugca

SEQ ID NO: 2508634 - RNA, 17 nt, Human
gggcuuggccugcugug

SEQ ID NO: 2508635 - RNA, 16 nt, Human
gggcuuggccugcugu

SEQ ID NO: 2508636 - RNA, 13 nt, Human
gggcuuggccugc

SEQ ID NO: 2508637 - RNA, 20 nt, Human
gggcuuggggaccagagcug

SEQ ID NO: 2508638 - RNA, 23 nt, Human
gggcuucugcacccuccacccug

SEQ ID NO: 2508639 - RNA, 21 nt, Human
gggcuucugcacccuccaccc

SEQ ID NO: 2508640 - RNA, 19 nt, Human
gggcuucugcacccuccac

SEQ ID NO: 2508641 - RNA, 18 nt, Human
gggcuucugcacccucca

SEQ ID NO: 2508642 - RNA, 17 nt, Human
gggcuucugcacccucc

SEQ ID NO: 2508643 - RNA, 16 nt, Human
gggcuucugcacccuc

SEQ ID NO: 2508644 - RNA, 15 nt, Human
gggcuucugcacccu

SEQ ID NO: 2508645 - RNA, 17 nt, Human
gggcuugaagccaaaga

SEQ ID NO: 2508646 - RNA, 15 nt, Human
gggcuugaagccaaa

SEQ ID NO: 2508647 - RNA, 13 nt, Human
gggcuugaagcca

SEQ ID NO: 2508648 - RNA, 16 nt, Human
gggcuugacuuuugua

SEQ ID NO: 2508649 - RNA, 13 nt, Human
gggcuugacuuuu

SEQ ID NO: 2508650 - RNA, 19 nt, Human
gggcuugcaaguauguuuu

SEQ ID NO: 2508651 - RNA, 18 nt, Human
ggggaugugggagggagc

SEQ ID NO: 2508652 - RNA, 17 nt, Human
ggggcagaacagccgcu

SEQ ID NO: 2508653 - RNA, 16 nt, Human
ggggcagagggcagag

SEQ ID NO: 2508654 - RNA, 13 nt, Human
ggggcagcugacc

SEQ ID NO: 2508655 - RNA, 20 nt, Human
ggggcagcgggggccaggga

SEQ ID NO: 2508656 - RNA, 20 nt, Human
ggggcagcugauacaaauug

SEQ ID NO: 2508657 - RNA, 14 nt, Human
ggggcagcugccag

SEQ ID NO: 2508658 - RNA, 18 nt, Human
ggggcagagggcagaggc

SEQ ID NO: 2508659 - RNA, 22 nt, Human
ggggcagagggcagaggcugga

SEQ ID NO: 2508660 - RNA, 15 nt, Human
ggggcagcccuugcu

SEQ ID NO: 2508661 - RNA, 21 nt, Human
ggggcagccaaacccaugagg

SEQ ID NO: 2508662 - RNA, 13 nt, Human
ggggauagaugug

SEQ ID NO: 2508663 - RNA, 17 nt, Human
ggggaucacagccucug

SEQ ID NO: 2508664 - RNA, 13 nt, Human
ggggaucucaggg

SEQ ID NO: 2508665 - RNA, 23 nt, Human
ggggaucccucccccccaugcac

SEQ ID NO: 2508666 - RNA, 20 nt, Human
ggggaugagagggugcuauc

SEQ ID NO: 2508667 - RNA, 21 nt, Human
ggggaugacuagaggcaggga

SEQ ID NO: 2508668 - RNA, 14 nt, Human
ggggaugugggagg

SEQ ID NO: 2508669 - RNA, 21 nt, Human
ggggaucccucccccccaugc

SEQ ID NO: 2508670 - RNA, 22 nt, Human
ggggaucaucugccgugccugg

SEQ ID NO: 2508671 - RNA, 13 nt, Human
ggggaucacagag

SEQ ID NO: 2508672 - RNA, 13 nt, Human
ggggauaugcuua

SEQ ID NO: 2508673 - RNA, 20 nt, Human
ggggaguuucuuuccugccu

SEQ ID NO: 2508674 - RNA, 20 nt, Human
ggggagugggacagagucug

SEQ ID NO: 2508675 - RNA, 21 nt, Human
gggcuuggggaccagagcugc

SEQ ID NO: 2508676 - RNA, 17 nt, Human
ggggagacugggcugag

SEQ ID NO: 2508677 - RNA, 19 nt, Human
ggggagaacuuacauugug

SEQ ID NO: 2508678 - RNA, 18 nt, Human
ggggagagccugcuggca

SEQ ID NO: 2508679 - RNA, 16 nt, Human
ggggagagccugcugg

SEQ ID NO: 2508680 - RNA, 14 nt, Human
ggggagagccugcu

SEQ ID NO: 2508681 - RNA, 18 nt, Human
ggggagagcaggcuggca

SEQ ID NO: 2508682 - RNA, 18 nt, Human
ggggagacugggcugagg

SEQ ID NO: 2508683 - RNA, 11 nt, Human
ggggagcccac

SEQ ID NO: 2508684 - RNA, 19 nt, Human
ggggagcccacuguccugg

SEQ ID NO: 2508685 - RNA, 11 nt, Human
ggggagcaggg

SEQ ID NO: 2508686 - RNA, 14 nt, Human
ggggagcagagaca

SEQ ID NO: 2508687 - RNA, 13 nt, Human
ggggaguggccac

SEQ ID NO: 2508688 - RNA, 17 nt, Human
ggggaguuaagaccugg

SEQ ID NO: 2508689 - RNA, 21 nt, Human
ggggaguuaagaccuggcagc

SEQ ID NO: 2508690 - RNA, 11 nt, Human
ggggaguggaa

SEQ ID NO: 2508691 - RNA, 17 nt, Human
ggggagucugaagcaga

SEQ ID NO: 2508692 - RNA, 13 nt, Human
ggggaguggaaua

SEQ ID NO: 2508693 - RNA, 19 nt, Human
ggggagugggacagagucu

SEQ ID NO: 2508694 - RNA, 22 nt, Human
ggggagccccuucugcucagcu

SEQ ID NO: 2508695 - RNA, 11 nt, Human
ggggagcccuc

SEQ ID NO: 2508696 - RNA, 18 nt, Human
ggggaggaaacucaccug

SEQ ID NO: 2508697 - RNA, 14 nt, Human
ggggaguaugcaaa

SEQ ID NO: 2508698 - RNA, 16 nt, Human
ggggagucugaagcag

SEQ ID NO: 2508699 - RNA, 14 nt, Human
ggggagggugacag

SEQ ID NO: 2508700 - RNA, 20 nt, Human
ggggagggugacaguggccg

SEQ ID NO: 2508701 - RNA, 20 nt, Human
gggcucugccucccaucacc

SEQ ID NO: 2508702 - RNA, 17 nt, Human
gggcucugccucccauc

SEQ ID NO: 2508703 - RNA, 16 nt, Human
gggcucugccucccau

SEQ ID NO: 2508704 - RNA, 15 nt, Human
gggcucugccuccca

SEQ ID NO: 2508705 - RNA, 13 nt, Human
gggcucugccucc

SEQ ID NO: 2508706 - RNA, 11 nt, Human
gggcucugccc

SEQ ID NO: 2508707 - RNA, 12 nt, Human
gggcucugcccc

SEQ ID NO: 2508708 - RNA, 23 nt, Human
gggcucugccccagaggccucuc

SEQ ID NO: 2508709 - RNA, 15 nt, Human
gggcucugccacccu

SEQ ID NO: 2508710 - RNA, 19 nt, Human
gggcucugccccagcucug

SEQ ID NO: 2508711 - RNA, 23 nt, Human
gggcucugcaauuccccucugcu

SEQ ID NO: 2508712 - RNA, 21 nt, Human
gggcucugcaauuccccucug

SEQ ID NO: 2508713 - RNA, 20 nt, Human
gggcucugcaauuccccucu

SEQ ID NO: 2508714 - RNA, 19 nt, Human
gggcucucugcuguacaua

SEQ ID NO: 2508715 - RNA, 14 nt, Human
gggcucgucuuugc

SEQ ID NO: 2508716 - RNA, 15 nt, Human
gggcucggaggcugc

SEQ ID NO: 2508717 - RNA, 17 nt, Human
gggcucgucuuugcaga

SEQ ID NO: 2508718 - RNA, 14 nt, Human
gggcucggaggcug

SEQ ID NO: 2508719 - RNA, 20 nt, Human
gggcucgccaugccgggggu

SEQ ID NO: 2508720 - RNA, 14 nt, Human
gggcucgccaugcc

SEQ ID NO: 2508721 - RNA, 21 nt, Human
gggcuccuuucuccagccagc

SEQ ID NO: 2508722 - RNA, 20 nt, Human
gggcuccuuucuccagccag

SEQ ID NO: 2508723 - RNA, 22 nt, Human
gggcuccuuucuccagccagca

SEQ ID NO: 2508724 - RNA, 18 nt, Human
gggcuccuuucuccagcc

SEQ ID NO: 2508725 - RNA, 13 nt, Human
gggcucucagcuc

SEQ ID NO: 2508726 - RNA, 23 nt, Human
gggcucucauguuuucaacugcc

SEQ ID NO: 2508727 - RNA, 13 nt, Human
gggcucuccaccu

SEQ ID NO: 2508728 - RNA, 14 nt, Human
gggcucuccaccuc

SEQ ID NO: 2508729 - RNA, 17 nt, Human
gggcucuccaccucagc

SEQ ID NO: 2508730 - RNA, 18 nt, Human
gggcucuccaccucagcc

SEQ ID NO: 2508731 - RNA, 19 nt, Human
gggcucuccaccucagccu

SEQ ID NO: 2508732 - RNA, 21 nt, Human
gggcucuccaccucagccuug

SEQ ID NO: 2508733 - RNA, 18 nt, Human
gggcuccugccuucuguc

SEQ ID NO: 2508734 - RNA, 17 nt, Human
gggcuccugccuucugu

SEQ ID NO: 2508735 - RNA, 22 nt, Human
gggcuccugcacuuacuugcuu

SEQ ID NO: 2508736 - RNA, 18 nt, Human
gggcuccugcacuuacuu

SEQ ID NO: 2508737 - RNA, 11 nt, Human
gggcuccugca

SEQ ID NO: 2508738 - RNA, 13 nt, Human
gggcucccuucau

SEQ ID NO: 2508739 - RNA, 15 nt, Human
gggcuccugugcccu

SEQ ID NO: 2508740 - RNA, 14 nt, Human
gggcuccugugccc

SEQ ID NO: 2508741 - RNA, 21 nt, Human
gggcuccugccuucuguccug

SEQ ID NO: 2508742 - RNA, 11 nt, Human
gggcuccugga

SEQ ID NO: 2508743 - RNA, 12 nt, Human
gggcuccuggaa

SEQ ID NO: 2508744 - RNA, 20 nt, Human
gggcuccuggaaaggcucag

SEQ ID NO: 2508745 - RNA, 23 nt, Human
gggcuccuggaaaggcucagucu

SEQ ID NO: 2508746 - RNA, 14 nt, Human
gggcugacugggac

SEQ ID NO: 2508747 - RNA, 10 nt, Human
gggcugagac

SEQ ID NO: 2508748 - RNA, 23 nt, Human
gggcugaccuuccucgcagagag

SEQ ID NO: 2508749 - RNA, 21 nt, Human
gggcugaccuuccucgcagag

SEQ ID NO: 2508750 - RNA, 20 nt, Human
gggcugacuagaagggccag

SEQ ID NO: 2508751 - RNA, 20 nt, Human
gggcugaccuuccucgcaga

SEQ ID NO: 2508752 - RNA, 16 nt, Human
gggcugaccuuccucg

SEQ ID NO: 2508753 - RNA, 19 nt, Human
gggcugaagguugaagagg

SEQ ID NO: 2508754 - RNA, 17 nt, Human
gggcugaagguugaaga

SEQ ID NO: 2508755 - RNA, 15 nt, Human
gggcucuucucauuu

SEQ ID NO: 2508756 - RNA, 19 nt, Human
gggcucugugggcugcacu

SEQ ID NO: 2508757 - RNA, 18 nt, Human
gggcugaacggggagaaa

SEQ ID NO: 2508758 - RNA, 11 nt, Human
gggcucugugg

SEQ ID NO: 2508759 - RNA, 16 nt, Human
gggcucuggagagaaa

SEQ ID NO: 2508760 - RNA, 16 nt, Human
gggcucugugcaguca

SEQ ID NO: 2508761 - RNA, 16 nt, Human
gggcucugugggcugc

SEQ ID NO: 2508762 - RNA, 14 nt, Human
gggcucugugggcu

SEQ ID NO: 2508763 - RNA, 12 nt, Human
gggcucuucuca

SEQ ID NO: 2508764 - RNA, 20 nt, Human
gggcucugccccagcucugg

SEQ ID NO: 2508765 - RNA, 21 nt, Human
gggcucugccccagcucuggc

SEQ ID NO: 2508766 - RNA, 15 nt, Human
gggcucuggagagaa

SEQ ID NO: 2508767 - RNA, 14 nt, Human
gggcucuggagaga

SEQ ID NO: 2508768 - RNA, 13 nt, Human
gggcucuggagag

SEQ ID NO: 2508769 - RNA, 12 nt, Human
gggcugagggag

SEQ ID NO: 2508770 - RNA, 13 nt, Human
gggcugagggagc

SEQ ID NO: 2508771 - RNA, 23 nt, Human
gggcugagcuggggaccugguac

SEQ ID NO: 2508772 - RNA, 16 nt, Human
gggcugagcugccugu

SEQ ID NO: 2508773 - RNA, 18 nt, Human
gggcugagcccuggcagg

SEQ ID NO: 2508774 - RNA, 16 nt, Human
gggcugagcccuggca

SEQ ID NO: 2508775 - RNA, 17 nt, Human
gggcugagcccuggcag

SEQ ID NO: 2508776 - RNA, 23 nt, Human
gggcugagccccuaccccacacc

SEQ ID NO: 2508777 - RNA, 15 nt, Human
gggcugagccccuac

SEQ ID NO: 2508778 - RNA, 14 nt, Human
gggcugagccccua

SEQ ID NO: 2508779 - RNA, 18 nt, Human
gggcugagagaaccucac

SEQ ID NO: 2508780 - RNA, 13 nt, Human
gggcugagcccug

SEQ ID NO: 2508781 - RNA, 15 nt, Human
gggcugagcccuggc

SEQ ID NO: 2508782 - RNA, 14 nt, Human
gggcugcaccggcu

SEQ ID NO: 2508783 - RNA, 16 nt, Human
gggcugaggugggagg

SEQ ID NO: 2508784 - RNA, 18 nt, Human
gggcuguaaaaugcauga

SEQ ID NO: 2508785 - RNA, 16 nt, Human
gggcugucaucugugc

SEQ ID NO: 2508786 - RNA, 23 nt, Human
gggcugguucuguaauugugugu

SEQ ID NO: 2508787 - RNA, 14 nt, Human
gggcugagggagcc

SEQ ID NO: 2508788 - RNA, 19 nt, Human
gggcuguccaguucccaga

SEQ ID NO: 2508789 - RNA, 17 nt, Human
gggcugucaucugugca

SEQ ID NO: 2508790 - RNA, 12 nt, Human
gggcugugaucg

SEQ ID NO: 2508791 - RNA, 16 nt, Human
gggcuguuggcacuca

SEQ ID NO: 2508792 - RNA, 11 nt, Human
gggcugugcua

SEQ ID NO: 2508793 - RNA, 15 nt, Human
gggcuuaagaaaucu

SEQ ID NO: 2508794 - RNA, 13 nt, Human
gggcuuagagcag

SEQ ID NO: 2508795 - RNA, 14 nt, Human
gggcuucaguggca

SEQ ID NO: 2508796 - RNA, 21 nt, Human
gggcuucaaccuugagacagc

SEQ ID NO: 2508797 - RNA, 24 nt, Human
gggcuuagagcaguuucuguccug

SEQ ID NO: 2508798 - RNA, 14 nt, Human
gggcuuagagcagu

SEQ ID NO: 2508799 - RNA, 23 nt, Human
gggcucccuucccaccucucuca

SEQ ID NO: 2508800 - RNA, 18 nt, Human
gggcucccuucccaccuc

SEQ ID NO: 2508801 - RNA, 17 nt, Human
gggcucccuucccaccu

SEQ ID NO: 2508802 - RNA, 14 nt, Human
gggcucccuuccca

SEQ ID NO: 2508803 - RNA, 13 nt, Human
gggcgcuggccca

SEQ ID NO: 2508804 - RNA, 12 nt, Human
gggcgcuggccc

SEQ ID NO: 2508805 - RNA, 14 nt, Human
gggcucccugacug

SEQ ID NO: 2508806 - RNA, 18 nt, Human
gggcucccugacugggag

SEQ ID NO: 2508807 - RNA, 21 nt, Human
gggcucccuguaaccucuuca

SEQ ID NO: 2508808 - RNA, 13 nt, Human
gggcucccuuccc

SEQ ID NO: 2508809 - RNA, 16 nt, Human
gggcgcgguggcucac

SEQ ID NO: 2508810 - RNA, 23 nt, Human
gggcgcggccagccccggcccug

SEQ ID NO: 2508811 - RNA, 18 nt, Human
gggcgcggccagccccgg

SEQ ID NO: 2508812 - RNA, 20 nt, Human
gggcgcucgcuuccgcaucc

SEQ ID NO: 2508813 - RNA, 12 nt, Human
gggccuugccca

SEQ ID NO: 2508814 - RNA, 14 nt, Human
gggccuugcccaga

SEQ ID NO: 2508815 - RNA, 15 nt, Human
gggccuugcccagag

SEQ ID NO: 2508816 - RNA, 17 nt, Human
gggccuugcccagagau

SEQ ID NO: 2508817 - RNA, 21 nt, Human
gggccuugcgguauccgcccc

SEQ ID NO: 2508818 - RNA, 22 nt, Human
gggccuugcccagagaugccuc

SEQ ID NO: 2508819 - RNA, 22 nt, Human
gggccuuggccuccccugcuga

SEQ ID NO: 2508820 - RNA, 23 nt, Human
gggccuugcuaccucaaggggga

SEQ ID NO: 2508821 - RNA, 16 nt, Human
gggccuuuggcaggug

SEQ ID NO: 2508822 - RNA, 20 nt, Human
gggcgaccccgucacagccu

SEQ ID NO: 2508823 - RNA, 19 nt, Human
gggcgaagcccaggccccu

SEQ ID NO: 2508824 - RNA, 20 nt, Human
gggcgagacuccgucucaaa

SEQ ID NO: 2508825 - RNA, 12 nt, Human
gggcgaggcaga

SEQ ID NO: 2508826 - RNA, 16 nt, Human
gggcgaggcagaggac

SEQ ID NO: 2508827 - RNA, 13 nt, Human
gggcgaggcagag

SEQ ID NO: 2508828 - RNA, 18 nt, Human
gggcgaucgcggcggagc

SEQ ID NO: 2508829 - RNA, 21 nt, Human
gggcgcccaccuccccacgcc

SEQ ID NO: 2508830 - RNA, 14 nt, Human
gggcgcccuggaag

SEQ ID NO: 2508831 - RNA, 18 nt, Human
gggcgagucacugccucu

SEQ ID NO: 2508832 - RNA, 13 nt, Human
gggcgcccaccuc

SEQ ID NO: 2508833 - RNA, 22 nt, Human
gggcgaucgcggcggagcuggc

SEQ ID NO: 2508834 - RNA, 22 nt, Human
gggcgccuguagucccagccac

SEQ ID NO: 2508835 - RNA, 15 nt, Human
gggcgcccuggaagc

SEQ ID NO: 2508836 - RNA, 15 nt, Human
gggcgcggccagccc

SEQ ID NO: 2508837 - RNA, 22 nt, Human
gggcgccgcaaaccacacugga

SEQ ID NO: 2508838 - RNA, 17 nt, Human
gggcccguugaggauga

SEQ ID NO: 2508839 - RNA, 20 nt, Human
gggcccguugucucccuggc

SEQ ID NO: 2508840 - RNA, 18 nt, Human
gggcccguugucucccug

SEQ ID NO: 2508841 - RNA, 16 nt, Human
gggcccguugucuccc

SEQ ID NO: 2508842 - RNA, 14 nt, Human
gggcccucccuugg

SEQ ID NO: 2508843 - RNA, 23 nt, Human
gggcccguugucucccuggcccu

SEQ ID NO: 2508844 - RNA, 22 nt, Human
gggcccguugucucccuggccc

SEQ ID NO: 2508845 - RNA, 21 nt, Human
gggcccguugucucccuggcc

SEQ ID NO: 2508846 - RNA, 19 nt, Human
gggcccuccgacagccccc

SEQ ID NO: 2508847 - RNA, 16 nt, Human
gggcccuccgacagcc

SEQ ID NO: 2508848 - RNA, 23 nt, Human
gggcccuccgacagcccccucug

SEQ ID NO: 2508849 - RNA, 21 nt, Human
gggccuggagauccuccugca

SEQ ID NO: 2508850 - RNA, 12 nt, Human
gggccuggagau

SEQ ID NO: 2508851 - RNA, 16 nt, Human
gggccuggaccugccu

SEQ ID NO: 2508852 - RNA, 14 nt, Human
gggccuggaccugc

SEQ ID NO: 2508853 - RNA, 13 nt, Human
gggccuggaccug

SEQ ID NO: 2508854 - RNA, 16 nt, Human
gggcccucucugcucu

SEQ ID NO: 2508855 - RNA, 12 nt, Human
gggcccuccuga

SEQ ID NO: 2508856 - RNA, 23 nt, Human
gggcccuccugaaacuuacacac

SEQ ID NO: 2508857 - RNA, 21 nt, Human
gggcccgcuugccucggcucc

SEQ ID NO: 2508858 - RNA, 20 nt, Human
gggcccgcuugccucggcuc

SEQ ID NO: 2508859 - RNA, 14 nt, Human
gggcccgcuugccu

SEQ ID NO: 2508860 - RNA, 13 nt, Human
gggcccgcuugcc

SEQ ID NO: 2508861 - RNA, 20 nt, Human
gggcccggccauguccuuag

SEQ ID NO: 2508862 - RNA, 16 nt, Human
gggcccggccagccau

SEQ ID NO: 2508863 - RNA, 23 nt, Human
gggcccgcuugccucggcuccug

SEQ ID NO: 2508864 - RNA, 13 nt, Human
gggcccggccagc

SEQ ID NO: 2508865 - RNA, 17 nt, Human
ggcucccacaggcagcu

SEQ ID NO: 2508866 - RNA, 21 nt, Human
ggcucccacaggcccuuccuc

SEQ ID NO: 2508867 - RNA, 20 nt, Human
ggcucccacaggcccuuccu

SEQ ID NO: 2508868 - RNA, 16 nt, Human
gggccuggcucaggug

SEQ ID NO: 2508869 - RNA, 14 nt, Human
gggccuggcucagg

SEQ ID NO: 2508870 - RNA, 18 nt, Human
gggccuggucguuuucaa

SEQ ID NO: 2508871 - RNA, 22 nt, Human
gggccuggcgggaugggccacc

SEQ ID NO: 2508872 - RNA, 19 nt, Human
gggccuggucccugggagg

SEQ ID NO: 2508873 - RNA, 16 nt, Human
gggccuggucccuggg

SEQ ID NO: 2508874 - RNA, 21 nt, Human
gggccuggauucauuuccugc

SEQ ID NO: 2508875 - RNA, 20 nt, Human
gggccuggauucauuuccug

SEQ ID NO: 2508876 - RNA, 18 nt, Human
gggccuggagcaggccuu

SEQ ID NO: 2508877 - RNA, 10 nt, Human
gggccuggca

SEQ ID NO: 2508878 - RNA, 22 nt, Human
gggccuggcagccgugccuuca

SEQ ID NO: 2508879 - RNA, 12 nt, Human
gggccuggcuca

SEQ ID NO: 2508880 - RNA, 19 nt, Human
gggccuggccugagcuggg

SEQ ID NO: 2508881 - RNA, 20 nt, Human
gggccuggcgggaugggcca

SEQ ID NO: 2508882 - RNA, 14 nt, Human
gucagccuccagcc

SEQ ID NO: 2508883 - RNA, 12 nt, Human
gucagccuccag

SEQ ID NO: 2508884 - RNA, 17 nt, Human
gucagccgggcccugag

SEQ ID NO: 2508885 - RNA, 16 nt, Human
gucagccgggcccuga

SEQ ID NO: 2508886 - RNA, 15 nt, Human
gucagccgggcccug

SEQ ID NO: 2508887 - RNA, 21 nt, Human
gucagccgagccgggccuggg

SEQ ID NO: 2508888 - RNA, 20 nt, Human
gucagccgagccgggccugg

SEQ ID NO: 2508889 - RNA, 16 nt, Human
gucagccgagccgggc

SEQ ID NO: 2508890 - RNA, 19 nt, Human
gucagccuccagccucugu

SEQ ID NO: 2508891 - RNA, 18 nt, Human
gucagccuccagccucug

SEQ ID NO: 2508892 - RNA, 16 nt, Human
gucagccuccagccuc

SEQ ID NO: 2508893 - RNA, 15 nt, Human
gucagccuccagccu

SEQ ID NO: 2508894 - RNA, 16 nt, Human
gucagccucucuccca

SEQ ID NO: 2508895 - RNA, 11 nt, Human
gucagccucuc

SEQ ID NO: 2508896 - RNA, 15 nt, Human
gucagcguugcaugu

SEQ ID NO: 2508897 - RNA, 20 nt, Human
gucagcgugcuuagccuccu

SEQ ID NO: 2508898 - RNA, 21 nt, Human
gucagcgcagguuuaguuuac

SEQ ID NO: 2508899 - RNA, 21 nt, Human
gucagccucucucccagucua

SEQ ID NO: 2508900 - RNA, 20 nt, Human
gucagccucucucccagucu

SEQ ID NO: 2508901 - RNA, 22 nt, Human
gucagccuucccccucccaggg

SEQ ID NO: 2508902 - RNA, 19 nt, Human
gucagcguugcaugucgug

SEQ ID NO: 2508903 - RNA, 18 nt, Human
gucagcguugcaugucgu

SEQ ID NO: 2508904 - RNA, 16 nt, Human
gucagcguugcauguc

SEQ ID NO: 2508905 - RNA, 13 nt, Human
gucauagaaauua

SEQ ID NO: 2508906 - RNA, 22 nt, Human
gucauagaaauuacacccaaag

SEQ ID NO: 2508907 - RNA, 22 nt, Human
gucauacuaucuacucuccuca

SEQ ID NO: 2508908 - RNA, 15 nt, Human
gucauaccaaugaaa

SEQ ID NO: 2508909 - RNA, 16 nt, Human
gucauaccaaugaaaa

SEQ ID NO: 2508910 - RNA, 20 nt, Human
gucauacuaucuacucuccu

SEQ ID NO: 2508911 - RNA, 21 nt, Human
gucauacuaucuacucuccuc

SEQ ID NO: 2508912 - RNA, 16 nt, Human
gucauaccaggccgcc

SEQ ID NO: 2508913 - RNA, 17 nt, Human
gucauacaauccauucu

SEQ ID NO: 2508914 - RNA, 14 nt, Human
gucagcuacuaaug

SEQ ID NO: 2508915 - RNA, 21 nt, Human
gucaccucagagacauacacc

SEQ ID NO: 2508916 - RNA, 23 nt, Human
gucaccugcccagaucccagaag

SEQ ID NO: 2508917 - RNA, 13 nt, Human
gucaccugugcuu

SEQ ID NO: 2508918 - RNA, 22 nt, Human
gucacguggaggagcagugcag

SEQ ID NO: 2508919 - RNA, 22 nt, Human
gucagcaaauuaauuggcagca

SEQ ID NO: 2508920 - RNA, 17 nt, Human
gucagcaaauuaauugg

SEQ ID NO: 2508921 - RNA, 23 nt, Human
gucagcaaaaagcaaaaucauuu

SEQ ID NO: 2508922 - RNA, 20 nt, Human
gucagcagccucccugaaga

SEQ ID NO: 2508923 - RNA, 23 nt, Human
gucagcagccucccugaagacca

SEQ ID NO: 2508924 - RNA, 13 nt, Human
gucagcaggaagc

SEQ ID NO: 2508925 - RNA, 15 nt, Human
gucagccaaauguaa

SEQ ID NO: 2508926 - RNA, 15 nt, Human
gucagccagggccag

SEQ ID NO: 2508927 - RNA, 12 nt, Human
gucagccagggc

SEQ ID NO: 2508928 - RNA, 14 nt, Human
gucagccagggcca

SEQ ID NO: 2508929 - RNA, 11 nt, Human
gucagccaggg

SEQ ID NO: 2508930 - RNA, 13 nt, Human
gucagcccuaggg

SEQ ID NO: 2508931 - RNA, 22 nt, Human
gucagcccuaggguggagagcc

SEQ ID NO: 2508932 - RNA, 23 nt, Human
gucagcccaaaccaccagaagcc

SEQ ID NO: 2508933 - RNA, 22 nt, Human
gucagcccaaaccaccagaagc

SEQ ID NO: 2508934 - RNA, 16 nt, Human
gucagccagggccagg

SEQ ID NO: 2508935 - RNA, 16 nt, Human
gucaugccccccucaa

SEQ ID NO: 2508936 - RNA, 15 nt, Human
gucaugccccccuca

SEQ ID NO: 2508937 - RNA, 19 nt, Human
gucaugcauaaauaugcag

SEQ ID NO: 2508938 - RNA, 18 nt, Human
gucaugcauaaauaugca

SEQ ID NO: 2508939 - RNA, 17 nt, Human
gucaugcauaaauaugc

SEQ ID NO: 2508940 - RNA, 14 nt, Human
gucaugcauaaaua

SEQ ID NO: 2508941 - RNA, 13 nt, Human
gucaugcauaaau

SEQ ID NO: 2508942 - RNA, 18 nt, Human
gucaugcaaaggcuggga

SEQ ID NO: 2508943 - RNA, 17 nt, Human
gucaugcaaaggcuggg

SEQ ID NO: 2508944 - RNA, 16 nt, Human
gucaugcaaaggcugg

SEQ ID NO: 2508945 - RNA, 15 nt, Human
gucaugauggcacca

SEQ ID NO: 2508946 - RNA, 20 nt, Human
gucaugaucucccugccgcc

SEQ ID NO: 2508947 - RNA, 22 nt, Human
gucaugaucucccugccgccuc

SEQ ID NO: 2508948 - RNA, 16 nt, Human
gucaugaucucccugc

SEQ ID NO: 2508949 - RNA, 17 nt, Human
gucaugaucucccugcc

SEQ ID NO: 2508950 - RNA, 18 nt, Human
gucaugaucucccugccg

SEQ ID NO: 2508951 - RNA, 19 nt, Human
gucaugaucucccugccgc

SEQ ID NO: 2508952 - RNA, 18 nt, Human
gucaucuugaccaagcag

SEQ ID NO: 2508953 - RNA, 16 nt, Human
gucaucugguagauuu

SEQ ID NO: 2508954 - RNA, 20 nt, Human
gucaucuugaccaagcagga

SEQ ID NO: 2508955 - RNA, 22 nt, Human
gucaucuugaccaagcaggaag

SEQ ID NO: 2508956 - RNA, 18 nt, Human
gucaucuuuuucucuaaa

SEQ ID NO: 2508957 - RNA, 18 nt, Human
gucaugaacauguuccug

SEQ ID NO: 2508958 - RNA, 22 nt, Human
gucaucuuuuucucuaaaauag

SEQ ID NO: 2508959 - RNA, 14 nt, Human
gucaugaagcccaa

SEQ ID NO: 2508960 - RNA, 18 nt, Human
gucaugagcugagcaggg

SEQ ID NO: 2508961 - RNA, 20 nt, Human
gucaugaauucuuaugcuua

SEQ ID NO: 2508962 - RNA, 16 nt, Human
gucaugagcugagcag

SEQ ID NO: 2508963 - RNA, 14 nt, Human
gucaugaucucccu

SEQ ID NO: 2508964 - RNA, 15 nt, Human
gucaugaucucccug

SEQ ID NO: 2508965 - RNA, 13 nt, Human
gucaucauacaug

SEQ ID NO: 2508966 - RNA, 17 nt, Human
gucaucaggagaaaaag

SEQ ID NO: 2508967 - RNA, 21 nt, Human
gucaucauuguauauaugugu

SEQ ID NO: 2508968 - RNA, 15 nt, Human
gucaucuaguuuuaa

SEQ ID NO: 2508969 - RNA, 12 nt, Human
gucaucuaguuu

SEQ ID NO: 2508970 - RNA, 16 nt, Human
gucaucucagcuggau

SEQ ID NO: 2508971 - RNA, 16 nt, Human
gucaucuaguuuuaaa

SEQ ID NO: 2508972 - RNA, 17 nt, Human
gucaucuccaucagcug

SEQ ID NO: 2508973 - RNA, 19 nt, Human
gucaucuccaucagcugua

SEQ ID NO: 2508974 - RNA, 14 nt, Human
gucaucagccacca

SEQ ID NO: 2508975 - RNA, 16 nt, Human
gucaucacuuuucagu

SEQ ID NO: 2508976 - RNA, 17 nt, Human
gucaucacuuuucagug

SEQ ID NO: 2508977 - RNA, 15 nt, Human
gucaucacuuuucag

SEQ ID NO: 2508978 - RNA, 16 nt, Human
gucauauuuugauuau

SEQ ID NO: 2508979 - RNA, 20 nt, Human
gucauauuuugauuauugua

SEQ ID NO: 2508980 - RNA, 12 nt, Human
gucauauuuuga

SEQ ID NO: 2508981 - RNA, 18 nt, Human
gucauauguaggugucug

SEQ ID NO: 2508982 - RNA, 21 nt, Human
gucauauaagauucauauuua

SEQ ID NO: 2508983 - RNA, 15 nt, Human
gucauagguuaauau

SEQ ID NO: 2508984 - RNA, 22 nt, Human
gucccagagcaggaggccccug

SEQ ID NO: 2508985 - RNA, 14 nt, Human
gucccagccacccc

SEQ ID NO: 2508986 - RNA, 15 nt, Human
gucccagccaccccg

SEQ ID NO: 2508987 - RNA, 16 nt, Human
gucccagccaccccgg

SEQ ID NO: 2508988 - RNA, 18 nt, Human
gucccagccaccccgggc

SEQ ID NO: 2508989 - RNA, 21 nt, Human
gucccagccaccccgggcucu

SEQ ID NO: 2508990 - RNA, 14 nt, Human
gucccagcuacucg

SEQ ID NO: 2508991 - RNA, 23 nt, Human
gucccagccaccccgggcucucu

SEQ ID NO: 2508992 - RNA, 22 nt, Human
gucccagcuacucagaagccug

SEQ ID NO: 2508993 - RNA, 16 nt, Human
gucccacuuccccucc

SEQ ID NO: 2508994 - RNA, 18 nt, Human
gucccacugccucagguu

SEQ ID NO: 2508995 - RNA, 19 nt, Human
gucccacugccucagguuc

SEQ ID NO: 2508996 - RNA, 21 nt, Human
gucccacuuccccuccuaccc

SEQ ID NO: 2508997 - RNA, 17 nt, Human
gucccacuuccccuccu

SEQ ID NO: 2508998 - RNA, 22 nt, Human
gucccagaaaaagcaucauggc

SEQ ID NO: 2508999 - RNA, 16 nt, Human
gucccagagcaggagg

SEQ ID NO: 2509000 - RNA, 19 nt, Human
gucccacuuggcaucagcu

SEQ ID NO: 2509001 - RNA, 20 nt, Human
gucccagaaugccuccugca

SEQ ID NO: 2509002 - RNA, 22 nt, Human
gucccagauuggcucacacuga

SEQ ID NO: 2509003 - RNA, 21 nt, Human
gucccagauuggcucacacug

SEQ ID NO: 2509004 - RNA, 19 nt, Human
gucccagagcaggaggccc

SEQ ID NO: 2509005 - RNA, 18 nt, Human
gucccagagcaggaggcc

SEQ ID NO: 2509006 - RNA, 17 nt, Human
gucccagauuggcucac

SEQ ID NO: 2509007 - RNA, 17 nt, Human
gucccagauacuugggg

SEQ ID NO: 2509008 - RNA, 17 nt, Human
gucccacugccucaggu

SEQ ID NO: 2509009 - RNA, 11 nt, Human
gucccacugcc

SEQ ID NO: 2509010 - RNA, 16 nt, Human
gucccacucaagccaa

SEQ ID NO: 2509011 - RNA, 18 nt, Human
gucccacucaagccaagc

SEQ ID NO: 2509012 - RNA, 21 nt, Human
gucccacucaagccaagcagc

SEQ ID NO: 2509013 - RNA, 22 nt, Human
gucccacucaagccaagcagcc

SEQ ID NO: 2509014 - RNA, 15 nt, Human
gucccacucagucca

SEQ ID NO: 2509015 - RNA, 14 nt, Human
gucccacucagucc

SEQ ID NO: 2509016 - RNA, 14 nt, Human
guccagggcccuga

SEQ ID NO: 2509017 - RNA, 15 nt, Human
guccagggcccugag

SEQ ID NO: 2509018 - RNA, 16 nt, Human
guccagggcccugagc

SEQ ID NO: 2509019 - RNA, 17 nt, Human
guccagggcccugagcu

SEQ ID NO: 2509020 - RNA, 12 nt, Human
gucccacucaag

SEQ ID NO: 2509021 - RNA, 23 nt, Human
guccagggaagagaaagugauuu

SEQ ID NO: 2509022 - RNA, 13 nt, Human
guccagggaagag

SEQ ID NO: 2509023 - RNA, 20 nt, Human
guccaggcugccguggggcc

SEQ ID NO: 2509024 - RNA, 16 nt, Human
guccaggcugccgugg

SEQ ID NO: 2509025 - RNA, 14 nt, Human
guccaggcugccgu

SEQ ID NO: 2509026 - RNA, 13 nt, Human
guccagggaagcu

SEQ ID NO: 2509027 - RNA, 15 nt, Human
guccagggaagcugg

SEQ ID NO: 2509028 - RNA, 20 nt, Human
guccagggaagcuggccgag

SEQ ID NO: 2509029 - RNA, 21 nt, Human
guccagggagcauuuuccucc

SEQ ID NO: 2509030 - RNA, 13 nt, Human
guccaggcugccg

SEQ ID NO: 2509031 - RNA, 15 nt, Human
guccaggcacugaga

SEQ ID NO: 2509032 - RNA, 17 nt, Human
guccaggccccaaaacc

SEQ ID NO: 2509033 - RNA, 21 nt, Human
guccaggaugcuaacaucuaa

SEQ ID NO: 2509034 - RNA, 16 nt, Human
guccacccaggagccc

SEQ ID NO: 2509035 - RNA, 15 nt, Human
guccacccaggagcc

SEQ ID NO: 2509036 - RNA, 23 nt, Human
gucauguuggucaaaagcuggau

SEQ ID NO: 2509037 - RNA, 17 nt, Human
gucauguuccuucaaga

SEQ ID NO: 2509038 - RNA, 13 nt, Human
guccacccaggag

SEQ ID NO: 2509039 - RNA, 14 nt, Human
guccacccaggagc

SEQ ID NO: 2509040 - RNA, 15 nt, Human
gucaugcuuguguua

SEQ ID NO: 2509041 - RNA, 16 nt, Human
gucaugcccuccucuc

SEQ ID NO: 2509042 - RNA, 17 nt, Human
gucaugcccuccucucc

SEQ ID NO: 2509043 - RNA, 18 nt, Human
gucaugcccuccucuccc

SEQ ID NO: 2509044 - RNA, 11 nt, Human
gucaugugacc

SEQ ID NO: 2509045 - RNA, 15 nt, Human
gucaugugacaggua

SEQ ID NO: 2509046 - RNA, 15 nt, Human
gucauggcuuaaugu

SEQ ID NO: 2509047 - RNA, 22 nt, Human
gucauggcugugcccucuugau

SEQ ID NO: 2509048 - RNA, 20 nt, Human
gucauggcuuaauguuuauu

SEQ ID NO: 2509049 - RNA, 20 nt, Human
gucauguaagcugaaaauau

SEQ ID NO: 2509050 - RNA, 21 nt, Human
guccagcucuggaggggaggg

SEQ ID NO: 2509051 - RNA, 16 nt, Human
guccagcucuggaggg

SEQ ID NO: 2509052 - RNA, 14 nt, Human
guccagcucuggag

SEQ ID NO: 2509053 - RNA, 13 nt, Human
guccagcucugga

SEQ ID NO: 2509054 - RNA, 14 nt, Human
guccagacagccug

SEQ ID NO: 2509055 - RNA, 12 nt, Human
guccagacagcc

SEQ ID NO: 2509056 - RNA, 22 nt, Human
guccagaagaauauucaggacu

SEQ ID NO: 2509057 - RNA, 11 nt, Human
guccagacagc

SEQ ID NO: 2509058 - RNA, 12 nt, Human
guccagcucugg

SEQ ID NO: 2509059 - RNA, 15 nt, Human
guccagacagccugu

SEQ ID NO: 2509060 - RNA, 14 nt, Human
guccagcuccaacc

SEQ ID NO: 2509061 - RNA, 17 nt, Human
guccagcugagcgccag

SEQ ID NO: 2509062 - RNA, 18 nt, Human
guccaggaaaugugcaca

SEQ ID NO: 2509063 - RNA, 13 nt, Human
guccaggagccug

SEQ ID NO: 2509064 - RNA, 14 nt, Human
guccagcuugcucu

SEQ ID NO: 2509065 - RNA, 16 nt, Human
guccagcuugcucuuc

SEQ ID NO: 2509066 - RNA, 17 nt, Human
guccagcuugcucuuca

SEQ ID NO: 2509067 - RNA, 14 nt, Human
guccacuguguaua

SEQ ID NO: 2509068 - RNA, 20 nt, Human
guccacugucacuguuucuc

SEQ ID NO: 2509069 - RNA, 23 nt, Human
guccacuguguauagaaguagau

SEQ ID NO: 2509070 - RNA, 21 nt, Human
guccagaagaauauucaggac

SEQ ID NO: 2509071 - RNA, 19 nt, Human
guccagaagaauauucagg

SEQ ID NO: 2509072 - RNA, 17 nt, Human
guccagaagaauauuca

SEQ ID NO: 2509073 - RNA, 15 nt, Human
guccagaagaauauu

SEQ ID NO: 2509074 - RNA, 17 nt, Human
gucaagugcguccacga

SEQ ID NO: 2509075 - RNA, 18 nt, Human
gucaaggcugcuuagaau

SEQ ID NO: 2509076 - RNA, 19 nt, Human
gucaagugaaaaaggagga

SEQ ID NO: 2509077 - RNA, 16 nt, Human
gucaagugaaaaagga

SEQ ID NO: 2509078 - RNA, 18 nt, Human
gucaagugaaaaaggagg

SEQ ID NO: 2509079 - RNA, 17 nt, Human
gucaagaagaagaugga

SEQ ID NO: 2509080 - RNA, 13 nt, Human
gucaagcuccucc

SEQ ID NO: 2509081 - RNA, 14 nt, Human
gucaagcccaggag

SEQ ID NO: 2509082 - RNA, 11 nt, Human
gucaagcacuc

SEQ ID NO: 2509083 - RNA, 14 nt, Human
gucaagauuuugaa

SEQ ID NO: 2509084 - RNA, 15 nt, Human
gucaagcuccuccuc

SEQ ID NO: 2509085 - RNA, 17 nt, Human
gucaagcuccuccuccc

SEQ ID NO: 2509086 - RNA, 19 nt, Human
gucaagcuccuccucccug

SEQ ID NO: 2509087 - RNA, 20 nt, Human
gucaagcuccuccucccugc

SEQ ID NO: 2509088 - RNA, 21 nt, Human
gucaagcuccuccucccugca

SEQ ID NO: 2509089 - RNA, 15 nt, Human
gucaaggaguggcuu

SEQ ID NO: 2509090 - RNA, 19 nt, Human
gucaagagggucugaggaa

SEQ ID NO: 2509091 - RNA, 18 nt, Human
gucaagagggucugagga

SEQ ID NO: 2509092 - RNA, 12 nt, Human
guauuuguuugc

SEQ ID NO: 2509093 - RNA, 12 nt, Human
gucaacuucugg

SEQ ID NO: 2509094 - RNA, 23 nt, Human
guauuuguuugcauaggugaucu

SEQ ID NO: 2509095 - RNA, 17 nt, Human
gucaacuucuggcuccu

SEQ ID NO: 2509096 - RNA, 15 nt, Human
gucaacuucuggcuc

SEQ ID NO: 2509097 - RNA, 17 nt, Human
guauuuuaaaagaauga

SEQ ID NO: 2509098 - RNA, 16 nt, Human
guauuuuaaaagaaug

SEQ ID NO: 2509099 - RNA, 11 nt, Human
guauuugugac

SEQ ID NO: 2509100 - RNA, 20 nt, Human
guauuugggaagugaagacu

SEQ ID NO: 2509101 - RNA, 21 nt, Human
guauuugugacuaauuguaua

SEQ ID NO: 2509102 - RNA, 20 nt, Human
guauuugugacuaauuguau

SEQ ID NO: 2509103 - RNA, 18 nt, Human
guauuugugacuaauugu

SEQ ID NO: 2509104 - RNA, 14 nt, Human
guauuuguuaaugg

SEQ ID NO: 2509105 - RNA, 16 nt, Human
gucaccucagagacau

SEQ ID NO: 2509106 - RNA, 21 nt, Human
gucaccguggaccuuccugcc

SEQ ID NO: 2509107 - RNA, 20 nt, Human
gucaccguggaccuuccugc

SEQ ID NO: 2509108 - RNA, 19 nt, Human
gucaccguggaccuuccug

SEQ ID NO: 2509109 - RNA, 18 nt, Human
gucaccguggaccuuccu

SEQ ID NO: 2509110 - RNA, 23 nt, Human
gucaccggauccuggguggucug

SEQ ID NO: 2509111 - RNA, 14 nt, Human
gucaccucauggaa

SEQ ID NO: 2509112 - RNA, 20 nt, Human
gucaccugaagacucauucu

SEQ ID NO: 2509113 - RNA, 20 nt, Human
gucacccaggcuggagugca

SEQ ID NO: 2509114 - RNA, 20 nt, Human
gucacccaggcuggaguaca

SEQ ID NO: 2509115 - RNA, 23 nt, Human
gucaccaucuuaagagaugccuc

SEQ ID NO: 2509116 - RNA, 16 nt, Human
gucaccaucucaggcc

SEQ ID NO: 2509117 - RNA, 17 nt, Human
gucaccaucucaggcca

SEQ ID NO: 2509118 - RNA, 20 nt, Human
gucaccaucucaggccaccu

SEQ ID NO: 2509119 - RNA, 21 nt, Human
gucaccaucucaggccaccug

SEQ ID NO: 2509120 - RNA, 13 nt, Human
gucaccccggcca

SEQ ID NO: 2509121 - RNA, 15 nt, Human
gucaccccggccacc

SEQ ID NO: 2509122 - RNA, 16 nt, Human
gucacccuccaccucu

SEQ ID NO: 2509123 - RNA, 16 nt, Human
gucaccggauccuggg

SEQ ID NO: 2509124 - RNA, 17 nt, Human
gucaccggauccugggu

SEQ ID NO: 2509125 - RNA, 19 nt, Human
gucaccggauccugggugg

SEQ ID NO: 2509126 - RNA, 15 nt, Human
gucaauaaaauccau

SEQ ID NO: 2509127 - RNA, 14 nt, Human
gucaagugggaucu

SEQ ID NO: 2509128 - RNA, 16 nt, Human
gucaagugggaucugu

SEQ ID NO: 2509129 - RNA, 17 nt, Human
gucaaguuccuuugggu

SEQ ID NO: 2509130 - RNA, 21 nt, Human
gucaauaaaauccauacauuu

SEQ ID NO: 2509131 - RNA, 18 nt, Human
gucaaguugugcuuguuu

SEQ ID NO: 2509132 - RNA, 17 nt, Human
gucaaguugugcuuguu

SEQ ID NO: 2509133 - RNA, 16 nt, Human
gucaaguugugcuugu

SEQ ID NO: 2509134 - RNA, 15 nt, Human
gucaauuacaggaag

SEQ ID NO: 2509135 - RNA, 13 nt, Human
gucaauuacagga

SEQ ID NO: 2509136 - RNA, 16 nt, Human
gucaauuacaggaagu

SEQ ID NO: 2509137 - RNA, 18 nt, Human
gucaaugugcaguguagc

SEQ ID NO: 2509138 - RNA, 15 nt, Human
gucaccaucucaggc

SEQ ID NO: 2509139 - RNA, 15 nt, Human
gucaauguuuucagu

SEQ ID NO: 2509140 - RNA, 14 nt, Human
gucaaugugcagug

SEQ ID NO: 2509141 - RNA, 15 nt, Human
guauuacuucugcua

SEQ ID NO: 2509142 - RNA, 14 nt, Human
guauuacuucugcu

SEQ ID NO: 2509143 - RNA, 13 nt, Human
guauuacuucugc

SEQ ID NO: 2509144 - RNA, 22 nt, Human
guauuacacuguauuuguaucu

SEQ ID NO: 2509145 - RNA, 21 nt, Human
guauuacuagaagaugaauac

SEQ ID NO: 2509146 - RNA, 15 nt, Human
guagagugggagcug

SEQ ID NO: 2509147 - RNA, 23 nt, Human
guagagucaucuccaucagcugu

SEQ ID NO: 2509148 - RNA, 14 nt, Human
guagagguuuuguu

SEQ ID NO: 2509149 - RNA, 15 nt, Human
guagagucaucucca

SEQ ID NO: 2509150 - RNA, 13 nt, Human
guagagugggagc

SEQ ID NO: 2509151 - RNA, 15 nt, Human
guauuauguguguuu

SEQ ID NO: 2509152 - RNA, 14 nt, Human
guauuaugcuucuu

SEQ ID NO: 2509153 - RNA, 12 nt, Human
guauuaugcuuc

SEQ ID NO: 2509154 - RNA, 20 nt, Human
guauuauaaauuauguuuau

SEQ ID NO: 2509155 - RNA, 19 nt, Human
guauuauaggccaaacugg

SEQ ID NO: 2509156 - RNA, 14 nt, Human
guauuauuuuccaa

SEQ ID NO: 2509157 - RNA, 15 nt, Human
guauuauucugcagc

SEQ ID NO: 2509158 - RNA, 17 nt, Human
guauuaugcuucuugga

SEQ ID NO: 2509159 - RNA, 15 nt, Human
guauuaugcuucuug

SEQ ID NO: 2509160 - RNA, 16 nt, Human
guauuaugucucuucu

SEQ ID NO: 2509161 - RNA, 21 nt, Human
guauuauguacucuacugaua

SEQ ID NO: 2509162 - RNA, 16 nt, Human
guauuauucugcagca

SEQ ID NO: 2509163 - RNA, 22 nt, Human
guauuagauguucucuaucauu

SEQ ID NO: 2509164 - RNA, 21 nt, Human
guauuagauguucucuaucau

SEQ ID NO: 2509165 - RNA, 18 nt, Human
guauuagauguucucuau

SEQ ID NO: 2509166 - RNA, 17 nt, Human
guauuagauguucucua

SEQ ID NO: 2509167 - RNA, 15 nt, Human
guauuagauguucuc

SEQ ID NO: 2509168 - RNA, 14 nt, Human
guauuagauguucu

SEQ ID NO: 2509169 - RNA, 13 nt, Human
guauuagauguuc

SEQ ID NO: 2509170 - RNA, 12 nt, Human
guauuagauguu

SEQ ID NO: 2509171 - RNA, 14 nt, Human
guauuauaccuuuu

SEQ ID NO: 2509172 - RNA, 19 nt, Human
guauuauaaauuauguuua

SEQ ID NO: 2509173 - RNA, 18 nt, Human
guauuauaaauuauguuu

SEQ ID NO: 2509174 - RNA, 12 nt, Human
guauuauaaauu

SEQ ID NO: 2509175 - RNA, 22 nt, Human
guauuagggguaauauauugcu

SEQ ID NO: 2509176 - RNA, 19 nt, Human
guauuagggguaauauauu

SEQ ID NO: 2509177 - RNA, 22 nt, Human
guauuugcuuuuuuguuuuggc

SEQ ID NO: 2509178 - RNA, 12 nt, Human
guauuugcuuuu

SEQ ID NO: 2509179 - RNA, 13 nt, Human
guauuugcaguuc

SEQ ID NO: 2509180 - RNA, 21 nt, Human
guauuugagaguucuaaauuu

SEQ ID NO: 2509181 - RNA, 19 nt, Human
guauuugagaguucuaaau

SEQ ID NO: 2509182 - RNA, 14 nt, Human
guauuugaaacuga

SEQ ID NO: 2509183 - RNA, 22 nt, Human
guauuucuaugaaauauuaugu

SEQ ID NO: 2509184 - RNA, 12 nt, Human
guauuucccagc

SEQ ID NO: 2509185 - RNA, 16 nt, Human
guauuuccagugcaau

SEQ ID NO: 2509186 - RNA, 17 nt, Human
guauuucuaugaaauau

SEQ ID NO: 2509187 - RNA, 13 nt, Human
guauuucaaauug

SEQ ID NO: 2509188 - RNA, 11 nt, Human
guauuucagac

SEQ ID NO: 2509189 - RNA, 23 nt, Human
guauuuauuuuccuccccagcag

SEQ ID NO: 2509190 - RNA, 19 nt, Human
guauuuauuuaguauuuau

SEQ ID NO: 2509191 - RNA, 18 nt, Human
guauuuauuuaaaagauu

SEQ ID NO: 2509192 - RNA, 14 nt, Human
guauuuauuuaaaa

SEQ ID NO: 2509193 - RNA, 13 nt, Human
guauuuauuuaaa

SEQ ID NO: 2509194 - RNA, 21 nt, Human
guauuuauuuaaaagauucau

SEQ ID NO: 2509195 - RNA, 17 nt, Human
guauuuauuuuccuccc

SEQ ID NO: 2509196 - RNA, 18 nt, Human
guauuuauuuuccucccc

SEQ ID NO: 2509197 - RNA, 19 nt, Human
guauuuauuuuccucccca

SEQ ID NO: 2509198 - RNA, 20 nt, Human
guauuuauuuuccuccccag

SEQ ID NO: 2509199 - RNA, 22 nt, Human
guauuuauuuuccuccccagca

SEQ ID NO: 2509200 - RNA, 22 nt, Human
guauuuauucaauaaaguauuu

SEQ ID NO: 2509201 - RNA, 20 nt, Human
guauuuauucaauaaaguau

SEQ ID NO: 2509202 - RNA, 19 nt, Human
guauuuauucaauaaagua

SEQ ID NO: 2509203 - RNA, 17 nt, Human
guauuuauucaauaaag

SEQ ID NO: 2509204 - RNA, 23 nt, Human
guauuuauuccauauucauguaa

SEQ ID NO: 2509205 - RNA, 22 nt, Human
guauuuauuccauauucaugua

SEQ ID NO: 2509206 - RNA, 21 nt, Human
guauuuauuccauauucaugu

SEQ ID NO: 2509207 - RNA, 15 nt, Human
guauuuauuccauau

SEQ ID NO: 2509208 - RNA, 23 nt, Human
guauuuauucaauaaaguauuua

SEQ ID NO: 2509209 - RNA, 13 nt, Human
guauuuauuccau

SEQ ID NO: 2509210 - RNA, 22 nt, Human
guauucgugcagcauaugagga

SEQ ID NO: 2509211 - RNA, 16 nt, Human
guauuuauucaauaaa

SEQ ID NO: 2509212 - RNA, 14 nt, Human
guauuuauucaaua

SEQ ID NO: 2509213 - RNA, 13 nt, Human
guauuuauucaau

SEQ ID NO: 2509214 - RNA, 20 nt, Human
guauuccuuuuguguacagu

SEQ ID NO: 2509215 - RNA, 23 nt, Human
guauuccuuuuguguacagugug

SEQ ID NO: 2509216 - RNA, 18 nt, Human
guauuccuuaaauaaacu

SEQ ID NO: 2509217 - RNA, 14 nt, Human
guauuccugccucc

SEQ ID NO: 2509218 - RNA, 19 nt, Human
guauucccauuagaccaag

SEQ ID NO: 2509219 - RNA, 11 nt, Human
guauuuauuca

SEQ ID NO: 2509220 - RNA, 19 nt, Human
guauuccagaccugaagaa

SEQ ID NO: 2509221 - RNA, 22 nt, Human
guauucagugagggucuucuua

SEQ ID NO: 2509222 - RNA, 18 nt, Human
guauucaauauccuuugc

SEQ ID NO: 2509223 - RNA, 13 nt, Human
gucucgcucuguc

SEQ ID NO: 2509224 - RNA, 21 nt, Human
gucucgcugaugcugggcugg

SEQ ID NO: 2509225 - RNA, 20 nt, Human
gucucgcugaugcugggcug

SEQ ID NO: 2509226 - RNA, 19 nt, Human
gucucgcugaugcugggcu

SEQ ID NO: 2509227 - RNA, 18 nt, Human
gucucgcugaugcugggc

SEQ ID NO: 2509228 - RNA, 18 nt, Human
gucucgcucugucaccca

SEQ ID NO: 2509229 - RNA, 17 nt, Human
gucucgcugaugcuggg

SEQ ID NO: 2509230 - RNA, 22 nt, Human
gucucacuugugcaguguugac

SEQ ID NO: 2509231 - RNA, 24 nt, Human
gucucagacucuuuuuguaccugg

SEQ ID NO: 2509232 - RNA, 23 nt, Human
gucucacuguugcccaggcuggc

SEQ ID NO: 2509233 - RNA, 22 nt, Human
gucucacuguugcccaggcugg

SEQ ID NO: 2509234 - RNA, 21 nt, Human
gucucacuguugcccaggcug

SEQ ID NO: 2509235 - RNA, 20 nt, Human
gucucacuguugcccaggcu

SEQ ID NO: 2509236 - RNA, 19 nt, Human
gucucacuguugcccaggc

SEQ ID NO: 2509237 - RNA, 18 nt, Human
gucucacuguugcccagg

SEQ ID NO: 2509238 - RNA, 17 nt, Human
gucucacuguugcccag

SEQ ID NO: 2509239 - RNA, 16 nt, Human
gucucacuguugccca

SEQ ID NO: 2509240 - RNA, 23 nt, Human
gucucacuauguugcccaggcag

SEQ ID NO: 2509241 - RNA, 13 nt, Human
gucucacuguugc

SEQ ID NO: 2509242 - RNA, 21 nt, Human
gucucacuauguugcccaggc

SEQ ID NO: 2509243 - RNA, 20 nt, Human
gucucacuauguugcccagg

SEQ ID NO: 2509244 - RNA, 17 nt, Human
guccuuaccagcagagc

SEQ ID NO: 2509245 - RNA, 16 nt, Human
guccuuaccagcagag

SEQ ID NO: 2509246 - RNA, 15 nt, Human
guccuuaccagcaga

SEQ ID NO: 2509247 - RNA, 17 nt, Human
guccuguggcaggcagc

SEQ ID NO: 2509248 - RNA, 16 nt, Human
guccuguggcaggcag

SEQ ID NO: 2509249 - RNA, 21 nt, Human
guccuguggcaggcagcgcca

SEQ ID NO: 2509250 - RNA, 15 nt, Human
guccuguggcaggca

SEQ ID NO: 2509251 - RNA, 21 nt, Human
guccuguguuuuuucugccac

SEQ ID NO: 2509252 - RNA, 23 nt, Human
guccuuaaacagggcaucuccag

SEQ ID NO: 2509253 - RNA, 20 nt, Human
guccuuaaugauccguucca

SEQ ID NO: 2509254 - RNA, 17 nt, Human
gucguggggugugcugg

SEQ ID NO: 2509255 - RNA, 21 nt, Human
gucguggggugugcugggagc

SEQ ID NO: 2509256 - RNA, 19 nt, Human
gucguggggugugcuggga

SEQ ID NO: 2509257 - RNA, 14 nt, Human
gucgugggugugug

SEQ ID NO: 2509258 - RNA, 13 nt, Human
gucguugugaggg

SEQ ID NO: 2509259 - RNA, 19 nt, Human
gucguugacuuuagggacu

SEQ ID NO: 2509260 - RNA, 17 nt, Human
gucguugacuuuaggga

SEQ ID NO: 2509261 - RNA, 12 nt, Human
gucuaaaaacac

SEQ ID NO: 2509262 - RNA, 14 nt, Human
gucuaaaaauaaaa

SEQ ID NO: 2509263 - RNA, 13 nt, Human
gucuaaaacaaua

SEQ ID NO: 2509264 - RNA, 14 nt, Human
gucuaaaacaauaa

SEQ ID NO: 2509265 - RNA, 16 nt, Human
gucuaaacaaugcuga

SEQ ID NO: 2509266 - RNA, 20 nt, Human
gucuaaaauuuuuaaggacu

SEQ ID NO: 2509267 - RNA, 23 nt, Human
gucuaagauaguaacaaugaaga

SEQ ID NO: 2509268 - RNA, 14 nt, Human
gucuaaagagcuuu

SEQ ID NO: 2509269 - RNA, 10 nt, Human
gucuaaacug

SEQ ID NO: 2509270 - RNA, 21 nt, Human
gucuaaacaaugcugauuugg

SEQ ID NO: 2509271 - RNA, 17 nt, Human
gucuacacuaagagaga

SEQ ID NO: 2509272 - RNA, 21 nt, Human
gucuaaucuagauaucgacuu

SEQ ID NO: 2509273 - RNA, 20 nt, Human
gucuaaggaugcuaaaccuu

SEQ ID NO: 2509274 - RNA, 23 nt, Human
gucuacacuaagagagaaugaga

SEQ ID NO: 2509275 - RNA, 15 nt, Human
gucuacacugugcug

SEQ ID NO: 2509276 - RNA, 21 nt, Human
gucuacccagagaagccccuu

SEQ ID NO: 2509277 - RNA, 20 nt, Human
gucuacccagagaagccccu

SEQ ID NO: 2509278 - RNA, 17 nt, Human
gucuacccagagaagcc

SEQ ID NO: 2509279 - RNA, 13 nt, Human
gucuacccagaga

SEQ ID NO: 2509280 - RNA, 19 nt, Human
gucugaggaauccagaccc

SEQ ID NO: 2509281 - RNA, 18 nt, Human
gucugaggaauccagacc

SEQ ID NO: 2509282 - RNA, 13 nt, Human
gucucuuccccuc

SEQ ID NO: 2509283 - RNA, 14 nt, Human
gucugacccucucc

SEQ ID NO: 2509284 - RNA, 17 nt, Human
gucucuucuccacugga

SEQ ID NO: 2509285 - RNA, 15 nt, Human
gucugacccacugcu

SEQ ID NO: 2509286 - RNA, 14 nt, Human
gucucuucuccacu

SEQ ID NO: 2509287 - RNA, 11 nt, Human
gucucuucaga

SEQ ID NO: 2509288 - RNA, 16 nt, Human
gucucuucuccacugg

SEQ ID NO: 2509289 - RNA, 15 nt, Human
gucucuucuccacug

SEQ ID NO: 2509290 - RNA, 14 nt, Human
gucugacccacugc

SEQ ID NO: 2509291 - RNA, 13 nt, Human
gucugacccacug

SEQ ID NO: 2509292 - RNA, 16 nt, Human
gucucucaugaaccuc

SEQ ID NO: 2509293 - RNA, 15 nt, Human
gucucucaugaaccu

SEQ ID NO: 2509294 - RNA, 12 nt, Human
gucucucagaau

SEQ ID NO: 2509295 - RNA, 14 nt, Human
gucucugugcuuug

SEQ ID NO: 2509296 - RNA, 15 nt, Human
gucucugugagacuc

SEQ ID NO: 2509297 - RNA, 16 nt, Human
gucucggacuaagccu

SEQ ID NO: 2509298 - RNA, 22 nt, Human
gucucggugguaccaggucucc

SEQ ID NO: 2509299 - RNA, 16 nt, Human
gucucggugguaccag

SEQ ID NO: 2509300 - RNA, 23 nt, Human
gucucggguggcuagucagagag

SEQ ID NO: 2509301 - RNA, 16 nt, Human
gucucgcuuuguugcc

SEQ ID NO: 2509302 - RNA, 17 nt, Human
gucucgcuuuguugccc

SEQ ID NO: 2509303 - RNA, 19 nt, Human
gucucgcuuuguugcccag

SEQ ID NO: 2509304 - RNA, 23 nt, Human
gucucgcuuuguugcccaggcug

SEQ ID NO: 2509305 - RNA, 20 nt, Human
gucucuaucauuaaaguucu

SEQ ID NO: 2509306 - RNA, 19 nt, Human
gucucuaucauuaaaguuc

SEQ ID NO: 2509307 - RNA, 18 nt, Human
gucucuaucauuaaaguu

SEQ ID NO: 2509308 - RNA, 17 nt, Human
gucucuaucauuaaagu

SEQ ID NO: 2509309 - RNA, 17 nt, Human
gucucuaugccagcuca

SEQ ID NO: 2509310 - RNA, 23 nt, Human
gucucuaugccagcucaguccca

SEQ ID NO: 2509311 - RNA, 16 nt, Human
gucucuaucauuaaag

SEQ ID NO: 2509312 - RNA, 21 nt, Human
gucugauucccaagcucugcu

SEQ ID NO: 2509313 - RNA, 20 nt, Human
gucugauucccaagcucugc

SEQ ID NO: 2509314 - RNA, 15 nt, Human
gucugcaagaaccug

SEQ ID NO: 2509315 - RNA, 23 nt, Human
gucugcaacuuuaagcagcucuu

SEQ ID NO: 2509316 - RNA, 22 nt, Human
gucugcaacuuuaagcagcucu

SEQ ID NO: 2509317 - RNA, 20 nt, Human
gucugcaacuuuaagcagcu

SEQ ID NO: 2509318 - RNA, 15 nt, Human
gucugcaacuuuaag

SEQ ID NO: 2509319 - RNA, 23 nt, Human
gucugcaaaaugaggaauguaua

SEQ ID NO: 2509320 - RNA, 21 nt, Human
gucugcaaaaugaggaaugua

SEQ ID NO: 2509321 - RNA, 16 nt, Human
gucugauuugugauga

SEQ ID NO: 2509322 - RNA, 24 nt, Human
gucugaucugugcuuuccagcuca

SEQ ID NO: 2509323 - RNA, 23 nt, Human
gucugaucugugcuuuccagcuc

SEQ ID NO: 2509324 - RNA, 22 nt, Human
gucugaucugugcuuuccagcu

SEQ ID NO: 2509325 - RNA, 21 nt, Human
gucugaucugugcuuuccagc

SEQ ID NO: 2509326 - RNA, 20 nt, Human
gucugauuggcucacccaag

SEQ ID NO: 2509327 - RNA, 22 nt, Human
gucugauuucaggauacucugu

SEQ ID NO: 2509328 - RNA, 20 nt, Human
gucugcauuucgguggcuag

SEQ ID NO: 2509329 - RNA, 21 nt, Human
gucugcauuucgguggcuagu

SEQ ID NO: 2509330 - RNA, 16 nt, Human
gucugcaggugcacca

SEQ ID NO: 2509331 - RNA, 13 nt, Human
gucugcaggcagg

SEQ ID NO: 2509332 - RNA, 19 nt, Human
gucugcagcccggcgccac

SEQ ID NO: 2509333 - RNA, 22 nt, Human
gucugcaggauugauuaugcag

SEQ ID NO: 2509334 - RNA, 12 nt, Human
gucugcaggcag

SEQ ID NO: 2509335 - RNA, 17 nt, Human
gucugccacacaaacgu

SEQ ID NO: 2509336 - RNA, 21 nt, Human
gucugccaauuuuugccuuca

SEQ ID NO: 2509337 - RNA, 18 nt, Human
gucugccaccauccugcu

SEQ ID NO: 2509338 - RNA, 18 nt, Human
gucugccaauuuuugccu

SEQ ID NO: 2509339 - RNA, 19 nt, Human
gucugcaagucagaggaug

SEQ ID NO: 2509340 - RNA, 18 nt, Human
gucugcaagucagaggau

SEQ ID NO: 2509341 - RNA, 17 nt, Human
gucugcaagucagagga

SEQ ID NO: 2509342 - RNA, 16 nt, Human
gucugcaagucagagg

SEQ ID NO: 2509343 - RNA, 15 nt, Human
gucugcaagucagag

SEQ ID NO: 2509344 - RNA, 14 nt, Human
gucugcaagucaga

SEQ ID NO: 2509345 - RNA, 13 nt, Human
gucugcaagucag

SEQ ID NO: 2509346 - RNA, 22 nt, Human
gucugcaagauucugaaacauu

SEQ ID NO: 2509347 - RNA, 15 nt, Human
gucugcacccagggg

SEQ ID NO: 2509348 - RNA, 13 nt, Human
gucugcacccagg

SEQ ID NO: 2509349 - RNA, 16 nt, Human
gucugcacaugcagcu

SEQ ID NO: 2509350 - RNA, 21 nt, Human
gucugcaagucagaggauggc

SEQ ID NO: 2509351 - RNA, 22 nt, Human
gucugcacucuaacccuaggca

SEQ ID NO: 2509352 - RNA, 17 nt, Human
gucugcacccaggggug

SEQ ID NO: 2509353 - RNA, 18 nt, Human
gucugcagcccggcgcca

SEQ ID NO: 2509354 - RNA, 19 nt, Human
gucugauucccaagcucug

SEQ ID NO: 2509355 - RNA, 18 nt, Human
gucugauucccaagcucu

SEQ ID NO: 2509356 - RNA, 17 nt, Human
gucugaucugugcuuuc

SEQ ID NO: 2509357 - RNA, 15 nt, Human
gucugaucugugcuu

SEQ ID NO: 2509358 - RNA, 13 nt, Human
gucugaucugugc

SEQ ID NO: 2509359 - RNA, 21 nt, Human
gucugaucgugacgcugaaua

SEQ ID NO: 2509360 - RNA, 20 nt, Human
gucugaucgugacgcugaau

SEQ ID NO: 2509361 - RNA, 19 nt, Human
gucugaucgugacgcugaa

SEQ ID NO: 2509362 - RNA, 14 nt, Human
gucugauauucaaa

SEQ ID NO: 2509363 - RNA, 17 nt, Human
gucugauucccaagcuc

SEQ ID NO: 2509364 - RNA, 14 nt, Human
gucugacugugugu

SEQ ID NO: 2509365 - RNA, 21 nt, Human
gucugaggaauccagacccgg

SEQ ID NO: 2509366 - RNA, 22 nt, Human
gucugaggggcaacugagucug

SEQ ID NO: 2509367 - RNA, 21 nt, Human
gucugagucauggccgggugg

SEQ ID NO: 2509368 - RNA, 14 nt, Human
gucugagucauggc

SEQ ID NO: 2509369 - RNA, 14 nt, Human
gucugagugaaccu

SEQ ID NO: 2509370 - RNA, 22 nt, Human
gucccagugggaggggcaggcu

SEQ ID NO: 2509371 - RNA, 21 nt, Human
gucccagugggaggggcaggc

SEQ ID NO: 2509372 - RNA, 20 nt, Human
gucccagugggaggggcagg

SEQ ID NO: 2509373 - RNA, 19 nt, Human
gucccagugggaggggcag

SEQ ID NO: 2509374 - RNA, 18 nt, Human
gucccagugggaggggca

SEQ ID NO: 2509375 - RNA, 18 nt, Human
gucccagugggaggcgcg

SEQ ID NO: 2509376 - RNA, 17 nt, Human
gucccagugggaggcgc

SEQ ID NO: 2509377 - RNA, 15 nt, Human
gucccagugggaggc

SEQ ID NO: 2509378 - RNA, 14 nt, Human
gucccagugggagg

SEQ ID NO: 2509379 - RNA, 11 nt, Human
gucccaguggg

SEQ ID NO: 2509380 - RNA, 10 nt, Human
gucccagugg

SEQ ID NO: 2509381 - RNA, 17 nt, Human
gucccagucucuggcag

SEQ ID NO: 2509382 - RNA, 17 nt, Human
gucccagguuaucuggg

SEQ ID NO: 2509383 - RNA, 19 nt, Human
gucccaggagcugcccaga

SEQ ID NO: 2509384 - RNA, 21 nt, Human
gucccaggcugagccucaguc

SEQ ID NO: 2509385 - RNA, 12 nt, Human
gucccagugccg

SEQ ID NO: 2509386 - RNA, 18 nt, Human
gucccauaggcccaguga

SEQ ID NO: 2509387 - RNA, 23 nt, Human
gucccagugggaggggcaggcug

SEQ ID NO: 2509388 - RNA, 16 nt, Human
gucccauaggcccagu

SEQ ID NO: 2509389 - RNA, 15 nt, Human
gucccuggggcuagg

SEQ ID NO: 2509390 - RNA, 17 nt, Human
gucccugguggcagcuc

SEQ ID NO: 2509391 - RNA, 13 nt, Human
guccuacucugug

SEQ ID NO: 2509392 - RNA, 16 nt, Human
gucccugguggcagcu

SEQ ID NO: 2509393 - RNA, 22 nt, Human
gucccuggggcuagggggagcc

SEQ ID NO: 2509394 - RNA, 19 nt, Human
gucccugggggaagcccug

SEQ ID NO: 2509395 - RNA, 20 nt, Human
gucccugggggaagcccugg

SEQ ID NO: 2509396 - RNA, 21 nt, Human
gucccugggggaagcccugga

SEQ ID NO: 2509397 - RNA, 22 nt, Human
gucccugggggaagcccuggau

SEQ ID NO: 2509398 - RNA, 23 nt, Human
gucccugggggaagcccuggauu

SEQ ID NO: 2509399 - RNA, 23 nt, Human
guccuacucugugucaggugggg

SEQ ID NO: 2509400 - RNA, 15 nt, Human
guccuacucuguguc

SEQ ID NO: 2509401 - RNA, 15 nt, Human
gucccugguaauaag

SEQ ID NO: 2509402 - RNA, 23 nt, Human
guccuagaaauuccccacccuga

SEQ ID NO: 2509403 - RNA, 13 nt, Human
guccucacacuca

SEQ ID NO: 2509404 - RNA, 20 nt, Human
guccucaaggggccauccug

SEQ ID NO: 2509405 - RNA, 19 nt, Human
guccucaaggggccauccu

SEQ ID NO: 2509406 - RNA, 22 nt, Human
guccucaccccuguccucacug

SEQ ID NO: 2509407 - RNA, 21 nt, Human
guccucaccccuguccucacu

SEQ ID NO: 2509408 - RNA, 20 nt, Human
guccucaccccuguccucac

SEQ ID NO: 2509409 - RNA, 17 nt, Human
guccucaccccuguccu

SEQ ID NO: 2509410 - RNA, 15 nt, Human
guccucaccccuguc

SEQ ID NO: 2509411 - RNA, 14 nt, Human
guccucaccccugu

SEQ ID NO: 2509412 - RNA, 13 nt, Human
guccucaccacau

SEQ ID NO: 2509413 - RNA, 18 nt, Human
guccucacaucuuucaca

SEQ ID NO: 2509414 - RNA, 18 nt, Human
guccucacggugccuuuu

SEQ ID NO: 2509415 - RNA, 23 nt, Human
guccucaccccuguccucacugc

SEQ ID NO: 2509416 - RNA, 14 nt, Human
guccucacucccag

SEQ ID NO: 2509417 - RNA, 16 nt, Human
guccucacucccaguc

SEQ ID NO: 2509418 - RNA, 17 nt, Human
guccucacucccagucc

SEQ ID NO: 2509419 - RNA, 22 nt, Human
guccuaggccacaccaucuccu

SEQ ID NO: 2509420 - RNA, 23 nt, Human
guccuagcuugggaggcuucccc

SEQ ID NO: 2509421 - RNA, 12 nt, Human
guccuaggagua

SEQ ID NO: 2509422 - RNA, 19 nt, Human
guccuaggaguauccucau

SEQ ID NO: 2509423 - RNA, 18 nt, Human
guccuagccacucaggag

SEQ ID NO: 2509424 - RNA, 20 nt, Human
guccuagcugcacagggcag

SEQ ID NO: 2509425 - RNA, 19 nt, Human
guccuagccacucaggagg

SEQ ID NO: 2509426 - RNA, 12 nt, Human
guccucagccuu

SEQ ID NO: 2509427 - RNA, 14 nt, Human
guccucagccuugc

SEQ ID NO: 2509428 - RNA, 21 nt, Human
guccucacugcucccugaagc

SEQ ID NO: 2509429 - RNA, 20 nt, Human
guccucacugcucccugaag

SEQ ID NO: 2509430 - RNA, 20 nt, Human
guccucagagaauuucuacc

SEQ ID NO: 2509431 - RNA, 19 nt, Human
guccucacugcucccugaa

SEQ ID NO: 2509432 - RNA, 18 nt, Human
guccucacugcucccuga

SEQ ID NO: 2509433 - RNA, 18 nt, Human
guccucacucccagucca

SEQ ID NO: 2509434 - RNA, 16 nt, Human
guccucagccuugcca

SEQ ID NO: 2509435 - RNA, 20 nt, Human
guccucagccuugccagaga

SEQ ID NO: 2509436 - RNA, 21 nt, Human
guccucagccuugccagagau

SEQ ID NO: 2509437 - RNA, 13 nt, Human
guccucagcuucu

SEQ ID NO: 2509438 - RNA, 17 nt, Human
guccucagcuucuuaau

SEQ ID NO: 2509439 - RNA, 15 nt, Human
guccucagguggcca

SEQ ID NO: 2509440 - RNA, 14 nt, Human
guccucagguggcc

SEQ ID NO: 2509441 - RNA, 13 nt, Human
guccuccagaagc

SEQ ID NO: 2509442 - RNA, 14 nt, Human
guccuccagaagcc

SEQ ID NO: 2509443 - RNA, 18 nt, Human
guccuccagaagccucug

SEQ ID NO: 2509444 - RNA, 19 nt, Human
guccuccagaagccucugg

SEQ ID NO: 2509445 - RNA, 20 nt, Human
guccuccagaagccucuggc

SEQ ID NO: 2509446 - RNA, 21 nt, Human
guccuccagaagccucuggcu

SEQ ID NO: 2509447 - RNA, 22 nt, Human
guccuccagaagccucuggcua

SEQ ID NO: 2509448 - RNA, 21 nt, Human
guccuccaacaccaagcacag

SEQ ID NO: 2509449 - RNA, 22 nt, Human
guccuccaacaccaagcacagc

SEQ ID NO: 2509450 - RNA, 14 nt, Human
guccuccacaauaa

SEQ ID NO: 2509451 - RNA, 14 nt, Human
guccuccaagccag

SEQ ID NO: 2509452 - RNA, 23 nt, Human
guccucagguggccaugccucag

SEQ ID NO: 2509453 - RNA, 17 nt, Human
guccucagguggccaug

SEQ ID NO: 2509454 - RNA, 16 nt, Human
guccucagguggccau

SEQ ID NO: 2509455 - RNA, 18 nt, Human
guccuggugcucucugcc

SEQ ID NO: 2509456 - RNA, 17 nt, Human
guccuggugcucucugc

SEQ ID NO: 2509457 - RNA, 19 nt, Human
guccuggugcucucugcca

SEQ ID NO: 2509458 - RNA, 16 nt, Human
guccuggugcucucug

SEQ ID NO: 2509459 - RNA, 15 nt, Human
guccuggugcucucu

SEQ ID NO: 2509460 - RNA, 14 nt, Human
guccuggugcucuc

SEQ ID NO: 2509461 - RNA, 12 nt, Human
guccugggcugg

SEQ ID NO: 2509462 - RNA, 11 nt, Human
guccuggugcu

SEQ ID NO: 2509463 - RNA, 16 nt, Human
guccuggugucacuua

SEQ ID NO: 2509464 - RNA, 15 nt, Human
guccuguacauugug

SEQ ID NO: 2509465 - RNA, 13 nt, Human
guccuggugucac

SEQ ID NO: 2509466 - RNA, 11 nt, Human
guccugguguc

SEQ ID NO: 2509467 - RNA, 23 nt, Human
guccuguaguugcguggacucug

SEQ ID NO: 2509468 - RNA, 21 nt, Human
guccuguaguugcguggacuc

SEQ ID NO: 2509469 - RNA, 13 nt, Human
guccugucagugc

SEQ ID NO: 2509470 - RNA, 19 nt, Human
guccugucagugccgccgc

SEQ ID NO: 2509471 - RNA, 16 nt, Human
guccugucagugccgc

SEQ ID NO: 2509472 - RNA, 15 nt, Human
guccugucagugccg

SEQ ID NO: 2509473 - RNA, 14 nt, Human
guccugucagugcc

SEQ ID NO: 2509474 - RNA, 22 nt, Human
guccugucagugccgccgccuc

SEQ ID NO: 2509475 - RNA, 21 nt, Human
guccugucagugccgccgccu

SEQ ID NO: 2509476 - RNA, 18 nt, Human
guccuguccacacccagc

SEQ ID NO: 2509477 - RNA, 15 nt, Human
guccugugaauuucu

SEQ ID NO: 2509478 - RNA, 19 nt, Human
guccugugaaugccacugc

SEQ ID NO: 2509479 - RNA, 22 nt, Human
guccuguccacacccagcucag

SEQ ID NO: 2509480 - RNA, 19 nt, Human
guccuguccacacccagcu

SEQ ID NO: 2509481 - RNA, 18 nt, Human
guccugugaaugccacug

SEQ ID NO: 2509482 - RNA, 19 nt, Human
guccugggcgcccuggaag

SEQ ID NO: 2509483 - RNA, 17 nt, Human
guccugggcgcccugga

SEQ ID NO: 2509484 - RNA, 16 nt, Human
guccugggcgcccugg

SEQ ID NO: 2509485 - RNA, 14 nt, Human
guccugggcgcccu

SEQ ID NO: 2509486 - RNA, 19 nt, Human
guccuggggaaccugaccc

SEQ ID NO: 2509487 - RNA, 20 nt, Human
guccuggggaaccugacccc

SEQ ID NO: 2509488 - RNA, 23 nt, Human
guccugggcgcccuggaagccgg

SEQ ID NO: 2509489 - RNA, 20 nt, Human
guccugggcgcccuggaagc

SEQ ID NO: 2509490 - RNA, 14 nt, Human
guccuggggccucg

SEQ ID NO: 2509491 - RNA, 22 nt, Human
guccuggggccucggagccuca

SEQ ID NO: 2509492 - RNA, 15 nt, Human
guccuggggcucugu

SEQ ID NO: 2509493 - RNA, 16 nt, Human
guccuggggcucugug

SEQ ID NO: 2509494 - RNA, 17 nt, Human
guccuggggcucugugc

SEQ ID NO: 2509495 - RNA, 18 nt, Human
guccugggagugagcugg

SEQ ID NO: 2509496 - RNA, 17 nt, Human
guccugggagugagcug

SEQ ID NO: 2509497 - RNA, 13 nt, Human
guccugggccugc

SEQ ID NO: 2509498 - RNA, 14 nt, Human
guccugggccugca

SEQ ID NO: 2509499 - RNA, 17 nt, Human
guccugggccugcagaa

SEQ ID NO: 2509500 - RNA, 19 nt, Human
guccugggagugagcuggu

SEQ ID NO: 2509501 - RNA, 19 nt, Human
guccuccccuugggcggcu

SEQ ID NO: 2509502 - RNA, 18 nt, Human
guccuccccuugggcggc

SEQ ID NO: 2509503 - RNA, 15 nt, Human
guccuccccuugggc

SEQ ID NO: 2509504 - RNA, 14 nt, Human
guccuccccuuggg

SEQ ID NO: 2509505 - RNA, 12 nt, Human
guccucccgggc

SEQ ID NO: 2509506 - RNA, 21 nt, Human
guccucccgggcccucccuug

SEQ ID NO: 2509507 - RNA, 17 nt, Human
guccucccgggcccucc

SEQ ID NO: 2509508 - RNA, 16 nt, Human
guccucccgggcccuc

SEQ ID NO: 2509509 - RNA, 15 nt, Human
guccucccgggcccu

SEQ ID NO: 2509510 - RNA, 22 nt, Human
guccucccgggcccucccuugg

SEQ ID NO: 2509511 - RNA, 15 nt, Human
guccuggccauccca

SEQ ID NO: 2509512 - RNA, 16 nt, Human
guccuggccaucccac

SEQ ID NO: 2509513 - RNA, 17 nt, Human
guccuggccuggcuucu

SEQ ID NO: 2509514 - RNA, 14 nt, Human
guccuggccuggcu

SEQ ID NO: 2509515 - RNA, 17 nt, Human
guccuggccaucccaca

SEQ ID NO: 2509516 - RNA, 18 nt, Human
guccuggccaucccacaa

SEQ ID NO: 2509517 - RNA, 17 nt, Human
guccuggcaugggaaug

SEQ ID NO: 2509518 - RNA, 16 nt, Human
guccugggagugagcu

SEQ ID NO: 2509519 - RNA, 15 nt, Human
guccugggagugagc

SEQ ID NO: 2509520 - RNA, 20 nt, Human
guccuggccuggcuucuccu

SEQ ID NO: 2509521 - RNA, 11 nt, Human
guccuggcucc

SEQ ID NO: 2509522 - RNA, 14 nt, Human
guccuggcuccuga

SEQ ID NO: 2509523 - RNA, 17 nt, Human
guccuggcuccugaggg

SEQ ID NO: 2509524 - RNA, 19 nt, Human
guccuggcuccugaggggc

SEQ ID NO: 2509525 - RNA, 19 nt, Human
guccugggagaaccucagg

SEQ ID NO: 2509526 - RNA, 20 nt, Human
guccugggagaaccucaggc

SEQ ID NO: 2509527 - RNA, 21 nt, Human
guccugggagaaccucaggcu

SEQ ID NO: 2509528 - RNA, 23 nt, Human
guccucccaucucacacaugagc

SEQ ID NO: 2509529 - RNA, 21 nt, Human
guccucccauccccuggacug

SEQ ID NO: 2509530 - RNA, 20 nt, Human
guccucccauccccuggacu

SEQ ID NO: 2509531 - RNA, 19 nt, Human
guccucccauccccuggac

SEQ ID NO: 2509532 - RNA, 18 nt, Human
guccucccauccccugga

SEQ ID NO: 2509533 - RNA, 15 nt, Human
guccucccccugcca

SEQ ID NO: 2509534 - RNA, 16 nt, Human
guccucccccugccag

SEQ ID NO: 2509535 - RNA, 17 nt, Human
guccucccccugccagu

SEQ ID NO: 2509536 - RNA, 19 nt, Human
guccucccccugccagugc

SEQ ID NO: 2509537 - RNA, 20 nt, Human
guccuccccucacagccucu

SEQ ID NO: 2509538 - RNA, 19 nt, Human
guccuccccucacagccuc

SEQ ID NO: 2509539 - RNA, 18 nt, Human
guccuccccucacagccu

SEQ ID NO: 2509540 - RNA, 17 nt, Human
guccuccccucacagcc

SEQ ID NO: 2509541 - RNA, 22 nt, Human
guccuccccucacagccucuga

SEQ ID NO: 2509542 - RNA, 21 nt, Human
guccuccccucacagccucug

SEQ ID NO: 2509543 - RNA, 13 nt, Human
guccuccccuugg

SEQ ID NO: 2509544 - RNA, 20 nt, Human
guccucccccugccagugcc

SEQ ID NO: 2509545 - RNA, 21 nt, Human
guccucccccugccagugccu

SEQ ID NO: 2509546 - RNA, 11 nt, Human
guccuccccuc

SEQ ID NO: 2509547 - RNA, 22 nt, Human
guccucccccugccagugccuu

SEQ ID NO: 2509548 - RNA, 16 nt, Human
guccuccccucacagc

SEQ ID NO: 2509549 - RNA, 12 nt, Human
guccuccccuca

SEQ ID NO: 2509550 - RNA, 15 nt, Human
guccuccccucacag

SEQ ID NO: 2509551 - RNA, 14 nt, Human
guccucccaucuca

SEQ ID NO: 2509552 - RNA, 13 nt, Human
guccucccaucuc

SEQ ID NO: 2509553 - RNA, 12 nt, Human
guccucccaucu

SEQ ID NO: 2509554 - RNA, 21 nt, Human
guccucccaauuucagacucc

SEQ ID NO: 2509555 - RNA, 17 nt, Human
guccucccauccccugg

SEQ ID NO: 2509556 - RNA, 16 nt, Human
guccucccauccccug

SEQ ID NO: 2509557 - RNA, 20 nt, Human
gugauccacccaccucagcc

SEQ ID NO: 2509558 - RNA, 18 nt, Human
gugauccacccaccucag

SEQ ID NO: 2509559 - RNA, 13 nt, Human
gugaggccagaga

SEQ ID NO: 2509560 - RNA, 15 nt, Human
gugauccacccaccu

SEQ ID NO: 2509561 - RNA, 16 nt, Human
gugaggaccacuccug

SEQ ID NO: 2509562 - RNA, 20 nt, Human
gugaggaauaguugagcccc

SEQ ID NO: 2509563 - RNA, 18 nt, Human
gugaggaaggcaggaaga

SEQ ID NO: 2509564 - RNA, 14 nt, Human
gugaggagcugcug

SEQ ID NO: 2509565 - RNA, 23 nt, Human
gugaggauuaaauaauguaaaua

SEQ ID NO: 2509566 - RNA, 23 nt, Human
gugaggcaaugggagcugaggcc

SEQ ID NO: 2509567 - RNA, 11 nt, Human
gugaggagcug

SEQ ID NO: 2509568 - RNA, 11 nt, Human
gugaggccaga

SEQ ID NO: 2509569 - RNA, 23 nt, Human
gugaggcagugggucccacuucc

SEQ ID NO: 2509570 - RNA, 15 nt, Human
gugaggcaggcuuug

SEQ ID NO: 2509571 - RNA, 12 nt, Human
gugaggcagggg

SEQ ID NO: 2509572 - RNA, 17 nt, Human
gugaggcaggggcggag

SEQ ID NO: 2509573 - RNA, 13 nt, Human
gugaggcaguggg

SEQ ID NO: 2509574 - RNA, 18 nt, Human
gugauccucccaccucag

SEQ ID NO: 2509575 - RNA, 15 nt, Human
gugauccucccaccu

SEQ ID NO: 2509576 - RNA, 14 nt, Human
gugauccacucgcc

SEQ ID NO: 2509577 - RNA, 14 nt, Human
gugauccucccacc

SEQ ID NO: 2509578 - RNA, 22 nt, Human
gugauccucccaccucagccuc

SEQ ID NO: 2509579 - RNA, 20 nt, Human
gugauccucccaccucagcc

SEQ ID NO: 2509580 - RNA, 23 nt, Human
gugauuccacuacaccuggcuga

SEQ ID NO: 2509581 - RNA, 22 nt, Human
gugauuccacuacaccuggcug

SEQ ID NO: 2509582 - RNA, 20 nt, Human
gugauucacagugugaaucu

SEQ ID NO: 2509583 - RNA, 21 nt, Human
gugaucccuagcugugaccuc

SEQ ID NO: 2509584 - RNA, 22 nt, Human
gugaucccuagcugugaccucu

SEQ ID NO: 2509585 - RNA, 23 nt, Human
gugauccucccaccucagccucc

SEQ ID NO: 2509586 - RNA, 22 nt, Human
gugauucuccugccucagccuc

SEQ ID NO: 2509587 - RNA, 20 nt, Human
gugauucuccugccucagcc

SEQ ID NO: 2509588 - RNA, 19 nt, Human
gugauucuccugccucagc

SEQ ID NO: 2509589 - RNA, 18 nt, Human
gugauucuccugccucag

SEQ ID NO: 2509590 - RNA, 17 nt, Human
gugauucuccugccuca

SEQ ID NO: 2509591 - RNA, 16 nt, Human
gugauucuccugccuc

SEQ ID NO: 2509592 - RNA, 20 nt, Human
gugauucucaugccucagcc

SEQ ID NO: 2509593 - RNA, 19 nt, Human
gugauuccuuugaagagga

SEQ ID NO: 2509594 - RNA, 16 nt, Human
gugauucuaaugucuu

SEQ ID NO: 2509595 - RNA, 14 nt, Human
gugauucuccugcc

SEQ ID NO: 2509596 - RNA, 18 nt, Human
gugauuuaauaguguuaa

SEQ ID NO: 2509597 - RNA, 16 nt, Human
gugauuuaauaguguu

SEQ ID NO: 2509598 - RNA, 20 nt, Human
gugauuuaauaguguuaauc

SEQ ID NO: 2509599 - RNA, 12 nt, Human
gugauuuucauu

SEQ ID NO: 2509600 - RNA, 15 nt, Human
gugauuuaauagugu

SEQ ID NO: 2509601 - RNA, 19 nt, Human
gugauuuaagacacuuuuu

SEQ ID NO: 2509602 - RNA, 16 nt, Human
gugauuuugcuguaga

SEQ ID NO: 2509603 - RNA, 17 nt, Human
gugauugggaauaaaua

SEQ ID NO: 2509604 - RNA, 21 nt, Human
gugauugacagcuuugcugcu

SEQ ID NO: 2509605 - RNA, 22 nt, Human
gugauugacagcuuugcugcug

SEQ ID NO: 2509606 - RNA, 23 nt, Human
gugauugacagcuuugcugcuga

SEQ ID NO: 2509607 - RNA, 16 nt, Human
gugauugggacagagg

SEQ ID NO: 2509608 - RNA, 20 nt, Human
gugauugggaauaaauaugc

SEQ ID NO: 2509609 - RNA, 14 nt, Human
gugauuguggaaug

SEQ ID NO: 2509610 - RNA, 19 nt, Human
gugauuguggaauggagau

SEQ ID NO: 2509611 - RNA, 23 nt, Human
gugauuguggaauggagauucag

SEQ ID NO: 2509612 - RNA, 23 nt, Human
gugauucuccugccucagccucc

SEQ ID NO: 2509613 - RNA, 13 nt, Human
gugauucugccuu

SEQ ID NO: 2509614 - RNA, 21 nt, Human
gugauuccuuugaagaggaaa

SEQ ID NO: 2509615 - RNA, 17 nt, Human
gugauugacagcuuugc

SEQ ID NO: 2509616 - RNA, 13 nt, Human
gugauucuccugc

SEQ ID NO: 2509617 - RNA, 23 nt, Human
gugcccaaguuguggugcugaca

SEQ ID NO: 2509618 - RNA, 20 nt, Human
gugcccaagcucagaaggcu

SEQ ID NO: 2509619 - RNA, 16 nt, Human
gugcccaagcucagaa

SEQ ID NO: 2509620 - RNA, 23 nt, Human
gugccauagaguuuaacacaagu

SEQ ID NO: 2509621 - RNA, 20 nt, Human
gugcccaagccagaggcugg

SEQ ID NO: 2509622 - RNA, 19 nt, Human
gugcccaagccagaggcug

SEQ ID NO: 2509623 - RNA, 12 nt, Human
gugcccaagcca

SEQ ID NO: 2509624 - RNA, 17 nt, Human
gugccauagucacaugg

SEQ ID NO: 2509625 - RNA, 23 nt, Human
gugcccaagaauagaugcugacu

SEQ ID NO: 2509626 - RNA, 15 nt, Human
gugccagucgcgcug

SEQ ID NO: 2509627 - RNA, 21 nt, Human
gugcaugcucucugcagccag

SEQ ID NO: 2509628 - RNA, 15 nt, Human
gugcaugcucucugc

SEQ ID NO: 2509629 - RNA, 16 nt, Human
gugcaugcucucugca

SEQ ID NO: 2509630 - RNA, 18 nt, Human
gugcaugcucucugcagc

SEQ ID NO: 2509631 - RNA, 19 nt, Human
gugcaugcucucugcagcc

SEQ ID NO: 2509632 - RNA, 19 nt, Human
gugccagucgcgcugccug

SEQ ID NO: 2509633 - RNA, 18 nt, Human
gugccagucgcgcugccu

SEQ ID NO: 2509634 - RNA, 17 nt, Human
gugccagucgcgcugcc

SEQ ID NO: 2509635 - RNA, 16 nt, Human
gugccagucgcgcugc

SEQ ID NO: 2509636 - RNA, 22 nt, Human
gugccagucgcgcugccugugu

SEQ ID NO: 2509637 - RNA, 21 nt, Human
gugccagucgcgcugccugug

SEQ ID NO: 2509638 - RNA, 18 nt, Human
gugccagucuugugucug

SEQ ID NO: 2509639 - RNA, 20 nt, Human
gugcccacaggaucagucug

SEQ ID NO: 2509640 - RNA, 15 nt, Human
gugcccacaucccag

SEQ ID NO: 2509641 - RNA, 21 nt, Human
gugcccacaggccgcccugcg

SEQ ID NO: 2509642 - RNA, 13 nt, Human
gugcccacaggcc

SEQ ID NO: 2509643 - RNA, 23 nt, Human
gugcccagcuagcugcagagcca

SEQ ID NO: 2509644 - RNA, 18 nt, Human
gugcccagcccggaccuu

SEQ ID NO: 2509645 - RNA, 20 nt, Human
gugcccagcuauaccugugc

SEQ ID NO: 2509646 - RNA, 21 nt, Human
gugcccagcuauaccugugcc

SEQ ID NO: 2509647 - RNA, 22 nt, Human
gugcccagcuauaccugugccu

SEQ ID NO: 2509648 - RNA, 16 nt, Human
gugcccagaauaaguu

SEQ ID NO: 2509649 - RNA, 20 nt, Human
gugcccacaucccaggcuuc

SEQ ID NO: 2509650 - RNA, 20 nt, Human
gugcccagagaugggacugg

SEQ ID NO: 2509651 - RNA, 23 nt, Human
gugcccaccaacaucccauugcc

SEQ ID NO: 2509652 - RNA, 22 nt, Human
gugcccagaacuggacucagga

SEQ ID NO: 2509653 - RNA, 23 nt, Human
gugcccagcuauaccugugccuc

SEQ ID NO: 2509654 - RNA, 19 nt, Human
gugcccaggggcccacagg

SEQ ID NO: 2509655 - RNA, 16 nt, Human
gugcccauuccucacc

SEQ ID NO: 2509656 - RNA, 21 nt, Human
gugcccaugggcacugcuggg

SEQ ID NO: 2509657 - RNA, 20 nt, Human
gugcccaugggcacugcugg

SEQ ID NO: 2509658 - RNA, 19 nt, Human
gugcccaugggcacugcug

SEQ ID NO: 2509659 - RNA, 16 nt, Human
gugcccaugggcacug

SEQ ID NO: 2509660 - RNA, 14 nt, Human
gugcccaugggcac

SEQ ID NO: 2509661 - RNA, 17 nt, Human
gugcccaucccuggaag

SEQ ID NO: 2509662 - RNA, 19 nt, Human
gugccccaggaccagcuca

SEQ ID NO: 2509663 - RNA, 21 nt, Human
gugccccaggaccagcucagg

SEQ ID NO: 2509664 - RNA, 16 nt, Human
gugccccaugccuguc

SEQ ID NO: 2509665 - RNA, 18 nt, Human
gugccccaugccugucca

SEQ ID NO: 2509666 - RNA, 14 nt, Human
gugccccaggacca

SEQ ID NO: 2509667 - RNA, 15 nt, Human
gugccccaggaccag

SEQ ID NO: 2509668 - RNA, 12 nt, Human
gugccccaggac

SEQ ID NO: 2509669 - RNA, 17 nt, Human
gugcccauuccucaccu

SEQ ID NO: 2509670 - RNA, 15 nt, Human
gugcccucgcugcuu

SEQ ID NO: 2509671 - RNA, 20 nt, Human
gugccccccauccuggccca

SEQ ID NO: 2509672 - RNA, 19 nt, Human
gugccccccauccuggccc

SEQ ID NO: 2509673 - RNA, 15 nt, Human
gugcccccacugacc

SEQ ID NO: 2509674 - RNA, 18 nt, Human
gugcccccacugaccaga

SEQ ID NO: 2509675 - RNA, 13 nt, Human
gugcccccacuga

SEQ ID NO: 2509676 - RNA, 21 nt, Human
gugccccaugccuguccagcc

SEQ ID NO: 2509677 - RNA, 17 nt, Human
gugccccccauccuggc

SEQ ID NO: 2509678 - RNA, 19 nt, Human
gugcccccacugaccagaa

SEQ ID NO: 2509679 - RNA, 12 nt, Human
gugcccccagac

SEQ ID NO: 2509680 - RNA, 13 nt, Human
gugcauaccacuu

SEQ ID NO: 2509681 - RNA, 14 nt, Human
gugcauaccacuuu

SEQ ID NO: 2509682 - RNA, 21 nt, Human
gugcauaccacuuuuguucuu

SEQ ID NO: 2509683 - RNA, 14 nt, Human
gugcagucugggug

SEQ ID NO: 2509684 - RNA, 12 nt, Human
gugcagucuggg

SEQ ID NO: 2509685 - RNA, 15 nt, Human
gugcaucucagccca

SEQ ID NO: 2509686 - RNA, 22 nt, Human
gugccagguuuuuggucugacc

SEQ ID NO: 2509687 - RNA, 20 nt, Human
gugccagguuuuuggucuga

SEQ ID NO: 2509688 - RNA, 18 nt, Human
gugcaugcagcaucuaag

SEQ ID NO: 2509689 - RNA, 18 nt, Human
gugcaugaucuugagcaa

SEQ ID NO: 2509690 - RNA, 13 nt, Human
gugcaugcucucu

SEQ ID NO: 2509691 - RNA, 18 nt, Human
gugcaucucagcccacau

SEQ ID NO: 2509692 - RNA, 14 nt, Human
gugcaucucagccc

SEQ ID NO: 2509693 - RNA, 22 nt, Human
gugcaugaagguuucugaaaau

SEQ ID NO: 2509694 - RNA, 18 nt, Human
gugcaaauugucacagga

SEQ ID NO: 2509695 - RNA, 22 nt, Human
gugcaaaguucccuacuuccug

SEQ ID NO: 2509696 - RNA, 23 nt, Human
gugcaaaugucagauacaaugua

SEQ ID NO: 2509697 - RNA, 19 nt, Human
gugcaaaugucagauacaa

SEQ ID NO: 2509698 - RNA, 19 nt, Human
gugauuuaauaguguuaau

SEQ ID NO: 2509699 - RNA, 22 nt, Human
gugcaacaagguccucugucag

SEQ ID NO: 2509700 - RNA, 15 nt, Human
gugcaacagcacugg

SEQ ID NO: 2509701 - RNA, 12 nt, Human
gugcaacagcac

SEQ ID NO: 2509702 - RNA, 23 nt, Human
gugcaacagcacuggcucucucc

SEQ ID NO: 2509703 - RNA, 20 nt, Human
gugcaacagcacuggcucuc

SEQ ID NO: 2509704 - RNA, 14 nt, Human
gugcaacaggguau

SEQ ID NO: 2509705 - RNA, 23 nt, Human
gugcagggaggagguggcagccc

SEQ ID NO: 2509706 - RNA, 19 nt, Human
gugcauaaguuaacuucca

SEQ ID NO: 2509707 - RNA, 22 nt, Human
gugcaguccugggauguggcug

SEQ ID NO: 2509708 - RNA, 12 nt, Human
gugcaguccugg

SEQ ID NO: 2509709 - RNA, 16 nt, Human
gugcaguccugaucag

SEQ ID NO: 2509710 - RNA, 19 nt, Human
gugcaguggcccccacaga

SEQ ID NO: 2509711 - RNA, 14 nt, Human
gugcagucacugga

SEQ ID NO: 2509712 - RNA, 22 nt, Human
gugcaguaucaugcccugugca

SEQ ID NO: 2509713 - RNA, 15 nt, Human
gugcagguggggaga

SEQ ID NO: 2509714 - RNA, 14 nt, Human
gugaauuuuucucu

SEQ ID NO: 2509715 - RNA, 15 nt, Human
gugaauuuuucucua

SEQ ID NO: 2509716 - RNA, 15 nt, Human
gugaaugggaaaaga

SEQ ID NO: 2509717 - RNA, 15 nt, Human
gugaaucagacccua

SEQ ID NO: 2509718 - RNA, 14 nt, Human
gugaaucagagcac

SEQ ID NO: 2509719 - RNA, 18 nt, Human
gugaaucacguaaagcua

SEQ ID NO: 2509720 - RNA, 16 nt, Human
gugaauauuguucaua

SEQ ID NO: 2509721 - RNA, 22 nt, Human
gugaauauuuccauauggauuu

SEQ ID NO: 2509722 - RNA, 16 nt, Human
gugaaucacguaaagc

SEQ ID NO: 2509723 - RNA, 13 nt, Human
gugaaaucauuca

SEQ ID NO: 2509724 - RNA, 17 nt, Human
gugaaauaccagugugg

SEQ ID NO: 2509725 - RNA, 17 nt, Human
gugaaauaguucaaagc

SEQ ID NO: 2509726 - RNA, 21 nt, Human
gugaaauaguucaaagccaag

SEQ ID NO: 2509727 - RNA, 19 nt, Human
gugaaaggaaagagggagg

SEQ ID NO: 2509728 - RNA, 17 nt, Human
gugaaaguacauuugga

SEQ ID NO: 2509729 - RNA, 21 nt, Human
gugaaagggagcuaucaggaa

SEQ ID NO: 2509730 - RNA, 21 nt, Human
gugaaagucagaugcccagag

SEQ ID NO: 2509731 - RNA, 20 nt, Human
gugaaauuauucauaauuau

SEQ ID NO: 2509732 - RNA, 18 nt, Human
gugaaauuauucauaauu

SEQ ID NO: 2509733 - RNA, 21 nt, Human
gugaaauuuauuaguuaauau

SEQ ID NO: 2509734 - RNA, 17 nt, Human
gugaaaucaaaggugcu

SEQ ID NO: 2509735 - RNA, 17 nt, Human
gugaaaccuuuuuuaag

SEQ ID NO: 2509736 - RNA, 14 nt, Human
gugaaaccuuuuuu

SEQ ID NO: 2509737 - RNA, 13 nt, Human
gugaaaccuuuuu

SEQ ID NO: 2509738 - RNA, 23 nt, Human
gugaaaccuuuagggcagcuugc

SEQ ID NO: 2509739 - RNA, 22 nt, Human
gugaaaccuuuagggcagcuug

SEQ ID NO: 2509740 - RNA, 20 nt, Human
gugaaaccuuuagggcagcu

SEQ ID NO: 2509741 - RNA, 19 nt, Human
gugaaaccuuuagggcagc

SEQ ID NO: 2509742 - RNA, 18 nt, Human
gugaaaccuuuagggcag

SEQ ID NO: 2509743 - RNA, 20 nt, Human
gugaaacucguuaauuugua

SEQ ID NO: 2509744 - RNA, 22 nt, Human
gugaaaccuuuuuuaagauuuu

SEQ ID NO: 2509745 - RNA, 21 nt, Human
gugaaaccuuuuuuaagauuu

SEQ ID NO: 2509746 - RNA, 19 nt, Human
gugaaaccuuuuuuaagau

SEQ ID NO: 2509747 - RNA, 18 nt, Human
gugaaaccuuuuuuaaga

SEQ ID NO: 2509748 - RNA, 20 nt, Human
gugaaacugcuuguuuccua

SEQ ID NO: 2509749 - RNA, 21 nt, Human
gugaaacugcuuguuuccuag

SEQ ID NO: 2509750 - RNA, 12 nt, Human
gugaaacuggau

SEQ ID NO: 2509751 - RNA, 19 nt, Human
gugaaagaaaauaacaaua

SEQ ID NO: 2509752 - RNA, 23 nt, Human
gugaaacugcuuguuuccuagca

SEQ ID NO: 2509753 - RNA, 16 nt, Human
gugaaacuuccuaagu

SEQ ID NO: 2509754 - RNA, 19 nt, Human
gugaaacuaacagauaagc

SEQ ID NO: 2509755 - RNA, 20 nt, Human
gugaaagcaucacuugggau

SEQ ID NO: 2509756 - RNA, 14 nt, Human
gugaaaagaaaaau

SEQ ID NO: 2509757 - RNA, 23 nt, Human
gugaaaagaaaaaugagccuggc

SEQ ID NO: 2509758 - RNA, 15 nt, Human
gugaaaacggagcug

SEQ ID NO: 2509759 - RNA, 14 nt, Human
gucugccagccagc

SEQ ID NO: 2509760 - RNA, 15 nt, Human
gucugccagccagca

SEQ ID NO: 2509761 - RNA, 21 nt, Human
gugaaaauagguauacagugg

SEQ ID NO: 2509762 - RNA, 19 nt, Human
gugaaaaguccuugauugu

SEQ ID NO: 2509763 - RNA, 20 nt, Human
gugaaaagagaggauauguu

SEQ ID NO: 2509764 - RNA, 15 nt, Human
gugaaaaugguccag

SEQ ID NO: 2509765 - RNA, 17 nt, Human
gugaaaaugguccagga

SEQ ID NO: 2509766 - RNA, 16 nt, Human
gugaaaaugugugugu

SEQ ID NO: 2509767 - RNA, 14 nt, Human
gugaaaauguacug

SEQ ID NO: 2509768 - RNA, 19 nt, Human
gugaaaauagguauacagu

SEQ ID NO: 2509769 - RNA, 16 nt, Human
gugaaacacaccaggc

SEQ ID NO: 2509770 - RNA, 17 nt, Human
gugaaacacaccaggcu

SEQ ID NO: 2509771 - RNA, 18 nt, Human
gugaaacacaccaggcug

SEQ ID NO: 2509772 - RNA, 20 nt, Human
gugaaacacaccaggcugug

SEQ ID NO: 2509773 - RNA, 23 nt, Human
gugaaacacaccaggcugugggc

SEQ ID NO: 2509774 - RNA, 16 nt, Human
gugaaacccugucucu

SEQ ID NO: 2509775 - RNA, 21 nt, Human
gugaaacacaccaggcugugg

SEQ ID NO: 2509776 - RNA, 12 nt, Human
gugaaacccugu

SEQ ID NO: 2509777 - RNA, 19 nt, Human
gugaccggacuuuucugca

SEQ ID NO: 2509778 - RNA, 15 nt, Human
gugaccggacuuuuc

SEQ ID NO: 2509779 - RNA, 21 nt, Human
gugacccucugaaugguccag

SEQ ID NO: 2509780 - RNA, 13 nt, Human
gugacccucugaa

SEQ ID NO: 2509781 - RNA, 16 nt, Human
gugaccucagcuuuga

SEQ ID NO: 2509782 - RNA, 21 nt, Human
gugaccggacuuuucugcaaa

SEQ ID NO: 2509783 - RNA, 12 nt, Human
gugaccucaggc

SEQ ID NO: 2509784 - RNA, 19 nt, Human
gugaccugaaguucaccau

SEQ ID NO: 2509785 - RNA, 14 nt, Human
gugaccugaaguuc

SEQ ID NO: 2509786 - RNA, 14 nt, Human
gugaccugaggaag

SEQ ID NO: 2509787 - RNA, 16 nt, Human
gugaccugaggaagcg

SEQ ID NO: 2509788 - RNA, 13 nt, Human
gugaccugagggc

SEQ ID NO: 2509789 - RNA, 23 nt, Human
gugaccugaggauuuaagggaug

SEQ ID NO: 2509790 - RNA, 19 nt, Human
gugaccucaggcacuagcc

SEQ ID NO: 2509791 - RNA, 18 nt, Human
gugaccuccacagcuacc

SEQ ID NO: 2509792 - RNA, 18 nt, Human
gugacccggaggccacau

SEQ ID NO: 2509793 - RNA, 15 nt, Human
gugacccggaggcca

SEQ ID NO: 2509794 - RNA, 17 nt, Human
gugaauuuuuuuuuccu

SEQ ID NO: 2509795 - RNA, 16 nt, Human
gugacaagcucacaga

SEQ ID NO: 2509796 - RNA, 16 nt, Human
gugacaacacuugugu

SEQ ID NO: 2509797 - RNA, 16 nt, Human
gugaauuuuucucuaa

SEQ ID NO: 2509798 - RNA, 16 nt, Human
gugacugaauuucuuu

SEQ ID NO: 2509799 - RNA, 18 nt, Human
gugacugaauuucuuuug

SEQ ID NO: 2509800 - RNA, 21 nt, Human
gugacucgggcuccugugccc

SEQ ID NO: 2509801 - RNA, 20 nt, Human
gugacucgggcuccugugcc

SEQ ID NO: 2509802 - RNA, 14 nt, Human
gugacucugaagcu

SEQ ID NO: 2509803 - RNA, 15 nt, Human
gugacugaauuucuu

SEQ ID NO: 2509804 - RNA, 19 nt, Human
gugaccuuccaagagccug

SEQ ID NO: 2509805 - RNA, 23 nt, Human
gugaccuuaguguuucugugcau

SEQ ID NO: 2509806 - RNA, 22 nt, Human
gugaccuuaguguuucugugca

SEQ ID NO: 2509807 - RNA, 20 nt, Human
gugaccuuccaagagccuga

SEQ ID NO: 2509808 - RNA, 19 nt, Human
gugacuccaggagaggagc

SEQ ID NO: 2509809 - RNA, 14 nt, Human
gugacuccaggaga

SEQ ID NO: 2509810 - RNA, 12 nt, Human
gugacuccagga

SEQ ID NO: 2509811 - RNA, 18 nt, Human
gugacucauccucuugaa

SEQ ID NO: 2509812 - RNA, 19 nt, Human
gugacucgggcuccugugc

SEQ ID NO: 2509813 - RNA, 18 nt, Human
gugacucgggcuccugug

SEQ ID NO: 2509814 - RNA, 17 nt, Human
gugacucgggcuccugu

SEQ ID NO: 2509815 - RNA, 23 nt, Human
gugaccugccccgcccagcugca

SEQ ID NO: 2509816 - RNA, 20 nt, Human
gugaccuuaguguuucugug

SEQ ID NO: 2509817 - RNA, 15 nt, Human
gugaccuuaguguuu

SEQ ID NO: 2509818 - RNA, 23 nt, Human
gugaccuguggggauuucuccca

SEQ ID NO: 2509819 - RNA, 16 nt, Human
gugagccaccacgccc

SEQ ID NO: 2509820 - RNA, 15 nt, Human
gugagccaccgugcc

SEQ ID NO: 2509821 - RNA, 15 nt, Human
gugagccaccacgcc

SEQ ID NO: 2509822 - RNA, 15 nt, Human
gugacuguauauaaa

SEQ ID NO: 2509823 - RNA, 17 nt, Human
gugagccaccgugccug

SEQ ID NO: 2509824 - RNA, 21 nt, Human
gugagccaccgugccuggcca

SEQ ID NO: 2509825 - RNA, 13 nt, Human
gugagccacugca

SEQ ID NO: 2509826 - RNA, 16 nt, Human
gugagcagucaggaaa

SEQ ID NO: 2509827 - RNA, 17 nt, Human
gugagcaggcugugagu

SEQ ID NO: 2509828 - RNA, 20 nt, Human
gugacugccccaacuccugg

SEQ ID NO: 2509829 - RNA, 21 nt, Human
gugacugccccaacuccugga

SEQ ID NO: 2509830 - RNA, 17 nt, Human
gugacugcgaucuucag

SEQ ID NO: 2509831 - RNA, 23 nt, Human
gugacugccccaacuccuggaag

SEQ ID NO: 2509832 - RNA, 17 nt, Human
gugacugaucucucgug

SEQ ID NO: 2509833 - RNA, 22 nt, Human
gugacucuuuuuagggccaggc

SEQ ID NO: 2509834 - RNA, 20 nt, Human
gugacucuuuuuagggccag

SEQ ID NO: 2509835 - RNA, 18 nt, Human
gugacucuuuuuagggcc

SEQ ID NO: 2509836 - RNA, 16 nt, Human
gugacucuuuuuaggg

SEQ ID NO: 2509837 - RNA, 21 nt, Human
gugacugauguuacaucacag

SEQ ID NO: 2509838 - RNA, 16 nt, Human
gugacugccccaacuc

SEQ ID NO: 2509839 - RNA, 19 nt, Human
gugaggaagccgcuggggc

SEQ ID NO: 2509840 - RNA, 16 nt, Human
gugaggaagccgcugg

SEQ ID NO: 2509841 - RNA, 11 nt, Human
gugaggaagcc

SEQ ID NO: 2509842 - RNA, 15 nt, Human
gugaggaaagucauu

SEQ ID NO: 2509843 - RNA, 15 nt, Human
gugagcuuugcugcu

SEQ ID NO: 2509844 - RNA, 16 nt, Human
gugagcuuugcugcua

SEQ ID NO: 2509845 - RNA, 14 nt, Human
gugagcuacaaaug

SEQ ID NO: 2509846 - RNA, 22 nt, Human
gugagccaccgugccuggccac

SEQ ID NO: 2509847 - RNA, 16 nt, Human
gugagcuccuaagcca

SEQ ID NO: 2509848 - RNA, 22 nt, Human
gugagcauuguggcugucagca

SEQ ID NO: 2509849 - RNA, 19 nt, Human
guggcagcugcuuuugucu

SEQ ID NO: 2509850 - RNA, 13 nt, Human
guggcagcugcuu

SEQ ID NO: 2509851 - RNA, 12 nt, Human
guggcagcugcu

SEQ ID NO: 2509852 - RNA, 23 nt, Human
guggcagcugcgguccacccagg

SEQ ID NO: 2509853 - RNA, 22 nt, Human
guggcagcugcgguccacccag

SEQ ID NO: 2509854 - RNA, 21 nt, Human
guggcagcugcgguccaccca

SEQ ID NO: 2509855 - RNA, 20 nt, Human
guggaugccugguggcagcu

SEQ ID NO: 2509856 - RNA, 19 nt, Human
guggcagcugcgguccacc

SEQ ID NO: 2509857 - RNA, 17 nt, Human
guggcaggaccaggacu

SEQ ID NO: 2509858 - RNA, 15 nt, Human
guggcaggaccagga

SEQ ID NO: 2509859 - RNA, 13 nt, Human
guggcaggaccag

SEQ ID NO: 2509860 - RNA, 19 nt, Human
guggcaggcagcgccaagc

SEQ ID NO: 2509861 - RNA, 12 nt, Human
guggcaggcagc

SEQ ID NO: 2509862 - RNA, 17 nt, Human
guggcagggcucaggau

SEQ ID NO: 2509863 - RNA, 16 nt, Human
guggcagggcucagga

SEQ ID NO: 2509864 - RNA, 13 nt, Human
guggcagggcuca

SEQ ID NO: 2509865 - RNA, 12 nt, Human
guggcagggcuc

SEQ ID NO: 2509866 - RNA, 23 nt, Human
guggcagggccuagcugcuacaa

SEQ ID NO: 2509867 - RNA, 22 nt, Human
guggcagggccuagcugcuaca

SEQ ID NO: 2509868 - RNA, 18 nt, Human
guggcagggccuagcugc

SEQ ID NO: 2509869 - RNA, 18 nt, Human
guggcaggggacaggagu

SEQ ID NO: 2509870 - RNA, 16 nt, Human
guggcaggggacagga

SEQ ID NO: 2509871 - RNA, 20 nt, Human
guggcaggggacaggagucc

SEQ ID NO: 2509872 - RNA, 23 nt, Human
guggcagguggaggugucaggcu

SEQ ID NO: 2509873 - RNA, 21 nt, Human
guggcaggugaccuucuggga

SEQ ID NO: 2509874 - RNA, 17 nt, Human
guggcagugggagcugc

SEQ ID NO: 2509875 - RNA, 16 nt, Human
guggcagugggagcug

SEQ ID NO: 2509876 - RNA, 11 nt, Human
guggcagucug

SEQ ID NO: 2509877 - RNA, 15 nt, Human
guggcagugggagcu

SEQ ID NO: 2509878 - RNA, 13 nt, Human
guggcucuccagu

SEQ ID NO: 2509879 - RNA, 21 nt, Human
guggcucuacaacugaguccu

SEQ ID NO: 2509880 - RNA, 20 nt, Human
guggccccacccugggcccu

SEQ ID NO: 2509881 - RNA, 19 nt, Human
guggccccacccugggccc

SEQ ID NO: 2509882 - RNA, 18 nt, Human
guggccccacccugggcc

SEQ ID NO: 2509883 - RNA, 23 nt, Human
guggccauuuagccaccaucuuu

SEQ ID NO: 2509884 - RNA, 20 nt, Human
guggcccauccccccucacc

SEQ ID NO: 2509885 - RNA, 17 nt, Human
guggcccauccccccuc

SEQ ID NO: 2509886 - RNA, 13 nt, Human
guggcccaggacc

SEQ ID NO: 2509887 - RNA, 15 nt, Human
guggccccacccugg

SEQ ID NO: 2509888 - RNA, 21 nt, Human
guggcccauccccccucacca

SEQ ID NO: 2509889 - RNA, 15 nt, Human
guggccagccuggau

SEQ ID NO: 2509890 - RNA, 14 nt, Human
guggccagccugga

SEQ ID NO: 2509891 - RNA, 16 nt, Human
guggccagcccggcug

SEQ ID NO: 2509892 - RNA, 15 nt, Human
guggccagcccggcu

SEQ ID NO: 2509893 - RNA, 14 nt, Human
guggccagcccggc

SEQ ID NO: 2509894 - RNA, 13 nt, Human
guggccagcccgg

SEQ ID NO: 2509895 - RNA, 11 nt, Human
guggccagccc

SEQ ID NO: 2509896 - RNA, 13 nt, Human
guggccaggguga

SEQ ID NO: 2509897 - RNA, 14 nt, Human
guggccacucagcu

SEQ ID NO: 2509898 - RNA, 13 nt, Human
guggccacucagc

SEQ ID NO: 2509899 - RNA, 17 nt, Human
guggccaaggagcugcu

SEQ ID NO: 2509900 - RNA, 18 nt, Human
guggccaaggagcugcua

SEQ ID NO: 2509901 - RNA, 19 nt, Human
guggccaaggagcugcuau

SEQ ID NO: 2509902 - RNA, 21 nt, Human
guggccacuccagaccccugg

SEQ ID NO: 2509903 - RNA, 17 nt, Human
guggccagagcugggag

SEQ ID NO: 2509904 - RNA, 23 nt, Human
guggccagagcugggaggcaugg

SEQ ID NO: 2509905 - RNA, 21 nt, Human
guggcagugggagcugccugu

SEQ ID NO: 2509906 - RNA, 19 nt, Human
guggcagugggagcugccu

SEQ ID NO: 2509907 - RNA, 15 nt, Human
guggcaguuuggcaa

SEQ ID NO: 2509908 - RNA, 15 nt, Human
guggcauagcccaga

SEQ ID NO: 2509909 - RNA, 21 nt, Human
guggcagugguuuuggcaaac

SEQ ID NO: 2509910 - RNA, 17 nt, Human
guggcauagcccagaca

SEQ ID NO: 2509911 - RNA, 14 nt, Human
guggcaucaccuua

SEQ ID NO: 2509912 - RNA, 20 nt, Human
guggcaucaccuuaggcagg

SEQ ID NO: 2509913 - RNA, 22 nt, Human
guggcaucaccuuaggcaggga

SEQ ID NO: 2509914 - RNA, 18 nt, Human
guggcaucuuugccuugg

SEQ ID NO: 2509915 - RNA, 20 nt, Human
guggcaucuuugccuugggc

SEQ ID NO: 2509916 - RNA, 21 nt, Human
guggcaucuuugccuugggcu

SEQ ID NO: 2509917 - RNA, 13 nt, Human
guggcauggccac

SEQ ID NO: 2509918 - RNA, 16 nt, Human
guggcaucccaguggc

SEQ ID NO: 2509919 - RNA, 15 nt, Human
guggcauguggccug

SEQ ID NO: 2509920 - RNA, 14 nt, Human
guggcauguggccu

SEQ ID NO: 2509921 - RNA, 18 nt, Human
guggcauguggccugugg

SEQ ID NO: 2509922 - RNA, 17 nt, Human
guggcauguggccugug

SEQ ID NO: 2509923 - RNA, 22 nt, Human
guggcauguucaucguauaaca

SEQ ID NO: 2509924 - RNA, 22 nt, Human
guggcauuggcagcaggugcug

SEQ ID NO: 2509925 - RNA, 18 nt, Human
guggcauuggcagcaggu

SEQ ID NO: 2509926 - RNA, 16 nt, Human
guggcauuggcagcag

SEQ ID NO: 2509927 - RNA, 19 nt, Human
guggcauguggccuguggc

SEQ ID NO: 2509928 - RNA, 19 nt, Human
guggccaaauuauuugugu

SEQ ID NO: 2509929 - RNA, 16 nt, Human
guggccaaggagcugc

SEQ ID NO: 2509930 - RNA, 15 nt, Human
guggccaaggagcug

SEQ ID NO: 2509931 - RNA, 14 nt, Human
guggccaaguucuu

SEQ ID NO: 2509932 - RNA, 23 nt, Human
guggagcccgcacccccacccuu

SEQ ID NO: 2509933 - RNA, 18 nt, Human
guggagccccacacuggg

SEQ ID NO: 2509934 - RNA, 14 nt, Human
guggagccccacac

SEQ ID NO: 2509935 - RNA, 17 nt, Human
guggagcaugggccugg

SEQ ID NO: 2509936 - RNA, 19 nt, Human
guggagcaaagugagggcc

SEQ ID NO: 2509937 - RNA, 22 nt, Human
guggagagggaugaggugcugg

SEQ ID NO: 2509938 - RNA, 14 nt, Human
guggagagcccggc

SEQ ID NO: 2509939 - RNA, 17 nt, Human
guggagagcuggugccc

SEQ ID NO: 2509940 - RNA, 18 nt, Human
guggagaugucuucguac

SEQ ID NO: 2509941 - RNA, 17 nt, Human
guggagaugucuucgua

SEQ ID NO: 2509942 - RNA, 16 nt, Human
guggagaugucuucgu

SEQ ID NO: 2509943 - RNA, 15 nt, Human
guggagaugucuucg

SEQ ID NO: 2509944 - RNA, 18 nt, Human
guggagcaaagugagggc

SEQ ID NO: 2509945 - RNA, 19 nt, Human
guggagaugucuucguaca

SEQ ID NO: 2509946 - RNA, 16 nt, Human
guggagcaugggccug

SEQ ID NO: 2509947 - RNA, 15 nt, Human
guggagaagccauug

SEQ ID NO: 2509948 - RNA, 14 nt, Human
guggagaagccauu

SEQ ID NO: 2509949 - RNA, 13 nt, Human
guggagaagccau

SEQ ID NO: 2509950 - RNA, 12 nt, Human
guggagaagcca

SEQ ID NO: 2509951 - RNA, 19 nt, Human
guggagaagccauugucuu

SEQ ID NO: 2509952 - RNA, 18 nt, Human
guggagaagccauugucu

SEQ ID NO: 2509953 - RNA, 20 nt, Human
guggagaagccauugucuuc

SEQ ID NO: 2509954 - RNA, 13 nt, Human
guggagacagggc

SEQ ID NO: 2509955 - RNA, 11 nt, Human
guggagacugc

SEQ ID NO: 2509956 - RNA, 18 nt, Human
guggagacugcuucccau

SEQ ID NO: 2509957 - RNA, 16 nt, Human
guggagacugcuuccc

SEQ ID NO: 2509958 - RNA, 20 nt, Human
guggagacuggggggcuuga

SEQ ID NO: 2509959 - RNA, 19 nt, Human
guggagacuggggggcuug

SEQ ID NO: 2509960 - RNA, 12 nt, Human
guggagagcugg

SEQ ID NO: 2509961 - RNA, 18 nt, Human
guggagaggcccggccuc

SEQ ID NO: 2509962 - RNA, 14 nt, Human
guggagagcuggug

SEQ ID NO: 2509963 - RNA, 16 nt, Human
guggagagcuggugcc

SEQ ID NO: 2509964 - RNA, 13 nt, Human
guggacuuuuauu

SEQ ID NO: 2509965 - RNA, 16 nt, Human
guggacuuuccacccc

SEQ ID NO: 2509966 - RNA, 17 nt, Human
guggacuuuccaccccc

SEQ ID NO: 2509967 - RNA, 20 nt, Human
guggacuuuccacccccucc

SEQ ID NO: 2509968 - RNA, 22 nt, Human
guggacuuuccacccccucccu

SEQ ID NO: 2509969 - RNA, 20 nt, Human
guggagaaagcacugaccug

SEQ ID NO: 2509970 - RNA, 21 nt, Human
guggagaaacuguagucucag

SEQ ID NO: 2509971 - RNA, 23 nt, Human
guggagaaauaaaaauaccucuu

SEQ ID NO: 2509972 - RNA, 22 nt, Human
guggagaaauaaaaauaccucu

SEQ ID NO: 2509973 - RNA, 22 nt, Human
guggagaaauuccuugauucac

SEQ ID NO: 2509974 - RNA, 20 nt, Human
guggagaagcggcuggcagc

SEQ ID NO: 2509975 - RNA, 22 nt, Human
guggagaagccacaggccugag

SEQ ID NO: 2509976 - RNA, 20 nt, Human
guggagaagccacaggccug

SEQ ID NO: 2509977 - RNA, 17 nt, Human
guggagaagccacaggc

SEQ ID NO: 2509978 - RNA, 16 nt, Human
guggagaacuccuagg

SEQ ID NO: 2509979 - RNA, 22 nt, Human
guggacuuagaaagcaggggcu

SEQ ID NO: 2509980 - RNA, 20 nt, Human
guggacuuagaaagcagggg

SEQ ID NO: 2509981 - RNA, 19 nt, Human
guggacuuagaaagcaggg

SEQ ID NO: 2509982 - RNA, 18 nt, Human
guggacuuagaaagcagg

SEQ ID NO: 2509983 - RNA, 16 nt, Human
guggacuuagaaagca

SEQ ID NO: 2509984 - RNA, 17 nt, Human
guggacuggccccuggg

SEQ ID NO: 2509985 - RNA, 21 nt, Human
guggaaccacugacuacuggc

SEQ ID NO: 2509986 - RNA, 21 nt, Human
guggaaauuaagaagaaacua

SEQ ID NO: 2509987 - RNA, 15 nt, Human
guggaaccaggaacc

SEQ ID NO: 2509988 - RNA, 22 nt, Human
guggaacguuuuuccuguucuu

SEQ ID NO: 2509989 - RNA, 19 nt, Human
guggaucuccaaggaccag

SEQ ID NO: 2509990 - RNA, 18 nt, Human
guggaucuccaaggacca

SEQ ID NO: 2509991 - RNA, 17 nt, Human
guggaucuccaaggacc

SEQ ID NO: 2509992 - RNA, 21 nt, Human
guggaucagagaugcaccacc

SEQ ID NO: 2509993 - RNA, 18 nt, Human
guggaucuguccaaggaa

SEQ ID NO: 2509994 - RNA, 17 nt, Human
guggaucuguccaagga

SEQ ID NO: 2509995 - RNA, 23 nt, Human
guggaucuccaaggaccagguua

SEQ ID NO: 2509996 - RNA, 15 nt, Human
guggaugauguuucg

SEQ ID NO: 2509997 - RNA, 18 nt, Human
guggaugccugguggcag

SEQ ID NO: 2509998 - RNA, 16 nt, Human
guggaugccugguggc

SEQ ID NO: 2509999 - RNA, 17 nt, Human
guggaguucaucuugaa

SEQ ID NO: 2510000 - RNA, 20 nt, Human
guggagucccuuuugcauca

SEQ ID NO: 2510001 - RNA, 13 nt, Human
guggaucacagag

SEQ ID NO: 2510002 - RNA, 16 nt, Human
guggauauaaauauau

SEQ ID NO: 2510003 - RNA, 15 nt, Human
guggauauaaauaua

SEQ ID NO: 2510004 - RNA, 13 nt, Human
guggauauaaaua

SEQ ID NO: 2510005 - RNA, 15 nt, Human
guggaguggggcagu

SEQ ID NO: 2510006 - RNA, 14 nt, Human
guggaucacagagg

SEQ ID NO: 2510007 - RNA, 15 nt, Human
guggaucacagaggc

SEQ ID NO: 2510008 - RNA, 13 nt, Human
guggaucaccuga

SEQ ID NO: 2510009 - RNA, 15 nt, Human
guggaucaccugagg

SEQ ID NO: 2510010 - RNA, 16 nt, Human
guggaucacagaggcu

SEQ ID NO: 2510011 - RNA, 15 nt, Human
guggaggaggccugg

SEQ ID NO: 2510012 - RNA, 17 nt, Human
guggaggaguccaggcc

SEQ ID NO: 2510013 - RNA, 13 nt, Human
guggaggcacuuu

SEQ ID NO: 2510014 - RNA, 14 nt, Human
guggaggcacuuua

SEQ ID NO: 2510015 - RNA, 16 nt, Human
guggaggcugcaguga

SEQ ID NO: 2510016 - RNA, 14 nt, Human
guggaggaggccug

SEQ ID NO: 2510017 - RNA, 19 nt, Human
guggaggaggaaggcaaga

SEQ ID NO: 2510018 - RNA, 17 nt, Human
guggaggaggaaggcaa

SEQ ID NO: 2510019 - RNA, 17 nt, Human
guggaggagcagugcag

SEQ ID NO: 2510020 - RNA, 23 nt, Human
guggaggagcucaggacacuaau

SEQ ID NO: 2510021 - RNA, 20 nt, Human
guggaggagcucaggacacu

SEQ ID NO: 2510022 - RNA, 20 nt, Human
guggaggaaggauuguaaaa

SEQ ID NO: 2510023 - RNA, 19 nt, Human
guggaggaaggauuguaaa

SEQ ID NO: 2510024 - RNA, 16 nt, Human
guggaggaaggauugu

SEQ ID NO: 2510025 - RNA, 15 nt, Human
guggaggaaggauug

SEQ ID NO: 2510026 - RNA, 14 nt, Human
guggaggaaggauu

SEQ ID NO: 2510027 - RNA, 13 nt, Human
guggaggaaggau

SEQ ID NO: 2510028 - RNA, 13 nt, Human
guggagcugccug

SEQ ID NO: 2510029 - RNA, 16 nt, Human
guggaggaaugcuccc

SEQ ID NO: 2510030 - RNA, 17 nt, Human
guggaggaaugcucccc

SEQ ID NO: 2510031 - RNA, 12 nt, Human
guggaggagcag

SEQ ID NO: 2510032 - RNA, 15 nt, Human
guggaggagcagugc

SEQ ID NO: 2510033 - RNA, 23 nt, Human
guggaggaaugcucccccauccu

SEQ ID NO: 2510034 - RNA, 16 nt, Human
guggaggagcucagga

SEQ ID NO: 2510035 - RNA, 16 nt, Human
guggagggcguggagg

SEQ ID NO: 2510036 - RNA, 23 nt, Human
guggagggcacauuccuugccug

SEQ ID NO: 2510037 - RNA, 12 nt, Human
guggaggggugu

SEQ ID NO: 2510038 - RNA, 15 nt, Human
guggaggcuuccugc

SEQ ID NO: 2510039 - RNA, 14 nt, Human
guggaggcuuccug

SEQ ID NO: 2510040 - RNA, 12 nt, Human
guggagggccac

SEQ ID NO: 2510041 - RNA, 13 nt, Human
guggaggcuuccu

SEQ ID NO: 2510042 - RNA, 23 nt, Human
guggagggacaaguggacucagg

SEQ ID NO: 2510043 - RNA, 23 nt, Human
guggagggguguggcagugguuu

SEQ ID NO: 2510044 - RNA, 16 nt, Human
guggagggguguggca

SEQ ID NO: 2510045 - RNA, 15 nt, Human
guggagggguguggc

SEQ ID NO: 2510046 - RNA, 18 nt, Human
guggaggugucaggcugc

SEQ ID NO: 2510047 - RNA, 17 nt, Human
guggaggugucaggcug

SEQ ID NO: 2510048 - RNA, 22 nt, Human
guggaggugucaggcugcuggc

SEQ ID NO: 2510049 - RNA, 21 nt, Human
guggagguuaaggcugaggaa

SEQ ID NO: 2510050 - RNA, 22 nt, Human
guggagguuaaggcugaggaaa

SEQ ID NO: 2510051 - RNA, 22 nt, Human
guggagguugcagugagccaag

SEQ ID NO: 2510052 - RNA, 23 nt, Human
guggagguugcagugagccaaga

SEQ ID NO: 2510053 - RNA, 19 nt, Human
guggagguugcagugagcu

SEQ ID NO: 2510054 - RNA, 14 nt, Human
gugcuucuuucuuu

SEQ ID NO: 2510055 - RNA, 20 nt, Human
gugcuuuccagcucaccccc

SEQ ID NO: 2510056 - RNA, 18 nt, Human
gugcuuuccagcucaccc

SEQ ID NO: 2510057 - RNA, 16 nt, Human
gugcuuuccagcucac

SEQ ID NO: 2510058 - RNA, 15 nt, Human
gugcuuuccagcuca

SEQ ID NO: 2510059 - RNA, 14 nt, Human
gugcuuuccagcuc

SEQ ID NO: 2510060 - RNA, 13 nt, Human
gugcuuuccagcu

SEQ ID NO: 2510061 - RNA, 15 nt, Human
gugcuuuaugcugaa

SEQ ID NO: 2510062 - RNA, 17 nt, Human
gugcuuuaugcugaaac

SEQ ID NO: 2510063 - RNA, 19 nt, Human
gugcuuucuauuguacaga

SEQ ID NO: 2510064 - RNA, 17 nt, Human
gugcuuucuauuguaca

SEQ ID NO: 2510065 - RNA, 13 nt, Human
gugcuuucuauug

SEQ ID NO: 2510066 - RNA, 12 nt, Human
gugcuuucuauu

SEQ ID NO: 2510067 - RNA, 19 nt, Human
gugcuuuccuuuuuuaaaa

SEQ ID NO: 2510068 - RNA, 20 nt, Human
gugcuuuccuuuuuuaaaaa

SEQ ID NO: 2510069 - RNA, 22 nt, Human
gugcuuuccguggcacugcaua

SEQ ID NO: 2510070 - RNA, 16 nt, Human
gugcuugccacagagc

SEQ ID NO: 2510071 - RNA, 20 nt, Human
gugcuuguucccucucccug

SEQ ID NO: 2510072 - RNA, 19 nt, Human
gugcuuguuuacagcacua

SEQ ID NO: 2510073 - RNA, 15 nt, Human
gugcuugugugugug

SEQ ID NO: 2510074 - RNA, 21 nt, Human
gugcuuguuugcucaccuggg

SEQ ID NO: 2510075 - RNA, 22 nt, Human
gugcuuguuugcucaccugggg

SEQ ID NO: 2510076 - RNA, 23 nt, Human
gugcuuguuugcucaccuggggu

SEQ ID NO: 2510077 - RNA, 14 nt, Human
gugcuuuaugcuga

SEQ ID NO: 2510078 - RNA, 18 nt, Human
guggaaaaauagccugcc

SEQ ID NO: 2510079 - RNA, 23 nt, Human
guggaaaagccaagaggcugcag

SEQ ID NO: 2510080 - RNA, 12 nt, Human
guggaaaaauau

SEQ ID NO: 2510081 - RNA, 13 nt, Human
guggaaaaauauu

SEQ ID NO: 2510082 - RNA, 14 nt, Human
guggaaaaauauuu

SEQ ID NO: 2510083 - RNA, 15 nt, Human
guggaaaaauauuua

SEQ ID NO: 2510084 - RNA, 19 nt, Human
gugcuuuuccuauuuguuu

SEQ ID NO: 2510085 - RNA, 17 nt, Human
gugcuuuuccuauuugu

SEQ ID NO: 2510086 - RNA, 19 nt, Human
gugcuuuuauagaggcuag

SEQ ID NO: 2510087 - RNA, 18 nt, Human
gugcuuuuauagaggcua

SEQ ID NO: 2510088 - RNA, 14 nt, Human
gugcuuuucuccaa

SEQ ID NO: 2510089 - RNA, 15 nt, Human
gugcuuuuaaaugca

SEQ ID NO: 2510090 - RNA, 22 nt, Human
gugcuuucuauuguacagaagc

SEQ ID NO: 2510091 - RNA, 20 nt, Human
gugcuuucuauuguacagaa

SEQ ID NO: 2510092 - RNA, 19 nt, Human
guggaaaaaugagagaagg

SEQ ID NO: 2510093 - RNA, 14 nt, Human
guggaaagccucug

SEQ ID NO: 2510094 - RNA, 15 nt, Human
guggaaagccucugc

SEQ ID NO: 2510095 - RNA, 13 nt, Human
guggaaagggugc

SEQ ID NO: 2510096 - RNA, 23 nt, Human
guggaaagccucugcugccaugg

SEQ ID NO: 2510097 - RNA, 20 nt, Human
guggaaagggugcugcuucc

SEQ ID NO: 2510098 - RNA, 22 nt, Human
guggaaagggugcugcuucccu

SEQ ID NO: 2510099 - RNA, 16 nt, Human
guggaaagugaauuug

SEQ ID NO: 2510100 - RNA, 19 nt, Human
guggaaagugaauuugaau

SEQ ID NO: 2510101 - RNA, 17 nt, Human
guggaaauuaagaagaa

SEQ ID NO: 2510102 - RNA, 18 nt, Human
guggaaauuaagaagaaa

SEQ ID NO: 2510103 - RNA, 19 nt, Human
guggaaauuaagaagaaac

SEQ ID NO: 2510104 - RNA, 20 nt, Human
guggaaauuaagaagaaacu

SEQ ID NO: 2510105 - RNA, 18 nt, Human
guggaaaguguaaagcau

SEQ ID NO: 2510106 - RNA, 16 nt, Human
guggaaaguguaaagc

SEQ ID NO: 2510107 - RNA, 15 nt, Human
guggaaaguguaaag

SEQ ID NO: 2510108 - RNA, 13 nt, Human
guggaaaguguaa

SEQ ID NO: 2510109 - RNA, 21 nt, Human
guggaaaguguaaagcauucc

SEQ ID NO: 2510110 - RNA, 20 nt, Human
guggaaaguguaaagcauuc

SEQ ID NO: 2510111 - RNA, 23 nt, Human
guggaaaguguaaagcauuccaa

SEQ ID NO: 2510112 - RNA, 17 nt, Human
gugcuuaagcagaagca

SEQ ID NO: 2510113 - RNA, 22 nt, Human
gugcuuaagcagaagcauuaac

SEQ ID NO: 2510114 - RNA, 21 nt, Human
gugcuuaucccauagccagga

SEQ ID NO: 2510115 - RNA, 11 nt, Human
gugcugugugu

SEQ ID NO: 2510116 - RNA, 22 nt, Human
gugcuguguaaaguuagucuac

SEQ ID NO: 2510117 - RNA, 18 nt, Human
gugcuguguaaaguuagu

SEQ ID NO: 2510118 - RNA, 16 nt, Human
gugcuguguaaaguua

SEQ ID NO: 2510119 - RNA, 15 nt, Human
gugcuguguaaaguu

SEQ ID NO: 2510120 - RNA, 14 nt, Human
gugcuguguaaagu

SEQ ID NO: 2510121 - RNA, 13 nt, Human
gugcuguguaaag

SEQ ID NO: 2510122 - RNA, 12 nt, Human
gugcuguguaaa

SEQ ID NO: 2510123 - RNA, 21 nt, Human
gugcugccacacuucaggcuc

SEQ ID NO: 2510124 - RNA, 18 nt, Human
gugcugcccgucuucagc

SEQ ID NO: 2510125 - RNA, 19 nt, Human
gugcugcccgucuucagcc

SEQ ID NO: 2510126 - RNA, 22 nt, Human
gugcugccauccagguucagcu

SEQ ID NO: 2510127 - RNA, 11 nt, Human
gugcugcccug

SEQ ID NO: 2510128 - RNA, 23 nt, Human
gugcuguggggcugguagcucag

SEQ ID NO: 2510129 - RNA, 19 nt, Human
gugcuguggggcugguagc

SEQ ID NO: 2510130 - RNA, 14 nt, Human
gugcuguggggcug

SEQ ID NO: 2510131 - RNA, 21 nt, Human
gugcugcccgucuucagccua

SEQ ID NO: 2510132 - RNA, 19 nt, Human
gugcuguggccugggcaag

SEQ ID NO: 2510133 - RNA, 15 nt, Human
gugcuuggaggaagg

SEQ ID NO: 2510134 - RNA, 13 nt, Human
gugcuuggaggaa

SEQ ID NO: 2510135 - RNA, 12 nt, Human
gugcuuggagga

SEQ ID NO: 2510136 - RNA, 21 nt, Human
gugcuucuaauauuuauugcu

SEQ ID NO: 2510137 - RNA, 17 nt, Human
gugcuucgggcccuucc

SEQ ID NO: 2510138 - RNA, 13 nt, Human
gugcuucuuucuu

SEQ ID NO: 2510139 - RNA, 14 nt, Human
gugcuucgggcccu

SEQ ID NO: 2510140 - RNA, 16 nt, Human
gugcuuccaaggcaga

SEQ ID NO: 2510141 - RNA, 13 nt, Human
gugcuucagccug

SEQ ID NO: 2510142 - RNA, 15 nt, Human
gugcuucagccugag

SEQ ID NO: 2510143 - RNA, 18 nt, Human
gugcuucagccugaggcu

SEQ ID NO: 2510144 - RNA, 18 nt, Human
gugcuuauguaugaggua

SEQ ID NO: 2510145 - RNA, 15 nt, Human
gugcuucaauuaaua

SEQ ID NO: 2510146 - RNA, 23 nt, Human
gugcugaaugguuuucaaaauaa

SEQ ID NO: 2510147 - RNA, 21 nt, Human
gugcugaacaguggaggaaga

SEQ ID NO: 2510148 - RNA, 19 nt, Human
gugcugaauguugggacug

SEQ ID NO: 2510149 - RNA, 19 nt, Human
gugcugaaugguuuucaaa

SEQ ID NO: 2510150 - RNA, 20 nt, Human
gugcugaaugguuuucaaaa

SEQ ID NO: 2510151 - RNA, 18 nt, Human
gugcucuggacaggcaug

SEQ ID NO: 2510152 - RNA, 17 nt, Human
gugcucuggacaggcau

SEQ ID NO: 2510153 - RNA, 17 nt, Human
gugccuuuugcaccccu

SEQ ID NO: 2510154 - RNA, 16 nt, Human
gugccuuuugcacccc

SEQ ID NO: 2510155 - RNA, 15 nt, Human
gugccuuuugcaccc

SEQ ID NO: 2510156 - RNA, 17 nt, Human
gugcucuucuucuuucu

SEQ ID NO: 2510157 - RNA, 22 nt, Human
gugcugaacaaaaaauaaaaau

SEQ ID NO: 2510158 - RNA, 18 nt, Human
gugccuuuuauagcuauu

SEQ ID NO: 2510159 - RNA, 14 nt, Human
gugccuuuuauagc

SEQ ID NO: 2510160 - RNA, 21 nt, Human
gugccuuugaguuuccucagg

SEQ ID NO: 2510161 - RNA, 16 nt, Human
gugcucuggacaggca

SEQ ID NO: 2510162 - RNA, 15 nt, Human
gugcucuggacaggc

SEQ ID NO: 2510163 - RNA, 21 nt, Human
gugccuuggggacaagagcag

SEQ ID NO: 2510164 - RNA, 21 nt, Human
gugccuuggggaauuuccucu

SEQ ID NO: 2510165 - RNA, 20 nt, Human
gugccuuggggaauuuccuc

SEQ ID NO: 2510166 - RNA, 15 nt, Human
gugccgacagaagga

SEQ ID NO: 2510167 - RNA, 14 nt, Human
gugccgacagaagg

SEQ ID NO: 2510168 - RNA, 22 nt, Human
gugccgagaaggaagccuccca

SEQ ID NO: 2510169 - RNA, 15 nt, Human
gugcccugguggaga

SEQ ID NO: 2510170 - RNA, 23 nt, Human
gugcccugguggagaaagcacug

SEQ ID NO: 2510171 - RNA, 16 nt, Human
gugcccuuggaggcca

SEQ ID NO: 2510172 - RNA, 12 nt, Human
gugcccugcccc

SEQ ID NO: 2510173 - RNA, 19 nt, Human
gugcugagucugaaggcug

SEQ ID NO: 2510174 - RNA, 18 nt, Human
gugcugagucugaaggcu

SEQ ID NO: 2510175 - RNA, 17 nt, Human
gugcugagucugaaggc

SEQ ID NO: 2510176 - RNA, 16 nt, Human
gugcugagucugaagg

SEQ ID NO: 2510177 - RNA, 15 nt, Human
gugcugacggaagcc

SEQ ID NO: 2510178 - RNA, 15 nt, Human
gugcugaccucuggu

SEQ ID NO: 2510179 - RNA, 15 nt, Human
gugcugacggccagg

SEQ ID NO: 2510180 - RNA, 16 nt, Human
gugcugacggccaggg

SEQ ID NO: 2510181 - RNA, 18 nt, Human
gugcugacggccagggag

SEQ ID NO: 2510182 - RNA, 14 nt, Human
gugcugaccucugg

SEQ ID NO: 2510183 - RNA, 18 nt, Human
gugcugacccuccuguug

SEQ ID NO: 2510184 - RNA, 16 nt, Human
gugcugacccuccugu

SEQ ID NO: 2510185 - RNA, 14 nt, Human
gugcugacccuccu

SEQ ID NO: 2510186 - RNA, 15 nt, Human
gugcugacagcugcu

SEQ ID NO: 2510187 - RNA, 16 nt, Human
gugcugacagcugcuc

SEQ ID NO: 2510188 - RNA, 17 nt, Human
gugcugacagcugcucc

SEQ ID NO: 2510189 - RNA, 21 nt, Human
gugcugacggccagggagaag

SEQ ID NO: 2510190 - RNA, 23 nt, Human
gugcugacggccagggagaagcu

SEQ ID NO: 2510191 - RNA, 11 nt, Human
gugcugagaag

SEQ ID NO: 2510192 - RNA, 13 nt, Human
gugcugagaagcu

SEQ ID NO: 2510193 - RNA, 14 nt, Human
gugcugagaagcuu

SEQ ID NO: 2510194 - RNA, 12 nt, Human
gugcugagucug

SEQ ID NO: 2510195 - RNA, 19 nt, Human
gugcugccauccagguuca

SEQ ID NO: 2510196 - RNA, 18 nt, Human
gugcugccauccagguuc

SEQ ID NO: 2510197 - RNA, 20 nt, Human
gugcugaucgugcuaaauuu

SEQ ID NO: 2510198 - RNA, 12 nt, Human
gugcugccacac

SEQ ID NO: 2510199 - RNA, 15 nt, Human
gugcugccauccagg

SEQ ID NO: 2510200 - RNA, 19 nt, Human
gugcugcauuuaaaagaua

SEQ ID NO: 2510201 - RNA, 20 nt, Human
gugcugcauuuaaaagauac

SEQ ID NO: 2510202 - RNA, 12 nt, Human
gugcugcauuua

SEQ ID NO: 2510203 - RNA, 22 nt, Human
gugcugaggccuuaucauucau

SEQ ID NO: 2510204 - RNA, 22 nt, Human
gugcugaucgugcuaaauuuuc

SEQ ID NO: 2510205 - RNA, 23 nt, Human
gugcugaguugguguugacaugu

SEQ ID NO: 2510206 - RNA, 19 nt, Human
uaucugugaaaugcuggca

SEQ ID NO: 2510207 - RNA, 17 nt, Human
uaucugugcgugaaaca

SEQ ID NO: 2510208 - RNA, 18 nt, Human
uaucugugcgugaaacac

SEQ ID NO: 2510209 - RNA, 22 nt, Human
uaucugugcucaggacucagaa

SEQ ID NO: 2510210 - RNA, 20 nt, Human
uaucuguguuuuugaaauau

SEQ ID NO: 2510211 - RNA, 14 nt, Human
uaucugugcucagg

SEQ ID NO: 2510212 - RNA, 19 nt, Human
uaucugugcgugaaacaca

SEQ ID NO: 2510213 - RNA, 20 nt, Human
uaucugugcgugaaacacac

SEQ ID NO: 2510214 - RNA, 23 nt, Human
uaucugucauuugagcagggcuc

SEQ ID NO: 2510215 - RNA, 21 nt, Human
uaucugucauuugagcagggc

SEQ ID NO: 2510216 - RNA, 19 nt, Human
uaucugggugcaugaucuu

SEQ ID NO: 2510217 - RNA, 18 nt, Human
uaucuguaaguuuugaau

SEQ ID NO: 2510218 - RNA, 22 nt, Human
uaucuggucaaccuccuggaca

SEQ ID NO: 2510219 - RNA, 21 nt, Human
uaucugggauucuacuuuaag

SEQ ID NO: 2510220 - RNA, 19 nt, Human
uaucugggauucuacuuua

SEQ ID NO: 2510221 - RNA, 18 nt, Human
uaucugggaacugugccu

SEQ ID NO: 2510222 - RNA, 22 nt, Human
uaucuguauuuaauuuugacac

SEQ ID NO: 2510223 - RNA, 17 nt, Human
uaucuguauuuaauuuu

SEQ ID NO: 2510224 - RNA, 15 nt, Human
uaucuguauuuaauu

SEQ ID NO: 2510225 - RNA, 11 nt, Human
uaucuguauuu

SEQ ID NO: 2510226 - RNA, 16 nt, Human
uaucuguaucucucuc

SEQ ID NO: 2510227 - RNA, 23 nt, Human
uaucuguagugagauagcauugu

SEQ ID NO: 2510228 - RNA, 20 nt, Human
uaucugucauuugagcaggg

SEQ ID NO: 2510229 - RNA, 20 nt, Human
uaugaaguuuuuuuuauaca

SEQ ID NO: 2510230 - RNA, 14 nt, Human
uaucuugaagacuu

SEQ ID NO: 2510231 - RNA, 18 nt, Human
uaugaauaaagacaccua

SEQ ID NO: 2510232 - RNA, 20 nt, Human
uaucuguucuuuaauuuauu

SEQ ID NO: 2510233 - RNA, 19 nt, Human
uaucuguucuuuaauuuau

SEQ ID NO: 2510234 - RNA, 14 nt, Human
uaucuguucuuuaa

SEQ ID NO: 2510235 - RNA, 17 nt, Human
uaucuguuuacaguguu

SEQ ID NO: 2510236 - RNA, 16 nt, Human
uaucuguuuacagugu

SEQ ID NO: 2510237 - RNA, 12 nt, Human
uaucuguucuug

SEQ ID NO: 2510238 - RNA, 17 nt, Human
uaucuguguuuuugaaa

SEQ ID NO: 2510239 - RNA, 13 nt, Human
uaucuuaauuuug

SEQ ID NO: 2510240 - RNA, 20 nt, Human
uaucuuaauuuugguuguau

SEQ ID NO: 2510241 - RNA, 20 nt, Human
uaugacaucacuuguacaaa

SEQ ID NO: 2510242 - RNA, 23 nt, Human
uaugacaucacuuguacaaaaua

SEQ ID NO: 2510243 - RNA, 19 nt, Human
uaugacauucaugccuggc

SEQ ID NO: 2510244 - RNA, 14 nt, Human
uaugacauucaugc

SEQ ID NO: 2510245 - RNA, 24 nt, Human
uaugacaucacuuguacaaaauaa

SEQ ID NO: 2510246 - RNA, 14 nt, Human
uaugaccacacucc

SEQ ID NO: 2510247 - RNA, 19 nt, Human
uaugaccacacuccagcug

SEQ ID NO: 2510248 - RNA, 19 nt, Human
uaugacaucacuuguacaa

SEQ ID NO: 2510249 - RNA, 15 nt, Human
uaugacaguuauacu

SEQ ID NO: 2510250 - RNA, 12 nt, Human
uaugacacaugc

SEQ ID NO: 2510251 - RNA, 21 nt, Human
uaugaauuuaaauauaauucu

SEQ ID NO: 2510252 - RNA, 20 nt, Human
uaugaauuuaaauauaauuc

SEQ ID NO: 2510253 - RNA, 19 nt, Human
uaugaauuuaaauauaauu

SEQ ID NO: 2510254 - RNA, 17 nt, Human
uaugaauuuaaauauaa

SEQ ID NO: 2510255 - RNA, 23 nt, Human
uaugaauuuaaauauaauucugu

SEQ ID NO: 2510256 - RNA, 22 nt, Human
uaugacacaugcaaggucauuu

SEQ ID NO: 2510257 - RNA, 16 nt, Human
uaugacagcugucccu

SEQ ID NO: 2510258 - RNA, 20 nt, Human
uaugacagcugucccuguca

SEQ ID NO: 2510259 - RNA, 22 nt, Human
uaugaaugggcaaaacugaauu

SEQ ID NO: 2510260 - RNA, 21 nt, Human
uaugaaugcccccagcuggcc

SEQ ID NO: 2510261 - RNA, 20 nt, Human
uaugaaugcccccagcuggc

SEQ ID NO: 2510262 - RNA, 17 nt, Human
uaugaauuacauuugua

SEQ ID NO: 2510263 - RNA, 23 nt, Human
uaugaauuacauuuguauaaaau

SEQ ID NO: 2510264 - RNA, 18 nt, Human
uaugaauugaauuaucuu

SEQ ID NO: 2510265 - RNA, 15 nt, Human
uaugaauuuaaauau

SEQ ID NO: 2510266 - RNA, 18 nt, Human
uaugaaucuauuauacug

SEQ ID NO: 2510267 - RNA, 12 nt, Human
uaugaaucuauu

SEQ ID NO: 2510268 - RNA, 22 nt, Human
uaugaaucuaugccaaagauca

SEQ ID NO: 2510269 - RNA, 21 nt, Human
uaugaaucuaugccaaagauc

SEQ ID NO: 2510270 - RNA, 20 nt, Human
uaugaaucuaugccaaagau

SEQ ID NO: 2510271 - RNA, 15 nt, Human
uaugaaucuaugcca

SEQ ID NO: 2510272 - RNA, 13 nt, Human
uaugaaucuaugc

SEQ ID NO: 2510273 - RNA, 19 nt, Human
uaugaaugcccccagcugg

SEQ ID NO: 2510274 - RNA, 23 nt, Human
uaugaaucuauuauacuguauua

SEQ ID NO: 2510275 - RNA, 21 nt, Human
uaugaaucuauuauacuguau

SEQ ID NO: 2510276 - RNA, 12 nt, Human
uaugaauacagg

SEQ ID NO: 2510277 - RNA, 16 nt, Human
uaugaauacagggcau

SEQ ID NO: 2510278 - RNA, 14 nt, Human
uaucuucugauuug

SEQ ID NO: 2510279 - RNA, 12 nt, Human
uaugaauaacau

SEQ ID NO: 2510280 - RNA, 15 nt, Human
uauccuucagccuga

SEQ ID NO: 2510281 - RNA, 14 nt, Human
uauccuucagccug

SEQ ID NO: 2510282 - RNA, 13 nt, Human
uauccugagccau

SEQ ID NO: 2510283 - RNA, 23 nt, Human
uauccuccagguuuuucaauuaa

SEQ ID NO: 2510284 - RNA, 17 nt, Human
uauccuuucuaacaaaa

SEQ ID NO: 2510285 - RNA, 22 nt, Human
uauccuuuguggcaccuuuucu

SEQ ID NO: 2510286 - RNA, 16 nt, Human
uaucgggaacaguguu

SEQ ID NO: 2510287 - RNA, 17 nt, Human
uaucgggaacaguguuu

SEQ ID NO: 2510288 - RNA, 18 nt, Human
uaucguaaaauuaagaaa

SEQ ID NO: 2510289 - RNA, 15 nt, Human
uaucguaaaauuaag

SEQ ID NO: 2510290 - RNA, 21 nt, Human
uaucguaaccagccagauccu

SEQ ID NO: 2510291 - RNA, 17 nt, Human
uaucgggagcagugucu

SEQ ID NO: 2510292 - RNA, 14 nt, Human
uaucgggagcagug

SEQ ID NO: 2510293 - RNA, 15 nt, Human
uaucgggagcagugu

SEQ ID NO: 2510294 - RNA, 18 nt, Human
uaucgggagcagugucuu

SEQ ID NO: 2510295 - RNA, 16 nt, Human
uaucuaaauguugaaa

SEQ ID NO: 2510296 - RNA, 23 nt, Human
uauauuaaaaauauaaaacugcg

SEQ ID NO: 2510297 - RNA, 21 nt, Human
uauauuaaaaauauaaaacug

SEQ ID NO: 2510298 - RNA, 20 nt, Human
uauauuaaaaauauaaaacu

SEQ ID NO: 2510299 - RNA, 19 nt, Human
uauauuaaaaauauaaaac

SEQ ID NO: 2510300 - RNA, 15 nt, Human
uauauuaaaauaagc

SEQ ID NO: 2510301 - RNA, 18 nt, Human
uauauuaaaaauauaaaa

SEQ ID NO: 2510302 - RNA, 17 nt, Human
uauauuaaaaauauaaa

SEQ ID NO: 2510303 - RNA, 15 nt, Human
uauauuaaaaauaua

SEQ ID NO: 2510304 - RNA, 13 nt, Human
uauauuaaaaaua

SEQ ID NO: 2510305 - RNA, 19 nt, Human
uauauguuuuugaaggcag

SEQ ID NO: 2510306 - RNA, 19 nt, Human
uauauguuuuaagaggcag

SEQ ID NO: 2510307 - RNA, 23 nt, Human
uauauguuuaccuuuuaauuaau

SEQ ID NO: 2510308 - RNA, 20 nt, Human
uauauguuuaccuuuuaauu

SEQ ID NO: 2510309 - RNA, 20 nt, Human
uauauguucuaauuaauaaa

SEQ ID NO: 2510310 - RNA, 14 nt, Human
uauauguucacugu

SEQ ID NO: 2510311 - RNA, 23 nt, Human
uauauguguguuuaaauaaagua

SEQ ID NO: 2510312 - RNA, 18 nt, Human
uauauguguuuuucacau

SEQ ID NO: 2510313 - RNA, 16 nt, Human
uauccugaaauuucag

SEQ ID NO: 2510314 - RNA, 17 nt, Human
uauccugaaauuucaga

SEQ ID NO: 2510315 - RNA, 14 nt, Human
uauccugaaauuuc

SEQ ID NO: 2510316 - RNA, 23 nt, Human
uauccucuuuagaguuagacugu

SEQ ID NO: 2510317 - RNA, 22 nt, Human
uauccucuuuagaguuagacug

SEQ ID NO: 2510318 - RNA, 17 nt, Human
uauccucuuuagaguua

SEQ ID NO: 2510319 - RNA, 16 nt, Human
uauccucuuuagaguu

SEQ ID NO: 2510320 - RNA, 14 nt, Human
uauccucuuuagag

SEQ ID NO: 2510321 - RNA, 12 nt, Human
uauccucuguaa

SEQ ID NO: 2510322 - RNA, 20 nt, Human
uauccucugaucuccauggc

SEQ ID NO: 2510323 - RNA, 14 nt, Human
uauccucugaucuc

SEQ ID NO: 2510324 - RNA, 11 nt, Human
uauccucugau

SEQ ID NO: 2510325 - RNA, 13 nt, Human
uaucugccuuuau

SEQ ID NO: 2510326 - RNA, 21 nt, Human
uaucugcaggcagacacggau

SEQ ID NO: 2510327 - RNA, 19 nt, Human
uaucugcaggcagacacgg

SEQ ID NO: 2510328 - RNA, 18 nt, Human
uaucugccuuuauugugu

SEQ ID NO: 2510329 - RNA, 14 nt, Human
uaucugccuuuauu

SEQ ID NO: 2510330 - RNA, 20 nt, Human
uaucugccuuuauuguguuu

SEQ ID NO: 2510331 - RNA, 12 nt, Human
uaucugcugucc

SEQ ID NO: 2510332 - RNA, 11 nt, Human
uaucugcuguc

SEQ ID NO: 2510333 - RNA, 20 nt, Human
uaucugcuucaguggagaau

SEQ ID NO: 2510334 - RNA, 22 nt, Human
uaucugcuguccagacagccug

SEQ ID NO: 2510335 - RNA, 17 nt, Human
uaucugcuguccagaca

SEQ ID NO: 2510336 - RNA, 13 nt, Human
uaucugcugucca

SEQ ID NO: 2510337 - RNA, 19 nt, Human
uaucuggaaguaaccauuu

SEQ ID NO: 2510338 - RNA, 23 nt, Human
uaucugcuuuugguuauaaugug

SEQ ID NO: 2510339 - RNA, 18 nt, Human
uaucuggacaagccaacu

SEQ ID NO: 2510340 - RNA, 23 nt, Human
uaucugggauuaugguuuuguga

SEQ ID NO: 2510341 - RNA, 15 nt, Human
uaucugcaggcagac

SEQ ID NO: 2510342 - RNA, 18 nt, Human
uaucugcaggcagacacg

SEQ ID NO: 2510343 - RNA, 17 nt, Human
uaucugcaggcagacac

SEQ ID NO: 2510344 - RNA, 16 nt, Human
uaucugcaggcagaca

SEQ ID NO: 2510345 - RNA, 13 nt, Human
uaucugaggucac

SEQ ID NO: 2510346 - RNA, 23 nt, Human
uaucugagggaggaggccaccuc

SEQ ID NO: 2510347 - RNA, 18 nt, Human
uaucugagggaggaggcc

SEQ ID NO: 2510348 - RNA, 17 nt, Human
uaucugagggaggaggc

SEQ ID NO: 2510349 - RNA, 15 nt, Human
uaucuaauaccucug

SEQ ID NO: 2510350 - RNA, 16 nt, Human
uaucuaauaccucugu

SEQ ID NO: 2510351 - RNA, 21 nt, Human
uaucuaauauguaacaagcca

SEQ ID NO: 2510352 - RNA, 16 nt, Human
uaucgucacugcuuaa

SEQ ID NO: 2510353 - RNA, 14 nt, Human
uaucuaaauugaau

SEQ ID NO: 2510354 - RNA, 13 nt, Human
uaucuaaauugaa

SEQ ID NO: 2510355 - RNA, 21 nt, Human
uaucuaaauugaauaauggua

SEQ ID NO: 2510356 - RNA, 20 nt, Human
uaucuaaauugaauaauggu

SEQ ID NO: 2510357 - RNA, 17 nt, Human
uaucuaaauugaauaau

SEQ ID NO: 2510358 - RNA, 16 nt, Human
uaucuaaauugaauaa

SEQ ID NO: 2510359 - RNA, 16 nt, Human
uaucuacccagaauua

SEQ ID NO: 2510360 - RNA, 13 nt, Human
uaucuacucuccu

SEQ ID NO: 2510361 - RNA, 20 nt, Human
uaucuaauaccucugugugc

SEQ ID NO: 2510362 - RNA, 16 nt, Human
uaucuacaucuuuuuu

SEQ ID NO: 2510363 - RNA, 21 nt, Human
uaucuacaucuuuuuucacaa

SEQ ID NO: 2510364 - RNA, 14 nt, Human
uaugcacacauuuu

SEQ ID NO: 2510365 - RNA, 13 nt, Human
uaugcacauaugg

SEQ ID NO: 2510366 - RNA, 13 nt, Human
uaugcacacauuu

SEQ ID NO: 2510367 - RNA, 15 nt, Human
uaugcaauauaucua

SEQ ID NO: 2510368 - RNA, 16 nt, Human
uaugcaauuuccuuuu

SEQ ID NO: 2510369 - RNA, 17 nt, Human
uaugcaaggaaggaaag

SEQ ID NO: 2510370 - RNA, 20 nt, Human
uaugcaaggaaggaaagaaa

SEQ ID NO: 2510371 - RNA, 20 nt, Human
uaugcaaauauuuuuuugua

SEQ ID NO: 2510372 - RNA, 14 nt, Human
uaugcaaauauuuu

SEQ ID NO: 2510373 - RNA, 18 nt, Human
uaugcaaucaaaucugcu

SEQ ID NO: 2510374 - RNA, 15 nt, Human
uaugcaaagcacuga

SEQ ID NO: 2510375 - RNA, 22 nt, Human
uaugcaaaaguucugacuugac

SEQ ID NO: 2510376 - RNA, 19 nt, Human
uaugauuuuuuuuucauac

SEQ ID NO: 2510377 - RNA, 13 nt, Human
uaugcaaagcacu

SEQ ID NO: 2510378 - RNA, 14 nt, Human
uaugcaaagcacug

SEQ ID NO: 2510379 - RNA, 12 nt, Human
uaugcaaagcac

SEQ ID NO: 2510380 - RNA, 16 nt, Human
uaugauuuuauuugac

SEQ ID NO: 2510381 - RNA, 17 nt, Human
uaugauuuuuuuuucau

SEQ ID NO: 2510382 - RNA, 14 nt, Human
uaugauuuaauaaa

SEQ ID NO: 2510383 - RNA, 18 nt, Human
uaugauuuaaaacaugua

SEQ ID NO: 2510384 - RNA, 17 nt, Human
uaugauuuaaaacaugu

SEQ ID NO: 2510385 - RNA, 14 nt, Human
uaugauuuaaaaca

SEQ ID NO: 2510386 - RNA, 18 nt, Human
uaugauuuaauaaaauaa

SEQ ID NO: 2510387 - RNA, 17 nt, Human
uaugauuuaauaaaaua

SEQ ID NO: 2510388 - RNA, 18 nt, Human
uaugauuuauaguuugua

SEQ ID NO: 2510389 - RNA, 15 nt, Human
uaugauuuauaguuu

SEQ ID NO: 2510390 - RNA, 14 nt, Human
uaugauuuauaguu

SEQ ID NO: 2510391 - RNA, 17 nt, Human
uaugauuuggaaaauaa

SEQ ID NO: 2510392 - RNA, 15 nt, Human
uaugauuuggaaaau

SEQ ID NO: 2510393 - RNA, 18 nt, Human
uaugauuuggaaaauaaa

SEQ ID NO: 2510394 - RNA, 14 nt, Human
uaugauucugcuuu

SEQ ID NO: 2510395 - RNA, 21 nt, Human
uaugauucagauuguuaucua

SEQ ID NO: 2510396 - RNA, 19 nt, Human
uaugauucugcuuuuacca

SEQ ID NO: 2510397 - RNA, 16 nt, Human
uaugauucccagccag

SEQ ID NO: 2510398 - RNA, 16 nt, Human
uaugauuaguaaagaa

SEQ ID NO: 2510399 - RNA, 14 nt, Human
uaugagcucuucau

SEQ ID NO: 2510400 - RNA, 15 nt, Human
uaugagcucuucaug

SEQ ID NO: 2510401 - RNA, 13 nt, Human
uaugagcugaggg

SEQ ID NO: 2510402 - RNA, 12 nt, Human
uaugagcugagg

SEQ ID NO: 2510403 - RNA, 16 nt, Human
uaugagcucuucaugu

SEQ ID NO: 2510404 - RNA, 16 nt, Human
uaugagcugagggggg

SEQ ID NO: 2510405 - RNA, 23 nt, Human
uaugagcuggggaugucucucau

SEQ ID NO: 2510406 - RNA, 23 nt, Human
uaugagaaaagaggcgucuguau

SEQ ID NO: 2510407 - RNA, 17 nt, Human
uaugagccagacaaaug

SEQ ID NO: 2510408 - RNA, 19 nt, Human
uaugagccagacaaaugga

SEQ ID NO: 2510409 - RNA, 15 nt, Human
uaugagaggcaauga

SEQ ID NO: 2510410 - RNA, 16 nt, Human
uaugagccagacaaau

SEQ ID NO: 2510411 - RNA, 23 nt, Human
uaugacuccagaauuucccaaag

SEQ ID NO: 2510412 - RNA, 17 nt, Human
uaugacuccagaauuuc

SEQ ID NO: 2510413 - RNA, 16 nt, Human
uaugacuucauuaaua

SEQ ID NO: 2510414 - RNA, 20 nt, Human
uaugacuucauuaauaauaa

SEQ ID NO: 2510415 - RNA, 23 nt, Human
uaugacugcuucaugacauuccu

SEQ ID NO: 2510416 - RNA, 17 nt, Human
uaugacugcuucaugac

SEQ ID NO: 2510417 - RNA, 22 nt, Human
uaugacugcuccccagcccugg

SEQ ID NO: 2510418 - RNA, 18 nt, Human
uaugacugcuccccagcc

SEQ ID NO: 2510419 - RNA, 17 nt, Human
uaugacugcuccccagc

SEQ ID NO: 2510420 - RNA, 16 nt, Human
uaugacucccaaauuu

SEQ ID NO: 2510421 - RNA, 16 nt, Human
uaugacuccagaauuu

SEQ ID NO: 2510422 - RNA, 18 nt, Human
uaugacuaaagagagaau

SEQ ID NO: 2510423 - RNA, 19 nt, Human
uaugacuaaagagagaaug

SEQ ID NO: 2510424 - RNA, 20 nt, Human
uaugacuaaagagagaaugu

SEQ ID NO: 2510425 - RNA, 21 nt, Human
uaugacuaaagagagaaugua

SEQ ID NO: 2510426 - RNA, 19 nt, Human
uaugacggaagaacauaga

SEQ ID NO: 2510427 - RNA, 20 nt, Human
uaugacggaagaacauagaa

SEQ ID NO: 2510428 - RNA, 12 nt, Human
uaugacuaaaga

SEQ ID NO: 2510429 - RNA, 13 nt, Human
uaugacuaaagag

SEQ ID NO: 2510430 - RNA, 14 nt, Human
uaugacuaaagaga

SEQ ID NO: 2510431 - RNA, 15 nt, Human
uaugacuaaagagag

SEQ ID NO: 2510432 - RNA, 16 nt, Human
uaugacuaaagagaga

SEQ ID NO: 2510433 - RNA, 17 nt, Human
uaugacuaaagagagaa

SEQ ID NO: 2510434 - RNA, 20 nt, Human
uaugacauucaugccuggcu

SEQ ID NO: 2510435 - RNA, 16 nt, Human
uaugacggaagaacau

SEQ ID NO: 2510436 - RNA, 16 nt, Human
uaugaccuucuaggaa

SEQ ID NO: 2510437 - RNA, 18 nt, Human
uaugaccuucuaggaagc

SEQ ID NO: 2510438 - RNA, 22 nt, Human
uaugcacuuauaauuuuccuaa

SEQ ID NO: 2510439 - RNA, 15 nt, Human
uaugcagaauacuuu

SEQ ID NO: 2510440 - RNA, 20 nt, Human
uaugcacuuauaauuuuccu

SEQ ID NO: 2510441 - RNA, 17 nt, Human
uaugcacgaccuuggga

SEQ ID NO: 2510442 - RNA, 15 nt, Human
uaugcacgaccuugg

SEQ ID NO: 2510443 - RNA, 19 nt, Human
uaugcacuuauaauuuucc

SEQ ID NO: 2510444 - RNA, 22 nt, Human
uaugcaccuugugucuguacac

SEQ ID NO: 2510445 - RNA, 20 nt, Human
uaugcaccuugugucuguac

SEQ ID NO: 2510446 - RNA, 19 nt, Human
uaugcaccuugugucugua

SEQ ID NO: 2510447 - RNA, 18 nt, Human
uaugcaccuugugucugu

SEQ ID NO: 2510448 - RNA, 20 nt, Human
uaugcacauauggacucugc

SEQ ID NO: 2510449 - RNA, 19 nt, Human
uaugcacauauggacucug

SEQ ID NO: 2510450 - RNA, 14 nt, Human
uaugcaccuugugu

SEQ ID NO: 2510451 - RNA, 18 nt, Human
uaugcagagguccacaac

SEQ ID NO: 2510452 - RNA, 14 nt, Human
uaugcagaauguuu

SEQ ID NO: 2510453 - RNA, 22 nt, Human
uaugcagugauauggcagaaga

SEQ ID NO: 2510454 - RNA, 19 nt, Human
uaugcagugauauggcaga

SEQ ID NO: 2510455 - RNA, 19 nt, Human
uaugcaguauugagcacug

SEQ ID NO: 2510456 - RNA, 14 nt, Human
uaugcauaaaguca

SEQ ID NO: 2510457 - RNA, 15 nt, Human
uaugcauaaagucag

SEQ ID NO: 2510458 - RNA, 20 nt, Human
uaugcauauuauuuuauguu

SEQ ID NO: 2510459 - RNA, 17 nt, Human
uaugcaguuuuucagag

SEQ ID NO: 2510460 - RNA, 16 nt, Human
uaugcuucuguuuuau

SEQ ID NO: 2510461 - RNA, 15 nt, Human
uaugcuucuguuuua

SEQ ID NO: 2510462 - RNA, 12 nt, Human
uaugcuucauac

SEQ ID NO: 2510463 - RNA, 13 nt, Human
uaugcuucauaca

SEQ ID NO: 2510464 - RNA, 14 nt, Human
uaugcuucauacag

SEQ ID NO: 2510465 - RNA, 16 nt, Human
uaugcuucauacaggg

SEQ ID NO: 2510466 - RNA, 13 nt, Human
uaugcaugaagua

SEQ ID NO: 2510467 - RNA, 18 nt, Human
uaugcaugaaguaauaug

SEQ ID NO: 2510468 - RNA, 22 nt, Human
uaugcuuauacacuuacacuuu

SEQ ID NO: 2510469 - RNA, 13 nt, Human
uaugcuuauuuua

SEQ ID NO: 2510470 - RNA, 16 nt, Human
uaugcaucuaauaaaa

SEQ ID NO: 2510471 - RNA, 17 nt, Human
uaugcaucuaauaaaaa

SEQ ID NO: 2510472 - RNA, 14 nt, Human
uaugcuuauuuuaa

SEQ ID NO: 2510473 - RNA, 17 nt, Human
uaugcuuauuuuaaaau

SEQ ID NO: 2510474 - RNA, 19 nt, Human
uaugcuuauuuuaaaauuu

SEQ ID NO: 2510475 - RNA, 17 nt, Human
uauggacaaugacccag

SEQ ID NO: 2510476 - RNA, 20 nt, Human
uauggaauuuuucauugaua

SEQ ID NO: 2510477 - RNA, 18 nt, Human
uauggaauugauuugcau

SEQ ID NO: 2510478 - RNA, 23 nt, Human
uauggaauacaguguuauuuucu

SEQ ID NO: 2510479 - RNA, 19 nt, Human
uauggaauugauuugcauu

SEQ ID NO: 2510480 - RNA, 11 nt, Human
uauggaauuga

SEQ ID NO: 2510481 - RNA, 22 nt, Human
uauggaauuacauguaaaacau

SEQ ID NO: 2510482 - RNA, 18 nt, Human
uauggaauuacauguaaa

SEQ ID NO: 2510483 - RNA, 14 nt, Human
uauggaauuacaug

SEQ ID NO: 2510484 - RNA, 14 nt, Human
uauggaauacagug

SEQ ID NO: 2510485 - RNA, 17 nt, Human
uauggaauacaguguua

SEQ ID NO: 2510486 - RNA, 24 nt, Human
uauggaauacaguguuauuuucuu

SEQ ID NO: 2510487 - RNA, 22 nt, Human
uauggaaggguuuguggcuggg

SEQ ID NO: 2510488 - RNA, 22 nt, Human
uauggaagcauauuguuauuau

SEQ ID NO: 2510489 - RNA, 19 nt, Human
uauggaaggguuuguggcu

SEQ ID NO: 2510490 - RNA, 20 nt, Human
uauggaacuucuaauauauu

SEQ ID NO: 2510491 - RNA, 17 nt, Human
uauggaacuucuaauau

SEQ ID NO: 2510492 - RNA, 15 nt, Human
uauggaacuucuaau

SEQ ID NO: 2510493 - RNA, 13 nt, Human
uauggaacuucua

SEQ ID NO: 2510494 - RNA, 17 nt, Human
uauggaacucucuccac

SEQ ID NO: 2510495 - RNA, 19 nt, Human
uauggaacacucugagacu

SEQ ID NO: 2510496 - RNA, 13 nt, Human
uauggaacucucu

SEQ ID NO: 2510497 - RNA, 17 nt, Human
uauggaaauaaauguau

SEQ ID NO: 2510498 - RNA, 21 nt, Human
uauggaaacuguugccagaga

SEQ ID NO: 2510499 - RNA, 18 nt, Human
uauggaacacucugagac

SEQ ID NO: 2510500 - RNA, 17 nt, Human
uauggaacacucugaga

SEQ ID NO: 2510501 - RNA, 16 nt, Human
uauggaacacucugag

SEQ ID NO: 2510502 - RNA, 13 nt, Human
uauggaacacucu

SEQ ID NO: 2510503 - RNA, 15 nt, Human
uaugcuuuaaacauu

SEQ ID NO: 2510504 - RNA, 12 nt, Human
uaugcuuugaau

SEQ ID NO: 2510505 - RNA, 16 nt, Human
uauggaaauaaaugua

SEQ ID NO: 2510506 - RNA, 15 nt, Human
uaugcuuugaaugua

SEQ ID NO: 2510507 - RNA, 17 nt, Human
uaugcuucauacaggga

SEQ ID NO: 2510508 - RNA, 13 nt, Human
uaugcuucuugga

SEQ ID NO: 2510509 - RNA, 13 nt, Human
uauauaaauauau

SEQ ID NO: 2510510 - RNA, 12 nt, Human
uauauaaauaua

SEQ ID NO: 2510511 - RNA, 22 nt, Human
uauauaaauaaauauauauauc

SEQ ID NO: 2510512 - RNA, 19 nt, Human
uauauaaauaaauauauau

SEQ ID NO: 2510513 - RNA, 16 nt, Human
uauauaaauauauaua

SEQ ID NO: 2510514 - RNA, 15 nt, Human
uauauaaauauauau

SEQ ID NO: 2510515 - RNA, 20 nt, Human
uauauaaauauauauaaaua

SEQ ID NO: 2510516 - RNA, 18 nt, Human
uauauaaauaaauauaua

SEQ ID NO: 2510517 - RNA, 16 nt, Human
uauauaaauaaauaua

SEQ ID NO: 2510518 - RNA, 15 nt, Human
uauauaaauaaauau

SEQ ID NO: 2510519 - RNA, 11 nt, Human
uauauaaauaa

SEQ ID NO: 2510520 - RNA, 16 nt, Human
uauaguuuuacuuuua

SEQ ID NO: 2510521 - RNA, 13 nt, Human
uauauaacaaugc

SEQ ID NO: 2510522 - RNA, 15 nt, Human
uauauaaaugcuuuu

SEQ ID NO: 2510523 - RNA, 12 nt, Human
uauauaaaugcu

SEQ ID NO: 2510524 - RNA, 18 nt, Human
uauauaaaugguuaaaag

SEQ ID NO: 2510525 - RNA, 15 nt, Human
uauaucuaucuuaua

SEQ ID NO: 2510526 - RNA, 23 nt, Human
uauauaaauuuuuuuuguuucau

SEQ ID NO: 2510527 - RNA, 13 nt, Human
uauaugcuucugu

SEQ ID NO: 2510528 - RNA, 16 nt, Human
uauaugcuuacugaua

SEQ ID NO: 2510529 - RNA, 17 nt, Human
uauaugcuuacugauau

SEQ ID NO: 2510530 - RNA, 21 nt, Human
uauaugcuuacugauauauuu

SEQ ID NO: 2510531 - RNA, 20 nt, Human
uauaugcucugcauguuaca

SEQ ID NO: 2510532 - RNA, 16 nt, Human
uauaucucucaugcau

SEQ ID NO: 2510533 - RNA, 14 nt, Human
uauaugcuuacuga

SEQ ID NO: 2510534 - RNA, 21 nt, Human
uauaugcucugcauguuacau

SEQ ID NO: 2510535 - RNA, 14 nt, Human
uauauguguaugua

SEQ ID NO: 2510536 - RNA, 18 nt, Human
uauaugugaacauuuauc

SEQ ID NO: 2510537 - RNA, 22 nt, Human
uauauguguguuuaaauaaagu

SEQ ID NO: 2510538 - RNA, 19 nt, Human
uauauguguguuuaaauaa

SEQ ID NO: 2510539 - RNA, 16 nt, Human
uauauguguguuuaaa

SEQ ID NO: 2510540 - RNA, 15 nt, Human
uauauguguguuuaa

SEQ ID NO: 2510541 - RNA, 13 nt, Human
uauaugugugugu

SEQ ID NO: 2510542 - RNA, 19 nt, Human
uauauguguguguauguuu

SEQ ID NO: 2510543 - RNA, 22 nt, Human
uauauguguguguauguuugca

SEQ ID NO: 2510544 - RNA, 22 nt, Human
uauaugugaauccucuucuuua

SEQ ID NO: 2510545 - RNA, 16 nt, Human
uauaugugaugaucua

SEQ ID NO: 2510546 - RNA, 12 nt, Human
uauaugucaaag

SEQ ID NO: 2510547 - RNA, 19 nt, Human
uauacguguagcuauaucu

SEQ ID NO: 2510548 - RNA, 17 nt, Human
uauacguguagcuauau

SEQ ID NO: 2510549 - RNA, 15 nt, Human
uauacguguagcuau

SEQ ID NO: 2510550 - RNA, 14 nt, Human
uauacguguagcua

SEQ ID NO: 2510551 - RNA, 13 nt, Human
uauacguguagcu

SEQ ID NO: 2510552 - RNA, 22 nt, Human
uauacgugaaaauuauuugaaa

SEQ ID NO: 2510553 - RNA, 20 nt, Human
uauacgcagcgugcuuuaaa

SEQ ID NO: 2510554 - RNA, 12 nt, Human
uauacugaagga

SEQ ID NO: 2510555 - RNA, 20 nt, Human
uauacugaaggaaaaacaca

SEQ ID NO: 2510556 - RNA, 15 nt, Human
uauacuaagaaaaga

SEQ ID NO: 2510557 - RNA, 16 nt, Human
uauaccuuugccuugg

SEQ ID NO: 2510558 - RNA, 18 nt, Human
uauacgauaaauaacuuu

SEQ ID NO: 2510559 - RNA, 11 nt, Human
uauacuguaaa

SEQ ID NO: 2510560 - RNA, 12 nt, Human
uauacuguaaag

SEQ ID NO: 2510561 - RNA, 13 nt, Human
uauacuguaaaga

SEQ ID NO: 2510562 - RNA, 14 nt, Human
uauacuguaaagaa

SEQ ID NO: 2510563 - RNA, 15 nt, Human
uauacuguaaagaaa

SEQ ID NO: 2510564 - RNA, 16 nt, Human
uauacuguaaagaaag

SEQ ID NO: 2510565 - RNA, 17 nt, Human
uauacuguaaagaaaga

SEQ ID NO: 2510566 - RNA, 19 nt, Human
uauacuguaaagaaagaga

SEQ ID NO: 2510567 - RNA, 12 nt, Human
uauacugcauac

SEQ ID NO: 2510568 - RNA, 16 nt, Human
uauacugcauacuuuu

SEQ ID NO: 2510569 - RNA, 22 nt, Human
uauacugaaggaaaaacacaag

SEQ ID NO: 2510570 - RNA, 17 nt, Human
uauacugcauacuuuuu

SEQ ID NO: 2510571 - RNA, 10 nt, Human
uauacuguaa

SEQ ID NO: 2510572 - RNA, 16 nt, Human
uauacuggagaagucu

SEQ ID NO: 2510573 - RNA, 22 nt, Human
uauaguugcuugccugauauaa

SEQ ID NO: 2510574 - RNA, 14 nt, Human
uauaguugcuugcc

SEQ ID NO: 2510575 - RNA, 19 nt, Human
uauaguuaggauagcauuu

SEQ ID NO: 2510576 - RNA, 18 nt, Human
uauaguuaggauagcauu

SEQ ID NO: 2510577 - RNA, 22 nt, Human
uauaguuucagauauauaucau

SEQ ID NO: 2510578 - RNA, 18 nt, Human
uauaguuuguacaugcau

SEQ ID NO: 2510579 - RNA, 15 nt, Human
uauaguuuguacaug

SEQ ID NO: 2510580 - RNA, 15 nt, Human
uauaguuuuacuuuu

SEQ ID NO: 2510581 - RNA, 21 nt, Human
uauaguuguggacauuuaaga

SEQ ID NO: 2510582 - RNA, 16 nt, Human
uauaguuuacuauuuu

SEQ ID NO: 2510583 - RNA, 19 nt, Human
uauaguuuauugacaauaa

SEQ ID NO: 2510584 - RNA, 13 nt, Human
uauaguuucagau

SEQ ID NO: 2510585 - RNA, 17 nt, Human
uauaguuuacuauuuua

SEQ ID NO: 2510586 - RNA, 17 nt, Human
uauaguuaggauagcau

SEQ ID NO: 2510587 - RNA, 18 nt, Human
uauaguguaaaauaagaa

SEQ ID NO: 2510588 - RNA, 13 nt, Human
uauaguguaaaau

SEQ ID NO: 2510589 - RNA, 21 nt, Human
uauaguguaaaauaagaauga

SEQ ID NO: 2510590 - RNA, 20 nt, Human
uauacuguaaagaaagagag

SEQ ID NO: 2510591 - RNA, 18 nt, Human
uauaauguuguuauuuaa

SEQ ID NO: 2510592 - RNA, 15 nt, Human
uauaauguuugcuau

SEQ ID NO: 2510593 - RNA, 18 nt, Human
uauaaucccagcacuuug

SEQ ID NO: 2510594 - RNA, 20 nt, Human
uauaaucacuuuuuuccaca

SEQ ID NO: 2510595 - RNA, 19 nt, Human
uauaauguuguuauuuaaa

SEQ ID NO: 2510596 - RNA, 17 nt, Human
uauaauguuguuauuua

SEQ ID NO: 2510597 - RNA, 20 nt, Human
uauaaucuuccauacuucuu

SEQ ID NO: 2510598 - RNA, 18 nt, Human
uauaauucuguacugauu

SEQ ID NO: 2510599 - RNA, 15 nt, Human
uauaccugugccucg

SEQ ID NO: 2510600 - RNA, 19 nt, Human
uauaccugugccucggcuu

SEQ ID NO: 2510601 - RNA, 14 nt, Human
uauaauuguaucgu

SEQ ID NO: 2510602 - RNA, 13 nt, Human
uauaauuguaucg

SEQ ID NO: 2510603 - RNA, 18 nt, Human
uauaauuguaucagaggc

SEQ ID NO: 2510604 - RNA, 12 nt, Human
uauaauuguauc

SEQ ID NO: 2510605 - RNA, 22 nt, Human
uauaauuguaucguauagcugu

SEQ ID NO: 2510606 - RNA, 15 nt, Human
uauaauucacauugu

SEQ ID NO: 2510607 - RNA, 18 nt, Human
uauaauuacauauuugca

SEQ ID NO: 2510608 - RNA, 19 nt, Human
uauaauuaucggaagcagu

SEQ ID NO: 2510609 - RNA, 22 nt, Human
uauaauucuguacauagccuau

SEQ ID NO: 2510610 - RNA, 21 nt, Human
uauaauucuguacauagccua

SEQ ID NO: 2510611 - RNA, 20 nt, Human
uauaauucuguacauagccu

SEQ ID NO: 2510612 - RNA, 19 nt, Human
uauaauucuguacauagcc

SEQ ID NO: 2510613 - RNA, 15 nt, Human
uauaauucuguacau

SEQ ID NO: 2510614 - RNA, 14 nt, Human
uauaauucuguaca

SEQ ID NO: 2510615 - RNA, 13 nt, Human
uauaauucuguac

SEQ ID NO: 2510616 - RNA, 16 nt, Human
uauaauucuguaaaug

SEQ ID NO: 2510617 - RNA, 15 nt, Human
uauaauucuguaaau

SEQ ID NO: 2510618 - RNA, 14 nt, Human
uauaauucuguaaa

SEQ ID NO: 2510619 - RNA, 19 nt, Human
uauaaagaagaacuugcau

SEQ ID NO: 2510620 - RNA, 21 nt, Human
uauaaagccuguauucucaaa

SEQ ID NO: 2510621 - RNA, 17 nt, Human
uauaaagauggcugacu

SEQ ID NO: 2510622 - RNA, 14 nt, Human
uauaaaugcuauuu

SEQ ID NO: 2510623 - RNA, 18 nt, Human
uauaaaugccaaagucuu

SEQ ID NO: 2510624 - RNA, 15 nt, Human
uauaaaugcaauauu

SEQ ID NO: 2510625 - RNA, 20 nt, Human
uauaaaucgcuuuugauaau

SEQ ID NO: 2510626 - RNA, 23 nt, Human
uauaaaucgcuuuugauaaucaa

SEQ ID NO: 2510627 - RNA, 21 nt, Human
uauaaaggaaaaaagagaagu

SEQ ID NO: 2510628 - RNA, 17 nt, Human
uaguugagccccaaguc

SEQ ID NO: 2510629 - RNA, 13 nt, Human
uaguugagcccca

SEQ ID NO: 2510630 - RNA, 12 nt, Human
uaguugagcccc

SEQ ID NO: 2510631 - RNA, 23 nt, Human
uaguugagccagcagacauuguc

SEQ ID NO: 2510632 - RNA, 17 nt, Human
uaguugcaauagaacag

SEQ ID NO: 2510633 - RNA, 14 nt, Human
uaguugcaauugaa

SEQ ID NO: 2510634 - RNA, 16 nt, Human
uaguugcaauugaauu

SEQ ID NO: 2510635 - RNA, 17 nt, Human
uaguugcagaaacauuu

SEQ ID NO: 2510636 - RNA, 19 nt, Human
uaguugcagaaacauuuug

SEQ ID NO: 2510637 - RNA, 23 nt, Human
uaguugcagacucaguuugucag

SEQ ID NO: 2510638 - RNA, 18 nt, Human
uaguugcagacucaguuu

SEQ ID NO: 2510639 - RNA, 22 nt, Human
uaguugcguggacucugcacau

SEQ ID NO: 2510640 - RNA, 18 nt, Human
uauaaacuuuaccuuuuu

SEQ ID NO: 2510641 - RNA, 13 nt, Human
uauaaacuuuaga

SEQ ID NO: 2510642 - RNA, 15 nt, Human
uauaaacuuuagagu

SEQ ID NO: 2510643 - RNA, 22 nt, Human
uauaaacuuuagaguagcauga

SEQ ID NO: 2510644 - RNA, 21 nt, Human
uauaaacuuuagaguagcaug

SEQ ID NO: 2510645 - RNA, 15 nt, Human
uauaaagaacaaggu

SEQ ID NO: 2510646 - RNA, 18 nt, Human
uauaaagaagaacuugca

SEQ ID NO: 2510647 - RNA, 22 nt, Human
uauaaagaacaagguaguuuuu

SEQ ID NO: 2510648 - RNA, 22 nt, Human
uauaauaaaaggaaaagcaaau

SEQ ID NO: 2510649 - RNA, 16 nt, Human
uauaaauuauguuuau

SEQ ID NO: 2510650 - RNA, 14 nt, Human
uauaaauuauguuu

SEQ ID NO: 2510651 - RNA, 14 nt, Human
uauaaauuccucuu

SEQ ID NO: 2510652 - RNA, 14 nt, Human
uauaauaaaaggaa

SEQ ID NO: 2510653 - RNA, 13 nt, Human
uauaauaaaagga

SEQ ID NO: 2510654 - RNA, 22 nt, Human
uauaaauuauguuuauauaaau

SEQ ID NO: 2510655 - RNA, 12 nt, Human
uauaauaaaagg

SEQ ID NO: 2510656 - RNA, 16 nt, Human
uauaaaugcuauuuuu

SEQ ID NO: 2510657 - RNA, 16 nt, Human
uauaaaugguguuuuu

SEQ ID NO: 2510658 - RNA, 20 nt, Human
uauaauauacuauauuuaug

SEQ ID NO: 2510659 - RNA, 15 nt, Human
uauaauauauuugug

SEQ ID NO: 2510660 - RNA, 15 nt, Human
uauaauauccuuugu

SEQ ID NO: 2510661 - RNA, 22 nt, Human
uauaauauuuuuaauuaaauaa

SEQ ID NO: 2510662 - RNA, 22 nt, Human
uauaauauauuuguguauuuaa

SEQ ID NO: 2510663 - RNA, 16 nt, Human
uauaauauauuugugu

SEQ ID NO: 2510664 - RNA, 16 nt, Human
uauaauaaauguacau

SEQ ID NO: 2510665 - RNA, 21 nt, Human
uauaauaaaaggaaaagcaaa

SEQ ID NO: 2510666 - RNA, 17 nt, Human
uauaauauacuauauuu

SEQ ID NO: 2510667 - RNA, 15 nt, Human
uauaauacuguauuu

SEQ ID NO: 2510668 - RNA, 12 nt, Human
uaggaauugacc

SEQ ID NO: 2510669 - RNA, 15 nt, Human
uaggaaucagcaaga

SEQ ID NO: 2510670 - RNA, 14 nt, Human
uaggaaucagcaag

SEQ ID NO: 2510671 - RNA, 17 nt, Human
uaggaaugugaaagcac

SEQ ID NO: 2510672 - RNA, 18 nt, Human
uaggaauuaaguuaucuu

SEQ ID NO: 2510673 - RNA, 21 nt, Human
uaggaauucccagcccaaagc

SEQ ID NO: 2510674 - RNA, 16 nt, Human
uaggaauuguguuuau

SEQ ID NO: 2510675 - RNA, 19 nt, Human
uaggaauucuuuuggggaa

SEQ ID NO: 2510676 - RNA, 18 nt, Human
uaggacaaucaguccccu

SEQ ID NO: 2510677 - RNA, 20 nt, Human
uaggacauaaauuagagguc

SEQ ID NO: 2510678 - RNA, 17 nt, Human
uaggaccaagcaucuug

SEQ ID NO: 2510679 - RNA, 20 nt, Human
uaggacaaucaguccccucc

SEQ ID NO: 2510680 - RNA, 23 nt, Human
guggcugcagcagcgguggccuc

SEQ ID NO: 2510681 - RNA, 15 nt, Human
guggcugcagcagcg

SEQ ID NO: 2510682 - RNA, 18 nt, Human
guggcugaggaggccucc

SEQ ID NO: 2510683 - RNA, 17 nt, Human
guggcugaggaggccuc

SEQ ID NO: 2510684 - RNA, 17 nt, Human
guggcugagccccuguc

SEQ ID NO: 2510685 - RNA, 15 nt, Human
guggcugagccccug

SEQ ID NO: 2510686 - RNA, 21 nt, Human
guggcucugaggugccugucc

SEQ ID NO: 2510687 - RNA, 15 nt, Human
guggcucugcuggcc

SEQ ID NO: 2510688 - RNA, 14 nt, Human
guggcugacccagu

SEQ ID NO: 2510689 - RNA, 15 nt, Human
guggcugacccaguc

SEQ ID NO: 2510690 - RNA, 17 nt, Human
guggcugacccaguccc

SEQ ID NO: 2510691 - RNA, 19 nt, Human
guggcugacccagucccug

SEQ ID NO: 2510692 - RNA, 12 nt, Human
uaggaaucagca

SEQ ID NO: 2510693 - RNA, 18 nt, Human
uaggccuggccagaugca

SEQ ID NO: 2510694 - RNA, 21 nt, Human
uaggccuuccucucuccagau

SEQ ID NO: 2510695 - RNA, 16 nt, Human
uaggccugggugcugg

SEQ ID NO: 2510696 - RNA, 19 nt, Human
uaggccugggugcuggcug

SEQ ID NO: 2510697 - RNA, 13 nt, Human
uaggccugggugc

SEQ ID NO: 2510698 - RNA, 19 nt, Human
uaggcccccacuugccucu

SEQ ID NO: 2510699 - RNA, 14 nt, Human
uaggcccccacuug

SEQ ID NO: 2510700 - RNA, 21 nt, Human
uaggcccccacuugccucuuc

SEQ ID NO: 2510701 - RNA, 15 nt, Human
uaggccuggccagau

SEQ ID NO: 2510702 - RNA, 18 nt, Human
uaggaccaagcaucuugg

SEQ ID NO: 2510703 - RNA, 22 nt, Human
uaggaccaagcaucuugggggg

SEQ ID NO: 2510704 - RNA, 16 nt, Human
uaggccaugggacagg

SEQ ID NO: 2510705 - RNA, 18 nt, Human
uaggccaugggacaggga

SEQ ID NO: 2510706 - RNA, 13 nt, Human
uaggacccuuccc

SEQ ID NO: 2510707 - RNA, 15 nt, Human
uaggcucugcacaga

SEQ ID NO: 2510708 - RNA, 18 nt, Human
uaggcucugcacagaugg

SEQ ID NO: 2510709 - RNA, 21 nt, Human
uaggcucugcacagauggauu

SEQ ID NO: 2510710 - RNA, 19 nt, Human
uagggaaaaaccagcgugu

SEQ ID NO: 2510711 - RNA, 20 nt, Human
uagggaaaaaccagcgugug

SEQ ID NO: 2510712 - RNA, 21 nt, Human
uagggaaaaaccagcguguga

SEQ ID NO: 2510713 - RNA, 23 nt, Human
uaggccuuccucucuccagaugu

SEQ ID NO: 2510714 - RNA, 20 nt, Human
uaggccugggugcuggcugc

SEQ ID NO: 2510715 - RNA, 14 nt, Human
uaggcuauucacaa

SEQ ID NO: 2510716 - RNA, 19 nt, Human
uaggcucagagaugugcac

SEQ ID NO: 2510717 - RNA, 15 nt, Human
uaggcuauucacaac

SEQ ID NO: 2510718 - RNA, 22 nt, Human
uaggcuccugccaguguggaac

SEQ ID NO: 2510719 - RNA, 11 nt, Human
uaggcucugca

SEQ ID NO: 2510720 - RNA, 22 nt, Human
uaggcuccgucaguaucaggcc

SEQ ID NO: 2510721 - RNA, 14 nt, Human
uagguacacagcuc

SEQ ID NO: 2510722 - RNA, 13 nt, Human
uagguaacuucau

SEQ ID NO: 2510723 - RNA, 16 nt, Human
uagguaaauuacaguu

SEQ ID NO: 2510724 - RNA, 15 nt, Human
uagguagauguucag

SEQ ID NO: 2510725 - RNA, 14 nt, Human
uagguagauguuca

SEQ ID NO: 2510726 - RNA, 14 nt, Human
uagguaggguuuaa

SEQ ID NO: 2510727 - RNA, 20 nt, Human
uaggcucugcacagauggau

SEQ ID NO: 2510728 - RNA, 20 nt, Human
uagguauaaguggugugugu

SEQ ID NO: 2510729 - RNA, 14 nt, Human
uagguauacagugg

SEQ ID NO: 2510730 - RNA, 11 nt, Human
uagguauuuug

SEQ ID NO: 2510731 - RNA, 16 nt, Human
uaggucaagaagaaga

SEQ ID NO: 2510732 - RNA, 14 nt, Human
uagguauuucaaaa

SEQ ID NO: 2510733 - RNA, 15 nt, Human
uagguaugaauaagu

SEQ ID NO: 2510734 - RNA, 15 nt, Human
uaggucacuccuggg

SEQ ID NO: 2510735 - RNA, 12 nt, Human
uaggucacuggc

SEQ ID NO: 2510736 - RNA, 18 nt, Human
uaggucaagaagaagaug

SEQ ID NO: 2510737 - RNA, 16 nt, Human
uaggucagugcaaaua

SEQ ID NO: 2510738 - RNA, 21 nt, Human
uaggucacuggcucuccaagu

SEQ ID NO: 2510739 - RNA, 20 nt, Human
uaggucacuggcucuccaag

SEQ ID NO: 2510740 - RNA, 19 nt, Human
uaggucacuggcucuccaa

SEQ ID NO: 2510741 - RNA, 14 nt, Human
uaggucacuggcuc

SEQ ID NO: 2510742 - RNA, 24 nt, Human
uaggucacuggcucuccaagugcc

SEQ ID NO: 2510743 - RNA, 14 nt, Human
uaggucagugaggc

SEQ ID NO: 2510744 - RNA, 15 nt, Human
uagugcaaauuguca

SEQ ID NO: 2510745 - RNA, 14 nt, Human
uagugcaaauuguc

SEQ ID NO: 2510746 - RNA, 14 nt, Human
uagucaaauugugu

SEQ ID NO: 2510747 - RNA, 13 nt, Human
uagucaaauugug

SEQ ID NO: 2510748 - RNA, 12 nt, Human
uagugcagcuga

SEQ ID NO: 2510749 - RNA, 13 nt, Human
uagugcagcugau

SEQ ID NO: 2510750 - RNA, 14 nt, Human
uagugcagcugauu

SEQ ID NO: 2510751 - RNA, 15 nt, Human
uagugcagcugauuu

SEQ ID NO: 2510752 - RNA, 17 nt, Human
uagugcagcugauuuua

SEQ ID NO: 2510753 - RNA, 18 nt, Human
uagugcagcugauuuuaa

SEQ ID NO: 2510754 - RNA, 19 nt, Human
uagugcagcugauuuuaac

SEQ ID NO: 2510755 - RNA, 20 nt, Human
uagugcagcugauuuuaaca

SEQ ID NO: 2510756 - RNA, 22 nt, Human
uagugcagcugauuuuaacaau

SEQ ID NO: 2510757 - RNA, 18 nt, Human
uagucaaaccauaaacuu

SEQ ID NO: 2510758 - RNA, 16 nt, Human
uagucaaauuauguau

SEQ ID NO: 2510759 - RNA, 20 nt, Human
uaguugcaacuuuguauaaa

SEQ ID NO: 2510760 - RNA, 22 nt, Human
uaguugagccagcagacauugu

SEQ ID NO: 2510761 - RNA, 21 nt, Human
uaguugagccagcagacauug

SEQ ID NO: 2510762 - RNA, 20 nt, Human
uaguugagccagcagacauu

SEQ ID NO: 2510763 - RNA, 19 nt, Human
uaguugagccagcagacau

SEQ ID NO: 2510764 - RNA, 17 nt, Human
uaguugagccagcagac

SEQ ID NO: 2510765 - RNA, 23 nt, Human
uaguguuaaucaauuuaaaccca

SEQ ID NO: 2510766 - RNA, 16 nt, Human
uaguguuaaucaauuu

SEQ ID NO: 2510767 - RNA, 15 nt, Human
uaguguuaaucaauu

SEQ ID NO: 2510768 - RNA, 14 nt, Human
uaguguuaaucaau

SEQ ID NO: 2510769 - RNA, 20 nt, Human
uaguguguucugauuagaaa

SEQ ID NO: 2510770 - RNA, 12 nt, Human
uaguguuaauca

SEQ ID NO: 2510771 - RNA, 19 nt, Human
uaguguguucugauuagaa

SEQ ID NO: 2510772 - RNA, 18 nt, Human
uaguguggaaauuaagaa

SEQ ID NO: 2510773 - RNA, 22 nt, Human
uaguguggaaauuaagaagaaa

SEQ ID NO: 2510774 - RNA, 15 nt, Human
uaguguguucugauu

SEQ ID NO: 2510775 - RNA, 13 nt, Human
uagugcuaagugu

SEQ ID NO: 2510776 - RNA, 17 nt, Human
uagugucacuuaccuag

SEQ ID NO: 2510777 - RNA, 12 nt, Human
uagugucuauca

SEQ ID NO: 2510778 - RNA, 17 nt, Human
uagugcggacaaguuuu

SEQ ID NO: 2510779 - RNA, 19 nt, Human
uagugcggacaaguuuuaa

SEQ ID NO: 2510780 - RNA, 16 nt, Human
uagugccuucuaaagg

SEQ ID NO: 2510781 - RNA, 19 nt, Human
uagugccuucuaaaggugu

SEQ ID NO: 2510782 - RNA, 14 nt, Human
uagugcggacaagu

SEQ ID NO: 2510783 - RNA, 23 nt, Human
uagugcccuccacagccgcagcc

SEQ ID NO: 2510784 - RNA, 22 nt, Human
uagugccugagaguauuuaggc

SEQ ID NO: 2510785 - RNA, 17 nt, Human
uagugcccuccacagcc

SEQ ID NO: 2510786 - RNA, 19 nt, Human
uaguauuucuaugaaauau

SEQ ID NO: 2510787 - RNA, 18 nt, Human
uaguauuucuaugaaaua

SEQ ID NO: 2510788 - RNA, 16 nt, Human
uaguaucuagcaauca

SEQ ID NO: 2510789 - RNA, 16 nt, Human
uaguauuucuaugaaa

SEQ ID NO: 2510790 - RNA, 23 nt, Human
uaguauccuccagguuuuucaau

SEQ ID NO: 2510791 - RNA, 22 nt, Human
uaguauccuccagguuuuucaa

SEQ ID NO: 2510792 - RNA, 21 nt, Human
uaguauccuccagguuuuuca

SEQ ID NO: 2510793 - RNA, 20 nt, Human
uaguauccuccagguuuuuc

SEQ ID NO: 2510794 - RNA, 19 nt, Human
uaguauccuccagguuuuu

SEQ ID NO: 2510795 - RNA, 18 nt, Human
uaguauccuccagguuuu

SEQ ID NO: 2510796 - RNA, 17 nt, Human
uaguauccuccagguuu

SEQ ID NO: 2510797 - RNA, 16 nt, Human
uaguauccuccagguu

SEQ ID NO: 2510798 - RNA, 19 nt, Human
uaguaucuagcaaucacaa

SEQ ID NO: 2510799 - RNA, 14 nt, Human
uaguaucuaacaug

SEQ ID NO: 2510800 - RNA, 15 nt, Human
uaguaucuaacaugu

SEQ ID NO: 2510801 - RNA, 13 nt, Human
uaguaucaaaaga

SEQ ID NO: 2510802 - RNA, 19 nt, Human
uaguaguuccugcuacaac

SEQ ID NO: 2510803 - RNA, 14 nt, Human
uaguauaaagaaaa

SEQ ID NO: 2510804 - RNA, 16 nt, Human
uaguauaaagaaaagu

SEQ ID NO: 2510805 - RNA, 19 nt, Human
uaguauacauugucucuaa

SEQ ID NO: 2510806 - RNA, 15 nt, Human
uaguauccuccaggu

SEQ ID NO: 2510807 - RNA, 14 nt, Human
uaguauccuccagg

SEQ ID NO: 2510808 - RNA, 13 nt, Human
uaguauccuccag

SEQ ID NO: 2510809 - RNA, 21 nt, Human
uaguaucaaauauuagaugug

SEQ ID NO: 2510810 - RNA, 20 nt, Human
uaguaucaaauauuagaugu

SEQ ID NO: 2510811 - RNA, 14 nt, Human
uaguaucaaauauu

SEQ ID NO: 2510812 - RNA, 12 nt, Human
uaguauccucca

SEQ ID NO: 2510813 - RNA, 23 nt, Human
uaguaucaaauauuagaugugau

SEQ ID NO: 2510814 - RNA, 19 nt, Human
uaguauaucuggacaagcc

SEQ ID NO: 2510815 - RNA, 16 nt, Human
uaguauaucuggacaa

SEQ ID NO: 2510816 - RNA, 21 nt, Human
uaggugauccacucgccuuca

SEQ ID NO: 2510817 - RNA, 23 nt, Human
uaggugacagagugagacucugu

SEQ ID NO: 2510818 - RNA, 21 nt, Human
uaggugaucucauuuaauccu

SEQ ID NO: 2510819 - RNA, 18 nt, Human
uaggugcuacaaaaacac

SEQ ID NO: 2510820 - RNA, 19 nt, Human
uaggugcccuuggaggcca

SEQ ID NO: 2510821 - RNA, 18 nt, Human
uaguaguaugaugauaca

SEQ ID NO: 2510822 - RNA, 15 nt, Human
uauuaucaacaauag

SEQ ID NO: 2510823 - RNA, 16 nt, Human
uauuaucaugcaaaug

SEQ ID NO: 2510824 - RNA, 18 nt, Human
uauuaucaugcaaaugcu

SEQ ID NO: 2510825 - RNA, 22 nt, Human
uauuaucaugcaaaugcuguau

SEQ ID NO: 2510826 - RNA, 16 nt, Human
uauuauccccauuucu

SEQ ID NO: 2510827 - RNA, 24 nt, Human
uauuaugcccaguuucugccucug

SEQ ID NO: 2510828 - RNA, 14 nt, Human
uauuaugcuucuug

SEQ ID NO: 2510829 - RNA, 13 nt, Human
uauuaugcuucuu

SEQ ID NO: 2510830 - RNA, 21 nt, Human
uauuauggaagauuuuaaauu

SEQ ID NO: 2510831 - RNA, 16 nt, Human
uauuauguuaaaacug

SEQ ID NO: 2510832 - RNA, 17 nt, Human
uauuaugucucuucuga

SEQ ID NO: 2510833 - RNA, 20 nt, Human
uauuauggaggcaggaguuu

SEQ ID NO: 2510834 - RNA, 22 nt, Human
uauuauuucuaggaagaauuuu

SEQ ID NO: 2510835 - RNA, 20 nt, Human
uauuauuucuaggaagaauu

SEQ ID NO: 2510836 - RNA, 19 nt, Human
uauuauuucuaggaagaau

SEQ ID NO: 2510837 - RNA, 16 nt, Human
uauuauuucaauguga

SEQ ID NO: 2510838 - RNA, 14 nt, Human
uauuauuuguguuu

SEQ ID NO: 2510839 - RNA, 15 nt, Human
uauuauuuucaccug

SEQ ID NO: 2510840 - RNA, 12 nt, Human
uauuauuuucca

SEQ ID NO: 2510841 - RNA, 16 nt, Human
uauuauuuucaccugu

SEQ ID NO: 2510842 - RNA, 12 nt, Human
uauuauguguuu

SEQ ID NO: 2510843 - RNA, 16 nt, Human
uauuauugaaauugua

SEQ ID NO: 2510844 - RNA, 12 nt, Human
uauuauuguucu

SEQ ID NO: 2510845 - RNA, 13 nt, Human
uauuauuuauaua

SEQ ID NO: 2510846 - RNA, 21 nt, Human
uauuaugucucuucugagcua

SEQ ID NO: 2510847 - RNA, 15 nt, Human
uauuauuguguguua

SEQ ID NO: 2510848 - RNA, 17 nt, Human
uauuauauuuacaaaug

SEQ ID NO: 2510849 - RNA, 19 nt, Human
uauuauacuguauuaagag

SEQ ID NO: 2510850 - RNA, 15 nt, Human
uauuauacuguauua

SEQ ID NO: 2510851 - RNA, 14 nt, Human
uauuauacuguauu

SEQ ID NO: 2510852 - RNA, 13 nt, Human
uauuauacuguau

SEQ ID NO: 2510853 - RNA, 14 nt, Human
uauuauaccuuuuu

SEQ ID NO: 2510854 - RNA, 19 nt, Human
uauuauaauuuuuuucaau

SEQ ID NO: 2510855 - RNA, 14 nt, Human
uauuauaauuguau

SEQ ID NO: 2510856 - RNA, 15 nt, Human
uauuauacuaagaaa

SEQ ID NO: 2510857 - RNA, 18 nt, Human
uauuauacuaagaaaaga

SEQ ID NO: 2510858 - RNA, 19 nt, Human
uauuauacuaagaaaagau

SEQ ID NO: 2510859 - RNA, 12 nt, Human
uauuauaccuuu

SEQ ID NO: 2510860 - RNA, 13 nt, Human
uauuauaccuuuu

SEQ ID NO: 2510861 - RNA, 15 nt, Human
uauuauaacuuaaaa

SEQ ID NO: 2510862 - RNA, 12 nt, Human
uauuauaauuua

SEQ ID NO: 2510863 - RNA, 15 nt, Human
uauuauaauuuaaug

SEQ ID NO: 2510864 - RNA, 19 nt, Human
uauuaauaaacauucuauc

SEQ ID NO: 2510865 - RNA, 16 nt, Human
uauuauaacuuaaaaa

SEQ ID NO: 2510866 - RNA, 17 nt, Human
uauuaagauuuccaagu

SEQ ID NO: 2510867 - RNA, 15 nt, Human
uauuaagauuuccaa

SEQ ID NO: 2510868 - RNA, 14 nt, Human
uauuaaggaagaca

SEQ ID NO: 2510869 - RNA, 15 nt, Human
uauuaaguuguuaau

SEQ ID NO: 2510870 - RNA, 12 nt, Human
uauguuaaaacu

SEQ ID NO: 2510871 - RNA, 14 nt, Human
uauguguuggcuug

SEQ ID NO: 2510872 - RNA, 21 nt, Human
uauguuaaacuagcauaucug

SEQ ID NO: 2510873 - RNA, 20 nt, Human
uauguuaaacuagcauaucu

SEQ ID NO: 2510874 - RNA, 19 nt, Human
uauguuaaccucaguguca

SEQ ID NO: 2510875 - RNA, 20 nt, Human
uauguuaaccucagugucau

SEQ ID NO: 2510876 - RNA, 22 nt, Human
uauguuaaccucagugucauuu

SEQ ID NO: 2510877 - RNA, 15 nt, Human
uauguguuuuucaca

SEQ ID NO: 2510878 - RNA, 16 nt, Human
uauguguuuuucacau

SEQ ID NO: 2510879 - RNA, 15 nt, Human
uauguguuugugugu

SEQ ID NO: 2510880 - RNA, 17 nt, Human
uauguguuuuucacauu

SEQ ID NO: 2510881 - RNA, 18 nt, Human
uauguuacuacaugcacu

SEQ ID NO: 2510882 - RNA, 18 nt, Human
uauguuaagcucuuuaug

SEQ ID NO: 2510883 - RNA, 14 nt, Human
uauguuaagcucuu

SEQ ID NO: 2510884 - RNA, 19 nt, Human
uauguuaagggaagaauuc

SEQ ID NO: 2510885 - RNA, 15 nt, Human
uauguuaaguuacuu

SEQ ID NO: 2510886 - RNA, 19 nt, Human
uauguuaagcucuuuauga

SEQ ID NO: 2510887 - RNA, 19 nt, Human
uauguuagugcaaauuguc

SEQ ID NO: 2510888 - RNA, 14 nt, Human
uauguuauaucaac

SEQ ID NO: 2510889 - RNA, 19 nt, Human
uauguuacaucuguuuuaa

SEQ ID NO: 2510890 - RNA, 22 nt, Human
uauguuacaucuguuuuaaauu

SEQ ID NO: 2510891 - RNA, 18 nt, Human
uauggagcccuguaauuu

SEQ ID NO: 2510892 - RNA, 15 nt, Human
uauggacucugcaca

SEQ ID NO: 2510893 - RNA, 21 nt, Human
uauggacggugcuccaggcag

SEQ ID NO: 2510894 - RNA, 15 nt, Human
uauggagagaaaaca

SEQ ID NO: 2510895 - RNA, 14 nt, Human
uauggaggcaggag

SEQ ID NO: 2510896 - RNA, 16 nt, Human
uauggacucugcacau

SEQ ID NO: 2510897 - RNA, 21 nt, Human
uauggacuaucugucuggugg

SEQ ID NO: 2510898 - RNA, 12 nt, Human
uauggacucugc

SEQ ID NO: 2510899 - RNA, 18 nt, Human
uauggacuaucugucugg

SEQ ID NO: 2510900 - RNA, 17 nt, Human
uauggacuaucugucug

SEQ ID NO: 2510901 - RNA, 13 nt, Human
uauggacuaucug

SEQ ID NO: 2510902 - RNA, 16 nt, Human
uauggacggugcucca

SEQ ID NO: 2510903 - RNA, 13 nt, Human
uauguguguuuua

SEQ ID NO: 2510904 - RNA, 21 nt, Human
uauguguguuuaaauaaagua

SEQ ID NO: 2510905 - RNA, 20 nt, Human
uauguguguuuaaauaaagu

SEQ ID NO: 2510906 - RNA, 17 nt, Human
uauguguguuuaaauaa

SEQ ID NO: 2510907 - RNA, 14 nt, Human
uauguguguuuaaa

SEQ ID NO: 2510908 - RNA, 13 nt, Human
uauguguguuuaa

SEQ ID NO: 2510909 - RNA, 19 nt, Human
uauggaggcuuugcauaga

SEQ ID NO: 2510910 - RNA, 18 nt, Human
uauggagcucagagaggg

SEQ ID NO: 2510911 - RNA, 17 nt, Human
uauggagcucagagagg

SEQ ID NO: 2510912 - RNA, 13 nt, Human
uauggauaaugcc

SEQ ID NO: 2510913 - RNA, 15 nt, Human
uauggaggauggaga

SEQ ID NO: 2510914 - RNA, 16 nt, Human
uauuaagaaagacuau

SEQ ID NO: 2510915 - RNA, 23 nt, Human
uauuaacaacaauaacacugucu

SEQ ID NO: 2510916 - RNA, 18 nt, Human
uauuaacaaauuauguua

SEQ ID NO: 2510917 - RNA, 23 nt, Human
uauuaacaaacaucacucugcug

SEQ ID NO: 2510918 - RNA, 16 nt, Human
uauuaacaaauuaugu

SEQ ID NO: 2510919 - RNA, 23 nt, Human
uauuaaauauaugauuagccagg

SEQ ID NO: 2510920 - RNA, 19 nt, Human
uauuaaaugcccagccccu

SEQ ID NO: 2510921 - RNA, 17 nt, Human
uauuaaaugcccagccc

SEQ ID NO: 2510922 - RNA, 15 nt, Human
uauuaaaugcccagc

SEQ ID NO: 2510923 - RNA, 21 nt, Human
uauuaaauacagacacuaagu

SEQ ID NO: 2510924 - RNA, 18 nt, Human
uauuaaauacagacacua

SEQ ID NO: 2510925 - RNA, 17 nt, Human
uauuaaauacagacacu

SEQ ID NO: 2510926 - RNA, 13 nt, Human
uauuaaauacaga

SEQ ID NO: 2510927 - RNA, 16 nt, Human
uauguuguguucuaau

SEQ ID NO: 2510928 - RNA, 12 nt, Human
uauguugaauac

SEQ ID NO: 2510929 - RNA, 15 nt, Human
uauguugaauacuuu

SEQ ID NO: 2510930 - RNA, 17 nt, Human
uauguugaagccuuugu

SEQ ID NO: 2510931 - RNA, 21 nt, Human
uauguugcccaggcaggucuu

SEQ ID NO: 2510932 - RNA, 21 nt, Human
uauguuguccaauuguugaca

SEQ ID NO: 2510933 - RNA, 16 nt, Human
uauguuguccaauugu

SEQ ID NO: 2510934 - RNA, 16 nt, Human
uauguugucaaagaga

SEQ ID NO: 2510935 - RNA, 20 nt, Human
uauguugcucagucucccuu

SEQ ID NO: 2510936 - RNA, 17 nt, Human
uauguugcucagucucc

SEQ ID NO: 2510937 - RNA, 14 nt, Human
uauguugcucaguc

SEQ ID NO: 2510938 - RNA, 13 nt, Human
uauguugucaaag

SEQ ID NO: 2510939 - RNA, 20 nt, Human
uauguugccuuuaugguuuc

SEQ ID NO: 2510940 - RNA, 18 nt, Human
uauguugccuuuaugguu

SEQ ID NO: 2510941 - RNA, 14 nt, Human
uauguugccuuuau

SEQ ID NO: 2510942 - RNA, 18 nt, Human
uauguugguagauucuaa

SEQ ID NO: 2510943 - RNA, 17 nt, Human
uauguucuaagaaguga

SEQ ID NO: 2510944 - RNA, 14 nt, Human
uauguucacaccua

SEQ ID NO: 2510945 - RNA, 22 nt, Human
uauguucuuaguggauguucug

SEQ ID NO: 2510946 - RNA, 13 nt, Human
uauguucacuguc

SEQ ID NO: 2510947 - RNA, 13 nt, Human
uauuguugguaau

SEQ ID NO: 2510948 - RNA, 15 nt, Human
uauuguuuaaaauca

SEQ ID NO: 2510949 - RNA, 16 nt, Human
uauuguuuaaaaucau

SEQ ID NO: 2510950 - RNA, 17 nt, Human
uauuguuuaaaaucauu

SEQ ID NO: 2510951 - RNA, 14 nt, Human
uauuguguugugaa

SEQ ID NO: 2510952 - RNA, 17 nt, Human
uauuguuccagcaguuu

SEQ ID NO: 2510953 - RNA, 23 nt, Human
uauuguuccagcaguuuucaagu

SEQ ID NO: 2510954 - RNA, 13 nt, Human
uauuguucccagu

SEQ ID NO: 2510955 - RNA, 17 nt, Human
uauuguucccagugaca

SEQ ID NO: 2510956 - RNA, 21 nt, Human
uauuguucccagugacacuuc

SEQ ID NO: 2510957 - RNA, 18 nt, Human
uauugugucuuuugcaug

SEQ ID NO: 2510958 - RNA, 16 nt, Human
uauugugucuuuugca

SEQ ID NO: 2510959 - RNA, 17 nt, Human
uauuguguguuauuuaa

SEQ ID NO: 2510960 - RNA, 19 nt, Human
uauugugucuuuugcauga

SEQ ID NO: 2510961 - RNA, 19 nt, Human
uauuguguguuauuuaaau

SEQ ID NO: 2510962 - RNA, 13 nt, Human
uauugcccagguu

SEQ ID NO: 2510963 - RNA, 15 nt, Human
uauugcccacgcugg

SEQ ID NO: 2510964 - RNA, 14 nt, Human
uauugcccacgcug

SEQ ID NO: 2510965 - RNA, 13 nt, Human
uauugcccacgcu

SEQ ID NO: 2510966 - RNA, 12 nt, Human
uauugcuggggu

SEQ ID NO: 2510967 - RNA, 11 nt, Human
uauugcugggg

SEQ ID NO: 2510968 - RNA, 22 nt, Human
uauugcugcugguaauuuguau

SEQ ID NO: 2510969 - RNA, 22 nt, Human
uauugcugauggugcaaugacc

SEQ ID NO: 2510970 - RNA, 23 nt, Human
uauugcugauggugcaaugaccu

SEQ ID NO: 2510971 - RNA, 23 nt, Human
uauugcuucuucuccuaugugua

SEQ ID NO: 2510972 - RNA, 21 nt, Human
uauugcuugauacuuuugaca

SEQ ID NO: 2510973 - RNA, 15 nt, Human
uauugcuugcacaaa

SEQ ID NO: 2510974 - RNA, 15 nt, Human
uauugcauuaauuuu

SEQ ID NO: 2510975 - RNA, 21 nt, Human
uauugcaucuguauaaguaag

SEQ ID NO: 2510976 - RNA, 22 nt, Human
uauugcauuuggauuggggucc

SEQ ID NO: 2510977 - RNA, 19 nt, Human
uauugcaguuuaucauuca

SEQ ID NO: 2510978 - RNA, 20 nt, Human
uauugcaguuuaucauucaa

SEQ ID NO: 2510979 - RNA, 17 nt, Human
uauugcaucuguauaag

SEQ ID NO: 2510980 - RNA, 16 nt, Human
uauugcaucuguauaa

SEQ ID NO: 2510981 - RNA, 15 nt, Human
uauugcaucuguaua

SEQ ID NO: 2510982 - RNA, 14 nt, Human
uauugcaucuguau

SEQ ID NO: 2510983 - RNA, 22 nt, Human
uauugcaucuggguagcuguaa

SEQ ID NO: 2510984 - RNA, 15 nt, Human
uauugcaguuauaga

SEQ ID NO: 2510985 - RNA, 15 nt, Human
uauugcauaugcaua

SEQ ID NO: 2510986 - RNA, 22 nt, Human
uauugcacaugucuuaaugaag

SEQ ID NO: 2510987 - RNA, 20 nt, Human
uauugcacaugucuuaauga

SEQ ID NO: 2510988 - RNA, 17 nt, Human
uauugcacaugucuuaa

SEQ ID NO: 2510989 - RNA, 16 nt, Human
uauugcacaugucuua

SEQ ID NO: 2510990 - RNA, 14 nt, Human
uauugcacaugucu

SEQ ID NO: 2510991 - RNA, 12 nt, Human
uauugcacaugu

SEQ ID NO: 2510992 - RNA, 15 nt, Human
uauugcaguuuauca

SEQ ID NO: 2510993 - RNA, 13 nt, Human
uauugcaguuuau

SEQ ID NO: 2510994 - RNA, 11 nt, Human
uauugcaguuu

SEQ ID NO: 2510995 - RNA, 17 nt, Human
uauugcacauuguaaaa

SEQ ID NO: 2510996 - RNA, 13 nt, Human
uauugcacauugu

SEQ ID NO: 2510997 - RNA, 23 nt, Human
uauugcacaugucuuaaugaagu

SEQ ID NO: 2510998 - RNA, 22 nt, Human
uauugcagcgauuaauaacagg

SEQ ID NO: 2510999 - RNA, 14 nt, Human
uauugauaacagca

SEQ ID NO: 2511000 - RNA, 18 nt, Human
uauugauaacagcacuga

SEQ ID NO: 2511001 - RNA, 20 nt, Human
uauugauaugcuuauacacu

SEQ ID NO: 2511002 - RNA, 14 nt, Human
uauucaugcuucuu

SEQ ID NO: 2511003 - RNA, 17 nt, Human
uauuauuuuuuccacau

SEQ ID NO: 2511004 - RNA, 15 nt, Human
uauucaucucaagga

SEQ ID NO: 2511005 - RNA, 14 nt, Human
uauuauuuuccaaa

SEQ ID NO: 2511006 - RNA, 13 nt, Human
uauuauuuuccaa

SEQ ID NO: 2511007 - RNA, 20 nt, Human
uauucauugaagucagaugu

SEQ ID NO: 2511008 - RNA, 13 nt, Human
uauucauguaaac

SEQ ID NO: 2511009 - RNA, 15 nt, Human
uauucauuuaaaaug

SEQ ID NO: 2511010 - RNA, 14 nt, Human
uauucauuuaaaau

SEQ ID NO: 2511011 - RNA, 13 nt, Human
uauucauuuaaaa

SEQ ID NO: 2511012 - RNA, 12 nt, Human
uauucauuuaaa

SEQ ID NO: 2511013 - RNA, 17 nt, Human
uauucauuuaaaaugau

SEQ ID NO: 2511014 - RNA, 16 nt, Human
uauucauuuaaaauga

SEQ ID NO: 2511015 - RNA, 19 nt, Human
uauucauuuaaaaugauua

SEQ ID NO: 2511016 - RNA, 14 nt, Human
uauuuauuacugua

SEQ ID NO: 2511017 - RNA, 22 nt, Human
uauuuauuaaaugcccagcccc

SEQ ID NO: 2511018 - RNA, 23 nt, Human
uauuuauuaaacagauuuuuaca

SEQ ID NO: 2511019 - RNA, 13 nt, Human
uauuuauguuugc

SEQ ID NO: 2511020 - RNA, 21 nt, Human
uauuuaugucuauuuaagccu

SEQ ID NO: 2511021 - RNA, 14 nt, Human
uauuuaugugugag

SEQ ID NO: 2511022 - RNA, 13 nt, Human
uauuucuaugaaa

SEQ ID NO: 2511023 - RNA, 20 nt, Human
uauuuauucaauaaaguauu

SEQ ID NO: 2511024 - RNA, 19 nt, Human
uauuuauucaauaaaguau

SEQ ID NO: 2511025 - RNA, 18 nt, Human
uauuuauucaauaaagua

SEQ ID NO: 2511026 - RNA, 16 nt, Human
uauuuauucaauaaag

SEQ ID NO: 2511027 - RNA, 14 nt, Human
uauuuauuauuuau

SEQ ID NO: 2511028 - RNA, 13 nt, Human
uauuuauuacugu

SEQ ID NO: 2511029 - RNA, 14 nt, Human
uauuuauucaauaa

SEQ ID NO: 2511030 - RNA, 13 nt, Human
uauuuauucaaua

SEQ ID NO: 2511031 - RNA, 12 nt, Human
uauuuauucaau

SEQ ID NO: 2511032 - RNA, 19 nt, Human
uauuuauuauuuucaccug

SEQ ID NO: 2511033 - RNA, 18 nt, Human
uauuugaaucuugucuca

SEQ ID NO: 2511034 - RNA, 16 nt, Human
uauuugaaucuugucu

SEQ ID NO: 2511035 - RNA, 14 nt, Human
uauuugaaucuugu

SEQ ID NO: 2511036 - RNA, 12 nt, Human
uauuugaaucuu

SEQ ID NO: 2511037 - RNA, 20 nt, Human
uauuugaaucuugucucaau

SEQ ID NO: 2511038 - RNA, 19 nt, Human
uauuugaaucuugucucaa

SEQ ID NO: 2511039 - RNA, 21 nt, Human
uauuugaauguaugcuucaua

SEQ ID NO: 2511040 - RNA, 14 nt, Human
uauuugaaggccag

SEQ ID NO: 2511041 - RNA, 19 nt, Human
uauuugaaacugaauguuu

SEQ ID NO: 2511042 - RNA, 22 nt, Human
uauuugaaaacauauaaagcac

SEQ ID NO: 2511043 - RNA, 15 nt, Human
uauuucuaugaaaua

SEQ ID NO: 2511044 - RNA, 14 nt, Human
uauuucuaugaaau

SEQ ID NO: 2511045 - RNA, 14 nt, Human
uauuucuuuguuau

SEQ ID NO: 2511046 - RNA, 19 nt, Human
uauuugaaaacauauaaag

SEQ ID NO: 2511047 - RNA, 13 nt, Human
uauuucuuuguua

SEQ ID NO: 2511048 - RNA, 22 nt, Human
uauuuaaagacagggaagagca

SEQ ID NO: 2511049 - RNA, 14 nt, Human
uauuuaaagacagg

SEQ ID NO: 2511050 - RNA, 11 nt, Human
uauuguuucua

SEQ ID NO: 2511051 - RNA, 14 nt, Human
uauuuaaaugucua

SEQ ID NO: 2511052 - RNA, 12 nt, Human
uauuuaaauguc

SEQ ID NO: 2511053 - RNA, 22 nt, Human
uauuuaaauauuaaauauguua

SEQ ID NO: 2511054 - RNA, 19 nt, Human
uauuuaaaugucuaaugua

SEQ ID NO: 2511055 - RNA, 15 nt, Human
uauuuaacaagaucu

SEQ ID NO: 2511056 - RNA, 20 nt, Human
uauuuaaaugucuaauguau

SEQ ID NO: 2511057 - RNA, 17 nt, Human
uauuuauauauuuauaa

SEQ ID NO: 2511058 - RNA, 18 nt, Human
uauuuauauauuuauaac

SEQ ID NO: 2511059 - RNA, 19 nt, Human
uauuuauauauuuauaacu

SEQ ID NO: 2511060 - RNA, 17 nt, Human
uauuguuuaaagcaacu

SEQ ID NO: 2511061 - RNA, 11 nt, Human
uauuguuuaaa

SEQ ID NO: 2511062 - RNA, 20 nt, Human
uauuguuuaaaaucauuucu

SEQ ID NO: 2511063 - RNA, 24 nt, Human
uauuguuuauucuuuuuaaaguau

SEQ ID NO: 2511064 - RNA, 22 nt, Human
uauuguuuauucuuuuuaaagu

SEQ ID NO: 2511065 - RNA, 22 nt, Human
uauuguuuaaagcaacugucua

SEQ ID NO: 2511066 - RNA, 12 nt, Human
uauuguuucaau

SEQ ID NO: 2511067 - RNA, 18 nt, Human
uauuguuucaauugcauc

SEQ ID NO: 2511068 - RNA, 12 nt, Human
uauuuaaagaca

SEQ ID NO: 2511069 - RNA, 13 nt, Human
uauuuaaagacaa

SEQ ID NO: 2511070 - RNA, 17 nt, Human
uauuuaaagacaaagac

SEQ ID NO: 2511071 - RNA, 18 nt, Human
uauuuaaagacaaagaca

SEQ ID NO: 2511072 - RNA, 17 nt, Human
uauuuauauguacauga

SEQ ID NO: 2511073 - RNA, 15 nt, Human
uauuuauauguacau

SEQ ID NO: 2511074 - RNA, 13 nt, Human
uauuuauauauuu

SEQ ID NO: 2511075 - RNA, 14 nt, Human
uauuuauauuucac

SEQ ID NO: 2511076 - RNA, 15 nt, Human
uauuuauauuucacu

SEQ ID NO: 2511077 - RNA, 16 nt, Human
uauuuauauuucacua

SEQ ID NO: 2511078 - RNA, 13 nt, Human
uauuuaucaguga

SEQ ID NO: 2511079 - RNA, 21 nt, Human
uauuuauauuuuuauuuuauu

SEQ ID NO: 2511080 - RNA, 15 nt, Human
uauuuaucagugaca

SEQ ID NO: 2511081 - RNA, 18 nt, Human
uauuuaucagugacagag

SEQ ID NO: 2511082 - RNA, 12 nt, Human
uauuuaucuuua

SEQ ID NO: 2511083 - RNA, 22 nt, Human
uauuuaucuguguuuuugaaau

SEQ ID NO: 2511084 - RNA, 17 nt, Human
uauuuaucucuauuuaa

SEQ ID NO: 2511085 - RNA, 21 nt, Human
uauuuaucuguaguaaacuau

SEQ ID NO: 2511086 - RNA, 20 nt, Human
uauuuaucugugcaaauccu

SEQ ID NO: 2511087 - RNA, 16 nt, Human
uauuuaucugauuaag

SEQ ID NO: 2511088 - RNA, 21 nt, Human
uauuuaucugauuaaguuguc

SEQ ID NO: 2511089 - RNA, 15 nt, Human
uauuuaucugauuaa

SEQ ID NO: 2511090 - RNA, 16 nt, Human
uauuuaucucuauuua

SEQ ID NO: 2511091 - RNA, 17 nt, Human
uauuuaugggauccugg

SEQ ID NO: 2511092 - RNA, 20 nt, Human
uauuuaugccucuguauuua

SEQ ID NO: 2511093 - RNA, 21 nt, Human
ucaccgaaaacguggcugcuu

SEQ ID NO: 2511094 - RNA, 20 nt, Human
ucaccgaaaacguggcugcu

SEQ ID NO: 2511095 - RNA, 19 nt, Human
ucaccgaaaacguggcugc

SEQ ID NO: 2511096 - RNA, 15 nt, Human
ucaccgaaaacgugg

SEQ ID NO: 2511097 - RNA, 23 nt, Human
ucaccgaaaacguggcugcuuca

SEQ ID NO: 2511098 - RNA, 22 nt, Human
ucaccgaaaacguggcugcuuc

SEQ ID NO: 2511099 - RNA, 17 nt, Human
ucaccgacgcgucuccu

SEQ ID NO: 2511100 - RNA, 15 nt, Human
ucaccgaagccacuu

SEQ ID NO: 2511101 - RNA, 22 nt, Human
ucacccuuugcugugaggcugu

SEQ ID NO: 2511102 - RNA, 15 nt, Human
ucacccuuugcugug

SEQ ID NO: 2511103 - RNA, 13 nt, Human
ucacccuuugcug

SEQ ID NO: 2511104 - RNA, 20 nt, Human
ucaccgcagucgucgcacag

SEQ ID NO: 2511105 - RNA, 19 nt, Human
ucaccgcagucgucgcaca

SEQ ID NO: 2511106 - RNA, 16 nt, Human
ucaccgagugggggca

SEQ ID NO: 2511107 - RNA, 20 nt, Human
ucaccgagaguagccgagag

SEQ ID NO: 2511108 - RNA, 23 nt, Human
ucaccgagaguagccgagagccu

SEQ ID NO: 2511109 - RNA, 13 nt, Human
ucacccugagccc

SEQ ID NO: 2511110 - RNA, 20 nt, Human
ucacccuccaccucuucacc

SEQ ID NO: 2511111 - RNA, 18 nt, Human
ucacccucguuuccagug

SEQ ID NO: 2511112 - RNA, 15 nt, Human
ucacccuccaccucu

SEQ ID NO: 2511113 - RNA, 14 nt, Human
ucacccuccaccuc

SEQ ID NO: 2511114 - RNA, 13 nt, Human
ucacccuccaccu

SEQ ID NO: 2511115 - RNA, 18 nt, Human
ucacccguccagaccuug

SEQ ID NO: 2511116 - RNA, 15 nt, Human
ucacccugccuuauc

SEQ ID NO: 2511117 - RNA, 13 nt, Human
ucacccugccuua

SEQ ID NO: 2511118 - RNA, 21 nt, Human
ucacccugagccccuuccuug

SEQ ID NO: 2511119 - RNA, 19 nt, Human
ucacccugagccccuuccu

SEQ ID NO: 2511120 - RNA, 23 nt, Human
ucacccugauuuaggagaagcca

SEQ ID NO: 2511121 - RNA, 19 nt, Human
ucacccgcuaagagggagg

SEQ ID NO: 2511122 - RNA, 17 nt, Human
ucacccuaccugugccu

SEQ ID NO: 2511123 - RNA, 15 nt, Human
ucacccuaccugugc

SEQ ID NO: 2511124 - RNA, 15 nt, Human
ucacccguccagacc

SEQ ID NO: 2511125 - RNA, 14 nt, Human
ucaccgaaaacgug

SEQ ID NO: 2511126 - RNA, 12 nt, Human
ucacccuuuucu

SEQ ID NO: 2511127 - RNA, 20 nt, Human
ucacccuggggcuaggaaau

SEQ ID NO: 2511128 - RNA, 13 nt, Human
ucacccuguccaa

SEQ ID NO: 2511129 - RNA, 18 nt, Human
ucacccuuaccaugugcc

SEQ ID NO: 2511130 - RNA, 19 nt, Human
ucacccuuaccaugugccu

SEQ ID NO: 2511131 - RNA, 21 nt, Human
ucacccuguccaaacugccua

SEQ ID NO: 2511132 - RNA, 22 nt, Human
ucacauuguauucagaguugau

SEQ ID NO: 2511133 - RNA, 12 nt, Human
ucacauuuaaau

SEQ ID NO: 2511134 - RNA, 18 nt, Human
ucaccaacgucugugcca

SEQ ID NO: 2511135 - RNA, 17 nt, Human
ucaccaacgucugugcc

SEQ ID NO: 2511136 - RNA, 14 nt, Human
ucacauuuauucug

SEQ ID NO: 2511137 - RNA, 21 nt, Human
ucaccaaaucagcugcuacua

SEQ ID NO: 2511138 - RNA, 13 nt, Human
ucaccccuguccu

SEQ ID NO: 2511139 - RNA, 13 nt, Human
ucaccagaauaaa

SEQ ID NO: 2511140 - RNA, 22 nt, Human
ucaccccugguucucaucuuuc

SEQ ID NO: 2511141 - RNA, 21 nt, Human
ucaccccugguucucaucuuu

SEQ ID NO: 2511142 - RNA, 19 nt, Human
ucaccccugguucucaucu

SEQ ID NO: 2511143 - RNA, 18 nt, Human
ucacccgcuaagagggag

SEQ ID NO: 2511144 - RNA, 20 nt, Human
ucaccccuguccucacugcu

SEQ ID NO: 2511145 - RNA, 17 nt, Human
ucaccccuguccucacu

SEQ ID NO: 2511146 - RNA, 16 nt, Human
ucaccccuguccucac

SEQ ID NO: 2511147 - RNA, 14 nt, Human
ucaccccuguccuc

SEQ ID NO: 2511148 - RNA, 19 nt, Human
ucacccgaggcugcccacu

SEQ ID NO: 2511149 - RNA, 16 nt, Human
ucacccgaggcugccc

SEQ ID NO: 2511150 - RNA, 23 nt, Human
ucacauuguaacugaacuucagg

SEQ ID NO: 2511151 - RNA, 20 nt, Human
ucacauucuuauaaauauga

SEQ ID NO: 2511152 - RNA, 16 nt, Human
ucaccacaugugcaca

SEQ ID NO: 2511153 - RNA, 13 nt, Human
ucaccaagcccag

SEQ ID NO: 2511154 - RNA, 13 nt, Human
ucaccaccucucc

SEQ ID NO: 2511155 - RNA, 14 nt, Human
ucaccaccuuccca

SEQ ID NO: 2511156 - RNA, 15 nt, Human
ucaccaccuucccag

SEQ ID NO: 2511157 - RNA, 16 nt, Human
ucaccaccuucccagc

SEQ ID NO: 2511158 - RNA, 18 nt, Human
ucaccaccuucccagcuc

SEQ ID NO: 2511159 - RNA, 21 nt, Human
ucaccacuucaauagaucaaa

SEQ ID NO: 2511160 - RNA, 19 nt, Human
ucacaggagggagggggaa

SEQ ID NO: 2511161 - RNA, 23 nt, Human
ucacagggccccagaaggcaggg

SEQ ID NO: 2511162 - RNA, 23 nt, Human
ucacaggacucugccuccucuuc

SEQ ID NO: 2511163 - RNA, 19 nt, Human
ucacaggacucugccuccu

SEQ ID NO: 2511164 - RNA, 24 nt, Human
ucacaggguugggcccagaucugg

SEQ ID NO: 2511165 - RNA, 19 nt, Human
ucacaggguugggcccaga

SEQ ID NO: 2511166 - RNA, 23 nt, Human
ucacaggguugggcccagaucug

SEQ ID NO: 2511167 - RNA, 13 nt, Human
ucacaccagccau

SEQ ID NO: 2511168 - RNA, 17 nt, Human
ucacagggccccagaag

SEQ ID NO: 2511169 - RNA, 14 nt, Human
ucacaggguugggc

SEQ ID NO: 2511170 - RNA, 16 nt, Human
ucacaggguugggccc

SEQ ID NO: 2511171 - RNA, 17 nt, Human
ucacaggguugggccca

SEQ ID NO: 2511172 - RNA, 21 nt, Human
ucacauucuuauaaauaugaa

SEQ ID NO: 2511173 - RNA, 19 nt, Human
ucacauucuuauaaauaug

SEQ ID NO: 2511174 - RNA, 18 nt, Human
ucacauucuuauaaauau

SEQ ID NO: 2511175 - RNA, 17 nt, Human
ucacauucuuauaaaua

SEQ ID NO: 2511176 - RNA, 15 nt, Human
ucacauucuuauaaa

SEQ ID NO: 2511177 - RNA, 13 nt, Human
ucacauucuuaua

SEQ ID NO: 2511178 - RNA, 23 nt, Human
ucacacaugagcaucaggccagg

SEQ ID NO: 2511179 - RNA, 22 nt, Human
ucacacaugagcaucaggccag

SEQ ID NO: 2511180 - RNA, 23 nt, Human
ucacacagccaggugccuuggag

SEQ ID NO: 2511181 - RNA, 22 nt, Human
ucacacagccaggugccuugga

SEQ ID NO: 2511182 - RNA, 20 nt, Human
ucacacagccaggugccuug

SEQ ID NO: 2511183 - RNA, 19 nt, Human
ucacacagccaggugccuu

SEQ ID NO: 2511184 - RNA, 18 nt, Human
ucacacagccaggugccu

SEQ ID NO: 2511185 - RNA, 13 nt, Human
ucacacacgugag

SEQ ID NO: 2511186 - RNA, 12 nt, Human
ucacacacugau

SEQ ID NO: 2511187 - RNA, 15 nt, Human
ucacacacuuuggcu

SEQ ID NO: 2511188 - RNA, 22 nt, Human
ucacacaggacccccuuccccu

SEQ ID NO: 2511189 - RNA, 21 nt, Human
ucacacaggacccccuucccc

SEQ ID NO: 2511190 - RNA, 20 nt, Human
ucacacaggacccccuuccc

SEQ ID NO: 2511191 - RNA, 19 nt, Human
ucacacaggacccccuucc

SEQ ID NO: 2511192 - RNA, 11 nt, Human
ucacaccagcc

SEQ ID NO: 2511193 - RNA, 22 nt, Human
ucacaccaggcuugccugcagg

SEQ ID NO: 2511194 - RNA, 21 nt, Human
ucacaccaggcuugccugcag

SEQ ID NO: 2511195 - RNA, 18 nt, Human
ucacaggacucugccucc

SEQ ID NO: 2511196 - RNA, 17 nt, Human
ucacaggacucugccuc

SEQ ID NO: 2511197 - RNA, 16 nt, Human
ucacaggacucugccu

SEQ ID NO: 2511198 - RNA, 12 nt, Human
ucacaccagcca

SEQ ID NO: 2511199 - RNA, 19 nt, Human
ucaauuccguagccagcug

SEQ ID NO: 2511200 - RNA, 22 nt, Human
ucaauuccguagccagcugcuc

SEQ ID NO: 2511201 - RNA, 17 nt, Human
ucacaagagcccagcag

SEQ ID NO: 2511202 - RNA, 22 nt, Human
ucacaaggcauucaaguguaca

SEQ ID NO: 2511203 - RNA, 22 nt, Human
ucacaagggcaaacuuuuuccu

SEQ ID NO: 2511204 - RNA, 12 nt, Human
ucacacaccugu

SEQ ID NO: 2511205 - RNA, 20 nt, Human
ucacacacaggcaacugagg

SEQ ID NO: 2511206 - RNA, 21 nt, Human
ucacacacaggcaacugaggc

SEQ ID NO: 2511207 - RNA, 16 nt, Human
ucacaagugaaaaaca

SEQ ID NO: 2511208 - RNA, 22 nt, Human
ucacaagugaaaaacauccaga

SEQ ID NO: 2511209 - RNA, 22 nt, Human
ucacaagacccaaaaggcagaa

SEQ ID NO: 2511210 - RNA, 22 nt, Human
ucaauucccccuggccaccacc

SEQ ID NO: 2511211 - RNA, 14 nt, Human
ucaauuccucuggg

SEQ ID NO: 2511212 - RNA, 17 nt, Human
ucaauucaacacucccu

SEQ ID NO: 2511213 - RNA, 13 nt, Human
ucaauucaacacu

SEQ ID NO: 2511214 - RNA, 14 nt, Human
ucaauuccaccugc

SEQ ID NO: 2511215 - RNA, 18 nt, Human
ucaauguuucuucuaggu

SEQ ID NO: 2511216 - RNA, 22 nt, Human
ucaauguuuaugcaaggaagga

SEQ ID NO: 2511217 - RNA, 23 nt, Human
ucaauguuuaugcaaggaaggaa

SEQ ID NO: 2511218 - RNA, 14 nt, Human
ucaauaaaaucaug

SEQ ID NO: 2511219 - RNA, 16 nt, Human
ucaauaaaaucaugua

SEQ ID NO: 2511220 - RNA, 18 nt, Human
ucaauaaaaucauguaca

SEQ ID NO: 2511221 - RNA, 21 nt, Human
ucaauaaaaucauguacauuu

SEQ ID NO: 2511222 - RNA, 21 nt, Human
ucaauguuuaugcaaggaagg

SEQ ID NO: 2511223 - RNA, 18 nt, Human
ucaauguucauuguaaug

SEQ ID NO: 2511224 - RNA, 16 nt, Human
ucaauguucauuguaa

SEQ ID NO: 2511225 - RNA, 14 nt, Human
ucaauaaaauccau

SEQ ID NO: 2511226 - RNA, 14 nt, Human
ucaaggagaggagg

SEQ ID NO: 2511227 - RNA, 13 nt, Human
ucaauaaaaucau

SEQ ID NO: 2511228 - RNA, 13 nt, Human
ucaauuaaaugua

SEQ ID NO: 2511229 - RNA, 21 nt, Human
ucaauuaaacggauuauuuuu

SEQ ID NO: 2511230 - RNA, 12 nt, Human
ucaauuaaaugu

SEQ ID NO: 2511231 - RNA, 19 nt, Human
ucaauuagaauaguguucu

SEQ ID NO: 2511232 - RNA, 14 nt, Human
ucaauuaaauguag

SEQ ID NO: 2511233 - RNA, 20 nt, Human
ucaauuacugguccaaaaga

SEQ ID NO: 2511234 - RNA, 20 nt, Human
ucaauuaaacggauuauuuu

SEQ ID NO: 2511235 - RNA, 19 nt, Human
ucaauuaaacggauuauuu

SEQ ID NO: 2511236 - RNA, 18 nt, Human
ucaauuaaacggauuauu

SEQ ID NO: 2511237 - RNA, 17 nt, Human
ucaauuaaacggauuau

SEQ ID NO: 2511238 - RNA, 16 nt, Human
ucaauuaaacggauua

SEQ ID NO: 2511239 - RNA, 15 nt, Human
ucaauuaaacggauu

SEQ ID NO: 2511240 - RNA, 14 nt, Human
ucaauuaaacggau

SEQ ID NO: 2511241 - RNA, 13 nt, Human
ucaauuaaacgga

SEQ ID NO: 2511242 - RNA, 15 nt, Human
ucaauguuuucaguu

SEQ ID NO: 2511243 - RNA, 24 nt, Human
ucaauguucauuguaauguuacug

SEQ ID NO: 2511244 - RNA, 11 nt, Human
ucaauuaaacg

SEQ ID NO: 2511245 - RNA, 17 nt, Human
ucaaggauccugagcca

SEQ ID NO: 2511246 - RNA, 16 nt, Human
ucaaggauccugagcc

SEQ ID NO: 2511247 - RNA, 15 nt, Human
ucaaggauccugagc

SEQ ID NO: 2511248 - RNA, 14 nt, Human
ucaaggauccugag

SEQ ID NO: 2511249 - RNA, 13 nt, Human
ucaaggauccuga

SEQ ID NO: 2511250 - RNA, 20 nt, Human
ucaaggacuuucugaagccu

SEQ ID NO: 2511251 - RNA, 18 nt, Human
ucaaggacuugaaagcau

SEQ ID NO: 2511252 - RNA, 19 nt, Human
ucaaggacuugaaagcauc

SEQ ID NO: 2511253 - RNA, 19 nt, Human
ucaagcgauucuucugcuu

SEQ ID NO: 2511254 - RNA, 18 nt, Human
ucaagcgauucuucugcu

SEQ ID NO: 2511255 - RNA, 21 nt, Human
ucaaggaaagggggucccagu

SEQ ID NO: 2511256 - RNA, 18 nt, Human
ucaaggaauaaugggcuu

SEQ ID NO: 2511257 - RNA, 20 nt, Human
ucaaggaaagggggucccag

SEQ ID NO: 2511258 - RNA, 19 nt, Human
ucaaggaaaggggguccca

SEQ ID NO: 2511259 - RNA, 19 nt, Human
ucaagcuucaguuuccugg

SEQ ID NO: 2511260 - RNA, 21 nt, Human
ucaagcgauucuucugcuuca

SEQ ID NO: 2511261 - RNA, 20 nt, Human
ucaagccaccaacauacucc

SEQ ID NO: 2511262 - RNA, 12 nt, Human
ucaagccaccaa

SEQ ID NO: 2511263 - RNA, 21 nt, Human
ucaagccaauccccuccuugg

SEQ ID NO: 2511264 - RNA, 20 nt, Human
ucaagccaauccccuccuug

SEQ ID NO: 2511265 - RNA, 18 nt, Human
ucaagccaauccccuccu

SEQ ID NO: 2511266 - RNA, 17 nt, Human
ucaagccaauccccucc

SEQ ID NO: 2511267 - RNA, 21 nt, Human
ucaagcccagccacguggagc

SEQ ID NO: 2511268 - RNA, 22 nt, Human
ucaagcccagccacguggagcc

SEQ ID NO: 2511269 - RNA, 13 nt, Human
ucaagcccaggag

SEQ ID NO: 2511270 - RNA, 16 nt, Human
ucaagcccaggaggac

SEQ ID NO: 2511271 - RNA, 17 nt, Human
ucaagcgauucuucugc

SEQ ID NO: 2511272 - RNA, 19 nt, Human
ucaaccccuucgcuccugu

SEQ ID NO: 2511273 - RNA, 18 nt, Human
ucaaccccuucgcuccug

SEQ ID NO: 2511274 - RNA, 15 nt, Human
ucaaccuccugggcu

SEQ ID NO: 2511275 - RNA, 20 nt, Human
ucaaccccuucgcuccugug

SEQ ID NO: 2511276 - RNA, 17 nt, Human
ucaaccucuucuggcuc

SEQ ID NO: 2511277 - RNA, 18 nt, Human
ucaaccucuucuggcuca

SEQ ID NO: 2511278 - RNA, 16 nt, Human
ucaaccuccugggcua

SEQ ID NO: 2511279 - RNA, 22 nt, Human
ucaacuccaaacugacucuuaa

SEQ ID NO: 2511280 - RNA, 17 nt, Human
ucaaccugggcaaagcc

SEQ ID NO: 2511281 - RNA, 13 nt, Human
ucaaccugccuga

SEQ ID NO: 2511282 - RNA, 19 nt, Human
ucaaccucuucuggcucaa

SEQ ID NO: 2511283 - RNA, 14 nt, Human
ucaacucccugccc

SEQ ID NO: 2511284 - RNA, 15 nt, Human
ucaacucccugcccc

SEQ ID NO: 2511285 - RNA, 21 nt, Human
ucaacucccugccccccagcc

SEQ ID NO: 2511286 - RNA, 22 nt, Human
ucaacucccugccccccagccc

SEQ ID NO: 2511287 - RNA, 20 nt, Human
ucaacucuccuccagaguca

SEQ ID NO: 2511288 - RNA, 18 nt, Human
ucaacugaccagccucca

SEQ ID NO: 2511289 - RNA, 23 nt, Human
ucaacugaaaagacucaguguuc

SEQ ID NO: 2511290 - RNA, 19 nt, Human
ucaagccaagcagccaagc

SEQ ID NO: 2511291 - RNA, 16 nt, Human
ucaagccaauccccuc

SEQ ID NO: 2511292 - RNA, 20 nt, Human
ucaagccaagcagccaagcu

SEQ ID NO: 2511293 - RNA, 18 nt, Human
ucaaauaugcaaagcacu

SEQ ID NO: 2511294 - RNA, 19 nt, Human
ucaaauaugcaaagcacug

SEQ ID NO: 2511295 - RNA, 15 nt, Human
ucaaauccuugaaga

SEQ ID NO: 2511296 - RNA, 16 nt, Human
ucaaauccuugaagau

SEQ ID NO: 2511297 - RNA, 19 nt, Human
ucaaauggggccagaucca

SEQ ID NO: 2511298 - RNA, 20 nt, Human
ucaaauggggccagauccag

SEQ ID NO: 2511299 - RNA, 20 nt, Human
ucaaaugguaggcauuuccu

SEQ ID NO: 2511300 - RNA, 21 nt, Human
ucaaaugguaggcauuuccua

SEQ ID NO: 2511301 - RNA, 18 nt, Human
ucaaaucuauucagacaa

SEQ ID NO: 2511302 - RNA, 17 nt, Human
ucaaaucuauucagaca

SEQ ID NO: 2511303 - RNA, 16 nt, Human
ucaaaucuauucagac

SEQ ID NO: 2511304 - RNA, 15 nt, Human
ucaaaucuauucaga

SEQ ID NO: 2511305 - RNA, 13 nt, Human
ucaaaucuauuca

SEQ ID NO: 2511306 - RNA, 14 nt, Human
ucaaaucuauucag

SEQ ID NO: 2511307 - RNA, 16 nt, Human
ucaaaucuccaguauu

SEQ ID NO: 2511308 - RNA, 16 nt, Human
ucaaauaugcaaagca

SEQ ID NO: 2511309 - RNA, 17 nt, Human
ucaaauaugcaaagcac

SEQ ID NO: 2511310 - RNA, 12 nt, Human
ucaaagagguuu

SEQ ID NO: 2511311 - RNA, 23 nt, Human
ucaaagagguuuuaaaaaaaucc

SEQ ID NO: 2511312 - RNA, 15 nt, Human
ucaaagagagaaaau

SEQ ID NO: 2511313 - RNA, 20 nt, Human
ucaaagagagaaaauaaaga

SEQ ID NO: 2511314 - RNA, 21 nt, Human
ucaaagaggcugaggcuggca

SEQ ID NO: 2511315 - RNA, 19 nt, Human
ucaaacuggggccucccug

SEQ ID NO: 2511316 - RNA, 14 nt, Human
ucaaacuguagaaa

SEQ ID NO: 2511317 - RNA, 20 nt, Human
ucaaacuguagaaaugauga

SEQ ID NO: 2511318 - RNA, 17 nt, Human
ucaaacuguagaaauga

SEQ ID NO: 2511319 - RNA, 14 nt, Human
ucaaacuuccaguc

SEQ ID NO: 2511320 - RNA, 20 nt, Human
ucaaacugccuuggcuucag

SEQ ID NO: 2511321 - RNA, 22 nt, Human
ucaaacuuccagugcaacacug

SEQ ID NO: 2511322 - RNA, 22 nt, Human
ucaaacaugaaguguguuuccu

SEQ ID NO: 2511323 - RNA, 17 nt, Human
uauuugccaugggcuuc

SEQ ID NO: 2511324 - RNA, 16 nt, Human
uauuugccaugggcuu

SEQ ID NO: 2511325 - RNA, 15 nt, Human
uauuugcauguuacc

SEQ ID NO: 2511326 - RNA, 20 nt, Human
ucaaaccccgaccaccugcc

SEQ ID NO: 2511327 - RNA, 19 nt, Human
ucaaaccccgaccaccugc

SEQ ID NO: 2511328 - RNA, 20 nt, Human
ucaaaccaaaucacugaacu

SEQ ID NO: 2511329 - RNA, 16 nt, Human
ucaaaccauaaacuuc

SEQ ID NO: 2511330 - RNA, 15 nt, Human
ucaaaccauaaacuu

SEQ ID NO: 2511331 - RNA, 19 nt, Human
ucaaacuggggccuccaga

SEQ ID NO: 2511332 - RNA, 20 nt, Human
ucaaacuggggccuccagaa

SEQ ID NO: 2511333 - RNA, 22 nt, Human
ucaaacuggggccuccagaacu

SEQ ID NO: 2511334 - RNA, 23 nt, Human
ucaaacuggggccuccagaacuc

SEQ ID NO: 2511335 - RNA, 14 nt, Human
ucaaacuggggccu

SEQ ID NO: 2511336 - RNA, 16 nt, Human
ucaaacuggggccucc

SEQ ID NO: 2511337 - RNA, 19 nt, Human
ucaaacugaggaauuucac

SEQ ID NO: 2511338 - RNA, 17 nt, Human
ucaaaccuccucuucug

SEQ ID NO: 2511339 - RNA, 20 nt, Human
ucaaaccgcacucacccaug

SEQ ID NO: 2511340 - RNA, 21 nt, Human
ucaaaccauaaacuucauggu

SEQ ID NO: 2511341 - RNA, 18 nt, Human
ucaaaccauaaacuucau

SEQ ID NO: 2511342 - RNA, 23 nt, Human
ucaaaccccgaccaccugcccaa

SEQ ID NO: 2511343 - RNA, 22 nt, Human
ucaaacagucucaggaaaucaa

SEQ ID NO: 2511344 - RNA, 17 nt, Human
ucaaacauauauaacaa

SEQ ID NO: 2511345 - RNA, 21 nt, Human
uauuugcauaacaauuccucu

SEQ ID NO: 2511346 - RNA, 22 nt, Human
uauuugcauaacaauuccucua

SEQ ID NO: 2511347 - RNA, 15 nt, Human
uauuugcauauguau

SEQ ID NO: 2511348 - RNA, 16 nt, Human
uauuugcauguuaccu

SEQ ID NO: 2511349 - RNA, 23 nt, Human
uauuugcaguucaccugcacuua

SEQ ID NO: 2511350 - RNA, 18 nt, Human
uauuugcaguucaccugc

SEQ ID NO: 2511351 - RNA, 16 nt, Human
uauuugcagacuagaa

SEQ ID NO: 2511352 - RNA, 16 nt, Human
uauuugcacuguagcc

SEQ ID NO: 2511353 - RNA, 22 nt, Human
uauuugaauguaugcuucauac

SEQ ID NO: 2511354 - RNA, 23 nt, Human
uauuugaauguaugcuucauaca

SEQ ID NO: 2511355 - RNA, 21 nt, Human
uauuugacaacguuucagcga

SEQ ID NO: 2511356 - RNA, 18 nt, Human
ucuaaaggcuaccuuugu

SEQ ID NO: 2511357 - RNA, 17 nt, Human
ucuaaaggcuaccuuug

SEQ ID NO: 2511358 - RNA, 19 nt, Human
ucuaaaggcuaccuuugua

SEQ ID NO: 2511359 - RNA, 20 nt, Human
ucuaaaggcuaccuuuguau

SEQ ID NO: 2511360 - RNA, 15 nt, Human
ucuaaaguuuacagu

SEQ ID NO: 2511361 - RNA, 13 nt, Human
ucuaaaguuuaca

SEQ ID NO: 2511362 - RNA, 12 nt, Human
ucuaaaguuuac

SEQ ID NO: 2511363 - RNA, 19 nt, Human
ucuaaaguguguuguugcu

SEQ ID NO: 2511364 - RNA, 16 nt, Human
ucguguccccuauccu

SEQ ID NO: 2511365 - RNA, 14 nt, Human
ucgugucucugguc

SEQ ID NO: 2511366 - RNA, 22 nt, Human
ucguguauccuggggcucccuu

SEQ ID NO: 2511367 - RNA, 18 nt, Human
ucuaaagguggugaggca

SEQ ID NO: 2511368 - RNA, 18 nt, Human
ucgugacgcugaauaaau

SEQ ID NO: 2511369 - RNA, 17 nt, Human
ucgugacgcugaauaaa

SEQ ID NO: 2511370 - RNA, 20 nt, Human
ucgugacgcugaauaaaugu

SEQ ID NO: 2511371 - RNA, 21 nt, Human
ucguggagacagggcauuuga

SEQ ID NO: 2511372 - RNA, 18 nt, Human
ucguguauccuggggcuc

SEQ ID NO: 2511373 - RNA, 16 nt, Human
ucguguauccuggggc

SEQ ID NO: 2511374 - RNA, 15 nt, Human
ucguguauccugggg

SEQ ID NO: 2511375 - RNA, 14 nt, Human
ucguguauccuggg

SEQ ID NO: 2511376 - RNA, 13 nt, Human
ucguguauccugg

SEQ ID NO: 2511377 - RNA, 22 nt, Human
ucgugguccccaacagcgacau

SEQ ID NO: 2511378 - RNA, 22 nt, Human
ucguggugaucaauuaaaugua

SEQ ID NO: 2511379 - RNA, 20 nt, Human
ucgugguaggacuguagaaa

SEQ ID NO: 2511380 - RNA, 15 nt, Human
ucgugguaggacugu

SEQ ID NO: 2511381 - RNA, 19 nt, Human
ucguggagaugucuucgua

SEQ ID NO: 2511382 - RNA, 17 nt, Human
ucguggagaugucuucg

SEQ ID NO: 2511383 - RNA, 16 nt, Human
ucguggagaugucuuc

SEQ ID NO: 2511384 - RNA, 20 nt, Human
ucguggcagauaaucagccu

SEQ ID NO: 2511385 - RNA, 21 nt, Human
ucguggcagauaaucagccuc

SEQ ID NO: 2511386 - RNA, 15 nt, Human
ucgugggugugugua

SEQ ID NO: 2511387 - RNA, 22 nt, Human
ucguggguguguguagccaagg

SEQ ID NO: 2511388 - RNA, 14 nt, Human
ucgugguaggacug

SEQ ID NO: 2511389 - RNA, 14 nt, Human
ucggagaagagcug

SEQ ID NO: 2511390 - RNA, 16 nt, Human
ucggagaagagcuguu

SEQ ID NO: 2511391 - RNA, 12 nt, Human
ucggagaagagc

SEQ ID NO: 2511392 - RNA, 18 nt, Human
ucggacuuagcugggaga

SEQ ID NO: 2511393 - RNA, 21 nt, Human
uccuuagcuuagaccucagcc

SEQ ID NO: 2511394 - RNA, 22 nt, Human
uccuuagcuuagaccucagccu

SEQ ID NO: 2511395 - RNA, 18 nt, Human
uccuuagcuuagaccuca

SEQ ID NO: 2511396 - RNA, 19 nt, Human
uccuuagcuuagaccucag

SEQ ID NO: 2511397 - RNA, 20 nt, Human
uccuuagcuuagaccucagc

SEQ ID NO: 2511398 - RNA, 17 nt, Human
uccugucugccagccag

SEQ ID NO: 2511399 - RNA, 21 nt, Human
uccugucugccagccagcagc

SEQ ID NO: 2511400 - RNA, 15 nt, Human
uccuuagaacauuuu

SEQ ID NO: 2511401 - RNA, 20 nt, Human
uccuuagaacauuuuaauuc

SEQ ID NO: 2511402 - RNA, 19 nt, Human
uccuuagagacaucaaaau

SEQ ID NO: 2511403 - RNA, 17 nt, Human
uccuuagaccuuccaua

SEQ ID NO: 2511404 - RNA, 18 nt, Human
ucgugaaacccugucucu

SEQ ID NO: 2511405 - RNA, 14 nt, Human
ucgugaaacccugu

SEQ ID NO: 2511406 - RNA, 20 nt, Human
ucgucuuucccauggggagg

SEQ ID NO: 2511407 - RNA, 18 nt, Human
ucgucuuucccaugggga

SEQ ID NO: 2511408 - RNA, 15 nt, Human
ucgucuuucccaugg

SEQ ID NO: 2511409 - RNA, 19 nt, Human
ucggcccacagcucccacc

SEQ ID NO: 2511410 - RNA, 12 nt, Human
ucggcccacagc

SEQ ID NO: 2511411 - RNA, 16 nt, Human
ucggcccacagcuccc

SEQ ID NO: 2511412 - RNA, 23 nt, Human
ucggcccacagcucccaccccac

SEQ ID NO: 2511413 - RNA, 21 nt, Human
ucgugaccaacuagacauucu

SEQ ID NO: 2511414 - RNA, 19 nt, Human
ucgugaaguauacuguauu

SEQ ID NO: 2511415 - RNA, 10 nt, Human
ucgucuuugc

SEQ ID NO: 2511416 - RNA, 17 nt, Human
ucgugaaguauacugua

SEQ ID NO: 2511417 - RNA, 13 nt, Human
ucgugacaacacu

SEQ ID NO: 2511418 - RNA, 14 nt, Human
ucggagacagugau

SEQ ID NO: 2511419 - RNA, 15 nt, Human
ucggagacagugauc

SEQ ID NO: 2511420 - RNA, 20 nt, Human
ucggagggaauugaggucug

SEQ ID NO: 2511421 - RNA, 22 nt, Human
ucggagggaauugaggucugcu

SEQ ID NO: 2511422 - RNA, 17 nt, Human
ucggaguaucugggaac

SEQ ID NO: 2511423 - RNA, 19 nt, Human
ucggaguaucugggaacug

SEQ ID NO: 2511424 - RNA, 16 nt, Human
ucggauuuggggugga

SEQ ID NO: 2511425 - RNA, 20 nt, Human
ucggaucuggggcucuggga

SEQ ID NO: 2511426 - RNA, 16 nt, Human
ucggcauuucaaaugu

SEQ ID NO: 2511427 - RNA, 16 nt, Human
ucggcagauacugucu

SEQ ID NO: 2511428 - RNA, 14 nt, Human
ucuaccuuccugca

SEQ ID NO: 2511429 - RNA, 21 nt, Human
ucuaccuuccagucaggauga

SEQ ID NO: 2511430 - RNA, 15 nt, Human
ucuaccuuccaguca

SEQ ID NO: 2511431 - RNA, 21 nt, Human
ucuaccuggucucuccuuguu

SEQ ID NO: 2511432 - RNA, 16 nt, Human
ucuaccuucuguaguu

SEQ ID NO: 2511433 - RNA, 14 nt, Human
ucuaccuucuguag

SEQ ID NO: 2511434 - RNA, 16 nt, Human
ucuaccuugaggucuu

SEQ ID NO: 2511435 - RNA, 17 nt, Human
ucuaccuugaggucuuu

SEQ ID NO: 2511436 - RNA, 15 nt, Human
ucuacgcucuccuuu

SEQ ID NO: 2511437 - RNA, 21 nt, Human
ucuacuaaaaagaaggaaaau

SEQ ID NO: 2511438 - RNA, 14 nt, Human
ucuacuaaaaagaa

SEQ ID NO: 2511439 - RNA, 19 nt, Human
ucuacgguguaugguucug

SEQ ID NO: 2511440 - RNA, 16 nt, Human
ucuacgcucuccuuuc

SEQ ID NO: 2511441 - RNA, 17 nt, Human
ucuacgcucuccuuucu

SEQ ID NO: 2511442 - RNA, 20 nt, Human
ucuacuggucuuguggaauu

SEQ ID NO: 2511443 - RNA, 23 nt, Human
ucuacuggucuuguggaauuggg

SEQ ID NO: 2511444 - RNA, 16 nt, Human
ucuacuggucuugugg

SEQ ID NO: 2511445 - RNA, 16 nt, Human
ucuacugggagccuac

SEQ ID NO: 2511446 - RNA, 19 nt, Human
ucuacugggagccuaccca

SEQ ID NO: 2511447 - RNA, 21 nt, Human
ucuacuguauggaauacaaug

SEQ ID NO: 2511448 - RNA, 21 nt, Human
ucuacuuaauccaauggguuu

SEQ ID NO: 2511449 - RNA, 19 nt, Human
ucuacuucugcccuugcca

SEQ ID NO: 2511450 - RNA, 18 nt, Human
ucuaauuuuuauucauaa

SEQ ID NO: 2511451 - RNA, 17 nt, Human
ucuaauuuuuauucaua

SEQ ID NO: 2511452 - RNA, 16 nt, Human
ucuaauuuuuaagcaa

SEQ ID NO: 2511453 - RNA, 22 nt, Human
ucuaaaguuuacaguaaauaaa

SEQ ID NO: 2511454 - RNA, 19 nt, Human
ucuaaaguuuacaguaaau

SEQ ID NO: 2511455 - RNA, 18 nt, Human
ucuaaaguuuacaguaaa

SEQ ID NO: 2511456 - RNA, 17 nt, Human
ucuaaaguuuacaguaa

SEQ ID NO: 2511457 - RNA, 16 nt, Human
ucuaaaguuuacagua

SEQ ID NO: 2511458 - RNA, 18 nt, Human
ucuacaaaauccugauga

SEQ ID NO: 2511459 - RNA, 17 nt, Human
ucuacacuaagagagaa

SEQ ID NO: 2511460 - RNA, 14 nt, Human
ucuacacagagcag

SEQ ID NO: 2511461 - RNA, 19 nt, Human
ucuacaaugugaacuuuau

SEQ ID NO: 2511462 - RNA, 20 nt, Human
ucuacaaugugaacuuuauu

SEQ ID NO: 2511463 - RNA, 15 nt, Human
ucuacaaugugaacu

SEQ ID NO: 2511464 - RNA, 17 nt, Human
ucuacaaugugaacuuu

SEQ ID NO: 2511465 - RNA, 16 nt, Human
ucuacagaggccaugg

SEQ ID NO: 2511466 - RNA, 15 nt, Human
ucuacagaggccaug

SEQ ID NO: 2511467 - RNA, 16 nt, Human
ucuacagagcuucccu

SEQ ID NO: 2511468 - RNA, 17 nt, Human
ucuacagagcuucccug

SEQ ID NO: 2511469 - RNA, 18 nt, Human
ucuacagagcuucccuga

SEQ ID NO: 2511470 - RNA, 19 nt, Human
ucuacagagcuucccugac

SEQ ID NO: 2511471 - RNA, 16 nt, Human
ucuacagacuucucca

SEQ ID NO: 2511472 - RNA, 17 nt, Human
ucuacagacuucuccag

SEQ ID NO: 2511473 - RNA, 18 nt, Human
ucuacagacuucuccaga

SEQ ID NO: 2511474 - RNA, 16 nt, Human
ucuacacauacaugua

SEQ ID NO: 2511475 - RNA, 18 nt, Human
ucuaugaaauauuauguu

SEQ ID NO: 2511476 - RNA, 14 nt, Human
ucuaugacacaugc

SEQ ID NO: 2511477 - RNA, 12 nt, Human
ucuaugagaaaa

SEQ ID NO: 2511478 - RNA, 18 nt, Human
ucuaugaaguauauaaug

SEQ ID NO: 2511479 - RNA, 17 nt, Human
ucuaugaaguauauaau

SEQ ID NO: 2511480 - RNA, 17 nt, Human
ucuaucauuuuuguaca

SEQ ID NO: 2511481 - RNA, 16 nt, Human
ucuaucauuuuuguac

SEQ ID NO: 2511482 - RNA, 15 nt, Human
ucuaucauuuuugua

SEQ ID NO: 2511483 - RNA, 23 nt, Human
ucuaugaacucuguuuucuuucu

SEQ ID NO: 2511484 - RNA, 17 nt, Human
ucuaugacacaugcaag

SEQ ID NO: 2511485 - RNA, 22 nt, Human
ucuaucauuuaauaauauacuu

SEQ ID NO: 2511486 - RNA, 18 nt, Human
ucuaucauuuaauaauau

SEQ ID NO: 2511487 - RNA, 17 nt, Human
ucuaucauuuaauaaua

SEQ ID NO: 2511488 - RNA, 16 nt, Human
ucuaucauuuaauaau

SEQ ID NO: 2511489 - RNA, 15 nt, Human
ucuaucauuuaauaa

SEQ ID NO: 2511490 - RNA, 14 nt, Human
ucuaucauuuaaua

SEQ ID NO: 2511491 - RNA, 13 nt, Human
ucuaucauuuaau

SEQ ID NO: 2511492 - RNA, 12 nt, Human
ucuaucauuuaa

SEQ ID NO: 2511493 - RNA, 14 nt, Human
ucuaucauuaaagu

SEQ ID NO: 2511494 - RNA, 15 nt, Human
ucuaucauuaaaguu

SEQ ID NO: 2511495 - RNA, 15 nt, Human
ucuaucaauagucaa

SEQ ID NO: 2511496 - RNA, 16 nt, Human
ucuaucauuaaaguuc

SEQ ID NO: 2511497 - RNA, 14 nt, Human
ucuaucaccaagga

SEQ ID NO: 2511498 - RNA, 14 nt, Human
ucuaucagagaaaa

SEQ ID NO: 2511499 - RNA, 19 nt, Human
ucuaguggucuuuguaaga

SEQ ID NO: 2511500 - RNA, 18 nt, Human
ucuaguggucuuuguaag

SEQ ID NO: 2511501 - RNA, 17 nt, Human
ucuaguggucuuuguaa

SEQ ID NO: 2511502 - RNA, 16 nt, Human
ucuaguggucuuugua

SEQ ID NO: 2511503 - RNA, 15 nt, Human
ucuaguggucuuugu

SEQ ID NO: 2511504 - RNA, 17 nt, Human
ucuagugcugcugaaga

SEQ ID NO: 2511505 - RNA, 16 nt, Human
ucuagugcugugaaaa

SEQ ID NO: 2511506 - RNA, 19 nt, Human
ucuagugcugugaaaaaaa

SEQ ID NO: 2511507 - RNA, 12 nt, Human
ucuagugggaag

SEQ ID NO: 2511508 - RNA, 23 nt, Human
ucuagugcugugaaaaaaaaaau

SEQ ID NO: 2511509 - RNA, 13 nt, Human
ucuagugcugcug

SEQ ID NO: 2511510 - RNA, 23 nt, Human
ucuagugccuucuaaagguguug

SEQ ID NO: 2511511 - RNA, 13 nt, Human
ucuagugcuguga

SEQ ID NO: 2511512 - RNA, 14 nt, Human
ucuagugcugugaa

SEQ ID NO: 2511513 - RNA, 15 nt, Human
ucuagugcugugaaa

SEQ ID NO: 2511514 - RNA, 14 nt, Human
ucuagugccuucua

SEQ ID NO: 2511515 - RNA, 18 nt, Human
ucuagugccuucuaaagg

SEQ ID NO: 2511516 - RNA, 20 nt, Human
ucuagugcccuccacagccg

SEQ ID NO: 2511517 - RNA, 22 nt, Human
ucuagugcagcugauuuuaaca

SEQ ID NO: 2511518 - RNA, 23 nt, Human
ucuagugcagcugauuuuaacaa

SEQ ID NO: 2511519 - RNA, 14 nt, Human
ucuagugcccucca

SEQ ID NO: 2511520 - RNA, 16 nt, Human
ucuaggaagacuuugg

SEQ ID NO: 2511521 - RNA, 15 nt, Human
ucuaggaagacuuug

SEQ ID NO: 2511522 - RNA, 19 nt, Human
ucuaggaagacuuuggaaa

SEQ ID NO: 2511523 - RNA, 21 nt, Human
ucuaggaagacuuuggaaaga

SEQ ID NO: 2511524 - RNA, 19 nt, Human
ucuagugcagcugauuuua

SEQ ID NO: 2511525 - RNA, 19 nt, Human
ucuccagcugggcucugca

SEQ ID NO: 2511526 - RNA, 17 nt, Human
ucuccagcugggcucug

SEQ ID NO: 2511527 - RNA, 11 nt, Human
ucuccagcugg

SEQ ID NO: 2511528 - RNA, 14 nt, Human
ucuccagcuccaag

SEQ ID NO: 2511529 - RNA, 22 nt, Human
ucuccagcuauaacaguaggga

SEQ ID NO: 2511530 - RNA, 23 nt, Human
ucuccagccuggacccccagcuu

SEQ ID NO: 2511531 - RNA, 22 nt, Human
ucuccagccuggacccccagcu

SEQ ID NO: 2511532 - RNA, 21 nt, Human
ucuccagccuggacccccagc

SEQ ID NO: 2511533 - RNA, 19 nt, Human
ucuccagccuggaccccca

SEQ ID NO: 2511534 - RNA, 15 nt, Human
ucuccagccuggacc

SEQ ID NO: 2511535 - RNA, 14 nt, Human
ucuccagccuggac

SEQ ID NO: 2511536 - RNA, 18 nt, Human
ucuccagccccuggaugc

SEQ ID NO: 2511537 - RNA, 16 nt, Human
ucuccagccccuggau

SEQ ID NO: 2511538 - RNA, 22 nt, Human
ucuccagccccuggaugcagcc

SEQ ID NO: 2511539 - RNA, 23 nt, Human
ucuccagccccuucucagaaucu

SEQ ID NO: 2511540 - RNA, 16 nt, Human
ucuccagccagcaaug

SEQ ID NO: 2511541 - RNA, 15 nt, Human
ucuccagccagcaau

SEQ ID NO: 2511542 - RNA, 22 nt, Human
ucuccagccccuucucagaauc

SEQ ID NO: 2511543 - RNA, 15 nt, Human
ucuccagccccugga

SEQ ID NO: 2511544 - RNA, 14 nt, Human
ucuccagccccugg

SEQ ID NO: 2511545 - RNA, 13 nt, Human
ucuccagccccug

SEQ ID NO: 2511546 - RNA, 12 nt, Human
ucuccagccccu

SEQ ID NO: 2511547 - RNA, 16 nt, Human
ucuccaccugcuccca

SEQ ID NO: 2511548 - RNA, 17 nt, Human
ucuccacucaguugcaa

SEQ ID NO: 2511549 - RNA, 14 nt, Human
ucuccacugccuuc

SEQ ID NO: 2511550 - RNA, 15 nt, Human
ucuccagacccccac

SEQ ID NO: 2511551 - RNA, 19 nt, Human
ucuccagauguuuccagac

SEQ ID NO: 2511552 - RNA, 13 nt, Human
ucuccagccagca

SEQ ID NO: 2511553 - RNA, 12 nt, Human
ucuccagccagc

SEQ ID NO: 2511554 - RNA, 15 nt, Human
ucuccagauguuucc

SEQ ID NO: 2511555 - RNA, 18 nt, Human
ucuccagauguuuccaga

SEQ ID NO: 2511556 - RNA, 14 nt, Human
ucuccagauguuuc

SEQ ID NO: 2511557 - RNA, 19 nt, Human
ucuccagacccccaccccu

SEQ ID NO: 2511558 - RNA, 20 nt, Human
ucuccagacccccaccccuu

SEQ ID NO: 2511559 - RNA, 18 nt, Human
ucucccucagucuggccc

SEQ ID NO: 2511560 - RNA, 23 nt, Human
ucucccucagucuggcccuuccu

SEQ ID NO: 2511561 - RNA, 15 nt, Human
ucuccccugccccca

SEQ ID NO: 2511562 - RNA, 14 nt, Human
ucuccccugccccc

SEQ ID NO: 2511563 - RNA, 12 nt, Human
ucuccccugccc

SEQ ID NO: 2511564 - RNA, 14 nt, Human
ucucccucccuugg

SEQ ID NO: 2511565 - RNA, 23 nt, Human
ucucccucacagcacagagaaga

SEQ ID NO: 2511566 - RNA, 23 nt, Human
ucucccucaacaagggagagacc

SEQ ID NO: 2511567 - RNA, 12 nt, Human
ucucccuccccu

SEQ ID NO: 2511568 - RNA, 18 nt, Human
ucucccuccccugccauu

SEQ ID NO: 2511569 - RNA, 12 nt, Human
ucucccugccgc

SEQ ID NO: 2511570 - RNA, 13 nt, Human
ucucccugccgcc

SEQ ID NO: 2511571 - RNA, 14 nt, Human
ucucccuggcccuc

SEQ ID NO: 2511572 - RNA, 14 nt, Human
ucucccugccgccu

SEQ ID NO: 2511573 - RNA, 15 nt, Human
ucucccugccgccuc

SEQ ID NO: 2511574 - RNA, 17 nt, Human
ucuccaggcacccuucu

SEQ ID NO: 2511575 - RNA, 13 nt, Human
ucuccaggaucca

SEQ ID NO: 2511576 - RNA, 19 nt, Human
ucuccaggauugaagagca

SEQ ID NO: 2511577 - RNA, 21 nt, Human
ucuccagcugggcucugcaau

SEQ ID NO: 2511578 - RNA, 18 nt, Human
ucuccaggaaggcggggc

SEQ ID NO: 2511579 - RNA, 11 nt, Human
ucuccaggcug

SEQ ID NO: 2511580 - RNA, 15 nt, Human
ucuccccagguccag

SEQ ID NO: 2511581 - RNA, 22 nt, Human
ucuccccagguccagcucugga

SEQ ID NO: 2511582 - RNA, 20 nt, Human
ucuccccagguccagcucug

SEQ ID NO: 2511583 - RNA, 19 nt, Human
ucuccccagguccagcucu

SEQ ID NO: 2511584 - RNA, 15 nt, Human
ucuccaggcgccggc

SEQ ID NO: 2511585 - RNA, 15 nt, Human
ucucccccacccccu

SEQ ID NO: 2511586 - RNA, 12 nt, Human
ucucccccaccc

SEQ ID NO: 2511587 - RNA, 23 nt, Human
ucuccaggcacccuucuuuccuc

SEQ ID NO: 2511588 - RNA, 20 nt, Human
ucucccccacccccuccccg

SEQ ID NO: 2511589 - RNA, 19 nt, Human
ucucccccacccccucccc

SEQ ID NO: 2511590 - RNA, 12 nt, Human
ucucccccagcc

SEQ ID NO: 2511591 - RNA, 13 nt, Human
ucuccccucaaag

SEQ ID NO: 2511592 - RNA, 11 nt, Human
ucuccccucaa

SEQ ID NO: 2511593 - RNA, 20 nt, Human
ucucccccugggcucugccc

SEQ ID NO: 2511594 - RNA, 18 nt, Human
ucuccccucagagugcaa

SEQ ID NO: 2511595 - RNA, 23 nt, Human
ucuccccucaaagucugcaacuu

SEQ ID NO: 2511596 - RNA, 16 nt, Human
ucuccccucaaagucu

SEQ ID NO: 2511597 - RNA, 13 nt, Human
ucuccccucagag

SEQ ID NO: 2511598 - RNA, 19 nt, Human
ucuccaccugccagggaca

SEQ ID NO: 2511599 - RNA, 17 nt, Human
ucuccaccugccaggga

SEQ ID NO: 2511600 - RNA, 22 nt, Human
ucuccaccugccagggacagag

SEQ ID NO: 2511601 - RNA, 13 nt, Human
ucuccacuccaga

SEQ ID NO: 2511602 - RNA, 17 nt, Human
ucuccaccucagccuug

SEQ ID NO: 2511603 - RNA, 18 nt, Human
ucuccaccucagccuugg

SEQ ID NO: 2511604 - RNA, 13 nt, Human
ucuccaccugcuc

SEQ ID NO: 2511605 - RNA, 19 nt, Human
ucuccaccucagccuugga

SEQ ID NO: 2511606 - RNA, 16 nt, Human
ucuccaccugccaggg

SEQ ID NO: 2511607 - RNA, 15 nt, Human
ucuccaccugccagg

SEQ ID NO: 2511608 - RNA, 14 nt, Human
ucuccaccugccag

SEQ ID NO: 2511609 - RNA, 23 nt, Human
ucuccaccuaguggcuguccagu

SEQ ID NO: 2511610 - RNA, 22 nt, Human
ucuccaccuaguggcuguccag

SEQ ID NO: 2511611 - RNA, 11 nt, Human
ucuccaccuca

SEQ ID NO: 2511612 - RNA, 12 nt, Human
ucuccaccucag

SEQ ID NO: 2511613 - RNA, 13 nt, Human
ucuccaccucagc

SEQ ID NO: 2511614 - RNA, 14 nt, Human
ucuccaccucagcc

SEQ ID NO: 2511615 - RNA, 15 nt, Human
ucuccaccucagccu

SEQ ID NO: 2511616 - RNA, 16 nt, Human
ucuccaccucagccuu

SEQ ID NO: 2511617 - RNA, 16 nt, Human
ucuccacccugcucuc

SEQ ID NO: 2511618 - RNA, 14 nt, Human
ucuccacccugcuc

SEQ ID NO: 2511619 - RNA, 21 nt, Human
ucuccaccuaguggcugucca

SEQ ID NO: 2511620 - RNA, 16 nt, Human
ucuccaccuaguggcu

SEQ ID NO: 2511621 - RNA, 15 nt, Human
ucuccaccuaguggc

SEQ ID NO: 2511622 - RNA, 14 nt, Human
ucuccaccuagugg

SEQ ID NO: 2511623 - RNA, 17 nt, Human
ucuccacccugcucucc

SEQ ID NO: 2511624 - RNA, 16 nt, Human
ucucaugccucagccu

SEQ ID NO: 2511625 - RNA, 19 nt, Human
ucucaugccucagccuccu

SEQ ID NO: 2511626 - RNA, 13 nt, Human
ucuccacccugcu

SEQ ID NO: 2511627 - RNA, 18 nt, Human
ucucaugccccuggcugg

SEQ ID NO: 2511628 - RNA, 21 nt, Human
ucucaugccccuggcugggac

SEQ ID NO: 2511629 - RNA, 13 nt, Human
ucucaugccucag

SEQ ID NO: 2511630 - RNA, 18 nt, Human
ucucaugaaucugcaaug

SEQ ID NO: 2511631 - RNA, 14 nt, Human
ucucaugaaucugc

SEQ ID NO: 2511632 - RNA, 22 nt, Human
ucucaugaaccucaagcugcau

SEQ ID NO: 2511633 - RNA, 18 nt, Human
ucucagucucugagcagu

SEQ ID NO: 2511634 - RNA, 15 nt, Human
ucucagucucugagc

SEQ ID NO: 2511635 - RNA, 17 nt, Human
ucucagucucugagcag

SEQ ID NO: 2511636 - RNA, 23 nt, Human
ucucaguccaugaagauguagag

SEQ ID NO: 2511637 - RNA, 11 nt, Human
ucucagucucu

SEQ ID NO: 2511638 - RNA, 13 nt, Human
ucucagucucuga

SEQ ID NO: 2511639 - RNA, 21 nt, Human
ucucagucaugcauaaauaug

SEQ ID NO: 2511640 - RNA, 20 nt, Human
ucucagucaugcauaaauau

SEQ ID NO: 2511641 - RNA, 23 nt, Human
ucucagucaugcauaaauaugca

SEQ ID NO: 2511642 - RNA, 13 nt, Human
ucuaugggacuca

SEQ ID NO: 2511643 - RNA, 12 nt, Human
ucuaugggacuc

SEQ ID NO: 2511644 - RNA, 17 nt, Human
ucuaugagaaaagaggc

SEQ ID NO: 2511645 - RNA, 19 nt, Human
ucucagucaugcauaaaua

SEQ ID NO: 2511646 - RNA, 19 nt, Human
ucuaugggacucaaugcac

SEQ ID NO: 2511647 - RNA, 13 nt, Human
ucucaugaaccuc

SEQ ID NO: 2511648 - RNA, 14 nt, Human
ucucaugaaccuca

SEQ ID NO: 2511649 - RNA, 22 nt, Human
ucucaucuuucuugaucaacau

SEQ ID NO: 2511650 - RNA, 13 nt, Human
ucucaucuuucuu

SEQ ID NO: 2511651 - RNA, 12 nt, Human
ucucaucuuucu

SEQ ID NO: 2511652 - RNA, 17 nt, Human
ucucaucugugauuccc

SEQ ID NO: 2511653 - RNA, 18 nt, Human
ucucaucucuucuuuuaa

SEQ ID NO: 2511654 - RNA, 20 nt, Human
ucucaucucuuagcuccccu

SEQ ID NO: 2511655 - RNA, 13 nt, Human
ucucaucugugau

SEQ ID NO: 2511656 - RNA, 19 nt, Human
ucucauaggaaaaguacau

SEQ ID NO: 2511657 - RNA, 16 nt, Human
ucucauaggaaaagua

SEQ ID NO: 2511658 - RNA, 21 nt, Human
ucucauaggaaaaguacauuu

SEQ ID NO: 2511659 - RNA, 17 nt, Human
ucucaucucuuagcucc

SEQ ID NO: 2511660 - RNA, 16 nt, Human
ucucauacucaccuca

SEQ ID NO: 2511661 - RNA, 18 nt, Human
ucucauacucaccucacc

SEQ ID NO: 2511662 - RNA, 17 nt, Human
ucucauacguccaccau

SEQ ID NO: 2511663 - RNA, 15 nt, Human
ucucauacguccacc

SEQ ID NO: 2511664 - RNA, 14 nt, Human
ucucauacguccac

SEQ ID NO: 2511665 - RNA, 13 nt, Human
ucucauagcauua

SEQ ID NO: 2511666 - RNA, 20 nt, Human
ucucauagcauuaacuaauc

SEQ ID NO: 2511667 - RNA, 24 nt, Human
ucucauagcauuaacuaaucuauu

SEQ ID NO: 2511668 - RNA, 15 nt, Human
ucucauccugcaggc

SEQ ID NO: 2511669 - RNA, 13 nt, Human
ucucauccugcag

SEQ ID NO: 2511670 - RNA, 20 nt, Human
uccgcucauacaggaaugaa

SEQ ID NO: 2511671 - RNA, 17 nt, Human
uccgccuucacuccggu

SEQ ID NO: 2511672 - RNA, 14 nt, Human
uccgcuggaggugg

SEQ ID NO: 2511673 - RNA, 12 nt, Human
uccgcuggaggu

SEQ ID NO: 2511674 - RNA, 16 nt, Human
uccgcuuucuacccag

SEQ ID NO: 2511675 - RNA, 20 nt, Human
uccgcuuucuacccagcgag

SEQ ID NO: 2511676 - RNA, 18 nt, Human
uccgcuuucuacccagcg

SEQ ID NO: 2511677 - RNA, 20 nt, Human
uccuaagcuauucaguaaua

SEQ ID NO: 2511678 - RNA, 21 nt, Human
uccuaagcuauucaguaauaa

SEQ ID NO: 2511679 - RNA, 15 nt, Human
uccgauccuuccucc

SEQ ID NO: 2511680 - RNA, 23 nt, Human
uccgaggggcgggacccaggcac

SEQ ID NO: 2511681 - RNA, 20 nt, Human
uccgaggggcgggacccagg

SEQ ID NO: 2511682 - RNA, 15 nt, Human
uccgaggggcgggac

SEQ ID NO: 2511683 - RNA, 12 nt, Human
ucccuuggagcu

SEQ ID NO: 2511684 - RNA, 14 nt, Human
uccgauccuuccuc

SEQ ID NO: 2511685 - RNA, 19 nt, Human
ucccuuggaaaccugcccu

SEQ ID NO: 2511686 - RNA, 18 nt, Human
ucccuuggaaaccugccc

SEQ ID NO: 2511687 - RNA, 20 nt, Human
ucccuugccucaaugccagu

SEQ ID NO: 2511688 - RNA, 23 nt, Human
ucccuuggaaaccugcccugccu

SEQ ID NO: 2511689 - RNA, 20 nt, Human
ucccuuggaaaccugcccug

SEQ ID NO: 2511690 - RNA, 16 nt, Human
uccgccagccuccucu

SEQ ID NO: 2511691 - RNA, 15 nt, Human
uccgccagccuccuc

SEQ ID NO: 2511692 - RNA, 14 nt, Human
uccgccagccuccu

SEQ ID NO: 2511693 - RNA, 13 nt, Human
uccgccagccucc

SEQ ID NO: 2511694 - RNA, 12 nt, Human
uccgccagccuc

SEQ ID NO: 2511695 - RNA, 11 nt, Human
uccgccagccu

SEQ ID NO: 2511696 - RNA, 14 nt, Human
uccgccucuugggu

SEQ ID NO: 2511697 - RNA, 20 nt, Human
uccgcccugcuccucccugg

SEQ ID NO: 2511698 - RNA, 20 nt, Human
uccgccagccuccucuggac

SEQ ID NO: 2511699 - RNA, 18 nt, Human
uccgccagccuccucugg

SEQ ID NO: 2511700 - RNA, 17 nt, Human
uccgccagccuccucug

SEQ ID NO: 2511701 - RNA, 22 nt, Human
uccgcccugcuccucccuggcu

SEQ ID NO: 2511702 - RNA, 17 nt, Human
uccgccucugcuggcac

SEQ ID NO: 2511703 - RNA, 12 nt, Human
ucccuugccuca

SEQ ID NO: 2511704 - RNA, 15 nt, Human
ucccuuccucuuucc

SEQ ID NO: 2511705 - RNA, 16 nt, Human
ucccuuccucuuucca

SEQ ID NO: 2511706 - RNA, 14 nt, Human
ucccuucacauagu

SEQ ID NO: 2511707 - RNA, 23 nt, Human
ucccuucaguacccucucagcuc

SEQ ID NO: 2511708 - RNA, 21 nt, Human
ucccuucaguacccucucagc

SEQ ID NO: 2511709 - RNA, 20 nt, Human
ucccuucaguacccucucag

SEQ ID NO: 2511710 - RNA, 19 nt, Human
ucccuucaguacccucuca

SEQ ID NO: 2511711 - RNA, 18 nt, Human
ucccuucaguacccucuc

SEQ ID NO: 2511712 - RNA, 16 nt, Human
ucccuucaguacccuc

SEQ ID NO: 2511713 - RNA, 22 nt, Human
ucccccuucacaaagcccaagg

SEQ ID NO: 2511714 - RNA, 18 nt, Human
ucccuucaucuccaggga

SEQ ID NO: 2511715 - RNA, 13 nt, Human
ucccuucaucucc

SEQ ID NO: 2511716 - RNA, 17 nt, Human
ucccuucccccauaagc

SEQ ID NO: 2511717 - RNA, 12 nt, Human
ucccuuccccuc

SEQ ID NO: 2511718 - RNA, 21 nt, Human
ucccuuccccucccuggcucc

SEQ ID NO: 2511719 - RNA, 20 nt, Human
ucccuuccccucccuggcuc

SEQ ID NO: 2511720 - RNA, 14 nt, Human
ucccccuucacaaa

SEQ ID NO: 2511721 - RNA, 15 nt, Human
ucccccuucacaaag

SEQ ID NO: 2511722 - RNA, 22 nt, Human
ucccuucaaccauuccccaugg

SEQ ID NO: 2511723 - RNA, 19 nt, Human
ucccuucacauaguuuuua

SEQ ID NO: 2511724 - RNA, 15 nt, Human
ucccccuuccaugga

SEQ ID NO: 2511725 - RNA, 19 nt, Human
ucccccuguccccucagcu

SEQ ID NO: 2511726 - RNA, 16 nt, Human
ucccccuguccccuca

SEQ ID NO: 2511727 - RNA, 15 nt, Human
ucccccuguccccuc

SEQ ID NO: 2511728 - RNA, 21 nt, Human
ucccccuggggcuucuccuga

SEQ ID NO: 2511729 - RNA, 20 nt, Human
ucccccuggggcuucuccug

SEQ ID NO: 2511730 - RNA, 10 nt, Human
ucccccuggg

SEQ ID NO: 2511731 - RNA, 23 nt, Human
ucccccugggcucugccccagcu

SEQ ID NO: 2511732 - RNA, 22 nt, Human
uccccccaucuugcuucccuaa

SEQ ID NO: 2511733 - RNA, 13 nt, Human
ucccccccaugca

SEQ ID NO: 2511734 - RNA, 17 nt, Human
ucccccccaugcacugu

SEQ ID NO: 2511735 - RNA, 18 nt, Human
ucccccccaugcacugug

SEQ ID NO: 2511736 - RNA, 15 nt, Human
uccccccaucuugcu

SEQ ID NO: 2511737 - RNA, 12 nt, Human
uccccccaucuu

SEQ ID NO: 2511738 - RNA, 12 nt, Human
uccccccacugc

SEQ ID NO: 2511739 - RNA, 13 nt, Human
uccccccacugca

SEQ ID NO: 2511740 - RNA, 18 nt, Human
uccccccacugcaggccc

SEQ ID NO: 2511741 - RNA, 19 nt, Human
uccccccacugcaggcccc

SEQ ID NO: 2511742 - RNA, 17 nt, Human
uccccccccuguauagu

SEQ ID NO: 2511743 - RNA, 16 nt, Human
uccccccccuguauag

SEQ ID NO: 2511744 - RNA, 16 nt, Human
uccccccccccuccaa

SEQ ID NO: 2511745 - RNA, 23 nt, Human
uccccccacugcaggccccgcuu

SEQ ID NO: 2511746 - RNA, 18 nt, Human
ucccccccggggcugggu

SEQ ID NO: 2511747 - RNA, 14 nt, Human
ucccccccggggcu

SEQ ID NO: 2511748 - RNA, 12 nt, Human
ucccccugggcu

SEQ ID NO: 2511749 - RNA, 14 nt, Human
ucccccugggcucu

SEQ ID NO: 2511750 - RNA, 15 nt, Human
ucccccugggcucug

SEQ ID NO: 2511751 - RNA, 20 nt, Human
ucccccugggcucugcccca

SEQ ID NO: 2511752 - RNA, 22 nt, Human
ucccccugggcucugccccagc

SEQ ID NO: 2511753 - RNA, 10 nt, Human
uccuccaggu

SEQ ID NO: 2511754 - RNA, 13 nt, Human
uccuccagggcca

SEQ ID NO: 2511755 - RNA, 19 nt, Human
uccuccagggccacgugcc

SEQ ID NO: 2511756 - RNA, 20 nt, Human
uccuccagggccacgugcca

SEQ ID NO: 2511757 - RNA, 23 nt, Human
uccuccagggccacgugccaggc

SEQ ID NO: 2511758 - RNA, 10 nt, Human
uccuccagcu

SEQ ID NO: 2511759 - RNA, 13 nt, Human
uccuccagcuucu

SEQ ID NO: 2511760 - RNA, 14 nt, Human
uccuccagcuucug

SEQ ID NO: 2511761 - RNA, 21 nt, Human
uccuccagggaugaucaacag

SEQ ID NO: 2511762 - RNA, 21 nt, Human
uccuccuccaaaggcccccua

SEQ ID NO: 2511763 - RNA, 12 nt, Human
uccucccaccuc

SEQ ID NO: 2511764 - RNA, 20 nt, Human
uccucccaauuucagacucc

SEQ ID NO: 2511765 - RNA, 21 nt, Human
uccucccaauuucagacuccc

SEQ ID NO: 2511766 - RNA, 12 nt, Human
uccuccauggga

SEQ ID NO: 2511767 - RNA, 19 nt, Human
uccuccaucuccaagaaug

SEQ ID NO: 2511768 - RNA, 17 nt, Human
uccucccaaguggugcc

SEQ ID NO: 2511769 - RNA, 16 nt, Human
uccuccauacucagga

SEQ ID NO: 2511770 - RNA, 16 nt, Human
uccuccaucuccaaga

SEQ ID NO: 2511771 - RNA, 17 nt, Human
uccuccaucgcaguguu

SEQ ID NO: 2511772 - RNA, 19 nt, Human
uccuaucaccuccccuccu

SEQ ID NO: 2511773 - RNA, 14 nt, Human
uccucauuccugaa

SEQ ID NO: 2511774 - RNA, 19 nt, Human
uccucauuugggguagcua

SEQ ID NO: 2511775 - RNA, 21 nt, Human
uccucauuugggguagcuaga

SEQ ID NO: 2511776 - RNA, 23 nt, Human
uccucauuugggguagcuagagg

SEQ ID NO: 2511777 - RNA, 17 nt, Human
uccuccaaaggcccccu

SEQ ID NO: 2511778 - RNA, 23 nt, Human
uccuccaaaggaagucuaggagc

SEQ ID NO: 2511779 - RNA, 17 nt, Human
uccuaucagaaguuucu

SEQ ID NO: 2511780 - RNA, 18 nt, Human
uccucauuagcauuuugc

SEQ ID NO: 2511781 - RNA, 23 nt, Human
uccuccacauccuuucuaaacaa

SEQ ID NO: 2511782 - RNA, 23 nt, Human
uccuccaccgccauggcuuccaa

SEQ ID NO: 2511783 - RNA, 22 nt, Human
uccuccaccgccauggcuucca

SEQ ID NO: 2511784 - RNA, 21 nt, Human
uccuccaccgccauggcuucc

SEQ ID NO: 2511785 - RNA, 18 nt, Human
uccuccaccgccauggcu

SEQ ID NO: 2511786 - RNA, 20 nt, Human
uccuccaccugccguggacu

SEQ ID NO: 2511787 - RNA, 19 nt, Human
uccuccacguucugcucau

SEQ ID NO: 2511788 - RNA, 20 nt, Human
uccuccagcagggaaaaugc

SEQ ID NO: 2511789 - RNA, 23 nt, Human
uccuccaaaggcccccuacgcca

SEQ ID NO: 2511790 - RNA, 18 nt, Human
uccuccaaaggcccccua

SEQ ID NO: 2511791 - RNA, 17 nt, Human
uccuccaacaccaagca

SEQ ID NO: 2511792 - RNA, 20 nt, Human
uccuccaagacacuguggac

SEQ ID NO: 2511793 - RNA, 17 nt, Human
uccuccaagaaucuauc

SEQ ID NO: 2511794 - RNA, 22 nt, Human
uccuccaacaccaagcacagca

SEQ ID NO: 2511795 - RNA, 16 nt, Human
uccuccacauccuuuc

SEQ ID NO: 2511796 - RNA, 15 nt, Human
uccuccacauccuuu

SEQ ID NO: 2511797 - RNA, 21 nt, Human
uccuccaagacacuguggacu

SEQ ID NO: 2511798 - RNA, 12 nt, Human
uccuccaagcca

SEQ ID NO: 2511799 - RNA, 14 nt, Human
uccuccaagccagc

SEQ ID NO: 2511800 - RNA, 23 nt, Human
uccuacaguuggaaauccaucca

SEQ ID NO: 2511801 - RNA, 21 nt, Human
uccuacaguuggaaauccauc

SEQ ID NO: 2511802 - RNA, 13 nt, Human
uccuacagccccu

SEQ ID NO: 2511803 - RNA, 17 nt, Human
uccuacagccccuuuuu

SEQ ID NO: 2511804 - RNA, 16 nt, Human
uccuacagauagucaa

SEQ ID NO: 2511805 - RNA, 16 nt, Human
uccuacaccuaacuca

SEQ ID NO: 2511806 - RNA, 15 nt, Human
uccuacaccuaacuc

SEQ ID NO: 2511807 - RNA, 20 nt, Human
uccuacacccuuggacuuga

SEQ ID NO: 2511808 - RNA, 18 nt, Human
uccuacacccuuggacuu

SEQ ID NO: 2511809 - RNA, 17 nt, Human
uccuacacccuuggacu

SEQ ID NO: 2511810 - RNA, 20 nt, Human
uccuacaagagcagccugug

SEQ ID NO: 2511811 - RNA, 22 nt, Human
uccuacaagagcagccuguggc

SEQ ID NO: 2511812 - RNA, 23 nt, Human
uccuacaagagcagccuguggca

SEQ ID NO: 2511813 - RNA, 12 nt, Human
uccuaaggacac

SEQ ID NO: 2511814 - RNA, 17 nt, Human
uccuaaggacacacuaa

SEQ ID NO: 2511815 - RNA, 16 nt, Human
uccuaaggacacacua

SEQ ID NO: 2511816 - RNA, 18 nt, Human
uccuaaggacacacuaau

SEQ ID NO: 2511817 - RNA, 19 nt, Human
uccuacaagagcagccugu

SEQ ID NO: 2511818 - RNA, 21 nt, Human
uccuauauuguuuucagugua

SEQ ID NO: 2511819 - RNA, 19 nt, Human
uccuaucaccuauuuccau

SEQ ID NO: 2511820 - RNA, 20 nt, Human
uccuaucaagccaguacgug

SEQ ID NO: 2511821 - RNA, 14 nt, Human
uccuaucaccuccc

SEQ ID NO: 2511822 - RNA, 16 nt, Human
uccuaucaccuccccu

SEQ ID NO: 2511823 - RNA, 17 nt, Human
uccuaucaccuccccuc

SEQ ID NO: 2511824 - RNA, 23 nt, Human
uccuauauuguuuucaguguaca

SEQ ID NO: 2511825 - RNA, 12 nt, Human
uccuaguuccac

SEQ ID NO: 2511826 - RNA, 23 nt, Human
uccuagucucuaucauuaaaguu

SEQ ID NO: 2511827 - RNA, 22 nt, Human
uccuagugcuuuccuuuuuuaa

SEQ ID NO: 2511828 - RNA, 14 nt, Human
uccuagugaaagag

SEQ ID NO: 2511829 - RNA, 23 nt, Human
uccuagugaaagaggcagcuuga

SEQ ID NO: 2511830 - RNA, 17 nt, Human
uccuaccccucccagcu

SEQ ID NO: 2511831 - RNA, 16 nt, Human
uccuaccccucccagc

SEQ ID NO: 2511832 - RNA, 15 nt, Human
uccuaccccucccag

SEQ ID NO: 2511833 - RNA, 14 nt, Human
uccuaccccuccca

SEQ ID NO: 2511834 - RNA, 13 nt, Human
uccuaccccuccc

SEQ ID NO: 2511835 - RNA, 12 nt, Human
uccuaccccucc

SEQ ID NO: 2511836 - RNA, 21 nt, Human
uccuaccccaauuccuuguag

SEQ ID NO: 2511837 - RNA, 18 nt, Human
uccuagucucccucacag

SEQ ID NO: 2511838 - RNA, 21 nt, Human
uccuacccucgggcccaccug

SEQ ID NO: 2511839 - RNA, 17 nt, Human
uccuacccucgggccca

SEQ ID NO: 2511840 - RNA, 18 nt, Human
uccuaccccucccagcug

SEQ ID NO: 2511841 - RNA, 18 nt, Human
uccuagguaggguuuaau

SEQ ID NO: 2511842 - RNA, 16 nt, Human
uccuggcacugcuucc

SEQ ID NO: 2511843 - RNA, 13 nt, Human
uccuggcacugcu

SEQ ID NO: 2511844 - RNA, 17 nt, Human
uccuggcaauagucaaa

SEQ ID NO: 2511845 - RNA, 23 nt, Human
uccuggcacccggccccugcugg

SEQ ID NO: 2511846 - RNA, 14 nt, Human
uccuggcccaucag

SEQ ID NO: 2511847 - RNA, 13 nt, Human
uccuggcccauca

SEQ ID NO: 2511848 - RNA, 11 nt, Human
uccuggcccau

SEQ ID NO: 2511849 - RNA, 13 nt, Human
uccuggcccucug

SEQ ID NO: 2511850 - RNA, 17 nt, Human
uccuggcccaucagugu

SEQ ID NO: 2511851 - RNA, 18 nt, Human
uccuggcccaucagugua

SEQ ID NO: 2511852 - RNA, 12 nt, Human
uccuggccucaa

SEQ ID NO: 2511853 - RNA, 11 nt, Human
uccuguagccc

SEQ ID NO: 2511854 - RNA, 13 nt, Human
uccuguagcccua

SEQ ID NO: 2511855 - RNA, 13 nt, Human
uccuggccuggca

SEQ ID NO: 2511856 - RNA, 23 nt, Human
uccuggccuggcacaucagaaag

SEQ ID NO: 2511857 - RNA, 16 nt, Human
uccuggcccucugugu

SEQ ID NO: 2511858 - RNA, 16 nt, Human
uccuggccuggcuucu

SEQ ID NO: 2511859 - RNA, 20 nt, Human
uccuguagaccuagggagga

SEQ ID NO: 2511860 - RNA, 15 nt, Human
uccuguagcaucuuc

SEQ ID NO: 2511861 - RNA, 14 nt, Human
uccuguagcaucuu

SEQ ID NO: 2511862 - RNA, 21 nt, Human
uccuguagagguuuuguuguu

SEQ ID NO: 2511863 - RNA, 23 nt, Human
uccuguagaccuagggaggaccu

SEQ ID NO: 2511864 - RNA, 15 nt, Human
uccugucucuggccu

SEQ ID NO: 2511865 - RNA, 15 nt, Human
uccugucuaacugcu

SEQ ID NO: 2511866 - RNA, 22 nt, Human
uccuguagccuucuguaggaau

SEQ ID NO: 2511867 - RNA, 21 nt, Human
uccuguagccuucuguaggaa

SEQ ID NO: 2511868 - RNA, 12 nt, Human
uccugucugcca

SEQ ID NO: 2511869 - RNA, 13 nt, Human
uccugucugccag

SEQ ID NO: 2511870 - RNA, 14 nt, Human
uccugucugccagc

SEQ ID NO: 2511871 - RNA, 16 nt, Human
uccugucugccagcca

SEQ ID NO: 2511872 - RNA, 16 nt, Human
uccuguagcucucccu

SEQ ID NO: 2511873 - RNA, 22 nt, Human
uccuguagcaucuucuggaguc

SEQ ID NO: 2511874 - RNA, 21 nt, Human
uccuguagcaucuucuggagu

SEQ ID NO: 2511875 - RNA, 19 nt, Human
uccuguagcaucuucugga

SEQ ID NO: 2511876 - RNA, 17 nt, Human
uccuguagcaucuucug

SEQ ID NO: 2511877 - RNA, 16 nt, Human
uccugccuaaggcuga

SEQ ID NO: 2511878 - RNA, 19 nt, Human
uccugccuaaggcugaacu

SEQ ID NO: 2511879 - RNA, 21 nt, Human
uccuggacaugaagauucuuu

SEQ ID NO: 2511880 - RNA, 21 nt, Human
uccuggacauccucuucugcu

SEQ ID NO: 2511881 - RNA, 14 nt, Human
uccuggacauuuuu

SEQ ID NO: 2511882 - RNA, 22 nt, Human
uccuggacauccucuucugcuu

SEQ ID NO: 2511883 - RNA, 22 nt, Human
uccuggacaugaagauucuuuc

SEQ ID NO: 2511884 - RNA, 19 nt, Human
uccuggacauuuuuucagu

SEQ ID NO: 2511885 - RNA, 15 nt, Human
uccuggaggcccagu

SEQ ID NO: 2511886 - RNA, 18 nt, Human
uccuggaggcccaguuca

SEQ ID NO: 2511887 - RNA, 21 nt, Human
uccuggagggaagcacugccu

SEQ ID NO: 2511888 - RNA, 14 nt, Human
uccuggaguucugg

SEQ ID NO: 2511889 - RNA, 19 nt, Human
uccuggagcagaccacccc

SEQ ID NO: 2511890 - RNA, 18 nt, Human
uccuggagcagaccaccc

SEQ ID NO: 2511891 - RNA, 18 nt, Human
uccuggagcccagaggag

SEQ ID NO: 2511892 - RNA, 15 nt, Human
uccuggagcccagag

SEQ ID NO: 2511893 - RNA, 13 nt, Human
uccuggaggccca

SEQ ID NO: 2511894 - RNA, 14 nt, Human
uccuggaggcccag

SEQ ID NO: 2511895 - RNA, 22 nt, Human
uccuggagcccagaggagggca

SEQ ID NO: 2511896 - RNA, 18 nt, Human
uccuggagccuuugaaua

SEQ ID NO: 2511897 - RNA, 17 nt, Human
uccugcccuuaccugcc

SEQ ID NO: 2511898 - RNA, 21 nt, Human
uccugcccugggaggcaguga

SEQ ID NO: 2511899 - RNA, 23 nt, Human
uccugcccuacagaggucucugc

SEQ ID NO: 2511900 - RNA, 14 nt, Human
uccugcccuacaga

SEQ ID NO: 2511901 - RNA, 12 nt, Human
uccugcccuguu

SEQ ID NO: 2511902 - RNA, 11 nt, Human
uccugcccugg

SEQ ID NO: 2511903 - RNA, 12 nt, Human
uccugcccuggg

SEQ ID NO: 2511904 - RNA, 14 nt, Human
uccugcccugggag

SEQ ID NO: 2511905 - RNA, 15 nt, Human
uccugcccugggagg

SEQ ID NO: 2511906 - RNA, 16 nt, Human
uccugccgacuccugg

SEQ ID NO: 2511907 - RNA, 15 nt, Human
uccugccgacuccug

SEQ ID NO: 2511908 - RNA, 14 nt, Human
uccugccgacuccu

SEQ ID NO: 2511909 - RNA, 19 nt, Human
uccugcccuuccucaguuu

SEQ ID NO: 2511910 - RNA, 17 nt, Human
uccugcccuuccucagu

SEQ ID NO: 2511911 - RNA, 16 nt, Human
uccugcccuuccucag

SEQ ID NO: 2511912 - RNA, 15 nt, Human
uccugcccuuccuca

SEQ ID NO: 2511913 - RNA, 18 nt, Human
uccugcccuguuguguau

SEQ ID NO: 2511914 - RNA, 20 nt, Human
uccugcccuuaccugccagg

SEQ ID NO: 2511915 - RNA, 17 nt, Human
uccugccgcagagcugg

SEQ ID NO: 2511916 - RNA, 16 nt, Human
uccugccgcagagcug

SEQ ID NO: 2511917 - RNA, 15 nt, Human
uccugccgcagagcu

SEQ ID NO: 2511918 - RNA, 13 nt, Human
uccugccgcagag

SEQ ID NO: 2511919 - RNA, 20 nt, Human
uccugccgcagagcuggccg

SEQ ID NO: 2511920 - RNA, 18 nt, Human
uccugccgcagagcuggc

SEQ ID NO: 2511921 - RNA, 19 nt, Human
uccugaggcuccacuuggu

SEQ ID NO: 2511922 - RNA, 20 nt, Human
uccugaggcuccacuugguc

SEQ ID NO: 2511923 - RNA, 19 nt, Human
uccugaggacagcuguccu

SEQ ID NO: 2511924 - RNA, 16 nt, Human
uccugcauuugugaaa

SEQ ID NO: 2511925 - RNA, 11 nt, Human
uccugccaaaa

SEQ ID NO: 2511926 - RNA, 11 nt, Human
uccugccacca

SEQ ID NO: 2511927 - RNA, 16 nt, Human
uccugccaccacgccc

SEQ ID NO: 2511928 - RNA, 22 nt, Human
uccugccaccagucacuguccc

SEQ ID NO: 2511929 - RNA, 17 nt, Human
uccugccaccagucacu

SEQ ID NO: 2511930 - RNA, 16 nt, Human
uccugccaccagucac

SEQ ID NO: 2511931 - RNA, 14 nt, Human
uccugccaccaguc

SEQ ID NO: 2511932 - RNA, 13 nt, Human
uccugccaccugc

SEQ ID NO: 2511933 - RNA, 13 nt, Human
uccugccaggcau

SEQ ID NO: 2511934 - RNA, 14 nt, Human
uccugccaggcaug

SEQ ID NO: 2511935 - RNA, 22 nt, Human
uccugcccccugaaacuuauuu

SEQ ID NO: 2511936 - RNA, 21 nt, Human
uccugcccccugaaacuuauu

SEQ ID NO: 2511937 - RNA, 19 nt, Human
uccugcccccugaaacuua

SEQ ID NO: 2511938 - RNA, 17 nt, Human
uccugcccccugaaacu

SEQ ID NO: 2511939 - RNA, 17 nt, Human
uccugccccugagccca

SEQ ID NO: 2511940 - RNA, 18 nt, Human
uccugccccugagcccau

SEQ ID NO: 2511941 - RNA, 12 nt, Human
uccugcccuaca

SEQ ID NO: 2511942 - RNA, 14 nt, Human
uccugccccuguuc

SEQ ID NO: 2511943 - RNA, 16 nt, Human
uccugccccuguucuc

SEQ ID NO: 2511944 - RNA, 10 nt, Human
uccugcccug

SEQ ID NO: 2511945 - RNA, 17 nt, Human
uccugccaguguggaac

SEQ ID NO: 2511946 - RNA, 18 nt, Human
uccugccaccuggggcag

SEQ ID NO: 2511947 - RNA, 20 nt, Human
uccugccaccuggggcaguc

SEQ ID NO: 2511948 - RNA, 12 nt, Human
uccugcccagga

SEQ ID NO: 2511949 - RNA, 13 nt, Human
uccugcccaggag

SEQ ID NO: 2511950 - RNA, 14 nt, Human
uccugcccaggaga

SEQ ID NO: 2511951 - RNA, 16 nt, Human
uccugcccaggagagc

SEQ ID NO: 2511952 - RNA, 18 nt, Human
uccugcccaggagagcca

SEQ ID NO: 2511953 - RNA, 19 nt, Human
uccugcccaggagagccag

SEQ ID NO: 2511954 - RNA, 22 nt, Human
uccugcccaggagagccagccc

SEQ ID NO: 2511955 - RNA, 23 nt, Human
uccugcccaggagagccagcccu

SEQ ID NO: 2511956 - RNA, 15 nt, Human
uccugccccaggccu

SEQ ID NO: 2511957 - RNA, 14 nt, Human
uccugccccaggcc

SEQ ID NO: 2511958 - RNA, 15 nt, Human
uccugcccccugaaa

SEQ ID NO: 2511959 - RNA, 16 nt, Human
uccugcccaguccccc

SEQ ID NO: 2511960 - RNA, 15 nt, Human
uccugcccagucccc

SEQ ID NO: 2511961 - RNA, 14 nt, Human
uccugcccaguccc

SEQ ID NO: 2511962 - RNA, 13 nt, Human
uccugcccagucc

SEQ ID NO: 2511963 - RNA, 21 nt, Human
uccugcccagucccccaaccc

SEQ ID NO: 2511964 - RNA, 17 nt, Human
uccugcccaguccccca

SEQ ID NO: 2511965 - RNA, 18 nt, Human
uccucugucugcccuuca

SEQ ID NO: 2511966 - RNA, 15 nt, Human
uccucugucugcccu

SEQ ID NO: 2511967 - RNA, 19 nt, Human
uccucugugaccaaugucu

SEQ ID NO: 2511968 - RNA, 21 nt, Human
uccucugugaccaaugucuug

SEQ ID NO: 2511969 - RNA, 20 nt, Human
uccucugugaccaaugucuu

SEQ ID NO: 2511970 - RNA, 12 nt, Human
uccucugugaag

SEQ ID NO: 2511971 - RNA, 22 nt, Human
uccucuguuucuccuucugaaa

SEQ ID NO: 2511972 - RNA, 14 nt, Human
uccucugucugccc

SEQ ID NO: 2511973 - RNA, 12 nt, Human
uccucugucugc

SEQ ID NO: 2511974 - RNA, 23 nt, Human
uccucuguccagggcccugagcu

SEQ ID NO: 2511975 - RNA, 12 nt, Human
uccuccucugug

SEQ ID NO: 2511976 - RNA, 22 nt, Human
uccucuguccaggcacugcugc

SEQ ID NO: 2511977 - RNA, 14 nt, Human
uccucuguccaggg

SEQ ID NO: 2511978 - RNA, 16 nt, Human
uccucuguccagggcc

SEQ ID NO: 2511979 - RNA, 20 nt, Human
uccuccucccacccggcugc

SEQ ID NO: 2511980 - RNA, 14 nt, Human
uccuccucccaccc

SEQ ID NO: 2511981 - RNA, 19 nt, Human
uccucccaaguggugccua

SEQ ID NO: 2511982 - RNA, 21 nt, Human
uccucccacccggcugcagag

SEQ ID NO: 2511983 - RNA, 20 nt, Human
uccucccacccggcugcaga

SEQ ID NO: 2511984 - RNA, 11 nt, Human
uccuccucugu

SEQ ID NO: 2511985 - RNA, 13 nt, Human
uccuccucuguga

SEQ ID NO: 2511986 - RNA, 17 nt, Human
uccuccucccugcaucu

SEQ ID NO: 2511987 - RNA, 18 nt, Human
uccuccucccugcaucug

SEQ ID NO: 2511988 - RNA, 13 nt, Human
uccuccucccugc

SEQ ID NO: 2511989 - RNA, 14 nt, Human
uccuccucccugca

SEQ ID NO: 2511990 - RNA, 15 nt, Human
uccuccucccccaga

SEQ ID NO: 2511991 - RNA, 21 nt, Human
uccugacuucaggggcugccc

SEQ ID NO: 2511992 - RNA, 21 nt, Human
uccugagccagauuucacucu

SEQ ID NO: 2511993 - RNA, 22 nt, Human
uccugacuucaggggcugcccg

SEQ ID NO: 2511994 - RNA, 19 nt, Human
uccugacuucaggggcugc

SEQ ID NO: 2511995 - RNA, 16 nt, Human
uccugacuucaggggc

SEQ ID NO: 2511996 - RNA, 19 nt, Human
uccugagaaaaaagguucc

SEQ ID NO: 2511997 - RNA, 24 nt, Human
uccugagaaaaaagguuccgcuug

SEQ ID NO: 2511998 - RNA, 13 nt, Human
uccucuuauuugc

SEQ ID NO: 2511999 - RNA, 20 nt, Human
uccucuuaaaaaauaaaaac

SEQ ID NO: 2512000 - RNA, 15 nt, Human
uccugacucugcccc

SEQ ID NO: 2512001 - RNA, 14 nt, Human
uccugacucugccc

SEQ ID NO: 2512002 - RNA, 19 nt, Human
uccugacucaacauguuac

SEQ ID NO: 2512003 - RNA, 23 nt, Human
uccugacucugcccccugcuggc

SEQ ID NO: 2512004 - RNA, 22 nt, Human
uccugacucugcccccugcugg

SEQ ID NO: 2512005 - RNA, 17 nt, Human
uccugacucugcccccu

SEQ ID NO: 2512006 - RNA, 16 nt, Human
uccugacucugccccc

SEQ ID NO: 2512007 - RNA, 12 nt, Human
uccugagcuugg

SEQ ID NO: 2512008 - RNA, 15 nt, Human
uccugagcuuggcca

SEQ ID NO: 2512009 - RNA, 16 nt, Human
uccugagcuuggccag

SEQ ID NO: 2512010 - RNA, 19 nt, Human
uccugagcuuggccagaag

SEQ ID NO: 2512011 - RNA, 20 nt, Human
uccugagcuuggccagaagg

SEQ ID NO: 2512012 - RNA, 18 nt, Human
uccugaggacagcugucc

SEQ ID NO: 2512013 - RNA, 16 nt, Human
uccugaggacagcugu

SEQ ID NO: 2512014 - RNA, 22 nt, Human
uccugagcuuggccagaagggg

SEQ ID NO: 2512015 - RNA, 16 nt, Human
uccugagaccacagag

SEQ ID NO: 2512016 - RNA, 23 nt, Human
uccugagaauaagaaaguuucac

SEQ ID NO: 2512017 - RNA, 23 nt, Human
uccugagccagugucaggaggaa

SEQ ID NO: 2512018 - RNA, 22 nt, Human
ucccaggacaccacacccagcc

SEQ ID NO: 2512019 - RNA, 21 nt, Human
ucccaggacaccacacccagc

SEQ ID NO: 2512020 - RNA, 19 nt, Human
ucccaggacaccacaccca

SEQ ID NO: 2512021 - RNA, 18 nt, Human
ucccaggacaccacaccc

SEQ ID NO: 2512022 - RNA, 23 nt, Human
ucccaggaacaaucgauggccuu

SEQ ID NO: 2512023 - RNA, 15 nt, Human
ucccaggacaccaca

SEQ ID NO: 2512024 - RNA, 23 nt, Human
ucccaggacaccacacccagccu

SEQ ID NO: 2512025 - RNA, 11 nt, Human
ucccaggaccc

SEQ ID NO: 2512026 - RNA, 24 nt, Human
ucccaggcauuccccaggaggcca

SEQ ID NO: 2512027 - RNA, 23 nt, Human
ucccaggcauuccccaggaggcc

SEQ ID NO: 2512028 - RNA, 12 nt, Human
ucccaggacccu

SEQ ID NO: 2512029 - RNA, 15 nt, Human
ucccaggccaggcuc

SEQ ID NO: 2512030 - RNA, 21 nt, Human
ucccaggccaggcuccuuccu

SEQ ID NO: 2512031 - RNA, 22 nt, Human
ucccagcugugcucuggacagg

SEQ ID NO: 2512032 - RNA, 21 nt, Human
ucccagcugugcucuggacag

SEQ ID NO: 2512033 - RNA, 11 nt, Human
ucccaggaacu

SEQ ID NO: 2512034 - RNA, 16 nt, Human
ucccaggaacugggcc

SEQ ID NO: 2512035 - RNA, 23 nt, Human
ucccagcugugcucuggacaggc

SEQ ID NO: 2512036 - RNA, 24 nt, Human
ucccaugacccaccccugugcucc

SEQ ID NO: 2512037 - RNA, 22 nt, Human
ucccaugacccaccccugugcu

SEQ ID NO: 2512038 - RNA, 21 nt, Human
ucccaugacccaccccugugc

SEQ ID NO: 2512039 - RNA, 20 nt, Human
ucccaugacccaccccugug

SEQ ID NO: 2512040 - RNA, 18 nt, Human
ucccaugacccaccccug

SEQ ID NO: 2512041 - RNA, 17 nt, Human
ucccaugacccaccccu

SEQ ID NO: 2512042 - RNA, 16 nt, Human
ucccaugacccacccc

SEQ ID NO: 2512043 - RNA, 14 nt, Human
ucccaugacccacc

SEQ ID NO: 2512044 - RNA, 19 nt, Human
ucccaugaacacacugugu

SEQ ID NO: 2512045 - RNA, 17 nt, Human
ucccaugaacacacugu

SEQ ID NO: 2512046 - RNA, 16 nt, Human
ucccaugaacacacug

SEQ ID NO: 2512047 - RNA, 14 nt, Human
ucccaugaacacac

SEQ ID NO: 2512048 - RNA, 19 nt, Human
ucccaugagccucagcauc

SEQ ID NO: 2512049 - RNA, 18 nt, Human
ucccaugagccucagcau

SEQ ID NO: 2512050 - RNA, 18 nt, Human
ucccaggccaguaaggga

SEQ ID NO: 2512051 - RNA, 21 nt, Human
ucccaucugugaaaggaaaga

SEQ ID NO: 2512052 - RNA, 16 nt, Human
ucccaggcgccccuuc

SEQ ID NO: 2512053 - RNA, 15 nt, Human
ucccaucuuccaagg

SEQ ID NO: 2512054 - RNA, 18 nt, Human
ucccaccuuggcugcagg

SEQ ID NO: 2512055 - RNA, 20 nt, Human
ucccagcugugcucuggaca

SEQ ID NO: 2512056 - RNA, 17 nt, Human
ucccaccuuggcugcag

SEQ ID NO: 2512057 - RNA, 16 nt, Human
ucccaccuuggcugca

SEQ ID NO: 2512058 - RNA, 22 nt, Human
ucccaccucuucucuuccugua

SEQ ID NO: 2512059 - RNA, 13 nt, Human
ucccaccuuggcu

SEQ ID NO: 2512060 - RNA, 22 nt, Human
ucccaccucugugaccucaggc

SEQ ID NO: 2512061 - RNA, 21 nt, Human
ucccaccucugugaccucagg

SEQ ID NO: 2512062 - RNA, 20 nt, Human
ucccaccucugugaccucag

SEQ ID NO: 2512063 - RNA, 18 nt, Human
ucccaccucugugaccuc

SEQ ID NO: 2512064 - RNA, 22 nt, Human
uccauucacaguucuuugggcc

SEQ ID NO: 2512065 - RNA, 15 nt, Human
uccauuauuuauauu

SEQ ID NO: 2512066 - RNA, 13 nt, Human
ucccaccucugug

SEQ ID NO: 2512067 - RNA, 11 nt, Human
ucccaccucug

SEQ ID NO: 2512068 - RNA, 12 nt, Human
uccauuccagaa

SEQ ID NO: 2512069 - RNA, 18 nt, Human
uccaugugguucuucaaa

SEQ ID NO: 2512070 - RNA, 22 nt, Human
uccauguggagaaaggagugaa

SEQ ID NO: 2512071 - RNA, 13 nt, Human
uccauguggagaa

SEQ ID NO: 2512072 - RNA, 17 nt, Human
uccauguguggacucaa

SEQ ID NO: 2512073 - RNA, 11 nt, Human
uccaugugugu

SEQ ID NO: 2512074 - RNA, 13 nt, Human
uccaugugugugc

SEQ ID NO: 2512075 - RNA, 14 nt, Human
uccaugugugugca

SEQ ID NO: 2512076 - RNA, 17 nt, Human
uccauguugcugccaac

SEQ ID NO: 2512077 - RNA, 15 nt, Human
uccauguugcugcca

SEQ ID NO: 2512078 - RNA, 14 nt, Human
uccauguugcugcc

SEQ ID NO: 2512079 - RNA, 18 nt, Human
uccaugugugugcaagug

SEQ ID NO: 2512080 - RNA, 18 nt, Human
uccauguuaguuuuuacu

SEQ ID NO: 2512081 - RNA, 12 nt, Human
uccauguugcug

SEQ ID NO: 2512082 - RNA, 19 nt, Human
uccauguuaguuuuuacuu

SEQ ID NO: 2512083 - RNA, 19 nt, Human
uccaugugcccccucuacc

SEQ ID NO: 2512084 - RNA, 23 nt, Human
uccaugggcagagcccaagggaa

SEQ ID NO: 2512085 - RNA, 20 nt, Human
uccauggcuuccuccucccu

SEQ ID NO: 2512086 - RNA, 14 nt, Human
uccaugugcccccu

SEQ ID NO: 2512087 - RNA, 20 nt, Human
uccaugugggcuaguugggc

SEQ ID NO: 2512088 - RNA, 22 nt, Human
ucccaccucucucacuccuuga

SEQ ID NO: 2512089 - RNA, 20 nt, Human
uccauuaucauguguaauca

SEQ ID NO: 2512090 - RNA, 15 nt, Human
uccauuaugauucuu

SEQ ID NO: 2512091 - RNA, 11 nt, Human
uccauuauuua

SEQ ID NO: 2512092 - RNA, 12 nt, Human
uccauuauuuau

SEQ ID NO: 2512093 - RNA, 14 nt, Human
uccauuauuuauau

SEQ ID NO: 2512094 - RNA, 16 nt, Human
uccauguuuguaaaac

SEQ ID NO: 2512095 - RNA, 13 nt, Human
uccauguuuguaa

SEQ ID NO: 2512096 - RNA, 19 nt, Human
uccauguuuguaaaacuac

SEQ ID NO: 2512097 - RNA, 22 nt, Human
uccauuaacuuagcauguguug

SEQ ID NO: 2512098 - RNA, 17 nt, Human
uccauuaucauguguaa

SEQ ID NO: 2512099 - RNA, 16 nt, Human
uccauuaucaugugua

SEQ ID NO: 2512100 - RNA, 15 nt, Human
uccauuaucaugugu

SEQ ID NO: 2512101 - RNA, 14 nt, Human
uccauuaucaugug

SEQ ID NO: 2512102 - RNA, 14 nt, Human
uccauuaggauuug

SEQ ID NO: 2512103 - RNA, 13 nt, Human
uccauuaucaugu

SEQ ID NO: 2512104 - RNA, 20 nt, Human
uccauuaacuuagcaugugu

SEQ ID NO: 2512105 - RNA, 22 nt, Human
uccccagagaaaggggagccca

SEQ ID NO: 2512106 - RNA, 23 nt, Human
uccccagagaaaggggagcccac

SEQ ID NO: 2512107 - RNA, 18 nt, Human
uccccagauugcaacagg

SEQ ID NO: 2512108 - RNA, 13 nt, Human
uccccagauugca

SEQ ID NO: 2512109 - RNA, 10 nt, Human
ucccaugugg

SEQ ID NO: 2512110 - RNA, 23 nt, Human
ucccauuaggacaaucagucccc

SEQ ID NO: 2512111 - RNA, 21 nt, Human
ucccauuaggacaaucagucc

SEQ ID NO: 2512112 - RNA, 16 nt, Human
ucccauuagcaaaaau

SEQ ID NO: 2512113 - RNA, 22 nt, Human
ucccauguauuuaucucuauuu

SEQ ID NO: 2512114 - RNA, 22 nt, Human
ucccauguagcccccuggccuc

SEQ ID NO: 2512115 - RNA, 14 nt, Human
ucccaugacccagg

SEQ ID NO: 2512116 - RNA, 20 nt, Human
ucccaugagccucagcaucc

SEQ ID NO: 2512117 - RNA, 22 nt, Human
uccccagcaagugagagcuggg

SEQ ID NO: 2512118 - RNA, 17 nt, Human
uccccagaguuccccau

SEQ ID NO: 2512119 - RNA, 19 nt, Human
uccccagaguccucuauga

SEQ ID NO: 2512120 - RNA, 21 nt, Human
uccccagagcacuggguugca

SEQ ID NO: 2512121 - RNA, 12 nt, Human
uccccagagcac

SEQ ID NO: 2512122 - RNA, 20 nt, Human
uccccagaguuccccaugca

SEQ ID NO: 2512123 - RNA, 18 nt, Human
uccccagaguuccccaug

SEQ ID NO: 2512124 - RNA, 21 nt, Human
uccccagcagggucuuuucau

SEQ ID NO: 2512125 - RNA, 10 nt, Human
uccccagcag

SEQ ID NO: 2512126 - RNA, 21 nt, Human
uccccagcaagugagagcugg

SEQ ID NO: 2512127 - RNA, 20 nt, Human
uccccagcaagugagagcug

SEQ ID NO: 2512128 - RNA, 23 nt, Human
uccccagauugcaacaggcuggg

SEQ ID NO: 2512129 - RNA, 22 nt, Human
uccccagauugcaacaggcugg

SEQ ID NO: 2512130 - RNA, 20 nt, Human
uccccagauugcaacaggcu

SEQ ID NO: 2512131 - RNA, 19 nt, Human
uccccagauugcaacaggc

SEQ ID NO: 2512132 - RNA, 21 nt, Human
ucccccagccccauccucugu

SEQ ID NO: 2512133 - RNA, 20 nt, Human
ucccccagccccauccucug

SEQ ID NO: 2512134 - RNA, 22 nt, Human
ucccccagccccauccucugua

SEQ ID NO: 2512135 - RNA, 12 nt, Human
uccccccacucu

SEQ ID NO: 2512136 - RNA, 21 nt, Human
uccccccacucuccccacacu

SEQ ID NO: 2512137 - RNA, 16 nt, Human
uccccaggaggccagc

SEQ ID NO: 2512138 - RNA, 15 nt, Human
uccccaggaggccag

SEQ ID NO: 2512139 - RNA, 17 nt, Human
ucccccagccccauccu

SEQ ID NO: 2512140 - RNA, 14 nt, Human
uccccaggaggcca

SEQ ID NO: 2512141 - RNA, 18 nt, Human
uccccagcccuggcucug

SEQ ID NO: 2512142 - RNA, 15 nt, Human
uccccagcccuggcu

SEQ ID NO: 2512143 - RNA, 21 nt, Human
uccccagccccuagcccagga

SEQ ID NO: 2512144 - RNA, 13 nt, Human
uccccagcccagg

SEQ ID NO: 2512145 - RNA, 14 nt, Human
uccccagcccaggg

SEQ ID NO: 2512146 - RNA, 15 nt, Human
uccccagcccagggu

SEQ ID NO: 2512147 - RNA, 22 nt, Human
uccccagcccaggguuccccca

SEQ ID NO: 2512148 - RNA, 23 nt, Human
uccccagcccaggguucccccag

SEQ ID NO: 2512149 - RNA, 16 nt, Human
uccccagccccuagcc

SEQ ID NO: 2512150 - RNA, 15 nt, Human
uccccagccccuagc

SEQ ID NO: 2512151 - RNA, 13 nt, Human
uccccagccccua

SEQ ID NO: 2512152 - RNA, 11 nt, Human
uccccagcccc

SEQ ID NO: 2512153 - RNA, 20 nt, Human
uccccagccccuagcccagg

SEQ ID NO: 2512154 - RNA, 19 nt, Human
uccccagccccuagcccag

SEQ ID NO: 2512155 - RNA, 13 nt, Human
uccccagcccugg

SEQ ID NO: 2512156 - RNA, 20 nt, Human
uccccagcauuccagccccu

SEQ ID NO: 2512157 - RNA, 15 nt, Human
uccccagcagguggg

SEQ ID NO: 2512158 - RNA, 23 nt, Human
uccccagcagggucuuuucaucu

SEQ ID NO: 2512159 - RNA, 22 nt, Human
uccccagcagggucuuuucauc

SEQ ID NO: 2512160 - RNA, 19 nt, Human
uccccagcagguggggagg

SEQ ID NO: 2512161 - RNA, 14 nt, Human
uccccagcccagag

SEQ ID NO: 2512162 - RNA, 15 nt, Human
uccccagcccagaga

SEQ ID NO: 2512163 - RNA, 16 nt, Human
uccccagcccagagac

SEQ ID NO: 2512164 - RNA, 17 nt, Human
uccccagcccagagaca

SEQ ID NO: 2512165 - RNA, 10 nt, Human
uccccagccc

SEQ ID NO: 2512166 - RNA, 13 nt, Human
uccccagcccaga

SEQ ID NO: 2512167 - RNA, 12 nt, Human
uccccagcccag

SEQ ID NO: 2512168 - RNA, 14 nt, Human
uccaguuaguucuc

SEQ ID NO: 2512169 - RNA, 16 nt, Human
uccaguucaugagaau

SEQ ID NO: 2512170 - RNA, 18 nt, Human
uccaguucccagaaggca

SEQ ID NO: 2512171 - RNA, 19 nt, Human
uccaguucaugagaaucua

SEQ ID NO: 2512172 - RNA, 22 nt, Human
uccaguuaaaaaaaauuuuaau

SEQ ID NO: 2512173 - RNA, 21 nt, Human
uccaguuaaaaaaaauuuuaa

SEQ ID NO: 2512174 - RNA, 18 nt, Human
uccaguuaauuacauccu

SEQ ID NO: 2512175 - RNA, 13 nt, Human
uccaguucccacu

SEQ ID NO: 2512176 - RNA, 20 nt, Human
uccauaaagaagcaauaaag

SEQ ID NO: 2512177 - RNA, 18 nt, Human
uccauaaagaagcaauaa

SEQ ID NO: 2512178 - RNA, 13 nt, Human
uccauaaagaagc

SEQ ID NO: 2512179 - RNA, 21 nt, Human
uccauaaagaagauguuuaac

SEQ ID NO: 2512180 - RNA, 17 nt, Human
uccauaaagaagauguu

SEQ ID NO: 2512181 - RNA, 20 nt, Human
uccaguuuuuuguuauauag

SEQ ID NO: 2512182 - RNA, 22 nt, Human
uccauaaucuggacuccucugu

SEQ ID NO: 2512183 - RNA, 17 nt, Human
uccauaaccccacccuu

SEQ ID NO: 2512184 - RNA, 14 nt, Human
uccauaaccccacc

SEQ ID NO: 2512185 - RNA, 12 nt, Human
uccauaaucacu

SEQ ID NO: 2512186 - RNA, 16 nt, Human
uccauaaggaauguag

SEQ ID NO: 2512187 - RNA, 23 nt, Human
uccagguuuuucaauuaaacgga

SEQ ID NO: 2512188 - RNA, 22 nt, Human
uccagguuuuucaauuaaacgg

SEQ ID NO: 2512189 - RNA, 21 nt, Human
uccagguuuuucaauuaaacg

SEQ ID NO: 2512190 - RNA, 20 nt, Human
uccagguuuuucaauuaaac

SEQ ID NO: 2512191 - RNA, 19 nt, Human
uccagguuuuucaauuaaa

SEQ ID NO: 2512192 - RNA, 18 nt, Human
uccagguuuuucaauuaa

SEQ ID NO: 2512193 - RNA, 17 nt, Human
uccagguuuuucaauua

SEQ ID NO: 2512194 - RNA, 16 nt, Human
uccagguuuuucaauu

SEQ ID NO: 2512195 - RNA, 24 nt, Human
uccagguuuuucaauuaaacggau

SEQ ID NO: 2512196 - RNA, 15 nt, Human
uccagguuuuucaau

SEQ ID NO: 2512197 - RNA, 14 nt, Human
uccagguuuuucaa

SEQ ID NO: 2512198 - RNA, 13 nt, Human
uccagguuuuuca

SEQ ID NO: 2512199 - RNA, 17 nt, Human
uccagguaucuccagga

SEQ ID NO: 2512200 - RNA, 16 nt, Human
uccagguaucuccagg

SEQ ID NO: 2512201 - RNA, 18 nt, Human
uccagguaucuccaggau

SEQ ID NO: 2512202 - RNA, 20 nt, Human
uccagguuuaagcuguuacu

SEQ ID NO: 2512203 - RNA, 19 nt, Human
uccagguagagggugugua

SEQ ID NO: 2512204 - RNA, 18 nt, Human
uccaggguugaucacacu

SEQ ID NO: 2512205 - RNA, 17 nt, Human
uccagggugugugcucg

SEQ ID NO: 2512206 - RNA, 15 nt, Human
uccagguaucuccag

SEQ ID NO: 2512207 - RNA, 16 nt, Human
uccaggucucacgggc

SEQ ID NO: 2512208 - RNA, 16 nt, Human
uccauggcuuccuccu

SEQ ID NO: 2512209 - RNA, 15 nt, Human
uccauggcuuccucc

SEQ ID NO: 2512210 - RNA, 23 nt, Human
uccauggaaugcuugaaaaaugu

SEQ ID NO: 2512211 - RNA, 22 nt, Human
uccauggaaugcuugaaaaaug

SEQ ID NO: 2512212 - RNA, 18 nt, Human
uccaugggagaaaauaga

SEQ ID NO: 2512213 - RNA, 15 nt, Human
uccaugggcagagcc

SEQ ID NO: 2512214 - RNA, 16 nt, Human
uccaugggcagagccc

SEQ ID NO: 2512215 - RNA, 17 nt, Human
uccaugggcagagccca

SEQ ID NO: 2512216 - RNA, 18 nt, Human
uccaugggcagagcccaa

SEQ ID NO: 2512217 - RNA, 22 nt, Human
uccaugggcagagcccaaggga

SEQ ID NO: 2512218 - RNA, 20 nt, Human
uccaugggccauaugaaaag

SEQ ID NO: 2512219 - RNA, 15 nt, Human
uccauggaaugcuug

SEQ ID NO: 2512220 - RNA, 23 nt, Human
uccaugcuuagucacugccugca

SEQ ID NO: 2512221 - RNA, 22 nt, Human
uccaugcuuagucacugccugc

SEQ ID NO: 2512222 - RNA, 20 nt, Human
uccaugcuuagucacugccu

SEQ ID NO: 2512223 - RNA, 19 nt, Human
uccaugcuuagucacugcc

SEQ ID NO: 2512224 - RNA, 21 nt, Human
uccauggaaugcuugaaaaau

SEQ ID NO: 2512225 - RNA, 18 nt, Human
uccauggaaugcuugaaa

SEQ ID NO: 2512226 - RNA, 17 nt, Human
uccauggaaugcuugaa

SEQ ID NO: 2512227 - RNA, 16 nt, Human
uccauggaaugcuuga

SEQ ID NO: 2512228 - RNA, 15 nt, Human
uccaugcugccucca

SEQ ID NO: 2512229 - RNA, 14 nt, Human
uccaugcugccucc

SEQ ID NO: 2512230 - RNA, 22 nt, Human
uccaugcguguuucugacucug

SEQ ID NO: 2512231 - RNA, 21 nt, Human
uccaugcguguuucugacucu

SEQ ID NO: 2512232 - RNA, 13 nt, Human
uccaucauguccc

SEQ ID NO: 2512233 - RNA, 15 nt, Human
uccaucagaaugaaa

SEQ ID NO: 2512234 - RNA, 14 nt, Human
uccaucaggccacu

SEQ ID NO: 2512235 - RNA, 12 nt, Human
uccaucaugucc

SEQ ID NO: 2512236 - RNA, 18 nt, Human
uccaucaguuagagcuga

SEQ ID NO: 2512237 - RNA, 13 nt, Human
uccaucaucaugu

SEQ ID NO: 2512238 - RNA, 17 nt, Human
uccaucaguuagagcug

SEQ ID NO: 2512239 - RNA, 19 nt, Human
uccaucagguuccaucccg

SEQ ID NO: 2512240 - RNA, 18 nt, Human
uccaucagguuccauccc

SEQ ID NO: 2512241 - RNA, 22 nt, Human
uccaucagcuuaggggcugcug

SEQ ID NO: 2512242 - RNA, 14 nt, Human
uccauauuuauuca

SEQ ID NO: 2512243 - RNA, 15 nt, Human
uccauagagagcaag

SEQ ID NO: 2512244 - RNA, 14 nt, Human
uccauagagagcaa

SEQ ID NO: 2512245 - RNA, 15 nt, Human
uccauacauuugugu

SEQ ID NO: 2512246 - RNA, 21 nt, Human
uccauaaucuggacuccucug

SEQ ID NO: 2512247 - RNA, 13 nt, Human
uccauacucagga

SEQ ID NO: 2512248 - RNA, 15 nt, Human
uccaggagcagccac

SEQ ID NO: 2512249 - RNA, 14 nt, Human
uccaggagcagcca

SEQ ID NO: 2512250 - RNA, 13 nt, Human
uccaggagcagcc

SEQ ID NO: 2512251 - RNA, 12 nt, Human
uccaggagcagc

SEQ ID NO: 2512252 - RNA, 18 nt, Human
uccaggggccccuccagc

SEQ ID NO: 2512253 - RNA, 17 nt, Human
uccaggggccccuccag

SEQ ID NO: 2512254 - RNA, 16 nt, Human
uccagcugccccgggg

SEQ ID NO: 2512255 - RNA, 22 nt, Human
uccaggggcugcuuccuccugg

SEQ ID NO: 2512256 - RNA, 21 nt, Human
uccaggggcugcuuccuccug

SEQ ID NO: 2512257 - RNA, 23 nt, Human
uccaggggcugcuuccuccugga

SEQ ID NO: 2512258 - RNA, 19 nt, Human
uccaggggccccuccagcu

SEQ ID NO: 2512259 - RNA, 20 nt, Human
uccaggggugggacacccug

SEQ ID NO: 2512260 - RNA, 19 nt, Human
uccaggggugggacacccu

SEQ ID NO: 2512261 - RNA, 16 nt, Human
uccagcugagcgccag

SEQ ID NO: 2512262 - RNA, 15 nt, Human
uccagcucuuuccuc

SEQ ID NO: 2512263 - RNA, 18 nt, Human
uccagcucuuuccuccuu

SEQ ID NO: 2512264 - RNA, 23 nt, Human
uccagcugacccugguucucucu

SEQ ID NO: 2512265 - RNA, 21 nt, Human
uccagcucuuuccuccuucca

SEQ ID NO: 2512266 - RNA, 20 nt, Human
uccagcucuggaggggaggg

SEQ ID NO: 2512267 - RNA, 15 nt, Human
uccagcucuggaggg

SEQ ID NO: 2512268 - RNA, 13 nt, Human
uccagcucuggag

SEQ ID NO: 2512269 - RNA, 12 nt, Human
uccagcucugga

SEQ ID NO: 2512270 - RNA, 13 nt, Human
uccagcuccugua

SEQ ID NO: 2512271 - RNA, 21 nt, Human
uccagcuccuccgugcuuccu

SEQ ID NO: 2512272 - RNA, 23 nt, Human
uccagcaccauccgccagggccc

SEQ ID NO: 2512273 - RNA, 22 nt, Human
uccagcaauucuccugccucag

SEQ ID NO: 2512274 - RNA, 14 nt, Human
uccagcaccacacu

SEQ ID NO: 2512275 - RNA, 21 nt, Human
uccagcaauucuccugccuca

SEQ ID NO: 2512276 - RNA, 21 nt, Human
uccacuuggucugugagaugc

SEQ ID NO: 2512277 - RNA, 17 nt, Human
uccacuuggucugugag

SEQ ID NO: 2512278 - RNA, 14 nt, Human
uccaaaguacacug

SEQ ID NO: 2512279 - RNA, 16 nt, Human
uccaaaguacacuguu

SEQ ID NO: 2512280 - RNA, 19 nt, Human
uccacuuucuagccagagg

SEQ ID NO: 2512281 - RNA, 23 nt, Human
uccacuuggucugugagaugcua

SEQ ID NO: 2512282 - RNA, 21 nt, Human
uccacuuucuagccagaggag

SEQ ID NO: 2512283 - RNA, 20 nt, Human
uccacuuucuagccagagga

SEQ ID NO: 2512284 - RNA, 11 nt, Human
uccagaaagaa

SEQ ID NO: 2512285 - RNA, 23 nt, Human
uccagaaagaaaacuuguauuau

SEQ ID NO: 2512286 - RNA, 21 nt, Human
uccagaaacggccauucagca

SEQ ID NO: 2512287 - RNA, 18 nt, Human
uccagaaaaccccagcau

SEQ ID NO: 2512288 - RNA, 19 nt, Human
uccacuuuguuucgugggg

SEQ ID NO: 2512289 - RNA, 18 nt, Human
uccacuuuguuucguggg

SEQ ID NO: 2512290 - RNA, 16 nt, Human
uccacuuuguucuuua

SEQ ID NO: 2512291 - RNA, 13 nt, Human
uccacuuuguucu

SEQ ID NO: 2512292 - RNA, 15 nt, Human
uccacuuuguuucgu

SEQ ID NO: 2512293 - RNA, 23 nt, Human
uccacuuuguuucguggggaggu

SEQ ID NO: 2512294 - RNA, 22 nt, Human
uccacuuuguuucguggggagg

SEQ ID NO: 2512295 - RNA, 20 nt, Human
uccacuuuguuggaaagcag

SEQ ID NO: 2512296 - RNA, 20 nt, Human
uccacuuuuuuuuguauguu

SEQ ID NO: 2512297 - RNA, 22 nt, Human
ucaguauuuuggagaaauuauu

SEQ ID NO: 2512298 - RNA, 20 nt, Human
ucaguauuuuggagaaauua

SEQ ID NO: 2512299 - RNA, 19 nt, Human
ucaguauuuuggagaaauu

SEQ ID NO: 2512300 - RNA, 18 nt, Human
ucaguauuuucccugcua

SEQ ID NO: 2512301 - RNA, 16 nt, Human
ucaguauuuucccugc

SEQ ID NO: 2512302 - RNA, 17 nt, Human
ucaguauuguuuugguu

SEQ ID NO: 2512303 - RNA, 15 nt, Human
ucaguauuguuuugg

SEQ ID NO: 2512304 - RNA, 14 nt, Human
ucaguauuguuuug

SEQ ID NO: 2512305 - RNA, 21 nt, Human
ucaggugcccaucccuggaag

SEQ ID NO: 2512306 - RNA, 24 nt, Human
ucaguauuguuuugguuugcuacu

SEQ ID NO: 2512307 - RNA, 22 nt, Human
ucaguauuguuuugguuugcua

SEQ ID NO: 2512308 - RNA, 23 nt, Human
ucaguauugaagcauuuuauaaa

SEQ ID NO: 2512309 - RNA, 22 nt, Human
ucaguauugaagcauuuuauaa

SEQ ID NO: 2512310 - RNA, 20 nt, Human
ucagguggggcagcuugagg

SEQ ID NO: 2512311 - RNA, 16 nt, Human
ucagucuauccacaga

SEQ ID NO: 2512312 - RNA, 15 nt, Human
ucagucuauccacag

SEQ ID NO: 2512313 - RNA, 18 nt, Human
ucagucuauccacagaga

SEQ ID NO: 2512314 - RNA, 16 nt, Human
ucagucucccucccuu

SEQ ID NO: 2512315 - RNA, 20 nt, Human
ucagucucccuuucccuucu

SEQ ID NO: 2512316 - RNA, 17 nt, Human
ucagucucccuuucccu

SEQ ID NO: 2512317 - RNA, 14 nt, Human
ucagucucccuuuc

SEQ ID NO: 2512318 - RNA, 23 nt, Human
ucagucucccuucucccaugagg

SEQ ID NO: 2512319 - RNA, 20 nt, Human
ucagucucccuucucccaug

SEQ ID NO: 2512320 - RNA, 19 nt, Human
ucagucucccuucucccau

SEQ ID NO: 2512321 - RNA, 14 nt, Human
ucagucucaggagc

SEQ ID NO: 2512322 - RNA, 16 nt, Human
ucagucaauauuuuua

SEQ ID NO: 2512323 - RNA, 13 nt, Human
ucagucacagcca

SEQ ID NO: 2512324 - RNA, 14 nt, Human
ucagucacagccac

SEQ ID NO: 2512325 - RNA, 22 nt, Human
ucaguccuccccucacagccuc

SEQ ID NO: 2512326 - RNA, 23 nt, Human
ucaguauuuuggagaaauuauuu

SEQ ID NO: 2512327 - RNA, 15 nt, Human
ucagucacagccacc

SEQ ID NO: 2512328 - RNA, 23 nt, Human
ucaguccuccccucacagccucu

SEQ ID NO: 2512329 - RNA, 15 nt, Human
ucaguccuuugauca

SEQ ID NO: 2512330 - RNA, 22 nt, Human
ucagucuuucuuagugccugug

SEQ ID NO: 2512331 - RNA, 23 nt, Human
ucagucucccuuucccuucuugg

SEQ ID NO: 2512332 - RNA, 22 nt, Human
ucagucuuuaaucugagaggcc

SEQ ID NO: 2512333 - RNA, 11 nt, Human
ucagugacaga

SEQ ID NO: 2512334 - RNA, 15 nt, Human
ucagugacagaguuc

SEQ ID NO: 2512335 - RNA, 19 nt, Human
ucagugacagaguucacua

SEQ ID NO: 2512336 - RNA, 14 nt, Human
ucagugaggcccag

SEQ ID NO: 2512337 - RNA, 17 nt, Human
ucagugaggcccaggga

SEQ ID NO: 2512338 - RNA, 18 nt, Human
ucagugaggcccagggag

SEQ ID NO: 2512339 - RNA, 19 nt, Human
ucagugauguaccaugaaa

SEQ ID NO: 2512340 - RNA, 14 nt, Human
ucagugcaaagauu

SEQ ID NO: 2512341 - RNA, 23 nt, Human
ucagugcagcccguguggccccu

SEQ ID NO: 2512342 - RNA, 23 nt, Human
ucagucugauucccaagcucugc

SEQ ID NO: 2512343 - RNA, 22 nt, Human
ucagucugauucccaagcucug

SEQ ID NO: 2512344 - RNA, 21 nt, Human
ucagucugauucccaagcucu

SEQ ID NO: 2512345 - RNA, 19 nt, Human
ucagguggggcagcuugag

SEQ ID NO: 2512346 - RNA, 18 nt, Human
ucagguggggcagcuuga

SEQ ID NO: 2512347 - RNA, 16 nt, Human
ucaggugacaugugaa

SEQ ID NO: 2512348 - RNA, 19 nt, Human
ucaggucucccacguggga

SEQ ID NO: 2512349 - RNA, 15 nt, Human
ucaggugacauguga

SEQ ID NO: 2512350 - RNA, 23 nt, Human
ucaggugauccacccaccucagc

SEQ ID NO: 2512351 - RNA, 21 nt, Human
ucaggucucccacgugggaga

SEQ ID NO: 2512352 - RNA, 18 nt, Human
ucaggucagggugaggau

SEQ ID NO: 2512353 - RNA, 12 nt, Human
ucaggucccugc

SEQ ID NO: 2512354 - RNA, 16 nt, Human
ucagguccucagagaa

SEQ ID NO: 2512355 - RNA, 15 nt, Human
ucaggucagggugag

SEQ ID NO: 2512356 - RNA, 16 nt, Human
ucaggugauccaccca

SEQ ID NO: 2512357 - RNA, 23 nt, Human
ucaggugagaagcagaggaagga

SEQ ID NO: 2512358 - RNA, 19 nt, Human
ucaggcugcuggcgccucu

SEQ ID NO: 2512359 - RNA, 17 nt, Human
ucaggcugcuggcgccu

SEQ ID NO: 2512360 - RNA, 12 nt, Human
ucaggcugcugg

SEQ ID NO: 2512361 - RNA, 15 nt, Human
ucaggcugcuggagg

SEQ ID NO: 2512362 - RNA, 16 nt, Human
ucaggcugcuggagga

SEQ ID NO: 2512363 - RNA, 14 nt, Human
ucaggcugcuggcg

SEQ ID NO: 2512364 - RNA, 13 nt, Human
ucaggcugcuggc

SEQ ID NO: 2512365 - RNA, 17 nt, Human
ucaggcugcuggaggaa

SEQ ID NO: 2512366 - RNA, 19 nt, Human
ucaggcugcuggaggaaaa

SEQ ID NO: 2512367 - RNA, 13 nt, Human
ucaggcugaggug

SEQ ID NO: 2512368 - RNA, 21 nt, Human
ucaggcucuucuccuuucaca

SEQ ID NO: 2512369 - RNA, 16 nt, Human
ucaggcucuucuccuu

SEQ ID NO: 2512370 - RNA, 22 nt, Human
ucagggaauuucaggaacuaga

SEQ ID NO: 2512371 - RNA, 18 nt, Human
ucagggacagagacaccu

SEQ ID NO: 2512372 - RNA, 21 nt, Human
ucagggacagagacaccugca

SEQ ID NO: 2512373 - RNA, 23 nt, Human
ucagggacagagacaccugcacc

SEQ ID NO: 2512374 - RNA, 15 nt, Human
ucagggacagagcca

SEQ ID NO: 2512375 - RNA, 14 nt, Human
ucagggacagagcc

SEQ ID NO: 2512376 - RNA, 15 nt, Human
ucagggacaggauga

SEQ ID NO: 2512377 - RNA, 14 nt, Human
ucagggaccaagga

SEQ ID NO: 2512378 - RNA, 15 nt, Human
ucagggaccaaggac

SEQ ID NO: 2512379 - RNA, 20 nt, Human
ucagggaccaaggaccccuc

SEQ ID NO: 2512380 - RNA, 13 nt, Human
ucagggaccacag

SEQ ID NO: 2512381 - RNA, 23 nt, Human
ucagggaccaaggaccccucacc

SEQ ID NO: 2512382 - RNA, 15 nt, Human
ucagggaccacagca

SEQ ID NO: 2512383 - RNA, 14 nt, Human
ucagggaccacagc

SEQ ID NO: 2512384 - RNA, 16 nt, Human
ucagggaccacagcaa

SEQ ID NO: 2512385 - RNA, 12 nt, Human
ucagggaccccu

SEQ ID NO: 2512386 - RNA, 14 nt, Human
ucagggaccccugc

SEQ ID NO: 2512387 - RNA, 21 nt, Human
ucagguauguugccuuuaugg

SEQ ID NO: 2512388 - RNA, 17 nt, Human
ucagguauuaagaaaau

SEQ ID NO: 2512389 - RNA, 15 nt, Human
ucagguauuaagaaa

SEQ ID NO: 2512390 - RNA, 16 nt, Human
ucagggaccccugccc

SEQ ID NO: 2512391 - RNA, 16 nt, Human
ucaggucaggaguucg

SEQ ID NO: 2512392 - RNA, 19 nt, Human
ucagcuccagguggcucug

SEQ ID NO: 2512393 - RNA, 14 nt, Human
ucagcuccaggugg

SEQ ID NO: 2512394 - RNA, 13 nt, Human
ucagcuccagcug

SEQ ID NO: 2512395 - RNA, 14 nt, Human
ucaccuaauguuua

SEQ ID NO: 2512396 - RNA, 21 nt, Human
ucaccuaauguuuaugagcca

SEQ ID NO: 2512397 - RNA, 22 nt, Human
ucaccuaauguuuaugagccag

SEQ ID NO: 2512398 - RNA, 24 nt, Human
ucagcuccagcucaccagccccag

SEQ ID NO: 2512399 - RNA, 23 nt, Human
ucagcuccagcucaccagcccca

SEQ ID NO: 2512400 - RNA, 13 nt, Human
ucaccgugggcuc

SEQ ID NO: 2512401 - RNA, 15 nt, Human
ucaccgugggcuccc

SEQ ID NO: 2512402 - RNA, 16 nt, Human
ucaccgugggcucccu

SEQ ID NO: 2512403 - RNA, 17 nt, Human
ucaccgugggcucccug

SEQ ID NO: 2512404 - RNA, 18 nt, Human
ucaccgugggcucccuga

SEQ ID NO: 2512405 - RNA, 19 nt, Human
ucaccgugggcucccugac

SEQ ID NO: 2512406 - RNA, 22 nt, Human
ucaccuaacucauacugugcug

SEQ ID NO: 2512407 - RNA, 14 nt, Human
ucaccuaacucaua

SEQ ID NO: 2512408 - RNA, 21 nt, Human
ucaccguggaccuuccugcca

SEQ ID NO: 2512409 - RNA, 20 nt, Human
ucaccguggaccuuccugcc

SEQ ID NO: 2512410 - RNA, 19 nt, Human
ucaccguggaccuuccugc

SEQ ID NO: 2512411 - RNA, 18 nt, Human
ucaccguggaccuuccug

SEQ ID NO: 2512412 - RNA, 17 nt, Human
ucaccguggaccuuccu

SEQ ID NO: 2512413 - RNA, 18 nt, Human
ucaccggggugguuuagu

SEQ ID NO: 2512414 - RNA, 23 nt, Human
ucaccggagcuuucaaagaagga

SEQ ID NO: 2512415 - RNA, 15 nt, Human
ucaccggauccuggg

SEQ ID NO: 2512416 - RNA, 23 nt, Human
ucaccgcagucgucgcacagucu

SEQ ID NO: 2512417 - RNA, 22 nt, Human
ucaccgcagucgucgcacaguc

SEQ ID NO: 2512418 - RNA, 14 nt, Human
ucaccggagcuuuc

SEQ ID NO: 2512419 - RNA, 23 nt, Human
ucaggaagcucagggccuggcuc

SEQ ID NO: 2512420 - RNA, 21 nt, Human
ucagcuucauuugugucaaug

SEQ ID NO: 2512421 - RNA, 18 nt, Human
ucagcuucauuuguguca

SEQ ID NO: 2512422 - RNA, 16 nt, Human
ucagcuucauuugugu

SEQ ID NO: 2512423 - RNA, 23 nt, Human
ucagcuucagaauggcauuguac

SEQ ID NO: 2512424 - RNA, 18 nt, Human
ucagcuuaggggcugcug

SEQ ID NO: 2512425 - RNA, 17 nt, Human
ucagcuguacuucgucu

SEQ ID NO: 2512426 - RNA, 16 nt, Human
ucagcuguaguccuca

SEQ ID NO: 2512427 - RNA, 12 nt, Human
ucagcugugaac

SEQ ID NO: 2512428 - RNA, 21 nt, Human
ucagcugugaacauggacucu

SEQ ID NO: 2512429 - RNA, 15 nt, Human
ucagcuguuugucau

SEQ ID NO: 2512430 - RNA, 16 nt, Human
ucagcuguuugucaua

SEQ ID NO: 2512431 - RNA, 23 nt, Human
ucagcucugcaagaauugaagca

SEQ ID NO: 2512432 - RNA, 17 nt, Human
ucagcucugggagagga

SEQ ID NO: 2512433 - RNA, 16 nt, Human
ucagcucugggagagg

SEQ ID NO: 2512434 - RNA, 12 nt, Human
ucagcucuggga

SEQ ID NO: 2512435 - RNA, 11 nt, Human
ucagcucuggg

SEQ ID NO: 2512436 - RNA, 19 nt, Human
ucagcucugggccauucuc

SEQ ID NO: 2512437 - RNA, 22 nt, Human
ucagcucuucugacuuaagugu

SEQ ID NO: 2512438 - RNA, 12 nt, Human
ucagcuguacuu

SEQ ID NO: 2512439 - RNA, 23 nt, Human
ucagcuguaagaagagacuggga

SEQ ID NO: 2512440 - RNA, 18 nt, Human
ucagcucugggagaggau

SEQ ID NO: 2512441 - RNA, 15 nt, Human
ucaggagcccuggga

SEQ ID NO: 2512442 - RNA, 14 nt, Human
ucaggagcccuggg

SEQ ID NO: 2512443 - RNA, 12 nt, Human
ucaggagcccug

SEQ ID NO: 2512444 - RNA, 11 nt, Human
ucaggagcccu

SEQ ID NO: 2512445 - RNA, 18 nt, Human
ucaggaauauuuuccaaa

SEQ ID NO: 2512446 - RNA, 17 nt, Human
ucaggaauauuuuccaa

SEQ ID NO: 2512447 - RNA, 14 nt, Human
ucaggaaugggcug

SEQ ID NO: 2512448 - RNA, 19 nt, Human
ucagcuuccuacccacacc

SEQ ID NO: 2512449 - RNA, 15 nt, Human
ucagcuuccuaccca

SEQ ID NO: 2512450 - RNA, 16 nt, Human
ucaggaaggaugagca

SEQ ID NO: 2512451 - RNA, 17 nt, Human
ucaggaaggaugagcau

SEQ ID NO: 2512452 - RNA, 18 nt, Human
ucaggaaggaugagcauu

SEQ ID NO: 2512453 - RNA, 20 nt, Human
ucaggaaggaugagcauuua

SEQ ID NO: 2512454 - RNA, 22 nt, Human
ucaggagcagccucagaacaaa

SEQ ID NO: 2512455 - RNA, 21 nt, Human
ucaggagcagccucagaacaa

SEQ ID NO: 2512456 - RNA, 10 nt, Human
ucaggagcag

SEQ ID NO: 2512457 - RNA, 18 nt, Human
ucaggagcacaggcagcu

SEQ ID NO: 2512458 - RNA, 12 nt, Human
ucaggacacuaa

SEQ ID NO: 2512459 - RNA, 20 nt, Human
ucaggaucaaaccccgacca

SEQ ID NO: 2512460 - RNA, 15 nt, Human
ucaggauacaugugc

SEQ ID NO: 2512461 - RNA, 14 nt, Human
ucaggauacaugug

SEQ ID NO: 2512462 - RNA, 16 nt, Human
ucaggauacaugugcc

SEQ ID NO: 2512463 - RNA, 18 nt, Human
ucaggauacucugucaga

SEQ ID NO: 2512464 - RNA, 12 nt, Human
ucaggaguuccu

SEQ ID NO: 2512465 - RNA, 20 nt, Human
ucaggaguuagaggccagcc

SEQ ID NO: 2512466 - RNA, 22 nt, Human
ucaggaguuagaggccagccug

SEQ ID NO: 2512467 - RNA, 17 nt, Human
ucaggaguuagaggcca

SEQ ID NO: 2512468 - RNA, 19 nt, Human
ucaggaguuagaggccagc

SEQ ID NO: 2512469 - RNA, 23 nt, Human
ucaggaucucuuagcauuuuaau

SEQ ID NO: 2512470 - RNA, 20 nt, Human
ucaggauacucugucagaug

SEQ ID NO: 2512471 - RNA, 16 nt, Human
ucaggaucaagaaagu

SEQ ID NO: 2512472 - RNA, 17 nt, Human
ucaggaucaagaaagug

SEQ ID NO: 2512473 - RNA, 16 nt, Human
ucaggaugaacccagg

SEQ ID NO: 2512474 - RNA, 15 nt, Human
ucaggaugaacccag

SEQ ID NO: 2512475 - RNA, 17 nt, Human
ucaggaugaacccagga

SEQ ID NO: 2512476 - RNA, 21 nt, Human
ucaggccugggggcugggcag

SEQ ID NO: 2512477 - RNA, 18 nt, Human
ucaggccuauaaccccag

SEQ ID NO: 2512478 - RNA, 22 nt, Human
ucaggccuauaaccccagcucc

SEQ ID NO: 2512479 - RNA, 15 nt, Human
ucaggcucuucuccu

SEQ ID NO: 2512480 - RNA, 23 nt, Human
ucaggcguagaucaccagaauaa

SEQ ID NO: 2512481 - RNA, 21 nt, Human
ucaggcgauccaccugucuca

SEQ ID NO: 2512482 - RNA, 17 nt, Human
ucaggccucccucucuc

SEQ ID NO: 2512483 - RNA, 18 nt, Human
ucaggccucccucucucu

SEQ ID NO: 2512484 - RNA, 20 nt, Human
ucaggcgauccaccugucuc

SEQ ID NO: 2512485 - RNA, 13 nt, Human
ucaggccugugug

SEQ ID NO: 2512486 - RNA, 17 nt, Human
ucauccacugugccaug

SEQ ID NO: 2512487 - RNA, 14 nt, Human
ucauccacugugcc

SEQ ID NO: 2512488 - RNA, 18 nt, Human
ucauccacugugccaugu

SEQ ID NO: 2512489 - RNA, 22 nt, Human
ucauccacuagugcaaaucaua

SEQ ID NO: 2512490 - RNA, 21 nt, Human
ucauccacuagugcaaaucau

SEQ ID NO: 2512491 - RNA, 16 nt, Human
ucaucucauucaaacc

SEQ ID NO: 2512492 - RNA, 20 nt, Human
ucaucucaggccucccucaa

SEQ ID NO: 2512493 - RNA, 16 nt, Human
ucaucuccccaucauu

SEQ ID NO: 2512494 - RNA, 22 nt, Human
ucaucuccagggaguccccucc

SEQ ID NO: 2512495 - RNA, 23 nt, Human
ucaucuccagggaguccccuccc

SEQ ID NO: 2512496 - RNA, 13 nt, Human
ucaucuccaucag

SEQ ID NO: 2512497 - RNA, 16 nt, Human
ucaucuugaccaagca

SEQ ID NO: 2512498 - RNA, 19 nt, Human
ucaucuugaccaagcagga

SEQ ID NO: 2512499 - RNA, 15 nt, Human
ucaucuccugccuuc

SEQ ID NO: 2512500 - RNA, 22 nt, Human
ucaucucccaccuagcagcacc

SEQ ID NO: 2512501 - RNA, 12 nt, Human
ucaucucccacc

SEQ ID NO: 2512502 - RNA, 16 nt, Human
ucaucuccaucagcug

SEQ ID NO: 2512503 - RNA, 17 nt, Human
ucaucuccaucagcugu

SEQ ID NO: 2512504 - RNA, 22 nt, Human
ucaucuuucauuaaaggcuucu

SEQ ID NO: 2512505 - RNA, 21 nt, Human
ucaucuugaccaagcaggaag

SEQ ID NO: 2512506 - RNA, 22 nt, Human
ucaucuugaccaagcaggaagc

SEQ ID NO: 2512507 - RNA, 22 nt, Human
ucaucuugguacuacuagaugu

SEQ ID NO: 2512508 - RNA, 15 nt, Human
ucaucuuguguuuua

SEQ ID NO: 2512509 - RNA, 23 nt, Human
ucaucuugaccaagcaggaagcu

SEQ ID NO: 2512510 - RNA, 23 nt, Human
ucaugguagagaccgagccucug

SEQ ID NO: 2512511 - RNA, 13 nt, Human
ucauggucucagu

SEQ ID NO: 2512512 - RNA, 22 nt, Human
ucaugguagagaccgagccucu

SEQ ID NO: 2512513 - RNA, 14 nt, Human
ucaugggguccaag

SEQ ID NO: 2512514 - RNA, 22 nt, Human
ucauggaaugguuauaaaagug

SEQ ID NO: 2512515 - RNA, 21 nt, Human
ucauggggugaugcugggcug

SEQ ID NO: 2512516 - RNA, 21 nt, Human
ucauggaaugguuauaaaagu

SEQ ID NO: 2512517 - RNA, 12 nt, Human
ucauggaauggu

SEQ ID NO: 2512518 - RNA, 17 nt, Human
ucaugcuucuuccuuac

SEQ ID NO: 2512519 - RNA, 18 nt, Human
ucaugcuuguguuauaac

SEQ ID NO: 2512520 - RNA, 22 nt, Human
ucaucauguaucgcuucaugua

SEQ ID NO: 2512521 - RNA, 20 nt, Human
ucauccacuagugcaaauca

SEQ ID NO: 2512522 - RNA, 19 nt, Human
ucauccacuagugcaaauc

SEQ ID NO: 2512523 - RNA, 20 nt, Human
ucauccaccccaucccuccc

SEQ ID NO: 2512524 - RNA, 18 nt, Human
ucaucauucucugucuca

SEQ ID NO: 2512525 - RNA, 16 nt, Human
ucauccaccccauccc

SEQ ID NO: 2512526 - RNA, 13 nt, Human
ucaucauucucug

SEQ ID NO: 2512527 - RNA, 14 nt, Human
ucaucauucucugu

SEQ ID NO: 2512528 - RNA, 14 nt, Human
ucaucauuccuuga

SEQ ID NO: 2512529 - RNA, 17 nt, Human
ucaucauuccuugagaa

SEQ ID NO: 2512530 - RNA, 21 nt, Human
ucaucaaggcacugccugaug

SEQ ID NO: 2512531 - RNA, 19 nt, Human
ucaucaaggcacugccuga

SEQ ID NO: 2512532 - RNA, 18 nt, Human
ucaucaaggcacugccug

SEQ ID NO: 2512533 - RNA, 17 nt, Human
ucaucaaugaaugaaug

SEQ ID NO: 2512534 - RNA, 19 nt, Human
ucaucaaucauuguacagu

SEQ ID NO: 2512535 - RNA, 16 nt, Human
ucaucaaucauuguac

SEQ ID NO: 2512536 - RNA, 15 nt, Human
ucaucaaucauugua

SEQ ID NO: 2512537 - RNA, 14 nt, Human
ucaucaaucauugu

SEQ ID NO: 2512538 - RNA, 23 nt, Human
ucaucaauugaauggucagcguu

SEQ ID NO: 2512539 - RNA, 24 nt, Human
ucaucaauugaauggucagcguug

SEQ ID NO: 2512540 - RNA, 14 nt, Human
ucaucauccuaagc

SEQ ID NO: 2512541 - RNA, 18 nt, Human
ucaguguaccauuugccu

SEQ ID NO: 2512542 - RNA, 19 nt, Human
ucaguguaccauuugccuc

SEQ ID NO: 2512543 - RNA, 20 nt, Human
ucaguguacauggaauaaca

SEQ ID NO: 2512544 - RNA, 23 nt, Human
ucaguguacccccgcccaggcug

SEQ ID NO: 2512545 - RNA, 22 nt, Human
ucaguguacccccgcccaggcu

SEQ ID NO: 2512546 - RNA, 21 nt, Human
ucaguguauggaaauaaaugu

SEQ ID NO: 2512547 - RNA, 22 nt, Human
ucaguguauggaaauaaaugua

SEQ ID NO: 2512548 - RNA, 21 nt, Human
ucaguguacccccgcccaggc

SEQ ID NO: 2512549 - RNA, 20 nt, Human
ucaguguacccccgcccagg

SEQ ID NO: 2512550 - RNA, 17 nt, Human
ucaguguacccccgccc

SEQ ID NO: 2512551 - RNA, 15 nt, Human
ucagugcagcccgug

SEQ ID NO: 2512552 - RNA, 11 nt, Human
ucauagcagcu

SEQ ID NO: 2512553 - RNA, 16 nt, Human
ucauagacccucucaa

SEQ ID NO: 2512554 - RNA, 23 nt, Human
ucauagaaauguaacuuuuguaa

SEQ ID NO: 2512555 - RNA, 14 nt, Human
ucaguguauuugua

SEQ ID NO: 2512556 - RNA, 12 nt, Human
ucauagcagcuu

SEQ ID NO: 2512557 - RNA, 14 nt, Human
ucauagcacuuccc

SEQ ID NO: 2512558 - RNA, 18 nt, Human
ucauagcagauuuuaauu

SEQ ID NO: 2512559 - RNA, 17 nt, Human
ucaucaaggcacugccu

SEQ ID NO: 2512560 - RNA, 21 nt, Human
uccaaaagaagcccccagcua

SEQ ID NO: 2512561 - RNA, 16 nt, Human
uccaaaccaaauaaaa

SEQ ID NO: 2512562 - RNA, 23 nt, Human
uccaaaauuugaaauauuaaaau

SEQ ID NO: 2512563 - RNA, 15 nt, Human
uccaaaagaagcccc

SEQ ID NO: 2512564 - RNA, 18 nt, Human
uccaaaagaagcccccag

SEQ ID NO: 2512565 - RNA, 14 nt, Human
uccaaaagaagccc

SEQ ID NO: 2512566 - RNA, 12 nt, Human
uccaaaacugcc

SEQ ID NO: 2512567 - RNA, 13 nt, Human
uccaaaacugccu

SEQ ID NO: 2512568 - RNA, 15 nt, Human
uccaaaacuccugcc

SEQ ID NO: 2512569 - RNA, 22 nt, Human
uccaaaaagauuuucagaaaau

SEQ ID NO: 2512570 - RNA, 19 nt, Human
ucauuucaaauacaucuuu

SEQ ID NO: 2512571 - RNA, 22 nt, Human
ucauuuauauagauuauaacuu

SEQ ID NO: 2512572 - RNA, 17 nt, Human
ucauuuauauagauuau

SEQ ID NO: 2512573 - RNA, 15 nt, Human
ucauuuaucccucaa

SEQ ID NO: 2512574 - RNA, 14 nt, Human
ucauuuaugaaaag

SEQ ID NO: 2512575 - RNA, 15 nt, Human
ucauuuaugaaaaga

SEQ ID NO: 2512576 - RNA, 13 nt, Human
uccaaaguacacu

SEQ ID NO: 2512577 - RNA, 20 nt, Human
uccaaagaguagaauugcau

SEQ ID NO: 2512578 - RNA, 14 nt, Human
uccaaaggcccccu

SEQ ID NO: 2512579 - RNA, 23 nt, Human
uccaaaggccauggagagcugga

SEQ ID NO: 2512580 - RNA, 22 nt, Human
uccaaaggccauggagagcugg

SEQ ID NO: 2512581 - RNA, 13 nt, Human
uccaaagagaaaa

SEQ ID NO: 2512582 - RNA, 14 nt, Human
uccaaagaaaugua

SEQ ID NO: 2512583 - RNA, 17 nt, Human
uccaaagaaauguaagg

SEQ ID NO: 2512584 - RNA, 21 nt, Human
uccaaaccuccuguuagcugu

SEQ ID NO: 2512585 - RNA, 16 nt, Human
ucauuaggauggcuag

SEQ ID NO: 2512586 - RNA, 19 nt, Human
ucauuagccugaguagaaa

SEQ ID NO: 2512587 - RNA, 18 nt, Human
ucauuagccugaguagaa

SEQ ID NO: 2512588 - RNA, 17 nt, Human
ucauuguacaguuuguu

SEQ ID NO: 2512589 - RNA, 14 nt, Human
ucauuguacaguuu

SEQ ID NO: 2512590 - RNA, 20 nt, Human
ucauuguaauguuacugauc

SEQ ID NO: 2512591 - RNA, 20 nt, Human
ucauuagccugaguagaaag

SEQ ID NO: 2512592 - RNA, 17 nt, Human
ucauuguaauguuacug

SEQ ID NO: 2512593 - RNA, 19 nt, Human
ucauuguaauguuacugau

SEQ ID NO: 2512594 - RNA, 14 nt, Human
ucauuguagaaaag

SEQ ID NO: 2512595 - RNA, 19 nt, Human
ucauuguacaguuuguuua

SEQ ID NO: 2512596 - RNA, 14 nt, Human
ucauuguauaaaaa

SEQ ID NO: 2512597 - RNA, 15 nt, Human
ucauuguauaaaaau

SEQ ID NO: 2512598 - RNA, 16 nt, Human
ucauuguauaaaaaua

SEQ ID NO: 2512599 - RNA, 15 nt, Human
ucauuguauauaugu

SEQ ID NO: 2512600 - RNA, 17 nt, Human
ucauuguauaaaaauag

SEQ ID NO: 2512601 - RNA, 18 nt, Human
ucauuagacuccuccucc

SEQ ID NO: 2512602 - RNA, 13 nt, Human
ucauuagacuccu

SEQ ID NO: 2512603 - RNA, 12 nt, Human
ucauuagagcag

SEQ ID NO: 2512604 - RNA, 15 nt, Human
ucauuagagcaggcg

SEQ ID NO: 2512605 - RNA, 13 nt, Human
ucauuagagcagg

SEQ ID NO: 2512606 - RNA, 18 nt, Human
ucaugguguaauaagaca

SEQ ID NO: 2512607 - RNA, 17 nt, Human
ucaugguguaauaagac

SEQ ID NO: 2512608 - RNA, 16 nt, Human
ucaugguguaauaaga

SEQ ID NO: 2512609 - RNA, 15 nt, Human
ucaugguguaauaag

SEQ ID NO: 2512610 - RNA, 10 nt, Human
ucauuagaac

SEQ ID NO: 2512611 - RNA, 19 nt, Human
ucaugguguaauaagacau

SEQ ID NO: 2512612 - RNA, 16 nt, Human
ucauuacuuuugaagu

SEQ ID NO: 2512613 - RNA, 14 nt, Human
ucauggugcucaga

SEQ ID NO: 2512614 - RNA, 14 nt, Human
ucauggugaaaaug

SEQ ID NO: 2512615 - RNA, 16 nt, Human
ucauggucucagucau

SEQ ID NO: 2512616 - RNA, 19 nt, Human
ucauggugaaaauguacug

SEQ ID NO: 2512617 - RNA, 14 nt, Human
ucaugguguaauaa

SEQ ID NO: 2512618 - RNA, 13 nt, Human
ucaugguguaaua

SEQ ID NO: 2512619 - RNA, 23 nt, Human
ucaugguggguucaggggacuca

SEQ ID NO: 2512620 - RNA, 18 nt, Human
ucauuguaugauguguug

SEQ ID NO: 2512621 - RNA, 17 nt, Human
ucauuguaugauguguu

SEQ ID NO: 2512622 - RNA, 15 nt, Human
ucauuguaugaugug

SEQ ID NO: 2512623 - RNA, 14 nt, Human
ucauuguaugaugu

SEQ ID NO: 2512624 - RNA, 22 nt, Human
ucauuguauauauguguguuua

SEQ ID NO: 2512625 - RNA, 21 nt, Human
ucauuguauauauguguguuu

SEQ ID NO: 2512626 - RNA, 17 nt, Human
ucauuguauauaugugu

SEQ ID NO: 2512627 - RNA, 16 nt, Human
ucauuguauauaugug

SEQ ID NO: 2512628 - RNA, 23 nt, Human
ucauuguaugauguguugugaua

SEQ ID NO: 2512629 - RNA, 17 nt, Human
ucauuuaaaaugauuag

SEQ ID NO: 2512630 - RNA, 16 nt, Human
ucauuuaaaaugauua

SEQ ID NO: 2512631 - RNA, 14 nt, Human
ucauuuaauaauau

SEQ ID NO: 2512632 - RNA, 11 nt, Human
ucauuuaauaa

SEQ ID NO: 2512633 - RNA, 15 nt, Human
ucauuuaaaaugauu

SEQ ID NO: 2512634 - RNA, 14 nt, Human
ucauuuaaaaugau

SEQ ID NO: 2512635 - RNA, 13 nt, Human
ucauuuaaaauga

SEQ ID NO: 2512636 - RNA, 23 nt, Human
ucauuuaaaaaaaaaauuuguuu

SEQ ID NO: 2512637 - RNA, 23 nt, Human
ucauuguuuauuaacaaauuaug

SEQ ID NO: 2512638 - RNA, 20 nt, Human
ucauuuaauaauauacuugu

SEQ ID NO: 2512639 - RNA, 18 nt, Human
ucauuuaauaauauacuu

SEQ ID NO: 2512640 - RNA, 21 nt, Human
ucauuuaauaauauacuugug

SEQ ID NO: 2512641 - RNA, 20 nt, Human
ucauuuacuguggcuucuua

SEQ ID NO: 2512642 - RNA, 15 nt, Human
ucauuuacuguggcu

SEQ ID NO: 2512643 - RNA, 13 nt, Human
ucauuuacugugg

SEQ ID NO: 2512644 - RNA, 18 nt, Human
ucauuuagucaugugacc

SEQ ID NO: 2512645 - RNA, 19 nt, Human
ucauuuaguuugauuauuc

SEQ ID NO: 2512646 - RNA, 21 nt, Human
ucauuuauaaaaccaucaaaa

SEQ ID NO: 2512647 - RNA, 22 nt, Human
ucauuuauaaagcuaaaauaac

SEQ ID NO: 2512648 - RNA, 19 nt, Human
ucauuuagauugaaaacuu

SEQ ID NO: 2512649 - RNA, 22 nt, Human
ucauuuagaacuugcagcugau

SEQ ID NO: 2512650 - RNA, 16 nt, Human
ucauuuagaacuugca

SEQ ID NO: 2512651 - RNA, 12 nt, Human
ucauuuagaacu

SEQ ID NO: 2512652 - RNA, 21 nt, Human
ucuuguuuuuccacuacugcu

SEQ ID NO: 2512653 - RNA, 13 nt, Human
ucuuguuuuucca

SEQ ID NO: 2512654 - RNA, 20 nt, Human
ucuuguuuuuccacuacugc

SEQ ID NO: 2512655 - RNA, 11 nt, Human
ucuuucaaaac

SEQ ID NO: 2512656 - RNA, 20 nt, Human
ucuuucaaaaccuuuugaaa

SEQ ID NO: 2512657 - RNA, 21 nt, Human
ucuuucaaaaccuuuugaaau

SEQ ID NO: 2512658 - RNA, 23 nt, Human
ucuuucaaaaccuuuugaaauua

SEQ ID NO: 2512659 - RNA, 18 nt, Human
ucuuucaaauugagagaa

SEQ ID NO: 2512660 - RNA, 19 nt, Human
ucuuucaaauugagagaau

SEQ ID NO: 2512661 - RNA, 22 nt, Human
ucuuucaaauugagagaaugga

SEQ ID NO: 2512662 - RNA, 20 nt, Human
ucuuucaaagguagccauca

SEQ ID NO: 2512663 - RNA, 22 nt, Human
ucuuucaaagguagccaucaug

SEQ ID NO: 2512664 - RNA, 17 nt, Human
ucuuucacauuuaaaua

SEQ ID NO: 2512665 - RNA, 21 nt, Human
ucuuucaagcagucgugccug

SEQ ID NO: 2512666 - RNA, 20 nt, Human
ucuuucaagcagucgugccu

SEQ ID NO: 2512667 - RNA, 18 nt, Human
ucuuucaacuugcaucca

SEQ ID NO: 2512668 - RNA, 23 nt, Human
ucuuucacccuuuucuguuugcu

SEQ ID NO: 2512669 - RNA, 15 nt, Human
ucuuucaacuugcau

SEQ ID NO: 2512670 - RNA, 16 nt, Human
ucuuucaagugaaucu

SEQ ID NO: 2512671 - RNA, 19 nt, Human
ucuuucaagugaaucuaaa

SEQ ID NO: 2512672 - RNA, 22 nt, Human
ucuuguuucuuuucacauagcu

SEQ ID NO: 2512673 - RNA, 14 nt, Human
ucuuguuuucaguu

SEQ ID NO: 2512674 - RNA, 20 nt, Human
ucuuguuuauaccuuugccu

SEQ ID NO: 2512675 - RNA, 14 nt, Human
ucuuguuucaauuc

SEQ ID NO: 2512676 - RNA, 21 nt, Human
ucuuguugcucaaaaaaugag

SEQ ID NO: 2512677 - RNA, 22 nt, Human
ucuuguguuuccacagccugca

SEQ ID NO: 2512678 - RNA, 16 nt, Human
ucuuguuaagugcagu

SEQ ID NO: 2512679 - RNA, 22 nt, Human
ucuuguugcucaaaaaaugagc

SEQ ID NO: 2512680 - RNA, 16 nt, Human
ucuuguguguuuauug

SEQ ID NO: 2512681 - RNA, 13 nt, Human
ucuugcuugggaa

SEQ ID NO: 2512682 - RNA, 21 nt, Human
ucuuguguguuuauugucaaa

SEQ ID NO: 2512683 - RNA, 12 nt, Human
ucuuguguuucu

SEQ ID NO: 2512684 - RNA, 20 nt, Human
ucuccucugcugcuggcugg

SEQ ID NO: 2512685 - RNA, 16 nt, Human
ucucccuucauccuuc

SEQ ID NO: 2512686 - RNA, 16 nt, Human
ucuccucuugccacug

SEQ ID NO: 2512687 - RNA, 13 nt, Human
ucuccucuugcca

SEQ ID NO: 2512688 - RNA, 13 nt, Human
ucucccuggcccu

SEQ ID NO: 2512689 - RNA, 12 nt, Human
ucuccucuuaaa

SEQ ID NO: 2512690 - RNA, 14 nt, Human
ucuccucuuaaaaa

SEQ ID NO: 2512691 - RNA, 17 nt, Human
ucuccucuugccacugc

SEQ ID NO: 2512692 - RNA, 22 nt, Human
ucuccucuuaaaaaauaaaaac

SEQ ID NO: 2512693 - RNA, 23 nt, Human
ucuccucuuaaaaaauaaaaacu

SEQ ID NO: 2512694 - RNA, 23 nt, Human
ucuugcaauggcagccuuggcaa

SEQ ID NO: 2512695 - RNA, 18 nt, Human
ucuugcacccgccucucc

SEQ ID NO: 2512696 - RNA, 15 nt, Human
ucuugcacccgccuc

SEQ ID NO: 2512697 - RNA, 14 nt, Human
ucuugcacccgccu

SEQ ID NO: 2512698 - RNA, 23 nt, Human
ucuugcaccccaaagcuuuccug

SEQ ID NO: 2512699 - RNA, 22 nt, Human
ucuugcaccccaaagcuuuccu

SEQ ID NO: 2512700 - RNA, 20 nt, Human
ucuugcacccgccucucccg

SEQ ID NO: 2512701 - RNA, 19 nt, Human
ucuugcacccgccucuccc

SEQ ID NO: 2512702 - RNA, 13 nt, Human
ucuugcaggucuc

SEQ ID NO: 2512703 - RNA, 20 nt, Human
ucuugcaggucucaacccuu

SEQ ID NO: 2512704 - RNA, 14 nt, Human
ucuugcaggucuca

SEQ ID NO: 2512705 - RNA, 14 nt, Human
ucuugcucuuucua

SEQ ID NO: 2512706 - RNA, 17 nt, Human
ucuugcuaccucaguca

SEQ ID NO: 2512707 - RNA, 20 nt, Human
ucuugcuaccucagucagua

SEQ ID NO: 2512708 - RNA, 21 nt, Human
ucuugcucuuucuacucugaa

SEQ ID NO: 2512709 - RNA, 19 nt, Human
ucuugcucuuucuacucug

SEQ ID NO: 2512710 - RNA, 23 nt, Human
ucuugcuucccuaaucuaugguc

SEQ ID NO: 2512711 - RNA, 22 nt, Human
ucuugcuucccuaaucuauggu

SEQ ID NO: 2512712 - RNA, 18 nt, Human
ucuugcuucccuaaucua

SEQ ID NO: 2512713 - RNA, 22 nt, Human
ucuugcugguugucauuuuugc

SEQ ID NO: 2512714 - RNA, 21 nt, Human
ucuugcuaaucagugucucac

SEQ ID NO: 2512715 - RNA, 20 nt, Human
ucuugcuaaucagugucuca

SEQ ID NO: 2512716 - RNA, 19 nt, Human
ucuugcuaaucagugucuc

SEQ ID NO: 2512717 - RNA, 17 nt, Human
ucuugcuaaucaguguc

SEQ ID NO: 2512718 - RNA, 23 nt, Human
ucuugcuaaucagugucucacac

SEQ ID NO: 2512719 - RNA, 22 nt, Human
ucuugcuaaucagugucucaca

SEQ ID NO: 2512720 - RNA, 16 nt, Human
ucuugcuaaucagugu

SEQ ID NO: 2512721 - RNA, 15 nt, Human
ucuugcuaaucagug

SEQ ID NO: 2512722 - RNA, 21 nt, Human
ucuuucagccaagaauucuua

SEQ ID NO: 2512723 - RNA, 20 nt, Human
ucuuucagccaagaauucuu

SEQ ID NO: 2512724 - RNA, 19 nt, Human
ucuuucagccaagaauucu

SEQ ID NO: 2512725 - RNA, 16 nt, Human
ucuuucagccaagaau

SEQ ID NO: 2512726 - RNA, 13 nt, Human
ucuuuccaaagua

SEQ ID NO: 2512727 - RNA, 14 nt, Human
ucuuuccaaaguac

SEQ ID NO: 2512728 - RNA, 23 nt, Human
ucuuucauccacuagugcaaauc

SEQ ID NO: 2512729 - RNA, 21 nt, Human
ucuuucauccacuagugcaaa

SEQ ID NO: 2512730 - RNA, 13 nt, Human
ucuuucauccacu

SEQ ID NO: 2512731 - RNA, 23 nt, Human
ucuuucaucaaucauuguacagu

SEQ ID NO: 2512732 - RNA, 20 nt, Human
ucuuucagggggguugugag

SEQ ID NO: 2512733 - RNA, 21 nt, Human
ucuuucuuuaccugagaccag

SEQ ID NO: 2512734 - RNA, 17 nt, Human
ucuuucuuuaccugaga

SEQ ID NO: 2512735 - RNA, 22 nt, Human
ucuuucuuugggaauauuugaa

SEQ ID NO: 2512736 - RNA, 15 nt, Human
ucuuucuuucuuaga

SEQ ID NO: 2512737 - RNA, 23 nt, Human
ucuuucuuugggaauauuugaau

SEQ ID NO: 2512738 - RNA, 22 nt, Human
ucuuucuuuugauucuuccuaa

SEQ ID NO: 2512739 - RNA, 20 nt, Human
ucuuuccauuggaucucauu

SEQ ID NO: 2512740 - RNA, 10 nt, Human
ucuuuccaga

SEQ ID NO: 2512741 - RNA, 19 nt, Human
ucuuuccauuaugauucuu

SEQ ID NO: 2512742 - RNA, 21 nt, Human
ucuuuccacuccuccuagcca

SEQ ID NO: 2512743 - RNA, 22 nt, Human
ucuuuccacuccuccuagccac

SEQ ID NO: 2512744 - RNA, 22 nt, Human
ucuuuccacggagccacuccuc

SEQ ID NO: 2512745 - RNA, 23 nt, Human
ucuuuccacggagccacuccucu

SEQ ID NO: 2512746 - RNA, 19 nt, Human
ucuuuccacggagccacuc

SEQ ID NO: 2512747 - RNA, 19 nt, Human
ucuuuccacagaagcucca

SEQ ID NO: 2512748 - RNA, 14 nt, Human
ucuuucaugaguuu

SEQ ID NO: 2512749 - RNA, 12 nt, Human
ucuuucaugagu

SEQ ID NO: 2512750 - RNA, 21 nt, Human
ucuuuggacagaagcagcucu

SEQ ID NO: 2512751 - RNA, 17 nt, Human
ucuuuuagcugaugaac

SEQ ID NO: 2512752 - RNA, 24 nt, Human
ucuuuggaaggagugagaucauuu

SEQ ID NO: 2512753 - RNA, 18 nt, Human
ucuuuggaaggagugaga

SEQ ID NO: 2512754 - RNA, 17 nt, Human
ucuuuggaaggagugag

SEQ ID NO: 2512755 - RNA, 19 nt, Human
ucuuuggacagaagcagcu

SEQ ID NO: 2512756 - RNA, 18 nt, Human
ucuuuuaguuuuaguugc

SEQ ID NO: 2512757 - RNA, 22 nt, Human
ucuuuuauaacuaguccuuuac

SEQ ID NO: 2512758 - RNA, 16 nt, Human
ucuuuuaguuuuaguu

SEQ ID NO: 2512759 - RNA, 19 nt, Human
ucuuuuauaacuaguccuu

SEQ ID NO: 2512760 - RNA, 13 nt, Human
ucuuugcuuugcc

SEQ ID NO: 2512761 - RNA, 12 nt, Human
ucuuugcuuugc

SEQ ID NO: 2512762 - RNA, 17 nt, Human
ucuuugcuuugcccagc

SEQ ID NO: 2512763 - RNA, 13 nt, Human
ucuuugcuuugcu

SEQ ID NO: 2512764 - RNA, 23 nt, Human
ucuuugcuuugcuuucugcucag

SEQ ID NO: 2512765 - RNA, 18 nt, Human
ucuuugcuuugcuuucug

SEQ ID NO: 2512766 - RNA, 17 nt, Human
ucuuuggacacucacac

SEQ ID NO: 2512767 - RNA, 17 nt, Human
ucuuugccacccucaug

SEQ ID NO: 2512768 - RNA, 18 nt, Human
ucuuugccacccucaugc

SEQ ID NO: 2512769 - RNA, 20 nt, Human
ucuuugccacccucaugcug

SEQ ID NO: 2512770 - RNA, 11 nt, Human
ucuuugcuuug

SEQ ID NO: 2512771 - RNA, 14 nt, Human
ucuuugccacccuc

SEQ ID NO: 2512772 - RNA, 16 nt, Human
ucuuugccacccucau

SEQ ID NO: 2512773 - RNA, 12 nt, Human
ucuuugcaugga

SEQ ID NO: 2512774 - RNA, 15 nt, Human
ucuuugcauggaauu

SEQ ID NO: 2512775 - RNA, 19 nt, Human
ucuuugauucuccuucagc

SEQ ID NO: 2512776 - RNA, 16 nt, Human
ucuuugauucuccuuc

SEQ ID NO: 2512777 - RNA, 19 nt, Human
ucuuugauguuaacacauu

SEQ ID NO: 2512778 - RNA, 15 nt, Human
ucuuugauucuccuu

SEQ ID NO: 2512779 - RNA, 23 nt, Human
ucuuugauucuccuucagcccuc

SEQ ID NO: 2512780 - RNA, 20 nt, Human
ucuuugauucuccuucagcc

SEQ ID NO: 2512781 - RNA, 17 nt, Human
ucuuugauguuaacaca

SEQ ID NO: 2512782 - RNA, 12 nt, Human
ucuuugccaagu

SEQ ID NO: 2512783 - RNA, 14 nt, Human
ucuuugauaauguu

SEQ ID NO: 2512784 - RNA, 13 nt, Human
ucuuugauaaugu

SEQ ID NO: 2512785 - RNA, 17 nt, Human
ucuuugauaauguuaaa

SEQ ID NO: 2512786 - RNA, 16 nt, Human
ucuuugauaauguuaa

SEQ ID NO: 2512787 - RNA, 21 nt, Human
ucuuugauaauguuaaauuug

SEQ ID NO: 2512788 - RNA, 20 nt, Human
ucuuugauacuuguucaaaa

SEQ ID NO: 2512789 - RNA, 15 nt, Human
ucuuugauguuaaca

SEQ ID NO: 2512790 - RNA, 12 nt, Human
ucuuugauguua

SEQ ID NO: 2512791 - RNA, 22 nt, Human
ucuuugaaauagucugugugaa

SEQ ID NO: 2512792 - RNA, 21 nt, Human
ucuuugaaauagucuguguga

SEQ ID NO: 2512793 - RNA, 16 nt, Human
ugaacuccuggccuca

SEQ ID NO: 2512794 - RNA, 20 nt, Human
ugaaccaccacacccagccc

SEQ ID NO: 2512795 - RNA, 17 nt, Human
ugaaccaccacacccag

SEQ ID NO: 2512796 - RNA, 23 nt, Human
ugaaccacaucuugcucugcuga

SEQ ID NO: 2512797 - RNA, 22 nt, Human
ugaaccaagaacuuuccaggaa

SEQ ID NO: 2512798 - RNA, 19 nt, Human
ugaaccacaucuugcucug

SEQ ID NO: 2512799 - RNA, 12 nt, Human
ugaacauugcau

SEQ ID NO: 2512800 - RNA, 22 nt, Human
ugaacauugcauauaacuuaua

SEQ ID NO: 2512801 - RNA, 12 nt, Human
ugaacaguggag

SEQ ID NO: 2512802 - RNA, 22 nt, Human
ugaacauuuaucaaucaguaua

SEQ ID NO: 2512803 - RNA, 14 nt, Human
ugaacauuuaucaa

SEQ ID NO: 2512804 - RNA, 15 nt, Human
ugaacagcggcugga

SEQ ID NO: 2512805 - RNA, 13 nt, Human
ugaacaauucucu

SEQ ID NO: 2512806 - RNA, 21 nt, Human
ugaacagcggcuggacuugga

SEQ ID NO: 2512807 - RNA, 22 nt, Human
ugaacagcggcuggacuuggag

SEQ ID NO: 2512808 - RNA, 15 nt, Human
ugaacaagucccugu

SEQ ID NO: 2512809 - RNA, 19 nt, Human
ugaacaaguuguuucauug

SEQ ID NO: 2512810 - RNA, 20 nt, Human
ugaacaaguuguuucauuga

SEQ ID NO: 2512811 - RNA, 16 nt, Human
ugaacaaucaaagcac

SEQ ID NO: 2512812 - RNA, 18 nt, Human
ugaacacaaacuguaaau

SEQ ID NO: 2512813 - RNA, 22 nt, Human
ugaacaaguuguuucauugacu

SEQ ID NO: 2512814 - RNA, 12 nt, Human
ugaacaagaauu

SEQ ID NO: 2512815 - RNA, 14 nt, Human
ugaacaagaauugg

SEQ ID NO: 2512816 - RNA, 11 nt, Human
ugaacaagaau

SEQ ID NO: 2512817 - RNA, 18 nt, Human
ugaacaagaauuggaagc

SEQ ID NO: 2512818 - RNA, 12 nt, Human
ugaaauuauuca

SEQ ID NO: 2512819 - RNA, 21 nt, Human
ugaaauuauguauguuuacau

SEQ ID NO: 2512820 - RNA, 19 nt, Human
ugaaauuauguauguuuac

SEQ ID NO: 2512821 - RNA, 23 nt, Human
ugaaauuauguauguuuacauau

SEQ ID NO: 2512822 - RNA, 16 nt, Human
ugaaauucuccuggag

SEQ ID NO: 2512823 - RNA, 15 nt, Human
ugaaauucuccugga

SEQ ID NO: 2512824 - RNA, 14 nt, Human
ugaaauucuccugg

SEQ ID NO: 2512825 - RNA, 23 nt, Human
ugaaauuaagaaggcaaaaaugu

SEQ ID NO: 2512826 - RNA, 22 nt, Human
ugaaauuacuuaucauccacau

SEQ ID NO: 2512827 - RNA, 19 nt, Human
ugaaauuacuuaucaucca

SEQ ID NO: 2512828 - RNA, 20 nt, Human
ugaaauuacuacaaaauuug

SEQ ID NO: 2512829 - RNA, 23 nt, Human
ugaaauuacuacaaaauuugaaa

SEQ ID NO: 2512830 - RNA, 18 nt, Human
ugaaauuauguauguuua

SEQ ID NO: 2512831 - RNA, 17 nt, Human
ugaaauuauguauguuu

SEQ ID NO: 2512832 - RNA, 23 nt, Human
ugaaauuagggcccaauuaauaa

SEQ ID NO: 2512833 - RNA, 15 nt, Human
ugaaauguguuucug

SEQ ID NO: 2512834 - RNA, 17 nt, Human
ugaaauuaaccucucac

SEQ ID NO: 2512835 - RNA, 19 nt, Human
ugaaauuaagaaggcaaaa

SEQ ID NO: 2512836 - RNA, 21 nt, Human
ugaaauuaagaaggcaaaaau

SEQ ID NO: 2512837 - RNA, 14 nt, Human
ugaaauuaaccucu

SEQ ID NO: 2512838 - RNA, 22 nt, Human
ugaaauuaaccauagauguaga

SEQ ID NO: 2512839 - RNA, 18 nt, Human
ugaaauuaaccauagaug

SEQ ID NO: 2512840 - RNA, 19 nt, Human
ugaaauguguuucuguaua

SEQ ID NO: 2512841 - RNA, 13 nt, Human
ugaaauguguuuc

SEQ ID NO: 2512842 - RNA, 16 nt, Human
ugaaauggagguccuu

SEQ ID NO: 2512843 - RNA, 16 nt, Human
ugaaaucaguuacucu

SEQ ID NO: 2512844 - RNA, 17 nt, Human
ugaaaucaguuacucuu

SEQ ID NO: 2512845 - RNA, 16 nt, Human
ugaaauauugacuuuu

SEQ ID NO: 2512846 - RNA, 17 nt, Human
ugaaaggcauucucuga

SEQ ID NO: 2512847 - RNA, 19 nt, Human
ugaaaggcauucucugaag

SEQ ID NO: 2512848 - RNA, 22 nt, Human
ugaaagcuccucgagggcaggg

SEQ ID NO: 2512849 - RNA, 13 nt, Human
ugaaagcuagaga

SEQ ID NO: 2512850 - RNA, 23 nt, Human
ugaaagggaguauuacaaaaaca

SEQ ID NO: 2512851 - RNA, 13 nt, Human
ugaaagggcccag

SEQ ID NO: 2512852 - RNA, 16 nt, Human
ugaaagguacuucaaa

SEQ ID NO: 2512853 - RNA, 16 nt, Human
ugaaagguaauuugag

SEQ ID NO: 2512854 - RNA, 19 nt, Human
ugaaagguuacccuguaac

SEQ ID NO: 2512855 - RNA, 15 nt, Human
ugaaagguacuucaa

SEQ ID NO: 2512856 - RNA, 20 nt, Human
ugaaagggagcuaucaggaa

SEQ ID NO: 2512857 - RNA, 22 nt, Human
ugaaagggagcuaucaggaaca

SEQ ID NO: 2512858 - RNA, 18 nt, Human
ugaaagaggcagcuugaa

SEQ ID NO: 2512859 - RNA, 15 nt, Human
ugaaacccuggacca

SEQ ID NO: 2512860 - RNA, 19 nt, Human
ugaaagaggcugaggccug

SEQ ID NO: 2512861 - RNA, 21 nt, Human
ugaaacccuggaccagugguc

SEQ ID NO: 2512862 - RNA, 21 nt, Human
ugaaagaggcugaggccugga

SEQ ID NO: 2512863 - RNA, 16 nt, Human
ugaaagaguaaaggaa

SEQ ID NO: 2512864 - RNA, 20 nt, Human
ugaaagaguaaaggaaauga

SEQ ID NO: 2512865 - RNA, 17 nt, Human
ugaaagaguaaaggaaa

SEQ ID NO: 2512866 - RNA, 18 nt, Human
ugaaagauggcugugccu

SEQ ID NO: 2512867 - RNA, 23 nt, Human
ugaaagccagcugccgaccagag

SEQ ID NO: 2512868 - RNA, 15 nt, Human
ugaaagcauccaugu

SEQ ID NO: 2512869 - RNA, 17 nt, Human
ugaaagcauccaugugu

SEQ ID NO: 2512870 - RNA, 19 nt, Human
ugaaagauggcugugccuc

SEQ ID NO: 2512871 - RNA, 18 nt, Human
ugaaagcccugagcuuuc

SEQ ID NO: 2512872 - RNA, 14 nt, Human
ugaaagccauuugu

SEQ ID NO: 2512873 - RNA, 13 nt, Human
ugaaagcccaagu

SEQ ID NO: 2512874 - RNA, 19 nt, Human
ugaaaauuuugauguuuua

SEQ ID NO: 2512875 - RNA, 21 nt, Human
ugaaaauuuugauguuuuaag

SEQ ID NO: 2512876 - RNA, 13 nt, Human
ugaaaauuuugau

SEQ ID NO: 2512877 - RNA, 16 nt, Human
ucuuuucacauucuua

SEQ ID NO: 2512878 - RNA, 13 nt, Human
ucuuuucacauuc

SEQ ID NO: 2512879 - RNA, 22 nt, Human
ucuuuucacauagcugucuaga

SEQ ID NO: 2512880 - RNA, 16 nt, Human
ucuuuucacaaauaaa

SEQ ID NO: 2512881 - RNA, 15 nt, Human
ucuuuucacaaauaa

SEQ ID NO: 2512882 - RNA, 14 nt, Human
ucuuuucacaaaua

SEQ ID NO: 2512883 - RNA, 13 nt, Human
ucuuuucacaaau

SEQ ID NO: 2512884 - RNA, 12 nt, Human
ucuuuucacaaa

SEQ ID NO: 2512885 - RNA, 13 nt, Human
ugaaaagcuauua

SEQ ID NO: 2512886 - RNA, 14 nt, Human
ucuuuucacauucu

SEQ ID NO: 2512887 - RNA, 17 nt, Human
ugaaacaagaagccaca

SEQ ID NO: 2512888 - RNA, 16 nt, Human
ugaaacaacuuggaaa

SEQ ID NO: 2512889 - RNA, 14 nt, Human
ugaaacaaagaagg

SEQ ID NO: 2512890 - RNA, 15 nt, Human
ugaaacaacuuggaa

SEQ ID NO: 2512891 - RNA, 13 nt, Human
ugaaacacaaaca

SEQ ID NO: 2512892 - RNA, 23 nt, Human
ugaaacaauacucauaaugugaa

SEQ ID NO: 2512893 - RNA, 21 nt, Human
ugaaacaagauaacugagaau

SEQ ID NO: 2512894 - RNA, 20 nt, Human
ugaaacacaaacaauaguaa

SEQ ID NO: 2512895 - RNA, 16 nt, Human
ugaaacacaccaggcu

SEQ ID NO: 2512896 - RNA, 17 nt, Human
ugaaacacaccaggcug

SEQ ID NO: 2512897 - RNA, 18 nt, Human
ugaaacacaccaggcugu

SEQ ID NO: 2512898 - RNA, 22 nt, Human
ugaaacaacaaauaggaauugu

SEQ ID NO: 2512899 - RNA, 23 nt, Human
ugaaaagcuauuagccaggauca

SEQ ID NO: 2512900 - RNA, 20 nt, Human
ugaaaagcuauuagccagga

SEQ ID NO: 2512901 - RNA, 19 nt, Human
ugaaaagcuauuagccagg

SEQ ID NO: 2512902 - RNA, 17 nt, Human
ugaaaagcuauuagcca

SEQ ID NO: 2512903 - RNA, 14 nt, Human
ugaaacaaagcugc

SEQ ID NO: 2512904 - RNA, 19 nt, Human
ugaaacacaccaggcugug

SEQ ID NO: 2512905 - RNA, 22 nt, Human
ugaaacacaccaggcugugggc

SEQ ID NO: 2512906 - RNA, 14 nt, Human
ugaaacauuuuguc

SEQ ID NO: 2512907 - RNA, 20 nt, Human
ugaaaccaguguuagggaag

SEQ ID NO: 2512908 - RNA, 17 nt, Human
ugaaacccccacacaca

SEQ ID NO: 2512909 - RNA, 18 nt, Human
ugaaacccccacacacac

SEQ ID NO: 2512910 - RNA, 16 nt, Human
ugaaacccccacacac

SEQ ID NO: 2512911 - RNA, 19 nt, Human
ugacagacaggcucuuagc

SEQ ID NO: 2512912 - RNA, 17 nt, Human
ugacagaccacaucuuu

SEQ ID NO: 2512913 - RNA, 18 nt, Human
ugacagaccacaucuuua

SEQ ID NO: 2512914 - RNA, 19 nt, Human
ugacagagugagacucugu

SEQ ID NO: 2512915 - RNA, 23 nt, Human
ugacauaaguauuuaauucaugu

SEQ ID NO: 2512916 - RNA, 17 nt, Human
ugacauacauccaacau

SEQ ID NO: 2512917 - RNA, 17 nt, Human
ugacauaacacuauaaa

SEQ ID NO: 2512918 - RNA, 21 nt, Human
ugacauaacacuauaaagguu

SEQ ID NO: 2512919 - RNA, 17 nt, Human
ugacagagugagacucu

SEQ ID NO: 2512920 - RNA, 14 nt, Human
ugacagagugagac

SEQ ID NO: 2512921 - RNA, 23 nt, Human
ugacagaggcagccccauucugc

SEQ ID NO: 2512922 - RNA, 18 nt, Human
ugacagaggcagccccau

SEQ ID NO: 2512923 - RNA, 17 nt, Human
ugacagaggcagcccca

SEQ ID NO: 2512924 - RNA, 16 nt, Human
ugacagaggcagcccc

SEQ ID NO: 2512925 - RNA, 15 nt, Human
ugacagaggcagccc

SEQ ID NO: 2512926 - RNA, 14 nt, Human
ugacagaggcagcc

SEQ ID NO: 2512927 - RNA, 23 nt, Human
ugacagacacaggcccggcucca

SEQ ID NO: 2512928 - RNA, 20 nt, Human
ugacagacacaggcccggcu

SEQ ID NO: 2512929 - RNA, 15 nt, Human
ugacagacaggcucu

SEQ ID NO: 2512930 - RNA, 14 nt, Human
ugacagacaggcuc

SEQ ID NO: 2512931 - RNA, 16 nt, Human
ugacagacagcccucc

SEQ ID NO: 2512932 - RNA, 13 nt, Human
ugacagaggcagc

SEQ ID NO: 2512933 - RNA, 22 nt, Human
ugaauugccugcagagagaagc

SEQ ID NO: 2512934 - RNA, 16 nt, Human
ugaauugccugcagag

SEQ ID NO: 2512935 - RNA, 19 nt, Human
ugacaacuuugccagcuuu

SEQ ID NO: 2512936 - RNA, 12 nt, Human
ugacaagcucac

SEQ ID NO: 2512937 - RNA, 15 nt, Human
ugacaagcacugcua

SEQ ID NO: 2512938 - RNA, 13 nt, Human
ugacaagccccag

SEQ ID NO: 2512939 - RNA, 15 nt, Human
ugacaagccccaggc

SEQ ID NO: 2512940 - RNA, 20 nt, Human
ugacaagcucacagaccuuu

SEQ ID NO: 2512941 - RNA, 15 nt, Human
ugacaagcucacaga

SEQ ID NO: 2512942 - RNA, 22 nt, Human
ugacaagcuccuggucuugaga

SEQ ID NO: 2512943 - RNA, 17 nt, Human
ugacaagccccaggcag

SEQ ID NO: 2512944 - RNA, 21 nt, Human
ugacaagccccaggcaggcug

SEQ ID NO: 2512945 - RNA, 18 nt, Human
ugacaaggauugcuacug

SEQ ID NO: 2512946 - RNA, 16 nt, Human
ugacaauuuuguacaa

SEQ ID NO: 2512947 - RNA, 16 nt, Human
ugacacaaaccugccu

SEQ ID NO: 2512948 - RNA, 18 nt, Human
ugacaauuuuguacaaau

SEQ ID NO: 2512949 - RNA, 22 nt, Human
ugacaauuuuguacaaauuugu

SEQ ID NO: 2512950 - RNA, 17 nt, Human
ugacaauaaaacauuaa

SEQ ID NO: 2512951 - RNA, 14 nt, Human
ugacaauaaaugug

SEQ ID NO: 2512952 - RNA, 14 nt, Human
ugacaauaauuuca

SEQ ID NO: 2512953 - RNA, 18 nt, Human
ugacaaucaacucuaaua

SEQ ID NO: 2512954 - RNA, 17 nt, Human
ugacaauaauuucaggu

SEQ ID NO: 2512955 - RNA, 15 nt, Human
ugacaaucaacucua

SEQ ID NO: 2512956 - RNA, 13 nt, Human
ugacagaaagcag

SEQ ID NO: 2512957 - RNA, 21 nt, Human
ugacagaacacugucuugaag

SEQ ID NO: 2512958 - RNA, 17 nt, Human
ugacagaacacugucuu

SEQ ID NO: 2512959 - RNA, 16 nt, Human
ugacagaacacugucu

SEQ ID NO: 2512960 - RNA, 20 nt, Human
ugacacuuugccagaaagca

SEQ ID NO: 2512961 - RNA, 22 nt, Human
ugacacuuuaauuaccaaccug

SEQ ID NO: 2512962 - RNA, 15 nt, Human
ugacacuugucccca

SEQ ID NO: 2512963 - RNA, 15 nt, Human
ugacagaacacuguc

SEQ ID NO: 2512964 - RNA, 14 nt, Human
ugacagaacacugu

SEQ ID NO: 2512965 - RNA, 13 nt, Human
ugacagaacacug

SEQ ID NO: 2512966 - RNA, 18 nt, Human
ugacaugggacauuugcu

SEQ ID NO: 2512967 - RNA, 12 nt, Human
ugacauguacag

SEQ ID NO: 2512968 - RNA, 13 nt, Human
ugacauguaacag

SEQ ID NO: 2512969 - RNA, 21 nt, Human
ugacauggugccugagaggca

SEQ ID NO: 2512970 - RNA, 18 nt, Human
ugacauggugccugagag

SEQ ID NO: 2512971 - RNA, 17 nt, Human
ugacauggugccugaga

SEQ ID NO: 2512972 - RNA, 16 nt, Human
ugacauggugccugag

SEQ ID NO: 2512973 - RNA, 15 nt, Human
ugacauggugccuga

SEQ ID NO: 2512974 - RNA, 13 nt, Human
ugacaugucuuuu

SEQ ID NO: 2512975 - RNA, 15 nt, Human
ugacauguacagaga

SEQ ID NO: 2512976 - RNA, 13 nt, Human
ugacauguacaga

SEQ ID NO: 2512977 - RNA, 17 nt, Human
ugacauguacagagaac

SEQ ID NO: 2512978 - RNA, 16 nt, Human
ugacaugucccuacac

SEQ ID NO: 2512979 - RNA, 17 nt, Human
ugacaugggacauuugc

SEQ ID NO: 2512980 - RNA, 16 nt, Human
ugacaugggacauuug

SEQ ID NO: 2512981 - RNA, 16 nt, Human
ugacauauuaugucuu

SEQ ID NO: 2512982 - RNA, 13 nt, Human
ugacaugugaaac

SEQ ID NO: 2512983 - RNA, 12 nt, Human
ugacaugugaaa

SEQ ID NO: 2512984 - RNA, 15 nt, Human
ugaccacagcacagc

SEQ ID NO: 2512985 - RNA, 16 nt, Human
ugaccacagcacagcc

SEQ ID NO: 2512986 - RNA, 17 nt, Human
ugaccacagcacagcca

SEQ ID NO: 2512987 - RNA, 15 nt, Human
ugacaugucuuuucu

SEQ ID NO: 2512988 - RNA, 21 nt, Human
ugaccacauagcaugaggcca

SEQ ID NO: 2512989 - RNA, 18 nt, Human
ugaccacauagcaugagg

SEQ ID NO: 2512990 - RNA, 18 nt, Human
ugaccacaggcaguuacu

SEQ ID NO: 2512991 - RNA, 13 nt, Human
ugaccacaggcag

SEQ ID NO: 2512992 - RNA, 22 nt, Human
ugaccacagcaucauuuugcau

SEQ ID NO: 2512993 - RNA, 14 nt, Human
ugaccacagcacag

SEQ ID NO: 2512994 - RNA, 19 nt, Human
ugaccacagcacagccaac

SEQ ID NO: 2512995 - RNA, 16 nt, Human
ugaccacccuccccuc

SEQ ID NO: 2512996 - RNA, 15 nt, Human
ugaccacccuccccu

SEQ ID NO: 2512997 - RNA, 13 nt, Human
ugaccacccuccc

SEQ ID NO: 2512998 - RNA, 12 nt, Human
ugaccacccucc

SEQ ID NO: 2512999 - RNA, 19 nt, Human
ugaccacccuccccucucu

SEQ ID NO: 2513000 - RNA, 18 nt, Human
ugaccacccuccccucuc

SEQ ID NO: 2513001 - RNA, 21 nt, Human
ugaccacgcuuucuagcuguu

SEQ ID NO: 2513002 - RNA, 20 nt, Human
ugaccacugcagaagacagu

SEQ ID NO: 2513003 - RNA, 19 nt, Human
ugaccagcaccaucucucc

SEQ ID NO: 2513004 - RNA, 15 nt, Human
ugaccacucugucuu

SEQ ID NO: 2513005 - RNA, 23 nt, Human
ugaccacggacguuuccaucagg

SEQ ID NO: 2513006 - RNA, 22 nt, Human
ugaccacggacguuuccaucag

SEQ ID NO: 2513007 - RNA, 21 nt, Human
ugaccacggacguuuccauca

SEQ ID NO: 2513008 - RNA, 20 nt, Human
ugaccacggacguuuccauc

SEQ ID NO: 2513009 - RNA, 22 nt, Human
ugaccacgcuuucuagcuguug

SEQ ID NO: 2513010 - RNA, 16 nt, Human
ugaccaggcauccucc

SEQ ID NO: 2513011 - RNA, 12 nt, Human
ugaccaggccug

SEQ ID NO: 2513012 - RNA, 15 nt, Human
ugaccaggccugggc

SEQ ID NO: 2513013 - RNA, 13 nt, Human
ugaccaggccugg

SEQ ID NO: 2513014 - RNA, 20 nt, Human
ugaccaggccugggccagag

SEQ ID NO: 2513015 - RNA, 15 nt, Human
ugaccagucugaccc

SEQ ID NO: 2513016 - RNA, 22 nt, Human
ugaccaggggugauuucagaga

SEQ ID NO: 2513017 - RNA, 16 nt, Human
ugaccagucugacccu

SEQ ID NO: 2513018 - RNA, 19 nt, Human
ugaccagcaacuugucuuu

SEQ ID NO: 2513019 - RNA, 23 nt, Human
ugaccagccuccaugcugccucc

SEQ ID NO: 2513020 - RNA, 18 nt, Human
ugaccauucuccaccugc

SEQ ID NO: 2513021 - RNA, 17 nt, Human
ugaccauucuccaccug

SEQ ID NO: 2513022 - RNA, 16 nt, Human
ugaccauucuccaccu

SEQ ID NO: 2513023 - RNA, 20 nt, Human
ugaccaguuuaaccugaugc

SEQ ID NO: 2513024 - RNA, 20 nt, Human
ugaccaguugcacuuggccu

SEQ ID NO: 2513025 - RNA, 23 nt, Human
ugaccaguuuaaccugaugcagu

SEQ ID NO: 2513026 - RNA, 21 nt, Human
ugaccaguuuaaccugaugca

SEQ ID NO: 2513027 - RNA, 16 nt, Human
ugaccauacugaggga

SEQ ID NO: 2513028 - RNA, 20 nt, Human
ugaccgugaggccagagaca

SEQ ID NO: 2513029 - RNA, 16 nt, Human
ugaccgugaggccaga

SEQ ID NO: 2513030 - RNA, 14 nt, Human
ugaccgugaggcca

SEQ ID NO: 2513031 - RNA, 13 nt, Human
ugaccgugaggcc

SEQ ID NO: 2513032 - RNA, 22 nt, Human
ugacccuuacagccucugacuu

SEQ ID NO: 2513033 - RNA, 19 nt, Human
ugaccgaaacagcgcuggg

SEQ ID NO: 2513034 - RNA, 20 nt, Human
ugacccuuacagccucugac

SEQ ID NO: 2513035 - RNA, 21 nt, Human
ugacccugcgaaggggcccug

SEQ ID NO: 2513036 - RNA, 20 nt, Human
ugacccuguauauagcccag

SEQ ID NO: 2513037 - RNA, 19 nt, Human
ugacccuguauauagccca

SEQ ID NO: 2513038 - RNA, 18 nt, Human
ugacccuguauauagccc

SEQ ID NO: 2513039 - RNA, 19 nt, Human
ugaccauucuccaccugcc

SEQ ID NO: 2513040 - RNA, 22 nt, Human
ugacccugcgaaggggcccugg

SEQ ID NO: 2513041 - RNA, 23 nt, Human
ugacccugcgaaggggcccuggu

SEQ ID NO: 2513042 - RNA, 17 nt, Human
ugacccuguauauagcc

SEQ ID NO: 2513043 - RNA, 15 nt, Human
ugaacucuuaaucaa

SEQ ID NO: 2513044 - RNA, 21 nt, Human
ugaagauaaguguauuuuuca

SEQ ID NO: 2513045 - RNA, 23 nt, Human
ugaagauaaguguauuuuucaau

SEQ ID NO: 2513046 - RNA, 14 nt, Human
ugaacucuuaauca

SEQ ID NO: 2513047 - RNA, 14 nt, Human
ugaacuccugggcu

SEQ ID NO: 2513048 - RNA, 16 nt, Human
ugaacucugacaacag

SEQ ID NO: 2513049 - RNA, 17 nt, Human
ugaacuccuggccucaa

SEQ ID NO: 2513050 - RNA, 23 nt, Human
ugaaggaauauauggcagaguug

SEQ ID NO: 2513051 - RNA, 22 nt, Human
ugaaggaauauauggcagaguu

SEQ ID NO: 2513052 - RNA, 21 nt, Human
ugaaggaauauauggcagagu

SEQ ID NO: 2513053 - RNA, 20 nt, Human
ugaaggaauauauggcagag

SEQ ID NO: 2513054 - RNA, 15 nt, Human
ugaaggaauauaugg

SEQ ID NO: 2513055 - RNA, 14 nt, Human
ugaaggaauauaug

SEQ ID NO: 2513056 - RNA, 13 nt, Human
ugaaggaauauau

SEQ ID NO: 2513057 - RNA, 20 nt, Human
ugaaggaauaaauugcuccu

SEQ ID NO: 2513058 - RNA, 20 nt, Human
ugaaggacauugcggacagc

SEQ ID NO: 2513059 - RNA, 19 nt, Human
ugaaggacauugcggacag

SEQ ID NO: 2513060 - RNA, 19 nt, Human
ugaaggacacuuccugccu

SEQ ID NO: 2513061 - RNA, 18 nt, Human
ugaaggacacuuccugcc

SEQ ID NO: 2513062 - RNA, 12 nt, Human
ugaaggacccuu

SEQ ID NO: 2513063 - RNA, 20 nt, Human
ugaaggacacuuccugccua

SEQ ID NO: 2513064 - RNA, 22 nt, Human
ugaaggacauugcggacagcca

SEQ ID NO: 2513065 - RNA, 16 nt, Human
ugaaggccccgcccag

SEQ ID NO: 2513066 - RNA, 15 nt, Human
ugaaggccccgccca

SEQ ID NO: 2513067 - RNA, 18 nt, Human
ugaaggcaaaauugcaaa

SEQ ID NO: 2513068 - RNA, 14 nt, Human
ugaaggcaaugcca

SEQ ID NO: 2513069 - RNA, 23 nt, Human
ugaaggacugugacaggcagcag

SEQ ID NO: 2513070 - RNA, 15 nt, Human
ugaaggcagaaagca

SEQ ID NO: 2513071 - RNA, 14 nt, Human
ugaaggacugugac

SEQ ID NO: 2513072 - RNA, 12 nt, Human
ugaaggacugug

SEQ ID NO: 2513073 - RNA, 10 nt, Human
ugaaggacug

SEQ ID NO: 2513074 - RNA, 16 nt, Human
ugaaggagagcccuuc

SEQ ID NO: 2513075 - RNA, 17 nt, Human
ugaaggccccgcccagg

SEQ ID NO: 2513076 - RNA, 18 nt, Human
ugaaggcagaaagcaaaa

SEQ ID NO: 2513077 - RNA, 11 nt, Human
ugaaguccaag

SEQ ID NO: 2513078 - RNA, 14 nt, Human
ugaagucagaugug

SEQ ID NO: 2513079 - RNA, 16 nt, Human
ugaagucagauguggu

SEQ ID NO: 2513080 - RNA, 13 nt, Human
ugaaguccaagca

SEQ ID NO: 2513081 - RNA, 17 nt, Human
ugaagugagcacagccu

SEQ ID NO: 2513082 - RNA, 14 nt, Human
ugaagugaaacugc

SEQ ID NO: 2513083 - RNA, 13 nt, Human
ugaagugaaacug

SEQ ID NO: 2513084 - RNA, 12 nt, Human
ugaagugaaacu

SEQ ID NO: 2513085 - RNA, 23 nt, Human
ugaagugagcugagauugcacca

SEQ ID NO: 2513086 - RNA, 18 nt, Human
ugaagugagcacagccua

SEQ ID NO: 2513087 - RNA, 18 nt, Human
ugaagugcauccaaaggu

SEQ ID NO: 2513088 - RNA, 16 nt, Human
ugaagugcauccaaag

SEQ ID NO: 2513089 - RNA, 23 nt, Human
ugaaguguuaauacuaguuguga

SEQ ID NO: 2513090 - RNA, 17 nt, Human
ugaaguguuaauacuag

SEQ ID NO: 2513091 - RNA, 20 nt, Human
ugaaguguuuuguucuuucu

SEQ ID NO: 2513092 - RNA, 18 nt, Human
ugaaguguguuuccuuca

SEQ ID NO: 2513093 - RNA, 22 nt, Human
ugaaguguguuuccuucagugc

SEQ ID NO: 2513094 - RNA, 18 nt, Human
ugaaguguaggcagacac

SEQ ID NO: 2513095 - RNA, 17 nt, Human
ugaaguguaggcagaca

SEQ ID NO: 2513096 - RNA, 16 nt, Human
ugaaguguaggcagac

SEQ ID NO: 2513097 - RNA, 19 nt, Human
ugaaguguaggcagacaca

SEQ ID NO: 2513098 - RNA, 16 nt, Human
ugaaguguguuuccuu

SEQ ID NO: 2513099 - RNA, 21 nt, Human
ugaaguuagaauuccuucagg

SEQ ID NO: 2513100 - RNA, 19 nt, Human
ugaaguuagaauuccuuca

SEQ ID NO: 2513101 - RNA, 16 nt, Human
ugaaguucaccauuaa

SEQ ID NO: 2513102 - RNA, 15 nt, Human
ugaaguuagaauucc

SEQ ID NO: 2513103 - RNA, 14 nt, Human
ugaaguuagaauuc

SEQ ID NO: 2513104 - RNA, 14 nt, Human
ugaaguuaacagag

SEQ ID NO: 2513105 - RNA, 20 nt, Human
ugaauaaaauuauuuuggau

SEQ ID NO: 2513106 - RNA, 15 nt, Human
ugaauaaaauuauuu

SEQ ID NO: 2513107 - RNA, 20 nt, Human
ugaauaaacuagauuacauu

SEQ ID NO: 2513108 - RNA, 15 nt, Human
ugaauaaaaaugcac

SEQ ID NO: 2513109 - RNA, 14 nt, Human
ugaauaaaaaugca

SEQ ID NO: 2513110 - RNA, 19 nt, Human
ugaauaaaaauauguacaa

SEQ ID NO: 2513111 - RNA, 21 nt, Human
ugaauaaaaacuuugcuaaau

SEQ ID NO: 2513112 - RNA, 19 nt, Human
ugaauaaaauuauuccuuu

SEQ ID NO: 2513113 - RNA, 13 nt, Human
ugaauaaaauuau

SEQ ID NO: 2513114 - RNA, 22 nt, Human
ugaaguuguuacuaacuaaacu

SEQ ID NO: 2513115 - RNA, 20 nt, Human
ugaaguuguuacuaacuaaa

SEQ ID NO: 2513116 - RNA, 18 nt, Human
ugaaguuguuacuaacua

SEQ ID NO: 2513117 - RNA, 14 nt, Human
ugaauaaaaacuuu

SEQ ID NO: 2513118 - RNA, 20 nt, Human
ugaauaaaaacuuugcuaaa

SEQ ID NO: 2513119 - RNA, 15 nt, Human
ugaaguuguuacuaa

SEQ ID NO: 2513120 - RNA, 16 nt, Human
ugaauuaguccuugcu

SEQ ID NO: 2513121 - RNA, 14 nt, Human
ugaauuagcucacu

SEQ ID NO: 2513122 - RNA, 23 nt, Human
ugaauuagaaacauaaauaaaau

SEQ ID NO: 2513123 - RNA, 21 nt, Human
ugaauuagaaacauaaauaaa

SEQ ID NO: 2513124 - RNA, 19 nt, Human
ugaauuagaaacauaaaua

SEQ ID NO: 2513125 - RNA, 21 nt, Human
ugaauguugucuguuuguucu

SEQ ID NO: 2513126 - RNA, 21 nt, Human
ugaauguucugacauuaacag

SEQ ID NO: 2513127 - RNA, 18 nt, Human
ugaauuacauuuguauaa

SEQ ID NO: 2513128 - RNA, 16 nt, Human
ugaauuacauuuguau

SEQ ID NO: 2513129 - RNA, 15 nt, Human
ugaauuacauuugua

SEQ ID NO: 2513130 - RNA, 14 nt, Human
ugaauguucugaca

SEQ ID NO: 2513131 - RNA, 15 nt, Human
ugaauguucugacau

SEQ ID NO: 2513132 - RNA, 16 nt, Human
ugaauguucugacauu

SEQ ID NO: 2513133 - RNA, 17 nt, Human
ugaauguucugacauua

SEQ ID NO: 2513134 - RNA, 18 nt, Human
ugaauguucugacauuaa

SEQ ID NO: 2513135 - RNA, 20 nt, Human
ugaauguucugacauuaaca

SEQ ID NO: 2513136 - RNA, 23 nt, Human
ugaauguucugacauuaacaguu

SEQ ID NO: 2513137 - RNA, 16 nt, Human
ugaauuauuuucucuc

SEQ ID NO: 2513138 - RNA, 21 nt, Human
ugaauuaucuugguugaaaau

SEQ ID NO: 2513139 - RNA, 15 nt, Human
ugaauuaucuauaca

SEQ ID NO: 2513140 - RNA, 20 nt, Human
ugaauucuugguugaggaaa

SEQ ID NO: 2513141 - RNA, 19 nt, Human
ugaauucugcaauguuuuc

SEQ ID NO: 2513142 - RNA, 17 nt, Human
ugaauucagauuuuaaa

SEQ ID NO: 2513143 - RNA, 12 nt, Human
ugaauucagauu

SEQ ID NO: 2513144 - RNA, 22 nt, Human
ugaauucuugguugaggaaaca

SEQ ID NO: 2513145 - RNA, 21 nt, Human
ugaauucuugguugaggaaac

SEQ ID NO: 2513146 - RNA, 17 nt, Human
ugaauucuuaugcuuau

SEQ ID NO: 2513147 - RNA, 20 nt, Human
ugaauugaggggauuaauau

SEQ ID NO: 2513148 - RNA, 14 nt, Human
ugaaugagaaucua

SEQ ID NO: 2513149 - RNA, 15 nt, Human
ugaaugacaacagaa

SEQ ID NO: 2513150 - RNA, 15 nt, Human
ugaaugacaaagagu

SEQ ID NO: 2513151 - RNA, 17 nt, Human
ugaaugacaacagaagc

SEQ ID NO: 2513152 - RNA, 22 nt, Human
ugaaugaggucagcaugucuau

SEQ ID NO: 2513153 - RNA, 17 nt, Human
ugaaugaggucccaggc

SEQ ID NO: 2513154 - RNA, 18 nt, Human
ugaaugaggucccaggca

SEQ ID NO: 2513155 - RNA, 19 nt, Human
ugaaugaggucccaggcag

SEQ ID NO: 2513156 - RNA, 21 nt, Human
ugaaugaaacccccacacaca

SEQ ID NO: 2513157 - RNA, 22 nt, Human
ugaaugaaacccccacacacac

SEQ ID NO: 2513158 - RNA, 14 nt, Human
ugaaugaaauauca

SEQ ID NO: 2513159 - RNA, 11 nt, Human
ugaauguuaaa

SEQ ID NO: 2513160 - RNA, 22 nt, Human
ugaaugaggucccaggcagaga

SEQ ID NO: 2513161 - RNA, 15 nt, Human
ugaaugaucucucug

SEQ ID NO: 2513162 - RNA, 18 nt, Human
ugaaugaucucucugaau

SEQ ID NO: 2513163 - RNA, 18 nt, Human
ugaauguuaaauaaauug

SEQ ID NO: 2513164 - RNA, 16 nt, Human
ugaauguuaaauaaau

SEQ ID NO: 2513165 - RNA, 15 nt, Human
ugaauguuaaauaaa

SEQ ID NO: 2513166 - RNA, 13 nt, Human
ugaauguuaaaua

SEQ ID NO: 2513167 - RNA, 21 nt, Human
ugaauguuaaauaaauuguau

SEQ ID NO: 2513168 - RNA, 20 nt, Human
ugaauguuaaauaaauugua

SEQ ID NO: 2513169 - RNA, 15 nt, Human
ugaauguuauuuguu

SEQ ID NO: 2513170 - RNA, 14 nt, Human
ugaauguuauuugu

SEQ ID NO: 2513171 - RNA, 23 nt, Human
ugaauguuauuuguuauuuucag

SEQ ID NO: 2513172 - RNA, 12 nt, Human
ugaauguucuga

SEQ ID NO: 2513173 - RNA, 23 nt, Human
ugaaucauuuuaccuuugacaaa

SEQ ID NO: 2513174 - RNA, 22 nt, Human
ugaaucauuuuaccuuugacaa

SEQ ID NO: 2513175 - RNA, 14 nt, Human
ugaaucauguagua

SEQ ID NO: 2513176 - RNA, 12 nt, Human
ugaaucauguag

SEQ ID NO: 2513177 - RNA, 19 nt, Human
ugaaucauguaguaucaaa

SEQ ID NO: 2513178 - RNA, 18 nt, Human
ugaaucauguaguaucaa

SEQ ID NO: 2513179 - RNA, 21 nt, Human
ugaaucauguaguaucaaaua

SEQ ID NO: 2513180 - RNA, 15 nt, Human
ugaauaaagacaccu

SEQ ID NO: 2513181 - RNA, 14 nt, Human
ugaauaaagacacc

SEQ ID NO: 2513182 - RNA, 16 nt, Human
ugaaugaaacccccac

SEQ ID NO: 2513183 - RNA, 18 nt, Human
ugaaugaaacccccacac

SEQ ID NO: 2513184 - RNA, 19 nt, Human
ugaaugaaacccccacaca

SEQ ID NO: 2513185 - RNA, 20 nt, Human
ugaaugaaacccccacacac

SEQ ID NO: 2513186 - RNA, 11 nt, Human
ugaaugaaaaa

SEQ ID NO: 2513187 - RNA, 16 nt, Human
ugaaugaaaaauuuaa

SEQ ID NO: 2513188 - RNA, 17 nt, Human
ugaaugaaaaauuuaag

SEQ ID NO: 2513189 - RNA, 18 nt, Human
ugaaugaaaaauuuaagc

SEQ ID NO: 2513190 - RNA, 19 nt, Human
ugaaugaaaaauuuaagca

SEQ ID NO: 2513191 - RNA, 20 nt, Human
ugaaugaaaaauuuaagcau

SEQ ID NO: 2513192 - RNA, 21 nt, Human
ugaaugaaaaauuuaagcauu

SEQ ID NO: 2513193 - RNA, 22 nt, Human
ugaaugaaaaauuuaagcauug

SEQ ID NO: 2513194 - RNA, 15 nt, Human
ugaauccaaacuaau

SEQ ID NO: 2513195 - RNA, 16 nt, Human
ugaauccaaacuaauc

SEQ ID NO: 2513196 - RNA, 20 nt, Human
ugaaucccacccacauguga

SEQ ID NO: 2513197 - RNA, 14 nt, Human
ugaauccaugcuug

SEQ ID NO: 2513198 - RNA, 17 nt, Human
ugaauccaugcuugggu

SEQ ID NO: 2513199 - RNA, 24 nt, Human
ugaaucuugucucaaugcucauaa

SEQ ID NO: 2513200 - RNA, 19 nt, Human
ugaaucuuuccaauaaacc

SEQ ID NO: 2513201 - RNA, 21 nt, Human
ugauucagacagcugccuggg

SEQ ID NO: 2513202 - RNA, 20 nt, Human
ugauucagacagcugccugg

SEQ ID NO: 2513203 - RNA, 19 nt, Human
ugauucagacagcugccug

SEQ ID NO: 2513204 - RNA, 18 nt, Human
ugauucagacagcugccu

SEQ ID NO: 2513205 - RNA, 21 nt, Human
ugauucuccuucagcccucac

SEQ ID NO: 2513206 - RNA, 19 nt, Human
ugauucuccuucagcccuc

SEQ ID NO: 2513207 - RNA, 18 nt, Human
ugauucuccuucagcccu

SEQ ID NO: 2513208 - RNA, 16 nt, Human
ugauucuccuucagcc

SEQ ID NO: 2513209 - RNA, 14 nt, Human
ugauucuccuucag

SEQ ID NO: 2513210 - RNA, 13 nt, Human
ugauucuccuuca

SEQ ID NO: 2513211 - RNA, 12 nt, Human
ugauucuccuuc

SEQ ID NO: 2513212 - RNA, 23 nt, Human
ugauucagacagcugccugggau

SEQ ID NO: 2513213 - RNA, 21 nt, Human
ugauucuccugccucagccuc

SEQ ID NO: 2513214 - RNA, 12 nt, Human
ugauugauuuga

SEQ ID NO: 2513215 - RNA, 17 nt, Human
ugauugagaguaacuua

SEQ ID NO: 2513216 - RNA, 21 nt, Human
ugauugacagcuuugcugcug

SEQ ID NO: 2513217 - RNA, 14 nt, Human
ugauugauuugaag

SEQ ID NO: 2513218 - RNA, 17 nt, Human
ugauugacagcuuugcu

SEQ ID NO: 2513219 - RNA, 19 nt, Human
ugauugacagcuuugcugc

SEQ ID NO: 2513220 - RNA, 12 nt, Human
ugauugacagcu

SEQ ID NO: 2513221 - RNA, 13 nt, Human
ugauugacagcuu

SEQ ID NO: 2513222 - RNA, 22 nt, Human
ugauugaaucugauuggacauu

SEQ ID NO: 2513223 - RNA, 18 nt, Human
ugauugccaagcucagga

SEQ ID NO: 2513224 - RNA, 16 nt, Human
ugauugcuaaauguaa

SEQ ID NO: 2513225 - RNA, 15 nt, Human
ugauugcuaaaugua

SEQ ID NO: 2513226 - RNA, 14 nt, Human
ugauugcuaaaugu

SEQ ID NO: 2513227 - RNA, 13 nt, Human
ugauugcuaaaug

SEQ ID NO: 2513228 - RNA, 20 nt, Human
ugauugcuaaauguaacagu

SEQ ID NO: 2513229 - RNA, 19 nt, Human
ugauugcuaaauguaacag

SEQ ID NO: 2513230 - RNA, 22 nt, Human
ugauugcuaaauguaacagucu

SEQ ID NO: 2513231 - RNA, 22 nt, Human
ugauugaaaauaguaaaugcuu

SEQ ID NO: 2513232 - RNA, 23 nt, Human
ugauucuuuuuaaaguguuucug

SEQ ID NO: 2513233 - RNA, 20 nt, Human
ugauucuugaguuuagugau

SEQ ID NO: 2513234 - RNA, 14 nt, Human
ugauucuuuguuac

SEQ ID NO: 2513235 - RNA, 18 nt, Human
ugauucuuuuuaaagugu

SEQ ID NO: 2513236 - RNA, 19 nt, Human
ugauucuuuguuacaggca

SEQ ID NO: 2513237 - RNA, 15 nt, Human
ugauucuguguguuu

SEQ ID NO: 2513238 - RNA, 17 nt, Human
ugauucugcuuuuacca

SEQ ID NO: 2513239 - RNA, 15 nt, Human
ugauucuugaguuua

SEQ ID NO: 2513240 - RNA, 16 nt, Human
ugauucugcaguaaau

SEQ ID NO: 2513241 - RNA, 22 nt, Human
ugauucugcaguaaaucuuuua

SEQ ID NO: 2513242 - RNA, 23 nt, Human
ugauucuccuucagcccucaccc

SEQ ID NO: 2513243 - RNA, 16 nt, Human
ugauucagaaauugga

SEQ ID NO: 2513244 - RNA, 12 nt, Human
ugauucugccuu

SEQ ID NO: 2513245 - RNA, 13 nt, Human
ugauucugccuuu

SEQ ID NO: 2513246 - RNA, 19 nt, Human
ugauucugcuuuuaccaug

SEQ ID NO: 2513247 - RNA, 13 nt, Human
ugauucugugugu

SEQ ID NO: 2513248 - RNA, 16 nt, Human
ugauuuaaaacaugua

SEQ ID NO: 2513249 - RNA, 15 nt, Human
ugauuuaaaacaugu

SEQ ID NO: 2513250 - RNA, 14 nt, Human
ugauuuaaaacaug

SEQ ID NO: 2513251 - RNA, 16 nt, Human
ugauuguuugcucuga

SEQ ID NO: 2513252 - RNA, 16 nt, Human
ugauugugucucuugg

SEQ ID NO: 2513253 - RNA, 18 nt, Human
ugauuguucgggugugca

SEQ ID NO: 2513254 - RNA, 14 nt, Human
ugauuguuggcaca

SEQ ID NO: 2513255 - RNA, 19 nt, Human
ugauuguucgggugugcaa

SEQ ID NO: 2513256 - RNA, 21 nt, Human
ugauuguggaauggagauuca

SEQ ID NO: 2513257 - RNA, 19 nt, Human
ugauuguuaauuuacagcu

SEQ ID NO: 2513258 - RNA, 17 nt, Human
ugauuguaacguugcug

SEQ ID NO: 2513259 - RNA, 23 nt, Human
ugauuguaaaauagcuuguauag

SEQ ID NO: 2513260 - RNA, 17 nt, Human
ugauuguaaaauagcuu

SEQ ID NO: 2513261 - RNA, 14 nt, Human
ugauuguaaaauag

SEQ ID NO: 2513262 - RNA, 12 nt, Human
ugauuguaaaau

SEQ ID NO: 2513263 - RNA, 17 nt, Human
ugauuggugcaacccuu

SEQ ID NO: 2513264 - RNA, 19 nt, Human
ugauuggugcaacccuuac

SEQ ID NO: 2513265 - RNA, 21 nt, Human
ugauuggugcaacccuuaccc

SEQ ID NO: 2513266 - RNA, 14 nt, Human
ugauuguggaaugg

SEQ ID NO: 2513267 - RNA, 18 nt, Human
ugauuguggaauggagau

SEQ ID NO: 2513268 - RNA, 14 nt, Human
ugauugucagcuac

SEQ ID NO: 2513269 - RNA, 21 nt, Human
ugauuguaacguugcuguggg

SEQ ID NO: 2513270 - RNA, 20 nt, Human
ugauuguaacguugcugugg

SEQ ID NO: 2513271 - RNA, 19 nt, Human
ugauuguaacguugcugug

SEQ ID NO: 2513272 - RNA, 18 nt, Human
ugauuguaacguugcugu

SEQ ID NO: 2513273 - RNA, 23 nt, Human
ugauuguaacguugcugugggaa

SEQ ID NO: 2513274 - RNA, 22 nt, Human
ugauuguaacguugcuguggga

SEQ ID NO: 2513275 - RNA, 21 nt, Human
ugauuggaggggggagguggg

SEQ ID NO: 2513276 - RNA, 15 nt, Human
ugauuggauuauuca

SEQ ID NO: 2513277 - RNA, 14 nt, Human
ugauuggauuauuc

SEQ ID NO: 2513278 - RNA, 23 nt, Human
ugauuggacauuuucuucagaga

SEQ ID NO: 2513279 - RNA, 13 nt, Human
ugauuggaggggg

SEQ ID NO: 2513280 - RNA, 17 nt, Human
ugauugggacagagguu

SEQ ID NO: 2513281 - RNA, 15 nt, Human
ugauugggacagagg

SEQ ID NO: 2513282 - RNA, 22 nt, Human
ugauugggacuggggcugaagg

SEQ ID NO: 2513283 - RNA, 21 nt, Human
ugauugggaauaaauaugccu

SEQ ID NO: 2513284 - RNA, 20 nt, Human
ugauugggaauaaauaugcc

SEQ ID NO: 2513285 - RNA, 18 nt, Human
ugauugggaauaaauaug

SEQ ID NO: 2513286 - RNA, 17 nt, Human
ugauugggaauaaauau

SEQ ID NO: 2513287 - RNA, 16 nt, Human
ugauugggaauaaaua

SEQ ID NO: 2513288 - RNA, 12 nt, Human
ugauugggaaua

SEQ ID NO: 2513289 - RNA, 16 nt, Human
ugauuggcauauaaug

SEQ ID NO: 2513290 - RNA, 21 nt, Human
ugauuggauuauucauuuaaa

SEQ ID NO: 2513291 - RNA, 12 nt, Human
ugauuggcucac

SEQ ID NO: 2513292 - RNA, 19 nt, Human
ugauuggauuauucauuua

SEQ ID NO: 2513293 - RNA, 18 nt, Human
ugauuggauuauucauuu

SEQ ID NO: 2513294 - RNA, 17 nt, Human
ugauuggauuauucauu

SEQ ID NO: 2513295 - RNA, 16 nt, Human
ugauuggauuauucau

SEQ ID NO: 2513296 - RNA, 20 nt, Human
ugauuggcaggaguuggaag

SEQ ID NO: 2513297 - RNA, 19 nt, Human
ugauuaugaauuacauuug

SEQ ID NO: 2513298 - RNA, 17 nt, Human
ugauuaugaauuacauu

SEQ ID NO: 2513299 - RNA, 13 nt, Human
ugauuauauguca

SEQ ID NO: 2513300 - RNA, 18 nt, Human
ugauuagcaaguuacagu

SEQ ID NO: 2513301 - RNA, 16 nt, Human
ugauuaguaaagaaau

SEQ ID NO: 2513302 - RNA, 17 nt, Human
ugauuaguaaagaaaug

SEQ ID NO: 2513303 - RNA, 11 nt, Human
ugauuagauga

SEQ ID NO: 2513304 - RNA, 13 nt, Human
ugauuagcaaguu

SEQ ID NO: 2513305 - RNA, 21 nt, Human
ugauuagaaggcaaguuucua

SEQ ID NO: 2513306 - RNA, 24 nt, Human
ugauuacugucaaggcugcuuaga

SEQ ID NO: 2513307 - RNA, 13 nt, Human
ugauuacugucaa

SEQ ID NO: 2513308 - RNA, 20 nt, Human
ugauguucaguguaauuucu

SEQ ID NO: 2513309 - RNA, 18 nt, Human
ugauguucaguguaauuu

SEQ ID NO: 2513310 - RNA, 21 nt, Human
ugauguucaguguaauuucuu

SEQ ID NO: 2513311 - RNA, 20 nt, Human
ugauguucuuucacccuuuu

SEQ ID NO: 2513312 - RNA, 18 nt, Human
ugauguuaacacauuuug

SEQ ID NO: 2513313 - RNA, 17 nt, Human
ugauguuaacacauuuu

SEQ ID NO: 2513314 - RNA, 16 nt, Human
ugauguuaacacauuu

SEQ ID NO: 2513315 - RNA, 15 nt, Human
ugauguuaacacauu

SEQ ID NO: 2513316 - RNA, 16 nt, Human
ugauguuaaaauucca

SEQ ID NO: 2513317 - RNA, 17 nt, Human
ugauguuaaaauuccau

SEQ ID NO: 2513318 - RNA, 11 nt, Human
ugauguuaaca

SEQ ID NO: 2513319 - RNA, 10 nt, Human
ugauguuaac

SEQ ID NO: 2513320 - RNA, 21 nt, Human
ugauguuaacacauuuuguau

SEQ ID NO: 2513321 - RNA, 20 nt, Human
ugauguuaacacauuuugua

SEQ ID NO: 2513322 - RNA, 22 nt, Human
ugauguuaacacauuuuguaua

SEQ ID NO: 2513323 - RNA, 22 nt, Human
ugauguuaaccagaauaaaguu

SEQ ID NO: 2513324 - RNA, 16 nt, Human
ugauguucaguguaau

SEQ ID NO: 2513325 - RNA, 15 nt, Human
ugauguucaguguaa

SEQ ID NO: 2513326 - RNA, 14 nt, Human
ugauguucagugua

SEQ ID NO: 2513327 - RNA, 13 nt, Human
ugauguucagugu

SEQ ID NO: 2513328 - RNA, 22 nt, Human
ugauguuuagaaacacaacuau

SEQ ID NO: 2513329 - RNA, 17 nt, Human
ugauguugagggaacag

SEQ ID NO: 2513330 - RNA, 16 nt, Human
ugauuaccagggacug

SEQ ID NO: 2513331 - RNA, 14 nt, Human
ugauguuggcuggg

SEQ ID NO: 2513332 - RNA, 13 nt, Human
ugauguuggaaga

SEQ ID NO: 2513333 - RNA, 16 nt, Human
ugauguuggcugggaa

SEQ ID NO: 2513334 - RNA, 15 nt, Human
ugauguuggcuggga

SEQ ID NO: 2513335 - RNA, 14 nt, Human
ugauuacucuuuga

SEQ ID NO: 2513336 - RNA, 16 nt, Human
ugauuacucuuugaga

SEQ ID NO: 2513337 - RNA, 21 nt, Human
ugauucaaucuguaaacugug

SEQ ID NO: 2513338 - RNA, 22 nt, Human
ugauucaaucuguaaacugugu

SEQ ID NO: 2513339 - RNA, 23 nt, Human
ugauucaaucuguaaacugugua

SEQ ID NO: 2513340 - RNA, 12 nt, Human
ugauucaauuca

SEQ ID NO: 2513341 - RNA, 16 nt, Human
ugauucaaucuguaaa

SEQ ID NO: 2513342 - RNA, 17 nt, Human
ugauucaaucuguaaac

SEQ ID NO: 2513343 - RNA, 14 nt, Human
ugauuauuuucaag

SEQ ID NO: 2513344 - RNA, 14 nt, Human
ugauucaacuaaaa

SEQ ID NO: 2513345 - RNA, 23 nt, Human
ugauucaacuaaaaaaaaaaaag

SEQ ID NO: 2513346 - RNA, 23 nt, Human
ugauuauuucacuuuagaugcug

SEQ ID NO: 2513347 - RNA, 16 nt, Human
ugauuauuucacuuua

SEQ ID NO: 2513348 - RNA, 15 nt, Human
ugauuauuucacuuu

SEQ ID NO: 2513349 - RNA, 20 nt, Human
ugauucaacagguuuuccug

SEQ ID NO: 2513350 - RNA, 22 nt, Human
ugauuaugaauuacauuuguau

SEQ ID NO: 2513351 - RNA, 21 nt, Human
ugauuaugaauuacauuugua

SEQ ID NO: 2513352 - RNA, 16 nt, Human
ugauuauuacuggcaa

SEQ ID NO: 2513353 - RNA, 14 nt, Human
ugauuauucagugu

SEQ ID NO: 2513354 - RNA, 16 nt, Human
ugauuauucaguguca

SEQ ID NO: 2513355 - RNA, 16 nt, Human
ugauuauuuauuauuu

SEQ ID NO: 2513356 - RNA, 18 nt, Human
ugauuauuguauuuauuc

SEQ ID NO: 2513357 - RNA, 15 nt, Human
ugauuauuguauuua

SEQ ID NO: 2513358 - RNA, 13 nt, Human
ugauuauuguauu

SEQ ID NO: 2513359 - RNA, 18 nt, Human
ugauuauucugauuccac

SEQ ID NO: 2513360 - RNA, 16 nt, Human
ugauucagacagcugc

SEQ ID NO: 2513361 - RNA, 15 nt, Human
ugauucagacagcug

SEQ ID NO: 2513362 - RNA, 14 nt, Human
ugauucagacagcu

SEQ ID NO: 2513363 - RNA, 13 nt, Human
ugauucagacagc

SEQ ID NO: 2513364 - RNA, 21 nt, Human
ugauucaauucaacacucccu

SEQ ID NO: 2513365 - RNA, 12 nt, Human
ugauucacagug

SEQ ID NO: 2513366 - RNA, 13 nt, Human
ugauucacugcau

SEQ ID NO: 2513367 - RNA, 12 nt, Human
ugauucacugca

SEQ ID NO: 2513368 - RNA, 22 nt, Human
ugauucacccccaaacagugac

SEQ ID NO: 2513369 - RNA, 14 nt, Human
ugauucagaaauug

SEQ ID NO: 2513370 - RNA, 17 nt, Human
ugauucacugcauggcu

SEQ ID NO: 2513371 - RNA, 15 nt, Human
ugauggugguauguu

SEQ ID NO: 2513372 - RNA, 18 nt, Human
ugaugcuucuucagagac

SEQ ID NO: 2513373 - RNA, 18 nt, Human
ugaugcugggcugggugc

SEQ ID NO: 2513374 - RNA, 16 nt, Human
ugaugcugggcugggu

SEQ ID NO: 2513375 - RNA, 20 nt, Human
ugaugcugggcugggugcga

SEQ ID NO: 2513376 - RNA, 17 nt, Human
ugaugcuucuucagaga

SEQ ID NO: 2513377 - RNA, 16 nt, Human
ugaugcuucuucagag

SEQ ID NO: 2513378 - RNA, 14 nt, Human
ugaugguuguacau

SEQ ID NO: 2513379 - RNA, 17 nt, Human
ugaugucaauuucugug

SEQ ID NO: 2513380 - RNA, 17 nt, Human
ugaugguucguucuguu

SEQ ID NO: 2513381 - RNA, 13 nt, Human
ugaugguuguaca

SEQ ID NO: 2513382 - RNA, 14 nt, Human
ugaugguuccccug

SEQ ID NO: 2513383 - RNA, 22 nt, Human
ugaugguguuuuggggaugaga

SEQ ID NO: 2513384 - RNA, 20 nt, Human
ugaugcugugcuaugaauuu

SEQ ID NO: 2513385 - RNA, 18 nt, Human
ugauguguuuauuuauag

SEQ ID NO: 2513386 - RNA, 14 nt, Human
ugauguguuuauuu

SEQ ID NO: 2513387 - RNA, 23 nt, Human
ugauguguugugauagcuaacau

SEQ ID NO: 2513388 - RNA, 14 nt, Human
ugauguuaaaauuc

SEQ ID NO: 2513389 - RNA, 13 nt, Human
ugauguguacauc

SEQ ID NO: 2513390 - RNA, 16 nt, Human
ugauguggugccugag

SEQ ID NO: 2513391 - RNA, 20 nt, Human
ugauguggugaggcaggcuu

SEQ ID NO: 2513392 - RNA, 15 nt, Human
ugauguggugccuga

SEQ ID NO: 2513393 - RNA, 16 nt, Human
ugauguguuaucucuu

SEQ ID NO: 2513394 - RNA, 19 nt, Human
ugaugucaauuucuguguu

SEQ ID NO: 2513395 - RNA, 18 nt, Human
ugaugucaauuucugugu

SEQ ID NO: 2513396 - RNA, 23 nt, Human
ugaugucaauuucuguguugcca

SEQ ID NO: 2513397 - RNA, 14 nt, Human
ugaucuggaaccca

SEQ ID NO: 2513398 - RNA, 13 nt, Human
ugauguccagaag

SEQ ID NO: 2513399 - RNA, 12 nt, Human
ugauguccagaa

SEQ ID NO: 2513400 - RNA, 17 nt, Human
ugaugucaucugucacu

SEQ ID NO: 2513401 - RNA, 19 nt, Human
ugaugucccaacuuguaaa

SEQ ID NO: 2513402 - RNA, 23 nt, Human
ugauguccagaagaauauucagg

SEQ ID NO: 2513403 - RNA, 15 nt, Human
ugauguccagaagaa

SEQ ID NO: 2513404 - RNA, 18 nt, Human
ugaugugggucaaggaau

SEQ ID NO: 2513405 - RNA, 11 nt, Human
ugaugccuggc

SEQ ID NO: 2513406 - RNA, 15 nt, Human
ugaugccugugaacu

SEQ ID NO: 2513407 - RNA, 20 nt, Human
ugaugccugugaacugaacu

SEQ ID NO: 2513408 - RNA, 20 nt, Human
ugaugcuacaggauuugaaa

SEQ ID NO: 2513409 - RNA, 23 nt, Human
ugaugcuacaggauuugaaauug

SEQ ID NO: 2513410 - RNA, 21 nt, Human
ugaugccugugaacugaacuc

SEQ ID NO: 2513411 - RNA, 15 nt, Human
ugaugcugggcuggg

SEQ ID NO: 2513412 - RNA, 14 nt, Human
ugaugcugggcugg

SEQ ID NO: 2513413 - RNA, 13 nt, Human
ugaugcugggcug

SEQ ID NO: 2513414 - RNA, 12 nt, Human
ugaugcugggau

SEQ ID NO: 2513415 - RNA, 11 nt, Human
ugaugcuaaau

SEQ ID NO: 2513416 - RNA, 16 nt, Human
ugaugcuaaauaggag

SEQ ID NO: 2513417 - RNA, 17 nt, Human
ugaucuuuaaaauacac

SEQ ID NO: 2513418 - RNA, 16 nt, Human
ugaucuuugcagacag

SEQ ID NO: 2513419 - RNA, 19 nt, Human
ugaucuuucuuuccuuucu

SEQ ID NO: 2513420 - RNA, 16 nt, Human
ugaugaugugccuggg

SEQ ID NO: 2513421 - RNA, 17 nt, Human
ugaugcaugcacuguuc

SEQ ID NO: 2513422 - RNA, 18 nt, Human
ugaugcaugcacuguucc

SEQ ID NO: 2513423 - RNA, 23 nt, Human
ugaugcaugcacuguucccccug

SEQ ID NO: 2513424 - RNA, 17 nt, Human
ugaugcauuaaaagaaa

SEQ ID NO: 2513425 - RNA, 18 nt, Human
ugaugcauuaaaagaaaa

SEQ ID NO: 2513426 - RNA, 19 nt, Human
ugaugcauuaaaagaaaau

SEQ ID NO: 2513427 - RNA, 21 nt, Human
ugaugcauuaaaagaaaauaa

SEQ ID NO: 2513428 - RNA, 14 nt, Human
ugaugccucccugu

SEQ ID NO: 2513429 - RNA, 15 nt, Human
ugaucucauuuaauc

SEQ ID NO: 2513430 - RNA, 14 nt, Human
ugaucucagguucu

SEQ ID NO: 2513431 - RNA, 19 nt, Human
ugauccacccaccucagcc

SEQ ID NO: 2513432 - RNA, 18 nt, Human
ugauccacccaccucagc

SEQ ID NO: 2513433 - RNA, 17 nt, Human
ugauccacccaccucag

SEQ ID NO: 2513434 - RNA, 15 nt, Human
ugaucuggaacccag

SEQ ID NO: 2513435 - RNA, 17 nt, Human
ugaucuggaacccagac

SEQ ID NO: 2513436 - RNA, 17 nt, Human
ugaucucucgugauuga

SEQ ID NO: 2513437 - RNA, 18 nt, Human
ugaucuggaacccagacu

SEQ ID NO: 2513438 - RNA, 19 nt, Human
ugaucuggaacccagacuc

SEQ ID NO: 2513439 - RNA, 21 nt, Human
ugaucucggcucacugcaacc

SEQ ID NO: 2513440 - RNA, 17 nt, Human
ugaucugguuugacucc

SEQ ID NO: 2513441 - RNA, 22 nt, Human
ugaucucauuuaauccucucaa

SEQ ID NO: 2513442 - RNA, 16 nt, Human
ugaucuccauauguua

SEQ ID NO: 2513443 - RNA, 19 nt, Human
ugaucuccauauguuacac

SEQ ID NO: 2513444 - RNA, 17 nt, Human
ugaucuccauggcuucc

SEQ ID NO: 2513445 - RNA, 21 nt, Human
ugaucuccauauguuacacua

SEQ ID NO: 2513446 - RNA, 20 nt, Human
ugaucuccauggcuuccucc

SEQ ID NO: 2513447 - RNA, 13 nt, Human
ugaucucccugcc

SEQ ID NO: 2513448 - RNA, 18 nt, Human
ugaucucggcucacugca

SEQ ID NO: 2513449 - RNA, 14 nt, Human
ugaucucccugccg

SEQ ID NO: 2513450 - RNA, 15 nt, Human
ugaucucccugccgc

SEQ ID NO: 2513451 - RNA, 16 nt, Human
ugaucucccugccgcc

SEQ ID NO: 2513452 - RNA, 17 nt, Human
ugaucucccugccgccu

SEQ ID NO: 2513453 - RNA, 14 nt, Human
ugaucuuuaaaaua

SEQ ID NO: 2513454 - RNA, 21 nt, Human
ugaucuuggcuuacugcagcc

SEQ ID NO: 2513455 - RNA, 14 nt, Human
ugaucuugugacau

SEQ ID NO: 2513456 - RNA, 15 nt, Human
ugaucuugugacaua

SEQ ID NO: 2513457 - RNA, 20 nt, Human
ugaucuucuuuauaauucua

SEQ ID NO: 2513458 - RNA, 22 nt, Human
ugaucugugcuuuccagcucac

SEQ ID NO: 2513459 - RNA, 21 nt, Human
ugaucugugcuuuccagcuca

SEQ ID NO: 2513460 - RNA, 20 nt, Human
ugaucugugcuuuccagcuc

SEQ ID NO: 2513461 - RNA, 19 nt, Human
ugaucugugcuuuccagcu

SEQ ID NO: 2513462 - RNA, 12 nt, Human
ugaucugugcuu

SEQ ID NO: 2513463 - RNA, 11 nt, Human
ugaucugugcu

SEQ ID NO: 2513464 - RNA, 15 nt, Human
ugaucugugggcaca

SEQ ID NO: 2513465 - RNA, 13 nt, Human
ugaucuguauaua

SEQ ID NO: 2513466 - RNA, 15 nt, Human
ugaucuguauauaca

SEQ ID NO: 2513467 - RNA, 19 nt, Human
ugaucuguauauacaauaa

SEQ ID NO: 2513468 - RNA, 22 nt, Human
ugaucuguauauacaauaacau

SEQ ID NO: 2513469 - RNA, 21 nt, Human
ugauagacacauaugaggggg

SEQ ID NO: 2513470 - RNA, 22 nt, Human
ugauagacacauaugaggggga

SEQ ID NO: 2513471 - RNA, 13 nt, Human
ugauagcaaagcg

SEQ ID NO: 2513472 - RNA, 19 nt, Human
ugauagacacauaugaggg

SEQ ID NO: 2513473 - RNA, 17 nt, Human
ugauaacuuugcuugca

SEQ ID NO: 2513474 - RNA, 14 nt, Human
ugauagcacagacc

SEQ ID NO: 2513475 - RNA, 13 nt, Human
ugauagcacagac

SEQ ID NO: 2513476 - RNA, 17 nt, Human
ugaucagcuuauugucu

SEQ ID NO: 2513477 - RNA, 17 nt, Human
ugaucagcuguuuguca

SEQ ID NO: 2513478 - RNA, 16 nt, Human
ugaucagcuguuuguc

SEQ ID NO: 2513479 - RNA, 23 nt, Human
ugauagcaagugaauuuuucucu

SEQ ID NO: 2513480 - RNA, 24 nt, Human
ugaucagcuuauugucuagugaaa

SEQ ID NO: 2513481 - RNA, 18 nt, Human
ugaucagcuguuugucau

SEQ ID NO: 2513482 - RNA, 16 nt, Human
ugauccacccaccuca

SEQ ID NO: 2513483 - RNA, 15 nt, Human
ugauccaagcugguc

SEQ ID NO: 2513484 - RNA, 14 nt, Human
ugauccaagcuggu

SEQ ID NO: 2513485 - RNA, 13 nt, Human
ugauccaagcugg

SEQ ID NO: 2513486 - RNA, 16 nt, Human
ugaucauuuucccccc

SEQ ID NO: 2513487 - RNA, 17 nt, Human
ugaucauuuucccccca

SEQ ID NO: 2513488 - RNA, 13 nt, Human
ugaucaugcauug

SEQ ID NO: 2513489 - RNA, 14 nt, Human
ugaucaugcauugu

SEQ ID NO: 2513490 - RNA, 15 nt, Human
ugaucaugcauuguu

SEQ ID NO: 2513491 - RNA, 16 nt, Human
ugaucaugcauuguug

SEQ ID NO: 2513492 - RNA, 17 nt, Human
ugaucaugcauuguuga

SEQ ID NO: 2513493 - RNA, 23 nt, Human
ugaucaugcauuguugagguggu

SEQ ID NO: 2513494 - RNA, 18 nt, Human
ugaucauuuuccccccac

SEQ ID NO: 2513495 - RNA, 19 nt, Human
ugaucauuuuccccccacu

SEQ ID NO: 2513496 - RNA, 20 nt, Human
ugaucauuuuccccccacuc

SEQ ID NO: 2513497 - RNA, 21 nt, Human
ugaucauuuuccccccacucu

SEQ ID NO: 2513498 - RNA, 13 nt, Human
ugauccaacuaau

SEQ ID NO: 2513499 - RNA, 22 nt, Human
ugaucauuuuccccccacucuc

SEQ ID NO: 2513500 - RNA, 14 nt, Human
ugauccaacuaaug

SEQ ID NO: 2513501 - RNA, 19 nt, Human
ugagacucgcgacaaugca

SEQ ID NO: 2513502 - RNA, 16 nt, Human
ugagacucgagaacuu

SEQ ID NO: 2513503 - RNA, 15 nt, Human
ugagacucgagaacu

SEQ ID NO: 2513504 - RNA, 12 nt, Human
ugagacucgaga

SEQ ID NO: 2513505 - RNA, 20 nt, Human
ugagacucagacaggaaagg

SEQ ID NO: 2513506 - RNA, 18 nt, Human
ugagacuaugcguuuuua

SEQ ID NO: 2513507 - RNA, 23 nt, Human
ugagacguuuuuggaagaguagu

SEQ ID NO: 2513508 - RNA, 14 nt, Human
ugagacccccacac

SEQ ID NO: 2513509 - RNA, 15 nt, Human
ugagacccccacacc

SEQ ID NO: 2513510 - RNA, 16 nt, Human
ugagacccccacaccu

SEQ ID NO: 2513511 - RNA, 23 nt, Human
ugagaccaguugggagcacugga

SEQ ID NO: 2513512 - RNA, 13 nt, Human
ugagaccacagag

SEQ ID NO: 2513513 - RNA, 21 nt, Human
ugagaccacagagagagggga

SEQ ID NO: 2513514 - RNA, 14 nt, Human
ugagaccacuguua

SEQ ID NO: 2513515 - RNA, 20 nt, Human
ugagacccagcccucauccc

SEQ ID NO: 2513516 - RNA, 21 nt, Human
ugagacccauuccuauuucuu

SEQ ID NO: 2513517 - RNA, 13 nt, Human
ugagacccccaca

SEQ ID NO: 2513518 - RNA, 21 nt, Human
ugagaccaguugggagcacug

SEQ ID NO: 2513519 - RNA, 12 nt, Human
ugagaccaguug

SEQ ID NO: 2513520 - RNA, 18 nt, Human
ugagacccagcccucauc

SEQ ID NO: 2513521 - RNA, 17 nt, Human
ugagaccagccugggca

SEQ ID NO: 2513522 - RNA, 16 nt, Human
ugaccggacuuuucug

SEQ ID NO: 2513523 - RNA, 19 nt, Human
ugaccgcgacuaauuucaa

SEQ ID NO: 2513524 - RNA, 19 nt, Human
ugaccggacuuuucugcaa

SEQ ID NO: 2513525 - RNA, 16 nt, Human
ugaccgugggcggggc

SEQ ID NO: 2513526 - RNA, 22 nt, Human
ugaccucagcuuugauauuuca

SEQ ID NO: 2513527 - RNA, 18 nt, Human
ugaccucaggcacuagcc

SEQ ID NO: 2513528 - RNA, 16 nt, Human
ugaccucagcuuugau

SEQ ID NO: 2513529 - RNA, 21 nt, Human
ugaccucaggugauccaccca

SEQ ID NO: 2513530 - RNA, 20 nt, Human
ugaccucaggugauccaccc

SEQ ID NO: 2513531 - RNA, 19 nt, Human
ugaccucaggcacuagccu

SEQ ID NO: 2513532 - RNA, 19 nt, Human
ugagaacaaccaaaaucuu

SEQ ID NO: 2513533 - RNA, 17 nt, Human
ugagaaauuuauaaacu

SEQ ID NO: 2513534 - RNA, 21 nt, Human
ugagaacccugcguggggaca

SEQ ID NO: 2513535 - RNA, 18 nt, Human
ugagaacccugcgugggg

SEQ ID NO: 2513536 - RNA, 22 nt, Human
ugagaacccugcguggggacag

SEQ ID NO: 2513537 - RNA, 14 nt, Human
ugagaacacuguga

SEQ ID NO: 2513538 - RNA, 12 nt, Human
ugagaacacugu

SEQ ID NO: 2513539 - RNA, 16 nt, Human
ugagaacacugugaaa

SEQ ID NO: 2513540 - RNA, 16 nt, Human
ugagaacccugcgugg

SEQ ID NO: 2513541 - RNA, 23 nt, Human
ugagacucgcgacaaugcaaacc

SEQ ID NO: 2513542 - RNA, 22 nt, Human
ugagacucgcgacaaugcaaac

SEQ ID NO: 2513543 - RNA, 21 nt, Human
ugagacucgcgacaaugcaaa

SEQ ID NO: 2513544 - RNA, 20 nt, Human
ugagacucgcgacaaugcaa

SEQ ID NO: 2513545 - RNA, 17 nt, Human
ugagacucgagaacuuu

SEQ ID NO: 2513546 - RNA, 16 nt, Human
ugagagugaacaaauu

SEQ ID NO: 2513547 - RNA, 17 nt, Human
ugagaguuuuggaugca

SEQ ID NO: 2513548 - RNA, 16 nt, Human
ugagaguuuaguugua

SEQ ID NO: 2513549 - RNA, 15 nt, Human
ugagaguuuuggaug

SEQ ID NO: 2513550 - RNA, 20 nt, Human
ugagagucugcacuuaacaa

SEQ ID NO: 2513551 - RNA, 24 nt, Human
ugagagugucuucacggcaggaca

SEQ ID NO: 2513552 - RNA, 22 nt, Human
ugagagugucuucacggcagga

SEQ ID NO: 2513553 - RNA, 15 nt, Human
ugagcagggcucagc

SEQ ID NO: 2513554 - RNA, 14 nt, Human
ugagcagggcucag

SEQ ID NO: 2513555 - RNA, 13 nt, Human
ugagcagggcuca

SEQ ID NO: 2513556 - RNA, 12 nt, Human
ugagcagggcuc

SEQ ID NO: 2513557 - RNA, 15 nt, Human
ugagaucaaaacggu

SEQ ID NO: 2513558 - RNA, 15 nt, Human
ugagauauuuauugu

SEQ ID NO: 2513559 - RNA, 14 nt, Human
ugagaucagccugg

SEQ ID NO: 2513560 - RNA, 15 nt, Human
ugagaucagccuggg

SEQ ID NO: 2513561 - RNA, 20 nt, Human
ugagcaucaggccaggcccu

SEQ ID NO: 2513562 - RNA, 19 nt, Human
ugagcaucaggccaggccc

SEQ ID NO: 2513563 - RNA, 18 nt, Human
ugagcaucaggccaggcc

SEQ ID NO: 2513564 - RNA, 21 nt, Human
ugagccccaaguccugaagag

SEQ ID NO: 2513565 - RNA, 17 nt, Human
ugagccccaaguccuga

SEQ ID NO: 2513566 - RNA, 14 nt, Human
ugagccccaagucc

SEQ ID NO: 2513567 - RNA, 15 nt, Human
ugagcaucacaguuu

SEQ ID NO: 2513568 - RNA, 23 nt, Human
ugagccccaaguccugaagaggc

SEQ ID NO: 2513569 - RNA, 22 nt, Human
ugagccccaaguccugaagagg

SEQ ID NO: 2513570 - RNA, 22 nt, Human
ugagccccuaccccacaccagg

SEQ ID NO: 2513571 - RNA, 21 nt, Human
ugagccccuaccccacaccag

SEQ ID NO: 2513572 - RNA, 19 nt, Human
ugagccccuaccccacacc

SEQ ID NO: 2513573 - RNA, 22 nt, Human
ugagccccgcagaccuccccag

SEQ ID NO: 2513574 - RNA, 23 nt, Human
ugagccccgcagaccuccccagc

SEQ ID NO: 2513575 - RNA, 17 nt, Human
ugagccccgcagaccuc

SEQ ID NO: 2513576 - RNA, 16 nt, Human
ugagccccgcagaccu

SEQ ID NO: 2513577 - RNA, 23 nt, Human
ugagcccccccaacacugugccc

SEQ ID NO: 2513578 - RNA, 22 nt, Human
ugagcccccccaacacugugcc

SEQ ID NO: 2513579 - RNA, 20 nt, Human
ugagcccccccaacacugug

SEQ ID NO: 2513580 - RNA, 14 nt, Human
ugagcaucacaguu

SEQ ID NO: 2513581 - RNA, 16 nt, Human
ugagcaucaggccagg

SEQ ID NO: 2513582 - RNA, 15 nt, Human
ugagcaguggcuggu

SEQ ID NO: 2513583 - RNA, 14 nt, Human
ugagcaguggcugg

SEQ ID NO: 2513584 - RNA, 13 nt, Human
ugagcaguggcug

SEQ ID NO: 2513585 - RNA, 12 nt, Human
ugagcaguggcu

SEQ ID NO: 2513586 - RNA, 22 nt, Human
ugagcaguggcugguccagggc

SEQ ID NO: 2513587 - RNA, 18 nt, Human
ugagcaguggcuggucca

SEQ ID NO: 2513588 - RNA, 17 nt, Human
ugagcagggcucagcgg

SEQ ID NO: 2513589 - RNA, 16 nt, Human
ugagcagggcucagcg

SEQ ID NO: 2513590 - RNA, 23 nt, Human
ugagcagugaguuacagcgagag

SEQ ID NO: 2513591 - RNA, 20 nt, Human
ugagauauuuauuguuuauu

SEQ ID NO: 2513592 - RNA, 19 nt, Human
ugagcagggcucagcgggg

SEQ ID NO: 2513593 - RNA, 21 nt, Human
ugagccucagcauccuggcac

SEQ ID NO: 2513594 - RNA, 18 nt, Human
ugagccucagcauccugg

SEQ ID NO: 2513595 - RNA, 14 nt, Human
ugagccucagucuc

SEQ ID NO: 2513596 - RNA, 22 nt, Human
ugagccucagcauccuggcacc

SEQ ID NO: 2513597 - RNA, 17 nt, Human
ugagccucagcauccug

SEQ ID NO: 2513598 - RNA, 21 nt, Human
ugagccgagaucacgccacug

SEQ ID NO: 2513599 - RNA, 20 nt, Human
ugagcccucagaacccuugg

SEQ ID NO: 2513600 - RNA, 22 nt, Human
ugagcccucagaacccuuggcu

SEQ ID NO: 2513601 - RNA, 18 nt, Human
ugagcccuguccugccua

SEQ ID NO: 2513602 - RNA, 19 nt, Human
ugagccgagaucacgccac

SEQ ID NO: 2513603 - RNA, 19 nt, Human
ugagccucucaccuguacu

SEQ ID NO: 2513604 - RNA, 19 nt, Human
ugagcuccucugggcagga

SEQ ID NO: 2513605 - RNA, 15 nt, Human
ugagccucucaccug

SEQ ID NO: 2513606 - RNA, 13 nt, Human
ugagccucucacc

SEQ ID NO: 2513607 - RNA, 12 nt, Human
ugagccucugcu

SEQ ID NO: 2513608 - RNA, 14 nt, Human
ugagccucugcucc

SEQ ID NO: 2513609 - RNA, 16 nt, Human
ugagccucugcucccc

SEQ ID NO: 2513610 - RNA, 17 nt, Human
ugagccucugcucccca

SEQ ID NO: 2513611 - RNA, 18 nt, Human
ugagccucugcuccccag

SEQ ID NO: 2513612 - RNA, 14 nt, Human
ugagccugagcaga

SEQ ID NO: 2513613 - RNA, 19 nt, Human
ugagcugccuucccuagcu

SEQ ID NO: 2513614 - RNA, 17 nt, Human
ugagcugccuucccuag

SEQ ID NO: 2513615 - RNA, 16 nt, Human
ugagcugccuucccua

SEQ ID NO: 2513616 - RNA, 16 nt, Human
ugagcucucggaacug

SEQ ID NO: 2513617 - RNA, 15 nt, Human
ugagcugccuucccu

SEQ ID NO: 2513618 - RNA, 12 nt, Human
ugagcugccuuc

SEQ ID NO: 2513619 - RNA, 12 nt, Human
ugagcuggaagg

SEQ ID NO: 2513620 - RNA, 21 nt, Human
ugagcuggaaggagugagagg

SEQ ID NO: 2513621 - RNA, 17 nt, Human
ugagcucuacccagggc

SEQ ID NO: 2513622 - RNA, 18 nt, Human
ugagcucuacccagggcc

SEQ ID NO: 2513623 - RNA, 19 nt, Human
ugagcucuacccagggccu

SEQ ID NO: 2513624 - RNA, 22 nt, Human
ugagcucuacccagggccugca

SEQ ID NO: 2513625 - RNA, 14 nt, Human
ugagcucgguggac

SEQ ID NO: 2513626 - RNA, 20 nt, Human
ugagcucgguggacccaggg

SEQ ID NO: 2513627 - RNA, 21 nt, Human
ugagcucgguggacccaggga

SEQ ID NO: 2513628 - RNA, 16 nt, Human
ugagucccaggagcug

SEQ ID NO: 2513629 - RNA, 22 nt, Human
ugaguccauucucccagguacc

SEQ ID NO: 2513630 - RNA, 20 nt, Human
ugaguccauucucccaggua

SEQ ID NO: 2513631 - RNA, 19 nt, Human
ugaguccauucucccaggu

SEQ ID NO: 2513632 - RNA, 15 nt, Human
ugagucccaggcuga

SEQ ID NO: 2513633 - RNA, 23 nt, Human
ugagguggcacuuuuucauuugc

SEQ ID NO: 2513634 - RNA, 21 nt, Human
ugagguggcacuuuuucauuu

SEQ ID NO: 2513635 - RNA, 17 nt, Human
ugaguccauucucccag

SEQ ID NO: 2513636 - RNA, 21 nt, Human
ugaggugggaggaucucuuga

SEQ ID NO: 2513637 - RNA, 13 nt, Human
ugaguccagaagu

SEQ ID NO: 2513638 - RNA, 19 nt, Human
ugaguccagaaguuugaga

SEQ ID NO: 2513639 - RNA, 19 nt, Human
ugagucgaggacagggagg

SEQ ID NO: 2513640 - RNA, 16 nt, Human
ugagucucccaaggcu

SEQ ID NO: 2513641 - RNA, 15 nt, Human
ugagucucccaaggc

SEQ ID NO: 2513642 - RNA, 23 nt, Human
ugagucucccaaggcugcgucug

SEQ ID NO: 2513643 - RNA, 14 nt, Human
ugagucucuucaga

SEQ ID NO: 2513644 - RNA, 21 nt, Human
ugagucccaggagcugcccag

SEQ ID NO: 2513645 - RNA, 20 nt, Human
ugagucccaggagcugccca

SEQ ID NO: 2513646 - RNA, 17 nt, Human
ugagucguacagaaagc

SEQ ID NO: 2513647 - RNA, 19 nt, Human
ugagucguacagaaagcug

SEQ ID NO: 2513648 - RNA, 18 nt, Human
ugagucgucaucacuuuu

SEQ ID NO: 2513649 - RNA, 18 nt, Human
ugagucugaaggcugggu

SEQ ID NO: 2513650 - RNA, 17 nt, Human
ugagucugaaggcuggg

SEQ ID NO: 2513651 - RNA, 15 nt, Human
ugagucugaaggcug

SEQ ID NO: 2513652 - RNA, 13 nt, Human
ugagucugaaggc

SEQ ID NO: 2513653 - RNA, 15 nt, Human
ugagugaauaaaugu

SEQ ID NO: 2513654 - RNA, 17 nt, Human
ugagugaaccuguauaa

SEQ ID NO: 2513655 - RNA, 23 nt, Human
ugagucuuggcggcagcagccau

SEQ ID NO: 2513656 - RNA, 15 nt, Human
ugagucucuucagaa

SEQ ID NO: 2513657 - RNA, 21 nt, Human
ugagucuuggcggcagcagcc

SEQ ID NO: 2513658 - RNA, 18 nt, Human
ugagucuuggcggcagca

SEQ ID NO: 2513659 - RNA, 17 nt, Human
ugagucuuggcggcagc

SEQ ID NO: 2513660 - RNA, 16 nt, Human
ugagucuuggcggcag

SEQ ID NO: 2513661 - RNA, 15 nt, Human
ugagucuuggcggca

SEQ ID NO: 2513662 - RNA, 16 nt, Human
ugauaacuggaaacuu

SEQ ID NO: 2513663 - RNA, 15 nt, Human
ugauaacuuugcuug

SEQ ID NO: 2513664 - RNA, 14 nt, Human
ugauaacuuugcuu

SEQ ID NO: 2513665 - RNA, 19 nt, Human
ugauaacugcaauuuuaau

SEQ ID NO: 2513666 - RNA, 18 nt, Human
ugauaacuagauggugcu

SEQ ID NO: 2513667 - RNA, 21 nt, Human
ugauaacuagauggugcugag

SEQ ID NO: 2513668 - RNA, 22 nt, Human
ugauaacuagauggugcugaga

SEQ ID NO: 2513669 - RNA, 23 nt, Human
ugauaacuagauggugcugagaa

SEQ ID NO: 2513670 - RNA, 18 nt, Human
ugauaacaaccuggagac

SEQ ID NO: 2513671 - RNA, 17 nt, Human
ugauaacaaccuggaga

SEQ ID NO: 2513672 - RNA, 18 nt, Human
ugaguuuuuucucuuggg

SEQ ID NO: 2513673 - RNA, 19 nt, Human
ugaguuuuuucucuugggc

SEQ ID NO: 2513674 - RNA, 18 nt, Human
ugaguuuucuucugugau

SEQ ID NO: 2513675 - RNA, 20 nt, Human
ugaguuuuguuuuaaaauua

SEQ ID NO: 2513676 - RNA, 18 nt, Human
ugaguuuuuauggggcug

SEQ ID NO: 2513677 - RNA, 13 nt, Human
ugaguuuuugaua

SEQ ID NO: 2513678 - RNA, 18 nt, Human
ugaguuuuugauagcuuu

SEQ ID NO: 2513679 - RNA, 19 nt, Human
ugaguuuuugauagcuuua

SEQ ID NO: 2513680 - RNA, 19 nt, Human
ugaguuuuuauggggcuga

SEQ ID NO: 2513681 - RNA, 17 nt, Human
ugaguuuuuucucuugg

SEQ ID NO: 2513682 - RNA, 20 nt, Human
ugaguuugucgcucaugugu

SEQ ID NO: 2513683 - RNA, 19 nt, Human
ugaguuugucgcucaugug

SEQ ID NO: 2513684 - RNA, 17 nt, Human
ugaguuuucuucuguga

SEQ ID NO: 2513685 - RNA, 18 nt, Human
ugaguuuuauugagaauu

SEQ ID NO: 2513686 - RNA, 20 nt, Human
ugaguugauagcacagaccc

SEQ ID NO: 2513687 - RNA, 16 nt, Human
ugaguugauagcacag

SEQ ID NO: 2513688 - RNA, 22 nt, Human
ugaguucucagggcuccugccu

SEQ ID NO: 2513689 - RNA, 19 nt, Human
ugaguucucagggcuccug

SEQ ID NO: 2513690 - RNA, 18 nt, Human
ugaguucucagggcuccu

SEQ ID NO: 2513691 - RNA, 17 nt, Human
ugaguucucagggcucc

SEQ ID NO: 2513692 - RNA, 16 nt, Human
ugaguucucagggcuc

SEQ ID NO: 2513693 - RNA, 13 nt, Human
ugaguucucaggg

SEQ ID NO: 2513694 - RNA, 14 nt, Human
ugagugagcaugcc

SEQ ID NO: 2513695 - RNA, 22 nt, Human
ugaguuugcuuauguaaucuca

SEQ ID NO: 2513696 - RNA, 13 nt, Human
ugaguuugcuuau

SEQ ID NO: 2513697 - RNA, 23 nt, Human
ugaguuugggccccagaggcugg

SEQ ID NO: 2513698 - RNA, 22 nt, Human
ugaguuugggccccagaggcug

SEQ ID NO: 2513699 - RNA, 14 nt, Human
ugaguuugcccugg

SEQ ID NO: 2513700 - RNA, 22 nt, Human
ugaguuugcccugguuucacug

SEQ ID NO: 2513701 - RNA, 21 nt, Human
ugaguuugagcugccuucccu

SEQ ID NO: 2513702 - RNA, 19 nt, Human
ugaguuugagcugccuucc

SEQ ID NO: 2513703 - RNA, 18 nt, Human
ugaguuugagcugccuuc

SEQ ID NO: 2513704 - RNA, 17 nt, Human
ugaguuugagcugccuu

SEQ ID NO: 2513705 - RNA, 16 nt, Human
ugaguuugagcugccu

SEQ ID NO: 2513706 - RNA, 19 nt, Human
ugaguuucucucacauuac

SEQ ID NO: 2513707 - RNA, 23 nt, Human
ugaguugacuugacagaacacug

SEQ ID NO: 2513708 - RNA, 16 nt, Human
ugaggagcuugaaacc

SEQ ID NO: 2513709 - RNA, 12 nt, Human
ugaggaggaagg

SEQ ID NO: 2513710 - RNA, 13 nt, Human
ugaggaggaagga

SEQ ID NO: 2513711 - RNA, 21 nt, Human
ugaggaggaaggagagaaggg

SEQ ID NO: 2513712 - RNA, 14 nt, Human
ugaggaggccucca

SEQ ID NO: 2513713 - RNA, 16 nt, Human
ugaggaggccuccauc

SEQ ID NO: 2513714 - RNA, 18 nt, Human
ugaggaggaaggagagaa

SEQ ID NO: 2513715 - RNA, 14 nt, Human
ugaggcaggucccc

SEQ ID NO: 2513716 - RNA, 16 nt, Human
ugaggcagguccccag

SEQ ID NO: 2513717 - RNA, 17 nt, Human
ugaggcagguccccaga

SEQ ID NO: 2513718 - RNA, 21 nt, Human
ugaggcagugggucccacuuc

SEQ ID NO: 2513719 - RNA, 19 nt, Human
ugaggcagugggucccacu

SEQ ID NO: 2513720 - RNA, 22 nt, Human
ugagcuggggaccugguacccu

SEQ ID NO: 2513721 - RNA, 20 nt, Human
ugagcuggggaugucucuca

SEQ ID NO: 2513722 - RNA, 13 nt, Human
ugagcugggauga

SEQ ID NO: 2513723 - RNA, 13 nt, Human
ugaggagcugggg

SEQ ID NO: 2513724 - RNA, 20 nt, Human
ugaggagcuggggaucccuc

SEQ ID NO: 2513725 - RNA, 12 nt, Human
ugaggagcuggg

SEQ ID NO: 2513726 - RNA, 17 nt, Human
ugaggagcugcuggcuu

SEQ ID NO: 2513727 - RNA, 13 nt, Human
ugaggagcugcug

SEQ ID NO: 2513728 - RNA, 14 nt, Human
ugaggagcugcugg

SEQ ID NO: 2513729 - RNA, 15 nt, Human
ugaggagcugcuggc

SEQ ID NO: 2513730 - RNA, 16 nt, Human
ugaggagcugcuggcu

SEQ ID NO: 2513731 - RNA, 12 nt, Human
ugaggcauuugu

SEQ ID NO: 2513732 - RNA, 23 nt, Human
ugaggcaucgcaauguaagacuc

SEQ ID NO: 2513733 - RNA, 23 nt, Human
ugaggcagugggucccacuuccc

SEQ ID NO: 2513734 - RNA, 22 nt, Human
ugaggcagugggucccacuucc

SEQ ID NO: 2513735 - RNA, 19 nt, Human
ugaggcauuuguuugaacu

SEQ ID NO: 2513736 - RNA, 20 nt, Human
ugaggcauuuguuugaacug

SEQ ID NO: 2513737 - RNA, 17 nt, Human
ugaggcuaguguggugu

SEQ ID NO: 2513738 - RNA, 21 nt, Human
ugaggcauuuguuugaacuga

SEQ ID NO: 2513739 - RNA, 23 nt, Human
ugaggcuagugugguguuuccug

SEQ ID NO: 2513740 - RNA, 18 nt, Human
ugaggcauugcacaggga

SEQ ID NO: 2513741 - RNA, 17 nt, Human
ugaggcauugcacaggg

SEQ ID NO: 2513742 - RNA, 21 nt, Human
ugaggcucaggggugugccug

SEQ ID NO: 2513743 - RNA, 12 nt, Human
ugaggugggagg

SEQ ID NO: 2513744 - RNA, 13 nt, Human
ugaggugggagga

SEQ ID NO: 2513745 - RNA, 14 nt, Human
ugaggugggagaug

SEQ ID NO: 2513746 - RNA, 20 nt, Human
ugagguggcacuuuuucauu

SEQ ID NO: 2513747 - RNA, 18 nt, Human
ugagguggcacuuuuuca

SEQ ID NO: 2513748 - RNA, 16 nt, Human
ugagguggcacuuuuu

SEQ ID NO: 2513749 - RNA, 23 nt, Human
ugaggucugcucggccgucuuca

SEQ ID NO: 2513750 - RNA, 18 nt, Human
ugaggucucgcugaugcu

SEQ ID NO: 2513751 - RNA, 23 nt, Human
ugaggucucgcugaugcugggcu

SEQ ID NO: 2513752 - RNA, 17 nt, Human
ugaggucucuugaggga

SEQ ID NO: 2513753 - RNA, 18 nt, Human
ugaggucucuugagggag

SEQ ID NO: 2513754 - RNA, 15 nt, Human
ugaggucugaaaugg

SEQ ID NO: 2513755 - RNA, 15 nt, Human
ugaggucugcucggc

SEQ ID NO: 2513756 - RNA, 16 nt, Human
ugaggucugcucggcc

SEQ ID NO: 2513757 - RNA, 14 nt, Human
ugagggagcuuagc

SEQ ID NO: 2513758 - RNA, 17 nt, Human
ugaggucccaggcagag

SEQ ID NO: 2513759 - RNA, 19 nt, Human
ugaggucccaggcagagaa

SEQ ID NO: 2513760 - RNA, 16 nt, Human
ugagggagcuuagcca

SEQ ID NO: 2513761 - RNA, 13 nt, Human
ugaggucccaggc

SEQ ID NO: 2513762 - RNA, 15 nt, Human
ugaggucccaggcag

SEQ ID NO: 2513763 - RNA, 14 nt, Human
ugaggucucgcuga

SEQ ID NO: 2513764 - RNA, 23 nt, Human
ugaggucuaggaacauacuucag

SEQ ID NO: 2513765 - RNA, 18 nt, Human
ugaggcuccacuuggucu

SEQ ID NO: 2513766 - RNA, 20 nt, Human
ugaggcuccacuuggucugu

SEQ ID NO: 2513767 - RNA, 14 nt, Human
ugaggcucugcccu

SEQ ID NO: 2513768 - RNA, 13 nt, Human
ugaggcucugccc

SEQ ID NO: 2513769 - RNA, 17 nt, Human
ugagggaacagagaggu

SEQ ID NO: 2513770 - RNA, 17 nt, Human
ugagggaacagacagga

SEQ ID NO: 2513771 - RNA, 16 nt, Human
ugaggcuccugugcua

SEQ ID NO: 2513772 - RNA, 15 nt, Human
ugaggcuccugugcu

SEQ ID NO: 2513773 - RNA, 21 nt, Human
ugaggcucugacccagugaga

SEQ ID NO: 2513774 - RNA, 20 nt, Human
ugagggaacagacaggagaa

SEQ ID NO: 2513775 - RNA, 22 nt, Human
ugagggaacagacaggagaaau

SEQ ID NO: 2513776 - RNA, 13 nt, Human
ugagggaccagcc

SEQ ID NO: 2513777 - RNA, 13 nt, Human
ugagggacucuga

SEQ ID NO: 2513778 - RNA, 18 nt, Human
ugagggaccagccaagag

SEQ ID NO: 2513779 - RNA, 18 nt, Human
ugagggacuggaaccagg

SEQ ID NO: 2513780 - RNA, 14 nt, Human
ugagggagccuggc

SEQ ID NO: 2513781 - RNA, 24 nt, Human
ugcugggccccugccucucugcag

SEQ ID NO: 2513782 - RNA, 23 nt, Human
ugcugggccccugccucucugca

SEQ ID NO: 2513783 - RNA, 22 nt, Human
ugcugggccccugccucucugc

SEQ ID NO: 2513784 - RNA, 21 nt, Human
ugcugggccccugccucucug

SEQ ID NO: 2513785 - RNA, 19 nt, Human
ugcugggccccugccucuc

SEQ ID NO: 2513786 - RNA, 18 nt, Human
ugcugggccccugccucu

SEQ ID NO: 2513787 - RNA, 17 nt, Human
ugcugggccccugccuc

SEQ ID NO: 2513788 - RNA, 16 nt, Human
ugcugggccccugccu

SEQ ID NO: 2513789 - RNA, 15 nt, Human
ugcugcuucccucug

SEQ ID NO: 2513790 - RNA, 16 nt, Human
ugcugcuucccucugc

SEQ ID NO: 2513791 - RNA, 17 nt, Human
ugcugcuucccucugcc

SEQ ID NO: 2513792 - RNA, 20 nt, Human
ugcugcuucccucugccugu

SEQ ID NO: 2513793 - RNA, 12 nt, Human
ugcugcuugagg

SEQ ID NO: 2513794 - RNA, 16 nt, Human
ugcugcugcugcgccc

SEQ ID NO: 2513795 - RNA, 15 nt, Human
ugcugcugcgcccuu

SEQ ID NO: 2513796 - RNA, 12 nt, Human
ugcugcugcugc

SEQ ID NO: 2513797 - RNA, 20 nt, Human
ugcugggauuacagguguga

SEQ ID NO: 2513798 - RNA, 19 nt, Human
ugcugcuugaggcaacuca

SEQ ID NO: 2513799 - RNA, 14 nt, Human
ugcugggccccugc

SEQ ID NO: 2513800 - RNA, 21 nt, Human
ugcugcuucccucugccuguc

SEQ ID NO: 2513801 - RNA, 14 nt, Human
ugcucuuucucugc

SEQ ID NO: 2513802 - RNA, 13 nt, Human
ugcucuuucucug

SEQ ID NO: 2513803 - RNA, 16 nt, Human
ugcucuuucuacucug

SEQ ID NO: 2513804 - RNA, 12 nt, Human
ugcucuuucucu

SEQ ID NO: 2513805 - RNA, 17 nt, Human
ugcugcauuuaaaagau

SEQ ID NO: 2513806 - RNA, 18 nt, Human
ugcugcauuuaaaagaua

SEQ ID NO: 2513807 - RNA, 19 nt, Human
ugcugcauuuaaaagauac

SEQ ID NO: 2513808 - RNA, 23 nt, Human
ugcugcauuuaaaagauacaguu

SEQ ID NO: 2513809 - RNA, 21 nt, Human
ugcugccaaccauaccuuccu

SEQ ID NO: 2513810 - RNA, 14 nt, Human
ugcugcauuuaaaa

SEQ ID NO: 2513811 - RNA, 17 nt, Human
ugcugccugcuuuuuau

SEQ ID NO: 2513812 - RNA, 15 nt, Human
ugcugccugcuuuuu

SEQ ID NO: 2513813 - RNA, 17 nt, Human
ugcugccaaccauaccu

SEQ ID NO: 2513814 - RNA, 23 nt, Human
ugcugcauuuuaauuuuaaccaa

SEQ ID NO: 2513815 - RNA, 14 nt, Human
ugcugccugaguca

SEQ ID NO: 2513816 - RNA, 22 nt, Human
ugcugccuccccaacccugccc

SEQ ID NO: 2513817 - RNA, 16 nt, Human
ugcugccugccugucu

SEQ ID NO: 2513818 - RNA, 15 nt, Human
ugcugccugccuguc

SEQ ID NO: 2513819 - RNA, 14 nt, Human
ugcugccugccugu

SEQ ID NO: 2513820 - RNA, 13 nt, Human
ugcugccugccug

SEQ ID NO: 2513821 - RNA, 17 nt, Human
ugcugccuucuggauuc

SEQ ID NO: 2513822 - RNA, 13 nt, Human
ugcugccuucugg

SEQ ID NO: 2513823 - RNA, 19 nt, Human
ugcugcuauccugccaaaa

SEQ ID NO: 2513824 - RNA, 17 nt, Human
ugcugggcuugucugua

SEQ ID NO: 2513825 - RNA, 14 nt, Human
ugcugggcuggggc

SEQ ID NO: 2513826 - RNA, 13 nt, Human
ugcugggcugggg

SEQ ID NO: 2513827 - RNA, 11 nt, Human
ugcugggcugg

SEQ ID NO: 2513828 - RNA, 24 nt, Human
ugcugggcugacggugcagucugg

SEQ ID NO: 2513829 - RNA, 21 nt, Human
ugcugggcugacggugcaguc

SEQ ID NO: 2513830 - RNA, 19 nt, Human
ugcugggcugacggugcag

SEQ ID NO: 2513831 - RNA, 10 nt, Human
ugcugggcug

SEQ ID NO: 2513832 - RNA, 23 nt, Human
ugcugggcucuccaccucagccu

SEQ ID NO: 2513833 - RNA, 19 nt, Human
ugcugggcauuuucccaga

SEQ ID NO: 2513834 - RNA, 14 nt, Human
ugcugggcucucca

SEQ ID NO: 2513835 - RNA, 15 nt, Human
ugcugggcucuccac

SEQ ID NO: 2513836 - RNA, 16 nt, Human
ugcugggcucuccacc

SEQ ID NO: 2513837 - RNA, 17 nt, Human
ugcugggcucuccaccu

SEQ ID NO: 2513838 - RNA, 18 nt, Human
ugcugggcucuccaccuc

SEQ ID NO: 2513839 - RNA, 20 nt, Human
ugcugggcucuccaccucag

SEQ ID NO: 2513840 - RNA, 22 nt, Human
ugcugggcucuccaccucagcc

SEQ ID NO: 2513841 - RNA, 20 nt, Human
ugcugggggggauuguaaaa

SEQ ID NO: 2513842 - RNA, 16 nt, Human
ugcugggcugggugcg

SEQ ID NO: 2513843 - RNA, 15 nt, Human
ugcugggcugggugc

SEQ ID NO: 2513844 - RNA, 14 nt, Human
ugcugggcugggug

SEQ ID NO: 2513845 - RNA, 17 nt, Human
ugcugggcuggggccug

SEQ ID NO: 2513846 - RNA, 20 nt, Human
ugcuggggacggggggcccc

SEQ ID NO: 2513847 - RNA, 23 nt, Human
ugcuggggcaagucccugacucu

SEQ ID NO: 2513848 - RNA, 23 nt, Human
ugcuggggacggggggccccagu

SEQ ID NO: 2513849 - RNA, 22 nt, Human
ugcuggggacggggggccccag

SEQ ID NO: 2513850 - RNA, 18 nt, Human
ugcuggggcaagucccug

SEQ ID NO: 2513851 - RNA, 23 nt, Human
ugcuggguuggugcacagugauu

SEQ ID NO: 2513852 - RNA, 21 nt, Human
ugcuggguuggugcacaguga

SEQ ID NO: 2513853 - RNA, 19 nt, Human
ugcuggguuggugcacagu

SEQ ID NO: 2513854 - RNA, 18 nt, Human
ugcuggguuggugcacag

SEQ ID NO: 2513855 - RNA, 17 nt, Human
ugcuggguuggugcaca

SEQ ID NO: 2513856 - RNA, 16 nt, Human
ugcuggguuggugcac

SEQ ID NO: 2513857 - RNA, 14 nt, Human
ugcuggguuggugc

SEQ ID NO: 2513858 - RNA, 22 nt, Human
ugcuggguggcccauccccccu

SEQ ID NO: 2513859 - RNA, 13 nt, Human
ugcuggguguggc

SEQ ID NO: 2513860 - RNA, 20 nt, Human
ugcuggguggcccauccccc

SEQ ID NO: 2513861 - RNA, 16 nt, Human
ugcuggguggcccauc

SEQ ID NO: 2513862 - RNA, 15 nt, Human
ugcuggguggcccau

SEQ ID NO: 2513863 - RNA, 14 nt, Human
ugcuggguggccca

SEQ ID NO: 2513864 - RNA, 13 nt, Human
ugcuggguggccc

SEQ ID NO: 2513865 - RNA, 16 nt, Human
ugcuggguaaacugug

SEQ ID NO: 2513866 - RNA, 17 nt, Human
ugcugguguccugacca

SEQ ID NO: 2513867 - RNA, 16 nt, Human
ugcugguguccugacc

SEQ ID NO: 2513868 - RNA, 15 nt, Human
ugcugguguccugac

SEQ ID NO: 2513869 - RNA, 14 nt, Human
ugcugguguccuga

SEQ ID NO: 2513870 - RNA, 17 nt, Human
ugcuggucacagccucc

SEQ ID NO: 2513871 - RNA, 16 nt, Human
ugcuggucacagccuc

SEQ ID NO: 2513872 - RNA, 22 nt, Human
ugcugguaauuuguaucugaag

SEQ ID NO: 2513873 - RNA, 16 nt, Human
ugcugguccgugggac

SEQ ID NO: 2513874 - RNA, 13 nt, Human
ugcugguccgugg

SEQ ID NO: 2513875 - RNA, 20 nt, Human
ugcuggucacagccuccucu

SEQ ID NO: 2513876 - RNA, 19 nt, Human
ugcuggucacagccuccuc

SEQ ID NO: 2513877 - RNA, 16 nt, Human
ugcuggucacugccau

SEQ ID NO: 2513878 - RNA, 16 nt, Human
ugcuguuaucccugcc

SEQ ID NO: 2513879 - RNA, 21 nt, Human
ugcuguguuugagcucugcag

SEQ ID NO: 2513880 - RNA, 15 nt, Human
ugcuguguuugagcu

SEQ ID NO: 2513881 - RNA, 22 nt, Human
ugcuguucucuugggaacugaa

SEQ ID NO: 2513882 - RNA, 17 nt, Human
ugcuguggugugucccc

SEQ ID NO: 2513883 - RNA, 23 nt, Human
ugcuguggugugucccccucugu

SEQ ID NO: 2513884 - RNA, 12 nt, Human
ugcuguguaaag

SEQ ID NO: 2513885 - RNA, 17 nt, Human
ugcuguguaaaguuagu

SEQ ID NO: 2513886 - RNA, 15 nt, Human
ugcuguguaaaguua

SEQ ID NO: 2513887 - RNA, 14 nt, Human
ugcuguguaaaguu

SEQ ID NO: 2513888 - RNA, 13 nt, Human
ugcuguguaaagu

SEQ ID NO: 2513889 - RNA, 16 nt, Human
ugcuguguaucugaua

SEQ ID NO: 2513890 - RNA, 15 nt, Human
ugcuguguaucugau

SEQ ID NO: 2513891 - RNA, 18 nt, Human
ugcuguguuaaauaaacc

SEQ ID NO: 2513892 - RNA, 11 nt, Human
ugcuguguuaa

SEQ ID NO: 2513893 - RNA, 14 nt, Human
ugcugugugguuug

SEQ ID NO: 2513894 - RNA, 11 nt, Human
ugcuguguggu

SEQ ID NO: 2513895 - RNA, 13 nt, Human
ugcugugugccuu

SEQ ID NO: 2513896 - RNA, 21 nt, Human
ugcuguguaucugauagcucu

SEQ ID NO: 2513897 - RNA, 21 nt, Human
ugcugugggugauauggacag

SEQ ID NO: 2513898 - RNA, 23 nt, Human
ugcuguggggcugguagcucagg

SEQ ID NO: 2513899 - RNA, 18 nt, Human
ugcuguggggcugguagc

SEQ ID NO: 2513900 - RNA, 16 nt, Human
ugcuguggggcuggua

SEQ ID NO: 2513901 - RNA, 15 nt, Human
ugcuguggugugucc

SEQ ID NO: 2513902 - RNA, 16 nt, Human
ugcugugguguguccc

SEQ ID NO: 2513903 - RNA, 22 nt, Human
ugcugugggaacgagaggggaa

SEQ ID NO: 2513904 - RNA, 19 nt, Human
ugcugugggaacgagaggg

SEQ ID NO: 2513905 - RNA, 17 nt, Human
ugcugugggaacgagag

SEQ ID NO: 2513906 - RNA, 14 nt, Human
ugcugugggaacga

SEQ ID NO: 2513907 - RNA, 12 nt, Human
ugcugugggaac

SEQ ID NO: 2513908 - RNA, 18 nt, Human
ugcugguuuuucaguuuu

SEQ ID NO: 2513909 - RNA, 16 nt, Human
ugcugguuuuucaguu

SEQ ID NO: 2513910 - RNA, 20 nt, Human
ugcuguaaauaaaugcuuua

SEQ ID NO: 2513911 - RNA, 20 nt, Human
ugcugguuuuccuaaaugca

SEQ ID NO: 2513912 - RNA, 17 nt, Human
ugcuguaaaaacugugg

SEQ ID NO: 2513913 - RNA, 13 nt, Human
ugcugguuuuagu

SEQ ID NO: 2513914 - RNA, 15 nt, Human
ugcugguugcugugu

SEQ ID NO: 2513915 - RNA, 14 nt, Human
ugcugguugcugug

SEQ ID NO: 2513916 - RNA, 13 nt, Human
ugcugguugcugu

SEQ ID NO: 2513917 - RNA, 22 nt, Human
ugcugguguccugaccacccuc

SEQ ID NO: 2513918 - RNA, 17 nt, Human
ugcugguugcugugugg

SEQ ID NO: 2513919 - RNA, 16 nt, Human
ugcugguugcugugug

SEQ ID NO: 2513920 - RNA, 23 nt, Human
ugcugguugucauuuuugcagua

SEQ ID NO: 2513921 - RNA, 15 nt, Human
ugcugguuuuucagu

SEQ ID NO: 2513922 - RNA, 12 nt, Human
ugcugguuuuuc

SEQ ID NO: 2513923 - RNA, 14 nt, Human
ugcugguuuuccua

SEQ ID NO: 2513924 - RNA, 22 nt, Human
ugcugguuuuccuaaaugcagu

SEQ ID NO: 2513925 - RNA, 15 nt, Human
ugcugguuuuccuaa

SEQ ID NO: 2513926 - RNA, 15 nt, Human
ugccucuaccugaca

SEQ ID NO: 2513927 - RNA, 17 nt, Human
ugccucuaccugacacu

SEQ ID NO: 2513928 - RNA, 23 nt, Human
ugccucgggaaccucacucuugc

SEQ ID NO: 2513929 - RNA, 18 nt, Human
ugccucgggaaccucacu

SEQ ID NO: 2513930 - RNA, 24 nt, Human
ugccucggcuuuucucagcuggau

SEQ ID NO: 2513931 - RNA, 22 nt, Human
ugccucggcuccugcugcacca

SEQ ID NO: 2513932 - RNA, 21 nt, Human
ugccucggcuccugcugcacc

SEQ ID NO: 2513933 - RNA, 20 nt, Human
ugccucggcuccugcugcac

SEQ ID NO: 2513934 - RNA, 20 nt, Human
ugccucggcuuuucucagcu

SEQ ID NO: 2513935 - RNA, 21 nt, Human
ugccucggcuuuucucagcug

SEQ ID NO: 2513936 - RNA, 20 nt, Human
ugccuugcauaauggucaga

SEQ ID NO: 2513937 - RNA, 24 nt, Human
ugccucgggaaccucacucuugcc

SEQ ID NO: 2513938 - RNA, 23 nt, Human
ugccucuaccugacacucccuug

SEQ ID NO: 2513939 - RNA, 13 nt, Human
ugccuuggcucag

SEQ ID NO: 2513940 - RNA, 16 nt, Human
ugccuuggcucagaca

SEQ ID NO: 2513941 - RNA, 17 nt, Human
ugccuuggcucagacau

SEQ ID NO: 2513942 - RNA, 19 nt, Human
ugccuuggcucagacaugu

SEQ ID NO: 2513943 - RNA, 20 nt, Human
ugccuuggagggucccaagc

SEQ ID NO: 2513944 - RNA, 19 nt, Human
ugccuuggagggucccaag

SEQ ID NO: 2513945 - RNA, 21 nt, Human
ugccuuggagggucccaagcu

SEQ ID NO: 2513946 - RNA, 18 nt, Human
ugccuuggaaguugcaug

SEQ ID NO: 2513947 - RNA, 22 nt, Human
ugcgcaggcuggcccugcccug

SEQ ID NO: 2513948 - RNA, 23 nt, Human
ugcgcaggcuggcccugcccugg

SEQ ID NO: 2513949 - RNA, 21 nt, Human
ugcgcaggcuggcccugcccu

SEQ ID NO: 2513950 - RNA, 11 nt, Human
ugccuugggcu

SEQ ID NO: 2513951 - RNA, 15 nt, Human
ugccuugggcugcuc

SEQ ID NO: 2513952 - RNA, 22 nt, Human
ugcgcucagggccaugcugagg

SEQ ID NO: 2513953 - RNA, 21 nt, Human
ugcgcucagggccaugcugag

SEQ ID NO: 2513954 - RNA, 19 nt, Human
ugcgcucagggccaugcug

SEQ ID NO: 2513955 - RNA, 15 nt, Human
ugcgcucagggccau

SEQ ID NO: 2513956 - RNA, 14 nt, Human
ugcgcucagggcca

SEQ ID NO: 2513957 - RNA, 13 nt, Human
ugcgcucagggcc

SEQ ID NO: 2513958 - RNA, 17 nt, Human
ugcgcugacaaccaccg

SEQ ID NO: 2513959 - RNA, 23 nt, Human
ugcgcugacaaccaccgcucccc

SEQ ID NO: 2513960 - RNA, 17 nt, Human
ugcgcgcacaauaguaa

SEQ ID NO: 2513961 - RNA, 23 nt, Human
ugcgcucagggccaugcugaggc

SEQ ID NO: 2513962 - RNA, 20 nt, Human
ugcgcucuagccugggcaac

SEQ ID NO: 2513963 - RNA, 23 nt, Human
ugcgcauucucauggagaaguua

SEQ ID NO: 2513964 - RNA, 19 nt, Human
ugcgcauucucauggagaa

SEQ ID NO: 2513965 - RNA, 17 nt, Human
ugcgcauucucauggag

SEQ ID NO: 2513966 - RNA, 17 nt, Human
ugcgccaccgcccagag

SEQ ID NO: 2513967 - RNA, 13 nt, Human
ugcgcauucucau

SEQ ID NO: 2513968 - RNA, 19 nt, Human
ugcgcaggcuggcccugcc

SEQ ID NO: 2513969 - RNA, 13 nt, Human
ugccuuggcuuca

SEQ ID NO: 2513970 - RNA, 23 nt, Human
ugcgcgugcacguggagagcugg

SEQ ID NO: 2513971 - RNA, 20 nt, Human
ugcgccacuacacuccagcc

SEQ ID NO: 2513972 - RNA, 19 nt, Human
ugcguguguccaugugugu

SEQ ID NO: 2513973 - RNA, 24 nt, Human
ugcguguguagaguuaagaagcug

SEQ ID NO: 2513974 - RNA, 17 nt, Human
ugcguguguccaugugu

SEQ ID NO: 2513975 - RNA, 16 nt, Human
ugcguguuugcacguu

SEQ ID NO: 2513976 - RNA, 14 nt, Human
ugcguguuugcacg

SEQ ID NO: 2513977 - RNA, 13 nt, Human
ugcguuacuaauu

SEQ ID NO: 2513978 - RNA, 21 nt, Human
ugcguguguagaguuaagaag

SEQ ID NO: 2513979 - RNA, 20 nt, Human
ugcguguguagaguuaagaa

SEQ ID NO: 2513980 - RNA, 19 nt, Human
ugcguguguagaguuaaga

SEQ ID NO: 2513981 - RNA, 14 nt, Human
ugcguguguagagu

SEQ ID NO: 2513982 - RNA, 15 nt, Human
ugcggaaucagcuuc

SEQ ID NO: 2513983 - RNA, 12 nt, Human
ugcguguguaga

SEQ ID NO: 2513984 - RNA, 15 nt, Human
ugcggacaaguuuua

SEQ ID NO: 2513985 - RNA, 14 nt, Human
ugcggaaucagcuu

SEQ ID NO: 2513986 - RNA, 18 nt, Human
ugcgugugcgugcaugug

SEQ ID NO: 2513987 - RNA, 14 nt, Human
ugcgcuugcuuuuc

SEQ ID NO: 2513988 - RNA, 18 nt, Human
ugcgcuuuugcuggucac

SEQ ID NO: 2513989 - RNA, 17 nt, Human
ugcgcuuuugcugguca

SEQ ID NO: 2513990 - RNA, 14 nt, Human
ugcuaaaccuuagu

SEQ ID NO: 2513991 - RNA, 13 nt, Human
ugcuaaaccuuag

SEQ ID NO: 2513992 - RNA, 21 nt, Human
ugcuaaaccuuaguacugagu

SEQ ID NO: 2513993 - RNA, 19 nt, Human
ugcuaaaccuuaguacuga

SEQ ID NO: 2513994 - RNA, 17 nt, Human
ugcguuccaugaugcug

SEQ ID NO: 2513995 - RNA, 13 nt, Human
ugcguuuuggaag

SEQ ID NO: 2513996 - RNA, 17 nt, Human
ugcuaaaaaugggacuu

SEQ ID NO: 2513997 - RNA, 15 nt, Human
ugcuaaaaaugggac

SEQ ID NO: 2513998 - RNA, 12 nt, Human
ugcuaaaaaugg

SEQ ID NO: 2513999 - RNA, 19 nt, Human
ugcguuagaaugaggagga

SEQ ID NO: 2514000 - RNA, 23 nt, Human
ugcuaaccacgucugucuucaca

SEQ ID NO: 2514001 - RNA, 20 nt, Human
ugcuaacuagcuuggaaacu

SEQ ID NO: 2514002 - RNA, 22 nt, Human
ugcuaagaagcgagcacugacc

SEQ ID NO: 2514003 - RNA, 17 nt, Human
ugcuaacuuggagcccc

SEQ ID NO: 2514004 - RNA, 19 nt, Human
ugcuaacuuggagccccag

SEQ ID NO: 2514005 - RNA, 22 nt, Human
ugcuaacuagcuuggaaacugg

SEQ ID NO: 2514006 - RNA, 19 nt, Human
ugcuacuuaauuccuuucu

SEQ ID NO: 2514007 - RNA, 22 nt, Human
ugcuacugucucacugaaacau

SEQ ID NO: 2514008 - RNA, 18 nt, Human
ugcuacuuugccuuuugc

SEQ ID NO: 2514009 - RNA, 17 nt, Human
ugcuacuuugccuuuug

SEQ ID NO: 2514010 - RNA, 22 nt, Human
ugcuacuuaauuccuuucucau

SEQ ID NO: 2514011 - RNA, 13 nt, Human
ugcuacuuugccu

SEQ ID NO: 2514012 - RNA, 22 nt, Human
ugcuacuguccuacccacccuc

SEQ ID NO: 2514013 - RNA, 21 nt, Human
ugcuacuguccuacccacccu

SEQ ID NO: 2514014 - RNA, 17 nt, Human
ugcuaagaauauuugaa

SEQ ID NO: 2514015 - RNA, 21 nt, Human
ugcuaagaauauuugaaugua

SEQ ID NO: 2514016 - RNA, 19 nt, Human
ugcuacgugugauuuuucu

SEQ ID NO: 2514017 - RNA, 22 nt, Human
ugcuaagaauauuugaauguau

SEQ ID NO: 2514018 - RNA, 14 nt, Human
ugcuacuacaaaaa

SEQ ID NO: 2514019 - RNA, 15 nt, Human
ugcuacucuguuccu

SEQ ID NO: 2514020 - RNA, 16 nt, Human
ugcuacucuguuccuu

SEQ ID NO: 2514021 - RNA, 15 nt, Human
ugcuacugccaaccu

SEQ ID NO: 2514022 - RNA, 14 nt, Human
ugcuacugccaacc

SEQ ID NO: 2514023 - RNA, 20 nt, Human
ugcuacugauuguuucauug

SEQ ID NO: 2514024 - RNA, 14 nt, Human
ugcuacugauuguu

SEQ ID NO: 2514025 - RNA, 12 nt, Human
ugcucuccucuu

SEQ ID NO: 2514026 - RNA, 22 nt, Human
ugcucucccucuucucaagugc

SEQ ID NO: 2514027 - RNA, 21 nt, Human
ugcucucccucuucucaagug

SEQ ID NO: 2514028 - RNA, 20 nt, Human
ugcucucccgguucuuccag

SEQ ID NO: 2514029 - RNA, 20 nt, Human
ugcucuccccugcccugcug

SEQ ID NO: 2514030 - RNA, 23 nt, Human
ugcucuccgaccagacaccuuga

SEQ ID NO: 2514031 - RNA, 16 nt, Human
ugcucuagugccuucu

SEQ ID NO: 2514032 - RNA, 14 nt, Human
ugcucuagugccuu

SEQ ID NO: 2514033 - RNA, 16 nt, Human
ugcucuccccugcccu

SEQ ID NO: 2514034 - RNA, 17 nt, Human
ugcucuccccugcccug

SEQ ID NO: 2514035 - RNA, 17 nt, Human
ugcucuugaugccuggc

SEQ ID NO: 2514036 - RNA, 18 nt, Human
ugcucuuucaucucugcu

SEQ ID NO: 2514037 - RNA, 18 nt, Human
ugcucuuguccuagcuug

SEQ ID NO: 2514038 - RNA, 19 nt, Human
ugcucuuguccuagcuugg

SEQ ID NO: 2514039 - RNA, 22 nt, Human
ugcucauauugugauucugccu

SEQ ID NO: 2514040 - RNA, 23 nt, Human
ugcucauauugugauucugccuu

SEQ ID NO: 2514041 - RNA, 22 nt, Human
ugcucaguuguagaauguauug

SEQ ID NO: 2514042 - RNA, 21 nt, Human
ugcucauauugugauucugcc

SEQ ID NO: 2514043 - RNA, 16 nt, Human
ugcucauaacggauca

SEQ ID NO: 2514044 - RNA, 21 nt, Human
ugcucaguuguagaauguauu

SEQ ID NO: 2514045 - RNA, 20 nt, Human
ugcucaguuguagaauguau

SEQ ID NO: 2514046 - RNA, 14 nt, Human
ugcucauaacggau

SEQ ID NO: 2514047 - RNA, 19 nt, Human
ugcucaguuguagaaugua

SEQ ID NO: 2514048 - RNA, 18 nt, Human
ugcucaguuguagaaugu

SEQ ID NO: 2514049 - RNA, 17 nt, Human
ugcucaguuguagaaug

SEQ ID NO: 2514050 - RNA, 16 nt, Human
ugcucaguuguagaau

SEQ ID NO: 2514051 - RNA, 15 nt, Human
ugcucaguuguagaa

SEQ ID NO: 2514052 - RNA, 13 nt, Human
ugcucaguuguag

SEQ ID NO: 2514053 - RNA, 18 nt, Human
ugcucaguucagaaucac

SEQ ID NO: 2514054 - RNA, 17 nt, Human
ugcucaguucagaauca

SEQ ID NO: 2514055 - RNA, 23 nt, Human
ugcucaguucagaaucacuucug

SEQ ID NO: 2514056 - RNA, 19 nt, Human
ugcucaggcuugaaaugca

SEQ ID NO: 2514057 - RNA, 23 nt, Human
ugcucgggcccaggccaucuucc

SEQ ID NO: 2514058 - RNA, 16 nt, Human
ugcucgggcccaggcc

SEQ ID NO: 2514059 - RNA, 15 nt, Human
ugcucgggcccaggc

SEQ ID NO: 2514060 - RNA, 14 nt, Human
ugcucgggcccagg

SEQ ID NO: 2514061 - RNA, 19 nt, Human
ugcucgcuguugcugaaua

SEQ ID NO: 2514062 - RNA, 15 nt, Human
ugcucggccgucuuc

SEQ ID NO: 2514063 - RNA, 13 nt, Human
ugcucuagugccu

SEQ ID NO: 2514064 - RNA, 13 nt, Human
ugcucagacagaa

SEQ ID NO: 2514065 - RNA, 15 nt, Human
ugcucaggagcccug

SEQ ID NO: 2514066 - RNA, 21 nt, Human
ugcucacuaccuccucaggga

SEQ ID NO: 2514067 - RNA, 20 nt, Human
ugcucacuaccuccucaggg

SEQ ID NO: 2514068 - RNA, 18 nt, Human
ugcucacuaccuccucag

SEQ ID NO: 2514069 - RNA, 17 nt, Human
ugcucacuaccuccuca

SEQ ID NO: 2514070 - RNA, 13 nt, Human
ugcucacuaccuc

SEQ ID NO: 2514071 - RNA, 23 nt, Human
ugcucaccuggggugugggaggc

SEQ ID NO: 2514072 - RNA, 17 nt, Human
ugcucacauaucuguca

SEQ ID NO: 2514073 - RNA, 19 nt, Human
ugcuaggcgagugccagga

SEQ ID NO: 2514074 - RNA, 12 nt, Human
ugcucaccuggg

SEQ ID NO: 2514075 - RNA, 13 nt, Human
ugcucaccugggg

SEQ ID NO: 2514076 - RNA, 14 nt, Human
ugcucaccuggggu

SEQ ID NO: 2514077 - RNA, 22 nt, Human
ugcucaccuggggugugggagg

SEQ ID NO: 2514078 - RNA, 19 nt, Human
ugcucaggagcccugggag

SEQ ID NO: 2514079 - RNA, 18 nt, Human
ugcucaggagcccuggga

SEQ ID NO: 2514080 - RNA, 20 nt, Human
ugcucaggagcccugggagg

SEQ ID NO: 2514081 - RNA, 14 nt, Human
ugcucagaccagcu

SEQ ID NO: 2514082 - RNA, 13 nt, Human
ugcuagaacuccc

SEQ ID NO: 2514083 - RNA, 14 nt, Human
ugcuagaacucccu

SEQ ID NO: 2514084 - RNA, 15 nt, Human
ugcuagaacucccuu

SEQ ID NO: 2514085 - RNA, 17 nt, Human
ugcuagaacucccuuuc

SEQ ID NO: 2514086 - RNA, 20 nt, Human
ugcuaggaacacuccuucac

SEQ ID NO: 2514087 - RNA, 21 nt, Human
ugcuaggaacacuccuucaca

SEQ ID NO: 2514088 - RNA, 22 nt, Human
ugcuaggaacacuccuucacag

SEQ ID NO: 2514089 - RNA, 18 nt, Human
ugcuaggcgagugccagg

SEQ ID NO: 2514090 - RNA, 17 nt, Human
ugcuaggcgagugccag

SEQ ID NO: 2514091 - RNA, 17 nt, Human
ugccccuccucucugcc

SEQ ID NO: 2514092 - RNA, 18 nt, Human
ugccccuccucucugccc

SEQ ID NO: 2514093 - RNA, 16 nt, Human
ugccccucccuucaac

SEQ ID NO: 2514094 - RNA, 15 nt, Human
ugccccucccuucaa

SEQ ID NO: 2514095 - RNA, 13 nt, Human
ugccccagccaga

SEQ ID NO: 2514096 - RNA, 12 nt, Human
ugccccagccag

SEQ ID NO: 2514097 - RNA, 16 nt, Human
ugccccagaggccucu

SEQ ID NO: 2514098 - RNA, 13 nt, Human
ugccccagaggcc

SEQ ID NO: 2514099 - RNA, 16 nt, Human
ugccccagcccaaguc

SEQ ID NO: 2514100 - RNA, 13 nt, Human
ugccccagcccaa

SEQ ID NO: 2514101 - RNA, 13 nt, Human
ugccccagcucug

SEQ ID NO: 2514102 - RNA, 14 nt, Human
ugccccagcucugg

SEQ ID NO: 2514103 - RNA, 16 nt, Human
ugccccagcucuggcu

SEQ ID NO: 2514104 - RNA, 18 nt, Human
ugccccagcucuggcuuc

SEQ ID NO: 2514105 - RNA, 13 nt, Human
ugccccucccuuc

SEQ ID NO: 2514106 - RNA, 20 nt, Human
ugccccucuccaggcgccgg

SEQ ID NO: 2514107 - RNA, 17 nt, Human
ugccccagcccaagucc

SEQ ID NO: 2514108 - RNA, 19 nt, Human
ugccccuccucucugcccu

SEQ ID NO: 2514109 - RNA, 20 nt, Human
ugccccuccucucugcccua

SEQ ID NO: 2514110 - RNA, 16 nt, Human
ugccccuggcagcccc

SEQ ID NO: 2514111 - RNA, 23 nt, Human
ugccccugagcaaugucugugcu

SEQ ID NO: 2514112 - RNA, 20 nt, Human
ugcccgagcuggugcauuac

SEQ ID NO: 2514113 - RNA, 16 nt, Human
ugcccgagcuggugca

SEQ ID NO: 2514114 - RNA, 19 nt, Human
ugcccgagcuggugcauua

SEQ ID NO: 2514115 - RNA, 13 nt, Human
ugcccgcucccag

SEQ ID NO: 2514116 - RNA, 15 nt, Human
ugcccgcucccagug

SEQ ID NO: 2514117 - RNA, 14 nt, Human
ugcccgcucccagu

SEQ ID NO: 2514118 - RNA, 21 nt, Human
ugcccggagauuggacggccu

SEQ ID NO: 2514119 - RNA, 14 nt, Human
ugcccgagcuggug

SEQ ID NO: 2514120 - RNA, 13 nt, Human
ugcccgagcuggu

SEQ ID NO: 2514121 - RNA, 23 nt, Human
ugccccugcugccuccccaaccc

SEQ ID NO: 2514122 - RNA, 13 nt, Human
ugccccugcugcc

SEQ ID NO: 2514123 - RNA, 14 nt, Human
ugccccugcugccu

SEQ ID NO: 2514124 - RNA, 16 nt, Human
ugccccugcugccucc

SEQ ID NO: 2514125 - RNA, 17 nt, Human
ugccccugcugccuccc

SEQ ID NO: 2514126 - RNA, 14 nt, Human
ugcccggcugcgga

SEQ ID NO: 2514127 - RNA, 12 nt, Human
ugcccggcugcg

SEQ ID NO: 2514128 - RNA, 18 nt, Human
ugcccggcgcccucuguc

SEQ ID NO: 2514129 - RNA, 16 nt, Human
ugcccggcgcccucug

SEQ ID NO: 2514130 - RNA, 17 nt, Human
ugcccgcucccaguguc

SEQ ID NO: 2514131 - RNA, 15 nt, Human
ugcccggcgcccucu

SEQ ID NO: 2514132 - RNA, 18 nt, Human
ugcccggauucugggagg

SEQ ID NO: 2514133 - RNA, 22 nt, Human
ugcccggauucugggaggaagc

SEQ ID NO: 2514134 - RNA, 23 nt, Human
ugcccggagauuggacggccuga

SEQ ID NO: 2514135 - RNA, 15 nt, Human
ugcccggauucuggg

SEQ ID NO: 2514136 - RNA, 16 nt, Human
ugcccggauucuggga

SEQ ID NO: 2514137 - RNA, 17 nt, Human
ugcccggauucugggag

SEQ ID NO: 2514138 - RNA, 19 nt, Human
ugccccaccuuuauuaaaa

SEQ ID NO: 2514139 - RNA, 16 nt, Human
ugccccaaccugcuga

SEQ ID NO: 2514140 - RNA, 17 nt, Human
ugccccaacccccagca

SEQ ID NO: 2514141 - RNA, 20 nt, Human
ugccccaacccccagcaccc

SEQ ID NO: 2514142 - RNA, 16 nt, Human
ugccccaacuccugga

SEQ ID NO: 2514143 - RNA, 13 nt, Human
ugccccaacuccu

SEQ ID NO: 2514144 - RNA, 15 nt, Human
ugccccaacuccugg

SEQ ID NO: 2514145 - RNA, 20 nt, Human
ugccccaccccuccccauua

SEQ ID NO: 2514146 - RNA, 21 nt, Human
ugccccaccuuuauuaaaauc

SEQ ID NO: 2514147 - RNA, 13 nt, Human
ugccccagagcug

SEQ ID NO: 2514148 - RNA, 14 nt, Human
ugccccagagcugu

SEQ ID NO: 2514149 - RNA, 15 nt, Human
ugccccagagcuguu

SEQ ID NO: 2514150 - RNA, 17 nt, Human
ugccccagagcuguuua

SEQ ID NO: 2514151 - RNA, 23 nt, Human
ugccccagagcuguuuauggccu

SEQ ID NO: 2514152 - RNA, 17 nt, Human
ugcccauuccucaccuu

SEQ ID NO: 2514153 - RNA, 14 nt, Human
ugccccaaacaaau

SEQ ID NO: 2514154 - RNA, 15 nt, Human
ugcccauuccucacc

SEQ ID NO: 2514155 - RNA, 16 nt, Human
ugccccaacccccagc

SEQ ID NO: 2514156 - RNA, 15 nt, Human
ugccccaacccccag

SEQ ID NO: 2514157 - RNA, 20 nt, Human
ugccccaaacaaauaugcaa

SEQ ID NO: 2514158 - RNA, 20 nt, Human
ugcccaggcuggcgugcagu

SEQ ID NO: 2514159 - RNA, 23 nt, Human
ugcccaugggcacugcugggugg

SEQ ID NO: 2514160 - RNA, 22 nt, Human
ugcccaugggcacugcugggug

SEQ ID NO: 2514161 - RNA, 21 nt, Human
ugcccaugucgcgcucagcau

SEQ ID NO: 2514162 - RNA, 19 nt, Human
ugcccaggcuggcgugcag

SEQ ID NO: 2514163 - RNA, 18 nt, Human
ugcccaggcuggcgugca

SEQ ID NO: 2514164 - RNA, 11 nt, Human
ugcccagagau

SEQ ID NO: 2514165 - RNA, 12 nt, Human
ugcccagagaug

SEQ ID NO: 2514166 - RNA, 16 nt, Human
ugcccagagaugccuc

SEQ ID NO: 2514167 - RNA, 17 nt, Human
ugcccagagaugccucc

SEQ ID NO: 2514168 - RNA, 18 nt, Human
ugcccagagaugccucca

SEQ ID NO: 2514169 - RNA, 19 nt, Human
ugcccagagaugccuccac

SEQ ID NO: 2514170 - RNA, 20 nt, Human
ugcccagagaugccuccacc

SEQ ID NO: 2514171 - RNA, 21 nt, Human
ugcccagagaugccuccaccg

SEQ ID NO: 2514172 - RNA, 22 nt, Human
ugcccagagaugccuccaccgc

SEQ ID NO: 2514173 - RNA, 15 nt, Human
ugcccagagauggga

SEQ ID NO: 2514174 - RNA, 18 nt, Human
ugcccagagggcccaggc

SEQ ID NO: 2514175 - RNA, 19 nt, Human
ugcccagaaugaggcugcu

SEQ ID NO: 2514176 - RNA, 15 nt, Human
ugcccagaccacacg

SEQ ID NO: 2514177 - RNA, 18 nt, Human
ugcccagaccccucuggc

SEQ ID NO: 2514178 - RNA, 19 nt, Human
ugcccagaccccucuggcc

SEQ ID NO: 2514179 - RNA, 22 nt, Human
ugcccagaccccucuggccagg

SEQ ID NO: 2514180 - RNA, 18 nt, Human
ugccaggccagccuccga

SEQ ID NO: 2514181 - RNA, 17 nt, Human
ugccaggccagccuccg

SEQ ID NO: 2514182 - RNA, 16 nt, Human
ugccaggccagccucc

SEQ ID NO: 2514183 - RNA, 15 nt, Human
ugccaggccagccuc

SEQ ID NO: 2514184 - RNA, 14 nt, Human
ugccaggccagccu

SEQ ID NO: 2514185 - RNA, 20 nt, Human
ugccaggcuagagugcagug

SEQ ID NO: 2514186 - RNA, 11 nt, Human
ugccaggcccg

SEQ ID NO: 2514187 - RNA, 14 nt, Human
ugccaggcccgggg

SEQ ID NO: 2514188 - RNA, 15 nt, Human
ugccuaacaccagcg

SEQ ID NO: 2514189 - RNA, 14 nt, Human
ugccuaacaccagc

SEQ ID NO: 2514190 - RNA, 19 nt, Human
ugccucaagccccagagug

SEQ ID NO: 2514191 - RNA, 15 nt, Human
ugccucaagagaagg

SEQ ID NO: 2514192 - RNA, 14 nt, Human
ugccucaagagaag

SEQ ID NO: 2514193 - RNA, 22 nt, Human
ugccuauucccacaccuccaca

SEQ ID NO: 2514194 - RNA, 13 nt, Human
ugccuauucccac

SEQ ID NO: 2514195 - RNA, 20 nt, Human
ugccuccuccuucccaaagg

SEQ ID NO: 2514196 - RNA, 18 nt, Human
ugccuccugccugccccu

SEQ ID NO: 2514197 - RNA, 14 nt, Human
ugccuccugccugc

SEQ ID NO: 2514198 - RNA, 16 nt, Human
ugccuccucuucaacu

SEQ ID NO: 2514199 - RNA, 14 nt, Human
ugccuccucuucaa

SEQ ID NO: 2514200 - RNA, 19 nt, Human
ugccucggcuccugcugca

SEQ ID NO: 2514201 - RNA, 18 nt, Human
ugccucggcuccugcugc

SEQ ID NO: 2514202 - RNA, 17 nt, Human
ugccucggcuccugcug

SEQ ID NO: 2514203 - RNA, 16 nt, Human
ugccucggcuccugcu

SEQ ID NO: 2514204 - RNA, 15 nt, Human
ugccucggcuccugc

SEQ ID NO: 2514205 - RNA, 14 nt, Human
ugccucggcuccug

SEQ ID NO: 2514206 - RNA, 13 nt, Human
ugccucggcuccu

SEQ ID NO: 2514207 - RNA, 20 nt, Human
ugccucggccucccaaagug

SEQ ID NO: 2514208 - RNA, 13 nt, Human
ugccuccugugua

SEQ ID NO: 2514209 - RNA, 12 nt, Human
ugccuccuccuu

SEQ ID NO: 2514210 - RNA, 14 nt, Human
ugccucacagcugg

SEQ ID NO: 2514211 - RNA, 23 nt, Human
ugccucaaugugaccagggguga

SEQ ID NO: 2514212 - RNA, 19 nt, Human
ugccucaaugugaccaggg

SEQ ID NO: 2514213 - RNA, 18 nt, Human
ugccucaaugugaccagg

SEQ ID NO: 2514214 - RNA, 24 nt, Human
ugccucaaugugaaucagacccua

SEQ ID NO: 2514215 - RNA, 15 nt, Human
ugccucaaugccagu

SEQ ID NO: 2514216 - RNA, 13 nt, Human
ugccucaaugcca

SEQ ID NO: 2514217 - RNA, 16 nt, Human
ugccucaaugccagua

SEQ ID NO: 2514218 - RNA, 22 nt, Human
ugccucaaugugaaucagaccc

SEQ ID NO: 2514219 - RNA, 23 nt, Human
ugccucaaugugaaucagacccu

SEQ ID NO: 2514220 - RNA, 20 nt, Human
ugcccugcccaccuggccuc

SEQ ID NO: 2514221 - RNA, 16 nt, Human
ugcccugcccaccugg

SEQ ID NO: 2514222 - RNA, 22 nt, Human
ugcccggcgcccucuguccuga

SEQ ID NO: 2514223 - RNA, 21 nt, Human
ugcccggcgcccucuguccug

SEQ ID NO: 2514224 - RNA, 20 nt, Human
ugcccggcuaauuuuuguaa

SEQ ID NO: 2514225 - RNA, 14 nt, Human
ugcccugcccaccu

SEQ ID NO: 2514226 - RNA, 15 nt, Human
ugcccugcccaccug

SEQ ID NO: 2514227 - RNA, 18 nt, Human
ugcccuggcccugaggug

SEQ ID NO: 2514228 - RNA, 21 nt, Human
ugcccgggaaggucaccagca

SEQ ID NO: 2514229 - RNA, 17 nt, Human
ugcccuggcccugaggu

SEQ ID NO: 2514230 - RNA, 12 nt, Human
ugcccuggcugc

SEQ ID NO: 2514231 - RNA, 22 nt, Human
ugcccuggcccugagguguggg

SEQ ID NO: 2514232 - RNA, 11 nt, Human
ugcccuggcug

SEQ ID NO: 2514233 - RNA, 17 nt, Human
ugcccuggcugcugccc

SEQ ID NO: 2514234 - RNA, 16 nt, Human
ugcccuggcugcugcc

SEQ ID NO: 2514235 - RNA, 15 nt, Human
ugcccuggcugcugc

SEQ ID NO: 2514236 - RNA, 14 nt, Human
ugcccuggcugcug

SEQ ID NO: 2514237 - RNA, 13 nt, Human
ugcccugggaggc

SEQ ID NO: 2514238 - RNA, 15 nt, Human
ugcccugggaggcag

SEQ ID NO: 2514239 - RNA, 17 nt, Human
ugcccugggaggcagug

SEQ ID NO: 2514240 - RNA, 18 nt, Human
ugcccugggaggcaguga

SEQ ID NO: 2514241 - RNA, 20 nt, Human
ugcccuggcugcugccccca

SEQ ID NO: 2514242 - RNA, 18 nt, Human
ugcccuggcugcugcccc

SEQ ID NO: 2514243 - RNA, 16 nt, Human
ugcccugggaugucca

SEQ ID NO: 2514244 - RNA, 17 nt, Human
ugcccugguuuccugcc

SEQ ID NO: 2514245 - RNA, 18 nt, Human
ugcccugguuuccugccc

SEQ ID NO: 2514246 - RNA, 17 nt, Human
ugcccuggugcugccac

SEQ ID NO: 2514247 - RNA, 21 nt, Human
ugcccugguccagggaagcug

SEQ ID NO: 2514248 - RNA, 16 nt, Human
ugcccuggugcugcca

SEQ ID NO: 2514249 - RNA, 14 nt, Human
ugcccuggugcugc

SEQ ID NO: 2514250 - RNA, 12 nt, Human
ugcccuggugcu

SEQ ID NO: 2514251 - RNA, 17 nt, Human
ugcccugguagggcagu

SEQ ID NO: 2514252 - RNA, 18 nt, Human
ugcccugguccagggaag

SEQ ID NO: 2514253 - RNA, 19 nt, Human
ugcccugguuuccugcccu

SEQ ID NO: 2514254 - RNA, 20 nt, Human
ugcccugguuuccugcccug

SEQ ID NO: 2514255 - RNA, 23 nt, Human
ugcccugguuuccugcccuggga

SEQ ID NO: 2514256 - RNA, 13 nt, Human
ugcccugggccac

SEQ ID NO: 2514257 - RNA, 17 nt, Human
ugccaccuccccuaucc

SEQ ID NO: 2514258 - RNA, 18 nt, Human
ugccaccuccccuaucca

SEQ ID NO: 2514259 - RNA, 21 nt, Human
ugccaccuccccuauccaccc

SEQ ID NO: 2514260 - RNA, 22 nt, Human
ugccaccuccccuauccaccca

SEQ ID NO: 2514261 - RNA, 14 nt, Human
ugccaccucccuga

SEQ ID NO: 2514262 - RNA, 10 nt, Human
ugccaccugc

SEQ ID NO: 2514263 - RNA, 16 nt, Human
ugccaccuggggcagu

SEQ ID NO: 2514264 - RNA, 17 nt, Human
ugccaccuggggcaguc

SEQ ID NO: 2514265 - RNA, 19 nt, Human
ugccaccuggggcagucac

SEQ ID NO: 2514266 - RNA, 22 nt, Human
ugccaacauugccuauuucagu

SEQ ID NO: 2514267 - RNA, 14 nt, Human
ugccaacauugccu

SEQ ID NO: 2514268 - RNA, 13 nt, Human
ugccaacauugcc

SEQ ID NO: 2514269 - RNA, 12 nt, Human
ugccaacauugc

SEQ ID NO: 2514270 - RNA, 22 nt, Human
ugccaaccauaccuuccuuccc

SEQ ID NO: 2514271 - RNA, 19 nt, Human
ugccaaccauaccuuccuu

SEQ ID NO: 2514272 - RNA, 13 nt, Human
ugccaccuccccu

SEQ ID NO: 2514273 - RNA, 20 nt, Human
ugccacccuggggagaaagu

SEQ ID NO: 2514274 - RNA, 21 nt, Human
ugccaacaguguuaggccugg

SEQ ID NO: 2514275 - RNA, 23 nt, Human
ugccaacacucaagaagcaggcu

SEQ ID NO: 2514276 - RNA, 22 nt, Human
ugccaacacucaagaagcaggc

SEQ ID NO: 2514277 - RNA, 21 nt, Human
ugccaacacucaagaagcagg

SEQ ID NO: 2514278 - RNA, 21 nt, Human
ugccaacaauccuagugcuuu

SEQ ID NO: 2514279 - RNA, 20 nt, Human
ugccaacacucaagaagcag

SEQ ID NO: 2514280 - RNA, 20 nt, Human
ugccaacaauccuagugcuu

SEQ ID NO: 2514281 - RNA, 18 nt, Human
ugccaaauuguaguucuu

SEQ ID NO: 2514282 - RNA, 15 nt, Human
ugccaacaauccuag

SEQ ID NO: 2514283 - RNA, 23 nt, Human
ugccaaauuuuggccaaaguguu

SEQ ID NO: 2514284 - RNA, 22 nt, Human
ugccaggaagccagcaggcucu

SEQ ID NO: 2514285 - RNA, 20 nt, Human
ugccaggaagccagcaggcu

SEQ ID NO: 2514286 - RNA, 16 nt, Human
ugccacuaaauugaca

SEQ ID NO: 2514287 - RNA, 14 nt, Human
ugccaggcauggug

SEQ ID NO: 2514288 - RNA, 22 nt, Human
ugccaggacuccccaggccagg

SEQ ID NO: 2514289 - RNA, 21 nt, Human
ugccaggacuccccaggccag

SEQ ID NO: 2514290 - RNA, 23 nt, Human
ugccaggacuccccaggccaggc

SEQ ID NO: 2514291 - RNA, 16 nt, Human
ugccaggacuccccag

SEQ ID NO: 2514292 - RNA, 12 nt, Human
ugccaggacucc

SEQ ID NO: 2514293 - RNA, 20 nt, Human
ugccaggaccagucaaccug

SEQ ID NO: 2514294 - RNA, 13 nt, Human
ugccaggacacgc

SEQ ID NO: 2514295 - RNA, 22 nt, Human
ugccacguuggagaagcccgug

SEQ ID NO: 2514296 - RNA, 21 nt, Human
ugcauggugccccaggaccag

SEQ ID NO: 2514297 - RNA, 22 nt, Human
ugcauggugccccaggaccagc

SEQ ID NO: 2514298 - RNA, 17 nt, Human
ugcauggugccccagga

SEQ ID NO: 2514299 - RNA, 18 nt, Human
ugcauggugccccaggac

SEQ ID NO: 2514300 - RNA, 19 nt, Human
ugcauggugccccaggacc

SEQ ID NO: 2514301 - RNA, 20 nt, Human
ugcauggugccccaggacca

SEQ ID NO: 2514302 - RNA, 21 nt, Human
ugcauuuggugguuucagaaa

SEQ ID NO: 2514303 - RNA, 16 nt, Human
ugcaugguggcaccag

SEQ ID NO: 2514304 - RNA, 17 nt, Human
ugcaugggugaagggag

SEQ ID NO: 2514305 - RNA, 12 nt, Human
ugcaugggagca

SEQ ID NO: 2514306 - RNA, 22 nt, Human
ugcauggcuccagaaaugucua

SEQ ID NO: 2514307 - RNA, 20 nt, Human
ugcauggcuccagaaauguc

SEQ ID NO: 2514308 - RNA, 19 nt, Human
ugcaucagcugcugaaaca

SEQ ID NO: 2514309 - RNA, 23 nt, Human
ugcauggggugggguagggcuga

SEQ ID NO: 2514310 - RNA, 19 nt, Human
ugcaugggcuaaugaagau

SEQ ID NO: 2514311 - RNA, 16 nt, Human
ugcaugggugaaggga

SEQ ID NO: 2514312 - RNA, 23 nt, Human
ugcauggugcaguugacagcagg

SEQ ID NO: 2514313 - RNA, 13 nt, Human
ugcaucagcugcu

SEQ ID NO: 2514314 - RNA, 18 nt, Human
ugccaaauauguccuggg

SEQ ID NO: 2514315 - RNA, 17 nt, Human
ugccaaauauguccugg

SEQ ID NO: 2514316 - RNA, 14 nt, Human
ugccaaagggaaau

SEQ ID NO: 2514317 - RNA, 18 nt, Human
ugccaaagggaaauauca

SEQ ID NO: 2514318 - RNA, 19 nt, Human
ugccaaaggaugugauaua

SEQ ID NO: 2514319 - RNA, 17 nt, Human
ugccaaaggaugugaua

SEQ ID NO: 2514320 - RNA, 16 nt, Human
ugccaaaggaugugau

SEQ ID NO: 2514321 - RNA, 15 nt, Human
ugccaaaggauguga

SEQ ID NO: 2514322 - RNA, 21 nt, Human
ugccaaagaucacuuguuguu

SEQ ID NO: 2514323 - RNA, 14 nt, Human
ugccaaagaucacu

SEQ ID NO: 2514324 - RNA, 20 nt, Human
ugccaaagcuaggguggccc

SEQ ID NO: 2514325 - RNA, 21 nt, Human
ugccaaagcuaggguggcccu

SEQ ID NO: 2514326 - RNA, 22 nt, Human
ugccaaagcuaggguggcccuu

SEQ ID NO: 2514327 - RNA, 23 nt, Human
ugcauuuggugguuucagaaaug

SEQ ID NO: 2514328 - RNA, 16 nt, Human
ugcauuuggucaagau

SEQ ID NO: 2514329 - RNA, 23 nt, Human
ugccaaacaaaaagguucucagg

SEQ ID NO: 2514330 - RNA, 17 nt, Human
ugccaaaaugcucuagu

SEQ ID NO: 2514331 - RNA, 17 nt, Human
ugccaaacaaaaagguu

SEQ ID NO: 2514332 - RNA, 18 nt, Human
ugccaaaaugcucuagug

SEQ ID NO: 2514333 - RNA, 19 nt, Human
ugccaaaaucauuuuaaug

SEQ ID NO: 2514334 - RNA, 15 nt, Human
ugcauuugucuauuc

SEQ ID NO: 2514335 - RNA, 16 nt, Human
ugcauauuguacacuu

SEQ ID NO: 2514336 - RNA, 15 nt, Human
ugcauauuguacacu

SEQ ID NO: 2514337 - RNA, 14 nt, Human
ugcauauuguacac

SEQ ID NO: 2514338 - RNA, 13 nt, Human
ugcauauuguaca

SEQ ID NO: 2514339 - RNA, 22 nt, Human
ugcauauuccuuucuaucauuu

SEQ ID NO: 2514340 - RNA, 16 nt, Human
ugcauauuccuuucua

SEQ ID NO: 2514341 - RNA, 13 nt, Human
ugcauauuccuuu

SEQ ID NO: 2514342 - RNA, 23 nt, Human
ugcauauucuuauguaugugaaa

SEQ ID NO: 2514343 - RNA, 22 nt, Human
ugcaucaauuuuucuuauuuca

SEQ ID NO: 2514344 - RNA, 16 nt, Human
ugcauauuguauuacu

SEQ ID NO: 2514345 - RNA, 15 nt, Human
ugcauauuguauuac

SEQ ID NO: 2514346 - RNA, 19 nt, Human
ugcauauuguacacuuuuu

SEQ ID NO: 2514347 - RNA, 17 nt, Human
ugcauauuguacacuuu

SEQ ID NO: 2514348 - RNA, 14 nt, Human
ugcauauaacuuau

SEQ ID NO: 2514349 - RNA, 15 nt, Human
ugcauauaacuuaua

SEQ ID NO: 2514350 - RNA, 16 nt, Human
ugcauauaacuuauau

SEQ ID NO: 2514351 - RNA, 22 nt, Human
ugcauaguaccaaucauuuuaa

SEQ ID NO: 2514352 - RNA, 19 nt, Human
ugcauaguucccauguuaa

SEQ ID NO: 2514353 - RNA, 18 nt, Human
ugcauauuauuuuauguu

SEQ ID NO: 2514354 - RNA, 13 nt, Human
ugcauauguuucg

SEQ ID NO: 2514355 - RNA, 19 nt, Human
ugcauauguugaauacuuu

SEQ ID NO: 2514356 - RNA, 21 nt, Human
ugcauaguauuccauugugug

SEQ ID NO: 2514357 - RNA, 14 nt, Human
ugcaguucugaaga

SEQ ID NO: 2514358 - RNA, 12 nt, Human
ugcaguucugaa

SEQ ID NO: 2514359 - RNA, 19 nt, Human
ugcaguucuaguuugcauu

SEQ ID NO: 2514360 - RNA, 18 nt, Human
ugcaguucuaguuugcau

SEQ ID NO: 2514361 - RNA, 20 nt, Human
ugcaguucuaguuugcauuc

SEQ ID NO: 2514362 - RNA, 16 nt, Human
ugcaguugccagucac

SEQ ID NO: 2514363 - RNA, 21 nt, Human
ugcauaguaccaaucauuuua

SEQ ID NO: 2514364 - RNA, 20 nt, Human
ugcauaguaccaaucauuuu

SEQ ID NO: 2514365 - RNA, 20 nt, Human
ugcauaggugaucucauuua

SEQ ID NO: 2514366 - RNA, 19 nt, Human
ugcaguuuaucauucaagu

SEQ ID NO: 2514367 - RNA, 12 nt, Human
ugcaguuuccaa

SEQ ID NO: 2514368 - RNA, 17 nt, Human
ugcaguuuaucauucaa

SEQ ID NO: 2514369 - RNA, 16 nt, Human
ugcaguuuaucauuca

SEQ ID NO: 2514370 - RNA, 12 nt, Human
ugcaguuuauca

SEQ ID NO: 2514371 - RNA, 10 nt, Human
ugcaguuuau

SEQ ID NO: 2514372 - RNA, 19 nt, Human
ugcaguuugagacaggaga

SEQ ID NO: 2514373 - RNA, 21 nt, Human
ugcaguggugcgaucuggguu

SEQ ID NO: 2514374 - RNA, 12 nt, Human
ugcagggccagg

SEQ ID NO: 2514375 - RNA, 21 nt, Human
ugcagggccagaccugccugc

SEQ ID NO: 2514376 - RNA, 21 nt, Human
ugcagggcagucauuggcugu

SEQ ID NO: 2514377 - RNA, 20 nt, Human
ugcaguggugcgaucugggu

SEQ ID NO: 2514378 - RNA, 19 nt, Human
ugcagggauugcugccacu

SEQ ID NO: 2514379 - RNA, 13 nt, Human
ugcagggcaguca

SEQ ID NO: 2514380 - RNA, 14 nt, Human
ugcagggcagucau

SEQ ID NO: 2514381 - RNA, 23 nt, Human
ugcagggagcauggcugugagga

SEQ ID NO: 2514382 - RNA, 24 nt, Human
ugcagggaggagguggcagcccug

SEQ ID NO: 2514383 - RNA, 20 nt, Human
ugcaguucccccaaccucag

SEQ ID NO: 2514384 - RNA, 17 nt, Human
ugcaguucuaguuugca

SEQ ID NO: 2514385 - RNA, 21 nt, Human
ugcaguucccccaaccucaga

SEQ ID NO: 2514386 - RNA, 15 nt, Human
ugcaguucagcacca

SEQ ID NO: 2514387 - RNA, 18 nt, Human
ugcaguucagcaccaccc

SEQ ID NO: 2514388 - RNA, 19 nt, Human
ugcaguucagcaccacccu

SEQ ID NO: 2514389 - RNA, 23 nt, Human
ugcagggccaggacugagccccg

SEQ ID NO: 2514390 - RNA, 15 nt, Human
ugcagggccaggacu

SEQ ID NO: 2514391 - RNA, 13 nt, Human
ugcagggccagga

SEQ ID NO: 2514392 - RNA, 14 nt, Human
ugcagugugaaaag

SEQ ID NO: 2514393 - RNA, 21 nt, Human
ugcaguuacacuaaaagguga

SEQ ID NO: 2514394 - RNA, 22 nt, Human
ugauuuaauaguguuaaucaau

SEQ ID NO: 2514395 - RNA, 16 nt, Human
ugauuuaauguuuuca

SEQ ID NO: 2514396 - RNA, 13 nt, Human
ugauuuaauguuu

SEQ ID NO: 2514397 - RNA, 16 nt, Human
ugcaggccugcucagg

SEQ ID NO: 2514398 - RNA, 21 nt, Human
ugcaggccugcucagggacug

SEQ ID NO: 2514399 - RNA, 20 nt, Human
ugcaggcccuggccuccccu

SEQ ID NO: 2514400 - RNA, 21 nt, Human
ugauuuaauaaaauaauucua

SEQ ID NO: 2514401 - RNA, 20 nt, Human
ugauuuaauaaaauaauucu

SEQ ID NO: 2514402 - RNA, 19 nt, Human
ugauuuaauaaaauaauuc

SEQ ID NO: 2514403 - RNA, 17 nt, Human
ugauuuaauaaaauaau

SEQ ID NO: 2514404 - RNA, 15 nt, Human
ugauuuaauaaaaua

SEQ ID NO: 2514405 - RNA, 14 nt, Human
ugauuuaauaaaau

SEQ ID NO: 2514406 - RNA, 13 nt, Human
ugauuuaauaaaa

SEQ ID NO: 2514407 - RNA, 18 nt, Human
ugauuuaagacacuuuuu

SEQ ID NO: 2514408 - RNA, 21 nt, Human
ugauuuaauaguguuaaucaa

SEQ ID NO: 2514409 - RNA, 20 nt, Human
ugauuuaauaguguuaauca

SEQ ID NO: 2514410 - RNA, 18 nt, Human
ugauuuaauaguguuaau

SEQ ID NO: 2514411 - RNA, 17 nt, Human
ugauuuaauaguguuaa

SEQ ID NO: 2514412 - RNA, 23 nt, Human
ugauuuaauaaaauaauucuaaa

SEQ ID NO: 2514413 - RNA, 22 nt, Human
ugauuuaauaaaauaauucuaa

SEQ ID NO: 2514414 - RNA, 13 nt, Human
ugauuuaauagug

SEQ ID NO: 2514415 - RNA, 15 nt, Human
ugcagggaaaauuau

SEQ ID NO: 2514416 - RNA, 20 nt, Human
ugcagggaaaauuauuugca

SEQ ID NO: 2514417 - RNA, 21 nt, Human
ugcagggaaaauuauuugcau

SEQ ID NO: 2514418 - RNA, 22 nt, Human
ugcagggaaaauuauuugcaua

SEQ ID NO: 2514419 - RNA, 18 nt, Human
ugcaggcuggcaccgccu

SEQ ID NO: 2514420 - RNA, 21 nt, Human
ugcaggcuggcaccgccuucu

SEQ ID NO: 2514421 - RNA, 22 nt, Human
ugcaggcuggcaccgccuucuc

SEQ ID NO: 2514422 - RNA, 23 nt, Human
ugcaggcuggcaccgccuucucu

SEQ ID NO: 2514423 - RNA, 13 nt, Human
ugcagggaguccg

SEQ ID NO: 2514424 - RNA, 14 nt, Human
ugcagggagccgag

SEQ ID NO: 2514425 - RNA, 15 nt, Human
uggcagaguugaaga

SEQ ID NO: 2514426 - RNA, 12 nt, Human
uggcagaggagg

SEQ ID NO: 2514427 - RNA, 12 nt, Human
uggcagacagac

SEQ ID NO: 2514428 - RNA, 22 nt, Human
uggcagagcuuggacuggaugc

SEQ ID NO: 2514429 - RNA, 13 nt, Human
uggcagagcuucu

SEQ ID NO: 2514430 - RNA, 21 nt, Human
uggcagaguggauucuugaac

SEQ ID NO: 2514431 - RNA, 19 nt, Human
uggcagaguugaagacaga

SEQ ID NO: 2514432 - RNA, 17 nt, Human
uggcagaguugaagaca

SEQ ID NO: 2514433 - RNA, 18 nt, Human
uggccagaugcaccagcc

SEQ ID NO: 2514434 - RNA, 17 nt, Human
uggccagaugcaccagc

SEQ ID NO: 2514435 - RNA, 16 nt, Human
uggccaggcugcucuu

SEQ ID NO: 2514436 - RNA, 17 nt, Human
uggccaggcugcucuug

SEQ ID NO: 2514437 - RNA, 19 nt, Human
uggccaggccucuuggcag

SEQ ID NO: 2514438 - RNA, 16 nt, Human
uggccagccuggaucu

SEQ ID NO: 2514439 - RNA, 17 nt, Human
uggccagcccggcuggu

SEQ ID NO: 2514440 - RNA, 16 nt, Human
uggccagcccggcugg

SEQ ID NO: 2514441 - RNA, 13 nt, Human
uggccagccuaca

SEQ ID NO: 2514442 - RNA, 14 nt, Human
uggccagccuggau

SEQ ID NO: 2514443 - RNA, 19 nt, Human
uggccagcccggcugguuu

SEQ ID NO: 2514444 - RNA, 20 nt, Human
uggccagcccggcugguuuu

SEQ ID NO: 2514445 - RNA, 15 nt, Human
uggccagcccggcug

SEQ ID NO: 2514446 - RNA, 14 nt, Human
uggccagcccggcu

SEQ ID NO: 2514447 - RNA, 13 nt, Human
uggccagcccggc

SEQ ID NO: 2514448 - RNA, 12 nt, Human
uggccagcccgg

SEQ ID NO: 2514449 - RNA, 11 nt, Human
uggccagcccg

SEQ ID NO: 2514450 - RNA, 23 nt, Human
uggccagccccacagcccacguc

SEQ ID NO: 2514451 - RNA, 20 nt, Human
uggccagccccacagcccac

SEQ ID NO: 2514452 - RNA, 19 nt, Human
uggccagccccacagccca

SEQ ID NO: 2514453 - RNA, 18 nt, Human
uggccagccccacagccc

SEQ ID NO: 2514454 - RNA, 19 nt, Human
uggccagaugcaccagccc

SEQ ID NO: 2514455 - RNA, 18 nt, Human
uggcccagggcccagagc

SEQ ID NO: 2514456 - RNA, 20 nt, Human
uggcccagggcccagagccc

SEQ ID NO: 2514457 - RNA, 21 nt, Human
uggcccagggcccagagccca

SEQ ID NO: 2514458 - RNA, 22 nt, Human
uggcccagggcccagagcccag

SEQ ID NO: 2514459 - RNA, 23 nt, Human
uggcccagggcccagagcccagc

SEQ ID NO: 2514460 - RNA, 17 nt, Human
uggcccagggcccagag

SEQ ID NO: 2514461 - RNA, 20 nt, Human
uggccaggcugcucuugaac

SEQ ID NO: 2514462 - RNA, 13 nt, Human
uggccaggcuggu

SEQ ID NO: 2514463 - RNA, 15 nt, Human
uggcccauccccccu

SEQ ID NO: 2514464 - RNA, 12 nt, Human
uggcccaucccc

SEQ ID NO: 2514465 - RNA, 23 nt, Human
uggcccaucaguguacccccgcc

SEQ ID NO: 2514466 - RNA, 22 nt, Human
uggcccaucaguguacccccgc

SEQ ID NO: 2514467 - RNA, 17 nt, Human
uggcccauccccccuca

SEQ ID NO: 2514468 - RNA, 16 nt, Human
uggcccauccccccuc

SEQ ID NO: 2514469 - RNA, 12 nt, Human
uggcccaucagu

SEQ ID NO: 2514470 - RNA, 12 nt, Human
uggcccaguguc

SEQ ID NO: 2514471 - RNA, 13 nt, Human
uggcccaguguca

SEQ ID NO: 2514472 - RNA, 13 nt, Human
uggcccccugucc

SEQ ID NO: 2514473 - RNA, 16 nt, Human
uggcccccgagcuggg

SEQ ID NO: 2514474 - RNA, 17 nt, Human
uggcccccgagcugggg

SEQ ID NO: 2514475 - RNA, 14 nt, Human
uggcccccgagcug

SEQ ID NO: 2514476 - RNA, 15 nt, Human
uggcccccgagcugg

SEQ ID NO: 2514477 - RNA, 20 nt, Human
uggccccgccgccugguacu

SEQ ID NO: 2514478 - RNA, 15 nt, Human
uggccccgccgccug

SEQ ID NO: 2514479 - RNA, 14 nt, Human
uggcccccuguccu

SEQ ID NO: 2514480 - RNA, 13 nt, Human
uggccccgccgcc

SEQ ID NO: 2514481 - RNA, 20 nt, Human
uggccccugcccggcugcgg

SEQ ID NO: 2514482 - RNA, 22 nt, Human
uggccuaggagauaucugaggg

SEQ ID NO: 2514483 - RNA, 21 nt, Human
uggccccucaaaucguccagc

SEQ ID NO: 2514484 - RNA, 21 nt, Human
uggccuaggagauaucugagg

SEQ ID NO: 2514485 - RNA, 17 nt, Human
uggccuaugcacauaug

SEQ ID NO: 2514486 - RNA, 15 nt, Human
uggccuaugcacaua

SEQ ID NO: 2514487 - RNA, 14 nt, Human
uggccuaugcacau

SEQ ID NO: 2514488 - RNA, 13 nt, Human
uggccuaugcaca

SEQ ID NO: 2514489 - RNA, 17 nt, Human
uggccuauuauauuaaa

SEQ ID NO: 2514490 - RNA, 20 nt, Human
uggccuaugcacauauggac

SEQ ID NO: 2514491 - RNA, 20 nt, Human
uggccuauuauauuaaaaua

SEQ ID NO: 2514492 - RNA, 13 nt, Human
uggccucaacccu

SEQ ID NO: 2514493 - RNA, 16 nt, Human
uggccccugcccggcu

SEQ ID NO: 2514494 - RNA, 15 nt, Human
uggccccugcccggc

SEQ ID NO: 2514495 - RNA, 14 nt, Human
uggccccugcccgg

SEQ ID NO: 2514496 - RNA, 16 nt, Human
uggccccguuucuggu

SEQ ID NO: 2514497 - RNA, 19 nt, Human
uggcccccgagcugggggc

SEQ ID NO: 2514498 - RNA, 19 nt, Human
uggccccuagaaucagccu

SEQ ID NO: 2514499 - RNA, 15 nt, Human
uggccccguuucugg

SEQ ID NO: 2514500 - RNA, 21 nt, Human
uggccccgccgccugguacuc

SEQ ID NO: 2514501 - RNA, 16 nt, Human
uggcuccucccggugc

SEQ ID NO: 2514502 - RNA, 14 nt, Human
uggcuccucccggu

SEQ ID NO: 2514503 - RNA, 14 nt, Human
uggcucccaugacc

SEQ ID NO: 2514504 - RNA, 19 nt, Human
uggcuccucccggugccca

SEQ ID NO: 2514505 - RNA, 18 nt, Human
uggcuccucccggugccc

SEQ ID NO: 2514506 - RNA, 14 nt, Human
uggcuccucucagu

SEQ ID NO: 2514507 - RNA, 14 nt, Human
uggcuccugagggg

SEQ ID NO: 2514508 - RNA, 12 nt, Human
uggcuccucuca

SEQ ID NO: 2514509 - RNA, 22 nt, Human
uggcuccucaaacaguagguug

SEQ ID NO: 2514510 - RNA, 14 nt, Human
uggcuccucaaaca

SEQ ID NO: 2514511 - RNA, 15 nt, Human
uggcugcuucaagga

SEQ ID NO: 2514512 - RNA, 15 nt, Human
uggcugggggccuca

SEQ ID NO: 2514513 - RNA, 11 nt, Human
uggcugcuuca

SEQ ID NO: 2514514 - RNA, 12 nt, Human
uggcugcugccc

SEQ ID NO: 2514515 - RNA, 11 nt, Human
uggcugcugcc

SEQ ID NO: 2514516 - RNA, 13 nt, Human
uggcuccucucag

SEQ ID NO: 2514517 - RNA, 14 nt, Human
uggcugcugacuga

SEQ ID NO: 2514518 - RNA, 20 nt, Human
uggcuccugaggggcaucug

SEQ ID NO: 2514519 - RNA, 20 nt, Human
uggcucccacaggcccuucc

SEQ ID NO: 2514520 - RNA, 17 nt, Human
uggcucccacaggcccu

SEQ ID NO: 2514521 - RNA, 19 nt, Human
uggcucccacaggcagcuu

SEQ ID NO: 2514522 - RNA, 18 nt, Human
uggcucccacaggcagcu

SEQ ID NO: 2514523 - RNA, 17 nt, Human
uggcucccacaggcagc

SEQ ID NO: 2514524 - RNA, 16 nt, Human
uggcucccacaggagu

SEQ ID NO: 2514525 - RNA, 14 nt, Human
uggcucccacaggc

SEQ ID NO: 2514526 - RNA, 20 nt, Human
uggcguagaaguuuuuguac

SEQ ID NO: 2514527 - RNA, 20 nt, Human
uggcuccauugguguugaca

SEQ ID NO: 2514528 - RNA, 15 nt, Human
uggcgggguggggug

SEQ ID NO: 2514529 - RNA, 12 nt, Human
uggcgggugggg

SEQ ID NO: 2514530 - RNA, 15 nt, Human
uggcgggugggggug

SEQ ID NO: 2514531 - RNA, 13 nt, Human
uggcggugccugg

SEQ ID NO: 2514532 - RNA, 19 nt, Human
uggcgggaugggccaccgc

SEQ ID NO: 2514533 - RNA, 16 nt, Human
uggcgggaugggccac

SEQ ID NO: 2514534 - RNA, 17 nt, Human
uggcgggcgccuguagu

SEQ ID NO: 2514535 - RNA, 14 nt, Human
uggcgggcgccugu

SEQ ID NO: 2514536 - RNA, 13 nt, Human
uggcgggccaagg

SEQ ID NO: 2514537 - RNA, 17 nt, Human
uggcgggccaaggacug

SEQ ID NO: 2514538 - RNA, 15 nt, Human
uggcggcagcagcca

SEQ ID NO: 2514539 - RNA, 15 nt, Human
uggcggcuacucagc

SEQ ID NO: 2514540 - RNA, 16 nt, Human
uggcggcuacucagca

SEQ ID NO: 2514541 - RNA, 17 nt, Human
uggcggcuacucagcag

SEQ ID NO: 2514542 - RNA, 21 nt, Human
uggcggcuacucagcagcccu

SEQ ID NO: 2514543 - RNA, 22 nt, Human
uggcggcuacucagcagcccuc

SEQ ID NO: 2514544 - RNA, 23 nt, Human
uggcggcuacucagcagcccucc

SEQ ID NO: 2514545 - RNA, 23 nt, Human
uggcggcagcagccaucauagga

SEQ ID NO: 2514546 - RNA, 14 nt, Human
uggcggcagcagcc

SEQ ID NO: 2514547 - RNA, 16 nt, Human
uggcgcagccaaggcc

SEQ ID NO: 2514548 - RNA, 23 nt, Human
uggcgcugccccuggcagccccu

SEQ ID NO: 2514549 - RNA, 13 nt, Human
uggcgcagccaag

SEQ ID NO: 2514550 - RNA, 12 nt, Human
uggcgcagccaa

SEQ ID NO: 2514551 - RNA, 18 nt, Human
uggcgcacccuccccucc

SEQ ID NO: 2514552 - RNA, 16 nt, Human
uggcgcacccuccccu

SEQ ID NO: 2514553 - RNA, 15 nt, Human
uggcgcacccucccc

SEQ ID NO: 2514554 - RNA, 14 nt, Human
uggcgcacccuccc

SEQ ID NO: 2514555 - RNA, 13 nt, Human
uggcgcacccucc

SEQ ID NO: 2514556 - RNA, 16 nt, Human
uggcgcugccccuggc

SEQ ID NO: 2514557 - RNA, 23 nt, Human
uggcgcagcauauucaggaagcu

SEQ ID NO: 2514558 - RNA, 22 nt, Human
uggcgcagcauauucaggaagc

SEQ ID NO: 2514559 - RNA, 23 nt, Human
uggccuccccugccaccaggcca

SEQ ID NO: 2514560 - RNA, 21 nt, Human
uggccuccccugccaccaggc

SEQ ID NO: 2514561 - RNA, 20 nt, Human
uggccuccccugccaccagg

SEQ ID NO: 2514562 - RNA, 19 nt, Human
uggccuccccugccaccag

SEQ ID NO: 2514563 - RNA, 15 nt, Human
uggccuccccugcug

SEQ ID NO: 2514564 - RNA, 14 nt, Human
uggcgcaagccugu

SEQ ID NO: 2514565 - RNA, 19 nt, Human
uggccucaacccucccuca

SEQ ID NO: 2514566 - RNA, 17 nt, Human
uggccucaacccucccu

SEQ ID NO: 2514567 - RNA, 18 nt, Human
uggccucaacccucccuc

SEQ ID NO: 2514568 - RNA, 13 nt, Human
uggccucagcugc

SEQ ID NO: 2514569 - RNA, 21 nt, Human
uggccuauuauauuaaaauau

SEQ ID NO: 2514570 - RNA, 14 nt, Human
uggccucaacccuc

SEQ ID NO: 2514571 - RNA, 15 nt, Human
uggccucaacccucc

SEQ ID NO: 2514572 - RNA, 16 nt, Human
uggccucaacccuccc

SEQ ID NO: 2514573 - RNA, 20 nt, Human
uggccucaacccucccucag

SEQ ID NO: 2514574 - RNA, 17 nt, Human
uggccucauguggcugg

SEQ ID NO: 2514575 - RNA, 15 nt, Human
uggccucauguggcu

SEQ ID NO: 2514576 - RNA, 13 nt, Human
uggccucaugugg

SEQ ID NO: 2514577 - RNA, 19 nt, Human
uggccucagcugccucacu

SEQ ID NO: 2514578 - RNA, 14 nt, Human
uggccucagcugcc

SEQ ID NO: 2514579 - RNA, 16 nt, Human
uggccucagcugccuc

SEQ ID NO: 2514580 - RNA, 17 nt, Human
uggccucagcugccuca

SEQ ID NO: 2514581 - RNA, 18 nt, Human
uggccucagcugccucac

SEQ ID NO: 2514582 - RNA, 21 nt, Human
uggccucauguggcuggaaga

SEQ ID NO: 2514583 - RNA, 20 nt, Human
uggccucauguggcuggaag

SEQ ID NO: 2514584 - RNA, 19 nt, Human
uggccucauguggcuggaa

SEQ ID NO: 2514585 - RNA, 18 nt, Human
uggccucauguggcugga

SEQ ID NO: 2514586 - RNA, 23 nt, Human
uggccucccaacucaccccagcc

SEQ ID NO: 2514587 - RNA, 17 nt, Human
uggccuccccugccacc

SEQ ID NO: 2514588 - RNA, 15 nt, Human
uggccuccccugcca

SEQ ID NO: 2514589 - RNA, 14 nt, Human
uggccuccccugcc

SEQ ID NO: 2514590 - RNA, 22 nt, Human
uggccucccacccgaugcugcu

SEQ ID NO: 2514591 - RNA, 21 nt, Human
uggccucccacccgaugcugc

SEQ ID NO: 2514592 - RNA, 15 nt, Human
uggccucccacccga

SEQ ID NO: 2514593 - RNA, 14 nt, Human
uggccucccacccg

SEQ ID NO: 2514594 - RNA, 13 nt, Human
uggccucccaccc

SEQ ID NO: 2514595 - RNA, 11 nt, Human
uggccucccac

SEQ ID NO: 2514596 - RNA, 22 nt, Human
uggccucauuacuuuaccaccc

SEQ ID NO: 2514597 - RNA, 18 nt, Human
uggccucccacagacuca

SEQ ID NO: 2514598 - RNA, 17 nt, Human
uggcaaaaauggcuaga

SEQ ID NO: 2514599 - RNA, 20 nt, Human
uggcaaaaggaucuuugugg

SEQ ID NO: 2514600 - RNA, 21 nt, Human
uggcaaaaggaucuuuguggc

SEQ ID NO: 2514601 - RNA, 24 nt, Human
uggcaaacgcuaaagagcccuugc

SEQ ID NO: 2514602 - RNA, 17 nt, Human
uggcaaacgcuaaagag

SEQ ID NO: 2514603 - RNA, 19 nt, Human
uggcaaacucuccaccaca

SEQ ID NO: 2514604 - RNA, 20 nt, Human
uggcaaggcugugcucccug

SEQ ID NO: 2514605 - RNA, 17 nt, Human
uggcaaagcuuuuagaa

SEQ ID NO: 2514606 - RNA, 18 nt, Human
uggcaaagcuuuuagaaa

SEQ ID NO: 2514607 - RNA, 16 nt, Human
uggcaaagcuuuuaga

SEQ ID NO: 2514608 - RNA, 21 nt, Human
uggcaaagccuucauugccuu

SEQ ID NO: 2514609 - RNA, 17 nt, Human
uggcaaacuucagacug

SEQ ID NO: 2514610 - RNA, 13 nt, Human
uggcaaagacaga

SEQ ID NO: 2514611 - RNA, 17 nt, Human
uggcaaagacagaagcc

SEQ ID NO: 2514612 - RNA, 20 nt, Human
uggcaaaacucuacuuaauc

SEQ ID NO: 2514613 - RNA, 20 nt, Human
uggauuuuugacucuggcaa

SEQ ID NO: 2514614 - RNA, 19 nt, Human
uggauuuuugacucuggca

SEQ ID NO: 2514615 - RNA, 16 nt, Human
uggcaaaaaggcagga

SEQ ID NO: 2514616 - RNA, 12 nt, Human
uggcaaaaaggc

SEQ ID NO: 2514617 - RNA, 19 nt, Human
uggaucugugaggggcucu

SEQ ID NO: 2514618 - RNA, 17 nt, Human
uggauuuuugucuugug

SEQ ID NO: 2514619 - RNA, 15 nt, Human
uggcacuaguauuuc

SEQ ID NO: 2514620 - RNA, 20 nt, Human
uggcaauagugggcccuccg

SEQ ID NO: 2514621 - RNA, 18 nt, Human
uggcaauagugggcccuc

SEQ ID NO: 2514622 - RNA, 15 nt, Human
uggcaauaguguguu

SEQ ID NO: 2514623 - RNA, 16 nt, Human
uggcaauaguguguuc

SEQ ID NO: 2514624 - RNA, 20 nt, Human
uggcaauagucaaauugugu

SEQ ID NO: 2514625 - RNA, 23 nt, Human
uggcaaggcugugcucccugguu

SEQ ID NO: 2514626 - RNA, 17 nt, Human
uggcaaggguucaccug

SEQ ID NO: 2514627 - RNA, 15 nt, Human
uggcacuauaaugua

SEQ ID NO: 2514628 - RNA, 16 nt, Human
uggcacuauaauguaa

SEQ ID NO: 2514629 - RNA, 23 nt, Human
uggcagaagacaccagagcagau

SEQ ID NO: 2514630 - RNA, 22 nt, Human
uggcacuaacguugagccccug

SEQ ID NO: 2514631 - RNA, 18 nt, Human
uggcacgucaucuaguuu

SEQ ID NO: 2514632 - RNA, 16 nt, Human
uggcacgucaucuagu

SEQ ID NO: 2514633 - RNA, 17 nt, Human
uggcaauaguguguucu

SEQ ID NO: 2514634 - RNA, 18 nt, Human
uggcaauaguguguucug

SEQ ID NO: 2514635 - RNA, 19 nt, Human
uggcagaauaaucuuuggg

SEQ ID NO: 2514636 - RNA, 20 nt, Human
uggcagaauaaucuuugggu

SEQ ID NO: 2514637 - RNA, 18 nt, Human
uggcagaaugcuagcucu

SEQ ID NO: 2514638 - RNA, 22 nt, Human
uggcagaagacaccagagcaga

SEQ ID NO: 2514639 - RNA, 22 nt, Human
uggcagaauggggugcaugaag

SEQ ID NO: 2514640 - RNA, 15 nt, Human
uggaucugugagggg

SEQ ID NO: 2514641 - RNA, 20 nt, Human
uggaucuguccaaggaaacu

SEQ ID NO: 2514642 - RNA, 18 nt, Human
uggaucuguccaaggaaa

SEQ ID NO: 2514643 - RNA, 16 nt, Human
uggaucuguccaagga

SEQ ID NO: 2514644 - RNA, 21 nt, Human
uggaucugggacccuuuccuu

SEQ ID NO: 2514645 - RNA, 20 nt, Human
uggaucugggacccuuuccu

SEQ ID NO: 2514646 - RNA, 19 nt, Human
uggaucugggacccuuucc

SEQ ID NO: 2514647 - RNA, 23 nt, Human
uggaucugggacccuuuccuucc

SEQ ID NO: 2514648 - RNA, 21 nt, Human
uggauaacuuagguggcaagc

SEQ ID NO: 2514649 - RNA, 15 nt, Human
uggauaaagccacug

SEQ ID NO: 2514650 - RNA, 21 nt, Human
uggaucuccaaggaccagguu

SEQ ID NO: 2514651 - RNA, 19 nt, Human
uggaucuccccacucuagg

SEQ ID NO: 2514652 - RNA, 15 nt, Human
uggaucuccccacuc

SEQ ID NO: 2514653 - RNA, 16 nt, Human
uggauaaagccacuga

SEQ ID NO: 2514654 - RNA, 23 nt, Human
uggaguuuuuguuuggagagcac

SEQ ID NO: 2514655 - RNA, 22 nt, Human
uggaguuuuuguuuggagagca

SEQ ID NO: 2514656 - RNA, 21 nt, Human
uggaguuuuuguuuggagagc

SEQ ID NO: 2514657 - RNA, 17 nt, Human
uggaguuuuaacuguaa

SEQ ID NO: 2514658 - RNA, 21 nt, Human
uggaguuucauguacaagaug

SEQ ID NO: 2514659 - RNA, 23 nt, Human
uggaggaggccugggggcaggga

SEQ ID NO: 2514660 - RNA, 20 nt, Human
uggaggauggagagagggga

SEQ ID NO: 2514661 - RNA, 15 nt, Human
uggaggauggagaga

SEQ ID NO: 2514662 - RNA, 23 nt, Human
uggaggaaggaaacccagcucug

SEQ ID NO: 2514663 - RNA, 21 nt, Human
uggaggaaggaaacccagcuc

SEQ ID NO: 2514664 - RNA, 20 nt, Human
uggagacugguccugugugc

SEQ ID NO: 2514665 - RNA, 19 nt, Human
uggagacugguccugugug

SEQ ID NO: 2514666 - RNA, 20 nt, Human
uggagacuggggggcuugaa

SEQ ID NO: 2514667 - RNA, 20 nt, Human
uggagacugcuucccauccu

SEQ ID NO: 2514668 - RNA, 19 nt, Human
uggagacugcuucccaucc

SEQ ID NO: 2514669 - RNA, 17 nt, Human
uggagacugcuucccau

SEQ ID NO: 2514670 - RNA, 14 nt, Human
uggagacugcuucc

SEQ ID NO: 2514671 - RNA, 12 nt, Human
uggagacugcuu

SEQ ID NO: 2514672 - RNA, 14 nt, Human
uggagacugucuca

SEQ ID NO: 2514673 - RNA, 21 nt, Human
uggaggaggaaggcaagaggg

SEQ ID NO: 2514674 - RNA, 17 nt, Human
uggaggaggaaggcaag

SEQ ID NO: 2514675 - RNA, 16 nt, Human
uggaggaggaaggcaa

SEQ ID NO: 2514676 - RNA, 15 nt, Human
uggaggaggaaggca

SEQ ID NO: 2514677 - RNA, 14 nt, Human
uggaggaggaaggc

SEQ ID NO: 2514678 - RNA, 13 nt, Human
uggaggaggaagg

SEQ ID NO: 2514679 - RNA, 22 nt, Human
uggaggagcuugggggaugacu

SEQ ID NO: 2514680 - RNA, 16 nt, Human
uggaggaggagcaggg

SEQ ID NO: 2514681 - RNA, 12 nt, Human
uggaggaggagg

SEQ ID NO: 2514682 - RNA, 13 nt, Human
uggaggaggaggc

SEQ ID NO: 2514683 - RNA, 14 nt, Human
uggaggaggaggca

SEQ ID NO: 2514684 - RNA, 18 nt, Human
uggaggaggccugggggc

SEQ ID NO: 2514685 - RNA, 15 nt, Human
uggaggaggccuggg

SEQ ID NO: 2514686 - RNA, 15 nt, Human
uggaggaggaggcaa

SEQ ID NO: 2514687 - RNA, 16 nt, Human
uggaggaggaggcaau

SEQ ID NO: 2514688 - RNA, 20 nt, Human
uggaggaaggauuguaaaaa

SEQ ID NO: 2514689 - RNA, 19 nt, Human
uggaggaaggauuguaaaa

SEQ ID NO: 2514690 - RNA, 18 nt, Human
uggaggaaggauuguaaa

SEQ ID NO: 2514691 - RNA, 13 nt, Human
uggaggaaggauu

SEQ ID NO: 2514692 - RNA, 15 nt, Human
uggaggaaugcuccc

SEQ ID NO: 2514693 - RNA, 16 nt, Human
uggaggaaugcucccc

SEQ ID NO: 2514694 - RNA, 17 nt, Human
uggaggaaugcuccccc

SEQ ID NO: 2514695 - RNA, 19 nt, Human
uggaggagcucaggacacu

SEQ ID NO: 2514696 - RNA, 22 nt, Human
uggaggaaugcucccccauccu

SEQ ID NO: 2514697 - RNA, 22 nt, Human
uggaggagcucaggacacuaau

SEQ ID NO: 2514698 - RNA, 20 nt, Human
uggaggagcucaggacacua

SEQ ID NO: 2514699 - RNA, 15 nt, Human
uggacacucagaccu

SEQ ID NO: 2514700 - RNA, 13 nt, Human
ugcuguuugacaa

SEQ ID NO: 2514701 - RNA, 14 nt, Human
ugcuguuuccuuuu

SEQ ID NO: 2514702 - RNA, 11 nt, Human
ugcuguuuccu

SEQ ID NO: 2514703 - RNA, 12 nt, Human
ugcuguuuccuu

SEQ ID NO: 2514704 - RNA, 13 nt, Human
ugcuguuguuucu

SEQ ID NO: 2514705 - RNA, 12 nt, Human
ugcuguuguccc

SEQ ID NO: 2514706 - RNA, 18 nt, Human
ugcuguugauugcuaaau

SEQ ID NO: 2514707 - RNA, 17 nt, Human
ugcuguugauugcuaaa

SEQ ID NO: 2514708 - RNA, 16 nt, Human
ugcuguugauugcuaa

SEQ ID NO: 2514709 - RNA, 15 nt, Human
ugcuguugauugcua

SEQ ID NO: 2514710 - RNA, 12 nt, Human
ugcuguugauug

SEQ ID NO: 2514711 - RNA, 17 nt, Human
ugcuguugauguuuugu

SEQ ID NO: 2514712 - RNA, 19 nt, Human
ugcuguugauuucuuucca

SEQ ID NO: 2514713 - RNA, 22 nt, Human
ugcuguugauugcuaaauguaa

SEQ ID NO: 2514714 - RNA, 20 nt, Human
ugcuguugauugcuaaaugu

SEQ ID NO: 2514715 - RNA, 19 nt, Human
ugcuguugauugcuaaaug

SEQ ID NO: 2514716 - RNA, 21 nt, Human
ugcuguugauuucuuuccaga

SEQ ID NO: 2514717 - RNA, 14 nt, Human
ugcuguugccucau

SEQ ID NO: 2514718 - RNA, 23 nt, Human
uggacauagagagggagaagaag

SEQ ID NO: 2514719 - RNA, 14 nt, Human
uggacauccuccuc

SEQ ID NO: 2514720 - RNA, 19 nt, Human
uggacauagagagggagaa

SEQ ID NO: 2514721 - RNA, 14 nt, Human
uggacauagagagg

SEQ ID NO: 2514722 - RNA, 21 nt, Human
uggacaguaucacugucuuuc

SEQ ID NO: 2514723 - RNA, 15 nt, Human
uggacaguccuggga

SEQ ID NO: 2514724 - RNA, 16 nt, Human
uggacaguccugggag

SEQ ID NO: 2514725 - RNA, 17 nt, Human
uggacaguccugggaga

SEQ ID NO: 2514726 - RNA, 21 nt, Human
uggaccaauagggcugagcuc

SEQ ID NO: 2514727 - RNA, 20 nt, Human
uggaccaauagggcugagcu

SEQ ID NO: 2514728 - RNA, 21 nt, Human
uggaccaacccuguuuccuga

SEQ ID NO: 2514729 - RNA, 19 nt, Human
uggacacuccagugccagc

SEQ ID NO: 2514730 - RNA, 17 nt, Human
uggacacuccagugcca

SEQ ID NO: 2514731 - RNA, 16 nt, Human
uggacacucagaccug

SEQ ID NO: 2514732 - RNA, 14 nt, Human
uggacacuuugaaa

SEQ ID NO: 2514733 - RNA, 21 nt, Human
uggacacuccagugccagcaa

SEQ ID NO: 2514734 - RNA, 14 nt, Human
uggacacuguacaa

SEQ ID NO: 2514735 - RNA, 23 nt, Human
uggacacuuaauacuaccuugaa

SEQ ID NO: 2514736 - RNA, 23 nt, Human
uggacaguaucacugucuuuccu

SEQ ID NO: 2514737 - RNA, 12 nt, Human
uggacaguccug

SEQ ID NO: 2514738 - RNA, 13 nt, Human
uggacaguccugg

SEQ ID NO: 2514739 - RNA, 14 nt, Human
uggacaguccuggg

SEQ ID NO: 2514740 - RNA, 20 nt, Human
uggacacuuugaaauguguu

SEQ ID NO: 2514741 - RNA, 14 nt, Human
uggacaggcuggcu

SEQ ID NO: 2514742 - RNA, 18 nt, Human
uggagacuccugcccugu

SEQ ID NO: 2514743 - RNA, 14 nt, Human
uggagacuccugcc

SEQ ID NO: 2514744 - RNA, 13 nt, Human
uggagacuccugc

SEQ ID NO: 2514745 - RNA, 22 nt, Human
uggagacuccuaggcaggacau

SEQ ID NO: 2514746 - RNA, 19 nt, Human
uggagacuccuaggcagga

SEQ ID NO: 2514747 - RNA, 18 nt, Human
uggagacuccuaggcagg

SEQ ID NO: 2514748 - RNA, 18 nt, Human
uggagacuaagcccuguc

SEQ ID NO: 2514749 - RNA, 19 nt, Human
uggagacuccugcccuguu

SEQ ID NO: 2514750 - RNA, 14 nt, Human
uggagacucugugg

SEQ ID NO: 2514751 - RNA, 19 nt, Human
uggagacucuguggggccu

SEQ ID NO: 2514752 - RNA, 14 nt, Human
uggagaauuauaua

SEQ ID NO: 2514753 - RNA, 15 nt, Human
uggacugaugcuuuu

SEQ ID NO: 2514754 - RNA, 18 nt, Human
uggacuggaaaaucucuu

SEQ ID NO: 2514755 - RNA, 14 nt, Human
uggacuggaagggg

SEQ ID NO: 2514756 - RNA, 21 nt, Human
uggagaagcucccugaaguaa

SEQ ID NO: 2514757 - RNA, 16 nt, Human
uggacuggaguggagc

SEQ ID NO: 2514758 - RNA, 22 nt, Human
uggagaagucuuagacuugaaa

SEQ ID NO: 2514759 - RNA, 14 nt, Human
uggacucagggcag

SEQ ID NO: 2514760 - RNA, 15 nt, Human
uggacucagggcagc

SEQ ID NO: 2514761 - RNA, 18 nt, Human
uggacucagggcagcgcc

SEQ ID NO: 2514762 - RNA, 20 nt, Human
uggacucagggcagcgccag

SEQ ID NO: 2514763 - RNA, 21 nt, Human
uggacuccagacucucuguga

SEQ ID NO: 2514764 - RNA, 19 nt, Human
uggacuccagacucucugu

SEQ ID NO: 2514765 - RNA, 18 nt, Human
uggacuccagacucucug

SEQ ID NO: 2514766 - RNA, 18 nt, Human
uggacucaggaugcccag

SEQ ID NO: 2514767 - RNA, 21 nt, Human
uggacuccagccugccuggca

SEQ ID NO: 2514768 - RNA, 20 nt, Human
uggacuccagccugccuggc

SEQ ID NO: 2514769 - RNA, 14 nt, Human
uggacuccagccug

SEQ ID NO: 2514770 - RNA, 20 nt, Human
uggaccacugcaugagcuuu

SEQ ID NO: 2514771 - RNA, 12 nt, Human
uggaccacugca

SEQ ID NO: 2514772 - RNA, 15 nt, Human
uggaccacugggcaa

SEQ ID NO: 2514773 - RNA, 19 nt, Human
uggaccacugggcaaugau

SEQ ID NO: 2514774 - RNA, 16 nt, Human
uggacucaggaugccc

SEQ ID NO: 2514775 - RNA, 16 nt, Human
uggacugaggccugag

SEQ ID NO: 2514776 - RNA, 15 nt, Human
uggacugaggccuga

SEQ ID NO: 2514777 - RNA, 14 nt, Human
uggacugaggccug

SEQ ID NO: 2514778 - RNA, 11 nt, Human
uggacugaggc

SEQ ID NO: 2514779 - RNA, 18 nt, Human
uggacugaagccugcagg

SEQ ID NO: 2514780 - RNA, 13 nt, Human
uggacugacauuu

SEQ ID NO: 2514781 - RNA, 17 nt, Human
uggacuccggcccuccu

SEQ ID NO: 2514782 - RNA, 17 nt, Human
uggacugaagccugcag

SEQ ID NO: 2514783 - RNA, 19 nt, Human
uggacugaagccugcagga

SEQ ID NO: 2514784 - RNA, 13 nt, Human
uggacuccucugu

SEQ ID NO: 2514785 - RNA, 23 nt, Human
uggacuccagccugccuggcagg

SEQ ID NO: 2514786 - RNA, 22 nt, Human
uggacuccagccugccuggcag

SEQ ID NO: 2514787 - RNA, 14 nt, Human
uggacuccggcccu

SEQ ID NO: 2514788 - RNA, 23 nt, Human
uggucccccuuccauggacuuug

SEQ ID NO: 2514789 - RNA, 18 nt, Human
uggucccccuuccaugga

SEQ ID NO: 2514790 - RNA, 16 nt, Human
uggucccccuuccaug

SEQ ID NO: 2514791 - RNA, 15 nt, Human
uggucccccuuccau

SEQ ID NO: 2514792 - RNA, 17 nt, Human
uggucccugcccucauc

SEQ ID NO: 2514793 - RNA, 13 nt, Human
uggucccugggag

SEQ ID NO: 2514794 - RNA, 14 nt, Human
uggucccugggagg

SEQ ID NO: 2514795 - RNA, 19 nt, Human
ugguccggacacuccuaga

SEQ ID NO: 2514796 - RNA, 16 nt, Human
ugguccggacacuccu

SEQ ID NO: 2514797 - RNA, 12 nt, Human
uggucccugggg

SEQ ID NO: 2514798 - RNA, 19 nt, Human
uggucccugggaggaaauu

SEQ ID NO: 2514799 - RNA, 19 nt, Human
ugguccuaaucuucugaac

SEQ ID NO: 2514800 - RNA, 17 nt, Human
ugguccuaaucuucuga

SEQ ID NO: 2514801 - RNA, 14 nt, Human
ugguccucacacuc

SEQ ID NO: 2514802 - RNA, 20 nt, Human
ugguccgugggacggugccc

SEQ ID NO: 2514803 - RNA, 12 nt, Human
ugguccuaccca

SEQ ID NO: 2514804 - RNA, 15 nt, Human
ugguccgguguccuu

SEQ ID NO: 2514805 - RNA, 23 nt, Human
ugguccugcugcaguugccaguc

SEQ ID NO: 2514806 - RNA, 15 nt, Human
ugguccugcugcagu

SEQ ID NO: 2514807 - RNA, 13 nt, Human
ugguccugcugca

SEQ ID NO: 2514808 - RNA, 15 nt, Human
ugguccucuugccuc

SEQ ID NO: 2514809 - RNA, 20 nt, Human
ugguccucuugccuccugga

SEQ ID NO: 2514810 - RNA, 12 nt, Human
ugguccugacuc

SEQ ID NO: 2514811 - RNA, 19 nt, Human
ugguccugacucaacaugu

SEQ ID NO: 2514812 - RNA, 19 nt, Human
ugguauggaacucucucca

SEQ ID NO: 2514813 - RNA, 21 nt, Human
ugguaugugacaugcgggcug

SEQ ID NO: 2514814 - RNA, 21 nt, Human
uggguaccuauuuucauugua

SEQ ID NO: 2514815 - RNA, 19 nt, Human
uggguauauucauuucaaa

SEQ ID NO: 2514816 - RNA, 13 nt, Human
ugggucaaggaau

SEQ ID NO: 2514817 - RNA, 13 nt, Human
ugguauguuuuca

SEQ ID NO: 2514818 - RNA, 21 nt, Human
ugguauguuuucaggcuagau

SEQ ID NO: 2514819 - RNA, 22 nt, Human
ugguauuguauuuauucaauaa

SEQ ID NO: 2514820 - RNA, 12 nt, Human
ugguaugugugu

SEQ ID NO: 2514821 - RNA, 15 nt, Human
ugguaugugugugua

SEQ ID NO: 2514822 - RNA, 17 nt, Human
ugguauguguguguaug

SEQ ID NO: 2514823 - RNA, 19 nt, Human
ugguauguguguguaugcu

SEQ ID NO: 2514824 - RNA, 23 nt, Human
ugguauuguauuuauucaauaaa

SEQ ID NO: 2514825 - RNA, 21 nt, Human
ugguauguguguguaugcuac

SEQ ID NO: 2514826 - RNA, 16 nt, Human
uggucaaacaaacucu

SEQ ID NO: 2514827 - RNA, 21 nt, Human
uggucaaacaaacucucugaa

SEQ ID NO: 2514828 - RNA, 13 nt, Human
uggucccacucag

SEQ ID NO: 2514829 - RNA, 19 nt, Human
uggucacaggacucugccu

SEQ ID NO: 2514830 - RNA, 14 nt, Human
uggucccccuucca

SEQ ID NO: 2514831 - RNA, 18 nt, Human
uggucccauccaggcagu

SEQ ID NO: 2514832 - RNA, 17 nt, Human
uggucccauccaggcag

SEQ ID NO: 2514833 - RNA, 16 nt, Human
uggucccauccaggca

SEQ ID NO: 2514834 - RNA, 15 nt, Human
uggucccauccaggc

SEQ ID NO: 2514835 - RNA, 13 nt, Human
uggucccauccag

SEQ ID NO: 2514836 - RNA, 18 nt, Human
uggucaaccuccuggaca

SEQ ID NO: 2514837 - RNA, 15 nt, Human
uggucaagauuuuga

SEQ ID NO: 2514838 - RNA, 22 nt, Human
uggucacaggaaguagaggagg

SEQ ID NO: 2514839 - RNA, 16 nt, Human
uggucaaccuccugga

SEQ ID NO: 2514840 - RNA, 14 nt, Human
uggucaaccuccug

SEQ ID NO: 2514841 - RNA, 18 nt, Human
uggucacaggacucugcc

SEQ ID NO: 2514842 - RNA, 17 nt, Human
uggucacaggaaguaga

SEQ ID NO: 2514843 - RNA, 20 nt, Human
uggucaaaccgcacucaccc

SEQ ID NO: 2514844 - RNA, 17 nt, Human
uggucaaaccgcacuca

SEQ ID NO: 2514845 - RNA, 21 nt, Human
uggucaaaccgcacucaccca

SEQ ID NO: 2514846 - RNA, 14 nt, Human
uggucaacacuuaa

SEQ ID NO: 2514847 - RNA, 14 nt, Human
uggucaaaccgcac

SEQ ID NO: 2514848 - RNA, 17 nt, Human
uggucaaaagcuggauu

SEQ ID NO: 2514849 - RNA, 22 nt, Human
uggucaaacaaacucucugaac

SEQ ID NO: 2514850 - RNA, 18 nt, Human
uggucuacacugugcuga

SEQ ID NO: 2514851 - RNA, 17 nt, Human
uggucuacacugugcug

SEQ ID NO: 2514852 - RNA, 16 nt, Human
uggucuacacugugcu

SEQ ID NO: 2514853 - RNA, 15 nt, Human
uggucuacacugugc

SEQ ID NO: 2514854 - RNA, 14 nt, Human
uggugaccucugcc

SEQ ID NO: 2514855 - RNA, 13 nt, Human
uggugaccucugc

SEQ ID NO: 2514856 - RNA, 19 nt, Human
uggucuacacugugcugag

SEQ ID NO: 2514857 - RNA, 16 nt, Human
uggugacaccagccuu

SEQ ID NO: 2514858 - RNA, 18 nt, Human
uggugacaccagccuuuc

SEQ ID NO: 2514859 - RNA, 16 nt, Human
ugguccuggggcucug

SEQ ID NO: 2514860 - RNA, 19 nt, Human
ugguccuggggcucugugc

SEQ ID NO: 2514861 - RNA, 20 nt, Human
ugguccugaggguccccacc

SEQ ID NO: 2514862 - RNA, 14 nt, Human
ugguccugagaccu

SEQ ID NO: 2514863 - RNA, 22 nt, Human
ugguccugacucaacauguuac

SEQ ID NO: 2514864 - RNA, 11 nt, Human
ugguccugggg

SEQ ID NO: 2514865 - RNA, 14 nt, Human
ugguccuggggcuc

SEQ ID NO: 2514866 - RNA, 13 nt, Human
uggucgcccagga

SEQ ID NO: 2514867 - RNA, 14 nt, Human
uggucgcccaggag

SEQ ID NO: 2514868 - RNA, 21 nt, Human
ugguccuuuacacucaggcuu

SEQ ID NO: 2514869 - RNA, 20 nt, Human
ugguccuuuacacucaggcu

SEQ ID NO: 2514870 - RNA, 12 nt, Human
ugguccuuuggg

SEQ ID NO: 2514871 - RNA, 14 nt, Human
ugguccuuuacacu

SEQ ID NO: 2514872 - RNA, 20 nt, Human
ugguccugugugcagugaag

SEQ ID NO: 2514873 - RNA, 23 nt, Human
ugguccuuccaggcccccaccac

SEQ ID NO: 2514874 - RNA, 17 nt, Human
uggucggaaaacaugcu

SEQ ID NO: 2514875 - RNA, 14 nt, Human
uggucggaaaacau

SEQ ID NO: 2514876 - RNA, 15 nt, Human
uggucgcuccugccc

SEQ ID NO: 2514877 - RNA, 13 nt, Human
uggucgcuccugc

SEQ ID NO: 2514878 - RNA, 15 nt, Human
uggucgcccaggaga

SEQ ID NO: 2514879 - RNA, 22 nt, Human
uggugaccucugccugaaguca

SEQ ID NO: 2514880 - RNA, 17 nt, Human
uggugaccucugccuga

SEQ ID NO: 2514881 - RNA, 16 nt, Human
uggugaccucugccug

SEQ ID NO: 2514882 - RNA, 15 nt, Human
uggugaccucugccu

SEQ ID NO: 2514883 - RNA, 21 nt, Human
uggugaccuuccaagagccug

SEQ ID NO: 2514884 - RNA, 22 nt, Human
uggugaccuuccaagagccuga

SEQ ID NO: 2514885 - RNA, 19 nt, Human
uggugacuuuccucuuugg

SEQ ID NO: 2514886 - RNA, 18 nt, Human
uggugacugcgaucuuca

SEQ ID NO: 2514887 - RNA, 17 nt, Human
uggugacccagucagag

SEQ ID NO: 2514888 - RNA, 22 nt, Human
uggugaccccuuuucagcuucu

SEQ ID NO: 2514889 - RNA, 17 nt, Human
uggugagaugcagcugg

SEQ ID NO: 2514890 - RNA, 16 nt, Human
uggugagaugcagcug

SEQ ID NO: 2514891 - RNA, 20 nt, Human
uggugagaugcagcuggaaa

SEQ ID NO: 2514892 - RNA, 17 nt, Human
uggugaggccuugcucc

SEQ ID NO: 2514893 - RNA, 18 nt, Human
uggugaggcaggcuuugu

SEQ ID NO: 2514894 - RNA, 18 nt, Human
uggugagucuuggcggca

SEQ ID NO: 2514895 - RNA, 22 nt, Human
uggugagucuuggcggcagcag

SEQ ID NO: 2514896 - RNA, 20 nt, Human
uggugagucuuggcggcagc

SEQ ID NO: 2514897 - RNA, 17 nt, Human
uggugaucaauuaaaug

SEQ ID NO: 2514898 - RNA, 18 nt, Human
uggugaucaauuaaaugu

SEQ ID NO: 2514899 - RNA, 15 nt, Human
uggugcacagugauu

SEQ ID NO: 2514900 - RNA, 20 nt, Human
uggugauggagguuucauac

SEQ ID NO: 2514901 - RNA, 21 nt, Human
uggugcaaugaccuuucaaua

SEQ ID NO: 2514902 - RNA, 20 nt, Human
uggugccaauggaaccuccu

SEQ ID NO: 2514903 - RNA, 17 nt, Human
uggugccaauggaaccu

SEQ ID NO: 2514904 - RNA, 15 nt, Human
uggugccaauuucaa

SEQ ID NO: 2514905 - RNA, 10 nt, Human
uggugcauua

SEQ ID NO: 2514906 - RNA, 13 nt, Human
uggugcauuacag

SEQ ID NO: 2514907 - RNA, 16 nt, Human
uggugcauuacagaga

SEQ ID NO: 2514908 - RNA, 19 nt, Human
uggugcauuacagagagga

SEQ ID NO: 2514909 - RNA, 15 nt, Human
uggugcagugugaaa

SEQ ID NO: 2514910 - RNA, 18 nt, Human
uggguacuuguggacaca

SEQ ID NO: 2514911 - RNA, 17 nt, Human
uggguacuuguggacac

SEQ ID NO: 2514912 - RNA, 15 nt, Human
uggguauaaaagaug

SEQ ID NO: 2514913 - RNA, 14 nt, Human
uggguauaaaagau

SEQ ID NO: 2514914 - RNA, 16 nt, Human
uggguacuucuugaag

SEQ ID NO: 2514915 - RNA, 19 nt, Human
uggguacuucuugaaggug

SEQ ID NO: 2514916 - RNA, 17 nt, Human
uggguauaaaagauggg

SEQ ID NO: 2514917 - RNA, 15 nt, Human
uggguauauucauuu

SEQ ID NO: 2514918 - RNA, 22 nt, Human
uggggguucuuucuuccucugc

SEQ ID NO: 2514919 - RNA, 20 nt, Human
uggggguucuuucuuccucu

SEQ ID NO: 2514920 - RNA, 15 nt, Human
uggguaccuauuuuc

SEQ ID NO: 2514921 - RNA, 18 nt, Human
uggguaaucgauggggga

SEQ ID NO: 2514922 - RNA, 15 nt, Human
uggguacagagaggu

SEQ ID NO: 2514923 - RNA, 13 nt, Human
ugggggugggcca

SEQ ID NO: 2514924 - RNA, 19 nt, Human
uggggguggaggcuuccug

SEQ ID NO: 2514925 - RNA, 16 nt, Human
ugggggugggccaggc

SEQ ID NO: 2514926 - RNA, 19 nt, Human
uggggguucuuucuuccuc

SEQ ID NO: 2514927 - RNA, 15 nt, Human
uggggguucuuucuu

SEQ ID NO: 2514928 - RNA, 16 nt, Human
ugggggaguggccaca

SEQ ID NO: 2514929 - RNA, 13 nt, Human
uggggggggugcu

SEQ ID NO: 2514930 - RNA, 21 nt, Human
ugggggaguagaucuuucuag

SEQ ID NO: 2514931 - RNA, 19 nt, Human
ugggggagagcaggcuggc

SEQ ID NO: 2514932 - RNA, 17 nt, Human
ugggggagagcaggcug

SEQ ID NO: 2514933 - RNA, 14 nt, Human
ugggggagagcagg

SEQ ID NO: 2514934 - RNA, 13 nt, Human
ugggggagagcag

SEQ ID NO: 2514935 - RNA, 14 nt, Human
ugggggacuuacau

SEQ ID NO: 2514936 - RNA, 21 nt, Human
ugggggacuuacaugauucau

SEQ ID NO: 2514937 - RNA, 18 nt, Human
ugggggacagggcuggcc

SEQ ID NO: 2514938 - RNA, 16 nt, Human
ugggggacagggcugg

SEQ ID NO: 2514939 - RNA, 22 nt, Human
ugggggacagggcuggcccagc

SEQ ID NO: 2514940 - RNA, 15 nt, Human
ugggggacagggcug

SEQ ID NO: 2514941 - RNA, 16 nt, Human
ugggggaagcccugga

SEQ ID NO: 2514942 - RNA, 16 nt, Human
uggggguagcagcugg

SEQ ID NO: 2514943 - RNA, 15 nt, Human
uggggguagcagcug

SEQ ID NO: 2514944 - RNA, 21 nt, Human
uggggguagagcugauccaga

SEQ ID NO: 2514945 - RNA, 18 nt, Human
uggggguagagcugaucc

SEQ ID NO: 2514946 - RNA, 18 nt, Human
uggggguagcagcuggac

SEQ ID NO: 2514947 - RNA, 17 nt, Human
uggggguagcagcugga

SEQ ID NO: 2514948 - RNA, 14 nt, Human
ugggggucugugug

SEQ ID NO: 2514949 - RNA, 18 nt, Human
uggggguggaggcuuccu

SEQ ID NO: 2514950 - RNA, 15 nt, Human
ugggggaguggaaua

SEQ ID NO: 2514951 - RNA, 15 nt, Human
uggggguagagcuga

SEQ ID NO: 2514952 - RNA, 23 nt, Human
uggggggguggccgcugaguggc

SEQ ID NO: 2514953 - RNA, 14 nt, Human
uggggggguggccg

SEQ ID NO: 2514954 - RNA, 13 nt, Human
uggggggguggcc

SEQ ID NO: 2514955 - RNA, 12 nt, Human
ugggggagugga

SEQ ID NO: 2514956 - RNA, 19 nt, Human
ugggggagucugaagcaga

SEQ ID NO: 2514957 - RNA, 16 nt, Human
uggggauagaugugug

SEQ ID NO: 2514958 - RNA, 17 nt, Human
uggggauagaugugugg

SEQ ID NO: 2514959 - RNA, 18 nt, Human
uggggauagaugugugga

SEQ ID NO: 2514960 - RNA, 20 nt, Human
uggggauagauguguggaca

SEQ ID NO: 2514961 - RNA, 14 nt, Human
ugggcuugauucug

SEQ ID NO: 2514962 - RNA, 13 nt, Human
ugggcuugauucu

SEQ ID NO: 2514963 - RNA, 14 nt, Human
ugggcuuggccugc

SEQ ID NO: 2514964 - RNA, 13 nt, Human
ugggcuucaucug

SEQ ID NO: 2514965 - RNA, 12 nt, Human
ugggccuucagg

SEQ ID NO: 2514966 - RNA, 23 nt, Human
ugggcuucccaguggcugcugcc

SEQ ID NO: 2514967 - RNA, 22 nt, Human
ugggcuucccaguggcugcugc

SEQ ID NO: 2514968 - RNA, 21 nt, Human
ugggcuucccaguggcugcug

SEQ ID NO: 2514969 - RNA, 19 nt, Human
ugggcuucccaguggcugc

SEQ ID NO: 2514970 - RNA, 12 nt, Human
ugggcuucccag

SEQ ID NO: 2514971 - RNA, 19 nt, Human
ugggcuuccauuugugugu

SEQ ID NO: 2514972 - RNA, 23 nt, Human
ugggcuuccauuugugugugugc

SEQ ID NO: 2514973 - RNA, 22 nt, Human
uggggccaggcugggucgcccu

SEQ ID NO: 2514974 - RNA, 21 nt, Human
uggggccaggcugggucgccc

SEQ ID NO: 2514975 - RNA, 20 nt, Human
uggggccaguuggucccccu

SEQ ID NO: 2514976 - RNA, 15 nt, Human
uggggccaggucacc

SEQ ID NO: 2514977 - RNA, 18 nt, Human
uggggaucucaggggcug

SEQ ID NO: 2514978 - RNA, 15 nt, Human
ugggggaagcccugg

SEQ ID NO: 2514979 - RNA, 14 nt, Human
uggggaucucaggg

SEQ ID NO: 2514980 - RNA, 15 nt, Human
uggggaucacagaga

SEQ ID NO: 2514981 - RNA, 20 nt, Human
uggggaucccucccccccau

SEQ ID NO: 2514982 - RNA, 20 nt, Human
uggggccaggcugggucgcc

SEQ ID NO: 2514983 - RNA, 23 nt, Human
uggggaugagaaagguugaagca

SEQ ID NO: 2514984 - RNA, 15 nt, Human
uggggaugagaaagg

SEQ ID NO: 2514985 - RNA, 21 nt, Human
uggggaucacagagacauucc

SEQ ID NO: 2514986 - RNA, 13 nt, Human
uggggauaugcuu

SEQ ID NO: 2514987 - RNA, 17 nt, Human
uggggauaaaggagaag

SEQ ID NO: 2514988 - RNA, 15 nt, Human
uggggauauaauacu

SEQ ID NO: 2514989 - RNA, 16 nt, Human
ugggagugggcccaau

SEQ ID NO: 2514990 - RNA, 14 nt, Human
ugggagugggccca

SEQ ID NO: 2514991 - RNA, 11 nt, Human
ugggagugugu

SEQ ID NO: 2514992 - RNA, 13 nt, Human
ugggaguguguaa

SEQ ID NO: 2514993 - RNA, 19 nt, Human
ugggaucacauguggacuu

SEQ ID NO: 2514994 - RNA, 20 nt, Human
uggcugcugcccccaccccg

SEQ ID NO: 2514995 - RNA, 16 nt, Human
uggcugcugcccccac

SEQ ID NO: 2514996 - RNA, 15 nt, Human
uggcugcugccccca

SEQ ID NO: 2514997 - RNA, 14 nt, Human
uggcugcugcccag

SEQ ID NO: 2514998 - RNA, 22 nt, Human
ugggagugaggaugucugggcc

SEQ ID NO: 2514999 - RNA, 20 nt, Human
uggcugggggccucagugcc

SEQ ID NO: 2515000 - RNA, 17 nt, Human
uggcugggggccucagu

SEQ ID NO: 2515001 - RNA, 16 nt, Human
uggcugggggccucag

SEQ ID NO: 2515002 - RNA, 22 nt, Human
ugggcagagcagagaccauccc

SEQ ID NO: 2515003 - RNA, 17 nt, Human
ugggauuacaggcguga

SEQ ID NO: 2515004 - RNA, 18 nt, Human
ugggcagagcagagacca

SEQ ID NO: 2515005 - RNA, 22 nt, Human
ugggauguucagcacugucccu

SEQ ID NO: 2515006 - RNA, 21 nt, Human
ugggauguucagcacuguccc

SEQ ID NO: 2515007 - RNA, 20 nt, Human
ugggauguucagcacugucc

SEQ ID NO: 2515008 - RNA, 16 nt, Human
ugggauguucagcacu

SEQ ID NO: 2515009 - RNA, 22 nt, Human
ugggauuacaagcgugagccac

SEQ ID NO: 2515010 - RNA, 13 nt, Human
ugggauccuccag

SEQ ID NO: 2515011 - RNA, 12 nt, Human
ugggauccucca

SEQ ID NO: 2515012 - RNA, 14 nt, Human
ugggauccuccagg

SEQ ID NO: 2515013 - RNA, 18 nt, Human
ugggaugguggagggcca

SEQ ID NO: 2515014 - RNA, 20 nt, Human
ugggaucccucugggcacug

SEQ ID NO: 2515015 - RNA, 19 nt, Human
ugggauguccacagaugcc

SEQ ID NO: 2515016 - RNA, 23 nt, Human
ugggauguggcugcagcagcggu

SEQ ID NO: 2515017 - RNA, 23 nt, Human
ugggccccugccucucugcaggu

SEQ ID NO: 2515018 - RNA, 21 nt, Human
ugggccccugccucucugcag

SEQ ID NO: 2515019 - RNA, 17 nt, Human
ugggcaggugguggcac

SEQ ID NO: 2515020 - RNA, 20 nt, Human
ugggccccugccucucugca

SEQ ID NO: 2515021 - RNA, 16 nt, Human
ugggcaggugguggca

SEQ ID NO: 2515022 - RNA, 15 nt, Human
ugggcaggugguggc

SEQ ID NO: 2515023 - RNA, 14 nt, Human
ugggcagguggugg

SEQ ID NO: 2515024 - RNA, 15 nt, Human
ugggcaggugggagc

SEQ ID NO: 2515025 - RNA, 13 nt, Human
ugggcccucucug

SEQ ID NO: 2515026 - RNA, 16 nt, Human
ugggcccucucugcuc

SEQ ID NO: 2515027 - RNA, 18 nt, Human
ugggcccucucugcucug

SEQ ID NO: 2515028 - RNA, 11 nt, Human
ugggcccuccu

SEQ ID NO: 2515029 - RNA, 11 nt, Human
ugggccuucag

SEQ ID NO: 2515030 - RNA, 14 nt, Human
ugggccuggcuccc

SEQ ID NO: 2515031 - RNA, 18 nt, Human
ugggcccugccucuguuu

SEQ ID NO: 2515032 - RNA, 13 nt, Human
ugggcccugccuc

SEQ ID NO: 2515033 - RNA, 23 nt, Human
ugggcaggacucagcuccccaga

SEQ ID NO: 2515034 - RNA, 14 nt, Human
ugggcagagcuggc

SEQ ID NO: 2515035 - RNA, 13 nt, Human
ugggcagggagcg

SEQ ID NO: 2515036 - RNA, 23 nt, Human
ugggcagagcagagaccaucccu

SEQ ID NO: 2515037 - RNA, 12 nt, Human
ugggcagagcug

SEQ ID NO: 2515038 - RNA, 14 nt, Human
ugggcagagcccaa

SEQ ID NO: 2515039 - RNA, 13 nt, Human
ugggcagagccca

SEQ ID NO: 2515040 - RNA, 14 nt, Human
ugggauguuucugu

SEQ ID NO: 2515041 - RNA, 22 nt, Human
uuugugguacgaccuuuagauu

SEQ ID NO: 2515042 - RNA, 11 nt, Human
uuuguggggag

SEQ ID NO: 2515043 - RNA, 12 nt, Human
uuuguggcuggg

SEQ ID NO: 2515044 - RNA, 19 nt, Human
uuuguguaauagaaaacug

SEQ ID NO: 2515045 - RNA, 14 nt, Human
uuuguguacagugu

SEQ ID NO: 2515046 - RNA, 23 nt, Human
uuaaauguuuuuuuuuaaagacu

SEQ ID NO: 2515047 - RNA, 21 nt, Human
uuaaauguuuuuuuuuaaaga

SEQ ID NO: 2515048 - RNA, 21 nt, Human
uuaaagacaaagacaaauucu

SEQ ID NO: 2515049 - RNA, 12 nt, Human
uuaaagacagag

SEQ ID NO: 2515050 - RNA, 11 nt, Human
uuaaagacaga

SEQ ID NO: 2515051 - RNA, 14 nt, Human
uuaacuagaauuua

SEQ ID NO: 2515052 - RNA, 12 nt, Human
uuaacuagaauu

SEQ ID NO: 2515053 - RNA, 23 nt, Human
uuaacuaaucuauuggguucauu

SEQ ID NO: 2515054 - RNA, 19 nt, Human
uuaacggcuccaggauuuu

SEQ ID NO: 2515055 - RNA, 17 nt, Human
uuaacggcuccaggauu

SEQ ID NO: 2515056 - RNA, 17 nt, Human
uuaaccuggugcuggau

SEQ ID NO: 2515057 - RNA, 15 nt, Human
uuaaccucugcacua

SEQ ID NO: 2515058 - RNA, 12 nt, Human
uuaaccucugca

SEQ ID NO: 2515059 - RNA, 13 nt, Human
uuaaccugaugca

SEQ ID NO: 2515060 - RNA, 19 nt, Human
uuaaccucagugucauuua

SEQ ID NO: 2515061 - RNA, 13 nt, Human
uuaaccuggugcu

SEQ ID NO: 2515062 - RNA, 21 nt, Human
uuaaccuaugauauuuucugu

SEQ ID NO: 2515063 - RNA, 15 nt, Human
uuaaccucaguguca

SEQ ID NO: 2515064 - RNA, 20 nt, Human
uuaaccuaugauauuuucug

SEQ ID NO: 2515065 - RNA, 17 nt, Human
uuaaccacuucagcuga

SEQ ID NO: 2515066 - RNA, 18 nt, Human
uuaaccaaaggugaagga

SEQ ID NO: 2515067 - RNA, 14 nt, Human
uuaaccaaagguga

SEQ ID NO: 2515068 - RNA, 13 nt, Human
uuaaccaaaggug

SEQ ID NO: 2515069 - RNA, 12 nt, Human
uuaaccaaaggu

SEQ ID NO: 2515070 - RNA, 19 nt, Human
uuaaccaaaaagaccagac

SEQ ID NO: 2515071 - RNA, 14 nt, Human
uuaacauuucaagg

SEQ ID NO: 2515072 - RNA, 13 nt, Human
uuaaccauugucu

SEQ ID NO: 2515073 - RNA, 18 nt, Human
uuaaccauuaaaacugaa

SEQ ID NO: 2515074 - RNA, 17 nt, Human
uuaaccauuaaaacuga

SEQ ID NO: 2515075 - RNA, 16 nt, Human
uuaaccauuaaaacug

SEQ ID NO: 2515076 - RNA, 13 nt, Human
uuaaccagaauaa

SEQ ID NO: 2515077 - RNA, 19 nt, Human
uuaaccauugucuuguucu

SEQ ID NO: 2515078 - RNA, 17 nt, Human
uuaacuugagcuuuaaa

SEQ ID NO: 2515079 - RNA, 12 nt, Human
uuaacuucugcc

SEQ ID NO: 2515080 - RNA, 18 nt, Human
uuaacuuuuauaaacuuu

SEQ ID NO: 2515081 - RNA, 21 nt, Human
uuaagcagauggaaugcugug

SEQ ID NO: 2515082 - RNA, 22 nt, Human
uuaacuugaggguaauaaacuu

SEQ ID NO: 2515083 - RNA, 16 nt, Human
uuaacuuuuauaaacu

SEQ ID NO: 2515084 - RNA, 17 nt, Human
uuaacuuuuauaaacuu

SEQ ID NO: 2515085 - RNA, 16 nt, Human
uuaacuucacauauug

SEQ ID NO: 2515086 - RNA, 18 nt, Human
uuaacuuagcuugaagga

SEQ ID NO: 2515087 - RNA, 18 nt, Human
uuaacuuaacauucugua

SEQ ID NO: 2515088 - RNA, 15 nt, Human
uuaacuuuuauaaac

SEQ ID NO: 2515089 - RNA, 14 nt, Human
uuaacuucucugga

SEQ ID NO: 2515090 - RNA, 22 nt, Human
uuaacuucagagggaaaguaaa

SEQ ID NO: 2515091 - RNA, 22 nt, Human
uuaacuuaaauuuuaauuuauu

SEQ ID NO: 2515092 - RNA, 13 nt, Human
uuaacucugucuu

SEQ ID NO: 2515093 - RNA, 12 nt, Human
uuaacucugucu

SEQ ID NO: 2515094 - RNA, 21 nt, Human
uuaacuagaauuuauucaauu

SEQ ID NO: 2515095 - RNA, 16 nt, Human
uuaacuagaauuuauu

SEQ ID NO: 2515096 - RNA, 15 nt, Human
uuaacuagaauuuau

SEQ ID NO: 2515097 - RNA, 19 nt, Human
uuaacuauuuuauuuucua

SEQ ID NO: 2515098 - RNA, 12 nt, Human
uuaacucagucu

SEQ ID NO: 2515099 - RNA, 22 nt, Human
uuaacucagaucacuacugcag

SEQ ID NO: 2515100 - RNA, 15 nt, Human
uuaacucagaucacu

SEQ ID NO: 2515101 - RNA, 14 nt, Human
uuaacucagaucac

SEQ ID NO: 2515102 - RNA, 23 nt, Human
uuaacuaauaugggcauuguagu

SEQ ID NO: 2515103 - RNA, 12 nt, Human
uuaacucaauau

SEQ ID NO: 2515104 - RNA, 21 nt, Human
uuaaugauaaguaaaugcuag

SEQ ID NO: 2515105 - RNA, 15 nt, Human
uuaauauucuauuaa

SEQ ID NO: 2515106 - RNA, 22 nt, Human
uuaauauucauuguauaaaaau

SEQ ID NO: 2515107 - RNA, 17 nt, Human
uuaaugauaaguaaaug

SEQ ID NO: 2515108 - RNA, 18 nt, Human
uuaauauugauaugcuua

SEQ ID NO: 2515109 - RNA, 22 nt, Human
uuaauauugauaugcuuauaca

SEQ ID NO: 2515110 - RNA, 19 nt, Human
uuaauauaucccagaaauu

SEQ ID NO: 2515111 - RNA, 20 nt, Human
uuaauauaucccagaaauua

SEQ ID NO: 2515112 - RNA, 17 nt, Human
uuaauauagcuauuuuu

SEQ ID NO: 2515113 - RNA, 15 nt, Human
uuaauauagcuauuu

SEQ ID NO: 2515114 - RNA, 23 nt, Human
uuaauauaacugccuuaaaacuu

SEQ ID NO: 2515115 - RNA, 18 nt, Human
uuaagcagcucuugcuaa

SEQ ID NO: 2515116 - RNA, 17 nt, Human
uuaagcagcucuugcua

SEQ ID NO: 2515117 - RNA, 13 nt, Human
uuaagcagcucuu

SEQ ID NO: 2515118 - RNA, 12 nt, Human
uuaagcagcucu

SEQ ID NO: 2515119 - RNA, 15 nt, Human
uuaagccuuuggaaa

SEQ ID NO: 2515120 - RNA, 16 nt, Human
uuaagccuuuggaaac

SEQ ID NO: 2515121 - RNA, 21 nt, Human
uuaagccucauauuuaaagac

SEQ ID NO: 2515122 - RNA, 22 nt, Human
uuaagccucauauuuaaagaca

SEQ ID NO: 2515123 - RNA, 20 nt, Human
uuaagcagcucuugcuaauc

SEQ ID NO: 2515124 - RNA, 17 nt, Human
uuaagcuguuacugucu

SEQ ID NO: 2515125 - RNA, 15 nt, Human
uuaauauaacugccu

SEQ ID NO: 2515126 - RNA, 15 nt, Human
uuaaugugcugugua

SEQ ID NO: 2515127 - RNA, 14 nt, Human
uuaaugugcugugu

SEQ ID NO: 2515128 - RNA, 15 nt, Human
uuaauguagccaugg

SEQ ID NO: 2515129 - RNA, 19 nt, Human
uuaaugugcuguguaaagu

SEQ ID NO: 2515130 - RNA, 18 nt, Human
uuaaugugcuguguaaag

SEQ ID NO: 2515131 - RNA, 17 nt, Human
uuaaugugcuguguaaa

SEQ ID NO: 2515132 - RNA, 16 nt, Human
uuaaugugcuguguaa

SEQ ID NO: 2515133 - RNA, 22 nt, Human
uuaaugugcuguguaaaguuag

SEQ ID NO: 2515134 - RNA, 21 nt, Human
uuaaugugcuguguaaaguua

SEQ ID NO: 2515135 - RNA, 13 nt, Human
uuaauguguauua

SEQ ID NO: 2515136 - RNA, 15 nt, Human
uuaauguagauuuuu

SEQ ID NO: 2515137 - RNA, 17 nt, Human
uuaauggugccuucauu

SEQ ID NO: 2515138 - RNA, 19 nt, Human
uuaauggugccuucauuug

SEQ ID NO: 2515139 - RNA, 20 nt, Human
uuaauggugccuucauuugg

SEQ ID NO: 2515140 - RNA, 18 nt, Human
uuaauguaaucugauggc

SEQ ID NO: 2515141 - RNA, 19 nt, Human
uuaauggggguagcagcug

SEQ ID NO: 2515142 - RNA, 21 nt, Human
uuaauggggguagcagcugga

SEQ ID NO: 2515143 - RNA, 14 nt, Human
uuaaugcacuuucu

SEQ ID NO: 2515144 - RNA, 13 nt, Human
uuaaugcacuuuc

SEQ ID NO: 2515145 - RNA, 12 nt, Human
uuaaugcacuuu

SEQ ID NO: 2515146 - RNA, 11 nt, Human
uuaaugcacuu

SEQ ID NO: 2515147 - RNA, 15 nt, Human
uuaaugcacuuucua

SEQ ID NO: 2515148 - RNA, 19 nt, Human
uuaaugccauuaucccuga

SEQ ID NO: 2515149 - RNA, 18 nt, Human
uuaaugcaucuagauuau

SEQ ID NO: 2515150 - RNA, 20 nt, Human
uuaaugcauguuaggaaaau

SEQ ID NO: 2515151 - RNA, 16 nt, Human
uuacaauguucauccc

SEQ ID NO: 2515152 - RNA, 21 nt, Human
uuacaagcgugagccacugca

SEQ ID NO: 2515153 - RNA, 19 nt, Human
uuacaauucccugcugucg

SEQ ID NO: 2515154 - RNA, 18 nt, Human
uuacaauucccugcuguc

SEQ ID NO: 2515155 - RNA, 13 nt, Human
uuacaauugaaau

SEQ ID NO: 2515156 - RNA, 14 nt, Human
uuacaauugaaaug

SEQ ID NO: 2515157 - RNA, 15 nt, Human
uuacaauugaaauga

SEQ ID NO: 2515158 - RNA, 19 nt, Human
uuacaauuuacaaagugug

SEQ ID NO: 2515159 - RNA, 18 nt, Human
uuacaauuuacaaagugu

SEQ ID NO: 2515160 - RNA, 16 nt, Human
uuacaauuuacaaagu

SEQ ID NO: 2515161 - RNA, 13 nt, Human
uuacaauuuacaa

SEQ ID NO: 2515162 - RNA, 12 nt, Human
uuacaauuuaca

SEQ ID NO: 2515163 - RNA, 13 nt, Human
uuacaauugucau

SEQ ID NO: 2515164 - RNA, 17 nt, Human
uuacaauugaaaugacu

SEQ ID NO: 2515165 - RNA, 23 nt, Human
uuaauguucugaauaauuucuua

SEQ ID NO: 2515166 - RNA, 22 nt, Human
uuaauguucugaauaauuucuu

SEQ ID NO: 2515167 - RNA, 15 nt, Human
uuaauguuuauuccu

SEQ ID NO: 2515168 - RNA, 17 nt, Human
uuaauguuuauuccuga

SEQ ID NO: 2515169 - RNA, 20 nt, Human
uuacaagcgugagccacugc

SEQ ID NO: 2515170 - RNA, 20 nt, Human
uuacaagcccccccuuccac

SEQ ID NO: 2515171 - RNA, 19 nt, Human
uuacaagcccccccuucca

SEQ ID NO: 2515172 - RNA, 17 nt, Human
uuacaagcccccccuuc

SEQ ID NO: 2515173 - RNA, 20 nt, Human
uggugccacaaauaaaaugg

SEQ ID NO: 2515174 - RNA, 18 nt, Human
uggugccacaaauaaaau

SEQ ID NO: 2515175 - RNA, 17 nt, Human
uggugccacaaauaaaa

SEQ ID NO: 2515176 - RNA, 22 nt, Human
uggugccaauggaaccuccuuu

SEQ ID NO: 2515177 - RNA, 21 nt, Human
uggugccagccuuccucugca

SEQ ID NO: 2515178 - RNA, 13 nt, Human
uggugccagccuu

SEQ ID NO: 2515179 - RNA, 14 nt, Human
uggugccagccuuc

SEQ ID NO: 2515180 - RNA, 13 nt, Human
uggugccccagga

SEQ ID NO: 2515181 - RNA, 14 nt, Human
uggugccccaggac

SEQ ID NO: 2515182 - RNA, 16 nt, Human
uggugccccaggacca

SEQ ID NO: 2515183 - RNA, 17 nt, Human
uggugccccaggaccag

SEQ ID NO: 2515184 - RNA, 18 nt, Human
uggugccccaggaccagc

SEQ ID NO: 2515185 - RNA, 19 nt, Human
uggugccccaggaccagcu

SEQ ID NO: 2515186 - RNA, 20 nt, Human
uggugccccaggaccagcuc

SEQ ID NO: 2515187 - RNA, 21 nt, Human
uggugccccaggaccagcuca

SEQ ID NO: 2515188 - RNA, 16 nt, Human
uguuuagaagaagugu

SEQ ID NO: 2515189 - RNA, 19 nt, Human
uguuuagaagaaguguguc

SEQ ID NO: 2515190 - RNA, 23 nt, Human
uggugccccaggaccagcucagg

SEQ ID NO: 2515191 - RNA, 16 nt, Human
uguuuagaguugcaau

SEQ ID NO: 2515192 - RNA, 19 nt, Human
uguuucaaacauauauaac

SEQ ID NO: 2515193 - RNA, 16 nt, Human
uguuuagauaauacac

SEQ ID NO: 2515194 - RNA, 22 nt, Human
uguuucaaacauauauaacaau

SEQ ID NO: 2515195 - RNA, 21 nt, Human
uguuucaaacauauauaacaa

SEQ ID NO: 2515196 - RNA, 17 nt, Human
uguuuagaguugcaauc

SEQ ID NO: 2515197 - RNA, 15 nt, Human
uguuucaaacuuuac

SEQ ID NO: 2515198 - RNA, 21 nt, Human
uguuucaaguggggcucgcca

SEQ ID NO: 2515199 - RNA, 17 nt, Human
uguuucaaguggggcuc

SEQ ID NO: 2515200 - RNA, 16 nt, Human
uguuucaauugcaucu

SEQ ID NO: 2515201 - RNA, 18 nt, Human
uguuucacgaaguuuguu

SEQ ID NO: 2515202 - RNA, 20 nt, Human
uguuucauauugaugugugu

SEQ ID NO: 2515203 - RNA, 21 nt, Human
uguuucuagcacuggccugca

SEQ ID NO: 2515204 - RNA, 21 nt, Human
uguuucuaauaaagaaagcag

SEQ ID NO: 2515205 - RNA, 11 nt, Human
uguuuccuuuu

SEQ ID NO: 2515206 - RNA, 22 nt, Human
uguuucggagacgggaccgggc

SEQ ID NO: 2515207 - RNA, 21 nt, Human
uguuucgcugauauauguguu

SEQ ID NO: 2515208 - RNA, 15 nt, Human
uguuucguggggagg

SEQ ID NO: 2515209 - RNA, 20 nt, Human
uguuucgugaaguauacugu

SEQ ID NO: 2515210 - RNA, 15 nt, Human
uguuucgugaaguau

SEQ ID NO: 2515211 - RNA, 19 nt, Human
uguuucgugaaguauacug

SEQ ID NO: 2515212 - RNA, 22 nt, Human
uguuuccaauguuuagcaaaua

SEQ ID NO: 2515213 - RNA, 21 nt, Human
uguuuccaauguuuagcaaau

SEQ ID NO: 2515214 - RNA, 15 nt, Human
uguuuccaauguuua

SEQ ID NO: 2515215 - RNA, 18 nt, Human
uguuuccaaccuggagua

SEQ ID NO: 2515216 - RNA, 23 nt, Human
uguuuccagacuuccuugagaca

SEQ ID NO: 2515217 - RNA, 14 nt, Human
uguuucauguuuug

SEQ ID NO: 2515218 - RNA, 13 nt, Human
uguuucauguuuu

SEQ ID NO: 2515219 - RNA, 21 nt, Human
uguuucauguuuugugacuau

SEQ ID NO: 2515220 - RNA, 19 nt, Human
uguuucauguuuugugacu

SEQ ID NO: 2515221 - RNA, 22 nt, Human
uguuucauguuuugugacuaua

SEQ ID NO: 2515222 - RNA, 23 nt, Human
uguuuccaauguuuagcaaauac

SEQ ID NO: 2515223 - RNA, 20 nt, Human
uguuuccagacuuccuugag

SEQ ID NO: 2515224 - RNA, 23 nt, Human
uguuuccuggcacugcuuccagu

SEQ ID NO: 2515225 - RNA, 12 nt, Human
uguuuccuucag

SEQ ID NO: 2515226 - RNA, 15 nt, Human
uguuuccuucagugc

SEQ ID NO: 2515227 - RNA, 13 nt, Human
uguuugugcugug

SEQ ID NO: 2515228 - RNA, 14 nt, Human
uguuugugcugugg

SEQ ID NO: 2515229 - RNA, 16 nt, Human
uguuugucuucucccc

SEQ ID NO: 2515230 - RNA, 17 nt, Human
uguuugucuucucccca

SEQ ID NO: 2515231 - RNA, 20 nt, Human
uguuuuaagaggcagggucu

SEQ ID NO: 2515232 - RNA, 13 nt, Human
uguuugugauuga

SEQ ID NO: 2515233 - RNA, 16 nt, Human
uguuugucucauccca

SEQ ID NO: 2515234 - RNA, 16 nt, Human
uguuugucagauauga

SEQ ID NO: 2515235 - RNA, 19 nt, Human
uguuugucugucuucauag

SEQ ID NO: 2515236 - RNA, 17 nt, Human
uguuugucugucuucau

SEQ ID NO: 2515237 - RNA, 16 nt, Human
uguuugguucuggggc

SEQ ID NO: 2515238 - RNA, 20 nt, Human
uguuugguucuggggccccu

SEQ ID NO: 2515239 - RNA, 17 nt, Human
uguuugguauuguauuu

SEQ ID NO: 2515240 - RNA, 16 nt, Human
uguuugguauuguauu

SEQ ID NO: 2515241 - RNA, 22 nt, Human
uguuugguauuguauuuauuca

SEQ ID NO: 2515242 - RNA, 17 nt, Human
uguuugucauuagccug

SEQ ID NO: 2515243 - RNA, 15 nt, Human
uguuugucauuagcc

SEQ ID NO: 2515244 - RNA, 19 nt, Human
uguuuguauaaugaaugag

SEQ ID NO: 2515245 - RNA, 15 nt, Human
uguuuguauguauaa

SEQ ID NO: 2515246 - RNA, 15 nt, Human
uuaaaagaugaaaau

SEQ ID NO: 2515247 - RNA, 18 nt, Human
uuaaaagaugaaaauauu

SEQ ID NO: 2515248 - RNA, 21 nt, Human
uuaaaagauucauuuuuaauc

SEQ ID NO: 2515249 - RNA, 17 nt, Human
uuaaaagauucauuuuu

SEQ ID NO: 2515250 - RNA, 16 nt, Human
uuaaaagauucauuuu

SEQ ID NO: 2515251 - RNA, 21 nt, Human
uuaaaagaugcaauguagagg

SEQ ID NO: 2515252 - RNA, 19 nt, Human
uuaaaauacacacucaaau

SEQ ID NO: 2515253 - RNA, 21 nt, Human
uuaaaauaccagccaguaaau

SEQ ID NO: 2515254 - RNA, 23 nt, Human
uuaaaagggauuacccaagcaaa

SEQ ID NO: 2515255 - RNA, 21 nt, Human
uuaaaagggauuacccaagca

SEQ ID NO: 2515256 - RNA, 22 nt, Human
uuaaaaggauuuuuaucuuucg

SEQ ID NO: 2515257 - RNA, 20 nt, Human
uuaaaaggauuuuuaucuuu

SEQ ID NO: 2515258 - RNA, 17 nt, Human
uuaaaaggauuuuuauc

SEQ ID NO: 2515259 - RNA, 22 nt, Human
uuaaacucagggacagagccau

SEQ ID NO: 2515260 - RNA, 20 nt, Human
uuaaacucagggacagagcc

SEQ ID NO: 2515261 - RNA, 16 nt, Human
uuaaacucagggacag

SEQ ID NO: 2515262 - RNA, 22 nt, Human
uuaaacucuguugcaagugcaa

SEQ ID NO: 2515263 - RNA, 19 nt, Human
uuaaacucuucacaaaauc

SEQ ID NO: 2515264 - RNA, 15 nt, Human
uuaaaauagaaauaa

SEQ ID NO: 2515265 - RNA, 22 nt, Human
uuaaaauagcaacacucuauau

SEQ ID NO: 2515266 - RNA, 19 nt, Human
uuaaacugguauuuuaucu

SEQ ID NO: 2515267 - RNA, 13 nt, Human
uuaaacugguauu

SEQ ID NO: 2515268 - RNA, 22 nt, Human
uuaaacugguauuuuaucuuug

SEQ ID NO: 2515269 - RNA, 12 nt, Human
uuaaacugugua

SEQ ID NO: 2515270 - RNA, 19 nt, Human
uuaaacuguguacauaacu

SEQ ID NO: 2515271 - RNA, 21 nt, Human
uuaaacuguguggacugugau

SEQ ID NO: 2515272 - RNA, 11 nt, Human
uuaaagaaagu

SEQ ID NO: 2515273 - RNA, 20 nt, Human
uuaaacuguguggacuguga

SEQ ID NO: 2515274 - RNA, 21 nt, Human
uuaaaagaauauuuuaacuuc

SEQ ID NO: 2515275 - RNA, 22 nt, Human
uuaaaagaauauuuuaacuucc

SEQ ID NO: 2515276 - RNA, 14 nt, Human
uuaaaagauacagu

SEQ ID NO: 2515277 - RNA, 17 nt, Human
uuaaaagauacaguuac

SEQ ID NO: 2515278 - RNA, 16 nt, Human
uguuuuuuggucuuuu

SEQ ID NO: 2515279 - RNA, 18 nt, Human
uguuuuuuuuuaaagacu

SEQ ID NO: 2515280 - RNA, 22 nt, Human
uuaaaagaaaauaaaaaaaaga

SEQ ID NO: 2515281 - RNA, 23 nt, Human
uuaaaagaaaauaaaaaaaagaa

SEQ ID NO: 2515282 - RNA, 20 nt, Human
uuaaaagaaagccucagaga

SEQ ID NO: 2515283 - RNA, 19 nt, Human
uguuuuuuuuuuccacuua

SEQ ID NO: 2515284 - RNA, 18 nt, Human
uguuuuuuuuuuccacuu

SEQ ID NO: 2515285 - RNA, 17 nt, Human
uguuuuguuuggagaca

SEQ ID NO: 2515286 - RNA, 17 nt, Human
uguuuuguucuuuaaag

SEQ ID NO: 2515287 - RNA, 14 nt, Human
uguuuuuuggucuu

SEQ ID NO: 2515288 - RNA, 18 nt, Human
uguuuuaaggaugcuugu

SEQ ID NO: 2515289 - RNA, 22 nt, Human
uguuuuaagaggcagggucuca

SEQ ID NO: 2515290 - RNA, 16 nt, Human
uguuuuguucuguggu

SEQ ID NO: 2515291 - RNA, 12 nt, Human
uuaguagcaugu

SEQ ID NO: 2515292 - RNA, 13 nt, Human
uuaguagcauguu

SEQ ID NO: 2515293 - RNA, 17 nt, Human
uuaguagagacaggguu

SEQ ID NO: 2515294 - RNA, 19 nt, Human
uuaggcugguggcccagga

SEQ ID NO: 2515295 - RNA, 17 nt, Human
uuaggcugguggcccag

SEQ ID NO: 2515296 - RNA, 18 nt, Human
uuaggcugguggcccagg

SEQ ID NO: 2515297 - RNA, 16 nt, Human
uuaggcugguggccca

SEQ ID NO: 2515298 - RNA, 15 nt, Human
uuaggccuggcacag

SEQ ID NO: 2515299 - RNA, 14 nt, Human
uuaggccuggcaca

SEQ ID NO: 2515300 - RNA, 12 nt, Human
uuaggccuggca

SEQ ID NO: 2515301 - RNA, 18 nt, Human
uuaggccuggcacagugu

SEQ ID NO: 2515302 - RNA, 17 nt, Human
uuaggccuggcacagug

SEQ ID NO: 2515303 - RNA, 16 nt, Human
uuaggccuuccucucu

SEQ ID NO: 2515304 - RNA, 15 nt, Human
uuaggcuauucacaa

SEQ ID NO: 2515305 - RNA, 16 nt, Human
uuaggcuauucacaac

SEQ ID NO: 2515306 - RNA, 18 nt, Human
uuaggcagggauuugagg

SEQ ID NO: 2515307 - RNA, 12 nt, Human
uuaggcagggau

SEQ ID NO: 2515308 - RNA, 19 nt, Human
uuaggcagggauuugagga

SEQ ID NO: 2515309 - RNA, 22 nt, Human
uuaggccaaaaaaauguaagau

SEQ ID NO: 2515310 - RNA, 12 nt, Human
uuaggagaagcc

SEQ ID NO: 2515311 - RNA, 13 nt, Human
uuaggagaagcca

SEQ ID NO: 2515312 - RNA, 23 nt, Human
uuaggaauuaaguuaucuuuaaa

SEQ ID NO: 2515313 - RNA, 19 nt, Human
uuaggaauuaaguuaucuu

SEQ ID NO: 2515314 - RNA, 21 nt, Human
uuaggacaaucaguccccucc

SEQ ID NO: 2515315 - RNA, 16 nt, Human
uuaggagaagccagga

SEQ ID NO: 2515316 - RNA, 17 nt, Human
uuaggagaagccaggaa

SEQ ID NO: 2515317 - RNA, 23 nt, Human
uuaggagauuuuagguguugauu

SEQ ID NO: 2515318 - RNA, 15 nt, Human
uuaggaagagaaacc

SEQ ID NO: 2515319 - RNA, 13 nt, Human
uuaggaaguguaa

SEQ ID NO: 2515320 - RNA, 19 nt, Human
uuaggaaguguaacagcug

SEQ ID NO: 2515321 - RNA, 20 nt, Human
uuaggaaguguaacagcuga

SEQ ID NO: 2515322 - RNA, 21 nt, Human
uuaggaaguguaacagcugag

SEQ ID NO: 2515323 - RNA, 18 nt, Human
uuaggauguugaaaaagu

SEQ ID NO: 2515324 - RNA, 19 nt, Human
uuaggagggaguuaucuaa

SEQ ID NO: 2515325 - RNA, 21 nt, Human
uuaggaguucgagaccagccu

SEQ ID NO: 2515326 - RNA, 13 nt, Human
uuaggcagcagcu

SEQ ID NO: 2515327 - RNA, 23 nt, Human
uuaggcagcagcuuuuaauacag

SEQ ID NO: 2515328 - RNA, 14 nt, Human
uuaggcagggaagu

SEQ ID NO: 2515329 - RNA, 22 nt, Human
uuaggauuuaacagucauuuaa

SEQ ID NO: 2515330 - RNA, 15 nt, Human
uuaggcagauugaaa

SEQ ID NO: 2515331 - RNA, 21 nt, Human
uuaggauuuaacagucauuua

SEQ ID NO: 2515332 - RNA, 14 nt, Human
uuaggauuuaacag

SEQ ID NO: 2515333 - RNA, 16 nt, Human
uuaggaugugugcaug

SEQ ID NO: 2515334 - RNA, 16 nt, Human
uuaguaugaggcauuu

SEQ ID NO: 2515335 - RNA, 15 nt, Human
uuaguaucuaacaug

SEQ ID NO: 2515336 - RNA, 17 nt, Human
uuaguaucuaacaugua

SEQ ID NO: 2515337 - RNA, 18 nt, Human
uuaguaucuaacauguau

SEQ ID NO: 2515338 - RNA, 18 nt, Human
uuaguaugaggcauuugu

SEQ ID NO: 2515339 - RNA, 23 nt, Human
uuaguaucuaacauguaucccaa

SEQ ID NO: 2515340 - RNA, 24 nt, Human
uuagucgugagcucuugugaggaa

SEQ ID NO: 2515341 - RNA, 21 nt, Human
uuagucgugagcucuugugag

SEQ ID NO: 2515342 - RNA, 19 nt, Human
uuagucgugagcucuugug

SEQ ID NO: 2515343 - RNA, 16 nt, Human
uuagucgugagcucuu

SEQ ID NO: 2515344 - RNA, 13 nt, Human
uuaguccuugcuu

SEQ ID NO: 2515345 - RNA, 13 nt, Human
uuagucgugagcu

SEQ ID NO: 2515346 - RNA, 17 nt, Human
uuagucccucaugcaaa

SEQ ID NO: 2515347 - RNA, 22 nt, Human
uuaguauuuauuuaauguuaug

SEQ ID NO: 2515348 - RNA, 13 nt, Human
uuaguauuugcau

SEQ ID NO: 2515349 - RNA, 16 nt, Human
uuaguauuugcauauu

SEQ ID NO: 2515350 - RNA, 14 nt, Human
uuagucaugugacc

SEQ ID NO: 2515351 - RNA, 13 nt, Human
uuagucaugugac

SEQ ID NO: 2515352 - RNA, 13 nt, Human
uuagucacuuuuu

SEQ ID NO: 2515353 - RNA, 23 nt, Human
uuagucacugccugcagaggucu

SEQ ID NO: 2515354 - RNA, 22 nt, Human
uuagucacuuuuuuuuuccaaa

SEQ ID NO: 2515355 - RNA, 22 nt, Human
uuaguuauaguuucagauauau

SEQ ID NO: 2515356 - RNA, 18 nt, Human
uuaguuauaguuucagau

SEQ ID NO: 2515357 - RNA, 15 nt, Human
uuaguuauaguuuca

SEQ ID NO: 2515358 - RNA, 13 nt, Human
uuaguuauaguuu

SEQ ID NO: 2515359 - RNA, 16 nt, Human
uuaguuauagaugucu

SEQ ID NO: 2515360 - RNA, 13 nt, Human
uuaguuaauauau

SEQ ID NO: 2515361 - RNA, 18 nt, Human
uuaguguuucugugcaug

SEQ ID NO: 2515362 - RNA, 17 nt, Human
uuaguguuucugugcau

SEQ ID NO: 2515363 - RNA, 21 nt, Human
uuaguguuuggguauauucau

SEQ ID NO: 2515364 - RNA, 14 nt, Human
uuaguguucauaaa

SEQ ID NO: 2515365 - RNA, 16 nt, Human
uuaguguuucugugca

SEQ ID NO: 2515366 - RNA, 12 nt, Human
uuaguguuucug

SEQ ID NO: 2515367 - RNA, 23 nt, Human
uuagugucacuuaccuagauuua

SEQ ID NO: 2515368 - RNA, 22 nt, Human
uuagucuacucuuaagccaucu

SEQ ID NO: 2515369 - RNA, 21 nt, Human
uuagucuacucuuaagccauc

SEQ ID NO: 2515370 - RNA, 20 nt, Human
uuagucuacucuuaagccau

SEQ ID NO: 2515371 - RNA, 19 nt, Human
uuagucuacucuuaagcca

SEQ ID NO: 2515372 - RNA, 21 nt, Human
uuagucucaguuugugugucu

SEQ ID NO: 2515373 - RNA, 12 nt, Human
uuagucucaguu

SEQ ID NO: 2515374 - RNA, 23 nt, Human
uuagucucaguuugugugucuua

SEQ ID NO: 2515375 - RNA, 22 nt, Human
uuagucucaguuugugugucuu

SEQ ID NO: 2515376 - RNA, 22 nt, Human
uuagucucuuguauuaaacucu

SEQ ID NO: 2515377 - RNA, 18 nt, Human
uuagucucuaaagaguuu

SEQ ID NO: 2515378 - RNA, 22 nt, Human
uuagauaauacaccacuacauu

SEQ ID NO: 2515379 - RNA, 16 nt, Human
uuagaguuaacaauga

SEQ ID NO: 2515380 - RNA, 23 nt, Human
uuagaucaaauacuuuaaaggaa

SEQ ID NO: 2515381 - RNA, 17 nt, Human
uuagauauaacacuaug

SEQ ID NO: 2515382 - RNA, 14 nt, Human
uuagauauaacacu

SEQ ID NO: 2515383 - RNA, 13 nt, Human
uuagaucaaauac

SEQ ID NO: 2515384 - RNA, 21 nt, Human
uuagaugcaguucugaagaag

SEQ ID NO: 2515385 - RNA, 20 nt, Human
uuagaugcaguucugaagaa

SEQ ID NO: 2515386 - RNA, 21 nt, Human
uuagcuaaacggauuccaaag

SEQ ID NO: 2515387 - RNA, 16 nt, Human
uuagcuacuauauaug

SEQ ID NO: 2515388 - RNA, 12 nt, Human
uuagcuaaagga

SEQ ID NO: 2515389 - RNA, 21 nt, Human
uuagcguagcuaagugaaaag

SEQ ID NO: 2515390 - RNA, 18 nt, Human
uuagaguuagacuguugg

SEQ ID NO: 2515391 - RNA, 17 nt, Human
uuagaguuagacuguug

SEQ ID NO: 2515392 - RNA, 14 nt, Human
uuagaguuagacug

SEQ ID NO: 2515393 - RNA, 14 nt, Human
uuagaguugauacu

SEQ ID NO: 2515394 - RNA, 13 nt, Human
uuagaguuagacu

SEQ ID NO: 2515395 - RNA, 12 nt, Human
uuagaguuagac

SEQ ID NO: 2515396 - RNA, 16 nt, Human
uuagagugucuuucca

SEQ ID NO: 2515397 - RNA, 17 nt, Human
uuagagugucuuuccac

SEQ ID NO: 2515398 - RNA, 21 nt, Human
uuagagguuuuaaagugauua

SEQ ID NO: 2515399 - RNA, 19 nt, Human
uuagagguuuuaaagugau

SEQ ID NO: 2515400 - RNA, 13 nt, Human
uuagagguuuuaa

SEQ ID NO: 2515401 - RNA, 20 nt, Human
uuagagguuuuaaagugauu

SEQ ID NO: 2515402 - RNA, 14 nt, Human
uuagagucagccuu

SEQ ID NO: 2515403 - RNA, 21 nt, Human
uuagagcugacacaaaccugc

SEQ ID NO: 2515404 - RNA, 13 nt, Human
uuagagccucccu

SEQ ID NO: 2515405 - RNA, 22 nt, Human
uuagagccaggcacacacugug

SEQ ID NO: 2515406 - RNA, 14 nt, Human
uuagagccucccuc

SEQ ID NO: 2515407 - RNA, 17 nt, Human
uuagaggaaaaaaauga

SEQ ID NO: 2515408 - RNA, 18 nt, Human
uuagaggaaaaaaaugac

SEQ ID NO: 2515409 - RNA, 23 nt, Human
uuagaggaaauaagaaaaaucau

SEQ ID NO: 2515410 - RNA, 22 nt, Human
uuagaggaaauaagaaaaauca

SEQ ID NO: 2515411 - RNA, 20 nt, Human
uuagaggaaauaagaaaaau

SEQ ID NO: 2515412 - RNA, 19 nt, Human
uuagaggaaaaaaaugacu

SEQ ID NO: 2515413 - RNA, 18 nt, Human
uuagagggaggagaauga

SEQ ID NO: 2515414 - RNA, 18 nt, Human
uuagagggagguguuuaa

SEQ ID NO: 2515415 - RNA, 12 nt, Human
uuagaggccagc

SEQ ID NO: 2515416 - RNA, 21 nt, Human
uuagagccaggcacacacugu

SEQ ID NO: 2515417 - RNA, 16 nt, Human
uuagagccaggcacac

SEQ ID NO: 2515418 - RNA, 15 nt, Human
uuagagcauugccau

SEQ ID NO: 2515419 - RNA, 20 nt, Human
uuagagcaguuucuguccug

SEQ ID NO: 2515420 - RNA, 13 nt, Human
uuagagaugaauu

SEQ ID NO: 2515421 - RNA, 21 nt, Human
uuagagcagaugaccccuccc

SEQ ID NO: 2515422 - RNA, 16 nt, Human
uuagcugugugaaaua

SEQ ID NO: 2515423 - RNA, 16 nt, Human
uuagcuguuauuucua

SEQ ID NO: 2515424 - RNA, 17 nt, Human
uuagcuguuauuucuau

SEQ ID NO: 2515425 - RNA, 19 nt, Human
uuagcuguuauuucuauuu

SEQ ID NO: 2515426 - RNA, 21 nt, Human
uuagcuguuauuucuauuuuu

SEQ ID NO: 2515427 - RNA, 16 nt, Human
uuagcuuagaccucag

SEQ ID NO: 2515428 - RNA, 17 nt, Human
uuagcuuagaccucagc

SEQ ID NO: 2515429 - RNA, 18 nt, Human
uuagcuuagaccucagcc

SEQ ID NO: 2515430 - RNA, 21 nt, Human
uuagcuuagaccucagccugu

SEQ ID NO: 2515431 - RNA, 15 nt, Human
uuagcuuugcucugc

SEQ ID NO: 2515432 - RNA, 17 nt, Human
uuagcuuuacuguuugu

SEQ ID NO: 2515433 - RNA, 15 nt, Human
uuagcuuuacuguuu

SEQ ID NO: 2515434 - RNA, 16 nt, Human
uuagcuuuacuguuug

SEQ ID NO: 2515435 - RNA, 21 nt, Human
uuagcuugaaggaucuguuuu

SEQ ID NO: 2515436 - RNA, 17 nt, Human
uuagcuuuuuaauuguu

SEQ ID NO: 2515437 - RNA, 16 nt, Human
uuagcuuuuuaauugu

SEQ ID NO: 2515438 - RNA, 19 nt, Human
uuagcuuugcucugccaac

SEQ ID NO: 2515439 - RNA, 18 nt, Human
uuagcuuuuuaauuguug

SEQ ID NO: 2515440 - RNA, 11 nt, Human
uuaggaaauaa

SEQ ID NO: 2515441 - RNA, 12 nt, Human
uuaggaaauaaa

SEQ ID NO: 2515442 - RNA, 17 nt, Human
uuaggaaaugaaugugu

SEQ ID NO: 2515443 - RNA, 15 nt, Human
uuaggaaaugaaugu

SEQ ID NO: 2515444 - RNA, 19 nt, Human
uuaggaaaugaaugugugu

SEQ ID NO: 2515445 - RNA, 20 nt, Human
uuaggaaauaaaaccuuuca

SEQ ID NO: 2515446 - RNA, 21 nt, Human
uuaggaaauaaaaccuuucaa

SEQ ID NO: 2515447 - RNA, 15 nt, Human
uuaggaaauaaaacc

SEQ ID NO: 2515448 - RNA, 17 nt, Human
uuaggaaauaaaaccuu

SEQ ID NO: 2515449 - RNA, 18 nt, Human
uuaggaaauaaaaccuuu

SEQ ID NO: 2515450 - RNA, 19 nt, Human
uuaggaaauaaaaccuuuc

SEQ ID NO: 2515451 - RNA, 13 nt, Human
uuagcuccugugg

SEQ ID NO: 2515452 - RNA, 20 nt, Human
uuagcucccuguucuugggu

SEQ ID NO: 2515453 - RNA, 18 nt, Human
uuagcuccccuccaaccu

SEQ ID NO: 2515454 - RNA, 14 nt, Human
uuagcuccccucca

SEQ ID NO: 2515455 - RNA, 13 nt, Human
uuagcuccccucc

SEQ ID NO: 2515456 - RNA, 22 nt, Human
uuagcucuuaauuguucauuuu

SEQ ID NO: 2515457 - RNA, 12 nt, Human
uuagcucuuaau

SEQ ID NO: 2515458 - RNA, 19 nt, Human
uuagcucuggaccagccug

SEQ ID NO: 2515459 - RNA, 14 nt, Human
uuagcuccuguggc

SEQ ID NO: 2515460 - RNA, 23 nt, Human
uuagcucuuaauuguucauuuug

SEQ ID NO: 2515461 - RNA, 10 nt, Human
uuagcugagc

SEQ ID NO: 2515462 - RNA, 23 nt, Human
uuagcugaugaacuuauucugua

SEQ ID NO: 2515463 - RNA, 13 nt, Human
uuagcugcagaac

SEQ ID NO: 2515464 - RNA, 13 nt, Human
uuagcuggaaaag

SEQ ID NO: 2515465 - RNA, 12 nt, Human
uuagcuggaaaa

SEQ ID NO: 2515466 - RNA, 17 nt, Human
uuagcugucugcucaga

SEQ ID NO: 2515467 - RNA, 15 nt, Human
uuagcugugugaaau

SEQ ID NO: 2515468 - RNA, 15 nt, Human
uuagcugucugcuca

SEQ ID NO: 2515469 - RNA, 12 nt, Human
uuagcugggaga

SEQ ID NO: 2515470 - RNA, 16 nt, Human
uuagcuggcauuacag

SEQ ID NO: 2515471 - RNA, 20 nt, Human
uuacuaagccacaagaaauu

SEQ ID NO: 2515472 - RNA, 18 nt, Human
uuacuaagccacaagaaa

SEQ ID NO: 2515473 - RNA, 17 nt, Human
uuacuaagccacaagaa

SEQ ID NO: 2515474 - RNA, 21 nt, Human
uuacuaagcauagcaaacaga

SEQ ID NO: 2515475 - RNA, 23 nt, Human
uuacuaagaugacauugcuaaga

SEQ ID NO: 2515476 - RNA, 22 nt, Human
uuacuaagaugacauugcuaag

SEQ ID NO: 2515477 - RNA, 21 nt, Human
uuacuaagaugacauugcuaa

SEQ ID NO: 2515478 - RNA, 22 nt, Human
uuacuaagaagaaaauugcugu

SEQ ID NO: 2515479 - RNA, 13 nt, Human
uuacuaaguuuuu

SEQ ID NO: 2515480 - RNA, 14 nt, Human
uuacuaaguuuuua

SEQ ID NO: 2515481 - RNA, 16 nt, Human
uuacuaauagacaauu

SEQ ID NO: 2515482 - RNA, 20 nt, Human
uuacuaacuaaacucucuuu

SEQ ID NO: 2515483 - RNA, 15 nt, Human
uuacuaacuaaacuc

SEQ ID NO: 2515484 - RNA, 22 nt, Human
uuacuaaagaaagauuacuuag

SEQ ID NO: 2515485 - RNA, 18 nt, Human
uuacuaaagaaagauuac

SEQ ID NO: 2515486 - RNA, 15 nt, Human
uuacuaaagaaagau

SEQ ID NO: 2515487 - RNA, 23 nt, Human
uuacuaaagaaaauaucugaaau

SEQ ID NO: 2515488 - RNA, 21 nt, Human
uuacacaaaacaaaugccaca

SEQ ID NO: 2515489 - RNA, 22 nt, Human
uuacuaaagaaaauaucugaaa

SEQ ID NO: 2515490 - RNA, 15 nt, Human
uuacuaagaagaaaa

SEQ ID NO: 2515491 - RNA, 13 nt, Human
uuacuaagaagaa

SEQ ID NO: 2515492 - RNA, 15 nt, Human
uuacaauuuuuuauc

SEQ ID NO: 2515493 - RNA, 17 nt, Human
uuacaauuuuuuaucau

SEQ ID NO: 2515494 - RNA, 18 nt, Human
uuacaauuuuuuaucaug

SEQ ID NO: 2515495 - RNA, 20 nt, Human
uuacaauuuuuuaucaugca

SEQ ID NO: 2515496 - RNA, 23 nt, Human
uuacaauuuuuuuaauuuuguau

SEQ ID NO: 2515497 - RNA, 22 nt, Human
uuacaauuuuuuuaauuuugua

SEQ ID NO: 2515498 - RNA, 21 nt, Human
uuacaauuuuuuuaauuuugu

SEQ ID NO: 2515499 - RNA, 18 nt, Human
uuacacaaaacaaaugcc

SEQ ID NO: 2515500 - RNA, 16 nt, Human
uuacacaaaacaaaug

SEQ ID NO: 2515501 - RNA, 14 nt, Human
uuacuagguaacuu

SEQ ID NO: 2515502 - RNA, 16 nt, Human
uuacuagguaacuuca

SEQ ID NO: 2515503 - RNA, 17 nt, Human
uuacuagguaacuucau

SEQ ID NO: 2515504 - RNA, 19 nt, Human
uuacuagguaacuucauau

SEQ ID NO: 2515505 - RNA, 21 nt, Human
uuacuaggugcccagaaugag

SEQ ID NO: 2515506 - RNA, 17 nt, Human
uuacuaguuucccuugc

SEQ ID NO: 2515507 - RNA, 19 nt, Human
uuacuaucaugucaaacgu

SEQ ID NO: 2515508 - RNA, 21 nt, Human
uuacuaucaugucaaacguga

SEQ ID NO: 2515509 - RNA, 13 nt, Human
uuacuaugccugu

SEQ ID NO: 2515510 - RNA, 16 nt, Human
uuacuaugcacaauuu

SEQ ID NO: 2515511 - RNA, 22 nt, Human
uuacuaagcuuugccagcugcu

SEQ ID NO: 2515512 - RNA, 14 nt, Human
uuacuaagcuuugc

SEQ ID NO: 2515513 - RNA, 22 nt, Human
uuacuaagccacaagaaauuug

SEQ ID NO: 2515514 - RNA, 21 nt, Human
uuacuaagccacaagaaauuu

SEQ ID NO: 2515515 - RNA, 14 nt, Human
uuacuacaaaauuu

SEQ ID NO: 2515516 - RNA, 20 nt, Human
uuacuacaaaauuugaaauu

SEQ ID NO: 2515517 - RNA, 13 nt, Human
uuacuacaugcac

SEQ ID NO: 2515518 - RNA, 14 nt, Human
uuacuacaugcacu

SEQ ID NO: 2515519 - RNA, 15 nt, Human
uuacuacaguuguuu

SEQ ID NO: 2515520 - RNA, 20 nt, Human
uuacuagaacacagaaagcc

SEQ ID NO: 2515521 - RNA, 16 nt, Human
uuacuagggaucccuc

SEQ ID NO: 2515522 - RNA, 20 nt, Human
uuacuagggaucccucaucu

SEQ ID NO: 2515523 - RNA, 23 nt, Human
uuacuagggaucccucaucuguc

SEQ ID NO: 2515524 - RNA, 13 nt, Human
uuacuagaacaca

SEQ ID NO: 2515525 - RNA, 13 nt, Human
uuacuacugugga

SEQ ID NO: 2515526 - RNA, 13 nt, Human
uuacuacaguugu

SEQ ID NO: 2515527 - RNA, 18 nt, Human
uuacuacaugugggagcu

SEQ ID NO: 2515528 - RNA, 18 nt, Human
uuacuuagguguggggga

SEQ ID NO: 2515529 - RNA, 17 nt, Human
uuacuuaucauccacau

SEQ ID NO: 2515530 - RNA, 23 nt, Human
uuacuuaucauccacauuguuuu

SEQ ID NO: 2515531 - RNA, 22 nt, Human
uuacuuaaagauuuaucaaauc

SEQ ID NO: 2515532 - RNA, 13 nt, Human
uuacuuaccuaaa

SEQ ID NO: 2515533 - RNA, 20 nt, Human
uuacuuagaggaaauaagaa

SEQ ID NO: 2515534 - RNA, 15 nt, Human
uuacuuagaggaaau

SEQ ID NO: 2515535 - RNA, 20 nt, Human
uuacuuaaagauuuaucaaa

SEQ ID NO: 2515536 - RNA, 19 nt, Human
uuacuuaaagauuuaucaa

SEQ ID NO: 2515537 - RNA, 14 nt, Human
uuacuuaaagauuu

SEQ ID NO: 2515538 - RNA, 13 nt, Human
uuacuuaaagauu

SEQ ID NO: 2515539 - RNA, 22 nt, Human
uuacuguuugucuucuccccag

SEQ ID NO: 2515540 - RNA, 21 nt, Human
uuacuguuugucuucucccca

SEQ ID NO: 2515541 - RNA, 15 nt, Human
uuacuguuuguuaug

SEQ ID NO: 2515542 - RNA, 12 nt, Human
uuacuucugcua

SEQ ID NO: 2515543 - RNA, 23 nt, Human
uuacuucuuauacauuugauaaa

SEQ ID NO: 2515544 - RNA, 11 nt, Human
uuacuucugcu

SEQ ID NO: 2515545 - RNA, 19 nt, Human
uuacuucacuuuaauucuc

SEQ ID NO: 2515546 - RNA, 16 nt, Human
uuacuuaucuuaugcc

SEQ ID NO: 2515547 - RNA, 22 nt, Human
uuacuucguguccgacucuucu

SEQ ID NO: 2515548 - RNA, 15 nt, Human
uuacuuccuaucaag

SEQ ID NO: 2515549 - RNA, 19 nt, Human
uuacugucuuuuuucuaaa

SEQ ID NO: 2515550 - RNA, 14 nt, Human
uuacuaugccugug

SEQ ID NO: 2515551 - RNA, 18 nt, Human
uuacuaugccugugucuu

SEQ ID NO: 2515552 - RNA, 19 nt, Human
uuacuauggcccuggccua

SEQ ID NO: 2515553 - RNA, 20 nt, Human
uuacuguggaggaaggauug

SEQ ID NO: 2515554 - RNA, 18 nt, Human
uuacuguggaggaaggau

SEQ ID NO: 2515555 - RNA, 17 nt, Human
uuacuguggaggaagga

SEQ ID NO: 2515556 - RNA, 16 nt, Human
uuacuguggaggaagg

SEQ ID NO: 2515557 - RNA, 16 nt, Human
uuacuguggcuucuua

SEQ ID NO: 2515558 - RNA, 14 nt, Human
uuacuguggaggaa

SEQ ID NO: 2515559 - RNA, 14 nt, Human
uuacugugaaacug

SEQ ID NO: 2515560 - RNA, 17 nt, Human
uuacugucuuuuuucua

SEQ ID NO: 2515561 - RNA, 16 nt, Human
uuacuguuucugucag

SEQ ID NO: 2515562 - RNA, 15 nt, Human
uuacuguuucuguca

SEQ ID NO: 2515563 - RNA, 14 nt, Human
uuacuguuucuguc

SEQ ID NO: 2515564 - RNA, 15 nt, Human
uuacuguugugaccu

SEQ ID NO: 2515565 - RNA, 14 nt, Human
uuacuguugugacc

SEQ ID NO: 2515566 - RNA, 21 nt, Human
uuacuuaaaccgccaaggcug

SEQ ID NO: 2515567 - RNA, 23 nt, Human
uuacuguuaccugaucaaugaca

SEQ ID NO: 2515568 - RNA, 18 nt, Human
uuacuguuagucauuugc

SEQ ID NO: 2515569 - RNA, 23 nt, Human
uuacuguggaggaaggauuguaa

SEQ ID NO: 2515570 - RNA, 13 nt, Human
uuagacauaacaa

SEQ ID NO: 2515571 - RNA, 19 nt, Human
uuagaaaauguuauuuaac

SEQ ID NO: 2515572 - RNA, 14 nt, Human
uuagacagucccug

SEQ ID NO: 2515573 - RNA, 18 nt, Human
uuagacagucccugccaa

SEQ ID NO: 2515574 - RNA, 17 nt, Human
uuagacagucccugcca

SEQ ID NO: 2515575 - RNA, 16 nt, Human
uuagacagucccugcc

SEQ ID NO: 2515576 - RNA, 13 nt, Human
uuagacccugggu

SEQ ID NO: 2515577 - RNA, 15 nt, Human
uuagaccacaaauag

SEQ ID NO: 2515578 - RNA, 18 nt, Human
uuagacuaaggccauuau

SEQ ID NO: 2515579 - RNA, 16 nt, Human
uuagaccucagccugu

SEQ ID NO: 2515580 - RNA, 14 nt, Human
uuagaccucagccu

SEQ ID NO: 2515581 - RNA, 15 nt, Human
uuagaccucagccug

SEQ ID NO: 2515582 - RNA, 11 nt, Human
uuagaccucag

SEQ ID NO: 2515583 - RNA, 12 nt, Human
uuagaccucagc

SEQ ID NO: 2515584 - RNA, 13 nt, Human
uuagaccucagcc

SEQ ID NO: 2515585 - RNA, 23 nt, Human
uuagacuguaggaagaguagcau

SEQ ID NO: 2515586 - RNA, 20 nt, Human
uuagacuguagccuggauau

SEQ ID NO: 2515587 - RNA, 14 nt, Human
uuagacuguagccu

SEQ ID NO: 2515588 - RNA, 20 nt, Human
uuagacuguuggggugggua

SEQ ID NO: 2515589 - RNA, 21 nt, Human
uuagacuucgacucaggaucc

SEQ ID NO: 2515590 - RNA, 13 nt, Human
uuagacuccuccu

SEQ ID NO: 2515591 - RNA, 18 nt, Human
uuagacuacauuuagaga

SEQ ID NO: 2515592 - RNA, 14 nt, Human
uuagacuacauuua

SEQ ID NO: 2515593 - RNA, 19 nt, Human
uuagacucaucuuacugua

SEQ ID NO: 2515594 - RNA, 17 nt, Human
uuagacuugaaauacua

SEQ ID NO: 2515595 - RNA, 21 nt, Human
uuagagaaguauacauaaguu

SEQ ID NO: 2515596 - RNA, 23 nt, Human
uuagagacaguugggugagaaca

SEQ ID NO: 2515597 - RNA, 16 nt, Human
uuacuuuauguuacua

SEQ ID NO: 2515598 - RNA, 20 nt, Human
uuacuuuaccacccccacac

SEQ ID NO: 2515599 - RNA, 15 nt, Human
uuacuuuaccacccc

SEQ ID NO: 2515600 - RNA, 21 nt, Human
uuacuuuccuuuccccagccc

SEQ ID NO: 2515601 - RNA, 18 nt, Human
uuacuuucuguugccaca

SEQ ID NO: 2515602 - RNA, 11 nt, Human
uuacuuucugu

SEQ ID NO: 2515603 - RNA, 14 nt, Human
uuacuugaccuccu

SEQ ID NO: 2515604 - RNA, 19 nt, Human
uuacuugcauugaauauau

SEQ ID NO: 2515605 - RNA, 18 nt, Human
uuacuuuaaaaggagcca

SEQ ID NO: 2515606 - RNA, 17 nt, Human
uuacuuuaaaaggagcc

SEQ ID NO: 2515607 - RNA, 19 nt, Human
uuagaaacacaacuauauu

SEQ ID NO: 2515608 - RNA, 15 nt, Human
uuagacagucccugc

SEQ ID NO: 2515609 - RNA, 21 nt, Human
uuagaaaacauaaucuucugc

SEQ ID NO: 2515610 - RNA, 20 nt, Human
uuagaaaagcaaagggugcu

SEQ ID NO: 2515611 - RNA, 13 nt, Human
uuacuuugugaau

SEQ ID NO: 2515612 - RNA, 17 nt, Human
uuacuuuuaaacaguga

SEQ ID NO: 2515613 - RNA, 14 nt, Human
uuacuuuuaaacug

SEQ ID NO: 2515614 - RNA, 15 nt, Human
uuacuuuuaaacugu

SEQ ID NO: 2515615 - RNA, 14 nt, Human
uuacuuuguguuca

SEQ ID NO: 2515616 - RNA, 16 nt, Human
uuacuuuuaaacugug

SEQ ID NO: 2515617 - RNA, 19 nt, Human
uuacuuuuaaacuguguac

SEQ ID NO: 2515618 - RNA, 23 nt, Human
uuacuuuuauaauaaaaggaaaa

SEQ ID NO: 2515619 - RNA, 15 nt, Human
uuacuuuuaaauguc

SEQ ID NO: 2515620 - RNA, 14 nt, Human
uuacuuuuuaaaau

SEQ ID NO: 2515621 - RNA, 22 nt, Human
uuacuuuuauaauaaaaggaaa

SEQ ID NO: 2515622 - RNA, 22 nt, Human
uuccuucuuugauaauguuaaa

SEQ ID NO: 2515623 - RNA, 19 nt, Human
uuccuucuuugauaauguu

SEQ ID NO: 2515624 - RNA, 14 nt, Human
uuccuucuuugaua

SEQ ID NO: 2515625 - RNA, 13 nt, Human
uuccuucuuugau

SEQ ID NO: 2515626 - RNA, 14 nt, Human
uuccuugaagccga

SEQ ID NO: 2515627 - RNA, 13 nt, Human
uuccuugaagccg

SEQ ID NO: 2515628 - RNA, 12 nt, Human
uuccuucuuuga

SEQ ID NO: 2515629 - RNA, 17 nt, Human
uuccuucuugccuucag

SEQ ID NO: 2515630 - RNA, 18 nt, Human
uuccuggcaauagugugu

SEQ ID NO: 2515631 - RNA, 20 nt, Human
uuccuggcaauaguguguuc

SEQ ID NO: 2515632 - RNA, 22 nt, Human
uuccuggcaauaguguguucug

SEQ ID NO: 2515633 - RNA, 23 nt, Human
uuccuggcaauaguguguucuga

SEQ ID NO: 2515634 - RNA, 20 nt, Human
uuccuugaguugauucagcu

SEQ ID NO: 2515635 - RNA, 22 nt, Human
uuccuugagacacggagcccag

SEQ ID NO: 2515636 - RNA, 17 nt, Human
uuccuugagaaaaacaa

SEQ ID NO: 2515637 - RNA, 13 nt, Human
uuccuugaccagc

SEQ ID NO: 2515638 - RNA, 15 nt, Human
uuccuugaccagcag

SEQ ID NO: 2515639 - RNA, 19 nt, Human
uuccuggacacucagaccu

SEQ ID NO: 2515640 - RNA, 16 nt, Human
uuccugccccaggccu

SEQ ID NO: 2515641 - RNA, 13 nt, Human
uuccugccccagg

SEQ ID NO: 2515642 - RNA, 20 nt, Human
uuccuggacauccucuucug

SEQ ID NO: 2515643 - RNA, 12 nt, Human
uuccuggacauc

SEQ ID NO: 2515644 - RNA, 14 nt, Human
uuccuggcacugcu

SEQ ID NO: 2515645 - RNA, 16 nt, Human
uuccuggagcccagag

SEQ ID NO: 2515646 - RNA, 15 nt, Human
uuccuggagcccaga

SEQ ID NO: 2515647 - RNA, 15 nt, Human
uuccuggcaauagug

SEQ ID NO: 2515648 - RNA, 24 nt, Human
uuccuggacauccucuucugcuua

SEQ ID NO: 2515649 - RNA, 17 nt, Human
uuccugccaggcauggu

SEQ ID NO: 2515650 - RNA, 17 nt, Human
uuccugccaccagucac

SEQ ID NO: 2515651 - RNA, 15 nt, Human
uuccugccaccaguc

SEQ ID NO: 2515652 - RNA, 18 nt, Human
uuccugccaccagucacu

SEQ ID NO: 2515653 - RNA, 12 nt, Human
uuccugccacca

SEQ ID NO: 2515654 - RNA, 14 nt, Human
uuccuccccagcag

SEQ ID NO: 2515655 - RNA, 18 nt, Human
uuccugcauuugugaaau

SEQ ID NO: 2515656 - RNA, 16 nt, Human
uuccugcauuugugaa

SEQ ID NO: 2515657 - RNA, 15 nt, Human
uuccugcauuuguga

SEQ ID NO: 2515658 - RNA, 19 nt, Human
uuccugaugcuucuucaga

SEQ ID NO: 2515659 - RNA, 18 nt, Human
uuccugaugcuucuucag

SEQ ID NO: 2515660 - RNA, 15 nt, Human
uuccugaugcuucuu

SEQ ID NO: 2515661 - RNA, 11 nt, Human
uuccuccccag

SEQ ID NO: 2515662 - RNA, 12 nt, Human
uuccuccccagc

SEQ ID NO: 2515663 - RNA, 13 nt, Human
uuccuccccagca

SEQ ID NO: 2515664 - RNA, 21 nt, Human
uuccuccccauuagagucagc

SEQ ID NO: 2515665 - RNA, 23 nt, Human
uuccuccccauuagagucagccu

SEQ ID NO: 2515666 - RNA, 20 nt, Human
uuccugauaugauuuaaaac

SEQ ID NO: 2515667 - RNA, 22 nt, Human
uucuaaaacuaaauagcaugua

SEQ ID NO: 2515668 - RNA, 19 nt, Human
uucuaaaacuaaauagcau

SEQ ID NO: 2515669 - RNA, 18 nt, Human
uucuaaaacuaaauagca

SEQ ID NO: 2515670 - RNA, 18 nt, Human
uucuaaaaauugugauca

SEQ ID NO: 2515671 - RNA, 14 nt, Human
uucuaaaaaaagaa

SEQ ID NO: 2515672 - RNA, 13 nt, Human
uucuaaaaaacag

SEQ ID NO: 2515673 - RNA, 15 nt, Human
uucguuuauuuucaa

SEQ ID NO: 2515674 - RNA, 13 nt, Human
uucguucuguuua

SEQ ID NO: 2515675 - RNA, 16 nt, Human
uucguuucuguauaca

SEQ ID NO: 2515676 - RNA, 14 nt, Human
uucguuucuguaua

SEQ ID NO: 2515677 - RNA, 17 nt, Human
uucguuuguuuguuuca

SEQ ID NO: 2515678 - RNA, 14 nt, Human
uucgggcugugccc

SEQ ID NO: 2515679 - RNA, 12 nt, Human
uucguucugugg

SEQ ID NO: 2515680 - RNA, 17 nt, Human
uucuaaagcugccagcc

SEQ ID NO: 2515681 - RNA, 13 nt, Human
uucuaaagcugcc

SEQ ID NO: 2515682 - RNA, 18 nt, Human
uucuaaagccuuaagucu

SEQ ID NO: 2515683 - RNA, 13 nt, Human
uucuaaagaugga

SEQ ID NO: 2515684 - RNA, 15 nt, Human
uucuaaagauggaaa

SEQ ID NO: 2515685 - RNA, 20 nt, Human
uuccuuggacucauuuuaaa

SEQ ID NO: 2515686 - RNA, 24 nt, Human
uuccuugagacacggagcccagcc

SEQ ID NO: 2515687 - RNA, 17 nt, Human
uuccuuggacucauuuu

SEQ ID NO: 2515688 - RNA, 13 nt, Human
uuccuuggcuggu

SEQ ID NO: 2515689 - RNA, 23 nt, Human
uuccuuggcucccauucacucuu

SEQ ID NO: 2515690 - RNA, 21 nt, Human
uuccuuggcucccauucacuc

SEQ ID NO: 2515691 - RNA, 15 nt, Human
uuccuuggcucccau

SEQ ID NO: 2515692 - RNA, 23 nt, Human
uuccuuggauaggcuuuuuagua

SEQ ID NO: 2515693 - RNA, 18 nt, Human
uuccuuggcaugccuucc

SEQ ID NO: 2515694 - RNA, 21 nt, Human
uuccuuggcaugccuuccagc

SEQ ID NO: 2515695 - RNA, 14 nt, Human
uuccuuggggcagg

SEQ ID NO: 2515696 - RNA, 15 nt, Human
uuccuuggcuggugc

SEQ ID NO: 2515697 - RNA, 15 nt, Human
uuccuuggggcaggc

SEQ ID NO: 2515698 - RNA, 18 nt, Human
uuccuuggggcaggcagu

SEQ ID NO: 2515699 - RNA, 17 nt, Human
uuccuuggggcaggcag

SEQ ID NO: 2515700 - RNA, 20 nt, Human
uucgggaggucgaggcagga

SEQ ID NO: 2515701 - RNA, 13 nt, Human
uucggcugucuca

SEQ ID NO: 2515702 - RNA, 12 nt, Human
uucgggcugugc

SEQ ID NO: 2515703 - RNA, 13 nt, Human
uucgggcugugcc

SEQ ID NO: 2515704 - RNA, 22 nt, Human
uucgggaagagaggaguucaau

SEQ ID NO: 2515705 - RNA, 14 nt, Human
uucgggaagagagg

SEQ ID NO: 2515706 - RNA, 23 nt, Human
uucgggaagagaggaguucaaug

SEQ ID NO: 2515707 - RNA, 14 nt, Human
uucgggcccugccu

SEQ ID NO: 2515708 - RNA, 15 nt, Human
uucccuccugcuacu

SEQ ID NO: 2515709 - RNA, 15 nt, Human
uucccucucucugac

SEQ ID NO: 2515710 - RNA, 14 nt, Human
uucccucucucuga

SEQ ID NO: 2515711 - RNA, 14 nt, Human
uucccucucccugu

SEQ ID NO: 2515712 - RNA, 23 nt, Human
uucccucugagaauuccaaggag

SEQ ID NO: 2515713 - RNA, 22 nt, Human
uucccucugagaauuccaagga

SEQ ID NO: 2515714 - RNA, 11 nt, Human
uucccucugag

SEQ ID NO: 2515715 - RNA, 13 nt, Human
uucccucugccug

SEQ ID NO: 2515716 - RNA, 14 nt, Human
uucccucugccugu

SEQ ID NO: 2515717 - RNA, 17 nt, Human
uucccucugccuguccc

SEQ ID NO: 2515718 - RNA, 18 nt, Human
uucccucugccugucccu

SEQ ID NO: 2515719 - RNA, 13 nt, Human
uucccugacucau

SEQ ID NO: 2515720 - RNA, 16 nt, Human
uucccugacucauucu

SEQ ID NO: 2515721 - RNA, 12 nt, Human
uucccugaggug

SEQ ID NO: 2515722 - RNA, 16 nt, Human
uucccugaaggaacca

SEQ ID NO: 2515723 - RNA, 20 nt, Human
uucccugaaaacccagagag

SEQ ID NO: 2515724 - RNA, 15 nt, Human
uucccugaauguauu

SEQ ID NO: 2515725 - RNA, 16 nt, Human
uucccucuuuggcucc

SEQ ID NO: 2515726 - RNA, 14 nt, Human
uucccucuuuggcu

SEQ ID NO: 2515727 - RNA, 19 nt, Human
uucccucugcuccuggagc

SEQ ID NO: 2515728 - RNA, 15 nt, Human
uucccucugcuccug

SEQ ID NO: 2515729 - RNA, 21 nt, Human
uucccucugccugucccucuc

SEQ ID NO: 2515730 - RNA, 20 nt, Human
uucccucuuuggcuccccug

SEQ ID NO: 2515731 - RNA, 17 nt, Human
uucccugaaaacccaga

SEQ ID NO: 2515732 - RNA, 19 nt, Human
uucccugaaaacccagaga

SEQ ID NO: 2515733 - RNA, 13 nt, Human
uucccugcuucca

SEQ ID NO: 2515734 - RNA, 22 nt, Human
uucccugcugucgucuuagcaa

SEQ ID NO: 2515735 - RNA, 12 nt, Human
uucccugccugg

SEQ ID NO: 2515736 - RNA, 19 nt, Human
uucccugcauuucugaguu

SEQ ID NO: 2515737 - RNA, 15 nt, Human
uucccugcuuccagg

SEQ ID NO: 2515738 - RNA, 14 nt, Human
uucccugcuuccag

SEQ ID NO: 2515739 - RNA, 12 nt, Human
uucccuggccuu

SEQ ID NO: 2515740 - RNA, 18 nt, Human
uucccugacuccucuaag

SEQ ID NO: 2515741 - RNA, 17 nt, Human
uucccugacacugcggg

SEQ ID NO: 2515742 - RNA, 16 nt, Human
uucccugagucaccag

SEQ ID NO: 2515743 - RNA, 18 nt, Human
uucccugagucaccagga

SEQ ID NO: 2515744 - RNA, 19 nt, Human
uucccugagucaccaggaa

SEQ ID NO: 2515745 - RNA, 10 nt, Human
uucccugcaa

SEQ ID NO: 2515746 - RNA, 14 nt, Human
uucccugccucuca

SEQ ID NO: 2515747 - RNA, 23 nt, Human
uucccugccucucaucaacugaa

SEQ ID NO: 2515748 - RNA, 17 nt, Human
uucccugcuuaaugaaa

SEQ ID NO: 2515749 - RNA, 20 nt, Human
uucccugggcugugcuaccu

SEQ ID NO: 2515750 - RNA, 17 nt, Human
uucccugggcugugcua

SEQ ID NO: 2515751 - RNA, 16 nt, Human
uucccugcuuccagga

SEQ ID NO: 2515752 - RNA, 17 nt, Human
uucccuggccuuucaua

SEQ ID NO: 2515753 - RNA, 16 nt, Human
uucccuggccuuucau

SEQ ID NO: 2515754 - RNA, 23 nt, Human
uucccuggcuuguaacuccacca

SEQ ID NO: 2515755 - RNA, 17 nt, Human
uucccuugaugaagaag

SEQ ID NO: 2515756 - RNA, 22 nt, Human
uucccuucuugguuuccaaagg

SEQ ID NO: 2515757 - RNA, 22 nt, Human
uucccuucuccaucucucuggc

SEQ ID NO: 2515758 - RNA, 20 nt, Human
uucccuucuccaucucucug

SEQ ID NO: 2515759 - RNA, 12 nt, Human
uucccuucucca

SEQ ID NO: 2515760 - RNA, 12 nt, Human
uuccuauaugca

SEQ ID NO: 2515761 - RNA, 21 nt, Human
uuccuauauaguuuauugaca

SEQ ID NO: 2515762 - RNA, 22 nt, Human
uuccuauauaguuuauugacaa

SEQ ID NO: 2515763 - RNA, 13 nt, Human
uuccuauacgcag

SEQ ID NO: 2515764 - RNA, 19 nt, Human
uuccuauacgcagcgugcu

SEQ ID NO: 2515765 - RNA, 19 nt, Human
uuccuauauaguuuauuga

SEQ ID NO: 2515766 - RNA, 23 nt, Human
uucccuugaaauuuuaaacuaua

SEQ ID NO: 2515767 - RNA, 15 nt, Human
uucccuuugugcaca

SEQ ID NO: 2515768 - RNA, 20 nt, Human
uuccuauaauauaauaaaua

SEQ ID NO: 2515769 - RNA, 22 nt, Human
uucccuuugacgccaucccagc

SEQ ID NO: 2515770 - RNA, 21 nt, Human
uucccuuugacgccaucccag

SEQ ID NO: 2515771 - RNA, 20 nt, Human
uucccuuugacgccauccca

SEQ ID NO: 2515772 - RNA, 15 nt, Human
uucccuugagcccuc

SEQ ID NO: 2515773 - RNA, 14 nt, Human
uucccuugagcccu

SEQ ID NO: 2515774 - RNA, 20 nt, Human
uuccuauugugauuugacug

SEQ ID NO: 2515775 - RNA, 14 nt, Human
uuccuauugugauu

SEQ ID NO: 2515776 - RNA, 12 nt, Human
uuccuauuguga

SEQ ID NO: 2515777 - RNA, 20 nt, Human
uuccuauugucauuaaaggu

SEQ ID NO: 2515778 - RNA, 22 nt, Human
uuccuauugugauuugacuguu

SEQ ID NO: 2515779 - RNA, 21 nt, Human
uuccuauugugauuugacugu

SEQ ID NO: 2515780 - RNA, 18 nt, Human
uuccuauugucauuaaag

SEQ ID NO: 2515781 - RNA, 17 nt, Human
uuccuauugucauuaaa

SEQ ID NO: 2515782 - RNA, 13 nt, Human
uuccuauugucau

SEQ ID NO: 2515783 - RNA, 20 nt, Human
uuccuauggcuggccacugc

SEQ ID NO: 2515784 - RNA, 14 nt, Human
uuccuauguaacug

SEQ ID NO: 2515785 - RNA, 21 nt, Human
uuccuauuuguuuucauggug

SEQ ID NO: 2515786 - RNA, 19 nt, Human
uuccuauuuguuuucaugg

SEQ ID NO: 2515787 - RNA, 23 nt, Human
uuccuauuugccaugggcuucac

SEQ ID NO: 2515788 - RNA, 22 nt, Human
uuccuauuugccaugggcuuca

SEQ ID NO: 2515789 - RNA, 20 nt, Human
uuccuauuugccaugggcuu

SEQ ID NO: 2515790 - RNA, 18 nt, Human
uuccuauuugccaugggc

SEQ ID NO: 2515791 - RNA, 15 nt, Human
uuccuauuucuuaua

SEQ ID NO: 2515792 - RNA, 23 nt, Human
uuccuccacauccuuucuaaaca

SEQ ID NO: 2515793 - RNA, 20 nt, Human
uuccucccaaguggugccua

SEQ ID NO: 2515794 - RNA, 23 nt, Human
uuccuccaucuccaagaaugcug

SEQ ID NO: 2515795 - RNA, 14 nt, Human
uuccucaugaauua

SEQ ID NO: 2515796 - RNA, 17 nt, Human
uuccuccacauccuuuc

SEQ ID NO: 2515797 - RNA, 15 nt, Human
uuccuccacauccuu

SEQ ID NO: 2515798 - RNA, 14 nt, Human
uuccuccacauccu

SEQ ID NO: 2515799 - RNA, 16 nt, Human
uuccucauuccugaaa

SEQ ID NO: 2515800 - RNA, 13 nt, Human
uuccucauuagca

SEQ ID NO: 2515801 - RNA, 13 nt, Human
uuccucacuucca

SEQ ID NO: 2515802 - RNA, 17 nt, Human
uuccuauuuucagccca

SEQ ID NO: 2515803 - RNA, 21 nt, Human
uuccucacaccaggcuugccu

SEQ ID NO: 2515804 - RNA, 12 nt, Human
uuccaaaauaau

SEQ ID NO: 2515805 - RNA, 20 nt, Human
uucauuugaguuauuuuaau

SEQ ID NO: 2515806 - RNA, 18 nt, Human
uucauuugagaaguaaac

SEQ ID NO: 2515807 - RNA, 16 nt, Human
uucauuugaugcuaaa

SEQ ID NO: 2515808 - RNA, 14 nt, Human
uucauuuccugccc

SEQ ID NO: 2515809 - RNA, 13 nt, Human
uucauuuccugcc

SEQ ID NO: 2515810 - RNA, 16 nt, Human
uucauuuccugugucu

SEQ ID NO: 2515811 - RNA, 15 nt, Human
uucauuuccuguguc

SEQ ID NO: 2515812 - RNA, 17 nt, Human
uucaugcaaacuuuauu

SEQ ID NO: 2515813 - RNA, 17 nt, Human
uucaugauuuugaaauc

SEQ ID NO: 2515814 - RNA, 14 nt, Human
uucaugcaaugaca

SEQ ID NO: 2515815 - RNA, 20 nt, Human
uucaugcaaggggaaaaucu

SEQ ID NO: 2515816 - RNA, 13 nt, Human
uucaugcauggaa

SEQ ID NO: 2515817 - RNA, 12 nt, Human
uucauuuccugc

SEQ ID NO: 2515818 - RNA, 15 nt, Human
uucaugcaaugacau

SEQ ID NO: 2515819 - RNA, 21 nt, Human
uucaugcaaugacaucuucaa

SEQ ID NO: 2515820 - RNA, 17 nt, Human
uucaucuugaauuguaa

SEQ ID NO: 2515821 - RNA, 13 nt, Human
uucaggaagcuca

SEQ ID NO: 2515822 - RNA, 11 nt, Human
uucaggaagcu

SEQ ID NO: 2515823 - RNA, 20 nt, Human
uucaggaaaagccucugugu

SEQ ID NO: 2515824 - RNA, 19 nt, Human
uucaggaaaagccucugug

SEQ ID NO: 2515825 - RNA, 21 nt, Human
uucaucuugaauuguaaggaa

SEQ ID NO: 2515826 - RNA, 14 nt, Human
uucaggaagaugaa

SEQ ID NO: 2515827 - RNA, 22 nt, Human
uucaucuuggucacauacaauu

SEQ ID NO: 2515828 - RNA, 15 nt, Human
uucaugauuuugaaa

SEQ ID NO: 2515829 - RNA, 23 nt, Human
uucaugauuucauuucaacuguu

SEQ ID NO: 2515830 - RNA, 16 nt, Human
uucaucuuuuguauag

SEQ ID NO: 2515831 - RNA, 22 nt, Human
uucaugaaaauagcucuuucag

SEQ ID NO: 2515832 - RNA, 21 nt, Human
uuccaaagaguagaauugcau

SEQ ID NO: 2515833 - RNA, 17 nt, Human
uuccaaaugaauguugu

SEQ ID NO: 2515834 - RNA, 16 nt, Human
uuccaaaccugacaga

SEQ ID NO: 2515835 - RNA, 21 nt, Human
uuccaaaauaauuuuaagaaa

SEQ ID NO: 2515836 - RNA, 13 nt, Human
uuccaaaauaauu

SEQ ID NO: 2515837 - RNA, 22 nt, Human
uuccaaaaguggccucuuuguc

SEQ ID NO: 2515838 - RNA, 22 nt, Human
uuccaacaaaggguuuuaaugu

SEQ ID NO: 2515839 - RNA, 21 nt, Human
uuccaacaaaggguuuuaaug

SEQ ID NO: 2515840 - RNA, 16 nt, Human
uuccaacaaaggguuu

SEQ ID NO: 2515841 - RNA, 15 nt, Human
uuccaacaaaggguu

SEQ ID NO: 2515842 - RNA, 16 nt, Human
uuccacuacaccuggc

SEQ ID NO: 2515843 - RNA, 12 nt, Human
uuccacuaaccc

SEQ ID NO: 2515844 - RNA, 15 nt, Human
uuccacuacaccugg

SEQ ID NO: 2515845 - RNA, 14 nt, Human
uuccaacaaagggu

SEQ ID NO: 2515846 - RNA, 23 nt, Human
uuccaaauucacaaguuguguuu

SEQ ID NO: 2515847 - RNA, 21 nt, Human
uuccaaauguaauaaacuuua

SEQ ID NO: 2515848 - RNA, 21 nt, Human
uuccaaaugaauguugucugu

SEQ ID NO: 2515849 - RNA, 15 nt, Human
uuccaaauucacaag

SEQ ID NO: 2515850 - RNA, 15 nt, Human
uuccaaauucugcuu

SEQ ID NO: 2515851 - RNA, 19 nt, Human
uuccagauccuggaaauca

SEQ ID NO: 2515852 - RNA, 20 nt, Human
uuccagagaguccucuggau

SEQ ID NO: 2515853 - RNA, 20 nt, Human
uuccagaugccuucuccaga

SEQ ID NO: 2515854 - RNA, 21 nt, Human
uuccagagaguggcuccuccc

SEQ ID NO: 2515855 - RNA, 20 nt, Human
uuccagagaguggcuccucc

SEQ ID NO: 2515856 - RNA, 19 nt, Human
uuccagagaguggcuccuc

SEQ ID NO: 2515857 - RNA, 18 nt, Human
uuccagagaguggcuccu

SEQ ID NO: 2515858 - RNA, 17 nt, Human
uuccagagaguggcucc

SEQ ID NO: 2515859 - RNA, 21 nt, Human
uuccacuccuccuagccaccc

SEQ ID NO: 2515860 - RNA, 17 nt, Human
uuccagagaguccucug

SEQ ID NO: 2515861 - RNA, 11 nt, Human
uuccagagaag

SEQ ID NO: 2515862 - RNA, 16 nt, Human
uuccacugaaguagug

SEQ ID NO: 2515863 - RNA, 15 nt, Human
uuccacuacugcuac

SEQ ID NO: 2515864 - RNA, 16 nt, Human
uuccacuccuccuagc

SEQ ID NO: 2515865 - RNA, 18 nt, Human
uuccacuccuccuagcca

SEQ ID NO: 2515866 - RNA, 22 nt, Human
uuccacuacaccuggcugaggu

SEQ ID NO: 2515867 - RNA, 19 nt, Human
uuccacuacaccuggcuga

SEQ ID NO: 2515868 - RNA, 18 nt, Human
uuccacuacaccuggcug

SEQ ID NO: 2515869 - RNA, 17 nt, Human
uuccacuacaccuggcu

SEQ ID NO: 2515870 - RNA, 20 nt, Human
uuccccaggaggccagccuu

SEQ ID NO: 2515871 - RNA, 19 nt, Human
uuccccaggaggccagccu

SEQ ID NO: 2515872 - RNA, 18 nt, Human
uuccccaggaggccagcc

SEQ ID NO: 2515873 - RNA, 17 nt, Human
uuccccaggaggccagc

SEQ ID NO: 2515874 - RNA, 23 nt, Human
uuccccaugggaagacgaggccc

SEQ ID NO: 2515875 - RNA, 12 nt, Human
uuccccauggga

SEQ ID NO: 2515876 - RNA, 19 nt, Human
uuccccaugucucgacuca

SEQ ID NO: 2515877 - RNA, 17 nt, Human
uuccccaucuucuaaac

SEQ ID NO: 2515878 - RNA, 18 nt, Human
uuccccaucuucuaaacc

SEQ ID NO: 2515879 - RNA, 11 nt, Human
uuccccauggg

SEQ ID NO: 2515880 - RNA, 21 nt, Human
uuccccaggaggccagccuug

SEQ ID NO: 2515881 - RNA, 18 nt, Human
uuccccaggggaaaauga

SEQ ID NO: 2515882 - RNA, 15 nt, Human
uuccccagcccaggg

SEQ ID NO: 2515883 - RNA, 15 nt, Human
uuccccaucuggguc

SEQ ID NO: 2515884 - RNA, 11 nt, Human
uucccucccuu

SEQ ID NO: 2515885 - RNA, 18 nt, Human
uuccccccacucucccca

SEQ ID NO: 2515886 - RNA, 19 nt, Human
uuccccccacucuccccac

SEQ ID NO: 2515887 - RNA, 23 nt, Human
uucccccgccgcuuuucuccucu

SEQ ID NO: 2515888 - RNA, 13 nt, Human
uucccccgccgcu

SEQ ID NO: 2515889 - RNA, 21 nt, Human
uuccccccacucuccccacac

SEQ ID NO: 2515890 - RNA, 17 nt, Human
uucccucccuuccucuu

SEQ ID NO: 2515891 - RNA, 20 nt, Human
uucccucccuuccucuuucc

SEQ ID NO: 2515892 - RNA, 15 nt, Human
uucccccacugauca

SEQ ID NO: 2515893 - RNA, 13 nt, Human
uucccccagcccu

SEQ ID NO: 2515894 - RNA, 14 nt, Human
uucccccagcccug

SEQ ID NO: 2515895 - RNA, 15 nt, Human
uucccccagcccugu

SEQ ID NO: 2515896 - RNA, 20 nt, Human
uucccccagcccuguggaag

SEQ ID NO: 2515897 - RNA, 14 nt, Human
uucccccauagcca

SEQ ID NO: 2515898 - RNA, 12 nt, Human
uuccccccacuc

SEQ ID NO: 2515899 - RNA, 18 nt, Human
uucccccauagccacccc

SEQ ID NO: 2515900 - RNA, 15 nt, Human
uucccccauagccac

SEQ ID NO: 2515901 - RNA, 17 nt, Human
uucccccauagccaccc

SEQ ID NO: 2515902 - RNA, 18 nt, Human
uucccccaccagcuaagg

SEQ ID NO: 2515903 - RNA, 23 nt, Human
uuccccaugguuuuaaucuguau

SEQ ID NO: 2515904 - RNA, 16 nt, Human
uuccccauugccuccu

SEQ ID NO: 2515905 - RNA, 18 nt, Human
uucccccaaccucagacu

SEQ ID NO: 2515906 - RNA, 17 nt, Human
uucccccaaccucagac

SEQ ID NO: 2515907 - RNA, 16 nt, Human
uuccccaggaggccag

SEQ ID NO: 2515908 - RNA, 15 nt, Human
uuccccaggaggcca

SEQ ID NO: 2515909 - RNA, 16 nt, Human
uucccauuugcuccuu

SEQ ID NO: 2515910 - RNA, 14 nt, Human
uucccauuucagcu

SEQ ID NO: 2515911 - RNA, 15 nt, Human
uucccauuucagcug

SEQ ID NO: 2515912 - RNA, 15 nt, Human
uucccauggggaggg

SEQ ID NO: 2515913 - RNA, 14 nt, Human
uucccauggggagg

SEQ ID NO: 2515914 - RNA, 23 nt, Human
uucccauggggagggauucuggu

SEQ ID NO: 2515915 - RNA, 17 nt, Human
uucccauguagcccccu

SEQ ID NO: 2515916 - RNA, 13 nt, Human
uucccauguuaaa

SEQ ID NO: 2515917 - RNA, 17 nt, Human
uucccauuguggcuccu

SEQ ID NO: 2515918 - RNA, 14 nt, Human
uucccauucuugca

SEQ ID NO: 2515919 - RNA, 19 nt, Human
uucccaugacccaggcugg

SEQ ID NO: 2515920 - RNA, 18 nt, Human
uucccaugacccaggcug

SEQ ID NO: 2515921 - RNA, 20 nt, Human
uucccaugacccaggcuggg

SEQ ID NO: 2515922 - RNA, 14 nt, Human
uucccaucugcacc

SEQ ID NO: 2515923 - RNA, 12 nt, Human
uucccaucugca

SEQ ID NO: 2515924 - RNA, 15 nt, Human
uucccaucgcuguca

SEQ ID NO: 2515925 - RNA, 14 nt, Human
uucccaucgcuguc

SEQ ID NO: 2515926 - RNA, 14 nt, Human
uucccauccuaccc

SEQ ID NO: 2515927 - RNA, 13 nt, Human
uucccauccuacc

SEQ ID NO: 2515928 - RNA, 11 nt, Human
uucccauaauu

SEQ ID NO: 2515929 - RNA, 15 nt, Human
uucccauaauuuucu

SEQ ID NO: 2515930 - RNA, 16 nt, Human
uucccauaauuuucuu

SEQ ID NO: 2515931 - RNA, 18 nt, Human
uucccauaauuuucuuca

SEQ ID NO: 2515932 - RNA, 21 nt, Human
uucccauaccacccaaugcug

SEQ ID NO: 2515933 - RNA, 23 nt, Human
uucccaucacuggagcaccaggc

SEQ ID NO: 2515934 - RNA, 13 nt, Human
uuccauucuggaa

SEQ ID NO: 2515935 - RNA, 15 nt, Human
uuccauucuggaagu

SEQ ID NO: 2515936 - RNA, 16 nt, Human
uuccauuccagaauau

SEQ ID NO: 2515937 - RNA, 13 nt, Human
uuccauuccagaa

SEQ ID NO: 2515938 - RNA, 16 nt, Human
uuccauuaugauucuu

SEQ ID NO: 2515939 - RNA, 17 nt, Human
uuccauuggaucucauu

SEQ ID NO: 2515940 - RNA, 16 nt, Human
uuccauuggaucucau

SEQ ID NO: 2515941 - RNA, 20 nt, Human
uuccauucuggauuuuguca

SEQ ID NO: 2515942 - RNA, 20 nt, Human
uuccagcaauucuccugccu

SEQ ID NO: 2515943 - RNA, 21 nt, Human
uuccagcaauucuccugccuc

SEQ ID NO: 2515944 - RNA, 22 nt, Human
uuccagcaauucuccugccuca

SEQ ID NO: 2515945 - RNA, 16 nt, Human
uuccauguugcugcca

SEQ ID NO: 2515946 - RNA, 15 nt, Human
uuccauguugcugcc

SEQ ID NO: 2515947 - RNA, 14 nt, Human
uuccauuaugauuc

SEQ ID NO: 2515948 - RNA, 15 nt, Human
uuccauuaugauucu

SEQ ID NO: 2515949 - RNA, 14 nt, Human
uuccauguggagaa

SEQ ID NO: 2515950 - RNA, 13 nt, Human
uuccauguugcug

SEQ ID NO: 2515951 - RNA, 23 nt, Human
uuauugagaaagagcacuuaaga

SEQ ID NO: 2515952 - RNA, 18 nt, Human
uuauugagaaagagcacu

SEQ ID NO: 2515953 - RNA, 16 nt, Human
uuauugagaaagagca

SEQ ID NO: 2515954 - RNA, 14 nt, Human
uuauugagaaagag

SEQ ID NO: 2515955 - RNA, 13 nt, Human
uuauugagaauuu

SEQ ID NO: 2515956 - RNA, 19 nt, Human
uuauugagaauuuuaaauu

SEQ ID NO: 2515957 - RNA, 15 nt, Human
uuauugcccacgcug

SEQ ID NO: 2515958 - RNA, 21 nt, Human
uuauugcaguuuaucauucaa

SEQ ID NO: 2515959 - RNA, 18 nt, Human
uuauugcaguuuaucauu

SEQ ID NO: 2515960 - RNA, 22 nt, Human
uuauugcaguuuaucauucaag

SEQ ID NO: 2515961 - RNA, 13 nt, Human
uuauugcauuaua

SEQ ID NO: 2515962 - RNA, 21 nt, Human
uuauugcaaaauagcauuugu

SEQ ID NO: 2515963 - RNA, 20 nt, Human
uuauugcaauaaaagugcuu

SEQ ID NO: 2515964 - RNA, 16 nt, Human
uuauugcaguuuauca

SEQ ID NO: 2515965 - RNA, 14 nt, Human
uuauugcaguuuau

SEQ ID NO: 2515966 - RNA, 19 nt, Human
uuauugcagcgauuaauaa

SEQ ID NO: 2515967 - RNA, 13 nt, Human
uuauucuuuuuaa

SEQ ID NO: 2515968 - RNA, 16 nt, Human
uuauucuuuuuaaagu

SEQ ID NO: 2515969 - RNA, 20 nt, Human
uuauucuguagauucugugg

SEQ ID NO: 2515970 - RNA, 13 nt, Human
uuauucuggaguu

SEQ ID NO: 2515971 - RNA, 11 nt, Human
uuauucugcuc

SEQ ID NO: 2515972 - RNA, 19 nt, Human
uuauugacacagaaaaugu

SEQ ID NO: 2515973 - RNA, 23 nt, Human
uuauugacacagaaaauguugag

SEQ ID NO: 2515974 - RNA, 14 nt, Human
uuauugacacagaa

SEQ ID NO: 2515975 - RNA, 22 nt, Human
uuauugacaauaauuucagguu

SEQ ID NO: 2515976 - RNA, 14 nt, Human
uuauugacaauaau

SEQ ID NO: 2515977 - RNA, 18 nt, Human
uuauugacaauaauuuca

SEQ ID NO: 2515978 - RNA, 20 nt, Human
uuauugaaucuauuuaagua

SEQ ID NO: 2515979 - RNA, 18 nt, Human
uuauugaaucuauuuaag

SEQ ID NO: 2515980 - RNA, 18 nt, Human
uuauuacuguaagaaaau

SEQ ID NO: 2515981 - RNA, 17 nt, Human
uuauuacuguaagaaaa

SEQ ID NO: 2515982 - RNA, 19 nt, Human
uuauuccuguauguugucc

SEQ ID NO: 2515983 - RNA, 15 nt, Human
uuauuccuguauguu

SEQ ID NO: 2515984 - RNA, 13 nt, Human
uuauuccuguaug

SEQ ID NO: 2515985 - RNA, 18 nt, Human
uuauuacuguuugucuuc

SEQ ID NO: 2515986 - RNA, 21 nt, Human
uuauuccugauaauaauugau

SEQ ID NO: 2515987 - RNA, 22 nt, Human
uuauuaauuguuuugcacuuuu

SEQ ID NO: 2515988 - RNA, 17 nt, Human
uuauuccuguauguugu

SEQ ID NO: 2515989 - RNA, 13 nt, Human
uuauucuagauua

SEQ ID NO: 2515990 - RNA, 17 nt, Human
uuauucucacuccacca

SEQ ID NO: 2515991 - RNA, 16 nt, Human
uuauuacuguaagaaa

SEQ ID NO: 2515992 - RNA, 14 nt, Human
uuauuaauugcuuu

SEQ ID NO: 2515993 - RNA, 15 nt, Human
uuauuaauugcuuug

SEQ ID NO: 2515994 - RNA, 17 nt, Human
uuauuaaugcacuuucu

SEQ ID NO: 2515995 - RNA, 13 nt, Human
uuauuaaugcacu

SEQ ID NO: 2515996 - RNA, 18 nt, Human
uuauuaaugcacuuucua

SEQ ID NO: 2515997 - RNA, 11 nt, Human
uuauuaaugca

SEQ ID NO: 2515998 - RNA, 17 nt, Human
uuauuaaaguucuguaa

SEQ ID NO: 2515999 - RNA, 22 nt, Human
uuauuaaacguaugcaugugaa

SEQ ID NO: 2516000 - RNA, 20 nt, Human
uuauuaaacguaugcaugug

SEQ ID NO: 2516001 - RNA, 18 nt, Human
uuauuaaacguaugcaug

SEQ ID NO: 2516002 - RNA, 21 nt, Human
uuauuaaacagauuuuuacaa

SEQ ID NO: 2516003 - RNA, 17 nt, Human
uuauggcuauaggugcu

SEQ ID NO: 2516004 - RNA, 21 nt, Human
uuauuaaaaugauuguaaaau

SEQ ID NO: 2516005 - RNA, 20 nt, Human
uuauuaaaaugauuguaaaa

SEQ ID NO: 2516006 - RNA, 19 nt, Human
uuauuaaaaugauuguaaa

SEQ ID NO: 2516007 - RNA, 14 nt, Human
uuauuaaaaugauu

SEQ ID NO: 2516008 - RNA, 12 nt, Human
uuauuaaaaucu

SEQ ID NO: 2516009 - RNA, 16 nt, Human
uuauuaaaaucuuaaa

SEQ ID NO: 2516010 - RNA, 12 nt, Human
uuauggccucag

SEQ ID NO: 2516011 - RNA, 13 nt, Human
uuauggccucagc

SEQ ID NO: 2516012 - RNA, 15 nt, Human
uuauggccucagcug

SEQ ID NO: 2516013 - RNA, 18 nt, Human
uuauggccucagcugccu

SEQ ID NO: 2516014 - RNA, 11 nt, Human
uuauggccuca

SEQ ID NO: 2516015 - RNA, 14 nt, Human
uuaugcuucuugga

SEQ ID NO: 2516016 - RNA, 19 nt, Human
uuaucucuauuuaauauuu

SEQ ID NO: 2516017 - RNA, 12 nt, Human
uuaucucugugu

SEQ ID NO: 2516018 - RNA, 14 nt, Human
uuaucucucugugc

SEQ ID NO: 2516019 - RNA, 17 nt, Human
uuaucuagauacuguau

SEQ ID NO: 2516020 - RNA, 20 nt, Human
uuaucuugaauaauguaaga

SEQ ID NO: 2516021 - RNA, 12 nt, Human
uuaucugugaau

SEQ ID NO: 2516022 - RNA, 12 nt, Human
uuaucuguccca

SEQ ID NO: 2516023 - RNA, 17 nt, Human
uuaucugugaauucaga

SEQ ID NO: 2516024 - RNA, 18 nt, Human
uuaucugugcgugaaaca

SEQ ID NO: 2516025 - RNA, 19 nt, Human
uuaucugugcgugaaacac

SEQ ID NO: 2516026 - RNA, 20 nt, Human
uuaucugggcauagaugcag

SEQ ID NO: 2516027 - RNA, 23 nt, Human
uuaucugggauuaugguuuugug

SEQ ID NO: 2516028 - RNA, 16 nt, Human
uuaguuccucauuagc

SEQ ID NO: 2516029 - RNA, 14 nt, Human
uuaguuccuugagu

SEQ ID NO: 2516030 - RNA, 13 nt, Human
uuaguugcaacuu

SEQ ID NO: 2516031 - RNA, 12 nt, Human
uuaguucccaac

SEQ ID NO: 2516032 - RNA, 21 nt, Human
uuaguucucacuguucccucu

SEQ ID NO: 2516033 - RNA, 16 nt, Human
uuaguucuuuggaaau

SEQ ID NO: 2516034 - RNA, 15 nt, Human
uuaguucuuuguuau

SEQ ID NO: 2516035 - RNA, 16 nt, Human
uuaucuagauacugua

SEQ ID NO: 2516036 - RNA, 20 nt, Human
uuaguuguaucucuuuugaa

SEQ ID NO: 2516037 - RNA, 17 nt, Human
uuaguuuacaaucagcc

SEQ ID NO: 2516038 - RNA, 20 nt, Human
uuaguugcaacuuuguauaa

SEQ ID NO: 2516039 - RNA, 15 nt, Human
uuaguugcuguaugu

SEQ ID NO: 2516040 - RNA, 13 nt, Human
uuaguugcuguau

SEQ ID NO: 2516041 - RNA, 24 nt, Human
uuaucuuucgugauaaacuuugcu

SEQ ID NO: 2516042 - RNA, 17 nt, Human
uuaucuuucgugauaaa

SEQ ID NO: 2516043 - RNA, 15 nt, Human
uuaucuuucgcacag

SEQ ID NO: 2516044 - RNA, 19 nt, Human
uuaucuugggacuggguuu

SEQ ID NO: 2516045 - RNA, 17 nt, Human
uuaugcaaggaaggaaa

SEQ ID NO: 2516046 - RNA, 18 nt, Human
uuaugcaaggaaggaaag

SEQ ID NO: 2516047 - RNA, 22 nt, Human
uuaugcaaggaaggaaagaaag

SEQ ID NO: 2516048 - RNA, 17 nt, Human
uuaucuugguugaaaau

SEQ ID NO: 2516049 - RNA, 14 nt, Human
uuaucuugggacug

SEQ ID NO: 2516050 - RNA, 16 nt, Human
uuaucuuggacugaca

SEQ ID NO: 2516051 - RNA, 17 nt, Human
uuaucuuggacugacau

SEQ ID NO: 2516052 - RNA, 16 nt, Human
uuaucuuuacuuuuaa

SEQ ID NO: 2516053 - RNA, 12 nt, Human
uuaucuuuauau

SEQ ID NO: 2516054 - RNA, 17 nt, Human
uuaucuugucucugggc

SEQ ID NO: 2516055 - RNA, 16 nt, Human
uuaucuugucucuggg

SEQ ID NO: 2516056 - RNA, 16 nt, Human
uuaugcaugaaguaau

SEQ ID NO: 2516057 - RNA, 20 nt, Human
uuaugcaagggacugugugu

SEQ ID NO: 2516058 - RNA, 14 nt, Human
uuaugcauagauaa

SEQ ID NO: 2516059 - RNA, 22 nt, Human
uuaugcaugaaguaauaugcac

SEQ ID NO: 2516060 - RNA, 21 nt, Human
uuauggcacuaguauuucuau

SEQ ID NO: 2516061 - RNA, 16 nt, Human
uuauggaacacucuga

SEQ ID NO: 2516062 - RNA, 13 nt, Human
uuaugcuuuaaac

SEQ ID NO: 2516063 - RNA, 14 nt, Human
uuaugcuuuaaaca

SEQ ID NO: 2516064 - RNA, 11 nt, Human
uuaugcuucuu

SEQ ID NO: 2516065 - RNA, 17 nt, Human
uuaugcugugacacaug

SEQ ID NO: 2516066 - RNA, 14 nt, Human
uuaugcugaguaug

SEQ ID NO: 2516067 - RNA, 16 nt, Human
uuaugcggucuaggga

SEQ ID NO: 2516068 - RNA, 13 nt, Human
uuaugcugaaaca

SEQ ID NO: 2516069 - RNA, 14 nt, Human
uuaugcucaggguc

SEQ ID NO: 2516070 - RNA, 21 nt, Human
uuaugcccaguuucugccucu

SEQ ID NO: 2516071 - RNA, 17 nt, Human
uuaugcccagcguuuga

SEQ ID NO: 2516072 - RNA, 17 nt, Human
uuaugccuuuuuugauc

SEQ ID NO: 2516073 - RNA, 20 nt, Human
uuaugccggaugugcuuuuc

SEQ ID NO: 2516074 - RNA, 17 nt, Human
uuaugccggaugugcuu

SEQ ID NO: 2516075 - RNA, 15 nt, Human
uuaugccuuuuauuu

SEQ ID NO: 2516076 - RNA, 15 nt, Human
uuauugucuagugaa

SEQ ID NO: 2516077 - RNA, 18 nt, Human
uuauugucaaagugguga

SEQ ID NO: 2516078 - RNA, 17 nt, Human
uuauugucaaaguggug

SEQ ID NO: 2516079 - RNA, 21 nt, Human
uuauuguauaaacuaucaguu

SEQ ID NO: 2516080 - RNA, 14 nt, Human
uuauuguauaaacu

SEQ ID NO: 2516081 - RNA, 12 nt, Human
uuauuguacuug

SEQ ID NO: 2516082 - RNA, 17 nt, Human
uuauuguaccucucuua

SEQ ID NO: 2516083 - RNA, 15 nt, Human
uuauuguaccucucu

SEQ ID NO: 2516084 - RNA, 16 nt, Human
uuauuuuaauaauguu

SEQ ID NO: 2516085 - RNA, 15 nt, Human
uuauuuuaauaaugu

SEQ ID NO: 2516086 - RNA, 17 nt, Human
uuauuguguuugucauu

SEQ ID NO: 2516087 - RNA, 16 nt, Human
uuauuguguuugucau

SEQ ID NO: 2516088 - RNA, 15 nt, Human
uuauuguguuuguca

SEQ ID NO: 2516089 - RNA, 16 nt, Human
uuauugugauuucccg

SEQ ID NO: 2516090 - RNA, 22 nt, Human
uuauuguauaaacuaucaguuu

SEQ ID NO: 2516091 - RNA, 12 nt, Human
uuauugcauuug

SEQ ID NO: 2516092 - RNA, 12 nt, Human
uuauugcuguug

SEQ ID NO: 2516093 - RNA, 15 nt, Human
uuauuggcugagaua

SEQ ID NO: 2516094 - RNA, 16 nt, Human
uuauuggcugagauau

SEQ ID NO: 2516095 - RNA, 14 nt, Human
uuauuggcugagau

SEQ ID NO: 2516096 - RNA, 22 nt, Human
uuauuggaauuaaccuggugcu

SEQ ID NO: 2516097 - RNA, 23 nt, Human
uuauugcuugauacuuuugacaa

SEQ ID NO: 2516098 - RNA, 13 nt, Human
uuauugcuuuuau

SEQ ID NO: 2516099 - RNA, 13 nt, Human
uuauuggaauuaa

SEQ ID NO: 2516100 - RNA, 17 nt, Human
uuauuguaacagacauu

SEQ ID NO: 2516101 - RNA, 16 nt, Human
uuauuguaacagacau

SEQ ID NO: 2516102 - RNA, 20 nt, Human
uuauugggcaagugauugaa

SEQ ID NO: 2516103 - RNA, 19 nt, Human
uuauuguacagcuguuuaa

SEQ ID NO: 2516104 - RNA, 20 nt, Human
uuauuguaacagacauuguu

SEQ ID NO: 2516105 - RNA, 19 nt, Human
uuauuguaacagacauugu

SEQ ID NO: 2516106 - RNA, 18 nt, Human
uuauuguaacagacauug

SEQ ID NO: 2516107 - RNA, 14 nt, Human
uuauuguaccucuc

SEQ ID NO: 2516108 - RNA, 12 nt, Human
uuauuguaccuc

SEQ ID NO: 2516109 - RNA, 22 nt, Human
uuauuggcugagauaugaacau

SEQ ID NO: 2516110 - RNA, 19 nt, Human
uuauugggcaagugauuga

SEQ ID NO: 2516111 - RNA, 16 nt, Human
uuauuggaauuaaccu

SEQ ID NO: 2516112 - RNA, 18 nt, Human
uucaaauagggucuaacu

SEQ ID NO: 2516113 - RNA, 19 nt, Human
uucaaauagggucuaacuc

SEQ ID NO: 2516114 - RNA, 17 nt, Human
uucaaauccuugaagau

SEQ ID NO: 2516115 - RNA, 19 nt, Human
uucaacgcagcccugcuuu

SEQ ID NO: 2516116 - RNA, 16 nt, Human
uucaacgcagcccugc

SEQ ID NO: 2516117 - RNA, 20 nt, Human
uucaacgcagcccugcuuug

SEQ ID NO: 2516118 - RNA, 12 nt, Human
uucaacucagac

SEQ ID NO: 2516119 - RNA, 15 nt, Human
uucaacgcagcccug

SEQ ID NO: 2516120 - RNA, 17 nt, Human
uucaacugaccagccuc

SEQ ID NO: 2516121 - RNA, 22 nt, Human
uucaaagcuuuuuccagaggcu

SEQ ID NO: 2516122 - RNA, 16 nt, Human
uucaaagcuugaagau

SEQ ID NO: 2516123 - RNA, 16 nt, Human
uuauuuuauccucugg

SEQ ID NO: 2516124 - RNA, 23 nt, Human
uucaaagccagcguccuccucug

SEQ ID NO: 2516125 - RNA, 21 nt, Human
uucaaagccagcguccuccuc

SEQ ID NO: 2516126 - RNA, 20 nt, Human
uuauuuuauguugcauagaa

SEQ ID NO: 2516127 - RNA, 16 nt, Human
uuauuuuaguuucugu

SEQ ID NO: 2516128 - RNA, 17 nt, Human
uuauuuuaauaauguuu

SEQ ID NO: 2516129 - RNA, 17 nt, Human
uuauuuuaauucaguug

SEQ ID NO: 2516130 - RNA, 12 nt, Human
uuauuuuaagac

SEQ ID NO: 2516131 - RNA, 20 nt, Human
uucagauaaucacaauacau

SEQ ID NO: 2516132 - RNA, 17 nt, Human
uucagauaacuguuauu

SEQ ID NO: 2516133 - RNA, 18 nt, Human
uucagauaacuguuauuu

SEQ ID NO: 2516134 - RNA, 18 nt, Human
uucaggaaaagccucugu

SEQ ID NO: 2516135 - RNA, 23 nt, Human
uucagauaacuguuauuuauaau

SEQ ID NO: 2516136 - RNA, 22 nt, Human
uucagaguugaugguuguacau

SEQ ID NO: 2516137 - RNA, 21 nt, Human
uucagaguugaugguuguaca

SEQ ID NO: 2516138 - RNA, 19 nt, Human
uucagagagcuaaauuaca

SEQ ID NO: 2516139 - RNA, 13 nt, Human
uucagagagcugg

SEQ ID NO: 2516140 - RNA, 14 nt, Human
uucagagagcuggu

SEQ ID NO: 2516141 - RNA, 15 nt, Human
uucagagagcuggua

SEQ ID NO: 2516142 - RNA, 20 nt, Human
uucagagagggcagaggggu

SEQ ID NO: 2516143 - RNA, 15 nt, Human
uucagagaggccuuu

SEQ ID NO: 2516144 - RNA, 23 nt, Human
uucagagcugacacaggaugaag

SEQ ID NO: 2516145 - RNA, 16 nt, Human
uucagacauagaauua

SEQ ID NO: 2516146 - RNA, 21 nt, Human
uucagacagcugccugggauc

SEQ ID NO: 2516147 - RNA, 20 nt, Human
uucagacauagaauuaacac

SEQ ID NO: 2516148 - RNA, 19 nt, Human
uucagagacuccugcaggc

SEQ ID NO: 2516149 - RNA, 18 nt, Human
uucacuauaaaugguguu

SEQ ID NO: 2516150 - RNA, 14 nt, Human
uucacuauuuccuu

SEQ ID NO: 2516151 - RNA, 13 nt, Human
uucacuauuuccu

SEQ ID NO: 2516152 - RNA, 20 nt, Human
uucacuauuuuuauuuauau

SEQ ID NO: 2516153 - RNA, 19 nt, Human
uucacuauuuccuuuauaa

SEQ ID NO: 2516154 - RNA, 13 nt, Human
uucacuccagccu

SEQ ID NO: 2516155 - RNA, 21 nt, Human
uucacuccggugugccugcag

SEQ ID NO: 2516156 - RNA, 22 nt, Human
uucacuccggugugccugcagc

SEQ ID NO: 2516157 - RNA, 13 nt, Human
uucacucuccuug

SEQ ID NO: 2516158 - RNA, 23 nt, Human
uucacuccggugugccugcagcc

SEQ ID NO: 2516159 - RNA, 24 nt, Human
uucacuccggugugccugcagccc

SEQ ID NO: 2516160 - RNA, 20 nt, Human
uucaauaggaaaaacugauu

SEQ ID NO: 2516161 - RNA, 18 nt, Human
uucaauaggaaaaacuga

SEQ ID NO: 2516162 - RNA, 15 nt, Human
uucaauaggaaaaac

SEQ ID NO: 2516163 - RNA, 13 nt, Human
uucaauaggaaaa

SEQ ID NO: 2516164 - RNA, 19 nt, Human
uucaauugcaucucccaga

SEQ ID NO: 2516165 - RNA, 12 nt, Human
uucaauuguaaa

SEQ ID NO: 2516166 - RNA, 14 nt, Human
uucaauuguaaauu

SEQ ID NO: 2516167 - RNA, 16 nt, Human
uucaauuuauucaaga

SEQ ID NO: 2516168 - RNA, 15 nt, Human
uucaauugcaucucc

SEQ ID NO: 2516169 - RNA, 17 nt, Human
uucaauugcaucuccca

SEQ ID NO: 2516170 - RNA, 16 nt, Human
uucaacucagacuagu

SEQ ID NO: 2516171 - RNA, 13 nt, Human
uucaacucagacu

SEQ ID NO: 2516172 - RNA, 14 nt, Human
uucaacugaaaaga

SEQ ID NO: 2516173 - RNA, 15 nt, Human
uucacaaaauuucca

SEQ ID NO: 2516174 - RNA, 19 nt, Human
uucaauuuauucaagaaaa

SEQ ID NO: 2516175 - RNA, 17 nt, Human
uucaauuuauucaagaa

SEQ ID NO: 2516176 - RNA, 19 nt, Human
uucaauuuccaagagcuga

SEQ ID NO: 2516177 - RNA, 17 nt, Human
uucaauuuccaagagcu

SEQ ID NO: 2516178 - RNA, 17 nt, Human
uucaccuguaaaccuga

SEQ ID NO: 2516179 - RNA, 18 nt, Human
uucaccuguaaaccugag

SEQ ID NO: 2516180 - RNA, 21 nt, Human
uucaccuguuuuuaagcuguu

SEQ ID NO: 2516181 - RNA, 19 nt, Human
uucaccuguuuuuaagcug

SEQ ID NO: 2516182 - RNA, 23 nt, Human
uucaccuguuuuuaagcuguuuc

SEQ ID NO: 2516183 - RNA, 22 nt, Human
uucaccuguuuuuaagcuguuu

SEQ ID NO: 2516184 - RNA, 23 nt, Human
uucaccuucguuuacuaugccug

SEQ ID NO: 2516185 - RNA, 14 nt, Human
uucaccuugaagaa

SEQ ID NO: 2516186 - RNA, 13 nt, Human
uucaccuguaaac

SEQ ID NO: 2516187 - RNA, 16 nt, Human
uucaccuguaaaccug

SEQ ID NO: 2516188 - RNA, 12 nt, Human
uucaccugagca

SEQ ID NO: 2516189 - RNA, 15 nt, Human
uucacaaacuuuuau

SEQ ID NO: 2516190 - RNA, 18 nt, Human
uucaccugccccaacucu

SEQ ID NO: 2516191 - RNA, 16 nt, Human
uucaccugauucaacu

SEQ ID NO: 2516192 - RNA, 15 nt, Human
uucacgugguccuaa

SEQ ID NO: 2516193 - RNA, 14 nt, Human
uucacgugcagcuc

SEQ ID NO: 2516194 - RNA, 13 nt, Human
uucacuaaagcag

SEQ ID NO: 2516195 - RNA, 14 nt, Human
uucacuaaagcagu

SEQ ID NO: 2516196 - RNA, 18 nt, Human
uucacggaagagccuugc

SEQ ID NO: 2516197 - RNA, 21 nt, Human
uucaccugauucaacuaaaaa

SEQ ID NO: 2516198 - RNA, 16 nt, Human
uucaccuugggaugau

SEQ ID NO: 2516199 - RNA, 22 nt, Human
uucaccuugggaugaugccuca

SEQ ID NO: 2516200 - RNA, 22 nt, Human
uucacggaaguuuucaaugaug

SEQ ID NO: 2516201 - RNA, 13 nt, Human
uucacggaaguuu

SEQ ID NO: 2516202 - RNA, 21 nt, Human
uuugaaauuguauuacaaauc

SEQ ID NO: 2516203 - RNA, 19 nt, Human
uuucuuguaauuuaaacag

SEQ ID NO: 2516204 - RNA, 23 nt, Human
uuucuugguucauaaaugaauuu

SEQ ID NO: 2516205 - RNA, 22 nt, Human
uuugaacaacuaggcuucagca

SEQ ID NO: 2516206 - RNA, 12 nt, Human
uuucuugccucu

SEQ ID NO: 2516207 - RNA, 15 nt, Human
uuugaagccugcccu

SEQ ID NO: 2516208 - RNA, 18 nt, Human
uuugaagcaguuguguca

SEQ ID NO: 2516209 - RNA, 16 nt, Human
uuugaagcaguugugu

SEQ ID NO: 2516210 - RNA, 15 nt, Human
uuugaacucagaucu

SEQ ID NO: 2516211 - RNA, 15 nt, Human
uuugaacuaauaaaa

SEQ ID NO: 2516212 - RNA, 20 nt, Human
uuugaaggaaacaguuaaua

SEQ ID NO: 2516213 - RNA, 13 nt, Human
uuugaaggaaaca

SEQ ID NO: 2516214 - RNA, 22 nt, Human
uuugaagccugcccuugucuga

SEQ ID NO: 2516215 - RNA, 12 nt, Human
uuugaaggcaaa

SEQ ID NO: 2516216 - RNA, 13 nt, Human
uuugaaggcaaaa

SEQ ID NO: 2516217 - RNA, 18 nt, Human
uuugaagcuacugugugu

SEQ ID NO: 2516218 - RNA, 16 nt, Human
uuugaagcuacugugu

SEQ ID NO: 2516219 - RNA, 19 nt, Human
uuucuuguguguuuauugu

SEQ ID NO: 2516220 - RNA, 19 nt, Human
uuucuugguucauaaauga

SEQ ID NO: 2516221 - RNA, 18 nt, Human
uuucuugguucauaaaug

SEQ ID NO: 2516222 - RNA, 17 nt, Human
uuucuugguucauaaau

SEQ ID NO: 2516223 - RNA, 21 nt, Human
uuucuugcugguugucauuuu

SEQ ID NO: 2516224 - RNA, 14 nt, Human
uuucuuaaccaucu

SEQ ID NO: 2516225 - RNA, 15 nt, Human
uuucuuaaccaucuu

SEQ ID NO: 2516226 - RNA, 21 nt, Human
uuucuugccucuguccccuuc

SEQ ID NO: 2516227 - RNA, 18 nt, Human
uuucuugccucugucccc

SEQ ID NO: 2516228 - RNA, 11 nt, Human
uuucuugcugg

SEQ ID NO: 2516229 - RNA, 12 nt, Human
uuucuuaaauaa

SEQ ID NO: 2516230 - RNA, 23 nt, Human
uuucugaucugaugcaagcaaga

SEQ ID NO: 2516231 - RNA, 18 nt, Human
uuucuuaaaccuucaguu

SEQ ID NO: 2516232 - RNA, 18 nt, Human
uuucuuaaccagaucauu

SEQ ID NO: 2516233 - RNA, 13 nt, Human
uuucuuaaauaau

SEQ ID NO: 2516234 - RNA, 15 nt, Human
uuucuuaaaugggcu

SEQ ID NO: 2516235 - RNA, 20 nt, Human
uuugaggagcagcuucaguu

SEQ ID NO: 2516236 - RNA, 15 nt, Human
uuugaggauauauuu

SEQ ID NO: 2516237 - RNA, 21 nt, Human
uuugaggagcagcuucaguug

SEQ ID NO: 2516238 - RNA, 22 nt, Human
uuugaggagcagcuucaguugu

SEQ ID NO: 2516239 - RNA, 21 nt, Human
uuugaggauauauuuucacuu

SEQ ID NO: 2516240 - RNA, 20 nt, Human
uuugaggauauauuuucacu

SEQ ID NO: 2516241 - RNA, 22 nt, Human
uuugaggauauauuuucacuuu

SEQ ID NO: 2516242 - RNA, 11 nt, Human
uuugaggggcu

SEQ ID NO: 2516243 - RNA, 20 nt, Human
uuugaggcuuucagguuuua

SEQ ID NO: 2516244 - RNA, 16 nt, Human
uuugaggggaaaacac

SEQ ID NO: 2516245 - RNA, 15 nt, Human
uuugaggcugcagcg

SEQ ID NO: 2516246 - RNA, 20 nt, Human
uuugauaaucaacugggcug

SEQ ID NO: 2516247 - RNA, 15 nt, Human
uuugauaaaguuucu

SEQ ID NO: 2516248 - RNA, 13 nt, Human
uuugauaaaguuu

SEQ ID NO: 2516249 - RNA, 21 nt, Human
uuugauaaaguaguaaaaauu

SEQ ID NO: 2516250 - RNA, 20 nt, Human
uuugauaaaguaguaaaaau

SEQ ID NO: 2516251 - RNA, 19 nt, Human
uuugauaaaguuucucaga

SEQ ID NO: 2516252 - RNA, 18 nt, Human
uuugauaaaguuucucag

SEQ ID NO: 2516253 - RNA, 19 nt, Human
uuugauaaaguaguaaaaa

SEQ ID NO: 2516254 - RNA, 14 nt, Human
uuugauaaaguagu

SEQ ID NO: 2516255 - RNA, 16 nt, Human
uuugauaaaauaaaug

SEQ ID NO: 2516256 - RNA, 13 nt, Human
uuugaguucuaca

SEQ ID NO: 2516257 - RNA, 20 nt, Human
uuugaggucaaguaagaaga

SEQ ID NO: 2516258 - RNA, 23 nt, Human
uuugaggucaaguaagaagacau

SEQ ID NO: 2516259 - RNA, 21 nt, Human
uuugaaguguaggcagacaca

SEQ ID NO: 2516260 - RNA, 20 nt, Human
uuugaaguguaggcagacac

SEQ ID NO: 2516261 - RNA, 18 nt, Human
uuugaaguguaggcagac

SEQ ID NO: 2516262 - RNA, 11 nt, Human
uuugaagugua

SEQ ID NO: 2516263 - RNA, 22 nt, Human
uuugaaguguaggcagacacag

SEQ ID NO: 2516264 - RNA, 22 nt, Human
uuugaagucauaccaaugaaaa

SEQ ID NO: 2516265 - RNA, 16 nt, Human
uuugaaguacaauugu

SEQ ID NO: 2516266 - RNA, 22 nt, Human
uuugaaguaaucccgccaccua

SEQ ID NO: 2516267 - RNA, 23 nt, Human
uuugaaguaguuuguauaacuuc

SEQ ID NO: 2516268 - RNA, 19 nt, Human
uuugaaggaggugagggau

SEQ ID NO: 2516269 - RNA, 16 nt, Human
uuugagaucagccugg

SEQ ID NO: 2516270 - RNA, 17 nt, Human
uuugagaucagccuggg

SEQ ID NO: 2516271 - RNA, 16 nt, Human
uuugagaguucuaaau

SEQ ID NO: 2516272 - RNA, 14 nt, Human
uuugagaguucuaa

SEQ ID NO: 2516273 - RNA, 18 nt, Human
uuugaauauaaacacuau

SEQ ID NO: 2516274 - RNA, 17 nt, Human
uuugaauauaaacacua

SEQ ID NO: 2516275 - RNA, 19 nt, Human
uuugauauuaaaggaguua

SEQ ID NO: 2516276 - RNA, 18 nt, Human
uuugaucagguggggagu

SEQ ID NO: 2516277 - RNA, 15 nt, Human
uuugauaauguuaaa

SEQ ID NO: 2516278 - RNA, 14 nt, Human
uuugauaauguuaa

SEQ ID NO: 2516279 - RNA, 12 nt, Human
uuugauaauguu

SEQ ID NO: 2516280 - RNA, 18 nt, Human
uuugauaaucaacugggc

SEQ ID NO: 2516281 - RNA, 17 nt, Human
uuugauauccaaagcug

SEQ ID NO: 2516282 - RNA, 23 nt, Human
uuugauauccaaagcugaauaca

SEQ ID NO: 2516283 - RNA, 19 nt, Human
uuugccacccucaugcugu

SEQ ID NO: 2516284 - RNA, 16 nt, Human
uuugccagcugcugcu

SEQ ID NO: 2516285 - RNA, 14 nt, Human
uuugccagcugcug

SEQ ID NO: 2516286 - RNA, 13 nt, Human
uuugccagcugcu

SEQ ID NO: 2516287 - RNA, 18 nt, Human
uuugccacccucaugcug

SEQ ID NO: 2516288 - RNA, 21 nt, Human
uuugccagaacaguuuguaca

SEQ ID NO: 2516289 - RNA, 14 nt, Human
uuugccaacauugc

SEQ ID NO: 2516290 - RNA, 19 nt, Human
uuuggacccugaggcccag

SEQ ID NO: 2516291 - RNA, 15 nt, Human
uuuggacccugaggc

SEQ ID NO: 2516292 - RNA, 19 nt, Human
uuuggaccuaaauggccuc

SEQ ID NO: 2516293 - RNA, 19 nt, Human
uuuggagacucuguggggc

SEQ ID NO: 2516294 - RNA, 16 nt, Human
uuuggaccuaauccaa

SEQ ID NO: 2516295 - RNA, 14 nt, Human
uuugcuugaaagaa

SEQ ID NO: 2516296 - RNA, 16 nt, Human
uuugcuugaaagaaaa

SEQ ID NO: 2516297 - RNA, 21 nt, Human
uuugcuugcaguagauuuucu

SEQ ID NO: 2516298 - RNA, 20 nt, Human
uuugcuugcaguagauuuuc

SEQ ID NO: 2516299 - RNA, 17 nt, Human
uuugcuugcaguagauu

SEQ ID NO: 2516300 - RNA, 20 nt, Human
uuugccagcugcugcuggau

SEQ ID NO: 2516301 - RNA, 16 nt, Human
uuugcuucucucucua

SEQ ID NO: 2516302 - RNA, 18 nt, Human
uuugguaaggggaauuga

SEQ ID NO: 2516303 - RNA, 18 nt, Human
uuugguacuuauuacugc

SEQ ID NO: 2516304 - RNA, 20 nt, Human
uuugguaaaauacuucuuga

SEQ ID NO: 2516305 - RNA, 14 nt, Human
uuuggguucugccu

SEQ ID NO: 2516306 - RNA, 15 nt, Human
uuuggguucugccug

SEQ ID NO: 2516307 - RNA, 22 nt, Human
uuuggagaaauuauuuaauaaa

SEQ ID NO: 2516308 - RNA, 22 nt, Human
uuuggguuaauauggcucuuca

SEQ ID NO: 2516309 - RNA, 16 nt, Human
uuuggguucugccugc

SEQ ID NO: 2516310 - RNA, 17 nt, Human
uuugguugcuuuaauau

SEQ ID NO: 2516311 - RNA, 14 nt, Human
uuugguugaauaaa

SEQ ID NO: 2516312 - RNA, 15 nt, Human
uuugguugaauaaac

SEQ ID NO: 2516313 - RNA, 21 nt, Human
uuugguucuuaguucucacug

SEQ ID NO: 2516314 - RNA, 18 nt, Human
uuugguuguauucuuuga

SEQ ID NO: 2516315 - RNA, 17 nt, Human
uuugguugaauaaacua

SEQ ID NO: 2516316 - RNA, 20 nt, Human
uuugguucauuaauucuaua

SEQ ID NO: 2516317 - RNA, 12 nt, Human
uuugguucugug

SEQ ID NO: 2516318 - RNA, 14 nt, Human
uuugguucuggggc

SEQ ID NO: 2516319 - RNA, 13 nt, Human
uuugguucugggg

SEQ ID NO: 2516320 - RNA, 13 nt, Human
uuugguucuaaua

SEQ ID NO: 2516321 - RNA, 16 nt, Human
uuuguaaacucaaaau

SEQ ID NO: 2516322 - RNA, 17 nt, Human
uuuguaaacucaaaaua

SEQ ID NO: 2516323 - RNA, 22 nt, Human
uuuguaaacucaaaauauuugu

SEQ ID NO: 2516324 - RNA, 22 nt, Human
uuuguaaaguguggucccaaca

SEQ ID NO: 2516325 - RNA, 17 nt, Human
uuuguaaaguguggucc

SEQ ID NO: 2516326 - RNA, 12 nt, Human
uuuguaaagugu

SEQ ID NO: 2516327 - RNA, 17 nt, Human
uuuguauguaaaugugc

SEQ ID NO: 2516328 - RNA, 16 nt, Human
uuuguauguaaaugug

SEQ ID NO: 2516329 - RNA, 14 nt, Human
uuuguauguauaau

SEQ ID NO: 2516330 - RNA, 15 nt, Human
uuuguauguauaauu

SEQ ID NO: 2516331 - RNA, 13 nt, Human
uuuguaugugugu

SEQ ID NO: 2516332 - RNA, 16 nt, Human
uuuguaugcacuuugu

SEQ ID NO: 2516333 - RNA, 14 nt, Human
uuuguauguaaaug

SEQ ID NO: 2516334 - RNA, 12 nt, Human
uuuguauguaaa

SEQ ID NO: 2516335 - RNA, 22 nt, Human
uuuguaugccaagugagaagau

SEQ ID NO: 2516336 - RNA, 15 nt, Human
uuuguggccucagaa

SEQ ID NO: 2516337 - RNA, 12 nt, Human
uuuguauguuuu

SEQ ID NO: 2516338 - RNA, 10 nt, Human
uuuguauguu

SEQ ID NO: 2516339 - RNA, 18 nt, Human
uuuguauguuuuuuuucu

SEQ ID NO: 2516340 - RNA, 20 nt, Human
uuuccuaaauauauuuuaag

SEQ ID NO: 2516341 - RNA, 12 nt, Human
uuuccacuuugu

SEQ ID NO: 2516342 - RNA, 15 nt, Human
uuuccuaaaugcagu

SEQ ID NO: 2516343 - RNA, 14 nt, Human
uuuccuaaauguuu

SEQ ID NO: 2516344 - RNA, 17 nt, Human
uuuccuaaaugcaguga

SEQ ID NO: 2516345 - RNA, 13 nt, Human
uuuccuaaauguu

SEQ ID NO: 2516346 - RNA, 22 nt, Human
uuuccuaacaggauuagacagu

SEQ ID NO: 2516347 - RNA, 18 nt, Human
uuuccuaacaggauuaga

SEQ ID NO: 2516348 - RNA, 19 nt, Human
uuuccacuccuccuagcca

SEQ ID NO: 2516349 - RNA, 12 nt, Human
uuuccacugaag

SEQ ID NO: 2516350 - RNA, 19 nt, Human
uuuccacgaugaaaaacuu

SEQ ID NO: 2516351 - RNA, 18 nt, Human
uuuccacuccuccuagcc

SEQ ID NO: 2516352 - RNA, 23 nt, Human
uuuccacggagccacuccucuga

SEQ ID NO: 2516353 - RNA, 13 nt, Human
uuuccacuacugc

SEQ ID NO: 2516354 - RNA, 14 nt, Human
uuuccacuacugcu

SEQ ID NO: 2516355 - RNA, 15 nt, Human
uuuccacuacugcua

SEQ ID NO: 2516356 - RNA, 23 nt, Human
uuuccaccacagccagcaccugg

SEQ ID NO: 2516357 - RNA, 18 nt, Human
uuuccaaaaguggccucu

SEQ ID NO: 2516358 - RNA, 15 nt, Human
uuuccacccccuccc

SEQ ID NO: 2516359 - RNA, 22 nt, Human
uuuccacccccucccuggccug

SEQ ID NO: 2516360 - RNA, 15 nt, Human
uuucauuuucugcaa

SEQ ID NO: 2516361 - RNA, 14 nt, Human
uuucauuuucugca

SEQ ID NO: 2516362 - RNA, 18 nt, Human
uuucauuuucugcaagcc

SEQ ID NO: 2516363 - RNA, 17 nt, Human
uuuccaaaaaaauacug

SEQ ID NO: 2516364 - RNA, 20 nt, Human
uuucauuuuuuuccaggcug

SEQ ID NO: 2516365 - RNA, 15 nt, Human
uuucauuuuuuucca

SEQ ID NO: 2516366 - RNA, 15 nt, Human
uuucaggugacaugu

SEQ ID NO: 2516367 - RNA, 13 nt, Human
uuucaggugacau

SEQ ID NO: 2516368 - RNA, 14 nt, Human
uuucagcugugaac

SEQ ID NO: 2516369 - RNA, 21 nt, Human
uuucagcgauguaugcagcua

SEQ ID NO: 2516370 - RNA, 22 nt, Human
uuucaggugacaugugaaaccu

SEQ ID NO: 2516371 - RNA, 20 nt, Human
uuucaggugacaugugaaac

SEQ ID NO: 2516372 - RNA, 19 nt, Human
uuucaggugacaugugaaa

SEQ ID NO: 2516373 - RNA, 16 nt, Human
uuucaggugacaugug

SEQ ID NO: 2516374 - RNA, 19 nt, Human
uuucagguuuuaguuuuua

SEQ ID NO: 2516375 - RNA, 14 nt, Human
uuucagguuuuagu

SEQ ID NO: 2516376 - RNA, 18 nt, Human
uuucagguguuuaguugc

SEQ ID NO: 2516377 - RNA, 18 nt, Human
uuucagguuuuguaaaga

SEQ ID NO: 2516378 - RNA, 19 nt, Human
uuucagguuuuguaaagau

SEQ ID NO: 2516379 - RNA, 20 nt, Human
uuucaguauuagugauguca

SEQ ID NO: 2516380 - RNA, 21 nt, Human
uuucaguauuuuggagaaauu

SEQ ID NO: 2516381 - RNA, 21 nt, Human
uuucagucauauaaaagcuau

SEQ ID NO: 2516382 - RNA, 14 nt, Human
uuucauuugccuau

SEQ ID NO: 2516383 - RNA, 13 nt, Human
uuucauuugccua

SEQ ID NO: 2516384 - RNA, 12 nt, Human
uuucauuucuug

SEQ ID NO: 2516385 - RNA, 14 nt, Human
uuucauuucaacug

SEQ ID NO: 2516386 - RNA, 22 nt, Human
uuucauuugccuauucccacac

SEQ ID NO: 2516387 - RNA, 19 nt, Human
uuucauuugguucauuaau

SEQ ID NO: 2516388 - RNA, 22 nt, Human
uuucaaugugauucuaaugucu

SEQ ID NO: 2516389 - RNA, 13 nt, Human
uuucaauuaaacg

SEQ ID NO: 2516390 - RNA, 12 nt, Human
uuucaauuaaac

SEQ ID NO: 2516391 - RNA, 20 nt, Human
uuucaaugugauucuaaugu

SEQ ID NO: 2516392 - RNA, 14 nt, Human
uuucaaugugauuc

SEQ ID NO: 2516393 - RNA, 13 nt, Human
uuucaaugugauu

SEQ ID NO: 2516394 - RNA, 17 nt, Human
uuucaauuaaacggauu

SEQ ID NO: 2516395 - RNA, 16 nt, Human
uuucaauuaaacggau

SEQ ID NO: 2516396 - RNA, 15 nt, Human
uuucaauuaaacgga

SEQ ID NO: 2516397 - RNA, 14 nt, Human
uuucaauuaaacgg

SEQ ID NO: 2516398 - RNA, 19 nt, Human
uuucaauuaaacggauuau

SEQ ID NO: 2516399 - RNA, 18 nt, Human
uuucaauuaaacggauua

SEQ ID NO: 2516400 - RNA, 15 nt, Human
uuuaugcuuuaaaca

SEQ ID NO: 2516401 - RNA, 16 nt, Human
uuuaugcuuuaaacau

SEQ ID NO: 2516402 - RNA, 17 nt, Human
uuuauggaaucuaccaa

SEQ ID NO: 2516403 - RNA, 21 nt, Human
uuuaugcugaaacagaauacu

SEQ ID NO: 2516404 - RNA, 23 nt, Human
uuuauggaggauggagagagggg

SEQ ID NO: 2516405 - RNA, 21 nt, Human
uuucaaugguuugcaaggaag

SEQ ID NO: 2516406 - RNA, 19 nt, Human
uuuaugagccagacaaaug

SEQ ID NO: 2516407 - RNA, 12 nt, Human
uuuaugagccag

SEQ ID NO: 2516408 - RNA, 17 nt, Human
uuuaugagccagacaaa

SEQ ID NO: 2516409 - RNA, 19 nt, Human
uuuaugccuucuuauugcu

SEQ ID NO: 2516410 - RNA, 21 nt, Human
uuuaugccggaugugcuuuuc

SEQ ID NO: 2516411 - RNA, 18 nt, Human
uuuaugccggaugugcuu

SEQ ID NO: 2516412 - RNA, 20 nt, Human
uuuaugcauuugcauuugcu

SEQ ID NO: 2516413 - RNA, 12 nt, Human
uuuaugcuuuaa

SEQ ID NO: 2516414 - RNA, 16 nt, Human
uuuaugcucaauccau

SEQ ID NO: 2516415 - RNA, 20 nt, Human
uuuaugccuuuuauuucuua

SEQ ID NO: 2516416 - RNA, 18 nt, Human
uuucacauagcugucuag

SEQ ID NO: 2516417 - RNA, 16 nt, Human
uuucacauagcugucu

SEQ ID NO: 2516418 - RNA, 17 nt, Human
uuucagccaagaauucu

SEQ ID NO: 2516419 - RNA, 23 nt, Human
uuucagcgacuccguuggccacu

SEQ ID NO: 2516420 - RNA, 18 nt, Human
uuucagcgacuccguugg

SEQ ID NO: 2516421 - RNA, 22 nt, Human
uuucagcgauguaugcagcuau

SEQ ID NO: 2516422 - RNA, 17 nt, Human
uuucagcgauguaugca

SEQ ID NO: 2516423 - RNA, 13 nt, Human
uuucacaguuuuu

SEQ ID NO: 2516424 - RNA, 14 nt, Human
uuucacauagaugu

SEQ ID NO: 2516425 - RNA, 15 nt, Human
uuucacaguuuuucc

SEQ ID NO: 2516426 - RNA, 13 nt, Human
uuucacagcuccu

SEQ ID NO: 2516427 - RNA, 19 nt, Human
uuucacaguguguuuguga

SEQ ID NO: 2516428 - RNA, 15 nt, Human
uuucaauucucaaaa

SEQ ID NO: 2516429 - RNA, 18 nt, Human
uuucaauugcaucuccca

SEQ ID NO: 2516430 - RNA, 14 nt, Human
uuucaauucucaaa

SEQ ID NO: 2516431 - RNA, 21 nt, Human
uuucaauuaaacggauuauuu

SEQ ID NO: 2516432 - RNA, 22 nt, Human
uuucaauuccaccugcaaucaa

SEQ ID NO: 2516433 - RNA, 20 nt, Human
uuucaauugcaucucccaga

SEQ ID NO: 2516434 - RNA, 19 nt, Human
uuucuaaaucuccaaaaua

SEQ ID NO: 2516435 - RNA, 22 nt, Human
uuucuaaaguaaaaacaaagaa

SEQ ID NO: 2516436 - RNA, 14 nt, Human
uuuccuggugccaa

SEQ ID NO: 2516437 - RNA, 16 nt, Human
uuuccuggugccaauu

SEQ ID NO: 2516438 - RNA, 19 nt, Human
uuuccuggugccaauuuca

SEQ ID NO: 2516439 - RNA, 22 nt, Human
uuuccuggugccaauuucaagu

SEQ ID NO: 2516440 - RNA, 17 nt, Human
uuucuaaaguaaaaaca

SEQ ID NO: 2516441 - RNA, 21 nt, Human
uuucuaacaaaaaaauauauu

SEQ ID NO: 2516442 - RNA, 15 nt, Human
uuucuaaugugugaa

SEQ ID NO: 2516443 - RNA, 19 nt, Human
uuuccuguagccuucugua

SEQ ID NO: 2516444 - RNA, 23 nt, Human
uuuccuguaaaaaaaaaaaaguu

SEQ ID NO: 2516445 - RNA, 13 nt, Human
uuucuaaauguuu

SEQ ID NO: 2516446 - RNA, 14 nt, Human
uuucuaaaguaaaa

SEQ ID NO: 2516447 - RNA, 17 nt, Human
uuucuacaaugugaacu

SEQ ID NO: 2516448 - RNA, 18 nt, Human
uuucuacaaugugaacuu

SEQ ID NO: 2516449 - RNA, 22 nt, Human
uuucuacaaugugaacuuuauu

SEQ ID NO: 2516450 - RNA, 18 nt, Human
uuucuacaguauuaugua

SEQ ID NO: 2516451 - RNA, 20 nt, Human
uuuccucuauugauguacag

SEQ ID NO: 2516452 - RNA, 19 nt, Human
uuuccucuauugauguaca

SEQ ID NO: 2516453 - RNA, 22 nt, Human
uuuccuccugaggcuuuggauu

SEQ ID NO: 2516454 - RNA, 14 nt, Human
uuuccuccuuccau

SEQ ID NO: 2516455 - RNA, 22 nt, Human
uuuccucccuuggguucugaua

SEQ ID NO: 2516456 - RNA, 21 nt, Human
uuuccuccugaggcuuuggau

SEQ ID NO: 2516457 - RNA, 22 nt, Human
uuuccuccgucaccucagagac

SEQ ID NO: 2516458 - RNA, 15 nt, Human
uuuccucccuugggu

SEQ ID NO: 2516459 - RNA, 20 nt, Human
uuuccucccuucugcuacug

SEQ ID NO: 2516460 - RNA, 21 nt, Human
uuuccuaauaaaguucuguac

SEQ ID NO: 2516461 - RNA, 23 nt, Human
uuuccuaauaaaguucuguacuc

SEQ ID NO: 2516462 - RNA, 19 nt, Human
uuuccuaagugauuguaug

SEQ ID NO: 2516463 - RNA, 15 nt, Human
uuuccuaaggcugca

SEQ ID NO: 2516464 - RNA, 17 nt, Human
uuuccuaaggcugcaag

SEQ ID NO: 2516465 - RNA, 24 nt, Human
uuuccuaauaaaguucuguacuca

SEQ ID NO: 2516466 - RNA, 19 nt, Human
uuuccucccuucugcuacu

SEQ ID NO: 2516467 - RNA, 23 nt, Human
uuuccuggcacugcuuccaguga

SEQ ID NO: 2516468 - RNA, 22 nt, Human
uuuccucuuagucgagccaagu

SEQ ID NO: 2516469 - RNA, 19 nt, Human
uuuccuggcacugcuucca

SEQ ID NO: 2516470 - RNA, 19 nt, Human
uuuccucucuuuguucuca

SEQ ID NO: 2516471 - RNA, 23 nt, Human
uuuccucucuuuguucucagcuc

SEQ ID NO: 2516472 - RNA, 22 nt, Human
uuuccucucuuuguucucagcu

SEQ ID NO: 2516473 - RNA, 23 nt, Human
uuucugauaacuagauggugcug

SEQ ID NO: 2516474 - RNA, 14 nt, Human
uuucugaaauaaca

SEQ ID NO: 2516475 - RNA, 20 nt, Human
uuucugaaaauuaacacugc

SEQ ID NO: 2516476 - RNA, 16 nt, Human
uuucugaaaauauaac

SEQ ID NO: 2516477 - RNA, 19 nt, Human
uuucugaaaauuaacacug

SEQ ID NO: 2516478 - RNA, 18 nt, Human
uuucuacccagcgagccc

SEQ ID NO: 2516479 - RNA, 15 nt, Human
uuucuacccagcgag

SEQ ID NO: 2516480 - RNA, 19 nt, Human
uuucuacagugguuuuaua

SEQ ID NO: 2516481 - RNA, 16 nt, Human
uuucuaccauuucaga

SEQ ID NO: 2516482 - RNA, 20 nt, Human
uuucuacccuagccauuccu

SEQ ID NO: 2516483 - RNA, 17 nt, Human
uuucuacccuagccauu

SEQ ID NO: 2516484 - RNA, 15 nt, Human
uuucuacccuagcca

SEQ ID NO: 2516485 - RNA, 21 nt, Human
uuucuacaaugugaacuuuau

SEQ ID NO: 2516486 - RNA, 22 nt, Human
uuucuacccagcgagcccuggu

SEQ ID NO: 2516487 - RNA, 12 nt, Human
uuucucuaggaa

SEQ ID NO: 2516488 - RNA, 20 nt, Human
uuucucuccagccugacuug

SEQ ID NO: 2516489 - RNA, 15 nt, Human
uuucuaccucccaga

SEQ ID NO: 2516490 - RNA, 16 nt, Human
uuucuccuuugauaaa

SEQ ID NO: 2516491 - RNA, 14 nt, Human
uuucuaccucccag

SEQ ID NO: 2516492 - RNA, 13 nt, Human
uuucuaccuccca

SEQ ID NO: 2516493 - RNA, 16 nt, Human
uuucuaccuugagguc

SEQ ID NO: 2516494 - RNA, 17 nt, Human
uuucucgauuuuaucuu

SEQ ID NO: 2516495 - RNA, 22 nt, Human
uuucucuaacuucaaggcccau

SEQ ID NO: 2516496 - RNA, 16 nt, Human
uuucuccuuuguacuu

SEQ ID NO: 2516497 - RNA, 13 nt, Human
uugucuuauauau

SEQ ID NO: 2516498 - RNA, 15 nt, Human
uugucuuauauauau

SEQ ID NO: 2516499 - RNA, 18 nt, Human
uugucuugccuuauuaaa

SEQ ID NO: 2516500 - RNA, 22 nt, Human
uugucuugaaugucuuuugaau

SEQ ID NO: 2516501 - RNA, 15 nt, Human
uugucuugaaugucu

SEQ ID NO: 2516502 - RNA, 14 nt, Human
uugucuugaaagau

SEQ ID NO: 2516503 - RNA, 13 nt, Human
uugucuugaaaga

SEQ ID NO: 2516504 - RNA, 16 nt, Human
uugucuucuccccagg

SEQ ID NO: 2516505 - RNA, 15 nt, Human
uugucuucuccccag

SEQ ID NO: 2516506 - RNA, 15 nt, Human
uugucuuuggacccu

SEQ ID NO: 2516507 - RNA, 13 nt, Human
uugucuuucagga

SEQ ID NO: 2516508 - RNA, 14 nt, Human
uugucuuuaacugu

SEQ ID NO: 2516509 - RNA, 14 nt, Human
uugucuuguucugu

SEQ ID NO: 2516510 - RNA, 24 nt, Human
uugucuuuggacccugaggcccag

SEQ ID NO: 2516511 - RNA, 20 nt, Human
uugucuuuggacccugaggc

SEQ ID NO: 2516512 - RNA, 23 nt, Human
uugucuuuguaaugucaccaccu

SEQ ID NO: 2516513 - RNA, 14 nt, Human
uuguuauuauauaa

SEQ ID NO: 2516514 - RNA, 23 nt, Human
uuguuauugggcaagugauugaa

SEQ ID NO: 2516515 - RNA, 23 nt, Human
uuguuauuauauaauuacauauu

SEQ ID NO: 2516516 - RNA, 18 nt, Human
uuguuuacuuaaagauuu

SEQ ID NO: 2516517 - RNA, 16 nt, Human
uuguuuacuuaaagau

SEQ ID NO: 2516518 - RNA, 22 nt, Human
uuguuuacagcacuacucugug

SEQ ID NO: 2516519 - RNA, 15 nt, Human
uuguuuagaagaagu

SEQ ID NO: 2516520 - RNA, 18 nt, Human
uuguuuagaagaagugug

SEQ ID NO: 2516521 - RNA, 17 nt, Human
uuguuuaaagcaacugu

SEQ ID NO: 2516522 - RNA, 13 nt, Human
uuguuuaaagcaa

SEQ ID NO: 2516523 - RNA, 13 nt, Human
uuguuauuuucag

SEQ ID NO: 2516524 - RNA, 19 nt, Human
uuguucaauaauaaauauu

SEQ ID NO: 2516525 - RNA, 21 nt, Human
uuguuuacagcacuacucugu

SEQ ID NO: 2516526 - RNA, 18 nt, Human
uuguuuaaaaucauuucu

SEQ ID NO: 2516527 - RNA, 17 nt, Human
uuguuuaaaaucauuuc

SEQ ID NO: 2516528 - RNA, 15 nt, Human
uuguuauuuguacag

SEQ ID NO: 2516529 - RNA, 14 nt, Human
uuguuauuuauaac

SEQ ID NO: 2516530 - RNA, 15 nt, Human
uuguuauuuugcaac

SEQ ID NO: 2516531 - RNA, 22 nt, Human
uuguuauuuugcaaccucgcug

SEQ ID NO: 2516532 - RNA, 20 nt, Human
uuguucaaaauauguucuuu

SEQ ID NO: 2516533 - RNA, 17 nt, Human
uuguuucucccccuggg

SEQ ID NO: 2516534 - RNA, 21 nt, Human
uuguuuagaaagaauauucau

SEQ ID NO: 2516535 - RNA, 23 nt, Human
uuguuuacuuaaagauuuaucaa

SEQ ID NO: 2516536 - RNA, 18 nt, Human
uuguuuauaccuuugccu

SEQ ID NO: 2516537 - RNA, 20 nt, Human
uuguuuauucuuuuuaaagu

SEQ ID NO: 2516538 - RNA, 20 nt, Human
uuguuuggggaugagaaagg

SEQ ID NO: 2516539 - RNA, 15 nt, Human
uuguuugguauugua

SEQ ID NO: 2516540 - RNA, 15 nt, Human
uuguuucuuccaaag

SEQ ID NO: 2516541 - RNA, 19 nt, Human
uuguuucuuccaaagcaca

SEQ ID NO: 2516542 - RNA, 13 nt, Human
uuguuucuuccaa

SEQ ID NO: 2516543 - RNA, 21 nt, Human
uuguuugguauuguauuuauu

SEQ ID NO: 2516544 - RNA, 15 nt, Human
uuguuucuuucuagu

SEQ ID NO: 2516545 - RNA, 13 nt, Human
uuguuuguaugua

SEQ ID NO: 2516546 - RNA, 19 nt, Human
uuguuuguauguauaauuc

SEQ ID NO: 2516547 - RNA, 19 nt, Human
uuguuugguauuguauuua

SEQ ID NO: 2516548 - RNA, 16 nt, Human
uuguuugguauuguau

SEQ ID NO: 2516549 - RNA, 22 nt, Human
uuguuuguauguauaauucaaa

SEQ ID NO: 2516550 - RNA, 12 nt, Human
uuguuugugcuu

SEQ ID NO: 2516551 - RNA, 11 nt, Human
uuguuugugcu

SEQ ID NO: 2516552 - RNA, 13 nt, Human
uuguuugucuuua

SEQ ID NO: 2516553 - RNA, 15 nt, Human
uuuaaaacagacacu

SEQ ID NO: 2516554 - RNA, 16 nt, Human
uuuaaaacauguaaua

SEQ ID NO: 2516555 - RNA, 15 nt, Human
uuuaaaacauguaau

SEQ ID NO: 2516556 - RNA, 14 nt, Human
uuuaaaacauguaa

SEQ ID NO: 2516557 - RNA, 12 nt, Human
uuguuuguuuca

SEQ ID NO: 2516558 - RNA, 13 nt, Human
uuguuuguuucaa

SEQ ID NO: 2516559 - RNA, 21 nt, Human
uuguuuguuucucccccuggg

SEQ ID NO: 2516560 - RNA, 20 nt, Human
uuguuuuaaaauuaaagcua

SEQ ID NO: 2516561 - RNA, 18 nt, Human
uuguuuuaaaauuaaagc

SEQ ID NO: 2516562 - RNA, 12 nt, Human
uuuaaaaugucu

SEQ ID NO: 2516563 - RNA, 16 nt, Human
uuuaaaaugagaaauc

SEQ ID NO: 2516564 - RNA, 14 nt, Human
uuuaaaaugauuag

SEQ ID NO: 2516565 - RNA, 12 nt, Human
uuuaaaaugauu

SEQ ID NO: 2516566 - RNA, 12 nt, Human
uuuaaacaaauu

SEQ ID NO: 2516567 - RNA, 20 nt, Human
uuuaaacaaaauagaagcug

SEQ ID NO: 2516568 - RNA, 19 nt, Human
uuuaaaauuuuuuuagaaa

SEQ ID NO: 2516569 - RNA, 18 nt, Human
uuuaaaauuuuuuuagaa

SEQ ID NO: 2516570 - RNA, 17 nt, Human
uuuaaaauuuuaucucu

SEQ ID NO: 2516571 - RNA, 19 nt, Human
uuuaaaauuuaaguaucuu

SEQ ID NO: 2516572 - RNA, 16 nt, Human
uuuaaaauugugaugu

SEQ ID NO: 2516573 - RNA, 20 nt, Human
uuuaaacaugguuacaauca

SEQ ID NO: 2516574 - RNA, 21 nt, Human
uuuaaacaggcccagcauugc

SEQ ID NO: 2516575 - RNA, 15 nt, Human
uuuaaacccauuuua

SEQ ID NO: 2516576 - RNA, 17 nt, Human
uuuaaacccauuuuagu

SEQ ID NO: 2516577 - RNA, 21 nt, Human
uuuaaacccauuuuagucacu

SEQ ID NO: 2516578 - RNA, 23 nt, Human
uuuaaacaaauucauauucuguc

SEQ ID NO: 2516579 - RNA, 14 nt, Human
uuuaaacaaauuca

SEQ ID NO: 2516580 - RNA, 14 nt, Human
uuuaaacaccuccu

SEQ ID NO: 2516581 - RNA, 13 nt, Human
uuuaaacagcagu

SEQ ID NO: 2516582 - RNA, 16 nt, Human
uuuaaacauagaaagu

SEQ ID NO: 2516583 - RNA, 16 nt, Human
uuuaaacaggcccagc

SEQ ID NO: 2516584 - RNA, 15 nt, Human
uuuaaacugauucau

SEQ ID NO: 2516585 - RNA, 22 nt, Human
uuuaaaccucaccuuugugggg

SEQ ID NO: 2516586 - RNA, 13 nt, Human
uuuaacagaaaug

SEQ ID NO: 2516587 - RNA, 23 nt, Human
uuuaacaauuuccuuuauauuua

SEQ ID NO: 2516588 - RNA, 14 nt, Human
uuuaaacuguguac

SEQ ID NO: 2516589 - RNA, 19 nt, Human
uuuaacacaaguccuguga

SEQ ID NO: 2516590 - RNA, 18 nt, Human
uuuaacaccugaugugua

SEQ ID NO: 2516591 - RNA, 17 nt, Human
uuuaacaccugaugugu

SEQ ID NO: 2516592 - RNA, 19 nt, Human
uuuaaaagacaagacuuca

SEQ ID NO: 2516593 - RNA, 16 nt, Human
uuuaaaagacaagacu

SEQ ID NO: 2516594 - RNA, 23 nt, Human
uuuaaaagaaugggcaguuacau

SEQ ID NO: 2516595 - RNA, 18 nt, Human
uuuaaaagaaugggcagu

SEQ ID NO: 2516596 - RNA, 17 nt, Human
uuuaaaagaaugggcag

SEQ ID NO: 2516597 - RNA, 11 nt, Human
uuuaaaacuug

SEQ ID NO: 2516598 - RNA, 17 nt, Human
uuuaaaagaaugauuau

SEQ ID NO: 2516599 - RNA, 14 nt, Human
uuuaaaagaaugau

SEQ ID NO: 2516600 - RNA, 14 nt, Human
uuuaaaacccauuu

SEQ ID NO: 2516601 - RNA, 21 nt, Human
uuuaaaacccauuuaaauuuu

SEQ ID NO: 2516602 - RNA, 13 nt, Human
uuuaaaagauaca

SEQ ID NO: 2516603 - RNA, 20 nt, Human
uuuaaaagauaaauauuaua

SEQ ID NO: 2516604 - RNA, 14 nt, Human
uuuaaaagacacug

SEQ ID NO: 2516605 - RNA, 16 nt, Human
uuuaaaagauucauuu

SEQ ID NO: 2516606 - RNA, 18 nt, Human
uuuaaaagaugcaaugua

SEQ ID NO: 2516607 - RNA, 14 nt, Human
uuuaaaagauucau

SEQ ID NO: 2516608 - RNA, 16 nt, Human
uuuaaaaucauuucug

SEQ ID NO: 2516609 - RNA, 15 nt, Human
uuuaaaaucugucac

SEQ ID NO: 2516610 - RNA, 16 nt, Human
uuuaaaaucuuuucua

SEQ ID NO: 2516611 - RNA, 16 nt, Human
uuuaaaauauuuaucu

SEQ ID NO: 2516612 - RNA, 19 nt, Human
uuuaaaauacacacucaaa

SEQ ID NO: 2516613 - RNA, 20 nt, Human
uuuaaaaguuucaaugugau

SEQ ID NO: 2516614 - RNA, 20 nt, Human
uuuaaaaggauuuuuaucuu

SEQ ID NO: 2516615 - RNA, 15 nt, Human
uuuaaaaguuauuaa

SEQ ID NO: 2516616 - RNA, 17 nt, Human
uuuaaaaguuucaaugu

SEQ ID NO: 2516617 - RNA, 19 nt, Human
uuuaaaaguuauuaauauu

SEQ ID NO: 2516618 - RNA, 11 nt, Human
uuuagacagua

SEQ ID NO: 2516619 - RNA, 21 nt, Human
uuuacccauauccccucuccc

SEQ ID NO: 2516620 - RNA, 18 nt, Human
uuuacccauauccccucu

SEQ ID NO: 2516621 - RNA, 17 nt, Human
uuuacccauauccccuc

SEQ ID NO: 2516622 - RNA, 14 nt, Human
uuuacccauauccc

SEQ ID NO: 2516623 - RNA, 19 nt, Human
uuuagacccuauugcugcu

SEQ ID NO: 2516624 - RNA, 16 nt, Human
uuuagacagucucacu

SEQ ID NO: 2516625 - RNA, 20 nt, Human
uuuagacagucucacuuugu

SEQ ID NO: 2516626 - RNA, 15 nt, Human
uuuagaccauuuauc

SEQ ID NO: 2516627 - RNA, 18 nt, Human
uuuaguugcaacuuugua

SEQ ID NO: 2516628 - RNA, 17 nt, Human
uuuaguugcaacuuugu

SEQ ID NO: 2516629 - RNA, 15 nt, Human
uuuagacuguagccu

SEQ ID NO: 2516630 - RNA, 13 nt, Human
uuuaguuauaguu

SEQ ID NO: 2516631 - RNA, 15 nt, Human
uuuaguuauaguuuc

SEQ ID NO: 2516632 - RNA, 14 nt, Human
uuuaguuauaguuu

SEQ ID NO: 2516633 - RNA, 22 nt, Human
uuuagacccuauugcugcuuga

SEQ ID NO: 2516634 - RNA, 19 nt, Human
uuuauacaccaauugauuu

SEQ ID NO: 2516635 - RNA, 15 nt, Human
uuuauacacauaauu

SEQ ID NO: 2516636 - RNA, 12 nt, Human
uuuauacacaua

SEQ ID NO: 2516637 - RNA, 11 nt, Human
uuuauacacau

SEQ ID NO: 2516638 - RNA, 23 nt, Human
uuuauacaacagugcuaaaaaug

SEQ ID NO: 2516639 - RNA, 19 nt, Human
uuuauacaacagugcuaaa

SEQ ID NO: 2516640 - RNA, 16 nt, Human
uuuauacaauaucauc

SEQ ID NO: 2516641 - RNA, 18 nt, Human
uuuauacaacagugcuaa

SEQ ID NO: 2516642 - RNA, 17 nt, Human
uuuauacaacagugcua

SEQ ID NO: 2516643 - RNA, 16 nt, Human
uuuauacaacagugcu

SEQ ID NO: 2516644 - RNA, 15 nt, Human
uuuauacaacagugc

SEQ ID NO: 2516645 - RNA, 19 nt, Human
uuuauacaaauuagaaaau

SEQ ID NO: 2516646 - RNA, 16 nt, Human
uuuauaaaugcuauuu

SEQ ID NO: 2516647 - RNA, 13 nt, Human
uuuauaaaugcua

SEQ ID NO: 2516648 - RNA, 12 nt, Human
uuuauaaaugcu

SEQ ID NO: 2516649 - RNA, 19 nt, Human
uuuauaaaucgcuuuugau

SEQ ID NO: 2516650 - RNA, 15 nt, Human
uuuauaaaugcuauu

SEQ ID NO: 2516651 - RNA, 14 nt, Human
uuuauaaaugcuau

SEQ ID NO: 2516652 - RNA, 18 nt, Human
uuuauaaacuuuaccuuu

SEQ ID NO: 2516653 - RNA, 17 nt, Human
uuuaguucuuuggaaau

SEQ ID NO: 2516654 - RNA, 11 nt, Human
uuuaguucuuu

SEQ ID NO: 2516655 - RNA, 19 nt, Human
uuuaguugcagaaacauuu

SEQ ID NO: 2516656 - RNA, 15 nt, Human
uuuauaaaucgcuuu

SEQ ID NO: 2516657 - RNA, 18 nt, Human
uuuauaaaucgcuuuuga

SEQ ID NO: 2516658 - RNA, 22 nt, Human
uuuauaaaucgcuuuugauaau

SEQ ID NO: 2516659 - RNA, 20 nt, Human
uuuaguuguaucucuuuuga

SEQ ID NO: 2516660 - RNA, 19 nt, Human
uuuaguugcagacucaguu

SEQ ID NO: 2516661 - RNA, 17 nt, Human
uuuaguuguaucucuuu

SEQ ID NO: 2516662 - RNA, 13 nt, Human
uuuaucuguucuu

SEQ ID NO: 2516663 - RNA, 14 nt, Human
uuuaucuugucucu

SEQ ID NO: 2516664 - RNA, 15 nt, Human
uuuaucuugggacug

SEQ ID NO: 2516665 - RNA, 21 nt, Human
uuuaucuuggacugacauuua

SEQ ID NO: 2516666 - RNA, 16 nt, Human
uuuaucuguaguaaac

SEQ ID NO: 2516667 - RNA, 19 nt, Human
uuuaucuguaguaaacuau

SEQ ID NO: 2516668 - RNA, 20 nt, Human
uuuaugacuucauuaauaau

SEQ ID NO: 2516669 - RNA, 16 nt, Human
uuuaugaauuaaagua

SEQ ID NO: 2516670 - RNA, 18 nt, Human
uuuaugaauuaaaguaau

SEQ ID NO: 2516671 - RNA, 20 nt, Human
uuuaugaaugaaaaaacagu

SEQ ID NO: 2516672 - RNA, 19 nt, Human
uuuauccugaaauuucaga

SEQ ID NO: 2516673 - RNA, 18 nt, Human
uuuauccugaaauuucag

SEQ ID NO: 2516674 - RNA, 18 nt, Human
uuuauccucuuuagaguu

SEQ ID NO: 2516675 - RNA, 13 nt, Human
uuuaucucuauuu

SEQ ID NO: 2516676 - RNA, 13 nt, Human
uuuaucugauuaa

SEQ ID NO: 2516677 - RNA, 17 nt, Human
uuuaucucuauuuaaua

SEQ ID NO: 2516678 - RNA, 14 nt, Human
uuuaucucuauuua

SEQ ID NO: 2516679 - RNA, 17 nt, Human
uuuaucugggauuaugg

SEQ ID NO: 2516680 - RNA, 12 nt, Human
uuuauacauaaa

SEQ ID NO: 2516681 - RNA, 20 nt, Human
uuuauacauaaacaagacca

SEQ ID NO: 2516682 - RNA, 16 nt, Human
uuuauacguguagcua

SEQ ID NO: 2516683 - RNA, 15 nt, Human
uuuauacguguagcu

SEQ ID NO: 2516684 - RNA, 16 nt, Human
uuuauacucuuucugu

SEQ ID NO: 2516685 - RNA, 16 nt, Human
uuuaucccucaccugu

SEQ ID NO: 2516686 - RNA, 21 nt, Human
uuuauccauucaacugaaaau

SEQ ID NO: 2516687 - RNA, 12 nt, Human
uuuaucauuuuc

SEQ ID NO: 2516688 - RNA, 16 nt, Human
uuuauacuguuuacug

SEQ ID NO: 2516689 - RNA, 13 nt, Human
uuuauacuguaua

SEQ ID NO: 2516690 - RNA, 18 nt, Human
uuuauacucuuucuguau

SEQ ID NO: 2516691 - RNA, 20 nt, Human
uuuauacucuuucuguauau

SEQ ID NO: 2516692 - RNA, 16 nt, Human
uuuauacugaaggaaa

SEQ ID NO: 2516693 - RNA, 17 nt, Human
uuuauacguguagcuau

SEQ ID NO: 2516694 - RNA, 15 nt, Human
uuuaauaauguuuca

SEQ ID NO: 2516695 - RNA, 14 nt, Human
uuuaauaauguuuc

SEQ ID NO: 2516696 - RNA, 13 nt, Human
uuuaauaaaccau

SEQ ID NO: 2516697 - RNA, 22 nt, Human
uuuaauaaacacucuugaaaaa

SEQ ID NO: 2516698 - RNA, 23 nt, Human
uuuaauauaaaguaguccuguga

SEQ ID NO: 2516699 - RNA, 17 nt, Human
uuuaauaguguuaauca

SEQ ID NO: 2516700 - RNA, 14 nt, Human
uuuaauaguguuaa

SEQ ID NO: 2516701 - RNA, 12 nt, Human
uuuaauaguguu

SEQ ID NO: 2516702 - RNA, 22 nt, Human
uuuaauaguguuaaucaauuua

SEQ ID NO: 2516703 - RNA, 18 nt, Human
uuuaauaguguuaaucaa

SEQ ID NO: 2516704 - RNA, 15 nt, Human
uuuaauauaaagccu

SEQ ID NO: 2516705 - RNA, 19 nt, Human
uuuaauaauguuucaaaca

SEQ ID NO: 2516706 - RNA, 16 nt, Human
uuuaaccuaugauauu

SEQ ID NO: 2516707 - RNA, 21 nt, Human
uuuaacaccugauguguacau

SEQ ID NO: 2516708 - RNA, 21 nt, Human
uuuaaccaaaggugaaggaau

SEQ ID NO: 2516709 - RNA, 15 nt, Human
uuuaaccaaagguga

SEQ ID NO: 2516710 - RNA, 13 nt, Human
uuuaaccaaaggu

SEQ ID NO: 2516711 - RNA, 12 nt, Human
uuuaaccaaagg

SEQ ID NO: 2516712 - RNA, 19 nt, Human
uuuaaccaaaacaugucuc

SEQ ID NO: 2516713 - RNA, 14 nt, Human
uuuaaccaaaacau

SEQ ID NO: 2516714 - RNA, 14 nt, Human
uuuaacagaaaugu

SEQ ID NO: 2516715 - RNA, 15 nt, Human
uuuaacagaaaugua

SEQ ID NO: 2516716 - RNA, 15 nt, Human
uuuaauaaacacucu

SEQ ID NO: 2516717 - RNA, 14 nt, Human
uuuaauaaacacuc

SEQ ID NO: 2516718 - RNA, 22 nt, Human
uuuaaccauugucuuguucugu

SEQ ID NO: 2516719 - RNA, 20 nt, Human
uuuaaccauuaaaacugaag

SEQ ID NO: 2516720 - RNA, 23 nt, Human
uuuaaccaaaggugaaggaauau

SEQ ID NO: 2516721 - RNA, 17 nt, Human
uuuaaccauuaaaacug

SEQ ID NO: 2516722 - RNA, 18 nt, Human
uuuaauauggguucuuuu

SEQ ID NO: 2516723 - RNA, 15 nt, Human
uuuaauauagcuauu

SEQ ID NO: 2516724 - RNA, 16 nt, Human
uuuaauauagcuauuu

SEQ ID NO: 2516725 - RNA, 14 nt, Human
uuuaauauagcuau

SEQ ID NO: 2516726 - RNA, 20 nt, Human
uuuacagaggacaguauuug

SEQ ID NO: 2516727 - RNA, 13 nt, Human
uuuacagagacag

SEQ ID NO: 2516728 - RNA, 15 nt, Human
uuuaauauuuaaaca

SEQ ID NO: 2516729 - RNA, 13 nt, Human
uuuaauauuuaaa

SEQ ID NO: 2516730 - RNA, 14 nt, Human
uuuaauauuuugca

SEQ ID NO: 2516731 - RNA, 18 nt, Human
uuuaauauuuaaacagca

SEQ ID NO: 2516732 - RNA, 15 nt, Human
uuuaauauugagaaa

SEQ ID NO: 2516733 - RNA, 22 nt, Human
uuuaauauugagaaagaaacua

SEQ ID NO: 2516734 - RNA, 12 nt, Human
uuuaauauuuaa

SEQ ID NO: 2516735 - RNA, 18 nt, Human
uuuacaugaauugcauuu

SEQ ID NO: 2516736 - RNA, 21 nt, Human
uuuacaguuucaaaaacugua

SEQ ID NO: 2516737 - RNA, 18 nt, Human
uuuacagcacuacucugu

SEQ ID NO: 2516738 - RNA, 15 nt, Human
uuuacauacugcugu

SEQ ID NO: 2516739 - RNA, 13 nt, Human
uuuacagcugccu

SEQ ID NO: 2516740 - RNA, 16 nt, Human
uuuacagcacuacucu

SEQ ID NO: 2516741 - RNA, 15 nt, Human
uuuacagcacuacuc

SEQ ID NO: 2516742 - RNA, 17 nt, Human
uuuacagaugaauguau

SEQ ID NO: 2516743 - RNA, 21 nt, Human
uuuacagcacuacucugugcc

SEQ ID NO: 2516744 - RNA, 20 nt, Human
uuuacagccucacuugaaug

SEQ ID NO: 2516745 - RNA, 20 nt, Human
uuuacaugcaauuuauuaaa

SEQ ID NO: 2516746 - RNA, 23 nt, Human
uuuaccagccuccguauuucaga

SEQ ID NO: 2516747 - RNA, 20 nt, Human
uuuaccaugccccugagcaa

SEQ ID NO: 2516748 - RNA, 18 nt, Human
uuuacccaaaaacuaaau

SEQ ID NO: 2516749 - RNA, 19 nt, Human
uuuacccacacacagauaa

SEQ ID NO: 2516750 - RNA, 20 nt, Human
uugauucuccuucagcccuc

SEQ ID NO: 2516751 - RNA, 15 nt, Human
uugcacuccagccug

SEQ ID NO: 2516752 - RNA, 17 nt, Human
uugauucuccuucagcc

SEQ ID NO: 2516753 - RNA, 13 nt, Human
uugauucuccuuc

SEQ ID NO: 2516754 - RNA, 12 nt, Human
uugauucuccuu

SEQ ID NO: 2516755 - RNA, 21 nt, Human
uugaucugcucagcccuggag

SEQ ID NO: 2516756 - RNA, 20 nt, Human
uugaucugcucagcccugga

SEQ ID NO: 2516757 - RNA, 22 nt, Human
uugaucugcucagcccuggagg

SEQ ID NO: 2516758 - RNA, 23 nt, Human
uugauucgguauccccccaucuu

SEQ ID NO: 2516759 - RNA, 19 nt, Human
uugauucauaguaacuucu

SEQ ID NO: 2516760 - RNA, 17 nt, Human
uugauucauaaugacuu

SEQ ID NO: 2516761 - RNA, 13 nt, Human
uugauucauaaug

SEQ ID NO: 2516762 - RNA, 20 nt, Human
uugcacuugugauuauuuau

SEQ ID NO: 2516763 - RNA, 17 nt, Human
uugcacuggaguucuau

SEQ ID NO: 2516764 - RNA, 15 nt, Human
uugcagaaacauuuu

SEQ ID NO: 2516765 - RNA, 17 nt, Human
uugcagaaaagcaccug

SEQ ID NO: 2516766 - RNA, 18 nt, Human
uugcagaaaagcaccugc

SEQ ID NO: 2516767 - RNA, 19 nt, Human
uugcagaaaagcaccugcc

SEQ ID NO: 2516768 - RNA, 20 nt, Human
uugcagaaaagcaccugccg

SEQ ID NO: 2516769 - RNA, 21 nt, Human
uugcacugagggccacacuau

SEQ ID NO: 2516770 - RNA, 16 nt, Human
uugcacugagggccac

SEQ ID NO: 2516771 - RNA, 17 nt, Human
uugcacuugugauuauu

SEQ ID NO: 2516772 - RNA, 13 nt, Human
uugcacugagggc

SEQ ID NO: 2516773 - RNA, 12 nt, Human
uugcacugaggg

SEQ ID NO: 2516774 - RNA, 17 nt, Human
uugcacucuagccuggg

SEQ ID NO: 2516775 - RNA, 22 nt, Human
uugcacucuaaaagguucaggg

SEQ ID NO: 2516776 - RNA, 16 nt, Human
uugcacuccagccugg

SEQ ID NO: 2516777 - RNA, 19 nt, Human
uugcacucuaaaagguuca

SEQ ID NO: 2516778 - RNA, 18 nt, Human
uugcagauucauuuuucu

SEQ ID NO: 2516779 - RNA, 19 nt, Human
uugcagaugacaaaaauuc

SEQ ID NO: 2516780 - RNA, 14 nt, Human
uugcagaugacaaa

SEQ ID NO: 2516781 - RNA, 19 nt, Human
uugcagagacaggaccuga

SEQ ID NO: 2516782 - RNA, 23 nt, Human
uugcagcagugagucucuucaga

SEQ ID NO: 2516783 - RNA, 18 nt, Human
uugcagcacucacacagg

SEQ ID NO: 2516784 - RNA, 12 nt, Human
uugcagcaguga

SEQ ID NO: 2516785 - RNA, 14 nt, Human
uugcagcagugagu

SEQ ID NO: 2516786 - RNA, 23 nt, Human
uugcagacaggcaagcaccuccu

SEQ ID NO: 2516787 - RNA, 13 nt, Human
uugcagacuagaa

SEQ ID NO: 2516788 - RNA, 21 nt, Human
uugcagaaaagcaccugccga

SEQ ID NO: 2516789 - RNA, 20 nt, Human
uugcagacuagaauucuagu

SEQ ID NO: 2516790 - RNA, 19 nt, Human
uugcagacucaguuuguca

SEQ ID NO: 2516791 - RNA, 14 nt, Human
uugcagagacagga

SEQ ID NO: 2516792 - RNA, 20 nt, Human
uugcaguguggugagaucau

SEQ ID NO: 2516793 - RNA, 18 nt, Human
uugcaguuuaucauucaa

SEQ ID NO: 2516794 - RNA, 13 nt, Human
uugcaguuuauca

SEQ ID NO: 2516795 - RNA, 13 nt, Human
uugcaguucaccu

SEQ ID NO: 2516796 - RNA, 16 nt, Human
uugcaguucagcacca

SEQ ID NO: 2516797 - RNA, 20 nt, Human
uugcagccggcacagggucu

SEQ ID NO: 2516798 - RNA, 18 nt, Human
uugcagccggcacagggu

SEQ ID NO: 2516799 - RNA, 18 nt, Human
uugcagcgauuaauaaca

SEQ ID NO: 2516800 - RNA, 19 nt, Human
uugcagcgauuaauaacag

SEQ ID NO: 2516801 - RNA, 12 nt, Human
uugccaggcuag

SEQ ID NO: 2516802 - RNA, 23 nt, Human
uugccaucugcgugacaauaaaa

SEQ ID NO: 2516803 - RNA, 19 nt, Human
uugccauguuggccaggcu

SEQ ID NO: 2516804 - RNA, 18 nt, Human
uugccauguuggccaggc

SEQ ID NO: 2516805 - RNA, 17 nt, Human
uugccauguuggccagg

SEQ ID NO: 2516806 - RNA, 16 nt, Human
uugccauguuggccag

SEQ ID NO: 2516807 - RNA, 19 nt, Human
uugccauauuuucaccauu

SEQ ID NO: 2516808 - RNA, 23 nt, Human
uugccauauugcacaugucuuaa

SEQ ID NO: 2516809 - RNA, 22 nt, Human
uugccagcuuuuccucccuugg

SEQ ID NO: 2516810 - RNA, 20 nt, Human
uugccagcuuuuccucccuu

SEQ ID NO: 2516811 - RNA, 19 nt, Human
uugccagcuuuuccucccu

SEQ ID NO: 2516812 - RNA, 18 nt, Human
uugccagcuuuuccuccc

SEQ ID NO: 2516813 - RNA, 12 nt, Human
uugccagcuuuu

SEQ ID NO: 2516814 - RNA, 19 nt, Human
uugccagcugcugcuggau

SEQ ID NO: 2516815 - RNA, 15 nt, Human
uugccagcugcugcu

SEQ ID NO: 2516816 - RNA, 17 nt, Human
uugccagaaagcauaaa

SEQ ID NO: 2516817 - RNA, 20 nt, Human
uugcaguuuaucauucaagu

SEQ ID NO: 2516818 - RNA, 19 nt, Human
uugcaguuuaucauucaag

SEQ ID NO: 2516819 - RNA, 23 nt, Human
uugcaguuuaucauucaagugua

SEQ ID NO: 2516820 - RNA, 19 nt, Human
uugcauaacaauuccucua

SEQ ID NO: 2516821 - RNA, 16 nt, Human
uugcauaacguauaaa

SEQ ID NO: 2516822 - RNA, 19 nt, Human
uugccagagauccaaaaga

SEQ ID NO: 2516823 - RNA, 14 nt, Human
uugccagagaugga

SEQ ID NO: 2516824 - RNA, 20 nt, Human
uugccagaaagcauaaaauu

SEQ ID NO: 2516825 - RNA, 22 nt, Human
uugccagacauguggugggaca

SEQ ID NO: 2516826 - RNA, 15 nt, Human
uugcauaauaagcua

SEQ ID NO: 2516827 - RNA, 20 nt, Human
uugcauaauaagcuaaagag

SEQ ID NO: 2516828 - RNA, 15 nt, Human
uugccagaaagcaua

SEQ ID NO: 2516829 - RNA, 21 nt, Human
uugaucccuguuacccagaga

SEQ ID NO: 2516830 - RNA, 19 nt, Human
uugaucgccuuucccaggu

SEQ ID NO: 2516831 - RNA, 19 nt, Human
uugaucugcucagcccugg

SEQ ID NO: 2516832 - RNA, 18 nt, Human
uugaucugcucagcccug

SEQ ID NO: 2516833 - RNA, 17 nt, Human
uugaucugcucagcccu

SEQ ID NO: 2516834 - RNA, 17 nt, Human
uugauccagaaagaaaa

SEQ ID NO: 2516835 - RNA, 18 nt, Human
uugaucauuuucccccca

SEQ ID NO: 2516836 - RNA, 19 nt, Human
uugaucauuuuccccccac

SEQ ID NO: 2516837 - RNA, 22 nt, Human
uugaucauuuuccccccacucu

SEQ ID NO: 2516838 - RNA, 21 nt, Human
uugauucagacagcugccugg

SEQ ID NO: 2516839 - RNA, 17 nt, Human
uugauucagacagcugc

SEQ ID NO: 2516840 - RNA, 23 nt, Human
uugauucagacagcugccuggga

SEQ ID NO: 2516841 - RNA, 16 nt, Human
uugauucagcucugca

SEQ ID NO: 2516842 - RNA, 20 nt, Human
uugauaugccuuuucccaac

SEQ ID NO: 2516843 - RNA, 19 nt, Human
uugaggccugcccucaggg

SEQ ID NO: 2516844 - RNA, 14 nt, Human
uugaggcugcagcg

SEQ ID NO: 2516845 - RNA, 13 nt, Human
uugauaugaaaaa

SEQ ID NO: 2516846 - RNA, 16 nt, Human
uugauaugcuuauaca

SEQ ID NO: 2516847 - RNA, 16 nt, Human
uugauaugaaaaauau

SEQ ID NO: 2516848 - RNA, 21 nt, Human
uugauaugaaaaauaugauau

SEQ ID NO: 2516849 - RNA, 17 nt, Human
uugaucaaauucauuuu

SEQ ID NO: 2516850 - RNA, 17 nt, Human
uugaucaacaucuuuuc

SEQ ID NO: 2516851 - RNA, 22 nt, Human
uugaucaacaucuuuucuugcc

SEQ ID NO: 2516852 - RNA, 18 nt, Human
uugaucaacaucuuuucu

SEQ ID NO: 2516853 - RNA, 18 nt, Human
uugaucagaucugacaug

SEQ ID NO: 2516854 - RNA, 14 nt, Human
uugaucaguauaau

SEQ ID NO: 2516855 - RNA, 22 nt, Human
uugauaugaaaaauaugauauu

SEQ ID NO: 2516856 - RNA, 22 nt, Human
uugauauuuucaacgcagcccu

SEQ ID NO: 2516857 - RNA, 22 nt, Human
uugaggauauauuuucacuuug

SEQ ID NO: 2516858 - RNA, 21 nt, Human
uugaggauauauuuucacuuu

SEQ ID NO: 2516859 - RNA, 13 nt, Human
uugaggaguguga

SEQ ID NO: 2516860 - RNA, 18 nt, Human
uugaggauauauuuucac

SEQ ID NO: 2516861 - RNA, 16 nt, Human
uugaggauuuugagua

SEQ ID NO: 2516862 - RNA, 15 nt, Human
uugaggauuuugagu

SEQ ID NO: 2516863 - RNA, 17 nt, Human
uugaggauuuugaguau

SEQ ID NO: 2516864 - RNA, 13 nt, Human
uugaggccaggag

SEQ ID NO: 2516865 - RNA, 19 nt, Human
uugaggaggggcagguaaa

SEQ ID NO: 2516866 - RNA, 16 nt, Human
uugaggagccccagcu

SEQ ID NO: 2516867 - RNA, 19 nt, Human
uugaggagcagcuucaguu

SEQ ID NO: 2516868 - RNA, 12 nt, Human
uugaggagcccc

SEQ ID NO: 2516869 - RNA, 17 nt, Human
uugaggacuauggaaau

SEQ ID NO: 2516870 - RNA, 22 nt, Human
uugagcugaaaugcugcauuuu

SEQ ID NO: 2516871 - RNA, 14 nt, Human
uugagcugaaaugc

SEQ ID NO: 2516872 - RNA, 14 nt, Human
uugagcugagaugg

SEQ ID NO: 2516873 - RNA, 19 nt, Human
uugagccuugaacuuugac

SEQ ID NO: 2516874 - RNA, 18 nt, Human
uugaauuguaacuguucu

SEQ ID NO: 2516875 - RNA, 15 nt, Human
uugagcuauugcugu

SEQ ID NO: 2516876 - RNA, 13 nt, Human
uugagcucagccc

SEQ ID NO: 2516877 - RNA, 19 nt, Human
uugagcucugcagcccagg

SEQ ID NO: 2516878 - RNA, 18 nt, Human
uugagcucucucauuguc

SEQ ID NO: 2516879 - RNA, 23 nt, Human
uugagcucagacccccacucuca

SEQ ID NO: 2516880 - RNA, 15 nt, Human
uugagccuugaacuu

SEQ ID NO: 2516881 - RNA, 16 nt, Human
uugagccuugaacuuu

SEQ ID NO: 2516882 - RNA, 14 nt, Human
uugagccuugaacu

SEQ ID NO: 2516883 - RNA, 14 nt, Human
uugagccugggagg

SEQ ID NO: 2516884 - RNA, 13 nt, Human
uugaauuaucuug

SEQ ID NO: 2516885 - RNA, 18 nt, Human
uugaauuaucuugguuga

SEQ ID NO: 2516886 - RNA, 20 nt, Human
uugaauuaucuugguugaaa

SEQ ID NO: 2516887 - RNA, 22 nt, Human
uugaauuaucuugguugaaaau

SEQ ID NO: 2516888 - RNA, 21 nt, Human
uugaauucuugguugaggaaa

SEQ ID NO: 2516889 - RNA, 15 nt, Human
uugaauuguaacugu

SEQ ID NO: 2516890 - RNA, 20 nt, Human
uugaauugaggggauuaaua

SEQ ID NO: 2516891 - RNA, 23 nt, Human
uugaauguuauuuguuauuuuca

SEQ ID NO: 2516892 - RNA, 20 nt, Human
uugaauguuaaauaaauugu

SEQ ID NO: 2516893 - RNA, 17 nt, Human
uugaauuaaauuaggaa

SEQ ID NO: 2516894 - RNA, 22 nt, Human
uugaauuaaauuaggaauaaau

SEQ ID NO: 2516895 - RNA, 23 nt, Human
uugaauuaauaucccuacaugua

SEQ ID NO: 2516896 - RNA, 23 nt, Human
uugaauuaaauuaggaauaaaua

SEQ ID NO: 2516897 - RNA, 23 nt, Human
uugaauuagaaacauaaauaaaa

SEQ ID NO: 2516898 - RNA, 14 nt, Human
uugaauuagaaaca

SEQ ID NO: 2516899 - RNA, 17 nt, Human
uucuguggaaaguguaa

SEQ ID NO: 2516900 - RNA, 16 nt, Human
uucuguggaaagugua

SEQ ID NO: 2516901 - RNA, 15 nt, Human
uucuguggaaagugu

SEQ ID NO: 2516902 - RNA, 13 nt, Human
uucuguggaaagu

SEQ ID NO: 2516903 - RNA, 19 nt, Human
uucuguggaaaguguaaag

SEQ ID NO: 2516904 - RNA, 18 nt, Human
uucuguggaaaguguaaa

SEQ ID NO: 2516905 - RNA, 20 nt, Human
uucuguggaaaguguaaagc

SEQ ID NO: 2516906 - RNA, 15 nt, Human
uucugugccugaaua

SEQ ID NO: 2516907 - RNA, 16 nt, Human
uucugugccugaauau

SEQ ID NO: 2516908 - RNA, 17 nt, Human
uucugugccugaauauu

SEQ ID NO: 2516909 - RNA, 13 nt, Human
uucugugccugaa

SEQ ID NO: 2516910 - RNA, 19 nt, Human
uucugugagacccccacac

SEQ ID NO: 2516911 - RNA, 14 nt, Human
uucugucuuuagau

SEQ ID NO: 2516912 - RNA, 21 nt, Human
uucuguauacaacccuggcau

SEQ ID NO: 2516913 - RNA, 13 nt, Human
uucuguauacaac

SEQ ID NO: 2516914 - RNA, 24 nt, Human
uucuguauacaacccuggcauuau

SEQ ID NO: 2516915 - RNA, 23 nt, Human
uucuguauacaacccuggcauua

SEQ ID NO: 2516916 - RNA, 15 nt, Human
uucuguauauacuuu

SEQ ID NO: 2516917 - RNA, 16 nt, Human
uucuguauauacuuuu

SEQ ID NO: 2516918 - RNA, 17 nt, Human
uucuguauauacuuuuu

SEQ ID NO: 2516919 - RNA, 24 nt, Human
uucuaaguaaaaccacagcaguug

SEQ ID NO: 2516920 - RNA, 17 nt, Human
uucuaagucuuuccauu

SEQ ID NO: 2516921 - RNA, 12 nt, Human
uucuaagucuuu

SEQ ID NO: 2516922 - RNA, 15 nt, Human
uucuaagucuuucca

SEQ ID NO: 2516923 - RNA, 20 nt, Human
uucuggcagaguugaagaca

SEQ ID NO: 2516924 - RNA, 15 nt, Human
uucuggcagaggagg

SEQ ID NO: 2516925 - RNA, 16 nt, Human
uucuggcuaugcauuu

SEQ ID NO: 2516926 - RNA, 15 nt, Human
uucuggccucccaca

SEQ ID NO: 2516927 - RNA, 14 nt, Human
uucuggccucccac

SEQ ID NO: 2516928 - RNA, 17 nt, Human
uucuucagaagacacug

SEQ ID NO: 2516929 - RNA, 17 nt, Human
uucuucagaucagugcu

SEQ ID NO: 2516930 - RNA, 23 nt, Human
uucuucagccaccucucuuuuuc

SEQ ID NO: 2516931 - RNA, 21 nt, Human
uucuucauaacaauuuuagga

SEQ ID NO: 2516932 - RNA, 18 nt, Human
uucuucauaacaauuuua

SEQ ID NO: 2516933 - RNA, 14 nt, Human
uucuucagccaccu

SEQ ID NO: 2516934 - RNA, 19 nt, Human
uucuuguauuaagaaugaa

SEQ ID NO: 2516935 - RNA, 18 nt, Human
uucuuguauuaagaauga

SEQ ID NO: 2516936 - RNA, 20 nt, Human
uucuucauucaauacaagug

SEQ ID NO: 2516937 - RNA, 21 nt, Human
uucuucauccggcagccugga

SEQ ID NO: 2516938 - RNA, 14 nt, Human
uucuucaugcaaug

SEQ ID NO: 2516939 - RNA, 15 nt, Human
uucuucaugcaauga

SEQ ID NO: 2516940 - RNA, 17 nt, Human
uucuucaugcaaugaca

SEQ ID NO: 2516941 - RNA, 18 nt, Human
uucuucaugcaaugacau

SEQ ID NO: 2516942 - RNA, 22 nt, Human
uucuugugccauagucacaugg

SEQ ID NO: 2516943 - RNA, 22 nt, Human
uucuugugacagauuauacaga

SEQ ID NO: 2516944 - RNA, 14 nt, Human
uucuuuaacuuaau

SEQ ID NO: 2516945 - RNA, 19 nt, Human
uucuugucugauuggcuca

SEQ ID NO: 2516946 - RNA, 14 nt, Human
uucuugucaaaaaa

SEQ ID NO: 2516947 - RNA, 13 nt, Human
uucuugucaaaaa

SEQ ID NO: 2516948 - RNA, 13 nt, Human
uucuucagagacu

SEQ ID NO: 2516949 - RNA, 15 nt, Human
uucuuaucuucugca

SEQ ID NO: 2516950 - RNA, 19 nt, Human
uucuuauucucacuccacc

SEQ ID NO: 2516951 - RNA, 17 nt, Human
uucuuauguugcccagu

SEQ ID NO: 2516952 - RNA, 23 nt, Human
uucuuaugccauguuaauuucau

SEQ ID NO: 2516953 - RNA, 15 nt, Human
uucuuauggaauuga

SEQ ID NO: 2516954 - RNA, 17 nt, Human
uucuuauggaauugauu

SEQ ID NO: 2516955 - RNA, 18 nt, Human
uucuuauggaauugauuu

SEQ ID NO: 2516956 - RNA, 22 nt, Human
uucuuauggaauugauuugcau

SEQ ID NO: 2516957 - RNA, 21 nt, Human
uucuuauguaugugaaaguua

SEQ ID NO: 2516958 - RNA, 19 nt, Human
uucuuaggguuaugauuaa

SEQ ID NO: 2516959 - RNA, 17 nt, Human
uucuuagggaaggauac

SEQ ID NO: 2516960 - RNA, 20 nt, Human
uucuuagcuuuuuaauuguu

SEQ ID NO: 2516961 - RNA, 19 nt, Human
uucuuagcuuuuuaauugu

SEQ ID NO: 2516962 - RNA, 13 nt, Human
uucuuagugacuu

SEQ ID NO: 2516963 - RNA, 15 nt, Human
uucuuagcuuuuuaa

SEQ ID NO: 2516964 - RNA, 23 nt, Human
uucuuagcucuuaauuguucauu

SEQ ID NO: 2516965 - RNA, 13 nt, Human
uucuuagugucac

SEQ ID NO: 2516966 - RNA, 15 nt, Human
uucuuaguagauuuu

SEQ ID NO: 2516967 - RNA, 16 nt, Human
uucuuaucuucugcaa

SEQ ID NO: 2516968 - RNA, 16 nt, Human
uucuuauauaugugaa

SEQ ID NO: 2516969 - RNA, 17 nt, Human
uugaauguuaagcagau

SEQ ID NO: 2516970 - RNA, 14 nt, Human
uugaauguuaagca

SEQ ID NO: 2516971 - RNA, 18 nt, Human
uugaauguuaaauaaauu

SEQ ID NO: 2516972 - RNA, 15 nt, Human
uugaauguuaaauaa

SEQ ID NO: 2516973 - RNA, 13 nt, Human
uugaauguuaaau

SEQ ID NO: 2516974 - RNA, 19 nt, Human
uugaauguggcuugagaaa

SEQ ID NO: 2516975 - RNA, 21 nt, Human
uugaauguggcuugagaaaua

SEQ ID NO: 2516976 - RNA, 22 nt, Human
uugaauguggcuugagaaauau

SEQ ID NO: 2516977 - RNA, 17 nt, Human
uugaaugucuuuugaau

SEQ ID NO: 2516978 - RNA, 23 nt, Human
uugaaugagaugauucagaaggg

SEQ ID NO: 2516979 - RNA, 22 nt, Human
uugaaugagaugauucagaagg

SEQ ID NO: 2516980 - RNA, 21 nt, Human
uugaaugacaacagaagcuuc

SEQ ID NO: 2516981 - RNA, 20 nt, Human
uugaaugacaacagaagcuu

SEQ ID NO: 2516982 - RNA, 20 nt, Human
uugaaugagaugauucagaa

SEQ ID NO: 2516983 - RNA, 16 nt, Human
uugaaugaugccauga

SEQ ID NO: 2516984 - RNA, 12 nt, Human
uugaaugaugcc

SEQ ID NO: 2516985 - RNA, 13 nt, Human
uugaagcauuuua

SEQ ID NO: 2516986 - RNA, 14 nt, Human
uugaagcauuuuau

SEQ ID NO: 2516987 - RNA, 15 nt, Human
uugaagcauuuuaua

SEQ ID NO: 2516988 - RNA, 17 nt, Human
uugaagcauuuuauaaa

SEQ ID NO: 2516989 - RNA, 22 nt, Human
uugaagcauuuuauaaaucgcu

SEQ ID NO: 2516990 - RNA, 20 nt, Human
uugaaugaaaaauuuaagca

SEQ ID NO: 2516991 - RNA, 21 nt, Human
uugaaugaaaaauuuaagcau

SEQ ID NO: 2516992 - RNA, 18 nt, Human
uugaaugacaacagaagc

SEQ ID NO: 2516993 - RNA, 17 nt, Human
uugaaugacaacagaag

SEQ ID NO: 2516994 - RNA, 22 nt, Human
uugaaugaaaaauuuaagcauu

SEQ ID NO: 2516995 - RNA, 23 nt, Human
uugaaugaaaaauuuaagcauug

SEQ ID NO: 2516996 - RNA, 22 nt, Human
uugaagaggaaaaugaauaaua

SEQ ID NO: 2516997 - RNA, 21 nt, Human
uugaagaggaaaaugaauaau

SEQ ID NO: 2516998 - RNA, 13 nt, Human
uugaagaggaaaa

SEQ ID NO: 2516999 - RNA, 20 nt, Human
uugaacuuugaccucugcag

SEQ ID NO: 2517000 - RNA, 17 nt, Human
uugaacuuugaccucug

SEQ ID NO: 2517001 - RNA, 18 nt, Human
uugaacuuugaccucugc

SEQ ID NO: 2517002 - RNA, 15 nt, Human
uugaagcaguugugu

SEQ ID NO: 2517003 - RNA, 18 nt, Human
uugaagcacguacauuuu

SEQ ID NO: 2517004 - RNA, 14 nt, Human
uugaagcacguaca

SEQ ID NO: 2517005 - RNA, 20 nt, Human
uugaagaucguuaguaucua

SEQ ID NO: 2517006 - RNA, 18 nt, Human
uugaagaugcugaaacag

SEQ ID NO: 2517007 - RNA, 15 nt, Human
uugaagaggugagca

SEQ ID NO: 2517008 - RNA, 22 nt, Human
uugaagauaucuugaaaugaaa

SEQ ID NO: 2517009 - RNA, 21 nt, Human
uucuuuaagaauuacagguug

SEQ ID NO: 2517010 - RNA, 12 nt, Human
uucuuuaaugcu

SEQ ID NO: 2517011 - RNA, 18 nt, Human
uucuuuaaugcuuuuaua

SEQ ID NO: 2517012 - RNA, 18 nt, Human
uucuuuccacagaagcuc

SEQ ID NO: 2517013 - RNA, 14 nt, Human
uucuuuaccugaga

SEQ ID NO: 2517014 - RNA, 21 nt, Human
uugaaaaucuuauaauuuaaa

SEQ ID NO: 2517015 - RNA, 21 nt, Human
uucuuuccugaggcugggcuc

SEQ ID NO: 2517016 - RNA, 20 nt, Human
uucuuuccauuaugauucuu

SEQ ID NO: 2517017 - RNA, 12 nt, Human
uucuuuccagag

SEQ ID NO: 2517018 - RNA, 20 nt, Human
uucuuuaccugagaccaguu

SEQ ID NO: 2517019 - RNA, 14 nt, Human
uucuuuccauuaug

SEQ ID NO: 2517020 - RNA, 17 nt, Human
uucuuuccauuaugauu

SEQ ID NO: 2517021 - RNA, 15 nt, Human
uugaacuuugaccuc

SEQ ID NO: 2517022 - RNA, 23 nt, Human
uugaaacaauacucauaauguga

SEQ ID NO: 2517023 - RNA, 15 nt, Human
uugaaacaauacuca

SEQ ID NO: 2517024 - RNA, 16 nt, Human
uugaaacaaagaaggu

SEQ ID NO: 2517025 - RNA, 13 nt, Human
uugaaacagaacc

SEQ ID NO: 2517026 - RNA, 19 nt, Human
uugaaaccaccuuuuauua

SEQ ID NO: 2517027 - RNA, 21 nt, Human
uugaaaauucaaaaaguguuu

SEQ ID NO: 2517028 - RNA, 20 nt, Human
uugaaaauucaaaaaguguu

SEQ ID NO: 2517029 - RNA, 18 nt, Human
uugaaaauucaaaaagug

SEQ ID NO: 2517030 - RNA, 22 nt, Human
uugaaaauuauuuuaaacaaaa

SEQ ID NO: 2517031 - RNA, 20 nt, Human
uugaaaauuauuuuaaacaa

SEQ ID NO: 2517032 - RNA, 19 nt, Human
uugaaaauuauuuuaaaca

SEQ ID NO: 2517033 - RNA, 15 nt, Human
uugaaaauuauuuua

SEQ ID NO: 2517034 - RNA, 18 nt, Human
uugaaaauuaacaugaau

SEQ ID NO: 2517035 - RNA, 21 nt, Human
uugaaaauaagaauagaaaua

SEQ ID NO: 2517036 - RNA, 13 nt, Human
uucuuuccugccu

SEQ ID NO: 2517037 - RNA, 22 nt, Human
uucuuuccucuuccccuugccc

SEQ ID NO: 2517038 - RNA, 21 nt, Human
uucuuucccugcuuaaugaaa

SEQ ID NO: 2517039 - RNA, 18 nt, Human
uugccuuuugcaaacuuu

SEQ ID NO: 2517040 - RNA, 17 nt, Human
uugcgaaugguuccauu

SEQ ID NO: 2517041 - RNA, 13 nt, Human
uugccuuuugcaa

SEQ ID NO: 2517042 - RNA, 18 nt, Human
uugccuuuucuagcccga

SEQ ID NO: 2517043 - RNA, 17 nt, Human
uugccuuuguuuugaug

SEQ ID NO: 2517044 - RNA, 13 nt, Human
uugccuuucucga

SEQ ID NO: 2517045 - RNA, 23 nt, Human
uugccuuuagugaucacagcagc

SEQ ID NO: 2517046 - RNA, 11 nt, Human
uugccuuucuc

SEQ ID NO: 2517047 - RNA, 22 nt, Human
uugccuuuagugaucacagcag

SEQ ID NO: 2517048 - RNA, 21 nt, Human
uugccuugaaccacuucccuc

SEQ ID NO: 2517049 - RNA, 20 nt, Human
uugccuugggcugcuccuca

SEQ ID NO: 2517050 - RNA, 19 nt, Human
uugccuucuucacccagcu

SEQ ID NO: 2517051 - RNA, 17 nt, Human
uugccuucuacuuuuaa

SEQ ID NO: 2517052 - RNA, 18 nt, Human
uugccuugaaccacuucc

SEQ ID NO: 2517053 - RNA, 21 nt, Human
uugccuuccacgcugucucca

SEQ ID NO: 2517054 - RNA, 16 nt, Human
uugccuuaaagaaagu

SEQ ID NO: 2517055 - RNA, 23 nt, Human
uugccuguucaguuacagaaagu

SEQ ID NO: 2517056 - RNA, 14 nt, Human
uugccuucaacuaa

SEQ ID NO: 2517057 - RNA, 17 nt, Human
uugccuuauuaaaguuc

SEQ ID NO: 2517058 - RNA, 16 nt, Human
uugccuuaacuggagc

SEQ ID NO: 2517059 - RNA, 22 nt, Human
uugccuguucaguuacagaaag

SEQ ID NO: 2517060 - RNA, 20 nt, Human
uugccuguucaguuacagaa

SEQ ID NO: 2517061 - RNA, 16 nt, Human
uugccuguucaguuac

SEQ ID NO: 2517062 - RNA, 13 nt, Human
uugccuguucagu

SEQ ID NO: 2517063 - RNA, 12 nt, Human
uugccugugcca

SEQ ID NO: 2517064 - RNA, 22 nt, Human
uugccaugggcuucacuguaua

SEQ ID NO: 2517065 - RNA, 21 nt, Human
uugccaugggcuucacuguau

SEQ ID NO: 2517066 - RNA, 20 nt, Human
uugccaugggcuucacugua

SEQ ID NO: 2517067 - RNA, 19 nt, Human
uugcccaacaccagccccu

SEQ ID NO: 2517068 - RNA, 18 nt, Human
uugcccaacaccagcccc

SEQ ID NO: 2517069 - RNA, 13 nt, Human
uugcccaacacca

SEQ ID NO: 2517070 - RNA, 21 nt, Human
uugcccaacaccagccccugc

SEQ ID NO: 2517071 - RNA, 20 nt, Human
uugcccaacaccagccccug

SEQ ID NO: 2517072 - RNA, 18 nt, Human
uugcccacaccgagggcg

SEQ ID NO: 2517073 - RNA, 21 nt, Human
uugccauguuggccaggcugg

SEQ ID NO: 2517074 - RNA, 20 nt, Human
uugccauguuggccaggcug

SEQ ID NO: 2517075 - RNA, 13 nt, Human
uugcgcuguugcg

SEQ ID NO: 2517076 - RNA, 16 nt, Human
uugcuaagcauuccaa

SEQ ID NO: 2517077 - RNA, 18 nt, Human
uugcuaagcauuccaacu

SEQ ID NO: 2517078 - RNA, 16 nt, Human
uugcuaagaugcucua

SEQ ID NO: 2517079 - RNA, 14 nt, Human
uugcuaagaugcuc

SEQ ID NO: 2517080 - RNA, 13 nt, Human
uugcuaagaugcu

SEQ ID NO: 2517081 - RNA, 20 nt, Human
uugcuaagaugcucuaucuu

SEQ ID NO: 2517082 - RNA, 21 nt, Human
uugcuaagccccagcaagcaa

SEQ ID NO: 2517083 - RNA, 14 nt, Human
uugcugcuugaggc

SEQ ID NO: 2517084 - RNA, 16 nt, Human
uugcugcuugaggcaa

SEQ ID NO: 2517085 - RNA, 13 nt, Human
uugcugcugaagg

SEQ ID NO: 2517086 - RNA, 23 nt, Human
uugcuggacggggacuggggaug

SEQ ID NO: 2517087 - RNA, 21 nt, Human
uugcuggacggggacugggga

SEQ ID NO: 2517088 - RNA, 23 nt, Human
uugcuggacugucauagaaauua

SEQ ID NO: 2517089 - RNA, 21 nt, Human
uugcuggaauaaguucaaauu

SEQ ID NO: 2517090 - RNA, 18 nt, Human
uugcugcuuuuccuuggg

SEQ ID NO: 2517091 - RNA, 23 nt, Human
uugcugcuuuuccuuggggcagg

SEQ ID NO: 2517092 - RNA, 16 nt, Human
uugcugucccuuuucc

SEQ ID NO: 2517093 - RNA, 22 nt, Human
uugcugggagcugaaaaaucac

SEQ ID NO: 2517094 - RNA, 21 nt, Human
uugcugggagcugaaaaauca

SEQ ID NO: 2517095 - RNA, 15 nt, Human
uugcugggagcugaa

SEQ ID NO: 2517096 - RNA, 12 nt, Human
uugcuggcugga

SEQ ID NO: 2517097 - RNA, 16 nt, Human
uugcuggcaaagacag

SEQ ID NO: 2517098 - RNA, 18 nt, Human
uugcugucccuuuuccuu

SEQ ID NO: 2517099 - RNA, 12 nt, Human
uugcugggcuuu

SEQ ID NO: 2517100 - RNA, 20 nt, Human
uugcugggcaguuuuucugu

SEQ ID NO: 2517101 - RNA, 21 nt, Human
uugcugucauaagaaugaaua

SEQ ID NO: 2517102 - RNA, 15 nt, Human
uugcuguccuaggcc

SEQ ID NO: 2517103 - RNA, 19 nt, Human
uugcugugaggcuguccug

SEQ ID NO: 2517104 - RNA, 18 nt, Human
uugcugugaggcuguccu

SEQ ID NO: 2517105 - RNA, 17 nt, Human
uugcugugaggcugucc

SEQ ID NO: 2517106 - RNA, 15 nt, Human
uugcugugaggcugu

SEQ ID NO: 2517107 - RNA, 14 nt, Human
uugcugugaggcug

SEQ ID NO: 2517108 - RNA, 20 nt, Human
uugcugugagcaagaaguca

SEQ ID NO: 2517109 - RNA, 20 nt, Human
uugcugugaauuagcucacu

SEQ ID NO: 2517110 - RNA, 23 nt, Human
uugcuggggacggggggccccag

SEQ ID NO: 2517111 - RNA, 11 nt, Human
uugcuguccua

SEQ ID NO: 2517112 - RNA, 23 nt, Human
uuggaauauuguccauuguccaa

SEQ ID NO: 2517113 - RNA, 13 nt, Human
uuggaauacuuuu

SEQ ID NO: 2517114 - RNA, 17 nt, Human
uuggaauuaaccuggug

SEQ ID NO: 2517115 - RNA, 22 nt, Human
uuggaauuuguaaccucagcuc

SEQ ID NO: 2517116 - RNA, 21 nt, Human
uuggaauuuguaaccucagcu

SEQ ID NO: 2517117 - RNA, 19 nt, Human
uuggaauuuguaaccucag

SEQ ID NO: 2517118 - RNA, 19 nt, Human
uuggaauuaaccuggugcu

SEQ ID NO: 2517119 - RNA, 20 nt, Human
uuggaauuaaccuggugcug

SEQ ID NO: 2517120 - RNA, 17 nt, Human
uuggaaugggcagcuca

SEQ ID NO: 2517121 - RNA, 16 nt, Human
uuggaaugcuucuucu

SEQ ID NO: 2517122 - RNA, 18 nt, Human
uuggaaugggcagcucau

SEQ ID NO: 2517123 - RNA, 18 nt, Human
uuggaauuaaccuggugc

SEQ ID NO: 2517124 - RNA, 16 nt, Human
uuggacagaagcagcu

SEQ ID NO: 2517125 - RNA, 19 nt, Human
uuggacagaagcagcucuu

SEQ ID NO: 2517126 - RNA, 14 nt, Human
uuggacauccuccu

SEQ ID NO: 2517127 - RNA, 16 nt, Human
uuggacaacugcaugg

SEQ ID NO: 2517128 - RNA, 15 nt, Human
uuggacacuguacaa

SEQ ID NO: 2517129 - RNA, 23 nt, Human
uuggacaaucaugaaauaugcau

SEQ ID NO: 2517130 - RNA, 13 nt, Human
uugcugugggaac

SEQ ID NO: 2517131 - RNA, 12 nt, Human
uugcugugggaa

SEQ ID NO: 2517132 - RNA, 19 nt, Human
uugcugugccucccaaaau

SEQ ID NO: 2517133 - RNA, 16 nt, Human
uugcugugccucccaa

SEQ ID NO: 2517134 - RNA, 20 nt, Human
uugcugugaggcuguccugu

SEQ ID NO: 2517135 - RNA, 14 nt, Human
uugcugugccuccc

SEQ ID NO: 2517136 - RNA, 20 nt, Human
uugcuguugauuucuuucca

SEQ ID NO: 2517137 - RNA, 21 nt, Human
uugcuguugaugaggccucuu

SEQ ID NO: 2517138 - RNA, 23 nt, Human
uugcugugggaacgagaggggaa

SEQ ID NO: 2517139 - RNA, 15 nt, Human
uugcugugggaacga

SEQ ID NO: 2517140 - RNA, 20 nt, Human
uugcugugucauaccaggcc

SEQ ID NO: 2517141 - RNA, 19 nt, Human
uugcuguugucccucugcu

SEQ ID NO: 2517142 - RNA, 13 nt, Human
uugcuguuuccuu

SEQ ID NO: 2517143 - RNA, 19 nt, Human
uugcuguuguuucuaaaca

SEQ ID NO: 2517144 - RNA, 20 nt, Human
uuggaagaccccacccaagc

SEQ ID NO: 2517145 - RNA, 15 nt, Human
uugcuguuuccuuuu

SEQ ID NO: 2517146 - RNA, 13 nt, Human
uuggaagagaaag

SEQ ID NO: 2517147 - RNA, 21 nt, Human
uuggaagcuagcuccccuccu

SEQ ID NO: 2517148 - RNA, 23 nt, Human
uuggaagcuagcuccccuccucu

SEQ ID NO: 2517149 - RNA, 22 nt, Human
uuggaagcuagcuccccuccuc

SEQ ID NO: 2517150 - RNA, 17 nt, Human
uuggaagcucugaaguc

SEQ ID NO: 2517151 - RNA, 19 nt, Human
uuggaagcuccgcuuucua

SEQ ID NO: 2517152 - RNA, 21 nt, Human
uuggacccugaggcccagagg

SEQ ID NO: 2517153 - RNA, 19 nt, Human
uuggacccugaggcccaga

SEQ ID NO: 2517154 - RNA, 18 nt, Human
uuggacccugaggcccag

SEQ ID NO: 2517155 - RNA, 15 nt, Human
uuggacccugaggcc

SEQ ID NO: 2517156 - RNA, 14 nt, Human
uuggauuugacauu

SEQ ID NO: 2517157 - RNA, 22 nt, Human
uuggauuugacauugcguuuga

SEQ ID NO: 2517158 - RNA, 18 nt, Human
uuggauuuguuuaaaagg

SEQ ID NO: 2517159 - RNA, 14 nt, Human
uuggauuuguuuaa

SEQ ID NO: 2517160 - RNA, 15 nt, Human
uuggauuguccccga

SEQ ID NO: 2517161 - RNA, 20 nt, Human
uuggcaauaguuugcauaga

SEQ ID NO: 2517162 - RNA, 16 nt, Human
uuggcaauaguuugca

SEQ ID NO: 2517163 - RNA, 17 nt, Human
uuggcaaugccaucauc

SEQ ID NO: 2517164 - RNA, 15 nt, Human
uuggcacagaaacac

SEQ ID NO: 2517165 - RNA, 16 nt, Human
uuggcacagaaacaca

SEQ ID NO: 2517166 - RNA, 21 nt, Human
uuggcaccagacacccaggac

SEQ ID NO: 2517167 - RNA, 23 nt, Human
uuggcaccagacacccaggacuu

SEQ ID NO: 2517168 - RNA, 19 nt, Human
uuggcaccuaauccaggca

SEQ ID NO: 2517169 - RNA, 17 nt, Human
uuggcaccagacaccca

SEQ ID NO: 2517170 - RNA, 20 nt, Human
uuggcaccagacacccagga

SEQ ID NO: 2517171 - RNA, 13 nt, Human
uuggcaccagaca

SEQ ID NO: 2517172 - RNA, 23 nt, Human
uuggcacagaaacacaauauuuu

SEQ ID NO: 2517173 - RNA, 15 nt, Human
uuggcagcaccuguc

SEQ ID NO: 2517174 - RNA, 12 nt, Human
uuggcagcagau

SEQ ID NO: 2517175 - RNA, 23 nt, Human
uuggcacucacagaccuggagcc

SEQ ID NO: 2517176 - RNA, 21 nt, Human
uuggcaccuaauccaggcaga

SEQ ID NO: 2517177 - RNA, 22 nt, Human
uuggcacucacagaccuggagc

SEQ ID NO: 2517178 - RNA, 14 nt, Human
uuggcacucacaga

SEQ ID NO: 2517179 - RNA, 22 nt, Human
uuggcacugagauauuuauugu

SEQ ID NO: 2517180 - RNA, 12 nt, Human
uuggcaggcugg

SEQ ID NO: 2517181 - RNA, 16 nt, Human
uuggcagcucuacucu

SEQ ID NO: 2517182 - RNA, 21 nt, Human
uuggcagcaggugcugcuacc

SEQ ID NO: 2517183 - RNA, 18 nt, Human
uuggcagcaggugcugcu

SEQ ID NO: 2517184 - RNA, 12 nt, Human
uuggcagcaggu

SEQ ID NO: 2517185 - RNA, 14 nt, Human
uuggcagcagauuu

SEQ ID NO: 2517186 - RNA, 22 nt, Human
uuggcagcaggugcugcuaccc

SEQ ID NO: 2517187 - RNA, 18 nt, Human
uuguaugauguguuguga

SEQ ID NO: 2517188 - RNA, 16 nt, Human
uuguaugauguguugu

SEQ ID NO: 2517189 - RNA, 14 nt, Human
uuguaugauguguu

SEQ ID NO: 2517190 - RNA, 13 nt, Human
uuguaugaugugu

SEQ ID NO: 2517191 - RNA, 21 nt, Human
uuguaugauguguugugauag

SEQ ID NO: 2517192 - RNA, 20 nt, Human
uuguaugauguguugugaua

SEQ ID NO: 2517193 - RNA, 20 nt, Human
uuguaugccuuuaaaucugu

SEQ ID NO: 2517194 - RNA, 20 nt, Human
uuguaugauccuaaugaaug

SEQ ID NO: 2517195 - RNA, 22 nt, Human
uuguaugaaagauggcugugcc

SEQ ID NO: 2517196 - RNA, 23 nt, Human
uuguauuuuccaagugugcauau

SEQ ID NO: 2517197 - RNA, 12 nt, Human
uuguauuuucca

SEQ ID NO: 2517198 - RNA, 12 nt, Human
uuguaugccuuu

SEQ ID NO: 2517199 - RNA, 14 nt, Human
uuguauuuuuaaug

SEQ ID NO: 2517200 - RNA, 21 nt, Human
uuguauuuuccaagugugcau

SEQ ID NO: 2517201 - RNA, 15 nt, Human
uuguauuuuuaaugg

SEQ ID NO: 2517202 - RNA, 21 nt, Human
uuguauuuuuuugcaagugaa

SEQ ID NO: 2517203 - RNA, 20 nt, Human
uuguauuuuuuugcaaguga

SEQ ID NO: 2517204 - RNA, 13 nt, Human
uugucaaagagag

SEQ ID NO: 2517205 - RNA, 22 nt, Human
uuguauuuuuuugcaagugaag

SEQ ID NO: 2517206 - RNA, 22 nt, Human
uugucaaacuguagaaaugaug

SEQ ID NO: 2517207 - RNA, 22 nt, Human
uugucaaaguggugagaggcau

SEQ ID NO: 2517208 - RNA, 14 nt, Human
uugucuaugggacu

SEQ ID NO: 2517209 - RNA, 18 nt, Human
uugucuauuuuugucuua

SEQ ID NO: 2517210 - RNA, 18 nt, Human
uugucucccuggcccuca

SEQ ID NO: 2517211 - RNA, 17 nt, Human
uugucuauuuuugucuu

SEQ ID NO: 2517212 - RNA, 16 nt, Human
uugucuauuuuugucu

SEQ ID NO: 2517213 - RNA, 15 nt, Human
uugucuauucuccag

SEQ ID NO: 2517214 - RNA, 19 nt, Human
uugucucccuggcccucaa

SEQ ID NO: 2517215 - RNA, 19 nt, Human
uugucucuaugccagcuca

SEQ ID NO: 2517216 - RNA, 18 nt, Human
uugucuauuaccuguuag

SEQ ID NO: 2517217 - RNA, 20 nt, Human
uugucuaugggacucaaugc

SEQ ID NO: 2517218 - RNA, 22 nt, Human
uugucuuaaaaaguggaaaaau

SEQ ID NO: 2517219 - RNA, 18 nt, Human
uugucugaagucacugca

SEQ ID NO: 2517220 - RNA, 17 nt, Human
uugucugaagucacugc

SEQ ID NO: 2517221 - RNA, 12 nt, Human
uugucucugggc

SEQ ID NO: 2517222 - RNA, 16 nt, Human
uuguaccgcaauguga

SEQ ID NO: 2517223 - RNA, 20 nt, Human
uuguaccccccaaccccuga

SEQ ID NO: 2517224 - RNA, 23 nt, Human
uuguacauuuaugauuuaauaaa

SEQ ID NO: 2517225 - RNA, 15 nt, Human
uuguaccccccaacc

SEQ ID NO: 2517226 - RNA, 13 nt, Human
uuguaccugguga

SEQ ID NO: 2517227 - RNA, 11 nt, Human
uuguaccucuc

SEQ ID NO: 2517228 - RNA, 22 nt, Human
uuguaaacucaaaauauuugua

SEQ ID NO: 2517229 - RNA, 16 nt, Human
uuguaaacucaaaaua

SEQ ID NO: 2517230 - RNA, 15 nt, Human
uuguaaacauguguu

SEQ ID NO: 2517231 - RNA, 14 nt, Human
uuguaaacaugugu

SEQ ID NO: 2517232 - RNA, 20 nt, Human
uuguaaaauggugugaccac

SEQ ID NO: 2517233 - RNA, 18 nt, Human
uuguacuuuagggaagua

SEQ ID NO: 2517234 - RNA, 21 nt, Human
uuguaccccccaaccccugag

SEQ ID NO: 2517235 - RNA, 15 nt, Human
uuguacuguaaagag

SEQ ID NO: 2517236 - RNA, 17 nt, Human
uuguagaauguauugua

SEQ ID NO: 2517237 - RNA, 16 nt, Human
uuguagaauguauugu

SEQ ID NO: 2517238 - RNA, 22 nt, Human
uuguagaaggguuauauuuuac

SEQ ID NO: 2517239 - RNA, 22 nt, Human
uuguagaaguaggaagugaaaa

SEQ ID NO: 2517240 - RNA, 21 nt, Human
uuguaucugcaggcagacacg

SEQ ID NO: 2517241 - RNA, 20 nt, Human
uuguaucucuuuugaaucca

SEQ ID NO: 2517242 - RNA, 17 nt, Human
uuguagcauccucuuua

SEQ ID NO: 2517243 - RNA, 20 nt, Human
uuggcagugagugagccugg

SEQ ID NO: 2517244 - RNA, 14 nt, Human
uuggcaggcuggcc

SEQ ID NO: 2517245 - RNA, 13 nt, Human
uuggcaggcuggc

SEQ ID NO: 2517246 - RNA, 14 nt, Human
uuggcagucugaau

SEQ ID NO: 2517247 - RNA, 22 nt, Human
uuggcuuccuuucuugguucau

SEQ ID NO: 2517248 - RNA, 17 nt, Human
uuggcuuccuuucuugg

SEQ ID NO: 2517249 - RNA, 21 nt, Human
uuggcuuccaugaugguuauu

SEQ ID NO: 2517250 - RNA, 19 nt, Human
uuggcuucuucuuuaggau

SEQ ID NO: 2517251 - RNA, 20 nt, Human
uuggcuuuauccucuuuaga

SEQ ID NO: 2517252 - RNA, 14 nt, Human
uuggcuuuauccuc

SEQ ID NO: 2517253 - RNA, 22 nt, Human
uuggcuuuaaacacccuucaca

SEQ ID NO: 2517254 - RNA, 17 nt, Human
uuggcuuuaaacacccu

SEQ ID NO: 2517255 - RNA, 23 nt, Human
uuggcagugagugagccuggcuc

SEQ ID NO: 2517256 - RNA, 17 nt, Human
uuggcuuacugcagccu

SEQ ID NO: 2517257 - RNA, 23 nt, Human
uuggcuucacggaagagccuugc

SEQ ID NO: 2517258 - RNA, 18 nt, Human
uugggacuggggcugaag

SEQ ID NO: 2517259 - RNA, 22 nt, Human
uugggaccgccagauggggccu

SEQ ID NO: 2517260 - RNA, 14 nt, Human
uugggagacaugug

SEQ ID NO: 2517261 - RNA, 16 nt, Human
uugggaccgccagaug

SEQ ID NO: 2517262 - RNA, 22 nt, Human
uugggacugcuaaauaaaauuu

SEQ ID NO: 2517263 - RNA, 17 nt, Human
uugggagacaugugaca

SEQ ID NO: 2517264 - RNA, 23 nt, Human
uugggacuggguuuggaccccag

SEQ ID NO: 2517265 - RNA, 16 nt, Human
uugggagauauauuuu

SEQ ID NO: 2517266 - RNA, 14 nt, Human
uugggaccccuggu

SEQ ID NO: 2517267 - RNA, 15 nt, Human
uugggaccccuggug

SEQ ID NO: 2517268 - RNA, 16 nt, Human
uugggaccccuggugg

SEQ ID NO: 2517269 - RNA, 20 nt, Human
uugggaccccuggugguuca

SEQ ID NO: 2517270 - RNA, 19 nt, Human
uugggaaugaggcuugcug

SEQ ID NO: 2517271 - RNA, 16 nt, Human
uugggaaugaggcuug

SEQ ID NO: 2517272 - RNA, 18 nt, Human
uugggaauggauccugga

SEQ ID NO: 2517273 - RNA, 19 nt, Human
uugggaauauuugaaucuu

SEQ ID NO: 2517274 - RNA, 17 nt, Human
uugggaauauuugaauc

SEQ ID NO: 2517275 - RNA, 14 nt, Human
uugggaauguuugu

SEQ ID NO: 2517276 - RNA, 11 nt, Human
uugggaauguu

SEQ ID NO: 2517277 - RNA, 16 nt, Human
uugggaauauuugaau

SEQ ID NO: 2517278 - RNA, 15 nt, Human
uugggaauauuugaa

SEQ ID NO: 2517279 - RNA, 17 nt, Human
uugggaauaaauaugcc

SEQ ID NO: 2517280 - RNA, 15 nt, Human
uugggaauaaauaug

SEQ ID NO: 2517281 - RNA, 14 nt, Human
uugggaauaaauau

SEQ ID NO: 2517282 - RNA, 22 nt, Human
uuggcuuuauccucuuuagagu

SEQ ID NO: 2517283 - RNA, 21 nt, Human
uuggcuuuauccucuuuagag

SEQ ID NO: 2517284 - RNA, 21 nt, Human
uugggaaggggacccccgccc

SEQ ID NO: 2517285 - RNA, 20 nt, Human
uuguaaaauauagcuguaca

SEQ ID NO: 2517286 - RNA, 18 nt, Human
uuguaaaauauagcugua

SEQ ID NO: 2517287 - RNA, 14 nt, Human
uuguaaaauauagc

SEQ ID NO: 2517288 - RNA, 13 nt, Human
uuguaaaauauag

SEQ ID NO: 2517289 - RNA, 15 nt, Human
uuggucugugagaug

SEQ ID NO: 2517290 - RNA, 12 nt, Human
uuguaaaauggu

SEQ ID NO: 2517291 - RNA, 13 nt, Human
uuguaaaauggug

SEQ ID NO: 2517292 - RNA, 14 nt, Human
uugguccuuuacac

SEQ ID NO: 2517293 - RNA, 15 nt, Human
uugguaauuauuuug

SEQ ID NO: 2517294 - RNA, 20 nt, Human
uugguacauggccaguguga

SEQ ID NO: 2517295 - RNA, 17 nt, Human
uuggucugggacuuccu

SEQ ID NO: 2517296 - RNA, 20 nt, Human
uuggucugacccacugcuuu

SEQ ID NO: 2517297 - RNA, 19 nt, Human
uugguaacauccuuucuau

SEQ ID NO: 2517298 - RNA, 16 nt, Human
uugguaacauccuuuc

SEQ ID NO: 2517299 - RNA, 20 nt, Human
uugguaaggggaauugagga

SEQ ID NO: 2517300 - RNA, 21 nt, Human
uugguaacauccuuucuauug

SEQ ID NO: 2517301 - RNA, 19 nt, Human
uugguaacacaaauuuuca

SEQ ID NO: 2517302 - RNA, 23 nt, Human
uugguaaauuuccccaacagugu

SEQ ID NO: 2517303 - RNA, 22 nt, Human
uugggauugggggcuggugcca

SEQ ID NO: 2517304 - RNA, 16 nt, Human
uugggagcacuggagu

SEQ ID NO: 2517305 - RNA, 15 nt, Human
uugggagcacuggag

SEQ ID NO: 2517306 - RNA, 11 nt, Human
uugggagcacu

SEQ ID NO: 2517307 - RNA, 22 nt, Human
uugggagcacuggagugcaggg

SEQ ID NO: 2517308 - RNA, 17 nt, Human
uugggagcuugggaaug

SEQ ID NO: 2517309 - RNA, 19 nt, Human
uugggagugagaugccugc

SEQ ID NO: 2517310 - RNA, 15 nt, Human
uugggagugagaugc

SEQ ID NO: 2517311 - RNA, 15 nt, Human
uugggaggcugaggc

SEQ ID NO: 2517312 - RNA, 16 nt, Human
uugggauacugcaggg

SEQ ID NO: 2517313 - RNA, 18 nt, Human
uugggaugaugccucaug

SEQ ID NO: 2517314 - RNA, 21 nt, Human
uugggauugggggcuggugcc

SEQ ID NO: 2517315 - RNA, 16 nt, Human
uugggauugggggcug

SEQ ID NO: 2517316 - RNA, 14 nt, Human
uugggauugggggc

SEQ ID NO: 2517317 - RNA, 21 nt, Human
uugggauuccugacccaggcc

SEQ ID NO: 2517318 - RNA, 18 nt, Human
uugggauuccugacccag

SEQ ID NO: 2517319 - RNA, 16 nt, Human
uugggauuccugaccc

SEQ ID NO: 2517320 - RNA, 13 nt, Human
uugggauuaauau

SEQ ID NO: 2517321 - RNA, 21 nt, Human
auauauuuuuauauuuaguua

SEQ ID NO: 2517322 - RNA, 15 nt, Human
auauauuuuuauauu

SEQ ID NO: 2517323 - RNA, 12 nt, Human
auaucagccuga

SEQ ID NO: 2517324 - RNA, 14 nt, Human
auaucagcaagucu

SEQ ID NO: 2517325 - RNA, 14 nt, Human
auauauuuuucaca

SEQ ID NO: 2517326 - RNA, 15 nt, Human
auauauuuuucacag

SEQ ID NO: 2517327 - RNA, 15 nt, Human
auauauuuuugguug

SEQ ID NO: 2517328 - RNA, 21 nt, Human
auauauuuuucacaguuuuuc

SEQ ID NO: 2517329 - RNA, 20 nt, Human
auauauuuuugguugucaau

SEQ ID NO: 2517330 - RNA, 14 nt, Human
auauauuuuuugua

SEQ ID NO: 2517331 - RNA, 17 nt, Human
auaugcaccuugugucu

SEQ ID NO: 2517332 - RNA, 15 nt, Human
auaugcaccuugugu

SEQ ID NO: 2517333 - RNA, 22 nt, Human
auaugcacacauuuuuuaaaug

SEQ ID NO: 2517334 - RNA, 20 nt, Human
auaucaucagcauaccuuua

SEQ ID NO: 2517335 - RNA, 18 nt, Human
auaucaucagcauaccuu

SEQ ID NO: 2517336 - RNA, 13 nt, Human
auaucaucaguau

SEQ ID NO: 2517337 - RNA, 19 nt, Human
auaucauauugguauucac

SEQ ID NO: 2517338 - RNA, 14 nt, Human
auaucauauuggua

SEQ ID NO: 2517339 - RNA, 22 nt, Human
auaucaguuacucagcccuggg

SEQ ID NO: 2517340 - RNA, 13 nt, Human
auaucaguuugcu

SEQ ID NO: 2517341 - RNA, 20 nt, Human
auaucaguuacucagcccug

SEQ ID NO: 2517342 - RNA, 21 nt, Human
auaucaguuacucagcccugg

SEQ ID NO: 2517343 - RNA, 23 nt, Human
auaucaguuacucagcccugggc

SEQ ID NO: 2517344 - RNA, 22 nt, Human
auaucagccugagucuccugug

SEQ ID NO: 2517345 - RNA, 20 nt, Human
auaucagccugagucuccug

SEQ ID NO: 2517346 - RNA, 14 nt, Human
auaucagccugagu

SEQ ID NO: 2517347 - RNA, 21 nt, Human
auaucagccugagucuccugu

SEQ ID NO: 2517348 - RNA, 17 nt, Human
auaucaguuacucagcc

SEQ ID NO: 2517349 - RNA, 18 nt, Human
auaucaguuacucagccc

SEQ ID NO: 2517350 - RNA, 19 nt, Human
auaucaguuacucagcccu

SEQ ID NO: 2517351 - RNA, 13 nt, Human
auaugcacuuaua

SEQ ID NO: 2517352 - RNA, 14 nt, Human
auaugcacuuauaa

SEQ ID NO: 2517353 - RNA, 17 nt, Human
auaugcagauuuugccc

SEQ ID NO: 2517354 - RNA, 20 nt, Human
auaugcaccuugugucugua

SEQ ID NO: 2517355 - RNA, 19 nt, Human
auaugcaccuugugucugu

SEQ ID NO: 2517356 - RNA, 21 nt, Human
auaugcaccuugugucuguac

SEQ ID NO: 2517357 - RNA, 21 nt, Human
auaucaucagcauaccuuuau

SEQ ID NO: 2517358 - RNA, 16 nt, Human
auaugcucugcauguu

SEQ ID NO: 2517359 - RNA, 17 nt, Human
auaugcucugcauguua

SEQ ID NO: 2517360 - RNA, 20 nt, Human
auauggcagaguuguaaaua

SEQ ID NO: 2517361 - RNA, 19 nt, Human
auauggcagaguuguaaau

SEQ ID NO: 2517362 - RNA, 18 nt, Human
auauggcagaguuguaaa

SEQ ID NO: 2517363 - RNA, 17 nt, Human
auauggcagaguuguaa

SEQ ID NO: 2517364 - RNA, 16 nt, Human
auauggcagaguugua

SEQ ID NO: 2517365 - RNA, 17 nt, Human
auauggcagaagacacc

SEQ ID NO: 2517366 - RNA, 15 nt, Human
auauggcagaagaca

SEQ ID NO: 2517367 - RNA, 12 nt, Human
auauggcagaag

SEQ ID NO: 2517368 - RNA, 19 nt, Human
auauggcaagaaagcuggu

SEQ ID NO: 2517369 - RNA, 18 nt, Human
auauggcaagaaagcugg

SEQ ID NO: 2517370 - RNA, 17 nt, Human
auauggcaagaaagcug

SEQ ID NO: 2517371 - RNA, 15 nt, Human
auauggcaagaaagc

SEQ ID NO: 2517372 - RNA, 13 nt, Human
auauggcaagaaa

SEQ ID NO: 2517373 - RNA, 16 nt, Human
auauggcaaaaauggc

SEQ ID NO: 2517374 - RNA, 23 nt, Human
auauggauuuucuauuguuacuc

SEQ ID NO: 2517375 - RNA, 22 nt, Human
auauggauuuucuauuguuacu

SEQ ID NO: 2517376 - RNA, 13 nt, Human
auauuauguuaaa

SEQ ID NO: 2517377 - RNA, 17 nt, Human
auauuauguguuuccau

SEQ ID NO: 2517378 - RNA, 13 nt, Human
auauggccacagu

SEQ ID NO: 2517379 - RNA, 15 nt, Human
auauggacucugcac

SEQ ID NO: 2517380 - RNA, 18 nt, Human
auaugcugccaaauuuug

SEQ ID NO: 2517381 - RNA, 12 nt, Human
auaugcugcuca

SEQ ID NO: 2517382 - RNA, 22 nt, Human
auaugcugccaaauuuuggcca

SEQ ID NO: 2517383 - RNA, 11 nt, Human
auauggagccc

SEQ ID NO: 2517384 - RNA, 16 nt, Human
auauggacucugcaca

SEQ ID NO: 2517385 - RNA, 18 nt, Human
auauggaugauucagaaa

SEQ ID NO: 2517386 - RNA, 20 nt, Human
auaugcucugcauguuacau

SEQ ID NO: 2517387 - RNA, 16 nt, Human
auaugcaguuuuccuu

SEQ ID NO: 2517388 - RNA, 20 nt, Human
auaugcagugauauggcaga

SEQ ID NO: 2517389 - RNA, 22 nt, Human
auauuauuuuauguugcauaga

SEQ ID NO: 2517390 - RNA, 15 nt, Human
auauuauuuuauguu

SEQ ID NO: 2517391 - RNA, 14 nt, Human
auauuauguuaaaa

SEQ ID NO: 2517392 - RNA, 14 nt, Human
auauuauuuuaugu

SEQ ID NO: 2517393 - RNA, 22 nt, Human
auauggcagaguuguaaauaua

SEQ ID NO: 2517394 - RNA, 23 nt, Human
auauggcagaguuguaaauauau

SEQ ID NO: 2517395 - RNA, 20 nt, Human
auauucaacucauaagacuu

SEQ ID NO: 2517396 - RNA, 19 nt, Human
auauucaggaagcucaggg

SEQ ID NO: 2517397 - RNA, 22 nt, Human
auauucagugcuguggccuggg

SEQ ID NO: 2517398 - RNA, 17 nt, Human
auauucaggaagcucag

SEQ ID NO: 2517399 - RNA, 19 nt, Human
auauucauguaaacaaaau

SEQ ID NO: 2517400 - RNA, 14 nt, Human
auauucauguaaac

SEQ ID NO: 2517401 - RNA, 22 nt, Human
auauucauguaaacaaaauuua

SEQ ID NO: 2517402 - RNA, 14 nt, Human
auauucauuguaua

SEQ ID NO: 2517403 - RNA, 15 nt, Human
auauucauuguauaa

SEQ ID NO: 2517404 - RNA, 16 nt, Human
auauucauuguauaaa

SEQ ID NO: 2517405 - RNA, 20 nt, Human
auauucaugcuucuuccuua

SEQ ID NO: 2517406 - RNA, 18 nt, Human
auauucaugcuucuuccu

SEQ ID NO: 2517407 - RNA, 23 nt, Human
auauucagugcuguggccugggc

SEQ ID NO: 2517408 - RNA, 17 nt, Human
auauuuauaacucauca

SEQ ID NO: 2517409 - RNA, 20 nt, Human
auauuuauaacucaucauaa

SEQ ID NO: 2517410 - RNA, 21 nt, Human
auauuuauaacucaucauaaa

SEQ ID NO: 2517411 - RNA, 22 nt, Human
auauuuauaacucaucauaaaa

SEQ ID NO: 2517412 - RNA, 23 nt, Human
auauuuauaacucaucauaaaau

SEQ ID NO: 2517413 - RNA, 15 nt, Human
auauuuauagucaca

SEQ ID NO: 2517414 - RNA, 15 nt, Human
auauuuauaacucau

SEQ ID NO: 2517415 - RNA, 15 nt, Human
auauuuauauauauu

SEQ ID NO: 2517416 - RNA, 15 nt, Human
auauuuauauauuua

SEQ ID NO: 2517417 - RNA, 14 nt, Human
auauuuauauuuca

SEQ ID NO: 2517418 - RNA, 15 nt, Human
auauuuauauuucac

SEQ ID NO: 2517419 - RNA, 21 nt, Human
auauuuaugucuauuuaagcc

SEQ ID NO: 2517420 - RNA, 19 nt, Human
auauuuauggggggagaac

SEQ ID NO: 2517421 - RNA, 14 nt, Human
auauuuauguagau

SEQ ID NO: 2517422 - RNA, 18 nt, Human
auauuuaugucuauuuaa

SEQ ID NO: 2517423 - RNA, 20 nt, Human
auauuuauguagaugugcau

SEQ ID NO: 2517424 - RNA, 19 nt, Human
auauuucccugaaggaacc

SEQ ID NO: 2517425 - RNA, 19 nt, Human
auauuuaugucuauuuaag

SEQ ID NO: 2517426 - RNA, 21 nt, Human
auauuuccauauggauuuucu

SEQ ID NO: 2517427 - RNA, 18 nt, Human
auauuuccauauggauuu

SEQ ID NO: 2517428 - RNA, 21 nt, Human
auacuuucauccugacucugc

SEQ ID NO: 2517429 - RNA, 13 nt, Human
auacuuugucuga

SEQ ID NO: 2517430 - RNA, 16 nt, Human
auacuuuaaaggaaaa

SEQ ID NO: 2517431 - RNA, 15 nt, Human
auacuuuaaaggaaa

SEQ ID NO: 2517432 - RNA, 14 nt, Human
auacuuuaaaggaa

SEQ ID NO: 2517433 - RNA, 23 nt, Human
auacuuuagugaacguggacucc

SEQ ID NO: 2517434 - RNA, 15 nt, Human
auacuuuagugaacg

SEQ ID NO: 2517435 - RNA, 23 nt, Human
auacuuuaaaggaaaaaauguug

SEQ ID NO: 2517436 - RNA, 12 nt, Human
auacuuuacaug

SEQ ID NO: 2517437 - RNA, 21 nt, Human
auacuuguggacuaaaagaua

SEQ ID NO: 2517438 - RNA, 20 nt, Human
auacuuguggacuaaaagau

SEQ ID NO: 2517439 - RNA, 14 nt, Human
auacuuguggacua

SEQ ID NO: 2517440 - RNA, 13 nt, Human
auacuuguggacu

SEQ ID NO: 2517441 - RNA, 18 nt, Human
auacuugucaauauuuaa

SEQ ID NO: 2517442 - RNA, 17 nt, Human
auacuugucuuguucac

SEQ ID NO: 2517443 - RNA, 23 nt, Human
auacuugaagggccagagccagg

SEQ ID NO: 2517444 - RNA, 13 nt, Human
auacuugagacug

SEQ ID NO: 2517445 - RNA, 22 nt, Human
auacuugaagggccagagccag

SEQ ID NO: 2517446 - RNA, 16 nt, Human
auagcauucucuauca

SEQ ID NO: 2517447 - RNA, 15 nt, Human
auagcauugugaacu

SEQ ID NO: 2517448 - RNA, 16 nt, Human
auagcauugugaacug

SEQ ID NO: 2517449 - RNA, 21 nt, Human
auagcauuuuugauuuaugca

SEQ ID NO: 2517450 - RNA, 19 nt, Human
auagcauuuuugauuuaug

SEQ ID NO: 2517451 - RNA, 18 nt, Human
auagcauuuuugauuuau

SEQ ID NO: 2517452 - RNA, 23 nt, Human
auagcauguauugugucuuuugc

SEQ ID NO: 2517453 - RNA, 16 nt, Human
auagcauguauugugu

SEQ ID NO: 2517454 - RNA, 15 nt, Human
auagcauguauugug

SEQ ID NO: 2517455 - RNA, 14 nt, Human
auagcauguauugu

SEQ ID NO: 2517456 - RNA, 10 nt, Human
auagcaugua

SEQ ID NO: 2517457 - RNA, 22 nt, Human
auagcauguauugugucuuuug

SEQ ID NO: 2517458 - RNA, 18 nt, Human
auagcauguauugugucu

SEQ ID NO: 2517459 - RNA, 13 nt, Human
auagcauuaacua

SEQ ID NO: 2517460 - RNA, 15 nt, Human
auagcauuaacuaau

SEQ ID NO: 2517461 - RNA, 21 nt, Human
auagcauuaacuaaucuauug

SEQ ID NO: 2517462 - RNA, 15 nt, Human
auagcagcuuauuca

SEQ ID NO: 2517463 - RNA, 19 nt, Human
auagcaugacauuucuuug

SEQ ID NO: 2517464 - RNA, 13 nt, Human
auagcauguaaug

SEQ ID NO: 2517465 - RNA, 22 nt, Human
auagcagauuuuaauuuugaau

SEQ ID NO: 2517466 - RNA, 11 nt, Human
auagcacuuuc

SEQ ID NO: 2517467 - RNA, 14 nt, Human
auagcagauuuuaa

SEQ ID NO: 2517468 - RNA, 18 nt, Human
auagcacagacccugccc

SEQ ID NO: 2517469 - RNA, 17 nt, Human
auagcacagacccugcc

SEQ ID NO: 2517470 - RNA, 16 nt, Human
auagcagacaguguuu

SEQ ID NO: 2517471 - RNA, 14 nt, Human
auagcaccagggcu

SEQ ID NO: 2517472 - RNA, 15 nt, Human
auagcacugagcaaa

SEQ ID NO: 2517473 - RNA, 15 nt, Human
auagcacagacccug

SEQ ID NO: 2517474 - RNA, 22 nt, Human
auagaaauaaaggaugugauug

SEQ ID NO: 2517475 - RNA, 20 nt, Human
auagaaauaaauagcuauau

SEQ ID NO: 2517476 - RNA, 19 nt, Human
auagaaauaagugguuauu

SEQ ID NO: 2517477 - RNA, 21 nt, Human
auagaaacucaccauguaaaa

SEQ ID NO: 2517478 - RNA, 22 nt, Human
auagaaagccaaaucaaaauau

SEQ ID NO: 2517479 - RNA, 23 nt, Human
auauacaguaacuuuauguguaa

SEQ ID NO: 2517480 - RNA, 22 nt, Human
auauacaguaacuuuaugugua

SEQ ID NO: 2517481 - RNA, 17 nt, Human
auauacaguaacuuuau

SEQ ID NO: 2517482 - RNA, 16 nt, Human
auauacaguaacuuua

SEQ ID NO: 2517483 - RNA, 14 nt, Human
auauacaguaacuu

SEQ ID NO: 2517484 - RNA, 19 nt, Human
auauacacaggauccuauu

SEQ ID NO: 2517485 - RNA, 15 nt, Human
auauacagcucagaa

SEQ ID NO: 2517486 - RNA, 13 nt, Human
auauacacacagc

SEQ ID NO: 2517487 - RNA, 17 nt, Human
auagccuaggugacaga

SEQ ID NO: 2517488 - RNA, 15 nt, Human
auagccuaggugaca

SEQ ID NO: 2517489 - RNA, 19 nt, Human
auagccuauauuuacagug

SEQ ID NO: 2517490 - RNA, 16 nt, Human
auagccuauauuuaca

SEQ ID NO: 2517491 - RNA, 12 nt, Human
auagccuauauu

SEQ ID NO: 2517492 - RNA, 14 nt, Human
auagccgggcaugg

SEQ ID NO: 2517493 - RNA, 18 nt, Human
auagccgggcaugguggc

SEQ ID NO: 2517494 - RNA, 16 nt, Human
auaguaaccuggguaa

SEQ ID NO: 2517495 - RNA, 19 nt, Human
auaguaacuucuuauggaa

SEQ ID NO: 2517496 - RNA, 21 nt, Human
auaguaacuucuuauggaauu

SEQ ID NO: 2517497 - RNA, 14 nt, Human
auaguaauucucag

SEQ ID NO: 2517498 - RNA, 14 nt, Human
auaguaaaaauaaa

SEQ ID NO: 2517499 - RNA, 22 nt, Human
auagguuuuguuugcuaucuua

SEQ ID NO: 2517500 - RNA, 21 nt, Human
auagguuuuguuugcuaucuu

SEQ ID NO: 2517501 - RNA, 16 nt, Human
auaguaaaauucuacu

SEQ ID NO: 2517502 - RNA, 18 nt, Human
auaguaaaagauaacaag

SEQ ID NO: 2517503 - RNA, 13 nt, Human
auaguaaaaauaa

SEQ ID NO: 2517504 - RNA, 19 nt, Human
auagguuuuguuugcuauc

SEQ ID NO: 2517505 - RNA, 17 nt, Human
auagguuuuguuugcua

SEQ ID NO: 2517506 - RNA, 16 nt, Human
auagguuuuguuugcu

SEQ ID NO: 2517507 - RNA, 21 nt, Human
auauaauaaauguacauuaau

SEQ ID NO: 2517508 - RNA, 21 nt, Human
auauaauaaagcuacugauuu

SEQ ID NO: 2517509 - RNA, 18 nt, Human
auauaauaaagcuacuga

SEQ ID NO: 2517510 - RNA, 21 nt, Human
auauaaguuugaaggaaacag

SEQ ID NO: 2517511 - RNA, 19 nt, Human
auauaaguuugaaggaaac

SEQ ID NO: 2517512 - RNA, 17 nt, Human
auauaaguuugaaggaa

SEQ ID NO: 2517513 - RNA, 21 nt, Human
auaguaccauuuauacaaauu

SEQ ID NO: 2517514 - RNA, 15 nt, Human
auaguagcauacauu

SEQ ID NO: 2517515 - RNA, 14 nt, Human
auauaaguuugaag

SEQ ID NO: 2517516 - RNA, 17 nt, Human
auaguaccaaucauuuu

SEQ ID NO: 2517517 - RNA, 14 nt, Human
auaguaccauuuau

SEQ ID NO: 2517518 - RNA, 19 nt, Human
auaguaccauuuauacaaa

SEQ ID NO: 2517519 - RNA, 14 nt, Human
auaguacuggcaug

SEQ ID NO: 2517520 - RNA, 18 nt, Human
auaguacucuuuguagca

SEQ ID NO: 2517521 - RNA, 21 nt, Human
auauaaugguuucaaagauuc

SEQ ID NO: 2517522 - RNA, 18 nt, Human
auauaaugguuucaaaga

SEQ ID NO: 2517523 - RNA, 15 nt, Human
auauaaugguuucaa

SEQ ID NO: 2517524 - RNA, 21 nt, Human
auauacaaccugcuugggugg

SEQ ID NO: 2517525 - RNA, 18 nt, Human
auauacaauaacauaauu

SEQ ID NO: 2517526 - RNA, 16 nt, Human
auauacaauaacauaa

SEQ ID NO: 2517527 - RNA, 14 nt, Human
auauacaauuauau

SEQ ID NO: 2517528 - RNA, 23 nt, Human
auauaauaugcacacagugcuuu

SEQ ID NO: 2517529 - RNA, 20 nt, Human
auauaauauauuuguguauu

SEQ ID NO: 2517530 - RNA, 17 nt, Human
auauaauauauuugugu

SEQ ID NO: 2517531 - RNA, 21 nt, Human
auaagccagacaucaacagau

SEQ ID NO: 2517532 - RNA, 22 nt, Human
auaagccagacaucaacagaua

SEQ ID NO: 2517533 - RNA, 18 nt, Human
auaaggccuuaauauguu

SEQ ID NO: 2517534 - RNA, 17 nt, Human
auaaggccuuaauaugu

SEQ ID NO: 2517535 - RNA, 21 nt, Human
auaagccuccauuuaguucuu

SEQ ID NO: 2517536 - RNA, 18 nt, Human
auaaggguaucuggugac

SEQ ID NO: 2517537 - RNA, 13 nt, Human
auaagggcagagu

SEQ ID NO: 2517538 - RNA, 15 nt, Human
auaagggcagaguca

SEQ ID NO: 2517539 - RNA, 13 nt, Human
auaauggucagag

SEQ ID NO: 2517540 - RNA, 15 nt, Human
auaaugguaccagau

SEQ ID NO: 2517541 - RNA, 19 nt, Human
auaaugggguccuggccau

SEQ ID NO: 2517542 - RNA, 21 nt, Human
auaagguaccuuucacauaga

SEQ ID NO: 2517543 - RNA, 15 nt, Human
auaauguaaauaaag

SEQ ID NO: 2517544 - RNA, 14 nt, Human
auaaugguuucaaa

SEQ ID NO: 2517545 - RNA, 22 nt, Human
auaauggucccauccaggcagu

SEQ ID NO: 2517546 - RNA, 18 nt, Human
auaaugguugacuggguu

SEQ ID NO: 2517547 - RNA, 17 nt, Human
auaauggucccauccag

SEQ ID NO: 2517548 - RNA, 19 nt, Human
auaaugguaccagauaaaa

SEQ ID NO: 2517549 - RNA, 18 nt, Human
auaaugguaccagauaaa

SEQ ID NO: 2517550 - RNA, 17 nt, Human
auaaugguaccagauaa

SEQ ID NO: 2517551 - RNA, 20 nt, Human
auaauggucccauccaggca

SEQ ID NO: 2517552 - RNA, 18 nt, Human
auaauggucccauccagg

SEQ ID NO: 2517553 - RNA, 14 nt, Human
auaaugguugacug

SEQ ID NO: 2517554 - RNA, 13 nt, Human
auaauguuucaaa

SEQ ID NO: 2517555 - RNA, 14 nt, Human
auaauguuguuauu

SEQ ID NO: 2517556 - RNA, 19 nt, Human
auaauguaaacaauaucag

SEQ ID NO: 2517557 - RNA, 16 nt, Human
auaccccaucauucau

SEQ ID NO: 2517558 - RNA, 20 nt, Human
auacccccugcaaagcccag

SEQ ID NO: 2517559 - RNA, 16 nt, Human
auaccugucccccuga

SEQ ID NO: 2517560 - RNA, 15 nt, Human
auaccugucccccug

SEQ ID NO: 2517561 - RNA, 14 nt, Human
auaccugucccccu

SEQ ID NO: 2517562 - RNA, 21 nt, Human
auacccccugcaaagcccagc

SEQ ID NO: 2517563 - RNA, 13 nt, Human
auaccuguccccc

SEQ ID NO: 2517564 - RNA, 16 nt, Human
auacccacccccaccc

SEQ ID NO: 2517565 - RNA, 14 nt, Human
auacccacccccac

SEQ ID NO: 2517566 - RNA, 13 nt, Human
auacccaccccca

SEQ ID NO: 2517567 - RNA, 22 nt, Human
auacacuuauuggaacucugcu

SEQ ID NO: 2517568 - RNA, 17 nt, Human
auacccacccccaccca

SEQ ID NO: 2517569 - RNA, 17 nt, Human
auacccccugcaaagcc

SEQ ID NO: 2517570 - RNA, 19 nt, Human
auacccccugcaaagccca

SEQ ID NO: 2517571 - RNA, 15 nt, Human
auacccaugaacuua

SEQ ID NO: 2517572 - RNA, 13 nt, Human
auaccccccucug

SEQ ID NO: 2517573 - RNA, 18 nt, Human
auacccauagcuuccaug

SEQ ID NO: 2517574 - RNA, 14 nt, Human
auacaaugcugugc

SEQ ID NO: 2517575 - RNA, 17 nt, Human
auacaaugcugugcccu

SEQ ID NO: 2517576 - RNA, 13 nt, Human
auacacuuacacu

SEQ ID NO: 2517577 - RNA, 22 nt, Human
auacacuuacacuuuaugcaca

SEQ ID NO: 2517578 - RNA, 18 nt, Human
auaauguuucaaacauau

SEQ ID NO: 2517579 - RNA, 19 nt, Human
auaauguuguuauuuaaag

SEQ ID NO: 2517580 - RNA, 19 nt, Human
auaauguuuaauauugaga

SEQ ID NO: 2517581 - RNA, 15 nt, Human
auacaauaucaucca

SEQ ID NO: 2517582 - RNA, 22 nt, Human
auaauguuuaauauugagaaag

SEQ ID NO: 2517583 - RNA, 17 nt, Human
aguuugauuaaauucuu

SEQ ID NO: 2517584 - RNA, 18 nt, Human
aguuugauuaaauucuug

SEQ ID NO: 2517585 - RNA, 20 nt, Human
aguuugauuaaauucuugca

SEQ ID NO: 2517586 - RNA, 22 nt, Human
aguuugauuaaauucuugcaaa

SEQ ID NO: 2517587 - RNA, 21 nt, Human
aguuugaauguuaaauaaauu

SEQ ID NO: 2517588 - RNA, 16 nt, Human
aguuugaauguuaaau

SEQ ID NO: 2517589 - RNA, 16 nt, Human
aguuugauuaaauucu

SEQ ID NO: 2517590 - RNA, 20 nt, Human
aguuugagaucagccugggc

SEQ ID NO: 2517591 - RNA, 18 nt, Human
aguuugagaucagccugg

SEQ ID NO: 2517592 - RNA, 19 nt, Human
aguuugagaucagccuggg

SEQ ID NO: 2517593 - RNA, 19 nt, Human
aguuguuacauuuuuaagu

SEQ ID NO: 2517594 - RNA, 20 nt, Human
aguuguuacauuuuuaagug

SEQ ID NO: 2517595 - RNA, 22 nt, Human
aguuguuacauuuuuaagugcu

SEQ ID NO: 2517596 - RNA, 22 nt, Human
aguuguuacuaacuaaacucuc

SEQ ID NO: 2517597 - RNA, 20 nt, Human
aguuguuacuaacuaaacuc

SEQ ID NO: 2517598 - RNA, 19 nt, Human
aguuguuacuaacuaaacu

SEQ ID NO: 2517599 - RNA, 18 nt, Human
aguuguuacuaacuaaac

SEQ ID NO: 2517600 - RNA, 19 nt, Human
aguugugcuuguuuacagc

SEQ ID NO: 2517601 - RNA, 23 nt, Human
aguugugccuuuuauagcuauua

SEQ ID NO: 2517602 - RNA, 17 nt, Human
aguuucuuagcuuuuua

SEQ ID NO: 2517603 - RNA, 23 nt, Human
aguuguuacuaacuaaacucucu

SEQ ID NO: 2517604 - RNA, 23 nt, Human
aguuucuuuccugccuucuucuu

SEQ ID NO: 2517605 - RNA, 21 nt, Human
aguuucuuuccugccuucuuc

SEQ ID NO: 2517606 - RNA, 19 nt, Human
aguuucuuuccugccuucu

SEQ ID NO: 2517607 - RNA, 18 nt, Human
aguuucuuuccugccuuc

SEQ ID NO: 2517608 - RNA, 13 nt, Human
aguuucuuuggga

SEQ ID NO: 2517609 - RNA, 18 nt, Human
aguuugaaggaaacaguu

SEQ ID NO: 2517610 - RNA, 16 nt, Human
aguuugaaggaaacag

SEQ ID NO: 2517611 - RNA, 15 nt, Human
aguuugaaggaaaca

SEQ ID NO: 2517612 - RNA, 15 nt, Human
aguuugaacuucaua

SEQ ID NO: 2517613 - RNA, 15 nt, Human
aguuugaauguuaaa

SEQ ID NO: 2517614 - RNA, 14 nt, Human
aguuugaauguuaa

SEQ ID NO: 2517615 - RNA, 12 nt, Human
aguuugaauguu

SEQ ID NO: 2517616 - RNA, 21 nt, Human
aguuugaaggaggugagggau

SEQ ID NO: 2517617 - RNA, 13 nt, Human
aguuugcuuagaa

SEQ ID NO: 2517618 - RNA, 14 nt, Human
aguuugcuuagaaa

SEQ ID NO: 2517619 - RNA, 18 nt, Human
aguuuggauucuuaugua

SEQ ID NO: 2517620 - RNA, 16 nt, Human
aguuuggcaaacucuc

SEQ ID NO: 2517621 - RNA, 20 nt, Human
auaaaaagccugcaauuuca

SEQ ID NO: 2517622 - RNA, 16 nt, Human
aguuuggcaauaguuu

SEQ ID NO: 2517623 - RNA, 17 nt, Human
aguuuggcaauaguuug

SEQ ID NO: 2517624 - RNA, 12 nt, Human
auaaaaagcaaa

SEQ ID NO: 2517625 - RNA, 18 nt, Human
aguuuggcaaacucucca

SEQ ID NO: 2517626 - RNA, 15 nt, Human
aguuugagcugccuu

SEQ ID NO: 2517627 - RNA, 14 nt, Human
aguuugagcugccu

SEQ ID NO: 2517628 - RNA, 14 nt, Human
aguuugauuauuca

SEQ ID NO: 2517629 - RNA, 17 nt, Human
aguuugauuauucagug

SEQ ID NO: 2517630 - RNA, 18 nt, Human
aguuugauuauucagugu

SEQ ID NO: 2517631 - RNA, 23 nt, Human
aguuugauuaaauucuugcaaag

SEQ ID NO: 2517632 - RNA, 23 nt, Human
aguuugauuauucagugucacug

SEQ ID NO: 2517633 - RNA, 18 nt, Human
aguuugcuguacuagaga

SEQ ID NO: 2517634 - RNA, 11 nt, Human
aguuugcugua

SEQ ID NO: 2517635 - RNA, 11 nt, Human
aguuugcuuag

SEQ ID NO: 2517636 - RNA, 20 nt, Human
aguuugcacuguaugcugga

SEQ ID NO: 2517637 - RNA, 14 nt, Human
aguuugcuauuaga

SEQ ID NO: 2517638 - RNA, 23 nt, Human
auaaaacauuuuaaauggacaga

SEQ ID NO: 2517639 - RNA, 12 nt, Human
auaaaacccuua

SEQ ID NO: 2517640 - RNA, 11 nt, Human
auaaaaccuuu

SEQ ID NO: 2517641 - RNA, 13 nt, Human
auaaaaccuuuca

SEQ ID NO: 2517642 - RNA, 14 nt, Human
auaaaaccuuucaa

SEQ ID NO: 2517643 - RNA, 15 nt, Human
auaaaaccuuucaaa

SEQ ID NO: 2517644 - RNA, 20 nt, Human
auaaaaccuuucaaauuuca

SEQ ID NO: 2517645 - RNA, 21 nt, Human
auaaaaccuuucaaauuucac

SEQ ID NO: 2517646 - RNA, 22 nt, Human
auaaaaccuuucaaauuucaca

SEQ ID NO: 2517647 - RNA, 23 nt, Human
auaaagaugaucuacucagaaau

SEQ ID NO: 2517648 - RNA, 15 nt, Human
auaaaacuggcuuug

SEQ ID NO: 2517649 - RNA, 14 nt, Human
auaaagaugcucuu

SEQ ID NO: 2517650 - RNA, 15 nt, Human
auaaagaugcucuuu

SEQ ID NO: 2517651 - RNA, 18 nt, Human
auaaagauggcugacuuu

SEQ ID NO: 2517652 - RNA, 20 nt, Human
auaaagaugaucuacucaga

SEQ ID NO: 2517653 - RNA, 17 nt, Human
auaaaacuuugcugcca

SEQ ID NO: 2517654 - RNA, 22 nt, Human
auaaaaagccugcaauuucaua

SEQ ID NO: 2517655 - RNA, 16 nt, Human
auaaaaagcaaaacaa

SEQ ID NO: 2517656 - RNA, 12 nt, Human
auaaaaagcuga

SEQ ID NO: 2517657 - RNA, 13 nt, Human
auaaaaagcaaaa

SEQ ID NO: 2517658 - RNA, 17 nt, Human
auaaaaagcuuccauga

SEQ ID NO: 2517659 - RNA, 21 nt, Human
auaaaaagcuuccaugauucu

SEQ ID NO: 2517660 - RNA, 11 nt, Human
auaaaaaggca

SEQ ID NO: 2517661 - RNA, 12 nt, Human
auaaaaaggcac

SEQ ID NO: 2517662 - RNA, 13 nt, Human
auaaaacauuaau

SEQ ID NO: 2517663 - RNA, 22 nt, Human
auaaaacauuaagaaaaucaua

SEQ ID NO: 2517664 - RNA, 18 nt, Human
auaaaacauuaagaaaau

SEQ ID NO: 2517665 - RNA, 19 nt, Human
auaaaacauuuuaaaugga

SEQ ID NO: 2517666 - RNA, 18 nt, Human
auaaaacauuuuaaaugg

SEQ ID NO: 2517667 - RNA, 13 nt, Human
auaaaacauuuua

SEQ ID NO: 2517668 - RNA, 11 nt, Human
auaaaacauuu

SEQ ID NO: 2517669 - RNA, 18 nt, Human
auaaaacauuuucacaca

SEQ ID NO: 2517670 - RNA, 20 nt, Human
auaaaacauuuucacacaau

SEQ ID NO: 2517671 - RNA, 20 nt, Human
auaacauguaauuaaguacu

SEQ ID NO: 2517672 - RNA, 23 nt, Human
auaacacacagcuaacacacagc

SEQ ID NO: 2517673 - RNA, 14 nt, Human
auaacacacagcua

SEQ ID NO: 2517674 - RNA, 11 nt, Human
auaacacacau

SEQ ID NO: 2517675 - RNA, 12 nt, Human
auaacauguaau

SEQ ID NO: 2517676 - RNA, 14 nt, Human
auaacaauuccucu

SEQ ID NO: 2517677 - RNA, 15 nt, Human
auaacaauuccucua

SEQ ID NO: 2517678 - RNA, 15 nt, Human
auaacaauuguuugg

SEQ ID NO: 2517679 - RNA, 22 nt, Human
auaacaauguuaaggaaacucu

SEQ ID NO: 2517680 - RNA, 13 nt, Human
auaacacacagcu

SEQ ID NO: 2517681 - RNA, 14 nt, Human
auaacacaauauga

SEQ ID NO: 2517682 - RNA, 13 nt, Human
auaacauguaauu

SEQ ID NO: 2517683 - RNA, 18 nt, Human
auaacauguaauuaagua

SEQ ID NO: 2517684 - RNA, 18 nt, Human
auaacaauguuaaggaaa

SEQ ID NO: 2517685 - RNA, 16 nt, Human
auaacaauguuaagga

SEQ ID NO: 2517686 - RNA, 14 nt, Human
auaacaauguuaag

SEQ ID NO: 2517687 - RNA, 13 nt, Human
auaacaauguuaa

SEQ ID NO: 2517688 - RNA, 21 nt, Human
auaacaagguccaagauaccu

SEQ ID NO: 2517689 - RNA, 17 nt, Human
auaacaagguccaagau

SEQ ID NO: 2517690 - RNA, 16 nt, Human
auaacaaugugcucuc

SEQ ID NO: 2517691 - RNA, 21 nt, Human
auaacaaugcuguauuuuaaa

SEQ ID NO: 2517692 - RNA, 20 nt, Human
auaacaaugcuguauuuuaa

SEQ ID NO: 2517693 - RNA, 19 nt, Human
auaacaaugcuguauuuua

SEQ ID NO: 2517694 - RNA, 17 nt, Human
auaacaaugcuguauuu

SEQ ID NO: 2517695 - RNA, 15 nt, Human
auaacaaugcuguau

SEQ ID NO: 2517696 - RNA, 14 nt, Human
auaacaaugaaagu

SEQ ID NO: 2517697 - RNA, 15 nt, Human
auaaauuguuugacc

SEQ ID NO: 2517698 - RNA, 13 nt, Human
auaaauuguuuga

SEQ ID NO: 2517699 - RNA, 14 nt, Human
auaaauuguauauu

SEQ ID NO: 2517700 - RNA, 17 nt, Human
auaaauuguuugaccau

SEQ ID NO: 2517701 - RNA, 14 nt, Human
auaaauuuauuuac

SEQ ID NO: 2517702 - RNA, 15 nt, Human
auaaauuuauuuacu

SEQ ID NO: 2517703 - RNA, 19 nt, Human
auaaauuuauuuacugcua

SEQ ID NO: 2517704 - RNA, 17 nt, Human
auaacaagaucuuucag

SEQ ID NO: 2517705 - RNA, 19 nt, Human
auaacaagaucuuucagga

SEQ ID NO: 2517706 - RNA, 22 nt, Human
auaaaaagaucacuuucucagu

SEQ ID NO: 2517707 - RNA, 16 nt, Human
auaacaagaucuuuca

SEQ ID NO: 2517708 - RNA, 20 nt, Human
auaaauuugguucuaauaga

SEQ ID NO: 2517709 - RNA, 19 nt, Human
auaaauuguauauucacuu

SEQ ID NO: 2517710 - RNA, 18 nt, Human
auaaauuguauauucacu

SEQ ID NO: 2517711 - RNA, 17 nt, Human
auaaauuguauauucac

SEQ ID NO: 2517712 - RNA, 16 nt, Human
auaaauuguauauuca

SEQ ID NO: 2517713 - RNA, 18 nt, Human
auaaagcaauuuuccuug

SEQ ID NO: 2517714 - RNA, 17 nt, Human
auaaagcaauuuuccuu

SEQ ID NO: 2517715 - RNA, 16 nt, Human
auaaagcaauuuuccu

SEQ ID NO: 2517716 - RNA, 15 nt, Human
auaaagcaauuuucc

SEQ ID NO: 2517717 - RNA, 14 nt, Human
auaaagcaauuuuc

SEQ ID NO: 2517718 - RNA, 13 nt, Human
auaaagcaauuuu

SEQ ID NO: 2517719 - RNA, 12 nt, Human
auaaagcaauuu

SEQ ID NO: 2517720 - RNA, 15 nt, Human
auaaagauguuaaaa

SEQ ID NO: 2517721 - RNA, 20 nt, Human
auaaagauuucuugaguuuu

SEQ ID NO: 2517722 - RNA, 11 nt, Human
auaaagcaauu

SEQ ID NO: 2517723 - RNA, 10 nt, Human
auaaagcaau

SEQ ID NO: 2517724 - RNA, 22 nt, Human
auaaagcaacuguuaugaaaua

SEQ ID NO: 2517725 - RNA, 14 nt, Human
agucaugagcugag

SEQ ID NO: 2517726 - RNA, 16 nt, Human
agucaugagcugagca

SEQ ID NO: 2517727 - RNA, 22 nt, Human
agucaugagcugagcagggaga

SEQ ID NO: 2517728 - RNA, 20 nt, Human
agucauguaagcugaaaaua

SEQ ID NO: 2517729 - RNA, 13 nt, Human
agucauggcugug

SEQ ID NO: 2517730 - RNA, 12 nt, Human
agucauggcugu

SEQ ID NO: 2517731 - RNA, 22 nt, Human
agucaugcauaaauaugcagug

SEQ ID NO: 2517732 - RNA, 21 nt, Human
agucaugcauaaauaugcagu

SEQ ID NO: 2517733 - RNA, 19 nt, Human
agucauguuccuucaagau

SEQ ID NO: 2517734 - RNA, 15 nt, Human
agucauguuccuuca

SEQ ID NO: 2517735 - RNA, 13 nt, Human
agucauguuccuu

SEQ ID NO: 2517736 - RNA, 12 nt, Human
agucaugugacc

SEQ ID NO: 2517737 - RNA, 13 nt, Human
agucaugugcauu

SEQ ID NO: 2517738 - RNA, 14 nt, Human
agucauuuuuguuu

SEQ ID NO: 2517739 - RNA, 16 nt, Human
aguccaaauguccucc

SEQ ID NO: 2517740 - RNA, 21 nt, Human
agucaugaucucccugccgcc

SEQ ID NO: 2517741 - RNA, 15 nt, Human
agucaugaucucccu

SEQ ID NO: 2517742 - RNA, 16 nt, Human
agucaugaucucccug

SEQ ID NO: 2517743 - RNA, 17 nt, Human
agucaugaucucccugc

SEQ ID NO: 2517744 - RNA, 18 nt, Human
agucaugaucucccugcc

SEQ ID NO: 2517745 - RNA, 19 nt, Human
agucaugaucucccugccg

SEQ ID NO: 2517746 - RNA, 20 nt, Human
agucaugaucucccugccgc

SEQ ID NO: 2517747 - RNA, 23 nt, Human
agucaugaucucccugccgccuc

SEQ ID NO: 2517748 - RNA, 14 nt, Human
agucaugcauaaau

SEQ ID NO: 2517749 - RNA, 13 nt, Human
agucaugcauaaa

SEQ ID NO: 2517750 - RNA, 20 nt, Human
agucaugcaaaggcugggac

SEQ ID NO: 2517751 - RNA, 19 nt, Human
agucaugcaaaggcuggga

SEQ ID NO: 2517752 - RNA, 18 nt, Human
agucaugcaaaggcuggg

SEQ ID NO: 2517753 - RNA, 17 nt, Human
agucaugcaaaggcugg

SEQ ID NO: 2517754 - RNA, 20 nt, Human
agucaugcauaaauaugcag

SEQ ID NO: 2517755 - RNA, 19 nt, Human
agucaugcauaaauaugca

SEQ ID NO: 2517756 - RNA, 17 nt, Human
agucaugcauaaauaug

SEQ ID NO: 2517757 - RNA, 16 nt, Human
agucaugcauaaauau

SEQ ID NO: 2517758 - RNA, 19 nt, Human
agucaugcguuuaaucaca

SEQ ID NO: 2517759 - RNA, 11 nt, Human
aguccaagcau

SEQ ID NO: 2517760 - RNA, 19 nt, Human
aguccucuuuucugagagg

SEQ ID NO: 2517761 - RNA, 23 nt, Human
aguccaacguggggcagcacaga

SEQ ID NO: 2517762 - RNA, 22 nt, Human
aguccaacguggggcagcacag

SEQ ID NO: 2517763 - RNA, 20 nt, Human
aguccaacguggggcagcac

SEQ ID NO: 2517764 - RNA, 19 nt, Human
aguccaacguggggcagca

SEQ ID NO: 2517765 - RNA, 19 nt, Human
aguccaaauguccuccaga

SEQ ID NO: 2517766 - RNA, 23 nt, Human
aguccaaauguccuccagaagcc

SEQ ID NO: 2517767 - RNA, 19 nt, Human
aguccaaauguuuacaggg

SEQ ID NO: 2517768 - RNA, 18 nt, Human
aguccaacguggggcagc

SEQ ID NO: 2517769 - RNA, 20 nt, Human
aguccuuaccagcagagcac

SEQ ID NO: 2517770 - RNA, 22 nt, Human
aguccugaagaggcgggccagc

SEQ ID NO: 2517771 - RNA, 21 nt, Human
aguccugaagaggcgggccag

SEQ ID NO: 2517772 - RNA, 23 nt, Human
aguccugaagaggcgggccagcc

SEQ ID NO: 2517773 - RNA, 20 nt, Human
aguccugaucagagccgugg

SEQ ID NO: 2517774 - RNA, 20 nt, Human
aguccugcacaguuuucugg

SEQ ID NO: 2517775 - RNA, 22 nt, Human
aguccucuuuucugagaggacu

SEQ ID NO: 2517776 - RNA, 19 nt, Human
aguccugaagaggcgggcc

SEQ ID NO: 2517777 - RNA, 14 nt, Human
aguccugaagaggc

SEQ ID NO: 2517778 - RNA, 13 nt, Human
aguccugaagagg

SEQ ID NO: 2517779 - RNA, 12 nt, Human
aguccugaagag

SEQ ID NO: 2517780 - RNA, 19 nt, Human
aguccaagaggguccuuua

SEQ ID NO: 2517781 - RNA, 18 nt, Human
agugaccugaggaagcgu

SEQ ID NO: 2517782 - RNA, 16 nt, Human
agugaccugaggaagc

SEQ ID NO: 2517783 - RNA, 17 nt, Human
agugaccugaggaagcg

SEQ ID NO: 2517784 - RNA, 18 nt, Human
agugaccucagcuuugau

SEQ ID NO: 2517785 - RNA, 14 nt, Human
agugaccugaggaa

SEQ ID NO: 2517786 - RNA, 15 nt, Human
agugaccugaggaag

SEQ ID NO: 2517787 - RNA, 14 nt, Human
agugacgugcaccu

SEQ ID NO: 2517788 - RNA, 20 nt, Human
agugaauucuugaaggaaaa

SEQ ID NO: 2517789 - RNA, 19 nt, Human
agugaaugcugggacucag

SEQ ID NO: 2517790 - RNA, 15 nt, Human
agugaaugcugggac

SEQ ID NO: 2517791 - RNA, 12 nt, Human
agucuguuuuau

SEQ ID NO: 2517792 - RNA, 19 nt, Human
agucugugugaugaacuuu

SEQ ID NO: 2517793 - RNA, 18 nt, Human
agucugugugaugaacuu

SEQ ID NO: 2517794 - RNA, 15 nt, Human
agucugugugaaggu

SEQ ID NO: 2517795 - RNA, 22 nt, Human
agucugugugaugaacuuucuc

SEQ ID NO: 2517796 - RNA, 21 nt, Human
agucugugugaugaacuuucu

SEQ ID NO: 2517797 - RNA, 17 nt, Human
agugaccucagcuuuga

SEQ ID NO: 2517798 - RNA, 19 nt, Human
agugaauuugaaugaaaaa

SEQ ID NO: 2517799 - RNA, 17 nt, Human
agugaauuuuucucuaa

SEQ ID NO: 2517800 - RNA, 20 nt, Human
agugaauuuuucucuaacuc

SEQ ID NO: 2517801 - RNA, 20 nt, Human
agugaauuugaaugaaaaau

SEQ ID NO: 2517802 - RNA, 15 nt, Human
agugaauuuuucucu

SEQ ID NO: 2517803 - RNA, 16 nt, Human
agugaauuuuucucua

SEQ ID NO: 2517804 - RNA, 21 nt, Human
agugaauugugaccaaguuau

SEQ ID NO: 2517805 - RNA, 13 nt, Human
agugaauuugaau

SEQ ID NO: 2517806 - RNA, 14 nt, Human
agugaauuugaaug

SEQ ID NO: 2517807 - RNA, 15 nt, Human
agugaauuugaauga

SEQ ID NO: 2517808 - RNA, 16 nt, Human
agucugaguaaaaucu

SEQ ID NO: 2517809 - RNA, 20 nt, Human
agucugugccacguguuugu

SEQ ID NO: 2517810 - RNA, 15 nt, Human
agucugauccaggag

SEQ ID NO: 2517811 - RNA, 21 nt, Human
agucugugagauucauucaug

SEQ ID NO: 2517812 - RNA, 17 nt, Human
agucuguggaucagaga

SEQ ID NO: 2517813 - RNA, 14 nt, Human
agucuguggaucag

SEQ ID NO: 2517814 - RNA, 11 nt, Human
agucuguguga

SEQ ID NO: 2517815 - RNA, 12 nt, Human
agucugugugaa

SEQ ID NO: 2517816 - RNA, 16 nt, Human
agucugaauuuuuaaa

SEQ ID NO: 2517817 - RNA, 22 nt, Human
aguccuugaaaauauuuuuuau

SEQ ID NO: 2517818 - RNA, 17 nt, Human
aguccuugaaaauauuu

SEQ ID NO: 2517819 - RNA, 16 nt, Human
aguccuugaaaauauu

SEQ ID NO: 2517820 - RNA, 17 nt, Human
agucugaaggcuggguu

SEQ ID NO: 2517821 - RNA, 19 nt, Human
aguccuuaccagcagagca

SEQ ID NO: 2517822 - RNA, 23 nt, Human
aguccugcacaguuuucuggcug

SEQ ID NO: 2517823 - RNA, 15 nt, Human
aguccuuaccucuuc

SEQ ID NO: 2517824 - RNA, 17 nt, Human
aguccuuaccucuuccg

SEQ ID NO: 2517825 - RNA, 21 nt, Human
aguccuuaccucuuccggaga

SEQ ID NO: 2517826 - RNA, 16 nt, Human
aguccuucaccucacu

SEQ ID NO: 2517827 - RNA, 23 nt, Human
aguccuuaccucuuccggagaug

SEQ ID NO: 2517828 - RNA, 14 nt, Human
aguccuugaaaaua

SEQ ID NO: 2517829 - RNA, 17 nt, Human
aguccuucaccucacug

SEQ ID NO: 2517830 - RNA, 11 nt, Human
aguccuuccac

SEQ ID NO: 2517831 - RNA, 19 nt, Human
aguacuugaaaucuaggau

SEQ ID NO: 2517832 - RNA, 11 nt, Human
aguacuugaaa

SEQ ID NO: 2517833 - RNA, 23 nt, Human
aguacuugggagaccuguaauca

SEQ ID NO: 2517834 - RNA, 20 nt, Human
aguauccuccagguuuuuca

SEQ ID NO: 2517835 - RNA, 19 nt, Human
aguauccuccagguuuuuc

SEQ ID NO: 2517836 - RNA, 17 nt, Human
aguauccuccagguuuu

SEQ ID NO: 2517837 - RNA, 16 nt, Human
aguauccuccagguuu

SEQ ID NO: 2517838 - RNA, 15 nt, Human
aguauccuccagguu

SEQ ID NO: 2517839 - RNA, 14 nt, Human
aguauccuccaggu

SEQ ID NO: 2517840 - RNA, 13 nt, Human
aguauccuccagg

SEQ ID NO: 2517841 - RNA, 14 nt, Human
aguauccacuuugc

SEQ ID NO: 2517842 - RNA, 20 nt, Human
aguaugaggcauuuguuuga

SEQ ID NO: 2517843 - RNA, 21 nt, Human
aguaugaggcauuuguuugaa

SEQ ID NO: 2517844 - RNA, 22 nt, Human
aguauccuccagguuuuucaau

SEQ ID NO: 2517845 - RNA, 21 nt, Human
aguauccuccagguuuuucaa

SEQ ID NO: 2517846 - RNA, 23 nt, Human
aguauccuccagguuuuucaauu

SEQ ID NO: 2517847 - RNA, 19 nt, Human
aguaucuauauauguguau

SEQ ID NO: 2517848 - RNA, 18 nt, Human
aguaucuauauaugugua

SEQ ID NO: 2517849 - RNA, 17 nt, Human
aguaucuauauaugugu

SEQ ID NO: 2517850 - RNA, 16 nt, Human
aguaucuaacauguau

SEQ ID NO: 2517851 - RNA, 23 nt, Human
aguaucuauauauguguauguac

SEQ ID NO: 2517852 - RNA, 22 nt, Human
aguaucuauauauguguaugua

SEQ ID NO: 2517853 - RNA, 23 nt, Human
aguaugaggcauuuguuugaacu

SEQ ID NO: 2517854 - RNA, 17 nt, Human
aguaugaggcauuuguu

SEQ ID NO: 2517855 - RNA, 17 nt, Human
agucaaaacuacaaauc

SEQ ID NO: 2517856 - RNA, 21 nt, Human
agucaaaacagagaugugaua

SEQ ID NO: 2517857 - RNA, 16 nt, Human
agucaaaacucaaaug

SEQ ID NO: 2517858 - RNA, 15 nt, Human
agucaaaaggugccu

SEQ ID NO: 2517859 - RNA, 16 nt, Human
agucaaaaggugccug

SEQ ID NO: 2517860 - RNA, 17 nt, Human
agucaaaaggugccugu

SEQ ID NO: 2517861 - RNA, 20 nt, Human
aguauuuuuuuaucuuggga

SEQ ID NO: 2517862 - RNA, 14 nt, Human
agucaaaacagaga

SEQ ID NO: 2517863 - RNA, 18 nt, Human
agucaauccccucauuca

SEQ ID NO: 2517864 - RNA, 15 nt, Human
agucaaugugcagug

SEQ ID NO: 2517865 - RNA, 14 nt, Human
agucaaugugcagu

SEQ ID NO: 2517866 - RNA, 23 nt, Human
agucaauguuuucaguucucuug

SEQ ID NO: 2517867 - RNA, 22 nt, Human
agucacacaguauuacuucugc

SEQ ID NO: 2517868 - RNA, 16 nt, Human
agucacaagagcccag

SEQ ID NO: 2517869 - RNA, 22 nt, Human
aguacuacaguccucccaucuc

SEQ ID NO: 2517870 - RNA, 19 nt, Human
aguacuacaguccucccau

SEQ ID NO: 2517871 - RNA, 14 nt, Human
aguacuauaauuua

SEQ ID NO: 2517872 - RNA, 23 nt, Human
aguacuaacuccuaggaaaauac

SEQ ID NO: 2517873 - RNA, 16 nt, Human
aguacguugugcauuu

SEQ ID NO: 2517874 - RNA, 17 nt, Human
aguacguugugcauuug

SEQ ID NO: 2517875 - RNA, 18 nt, Human
aguacguugugcauuugg

SEQ ID NO: 2517876 - RNA, 22 nt, Human
aguaagcccuugaagauaucuu

SEQ ID NO: 2517877 - RNA, 22 nt, Human
aguacuucuccacccugcucuc

SEQ ID NO: 2517878 - RNA, 12 nt, Human
aguacuucuuuu

SEQ ID NO: 2517879 - RNA, 17 nt, Human
aguacuucuccacccug

SEQ ID NO: 2517880 - RNA, 12 nt, Human
aguacuauguau

SEQ ID NO: 2517881 - RNA, 14 nt, Human
aguacuauguauca

SEQ ID NO: 2517882 - RNA, 16 nt, Human
aguacuguguacagaa

SEQ ID NO: 2517883 - RNA, 20 nt, Human
aguacuggcugauggaguaa

SEQ ID NO: 2517884 - RNA, 22 nt, Human
aguaaaugcuagguuaauucca

SEQ ID NO: 2517885 - RNA, 11 nt, Human
aguaaaugcua

SEQ ID NO: 2517886 - RNA, 23 nt, Human
aguaaaugcuagguuaauuccaa

SEQ ID NO: 2517887 - RNA, 15 nt, Human
aguaaaucuuuuaca

SEQ ID NO: 2517888 - RNA, 22 nt, Human
aguaaauggcuuauccagcugg

SEQ ID NO: 2517889 - RNA, 19 nt, Human
aguaacaaugaagauaaaa

SEQ ID NO: 2517890 - RNA, 13 nt, Human
aggucuguucuuu

SEQ ID NO: 2517891 - RNA, 15 nt, Human
aggucuguucuuucc

SEQ ID NO: 2517892 - RNA, 16 nt, Human
aggucuguucuuucca

SEQ ID NO: 2517893 - RNA, 14 nt, Human
aguaaauauuucag

SEQ ID NO: 2517894 - RNA, 15 nt, Human
aguacguugugcauu

SEQ ID NO: 2517895 - RNA, 14 nt, Human
aguacguugugcau

SEQ ID NO: 2517896 - RNA, 19 nt, Human
aguaagagcuggugucuga

SEQ ID NO: 2517897 - RNA, 14 nt, Human
aguaagaagacaug

SEQ ID NO: 2517898 - RNA, 15 nt, Human
aguaagaagacauga

SEQ ID NO: 2517899 - RNA, 16 nt, Human
aguaagaagacaugaa

SEQ ID NO: 2517900 - RNA, 12 nt, Human
aguaagagcugg

SEQ ID NO: 2517901 - RNA, 14 nt, Human
aguaagagcuggug

SEQ ID NO: 2517902 - RNA, 23 nt, Human
aguaacaggaaaccacuuaucac

SEQ ID NO: 2517903 - RNA, 17 nt, Human
aguaacaugaggggaca

SEQ ID NO: 2517904 - RNA, 16 nt, Human
aguaagaaaauauuuu

SEQ ID NO: 2517905 - RNA, 14 nt, Human
aguaagaaaauauu

SEQ ID NO: 2517906 - RNA, 20 nt, Human
aguaagaaagugaagcaaau

SEQ ID NO: 2517907 - RNA, 17 nt, Human
aguaagaaccuugccug

SEQ ID NO: 2517908 - RNA, 23 nt, Human
aguaagaaaauauuuugucuaaa

SEQ ID NO: 2517909 - RNA, 21 nt, Human
aguaagaaagugaagcaaauc

SEQ ID NO: 2517910 - RNA, 14 nt, Human
aguaaccauuugca

SEQ ID NO: 2517911 - RNA, 23 nt, Human
aguaaccaucacugguugcacuu

SEQ ID NO: 2517912 - RNA, 13 nt, Human
aguaagaaaauau

SEQ ID NO: 2517913 - RNA, 12 nt, Human
aguaagaaaaua

SEQ ID NO: 2517914 - RNA, 19 nt, Human
aguugaaaagacuccaaag

SEQ ID NO: 2517915 - RNA, 20 nt, Human
aguugaaaagacuccaaaga

SEQ ID NO: 2517916 - RNA, 18 nt, Human
aguugaaaagacuccaaa

SEQ ID NO: 2517917 - RNA, 22 nt, Human
aguucaucuugaauuguaagga

SEQ ID NO: 2517918 - RNA, 22 nt, Human
aguugacaaaaagcucuuacac

SEQ ID NO: 2517919 - RNA, 13 nt, Human
aguugacagcagg

SEQ ID NO: 2517920 - RNA, 17 nt, Human
aguugacaugagauuua

SEQ ID NO: 2517921 - RNA, 20 nt, Human
aguugagccagcagacauug

SEQ ID NO: 2517922 - RNA, 19 nt, Human
aguugagccagcagacauu

SEQ ID NO: 2517923 - RNA, 16 nt, Human
aguugagccagcagac

SEQ ID NO: 2517924 - RNA, 15 nt, Human
aguugagccagcaga

SEQ ID NO: 2517925 - RNA, 22 nt, Human
aguugacuugacagaacacugu

SEQ ID NO: 2517926 - RNA, 16 nt, Human
aguugauacuacaguu

SEQ ID NO: 2517927 - RNA, 17 nt, Human
aguugagugauagagcu

SEQ ID NO: 2517928 - RNA, 20 nt, Human
aguugagucgucaucacuuu

SEQ ID NO: 2517929 - RNA, 16 nt, Human
aguugagccccaaguc

SEQ ID NO: 2517930 - RNA, 12 nt, Human
aguugagcccca

SEQ ID NO: 2517931 - RNA, 11 nt, Human
aguugagcccc

SEQ ID NO: 2517932 - RNA, 21 nt, Human
aguugagccagcagacauugu

SEQ ID NO: 2517933 - RNA, 21 nt, Human
aguugagccccaaguccugaa

SEQ ID NO: 2517934 - RNA, 13 nt, Human
aguugucuaaaca

SEQ ID NO: 2517935 - RNA, 13 nt, Human
aguugucuugucc

SEQ ID NO: 2517936 - RNA, 19 nt, Human
aguugugccuuuuauagcu

SEQ ID NO: 2517937 - RNA, 18 nt, Human
aguugugccuuuuauagc

SEQ ID NO: 2517938 - RNA, 15 nt, Human
aguugugccuuuuau

SEQ ID NO: 2517939 - RNA, 21 nt, Human
aguugugaccuuaguguuucu

SEQ ID NO: 2517940 - RNA, 22 nt, Human
aguugugccuuuuauagcuauu

SEQ ID NO: 2517941 - RNA, 21 nt, Human
aguugugccuuuuauagcuau

SEQ ID NO: 2517942 - RNA, 14 nt, Human
aguugugcuuguuu

SEQ ID NO: 2517943 - RNA, 22 nt, Human
aguugugaguuuaccuuguaua

SEQ ID NO: 2517944 - RNA, 18 nt, Human
aguugugcacauggcuua

SEQ ID NO: 2517945 - RNA, 18 nt, Human
aguugugaccuuaguguu

SEQ ID NO: 2517946 - RNA, 19 nt, Human
aguucaucuugaauuguaa

SEQ ID NO: 2517947 - RNA, 15 nt, Human
aguucaucuugaauu

SEQ ID NO: 2517948 - RNA, 13 nt, Human
aguucaucuugaa

SEQ ID NO: 2517949 - RNA, 18 nt, Human
aguucagguaacaggcag

SEQ ID NO: 2517950 - RNA, 21 nt, Human
aguucaggagucccaaggaaa

SEQ ID NO: 2517951 - RNA, 19 nt, Human
aguucaggagucccaagga

SEQ ID NO: 2517952 - RNA, 20 nt, Human
aguucaggagucccaaggaa

SEQ ID NO: 2517953 - RNA, 14 nt, Human
aguucagcuugggg

SEQ ID NO: 2517954 - RNA, 16 nt, Human
aguucaggagucccaa

SEQ ID NO: 2517955 - RNA, 15 nt, Human
aguucagcaccaccc

SEQ ID NO: 2517956 - RNA, 17 nt, Human
aguucagcaccacccua

SEQ ID NO: 2517957 - RNA, 18 nt, Human
aguucagcaccacccuag

SEQ ID NO: 2517958 - RNA, 13 nt, Human
aguucagcuuggg

SEQ ID NO: 2517959 - RNA, 15 nt, Human
agugccuuauggaac

SEQ ID NO: 2517960 - RNA, 14 nt, Human
agugccuuauggaa

SEQ ID NO: 2517961 - RNA, 13 nt, Human
agugccuuaugga

SEQ ID NO: 2517962 - RNA, 10 nt, Human
agugccuuau

SEQ ID NO: 2517963 - RNA, 18 nt, Human
agugcuaagugugaacug

SEQ ID NO: 2517964 - RNA, 17 nt, Human
agugcuaagugugaacu

SEQ ID NO: 2517965 - RNA, 16 nt, Human
agugcuaagugugaac

SEQ ID NO: 2517966 - RNA, 15 nt, Human
agugcuaagugugaa

SEQ ID NO: 2517967 - RNA, 15 nt, Human
agugcuaauuuugaa

SEQ ID NO: 2517968 - RNA, 16 nt, Human
agugccuuauggaaca

SEQ ID NO: 2517969 - RNA, 14 nt, Human
agugcuaaguguga

SEQ ID NO: 2517970 - RNA, 23 nt, Human
agugccuuaccuccugcccagga

SEQ ID NO: 2517971 - RNA, 21 nt, Human
agugccuuaccuccugcccag

SEQ ID NO: 2517972 - RNA, 22 nt, Human
agugccuuaccuccugcccagg

SEQ ID NO: 2517973 - RNA, 20 nt, Human
agugcucgcuguugcugaau

SEQ ID NO: 2517974 - RNA, 19 nt, Human
agugcucgcuguugcugaa

SEQ ID NO: 2517975 - RNA, 18 nt, Human
agugcucgcuguugcuga

SEQ ID NO: 2517976 - RNA, 17 nt, Human
agugcucgcuguugcug

SEQ ID NO: 2517977 - RNA, 16 nt, Human
agugcucgcuguugcu

SEQ ID NO: 2517978 - RNA, 15 nt, Human
agugcucgcuguugc

SEQ ID NO: 2517979 - RNA, 22 nt, Human
agugcuaagugugaacuggacc

SEQ ID NO: 2517980 - RNA, 19 nt, Human
agugcuaagugugaacugg

SEQ ID NO: 2517981 - RNA, 20 nt, Human
agugcuaauuuugaaaaacu

SEQ ID NO: 2517982 - RNA, 18 nt, Human
agugcuaauuuugaaaaa

SEQ ID NO: 2517983 - RNA, 23 nt, Human
agugcucgcuguugcugaauagg

SEQ ID NO: 2517984 - RNA, 22 nt, Human
agugcucgcuguugcugaauag

SEQ ID NO: 2517985 - RNA, 18 nt, Human
agugcucgcuuucuaugu

SEQ ID NO: 2517986 - RNA, 12 nt, Human
agugcucgcuuu

SEQ ID NO: 2517987 - RNA, 11 nt, Human
agugcucugau

SEQ ID NO: 2517988 - RNA, 12 nt, Human
agugcucugaua

SEQ ID NO: 2517989 - RNA, 20 nt, Human
agugcucgcuuucuauguag

SEQ ID NO: 2517990 - RNA, 16 nt, Human
agugcucugaucccuc

SEQ ID NO: 2517991 - RNA, 17 nt, Human
agugcucugaucccucu

SEQ ID NO: 2517992 - RNA, 21 nt, Human
agugcucugaucccucuacag

SEQ ID NO: 2517993 - RNA, 15 nt, Human
agugcugaacagugg

SEQ ID NO: 2517994 - RNA, 14 nt, Human
agugcugaacagug

SEQ ID NO: 2517995 - RNA, 22 nt, Human
aguggccucaacccucccucag

SEQ ID NO: 2517996 - RNA, 15 nt, Human
aguggccucaacccu

SEQ ID NO: 2517997 - RNA, 20 nt, Human
aguggccucaacccucccuc

SEQ ID NO: 2517998 - RNA, 21 nt, Human
aguggccucaacccucccuca

SEQ ID NO: 2517999 - RNA, 24 nt, Human
agugauccucccaccucagccucc

SEQ ID NO: 2518000 - RNA, 23 nt, Human
agugauccucccaccucagccuc

SEQ ID NO: 2518001 - RNA, 18 nt, Human
agugauccucccaccuca

SEQ ID NO: 2518002 - RNA, 15 nt, Human
agugauccucccacc

SEQ ID NO: 2518003 - RNA, 14 nt, Human
agugauccucccac

SEQ ID NO: 2518004 - RNA, 17 nt, Human
agugauucuccugccuc

SEQ ID NO: 2518005 - RNA, 15 nt, Human
agugauucuccugcc

SEQ ID NO: 2518006 - RNA, 18 nt, Human
agugccuuacacaauggu

SEQ ID NO: 2518007 - RNA, 18 nt, Human
agugauggagcagagcaa

SEQ ID NO: 2518008 - RNA, 14 nt, Human
agugauggagcaga

SEQ ID NO: 2518009 - RNA, 16 nt, Human
agugccuuaccuccug

SEQ ID NO: 2518010 - RNA, 17 nt, Human
agugccuuaccuccugc

SEQ ID NO: 2518011 - RNA, 18 nt, Human
agugccuuaccuccugcc

SEQ ID NO: 2518012 - RNA, 19 nt, Human
agugccuuaccuccugccc

SEQ ID NO: 2518013 - RNA, 20 nt, Human
agugccuuaccuccugccca

SEQ ID NO: 2518014 - RNA, 21 nt, Human
agugauucucaugccucagcc

SEQ ID NO: 2518015 - RNA, 14 nt, Human
agugauucuccugc

SEQ ID NO: 2518016 - RNA, 16 nt, Human
agugauccuuacaagu

SEQ ID NO: 2518017 - RNA, 13 nt, Human
agugaucuccaua

SEQ ID NO: 2518018 - RNA, 14 nt, Human
agugaucuccauau

SEQ ID NO: 2518019 - RNA, 21 nt, Human
agugaucuccauauguuacac

SEQ ID NO: 2518020 - RNA, 21 nt, Human
agugaugcugugcuaugaauu

SEQ ID NO: 2518021 - RNA, 13 nt, Human
agugucuggcugc

SEQ ID NO: 2518022 - RNA, 14 nt, Human
agugucuggcugca

SEQ ID NO: 2518023 - RNA, 14 nt, Human
agugucugggcuga

SEQ ID NO: 2518024 - RNA, 16 nt, Human
agugucuggcacacag

SEQ ID NO: 2518025 - RNA, 19 nt, Human
agugucucaguccaccuga

SEQ ID NO: 2518026 - RNA, 22 nt, Human
agugucucaguccaccugagcu

SEQ ID NO: 2518027 - RNA, 19 nt, Human
agugucugggcugacuggg

SEQ ID NO: 2518028 - RNA, 22 nt, Human
agugucuguaucggagacagug

SEQ ID NO: 2518029 - RNA, 22 nt, Human
agugucugucccgggguccugu

SEQ ID NO: 2518030 - RNA, 13 nt, Human
agugucugugugc

SEQ ID NO: 2518031 - RNA, 22 nt, Human
agugucugugugcaagugugug

SEQ ID NO: 2518032 - RNA, 21 nt, Human
agugggacagggcauggccag

SEQ ID NO: 2518033 - RNA, 19 nt, Human
agugggacagggcauggcc

SEQ ID NO: 2518034 - RNA, 20 nt, Human
agugggaacgugacugcccc

SEQ ID NO: 2518035 - RNA, 15 nt, Human
agugggacagagucu

SEQ ID NO: 2518036 - RNA, 17 nt, Human
agugggaggggcaggcu

SEQ ID NO: 2518037 - RNA, 16 nt, Human
agugggaggggcaggc

SEQ ID NO: 2518038 - RNA, 15 nt, Human
agugggaggggcagg

SEQ ID NO: 2518039 - RNA, 14 nt, Human
agugggaggggcag

SEQ ID NO: 2518040 - RNA, 13 nt, Human
agugggaggggca

SEQ ID NO: 2518041 - RNA, 12 nt, Human
agugggaggggc

SEQ ID NO: 2518042 - RNA, 11 nt, Human
agugggagggg

SEQ ID NO: 2518043 - RNA, 16 nt, Human
agugggaggcgcgagc

SEQ ID NO: 2518044 - RNA, 17 nt, Human
agugggacagagucugg

SEQ ID NO: 2518045 - RNA, 14 nt, Human
aguggccucuuugu

SEQ ID NO: 2518046 - RNA, 15 nt, Human
aguggccucuuuguc

SEQ ID NO: 2518047 - RNA, 21 nt, Human
aguggccucuuugucuaaaac

SEQ ID NO: 2518048 - RNA, 23 nt, Human
aguggccucuuugucuaaaacaa

SEQ ID NO: 2518049 - RNA, 13 nt, Human
aguggccuggcca

SEQ ID NO: 2518050 - RNA, 14 nt, Human
aguggccuggccag

SEQ ID NO: 2518051 - RNA, 15 nt, Human
aguggccuggccagg

SEQ ID NO: 2518052 - RNA, 18 nt, Human
aguggccuggccaggagc

SEQ ID NO: 2518053 - RNA, 19 nt, Human
aguggccuggccaggagcu

SEQ ID NO: 2518054 - RNA, 20 nt, Human
aguggccuggccaggagcuc

SEQ ID NO: 2518055 - RNA, 22 nt, Human
aguggccuggccaggagcucuu

SEQ ID NO: 2518056 - RNA, 23 nt, Human
aguggccuggccaggagcucuuc

SEQ ID NO: 2518057 - RNA, 21 nt, Human
aguggcuuuuuuccuccugug

SEQ ID NO: 2518058 - RNA, 19 nt, Human
aguggcuuuuuuccuccug

SEQ ID NO: 2518059 - RNA, 17 nt, Human
aguggcuuuaaugaaua

SEQ ID NO: 2518060 - RNA, 19 nt, Human
agugucaaugcagccccca

SEQ ID NO: 2518061 - RNA, 21 nt, Human
agugggccaggacaggcccgg

SEQ ID NO: 2518062 - RNA, 17 nt, Human
agugucaaguugugcuu

SEQ ID NO: 2518063 - RNA, 20 nt, Human
agugucaaguugugcuuguu

SEQ ID NO: 2518064 - RNA, 19 nt, Human
agugucaaguugugcuugu

SEQ ID NO: 2518065 - RNA, 18 nt, Human
agugucaaguugugcuug

SEQ ID NO: 2518066 - RNA, 14 nt, Human
agugggccagugug

SEQ ID NO: 2518067 - RNA, 19 nt, Human
agugggaggggcaggcuga

SEQ ID NO: 2518068 - RNA, 18 nt, Human
agugggaggggcaggcug

SEQ ID NO: 2518069 - RNA, 22 nt, Human
agugggaggggcaggcugacau

SEQ ID NO: 2518070 - RNA, 14 nt, Human
agugcucgcuguug

SEQ ID NO: 2518071 - RNA, 20 nt, Human
agugggaucugucacaccag

SEQ ID NO: 2518072 - RNA, 13 nt, Human
agugggccaggac

SEQ ID NO: 2518073 - RNA, 15 nt, Human
agugggccaggacag

SEQ ID NO: 2518074 - RNA, 16 nt, Human
agugggccaggacagg

SEQ ID NO: 2518075 - RNA, 19 nt, Human
agugggccaggacaggccc

SEQ ID NO: 2518076 - RNA, 20 nt, Human
agugggccaggacaggcccg

SEQ ID NO: 2518077 - RNA, 12 nt, Human
agugucuggcug

SEQ ID NO: 2518078 - RNA, 22 nt, Human
agugucucggagggauuccccu

SEQ ID NO: 2518079 - RNA, 14 nt, Human
agugucuaaaaaca

SEQ ID NO: 2518080 - RNA, 15 nt, Human
agugucucacacugg

SEQ ID NO: 2518081 - RNA, 18 nt, Human
agugucucaguccaccug

SEQ ID NO: 2518082 - RNA, 20 nt, Human
agugucauauguaggugucu

SEQ ID NO: 2518083 - RNA, 22 nt, Human
agugucaaguugugcuuguuua

SEQ ID NO: 2518084 - RNA, 20 nt, Human
agugucaucagaagauaacu

SEQ ID NO: 2518085 - RNA, 16 nt, Human
agugucaucagaagau

SEQ ID NO: 2518086 - RNA, 19 nt, Human
agugucauuuaugaaaaga

SEQ ID NO: 2518087 - RNA, 19 nt, Human
agugucacuuaccuagauu

SEQ ID NO: 2518088 - RNA, 21 nt, Human
agugucacuuaccuagauuua

SEQ ID NO: 2518089 - RNA, 14 nt, Human
agugucaggaggaa

SEQ ID NO: 2518090 - RNA, 15 nt, Human
augcugcccugugag

SEQ ID NO: 2518091 - RNA, 14 nt, Human
augcugcccuguga

SEQ ID NO: 2518092 - RNA, 20 nt, Human
augcugauguucaguguaau

SEQ ID NO: 2518093 - RNA, 12 nt, Human
augcugcccugu

SEQ ID NO: 2518094 - RNA, 19 nt, Human
augcugauguucaguguaa

SEQ ID NO: 2518095 - RNA, 18 nt, Human
augcugauguucagugua

SEQ ID NO: 2518096 - RNA, 17 nt, Human
augcugauguucagugu

SEQ ID NO: 2518097 - RNA, 16 nt, Human
augcugauguucagug

SEQ ID NO: 2518098 - RNA, 13 nt, Human
augcugcccugug

SEQ ID NO: 2518099 - RNA, 16 nt, Human
augcugcccugugagu

SEQ ID NO: 2518100 - RNA, 15 nt, Human
augcugccuccagaa

SEQ ID NO: 2518101 - RNA, 12 nt, Human
augcugccucca

SEQ ID NO: 2518102 - RNA, 18 nt, Human
augcugccugccugucug

SEQ ID NO: 2518103 - RNA, 17 nt, Human
augcugccugccugucu

SEQ ID NO: 2518104 - RNA, 15 nt, Human
augcugccugccugu

SEQ ID NO: 2518105 - RNA, 14 nt, Human
augcugccugccug

SEQ ID NO: 2518106 - RNA, 16 nt, Human
augcugcgcccuuccc

SEQ ID NO: 2518107 - RNA, 18 nt, Human
augcugcgcccuucccca

SEQ ID NO: 2518108 - RNA, 17 nt, Human
augcugccuaggcugac

SEQ ID NO: 2518109 - RNA, 19 nt, Human
augcugccuaggcugaccu

SEQ ID NO: 2518110 - RNA, 12 nt, Human
augcugccugag

SEQ ID NO: 2518111 - RNA, 13 nt, Human
augcugccugccu

SEQ ID NO: 2518112 - RNA, 11 nt, Human
augcugccugc

SEQ ID NO: 2518113 - RNA, 13 nt, Human
augcugccugagu

SEQ ID NO: 2518114 - RNA, 15 nt, Human
augcugauguucagu

SEQ ID NO: 2518115 - RNA, 12 nt, Human
augcugauguuc

SEQ ID NO: 2518116 - RNA, 16 nt, Human
augcugauguccucac

SEQ ID NO: 2518117 - RNA, 18 nt, Human
augcugagucucccaagg

SEQ ID NO: 2518118 - RNA, 14 nt, Human
augcugagucuccc

SEQ ID NO: 2518119 - RNA, 22 nt, Human
augcugaguauguuaagcucuu

SEQ ID NO: 2518120 - RNA, 14 nt, Human
augcugauguccuc

SEQ ID NO: 2518121 - RNA, 22 nt, Human
augcugaggccugggccgcugc

SEQ ID NO: 2518122 - RNA, 18 nt, Human
augcugaggccugggccg

SEQ ID NO: 2518123 - RNA, 17 nt, Human
augcugaggccugggcc

SEQ ID NO: 2518124 - RNA, 15 nt, Human
augcugaggccuggg

SEQ ID NO: 2518125 - RNA, 14 nt, Human
augcugaggccugg

SEQ ID NO: 2518126 - RNA, 21 nt, Human
augcugagauuacagguguga

SEQ ID NO: 2518127 - RNA, 23 nt, Human
augcugaauauacagcaggugcu

SEQ ID NO: 2518128 - RNA, 12 nt, Human
augcugaaggga

SEQ ID NO: 2518129 - RNA, 19 nt, Human
augcugacauucaccugcc

SEQ ID NO: 2518130 - RNA, 20 nt, Human
augcugacauucaccugccc

SEQ ID NO: 2518131 - RNA, 21 nt, Human
augcugacuguacuccuccca

SEQ ID NO: 2518132 - RNA, 20 nt, Human
augcugacuguacuccuccc

SEQ ID NO: 2518133 - RNA, 22 nt, Human
augcugacauucaccugcccca

SEQ ID NO: 2518134 - RNA, 19 nt, Human
augcugacuguacuccucc

SEQ ID NO: 2518135 - RNA, 17 nt, Human
auggcuuugugauucaa

SEQ ID NO: 2518136 - RNA, 18 nt, Human
auggcuuuugugcauuau

SEQ ID NO: 2518137 - RNA, 16 nt, Human
auggcuuuugugcauu

SEQ ID NO: 2518138 - RNA, 17 nt, Human
auggcuuuugugcauua

SEQ ID NO: 2518139 - RNA, 19 nt, Human
auggauaaccuauaugauu

SEQ ID NO: 2518140 - RNA, 18 nt, Human
auggauaaccuauaugau

SEQ ID NO: 2518141 - RNA, 22 nt, Human
auggauaaugccggugagaaua

SEQ ID NO: 2518142 - RNA, 21 nt, Human
auggauaaugccggugagaau

SEQ ID NO: 2518143 - RNA, 17 nt, Human
auggauaggcacaggaa

SEQ ID NO: 2518144 - RNA, 18 nt, Human
auggauaggcacaggaaa

SEQ ID NO: 2518145 - RNA, 22 nt, Human
auggauauaguuuuacuuuuaa

SEQ ID NO: 2518146 - RNA, 15 nt, Human
auggcugugaggaug

SEQ ID NO: 2518147 - RNA, 14 nt, Human
auggcugugaggau

SEQ ID NO: 2518148 - RNA, 13 nt, Human
auggcugugagga

SEQ ID NO: 2518149 - RNA, 20 nt, Human
auggcugucucaaaccaagc

SEQ ID NO: 2518150 - RNA, 23 nt, Human
auggcugggaacugcagaccugu

SEQ ID NO: 2518151 - RNA, 22 nt, Human
auggcugggaacugcagaccug

SEQ ID NO: 2518152 - RNA, 21 nt, Human
auggcugggaacugcagaccu

SEQ ID NO: 2518153 - RNA, 23 nt, Human
auggcuggccacugcacagagcu

SEQ ID NO: 2518154 - RNA, 22 nt, Human
auggcuggccacugcacagagc

SEQ ID NO: 2518155 - RNA, 21 nt, Human
auggcuggccacugcacagag

SEQ ID NO: 2518156 - RNA, 16 nt, Human
auggcuggccacugca

SEQ ID NO: 2518157 - RNA, 15 nt, Human
auggcuggccacugc

SEQ ID NO: 2518158 - RNA, 17 nt, Human
auggcugugccucugcc

SEQ ID NO: 2518159 - RNA, 16 nt, Human
auggcugugccucugc

SEQ ID NO: 2518160 - RNA, 15 nt, Human
auggcugugccucug

SEQ ID NO: 2518161 - RNA, 24 nt, Human
auggagguuucauacucuagauuu

SEQ ID NO: 2518162 - RNA, 20 nt, Human
auggaguccagggaagagaa

SEQ ID NO: 2518163 - RNA, 18 nt, Human
auggaggggugguccuga

SEQ ID NO: 2518164 - RNA, 20 nt, Human
auggaggggugguccugacu

SEQ ID NO: 2518165 - RNA, 22 nt, Human
auggaggggugguccugacuca

SEQ ID NO: 2518166 - RNA, 16 nt, Human
auggagggaauaauac

SEQ ID NO: 2518167 - RNA, 15 nt, Human
auggaggccuguccu

SEQ ID NO: 2518168 - RNA, 17 nt, Human
auggaggcagaauccug

SEQ ID NO: 2518169 - RNA, 12 nt, Human
auggaggccugu

SEQ ID NO: 2518170 - RNA, 19 nt, Human
auggaggcacacagcugca

SEQ ID NO: 2518171 - RNA, 16 nt, Human
augcuuguacauaaug

SEQ ID NO: 2518172 - RNA, 15 nt, Human
augcuuguacauaau

SEQ ID NO: 2518173 - RNA, 13 nt, Human
augcuuuaaacau

SEQ ID NO: 2518174 - RNA, 13 nt, Human
augcuuguguuau

SEQ ID NO: 2518175 - RNA, 19 nt, Human
augcugcgcccuuccccag

SEQ ID NO: 2518176 - RNA, 18 nt, Human
augcuuuaggauguacag

SEQ ID NO: 2518177 - RNA, 16 nt, Human
augccuuacucuucuu

SEQ ID NO: 2518178 - RNA, 18 nt, Human
augccuuacucuucuuga

SEQ ID NO: 2518179 - RNA, 18 nt, Human
augccuuccagcacccug

SEQ ID NO: 2518180 - RNA, 16 nt, Human
augccuuccccugggc

SEQ ID NO: 2518181 - RNA, 19 nt, Human
augccuuccagcacccugc

SEQ ID NO: 2518182 - RNA, 14 nt, Human
augccuucuuauug

SEQ ID NO: 2518183 - RNA, 15 nt, Human
augccuucuccagac

SEQ ID NO: 2518184 - RNA, 20 nt, Human
augccuucuuauugcuuuua

SEQ ID NO: 2518185 - RNA, 22 nt, Human
augccuuuaaaguaugaaucua

SEQ ID NO: 2518186 - RNA, 21 nt, Human
augccuuuaaaguaugaaucu

SEQ ID NO: 2518187 - RNA, 17 nt, Human
augccuuuaaaguauga

SEQ ID NO: 2518188 - RNA, 20 nt, Human
augccuuuaaaucugugaug

SEQ ID NO: 2518189 - RNA, 19 nt, Human
augcacagaguuguuacau

SEQ ID NO: 2518190 - RNA, 21 nt, Human
augcacagaguuguuacauuu

SEQ ID NO: 2518191 - RNA, 22 nt, Human
augcacagaguuguuacauuuu

SEQ ID NO: 2518192 - RNA, 14 nt, Human
augcaugugaagaa

SEQ ID NO: 2518193 - RNA, 13 nt, Human
augcaugugaaga

SEQ ID NO: 2518194 - RNA, 17 nt, Human
augcauguccuguaaag

SEQ ID NO: 2518195 - RNA, 13 nt, Human
augcacacauuuu

SEQ ID NO: 2518196 - RNA, 14 nt, Human
augcacacauuuuu

SEQ ID NO: 2518197 - RNA, 15 nt, Human
augcacacauuuuuu

SEQ ID NO: 2518198 - RNA, 22 nt, Human
augcacacaaaacaacccuaga

SEQ ID NO: 2518199 - RNA, 15 nt, Human
augcacacaaaacaa

SEQ ID NO: 2518200 - RNA, 14 nt, Human
augcacacaaaaca

SEQ ID NO: 2518201 - RNA, 21 nt, Human
augcacacagugcuuuccgug

SEQ ID NO: 2518202 - RNA, 20 nt, Human
augcauguuuuccagcuccu

SEQ ID NO: 2518203 - RNA, 22 nt, Human
augcauuauaggaucauuuguu

SEQ ID NO: 2518204 - RNA, 21 nt, Human
augcauucuugguuggcuggc

SEQ ID NO: 2518205 - RNA, 16 nt, Human
augccugagugccugg

SEQ ID NO: 2518206 - RNA, 17 nt, Human
augccugaggguggaga

SEQ ID NO: 2518207 - RNA, 21 nt, Human
augcauuauaggaucauuugu

SEQ ID NO: 2518208 - RNA, 17 nt, Human
augcauuaaaagaaaau

SEQ ID NO: 2518209 - RNA, 20 nt, Human
augcauuaaaagaaaauaaa

SEQ ID NO: 2518210 - RNA, 19 nt, Human
augcauguuuuccagcucc

SEQ ID NO: 2518211 - RNA, 16 nt, Human
augcaugugaagaaag

SEQ ID NO: 2518212 - RNA, 17 nt, Human
augcaugugaagaaagg

SEQ ID NO: 2518213 - RNA, 15 nt, Human
augcauuaaaagaaa

SEQ ID NO: 2518214 - RNA, 16 nt, Human
augcauuaaaagaaaa

SEQ ID NO: 2518215 - RNA, 20 nt, Human
augccuggauggggcugcac

SEQ ID NO: 2518216 - RNA, 17 nt, Human
augccuguccagccugg

SEQ ID NO: 2518217 - RNA, 18 nt, Human
augccuguccagccuggg

SEQ ID NO: 2518218 - RNA, 19 nt, Human
augccuggauggggcugca

SEQ ID NO: 2518219 - RNA, 20 nt, Human
augccugagugccuggccaa

SEQ ID NO: 2518220 - RNA, 19 nt, Human
augccugagugccuggcca

SEQ ID NO: 2518221 - RNA, 19 nt, Human
augccugccccaaacaaau

SEQ ID NO: 2518222 - RNA, 21 nt, Human
augccugauugccaagcucag

SEQ ID NO: 2518223 - RNA, 16 nt, Human
augccugcggaguugu

SEQ ID NO: 2518224 - RNA, 16 nt, Human
augaucuuuaaaauac

SEQ ID NO: 2518225 - RNA, 17 nt, Human
augaucuuugcagacag

SEQ ID NO: 2518226 - RNA, 14 nt, Human
augaucuugugaca

SEQ ID NO: 2518227 - RNA, 15 nt, Human
augaucuugugacau

SEQ ID NO: 2518228 - RNA, 13 nt, Human
augaugaaaauau

SEQ ID NO: 2518229 - RNA, 15 nt, Human
augaugaaaauauuu

SEQ ID NO: 2518230 - RNA, 21 nt, Human
augaucuuugcagacaggcaa

SEQ ID NO: 2518231 - RNA, 19 nt, Human
augaucuuugcagacaggc

SEQ ID NO: 2518232 - RNA, 18 nt, Human
augaucuuugcagacagg

SEQ ID NO: 2518233 - RNA, 22 nt, Human
augcacaaauucugucucugga

SEQ ID NO: 2518234 - RNA, 15 nt, Human
augcacaaauucugu

SEQ ID NO: 2518235 - RNA, 23 nt, Human
augcacaaauucugucucuggau

SEQ ID NO: 2518236 - RNA, 13 nt, Human
augauguauauuu

SEQ ID NO: 2518237 - RNA, 21 nt, Human
augauguagugccucuuucau

SEQ ID NO: 2518238 - RNA, 12 nt, Human
augauguauauu

SEQ ID NO: 2518239 - RNA, 18 nt, Human
augcacaaacagaggccg

SEQ ID NO: 2518240 - RNA, 20 nt, Human
augauguaaguuuaccuaug

SEQ ID NO: 2518241 - RNA, 18 nt, Human
augaugguugcaaaagac

SEQ ID NO: 2518242 - RNA, 16 nt, Human
augauggugcugaccu

SEQ ID NO: 2518243 - RNA, 16 nt, Human
augaugggucaguugu

SEQ ID NO: 2518244 - RNA, 16 nt, Human
augauggguguuuuua

SEQ ID NO: 2518245 - RNA, 15 nt, Human
augauggaugccaau

SEQ ID NO: 2518246 - RNA, 19 nt, Human
augauggaugccaauauua

SEQ ID NO: 2518247 - RNA, 19 nt, Human
augauggcaauuuuguaac

SEQ ID NO: 2518248 - RNA, 21 nt, Human
augaugaucuuuaaaauacac

SEQ ID NO: 2518249 - RNA, 18 nt, Human
augaugaugggaauugug

SEQ ID NO: 2518250 - RNA, 15 nt, Human
augauggagucaggu

SEQ ID NO: 2518251 - RNA, 15 nt, Human
augaugaugggaauu

SEQ ID NO: 2518252 - RNA, 22 nt, Human
augaugauccggauuuaauuug

SEQ ID NO: 2518253 - RNA, 20 nt, Human
augaugauguggaagaacuu

SEQ ID NO: 2518254 - RNA, 18 nt, Human
augaugaucuuuaaaaua

SEQ ID NO: 2518255 - RNA, 15 nt, Human
augaugauccuaggc

SEQ ID NO: 2518256 - RNA, 23 nt, Human
augaugaaaugaggucagagccu

SEQ ID NO: 2518257 - RNA, 12 nt, Human
augaugaaugag

SEQ ID NO: 2518258 - RNA, 15 nt, Human
augaugaaugagaau

SEQ ID NO: 2518259 - RNA, 18 nt, Human
augaugaaaugaggucag

SEQ ID NO: 2518260 - RNA, 19 nt, Human
augaugaaaauauuuaaag

SEQ ID NO: 2518261 - RNA, 20 nt, Human
augaucuuucuuuccuuucu

SEQ ID NO: 2518262 - RNA, 15 nt, Human
augaucuuuucaagu

SEQ ID NO: 2518263 - RNA, 14 nt, Human
auguuugccucugc

SEQ ID NO: 2518264 - RNA, 23 nt, Human
auguuucugcaguagucucugug

SEQ ID NO: 2518265 - RNA, 15 nt, Human
auguuucuucuaggu

SEQ ID NO: 2518266 - RNA, 18 nt, Human
auguuucuuaaaugggcu

SEQ ID NO: 2518267 - RNA, 17 nt, Human
auguuugccucugccuc

SEQ ID NO: 2518268 - RNA, 15 nt, Human
auguuugccucugcc

SEQ ID NO: 2518269 - RNA, 14 nt, Human
auguuuccucuagu

SEQ ID NO: 2518270 - RNA, 22 nt, Human
auguuucugcaguagucucugu

SEQ ID NO: 2518271 - RNA, 17 nt, Human
auguuucucuggcccca

SEQ ID NO: 2518272 - RNA, 19 nt, Human
auguuucucuggccccaag

SEQ ID NO: 2518273 - RNA, 12 nt, Human
auguuucucugg

SEQ ID NO: 2518274 - RNA, 23 nt, Human
auguuucgugaaguauacuguau

SEQ ID NO: 2518275 - RNA, 20 nt, Human
auguuuccucuaguucuuug

SEQ ID NO: 2518276 - RNA, 22 nt, Human
auguuucgcugauauauguguu

SEQ ID NO: 2518277 - RNA, 20 nt, Human
auguuucgugaaguauacug

SEQ ID NO: 2518278 - RNA, 13 nt, Human
auguucucugagg

SEQ ID NO: 2518279 - RNA, 17 nt, Human
auguucucucuucucca

SEQ ID NO: 2518280 - RNA, 17 nt, Human
auguuccuagugaaaga

SEQ ID NO: 2518281 - RNA, 16 nt, Human
auguucucucuucucc

SEQ ID NO: 2518282 - RNA, 14 nt, Human
auguucugggacac

SEQ ID NO: 2518283 - RNA, 17 nt, Human
auguucucugaggacac

SEQ ID NO: 2518284 - RNA, 15 nt, Human
auguucugggacaca

SEQ ID NO: 2518285 - RNA, 21 nt, Human
auguucugugccuguaaacau

SEQ ID NO: 2518286 - RNA, 15 nt, Human
auguguaaggugaac

SEQ ID NO: 2518287 - RNA, 22 nt, Human
auguguaacacagugccuucaa

SEQ ID NO: 2518288 - RNA, 15 nt, Human
auguguaaaauguga

SEQ ID NO: 2518289 - RNA, 15 nt, Human
auguuccuagugaaa

SEQ ID NO: 2518290 - RNA, 16 nt, Human
auguuccuagugaaag

SEQ ID NO: 2518291 - RNA, 14 nt, Human
auguuccacuaacc

SEQ ID NO: 2518292 - RNA, 15 nt, Human
auguuccacuaaccc

SEQ ID NO: 2518293 - RNA, 18 nt, Human
auguguaucggaugcuuu

SEQ ID NO: 2518294 - RNA, 23 nt, Human
auguguagccugugcauguaugu

SEQ ID NO: 2518295 - RNA, 17 nt, Human
auguguagccugugcau

SEQ ID NO: 2518296 - RNA, 16 nt, Human
auguguagccugugca

SEQ ID NO: 2518297 - RNA, 14 nt, Human
auguguagccugug

SEQ ID NO: 2518298 - RNA, 15 nt, Human
auguguagccugugc

SEQ ID NO: 2518299 - RNA, 13 nt, Human
auguguaaguauu

SEQ ID NO: 2518300 - RNA, 13 nt, Human
augguccaggaga

SEQ ID NO: 2518301 - RNA, 16 nt, Human
augguccaggagaagg

SEQ ID NO: 2518302 - RNA, 18 nt, Human
augguccaggagaaggcc

SEQ ID NO: 2518303 - RNA, 19 nt, Human
augguccaggagaaggcca

SEQ ID NO: 2518304 - RNA, 16 nt, Human
auggucccaucugcag

SEQ ID NO: 2518305 - RNA, 20 nt, Human
auggucccauccaggcaguc

SEQ ID NO: 2518306 - RNA, 19 nt, Human
auggucccauccaggcagu

SEQ ID NO: 2518307 - RNA, 18 nt, Human
auggucccauccaggcag

SEQ ID NO: 2518308 - RNA, 17 nt, Human
auggucccauccaggca

SEQ ID NO: 2518309 - RNA, 15 nt, Human
auggucccauccagg

SEQ ID NO: 2518310 - RNA, 14 nt, Human
auggucccauccag

SEQ ID NO: 2518311 - RNA, 13 nt, Human
auggucccaucca

SEQ ID NO: 2518312 - RNA, 20 nt, Human
augguagccaguugaauuua

SEQ ID NO: 2518313 - RNA, 17 nt, Human
augguaggcauuuccua

SEQ ID NO: 2518314 - RNA, 18 nt, Human
augguaggcauuuccuau

SEQ ID NO: 2518315 - RNA, 15 nt, Human
augguaccagauaaa

SEQ ID NO: 2518316 - RNA, 13 nt, Human
augguacuauuua

SEQ ID NO: 2518317 - RNA, 15 nt, Human
augguacccccuucu

SEQ ID NO: 2518318 - RNA, 14 nt, Human
augguacccccuuc

SEQ ID NO: 2518319 - RNA, 17 nt, Human
augguacccccuucugg

SEQ ID NO: 2518320 - RNA, 19 nt, Human
augguacuagggggaagug

SEQ ID NO: 2518321 - RNA, 23 nt, Human
augggugcuuggaggaaggaaac

SEQ ID NO: 2518322 - RNA, 21 nt, Human
augggugcuuggaggaaggaa

SEQ ID NO: 2518323 - RNA, 20 nt, Human
augggugcuuggaggaagga

SEQ ID NO: 2518324 - RNA, 22 nt, Human
auggguuagggaaaacauucca

SEQ ID NO: 2518325 - RNA, 19 nt, Human
auggguguguguuugugug

SEQ ID NO: 2518326 - RNA, 12 nt, Human
augggugugugu

SEQ ID NO: 2518327 - RNA, 13 nt, Human
auggguguguguu

SEQ ID NO: 2518328 - RNA, 22 nt, Human
auggguuuuucccuguacagua

SEQ ID NO: 2518329 - RNA, 16 nt, Human
auggguuggugcuucu

SEQ ID NO: 2518330 - RNA, 14 nt, Human
auggguugcauuug

SEQ ID NO: 2518331 - RNA, 23 nt, Human
augguaaaaguuacuuauucuag

SEQ ID NO: 2518332 - RNA, 14 nt, Human
augguaauuguugc

SEQ ID NO: 2518333 - RNA, 15 nt, Human
augugaacacaucag

SEQ ID NO: 2518334 - RNA, 22 nt, Human
augugaaaaugguccaggagaa

SEQ ID NO: 2518335 - RNA, 16 nt, Human
augugaacagcggcug

SEQ ID NO: 2518336 - RNA, 18 nt, Human
augugaaaucauucauuu

SEQ ID NO: 2518337 - RNA, 17 nt, Human
augugaaaucauucauu

SEQ ID NO: 2518338 - RNA, 16 nt, Human
augucaauuucugugu

SEQ ID NO: 2518339 - RNA, 21 nt, Human
auguauuuauuuaaaagauuc

SEQ ID NO: 2518340 - RNA, 19 nt, Human
augucacaggcagguccag

SEQ ID NO: 2518341 - RNA, 13 nt, Human
augucacagggcc

SEQ ID NO: 2518342 - RNA, 12 nt, Human
augucacagggc

SEQ ID NO: 2518343 - RNA, 19 nt, Human
augucaauuucuguguugc

SEQ ID NO: 2518344 - RNA, 14 nt, Human
augucacagggcca

SEQ ID NO: 2518345 - RNA, 13 nt, Human
augucaccaccuu

SEQ ID NO: 2518346 - RNA, 15 nt, Human
augucaccaccuucc

SEQ ID NO: 2518347 - RNA, 16 nt, Human
augucaccaccuuccc

SEQ ID NO: 2518348 - RNA, 18 nt, Human
augucaccaccuucccag

SEQ ID NO: 2518349 - RNA, 19 nt, Human
augucaccaccuucccagc

SEQ ID NO: 2518350 - RNA, 20 nt, Human
augucaccaccuucccagcu

SEQ ID NO: 2518351 - RNA, 23 nt, Human
augucaccaccuucccagcucuc

SEQ ID NO: 2518352 - RNA, 21 nt, Human
augucaccguggaccuuccug

SEQ ID NO: 2518353 - RNA, 20 nt, Human
augucaccguggaccuuccu

SEQ ID NO: 2518354 - RNA, 19 nt, Human
augucaccggauccugggu

SEQ ID NO: 2518355 - RNA, 20 nt, Human
augucaccggauccugggug

SEQ ID NO: 2518356 - RNA, 18 nt, Human
augugaaaaucaaauaca

SEQ ID NO: 2518357 - RNA, 19 nt, Human
augucuuuuuuuuaaugug

SEQ ID NO: 2518358 - RNA, 21 nt, Human
augugaaaaugguccaggaga

SEQ ID NO: 2518359 - RNA, 14 nt, Human
augugaaaucauuc

SEQ ID NO: 2518360 - RNA, 14 nt, Human
augugaaacauguu

SEQ ID NO: 2518361 - RNA, 23 nt, Human
augucaccguggaccuuccugcc

SEQ ID NO: 2518362 - RNA, 22 nt, Human
augucaccguggaccuuccugc

SEQ ID NO: 2518363 - RNA, 16 nt, Human
augucuuuuuaagcuu

SEQ ID NO: 2518364 - RNA, 16 nt, Human
augucuuuugaauauu

SEQ ID NO: 2518365 - RNA, 18 nt, Human
augucuuuuuaagcuuau

SEQ ID NO: 2518366 - RNA, 23 nt, Human
augucuuuuuaagcuuauuuaau

SEQ ID NO: 2518367 - RNA, 17 nt, Human
augucuuuuuuuuaaug

SEQ ID NO: 2518368 - RNA, 18 nt, Human
augucuuuuuuuuaaugu

SEQ ID NO: 2518369 - RNA, 20 nt, Human
augucuuuuuaagcuuauuu

SEQ ID NO: 2518370 - RNA, 22 nt, Human
augucuuuuuuuuaaugugcug

SEQ ID NO: 2518371 - RNA, 16 nt, Human
augugaaaaucaaaua

SEQ ID NO: 2518372 - RNA, 21 nt, Human
auguaacagccaggaguguua

SEQ ID NO: 2518373 - RNA, 14 nt, Human
auguaacagaaagg

SEQ ID NO: 2518374 - RNA, 13 nt, Human
auguaacagaaag

SEQ ID NO: 2518375 - RNA, 16 nt, Human
auguaacagucugauc

SEQ ID NO: 2518376 - RNA, 13 nt, Human
auguaacagucug

SEQ ID NO: 2518377 - RNA, 14 nt, Human
auguaacuagaauu

SEQ ID NO: 2518378 - RNA, 20 nt, Human
auguaacugcauugagaacu

SEQ ID NO: 2518379 - RNA, 23 nt, Human
auguaacugcauugagaacugca

SEQ ID NO: 2518380 - RNA, 20 nt, Human
auguaaauuuuguaugaaaa

SEQ ID NO: 2518381 - RNA, 15 nt, Human
augguccgguguccu

SEQ ID NO: 2518382 - RNA, 13 nt, Human
auguaacugcuga

SEQ ID NO: 2518383 - RNA, 14 nt, Human
auguaacugcugaa

SEQ ID NO: 2518384 - RNA, 20 nt, Human
auguaauuguuugucuuuaa

SEQ ID NO: 2518385 - RNA, 15 nt, Human
auguaauugaauaaa

SEQ ID NO: 2518386 - RNA, 19 nt, Human
auguauuuauuuaaaagau

SEQ ID NO: 2518387 - RNA, 18 nt, Human
auguauuuauuuaaaaga

SEQ ID NO: 2518388 - RNA, 22 nt, Human
auguauuuauuuaaaagauuca

SEQ ID NO: 2518389 - RNA, 16 nt, Human
auguauuuauuuaaaa

SEQ ID NO: 2518390 - RNA, 14 nt, Human
auguauuuauauuu

SEQ ID NO: 2518391 - RNA, 17 nt, Human
auguauuuauaaauaua

SEQ ID NO: 2518392 - RNA, 21 nt, Human
augucaaucagccuaguugau

SEQ ID NO: 2518393 - RNA, 13 nt, Human
augucacaggcag

SEQ ID NO: 2518394 - RNA, 20 nt, Human
auguauuguaaacauguguu

SEQ ID NO: 2518395 - RNA, 19 nt, Human
auguauuguaaacaugugu

SEQ ID NO: 2518396 - RNA, 11 nt, Human
auguauuguaa

SEQ ID NO: 2518397 - RNA, 11 nt, Human
auguaauuguu

SEQ ID NO: 2518398 - RNA, 21 nt, Human
auguacaaaaucgauuggcuu

SEQ ID NO: 2518399 - RNA, 15 nt, Human
auguauuguaccuuu

SEQ ID NO: 2518400 - RNA, 13 nt, Human
auguauuguaccu

SEQ ID NO: 2518401 - RNA, 12 nt, Human
auguauuguacc

SEQ ID NO: 2518402 - RNA, 21 nt, Human
auguauuguaaacauguguuu

SEQ ID NO: 2518403 - RNA, 19 nt, Human
auguauugugucuuuugca

SEQ ID NO: 2518404 - RNA, 22 nt, Human
auguauugugucuuuugcauga

SEQ ID NO: 2518405 - RNA, 20 nt, Human
auguauugugucuuuugcau

SEQ ID NO: 2518406 - RNA, 14 nt, Human
augaaaacacauuu

SEQ ID NO: 2518407 - RNA, 15 nt, Human
augaaaacacauuuu

SEQ ID NO: 2518408 - RNA, 12 nt, Human
augaaaauauuu

SEQ ID NO: 2518409 - RNA, 13 nt, Human
augaaaauauuua

SEQ ID NO: 2518410 - RNA, 14 nt, Human
augaaaauauuuaa

SEQ ID NO: 2518411 - RNA, 16 nt, Human
augaaaauauuuaaag

SEQ ID NO: 2518412 - RNA, 16 nt, Human
augaaaacacauuuuu

SEQ ID NO: 2518413 - RNA, 22 nt, Human
augaaaaauuuaagcauuguuu

SEQ ID NO: 2518414 - RNA, 21 nt, Human
augaaaaauuuaagcauuguu

SEQ ID NO: 2518415 - RNA, 13 nt, Human
augaggcauuugu

SEQ ID NO: 2518416 - RNA, 14 nt, Human
augaggcauuuguu

SEQ ID NO: 2518417 - RNA, 21 nt, Human
augaggcauuuguuugaacug

SEQ ID NO: 2518418 - RNA, 22 nt, Human
augaggcauuuguuugaacuga

SEQ ID NO: 2518419 - RNA, 21 nt, Human
augacuaaagagagaauguag

SEQ ID NO: 2518420 - RNA, 19 nt, Human
augacuaaagagagaaugu

SEQ ID NO: 2518421 - RNA, 20 nt, Human
augacuaaagagagaaugua

SEQ ID NO: 2518422 - RNA, 23 nt, Human
augacuaaagagagaauguagau

SEQ ID NO: 2518423 - RNA, 21 nt, Human
augacugcuccccagcccugg

SEQ ID NO: 2518424 - RNA, 13 nt, Human
augacugcacaug

SEQ ID NO: 2518425 - RNA, 17 nt, Human
augacuguagaauuugu

SEQ ID NO: 2518426 - RNA, 13 nt, Human
augacuguagaau

SEQ ID NO: 2518427 - RNA, 17 nt, Human
augacugugauuuucag

SEQ ID NO: 2518428 - RNA, 23 nt, Human
augacugcuccccagcccuggcu

SEQ ID NO: 2518429 - RNA, 22 nt, Human
augacugcuccccagcccuggc

SEQ ID NO: 2518430 - RNA, 13 nt, Human
augagggucuugg

SEQ ID NO: 2518431 - RNA, 20 nt, Human
augagggucuugguuccagc

SEQ ID NO: 2518432 - RNA, 11 nt, Human
augagggccac

SEQ ID NO: 2518433 - RNA, 19 nt, Human
augaggggacauuuuggug

SEQ ID NO: 2518434 - RNA, 20 nt, Human
augaggguaucaaauaaaau

SEQ ID NO: 2518435 - RNA, 14 nt, Human
augaggggaggggg

SEQ ID NO: 2518436 - RNA, 13 nt, Human
augaggggagggg

SEQ ID NO: 2518437 - RNA, 15 nt, Human
augaggggcccgagc

SEQ ID NO: 2518438 - RNA, 20 nt, Human
augagggacuggaaccaggg

SEQ ID NO: 2518439 - RNA, 13 nt, Human
augagggacugga

SEQ ID NO: 2518440 - RNA, 17 nt, Human
augacuguuuuuguagu

SEQ ID NO: 2518441 - RNA, 18 nt, Human
augacuguuuuuguagug

SEQ ID NO: 2518442 - RNA, 14 nt, Human
augagggacuggaa

SEQ ID NO: 2518443 - RNA, 16 nt, Human
augagggaucacaggg

SEQ ID NO: 2518444 - RNA, 20 nt, Human
augacgguauuaugcuucuu

SEQ ID NO: 2518445 - RNA, 14 nt, Human
augacuaaaaauau

SEQ ID NO: 2518446 - RNA, 16 nt, Human
augacuaaaaauauua

SEQ ID NO: 2518447 - RNA, 23 nt, Human
augacuaaaaauauuauaacuua

SEQ ID NO: 2518448 - RNA, 11 nt, Human
augacuaaaga

SEQ ID NO: 2518449 - RNA, 12 nt, Human
augacuaaagag

SEQ ID NO: 2518450 - RNA, 13 nt, Human
augacuaaagaga

SEQ ID NO: 2518451 - RNA, 14 nt, Human
augacuaaagagag

SEQ ID NO: 2518452 - RNA, 15 nt, Human
augacuaaagagaga

SEQ ID NO: 2518453 - RNA, 16 nt, Human
augacuaaagagagaa

SEQ ID NO: 2518454 - RNA, 17 nt, Human
augacuaaagagagaau

SEQ ID NO: 2518455 - RNA, 18 nt, Human
augacuaaagagagaaug

SEQ ID NO: 2518456 - RNA, 17 nt, Human
augacccaccccugugc

SEQ ID NO: 2518457 - RNA, 16 nt, Human
augacccaccccugug

SEQ ID NO: 2518458 - RNA, 14 nt, Human
augacccaccccug

SEQ ID NO: 2518459 - RNA, 13 nt, Human
augacccaccccu

SEQ ID NO: 2518460 - RNA, 12 nt, Human
augacccaggcu

SEQ ID NO: 2518461 - RNA, 14 nt, Human
augacccaggcugg

SEQ ID NO: 2518462 - RNA, 15 nt, Human
augacccaggcuggg

SEQ ID NO: 2518463 - RNA, 19 nt, Human
augacccaccccugugcuc

SEQ ID NO: 2518464 - RNA, 16 nt, Human
augacccaggcugggc

SEQ ID NO: 2518465 - RNA, 15 nt, Human
augacggaagaacau

SEQ ID NO: 2518466 - RNA, 16 nt, Human
augacggaagaacaua

SEQ ID NO: 2518467 - RNA, 17 nt, Human
augacgguauuaugcuu

SEQ ID NO: 2518468 - RNA, 16 nt, Human
augacgguauuaugcu

SEQ ID NO: 2518469 - RNA, 19 nt, Human
augacggaagaacauagaa

SEQ ID NO: 2518470 - RNA, 21 nt, Human
augacggaagaacauagaacu

SEQ ID NO: 2518471 - RNA, 12 nt, Human
augacccacccc

SEQ ID NO: 2518472 - RNA, 16 nt, Human
augacccaaagaccaa

SEQ ID NO: 2518473 - RNA, 15 nt, Human
augacccaaagacca

SEQ ID NO: 2518474 - RNA, 13 nt, Human
augacccaaagac

SEQ ID NO: 2518475 - RNA, 19 nt, Human
augaccaguaauugugaaa

SEQ ID NO: 2518476 - RNA, 17 nt, Human
augaccauacugaggga

SEQ ID NO: 2518477 - RNA, 19 nt, Human
augaaguuuccuuggcugg

SEQ ID NO: 2518478 - RNA, 18 nt, Human
augaccacacuccagcug

SEQ ID NO: 2518479 - RNA, 15 nt, Human
augaccacacuccag

SEQ ID NO: 2518480 - RNA, 15 nt, Human
augaaguguuagaua

SEQ ID NO: 2518481 - RNA, 18 nt, Human
augaaguguuagauagaa

SEQ ID NO: 2518482 - RNA, 15 nt, Human
augaaguuguaggua

SEQ ID NO: 2518483 - RNA, 23 nt, Human
augaaguccaagcauuuagaugu

SEQ ID NO: 2518484 - RNA, 20 nt, Human
augaaguccaagcauuuaga

SEQ ID NO: 2518485 - RNA, 17 nt, Human
augaaguauauaauggu

SEQ ID NO: 2518486 - RNA, 18 nt, Human
augaagucguugugaggg

SEQ ID NO: 2518487 - RNA, 16 nt, Human
augaaguauauaaugg

SEQ ID NO: 2518488 - RNA, 14 nt, Human
augaaguauauaau

SEQ ID NO: 2518489 - RNA, 14 nt, Human
augaaaaugucuug

SEQ ID NO: 2518490 - RNA, 14 nt, Human
augaagucucugaa

SEQ ID NO: 2518491 - RNA, 19 nt, Human
augaaguguguuuccuuca

SEQ ID NO: 2518492 - RNA, 23 nt, Human
augaaguguguuuccuucagugc

SEQ ID NO: 2518493 - RNA, 15 nt, Human
augaaaaugucuugu

SEQ ID NO: 2518494 - RNA, 21 nt, Human
augaaguacucauacauguua

SEQ ID NO: 2518495 - RNA, 12 nt, Human
augaaaauguca

SEQ ID NO: 2518496 - RNA, 13 nt, Human
augaaaaugucag

SEQ ID NO: 2518497 - RNA, 15 nt, Human
augaaaaugucagaa

SEQ ID NO: 2518498 - RNA, 13 nt, Human
augaaaaugucuu

SEQ ID NO: 2518499 - RNA, 19 nt, Human
augaaaaugucagaaacca

SEQ ID NO: 2518500 - RNA, 20 nt, Human
augaaaaugcaacaacaugu

SEQ ID NO: 2518501 - RNA, 19 nt, Human
aucuagguuuaacucagau

SEQ ID NO: 2518502 - RNA, 18 nt, Human
aucuagguuuaacucaga

SEQ ID NO: 2518503 - RNA, 17 nt, Human
aucuagguuuaacucag

SEQ ID NO: 2518504 - RNA, 16 nt, Human
aucuagguuuaacuca

SEQ ID NO: 2518505 - RNA, 22 nt, Human
aucuagguuuaacucagaucac

SEQ ID NO: 2518506 - RNA, 20 nt, Human
aucuaggugaggauugauua

SEQ ID NO: 2518507 - RNA, 14 nt, Human
aucuagguuuaacu

SEQ ID NO: 2518508 - RNA, 13 nt, Human
aucuagguuuaac

SEQ ID NO: 2518509 - RNA, 12 nt, Human
aucuagguuuaa

SEQ ID NO: 2518510 - RNA, 21 nt, Human
aucuagugcagcugauuuuaa

SEQ ID NO: 2518511 - RNA, 18 nt, Human
aucuagugcagcugauuu

SEQ ID NO: 2518512 - RNA, 19 nt, Human
aucuagugcagcugauuuu

SEQ ID NO: 2518513 - RNA, 22 nt, Human
aucuagugcagcugauuuuaac

SEQ ID NO: 2518514 - RNA, 13 nt, Human
aucuagugcagcu

SEQ ID NO: 2518515 - RNA, 14 nt, Human
aucuagugcagcug

SEQ ID NO: 2518516 - RNA, 15 nt, Human
aucuagugcagcuga

SEQ ID NO: 2518517 - RNA, 17 nt, Human
aucuagugcagcugauu

SEQ ID NO: 2518518 - RNA, 16 nt, Human
aucuauaaagaagaac

SEQ ID NO: 2518519 - RNA, 13 nt, Human
aucuauaaagaag

SEQ ID NO: 2518520 - RNA, 16 nt, Human
aucuauacauaucuuu

SEQ ID NO: 2518521 - RNA, 14 nt, Human
aucuauuuuggauu

SEQ ID NO: 2518522 - RNA, 14 nt, Human
aucuauuucugaga

SEQ ID NO: 2518523 - RNA, 16 nt, Human
aucuccugccuuccuc

SEQ ID NO: 2518524 - RNA, 17 nt, Human
aucuccugccuuccucc

SEQ ID NO: 2518525 - RNA, 19 nt, Human
aucuccucaaguccccaag

SEQ ID NO: 2518526 - RNA, 20 nt, Human
aucuccucgcaagcugggua

SEQ ID NO: 2518527 - RNA, 21 nt, Human
aucucucaggagcacaggcag

SEQ ID NO: 2518528 - RNA, 18 nt, Human
aucucucaggagcacagg

SEQ ID NO: 2518529 - RNA, 17 nt, Human
aucucucaggagcacag

SEQ ID NO: 2518530 - RNA, 16 nt, Human
aucucucaggagcaca

SEQ ID NO: 2518531 - RNA, 14 nt, Human
aucucucaggagca

SEQ ID NO: 2518532 - RNA, 13 nt, Human
aucucucaggagc

SEQ ID NO: 2518533 - RNA, 17 nt, Human
aucucucagaagggagg

SEQ ID NO: 2518534 - RNA, 18 nt, Human
aucucuauuuaauauuua

SEQ ID NO: 2518535 - RNA, 19 nt, Human
aucucuauuuaauauuuau

SEQ ID NO: 2518536 - RNA, 20 nt, Human
aucuccugccuuccuccugg

SEQ ID NO: 2518537 - RNA, 17 nt, Human
aucucuauuuaauauuu

SEQ ID NO: 2518538 - RNA, 23 nt, Human
aucucucaggagcacaggcagcu

SEQ ID NO: 2518539 - RNA, 22 nt, Human
aucucucaggagcacaggcagc

SEQ ID NO: 2518540 - RNA, 11 nt, Human
aucucucccuc

SEQ ID NO: 2518541 - RNA, 12 nt, Human
aucucuccucca

SEQ ID NO: 2518542 - RNA, 23 nt, Human
aucucucccuccccugccauuuu

SEQ ID NO: 2518543 - RNA, 14 nt, Human
aucucucccucccc

SEQ ID NO: 2518544 - RNA, 15 nt, Human
aucucucccuccccu

SEQ ID NO: 2518545 - RNA, 21 nt, Human
aucuauauguacuugucaaag

SEQ ID NO: 2518546 - RNA, 16 nt, Human
aucuauauguacuugu

SEQ ID NO: 2518547 - RNA, 19 nt, Human
aucuauauauguguaugua

SEQ ID NO: 2518548 - RNA, 18 nt, Human
aucuauauauguguaugu

SEQ ID NO: 2518549 - RNA, 23 nt, Human
aucuauauguacuugucaaagaa

SEQ ID NO: 2518550 - RNA, 22 nt, Human
aucuauauguacuugucaaaga

SEQ ID NO: 2518551 - RNA, 15 nt, Human
aucuauauuuaacaa

SEQ ID NO: 2518552 - RNA, 17 nt, Human
aucuauauauguguaug

SEQ ID NO: 2518553 - RNA, 16 nt, Human
aucuauauauguguau

SEQ ID NO: 2518554 - RNA, 15 nt, Human
aucuauauaugugua

SEQ ID NO: 2518555 - RNA, 20 nt, Human
aucuauauauaauucuguac

SEQ ID NO: 2518556 - RNA, 19 nt, Human
aucuauauauaauucugua

SEQ ID NO: 2518557 - RNA, 15 nt, Human
aucuauauauaauuc

SEQ ID NO: 2518558 - RNA, 14 nt, Human
aucuauauauaauu

SEQ ID NO: 2518559 - RNA, 16 nt, Human
aucuauagaacugaau

SEQ ID NO: 2518560 - RNA, 13 nt, Human
aucuauauauaau

SEQ ID NO: 2518561 - RNA, 15 nt, Human
aucuauuucuaugag

SEQ ID NO: 2518562 - RNA, 15 nt, Human
aucuauuucugagaa

SEQ ID NO: 2518563 - RNA, 22 nt, Human
aucuauuggguucauuauugga

SEQ ID NO: 2518564 - RNA, 16 nt, Human
aucuauuggguucauu

SEQ ID NO: 2518565 - RNA, 17 nt, Human
aucuauuggguucauua

SEQ ID NO: 2518566 - RNA, 19 nt, Human
aucuauuggguucauuauu

SEQ ID NO: 2518567 - RNA, 23 nt, Human
aucuauugcuggcaaagacagaa

SEQ ID NO: 2518568 - RNA, 13 nt, Human
aucuauuuaagua

SEQ ID NO: 2518569 - RNA, 21 nt, Human
aucuucuaaacccaauccaaa

SEQ ID NO: 2518570 - RNA, 18 nt, Human
aucuuccaggugggguga

SEQ ID NO: 2518571 - RNA, 11 nt, Human
aucuucccagc

SEQ ID NO: 2518572 - RNA, 19 nt, Human
aucuuccagaagugugauu

SEQ ID NO: 2518573 - RNA, 18 nt, Human
aucuuccagaagugugau

SEQ ID NO: 2518574 - RNA, 17 nt, Human
aucuuccagaaguguga

SEQ ID NO: 2518575 - RNA, 14 nt, Human
aucuucccucuccc

SEQ ID NO: 2518576 - RNA, 22 nt, Human
aucuucccuagaggguuccugu

SEQ ID NO: 2518577 - RNA, 23 nt, Human
aucuucccagcagggccacuccc

SEQ ID NO: 2518578 - RNA, 20 nt, Human
aucuucccagcagggccacu

SEQ ID NO: 2518579 - RNA, 21 nt, Human
aucuucccuagaggguuccug

SEQ ID NO: 2518580 - RNA, 23 nt, Human
aucucugcacccuggggccugga

SEQ ID NO: 2518581 - RNA, 20 nt, Human
aucucugcacccuggggccu

SEQ ID NO: 2518582 - RNA, 20 nt, Human
aucuggagaccagggagccu

SEQ ID NO: 2518583 - RNA, 21 nt, Human
aucuggagaccagggagccuu

SEQ ID NO: 2518584 - RNA, 22 nt, Human
aucuggagaccagggagccuuu

SEQ ID NO: 2518585 - RNA, 23 nt, Human
aucuggagagcuagaaccuggag

SEQ ID NO: 2518586 - RNA, 22 nt, Human
aucuggagagcuagaaccugga

SEQ ID NO: 2518587 - RNA, 20 nt, Human
aucuggagagcuagaaccug

SEQ ID NO: 2518588 - RNA, 15 nt, Human
aucuggagagcuaga

SEQ ID NO: 2518589 - RNA, 16 nt, Human
aucuggcaacaucuuu

SEQ ID NO: 2518590 - RNA, 22 nt, Human
aucuggauaggagccugcuggu

SEQ ID NO: 2518591 - RNA, 21 nt, Human
aucuggauaggagccugcugg

SEQ ID NO: 2518592 - RNA, 20 nt, Human
aucuggauaggagccugcug

SEQ ID NO: 2518593 - RNA, 18 nt, Human
aucuggauaggagccugc

SEQ ID NO: 2518594 - RNA, 17 nt, Human
aucuggauaggagccug

SEQ ID NO: 2518595 - RNA, 18 nt, Human
aucucugcaaucuucuca

SEQ ID NO: 2518596 - RNA, 21 nt, Human
aucucugcaaucuucucagaa

SEQ ID NO: 2518597 - RNA, 22 nt, Human
aucucugcaggaaauggcugug

SEQ ID NO: 2518598 - RNA, 16 nt, Human
aucucugcuuuggaaa

SEQ ID NO: 2518599 - RNA, 22 nt, Human
aucuggacuccucuguccaggc

SEQ ID NO: 2518600 - RNA, 20 nt, Human
aucucugaagcauguuucau

SEQ ID NO: 2518601 - RNA, 19 nt, Human
aucucugaagcauguuuca

SEQ ID NO: 2518602 - RNA, 17 nt, Human
aucucugaagcauguuu

SEQ ID NO: 2518603 - RNA, 16 nt, Human
aucucugaagcauguu

SEQ ID NO: 2518604 - RNA, 19 nt, Human
aucucucgguuccacgucc

SEQ ID NO: 2518605 - RNA, 20 nt, Human
aucucuccuccaagacacug

SEQ ID NO: 2518606 - RNA, 13 nt, Human
aucucugaagcau

SEQ ID NO: 2518607 - RNA, 17 nt, Human
aucucucuuuaauauaa

SEQ ID NO: 2518608 - RNA, 14 nt, Human
aucuggguagcugu

SEQ ID NO: 2518609 - RNA, 15 nt, Human
aucuggguagcugua

SEQ ID NO: 2518610 - RNA, 17 nt, Human
aucuggguagcuguaag

SEQ ID NO: 2518611 - RNA, 18 nt, Human
aucuggguagcuguaagg

SEQ ID NO: 2518612 - RNA, 21 nt, Human
aucugggugcaugaucuugag

SEQ ID NO: 2518613 - RNA, 18 nt, Human
aucuggguccuugcaccc

SEQ ID NO: 2518614 - RNA, 14 nt, Human
aucuggguccuugc

SEQ ID NO: 2518615 - RNA, 18 nt, Human
aucugggggaguggaaua

SEQ ID NO: 2518616 - RNA, 18 nt, Human
aucugggugcaugaucuu

SEQ ID NO: 2518617 - RNA, 18 nt, Human
aucugggggccucuucug

SEQ ID NO: 2518618 - RNA, 17 nt, Human
aucugggggaguggaau

SEQ ID NO: 2518619 - RNA, 16 nt, Human
aucugggggaguggaa

SEQ ID NO: 2518620 - RNA, 15 nt, Human
aucugggggagugga

SEQ ID NO: 2518621 - RNA, 16 nt, Human
aucuggggcucuggga

SEQ ID NO: 2518622 - RNA, 22 nt, Human
aucugggugcaugaucuugagc

SEQ ID NO: 2518623 - RNA, 21 nt, Human
aucuuauuagggagaaaauuc

SEQ ID NO: 2518624 - RNA, 22 nt, Human
aucuuauuagggagaaaauuca

SEQ ID NO: 2518625 - RNA, 13 nt, Human
aucuuauucacau

SEQ ID NO: 2518626 - RNA, 16 nt, Human
aucuuauuuucaugua

SEQ ID NO: 2518627 - RNA, 23 nt, Human
aucuuauuuucauguauaugugu

SEQ ID NO: 2518628 - RNA, 15 nt, Human
aucuucaauggcuuu

SEQ ID NO: 2518629 - RNA, 15 nt, Human
aucuucaaagcuuga

SEQ ID NO: 2518630 - RNA, 19 nt, Human
aucuucaaagcuugaagau

SEQ ID NO: 2518631 - RNA, 12 nt, Human
aucaccagagag

SEQ ID NO: 2518632 - RNA, 16 nt, Human
aucaccagaauaaacc

SEQ ID NO: 2518633 - RNA, 13 nt, Human
aucaccagaauaa

SEQ ID NO: 2518634 - RNA, 13 nt, Human
aucacauguaugu

SEQ ID NO: 2518635 - RNA, 19 nt, Human
aucaccacaguaaguuccu

SEQ ID NO: 2518636 - RNA, 13 nt, Human
aucaccacaguuu

SEQ ID NO: 2518637 - RNA, 15 nt, Human
aucaccagcccggcc

SEQ ID NO: 2518638 - RNA, 23 nt, Human
aucaccagagagggacugacacc

SEQ ID NO: 2518639 - RNA, 21 nt, Human
aucaccagcccggccugcucc

SEQ ID NO: 2518640 - RNA, 19 nt, Human
aucaccgugggcucccuga

SEQ ID NO: 2518641 - RNA, 20 nt, Human
aucaccgugggcucccugac

SEQ ID NO: 2518642 - RNA, 22 nt, Human
aucaccgugggcucccugacug

SEQ ID NO: 2518643 - RNA, 20 nt, Human
aucaccgacgcgucuccugu

SEQ ID NO: 2518644 - RNA, 22 nt, Human
aucaccgacgcgucuccuguuu

SEQ ID NO: 2518645 - RNA, 20 nt, Human
aucaccgagaguagccgaga

SEQ ID NO: 2518646 - RNA, 11 nt, Human
aucacauguau

SEQ ID NO: 2518647 - RNA, 22 nt, Human
aucacagucuaauuuuuauuca

SEQ ID NO: 2518648 - RNA, 20 nt, Human
aucaccaacgucugugccau

SEQ ID NO: 2518649 - RNA, 13 nt, Human
aucaccagacagg

SEQ ID NO: 2518650 - RNA, 22 nt, Human
aucacaguuuugguugcuuuaa

SEQ ID NO: 2518651 - RNA, 21 nt, Human
aucacaguuuugguugcuuua

SEQ ID NO: 2518652 - RNA, 12 nt, Human
aucacauccugg

SEQ ID NO: 2518653 - RNA, 19 nt, Human
aucacagucuaauuuuuau

SEQ ID NO: 2518654 - RNA, 18 nt, Human
aucacagucuaauuuuua

SEQ ID NO: 2518655 - RNA, 15 nt, Human
aucacaguuuugguu

SEQ ID NO: 2518656 - RNA, 23 nt, Human
aucacaggguugggcccagaucu

SEQ ID NO: 2518657 - RNA, 15 nt, Human
aucacagucuaauuu

SEQ ID NO: 2518658 - RNA, 21 nt, Human
aucacagggccccagaaggca

SEQ ID NO: 2518659 - RNA, 14 nt, Human
aucaaauaugcaaa

SEQ ID NO: 2518660 - RNA, 22 nt, Human
aucaaauauauucagccuggcu

SEQ ID NO: 2518661 - RNA, 14 nt, Human
aucacacuucugug

SEQ ID NO: 2518662 - RNA, 16 nt, Human
aucacacuucugugag

SEQ ID NO: 2518663 - RNA, 18 nt, Human
aucacacuucugugagac

SEQ ID NO: 2518664 - RNA, 11 nt, Human
aucacacacac

SEQ ID NO: 2518665 - RNA, 13 nt, Human
aucacagccucug

SEQ ID NO: 2518666 - RNA, 17 nt, Human
aucacagagacauuccu

SEQ ID NO: 2518667 - RNA, 16 nt, Human
aucacagagacauucc

SEQ ID NO: 2518668 - RNA, 15 nt, Human
aucacagagacauuc

SEQ ID NO: 2518669 - RNA, 14 nt, Human
aucacagagacauu

SEQ ID NO: 2518670 - RNA, 22 nt, Human
aucacagagacauuccuccgag

SEQ ID NO: 2518671 - RNA, 18 nt, Human
aucacagagacauuccuc

SEQ ID NO: 2518672 - RNA, 15 nt, Human
aucacagaggcuucu

SEQ ID NO: 2518673 - RNA, 12 nt, Human
aucacagggccc

SEQ ID NO: 2518674 - RNA, 16 nt, Human
aucacagggccccaga

SEQ ID NO: 2518675 - RNA, 14 nt, Human
aucacagcagcuuc

SEQ ID NO: 2518676 - RNA, 14 nt, Human
aucacagaggcuuc

SEQ ID NO: 2518677 - RNA, 22 nt, Human
aucacagggccccagaaggcag

SEQ ID NO: 2518678 - RNA, 18 nt, Human
aucacaggguugggccca

SEQ ID NO: 2518679 - RNA, 19 nt, Human
aucacaggguugggcccag

SEQ ID NO: 2518680 - RNA, 20 nt, Human
aucacaggguugggcccaga

SEQ ID NO: 2518681 - RNA, 21 nt, Human
auauuucccugaaggaaccaa

SEQ ID NO: 2518682 - RNA, 21 nt, Human
auauuucccuccccuggggac

SEQ ID NO: 2518683 - RNA, 21 nt, Human
auauuuccuuaaacugugugg

SEQ ID NO: 2518684 - RNA, 14 nt, Human
aucaaaauaaaaag

SEQ ID NO: 2518685 - RNA, 18 nt, Human
aucaaaauaaaaagugac

SEQ ID NO: 2518686 - RNA, 15 nt, Human
aucaaaauaaaaagu

SEQ ID NO: 2518687 - RNA, 20 nt, Human
aucaaagagguuuuaaaaaa

SEQ ID NO: 2518688 - RNA, 23 nt, Human
aucaaagagguuuuaaaaaaauc

SEQ ID NO: 2518689 - RNA, 12 nt, Human
aucaaaaugcuu

SEQ ID NO: 2518690 - RNA, 22 nt, Human
aucaaaaugcuuuuuauuucug

SEQ ID NO: 2518691 - RNA, 13 nt, Human
aucaaaaugcuuu

SEQ ID NO: 2518692 - RNA, 14 nt, Human
aucaaauauauuca

SEQ ID NO: 2518693 - RNA, 22 nt, Human
aucaaauacuuuaaaggaaaaa

SEQ ID NO: 2518694 - RNA, 21 nt, Human
aucaaauacuuuaaaggaaaa

SEQ ID NO: 2518695 - RNA, 20 nt, Human
aucaaauacuuuaaaggaaa

SEQ ID NO: 2518696 - RNA, 15 nt, Human
aucaaauacuuuaaa

SEQ ID NO: 2518697 - RNA, 20 nt, Human
aucaaauagaaccacuauga

SEQ ID NO: 2518698 - RNA, 21 nt, Human
aucaaauagaaccacuaugaa

SEQ ID NO: 2518699 - RNA, 23 nt, Human
aucaaagcacuuggacucuugcu

SEQ ID NO: 2518700 - RNA, 17 nt, Human
aucaaagcaaugcauuu

SEQ ID NO: 2518701 - RNA, 14 nt, Human
aucaaauacuuuaa

SEQ ID NO: 2518702 - RNA, 13 nt, Human
aucaaauacuuua

SEQ ID NO: 2518703 - RNA, 16 nt, Human
aucaaagccacacucu

SEQ ID NO: 2518704 - RNA, 16 nt, Human
aucaaagcaaugcauu

SEQ ID NO: 2518705 - RNA, 15 nt, Human
aucaaagcaaugcau

SEQ ID NO: 2518706 - RNA, 12 nt, Human
aucaaagcaaug

SEQ ID NO: 2518707 - RNA, 14 nt, Human
aucaaagccacacu

SEQ ID NO: 2518708 - RNA, 14 nt, Human
aucauguccccaaa

SEQ ID NO: 2518709 - RNA, 12 nt, Human
aucaugugaaau

SEQ ID NO: 2518710 - RNA, 18 nt, Human
aucauguaguaucaaaua

SEQ ID NO: 2518711 - RNA, 17 nt, Human
aucauguaguaucaaau

SEQ ID NO: 2518712 - RNA, 18 nt, Human
aucaugaauguguaacac

SEQ ID NO: 2518713 - RNA, 15 nt, Human
aucaugaauguguaa

SEQ ID NO: 2518714 - RNA, 15 nt, Human
aucauguacauuucu

SEQ ID NO: 2518715 - RNA, 17 nt, Human
aucaugaauuaguuuua

SEQ ID NO: 2518716 - RNA, 20 nt, Human
aucauguccccaaaccugca

SEQ ID NO: 2518717 - RNA, 12 nt, Human
aucaugucccca

SEQ ID NO: 2518718 - RNA, 18 nt, Human
aucaugucaggccugugu

SEQ ID NO: 2518719 - RNA, 19 nt, Human
aucaugucaggccugugug

SEQ ID NO: 2518720 - RNA, 21 nt, Human
aucauguaguaucaaauauua

SEQ ID NO: 2518721 - RNA, 19 nt, Human
aucauguaguaucaaauau

SEQ ID NO: 2518722 - RNA, 14 nt, Human
aucaugucuggcua

SEQ ID NO: 2518723 - RNA, 22 nt, Human
aucagcuugcccuguuaaaaga

SEQ ID NO: 2518724 - RNA, 13 nt, Human
aucagcuuauugu

SEQ ID NO: 2518725 - RNA, 15 nt, Human
aucaccuauuuccau

SEQ ID NO: 2518726 - RNA, 22 nt, Human
aucaccuauuuccauucaacaa

SEQ ID NO: 2518727 - RNA, 14 nt, Human
aucaccuauuucca

SEQ ID NO: 2518728 - RNA, 18 nt, Human
aucaugaagauauuuuuc

SEQ ID NO: 2518729 - RNA, 16 nt, Human
aucaugaaauaugcau

SEQ ID NO: 2518730 - RNA, 15 nt, Human
aucaugaaauaugca

SEQ ID NO: 2518731 - RNA, 16 nt, Human
aucaugaaauuacuua

SEQ ID NO: 2518732 - RNA, 18 nt, Human
aucaugaaauaugcaucu

SEQ ID NO: 2518733 - RNA, 21 nt, Human
aucagcuucuauccuugacuu

SEQ ID NO: 2518734 - RNA, 16 nt, Human
aucagcuguuugucau

SEQ ID NO: 2518735 - RNA, 21 nt, Human
aucaggaaauauauaugugug

SEQ ID NO: 2518736 - RNA, 20 nt, Human
aucaggaaauauauaugugu

SEQ ID NO: 2518737 - RNA, 14 nt, Human
aucaugaaauaugc

SEQ ID NO: 2518738 - RNA, 18 nt, Human
aucccuaaugugugccau

SEQ ID NO: 2518739 - RNA, 16 nt, Human
aucccuaaugcugcag

SEQ ID NO: 2518740 - RNA, 12 nt, Human
aucccuacaugu

SEQ ID NO: 2518741 - RNA, 16 nt, Human
aucccguguucuccuu

SEQ ID NO: 2518742 - RNA, 13 nt, Human
aucccguguucuc

SEQ ID NO: 2518743 - RNA, 23 nt, Human
auccccaggggucccagccaccc

SEQ ID NO: 2518744 - RNA, 17 nt, Human
auccccaccugucuuca

SEQ ID NO: 2518745 - RNA, 15 nt, Human
aucccggcugcccuu

SEQ ID NO: 2518746 - RNA, 19 nt, Human
auccccaggggucccagcc

SEQ ID NO: 2518747 - RNA, 21 nt, Human
auccccaggggucccagccac

SEQ ID NO: 2518748 - RNA, 19 nt, Human
auccucaguuuuugugaaa

SEQ ID NO: 2518749 - RNA, 18 nt, Human
aucccuacauguauugca

SEQ ID NO: 2518750 - RNA, 15 nt, Human
aucccuacauguauu

SEQ ID NO: 2518751 - RNA, 14 nt, Human
aucccuacauguau

SEQ ID NO: 2518752 - RNA, 13 nt, Human
aucccuacaugua

SEQ ID NO: 2518753 - RNA, 22 nt, Human
aucccuacccccuaagagccau

SEQ ID NO: 2518754 - RNA, 14 nt, Human
aucccuacccccua

SEQ ID NO: 2518755 - RNA, 21 nt, Human
aucccuacccccuaagagcca

SEQ ID NO: 2518756 - RNA, 16 nt, Human
auccacucccaggcag

SEQ ID NO: 2518757 - RNA, 19 nt, Human
aucccaugagccucagcau

SEQ ID NO: 2518758 - RNA, 15 nt, Human
aucccauguauuuau

SEQ ID NO: 2518759 - RNA, 23 nt, Human
aucccauguaacagaaagggcaa

SEQ ID NO: 2518760 - RNA, 19 nt, Human
aucccauguaacagaaagg

SEQ ID NO: 2518761 - RNA, 18 nt, Human
aucccauguaacagaaag

SEQ ID NO: 2518762 - RNA, 16 nt, Human
aucccauguaacagaa

SEQ ID NO: 2518763 - RNA, 13 nt, Human
aucccauguaaca

SEQ ID NO: 2518764 - RNA, 14 nt, Human
auccccaaguguga

SEQ ID NO: 2518765 - RNA, 16 nt, Human
auccccaagugugaac

SEQ ID NO: 2518766 - RNA, 12 nt, Human
auccccaauaau

SEQ ID NO: 2518767 - RNA, 18 nt, Human
auccccaagccuggcaag

SEQ ID NO: 2518768 - RNA, 19 nt, Human
auccccaauaauugcagaa

SEQ ID NO: 2518769 - RNA, 21 nt, Human
auccccaauaauugcagaacu

SEQ ID NO: 2518770 - RNA, 11 nt, Human
auccccacccu

SEQ ID NO: 2518771 - RNA, 22 nt, Human
auccccaauaauugcagaacua

SEQ ID NO: 2518772 - RNA, 16 nt, Human
auccccacccugggcu

SEQ ID NO: 2518773 - RNA, 14 nt, Human
auccccacccuggg

SEQ ID NO: 2518774 - RNA, 15 nt, Human
auccccaccugucuu

SEQ ID NO: 2518775 - RNA, 13 nt, Human
auccccacccuug

SEQ ID NO: 2518776 - RNA, 16 nt, Human
aucccauucugcguca

SEQ ID NO: 2518777 - RNA, 16 nt, Human
auccccaagccuggca

SEQ ID NO: 2518778 - RNA, 15 nt, Human
auccaccuccuucuc

SEQ ID NO: 2518779 - RNA, 14 nt, Human
auccaccuccuucu

SEQ ID NO: 2518780 - RNA, 13 nt, Human
auccaccuccuuc

SEQ ID NO: 2518781 - RNA, 22 nt, Human
auccaccuccaucuucuuugca

SEQ ID NO: 2518782 - RNA, 14 nt, Human
auccaccuccaucu

SEQ ID NO: 2518783 - RNA, 12 nt, Human
auccaccuccau

SEQ ID NO: 2518784 - RNA, 10 nt, Human
auccaccucc

SEQ ID NO: 2518785 - RNA, 13 nt, Human
auccacucgccuu

SEQ ID NO: 2518786 - RNA, 21 nt, Human
auccacuagugcaaaucauag

SEQ ID NO: 2518787 - RNA, 19 nt, Human
auccacuagugcaaaucau

SEQ ID NO: 2518788 - RNA, 16 nt, Human
auccacucuacccucc

SEQ ID NO: 2518789 - RNA, 13 nt, Human
auccaccugucuc

SEQ ID NO: 2518790 - RNA, 18 nt, Human
auccaccugucucagccu

SEQ ID NO: 2518791 - RNA, 21 nt, Human
auccaccugucucagccuccc

SEQ ID NO: 2518792 - RNA, 19 nt, Human
auccagacccggcugcgug

SEQ ID NO: 2518793 - RNA, 18 nt, Human
auccacucuacccuccca

SEQ ID NO: 2518794 - RNA, 19 nt, Human
auccacucuacccucccac

SEQ ID NO: 2518795 - RNA, 20 nt, Human
auccacucuacccucccacc

SEQ ID NO: 2518796 - RNA, 21 nt, Human
auccacucuacccucccaccc

SEQ ID NO: 2518797 - RNA, 12 nt, Human
aucgccuuuccc

SEQ ID NO: 2518798 - RNA, 23 nt, Human
aucgcgccacuacacuccagccu

SEQ ID NO: 2518799 - RNA, 22 nt, Human
aucgcggcggagcuggccccgc

SEQ ID NO: 2518800 - RNA, 20 nt, Human
aucgcggcggagcuggcccc

SEQ ID NO: 2518801 - RNA, 23 nt, Human
auccuuguuucaaacacaaaugc

SEQ ID NO: 2518802 - RNA, 16 nt, Human
auccuuguuucaaaca

SEQ ID NO: 2518803 - RNA, 14 nt, Human
auccuuguuucaaa

SEQ ID NO: 2518804 - RNA, 13 nt, Human
auccuuguuucaa

SEQ ID NO: 2518805 - RNA, 12 nt, Human
auccuuguuuca

SEQ ID NO: 2518806 - RNA, 17 nt, Human
auccuuuaaauccuucc

SEQ ID NO: 2518807 - RNA, 17 nt, Human
auccuuuccagcaugag

SEQ ID NO: 2518808 - RNA, 14 nt, Human
auccuuuccagcau

SEQ ID NO: 2518809 - RNA, 22 nt, Human
aucgcaucauugcacucuagcc

SEQ ID NO: 2518810 - RNA, 19 nt, Human
aucgcccuccacaucccug

SEQ ID NO: 2518811 - RNA, 13 nt, Human
auccuuacaaguu

SEQ ID NO: 2518812 - RNA, 14 nt, Human
auccucacugggug

SEQ ID NO: 2518813 - RNA, 17 nt, Human
auccucauacccacccc

SEQ ID NO: 2518814 - RNA, 12 nt, Human
auccucaaucca

SEQ ID NO: 2518815 - RNA, 15 nt, Human
auccucaauccagcu

SEQ ID NO: 2518816 - RNA, 15 nt, Human
auccucacugggugg

SEQ ID NO: 2518817 - RNA, 22 nt, Human
auccuuguauaaaaaaaauagu

SEQ ID NO: 2518818 - RNA, 16 nt, Human
auccuugagucaaaaa

SEQ ID NO: 2518819 - RNA, 20 nt, Human
auccuucaagaacucugggc

SEQ ID NO: 2518820 - RNA, 22 nt, Human
auccuucccugucugccagggc

SEQ ID NO: 2518821 - RNA, 19 nt, Human
auccuucccugucugccag

SEQ ID NO: 2518822 - RNA, 16 nt, Human
agaggaaggggccaga

SEQ ID NO: 2518823 - RNA, 18 nt, Human
agaggaaggggccagagg

SEQ ID NO: 2518824 - RNA, 20 nt, Human
agaggaaggggccagaggcu

SEQ ID NO: 2518825 - RNA, 13 nt, Human
agaggaaugaagu

SEQ ID NO: 2518826 - RNA, 23 nt, Human
agaggaaggggccagaggcucgu

SEQ ID NO: 2518827 - RNA, 22 nt, Human
agaggaaucacucuuguggaug

SEQ ID NO: 2518828 - RNA, 24 nt, Human
agaggaaucagacuucacacugca

SEQ ID NO: 2518829 - RNA, 20 nt, Human
agaggagcgggaccuguggc

SEQ ID NO: 2518830 - RNA, 19 nt, Human
agaggagcgggaccugugg

SEQ ID NO: 2518831 - RNA, 23 nt, Human
agaggagggagcaucagugcccu

SEQ ID NO: 2518832 - RNA, 23 nt, Human
agaggacuuuucuuuguggcuuc

SEQ ID NO: 2518833 - RNA, 20 nt, Human
agaggaggggccgcugccac

SEQ ID NO: 2518834 - RNA, 22 nt, Human
agaggaggggccgcugccaccc

SEQ ID NO: 2518835 - RNA, 20 nt, Human
agaggaguacaggugaagca

SEQ ID NO: 2518836 - RNA, 14 nt, Human
agaggagucagaga

SEQ ID NO: 2518837 - RNA, 14 nt, Human
agaggaggggccgc

SEQ ID NO: 2518838 - RNA, 18 nt, Human
agaggaggggccgcugcc

SEQ ID NO: 2518839 - RNA, 12 nt, Human
agaggaggggcc

SEQ ID NO: 2518840 - RNA, 21 nt, Human
agaggagggcgugacucaccc

SEQ ID NO: 2518841 - RNA, 23 nt, Human
agaggagggcagcagaagggggu

SEQ ID NO: 2518842 - RNA, 19 nt, Human
agaggagggcgugacucac

SEQ ID NO: 2518843 - RNA, 21 nt, Human
agaggagcgggaccuguggcu

SEQ ID NO: 2518844 - RNA, 17 nt, Human
agaggagggaugcugcc

SEQ ID NO: 2518845 - RNA, 22 nt, Human
agaggacuuuucuuuguggcuu

SEQ ID NO: 2518846 - RNA, 21 nt, Human
agaggacuuuucuuuguggcu

SEQ ID NO: 2518847 - RNA, 14 nt, Human
agaggacuuuucuu

SEQ ID NO: 2518848 - RNA, 23 nt, Human
agaggaaucagacuucacacugc

SEQ ID NO: 2518849 - RNA, 16 nt, Human
agagggccugcaaggg

SEQ ID NO: 2518850 - RNA, 13 nt, Human
agagggccugcaa

SEQ ID NO: 2518851 - RNA, 19 nt, Human
agagggccugugggagccu

SEQ ID NO: 2518852 - RNA, 16 nt, Human
agagggccugugggag

SEQ ID NO: 2518853 - RNA, 15 nt, Human
agagggccuguggga

SEQ ID NO: 2518854 - RNA, 13 nt, Human
agaggaguucaau

SEQ ID NO: 2518855 - RNA, 12 nt, Human
agaggaguucaa

SEQ ID NO: 2518856 - RNA, 14 nt, Human
agaggagugcuugu

SEQ ID NO: 2518857 - RNA, 16 nt, Human
agaggagugacugagc

SEQ ID NO: 2518858 - RNA, 19 nt, Human
agaggggguggccucccaa

SEQ ID NO: 2518859 - RNA, 17 nt, Human
agaggggguggccuccc

SEQ ID NO: 2518860 - RNA, 12 nt, Human
agagggcuuccu

SEQ ID NO: 2518861 - RNA, 18 nt, Human
agaggggcuuucuggaga

SEQ ID NO: 2518862 - RNA, 22 nt, Human
agaggggggaagaucaggucau

SEQ ID NO: 2518863 - RNA, 14 nt, Human
agaggggggcugcc

SEQ ID NO: 2518864 - RNA, 12 nt, Human
agagggggccac

SEQ ID NO: 2518865 - RNA, 16 nt, Human
agacgcugugcugccc

SEQ ID NO: 2518866 - RNA, 13 nt, Human
agacucugucuca

SEQ ID NO: 2518867 - RNA, 18 nt, Human
agacucugucucaaaaaa

SEQ ID NO: 2518868 - RNA, 18 nt, Human
agacucugucucagucca

SEQ ID NO: 2518869 - RNA, 16 nt, Human
agacucuguggggccu

SEQ ID NO: 2518870 - RNA, 20 nt, Human
agacugaguacguugugcau

SEQ ID NO: 2518871 - RNA, 22 nt, Human
agacugaccaauauuguacagu

SEQ ID NO: 2518872 - RNA, 16 nt, Human
agacugagcaccugcu

SEQ ID NO: 2518873 - RNA, 21 nt, Human
agacugaccaauauuguacag

SEQ ID NO: 2518874 - RNA, 20 nt, Human
agacugcuguguuugagcuc

SEQ ID NO: 2518875 - RNA, 16 nt, Human
agacugcuucccaucc

SEQ ID NO: 2518876 - RNA, 14 nt, Human
agacugcuucccau

SEQ ID NO: 2518877 - RNA, 19 nt, Human
agacugcuuccaauuuucu

SEQ ID NO: 2518878 - RNA, 17 nt, Human
agacugagcaccugcuu

SEQ ID NO: 2518879 - RNA, 20 nt, Human
agacugcugggacuggccag

SEQ ID NO: 2518880 - RNA, 22 nt, Human
agacugcugggacuggccaggu

SEQ ID NO: 2518881 - RNA, 22 nt, Human
agacugaguacguugugcauuu

SEQ ID NO: 2518882 - RNA, 19 nt, Human
agacugcugggacuggcca

SEQ ID NO: 2518883 - RNA, 13 nt, Human
agacugagcucaa

SEQ ID NO: 2518884 - RNA, 22 nt, Human
agagccucccucaauucccccu

SEQ ID NO: 2518885 - RNA, 15 nt, Human
agagccugagaguga

SEQ ID NO: 2518886 - RNA, 17 nt, Human
agagccgugaugccucc

SEQ ID NO: 2518887 - RNA, 20 nt, Human
agagccauguagaagcugca

SEQ ID NO: 2518888 - RNA, 18 nt, Human
agagccauguagaagcug

SEQ ID NO: 2518889 - RNA, 16 nt, Human
agagccauuuugugaa

SEQ ID NO: 2518890 - RNA, 15 nt, Human
agagcccuucauuug

SEQ ID NO: 2518891 - RNA, 19 nt, Human
agagcccuugccuccccau

SEQ ID NO: 2518892 - RNA, 17 nt, Human
agagccauuuugugaau

SEQ ID NO: 2518893 - RNA, 13 nt, Human
agagccgggaagc

SEQ ID NO: 2518894 - RNA, 16 nt, Human
agagccgggaagcgau

SEQ ID NO: 2518895 - RNA, 14 nt, Human
agagcccuugccuc

SEQ ID NO: 2518896 - RNA, 19 nt, Human
agagagaagugccccugcu

SEQ ID NO: 2518897 - RNA, 11 nt, Human
agagagaagcc

SEQ ID NO: 2518898 - RNA, 15 nt, Human
agagagaagugcccc

SEQ ID NO: 2518899 - RNA, 13 nt, Human
agacuggagggga

SEQ ID NO: 2518900 - RNA, 23 nt, Human
agacuggaggggacgcugguaga

SEQ ID NO: 2518901 - RNA, 15 nt, Human
agacuggauacugcc

SEQ ID NO: 2518902 - RNA, 16 nt, Human
agacuggauacugccc

SEQ ID NO: 2518903 - RNA, 16 nt, Human
agagagaccacuuuuc

SEQ ID NO: 2518904 - RNA, 17 nt, Human
agagagagagacagaga

SEQ ID NO: 2518905 - RNA, 13 nt, Human
agagagagaagug

SEQ ID NO: 2518906 - RNA, 20 nt, Human
agacuggaagcuaauuugca

SEQ ID NO: 2518907 - RNA, 23 nt, Human
agacugcuucccauccuacccuc

SEQ ID NO: 2518908 - RNA, 22 nt, Human
agacugcuucccauccuacccu

SEQ ID NO: 2518909 - RNA, 21 nt, Human
agacugcuucccauccuaccc

SEQ ID NO: 2518910 - RNA, 17 nt, Human
agacugcuucccauccu

SEQ ID NO: 2518911 - RNA, 11 nt, Human
agacuggaagg

SEQ ID NO: 2518912 - RNA, 21 nt, Human
agacuggaagcuaauuugcau

SEQ ID NO: 2518913 - RNA, 14 nt, Human
agacuggagcaucu

SEQ ID NO: 2518914 - RNA, 16 nt, Human
agacuggagcaucuga

SEQ ID NO: 2518915 - RNA, 15 nt, Human
agacuggagcaucug

SEQ ID NO: 2518916 - RNA, 18 nt, Human
agacuggagcaucugacu

SEQ ID NO: 2518917 - RNA, 11 nt, Human
agacuggaggg

SEQ ID NO: 2518918 - RNA, 19 nt, Human
agagccauauaaguuugaa

SEQ ID NO: 2518919 - RNA, 22 nt, Human
agagccauauaaguuugaagga

SEQ ID NO: 2518920 - RNA, 20 nt, Human
agagccauauaaguuugaag

SEQ ID NO: 2518921 - RNA, 16 nt, Human
agagccaugcugggaa

SEQ ID NO: 2518922 - RNA, 19 nt, Human
agagccauggacucuacac

SEQ ID NO: 2518923 - RNA, 13 nt, Human
agagcccaccuug

SEQ ID NO: 2518924 - RNA, 13 nt, Human
agagccagggucu

SEQ ID NO: 2518925 - RNA, 19 nt, Human
agagagggguacauuuccc

SEQ ID NO: 2518926 - RNA, 22 nt, Human
agagaggggaauaauagaagaa

SEQ ID NO: 2518927 - RNA, 19 nt, Human
agagagggggccaccuccc

SEQ ID NO: 2518928 - RNA, 16 nt, Human
agagagggggccaccu

SEQ ID NO: 2518929 - RNA, 14 nt, Human
agagagggggccac

SEQ ID NO: 2518930 - RNA, 15 nt, Human
agagagggcuuuaau

SEQ ID NO: 2518931 - RNA, 14 nt, Human
agagagggcaggca

SEQ ID NO: 2518932 - RNA, 15 nt, Human
agagagggcaggcau

SEQ ID NO: 2518933 - RNA, 15 nt, Human
agagagggcagaggg

SEQ ID NO: 2518934 - RNA, 17 nt, Human
agagagggagguaugga

SEQ ID NO: 2518935 - RNA, 17 nt, Human
agagagggaggcaagcc

SEQ ID NO: 2518936 - RNA, 18 nt, Human
agagagggaggcaagccc

SEQ ID NO: 2518937 - RNA, 16 nt, Human
agagaggccuuguccc

SEQ ID NO: 2518938 - RNA, 19 nt, Human
agagagggagaagaaguca

SEQ ID NO: 2518939 - RNA, 16 nt, Human
agagagggagaagaag

SEQ ID NO: 2518940 - RNA, 15 nt, Human
agagagggagaagaa

SEQ ID NO: 2518941 - RNA, 14 nt, Human
agagaggccuuuug

SEQ ID NO: 2518942 - RNA, 20 nt, Human
agagaggccuuuuggaaugu

SEQ ID NO: 2518943 - RNA, 14 nt, Human
agagagaguguuug

SEQ ID NO: 2518944 - RNA, 14 nt, Human
agagagagaggaca

SEQ ID NO: 2518945 - RNA, 13 nt, Human
agagagagagagg

SEQ ID NO: 2518946 - RNA, 15 nt, Human
agagagagagagagg

SEQ ID NO: 2518947 - RNA, 15 nt, Human
agagagagagagaga

SEQ ID NO: 2518948 - RNA, 15 nt, Human
agagagagaggacag

SEQ ID NO: 2518949 - RNA, 20 nt, Human
agacaaugacuuacuguaca

SEQ ID NO: 2518950 - RNA, 23 nt, Human
agacaaaucuaugccacucagaa

SEQ ID NO: 2518951 - RNA, 16 nt, Human
agacaaauauuuggag

SEQ ID NO: 2518952 - RNA, 16 nt, Human
agacaaaucaaagcag

SEQ ID NO: 2518953 - RNA, 15 nt, Human
agacaaauauuugga

SEQ ID NO: 2518954 - RNA, 12 nt, Human
agacaaauauuu

SEQ ID NO: 2518955 - RNA, 17 nt, Human
agacaaauacucaugug

SEQ ID NO: 2518956 - RNA, 14 nt, Human
agacaaauacucau

SEQ ID NO: 2518957 - RNA, 13 nt, Human
agacaaauacuca

SEQ ID NO: 2518958 - RNA, 20 nt, Human
agacaaauacucauguguau

SEQ ID NO: 2518959 - RNA, 18 nt, Human
agacaaauacucaugugu

SEQ ID NO: 2518960 - RNA, 18 nt, Human
agacaaagguuuuccucu

SEQ ID NO: 2518961 - RNA, 16 nt, Human
agacaaaccagaagca

SEQ ID NO: 2518962 - RNA, 19 nt, Human
agacaaacaccucccagga

SEQ ID NO: 2518963 - RNA, 17 nt, Human
agacaaaccagaagcaa

SEQ ID NO: 2518964 - RNA, 21 nt, Human
agacaaugacuuacuguacau

SEQ ID NO: 2518965 - RNA, 22 nt, Human
agacaaugacuuacuguacaug

SEQ ID NO: 2518966 - RNA, 15 nt, Human
agacagagcuacaca

SEQ ID NO: 2518967 - RNA, 18 nt, Human
agacaaaugcugcgcccu

SEQ ID NO: 2518968 - RNA, 14 nt, Human
agacaaauggagga

SEQ ID NO: 2518969 - RNA, 18 nt, Human
agacaaauggaggaauau

SEQ ID NO: 2518970 - RNA, 20 nt, Human
agacagagucucacuguugc

SEQ ID NO: 2518971 - RNA, 19 nt, Human
agacagagucucacuguug

SEQ ID NO: 2518972 - RNA, 11 nt, Human
agacagagucu

SEQ ID NO: 2518973 - RNA, 13 nt, Human
agacagagcuaca

SEQ ID NO: 2518974 - RNA, 15 nt, Human
agacagagcucacaa

SEQ ID NO: 2518975 - RNA, 21 nt, Human
agacagagcugguugggaaga

SEQ ID NO: 2518976 - RNA, 12 nt, Human
agacagagcugg

SEQ ID NO: 2518977 - RNA, 21 nt, Human
agacagagucucacuguugcc

SEQ ID NO: 2518978 - RNA, 22 nt, Human
agacagauacuccuccaagguu

SEQ ID NO: 2518979 - RNA, 14 nt, Human
agacagaugcccca

SEQ ID NO: 2518980 - RNA, 15 nt, Human
agacagaugccccag

SEQ ID NO: 2518981 - RNA, 16 nt, Human
agacagaugccccaga

SEQ ID NO: 2518982 - RNA, 19 nt, Human
agacagaugccccagagcu

SEQ ID NO: 2518983 - RNA, 12 nt, Human
agacagcagcuc

SEQ ID NO: 2518984 - RNA, 14 nt, Human
agacagcagcucag

SEQ ID NO: 2518985 - RNA, 22 nt, Human
agacagccaacuauggccugug

SEQ ID NO: 2518986 - RNA, 16 nt, Human
agacagcagcucaggc

SEQ ID NO: 2518987 - RNA, 14 nt, Human
agaccagacugugg

SEQ ID NO: 2518988 - RNA, 18 nt, Human
agacagccacauugggca

SEQ ID NO: 2518989 - RNA, 15 nt, Human
agaccacguuucuaa

SEQ ID NO: 2518990 - RNA, 22 nt, Human
agaccagacuguggagaaauaa

SEQ ID NO: 2518991 - RNA, 18 nt, Human
agaccagacuguggagaa

SEQ ID NO: 2518992 - RNA, 17 nt, Human
agaccagacuguggaga

SEQ ID NO: 2518993 - RNA, 16 nt, Human
agaccagacuguggag

SEQ ID NO: 2518994 - RNA, 22 nt, Human
agacgccggggacagaggccug

SEQ ID NO: 2518995 - RNA, 20 nt, Human
agacgccggggacagaggcc

SEQ ID NO: 2518996 - RNA, 13 nt, Human
agacgccugagga

SEQ ID NO: 2518997 - RNA, 15 nt, Human
agacgccugagcuca

SEQ ID NO: 2518998 - RNA, 15 nt, Human
agacgccugaggaac

SEQ ID NO: 2518999 - RNA, 20 nt, Human
agacgccaccauuccuggaa

SEQ ID NO: 2519000 - RNA, 17 nt, Human
agacgccaccauuccug

SEQ ID NO: 2519001 - RNA, 15 nt, Human
agacgccaccauucc

SEQ ID NO: 2519002 - RNA, 19 nt, Human
agacgaugucuucauaccu

SEQ ID NO: 2519003 - RNA, 16 nt, Human
agacgaugucuucaua

SEQ ID NO: 2519004 - RNA, 18 nt, Human
agacccagcccucauccc

SEQ ID NO: 2519005 - RNA, 19 nt, Human
agacccagcccucaucccg

SEQ ID NO: 2519006 - RNA, 17 nt, Human
agacgaugucuucauac

SEQ ID NO: 2519007 - RNA, 14 nt, Human
agacccaaggagga

SEQ ID NO: 2519008 - RNA, 16 nt, Human
agacccaaggaggaaa

SEQ ID NO: 2519009 - RNA, 17 nt, Human
agacccagcccucaucc

SEQ ID NO: 2519010 - RNA, 17 nt, Human
agacccaaaaggcagaa

SEQ ID NO: 2519011 - RNA, 19 nt, Human
agacccaaaaggcagaagc

SEQ ID NO: 2519012 - RNA, 12 nt, Human
agaccagccugg

SEQ ID NO: 2519013 - RNA, 14 nt, Human
agaccagccuggcc

SEQ ID NO: 2519014 - RNA, 13 nt, Human
agaccagccuggc

SEQ ID NO: 2519015 - RNA, 15 nt, Human
agaccagccuggcca

SEQ ID NO: 2519016 - RNA, 12 nt, Human
agaccagcucuu

SEQ ID NO: 2519017 - RNA, 17 nt, Human
agaaugggaauauuuua

SEQ ID NO: 2519018 - RNA, 20 nt, Human
agaaugcuguacaucuauuu

SEQ ID NO: 2519019 - RNA, 14 nt, Human
agaaugcuguacau

SEQ ID NO: 2519020 - RNA, 15 nt, Human
agaaugcuguacauc

SEQ ID NO: 2519021 - RNA, 11 nt, Human
agaaugcugaa

SEQ ID NO: 2519022 - RNA, 16 nt, Human
agaaugauuuuuagau

SEQ ID NO: 2519023 - RNA, 13 nt, Human
agaaugauuucau

SEQ ID NO: 2519024 - RNA, 14 nt, Human
agaaugauuucaug

SEQ ID NO: 2519025 - RNA, 17 nt, Human
agaaugcugaaaccaag

SEQ ID NO: 2519026 - RNA, 12 nt, Human
agaaugcugaaa

SEQ ID NO: 2519027 - RNA, 22 nt, Human
agaaugcugcaggacuugagaa

SEQ ID NO: 2519028 - RNA, 13 nt, Human
agaaugcuguaca

SEQ ID NO: 2519029 - RNA, 13 nt, Human
agaaugcugguuu

SEQ ID NO: 2519030 - RNA, 18 nt, Human
agaaugcugguuuuccua

SEQ ID NO: 2519031 - RNA, 22 nt, Human
agaaugagagacacacugaaga

SEQ ID NO: 2519032 - RNA, 17 nt, Human
agaaugagagacacacu

SEQ ID NO: 2519033 - RNA, 16 nt, Human
agaagugacagggaag

SEQ ID NO: 2519034 - RNA, 15 nt, Human
agaaugaacaaauug

SEQ ID NO: 2519035 - RNA, 22 nt, Human
agaaugcacaaacagaggccgc

SEQ ID NO: 2519036 - RNA, 19 nt, Human
agaaugcacaaacagaggc

SEQ ID NO: 2519037 - RNA, 17 nt, Human
agaaugauuaugaauua

SEQ ID NO: 2519038 - RNA, 14 nt, Human
agaaugagagugug

SEQ ID NO: 2519039 - RNA, 17 nt, Human
agaagugacagggaagc

SEQ ID NO: 2519040 - RNA, 14 nt, Human
agaagugacaggga

SEQ ID NO: 2519041 - RNA, 13 nt, Human
agaagugacaggg

SEQ ID NO: 2519042 - RNA, 16 nt, Human
agaaugaaauacuguu

SEQ ID NO: 2519043 - RNA, 19 nt, Human
agaaugaaauacuguuuga

SEQ ID NO: 2519044 - RNA, 20 nt, Human
agaaugaaauacuguuugag

SEQ ID NO: 2519045 - RNA, 20 nt, Human
agaaugaaauugcugaaaga

SEQ ID NO: 2519046 - RNA, 12 nt, Human
agaagugacagg

SEQ ID NO: 2519047 - RNA, 21 nt, Human
agaagugaaugcugggacuca

SEQ ID NO: 2519048 - RNA, 19 nt, Human
agaagugaaugcugggacu

SEQ ID NO: 2519049 - RNA, 17 nt, Human
agaagugaaugcuggga

SEQ ID NO: 2519050 - RNA, 18 nt, Human
agaaugaaagggcccaga

SEQ ID NO: 2519051 - RNA, 14 nt, Human
agaagucaaaguaa

SEQ ID NO: 2519052 - RNA, 16 nt, Human
agaaguauuauaaauu

SEQ ID NO: 2519053 - RNA, 22 nt, Human
agaagucagagagggugacaag

SEQ ID NO: 2519054 - RNA, 13 nt, Human
agaagucaugaag

SEQ ID NO: 2519055 - RNA, 21 nt, Human
agaagugaaaaucuacacucc

SEQ ID NO: 2519056 - RNA, 17 nt, Human
agaagucaugaagccca

SEQ ID NO: 2519057 - RNA, 16 nt, Human
agaagugaaugcuggg

SEQ ID NO: 2519058 - RNA, 21 nt, Human
agaagguauuccuuuugugua

SEQ ID NO: 2519059 - RNA, 23 nt, Human
agaaggguuuuccacccuggaau

SEQ ID NO: 2519060 - RNA, 21 nt, Human
agaaggguuuuccacccugga

SEQ ID NO: 2519061 - RNA, 22 nt, Human
agaaggguuuuccacccuggaa

SEQ ID NO: 2519062 - RNA, 15 nt, Human
agaaggguccuuccc

SEQ ID NO: 2519063 - RNA, 18 nt, Human
agaaggguccuucccucu

SEQ ID NO: 2519064 - RNA, 20 nt, Human
agaaggguccuucccucucc

SEQ ID NO: 2519065 - RNA, 23 nt, Human
agaaggguccuucccucucccca

SEQ ID NO: 2519066 - RNA, 16 nt, Human
agaaggguuauauuuu

SEQ ID NO: 2519067 - RNA, 19 nt, Human
agaaggguuauauuuuacu

SEQ ID NO: 2519068 - RNA, 20 nt, Human
agaaggguuuuccacccugg

SEQ ID NO: 2519069 - RNA, 18 nt, Human
agaagguuaccaagaagc

SEQ ID NO: 2519070 - RNA, 22 nt, Human
agaagguggguuuucaucaaga

SEQ ID NO: 2519071 - RNA, 21 nt, Human
agaaggugccucaagaauuuc

SEQ ID NO: 2519072 - RNA, 14 nt, Human
agaagguccuuaau

SEQ ID NO: 2519073 - RNA, 20 nt, Human
agaagguccuuaaugauccg

SEQ ID NO: 2519074 - RNA, 20 nt, Human
agaaggucggaggcuuggga

SEQ ID NO: 2519075 - RNA, 21 nt, Human
agaagguccuuaaugauccgu

SEQ ID NO: 2519076 - RNA, 18 nt, Human
agaagagggccuguggga

SEQ ID NO: 2519077 - RNA, 16 nt, Human
agaagagggccugugg

SEQ ID NO: 2519078 - RNA, 14 nt, Human
agaagagggccugu

SEQ ID NO: 2519079 - RNA, 12 nt, Human
agaagagggaga

SEQ ID NO: 2519080 - RNA, 15 nt, Human
agaagagggguuuuu

SEQ ID NO: 2519081 - RNA, 24 nt, Human
agaagagggccugugggagccugc

SEQ ID NO: 2519082 - RNA, 22 nt, Human
agaagagaugggcuuguuuucu

SEQ ID NO: 2519083 - RNA, 22 nt, Human
agaagaggcuggugcuguggcc

SEQ ID NO: 2519084 - RNA, 17 nt, Human
agaagaggcuggugcug

SEQ ID NO: 2519085 - RNA, 20 nt, Human
agaagagaugggcuuguuuu

SEQ ID NO: 2519086 - RNA, 13 nt, Human
agaagauagcagg

SEQ ID NO: 2519087 - RNA, 20 nt, Human
agaaggggguggugucucca

SEQ ID NO: 2519088 - RNA, 13 nt, Human
agaaggggguggu

SEQ ID NO: 2519089 - RNA, 17 nt, Human
agaagggggccaugagg

SEQ ID NO: 2519090 - RNA, 19 nt, Human
agaaguauuauaaauuaug

SEQ ID NO: 2519091 - RNA, 14 nt, Human
agaaguauuauaaa

SEQ ID NO: 2519092 - RNA, 20 nt, Human
agaaguagauuaagagccau

SEQ ID NO: 2519093 - RNA, 13 nt, Human
agaaguagauuaa

SEQ ID NO: 2519094 - RNA, 21 nt, Human
agaaguaggcaugagggauca

SEQ ID NO: 2519095 - RNA, 19 nt, Human
agaaguagauuaagagcca

SEQ ID NO: 2519096 - RNA, 17 nt, Human
agaaguaggcaugaggg

SEQ ID NO: 2519097 - RNA, 13 nt, Human
agaaguauacaua

SEQ ID NO: 2519098 - RNA, 21 nt, Human
agaaguacugcccuuuugugu

SEQ ID NO: 2519099 - RNA, 14 nt, Human
agaaguaacuuacu

SEQ ID NO: 2519100 - RNA, 16 nt, Human
agaagguugcucuaga

SEQ ID NO: 2519101 - RNA, 20 nt, Human
agaagguugcucuagauuga

SEQ ID NO: 2519102 - RNA, 20 nt, Human
agaagguuaccaagaagccu

SEQ ID NO: 2519103 - RNA, 18 nt, Human
agaagguuucagaaagaa

SEQ ID NO: 2519104 - RNA, 20 nt, Human
agaagguuuguguuuuucug

SEQ ID NO: 2519105 - RNA, 19 nt, Human
agaagguuuguguuuuucu

SEQ ID NO: 2519106 - RNA, 17 nt, Human
agaagguuuguguuuuu

SEQ ID NO: 2519107 - RNA, 16 nt, Human
agaagacauguuuuag

SEQ ID NO: 2519108 - RNA, 15 nt, Human
agaagacauguuuua

SEQ ID NO: 2519109 - RNA, 14 nt, Human
agaagacauguuuu

SEQ ID NO: 2519110 - RNA, 13 nt, Human
agaagacauguuu

SEQ ID NO: 2519111 - RNA, 22 nt, Human
agaagacauggagacuccugcc

SEQ ID NO: 2519112 - RNA, 20 nt, Human
agaagacauggagacuccug

SEQ ID NO: 2519113 - RNA, 19 nt, Human
agaagacauggagacuccu

SEQ ID NO: 2519114 - RNA, 16 nt, Human
agaagacauggagacu

SEQ ID NO: 2519115 - RNA, 19 nt, Human
agaagacucuaccagacug

SEQ ID NO: 2519116 - RNA, 14 nt, Human
agaagacccuucuc

SEQ ID NO: 2519117 - RNA, 14 nt, Human
agaagacucuacca

SEQ ID NO: 2519118 - RNA, 19 nt, Human
agaagacauguuuuagaca

SEQ ID NO: 2519119 - RNA, 17 nt, Human
agaagacauguuuuaga

SEQ ID NO: 2519120 - RNA, 21 nt, Human
agaagaccacaaaaauugacu

SEQ ID NO: 2519121 - RNA, 18 nt, Human
agaagacugcauuauauu

SEQ ID NO: 2519122 - RNA, 12 nt, Human
agaagagacagg

SEQ ID NO: 2519123 - RNA, 20 nt, Human
agaagacucuaccagacugu

SEQ ID NO: 2519124 - RNA, 18 nt, Human
agaagagacucuuugcau

SEQ ID NO: 2519125 - RNA, 13 nt, Human
agaagagaggaga

SEQ ID NO: 2519126 - RNA, 15 nt, Human
agaagagagaucaaa

SEQ ID NO: 2519127 - RNA, 15 nt, Human
agaagagagaaauag

SEQ ID NO: 2519128 - RNA, 22 nt, Human
agaagagcuguucacagccaga

SEQ ID NO: 2519129 - RNA, 21 nt, Human
agaagagcuguucacagccag

SEQ ID NO: 2519130 - RNA, 21 nt, Human
agaagagauugugguuucauu

SEQ ID NO: 2519131 - RNA, 21 nt, Human
agaagagaggagaggagagag

SEQ ID NO: 2519132 - RNA, 20 nt, Human
agaagagaggagaggagaga

SEQ ID NO: 2519133 - RNA, 16 nt, Human
agaagagaggagagga

SEQ ID NO: 2519134 - RNA, 15 nt, Human
agaagagaggagagg

SEQ ID NO: 2519135 - RNA, 22 nt, Human
agaagagaggagaggagagagg

SEQ ID NO: 2519136 - RNA, 22 nt, Human
agaagagaguccauauuucaau

SEQ ID NO: 2519137 - RNA, 21 nt, Human
agaagacacugaugggcaacc

SEQ ID NO: 2519138 - RNA, 12 nt, Human
agaagacaugaa

SEQ ID NO: 2519139 - RNA, 23 nt, Human
agaagacaccagagcagaugcag

SEQ ID NO: 2519140 - RNA, 12 nt, Human
agaagacacugc

SEQ ID NO: 2519141 - RNA, 15 nt, Human
agaagacaugaacca

SEQ ID NO: 2519142 - RNA, 14 nt, Human
agaagacauggaga

SEQ ID NO: 2519143 - RNA, 16 nt, Human
agaagacaugaaccaa

SEQ ID NO: 2519144 - RNA, 22 nt, Human
agaagacaccagagcagaugca

SEQ ID NO: 2519145 - RNA, 19 nt, Human
agaagacaccagagcagau

SEQ ID NO: 2519146 - RNA, 18 nt, Human
agaagacaccagagcaga

SEQ ID NO: 2519147 - RNA, 17 nt, Human
agaagacaccagagcag

SEQ ID NO: 2519148 - RNA, 16 nt, Human
agaagacaccagagca

SEQ ID NO: 2519149 - RNA, 15 nt, Human
agaagacaccagagc

SEQ ID NO: 2519150 - RNA, 14 nt, Human
agaagacaccagag

SEQ ID NO: 2519151 - RNA, 13 nt, Human
agaagacacugau

SEQ ID NO: 2519152 - RNA, 19 nt, Human
acuuuccuccugaggcuuu

SEQ ID NO: 2519153 - RNA, 21 nt, Human
acuuuccucuuuggucuacac

SEQ ID NO: 2519154 - RNA, 21 nt, Human
acuuuccucuuagucgagcca

SEQ ID NO: 2519155 - RNA, 17 nt, Human
acuuuccuccuggcaga

SEQ ID NO: 2519156 - RNA, 16 nt, Human
agccaaaccucuguga

SEQ ID NO: 2519157 - RNA, 13 nt, Human
agccaaagaaaaa

SEQ ID NO: 2519158 - RNA, 14 nt, Human
agccaaacucugcc

SEQ ID NO: 2519159 - RNA, 15 nt, Human
agccaaacucugcca

SEQ ID NO: 2519160 - RNA, 17 nt, Human
agcauccuggcacccgg

SEQ ID NO: 2519161 - RNA, 14 nt, Human
agcauccuggcacc

SEQ ID NO: 2519162 - RNA, 18 nt, Human
agccaaagcuaggccugg

SEQ ID NO: 2519163 - RNA, 16 nt, Human
agccaaagcuaggccu

SEQ ID NO: 2519164 - RNA, 11 nt, Human
agccaaagagu

SEQ ID NO: 2519165 - RNA, 12 nt, Human
agccaaagaaaa

SEQ ID NO: 2519166 - RNA, 15 nt, Human
agccaaagauaaucu

SEQ ID NO: 2519167 - RNA, 19 nt, Human
agccaagaucgcgccacug

SEQ ID NO: 2519168 - RNA, 12 nt, Human
agccaaagccaa

SEQ ID NO: 2519169 - RNA, 19 nt, Human
agccaagauugcgccauug

SEQ ID NO: 2519170 - RNA, 17 nt, Human
agccaagcacaguggug

SEQ ID NO: 2519171 - RNA, 16 nt, Human
agccaagcacaguggu

SEQ ID NO: 2519172 - RNA, 14 nt, Human
agccaagcacagug

SEQ ID NO: 2519173 - RNA, 13 nt, Human
agccaagcacagu

SEQ ID NO: 2519174 - RNA, 21 nt, Human
agccaagcacagugguggcag

SEQ ID NO: 2519175 - RNA, 18 nt, Human
agccaagcacaguggugg

SEQ ID NO: 2519176 - RNA, 13 nt, Human
agccaagcagcca

SEQ ID NO: 2519177 - RNA, 16 nt, Human
agccaagcagccaagc

SEQ ID NO: 2519178 - RNA, 15 nt, Human
agccagaggagagag

SEQ ID NO: 2519179 - RNA, 13 nt, Human
agccagaggagag

SEQ ID NO: 2519180 - RNA, 21 nt, Human
agccaagcuagaauucccucu

SEQ ID NO: 2519181 - RNA, 15 nt, Human
agccaagcuccuugg

SEQ ID NO: 2519182 - RNA, 17 nt, Human
agccaagcuccuuggga

SEQ ID NO: 2519183 - RNA, 23 nt, Human
agccaagcuccuugggaggcccc

SEQ ID NO: 2519184 - RNA, 18 nt, Human
agccagaggagagaggac

SEQ ID NO: 2519185 - RNA, 17 nt, Human
agccagaggagagagga

SEQ ID NO: 2519186 - RNA, 14 nt, Human
agccagcaggcucu

SEQ ID NO: 2519187 - RNA, 11 nt, Human
agccagcagcc

SEQ ID NO: 2519188 - RNA, 13 nt, Human
agccagcagccag

SEQ ID NO: 2519189 - RNA, 17 nt, Human
agccagcagacauuguc

SEQ ID NO: 2519190 - RNA, 15 nt, Human
agcccacgcccccac

SEQ ID NO: 2519191 - RNA, 20 nt, Human
agcccacgcccccacuggug

SEQ ID NO: 2519192 - RNA, 14 nt, Human
agcccacgccccca

SEQ ID NO: 2519193 - RNA, 23 nt, Human
agcccacgcccccacuggugaca

SEQ ID NO: 2519194 - RNA, 15 nt, Human
agcccacucugcucg

SEQ ID NO: 2519195 - RNA, 13 nt, Human
agcccacucugcu

SEQ ID NO: 2519196 - RNA, 14 nt, Human
agcccacucugcuc

SEQ ID NO: 2519197 - RNA, 17 nt, Human
agcccacguccugucag

SEQ ID NO: 2519198 - RNA, 15 nt, Human
agcccacguccuguc

SEQ ID NO: 2519199 - RNA, 14 nt, Human
agcccacguccugu

SEQ ID NO: 2519200 - RNA, 21 nt, Human
agcccacguccugucagugcc

SEQ ID NO: 2519201 - RNA, 19 nt, Human
agcccacguccugucagug

SEQ ID NO: 2519202 - RNA, 22 nt, Human
agcccacguccugucagugccg

SEQ ID NO: 2519203 - RNA, 14 nt, Human
agcccaccuuggcu

SEQ ID NO: 2519204 - RNA, 16 nt, Human
agcccaccuuggcuca

SEQ ID NO: 2519205 - RNA, 15 nt, Human
agcccaccccucaac

SEQ ID NO: 2519206 - RNA, 13 nt, Human
agcccaccccccu

SEQ ID NO: 2519207 - RNA, 14 nt, Human
agcccaccccccuc

SEQ ID NO: 2519208 - RNA, 16 nt, Human
agcccaccccccucau

SEQ ID NO: 2519209 - RNA, 17 nt, Human
agcccacacuugagagg

SEQ ID NO: 2519210 - RNA, 16 nt, Human
agccagcaggcucuca

SEQ ID NO: 2519211 - RNA, 16 nt, Human
agcccaauaaaccucu

SEQ ID NO: 2519212 - RNA, 14 nt, Human
agccagcagccagc

SEQ ID NO: 2519213 - RNA, 16 nt, Human
agccagcagccagcuc

SEQ ID NO: 2519214 - RNA, 23 nt, Human
agcccacacuugagaggaugaau

SEQ ID NO: 2519215 - RNA, 15 nt, Human
agcccacacuugaga

SEQ ID NO: 2519216 - RNA, 17 nt, Human
agcccacaaagccuuau

SEQ ID NO: 2519217 - RNA, 16 nt, Human
agcccacaaagccuua

SEQ ID NO: 2519218 - RNA, 22 nt, Human
agccagcagacauugucagcaa

SEQ ID NO: 2519219 - RNA, 16 nt, Human
agcccaaugaaaugaa

SEQ ID NO: 2519220 - RNA, 20 nt, Human
agcccaauauuauaauuuuu

SEQ ID NO: 2519221 - RNA, 16 nt, Human
agcccaauauuauaau

SEQ ID NO: 2519222 - RNA, 15 nt, Human
agcccaauauuauaa

SEQ ID NO: 2519223 - RNA, 20 nt, Human
agccagcagccagcucucag

SEQ ID NO: 2519224 - RNA, 15 nt, Human
agcaggaaaugaaaa

SEQ ID NO: 2519225 - RNA, 21 nt, Human
agcaggaaaugaaaaugucuu

SEQ ID NO: 2519226 - RNA, 21 nt, Human
agcagcuuuuuuuuccccccu

SEQ ID NO: 2519227 - RNA, 22 nt, Human
agcagcuuuaaacucagggaca

SEQ ID NO: 2519228 - RNA, 23 nt, Human
agcaggaaaugaaaaugucuugu

SEQ ID NO: 2519229 - RNA, 21 nt, Human
agcaggaagcauucagagagc

SEQ ID NO: 2519230 - RNA, 13 nt, Human
agcauccuggcac

SEQ ID NO: 2519231 - RNA, 23 nt, Human
agccccaaagucaauuaaaggcu

SEQ ID NO: 2519232 - RNA, 14 nt, Human
agccccaaguccug

SEQ ID NO: 2519233 - RNA, 18 nt, Human
agccccacagcccacguc

SEQ ID NO: 2519234 - RNA, 17 nt, Human
agccccacagcccacgu

SEQ ID NO: 2519235 - RNA, 16 nt, Human
agccccacagcccacg

SEQ ID NO: 2519236 - RNA, 15 nt, Human
agccccacagcccac

SEQ ID NO: 2519237 - RNA, 14 nt, Human
agccccacagccca

SEQ ID NO: 2519238 - RNA, 12 nt, Human
agccccacagcc

SEQ ID NO: 2519239 - RNA, 13 nt, Human
agccccacagccc

SEQ ID NO: 2519240 - RNA, 19 nt, Human
agccccaaguccugaagag

SEQ ID NO: 2519241 - RNA, 15 nt, Human
agccccaaguccuga

SEQ ID NO: 2519242 - RNA, 11 nt, Human
agccccacagc

SEQ ID NO: 2519243 - RNA, 20 nt, Human
agccccacacuggggugccg

SEQ ID NO: 2519244 - RNA, 15 nt, Human
agccccacacggagg

SEQ ID NO: 2519245 - RNA, 21 nt, Human
agcccgggcucugccucccau

SEQ ID NO: 2519246 - RNA, 20 nt, Human
agcccgggcucugccuccca

SEQ ID NO: 2519247 - RNA, 18 nt, Human
agcccgggcucugccucc

SEQ ID NO: 2519248 - RNA, 17 nt, Human
agcccgggcucugccuc

SEQ ID NO: 2519249 - RNA, 21 nt, Human
agcccuccaucuaaacugccc

SEQ ID NO: 2519250 - RNA, 23 nt, Human
agcccuccaucuaaacugccccc

SEQ ID NO: 2519251 - RNA, 20 nt, Human
agccccacagcccacguccu

SEQ ID NO: 2519252 - RNA, 12 nt, Human
agcccuccccau

SEQ ID NO: 2519253 - RNA, 19 nt, Human
agcccuccccauggagcca

SEQ ID NO: 2519254 - RNA, 20 nt, Human
agcccuccccauggagccag

SEQ ID NO: 2519255 - RNA, 21 nt, Human
agcccuccccauggagccagc

SEQ ID NO: 2519256 - RNA, 13 nt, Human
agcccucccugcc

SEQ ID NO: 2519257 - RNA, 12 nt, Human
agcccucccugc

SEQ ID NO: 2519258 - RNA, 19 nt, Human
agccccauucugccugccc

SEQ ID NO: 2519259 - RNA, 18 nt, Human
agccccauucugccugcc

SEQ ID NO: 2519260 - RNA, 17 nt, Human
agccccauucugccugc

SEQ ID NO: 2519261 - RNA, 20 nt, Human
agccccacccaggagggagg

SEQ ID NO: 2519262 - RNA, 23 nt, Human
agccccauccucuguacagagcc

SEQ ID NO: 2519263 - RNA, 17 nt, Human
agccccauccucuguac

SEQ ID NO: 2519264 - RNA, 15 nt, Human
agccccauccucugu

SEQ ID NO: 2519265 - RNA, 12 nt, Human
agccccacccag

SEQ ID NO: 2519266 - RNA, 13 nt, Human
agccccacccagg

SEQ ID NO: 2519267 - RNA, 15 nt, Human
agccccacccaggag

SEQ ID NO: 2519268 - RNA, 16 nt, Human
agccccacccaggagg

SEQ ID NO: 2519269 - RNA, 12 nt, Human
agcacuuaagag

SEQ ID NO: 2519270 - RNA, 20 nt, Human
agcacggccaacaaagcugu

SEQ ID NO: 2519271 - RNA, 17 nt, Human
agcacggacucuuacug

SEQ ID NO: 2519272 - RNA, 18 nt, Human
agcacuuaagagaauauu

SEQ ID NO: 2519273 - RNA, 17 nt, Human
agcacuuaagagaauau

SEQ ID NO: 2519274 - RNA, 15 nt, Human
agcacuuaagagaau

SEQ ID NO: 2519275 - RNA, 13 nt, Human
agcacuuaagaga

SEQ ID NO: 2519276 - RNA, 15 nt, Human
agcacuuauuuaaug

SEQ ID NO: 2519277 - RNA, 16 nt, Human
agcacagacccugccc

SEQ ID NO: 2519278 - RNA, 17 nt, Human
agcacgauuucuguuua

SEQ ID NO: 2519279 - RNA, 19 nt, Human
agcacgauuucuguuuaga

SEQ ID NO: 2519280 - RNA, 21 nt, Human
agcacgauuucuguuuagaua

SEQ ID NO: 2519281 - RNA, 17 nt, Human
agcagcuucaguuguuu

SEQ ID NO: 2519282 - RNA, 16 nt, Human
agcagcuucaguuguu

SEQ ID NO: 2519283 - RNA, 18 nt, Human
agcagcuucaccagagca

SEQ ID NO: 2519284 - RNA, 16 nt, Human
agcagcuucaccagag

SEQ ID NO: 2519285 - RNA, 13 nt, Human
agcagccugagca

SEQ ID NO: 2519286 - RNA, 19 nt, Human
agcagccugagcaacucuu

SEQ ID NO: 2519287 - RNA, 20 nt, Human
agcagccucuccccaggucc

SEQ ID NO: 2519288 - RNA, 18 nt, Human
agcagccucuccccaggu

SEQ ID NO: 2519289 - RNA, 21 nt, Human
agcagccucuccccaggucca

SEQ ID NO: 2519290 - RNA, 16 nt, Human
agcagcuucugccacu

SEQ ID NO: 2519291 - RNA, 15 nt, Human
agcagcuucugccac

SEQ ID NO: 2519292 - RNA, 16 nt, Human
agcagcuuccagauug

SEQ ID NO: 2519293 - RNA, 14 nt, Human
agcagcuuccagau

SEQ ID NO: 2519294 - RNA, 12 nt, Human
agcagcuuccag

SEQ ID NO: 2519295 - RNA, 20 nt, Human
agcagcuuuaaacucaggga

SEQ ID NO: 2519296 - RNA, 19 nt, Human
agcagcuuuaaacucaggg

SEQ ID NO: 2519297 - RNA, 17 nt, Human
agcagcuuuaaacaaau

SEQ ID NO: 2519298 - RNA, 22 nt, Human
agcagcuucugccacuucccag

SEQ ID NO: 2519299 - RNA, 20 nt, Human
agcagcuucugccacuuccc

SEQ ID NO: 2519300 - RNA, 17 nt, Human
agcagcuucugccacuu

SEQ ID NO: 2519301 - RNA, 16 nt, Human
agcagcuuuaaacaaa

SEQ ID NO: 2519302 - RNA, 21 nt, Human
agcacuuggacucuugcucuu

SEQ ID NO: 2519303 - RNA, 20 nt, Human
agcacuuggacucuugcucu

SEQ ID NO: 2519304 - RNA, 18 nt, Human
agcacuuggacucuugcu

SEQ ID NO: 2519305 - RNA, 13 nt, Human
agcacuuggacuc

SEQ ID NO: 2519306 - RNA, 22 nt, Human
agcacuugcaaccgucuguuau

SEQ ID NO: 2519307 - RNA, 13 nt, Human
agcacuugcugua

SEQ ID NO: 2519308 - RNA, 14 nt, Human
agcacuuggagcca

SEQ ID NO: 2519309 - RNA, 17 nt, Human
agcacuuggagccaagg

SEQ ID NO: 2519310 - RNA, 16 nt, Human
agcagcccuccucacc

SEQ ID NO: 2519311 - RNA, 17 nt, Human
agcagcccuccucaccc

SEQ ID NO: 2519312 - RNA, 23 nt, Human
agcagcccuccucaccccgucug

SEQ ID NO: 2519313 - RNA, 15 nt, Human
agcagccucucccca

SEQ ID NO: 2519314 - RNA, 20 nt, Human
agcagccucagaacaaagug

SEQ ID NO: 2519315 - RNA, 16 nt, Human
agcagcccuuggccag

SEQ ID NO: 2519316 - RNA, 22 nt, Human
agcagcccuuggccagaaguca

SEQ ID NO: 2519317 - RNA, 13 nt, Human
agcagcccuuggc

SEQ ID NO: 2519318 - RNA, 19 nt, Human
agcagcccuggagucaugc

SEQ ID NO: 2519319 - RNA, 17 nt, Human
agcagcccuggagucau

SEQ ID NO: 2519320 - RNA, 16 nt, Human
agcagcccuggaguca

SEQ ID NO: 2519321 - RNA, 15 nt, Human
agcagcccuggaguc

SEQ ID NO: 2519322 - RNA, 18 nt, Human
agcagcccuccucacccc

SEQ ID NO: 2519323 - RNA, 19 nt, Human
agcaaugacaucucagggg

SEQ ID NO: 2519324 - RNA, 18 nt, Human
agcaaugacaucucaggg

SEQ ID NO: 2519325 - RNA, 20 nt, Human
agcaaugcccguaaugcuua

SEQ ID NO: 2519326 - RNA, 13 nt, Human
agcaaugcauuuu

SEQ ID NO: 2519327 - RNA, 23 nt, Human
agcaaugauguccagaagaauau

SEQ ID NO: 2519328 - RNA, 20 nt, Human
agcaaugauguccagaagaa

SEQ ID NO: 2519329 - RNA, 19 nt, Human
agcaaugauguccagaaga

SEQ ID NO: 2519330 - RNA, 18 nt, Human
agcaaugauguccagaag

SEQ ID NO: 2519331 - RNA, 21 nt, Human
agcaaugacaucucaggggcc

SEQ ID NO: 2519332 - RNA, 20 nt, Human
agcaaugacaucucaggggc

SEQ ID NO: 2519333 - RNA, 21 nt, Human
agcaauggacgguccgcagaa

SEQ ID NO: 2519334 - RNA, 21 nt, Human
agcaaugcccguaaugcuuag

SEQ ID NO: 2519335 - RNA, 13 nt, Human
agcaaugucugug

SEQ ID NO: 2519336 - RNA, 15 nt, Human
agcaaugccugccca

SEQ ID NO: 2519337 - RNA, 18 nt, Human
agcacaagaagcgugaga

SEQ ID NO: 2519338 - RNA, 13 nt, Human
agcacaagaagcg

SEQ ID NO: 2519339 - RNA, 12 nt, Human
agcacaagaagc

SEQ ID NO: 2519340 - RNA, 11 nt, Human
agcacaagaag

SEQ ID NO: 2519341 - RNA, 19 nt, Human
agcacaacuuuaagaggac

SEQ ID NO: 2519342 - RNA, 15 nt, Human
agcaaugucugugcu

SEQ ID NO: 2519343 - RNA, 14 nt, Human
agcaaugucugugc

SEQ ID NO: 2519344 - RNA, 16 nt, Human
agcaaugucugugcua

SEQ ID NO: 2519345 - RNA, 15 nt, Human
agcacagacccugcc

SEQ ID NO: 2519346 - RNA, 14 nt, Human
agcacagacccugc

SEQ ID NO: 2519347 - RNA, 12 nt, Human
agcacagacccu

SEQ ID NO: 2519348 - RNA, 14 nt, Human
agcacacacuuuug

SEQ ID NO: 2519349 - RNA, 20 nt, Human
agcacacacuuuugguuaag

SEQ ID NO: 2519350 - RNA, 13 nt, Human
agaucuggaaccu

SEQ ID NO: 2519351 - RNA, 14 nt, Human
agaucuggaaccuc

SEQ ID NO: 2519352 - RNA, 12 nt, Human
agaucugguuuu

SEQ ID NO: 2519353 - RNA, 17 nt, Human
agaucuggacuuggcaa

SEQ ID NO: 2519354 - RNA, 17 nt, Human
agaucugguuuugcuau

SEQ ID NO: 2519355 - RNA, 15 nt, Human
agaucugguuuugcu

SEQ ID NO: 2519356 - RNA, 14 nt, Human
agaucuguccucag

SEQ ID NO: 2519357 - RNA, 15 nt, Human
agaucuggaaccuca

SEQ ID NO: 2519358 - RNA, 17 nt, Human
agaucuggaaccucagc

SEQ ID NO: 2519359 - RNA, 19 nt, Human
agaucuggaaccucagccu

SEQ ID NO: 2519360 - RNA, 20 nt, Human
agaucuggaaccucagccug

SEQ ID NO: 2519361 - RNA, 18 nt, Human
agaucugguuuugcuauu

SEQ ID NO: 2519362 - RNA, 18 nt, Human
agaucuguccucagccuu

SEQ ID NO: 2519363 - RNA, 15 nt, Human
agaucuguccucagc

SEQ ID NO: 2519364 - RNA, 17 nt, Human
agaucuguccucagccu

SEQ ID NO: 2519365 - RNA, 17 nt, Human
agaugaagagugagagg

SEQ ID NO: 2519366 - RNA, 19 nt, Human
agaugaacucuuagaaaug

SEQ ID NO: 2519367 - RNA, 19 nt, Human
agaugaagagugagagggc

SEQ ID NO: 2519368 - RNA, 16 nt, Human
agaugaaggagaggca

SEQ ID NO: 2519369 - RNA, 17 nt, Human
agaugaagcaaacacau

SEQ ID NO: 2519370 - RNA, 18 nt, Human
agaugaagcaaacacauu

SEQ ID NO: 2519371 - RNA, 15 nt, Human
agaugaaguuuuaca

SEQ ID NO: 2519372 - RNA, 20 nt, Human
agaugaagagugagagggca

SEQ ID NO: 2519373 - RNA, 19 nt, Human
agaugaagcaaacacauua

SEQ ID NO: 2519374 - RNA, 11 nt, Human
agaguggccug

SEQ ID NO: 2519375 - RNA, 19 nt, Human
agaggggguggaggggugu

SEQ ID NO: 2519376 - RNA, 12 nt, Human
agagggggugga

SEQ ID NO: 2519377 - RNA, 20 nt, Human
agagugauagucuuuugcuu

SEQ ID NO: 2519378 - RNA, 17 nt, Human
agagugauaauacaagu

SEQ ID NO: 2519379 - RNA, 22 nt, Human
agagugauagucuuuugcuuuu

SEQ ID NO: 2519380 - RNA, 13 nt, Human
agagugcaacagu

SEQ ID NO: 2519381 - RNA, 17 nt, Human
agagugcaacaguagca

SEQ ID NO: 2519382 - RNA, 22 nt, Human
agagugcaacaguagcauagga

SEQ ID NO: 2519383 - RNA, 22 nt, Human
agaguggaaugcuuccuagaag

SEQ ID NO: 2519384 - RNA, 17 nt, Human
agagugcgccgagucug

SEQ ID NO: 2519385 - RNA, 21 nt, Human
agagugcgccgagucugucuc

SEQ ID NO: 2519386 - RNA, 13 nt, Human
agagugcccagaa

SEQ ID NO: 2519387 - RNA, 12 nt, Human
agagugcccaga

SEQ ID NO: 2519388 - RNA, 18 nt, Human
agagugcauugugagggu

SEQ ID NO: 2519389 - RNA, 21 nt, Human
agagugcaagccccugcucca

SEQ ID NO: 2519390 - RNA, 21 nt, Human
agaugaguaaaggaguaagaa

SEQ ID NO: 2519391 - RNA, 16 nt, Human
agaugaauacaaacaa

SEQ ID NO: 2519392 - RNA, 22 nt, Human
agaugaauacaaacaauggaaa

SEQ ID NO: 2519393 - RNA, 19 nt, Human
agaugaaguuuuacauugu

SEQ ID NO: 2519394 - RNA, 14 nt, Human
agaugagugagcau

SEQ ID NO: 2519395 - RNA, 16 nt, Human
agaugauacauccaaa

SEQ ID NO: 2519396 - RNA, 20 nt, Human
agaugauacauccaaagcag

SEQ ID NO: 2519397 - RNA, 18 nt, Human
agaugaugaaaauauuua

SEQ ID NO: 2519398 - RNA, 16 nt, Human
agaugaucuacucaga

SEQ ID NO: 2519399 - RNA, 13 nt, Human
agaugaucauuug

SEQ ID NO: 2519400 - RNA, 13 nt, Human
agaugauccauga

SEQ ID NO: 2519401 - RNA, 14 nt, Human
agaugguggcagua

SEQ ID NO: 2519402 - RNA, 17 nt, Human
agauggugcugagaagc

SEQ ID NO: 2519403 - RNA, 15 nt, Human
agauggugaaauuua

SEQ ID NO: 2519404 - RNA, 14 nt, Human
agauggugcugaga

SEQ ID NO: 2519405 - RNA, 21 nt, Human
agauggucacgcaccugggug

SEQ ID NO: 2519406 - RNA, 19 nt, Human
agauggucacgcaccuggg

SEQ ID NO: 2519407 - RNA, 19 nt, Human
agaugguauauuugguacu

SEQ ID NO: 2519408 - RNA, 23 nt, Human
agaugaugaaaauauuuaaaggc

SEQ ID NO: 2519409 - RNA, 13 nt, Human
agaugggugggga

SEQ ID NO: 2519410 - RNA, 19 nt, Human
agauguagaggagaaacug

SEQ ID NO: 2519411 - RNA, 18 nt, Human
agauguagauuuauuuca

SEQ ID NO: 2519412 - RNA, 21 nt, Human
agauguagcaaaacgcaugga

SEQ ID NO: 2519413 - RNA, 15 nt, Human
agauguagauuuauu

SEQ ID NO: 2519414 - RNA, 19 nt, Human
agauguagauaaacucaga

SEQ ID NO: 2519415 - RNA, 16 nt, Human
agauguagaggagaaa

SEQ ID NO: 2519416 - RNA, 22 nt, Human
agaugguuuuauaaucugauuu

SEQ ID NO: 2519417 - RNA, 18 nt, Human
agaugguuugagccugag

SEQ ID NO: 2519418 - RNA, 17 nt, Human
agauguaaaagguauua

SEQ ID NO: 2519419 - RNA, 15 nt, Human
agauucuccugugcu

SEQ ID NO: 2519420 - RNA, 17 nt, Human
agauucugaaacauugc

SEQ ID NO: 2519421 - RNA, 17 nt, Human
agcaaaugucuuccugg

SEQ ID NO: 2519422 - RNA, 20 nt, Human
agcaaaugucuuccuggauu

SEQ ID NO: 2519423 - RNA, 16 nt, Human
agcaaauguggcuccu

SEQ ID NO: 2519424 - RNA, 15 nt, Human
agcaaaugugaccug

SEQ ID NO: 2519425 - RNA, 20 nt, Human
agcaaaggagauuggaagga

SEQ ID NO: 2519426 - RNA, 21 nt, Human
agcaaagcugaugacaacuuc

SEQ ID NO: 2519427 - RNA, 23 nt, Human
agcaaagcugaugacaacuuccc

SEQ ID NO: 2519428 - RNA, 21 nt, Human
agauugcaacaggcugggcuu

SEQ ID NO: 2519429 - RNA, 20 nt, Human
agauugcaacaggcugggcu

SEQ ID NO: 2519430 - RNA, 23 nt, Human
agauugcaacaggcugggcuuca

SEQ ID NO: 2519431 - RNA, 17 nt, Human
agcaaaacuccaucuca

SEQ ID NO: 2519432 - RNA, 21 nt, Human
agauucuuuccugaggcuggg

SEQ ID NO: 2519433 - RNA, 19 nt, Human
agauucuuuccugaggcug

SEQ ID NO: 2519434 - RNA, 20 nt, Human
agauugaaaacuuuucucag

SEQ ID NO: 2519435 - RNA, 19 nt, Human
agauugaaaacuuuucuca

SEQ ID NO: 2519436 - RNA, 24 nt, Human
agcaaaauuuuuucucuaggaaau

SEQ ID NO: 2519437 - RNA, 21 nt, Human
agcaaaauaauuuuaaacaaa

SEQ ID NO: 2519438 - RNA, 21 nt, Human
agcaaaagggugucugagccc

SEQ ID NO: 2519439 - RNA, 18 nt, Human
agcaaaagggugucugag

SEQ ID NO: 2519440 - RNA, 21 nt, Human
agcaaaaccaaauauuccaga

SEQ ID NO: 2519441 - RNA, 18 nt, Human
agcaaaagaugcuucuca

SEQ ID NO: 2519442 - RNA, 22 nt, Human
agcaaagccccaugcuggagcc

SEQ ID NO: 2519443 - RNA, 21 nt, Human
agcaaagccccaugcuggagc

SEQ ID NO: 2519444 - RNA, 23 nt, Human
agcaaagccccaugcuggagccu

SEQ ID NO: 2519445 - RNA, 19 nt, Human
agcaaacuaacuugacuuu

SEQ ID NO: 2519446 - RNA, 13 nt, Human
agcaaacagagga

SEQ ID NO: 2519447 - RNA, 20 nt, Human
agcaaaaucauggaaugguu

SEQ ID NO: 2519448 - RNA, 13 nt, Human
agcaaacacauua

SEQ ID NO: 2519449 - RNA, 23 nt, Human
agcaaaaucauggaaugguuaua

SEQ ID NO: 2519450 - RNA, 13 nt, Human
aggcuaccuuugu

SEQ ID NO: 2519451 - RNA, 14 nt, Human
aggcuaccuuugua

SEQ ID NO: 2519452 - RNA, 15 nt, Human
aggcuaccuuuguau

SEQ ID NO: 2519453 - RNA, 13 nt, Human
aggcugaccacag

SEQ ID NO: 2519454 - RNA, 14 nt, Human
aggcugaccacagc

SEQ ID NO: 2519455 - RNA, 18 nt, Human
aggcugaccaagagagaa

SEQ ID NO: 2519456 - RNA, 19 nt, Human
aggcugaccaagagagaaa

SEQ ID NO: 2519457 - RNA, 20 nt, Human
aggcugaccaagagagaaag

SEQ ID NO: 2519458 - RNA, 22 nt, Human
aggcugaccaagagagaaagaa

SEQ ID NO: 2519459 - RNA, 20 nt, Human
aggcuaaggcguggagcugc

SEQ ID NO: 2519460 - RNA, 23 nt, Human
aggcuaaggcguggagcugccug

SEQ ID NO: 2519461 - RNA, 19 nt, Human
aggcuaaggcguggagcug

SEQ ID NO: 2519462 - RNA, 18 nt, Human
aggcuaaggcguggagcu

SEQ ID NO: 2519463 - RNA, 15 nt, Human
aggcuaaggcgugga

SEQ ID NO: 2519464 - RNA, 19 nt, Human
aggcuaaauuacucaggaa

SEQ ID NO: 2519465 - RNA, 18 nt, Human
aggcuacaauuuucuccc

SEQ ID NO: 2519466 - RNA, 19 nt, Human
aggcuacaauuuucuccca

SEQ ID NO: 2519467 - RNA, 18 nt, Human
aggcuacacugacacugg

SEQ ID NO: 2519468 - RNA, 13 nt, Human
aggcuacacugac

SEQ ID NO: 2519469 - RNA, 23 nt, Human
aggcuacaauuuucucccaggaa

SEQ ID NO: 2519470 - RNA, 22 nt, Human
aggcuacaauuuucucccagga

SEQ ID NO: 2519471 - RNA, 19 nt, Human
aggcuacacugacacuggu

SEQ ID NO: 2519472 - RNA, 14 nt, Human
aggcugaggcuggc

SEQ ID NO: 2519473 - RNA, 15 nt, Human
aggcugaggcuggca

SEQ ID NO: 2519474 - RNA, 16 nt, Human
aggcugaggcuggcac

SEQ ID NO: 2519475 - RNA, 17 nt, Human
aggcugaggcuggcaca

SEQ ID NO: 2519476 - RNA, 18 nt, Human
aggcuggguucugauccu

SEQ ID NO: 2519477 - RNA, 15 nt, Human
aggcugaggccugga

SEQ ID NO: 2519478 - RNA, 14 nt, Human
aggcugaggccugg

SEQ ID NO: 2519479 - RNA, 13 nt, Human
aggcugaggccug

SEQ ID NO: 2519480 - RNA, 17 nt, Human
aggcugaggcaggagga

SEQ ID NO: 2519481 - RNA, 17 nt, Human
aggcugaggccuggacu

SEQ ID NO: 2519482 - RNA, 16 nt, Human
aggcugaggccuggac

SEQ ID NO: 2519483 - RNA, 11 nt, Human
aggcugaggcg

SEQ ID NO: 2519484 - RNA, 21 nt, Human
aggcugaggcggguggaucac

SEQ ID NO: 2519485 - RNA, 16 nt, Human
aggcugaccacagcac

SEQ ID NO: 2519486 - RNA, 17 nt, Human
aggcugaccacagcaca

SEQ ID NO: 2519487 - RNA, 18 nt, Human
aggcugaccacagcacag

SEQ ID NO: 2519488 - RNA, 21 nt, Human
aggcugaccacagcacagcca

SEQ ID NO: 2519489 - RNA, 14 nt, Human
aggcugagacagga

SEQ ID NO: 2519490 - RNA, 13 nt, Human
aggcugagacagg

SEQ ID NO: 2519491 - RNA, 19 nt, Human
aggcugagaacacugugaa

SEQ ID NO: 2519492 - RNA, 16 nt, Human
aggcugagaacacugu

SEQ ID NO: 2519493 - RNA, 22 nt, Human
aggcugaccuugaacuccuggg

SEQ ID NO: 2519494 - RNA, 15 nt, Human
aggcugaggcagaag

SEQ ID NO: 2519495 - RNA, 17 nt, Human
aggcugagacugcggga

SEQ ID NO: 2519496 - RNA, 18 nt, Human
aggcugagacaggagaau

SEQ ID NO: 2519497 - RNA, 15 nt, Human
aggcugagacaggag

SEQ ID NO: 2519498 - RNA, 16 nt, Human
aggcugagacugcggg

SEQ ID NO: 2519499 - RNA, 14 nt, Human
aggcugaggcagga

SEQ ID NO: 2519500 - RNA, 15 nt, Human
aggcugaggcaggag

SEQ ID NO: 2519501 - RNA, 19 nt, Human
aggcugaggcaggagaaug

SEQ ID NO: 2519502 - RNA, 21 nt, Human
agggaccaaggcaaggcaggu

SEQ ID NO: 2519503 - RNA, 17 nt, Human
agggaccaaggcaaggc

SEQ ID NO: 2519504 - RNA, 13 nt, Human
agggaccaaggca

SEQ ID NO: 2519505 - RNA, 12 nt, Human
agggaccaaggc

SEQ ID NO: 2519506 - RNA, 21 nt, Human
agggaccaaggaccccucacc

SEQ ID NO: 2519507 - RNA, 18 nt, Human
aggcuuagucacugagac

SEQ ID NO: 2519508 - RNA, 13 nt, Human
agggaccacagca

SEQ ID NO: 2519509 - RNA, 23 nt, Human
agggaccaaggcaaggcaggugc

SEQ ID NO: 2519510 - RNA, 18 nt, Human
agggaccacacccuguac

SEQ ID NO: 2519511 - RNA, 23 nt, Human
agggaccacagcaaggcaccugc

SEQ ID NO: 2519512 - RNA, 14 nt, Human
agggaccacagcaa

SEQ ID NO: 2519513 - RNA, 14 nt, Human
agggaccagccaag

SEQ ID NO: 2519514 - RNA, 15 nt, Human
agggaccagccaaga

SEQ ID NO: 2519515 - RNA, 12 nt, Human
agggaccccucc

SEQ ID NO: 2519516 - RNA, 20 nt, Human
agggaccagccaagagggcu

SEQ ID NO: 2519517 - RNA, 14 nt, Human
agggaccccuccuc

SEQ ID NO: 2519518 - RNA, 13 nt, Human
agggaccccuccu

SEQ ID NO: 2519519 - RNA, 15 nt, Human
agggaccccuccucc

SEQ ID NO: 2519520 - RNA, 15 nt, Human
agggaccccugcccu

SEQ ID NO: 2519521 - RNA, 15 nt, Human
agggacccuccacca

SEQ ID NO: 2519522 - RNA, 23 nt, Human
agggaccccugcccuugucccac

SEQ ID NO: 2519523 - RNA, 15 nt, Human
agggacugaggggag

SEQ ID NO: 2519524 - RNA, 18 nt, Human
agggacuggaaccaggga

SEQ ID NO: 2519525 - RNA, 15 nt, Human
agggacuggaaccag

SEQ ID NO: 2519526 - RNA, 23 nt, Human
agggacugccagucccccugccc

SEQ ID NO: 2519527 - RNA, 20 nt, Human
aggcuuagcuuugcucugcc

SEQ ID NO: 2519528 - RNA, 19 nt, Human
aggcuuagcuuugcucugc

SEQ ID NO: 2519529 - RNA, 15 nt, Human
aggcuuagcuuugcu

SEQ ID NO: 2519530 - RNA, 17 nt, Human
aggcuuagucacugaga

SEQ ID NO: 2519531 - RNA, 23 nt, Human
aggcuggugcuguggccagggug

SEQ ID NO: 2519532 - RNA, 22 nt, Human
aggcuggugcuguggccagggu

SEQ ID NO: 2519533 - RNA, 13 nt, Human
aggcugguggccc

SEQ ID NO: 2519534 - RNA, 14 nt, Human
aggcugguggccca

SEQ ID NO: 2519535 - RNA, 22 nt, Human
aggcuguaucccaugagccuca

SEQ ID NO: 2519536 - RNA, 21 nt, Human
aggcuguaucccaugagccuc

SEQ ID NO: 2519537 - RNA, 20 nt, Human
aggcuguaucccaugagccu

SEQ ID NO: 2519538 - RNA, 20 nt, Human
aggcuggugcuguggccagg

SEQ ID NO: 2519539 - RNA, 23 nt, Human
aggcuggucucgaacuccugacc

SEQ ID NO: 2519540 - RNA, 17 nt, Human
aggcugaggcagaagaa

SEQ ID NO: 2519541 - RNA, 22 nt, Human
aggcuggucucaaacuccugac

SEQ ID NO: 2519542 - RNA, 20 nt, Human
aggccggcgagcccugugga

SEQ ID NO: 2519543 - RNA, 13 nt, Human
aggcgggccagcc

SEQ ID NO: 2519544 - RNA, 12 nt, Human
aggcgggccagc

SEQ ID NO: 2519545 - RNA, 14 nt, Human
aggcgggaguggag

SEQ ID NO: 2519546 - RNA, 14 nt, Human
aggcgggaaggagg

SEQ ID NO: 2519547 - RNA, 15 nt, Human
aggcgggaaggaggg

SEQ ID NO: 2519548 - RNA, 16 nt, Human
aggcggccccucccgc

SEQ ID NO: 2519549 - RNA, 21 nt, Human
aggcgggaaaagcagcccuug

SEQ ID NO: 2519550 - RNA, 14 nt, Human
aggcgggcucaagg

SEQ ID NO: 2519551 - RNA, 15 nt, Human
aggcgggcggucagg

SEQ ID NO: 2519552 - RNA, 23 nt, Human
aggcgggccagccaggcgggcuc

SEQ ID NO: 2519553 - RNA, 21 nt, Human
aggcgggccagccaggcgggc

SEQ ID NO: 2519554 - RNA, 17 nt, Human
aggcgggccagccaggc

SEQ ID NO: 2519555 - RNA, 16 nt, Human
aggcgggccagccagg

SEQ ID NO: 2519556 - RNA, 15 nt, Human
aggcgggccagccag

SEQ ID NO: 2519557 - RNA, 14 nt, Human
aggcgggccagcca

SEQ ID NO: 2519558 - RNA, 19 nt, Human
aggcuaaggcaggaaaauu

SEQ ID NO: 2519559 - RNA, 18 nt, Human
aggcuaaagcccagagac

SEQ ID NO: 2519560 - RNA, 21 nt, Human
aggcuaaagcccagagacagc

SEQ ID NO: 2519561 - RNA, 19 nt, Human
aggcgucaacgugcauuuu

SEQ ID NO: 2519562 - RNA, 21 nt, Human
aggcggugggcacccacccug

SEQ ID NO: 2519563 - RNA, 14 nt, Human
aggcggugggcacc

SEQ ID NO: 2519564 - RNA, 17 nt, Human
aggcauuccccaggagg

SEQ ID NO: 2519565 - RNA, 18 nt, Human
aggcauuccccaggaggc

SEQ ID NO: 2519566 - RNA, 19 nt, Human
aggcauguucucugaggac

SEQ ID NO: 2519567 - RNA, 18 nt, Human
aggcauguucucugagga

SEQ ID NO: 2519568 - RNA, 20 nt, Human
aggcaugugaugagaggaaa

SEQ ID NO: 2519569 - RNA, 19 nt, Human
aggcaugugaugagaggaa

SEQ ID NO: 2519570 - RNA, 21 nt, Human
aggcaugugaugagaggaaau

SEQ ID NO: 2519571 - RNA, 17 nt, Human
aggcauguucucugagg

SEQ ID NO: 2519572 - RNA, 17 nt, Human
aggcagauugaaaagga

SEQ ID NO: 2519573 - RNA, 16 nt, Human
aggcagauugaaaagg

SEQ ID NO: 2519574 - RNA, 15 nt, Human
aggcagauugaaaag

SEQ ID NO: 2519575 - RNA, 22 nt, Human
aggcagaucugugccccaugcc

SEQ ID NO: 2519576 - RNA, 23 nt, Human
aggcagaucugugccccaugccu

SEQ ID NO: 2519577 - RNA, 19 nt, Human
aggcagcagugugaggcca

SEQ ID NO: 2519578 - RNA, 20 nt, Human
aggcagcagugugaggccag

SEQ ID NO: 2519579 - RNA, 22 nt, Human
aggcagcagugugaggccaggg

SEQ ID NO: 2519580 - RNA, 23 nt, Human
aggcagcagugugaggccagggc

SEQ ID NO: 2519581 - RNA, 13 nt, Human
aggcauggcccug

SEQ ID NO: 2519582 - RNA, 12 nt, Human
aggcauggcccu

SEQ ID NO: 2519583 - RNA, 12 nt, Human
aggcagcauuua

SEQ ID NO: 2519584 - RNA, 16 nt, Human
aggcaugccuguguga

SEQ ID NO: 2519585 - RNA, 17 nt, Human
aggcaugugaugagagg

SEQ ID NO: 2519586 - RNA, 12 nt, Human
aggcauggugga

SEQ ID NO: 2519587 - RNA, 12 nt, Human
aggcauguccug

SEQ ID NO: 2519588 - RNA, 15 nt, Human
aggcauggcccuggg

SEQ ID NO: 2519589 - RNA, 14 nt, Human
aggcauggcccugg

SEQ ID NO: 2519590 - RNA, 21 nt, Human
aggcauggcccugggguccca

SEQ ID NO: 2519591 - RNA, 16 nt, Human
aggcauggcccugggg

SEQ ID NO: 2519592 - RNA, 15 nt, Human
aggcaugguggccca

SEQ ID NO: 2519593 - RNA, 13 nt, Human
aggcagaggacag

SEQ ID NO: 2519594 - RNA, 20 nt, Human
aggcagagagcggucucagg

SEQ ID NO: 2519595 - RNA, 13 nt, Human
aggcagagagcgg

SEQ ID NO: 2519596 - RNA, 11 nt, Human
aggcagagagc

SEQ ID NO: 2519597 - RNA, 22 nt, Human
aggcagagaaucauacuuagca

SEQ ID NO: 2519598 - RNA, 14 nt, Human
aggcagagaaucau

SEQ ID NO: 2519599 - RNA, 17 nt, Human
aggcagauccaggacua

SEQ ID NO: 2519600 - RNA, 15 nt, Human
aggcagaucugugcc

SEQ ID NO: 2519601 - RNA, 16 nt, Human
aggcagaucugugccc

SEQ ID NO: 2519602 - RNA, 20 nt, Human
aggcagaucugugccccaug

SEQ ID NO: 2519603 - RNA, 21 nt, Human
aggcagaucugugccccaugc

SEQ ID NO: 2519604 - RNA, 22 nt, Human
aggcagagaaagaagagacagg

SEQ ID NO: 2519605 - RNA, 21 nt, Human
aggcagagaaagaagagacag

SEQ ID NO: 2519606 - RNA, 19 nt, Human
aggcagagaaagaagagac

SEQ ID NO: 2519607 - RNA, 18 nt, Human
aggcagagaaagaagaga

SEQ ID NO: 2519608 - RNA, 17 nt, Human
aggcagagaaagaagag

SEQ ID NO: 2519609 - RNA, 15 nt, Human
aggcagagaaagaag

SEQ ID NO: 2519610 - RNA, 13 nt, Human
aggcagagaaaga

SEQ ID NO: 2519611 - RNA, 17 nt, Human
aggcacugaagugcuua

SEQ ID NO: 2519612 - RNA, 9 nt, Human
aggcagaga

SEQ ID NO: 2519613 - RNA, 19 nt, Human
aggcacucuguuauuuaga

SEQ ID NO: 2519614 - RNA, 22 nt, Human
aggcagacuucccugaauguau

SEQ ID NO: 2519615 - RNA, 20 nt, Human
aggcacucuguuauuuagac

SEQ ID NO: 2519616 - RNA, 16 nt, Human
aggcacucuguuauuu

SEQ ID NO: 2519617 - RNA, 23 nt, Human
aggcacuagccuuuggcucugga

SEQ ID NO: 2519618 - RNA, 17 nt, Human
aggcacgaacccaccug

SEQ ID NO: 2519619 - RNA, 18 nt, Human
aggcacgaacccaccugc

SEQ ID NO: 2519620 - RNA, 19 nt, Human
aggcacgaacccaccugcu

SEQ ID NO: 2519621 - RNA, 20 nt, Human
aggcacgaacccaccugcug

SEQ ID NO: 2519622 - RNA, 15 nt, Human
aggcacuagccuuug

SEQ ID NO: 2519623 - RNA, 13 nt, Human
aggcacuagccuu

SEQ ID NO: 2519624 - RNA, 21 nt, Human
aggcacgaacccaccugcuga

SEQ ID NO: 2519625 - RNA, 22 nt, Human
aggagaggggaagggccagucu

SEQ ID NO: 2519626 - RNA, 21 nt, Human
aggagaggaugagagcccaga

SEQ ID NO: 2519627 - RNA, 20 nt, Human
aggagaggaugagagcccag

SEQ ID NO: 2519628 - RNA, 19 nt, Human
aggagaggaugagagccca

SEQ ID NO: 2519629 - RNA, 18 nt, Human
aggagaggaugagagccc

SEQ ID NO: 2519630 - RNA, 20 nt, Human
aggagaggcaacauccaaaa

SEQ ID NO: 2519631 - RNA, 23 nt, Human
aggagaggaugagagcccagagg

SEQ ID NO: 2519632 - RNA, 19 nt, Human
aggagaggggaagggccag

SEQ ID NO: 2519633 - RNA, 18 nt, Human
aggagaggggaagggcca

SEQ ID NO: 2519634 - RNA, 21 nt, Human
aggagaggcaacauccaaaau

SEQ ID NO: 2519635 - RNA, 14 nt, Human
aggcaccugcauuu

SEQ ID NO: 2519636 - RNA, 21 nt, Human
aggcaccugcagguugggcca

SEQ ID NO: 2519637 - RNA, 18 nt, Human
aggcaccugcagguuggg

SEQ ID NO: 2519638 - RNA, 14 nt, Human
aggcaccugcaggu

SEQ ID NO: 2519639 - RNA, 19 nt, Human
aggcaccuuaguggcuuuu

SEQ ID NO: 2519640 - RNA, 14 nt, Human
aggcacgaacccac

SEQ ID NO: 2519641 - RNA, 23 nt, Human
aggcccucugcccacucccugca

SEQ ID NO: 2519642 - RNA, 22 nt, Human
aggcccucugcccacucccugc

SEQ ID NO: 2519643 - RNA, 21 nt, Human
aggccaugggcacugugggua

SEQ ID NO: 2519644 - RNA, 21 nt, Human
aggcccucugcccacucccug

SEQ ID NO: 2519645 - RNA, 15 nt, Human
aggcccuggccuccc

SEQ ID NO: 2519646 - RNA, 14 nt, Human
aggcccuggccucc

SEQ ID NO: 2519647 - RNA, 24 nt, Human
aggcccugcacuguccugcuccac

SEQ ID NO: 2519648 - RNA, 23 nt, Human
aggcccugcacuguccugcucca

SEQ ID NO: 2519649 - RNA, 22 nt, Human
aggcccugcacuguccugcucc

SEQ ID NO: 2519650 - RNA, 21 nt, Human
aggcccugcacuguccugcuc

SEQ ID NO: 2519651 - RNA, 19 nt, Human
aggcccugcacuguccugc

SEQ ID NO: 2519652 - RNA, 18 nt, Human
aggcccugcacuguccug

SEQ ID NO: 2519653 - RNA, 17 nt, Human
aggcccugcacuguccu

SEQ ID NO: 2519654 - RNA, 16 nt, Human
aggcccugcacugucc

SEQ ID NO: 2519655 - RNA, 15 nt, Human
aggcccugcacuguc

SEQ ID NO: 2519656 - RNA, 13 nt, Human
aggcccugcacug

SEQ ID NO: 2519657 - RNA, 20 nt, Human
aggcccucuggaguggccac

SEQ ID NO: 2519658 - RNA, 21 nt, Human
aggcccucuggaguggccacu

SEQ ID NO: 2519659 - RNA, 22 nt, Human
aggcccucuggaguggccacua

SEQ ID NO: 2519660 - RNA, 13 nt, Human
aggcccucuggag

SEQ ID NO: 2519661 - RNA, 15 nt, Human
aggcccucuggagug

SEQ ID NO: 2519662 - RNA, 19 nt, Human
aggcccuucucuccagccc

SEQ ID NO: 2519663 - RNA, 15 nt, Human
aggcccuucucucca

SEQ ID NO: 2519664 - RNA, 14 nt, Human
aggcccugucugua

SEQ ID NO: 2519665 - RNA, 13 nt, Human
aggcccugucugu

SEQ ID NO: 2519666 - RNA, 23 nt, Human
aggcccuggccuccccugccacc

SEQ ID NO: 2519667 - RNA, 22 nt, Human
aggcccuggccuccccugccac

SEQ ID NO: 2519668 - RNA, 21 nt, Human
aggcccuggccuccccugcca

SEQ ID NO: 2519669 - RNA, 12 nt, Human
aggcccuucucu

SEQ ID NO: 2519670 - RNA, 22 nt, Human
aggcccuuccucuccacugccu

SEQ ID NO: 2519671 - RNA, 21 nt, Human
aggccgcagcucuugcccuuc

SEQ ID NO: 2519672 - RNA, 19 nt, Human
aggcccuuccucuccacug

SEQ ID NO: 2519673 - RNA, 22 nt, Human
aggccgcagcucuugcccuucc

SEQ ID NO: 2519674 - RNA, 14 nt, Human
aggccgccccagcc

SEQ ID NO: 2519675 - RNA, 19 nt, Human
aggccgccccagccucuga

SEQ ID NO: 2519676 - RNA, 17 nt, Human
aggccgcuagaggccug

SEQ ID NO: 2519677 - RNA, 14 nt, Human
aggccgcuagaggc

SEQ ID NO: 2519678 - RNA, 18 nt, Human
aggccgccccagccucug

SEQ ID NO: 2519679 - RNA, 19 nt, Human
aggccggcgagcccugugg

SEQ ID NO: 2519680 - RNA, 20 nt, Human
aggccgcuguucacccacag

SEQ ID NO: 2519681 - RNA, 20 nt, Human
aggccgcuagaggccugagg

SEQ ID NO: 2519682 - RNA, 18 nt, Human
aggccgcuagaggccuga

SEQ ID NO: 2519683 - RNA, 21 nt, Human
aggccgcuagaggccugagga

SEQ ID NO: 2519684 - RNA, 17 nt, Human
aggccgcuguucaccca

SEQ ID NO: 2519685 - RNA, 20 nt, Human
aggcauuccccaggaggcca

SEQ ID NO: 2519686 - RNA, 19 nt, Human
aggcauuccccaggaggcc

SEQ ID NO: 2519687 - RNA, 23 nt, Human
aggccagcugcuugggcuucauc

SEQ ID NO: 2519688 - RNA, 14 nt, Human
aggcauguccugga

SEQ ID NO: 2519689 - RNA, 14 nt, Human
aggccagcuggcag

SEQ ID NO: 2519690 - RNA, 15 nt, Human
aggccagcuggcagc

SEQ ID NO: 2519691 - RNA, 16 nt, Human
aggccagcuggcagca

SEQ ID NO: 2519692 - RNA, 17 nt, Human
aggccagcuggcagcag

SEQ ID NO: 2519693 - RNA, 18 nt, Human
aggccagcuggcagcaga

SEQ ID NO: 2519694 - RNA, 19 nt, Human
aggccagcuggcagcagag

SEQ ID NO: 2519695 - RNA, 20 nt, Human
aggccagcuggcagcagagu

SEQ ID NO: 2519696 - RNA, 14 nt, Human
aggccaggcccucu

SEQ ID NO: 2519697 - RNA, 13 nt, Human
aggccaggcccuc

SEQ ID NO: 2519698 - RNA, 11 nt, Human
aggccaggagu

SEQ ID NO: 2519699 - RNA, 18 nt, Human
aggccaggccaccaggau

SEQ ID NO: 2519700 - RNA, 17 nt, Human
aggccaggccaccagga

SEQ ID NO: 2519701 - RNA, 16 nt, Human
aggccaggccaccagg

SEQ ID NO: 2519702 - RNA, 14 nt, Human
aggccaggccacca

SEQ ID NO: 2519703 - RNA, 21 nt, Human
aggccaggaguuugagaccag

SEQ ID NO: 2519704 - RNA, 16 nt, Human
aggccauggagagcug

SEQ ID NO: 2519705 - RNA, 22 nt, Human
aggccauggagagcuggagccu

SEQ ID NO: 2519706 - RNA, 21 nt, Human
aggccauggagagcuggagcc

SEQ ID NO: 2519707 - RNA, 18 nt, Human
aggccauggagagcugga

SEQ ID NO: 2519708 - RNA, 17 nt, Human
aggccauggagagcugg

SEQ ID NO: 2519709 - RNA, 15 nt, Human
aggccauggcagaau

SEQ ID NO: 2519710 - RNA, 21 nt, Human
aggccaucugggcuccuccag

SEQ ID NO: 2519711 - RNA, 22 nt, Human
aggccaucugggcuccuccagg

SEQ ID NO: 2519712 - RNA, 19 nt, Human
aggccaucuuccagguggg

SEQ ID NO: 2519713 - RNA, 18 nt, Human
aggccaucuuccaggugg

SEQ ID NO: 2519714 - RNA, 15 nt, Human
aggccaucuuccagg

SEQ ID NO: 2519715 - RNA, 19 nt, Human
aggccaugaaaaaaaugau

SEQ ID NO: 2519716 - RNA, 13 nt, Human
aggccaugaaaaa

SEQ ID NO: 2519717 - RNA, 19 nt, Human
aggccaugauucgcccaaa

SEQ ID NO: 2519718 - RNA, 21 nt, Human
aggccaugauucgcccaaagc

SEQ ID NO: 2519719 - RNA, 14 nt, Human
aggccaggugcagu

SEQ ID NO: 2519720 - RNA, 15 nt, Human
aggccaggugcaggu

SEQ ID NO: 2519721 - RNA, 21 nt, Human
aggccaguaagggaaauagaa

SEQ ID NO: 2519722 - RNA, 19 nt, Human
aggccaggccaccaggaug

SEQ ID NO: 2519723 - RNA, 21 nt, Human
aggccaucaucaguggagcca

SEQ ID NO: 2519724 - RNA, 16 nt, Human
aggccauaaaacaggu

SEQ ID NO: 2519725 - RNA, 21 nt, Human
aggccauccuucccugucugc

SEQ ID NO: 2519726 - RNA, 15 nt, Human
aggccaggcccucug

SEQ ID NO: 2519727 - RNA, 13 nt, Human
aggccaggccagc

SEQ ID NO: 2519728 - RNA, 15 nt, Human
aggccaggccagcug

SEQ ID NO: 2519729 - RNA, 23 nt, Human
aggccagggucacugaaggccug

SEQ ID NO: 2519730 - RNA, 20 nt, Human
agggucucacuauguugccc

SEQ ID NO: 2519731 - RNA, 15 nt, Human
agggucuagggagag

SEQ ID NO: 2519732 - RNA, 16 nt, Human
agggucuagggagaga

SEQ ID NO: 2519733 - RNA, 19 nt, Human
agggucuagggagagaccc

SEQ ID NO: 2519734 - RNA, 23 nt, Human
agggucuagggagagacccuugu

SEQ ID NO: 2519735 - RNA, 23 nt, Human
aggguuuugccauguuggccagg

SEQ ID NO: 2519736 - RNA, 15 nt, Human
aggguuuuccacccu

SEQ ID NO: 2519737 - RNA, 18 nt, Human
aggguuuuccacccugga

SEQ ID NO: 2519738 - RNA, 23 nt, Human
agguaacagaacagcuucagguu

SEQ ID NO: 2519739 - RNA, 22 nt, Human
agguaacagaacagcuucaggu

SEQ ID NO: 2519740 - RNA, 19 nt, Human
aggguuuuccacccuggaa

SEQ ID NO: 2519741 - RNA, 22 nt, Human
aggguuuugccauguuggccag

SEQ ID NO: 2519742 - RNA, 17 nt, Human
aggguuuuaauguagau

SEQ ID NO: 2519743 - RNA, 16 nt, Human
aggguuuuaauguaga

SEQ ID NO: 2519744 - RNA, 14 nt, Human
aggguuuguggcug

SEQ ID NO: 2519745 - RNA, 14 nt, Human
agguaacaggcaga

SEQ ID NO: 2519746 - RNA, 13 nt, Human
agguaacaggcag

SEQ ID NO: 2519747 - RNA, 22 nt, Human
agguacgaaaagaggggaagag

SEQ ID NO: 2519748 - RNA, 16 nt, Human
agguaacaggcagaua

SEQ ID NO: 2519749 - RNA, 13 nt, Human
agguacucuccug

SEQ ID NO: 2519750 - RNA, 14 nt, Human
agguacucuccugg

SEQ ID NO: 2519751 - RNA, 12 nt, Human
agguacuauuau

SEQ ID NO: 2519752 - RNA, 14 nt, Human
aggucccuuguuuc

SEQ ID NO: 2519753 - RNA, 23 nt, Human
aggucccuaauaaagcugugugg

SEQ ID NO: 2519754 - RNA, 15 nt, Human
agguacuaaauaccu

SEQ ID NO: 2519755 - RNA, 23 nt, Human
agguccucugucagucacagcca

SEQ ID NO: 2519756 - RNA, 22 nt, Human
aggucuaggaacauacuucagc

SEQ ID NO: 2519757 - RNA, 17 nt, Human
aggucggaggcuuggga

SEQ ID NO: 2519758 - RNA, 22 nt, Human
aggucgguagguucagccaagg

SEQ ID NO: 2519759 - RNA, 14 nt, Human
agguccucugucag

SEQ ID NO: 2519760 - RNA, 19 nt, Human
agguccucugucagucaca

SEQ ID NO: 2519761 - RNA, 13 nt, Human
agguccucuguca

SEQ ID NO: 2519762 - RNA, 20 nt, Human
agguccucugauacccagag

SEQ ID NO: 2519763 - RNA, 15 nt, Human
agguccucagagaau

SEQ ID NO: 2519764 - RNA, 21 nt, Human
agguccucuacuuaaugagau

SEQ ID NO: 2519765 - RNA, 23 nt, Human
aggucuccuccaccgccauggcu

SEQ ID NO: 2519766 - RNA, 18 nt, Human
aggucuccuccaccgcca

SEQ ID NO: 2519767 - RNA, 11 nt, Human
aggucuccucu

SEQ ID NO: 2519768 - RNA, 12 nt, Human
aggucuccucuu

SEQ ID NO: 2519769 - RNA, 13 nt, Human
aggucuccucuua

SEQ ID NO: 2519770 - RNA, 14 nt, Human
aggucuccucuuaa

SEQ ID NO: 2519771 - RNA, 15 nt, Human
aggucuccucuuaaa

SEQ ID NO: 2519772 - RNA, 17 nt, Human
aggucuccucuuaaaaa

SEQ ID NO: 2519773 - RNA, 16 nt, Human
aggucuggcugcuugc

SEQ ID NO: 2519774 - RNA, 16 nt, Human
aggucuggccucaggu

SEQ ID NO: 2519775 - RNA, 23 nt, Human
aggucuggagaagcucccaggaa

SEQ ID NO: 2519776 - RNA, 23 nt, Human
aggucuccucuuaaaaaauaaaa

SEQ ID NO: 2519777 - RNA, 14 nt, Human
aggucugugcugag

SEQ ID NO: 2519778 - RNA, 11 nt, Human
aggucugugcu

SEQ ID NO: 2519779 - RNA, 15 nt, Human
aggucuccuccaccg

SEQ ID NO: 2519780 - RNA, 13 nt, Human
aggucuccuccac

SEQ ID NO: 2519781 - RNA, 12 nt, Human
aggucuccucca

SEQ ID NO: 2519782 - RNA, 17 nt, Human
aggucucccacguggga

SEQ ID NO: 2519783 - RNA, 13 nt, Human
aggucucacgggc

SEQ ID NO: 2519784 - RNA, 22 nt, Human
aggucucaacccuuuugucugc

SEQ ID NO: 2519785 - RNA, 16 nt, Human
agggauacccauccca

SEQ ID NO: 2519786 - RNA, 21 nt, Human
agggaucaaccagcuaagaaa

SEQ ID NO: 2519787 - RNA, 17 nt, Human
agggauagcacugagca

SEQ ID NO: 2519788 - RNA, 18 nt, Human
agggauauauaagaugga

SEQ ID NO: 2519789 - RNA, 13 nt, Human
agggauagagggg

SEQ ID NO: 2519790 - RNA, 16 nt, Human
agggauagaggggggc

SEQ ID NO: 2519791 - RNA, 22 nt, Human
agggauagcacugagcaaagca

SEQ ID NO: 2519792 - RNA, 13 nt, Human
agggacuuaaaaa

SEQ ID NO: 2519793 - RNA, 17 nt, Human
agggacuuaaaaaacuu

SEQ ID NO: 2519794 - RNA, 12 nt, Human
agggacuuaaaa

SEQ ID NO: 2519795 - RNA, 16 nt, Human
agggaugguguucaaa

SEQ ID NO: 2519796 - RNA, 23 nt, Human
agggaugugaauugccugcagag

SEQ ID NO: 2519797 - RNA, 22 nt, Human
agggaugugaauugccugcaga

SEQ ID NO: 2519798 - RNA, 18 nt, Human
agggauuaaccucugcac

SEQ ID NO: 2519799 - RNA, 17 nt, Human
agggauuaaccucugca

SEQ ID NO: 2519800 - RNA, 18 nt, Human
agggauguucuggcccuc

SEQ ID NO: 2519801 - RNA, 16 nt, Human
agggaucccucaucug

SEQ ID NO: 2519802 - RNA, 19 nt, Human
agggaucccucaucugucc

SEQ ID NO: 2519803 - RNA, 14 nt, Human
agggaugguguuca

SEQ ID NO: 2519804 - RNA, 22 nt, Human
agggaucaaccagcuaagaaaa

SEQ ID NO: 2519805 - RNA, 13 nt, Human
agggaucacaggg

SEQ ID NO: 2519806 - RNA, 14 nt, Human
agggaucacagggc

SEQ ID NO: 2519807 - RNA, 15 nt, Human
agggaucacagggcc

SEQ ID NO: 2519808 - RNA, 15 nt, Human
agggaucccucaucu

SEQ ID NO: 2519809 - RNA, 17 nt, Human
agggaucacagggcccc

SEQ ID NO: 2519810 - RNA, 22 nt, Human
agggaucacagggccccagaag

SEQ ID NO: 2519811 - RNA, 18 nt, Human
agggauuacccaagcaaa

SEQ ID NO: 2519812 - RNA, 17 nt, Human
agggauuacccaagcaa

SEQ ID NO: 2519813 - RNA, 19 nt, Human
agggauuaaccucugcacu

SEQ ID NO: 2519814 - RNA, 19 nt, Human
agggauuuuagucacacgu

SEQ ID NO: 2519815 - RNA, 19 nt, Human
agggauuacccaagcaaaa

SEQ ID NO: 2519816 - RNA, 15 nt, Human
agggauuagggagag

SEQ ID NO: 2519817 - RNA, 20 nt, Human
agggcaacaauaaaauagca

SEQ ID NO: 2519818 - RNA, 22 nt, Human
agggcaacaauacaugcugcua

SEQ ID NO: 2519819 - RNA, 13 nt, Human
agggcaagggcca

SEQ ID NO: 2519820 - RNA, 18 nt, Human
agggccugagccuggcca

SEQ ID NO: 2519821 - RNA, 20 nt, Human
agggccugagccuggccagc

SEQ ID NO: 2519822 - RNA, 22 nt, Human
agggccugaggucuggcugcuu

SEQ ID NO: 2519823 - RNA, 21 nt, Human
agggccugaggucuggcugcu

SEQ ID NO: 2519824 - RNA, 16 nt, Human
agggccugaggucugg

SEQ ID NO: 2519825 - RNA, 14 nt, Human
agggcaagggccau

SEQ ID NO: 2519826 - RNA, 22 nt, Human
agggccugagccuggccagccu

SEQ ID NO: 2519827 - RNA, 14 nt, Human
agggccugcaaggg

SEQ ID NO: 2519828 - RNA, 13 nt, Human
agggccuggccug

SEQ ID NO: 2519829 - RNA, 12 nt, Human
agggccuggccu

SEQ ID NO: 2519830 - RNA, 15 nt, Human
agggccugcaaggga

SEQ ID NO: 2519831 - RNA, 20 nt, Human
agggccugcaggaccugccu

SEQ ID NO: 2519832 - RNA, 22 nt, Human
agggccugcaggaccugccugu

SEQ ID NO: 2519833 - RNA, 23 nt, Human
agggccugcaggaccugccugua

SEQ ID NO: 2519834 - RNA, 14 nt, Human
aggggcccacaggg

SEQ ID NO: 2519835 - RNA, 22 nt, Human
aggggcccaaggcggccccucc

SEQ ID NO: 2519836 - RNA, 20 nt, Human
aggggcccaaggcggccccu

SEQ ID NO: 2519837 - RNA, 17 nt, Human
aggggcccaaggcggcc

SEQ ID NO: 2519838 - RNA, 21 nt, Human
aggggcccacagggaacccug

SEQ ID NO: 2519839 - RNA, 19 nt, Human
aggggcccacagggaaccc

SEQ ID NO: 2519840 - RNA, 19 nt, Human
aggggcccaguccuggccu

SEQ ID NO: 2519841 - RNA, 22 nt, Human
aggggcccaaauucuuucagug

SEQ ID NO: 2519842 - RNA, 20 nt, Human
aggggcagucuggaggggca

SEQ ID NO: 2519843 - RNA, 15 nt, Human
aggggcaucugcccc

SEQ ID NO: 2519844 - RNA, 17 nt, Human
aggggcagucuggaggg

SEQ ID NO: 2519845 - RNA, 18 nt, Human
aggggcagucuggagggg

SEQ ID NO: 2519846 - RNA, 14 nt, Human
aggggcaucugccc

SEQ ID NO: 2519847 - RNA, 12 nt, Human
aggggcaggcug

SEQ ID NO: 2519848 - RNA, 23 nt, Human
aggggcaggcccugcacuguccu

SEQ ID NO: 2519849 - RNA, 19 nt, Human
aggggcaggcccugcacug

SEQ ID NO: 2519850 - RNA, 15 nt, Human
aggggcaggcccugc

SEQ ID NO: 2519851 - RNA, 23 nt, Human
aggggcagguaaacuccuguccu

SEQ ID NO: 2519852 - RNA, 13 nt, Human
aggggcaggcuga

SEQ ID NO: 2519853 - RNA, 15 nt, Human
aggggcagucuggag

SEQ ID NO: 2519854 - RNA, 16 nt, Human
aggggcagucuggagg

SEQ ID NO: 2519855 - RNA, 15 nt, Human
aggggcccgcuugcc

SEQ ID NO: 2519856 - RNA, 14 nt, Human
aggggccuggagau

SEQ ID NO: 2519857 - RNA, 13 nt, Human
aggggccuggaga

SEQ ID NO: 2519858 - RNA, 16 nt, Human
aggggccccuccagcu

SEQ ID NO: 2519859 - RNA, 20 nt, Human
aggggccccguguccugccu

SEQ ID NO: 2519860 - RNA, 18 nt, Human
aggggccccguguccugc

SEQ ID NO: 2519861 - RNA, 17 nt, Human
aggggccccguguccug

SEQ ID NO: 2519862 - RNA, 13 nt, Human
aggggccccugcu

SEQ ID NO: 2519863 - RNA, 20 nt, Human
aggggccccugcuucuccag

SEQ ID NO: 2519864 - RNA, 16 nt, Human
aggggccccugcuucu

SEQ ID NO: 2519865 - RNA, 21 nt, Human
aggggccccugcuucuccagc

SEQ ID NO: 2519866 - RNA, 21 nt, Human
aggggcccgagcagaagcagg

SEQ ID NO: 2519867 - RNA, 19 nt, Human
agggccuggaagacagaga

SEQ ID NO: 2519868 - RNA, 14 nt, Human
agggccuggccuga

SEQ ID NO: 2519869 - RNA, 22 nt, Human
agggccuggguuuucauguuuu

SEQ ID NO: 2519870 - RNA, 21 nt, Human
agggccuggucccugggagga

SEQ ID NO: 2519871 - RNA, 12 nt, Human
agggccuguggg

SEQ ID NO: 2519872 - RNA, 17 nt, Human
agggccuggucccuggg

SEQ ID NO: 2519873 - RNA, 19 nt, Human
agggccugugggagccugc

SEQ ID NO: 2519874 - RNA, 18 nt, Human
agggccugugggagccug

SEQ ID NO: 2519875 - RNA, 12 nt, Human
agggccuugccc

SEQ ID NO: 2519876 - RNA, 14 nt, Human
agggccuugcccag

SEQ ID NO: 2519877 - RNA, 15 nt, Human
agggccuugcccaga

SEQ ID NO: 2519878 - RNA, 16 nt, Human
agggccuugcccagag

SEQ ID NO: 2519879 - RNA, 17 nt, Human
agggccuugcccagaga

SEQ ID NO: 2519880 - RNA, 12 nt, Human
aggggcaggagg

SEQ ID NO: 2519881 - RNA, 13 nt, Human
aggggcaggagga

SEQ ID NO: 2519882 - RNA, 17 nt, Human
aggggcaggcacagcac

SEQ ID NO: 2519883 - RNA, 16 nt, Human
aggggcaggcacagca

SEQ ID NO: 2519884 - RNA, 14 nt, Human
aggggcaggcacag

SEQ ID NO: 2519885 - RNA, 13 nt, Human
aggggcaggcaca

SEQ ID NO: 2519886 - RNA, 18 nt, Human
aggggcaggaggaagggg

SEQ ID NO: 2519887 - RNA, 23 nt, Human
agggcgaggggaggguggcaggu

SEQ ID NO: 2519888 - RNA, 13 nt, Human
agggcgaggggag

SEQ ID NO: 2519889 - RNA, 15 nt, Human
aggggcagcuucuau

SEQ ID NO: 2519890 - RNA, 18 nt, Human
agggccuugcccagagau

SEQ ID NO: 2519891 - RNA, 19 nt, Human
agggccuugcccagagaug

SEQ ID NO: 2519892 - RNA, 13 nt, Human
agggcgagacucc

SEQ ID NO: 2519893 - RNA, 21 nt, Human
agggcgaccccgucacagccu

SEQ ID NO: 2519894 - RNA, 23 nt, Human
agggccuugcccagagaugccuc

SEQ ID NO: 2519895 - RNA, 20 nt, Human
agggcgaacgacaauagcuu

SEQ ID NO: 2519896 - RNA, 22 nt, Human
agggucccugguggcagcucac

SEQ ID NO: 2519897 - RNA, 20 nt, Human
agggucccugguggcagcuc

SEQ ID NO: 2519898 - RNA, 17 nt, Human
agggucccugguggcag

SEQ ID NO: 2519899 - RNA, 16 nt, Human
agggucccugguggca

SEQ ID NO: 2519900 - RNA, 20 nt, Human
aggguccuuuaguaccugaa

SEQ ID NO: 2519901 - RNA, 17 nt, Human
agggucggaacccaagc

SEQ ID NO: 2519902 - RNA, 23 nt, Human
agggucggggaggaaauaccaaa

SEQ ID NO: 2519903 - RNA, 22 nt, Human
agggucggaacccaagcuuaga

SEQ ID NO: 2519904 - RNA, 15 nt, Human
aggguccuccacaau

SEQ ID NO: 2519905 - RNA, 14 nt, Human
aggguccuggcucc

SEQ ID NO: 2519906 - RNA, 18 nt, Human
aggguccuuuaguaccug

SEQ ID NO: 2519907 - RNA, 22 nt, Human
aggguccuucccucuccccaag

SEQ ID NO: 2519908 - RNA, 16 nt, Human
aggguccuggcuccug

SEQ ID NO: 2519909 - RNA, 21 nt, Human
aggggccuggagauccuccug

SEQ ID NO: 2519910 - RNA, 18 nt, Human
aggggccuggagauccuc

SEQ ID NO: 2519911 - RNA, 12 nt, Human
aggggccuggca

SEQ ID NO: 2519912 - RNA, 13 nt, Human
aggggccuggcag

SEQ ID NO: 2519913 - RNA, 21 nt, Human
aggguaucuggugacuuuccu

SEQ ID NO: 2519914 - RNA, 13 nt, Human
aggguauuccaga

SEQ ID NO: 2519915 - RNA, 14 nt, Human
agggucccuggugg

SEQ ID NO: 2519916 - RNA, 12 nt, Human
agggucccuggu

SEQ ID NO: 2519917 - RNA, 22 nt, Human
aggggccuggagauccuccugc

SEQ ID NO: 2519918 - RNA, 21 nt, Human
aggguauggacuaucugucug

SEQ ID NO: 2519919 - RNA, 20 nt, Human
agggucaacaucuuuuacau

SEQ ID NO: 2519920 - RNA, 19 nt, Human
agggucagacgccugagga

SEQ ID NO: 2519921 - RNA, 18 nt, Human
aggaauaugggagaaaua

SEQ ID NO: 2519922 - RNA, 23 nt, Human
aggaauauauggcagaguuguaa

SEQ ID NO: 2519923 - RNA, 22 nt, Human
aggaauaugacggaagaacaua

SEQ ID NO: 2519924 - RNA, 21 nt, Human
aggaauaguugagccccaagu

SEQ ID NO: 2519925 - RNA, 17 nt, Human
aggaauaguugagcccc

SEQ ID NO: 2519926 - RNA, 17 nt, Human
aggaauauauggcagag

SEQ ID NO: 2519927 - RNA, 12 nt, Human
aggaauauaugg

SEQ ID NO: 2519928 - RNA, 20 nt, Human
aggaauaugacggaagaaca

SEQ ID NO: 2519929 - RNA, 18 nt, Human
aggaaucacucuugugga

SEQ ID NO: 2519930 - RNA, 16 nt, Human
aggaaucacucuugug

SEQ ID NO: 2519931 - RNA, 21 nt, Human
aggaaucaagagcugcccucc

SEQ ID NO: 2519932 - RNA, 15 nt, Human
aggaaucacucuugu

SEQ ID NO: 2519933 - RNA, 20 nt, Human
aggaaucaagagcugcccuc

SEQ ID NO: 2519934 - RNA, 19 nt, Human
aggaaucaagagcugcccu

SEQ ID NO: 2519935 - RNA, 17 nt, Human
aggaaucaagagcugcc

SEQ ID NO: 2519936 - RNA, 16 nt, Human
aggaauauuuuccaaa

SEQ ID NO: 2519937 - RNA, 15 nt, Human
aggaauauuuuccaa

SEQ ID NO: 2519938 - RNA, 20 nt, Human
aggaauauuuuccaaagagu

SEQ ID NO: 2519939 - RNA, 16 nt, Human
aggaaucaagagcugc

SEQ ID NO: 2519940 - RNA, 22 nt, Human
aggaaucaugucaggccugugu

SEQ ID NO: 2519941 - RNA, 21 nt, Human
aggaaucaugucaggccugug

SEQ ID NO: 2519942 - RNA, 22 nt, Human
aggaaucagcaagaagauccua

SEQ ID NO: 2519943 - RNA, 15 nt, Human
aggaaucagacuuca

SEQ ID NO: 2519944 - RNA, 24 nt, Human
aggaccagcucaggacagaugcca

SEQ ID NO: 2519945 - RNA, 15 nt, Human
aggaccagcuggggc

SEQ ID NO: 2519946 - RNA, 14 nt, Human
aggaccagcugggg

SEQ ID NO: 2519947 - RNA, 13 nt, Human
aggaccagcuggg

SEQ ID NO: 2519948 - RNA, 23 nt, Human
aggaccagcucaggacagaugcc

SEQ ID NO: 2519949 - RNA, 22 nt, Human
aggaccaggacuauagcccagg

SEQ ID NO: 2519950 - RNA, 19 nt, Human
aggaccagcuggggcgugg

SEQ ID NO: 2519951 - RNA, 12 nt, Human
aggaccaggacu

SEQ ID NO: 2519952 - RNA, 20 nt, Human
aggaccagucaaccugggca

SEQ ID NO: 2519953 - RNA, 19 nt, Human
aggaccagucaaccugggc

SEQ ID NO: 2519954 - RNA, 20 nt, Human
aggacccggaggggccuggc

SEQ ID NO: 2519955 - RNA, 18 nt, Human
aggacccggaggggccug

SEQ ID NO: 2519956 - RNA, 13 nt, Human
aggaccaggacuc

SEQ ID NO: 2519957 - RNA, 16 nt, Human
aggaccaggacucccu

SEQ ID NO: 2519958 - RNA, 17 nt, Human
aggaccaggacucccuc

SEQ ID NO: 2519959 - RNA, 18 nt, Human
aggaccaggacucccucc

SEQ ID NO: 2519960 - RNA, 18 nt, Human
aggaccagggcagggcca

SEQ ID NO: 2519961 - RNA, 13 nt, Human
aggaccaggcaau

SEQ ID NO: 2519962 - RNA, 23 nt, Human
aggaccaggacuauagcccaggu

SEQ ID NO: 2519963 - RNA, 19 nt, Human
aggaccaggacucccuccu

SEQ ID NO: 2519964 - RNA, 21 nt, Human
aggaccaggacucccuccuca

SEQ ID NO: 2519965 - RNA, 22 nt, Human
aggacccggaggggccuggcag

SEQ ID NO: 2519966 - RNA, 21 nt, Human
aggacccggaggggccuggca

SEQ ID NO: 2519967 - RNA, 15 nt, Human
aggacccugaagggg

SEQ ID NO: 2519968 - RNA, 19 nt, Human
aggacccugaaggggccau

SEQ ID NO: 2519969 - RNA, 17 nt, Human
aggagaggaugagagcc

SEQ ID NO: 2519970 - RNA, 15 nt, Human
aggagaggaugagag

SEQ ID NO: 2519971 - RNA, 13 nt, Human
aggagaggaugag

SEQ ID NO: 2519972 - RNA, 18 nt, Human
aggagagaggcagagagc

SEQ ID NO: 2519973 - RNA, 14 nt, Human
aggagagaggcaga

SEQ ID NO: 2519974 - RNA, 13 nt, Human
aggagagaggcag

SEQ ID NO: 2519975 - RNA, 10 nt, Human
aggagagagg

SEQ ID NO: 2519976 - RNA, 20 nt, Human
aggagagagcagcuucugcc

SEQ ID NO: 2519977 - RNA, 15 nt, Human
aggagaggagagggg

SEQ ID NO: 2519978 - RNA, 11 nt, Human
aggagagaccg

SEQ ID NO: 2519979 - RNA, 15 nt, Human
aggagagaagaauga

SEQ ID NO: 2519980 - RNA, 17 nt, Human
aggagagaaggggagga

SEQ ID NO: 2519981 - RNA, 11 nt, Human
aggagagagaa

SEQ ID NO: 2519982 - RNA, 21 nt, Human
aggagagaaggggaggagggc

SEQ ID NO: 2519983 - RNA, 19 nt, Human
aggagagagaaagccaggc

SEQ ID NO: 2519984 - RNA, 18 nt, Human
aggagagagaaagccagg

SEQ ID NO: 2519985 - RNA, 14 nt, Human
aggagagagaaagc

SEQ ID NO: 2519986 - RNA, 12 nt, Human
aggagagagaaa

SEQ ID NO: 2519987 - RNA, 22 nt, Human
aggagagagaaagccaggcagg

SEQ ID NO: 2519988 - RNA, 21 nt, Human
aggagagagaaagccaggcag

SEQ ID NO: 2519989 - RNA, 17 nt, Human
aggagagagcagcuucu

SEQ ID NO: 2519990 - RNA, 19 nt, Human
aggaccugggaccuccccu

SEQ ID NO: 2519991 - RNA, 13 nt, Human
aggaccuggcugc

SEQ ID NO: 2519992 - RNA, 16 nt, Human
aggaccuggcugccau

SEQ ID NO: 2519993 - RNA, 13 nt, Human
aggaccugccugu

SEQ ID NO: 2519994 - RNA, 14 nt, Human
aggaccugccugua

SEQ ID NO: 2519995 - RNA, 14 nt, Human
aggagagaagaaug

SEQ ID NO: 2519996 - RNA, 13 nt, Human
aggagagaagaau

SEQ ID NO: 2519997 - RNA, 12 nt, Human
aggagagaagaa

SEQ ID NO: 2519998 - RNA, 17 nt, Human
aggaccuggcugccaua

SEQ ID NO: 2519999 - RNA, 16 nt, Human
aggaccuguggccaag

SEQ ID NO: 2520000 - RNA, 20 nt, Human
aggaagggcauccuucugcc

SEQ ID NO: 2520001 - RNA, 18 nt, Human
aggaagggcauccuucug

SEQ ID NO: 2520002 - RNA, 16 nt, Human
aggaaggggccagagg

SEQ ID NO: 2520003 - RNA, 18 nt, Human
aggaaggggccagaggcu

SEQ ID NO: 2520004 - RNA, 20 nt, Human
aggaaggggccagaggcucg

SEQ ID NO: 2520005 - RNA, 15 nt, Human
aggaaguaggaagua

SEQ ID NO: 2520006 - RNA, 18 nt, Human
aggaagucaaagcaagga

SEQ ID NO: 2520007 - RNA, 14 nt, Human
aggaaguaggaagu

SEQ ID NO: 2520008 - RNA, 17 nt, Human
aggaagucuaggagcug

SEQ ID NO: 2520009 - RNA, 18 nt, Human
aggaagucuaggagcugg

SEQ ID NO: 2520010 - RNA, 17 nt, Human
aggaagugaaaauaggu

SEQ ID NO: 2520011 - RNA, 19 nt, Human
aggaacuguccagagagca

SEQ ID NO: 2520012 - RNA, 18 nt, Human
aggaacuguccagagagc

SEQ ID NO: 2520013 - RNA, 20 nt, Human
aggaacuguccagagagcaa

SEQ ID NO: 2520014 - RNA, 23 nt, Human
aggaagggaccaaggcaaggcag

SEQ ID NO: 2520015 - RNA, 17 nt, Human
aggaagggaccaaggca

SEQ ID NO: 2520016 - RNA, 16 nt, Human
aggaagggaccaaggc

SEQ ID NO: 2520017 - RNA, 12 nt, Human
aggaagggcaaa

SEQ ID NO: 2520018 - RNA, 17 nt, Human
aggaagggcaggaagga

SEQ ID NO: 2520019 - RNA, 17 nt, Human
aggaacuguccagagag

SEQ ID NO: 2520020 - RNA, 16 nt, Human
aggaacuguccagaga

SEQ ID NO: 2520021 - RNA, 15 nt, Human
aggaacuguccagag

SEQ ID NO: 2520022 - RNA, 22 nt, Human
aggaaggcugagaggagagaga

SEQ ID NO: 2520023 - RNA, 15 nt, Human
aggaaggcugagagg

SEQ ID NO: 2520024 - RNA, 18 nt, Human
aggaauaccugucccccu

SEQ ID NO: 2520025 - RNA, 15 nt, Human
aggaauaccuguccc

SEQ ID NO: 2520026 - RNA, 17 nt, Human
aggaauaauuauuuauu

SEQ ID NO: 2520027 - RNA, 16 nt, Human
aggaauaauuauuuau

SEQ ID NO: 2520028 - RNA, 23 nt, Human
aggaauaaugggcuuagagcagu

SEQ ID NO: 2520029 - RNA, 15 nt, Human
aggaauaaugggcuu

SEQ ID NO: 2520030 - RNA, 22 nt, Human
aggaauaauuauuuauuuaaua

SEQ ID NO: 2520031 - RNA, 18 nt, Human
aggaauaauuauuuauuu

SEQ ID NO: 2520032 - RNA, 22 nt, Human
aggaauaccugucccccugaca

SEQ ID NO: 2520033 - RNA, 14 nt, Human
aggaagugaagaau

SEQ ID NO: 2520034 - RNA, 16 nt, Human
aggaaguguaacagcu

SEQ ID NO: 2520035 - RNA, 18 nt, Human
aggaaguguaacagcuga

SEQ ID NO: 2520036 - RNA, 17 nt, Human
aggaaguguaacagcug

SEQ ID NO: 2520037 - RNA, 19 nt, Human
aggaauaaauugcuccuug

SEQ ID NO: 2520038 - RNA, 13 nt, Human
aggaauaaauaaa

SEQ ID NO: 2520039 - RNA, 19 nt, Human
aggaauaaauaaaaaugga

SEQ ID NO: 2520040 - RNA, 20 nt, Human
aggaauaaauugcuccuuga

SEQ ID NO: 2520041 - RNA, 14 nt, Human
aggaauaaggccuu

SEQ ID NO: 2520042 - RNA, 21 nt, Human
aggaauaaauaaaaauggaua

SEQ ID NO: 2520043 - RNA, 13 nt, Human
aggaaccaaagcg

SEQ ID NO: 2520044 - RNA, 15 nt, Human
aggaaccaaagcgaa

SEQ ID NO: 2520045 - RNA, 15 nt, Human
aggaaccacaccaca

SEQ ID NO: 2520046 - RNA, 17 nt, Human
aggaaccacaccacauc

SEQ ID NO: 2520047 - RNA, 16 nt, Human
aggaaccauaaucaau

SEQ ID NO: 2520048 - RNA, 19 nt, Human
aggaacauaugaaaauaca

SEQ ID NO: 2520049 - RNA, 20 nt, Human
aggaacaaggcaaggcuguc

SEQ ID NO: 2520050 - RNA, 19 nt, Human
aggaacccuuacaguagga

SEQ ID NO: 2520051 - RNA, 21 nt, Human
aggaacuuaaauaaugugaaa

SEQ ID NO: 2520052 - RNA, 22 nt, Human
aggaacugcugggcuuggcagc

SEQ ID NO: 2520053 - RNA, 19 nt, Human
aggaaccuccuccacacca

SEQ ID NO: 2520054 - RNA, 19 nt, Human
aggaacaaggcaaggcugu

SEQ ID NO: 2520055 - RNA, 17 nt, Human
aggaacaaggcaaggcu

SEQ ID NO: 2520056 - RNA, 16 nt, Human
aggaacaaggcaaggc

SEQ ID NO: 2520057 - RNA, 13 nt, Human
aggaacaaggcaa

SEQ ID NO: 2520058 - RNA, 12 nt, Human
aggaacaaggca

SEQ ID NO: 2520059 - RNA, 23 nt, Human
aggaaauugagauuagagggagg

SEQ ID NO: 2520060 - RNA, 15 nt, Human
agcuuuuaugugaaa

SEQ ID NO: 2520061 - RNA, 17 nt, Human
agcuguaaaccagagag

SEQ ID NO: 2520062 - RNA, 17 nt, Human
agcuguaagaagagacu

SEQ ID NO: 2520063 - RNA, 16 nt, Human
agcuguaaaccagaga

SEQ ID NO: 2520064 - RNA, 14 nt, Human
agcuguaaaccaga

SEQ ID NO: 2520065 - RNA, 19 nt, Human
agcuguaaaaagagagaaa

SEQ ID NO: 2520066 - RNA, 15 nt, Human
agcuguaaaaagaga

SEQ ID NO: 2520067 - RNA, 22 nt, Human
agcugguuuccucauuccugaa

SEQ ID NO: 2520068 - RNA, 19 nt, Human
agcuucauuugugucaaug

SEQ ID NO: 2520069 - RNA, 17 nt, Human
agcuucauuugugucaa

SEQ ID NO: 2520070 - RNA, 13 nt, Human
agcuucauuugug

SEQ ID NO: 2520071 - RNA, 15 nt, Human
agcuucaccagagca

SEQ ID NO: 2520072 - RNA, 20 nt, Human
agcuucauuugugucaaugg

SEQ ID NO: 2520073 - RNA, 12 nt, Human
agcuucuccagg

SEQ ID NO: 2520074 - RNA, 19 nt, Human
agcuucauuuccugugucu

SEQ ID NO: 2520075 - RNA, 15 nt, Human
agcuucuccaggcuc

SEQ ID NO: 2520076 - RNA, 14 nt, Human
agcuucuccaggcu

SEQ ID NO: 2520077 - RNA, 23 nt, Human
agcuucuccaggcucuuuggggu

SEQ ID NO: 2520078 - RNA, 12 nt, Human
agcuucuccugu

SEQ ID NO: 2520079 - RNA, 16 nt, Human
agcuucuccuguguga

SEQ ID NO: 2520080 - RNA, 21 nt, Human
agcuucuccugugugauugac

SEQ ID NO: 2520081 - RNA, 13 nt, Human
agcuucucuguga

SEQ ID NO: 2520082 - RNA, 14 nt, Human
agcuucucugugaa

SEQ ID NO: 2520083 - RNA, 17 nt, Human
agcuucugcuuuucugc

SEQ ID NO: 2520084 - RNA, 12 nt, Human
agcuucugcuuu

SEQ ID NO: 2520085 - RNA, 16 nt, Human
agcuuuuaaacccuau

SEQ ID NO: 2520086 - RNA, 23 nt, Human
agcuuuguuuguugucagcugaa

SEQ ID NO: 2520087 - RNA, 19 nt, Human
agcuucugcuuuucugccc

SEQ ID NO: 2520088 - RNA, 18 nt, Human
agcuucugcugggcuggg

SEQ ID NO: 2520089 - RNA, 17 nt, Human
agcuucugcugggcugg

SEQ ID NO: 2520090 - RNA, 16 nt, Human
agcuucugcugggcug

SEQ ID NO: 2520091 - RNA, 15 nt, Human
agcuucugcugggcu

SEQ ID NO: 2520092 - RNA, 14 nt, Human
agcuucugcugggc

SEQ ID NO: 2520093 - RNA, 13 nt, Human
agcuucugcuggg

SEQ ID NO: 2520094 - RNA, 18 nt, Human
agcuucugaggcgcugcu

SEQ ID NO: 2520095 - RNA, 13 nt, Human
agcuucugccacu

SEQ ID NO: 2520096 - RNA, 12 nt, Human
agcuuauuuaau

SEQ ID NO: 2520097 - RNA, 18 nt, Human
agcuucauuuccuguguc

SEQ ID NO: 2520098 - RNA, 19 nt, Human
agcuucauggcagaaggca

SEQ ID NO: 2520099 - RNA, 21 nt, Human
agcuucaccccaaucccagcu

SEQ ID NO: 2520100 - RNA, 18 nt, Human
agcuucacuguaaaauaa

SEQ ID NO: 2520101 - RNA, 18 nt, Human
agcuucaccccaauccca

SEQ ID NO: 2520102 - RNA, 20 nt, Human
agcuucaccccaaucccagc

SEQ ID NO: 2520103 - RNA, 23 nt, Human
agccuggcucccacaggcagcuu

SEQ ID NO: 2520104 - RNA, 22 nt, Human
agccuggcucccacaggcagcu

SEQ ID NO: 2520105 - RNA, 21 nt, Human
agccuggcucccacaggcagc

SEQ ID NO: 2520106 - RNA, 20 nt, Human
agccuggcucccacaggcag

SEQ ID NO: 2520107 - RNA, 22 nt, Human
agccuggcuccaaacccucgag

SEQ ID NO: 2520108 - RNA, 17 nt, Human
agccuggcuucaaauug

SEQ ID NO: 2520109 - RNA, 18 nt, Human
agccuggcuucaaauugu

SEQ ID NO: 2520110 - RNA, 12 nt, Human
agccuggcucuu

SEQ ID NO: 2520111 - RNA, 11 nt, Human
agccuggcucu

SEQ ID NO: 2520112 - RNA, 14 nt, Human
agccuggcuucugg

SEQ ID NO: 2520113 - RNA, 19 nt, Human
agcccucccugccccuccc

SEQ ID NO: 2520114 - RNA, 17 nt, Human
agcccucccugccccuc

SEQ ID NO: 2520115 - RNA, 16 nt, Human
agcccucccugccccu

SEQ ID NO: 2520116 - RNA, 15 nt, Human
agcccucccugcccc

SEQ ID NO: 2520117 - RNA, 23 nt, Human
agcccucccugccccucccuuca

SEQ ID NO: 2520118 - RNA, 22 nt, Human
agcccucccugccccucccuuc

SEQ ID NO: 2520119 - RNA, 20 nt, Human
agccuggcuccaaacccucg

SEQ ID NO: 2520120 - RNA, 13 nt, Human
agccuggcuccaa

SEQ ID NO: 2520121 - RNA, 12 nt, Human
agccugggaggu

SEQ ID NO: 2520122 - RNA, 19 nt, Human
agccugggcagccaggcug

SEQ ID NO: 2520123 - RNA, 20 nt, Human
agccugggcagccaggcugc

SEQ ID NO: 2520124 - RNA, 21 nt, Human
agccuggcuucuggagcccuu

SEQ ID NO: 2520125 - RNA, 23 nt, Human
agccuggcuucuggagcccuugg

SEQ ID NO: 2520126 - RNA, 15 nt, Human
agccuggcuucugga

SEQ ID NO: 2520127 - RNA, 18 nt, Human
agccuggcuucuggagcc

SEQ ID NO: 2520128 - RNA, 19 nt, Human
agccuggcuucuggagccc

SEQ ID NO: 2520129 - RNA, 20 nt, Human
agccuggcuucuggagcccu

SEQ ID NO: 2520130 - RNA, 15 nt, Human
agccugggcgacaga

SEQ ID NO: 2520131 - RNA, 21 nt, Human
agccugggcagccaggcugcc

SEQ ID NO: 2520132 - RNA, 14 nt, Human
agccugggcgacag

SEQ ID NO: 2520133 - RNA, 19 nt, Human
agccuuugguucuggccag

SEQ ID NO: 2520134 - RNA, 18 nt, Human
agccuuuucccucuuugg

SEQ ID NO: 2520135 - RNA, 21 nt, Human
agccuuuggcucuggagacag

SEQ ID NO: 2520136 - RNA, 18 nt, Human
agccuuuggcucuggaga

SEQ ID NO: 2520137 - RNA, 17 nt, Human
agccuuuggcucuggag

SEQ ID NO: 2520138 - RNA, 16 nt, Human
agccuuuggcucugga

SEQ ID NO: 2520139 - RNA, 23 nt, Human
agccuuuggcucuggagacagcc

SEQ ID NO: 2520140 - RNA, 18 nt, Human
agccuuugguucuggcca

SEQ ID NO: 2520141 - RNA, 20 nt, Human
agccuuuggaugaccagaac

SEQ ID NO: 2520142 - RNA, 18 nt, Human
agccuuuggaugaccaga

SEQ ID NO: 2520143 - RNA, 14 nt, Human
agccuggggcuggc

SEQ ID NO: 2520144 - RNA, 15 nt, Human
agccuuuggaaacag

SEQ ID NO: 2520145 - RNA, 20 nt, Human
agcgaccaccccugccucca

SEQ ID NO: 2520146 - RNA, 19 nt, Human
agcgaccaccccugccucc

SEQ ID NO: 2520147 - RNA, 17 nt, Human
agcgaccaccccugccu

SEQ ID NO: 2520148 - RNA, 19 nt, Human
agcgacauagcccaucccu

SEQ ID NO: 2520149 - RNA, 21 nt, Human
agcgacauagcccaucccugc

SEQ ID NO: 2520150 - RNA, 23 nt, Human
agccuuuucccucuuuggcuccc

SEQ ID NO: 2520151 - RNA, 17 nt, Human
agcgacagugagacucu

SEQ ID NO: 2520152 - RNA, 17 nt, Human
agcgacuccguuggcca

SEQ ID NO: 2520153 - RNA, 16 nt, Human
agcgacuccguuggcc

SEQ ID NO: 2520154 - RNA, 22 nt, Human
agcgaccuuccucauccacccc

SEQ ID NO: 2520155 - RNA, 17 nt, Human
agcgaccgcccccuccu

SEQ ID NO: 2520156 - RNA, 16 nt, Human
agcgaccgcccccucc

SEQ ID NO: 2520157 - RNA, 15 nt, Human
agcgaccgcccccuc

SEQ ID NO: 2520158 - RNA, 14 nt, Human
agcgaccgcccccu

SEQ ID NO: 2520159 - RNA, 21 nt, Human
agcgaccaccccugccuccac

SEQ ID NO: 2520160 - RNA, 18 nt, Human
agcgaggucaacagagaa

SEQ ID NO: 2520161 - RNA, 23 nt, Human
agcgaggucaacagagaaggcag

SEQ ID NO: 2520162 - RNA, 19 nt, Human
agcgaggucaacagagaag

SEQ ID NO: 2520163 - RNA, 22 nt, Human
agcgaggucaacagagaaggca

SEQ ID NO: 2520164 - RNA, 14 nt, Human
agcgaguuguggaa

SEQ ID NO: 2520165 - RNA, 21 nt, Human
agcgaguuguggaaagccucu

SEQ ID NO: 2520166 - RNA, 23 nt, Human
agcgauuauuaucuaaagugugu

SEQ ID NO: 2520167 - RNA, 19 nt, Human
agcgauuauuaucuaaagu

SEQ ID NO: 2520168 - RNA, 18 nt, Human
agcgauguaugcagcuau

SEQ ID NO: 2520169 - RNA, 16 nt, Human
agcgauguaugcagcu

SEQ ID NO: 2520170 - RNA, 18 nt, Human
agcgauggucucagaaac

SEQ ID NO: 2520171 - RNA, 19 nt, Human
agcgaugaauuuggagacu

SEQ ID NO: 2520172 - RNA, 18 nt, Human
agcgaugaauuuggagac

SEQ ID NO: 2520173 - RNA, 20 nt, Human
agcgaggagaugcuccuugg

SEQ ID NO: 2520174 - RNA, 15 nt, Human
agcgaggaggcucca

SEQ ID NO: 2520175 - RNA, 19 nt, Human
agcgaggaggcuccagagg

SEQ ID NO: 2520176 - RNA, 19 nt, Human
agcgagcccugguggcagu

SEQ ID NO: 2520177 - RNA, 13 nt, Human
agcgagcccuggu

SEQ ID NO: 2520178 - RNA, 20 nt, Human
agcgacuccguuggccacuc

SEQ ID NO: 2520179 - RNA, 19 nt, Human
agcgacuccguuggccacu

SEQ ID NO: 2520180 - RNA, 21 nt, Human
agcgacuccguuggccacucc

SEQ ID NO: 2520181 - RNA, 16 nt, Human
agcgagagucugucuc

SEQ ID NO: 2520182 - RNA, 16 nt, Human
agcuaaucagcauucu

SEQ ID NO: 2520183 - RNA, 21 nt, Human
agcuaaucagcauucucacuc

SEQ ID NO: 2520184 - RNA, 15 nt, Human
agcuaaaaccugagc

SEQ ID NO: 2520185 - RNA, 15 nt, Human
agcuaaaaugauuuu

SEQ ID NO: 2520186 - RNA, 20 nt, Human
agcuaaaaugauuuuaucug

SEQ ID NO: 2520187 - RNA, 16 nt, Human
agcuaaaaugauuuua

SEQ ID NO: 2520188 - RNA, 14 nt, Human
agcguugcaugucg

SEQ ID NO: 2520189 - RNA, 21 nt, Human
agcguuugaggggcuggccuu

SEQ ID NO: 2520190 - RNA, 14 nt, Human
agcucaauggacug

SEQ ID NO: 2520191 - RNA, 16 nt, Human
agcucaccagccccag

SEQ ID NO: 2520192 - RNA, 19 nt, Human
agcucaaggaaaggccuga

SEQ ID NO: 2520193 - RNA, 23 nt, Human
agcucaagucuucccugaucaag

SEQ ID NO: 2520194 - RNA, 20 nt, Human
agcucaagcaggaaguucaa

SEQ ID NO: 2520195 - RNA, 18 nt, Human
agcucaagucuucccuga

SEQ ID NO: 2520196 - RNA, 13 nt, Human
agcuaauuugcau

SEQ ID NO: 2520197 - RNA, 14 nt, Human
agcuaauuugcauu

SEQ ID NO: 2520198 - RNA, 19 nt, Human
agcuaauucuuugaccugu

SEQ ID NO: 2520199 - RNA, 23 nt, Human
agcuaauguaauaacugugaagu

SEQ ID NO: 2520200 - RNA, 20 nt, Human
agcuaauuugcauuaaauuc

SEQ ID NO: 2520201 - RNA, 22 nt, Human
agcuaauuugcauuaaauucac

SEQ ID NO: 2520202 - RNA, 22 nt, Human
agcucaaagcguggacaggugu

SEQ ID NO: 2520203 - RNA, 13 nt, Human
agcucaaaggcac

SEQ ID NO: 2520204 - RNA, 15 nt, Human
agcucaaaggcacag

SEQ ID NO: 2520205 - RNA, 16 nt, Human
agcucaaaggcacagu

SEQ ID NO: 2520206 - RNA, 21 nt, Human
agcucaccuguugcuuacaau

SEQ ID NO: 2520207 - RNA, 19 nt, Human
agcucaccuguugcuuaca

SEQ ID NO: 2520208 - RNA, 18 nt, Human
agcucaccuguugcuuac

SEQ ID NO: 2520209 - RNA, 17 nt, Human
agcucaccuguugcuua

SEQ ID NO: 2520210 - RNA, 16 nt, Human
agcucaccuguugcuu

SEQ ID NO: 2520211 - RNA, 13 nt, Human
agcucaccccugg

SEQ ID NO: 2520212 - RNA, 21 nt, Human
agcucaccccccacacucacu

SEQ ID NO: 2520213 - RNA, 17 nt, Human
agcucaccccccacacu

SEQ ID NO: 2520214 - RNA, 19 nt, Human
agcucaccucucccuugga

SEQ ID NO: 2520215 - RNA, 18 nt, Human
agcucaccucucccuugg

SEQ ID NO: 2520216 - RNA, 15 nt, Human
agcucaccucucccu

SEQ ID NO: 2520217 - RNA, 15 nt, Human
agcucaccccccaca

SEQ ID NO: 2520218 - RNA, 14 nt, Human
agcucaccccccac

SEQ ID NO: 2520219 - RNA, 21 nt, Human
agcucacccaauaaacauuaa

SEQ ID NO: 2520220 - RNA, 15 nt, Human
agcucaccagcccca

SEQ ID NO: 2520221 - RNA, 12 nt, Human
agcucaccucuc

SEQ ID NO: 2520222 - RNA, 20 nt, Human
agcucaccagccccagugcc

SEQ ID NO: 2520223 - RNA, 19 nt, Human
agcucaccagccccagugc

SEQ ID NO: 2520224 - RNA, 12 nt, Human
agcucagagagg

SEQ ID NO: 2520225 - RNA, 23 nt, Human
agcucagaaggcucuucugacua

SEQ ID NO: 2520226 - RNA, 19 nt, Human
agcucagaaggcucuucug

SEQ ID NO: 2520227 - RNA, 16 nt, Human
agcucagaaggcucuu

SEQ ID NO: 2520228 - RNA, 15 nt, Human
agcucagaaggcucu

SEQ ID NO: 2520229 - RNA, 23 nt, Human
agcucacuucugggcuucaucug

SEQ ID NO: 2520230 - RNA, 13 nt, Human
agcucacuucugg

SEQ ID NO: 2520231 - RNA, 13 nt, Human
agcucacuacccu

SEQ ID NO: 2520232 - RNA, 23 nt, Human
agcucaccuguugcuuacaauuu

SEQ ID NO: 2520233 - RNA, 22 nt, Human
agcucaccuguugcuuacaauu

SEQ ID NO: 2520234 - RNA, 13 nt, Human
agcucacgucaca

SEQ ID NO: 2520235 - RNA, 16 nt, Human
agcucacgucacacuu

SEQ ID NO: 2520236 - RNA, 17 nt, Human
agcucagagagggcagg

SEQ ID NO: 2520237 - RNA, 16 nt, Human
agcucagagagggcag

SEQ ID NO: 2520238 - RNA, 19 nt, Human
agcucagaggcgcacugug

SEQ ID NO: 2520239 - RNA, 21 nt, Human
agcucagagagggcaggcaug

SEQ ID NO: 2520240 - RNA, 22 nt, Human
agcucagaggcgcacugugacc

SEQ ID NO: 2520241 - RNA, 18 nt, Human
agcucagagaggguggga

SEQ ID NO: 2520242 - RNA, 14 nt, Human
agcucagagagggu

SEQ ID NO: 2520243 - RNA, 22 nt, Human
agcucagaauccaagugaacac

SEQ ID NO: 2520244 - RNA, 16 nt, Human
agcucagaauccaagu

SEQ ID NO: 2520245 - RNA, 15 nt, Human
agcucagacccccac

SEQ ID NO: 2520246 - RNA, 16 nt, Human
agcucagacccccacu

SEQ ID NO: 2520247 - RNA, 17 nt, Human
agcucagacccccacuc

SEQ ID NO: 2520248 - RNA, 18 nt, Human
agcucagacccccacucu

SEQ ID NO: 2520249 - RNA, 14 nt, Human
agcucagagagggc

SEQ ID NO: 2520250 - RNA, 20 nt, Human
agcucagacccccacucuca

SEQ ID NO: 2520251 - RNA, 21 nt, Human
agcuccccgcuucugccugca

SEQ ID NO: 2520252 - RNA, 22 nt, Human
agcucagcccaccccccucauu

SEQ ID NO: 2520253 - RNA, 16 nt, Human
agcucagcccaccccc

SEQ ID NO: 2520254 - RNA, 19 nt, Human
agcucagcccaccccccuc

SEQ ID NO: 2520255 - RNA, 20 nt, Human
agcucagcccaccccccuca

SEQ ID NO: 2520256 - RNA, 21 nt, Human
agcucagcccaccccccucau

SEQ ID NO: 2520257 - RNA, 16 nt, Human
agcucagcauuuccac

SEQ ID NO: 2520258 - RNA, 11 nt, Human
agcucagccca

SEQ ID NO: 2520259 - RNA, 14 nt, Human
agcucagcccaccc

SEQ ID NO: 2520260 - RNA, 15 nt, Human
agcucagcccacccc

SEQ ID NO: 2520261 - RNA, 18 nt, Human
agcugcgguccacccagg

SEQ ID NO: 2520262 - RNA, 17 nt, Human
agcugcgguccacccag

SEQ ID NO: 2520263 - RNA, 16 nt, Human
agcugcgguccaccca

SEQ ID NO: 2520264 - RNA, 13 nt, Human
agcugcgguccac

SEQ ID NO: 2520265 - RNA, 20 nt, Human
agcugcgguccacccaggag

SEQ ID NO: 2520266 - RNA, 19 nt, Human
agcugcgguccacccagga

SEQ ID NO: 2520267 - RNA, 15 nt, Human
agcugcgggcugggu

SEQ ID NO: 2520268 - RNA, 12 nt, Human
agcugcugacag

SEQ ID NO: 2520269 - RNA, 17 nt, Human
agcuggucccacucagu

SEQ ID NO: 2520270 - RNA, 16 nt, Human
agcuggucccacucag

SEQ ID NO: 2520271 - RNA, 14 nt, Human
agcugcugacagug

SEQ ID NO: 2520272 - RNA, 13 nt, Human
agcugcugacagu

SEQ ID NO: 2520273 - RNA, 19 nt, Human
agcuggucccacucagucc

SEQ ID NO: 2520274 - RNA, 18 nt, Human
agcuggucccacucaguc

SEQ ID NO: 2520275 - RNA, 22 nt, Human
agcugguuuuuagcggagacgg

SEQ ID NO: 2520276 - RNA, 15 nt, Human
agcugguuuccucau

SEQ ID NO: 2520277 - RNA, 15 nt, Human
agcugguuggagagc

SEQ ID NO: 2520278 - RNA, 21 nt, Human
agcugguuuccucauuccuga

SEQ ID NO: 2520279 - RNA, 16 nt, Human
agcugguugagguuuc

SEQ ID NO: 2520280 - RNA, 13 nt, Human
agcuccccuccuc

SEQ ID NO: 2520281 - RNA, 14 nt, Human
agcuccccuccucu

SEQ ID NO: 2520282 - RNA, 19 nt, Human
agcuccccuccucuccccu

SEQ ID NO: 2520283 - RNA, 14 nt, Human
agcuccuguccucc

SEQ ID NO: 2520284 - RNA, 20 nt, Human
agcuccccucggagaagagc

SEQ ID NO: 2520285 - RNA, 17 nt, Human
agcuccccucggagaag

SEQ ID NO: 2520286 - RNA, 19 nt, Human
agcuccccucggagaagag

SEQ ID NO: 2520287 - RNA, 22 nt, Human
agcuccuguggccccacccugg

SEQ ID NO: 2520288 - RNA, 19 nt, Human
agcuccuguggccccaccc

SEQ ID NO: 2520289 - RNA, 16 nt, Human
agcuccuguggcccca

SEQ ID NO: 2520290 - RNA, 15 nt, Human
agcuccuguggcccc

SEQ ID NO: 2520291 - RNA, 21 nt, Human
agcuccuguccucccaucccc

SEQ ID NO: 2520292 - RNA, 17 nt, Human
agcuccuguccucccau

SEQ ID NO: 2520293 - RNA, 16 nt, Human
agcuccuguccuccca

SEQ ID NO: 2520294 - RNA, 15 nt, Human
agcuccuguccuccc

SEQ ID NO: 2520295 - RNA, 13 nt, Human
agcuccuguggcc

SEQ ID NO: 2520296 - RNA, 12 nt, Human
agcuccuguggc

SEQ ID NO: 2520297 - RNA, 23 nt, Human
agcugaacaauaggcuguuccca

SEQ ID NO: 2520298 - RNA, 22 nt, Human
agcugaacagccaaaugcaugg

SEQ ID NO: 2520299 - RNA, 19 nt, Human
agcugaacccauuuugagu

SEQ ID NO: 2520300 - RNA, 15 nt, Human
agcugaaccugggua

SEQ ID NO: 2520301 - RNA, 17 nt, Human
agcugaagugcauccaa

SEQ ID NO: 2520302 - RNA, 16 nt, Human
agcugaagauuuugga

SEQ ID NO: 2520303 - RNA, 15 nt, Human
agcugaauacauucu

SEQ ID NO: 2520304 - RNA, 18 nt, Human
agcugaauacauucugcu

SEQ ID NO: 2520305 - RNA, 14 nt, Human
agcugagccucuca

SEQ ID NO: 2520306 - RNA, 13 nt, Human
agcugagccucuc

SEQ ID NO: 2520307 - RNA, 12 nt, Human
agcugagcgcca

SEQ ID NO: 2520308 - RNA, 14 nt, Human
agcugagcgccagg

SEQ ID NO: 2520309 - RNA, 15 nt, Human
agcugagcgccagga

SEQ ID NO: 2520310 - RNA, 17 nt, Human
agcugagcgccaggaug

SEQ ID NO: 2520311 - RNA, 16 nt, Human
agcugaggcagcagug

SEQ ID NO: 2520312 - RNA, 17 nt, Human
agcugaggcagcagugu

SEQ ID NO: 2520313 - RNA, 13 nt, Human
agcugaggccaca

SEQ ID NO: 2520314 - RNA, 17 nt, Human
agcugaggccacacuca

SEQ ID NO: 2520315 - RNA, 15 nt, Human
agcugaggcagcagu

SEQ ID NO: 2520316 - RNA, 17 nt, Human
agcugaggcaauucuaa

SEQ ID NO: 2520317 - RNA, 22 nt, Human
aaagcauuugaaugcauuuugu

SEQ ID NO: 2520318 - RNA, 20 nt, Human
aaagcauuugaaugcauuuu

SEQ ID NO: 2520319 - RNA, 19 nt, Human
aaagcauuugaaugcauuu

SEQ ID NO: 2520320 - RNA, 17 nt, Human
aaagcauuugaaugcau

SEQ ID NO: 2520321 - RNA, 23 nt, Human
aaagcauuugaaugcauuuuguu

SEQ ID NO: 2520322 - RNA, 15 nt, Human
aaagccaaagcuagg

SEQ ID NO: 2520323 - RNA, 12 nt, Human
aaagcauuuaua

SEQ ID NO: 2520324 - RNA, 17 nt, Human
aaagccaaacucugcca

SEQ ID NO: 2520325 - RNA, 20 nt, Human
aaagccaaaucaaaauaugu

SEQ ID NO: 2520326 - RNA, 23 nt, Human
aaagccaacagucaaaacagaga

SEQ ID NO: 2520327 - RNA, 19 nt, Human
aaagcauuguaaaugugcu

SEQ ID NO: 2520328 - RNA, 20 nt, Human
aaagcauuguaaaugugcuu

SEQ ID NO: 2520329 - RNA, 15 nt, Human
aaagcauuugaaugc

SEQ ID NO: 2520330 - RNA, 14 nt, Human
aaagcauuugaaug

SEQ ID NO: 2520331 - RNA, 13 nt, Human
aaagcauuugaau

SEQ ID NO: 2520332 - RNA, 15 nt, Human
aaagcauuuauaaau

SEQ ID NO: 2520333 - RNA, 16 nt, Human
aaagcauuuacuuuga

SEQ ID NO: 2520334 - RNA, 17 nt, Human
aaagcauuuacuuugaa

SEQ ID NO: 2520335 - RNA, 17 nt, Human
aaaggcuaccuuuguau

SEQ ID NO: 2520336 - RNA, 14 nt, Human
aaaggcuaccuuug

SEQ ID NO: 2520337 - RNA, 14 nt, Human
aaaggcuccaggag

SEQ ID NO: 2520338 - RNA, 19 nt, Human
aaaggcuagguacacagcu

SEQ ID NO: 2520339 - RNA, 14 nt, Human
aaaggccaaaccuc

SEQ ID NO: 2520340 - RNA, 15 nt, Human
aaaggccaaaccucu

SEQ ID NO: 2520341 - RNA, 16 nt, Human
aaaggcauucucugaa

SEQ ID NO: 2520342 - RNA, 18 nt, Human
aaaggcauucucugaaga

SEQ ID NO: 2520343 - RNA, 22 nt, Human
aaaggcuccaggagcagccaca

SEQ ID NO: 2520344 - RNA, 18 nt, Human
aaaggcucgauuuuguau

SEQ ID NO: 2520345 - RNA, 17 nt, Human
aaaggcucgauuuugua

SEQ ID NO: 2520346 - RNA, 16 nt, Human
aaaggcucgauuuugu

SEQ ID NO: 2520347 - RNA, 17 nt, Human
aaaggccaaaccucugu

SEQ ID NO: 2520348 - RNA, 23 nt, Human
aaaggcucgauuuuguaucugca

SEQ ID NO: 2520349 - RNA, 19 nt, Human
aaaggcucgauuuuguauc

SEQ ID NO: 2520350 - RNA, 20 nt, Human
aaaggcucugaaagccagcu

SEQ ID NO: 2520351 - RNA, 21 nt, Human
aaaggcuccaggagcagccac

SEQ ID NO: 2520352 - RNA, 19 nt, Human
aaaggcucagucucaggag

SEQ ID NO: 2520353 - RNA, 21 nt, Human
aaaggcucagucucaggagca

SEQ ID NO: 2520354 - RNA, 19 nt, Human
aaaggcagaagcaacccaa

SEQ ID NO: 2520355 - RNA, 21 nt, Human
aaagccccaugcuggagccug

SEQ ID NO: 2520356 - RNA, 17 nt, Human
aaaggcauauugcuuuu

SEQ ID NO: 2520357 - RNA, 15 nt, Human
aaaggcauauugcuu

SEQ ID NO: 2520358 - RNA, 21 nt, Human
aaaggcauaagacccuaagcc

SEQ ID NO: 2520359 - RNA, 15 nt, Human
aaagccaagaggcug

SEQ ID NO: 2520360 - RNA, 18 nt, Human
aaagcccaaagugguaua

SEQ ID NO: 2520361 - RNA, 16 nt, Human
aaagcccaaccuccug

SEQ ID NO: 2520362 - RNA, 15 nt, Human
aaagcccaaaguggu

SEQ ID NO: 2520363 - RNA, 18 nt, Human
aaagcccaagggaucugg

SEQ ID NO: 2520364 - RNA, 15 nt, Human
aaagcccagagacag

SEQ ID NO: 2520365 - RNA, 23 nt, Human
aaagcccaagggaucugguccua

SEQ ID NO: 2520366 - RNA, 16 nt, Human
aaagcccauucauucc

SEQ ID NO: 2520367 - RNA, 20 nt, Human
aaagccccaugcuggagccu

SEQ ID NO: 2520368 - RNA, 19 nt, Human
aaagccccaugcuggagcc

SEQ ID NO: 2520369 - RNA, 18 nt, Human
aaagccccaugcuggagc

SEQ ID NO: 2520370 - RNA, 17 nt, Human
aaagccccaugcuggag

SEQ ID NO: 2520371 - RNA, 17 nt, Human
aaagcccauucauucca

SEQ ID NO: 2520372 - RNA, 15 nt, Human
aaagccccaugcugg

SEQ ID NO: 2520373 - RNA, 21 nt, Human
aaauaaauguaucauagaaau

SEQ ID NO: 2520374 - RNA, 16 nt, Human
aaauaaauguaucaua

SEQ ID NO: 2520375 - RNA, 13 nt, Human
aaauaaauuguau

SEQ ID NO: 2520376 - RNA, 19 nt, Human
aaauaaauuguauauucac

SEQ ID NO: 2520377 - RNA, 18 nt, Human
aaauaaauuguauauuca

SEQ ID NO: 2520378 - RNA, 15 nt, Human
aaauaaauuguauau

SEQ ID NO: 2520379 - RNA, 14 nt, Human
aaauaaauuguaua

SEQ ID NO: 2520380 - RNA, 15 nt, Human
aaauaaauguaucau

SEQ ID NO: 2520381 - RNA, 12 nt, Human
aaauaaacacug

SEQ ID NO: 2520382 - RNA, 11 nt, Human
aaauaaauuau

SEQ ID NO: 2520383 - RNA, 15 nt, Human
aaauaaauuguuuga

SEQ ID NO: 2520384 - RNA, 13 nt, Human
aaauaaauuguuu

SEQ ID NO: 2520385 - RNA, 21 nt, Human
aaauaaauuguauauucacuu

SEQ ID NO: 2520386 - RNA, 20 nt, Human
aaauaaauuguauauucacu

SEQ ID NO: 2520387 - RNA, 22 nt, Human
aaauaaauuguauauucacuuu

SEQ ID NO: 2520388 - RNA, 12 nt, Human
aaauaaauuguu

SEQ ID NO: 2520389 - RNA, 19 nt, Human
aaauaaaccucaaaauguc

SEQ ID NO: 2520390 - RNA, 13 nt, Human
aaauaaacacugu

SEQ ID NO: 2520391 - RNA, 23 nt, Human
aaauaaaacauuuuaaauggaca

SEQ ID NO: 2520392 - RNA, 19 nt, Human
aaauaaaauuuguugcaua

SEQ ID NO: 2520393 - RNA, 18 nt, Human
aaauaaacaaauaacaau

SEQ ID NO: 2520394 - RNA, 18 nt, Human
aaauaaaauuuguugcau

SEQ ID NO: 2520395 - RNA, 15 nt, Human
aaauaaaaccuuuca

SEQ ID NO: 2520396 - RNA, 11 nt, Human
aaauaaaaccu

SEQ ID NO: 2520397 - RNA, 12 nt, Human
aaauaaaaccuu

SEQ ID NO: 2520398 - RNA, 13 nt, Human
aaauaaaaccuuu

SEQ ID NO: 2520399 - RNA, 14 nt, Human
aaauaaaaccuuuc

SEQ ID NO: 2520400 - RNA, 20 nt, Human
aaauaaaaauauuguguugu

SEQ ID NO: 2520401 - RNA, 15 nt, Human
aaauaaaaauggaua

SEQ ID NO: 2520402 - RNA, 14 nt, Human
aaauaaaaccagcu

SEQ ID NO: 2520403 - RNA, 22 nt, Human
aaauaaaacauuuucacacaau

SEQ ID NO: 2520404 - RNA, 15 nt, Human
aaauaaaacauuuua

SEQ ID NO: 2520405 - RNA, 13 nt, Human
aaauaaaacauuu

SEQ ID NO: 2520406 - RNA, 18 nt, Human
aaauaaaacauuuucaca

SEQ ID NO: 2520407 - RNA, 16 nt, Human
aaauaaaaauucugaa

SEQ ID NO: 2520408 - RNA, 23 nt, Human
aaauaaaaauuauuauugauuuu

SEQ ID NO: 2520409 - RNA, 12 nt, Human
aaauaaaacauu

SEQ ID NO: 2520410 - RNA, 18 nt, Human
aaagucaauguuuucagu

SEQ ID NO: 2520411 - RNA, 20 nt, Human
aaagucaaaaggugccugug

SEQ ID NO: 2520412 - RNA, 17 nt, Human
aaagucaauguuuucag

SEQ ID NO: 2520413 - RNA, 17 nt, Human
aaaguauuuuccuguaa

SEQ ID NO: 2520414 - RNA, 18 nt, Human
aaagucaaaaggugccug

SEQ ID NO: 2520415 - RNA, 16 nt, Human
aaagucagguccaauu

SEQ ID NO: 2520416 - RNA, 13 nt, Human
aaaggcuguggua

SEQ ID NO: 2520417 - RNA, 21 nt, Human
aaaguauuuuccuguaaaaaa

SEQ ID NO: 2520418 - RNA, 14 nt, Human
aaaguauuuuccug

SEQ ID NO: 2520419 - RNA, 13 nt, Human
aaaguauuuuccu

SEQ ID NO: 2520420 - RNA, 12 nt, Human
aaaguauuuucc

SEQ ID NO: 2520421 - RNA, 19 nt, Human
aaagucaugcaaaggcugg

SEQ ID NO: 2520422 - RNA, 15 nt, Human
aaagugauaauuucu

SEQ ID NO: 2520423 - RNA, 10 nt, Human
aaagugauua

SEQ ID NO: 2520424 - RNA, 23 nt, Human
aaagugaucaauaaaaugugauu

SEQ ID NO: 2520425 - RNA, 21 nt, Human
aaagugauaauuucuggaauu

SEQ ID NO: 2520426 - RNA, 12 nt, Human
aaagugauuucu

SEQ ID NO: 2520427 - RNA, 15 nt, Human
aaagugauuaaacgu

SEQ ID NO: 2520428 - RNA, 23 nt, Human
aaagugcagcuccguuuggcagu

SEQ ID NO: 2520429 - RNA, 15 nt, Human
aaagugccacucauu

SEQ ID NO: 2520430 - RNA, 24 nt, Human
aaagaggugacugggcccugccuc

SEQ ID NO: 2520431 - RNA, 13 nt, Human
aaagaggugugca

SEQ ID NO: 2520432 - RNA, 19 nt, Human
aaagagggcuuccucuaga

SEQ ID NO: 2520433 - RNA, 15 nt, Human
aaagagggcuuccuc

SEQ ID NO: 2520434 - RNA, 14 nt, Human
aaagauaaauauua

SEQ ID NO: 2520435 - RNA, 15 nt, Human
aaagauaaauauuau

SEQ ID NO: 2520436 - RNA, 13 nt, Human
aaagauaaauauu

SEQ ID NO: 2520437 - RNA, 15 nt, Human
aaagauacaguuacu

SEQ ID NO: 2520438 - RNA, 16 nt, Human
aaagauaaauauuaua

SEQ ID NO: 2520439 - RNA, 21 nt, Human
aaagauaaauuauaucaauuu

SEQ ID NO: 2520440 - RNA, 20 nt, Human
aaagauaacaagaucuuuca

SEQ ID NO: 2520441 - RNA, 21 nt, Human
aaagauacagaacucuuucaa

SEQ ID NO: 2520442 - RNA, 22 nt, Human
aaagauaacaagaucuuucagg

SEQ ID NO: 2520443 - RNA, 19 nt, Human
aaagauaaucucucagcuu

SEQ ID NO: 2520444 - RNA, 23 nt, Human
aaagaaccaacaaccucaacugc

SEQ ID NO: 2520445 - RNA, 13 nt, Human
aaagaaacauuug

SEQ ID NO: 2520446 - RNA, 20 nt, Human
aaagaaacccgacagaggga

SEQ ID NO: 2520447 - RNA, 22 nt, Human
aaagaaccaaaaguuuuccuga

SEQ ID NO: 2520448 - RNA, 23 nt, Human
aaagaaacccgacagagggaaga

SEQ ID NO: 2520449 - RNA, 21 nt, Human
aaagaggcugaggccuggacu

SEQ ID NO: 2520450 - RNA, 20 nt, Human
aaagaggcugaggccuggac

SEQ ID NO: 2520451 - RNA, 19 nt, Human
aaagaggcugaggccugga

SEQ ID NO: 2520452 - RNA, 12 nt, Human
aaagaggcugag

SEQ ID NO: 2520453 - RNA, 19 nt, Human
aaagaggcugaggcuggca

SEQ ID NO: 2520454 - RNA, 17 nt, Human
aaagaagaaacgucuau

SEQ ID NO: 2520455 - RNA, 14 nt, Human
aaagaagacauguu

SEQ ID NO: 2520456 - RNA, 12 nt, Human
aaagaagacaug

SEQ ID NO: 2520457 - RNA, 17 nt, Human
aaagaagaacuugcaug

SEQ ID NO: 2520458 - RNA, 19 nt, Human
aaagaagacaacauuaaaa

SEQ ID NO: 2520459 - RNA, 19 nt, Human
aaacugauuuuuuuuuccu

SEQ ID NO: 2520460 - RNA, 13 nt, Human
aaacugauuuuuu

SEQ ID NO: 2520461 - RNA, 19 nt, Human
aaacugaaaaucuaauauu

SEQ ID NO: 2520462 - RNA, 18 nt, Human
aaacugaaaaucuaauau

SEQ ID NO: 2520463 - RNA, 17 nt, Human
aaacugaaaaucuaaua

SEQ ID NO: 2520464 - RNA, 14 nt, Human
aaacugaaaaucua

SEQ ID NO: 2520465 - RNA, 21 nt, Human
aaacugaagcagccucucccc

SEQ ID NO: 2520466 - RNA, 18 nt, Human
aaacugaagcagccucuc

SEQ ID NO: 2520467 - RNA, 13 nt, Human
aaacugaaaaucu

SEQ ID NO: 2520468 - RNA, 12 nt, Human
aaacugaaaauc

SEQ ID NO: 2520469 - RNA, 13 nt, Human
aaacucuuuuccc

SEQ ID NO: 2520470 - RNA, 22 nt, Human
aaacugaagcagccucucccca

SEQ ID NO: 2520471 - RNA, 19 nt, Human
aaacugaggaauuuucuuu

SEQ ID NO: 2520472 - RNA, 20 nt, Human
aaacugauuuuuuuuuccuu

SEQ ID NO: 2520473 - RNA, 18 nt, Human
aaagaaaauucuuggaau

SEQ ID NO: 2520474 - RNA, 13 nt, Human
aaagaaaauaugc

SEQ ID NO: 2520475 - RNA, 14 nt, Human
aaagaaaauaugca

SEQ ID NO: 2520476 - RNA, 17 nt, Human
aaagaaaauaugcaucu

SEQ ID NO: 2520477 - RNA, 15 nt, Human
aaagaaaauaugcau

SEQ ID NO: 2520478 - RNA, 22 nt, Human
aaaccucaaaaugucuaagaua

SEQ ID NO: 2520479 - RNA, 17 nt, Human
aaaccucaaaaugucua

SEQ ID NO: 2520480 - RNA, 19 nt, Human
aaaccuaaguccuuuaugu

SEQ ID NO: 2520481 - RNA, 20 nt, Human
aaaccuaaguccuuuaugug

SEQ ID NO: 2520482 - RNA, 19 nt, Human
aaaccuaaaaaagauauau

SEQ ID NO: 2520483 - RNA, 17 nt, Human
aaaccuaaaaaagauau

SEQ ID NO: 2520484 - RNA, 15 nt, Human
aaaccuaaaaaagau

SEQ ID NO: 2520485 - RNA, 14 nt, Human
aaacucuuuaacuu

SEQ ID NO: 2520486 - RNA, 16 nt, Human
aaacucuuuaacuucu

SEQ ID NO: 2520487 - RNA, 22 nt, Human
aaacucuuaucucagucaugca

SEQ ID NO: 2520488 - RNA, 17 nt, Human
aaacucuugaccucagg

SEQ ID NO: 2520489 - RNA, 19 nt, Human
aaacccuugccaugugcua

SEQ ID NO: 2520490 - RNA, 14 nt, Human
aaacccuucagugc

SEQ ID NO: 2520491 - RNA, 12 nt, Human
aaacccugucuc

SEQ ID NO: 2520492 - RNA, 16 nt, Human
aaacccuugaaaagac

SEQ ID NO: 2520493 - RNA, 17 nt, Human
aaacccaguugccaucu

SEQ ID NO: 2520494 - RNA, 18 nt, Human
aaacccagcucuggucca

SEQ ID NO: 2520495 - RNA, 15 nt, Human
aaacccccacacaca

SEQ ID NO: 2520496 - RNA, 16 nt, Human
aaacccccacacacac

SEQ ID NO: 2520497 - RNA, 22 nt, Human
aaacccccacacacacacacau

SEQ ID NO: 2520498 - RNA, 17 nt, Human
aaacccccuuugugcug

SEQ ID NO: 2520499 - RNA, 21 nt, Human
aaacccugucucuacuaaaaa

SEQ ID NO: 2520500 - RNA, 17 nt, Human
aaaccccaucucuacaa

SEQ ID NO: 2520501 - RNA, 13 nt, Human
aaaccccaucucu

SEQ ID NO: 2520502 - RNA, 22 nt, Human
aaaaguuuacaaguguauauca

SEQ ID NO: 2520503 - RNA, 16 nt, Human
aaaaguuuacaagugu

SEQ ID NO: 2520504 - RNA, 15 nt, Human
aaaauaaaaaaaaga

SEQ ID NO: 2520505 - RNA, 16 nt, Human
aaaauaaaaaaaagaa

SEQ ID NO: 2520506 - RNA, 17 nt, Human
aaaauaaaaaaaagaaa

SEQ ID NO: 2520507 - RNA, 18 nt, Human
aaaauaaaaaaaagaaaa

SEQ ID NO: 2520508 - RNA, 12 nt, Human
aaaaguuuccau

SEQ ID NO: 2520509 - RNA, 13 nt, Human
aaaaguuucaaug

SEQ ID NO: 2520510 - RNA, 12 nt, Human
aaaaguuucaau

SEQ ID NO: 2520511 - RNA, 17 nt, Human
aaaaguuuuauuuuucu

SEQ ID NO: 2520512 - RNA, 18 nt, Human
aaaaguuucaaugugauu

SEQ ID NO: 2520513 - RNA, 16 nt, Human
aaaaguuugccagaag

SEQ ID NO: 2520514 - RNA, 15 nt, Human
aaaauaaaaaacacu

SEQ ID NO: 2520515 - RNA, 21 nt, Human
aaaauaaaaaaaagaaaaaag

SEQ ID NO: 2520516 - RNA, 17 nt, Human
aaaauaaaaaacauaua

SEQ ID NO: 2520517 - RNA, 17 nt, Human
aaaaguuugccagaagu

SEQ ID NO: 2520518 - RNA, 11 nt, Human
aaaauaaaaac

SEQ ID NO: 2520519 - RNA, 21 nt, Human
aaaauaaaaagugacacagca

SEQ ID NO: 2520520 - RNA, 17 nt, Human
aaaauaaaaagugacac

SEQ ID NO: 2520521 - RNA, 12 nt, Human
aaaauaaaaagu

SEQ ID NO: 2520522 - RNA, 20 nt, Human
aaaauaaaaagaucacuuuc

SEQ ID NO: 2520523 - RNA, 21 nt, Human
aaaauaaaaagcgggcacggg

SEQ ID NO: 2520524 - RNA, 13 nt, Human
aaaauaaaaaguu

SEQ ID NO: 2520525 - RNA, 22 nt, Human
aaaauaaaaagugacacagcag

SEQ ID NO: 2520526 - RNA, 18 nt, Human
aaaauauuuugucuaaaa

SEQ ID NO: 2520527 - RNA, 16 nt, Human
aaaauauuuugucuaa

SEQ ID NO: 2520528 - RNA, 12 nt, Human
aaaauauuuugu

SEQ ID NO: 2520529 - RNA, 20 nt, Human
aaaauauuuuuuauauauac

SEQ ID NO: 2520530 - RNA, 20 nt, Human
aaaauauuuugucuaaaaug

SEQ ID NO: 2520531 - RNA, 23 nt, Human
aaaauauuuuuuauauauacagu

SEQ ID NO: 2520532 - RNA, 21 nt, Human
aaaauccacuuuaucuugaau

SEQ ID NO: 2520533 - RNA, 22 nt, Human
aaaaucauuuuauaugucaaag

SEQ ID NO: 2520534 - RNA, 20 nt, Human
aaaaucauuuuauaugucaa

SEQ ID NO: 2520535 - RNA, 19 nt, Human
aaaaucauuuuauauguca

SEQ ID NO: 2520536 - RNA, 20 nt, Human
aaaaucagccaauuauguua

SEQ ID NO: 2520537 - RNA, 19 nt, Human
aaaaucagccaauuauguu

SEQ ID NO: 2520538 - RNA, 18 nt, Human
aaaaucagccaauuaugu

SEQ ID NO: 2520539 - RNA, 17 nt, Human
aaaaucagccaauuaug

SEQ ID NO: 2520540 - RNA, 14 nt, Human
aaaaucagccaauu

SEQ ID NO: 2520541 - RNA, 22 nt, Human
aaaauuauagaugggaaugaag

SEQ ID NO: 2520542 - RNA, 18 nt, Human
aaaauuauagaugggaau

SEQ ID NO: 2520543 - RNA, 13 nt, Human
aaaauuauuuugg

SEQ ID NO: 2520544 - RNA, 19 nt, Human
aaaauuauuuuaaacaaaa

SEQ ID NO: 2520545 - RNA, 18 nt, Human
aaaauuauuuuaaacaaa

SEQ ID NO: 2520546 - RNA, 17 nt, Human
aaaauuauuuuaaacaa

SEQ ID NO: 2520547 - RNA, 13 nt, Human
aaaauuauuugca

SEQ ID NO: 2520548 - RNA, 14 nt, Human
aaaauuauuugcau

SEQ ID NO: 2520549 - RNA, 23 nt, Human
aaaauuauguuugccacuuugca

SEQ ID NO: 2520550 - RNA, 14 nt, Human
aaaauuauuucaga

SEQ ID NO: 2520551 - RNA, 21 nt, Human
aaaauuauuugaaaacauaua

SEQ ID NO: 2520552 - RNA, 19 nt, Human
aaaauuauuucagaaaugu

SEQ ID NO: 2520553 - RNA, 19 nt, Human
aaaauuaggauuucaugau

SEQ ID NO: 2520554 - RNA, 18 nt, Human
aaaauuagccgggcgugg

SEQ ID NO: 2520555 - RNA, 20 nt, Human
aaaauuagaaauuggcugga

SEQ ID NO: 2520556 - RNA, 14 nt, Human
aaaauuagaaauug

SEQ ID NO: 2520557 - RNA, 15 nt, Human
aaaauuagccaagug

SEQ ID NO: 2520558 - RNA, 12 nt, Human
aaaauuaagaaa

SEQ ID NO: 2520559 - RNA, 22 nt, Human
aaaauuaacaugaauauuuagu

SEQ ID NO: 2520560 - RNA, 19 nt, Human
aaaauccauacauuugugu

SEQ ID NO: 2520561 - RNA, 11 nt, Human
aaaauuaaagc

SEQ ID NO: 2520562 - RNA, 20 nt, Human
aaaauuaagaaaggauaaag

SEQ ID NO: 2520563 - RNA, 13 nt, Human
aaaauuaagaaag

SEQ ID NO: 2520564 - RNA, 23 nt, Human
aaaauuaaucugggccagaauuu

SEQ ID NO: 2520565 - RNA, 17 nt, Human
aaaauuaaaucaaccuu

SEQ ID NO: 2520566 - RNA, 14 nt, Human
aaaauuaacacugc

SEQ ID NO: 2520567 - RNA, 22 nt, Human
aaaauuccuuuguguuucuauu

SEQ ID NO: 2520568 - RNA, 17 nt, Human
aaaauuccuauugugau

SEQ ID NO: 2520569 - RNA, 14 nt, Human
aaaauuccuauugu

SEQ ID NO: 2520570 - RNA, 21 nt, Human
aaaauuccaucccaucaucuu

SEQ ID NO: 2520571 - RNA, 15 nt, Human
aaaauucugaaugua

SEQ ID NO: 2520572 - RNA, 16 nt, Human
aaaauucuacuguaug

SEQ ID NO: 2520573 - RNA, 20 nt, Human
aaaauucucagucaguaauu

SEQ ID NO: 2520574 - RNA, 23 nt, Human
aaaauucgaccugauuuacaguu

SEQ ID NO: 2520575 - RNA, 21 nt, Human
aaaauucgaccugauuuacag

SEQ ID NO: 2520576 - RNA, 21 nt, Human
aaacagcgcuggguccacccc

SEQ ID NO: 2520577 - RNA, 18 nt, Human
aaacagcauugcuuucug

SEQ ID NO: 2520578 - RNA, 22 nt, Human
aaacagccgucagccaaaugua

SEQ ID NO: 2520579 - RNA, 23 nt, Human
aaacagccgucagccaaauguaa

SEQ ID NO: 2520580 - RNA, 15 nt, Human
aaacagccucacaga

SEQ ID NO: 2520581 - RNA, 14 nt, Human
aaacagcaguguuc

SEQ ID NO: 2520582 - RNA, 14 nt, Human
aaacagcauugcuu

SEQ ID NO: 2520583 - RNA, 16 nt, Human
aaacagcauugcuuuc

SEQ ID NO: 2520584 - RNA, 17 nt, Human
aaacagcauugcuuucu

SEQ ID NO: 2520585 - RNA, 21 nt, Human
aaacagcauugcuuucugaaa

SEQ ID NO: 2520586 - RNA, 20 nt, Human
aaaauucuguagguucugug

SEQ ID NO: 2520587 - RNA, 13 nt, Human
aaaauucuuggaa

SEQ ID NO: 2520588 - RNA, 17 nt, Human
aaacagggcaucuccag

SEQ ID NO: 2520589 - RNA, 15 nt, Human
aaacaggcccagcau

SEQ ID NO: 2520590 - RNA, 14 nt, Human
aaacaggcccagca

SEQ ID NO: 2520591 - RNA, 13 nt, Human
aaacaggcccagc

SEQ ID NO: 2520592 - RNA, 19 nt, Human
aaacagggcaucuccagga

SEQ ID NO: 2520593 - RNA, 11 nt, Human
aaacaggcagu

SEQ ID NO: 2520594 - RNA, 21 nt, Human
aaacaggcaguuggccagaga

SEQ ID NO: 2520595 - RNA, 17 nt, Human
aaacagcuaaugggaca

SEQ ID NO: 2520596 - RNA, 15 nt, Human
aaacagcguuuaaga

SEQ ID NO: 2520597 - RNA, 11 nt, Human
aaacaggacca

SEQ ID NO: 2520598 - RNA, 12 nt, Human
aaacaggagaga

SEQ ID NO: 2520599 - RNA, 18 nt, Human
aaacaggagacaggaagg

SEQ ID NO: 2520600 - RNA, 17 nt, Human
aaacaggagacaggaag

SEQ ID NO: 2520601 - RNA, 16 nt, Human
aaacaggagacaggaa

SEQ ID NO: 2520602 - RNA, 22 nt, Human
aaccuuuuuuaagauuuuucuc

SEQ ID NO: 2520603 - RNA, 21 nt, Human
aaccuuuuuuaagauuuuucu

SEQ ID NO: 2520604 - RNA, 18 nt, Human
aaccuuuuuuaagauuuu

SEQ ID NO: 2520605 - RNA, 17 nt, Human
aaccuuuuuuaagauuu

SEQ ID NO: 2520606 - RNA, 15 nt, Human
aaccuuuuuuaagau

SEQ ID NO: 2520607 - RNA, 16 nt, Human
aacgagucaauccccu

SEQ ID NO: 2520608 - RNA, 12 nt, Human
aacgaggaagcc

SEQ ID NO: 2520609 - RNA, 23 nt, Human
aacgagaggggaagaguguacug

SEQ ID NO: 2520610 - RNA, 18 nt, Human
aacgacugggcacugcca

SEQ ID NO: 2520611 - RNA, 14 nt, Human
aacgacaauagcuu

SEQ ID NO: 2520612 - RNA, 23 nt, Human
aaccuuuuuuaagauuuuucuca

SEQ ID NO: 2520613 - RNA, 11 nt, Human
aacgaaugaag

SEQ ID NO: 2520614 - RNA, 23 nt, Human
aacgacaaagccaaacucugcca

SEQ ID NO: 2520615 - RNA, 22 nt, Human
aacucaaaugcuuggcuucuca

SEQ ID NO: 2520616 - RNA, 11 nt, Human
aacucaaaugc

SEQ ID NO: 2520617 - RNA, 18 nt, Human
aacucaaauggggccaga

SEQ ID NO: 2520618 - RNA, 21 nt, Human
aacucaaauggggccagaucc

SEQ ID NO: 2520619 - RNA, 22 nt, Human
aacucaaauggggccagaucca

SEQ ID NO: 2520620 - RNA, 23 nt, Human
aacucaaauggggccagauccag

SEQ ID NO: 2520621 - RNA, 17 nt, Human
aacucaaacucuuaaaa

SEQ ID NO: 2520622 - RNA, 21 nt, Human
aacguaugcaugugaagaaag

SEQ ID NO: 2520623 - RNA, 18 nt, Human
aacguaugcaugugaaga

SEQ ID NO: 2520624 - RNA, 16 nt, Human
aacucaaaauauuugu

SEQ ID NO: 2520625 - RNA, 22 nt, Human
aacucaaacugaggaauuucac

SEQ ID NO: 2520626 - RNA, 17 nt, Human
aacucaccccagcccca

SEQ ID NO: 2520627 - RNA, 16 nt, Human
aacucaccccagcccc

SEQ ID NO: 2520628 - RNA, 18 nt, Human
aacucaccccagccccaa

SEQ ID NO: 2520629 - RNA, 14 nt, Human
aacucaccuaacuc

SEQ ID NO: 2520630 - RNA, 22 nt, Human
aacucacccccaaggggcaguc

SEQ ID NO: 2520631 - RNA, 23 nt, Human
aacucauacugugcuggagccac

SEQ ID NO: 2520632 - RNA, 22 nt, Human
aacucauacugugcuggagcca

SEQ ID NO: 2520633 - RNA, 15 nt, Human
aacucaccccagccc

SEQ ID NO: 2520634 - RNA, 22 nt, Human
aacgcuaaagagcccuugccuc

SEQ ID NO: 2520635 - RNA, 21 nt, Human
aacgcuaaagagcccuugccu

SEQ ID NO: 2520636 - RNA, 17 nt, Human
aacgcuaaagagcccuu

SEQ ID NO: 2520637 - RNA, 16 nt, Human
aacgcguguguacacg

SEQ ID NO: 2520638 - RNA, 15 nt, Human
aacguauaaaagccu

SEQ ID NO: 2520639 - RNA, 15 nt, Human
aacucaaaauauuug

SEQ ID NO: 2520640 - RNA, 17 nt, Human
aacguaaccacggaaaa

SEQ ID NO: 2520641 - RNA, 16 nt, Human
aacggggcucuucuca

SEQ ID NO: 2520642 - RNA, 17 nt, Human
aacgggcugcccugcca

SEQ ID NO: 2520643 - RNA, 18 nt, Human
aacggggcucuucucauu

SEQ ID NO: 2520644 - RNA, 15 nt, Human
aacgggguccuucaa

SEQ ID NO: 2520645 - RNA, 12 nt, Human
aacggggagaaa

SEQ ID NO: 2520646 - RNA, 17 nt, Human
aacgguaaauuucugug

SEQ ID NO: 2520647 - RNA, 14 nt, Human
aacgguuaaaacug

SEQ ID NO: 2520648 - RNA, 13 nt, Human
aacgguuaaaacu

SEQ ID NO: 2520649 - RNA, 18 nt, Human
aacugaaugaaaccccca

SEQ ID NO: 2520650 - RNA, 23 nt, Human
aacugaaugaaacccccacacac

SEQ ID NO: 2520651 - RNA, 12 nt, Human
aacugaaugaga

SEQ ID NO: 2520652 - RNA, 20 nt, Human
aacugaauguuuauuccuug

SEQ ID NO: 2520653 - RNA, 22 nt, Human
aacugaauggaagguuuguaua

SEQ ID NO: 2520654 - RNA, 12 nt, Human
aacugaauaaau

SEQ ID NO: 2520655 - RNA, 10 nt, Human
aacugaauaa

SEQ ID NO: 2520656 - RNA, 15 nt, Human
aacugaagucugaaa

SEQ ID NO: 2520657 - RNA, 16 nt, Human
aacugaaguuucacau

SEQ ID NO: 2520658 - RNA, 16 nt, Human
aacugaagucugaaau

SEQ ID NO: 2520659 - RNA, 14 nt, Human
aacugaagucugaa

SEQ ID NO: 2520660 - RNA, 13 nt, Human
aacugaaggagaa

SEQ ID NO: 2520661 - RNA, 15 nt, Human
aacugaaggagaagg

SEQ ID NO: 2520662 - RNA, 14 nt, Human
aacucaucauaaaa

SEQ ID NO: 2520663 - RNA, 15 nt, Human
aacucaucauaaaau

SEQ ID NO: 2520664 - RNA, 21 nt, Human
aacugaagcagccucucccca

SEQ ID NO: 2520665 - RNA, 13 nt, Human
aacugaagccaga

SEQ ID NO: 2520666 - RNA, 20 nt, Human
aacugaagcagccucucccc

SEQ ID NO: 2520667 - RNA, 16 nt, Human
aacucaucauaaaaua

SEQ ID NO: 2520668 - RNA, 17 nt, Human
aacucaucauaaaauaa

SEQ ID NO: 2520669 - RNA, 22 nt, Human
aacucaucccuaaugcugcaga

SEQ ID NO: 2520670 - RNA, 21 nt, Human
aacucaucccuaaugcugcag

SEQ ID NO: 2520671 - RNA, 18 nt, Human
aacucaucauaaaauaaa

SEQ ID NO: 2520672 - RNA, 23 nt, Human
aacugagaugugaacacaucagc

SEQ ID NO: 2520673 - RNA, 13 nt, Human
aacugagcuugga

SEQ ID NO: 2520674 - RNA, 17 nt, Human
aacugagcuuggaagcu

SEQ ID NO: 2520675 - RNA, 13 nt, Human
aacugaggaauuu

SEQ ID NO: 2520676 - RNA, 18 nt, Human
aacugaggaauuucaccu

SEQ ID NO: 2520677 - RNA, 16 nt, Human
aacugaggaauuuucu

SEQ ID NO: 2520678 - RNA, 21 nt, Human
aacugagcuuggaagcuucug

SEQ ID NO: 2520679 - RNA, 12 nt, Human
aacugaggaauu

SEQ ID NO: 2520680 - RNA, 14 nt, Human
aacugagcuccucu

SEQ ID NO: 2520681 - RNA, 18 nt, Human
aacugagcuccucugggc

SEQ ID NO: 2520682 - RNA, 14 nt, Human
aacuguuaugaaau

SEQ ID NO: 2520683 - RNA, 19 nt, Human
aacuguuaaauugcugugu

SEQ ID NO: 2520684 - RNA, 22 nt, Human
aacuguguuucaaguucaaucc

SEQ ID NO: 2520685 - RNA, 19 nt, Human
aacuguguuucaaguucaa

SEQ ID NO: 2520686 - RNA, 22 nt, Human
aacugagcuccucugggcagga

SEQ ID NO: 2520687 - RNA, 15 nt, Human
aacuguuauuuauaa

SEQ ID NO: 2520688 - RNA, 16 nt, Human
aacuguuauuuauaau

SEQ ID NO: 2520689 - RNA, 17 nt, Human
aacuguuauuuauaauc

SEQ ID NO: 2520690 - RNA, 20 nt, Human
aacuguuauuuauaaucacu

SEQ ID NO: 2520691 - RNA, 22 nt, Human
aacuguuauuuauaaucacuuu

SEQ ID NO: 2520692 - RNA, 13 nt, Human
aacuguucccacc

SEQ ID NO: 2520693 - RNA, 15 nt, Human
aacuguucccaccug

SEQ ID NO: 2520694 - RNA, 18 nt, Human
aacuguucccaccugcug

SEQ ID NO: 2520695 - RNA, 18 nt, Human
aacagauuugugaacuca

SEQ ID NO: 2520696 - RNA, 16 nt, Human
aacagauuugugaacu

SEQ ID NO: 2520697 - RNA, 15 nt, Human
aacagauuugugaac

SEQ ID NO: 2520698 - RNA, 14 nt, Human
aacagauuugugaa

SEQ ID NO: 2520699 - RNA, 13 nt, Human
aacagauuuguga

SEQ ID NO: 2520700 - RNA, 14 nt, Human
aacagcguuuaaga

SEQ ID NO: 2520701 - RNA, 20 nt, Human
aacagcggcuggacuuggag

SEQ ID NO: 2520702 - RNA, 16 nt, Human
aacagcuaaugggaca

SEQ ID NO: 2520703 - RNA, 17 nt, Human
aacagauuuuuacaaau

SEQ ID NO: 2520704 - RNA, 14 nt, Human
aacagauuuuuaca

SEQ ID NO: 2520705 - RNA, 13 nt, Human
aacagauuuuuac

SEQ ID NO: 2520706 - RNA, 16 nt, Human
aacagauuuugggguu

SEQ ID NO: 2520707 - RNA, 23 nt, Human
aacagauuugugaacucagccaa

SEQ ID NO: 2520708 - RNA, 22 nt, Human
aacagauuugugaacucagcca

SEQ ID NO: 2520709 - RNA, 21 nt, Human
aacagauuugugaacucagcc

SEQ ID NO: 2520710 - RNA, 13 nt, Human
aacagcgcugggu

SEQ ID NO: 2520711 - RNA, 15 nt, Human
aacauccuacaagac

SEQ ID NO: 2520712 - RNA, 22 nt, Human
aacauccuacaagacacaguga

SEQ ID NO: 2520713 - RNA, 22 nt, Human
aacauccuuucuauugaaaaau

SEQ ID NO: 2520714 - RNA, 22 nt, Human
aacauccuaucaacaacaaggu

SEQ ID NO: 2520715 - RNA, 19 nt, Human
aacauccuucaagaacucu

SEQ ID NO: 2520716 - RNA, 19 nt, Human
aacaggaggacaauucaug

SEQ ID NO: 2520717 - RNA, 18 nt, Human
aacaggaggacaauucau

SEQ ID NO: 2520718 - RNA, 17 nt, Human
aacaggaggacaauuca

SEQ ID NO: 2520719 - RNA, 16 nt, Human
aacaggaggacaauuc

SEQ ID NO: 2520720 - RNA, 16 nt, Human
aacaggauuagacagu

SEQ ID NO: 2520721 - RNA, 15 nt, Human
aacaucccuccuggg

SEQ ID NO: 2520722 - RNA, 22 nt, Human
aacaggaggacaauucaugaac

SEQ ID NO: 2520723 - RNA, 19 nt, Human
aacaggauuagacagucaa

SEQ ID NO: 2520724 - RNA, 18 nt, Human
aacagcucaagucuuccc

SEQ ID NO: 2520725 - RNA, 22 nt, Human
aacagcuaugggagccccaggg

SEQ ID NO: 2520726 - RNA, 22 nt, Human
aacaggaaaggcucgaaauaca

SEQ ID NO: 2520727 - RNA, 23 nt, Human
aacagcguuuaagacuguaauga

SEQ ID NO: 2520728 - RNA, 18 nt, Human
aacagcuaugggagcccc

SEQ ID NO: 2520729 - RNA, 19 nt, Human
aacagcuaugggagcccca

SEQ ID NO: 2520730 - RNA, 10 nt, Human
aacaggaagc

SEQ ID NO: 2520731 - RNA, 22 nt, Human
aacaggaagaucuuaaauuuug

SEQ ID NO: 2520732 - RNA, 14 nt, Human
aacaggaagaucuu

SEQ ID NO: 2520733 - RNA, 10 nt, Human
aacagcucag

SEQ ID NO: 2520734 - RNA, 20 nt, Human
aacaggaaucaagagcugcc

SEQ ID NO: 2520735 - RNA, 20 nt, Human
aacaggaccacaaaaaugaa

SEQ ID NO: 2520736 - RNA, 17 nt, Human
aacaggagacaggaagg

SEQ ID NO: 2520737 - RNA, 19 nt, Human
aacaggagcugggauccua

SEQ ID NO: 2520738 - RNA, 14 nt, Human
aacaggaggacaau

SEQ ID NO: 2520739 - RNA, 21 nt, Human
aacaggagcugggauccuaag

SEQ ID NO: 2520740 - RNA, 12 nt, Human
aacaggagaauu

SEQ ID NO: 2520741 - RNA, 15 nt, Human
aacacuauaaagguu

SEQ ID NO: 2520742 - RNA, 20 nt, Human
aacacuauauggcagugucu

SEQ ID NO: 2520743 - RNA, 14 nt, Human
aacacuagccagac

SEQ ID NO: 2520744 - RNA, 18 nt, Human
aacacuauauggcagugu

SEQ ID NO: 2520745 - RNA, 14 nt, Human
aacacuauauggca

SEQ ID NO: 2520746 - RNA, 14 nt, Human
aaccgcugaauaug

SEQ ID NO: 2520747 - RNA, 21 nt, Human
aaccggauggcggacaccugg

SEQ ID NO: 2520748 - RNA, 21 nt, Human
aaccgcaggaagcugcuccgu

SEQ ID NO: 2520749 - RNA, 18 nt, Human
aaccgcacucacccaugu

SEQ ID NO: 2520750 - RNA, 13 nt, Human
aaccgcaggaagc

SEQ ID NO: 2520751 - RNA, 14 nt, Human
aaccgcaggaagcu

SEQ ID NO: 2520752 - RNA, 15 nt, Human
aaccgcaggaagcug

SEQ ID NO: 2520753 - RNA, 15 nt, Human
aaccgaugcuccagc

SEQ ID NO: 2520754 - RNA, 17 nt, Human
aaccgaugcuccagcca

SEQ ID NO: 2520755 - RNA, 21 nt, Human
aaccgaugcuccagccaaccc

SEQ ID NO: 2520756 - RNA, 20 nt, Human
aaccgaggggcucaggaaaa

SEQ ID NO: 2520757 - RNA, 22 nt, Human
aaccgagcaaagaucaaaauaa

SEQ ID NO: 2520758 - RNA, 13 nt, Human
aaccgaugcucca

SEQ ID NO: 2520759 - RNA, 17 nt, Human
aaccgagcaaagaucaa

SEQ ID NO: 2520760 - RNA, 20 nt, Human
aacccuucuccucuuguaaa

SEQ ID NO: 2520761 - RNA, 18 nt, Human
aacccuucuccucuugua

SEQ ID NO: 2520762 - RNA, 11 nt, Human
aacccuucucc

SEQ ID NO: 2520763 - RNA, 18 nt, Human
aaccauaacaacuucaua

SEQ ID NO: 2520764 - RNA, 13 nt, Human
aaccauaaacuuc

SEQ ID NO: 2520765 - RNA, 21 nt, Human
aaccauaccuuccuucccugg

SEQ ID NO: 2520766 - RNA, 18 nt, Human
aaccauaaacuucauggu

SEQ ID NO: 2520767 - RNA, 15 nt, Human
aacccuguuuuauac

SEQ ID NO: 2520768 - RNA, 16 nt, Human
aacccuguuuuauacu

SEQ ID NO: 2520769 - RNA, 23 nt, Human
aacccuguuuuauacuguacuua

SEQ ID NO: 2520770 - RNA, 20 nt, Human
aacccuguuuuauacuguac

SEQ ID NO: 2520771 - RNA, 22 nt, Human
aacccuguuuuauacuguacuu

SEQ ID NO: 2520772 - RNA, 13 nt, Human
aacccuucagugc

SEQ ID NO: 2520773 - RNA, 23 nt, Human
aacccuuaggacagggucccugc

SEQ ID NO: 2520774 - RNA, 20 nt, Human
aacccuuccccacugcacac

SEQ ID NO: 2520775 - RNA, 21 nt, Human
aacccuuaccccuuagccucc

SEQ ID NO: 2520776 - RNA, 23 nt, Human
aacccuuaccccuuagccucccu

SEQ ID NO: 2520777 - RNA, 17 nt, Human
aaccaguguuguggauu

SEQ ID NO: 2520778 - RNA, 19 nt, Human
aaccaguguuguggauuua

SEQ ID NO: 2520779 - RNA, 23 nt, Human
aaccaguuggcuaggggagcagg

SEQ ID NO: 2520780 - RNA, 13 nt, Human
aaccaguuggcua

SEQ ID NO: 2520781 - RNA, 14 nt, Human
aaccaguuauguga

SEQ ID NO: 2520782 - RNA, 15 nt, Human
aaccauaaaaagcug

SEQ ID NO: 2520783 - RNA, 18 nt, Human
aaccaguuucagguguuu

SEQ ID NO: 2520784 - RNA, 22 nt, Human
aacaugcuacacacugcauguu

SEQ ID NO: 2520785 - RNA, 14 nt, Human
aacaucuauucucu

SEQ ID NO: 2520786 - RNA, 17 nt, Human
aacaucuagcaaauguu

SEQ ID NO: 2520787 - RNA, 21 nt, Human
aacaucugagaaaagcuuuga

SEQ ID NO: 2520788 - RNA, 15 nt, Human
aacauccuuccuucc

SEQ ID NO: 2520789 - RNA, 16 nt, Human
aacaucugaaagccac

SEQ ID NO: 2520790 - RNA, 22 nt, Human
aacauggaacucauuccugccu

SEQ ID NO: 2520791 - RNA, 15 nt, Human
aacauggaaguacua

SEQ ID NO: 2520792 - RNA, 14 nt, Human
aacauggacuugua

SEQ ID NO: 2520793 - RNA, 22 nt, Human
aaccaggagcugcucacuaccu

SEQ ID NO: 2520794 - RNA, 18 nt, Human
aaccagggaagcuguccc

SEQ ID NO: 2520795 - RNA, 19 nt, Human
aaccagggaagcugucccu

SEQ ID NO: 2520796 - RNA, 21 nt, Human
aaccagguuuagacaguauga

SEQ ID NO: 2520797 - RNA, 16 nt, Human
aaccagggagacugca

SEQ ID NO: 2520798 - RNA, 21 nt, Human
aaccagggagccccuuugaug

SEQ ID NO: 2520799 - RNA, 14 nt, Human
aaaugcugccugcc

SEQ ID NO: 2520800 - RNA, 13 nt, Human
aaaugcugccugc

SEQ ID NO: 2520801 - RNA, 14 nt, Human
aaaugcugcauuuu

SEQ ID NO: 2520802 - RNA, 14 nt, Human
aaauggacguguua

SEQ ID NO: 2520803 - RNA, 14 nt, Human
aaaugcuauuuuuu

SEQ ID NO: 2520804 - RNA, 12 nt, Human
aaaugcugaaca

SEQ ID NO: 2520805 - RNA, 15 nt, Human
aaaugcugaacauug

SEQ ID NO: 2520806 - RNA, 17 nt, Human
aaauggacguguuauga

SEQ ID NO: 2520807 - RNA, 15 nt, Human
aaauggacguguuau

SEQ ID NO: 2520808 - RNA, 19 nt, Human
aaauggacauaggacucaa

SEQ ID NO: 2520809 - RNA, 16 nt, Human
aaaugcugccugccug

SEQ ID NO: 2520810 - RNA, 17 nt, Human
aaaugcugcgcccuucc

SEQ ID NO: 2520811 - RNA, 16 nt, Human
aaauggacacugugcc

SEQ ID NO: 2520812 - RNA, 22 nt, Human
aaaucuccaaaauaaaacuuuu

SEQ ID NO: 2520813 - RNA, 12 nt, Human
aaaucucuaaua

SEQ ID NO: 2520814 - RNA, 19 nt, Human
aaaucuccaaaauaaaacu

SEQ ID NO: 2520815 - RNA, 15 nt, Human
aaaucucuaauaugg

SEQ ID NO: 2520816 - RNA, 13 nt, Human
aaaucucuaauau

SEQ ID NO: 2520817 - RNA, 11 nt, Human
aaaucugaaga

SEQ ID NO: 2520818 - RNA, 13 nt, Human
aaaucugaagacc

SEQ ID NO: 2520819 - RNA, 20 nt, Human
aaaucugacccagugccccc

SEQ ID NO: 2520820 - RNA, 14 nt, Human
aaaucugacccagu

SEQ ID NO: 2520821 - RNA, 17 nt, Human
aaaucugaccaaaacaa

SEQ ID NO: 2520822 - RNA, 23 nt, Human
aaaucugugaugauccucauaug

SEQ ID NO: 2520823 - RNA, 19 nt, Human
aaaucugugaugauccuca

SEQ ID NO: 2520824 - RNA, 22 nt, Human
aaaucugcuggaguuucaugua

SEQ ID NO: 2520825 - RNA, 18 nt, Human
aaaucugacccagugccc

SEQ ID NO: 2520826 - RNA, 23 nt, Human
aaaucugcagaaggaaaaaugug

SEQ ID NO: 2520827 - RNA, 20 nt, Human
aaaucugcuggaguuucaug

SEQ ID NO: 2520828 - RNA, 18 nt, Human
aaaucugcuuuuuaaaga

SEQ ID NO: 2520829 - RNA, 14 nt, Human
aaaucuuaacuuga

SEQ ID NO: 2520830 - RNA, 19 nt, Human
aaaucugugccugagaaca

SEQ ID NO: 2520831 - RNA, 19 nt, Human
aaaucuguuugaucccugu

SEQ ID NO: 2520832 - RNA, 18 nt, Human
aaaucuguuugaucccug

SEQ ID NO: 2520833 - RNA, 20 nt, Human
aaaugcuagguuaauuccaa

SEQ ID NO: 2520834 - RNA, 20 nt, Human
aaauguucaucaaugaauga

SEQ ID NO: 2520835 - RNA, 21 nt, Human
aaauguuuuuuuuuaaagacu

SEQ ID NO: 2520836 - RNA, 18 nt, Human
aaauguuuuuuuuuaaag

SEQ ID NO: 2520837 - RNA, 15 nt, Human
aaauguugaauaaaa

SEQ ID NO: 2520838 - RNA, 12 nt, Human
aaauguugaaua

SEQ ID NO: 2520839 - RNA, 21 nt, Human
aaauguugaaaagucaaacug

SEQ ID NO: 2520840 - RNA, 15 nt, Human
aaauguucuuugggg

SEQ ID NO: 2520841 - RNA, 19 nt, Human
aaauuaaaaaaaaaaaacu

SEQ ID NO: 2520842 - RNA, 21 nt, Human
aaauuaaaaaaaaaaaacuuu

SEQ ID NO: 2520843 - RNA, 22 nt, Human
aaauguuuuuuuuuaaagacuu

SEQ ID NO: 2520844 - RNA, 12 nt, Human
aaauuaacuuuu

SEQ ID NO: 2520845 - RNA, 17 nt, Human
aaauuaacuugaguuuu

SEQ ID NO: 2520846 - RNA, 20 nt, Human
aaauuaaccauagauguaga

SEQ ID NO: 2520847 - RNA, 13 nt, Human
aaauuaacuuuua

SEQ ID NO: 2520848 - RNA, 14 nt, Human
aaauuaacuuuuau

SEQ ID NO: 2520849 - RNA, 22 nt, Human
aaauugacacuuaaaaaugguu

SEQ ID NO: 2520850 - RNA, 22 nt, Human
aaauugacagaucaagcuguga

SEQ ID NO: 2520851 - RNA, 15 nt, Human
aaauugacauugcuu

SEQ ID NO: 2520852 - RNA, 13 nt, Human
aaauugagagaau

SEQ ID NO: 2520853 - RNA, 17 nt, Human
aaauugagagaauggaa

SEQ ID NO: 2520854 - RNA, 14 nt, Human
aaauugauguguuu

SEQ ID NO: 2520855 - RNA, 18 nt, Human
aaauugaugggauuuggu

SEQ ID NO: 2520856 - RNA, 20 nt, Human
aaauugguaucaagaaaguc

SEQ ID NO: 2520857 - RNA, 22 nt, Human
aaauugguuggagaauuuaggu

SEQ ID NO: 2520858 - RNA, 22 nt, Human
aacaaaauuuaguuuuuguucu

SEQ ID NO: 2520859 - RNA, 16 nt, Human
aaauugguucuuuauu

SEQ ID NO: 2520860 - RNA, 19 nt, Human
aacaaaauuuguuugaaau

SEQ ID NO: 2520861 - RNA, 15 nt, Human
aacaaaauuucuauu

SEQ ID NO: 2520862 - RNA, 13 nt, Human
aacaaaauuucua

SEQ ID NO: 2520863 - RNA, 12 nt, Human
aacacaucagcu

SEQ ID NO: 2520864 - RNA, 21 nt, Human
aacacaguguuuuuguaaagu

SEQ ID NO: 2520865 - RNA, 20 nt, Human
aacacaguguuuuuguaaag

SEQ ID NO: 2520866 - RNA, 19 nt, Human
aacacaguguuuuuguaaa

SEQ ID NO: 2520867 - RNA, 18 nt, Human
aacacaguguuuuuguaa

SEQ ID NO: 2520868 - RNA, 22 nt, Human
aacacaguguuuuuguaaagug

SEQ ID NO: 2520869 - RNA, 17 nt, Human
aacacccucacacuggg

SEQ ID NO: 2520870 - RNA, 16 nt, Human
aacacccuauauuuug

SEQ ID NO: 2520871 - RNA, 21 nt, Human
aacacccucacacugggacuu

SEQ ID NO: 2520872 - RNA, 19 nt, Human
aacaccuagcuuuauucuu

SEQ ID NO: 2520873 - RNA, 18 nt, Human
aacacccucgaagcgcgc

SEQ ID NO: 2520874 - RNA, 11 nt, Human
aacacuaaccu

SEQ ID NO: 2520875 - RNA, 16 nt, Human
aacaccuccucaugua

SEQ ID NO: 2520876 - RNA, 18 nt, Human
aacacuaacuaugcaugg

SEQ ID NO: 2520877 - RNA, 13 nt, Human
aacaccucccagg

SEQ ID NO: 2520878 - RNA, 23 nt, Human
aacaccucccaggagacaguuca

SEQ ID NO: 2520879 - RNA, 17 nt, Human
aacacuaacaugauuug

SEQ ID NO: 2520880 - RNA, 19 nt, Human
aacaccucugcacaagcug

SEQ ID NO: 2520881 - RNA, 20 nt, Human
aacaaauuagguuuuguaca

SEQ ID NO: 2520882 - RNA, 19 nt, Human
aacaaauuagguuuuguac

SEQ ID NO: 2520883 - RNA, 16 nt, Human
aacacaguguuuuugu

SEQ ID NO: 2520884 - RNA, 19 nt, Human
aacacagugccuucaauaa

SEQ ID NO: 2520885 - RNA, 21 nt, Human
aacacauacaggaagguagaa

SEQ ID NO: 2520886 - RNA, 14 nt, Human
aacaaaugugaagg

SEQ ID NO: 2520887 - RNA, 22 nt, Human
aacacaggcaaaauccuugcuu

SEQ ID NO: 2520888 - RNA, 16 nt, Human
aacaaagguugagaug

SEQ ID NO: 2520889 - RNA, 23 nt, Human
aacaaaguuacuagguaacuuca

SEQ ID NO: 2520890 - RNA, 18 nt, Human
aacaaaggguuuuaaugu

SEQ ID NO: 2520891 - RNA, 13 nt, Human
aacaaaguuacua

SEQ ID NO: 2520892 - RNA, 13 nt, Human
aacaaauaugcaa

SEQ ID NO: 2520893 - RNA, 12 nt, Human
aacaaauaugca

SEQ ID NO: 2520894 - RNA, 22 nt, Human
aacaaaccuguuucugcagcca

SEQ ID NO: 2520895 - RNA, 15 nt, Human
aacaaacuauuucuu

SEQ ID NO: 2520896 - RNA, 14 nt, Human
aacaaacuauuucu

SEQ ID NO: 2520897 - RNA, 16 nt, Human
aacaaacucucugaac

SEQ ID NO: 2520898 - RNA, 14 nt, Human
aagugcugcauuua

SEQ ID NO: 2520899 - RNA, 13 nt, Human
aagugcugcauuu

SEQ ID NO: 2520900 - RNA, 23 nt, Human
aagugcguguguagaguuaagaa

SEQ ID NO: 2520901 - RNA, 22 nt, Human
aagugcguguguagaguuaaga

SEQ ID NO: 2520902 - RNA, 15 nt, Human
aaguagugugcaguu

SEQ ID NO: 2520903 - RNA, 13 nt, Human
aaguaggaaguaa

SEQ ID NO: 2520904 - RNA, 12 nt, Human
aaguaguuugua

SEQ ID NO: 2520905 - RNA, 20 nt, Human
aaguaguuuguauaacuucu

SEQ ID NO: 2520906 - RNA, 15 nt, Human
aaguauacauaaguu

SEQ ID NO: 2520907 - RNA, 12 nt, Human
aaguauacugua

SEQ ID NO: 2520908 - RNA, 18 nt, Human
aaguauacuguauuuuua

SEQ ID NO: 2520909 - RNA, 15 nt, Human
aaguggggacagagc

SEQ ID NO: 2520910 - RNA, 22 nt, Human
aagugggcuugauucugcagua

SEQ ID NO: 2520911 - RNA, 16 nt, Human
aagugggccaggacag

SEQ ID NO: 2520912 - RNA, 12 nt, Human
aagugggcuuga

SEQ ID NO: 2520913 - RNA, 16 nt, Human
aagugggcuugauucu

SEQ ID NO: 2520914 - RNA, 21 nt, Human
aagugggccaggacaggcccg

SEQ ID NO: 2520915 - RNA, 19 nt, Human
aaguggguuauucuggagu

SEQ ID NO: 2520916 - RNA, 19 nt, Human
aagugggugagaugcugga

SEQ ID NO: 2520917 - RNA, 14 nt, Human
aagugggugagaug

SEQ ID NO: 2520918 - RNA, 13 nt, Human
aaguggggcucgc

SEQ ID NO: 2520919 - RNA, 15 nt, Human
aaguggggcucgcca

SEQ ID NO: 2520920 - RNA, 20 nt, Human
aagugggguugcaaccacug

SEQ ID NO: 2520921 - RNA, 18 nt, Human
aaguggggugcugggagg

SEQ ID NO: 2520922 - RNA, 19 nt, Human
aagugggggcagagggcag

SEQ ID NO: 2520923 - RNA, 22 nt, Human
aaguugauaugccuuuucccaa

SEQ ID NO: 2520924 - RNA, 15 nt, Human
aaguucuucuccaau

SEQ ID NO: 2520925 - RNA, 20 nt, Human
aaguucuggaugcauuucuc

SEQ ID NO: 2520926 - RNA, 22 nt, Human
aaguucuuaguugcuguauguc

SEQ ID NO: 2520927 - RNA, 19 nt, Human
aaguucuggaugcauuucu

SEQ ID NO: 2520928 - RNA, 19 nt, Human
aaguucuguacucaaaugu

SEQ ID NO: 2520929 - RNA, 15 nt, Human
aaguucuuaguugcu

SEQ ID NO: 2520930 - RNA, 17 nt, Human
aauaaaauuuguugcau

SEQ ID NO: 2520931 - RNA, 16 nt, Human
aauaaaauuuguugca

SEQ ID NO: 2520932 - RNA, 18 nt, Human
aauaaaauuuuuuuucau

SEQ ID NO: 2520933 - RNA, 19 nt, Human
aauaaaauuuuuuuucaug

SEQ ID NO: 2520934 - RNA, 12 nt, Human
aauaaaauuuuu

SEQ ID NO: 2520935 - RNA, 10 nt, Human
aauaaaccau

SEQ ID NO: 2520936 - RNA, 17 nt, Human
aauaaaccucaaaaugu

SEQ ID NO: 2520937 - RNA, 13 nt, Human
aauaaacaaauaa

SEQ ID NO: 2520938 - RNA, 22 nt, Human
aauaaaauuuuuuuucauguuu

SEQ ID NO: 2520939 - RNA, 20 nt, Human
aaguugcacugauauuuuac

SEQ ID NO: 2520940 - RNA, 18 nt, Human
aaguugcacugauauuuu

SEQ ID NO: 2520941 - RNA, 18 nt, Human
aaguugcacggcugcuga

SEQ ID NO: 2520942 - RNA, 16 nt, Human
aaguugcacggcugcu

SEQ ID NO: 2520943 - RNA, 15 nt, Human
aaguugcacggcugc

SEQ ID NO: 2520944 - RNA, 14 nt, Human
aaguugaugcaauc

SEQ ID NO: 2520945 - RNA, 18 nt, Human
aaguugauggugaugaaa

SEQ ID NO: 2520946 - RNA, 14 nt, Human
aauaaaauuuguug

SEQ ID NO: 2520947 - RNA, 13 nt, Human
aauaaaauuuguu

SEQ ID NO: 2520948 - RNA, 12 nt, Human
aauaaaauuugu

SEQ ID NO: 2520949 - RNA, 11 nt, Human
aauaaaauuug

SEQ ID NO: 2520950 - RNA, 14 nt, Human
aauaaaauuguaaa

SEQ ID NO: 2520951 - RNA, 12 nt, Human
aauaaaauugua

SEQ ID NO: 2520952 - RNA, 15 nt, Human
aauaaaauugcacuu

SEQ ID NO: 2520953 - RNA, 13 nt, Human
aauaauaaagauc

SEQ ID NO: 2520954 - RNA, 16 nt, Human
aauaaaggaugugauu

SEQ ID NO: 2520955 - RNA, 21 nt, Human
aauaaacgauuuaauucucuu

SEQ ID NO: 2520956 - RNA, 19 nt, Human
aauaauaaagaugcucuuu

SEQ ID NO: 2520957 - RNA, 21 nt, Human
aauaauaaagaucauguaaaa

SEQ ID NO: 2520958 - RNA, 18 nt, Human
aauaauaaagaugcucuu

SEQ ID NO: 2520959 - RNA, 14 nt, Human
aauaauaaauauuu

SEQ ID NO: 2520960 - RNA, 19 nt, Human
aauaaagcuguguggcagu

SEQ ID NO: 2520961 - RNA, 11 nt, Human
aauaaagcugu

SEQ ID NO: 2520962 - RNA, 20 nt, Human
aauaaaccucaaaaugucua

SEQ ID NO: 2520963 - RNA, 15 nt, Human
aauaaacgauuuaau

SEQ ID NO: 2520964 - RNA, 12 nt, Human
aauaaacgauuu

SEQ ID NO: 2520965 - RNA, 15 nt, Human
aauaaagcccuggga

SEQ ID NO: 2520966 - RNA, 15 nt, Human
aauaaagccugcuuu

SEQ ID NO: 2520967 - RNA, 18 nt, Human
aauaaagccuucaaacuc

SEQ ID NO: 2520968 - RNA, 19 nt, Human
aauaauguuucaaacauau

SEQ ID NO: 2520969 - RNA, 14 nt, Human
aauaauguuucaaa

SEQ ID NO: 2520970 - RNA, 12 nt, Human
aauaauguuuca

SEQ ID NO: 2520971 - RNA, 14 nt, Human
aauaauauauguuu

SEQ ID NO: 2520972 - RNA, 17 nt, Human
aauaauaugcauuguca

SEQ ID NO: 2520973 - RNA, 19 nt, Human
aauaauauauuuucuguuu

SEQ ID NO: 2520974 - RNA, 17 nt, Human
aauaauauauuuucugu

SEQ ID NO: 2520975 - RNA, 15 nt, Human
aauaauauauuuucu

SEQ ID NO: 2520976 - RNA, 15 nt, Human
aauaauaugcauugu

SEQ ID NO: 2520977 - RNA, 13 nt, Human
aauaauaugcauu

SEQ ID NO: 2520978 - RNA, 12 nt, Human
aauaauaugcau

SEQ ID NO: 2520979 - RNA, 11 nt, Human
aauaauaugca

SEQ ID NO: 2520980 - RNA, 13 nt, Human
aauaauauauguu

SEQ ID NO: 2520981 - RNA, 17 nt, Human
aauaauauauuuuaaau

SEQ ID NO: 2520982 - RNA, 16 nt, Human
aauaauauacuugugg

SEQ ID NO: 2520983 - RNA, 13 nt, Human
aauaauauacuug

SEQ ID NO: 2520984 - RNA, 12 nt, Human
aauaauauacuu

SEQ ID NO: 2520985 - RNA, 14 nt, Human
aauaauacacuaau

SEQ ID NO: 2520986 - RNA, 18 nt, Human
aauaauaccuaagccuuc

SEQ ID NO: 2520987 - RNA, 20 nt, Human
aauaauacauugaauuagaa

SEQ ID NO: 2520988 - RNA, 21 nt, Human
aauaauaauuauccagaguuu

SEQ ID NO: 2520989 - RNA, 11 nt, Human
aauaauaauua

SEQ ID NO: 2520990 - RNA, 11 nt, Human
aauaauaaauc

SEQ ID NO: 2520991 - RNA, 22 nt, Human
aauacuucucaaaccuguuuaa

SEQ ID NO: 2520992 - RNA, 21 nt, Human
aauacuucucaaaccuguuua

SEQ ID NO: 2520993 - RNA, 23 nt, Human
aauacuucucaaaccuguuuaaa

SEQ ID NO: 2520994 - RNA, 12 nt, Human
aauacuguuuga

SEQ ID NO: 2520995 - RNA, 17 nt, Human
aauacuucucaaaccug

SEQ ID NO: 2520996 - RNA, 14 nt, Human
aauacuaccuugaa

SEQ ID NO: 2520997 - RNA, 15 nt, Human
aauacuaccuugaaa

SEQ ID NO: 2520998 - RNA, 16 nt, Human
aauacuaccuugaaaa

SEQ ID NO: 2520999 - RNA, 21 nt, Human
aauaccugucccccugacaac

SEQ ID NO: 2521000 - RNA, 18 nt, Human
aauacgcacuacaugugg

SEQ ID NO: 2521001 - RNA, 16 nt, Human
aauacgcacuacaugu

SEQ ID NO: 2521002 - RNA, 22 nt, Human
aauauaaaaggcaaauguguac

SEQ ID NO: 2521003 - RNA, 23 nt, Human
aauauaaaauaugaagacauaaa

SEQ ID NO: 2521004 - RNA, 14 nt, Human
aauauaaaaggcaa

SEQ ID NO: 2521005 - RNA, 17 nt, Human
aauauaaaacuguacuu

SEQ ID NO: 2521006 - RNA, 18 nt, Human
aauauaaaacugcguuaa

SEQ ID NO: 2521007 - RNA, 14 nt, Human
aauauaaaacugcg

SEQ ID NO: 2521008 - RNA, 23 nt, Human
aauauaaaaggcaaauguguaca

SEQ ID NO: 2521009 - RNA, 14 nt, Human
aauauaaaauauga

SEQ ID NO: 2521010 - RNA, 21 nt, Human
aauaguuuuauuaauaaacau

SEQ ID NO: 2521011 - RNA, 20 nt, Human
aauaguuuuauuaauaaaca

SEQ ID NO: 2521012 - RNA, 22 nt, Human
aauaguuuuauuaauaaacauu

SEQ ID NO: 2521013 - RNA, 11 nt, Human
aauauaaaacu

SEQ ID NO: 2521014 - RNA, 20 nt, Human
aauagaaaacugaaaaucua

SEQ ID NO: 2521015 - RNA, 13 nt, Human
aauagaaacucac

SEQ ID NO: 2521016 - RNA, 22 nt, Human
aauagaaauaaaggaugugauu

SEQ ID NO: 2521017 - RNA, 21 nt, Human
aauagaaacucaccauguaaa

SEQ ID NO: 2521018 - RNA, 15 nt, Human
aauagaagaacaucc

SEQ ID NO: 2521019 - RNA, 16 nt, Human
aauagaaauuuccaga

SEQ ID NO: 2521020 - RNA, 16 nt, Human
aauagaaauaaguggu

SEQ ID NO: 2521021 - RNA, 17 nt, Human
aauagaaauggggaacu

SEQ ID NO: 2521022 - RNA, 13 nt, Human
aauauagaaacac

SEQ ID NO: 2521023 - RNA, 22 nt, Human
aauauagaaacacgaacuuuag

SEQ ID NO: 2521024 - RNA, 14 nt, Human
aauauagaaacacg

SEQ ID NO: 2521025 - RNA, 21 nt, Human
aauauagaucaguuauaagua

SEQ ID NO: 2521026 - RNA, 23 nt, Human
aauauacuuguggacuaaaagau

SEQ ID NO: 2521027 - RNA, 22 nt, Human
aauauacuuguggacuaaaaga

SEQ ID NO: 2521028 - RNA, 17 nt, Human
aauauacuuguggacua

SEQ ID NO: 2521029 - RNA, 16 nt, Human
aauauaggaacuuaaa

SEQ ID NO: 2521030 - RNA, 15 nt, Human
aauauagcuauuuuu

SEQ ID NO: 2521031 - RNA, 16 nt, Human
aauauagcuguacaaa

SEQ ID NO: 2521032 - RNA, 13 nt, Human
aauauagcuauuu

SEQ ID NO: 2521033 - RNA, 13 nt, Human
aauauaacugccu

SEQ ID NO: 2521034 - RNA, 21 nt, Human
aauauaaagauggcugacuuu

SEQ ID NO: 2521035 - RNA, 14 nt, Human
aauauaaacacuau

SEQ ID NO: 2521036 - RNA, 13 nt, Human
aauauaaacacua

SEQ ID NO: 2521037 - RNA, 20 nt, Human
aauauggaacuucuaauaua

SEQ ID NO: 2521038 - RNA, 10 nt, Human
aauaugcuua

SEQ ID NO: 2521039 - RNA, 11 nt, Human
aauaugcuuac

SEQ ID NO: 2521040 - RNA, 14 nt, Human
aauauggaacuuac

SEQ ID NO: 2521041 - RNA, 15 nt, Human
aauauggaacuuaca

SEQ ID NO: 2521042 - RNA, 16 nt, Human
aauauggaacuuacau

SEQ ID NO: 2521043 - RNA, 17 nt, Human
aauauggaacuuacauu

SEQ ID NO: 2521044 - RNA, 17 nt, Human
aauauggaacuucuaau

SEQ ID NO: 2521045 - RNA, 14 nt, Human
aauauggaacuucu

SEQ ID NO: 2521046 - RNA, 20 nt, Human
aauauggaacuuacauuguu

SEQ ID NO: 2521047 - RNA, 24 nt, Human
aauauggaacuuacauuguucaau

SEQ ID NO: 2521048 - RNA, 21 nt, Human
aauauagcuguacaaauauaa

SEQ ID NO: 2521049 - RNA, 20 nt, Human
aauauagcuguacaaauaua

SEQ ID NO: 2521050 - RNA, 19 nt, Human
aauauagcuguacaaauau

SEQ ID NO: 2521051 - RNA, 18 nt, Human
aauauagcuguacaaaua

SEQ ID NO: 2521052 - RNA, 22 nt, Human
aauauagcuguacaaauauaag

SEQ ID NO: 2521053 - RNA, 17 nt, Human
aauaugccuuuuugaag

SEQ ID NO: 2521054 - RNA, 14 nt, Human
aauaugcugccaaa

SEQ ID NO: 2521055 - RNA, 19 nt, Human
aauaugcugccaaauuuug

SEQ ID NO: 2521056 - RNA, 22 nt, Human
aauaugcugccaaauuuuggcc

SEQ ID NO: 2521057 - RNA, 16 nt, Human
aauaugcuggcuggag

SEQ ID NO: 2521058 - RNA, 14 nt, Human
aauaugcuggcugg

SEQ ID NO: 2521059 - RNA, 15 nt, Human
aaucaaauaugcaaa

SEQ ID NO: 2521060 - RNA, 16 nt, Human
aaucaaauaugcaaag

SEQ ID NO: 2521061 - RNA, 22 nt, Human
aaucaaauaugcaaagcacuga

SEQ ID NO: 2521062 - RNA, 18 nt, Human
aauauggaacuucuaaua

SEQ ID NO: 2521063 - RNA, 22 nt, Human
aaucauuucugcaucagcugcu

SEQ ID NO: 2521064 - RNA, 22 nt, Human
aaucauuuggguuaauauggcu

SEQ ID NO: 2521065 - RNA, 14 nt, Human
aaucauuugcuuuu

SEQ ID NO: 2521066 - RNA, 11 nt, Human
aaucauuuguu

SEQ ID NO: 2521067 - RNA, 21 nt, Human
aaucauuucuugggcccuccu

SEQ ID NO: 2521068 - RNA, 22 nt, Human
aaucauuucuugggcccuccug

SEQ ID NO: 2521069 - RNA, 22 nt, Human
aaucauuuuaauuauuauucuu

SEQ ID NO: 2521070 - RNA, 20 nt, Human
aaucauuuuaauuauuauuc

SEQ ID NO: 2521071 - RNA, 19 nt, Human
aaucauuuuaauuauuauu

SEQ ID NO: 2521072 - RNA, 17 nt, Human
aaucauuuuaauuauua

SEQ ID NO: 2521073 - RNA, 16 nt, Human
aaucauuuuaauuauu

SEQ ID NO: 2521074 - RNA, 15 nt, Human
aaucauuuuaauuau

SEQ ID NO: 2521075 - RNA, 18 nt, Human
aaucauuuguucaaagcu

SEQ ID NO: 2521076 - RNA, 19 nt, Human
aaucauuuugccucuuuuc

SEQ ID NO: 2521077 - RNA, 23 nt, Human
aaucauuuuauaugucaaagcag

SEQ ID NO: 2521078 - RNA, 20 nt, Human
aaucauuuuauaugucaaag

SEQ ID NO: 2521079 - RNA, 19 nt, Human
aaucauuuuauaugucaaa

SEQ ID NO: 2521080 - RNA, 20 nt, Human
aaucauuuuacccuuggcuc

SEQ ID NO: 2521081 - RNA, 18 nt, Human
aaugauguccagaagaau

SEQ ID NO: 2521082 - RNA, 15 nt, Human
aaugauguccagaag

SEQ ID NO: 2521083 - RNA, 14 nt, Human
aaugauguccagaa

SEQ ID NO: 2521084 - RNA, 23 nt, Human
aaugauguauguugaagccuuug

SEQ ID NO: 2521085 - RNA, 17 nt, Human
aaugauauauggauaau

SEQ ID NO: 2521086 - RNA, 18 nt, Human
aaugauauagccagaaaa

SEQ ID NO: 2521087 - RNA, 18 nt, Human
aaugauaguaagaaaagu

SEQ ID NO: 2521088 - RNA, 15 nt, Human
aaugauagcuacugu

SEQ ID NO: 2521089 - RNA, 13 nt, Human
aaugauuaauuaa

SEQ ID NO: 2521090 - RNA, 12 nt, Human
aaugauuaauua

SEQ ID NO: 2521091 - RNA, 21 nt, Human
aaugauguguacccaaacgug

SEQ ID NO: 2521092 - RNA, 14 nt, Human
aaugauaacuggaa

SEQ ID NO: 2521093 - RNA, 14 nt, Human
aaugaacaaauuga

SEQ ID NO: 2521094 - RNA, 23 nt, Human
aaugaaauuacuacaaaauuuga

SEQ ID NO: 2521095 - RNA, 14 nt, Human
aaugaaauuguaaa

SEQ ID NO: 2521096 - RNA, 17 nt, Human
aaugaaauuacuacaaa

SEQ ID NO: 2521097 - RNA, 16 nt, Human
aaugauaacuggaaac

SEQ ID NO: 2521098 - RNA, 15 nt, Human
aaugauaacuggaaa

SEQ ID NO: 2521099 - RNA, 21 nt, Human
aaugaacacucuuuugcuuua

SEQ ID NO: 2521100 - RNA, 15 nt, Human
aaugaacacucuuuu

SEQ ID NO: 2521101 - RNA, 18 nt, Human
aaugaacacucuuuugcu

SEQ ID NO: 2521102 - RNA, 18 nt, Human
aaugauacccugaauuug

SEQ ID NO: 2521103 - RNA, 16 nt, Human
aauccauacauuugug

SEQ ID NO: 2521104 - RNA, 18 nt, Human
aauccacucccaggcagc

SEQ ID NO: 2521105 - RNA, 17 nt, Human
aauccacucccaggcag

SEQ ID NO: 2521106 - RNA, 15 nt, Human
aauccacucccaggc

SEQ ID NO: 2521107 - RNA, 23 nt, Human
aauccacccauccuaccaaugca

SEQ ID NO: 2521108 - RNA, 13 nt, Human
aauccagaaagaa

SEQ ID NO: 2521109 - RNA, 17 nt, Human
aauccagaaagaaaaaa

SEQ ID NO: 2521110 - RNA, 17 nt, Human
aauccauacauuugugu

SEQ ID NO: 2521111 - RNA, 21 nt, Human
aauccaucuaaauaccugccc

SEQ ID NO: 2521112 - RNA, 22 nt, Human
aauccagaauugaccuuuugac

SEQ ID NO: 2521113 - RNA, 14 nt, Human
aauccaaacuugga

SEQ ID NO: 2521114 - RNA, 21 nt, Human
aauccaaacuuggauuuuuga

SEQ ID NO: 2521115 - RNA, 13 nt, Human
aauccaaauggcg

SEQ ID NO: 2521116 - RNA, 20 nt, Human
aauccaaauggcgucuggaa

SEQ ID NO: 2521117 - RNA, 17 nt, Human
aauccaacccaugauga

SEQ ID NO: 2521118 - RNA, 22 nt, Human
aauccaagauauuuuaaaaucu

SEQ ID NO: 2521119 - RNA, 18 nt, Human
aauccacaaucugacauu

SEQ ID NO: 2521120 - RNA, 12 nt, Human
aauccacccauc

SEQ ID NO: 2521121 - RNA, 19 nt, Human
aauccaccugccucggccu

SEQ ID NO: 2521122 - RNA, 18 nt, Human
aauccaccugccucggcc

SEQ ID NO: 2521123 - RNA, 19 nt, Human
aaucucguuucaaaaacac

SEQ ID NO: 2521124 - RNA, 18 nt, Human
aaucucguuucaaaaaca

SEQ ID NO: 2521125 - RNA, 16 nt, Human
aaucucguuucaaaaa

SEQ ID NO: 2521126 - RNA, 15 nt, Human
aaucucguuucaaaa

SEQ ID NO: 2521127 - RNA, 23 nt, Human
aaucuggaccccaucugugaaua

SEQ ID NO: 2521128 - RNA, 24 nt, Human
aaucuggaccccaucugugaauaa

SEQ ID NO: 2521129 - RNA, 16 nt, Human
aaucuggacuccucug

SEQ ID NO: 2521130 - RNA, 15 nt, Human
aaucuggacuccucu

SEQ ID NO: 2521131 - RNA, 18 nt, Human
aaucuggacuccucuguc

SEQ ID NO: 2521132 - RNA, 17 nt, Human
aaucuggacuccucugu

SEQ ID NO: 2521133 - RNA, 20 nt, Human
aaucuggacuccucugucca

SEQ ID NO: 2521134 - RNA, 14 nt, Human
aaucuggagaccag

SEQ ID NO: 2521135 - RNA, 23 nt, Human
aauccaucuaaauaccugcccug

SEQ ID NO: 2521136 - RNA, 22 nt, Human
aauccaucuaaauaccugcccu

SEQ ID NO: 2521137 - RNA, 15 nt, Human
aauccaugcuugggu

SEQ ID NO: 2521138 - RNA, 18 nt, Human
aaucuccaaaauaaaacu

SEQ ID NO: 2521139 - RNA, 16 nt, Human
aauccauguaagguau

SEQ ID NO: 2521140 - RNA, 12 nt, Human
aauccauguaag

SEQ ID NO: 2521141 - RNA, 15 nt, Human
aaucuccaguauucu

SEQ ID NO: 2521142 - RNA, 17 nt, Human
aaucucccgcugcugcu

SEQ ID NO: 2521143 - RNA, 23 nt, Human
aaucucgcucugucgcccaggcu

SEQ ID NO: 2521144 - RNA, 19 nt, Human
aaucucccgcugcugcugc

SEQ ID NO: 2521145 - RNA, 15 nt, Human
aaucuccucuuuuau

SEQ ID NO: 2521146 - RNA, 18 nt, Human
aaucucggcucacugcau

SEQ ID NO: 2521147 - RNA, 18 nt, Human
aaucuccucuuuuaucuu

SEQ ID NO: 2521148 - RNA, 18 nt, Human
aaugcccguaaugcuuag

SEQ ID NO: 2521149 - RNA, 19 nt, Human
aaugcccguaaugcuuaga

SEQ ID NO: 2521150 - RNA, 22 nt, Human
aaugcccuuacacuuacuguug

SEQ ID NO: 2521151 - RNA, 18 nt, Human
aaugcccuuacacuuacu

SEQ ID NO: 2521152 - RNA, 22 nt, Human
aaugcccucaggggacuugaau

SEQ ID NO: 2521153 - RNA, 16 nt, Human
aaugcccuuaaaucau

SEQ ID NO: 2521154 - RNA, 20 nt, Human
aaugccucaguguauuugua

SEQ ID NO: 2521155 - RNA, 15 nt, Human
aaugccucaguguau

SEQ ID NO: 2521156 - RNA, 20 nt, Human
aaugccucaaugugaccagg

SEQ ID NO: 2521157 - RNA, 23 nt, Human
aaugccucaguguauuuguauuu

SEQ ID NO: 2521158 - RNA, 21 nt, Human
aaugccucaguguauuuguau

SEQ ID NO: 2521159 - RNA, 12 nt, Human
aaugccuccucc

SEQ ID NO: 2521160 - RNA, 14 nt, Human
aaugccuccucccu

SEQ ID NO: 2521161 - RNA, 15 nt, Human
aaugccuccucccug

SEQ ID NO: 2521162 - RNA, 17 nt, Human
aaugcgcaggcuggccc

SEQ ID NO: 2521163 - RNA, 18 nt, Human
aaugcgcaggcuggcccu

SEQ ID NO: 2521164 - RNA, 19 nt, Human
aaugcgcaggcuggcccug

SEQ ID NO: 2521165 - RNA, 20 nt, Human
aaugcgcaggcuggcccugc

SEQ ID NO: 2521166 - RNA, 15 nt, Human
aaugcgcaggcuggc

SEQ ID NO: 2521167 - RNA, 14 nt, Human
aaugcgcaggcugg

SEQ ID NO: 2521168 - RNA, 16 nt, Human
aaugccugagugccug

SEQ ID NO: 2521169 - RNA, 19 nt, Human
aaugccugagugccuggcc

SEQ ID NO: 2521170 - RNA, 17 nt, Human
aaugccugagugccugg

SEQ ID NO: 2521171 - RNA, 21 nt, Human
aaugcgugcauaccacuuuug

SEQ ID NO: 2521172 - RNA, 23 nt, Human
aaugcgugcauaccacuuuuguu

SEQ ID NO: 2521173 - RNA, 13 nt, Human
aaugcuacuuuau

SEQ ID NO: 2521174 - RNA, 23 nt, Human
aaugcuacgugugauuuuucugg

SEQ ID NO: 2521175 - RNA, 18 nt, Human
aaugcuagcucugagcca

SEQ ID NO: 2521176 - RNA, 19 nt, Human
aaugcuacgugugauuuuu

SEQ ID NO: 2521177 - RNA, 17 nt, Human
aaugcuacgugugauuu

SEQ ID NO: 2521178 - RNA, 16 nt, Human
aaugcuacgugugauu

SEQ ID NO: 2521179 - RNA, 20 nt, Human
aaugcuaaagaaaaagucau

SEQ ID NO: 2521180 - RNA, 18 nt, Human
aaugcuaaagaaaaaguc

SEQ ID NO: 2521181 - RNA, 15 nt, Human
aaugguaugagcuga

SEQ ID NO: 2521182 - RNA, 15 nt, Human
aaugguauagcaaau

SEQ ID NO: 2521183 - RNA, 16 nt, Human
aauggguaucuauauu

SEQ ID NO: 2521184 - RNA, 12 nt, Human
aauggguaauau

SEQ ID NO: 2521185 - RNA, 20 nt, Human
aaugggggccucuucaaauu

SEQ ID NO: 2521186 - RNA, 14 nt, Human
aauggggccagauc

SEQ ID NO: 2521187 - RNA, 22 nt, Human
aauggggccagauccagccugg

SEQ ID NO: 2521188 - RNA, 19 nt, Human
aauggggguagcagcugga

SEQ ID NO: 2521189 - RNA, 18 nt, Human
aauggggguagcagcugg

SEQ ID NO: 2521190 - RNA, 17 nt, Human
aaugggguccuggccau

SEQ ID NO: 2521191 - RNA, 18 nt, Human
aaugggguccuggccauc

SEQ ID NO: 2521192 - RNA, 15 nt, Human
aaugggggugcauuu

SEQ ID NO: 2521193 - RNA, 17 nt, Human
aaugggggugcauuuga

SEQ ID NO: 2521194 - RNA, 17 nt, Human
aauggucccauccaggc

SEQ ID NO: 2521195 - RNA, 16 nt, Human
aaugguccaggguuga

SEQ ID NO: 2521196 - RNA, 14 nt, Human
aaugguccaggguu

SEQ ID NO: 2521197 - RNA, 13 nt, Human
aaugguccagggu

SEQ ID NO: 2521198 - RNA, 15 nt, Human
aaugucacaggcagg

SEQ ID NO: 2521199 - RNA, 18 nt, Human
aauggucagcguugcaug

SEQ ID NO: 2521200 - RNA, 14 nt, Human
aauggucagcguug

SEQ ID NO: 2521201 - RNA, 20 nt, Human
aauggucagcguugcauguc

SEQ ID NO: 2521202 - RNA, 14 nt, Human
aaugguccaggaga

SEQ ID NO: 2521203 - RNA, 19 nt, Human
aaugguccaggagaaggcc

SEQ ID NO: 2521204 - RNA, 16 nt, Human
aaugguauggaacucu

SEQ ID NO: 2521205 - RNA, 18 nt, Human
aaugguaugagcugaggg

SEQ ID NO: 2521206 - RNA, 14 nt, Human
aaugggagcucaug

SEQ ID NO: 2521207 - RNA, 13 nt, Human
aaugggacacuaa

SEQ ID NO: 2521208 - RNA, 23 nt, Human
aaugggcacugggaugagccgcu

SEQ ID NO: 2521209 - RNA, 12 nt, Human
aaugggcacagc

SEQ ID NO: 2521210 - RNA, 18 nt, Human
aaugggcaaaacugaauu

SEQ ID NO: 2521211 - RNA, 17 nt, Human
aauggggccagauccag

SEQ ID NO: 2521212 - RNA, 21 nt, Human
aaugggagcugaggccacacu

SEQ ID NO: 2521213 - RNA, 21 nt, Human
aaugggacuucuuuucacauu

SEQ ID NO: 2521214 - RNA, 20 nt, Human
aaugggacuucuuuucacau

SEQ ID NO: 2521215 - RNA, 18 nt, Human
aaugggacuucuuuucac

SEQ ID NO: 2521216 - RNA, 17 nt, Human
aaugggacuucuuuuca

SEQ ID NO: 2521217 - RNA, 23 nt, Human
aaugcucuuuacuucauggacuu

SEQ ID NO: 2521218 - RNA, 20 nt, Human
aaugcucuggggucuuuuua

SEQ ID NO: 2521219 - RNA, 16 nt, Human
aaugggaauauuuuau

SEQ ID NO: 2521220 - RNA, 13 nt, Human
aaugcucuccuuu

SEQ ID NO: 2521221 - RNA, 14 nt, Human
aaugcucuccuuuc

SEQ ID NO: 2521222 - RNA, 19 nt, Human
aaugcuccuuguuccuaga

SEQ ID NO: 2521223 - RNA, 11 nt, Human
aaugcucuagu

SEQ ID NO: 2521224 - RNA, 21 nt, Human
aaugcucccccauccuccccu

SEQ ID NO: 2521225 - RNA, 22 nt, Human
aaugcucccccauccuccccuu

SEQ ID NO: 2521226 - RNA, 20 nt, Human
aaugcuauuuuuuauuuuac

SEQ ID NO: 2521227 - RNA, 11 nt, Human
aaugcuccccc

SEQ ID NO: 2521228 - RNA, 14 nt, Human
aaugcucccccauc

SEQ ID NO: 2521229 - RNA, 20 nt, Human
aaugcucccccauccucccc

SEQ ID NO: 2521230 - RNA, 12 nt, Human
aaugcucaucug

SEQ ID NO: 2521231 - RNA, 16 nt, Human
aaugcucauaacggau

SEQ ID NO: 2521232 - RNA, 17 nt, Human
aaugcuaggucucggac

SEQ ID NO: 2521233 - RNA, 15 nt, Human
aaugcucagaccagc

SEQ ID NO: 2521234 - RNA, 13 nt, Human
aacuguuguauaa

SEQ ID NO: 2521235 - RNA, 14 nt, Human
aacuguuguauaaa

SEQ ID NO: 2521236 - RNA, 15 nt, Human
aacuguuguauaaau

SEQ ID NO: 2521237 - RNA, 17 nt, Human
aacuguugccagagaug

SEQ ID NO: 2521238 - RNA, 18 nt, Human
aacuguugccagagaugg

SEQ ID NO: 2521239 - RNA, 14 nt, Human
aacuguugauugca

SEQ ID NO: 2521240 - RNA, 16 nt, Human
aacuguuaugaaauaa

SEQ ID NO: 2521241 - RNA, 15 nt, Human
aacuguugccagaga

SEQ ID NO: 2521242 - RNA, 19 nt, Human
aacuguuguauaaauuuau

SEQ ID NO: 2521243 - RNA, 22 nt, Human
aacuguuuagggcccugauuug

SEQ ID NO: 2521244 - RNA, 13 nt, Human
aacuuacacacaa

SEQ ID NO: 2521245 - RNA, 19 nt, Human
aacuuacauuguucaauua

SEQ ID NO: 2521246 - RNA, 20 nt, Human
aacuuacauuguucaauuag

SEQ ID NO: 2521247 - RNA, 21 nt, Human
aacuuacauuguucaauuaga

SEQ ID NO: 2521248 - RNA, 22 nt, Human
aacuuacauuguucaauuagaa

SEQ ID NO: 2521249 - RNA, 23 nt, Human
aacuuacauugugaaacuucugu

SEQ ID NO: 2521250 - RNA, 15 nt, Human
aacuuagaauaaaau

SEQ ID NO: 2521251 - RNA, 16 nt, Human
aacuuagaauaaaauu

SEQ ID NO: 2521252 - RNA, 23 nt, Human
aacuuaccgugagcgacaaagau

SEQ ID NO: 2521253 - RNA, 19 nt, Human
aacuuaccugggcauucuu

SEQ ID NO: 2521254 - RNA, 14 nt, Human
aacuuacuuagugu

SEQ ID NO: 2521255 - RNA, 21 nt, Human
aacuuagaauaaaauuguaaa

SEQ ID NO: 2521256 - RNA, 19 nt, Human
aacuuagaauaaaauugua

SEQ ID NO: 2521257 - RNA, 18 nt, Human
aacuuagaauaaaauugu

SEQ ID NO: 2521258 - RNA, 17 nt, Human
aacuuagaauaaaauug

SEQ ID NO: 2521259 - RNA, 23 nt, Human
aagacaggacagugcuucagccu

SEQ ID NO: 2521260 - RNA, 22 nt, Human
aagacagcuucucauccugcag

SEQ ID NO: 2521261 - RNA, 16 nt, Human
aagacaugucuguucu

SEQ ID NO: 2521262 - RNA, 17 nt, Human
aagacaugucuguucua

SEQ ID NO: 2521263 - RNA, 19 nt, Human
aagacaugucuguucuaca

SEQ ID NO: 2521264 - RNA, 21 nt, Human
aagacauucuuccaaaaagau

SEQ ID NO: 2521265 - RNA, 16 nt, Human
aagacuuuggaaagag

SEQ ID NO: 2521266 - RNA, 15 nt, Human
aagacauuaaaucua

SEQ ID NO: 2521267 - RNA, 17 nt, Human
aagacauguuuuagaca

SEQ ID NO: 2521268 - RNA, 14 nt, Human
aagacauguuuuag

SEQ ID NO: 2521269 - RNA, 13 nt, Human
aagacauguuuua

SEQ ID NO: 2521270 - RNA, 18 nt, Human
aagacauuaaaucuauga

SEQ ID NO: 2521271 - RNA, 13 nt, Human
aagacauugucaa

SEQ ID NO: 2521272 - RNA, 23 nt, Human
aagacagugaaagaaaauaacaa

SEQ ID NO: 2521273 - RNA, 12 nt, Human
aagacaugucug

SEQ ID NO: 2521274 - RNA, 13 nt, Human
aagacaugucugu

SEQ ID NO: 2521275 - RNA, 19 nt, Human
aagacauggagacuccugc

SEQ ID NO: 2521276 - RNA, 22 nt, Human
aagacaggaugggggcuggccu

SEQ ID NO: 2521277 - RNA, 16 nt, Human
aagacauguagguguu

SEQ ID NO: 2521278 - RNA, 19 nt, Human
aagacauggggaggaagga

SEQ ID NO: 2521279 - RNA, 21 nt, Human
aagacagggcugauaagcuaa

SEQ ID NO: 2521280 - RNA, 18 nt, Human
aagacauggagacuccug

SEQ ID NO: 2521281 - RNA, 15 nt, Human
aagagaacuuccaga

SEQ ID NO: 2521282 - RNA, 20 nt, Human
aagagaacccacgaacauuc

SEQ ID NO: 2521283 - RNA, 15 nt, Human
aagacuuuuaugaua

SEQ ID NO: 2521284 - RNA, 20 nt, Human
aagacuuugggauaggaaaa

SEQ ID NO: 2521285 - RNA, 18 nt, Human
aagagaagggcagggcug

SEQ ID NO: 2521286 - RNA, 22 nt, Human
aagagaaccgagcaaagaucaa

SEQ ID NO: 2521287 - RNA, 21 nt, Human
aagagaaccgagcaaagauca

SEQ ID NO: 2521288 - RNA, 16 nt, Human
aagagaaccgagcaaa

SEQ ID NO: 2521289 - RNA, 19 nt, Human
aagacuuugggauaggaaa

SEQ ID NO: 2521290 - RNA, 22 nt, Human
aagagaauauuuuaaguauugc

SEQ ID NO: 2521291 - RNA, 20 nt, Human
aagagaauauuuuaaguauu

SEQ ID NO: 2521292 - RNA, 18 nt, Human
aagagaauauuuuaagua

SEQ ID NO: 2521293 - RNA, 21 nt, Human
aagagaaguuauuuucuacag

SEQ ID NO: 2521294 - RNA, 14 nt, Human
aagagaaguuauuu

SEQ ID NO: 2521295 - RNA, 13 nt, Human
aagagaauauuuu

SEQ ID NO: 2521296 - RNA, 12 nt, Human
aagagaauauuu

SEQ ID NO: 2521297 - RNA, 20 nt, Human
aagagaauauuagcuuuacu

SEQ ID NO: 2521298 - RNA, 18 nt, Human
aagagaggagaggagaga

SEQ ID NO: 2521299 - RNA, 17 nt, Human
aagagaggagaggagag

SEQ ID NO: 2521300 - RNA, 22 nt, Human
aagagagcuuaaugauaauauu

SEQ ID NO: 2521301 - RNA, 15 nt, Human
aagagaggacacaaa

SEQ ID NO: 2521302 - RNA, 15 nt, Human
aagagagauguuuug

SEQ ID NO: 2521303 - RNA, 12 nt, Human
aagagagaaugu

SEQ ID NO: 2521304 - RNA, 13 nt, Human
aagagagaaugua

SEQ ID NO: 2521305 - RNA, 22 nt, Human
aagagacaggagggcaagggcc

SEQ ID NO: 2521306 - RNA, 21 nt, Human
aagagacagucaccccaggac

SEQ ID NO: 2521307 - RNA, 20 nt, Human
aagagacagucaccccagga

SEQ ID NO: 2521308 - RNA, 14 nt, Human
aagagacagucacc

SEQ ID NO: 2521309 - RNA, 21 nt, Human
aagagacaaacaccucccagg

SEQ ID NO: 2521310 - RNA, 19 nt, Human
aagagacaaacaccuccca

SEQ ID NO: 2521311 - RNA, 19 nt, Human
aagagagaaaauaaaaagu

SEQ ID NO: 2521312 - RNA, 20 nt, Human
aagagagaaaauaaaaaguu

SEQ ID NO: 2521313 - RNA, 21 nt, Human
aagagagaaaauaaaaaguua

SEQ ID NO: 2521314 - RNA, 22 nt, Human
aagagagaaaauaaaaaguuaa

SEQ ID NO: 2521315 - RNA, 21 nt, Human
aagagagaaagaaguaggcau

SEQ ID NO: 2521316 - RNA, 23 nt, Human
aagagagaaaauaaaaaguuaaa

SEQ ID NO: 2521317 - RNA, 14 nt, Human
aagagagaaagaag

SEQ ID NO: 2521318 - RNA, 14 nt, Human
aagauuuuucucaa

SEQ ID NO: 2521319 - RNA, 13 nt, Human
aagauuuuucuca

SEQ ID NO: 2521320 - RNA, 23 nt, Human
aagauuuuggaggguccuccaca

SEQ ID NO: 2521321 - RNA, 21 nt, Human
aagauuuuggaggagaaggac

SEQ ID NO: 2521322 - RNA, 18 nt, Human
aagauuuuccuuuuuuau

SEQ ID NO: 2521323 - RNA, 12 nt, Human
aagauuuuccuu

SEQ ID NO: 2521324 - RNA, 21 nt, Human
aagauuuuccuuuuuuauaca

SEQ ID NO: 2521325 - RNA, 15 nt, Human
aagauuuugaaugcu

SEQ ID NO: 2521326 - RNA, 17 nt, Human
aagauuuugaaugcuuc

SEQ ID NO: 2521327 - RNA, 21 nt, Human
aagauuuugaaugcuuccuga

SEQ ID NO: 2521328 - RNA, 19 nt, Human
aagauuuugaaauuuuuau

SEQ ID NO: 2521329 - RNA, 13 nt, Human
aagauuuucagaa

SEQ ID NO: 2521330 - RNA, 15 nt, Human
aagauugcugaaauu

SEQ ID NO: 2521331 - RNA, 22 nt, Human
aagcagaauaaagcaauuuucc

SEQ ID NO: 2521332 - RNA, 21 nt, Human
aagcagaauaaagcaauuuuc

SEQ ID NO: 2521333 - RNA, 20 nt, Human
aagcagaauaaagcaauuuu

SEQ ID NO: 2521334 - RNA, 19 nt, Human
aagcagaauaaagcaauuu

SEQ ID NO: 2521335 - RNA, 18 nt, Human
aagcagaauaaagcaauu

SEQ ID NO: 2521336 - RNA, 17 nt, Human
aagcagaauaaagcaau

SEQ ID NO: 2521337 - RNA, 16 nt, Human
aagcagaauaaagcaa

SEQ ID NO: 2521338 - RNA, 15 nt, Human
aagcagaauaaagca

SEQ ID NO: 2521339 - RNA, 14 nt, Human
aagcagaauaaagc

SEQ ID NO: 2521340 - RNA, 13 nt, Human
aagcagaauaaag

SEQ ID NO: 2521341 - RNA, 12 nt, Human
aagcagaauaaa

SEQ ID NO: 2521342 - RNA, 11 nt, Human
aagcagaauaa

SEQ ID NO: 2521343 - RNA, 12 nt, Human
aagcagaaauac

SEQ ID NO: 2521344 - RNA, 20 nt, Human
aagcagaaaauacagcugga

SEQ ID NO: 2521345 - RNA, 19 nt, Human
aagcacuuggacucuugcu

SEQ ID NO: 2521346 - RNA, 15 nt, Human
aagcacugugcucag

SEQ ID NO: 2521347 - RNA, 16 nt, Human
aagcacugugcucagg

SEQ ID NO: 2521348 - RNA, 13 nt, Human
aagcagaaaauac

SEQ ID NO: 2521349 - RNA, 20 nt, Human
aagcacuuggacucuugcuc

SEQ ID NO: 2521350 - RNA, 18 nt, Human
aagcacuuugggauucuu

SEQ ID NO: 2521351 - RNA, 19 nt, Human
aagccaccaacauacuccc

SEQ ID NO: 2521352 - RNA, 20 nt, Human
aagcaggggcuacaagaggg

SEQ ID NO: 2521353 - RNA, 19 nt, Human
aagcaggggaguaugcaaa

SEQ ID NO: 2521354 - RNA, 18 nt, Human
aagcaggggaguaugcaa

SEQ ID NO: 2521355 - RNA, 17 nt, Human
aagcaggggaguaugca

SEQ ID NO: 2521356 - RNA, 22 nt, Human
aagcaggggcuacaagagggaa

SEQ ID NO: 2521357 - RNA, 21 nt, Human
aagcaggggcuacaagaggga

SEQ ID NO: 2521358 - RNA, 17 nt, Human
aagcagggucugggcag

SEQ ID NO: 2521359 - RNA, 22 nt, Human
aagcagaggaggggccgcugcc

SEQ ID NO: 2521360 - RNA, 14 nt, Human
aagcagaugcaaag

SEQ ID NO: 2521361 - RNA, 16 nt, Human
aagcagaugcaaagag

SEQ ID NO: 2521362 - RNA, 12 nt, Human
aagcagggagga

SEQ ID NO: 2521363 - RNA, 15 nt, Human
aagcagaggaggggc

SEQ ID NO: 2521364 - RNA, 20 nt, Human
aagcagaggaggggccgcug

SEQ ID NO: 2521365 - RNA, 15 nt, Human
aagcagggacuugaa

SEQ ID NO: 2521366 - RNA, 23 nt, Human
aagcagaauaaagcaauuuuccu

SEQ ID NO: 2521367 - RNA, 21 nt, Human
aagcagaggaaggagaggaga

SEQ ID NO: 2521368 - RNA, 12 nt, Human
aagcagaggagg

SEQ ID NO: 2521369 - RNA, 14 nt, Human
aagcagaggagggg

SEQ ID NO: 2521370 - RNA, 17 nt, Human
aagauucaaucccagga

SEQ ID NO: 2521371 - RNA, 18 nt, Human
aagauuagaaugaaaauu

SEQ ID NO: 2521372 - RNA, 13 nt, Human
aagauuagaauga

SEQ ID NO: 2521373 - RNA, 18 nt, Human
aagauuagaagcugaaaa

SEQ ID NO: 2521374 - RNA, 14 nt, Human
aagauagcagggca

SEQ ID NO: 2521375 - RNA, 13 nt, Human
aagauuagaagcu

SEQ ID NO: 2521376 - RNA, 11 nt, Human
aagauuagaag

SEQ ID NO: 2521377 - RNA, 17 nt, Human
aagauuacuuuuucuuu

SEQ ID NO: 2521378 - RNA, 23 nt, Human
aagauucacaccugacucugaaa

SEQ ID NO: 2521379 - RNA, 19 nt, Human
aagauucacaccugacucu

SEQ ID NO: 2521380 - RNA, 15 nt, Human
aagauucagguaugu

SEQ ID NO: 2521381 - RNA, 20 nt, Human
aagauucauauuuacuucuu

SEQ ID NO: 2521382 - RNA, 12 nt, Human
aagauucccaga

SEQ ID NO: 2521383 - RNA, 13 nt, Human
aagauucccagag

SEQ ID NO: 2521384 - RNA, 14 nt, Human
aagauucccagaga

SEQ ID NO: 2521385 - RNA, 21 nt, Human
aagauucauuuuuaaucauga

SEQ ID NO: 2521386 - RNA, 20 nt, Human
aagauucauuuuuaaucaug

SEQ ID NO: 2521387 - RNA, 19 nt, Human
aagauucauuuuuaaucau

SEQ ID NO: 2521388 - RNA, 17 nt, Human
aagauucauccauuuau

SEQ ID NO: 2521389 - RNA, 15 nt, Human
aagauucccagagac

SEQ ID NO: 2521390 - RNA, 18 nt, Human
aagauucccagagacagg

SEQ ID NO: 2521391 - RNA, 17 nt, Human
aagauucuccugugcua

SEQ ID NO: 2521392 - RNA, 12 nt, Human
aagauugcugaa

SEQ ID NO: 2521393 - RNA, 16 nt, Human
aagauucuuucccaau

SEQ ID NO: 2521394 - RNA, 13 nt, Human
aagauucuuuccc

SEQ ID NO: 2521395 - RNA, 19 nt, Human
aaggucuuugguucagcua

SEQ ID NO: 2521396 - RNA, 15 nt, Human
aaggugaaggaauau

SEQ ID NO: 2521397 - RNA, 14 nt, Human
aaggugaaggaaua

SEQ ID NO: 2521398 - RNA, 11 nt, Human
aaggugaagga

SEQ ID NO: 2521399 - RNA, 13 nt, Human
aaggucuuugguu

SEQ ID NO: 2521400 - RNA, 16 nt, Human
aaggucuggccucagg

SEQ ID NO: 2521401 - RNA, 17 nt, Human
aagggcauccuucugcc

SEQ ID NO: 2521402 - RNA, 14 nt, Human
aagggcauccuucu

SEQ ID NO: 2521403 - RNA, 23 nt, Human
aaggucuggagaagcucccagga

SEQ ID NO: 2521404 - RNA, 17 nt, Human
aagguguaacucuaauu

SEQ ID NO: 2521405 - RNA, 20 nt, Human
aagguggugggggugcagau

SEQ ID NO: 2521406 - RNA, 22 nt, Human
aagguggucugcucgggcccag

SEQ ID NO: 2521407 - RNA, 20 nt, Human
aaggugguauguguguguau

SEQ ID NO: 2521408 - RNA, 18 nt, Human
aaggugucagaauaauaa

SEQ ID NO: 2521409 - RNA, 20 nt, Human
aaggugucuuccucccaagu

SEQ ID NO: 2521410 - RNA, 16 nt, Human
aaggugucuuccuccc

SEQ ID NO: 2521411 - RNA, 15 nt, Human
aaggugucuuccucc

SEQ ID NO: 2521412 - RNA, 18 nt, Human
aaggugaaggaauauaug

SEQ ID NO: 2521413 - RNA, 16 nt, Human
aaggugaaggaauaua

SEQ ID NO: 2521414 - RNA, 20 nt, Human
aaggugggcugagcccuggc

SEQ ID NO: 2521415 - RNA, 21 nt, Human
aaggugggcugagcccuggca

SEQ ID NO: 2521416 - RNA, 16 nt, Human
aaggugguaugugugu

SEQ ID NO: 2521417 - RNA, 21 nt, Human
aagguggggucuuugugagag

SEQ ID NO: 2521418 - RNA, 17 nt, Human
aaggugguaugugugug

SEQ ID NO: 2521419 - RNA, 16 nt, Human
aagguggggacaggga

SEQ ID NO: 2521420 - RNA, 23 nt, Human
aaggugggguauuuaccacagca

SEQ ID NO: 2521421 - RNA, 18 nt, Human
aagguuaggauuuaacag

SEQ ID NO: 2521422 - RNA, 17 nt, Human
aagguuaggauuuaaca

SEQ ID NO: 2521423 - RNA, 22 nt, Human
aagguguucauucacuugcauu

SEQ ID NO: 2521424 - RNA, 17 nt, Human
aagguuauuuauuuaaa

SEQ ID NO: 2521425 - RNA, 18 nt, Human
aagguuaccaagaagccu

SEQ ID NO: 2521426 - RNA, 22 nt, Human
aagguuauuuauuuaaaugucu

SEQ ID NO: 2521427 - RNA, 20 nt, Human
aagguuauuuauuuaaaugu

SEQ ID NO: 2521428 - RNA, 17 nt, Human
aagguucacuaaagcag

SEQ ID NO: 2521429 - RNA, 21 nt, Human
aagguucucagguguugccaa

SEQ ID NO: 2521430 - RNA, 21 nt, Human
aagguuccaacuguauauauu

SEQ ID NO: 2521431 - RNA, 16 nt, Human
aagguucccucugaga

SEQ ID NO: 2521432 - RNA, 23 nt, Human
aagguuccgcuuggagcagaggg

SEQ ID NO: 2521433 - RNA, 19 nt, Human
aagguuccaacuguauaua

SEQ ID NO: 2521434 - RNA, 18 nt, Human
aagguuccaacuguauau

SEQ ID NO: 2521435 - RNA, 22 nt, Human
aagguuccaaucagaucuuuau

SEQ ID NO: 2521436 - RNA, 12 nt, Human
aaguagaggagg

SEQ ID NO: 2521437 - RNA, 21 nt, Human
aagguucucuccuccccaagg

SEQ ID NO: 2521438 - RNA, 17 nt, Human
aagguucucauaggaaa

SEQ ID NO: 2521439 - RNA, 19 nt, Human
aaguagacuucauuuuucc

SEQ ID NO: 2521440 - RNA, 23 nt, Human
aaguagacuucauuuuuccuaac

SEQ ID NO: 2521441 - RNA, 15 nt, Human
aaguaggaaaaauaa

SEQ ID NO: 2521442 - RNA, 18 nt, Human
aagggcaaaauucccagg

SEQ ID NO: 2521443 - RNA, 22 nt, Human
aagggauuuuagucacacgugg

SEQ ID NO: 2521444 - RNA, 20 nt, Human
aagggcaacaauaaaauagc

SEQ ID NO: 2521445 - RNA, 21 nt, Human
aagggcaauaccguguugguu

SEQ ID NO: 2521446 - RNA, 19 nt, Human
aagggcagaacacuaaccu

SEQ ID NO: 2521447 - RNA, 18 nt, Human
aagggcagaacacuaacc

SEQ ID NO: 2521448 - RNA, 15 nt, Human
aagggcagagucaca

SEQ ID NO: 2521449 - RNA, 22 nt, Human
aagggcagggcaucuccugugc

SEQ ID NO: 2521450 - RNA, 21 nt, Human
aagggcaggaaggagagccug

SEQ ID NO: 2521451 - RNA, 22 nt, Human
aagggcaggaaggagagccugc

SEQ ID NO: 2521452 - RNA, 14 nt, Human
aagggauggcaaga

SEQ ID NO: 2521453 - RNA, 17 nt, Human
aagggauggcaagaugu

SEQ ID NO: 2521454 - RNA, 18 nt, Human
aagggauuacccaagcaa

SEQ ID NO: 2521455 - RNA, 17 nt, Human
aagggauuacccaagca

SEQ ID NO: 2521456 - RNA, 21 nt, Human
aagggauggaaaaggaagacu

SEQ ID NO: 2521457 - RNA, 24 nt, Human
aagggauggaggucacacugguag

SEQ ID NO: 2521458 - RNA, 20 nt, Human
aagggauuuuagucacacgu

SEQ ID NO: 2521459 - RNA, 17 nt, Human
aagggauuuuagucaca

SEQ ID NO: 2521460 - RNA, 19 nt, Human
aagggauuacccaagcaaa

SEQ ID NO: 2521461 - RNA, 17 nt, Human
aagggacugagaaauuu

SEQ ID NO: 2521462 - RNA, 15 nt, Human
aagggacugagaaau

SEQ ID NO: 2521463 - RNA, 18 nt, Human
aagggacgcuacccggga

SEQ ID NO: 2521464 - RNA, 12 nt, Human
aagggagaagaa

SEQ ID NO: 2521465 - RNA, 13 nt, Human
aagggagaaaaaa

SEQ ID NO: 2521466 - RNA, 20 nt, Human
aagggacuuggaagcuccgc

SEQ ID NO: 2521467 - RNA, 19 nt, Human
aagggauauauaagaugga

SEQ ID NO: 2521468 - RNA, 15 nt, Human
aagggaucugguccu

SEQ ID NO: 2521469 - RNA, 15 nt, Human
aagggauggaaaagg

SEQ ID NO: 2521470 - RNA, 20 nt, Human
aagggauggaaaaggaagac

SEQ ID NO: 2521471 - RNA, 16 nt, Human
aagcgauucuucugcu

SEQ ID NO: 2521472 - RNA, 16 nt, Human
aagcgugagccacugc

SEQ ID NO: 2521473 - RNA, 14 nt, Human
aagcgauucuucug

SEQ ID NO: 2521474 - RNA, 15 nt, Human
aagcgauucuucugc

SEQ ID NO: 2521475 - RNA, 18 nt, Human
aagccagcaggcucucag

SEQ ID NO: 2521476 - RNA, 15 nt, Human
aagccagcaggcucu

SEQ ID NO: 2521477 - RNA, 17 nt, Human
aagccaccucucccuca

SEQ ID NO: 2521478 - RNA, 17 nt, Human
aagccacugaagcuggg

SEQ ID NO: 2521479 - RNA, 13 nt, Human
aagccacugaagc

SEQ ID NO: 2521480 - RNA, 14 nt, Human
aagccacugaagcu

SEQ ID NO: 2521481 - RNA, 18 nt, Human
aagcagguucccaagcuc

SEQ ID NO: 2521482 - RNA, 21 nt, Human
aagccaccaacauacucccau

SEQ ID NO: 2521483 - RNA, 19 nt, Human
aagccagauuuuccugaaa

SEQ ID NO: 2521484 - RNA, 20 nt, Human
aagccaccucucccucaaca

SEQ ID NO: 2521485 - RNA, 13 nt, Human
aagccaccucucc

SEQ ID NO: 2521486 - RNA, 11 nt, Human
aagccaccucu

SEQ ID NO: 2521487 - RNA, 13 nt, Human
aagcacugugcua

SEQ ID NO: 2521488 - RNA, 12 nt, Human
aagcugccagcc

SEQ ID NO: 2521489 - RNA, 11 nt, Human
aagcugccagc

SEQ ID NO: 2521490 - RNA, 22 nt, Human
aagcugccagccgagauagcca

SEQ ID NO: 2521491 - RNA, 14 nt, Human
aagcugcugacagu

SEQ ID NO: 2521492 - RNA, 20 nt, Human
aagcgugagccacugcaccg

SEQ ID NO: 2521493 - RNA, 17 nt, Human
aagcgugagccacugca

SEQ ID NO: 2521494 - RNA, 18 nt, Human
aagcugcaucuagaggcu

SEQ ID NO: 2521495 - RNA, 21 nt, Human
aagcgugagccacugcaccgg

SEQ ID NO: 2521496 - RNA, 23 nt, Human
aaggaaugauuaauuaaaacaca

SEQ ID NO: 2521497 - RNA, 23 nt, Human
aaggaauccacucccaggcagcc

SEQ ID NO: 2521498 - RNA, 22 nt, Human
aaggaauccacucccaggcagc

SEQ ID NO: 2521499 - RNA, 21 nt, Human
aaggaauccacucccaggcag

SEQ ID NO: 2521500 - RNA, 23 nt, Human
aaggaauauauggcagaguugua

SEQ ID NO: 2521501 - RNA, 20 nt, Human
aaggaauccacucccaggca

SEQ ID NO: 2521502 - RNA, 21 nt, Human
aaggaauaugggagaaauagu

SEQ ID NO: 2521503 - RNA, 21 nt, Human
aaggaaucuccaguuuucagu

SEQ ID NO: 2521504 - RNA, 15 nt, Human
aaggaauucuaggca

SEQ ID NO: 2521505 - RNA, 21 nt, Human
aaggaauguagcugguuuccu

SEQ ID NO: 2521506 - RNA, 17 nt, Human
aaggaaucuccaguuuu

SEQ ID NO: 2521507 - RNA, 15 nt, Human
aagcugcccugccca

SEQ ID NO: 2521508 - RNA, 16 nt, Human
aagcugcugacagugu

SEQ ID NO: 2521509 - RNA, 22 nt, Human
aaggaauauauggcagaguugu

SEQ ID NO: 2521510 - RNA, 18 nt, Human
aaggaauauauggcagag

SEQ ID NO: 2521511 - RNA, 23 nt, Human
aagcuggaggacuagaaccugga

SEQ ID NO: 2521512 - RNA, 17 nt, Human
aaggaauauauggcaga

SEQ ID NO: 2521513 - RNA, 19 nt, Human
aagcuggaggacuagaacc

SEQ ID NO: 2521514 - RNA, 14 nt, Human
aagcuggaagcaca

SEQ ID NO: 2521515 - RNA, 21 nt, Human
aagcugcuuuaaaaaaauaca

SEQ ID NO: 2521516 - RNA, 11 nt, Human
aagcuggaagc

SEQ ID NO: 2521517 - RNA, 12 nt, Human
aaggaauuuuau

SEQ ID NO: 2521518 - RNA, 20 nt, Human
aaggaauucuaggcauccca

SEQ ID NO: 2521519 - RNA, 23 nt, Human
aaggacaaaaaugaacugaaguu

SEQ ID NO: 2521520 - RNA, 17 nt, Human
aaggacaaaaaugaacu

SEQ ID NO: 2521521 - RNA, 22 nt, Human
aaggacacagaugaaacacaaa

SEQ ID NO: 2521522 - RNA, 18 nt, Human
aaggacacagaugaaaca

SEQ ID NO: 2521523 - RNA, 14 nt, Human
aaggacacacuaau

SEQ ID NO: 2521524 - RNA, 14 nt, Human
aaggacaauuucaa

SEQ ID NO: 2521525 - RNA, 22 nt, Human
aaggacccggaggggccuggca

SEQ ID NO: 2521526 - RNA, 13 nt, Human
aaggaccuccuga

SEQ ID NO: 2521527 - RNA, 15 nt, Human
aaggcaaaaauguaa

SEQ ID NO: 2521528 - RNA, 21 nt, Human
aaggacuacguuaagggaagg

SEQ ID NO: 2521529 - RNA, 12 nt, Human
aaggcaaaauug

SEQ ID NO: 2521530 - RNA, 13 nt, Human
aaggacuaggguc

SEQ ID NO: 2521531 - RNA, 21 nt, Human
aaggacggccuucaacugaaa

SEQ ID NO: 2521532 - RNA, 14 nt, Human
aaggcagaagcagc

SEQ ID NO: 2521533 - RNA, 14 nt, Human
aaggcacugccuga

SEQ ID NO: 2521534 - RNA, 15 nt, Human
aaggcagaaagcaaa

SEQ ID NO: 2521535 - RNA, 16 nt, Human
aaggcagaaagcaaaa

SEQ ID NO: 2521536 - RNA, 17 nt, Human
aaggcagaaagcaaaau

SEQ ID NO: 2521537 - RNA, 19 nt, Human
aaggcagaaagcaaaauua

SEQ ID NO: 2521538 - RNA, 14 nt, Human
aaggcagccaccag

SEQ ID NO: 2521539 - RNA, 11 nt, Human
aaggcagccac

SEQ ID NO: 2521540 - RNA, 13 nt, Human
aaggcacugccug

SEQ ID NO: 2521541 - RNA, 12 nt, Human
aaggcacugccu

SEQ ID NO: 2521542 - RNA, 21 nt, Human
aaggcacucuguuauuuagac

SEQ ID NO: 2521543 - RNA, 17 nt, Human
aaggcaaaugcccaagg

SEQ ID NO: 2521544 - RNA, 14 nt, Human
aaggcaaaugacuu

SEQ ID NO: 2521545 - RNA, 15 nt, Human
aaggcaaaugacuuu

SEQ ID NO: 2521546 - RNA, 16 nt, Human
aaggcaaaugacuuug

SEQ ID NO: 2521547 - RNA, 16 nt, Human
aaggcaaaugcccaag

SEQ ID NO: 2521548 - RNA, 14 nt, Human
aaggcaaaauugca

SEQ ID NO: 2521549 - RNA, 15 nt, Human
aaggcaaaauugcaa

SEQ ID NO: 2521550 - RNA, 19 nt, Human
aaggcaaaauugcaaaucu

SEQ ID NO: 2521551 - RNA, 15 nt, Human
aaggcaaacccauca

SEQ ID NO: 2521552 - RNA, 20 nt, Human
aaggcaaacccaucaacaaa

SEQ ID NO: 2521553 - RNA, 20 nt, Human
aaggcaaagcacgaaauguu

SEQ ID NO: 2521554 - RNA, 20 nt, Human
acagugauuaccagggacug

SEQ ID NO: 2521555 - RNA, 23 nt, Human
acagugagucgaggacagggagg

SEQ ID NO: 2521556 - RNA, 21 nt, Human
acagugauuaccagggacuga

SEQ ID NO: 2521557 - RNA, 20 nt, Human
acagugcauauuccuuucua

SEQ ID NO: 2521558 - RNA, 13 nt, Human
acagugauuuuuu

SEQ ID NO: 2521559 - RNA, 10 nt, Human
acagugauuu

SEQ ID NO: 2521560 - RNA, 21 nt, Human
acagugcauauuccuuucuau

SEQ ID NO: 2521561 - RNA, 14 nt, Human
acagugggugcccc

SEQ ID NO: 2521562 - RNA, 21 nt, Human
acagugggugccccccuugcc

SEQ ID NO: 2521563 - RNA, 15 nt, Human
acagugguggcaggg

SEQ ID NO: 2521564 - RNA, 13 nt, Human
acagugguggcag

SEQ ID NO: 2521565 - RNA, 15 nt, Human
acaguggguggugga

SEQ ID NO: 2521566 - RNA, 17 nt, Human
acagugguggcagggcc

SEQ ID NO: 2521567 - RNA, 16 nt, Human
acagugguggcagggc

SEQ ID NO: 2521568 - RNA, 18 nt, Human
acagugguuuuauacuga

SEQ ID NO: 2521569 - RNA, 13 nt, Human
acaguguacaguc

SEQ ID NO: 2521570 - RNA, 12 nt, Human
acaguguacagu

SEQ ID NO: 2521571 - RNA, 17 nt, Human
acaguguacagucuugu

SEQ ID NO: 2521572 - RNA, 15 nt, Human
acaguguacagucuu

SEQ ID NO: 2521573 - RNA, 20 nt, Human
acagugguuuuauacugaag

SEQ ID NO: 2521574 - RNA, 23 nt, Human
acagugguggcagggccuagcug

SEQ ID NO: 2521575 - RNA, 22 nt, Human
acagugguuuuauacugaagga

SEQ ID NO: 2521576 - RNA, 18 nt, Human
acaguguacagucuugua

SEQ ID NO: 2521577 - RNA, 21 nt, Human
acagugucugggcugacuggg

SEQ ID NO: 2521578 - RNA, 19 nt, Human
acagugucugggcugacug

SEQ ID NO: 2521579 - RNA, 16 nt, Human
acagugucugggcuga

SEQ ID NO: 2521580 - RNA, 15 nt, Human
acagugucugggcug

SEQ ID NO: 2521581 - RNA, 23 nt, Human
acagugucuguaucggagacagu

SEQ ID NO: 2521582 - RNA, 14 nt, Human
acagcucuguccug

SEQ ID NO: 2521583 - RNA, 23 nt, Human
acagcuccuucuguccuacucug

SEQ ID NO: 2521584 - RNA, 18 nt, Human
acagcuccuucuguccua

SEQ ID NO: 2521585 - RNA, 16 nt, Human
acagcuccuucugucc

SEQ ID NO: 2521586 - RNA, 18 nt, Human
acagaggggguggccucc

SEQ ID NO: 2521587 - RNA, 17 nt, Human
acagaggggguggccuc

SEQ ID NO: 2521588 - RNA, 19 nt, Human
acagaggggguggccuccc

SEQ ID NO: 2521589 - RNA, 15 nt, Human
acagcuccuucuguc

SEQ ID NO: 2521590 - RNA, 23 nt, Human
acaggcaagcaccuccugccucg

SEQ ID NO: 2521591 - RNA, 20 nt, Human
acaggcaagcaccuccugcc

SEQ ID NO: 2521592 - RNA, 12 nt, Human
acagcugccugc

SEQ ID NO: 2521593 - RNA, 13 nt, Human
acagcugccuggg

SEQ ID NO: 2521594 - RNA, 16 nt, Human
acagcugccugcagua

SEQ ID NO: 2521595 - RNA, 17 nt, Human
acagcucuguccuggga

SEQ ID NO: 2521596 - RNA, 16 nt, Human
acagcucuguccuggg

SEQ ID NO: 2521597 - RNA, 13 nt, Human
acagcucuguccu

SEQ ID NO: 2521598 - RNA, 20 nt, Human
acagaggagggcgugacuca

SEQ ID NO: 2521599 - RNA, 23 nt, Human
acagcugagcacauucuggcuca

SEQ ID NO: 2521600 - RNA, 22 nt, Human
acagcugaggucucuugaggga

SEQ ID NO: 2521601 - RNA, 21 nt, Human
acagcugcagagacagagagg

SEQ ID NO: 2521602 - RNA, 17 nt, Human
acagcugcagagacaga

SEQ ID NO: 2521603 - RNA, 15 nt, Human
acagcugcagagaca

SEQ ID NO: 2521604 - RNA, 16 nt, Human
acagcugaggucucuu

SEQ ID NO: 2521605 - RNA, 20 nt, Human
acaggugggcuucccagugg

SEQ ID NO: 2521606 - RNA, 21 nt, Human
acagguggcaggaccaggacu

SEQ ID NO: 2521607 - RNA, 22 nt, Human
acaggugggcuucccaguggcu

SEQ ID NO: 2521608 - RNA, 23 nt, Human
acaggugugagucaccaagccca

SEQ ID NO: 2521609 - RNA, 22 nt, Human
acaggugugagucaccaagccc

SEQ ID NO: 2521610 - RNA, 19 nt, Human
acaggugugaaccaccaca

SEQ ID NO: 2521611 - RNA, 18 nt, Human
acagugagccugaauuuu

SEQ ID NO: 2521612 - RNA, 21 nt, Human
acagugagccugaauuuuguu

SEQ ID NO: 2521613 - RNA, 17 nt, Human
acagguuacaacagauu

SEQ ID NO: 2521614 - RNA, 16 nt, Human
acagguuacaacagau

SEQ ID NO: 2521615 - RNA, 17 nt, Human
acagugagccugaauuu

SEQ ID NO: 2521616 - RNA, 15 nt, Human
acagguuacaacaga

SEQ ID NO: 2521617 - RNA, 14 nt, Human
acagguuacaacag

SEQ ID NO: 2521618 - RNA, 13 nt, Human
acagguuacaaca

SEQ ID NO: 2521619 - RNA, 12 nt, Human
acagguuacaac

SEQ ID NO: 2521620 - RNA, 14 nt, Human
acagguguuuauac

SEQ ID NO: 2521621 - RNA, 22 nt, Human
acagugagucgaggacagggag

SEQ ID NO: 2521622 - RNA, 17 nt, Human
acagugaggugcccagc

SEQ ID NO: 2521623 - RNA, 23 nt, Human
acagugagcuuggaaaggaccag

SEQ ID NO: 2521624 - RNA, 21 nt, Human
acagggccuuuggcaggugca

SEQ ID NO: 2521625 - RNA, 22 nt, Human
acagggcuaagagcuagcgcug

SEQ ID NO: 2521626 - RNA, 19 nt, Human
acaggcaagcaccuccugc

SEQ ID NO: 2521627 - RNA, 14 nt, Human
acaggcaaugcugg

SEQ ID NO: 2521628 - RNA, 21 nt, Human
acaggucuuuccuaaggcugc

SEQ ID NO: 2521629 - RNA, 16 nt, Human
acaggucuucaucgaa

SEQ ID NO: 2521630 - RNA, 19 nt, Human
acaggucuccucuuaaaaa

SEQ ID NO: 2521631 - RNA, 20 nt, Human
acagguggcaggaccaggac

SEQ ID NO: 2521632 - RNA, 19 nt, Human
acagguggcaggaccagga

SEQ ID NO: 2521633 - RNA, 16 nt, Human
acagguggcaggacca

SEQ ID NO: 2521634 - RNA, 15 nt, Human
acagguggcaggacc

SEQ ID NO: 2521635 - RNA, 16 nt, Human
acagguggacacacaa

SEQ ID NO: 2521636 - RNA, 18 nt, Human
acagguggacacacaagg

SEQ ID NO: 2521637 - RNA, 18 nt, Human
acaggucuccucuuaaaa

SEQ ID NO: 2521638 - RNA, 23 nt, Human
acagggcuggcccagcccugcug

SEQ ID NO: 2521639 - RNA, 22 nt, Human
acagggcuggcccagcccugcu

SEQ ID NO: 2521640 - RNA, 21 nt, Human
acagggcuggcccagcccugc

SEQ ID NO: 2521641 - RNA, 20 nt, Human
acagggcuggcccagcccug

SEQ ID NO: 2521642 - RNA, 19 nt, Human
acagggcuggcccagcccu

SEQ ID NO: 2521643 - RNA, 18 nt, Human
acagggcuggcccagccc

SEQ ID NO: 2521644 - RNA, 17 nt, Human
acagggcuggcccagcc

SEQ ID NO: 2521645 - RNA, 16 nt, Human
acagggcuggcccagc

SEQ ID NO: 2521646 - RNA, 15 nt, Human
acagggcuggcccag

SEQ ID NO: 2521647 - RNA, 14 nt, Human
acagggcuggccca

SEQ ID NO: 2521648 - RNA, 13 nt, Human
acagggcuggccc

SEQ ID NO: 2521649 - RNA, 21 nt, Human
acagggcugauaagcuaacac

SEQ ID NO: 2521650 - RNA, 20 nt, Human
acaucaucaaggcacugccu

SEQ ID NO: 2521651 - RNA, 15 nt, Human
acaucaguuacucug

SEQ ID NO: 2521652 - RNA, 18 nt, Human
acaucaguuacucugaag

SEQ ID NO: 2521653 - RNA, 19 nt, Human
acaucaucaaggcacugcc

SEQ ID NO: 2521654 - RNA, 15 nt, Human
acaucaguuuuaacg

SEQ ID NO: 2521655 - RNA, 20 nt, Human
acaucaguuacucugaaggg

SEQ ID NO: 2521656 - RNA, 20 nt, Human
acaucccuuaccugggaaag

SEQ ID NO: 2521657 - RNA, 15 nt, Human
acauccucuucugcu

SEQ ID NO: 2521658 - RNA, 13 nt, Human
acauccucuucug

SEQ ID NO: 2521659 - RNA, 21 nt, Human
acaugauuuccuugaaugugg

SEQ ID NO: 2521660 - RNA, 16 nt, Human
acaugcaaggucauuu

SEQ ID NO: 2521661 - RNA, 15 nt, Human
acauccuacaagaca

SEQ ID NO: 2521662 - RNA, 21 nt, Human
acauccuccacguucugcuca

SEQ ID NO: 2521663 - RNA, 15 nt, Human
acauccuccucccac

SEQ ID NO: 2521664 - RNA, 13 nt, Human
acauccuccuccc

SEQ ID NO: 2521665 - RNA, 14 nt, Human
acauccuccgucca

SEQ ID NO: 2521666 - RNA, 17 nt, Human
acauccuccguccagcc

SEQ ID NO: 2521667 - RNA, 18 nt, Human
acaugccucucucaggcc

SEQ ID NO: 2521668 - RNA, 17 nt, Human
acaugccucucucaggc

SEQ ID NO: 2521669 - RNA, 16 nt, Human
acaugccucucucagg

SEQ ID NO: 2521670 - RNA, 15 nt, Human
acaugccucucucag

SEQ ID NO: 2521671 - RNA, 23 nt, Human
acaugauuuccuugaauguggcu

SEQ ID NO: 2521672 - RNA, 18 nt, Human
acaugcaaggucauuuuu

SEQ ID NO: 2521673 - RNA, 17 nt, Human
acaugcaaggucauuuu

SEQ ID NO: 2521674 - RNA, 14 nt, Human
acaugccacaagga

SEQ ID NO: 2521675 - RNA, 18 nt, Human
acaugccaagcacugugc

SEQ ID NO: 2521676 - RNA, 14 nt, Human
acaugccaagcacu

SEQ ID NO: 2521677 - RNA, 16 nt, Human
acauaagauaaaugug

SEQ ID NO: 2521678 - RNA, 14 nt, Human
acauaagcucagaa

SEQ ID NO: 2521679 - RNA, 15 nt, Human
acauaagauaaaugu

SEQ ID NO: 2521680 - RNA, 22 nt, Human
acauaagcggcguaaguuuaaa

SEQ ID NO: 2521681 - RNA, 19 nt, Human
acauaauuaaauuuugagu

SEQ ID NO: 2521682 - RNA, 15 nt, Human
acauaaguaauucaa

SEQ ID NO: 2521683 - RNA, 20 nt, Human
acauaauuaaaguguccauu

SEQ ID NO: 2521684 - RNA, 14 nt, Human
acaucaggaguuca

SEQ ID NO: 2521685 - RNA, 20 nt, Human
acaucaguggcauggcucca

SEQ ID NO: 2521686 - RNA, 22 nt, Human
acaucaguggcauggcuccagu

SEQ ID NO: 2521687 - RNA, 23 nt, Human
acaucaguggcauggcuccaguc

SEQ ID NO: 2521688 - RNA, 16 nt, Human
acauacaauuauuuuu

SEQ ID NO: 2521689 - RNA, 22 nt, Human
acauacaauuauuuuuacaguu

SEQ ID NO: 2521690 - RNA, 22 nt, Human
acaucagcuggucaaacaaacu

SEQ ID NO: 2521691 - RNA, 20 nt, Human
acauaauucaggaagcagcu

SEQ ID NO: 2521692 - RNA, 21 nt, Human
acauaauuuuuuuuuuuuaac

SEQ ID NO: 2521693 - RNA, 18 nt, Human
acauaauuuuuuauucaa

SEQ ID NO: 2521694 - RNA, 12 nt, Human
acauaauuuuuu

SEQ ID NO: 2521695 - RNA, 15 nt, Human
accagcccggccugc

SEQ ID NO: 2521696 - RNA, 14 nt, Human
accagcccggccug

SEQ ID NO: 2521697 - RNA, 18 nt, Human
accagccccugccccagc

SEQ ID NO: 2521698 - RNA, 16 nt, Human
accagccccugcccca

SEQ ID NO: 2521699 - RNA, 21 nt, Human
accagcccggccugcucccag

SEQ ID NO: 2521700 - RNA, 16 nt, Human
accagcccggccugcu

SEQ ID NO: 2521701 - RNA, 15 nt, Human
accagccccugcccc

SEQ ID NO: 2521702 - RNA, 12 nt, Human
accagccccugc

SEQ ID NO: 2521703 - RNA, 11 nt, Human
accagccccug

SEQ ID NO: 2521704 - RNA, 20 nt, Human
accagccccagugcccacag

SEQ ID NO: 2521705 - RNA, 19 nt, Human
accagccccagugcccaca

SEQ ID NO: 2521706 - RNA, 18 nt, Human
accagccccagugcccac

SEQ ID NO: 2521707 - RNA, 19 nt, Human
accagcagaucccagcuca

SEQ ID NO: 2521708 - RNA, 21 nt, Human
accagcagaucccagcucacg

SEQ ID NO: 2521709 - RNA, 17 nt, Human
accacgauguggcccug

SEQ ID NO: 2521710 - RNA, 18 nt, Human
accacgauguggcccugg

SEQ ID NO: 2521711 - RNA, 15 nt, Human
accagcagaucccag

SEQ ID NO: 2521712 - RNA, 17 nt, Human
accagccccagugccca

SEQ ID NO: 2521713 - RNA, 16 nt, Human
accagccccagugccc

SEQ ID NO: 2521714 - RNA, 13 nt, Human
accagcagagcac

SEQ ID NO: 2521715 - RNA, 12 nt, Human
accagcagagca

SEQ ID NO: 2521716 - RNA, 14 nt, Human
accagcagaaaugc

SEQ ID NO: 2521717 - RNA, 22 nt, Human
accaccuucccagcucucccuc

SEQ ID NO: 2521718 - RNA, 17 nt, Human
accaccuuuuauuacau

SEQ ID NO: 2521719 - RNA, 16 nt, Human
accacgauguggcccu

SEQ ID NO: 2521720 - RNA, 17 nt, Human
accacccuccccucucu

SEQ ID NO: 2521721 - RNA, 16 nt, Human
accacccuccccucuc

SEQ ID NO: 2521722 - RNA, 15 nt, Human
accacccuccccucu

SEQ ID NO: 2521723 - RNA, 14 nt, Human
accacccuccccuc

SEQ ID NO: 2521724 - RNA, 13 nt, Human
accacccuccccu

SEQ ID NO: 2521725 - RNA, 11 nt, Human
accacccuccc

SEQ ID NO: 2521726 - RNA, 21 nt, Human
accacccuccccucucuugca

SEQ ID NO: 2521727 - RNA, 18 nt, Human
accacccuccccucucuu

SEQ ID NO: 2521728 - RNA, 23 nt, Human
accacccuccccucucuugcacc

SEQ ID NO: 2521729 - RNA, 12 nt, Human
accaccugccca

SEQ ID NO: 2521730 - RNA, 13 nt, Human
accaccuucccag

SEQ ID NO: 2521731 - RNA, 14 nt, Human
accaccuucccagc

SEQ ID NO: 2521732 - RNA, 14 nt, Human
accaccuuucagau

SEQ ID NO: 2521733 - RNA, 20 nt, Human
accaccuucccagcucuccc

SEQ ID NO: 2521734 - RNA, 21 nt, Human
accaccuucccagcucucccu

SEQ ID NO: 2521735 - RNA, 15 nt, Human
accaccuucccagcu

SEQ ID NO: 2521736 - RNA, 16 nt, Human
accaccuucccagcuc

SEQ ID NO: 2521737 - RNA, 17 nt, Human
accaccuucccagcucu

SEQ ID NO: 2521738 - RNA, 19 nt, Human
accaccuucccagcucucc

SEQ ID NO: 2521739 - RNA, 20 nt, Human
accaaggcaaggcaggugcc

SEQ ID NO: 2521740 - RNA, 19 nt, Human
accaaggcaaggcaggugc

SEQ ID NO: 2521741 - RNA, 18 nt, Human
accaaggcaaggcaggug

SEQ ID NO: 2521742 - RNA, 22 nt, Human
accaccccgccugcccucaugg

SEQ ID NO: 2521743 - RNA, 20 nt, Human
accaaggcugauuaaaccaa

SEQ ID NO: 2521744 - RNA, 14 nt, Human
accaccccuuccug

SEQ ID NO: 2521745 - RNA, 22 nt, Human
accaccccugccuccacccucu

SEQ ID NO: 2521746 - RNA, 20 nt, Human
accaccccugccuccacccu

SEQ ID NO: 2521747 - RNA, 19 nt, Human
accaccccugccuccaccc

SEQ ID NO: 2521748 - RNA, 15 nt, Human
accaccccugccucc

SEQ ID NO: 2521749 - RNA, 14 nt, Human
accaccccugccuc

SEQ ID NO: 2521750 - RNA, 13 nt, Human
accaccccugccu

SEQ ID NO: 2521751 - RNA, 15 nt, Human
accaccccuuccugu

SEQ ID NO: 2521752 - RNA, 20 nt, Human
accacccuagucccuucccc

SEQ ID NO: 2521753 - RNA, 21 nt, Human
accacccuagucccuuccccu

SEQ ID NO: 2521754 - RNA, 12 nt, Human
acauuucucaau

SEQ ID NO: 2521755 - RNA, 20 nt, Human
acauuuaugauuuaauaaaa

SEQ ID NO: 2521756 - RNA, 19 nt, Human
acauuuaugauuuaauaaa

SEQ ID NO: 2521757 - RNA, 22 nt, Human
acauuuaugauuuaauaaaaua

SEQ ID NO: 2521758 - RNA, 14 nt, Human
accaagaaagcagg

SEQ ID NO: 2521759 - RNA, 11 nt, Human
accaagaagau

SEQ ID NO: 2521760 - RNA, 19 nt, Human
accaagaagccuuuccugu

SEQ ID NO: 2521761 - RNA, 16 nt, Human
accaagaagaugucuu

SEQ ID NO: 2521762 - RNA, 23 nt, Human
acauuucucuaagagaacaaugu

SEQ ID NO: 2521763 - RNA, 18 nt, Human
accaacuuucuguaaacu

SEQ ID NO: 2521764 - RNA, 22 nt, Human
acauuucuccuuugauaaaaua

SEQ ID NO: 2521765 - RNA, 19 nt, Human
accaacuuucuguaaacuc

SEQ ID NO: 2521766 - RNA, 13 nt, Human
accaagagagaaa

SEQ ID NO: 2521767 - RNA, 15 nt, Human
accaagagagaaaga

SEQ ID NO: 2521768 - RNA, 20 nt, Human
accaagagagaaagaaguag

SEQ ID NO: 2521769 - RNA, 24 nt, Human
accaagaagccuuuccuguagccu

SEQ ID NO: 2521770 - RNA, 20 nt, Human
accaagaagccuuuccugua

SEQ ID NO: 2521771 - RNA, 16 nt, Human
accaagacucugaaau

SEQ ID NO: 2521772 - RNA, 19 nt, Human
accaaggcugauuaaacca

SEQ ID NO: 2521773 - RNA, 16 nt, Human
accaaggaccccucac

SEQ ID NO: 2521774 - RNA, 18 nt, Human
accaaggaccccucaccu

SEQ ID NO: 2521775 - RNA, 17 nt, Human
accaaggcaaggcaggu

SEQ ID NO: 2521776 - RNA, 16 nt, Human
accaaggcaaggcagg

SEQ ID NO: 2521777 - RNA, 17 nt, Human
accaaggagaugaagca

SEQ ID NO: 2521778 - RNA, 17 nt, Human
acaugugaaaccuuuuu

SEQ ID NO: 2521779 - RNA, 15 nt, Human
acaugugaaaccuuu

SEQ ID NO: 2521780 - RNA, 14 nt, Human
acaugugaaaccuu

SEQ ID NO: 2521781 - RNA, 13 nt, Human
acaugugaaaccu

SEQ ID NO: 2521782 - RNA, 21 nt, Human
acaugugaaaccuuuuuuaag

SEQ ID NO: 2521783 - RNA, 20 nt, Human
acaugugaaaccuuuuuuaa

SEQ ID NO: 2521784 - RNA, 12 nt, Human
acaugugacaca

SEQ ID NO: 2521785 - RNA, 23 nt, Human
acaugugaaaccuuuuuuaagau

SEQ ID NO: 2521786 - RNA, 14 nt, Human
acaugugacacaua

SEQ ID NO: 2521787 - RNA, 19 nt, Human
acaugccucucucaggcca

SEQ ID NO: 2521788 - RNA, 23 nt, Human
acaugucuuuucuugcaugaggc

SEQ ID NO: 2521789 - RNA, 12 nt, Human
acaugugaaacc

SEQ ID NO: 2521790 - RNA, 21 nt, Human
acaugcauuugaggucaagua

SEQ ID NO: 2521791 - RNA, 17 nt, Human
acauuuccuaaauauau

SEQ ID NO: 2521792 - RNA, 16 nt, Human
acauuuccuaaauaua

SEQ ID NO: 2521793 - RNA, 17 nt, Human
acauuuaugauuuaaua

SEQ ID NO: 2521794 - RNA, 15 nt, Human
acauuuaugauuuaa

SEQ ID NO: 2521795 - RNA, 14 nt, Human
acauuuaugauuua

SEQ ID NO: 2521796 - RNA, 23 nt, Human
acauuuaucaaucaguauaauuc

SEQ ID NO: 2521797 - RNA, 15 nt, Human
acauuucccugugcu

SEQ ID NO: 2521798 - RNA, 21 nt, Human
acauuuagagaacuguggccg

SEQ ID NO: 2521799 - RNA, 15 nt, Human
acauuuauaauguuu

SEQ ID NO: 2521800 - RNA, 20 nt, Human
acauuuauaauguuugcuau

SEQ ID NO: 2521801 - RNA, 22 nt, Human
acauuuaucaaucaguauaauu

SEQ ID NO: 2521802 - RNA, 18 nt, Human
acauuuauaauguuugcu

SEQ ID NO: 2521803 - RNA, 14 nt, Human
acauuuacauguau

SEQ ID NO: 2521804 - RNA, 21 nt, Human
acauuuacauguauuauuuca

SEQ ID NO: 2521805 - RNA, 16 nt, Human
acauuuacauguauua

SEQ ID NO: 2521806 - RNA, 13 nt, Human
accauacuaauua

SEQ ID NO: 2521807 - RNA, 16 nt, Human
accauacuaauuauac

SEQ ID NO: 2521808 - RNA, 21 nt, Human
accauaguaccauuuauacaa

SEQ ID NO: 2521809 - RNA, 23 nt, Human
accauaguaccauuuauacaaau

SEQ ID NO: 2521810 - RNA, 14 nt, Human
accaucaagccacc

SEQ ID NO: 2521811 - RNA, 21 nt, Human
accauacuaauuauacccccu

SEQ ID NO: 2521812 - RNA, 15 nt, Human
accauacugagggac

SEQ ID NO: 2521813 - RNA, 17 nt, Human
accauaggucaccuuua

SEQ ID NO: 2521814 - RNA, 20 nt, Human
accauaguaccauuuauaca

SEQ ID NO: 2521815 - RNA, 15 nt, Human
accaucaagccacca

SEQ ID NO: 2521816 - RNA, 20 nt, Human
accaucagaaacacccucac

SEQ ID NO: 2521817 - RNA, 15 nt, Human
accaucauugaaauc

SEQ ID NO: 2521818 - RNA, 15 nt, Human
accaucagggacagg

SEQ ID NO: 2521819 - RNA, 14 nt, Human
accaucagggacag

SEQ ID NO: 2521820 - RNA, 23 nt, Human
accaucagaaacacccucacacu

SEQ ID NO: 2521821 - RNA, 12 nt, Human
accaucauugaa

SEQ ID NO: 2521822 - RNA, 14 nt, Human
accaucucuuuacc

SEQ ID NO: 2521823 - RNA, 19 nt, Human
accaucauuggaaaugaaa

SEQ ID NO: 2521824 - RNA, 23 nt, Human
accaucauugaaaucuuuuugcu

SEQ ID NO: 2521825 - RNA, 22 nt, Human
accauccacucuacccucccac

SEQ ID NO: 2521826 - RNA, 23 nt, Human
accauccacucuacccucccacc

SEQ ID NO: 2521827 - RNA, 23 nt, Human
accaugaacagaaaacauucuga

SEQ ID NO: 2521828 - RNA, 18 nt, Human
accaugaacagaaaacau

SEQ ID NO: 2521829 - RNA, 15 nt, Human
accaugaagacagga

SEQ ID NO: 2521830 - RNA, 14 nt, Human
accaugaagacagg

SEQ ID NO: 2521831 - RNA, 19 nt, Human
accaugaagagauuuuuca

SEQ ID NO: 2521832 - RNA, 14 nt, Human
accaugaaacaaag

SEQ ID NO: 2521833 - RNA, 21 nt, Human
accaucuuuuccucauuuuca

SEQ ID NO: 2521834 - RNA, 15 nt, Human
accaugaaacaaagc

SEQ ID NO: 2521835 - RNA, 16 nt, Human
acccacaugugacaca

SEQ ID NO: 2521836 - RNA, 15 nt, Human
acccacaugugacac

SEQ ID NO: 2521837 - RNA, 13 nt, Human
acccacagggcua

SEQ ID NO: 2521838 - RNA, 18 nt, Human
acccacaggcccacagua

SEQ ID NO: 2521839 - RNA, 17 nt, Human
acccacccccacccaag

SEQ ID NO: 2521840 - RNA, 13 nt, Human
acccaccccugug

SEQ ID NO: 2521841 - RNA, 12 nt, Human
acccaccccugu

SEQ ID NO: 2521842 - RNA, 16 nt, Human
acccacccagcaccca

SEQ ID NO: 2521843 - RNA, 15 nt, Human
acccacccccaccca

SEQ ID NO: 2521844 - RNA, 15 nt, Human
acccaccaccaugcc

SEQ ID NO: 2521845 - RNA, 17 nt, Human
acccaccccugugcucc

SEQ ID NO: 2521846 - RNA, 16 nt, Human
acccaccccugugcuc

SEQ ID NO: 2521847 - RNA, 15 nt, Human
acccaccccugugcu

SEQ ID NO: 2521848 - RNA, 14 nt, Human
acccaccccugugc

SEQ ID NO: 2521849 - RNA, 15 nt, Human
acccaccgcccuugc

SEQ ID NO: 2521850 - RNA, 20 nt, Human
acccaccgccacaauaaaga

SEQ ID NO: 2521851 - RNA, 15 nt, Human
acccacccuccuuuc

SEQ ID NO: 2521852 - RNA, 15 nt, Human
acccauagcuuccau

SEQ ID NO: 2521853 - RNA, 11 nt, Human
acccauauccc

SEQ ID NO: 2521854 - RNA, 16 nt, Human
acccauagcuuccaug

SEQ ID NO: 2521855 - RNA, 21 nt, Human
acccauauccccucucccccc

SEQ ID NO: 2521856 - RNA, 18 nt, Human
acccaucacgccugugca

SEQ ID NO: 2521857 - RNA, 14 nt, Human
acccaucagaagga

SEQ ID NO: 2521858 - RNA, 18 nt, Human
acccaucagaaggagaag

SEQ ID NO: 2521859 - RNA, 15 nt, Human
acccaucaacaaaaa

SEQ ID NO: 2521860 - RNA, 20 nt, Human
acccauauccccucuccccc

SEQ ID NO: 2521861 - RNA, 19 nt, Human
acccauauccccucucccc

SEQ ID NO: 2521862 - RNA, 15 nt, Human
acccauauccccucu

SEQ ID NO: 2521863 - RNA, 14 nt, Human
acccauauccccuc

SEQ ID NO: 2521864 - RNA, 23 nt, Human
acccauauccuuacccuccuugg

SEQ ID NO: 2521865 - RNA, 13 nt, Human
acccaugcugccc

SEQ ID NO: 2521866 - RNA, 18 nt, Human
acccaugaugagcuccuc

SEQ ID NO: 2521867 - RNA, 17 nt, Human
acccauccccgcagugu

SEQ ID NO: 2521868 - RNA, 19 nt, Human
acccaucagaaggagaagg

SEQ ID NO: 2521869 - RNA, 20 nt, Human
acccaugaugagcuccucuu

SEQ ID NO: 2521870 - RNA, 21 nt, Human
aauuuccuuuauauuuaguga

SEQ ID NO: 2521871 - RNA, 16 nt, Human
aauuuccuuuauauuu

SEQ ID NO: 2521872 - RNA, 21 nt, Human
aauuuccuguuggauuuguuu

SEQ ID NO: 2521873 - RNA, 20 nt, Human
aauuuccuguuggauuuguu

SEQ ID NO: 2521874 - RNA, 22 nt, Human
aauuuccuggugugaagguccu

SEQ ID NO: 2521875 - RNA, 18 nt, Human
aauuuccuggugugaagg

SEQ ID NO: 2521876 - RNA, 18 nt, Human
aauuucgccguugaagag

SEQ ID NO: 2521877 - RNA, 21 nt, Human
aauuucgccguugaagaggaa

SEQ ID NO: 2521878 - RNA, 16 nt, Human
aauuucaaaaugcuuu

SEQ ID NO: 2521879 - RNA, 16 nt, Human
aauuucaccuguaaac

SEQ ID NO: 2521880 - RNA, 14 nt, Human
aauuucacauuaau

SEQ ID NO: 2521881 - RNA, 17 nt, Human
aauuucaaaaauauaac

SEQ ID NO: 2521882 - RNA, 16 nt, Human
aauuucaaaaauauaa

SEQ ID NO: 2521883 - RNA, 15 nt, Human
aauuucaaaaauaua

SEQ ID NO: 2521884 - RNA, 20 nt, Human
aauuuauuuuugcauggcac

SEQ ID NO: 2521885 - RNA, 19 nt, Human
aauuucaaaaauauaacuu

SEQ ID NO: 2521886 - RNA, 12 nt, Human
aauuucaaaaug

SEQ ID NO: 2521887 - RNA, 21 nt, Human
aauuuauuuugucgaauuuuu

SEQ ID NO: 2521888 - RNA, 17 nt, Human
aauuuauuuugucgaau

SEQ ID NO: 2521889 - RNA, 12 nt, Human
aauuuauuuugu

SEQ ID NO: 2521890 - RNA, 15 nt, Human
aauuuauuuuugcau

SEQ ID NO: 2521891 - RNA, 20 nt, Human
aauuucagguuuuguaaaga

SEQ ID NO: 2521892 - RNA, 22 nt, Human
aauuucagguuuuguaaagaug

SEQ ID NO: 2521893 - RNA, 19 nt, Human
aauuucaccuguaaaccug

SEQ ID NO: 2521894 - RNA, 20 nt, Human
aauuucaccuguaaaccuga

SEQ ID NO: 2521895 - RNA, 16 nt, Human
aauuguauagagauau

SEQ ID NO: 2521896 - RNA, 13 nt, Human
aauuucagacucc

SEQ ID NO: 2521897 - RNA, 23 nt, Human
aauuucagacucccauuccugaa

SEQ ID NO: 2521898 - RNA, 20 nt, Human
aauuuauuuaugggauccug

SEQ ID NO: 2521899 - RNA, 17 nt, Human
aauuuauuuauacuauu

SEQ ID NO: 2521900 - RNA, 20 nt, Human
aauuuauuuauacuauuuag

SEQ ID NO: 2521901 - RNA, 22 nt, Human
aauuuauuuccuaguucuguag

SEQ ID NO: 2521902 - RNA, 19 nt, Human
aauuuauuuccuaguucug

SEQ ID NO: 2521903 - RNA, 16 nt, Human
aauuuauuuccuaguu

SEQ ID NO: 2521904 - RNA, 17 nt, Human
aauuuauuuauuaagau

SEQ ID NO: 2521905 - RNA, 16 nt, Human
aauuuauugcuugaua

SEQ ID NO: 2521906 - RNA, 16 nt, Human
aauuuauuuauuaaga

SEQ ID NO: 2521907 - RNA, 22 nt, Human
aauuuauuuauuaagauggauu

SEQ ID NO: 2521908 - RNA, 21 nt, Human
aauuuauucaauuccucuggg

SEQ ID NO: 2521909 - RNA, 18 nt, Human
aauuuauuauugaaauug

SEQ ID NO: 2521910 - RNA, 17 nt, Human
aauuuauuauugaaauu

SEQ ID NO: 2521911 - RNA, 16 nt, Human
aauuuauuauugaaau

SEQ ID NO: 2521912 - RNA, 12 nt, Human
aauuuauucaau

SEQ ID NO: 2521913 - RNA, 16 nt, Human
aauuuauuauuguucu

SEQ ID NO: 2521914 - RNA, 14 nt, Human
aauuuauucaagaa

SEQ ID NO: 2521915 - RNA, 11 nt, Human
aauugucccuu

SEQ ID NO: 2521916 - RNA, 16 nt, Human
aauugucccuuaaaca

SEQ ID NO: 2521917 - RNA, 18 nt, Human
aauugucccuuaaacaaa

SEQ ID NO: 2521918 - RNA, 17 nt, Human
aauuguccguguucaua

SEQ ID NO: 2521919 - RNA, 13 nt, Human
aauuguccccagu

SEQ ID NO: 2521920 - RNA, 14 nt, Human
aauugugauguguc

SEQ ID NO: 2521921 - RNA, 15 nt, Human
aauugugaugugucc

SEQ ID NO: 2521922 - RNA, 11 nt, Human
aauugugaugu

SEQ ID NO: 2521923 - RNA, 12 nt, Human
aauugugaaaaa

SEQ ID NO: 2521924 - RNA, 21 nt, Human
aauugugggucuauuucuagu

SEQ ID NO: 2521925 - RNA, 17 nt, Human
aauugugggucuauuuc

SEQ ID NO: 2521926 - RNA, 16 nt, Human
aauugugggucuauuu

SEQ ID NO: 2521927 - RNA, 14 nt, Human
aauugugucugcag

SEQ ID NO: 2521928 - RNA, 13 nt, Human
aauugugucugca

SEQ ID NO: 2521929 - RNA, 17 nt, Human
aauuuauuauggcacau

SEQ ID NO: 2521930 - RNA, 20 nt, Human
aauugugccgagaaaagcau

SEQ ID NO: 2521931 - RNA, 21 nt, Human
aauuguggggaugaugaaaua

SEQ ID NO: 2521932 - RNA, 14 nt, Human
aauuguaacuguuc

SEQ ID NO: 2521933 - RNA, 16 nt, Human
aauuguaacuguucuu

SEQ ID NO: 2521934 - RNA, 12 nt, Human
aauuguauauuc

SEQ ID NO: 2521935 - RNA, 23 nt, Human
aauuguauagagauaugcagaag

SEQ ID NO: 2521936 - RNA, 24 nt, Human
aauuguaaauugaaucaguauaaa

SEQ ID NO: 2521937 - RNA, 16 nt, Human
aauuguaaggaaugau

SEQ ID NO: 2521938 - RNA, 12 nt, Human
aauuguaaggaa

SEQ ID NO: 2521939 - RNA, 17 nt, Human
aauuguaaauugaauca

SEQ ID NO: 2521940 - RNA, 21 nt, Human
aauuguaaaauuguauagaga

SEQ ID NO: 2521941 - RNA, 18 nt, Human
aauuguaaaauuguauag

SEQ ID NO: 2521942 - RNA, 17 nt, Human
aauuguaaaacugaggc

SEQ ID NO: 2521943 - RNA, 17 nt, Human
aauuguauauucacuuu

SEQ ID NO: 2521944 - RNA, 16 nt, Human
aauuguauauucacuu

SEQ ID NO: 2521945 - RNA, 14 nt, Human
aauuguauauucac

SEQ ID NO: 2521946 - RNA, 13 nt, Human
aauuguauauuca

SEQ ID NO: 2521947 - RNA, 21 nt, Human
aauuguaucagaggccuauaa

SEQ ID NO: 2521948 - RNA, 20 nt, Human
aauuguaucagaggccuaua

SEQ ID NO: 2521949 - RNA, 17 nt, Human
aauuguaucagaggccu

SEQ ID NO: 2521950 - RNA, 22 nt, Human
aauuguaucagaggccuauaau

SEQ ID NO: 2521951 - RNA, 18 nt, Human
aauuguaucauuugaaca

SEQ ID NO: 2521952 - RNA, 19 nt, Human
aauuguaucguauagcugu

SEQ ID NO: 2521953 - RNA, 24 nt, Human
aauuguaucauuugaacaacuagg

SEQ ID NO: 2521954 - RNA, 21 nt, Human
aauuguaucguauagcuguau

SEQ ID NO: 2521955 - RNA, 20 nt, Human
aauuguaucguauagcugua

SEQ ID NO: 2521956 - RNA, 22 nt, Human
aauuguaucguauagcuguauu

SEQ ID NO: 2521957 - RNA, 13 nt, Human
aauuguaucuagu

SEQ ID NO: 2521958 - RNA, 22 nt, Human
aauuguauguuaaguuacuuca

SEQ ID NO: 2521959 - RNA, 12 nt, Human
aauuguauguua

SEQ ID NO: 2521960 - RNA, 20 nt, Human
aauuguaucuagugcagcug

SEQ ID NO: 2521961 - RNA, 23 nt, Human
aauuguaucuagugcagcugauu

SEQ ID NO: 2521962 - RNA, 16 nt, Human
aauuguauuuuaguaa

SEQ ID NO: 2521963 - RNA, 19 nt, Human
aaugucacaggcaggucca

SEQ ID NO: 2521964 - RNA, 16 nt, Human
aaugucacaggcaggu

SEQ ID NO: 2521965 - RNA, 19 nt, Human
aaugucaccaccuucccag

SEQ ID NO: 2521966 - RNA, 20 nt, Human
aaugucaccaccuucccagc

SEQ ID NO: 2521967 - RNA, 19 nt, Human
aauggucccauccaggcag

SEQ ID NO: 2521968 - RNA, 15 nt, Human
aaugucaccaccuuc

SEQ ID NO: 2521969 - RNA, 16 nt, Human
aaugucaccaccuucc

SEQ ID NO: 2521970 - RNA, 18 nt, Human
aaugucaccaccuuccca

SEQ ID NO: 2521971 - RNA, 21 nt, Human
aauuggguggggggcuucaua

SEQ ID NO: 2521972 - RNA, 22 nt, Human
aauuggguggggggcuucauac

SEQ ID NO: 2521973 - RNA, 23 nt, Human
aauuggguggggggcuucauaca

SEQ ID NO: 2521974 - RNA, 18 nt, Human
aauugguaucaagaaagu

SEQ ID NO: 2521975 - RNA, 21 nt, Human
aauugguuggagaauuuaggu

SEQ ID NO: 2521976 - RNA, 15 nt, Human
aauugguucuuuauu

SEQ ID NO: 2521977 - RNA, 18 nt, Human
aauuuugugaagcaaaau

SEQ ID NO: 2521978 - RNA, 16 nt, Human
aauuuugugcccccau

SEQ ID NO: 2521979 - RNA, 17 nt, Human
aauuuugugaagcaaaa

SEQ ID NO: 2521980 - RNA, 16 nt, Human
aauuuugguuguauuc

SEQ ID NO: 2521981 - RNA, 15 nt, Human
aauuuugguuguauu

SEQ ID NO: 2521982 - RNA, 22 nt, Human
aauuuuggccaaaguguuaauc

SEQ ID NO: 2521983 - RNA, 14 nt, Human
aauuuugauguuuu

SEQ ID NO: 2521984 - RNA, 14 nt, Human
aauuuugaugaaca

SEQ ID NO: 2521985 - RNA, 20 nt, Human
aauuuucaguauaauuuaac

SEQ ID NO: 2521986 - RNA, 16 nt, Human
aauuuugaugaacaaa

SEQ ID NO: 2521987 - RNA, 17 nt, Human
aauuuuggccaaagugu

SEQ ID NO: 2521988 - RNA, 18 nt, Human
aauuuucaucuaggauuu

SEQ ID NO: 2521989 - RNA, 21 nt, Human
aauuuucacaugaacauacug

SEQ ID NO: 2521990 - RNA, 17 nt, Human
aauuuucagaccccagc

SEQ ID NO: 2521991 - RNA, 17 nt, Human
aauuuucacaugaacau

SEQ ID NO: 2521992 - RNA, 16 nt, Human
aauuuucacaugaaca

SEQ ID NO: 2521993 - RNA, 14 nt, Human
aauuuucacaugaa

SEQ ID NO: 2521994 - RNA, 19 nt, Human
aauuuucacacacgugaga

SEQ ID NO: 2521995 - RNA, 19 nt, Human
aauuuucaaguaauuguga

SEQ ID NO: 2521996 - RNA, 12 nt, Human
aauuuuauuccu

SEQ ID NO: 2521997 - RNA, 15 nt, Human
aauuuucaaguaauu

SEQ ID NO: 2521998 - RNA, 21 nt, Human
acaaaaugacauuuugccaaa

SEQ ID NO: 2521999 - RNA, 14 nt, Human
acaaaaucuguuua

SEQ ID NO: 2522000 - RNA, 18 nt, Human
aauuuugguuguauucuu

SEQ ID NO: 2522001 - RNA, 22 nt, Human
acaaaaugaaacgcaaccacca

SEQ ID NO: 2522002 - RNA, 13 nt, Human
acaaaaugaaacg

SEQ ID NO: 2522003 - RNA, 16 nt, Human
acaaagaaauuaugug

SEQ ID NO: 2522004 - RNA, 14 nt, Human
acaaagaaauuaug

SEQ ID NO: 2522005 - RNA, 13 nt, Human
acaaacuuuuaua

SEQ ID NO: 2522006 - RNA, 12 nt, Human
acaaagaaauua

SEQ ID NO: 2522007 - RNA, 15 nt, Human
acaagaaaugaaagc

SEQ ID NO: 2522008 - RNA, 16 nt, Human
acaagaaaugaaagca

SEQ ID NO: 2522009 - RNA, 21 nt, Human
acaaggaugaauuaaguuuuu

SEQ ID NO: 2522010 - RNA, 12 nt, Human
acaaccuggaga

SEQ ID NO: 2522011 - RNA, 23 nt, Human
acaaccugcuuggguggagaagc

SEQ ID NO: 2522012 - RNA, 22 nt, Human
acaaccugcuuggguggagaag

SEQ ID NO: 2522013 - RNA, 13 nt, Human
acaaccguuggaa

SEQ ID NO: 2522014 - RNA, 14 nt, Human
acaacccugcaaag

SEQ ID NO: 2522015 - RNA, 19 nt, Human
acaacccugcaaaggacug

SEQ ID NO: 2522016 - RNA, 17 nt, Human
acaacccuguuuuauac

SEQ ID NO: 2522017 - RNA, 16 nt, Human
acaaccucaacugccu

SEQ ID NO: 2522018 - RNA, 18 nt, Human
acaacccuguuuuauacu

SEQ ID NO: 2522019 - RNA, 19 nt, Human
acaaccgaugcuccagcca

SEQ ID NO: 2522020 - RNA, 20 nt, Human
acaaccgaugcuccagccaa

SEQ ID NO: 2522021 - RNA, 22 nt, Human
acaaccgaugcuccagccaacc

SEQ ID NO: 2522022 - RNA, 18 nt, Human
acaaccugaaccuaggag

SEQ ID NO: 2522023 - RNA, 14 nt, Human
acaaccugaaccua

SEQ ID NO: 2522024 - RNA, 15 nt, Human
acaaccucaacugcc

SEQ ID NO: 2522025 - RNA, 13 nt, Human
acaaccugaaccu

SEQ ID NO: 2522026 - RNA, 13 nt, Human
acaagaaaugaaa

SEQ ID NO: 2522027 - RNA, 16 nt, Human
acacgggggcagcuga

SEQ ID NO: 2522028 - RNA, 20 nt, Human
acacgggagccgcuggcaga

SEQ ID NO: 2522029 - RNA, 21 nt, Human
acacggaucugagaaucuuua

SEQ ID NO: 2522030 - RNA, 20 nt, Human
acacggccacaucaaagagg

SEQ ID NO: 2522031 - RNA, 17 nt, Human
acacgggguauuuuagg

SEQ ID NO: 2522032 - RNA, 16 nt, Human
acacgggguauuuuag

SEQ ID NO: 2522033 - RNA, 23 nt, Human
acacgggggcagcugauacaaau

SEQ ID NO: 2522034 - RNA, 20 nt, Human
acacguaaugaaacuuggau

SEQ ID NO: 2522035 - RNA, 19 nt, Human
acacguaccucucaucagu

SEQ ID NO: 2522036 - RNA, 22 nt, Human
acacgguuugaagccuggaaca

SEQ ID NO: 2522037 - RNA, 19 nt, Human
acacgguuugaagccugga

SEQ ID NO: 2522038 - RNA, 16 nt, Human
acacguacuuaaauga

SEQ ID NO: 2522039 - RNA, 21 nt, Human
acacgaauauugcugauggug

SEQ ID NO: 2522040 - RNA, 15 nt, Human
acacgaauauugcug

SEQ ID NO: 2522041 - RNA, 19 nt, Human
acacggaucugagaaucuu

SEQ ID NO: 2522042 - RNA, 17 nt, Human
acacggaucugagaauc

SEQ ID NO: 2522043 - RNA, 16 nt, Human
acacggaucugagaau

SEQ ID NO: 2522044 - RNA, 15 nt, Human
acacggaucugagaa

SEQ ID NO: 2522045 - RNA, 12 nt, Human
acacggccacau

SEQ ID NO: 2522046 - RNA, 14 nt, Human
acacggccacauca

SEQ ID NO: 2522047 - RNA, 14 nt, Human
acacggaggcaucu

SEQ ID NO: 2522048 - RNA, 17 nt, Human
acacggaggcaucugca

SEQ ID NO: 2522049 - RNA, 18 nt, Human
acacggaggcaucugcac

SEQ ID NO: 2522050 - RNA, 16 nt, Human
acacauuuuuuaaaug

SEQ ID NO: 2522051 - RNA, 18 nt, Human
acacauuuuuuaaaugca

SEQ ID NO: 2522052 - RNA, 19 nt, Human
acacauuuuuuaaaugcac

SEQ ID NO: 2522053 - RNA, 15 nt, Human
acaccacuacauucu

SEQ ID NO: 2522054 - RNA, 14 nt, Human
acacgaauauugcu

SEQ ID NO: 2522055 - RNA, 12 nt, Human
acacgaauauug

SEQ ID NO: 2522056 - RNA, 17 nt, Human
acaccacuacauucugu

SEQ ID NO: 2522057 - RNA, 20 nt, Human
acaccacuacauucuguuaa

SEQ ID NO: 2522058 - RNA, 21 nt, Human
acacagcucuucuccaggcug

SEQ ID NO: 2522059 - RNA, 20 nt, Human
acacagcucuucuccaggcu

SEQ ID NO: 2522060 - RNA, 14 nt, Human
acacauuuuuuaaa

SEQ ID NO: 2522061 - RNA, 19 nt, Human
acaauuuuuuuaauuuugu

SEQ ID NO: 2522062 - RNA, 18 nt, Human
acaauuuuuuuaauuuug

SEQ ID NO: 2522063 - RNA, 17 nt, Human
acaauuuuuuuaauuuu

SEQ ID NO: 2522064 - RNA, 14 nt, Human
acaauuuuuuuaau

SEQ ID NO: 2522065 - RNA, 16 nt, Human
acaauuuuuuaucaug

SEQ ID NO: 2522066 - RNA, 22 nt, Human
acaauuuuuuaucaugcauguc

SEQ ID NO: 2522067 - RNA, 19 nt, Human
acacaaaaguuucucuuuu

SEQ ID NO: 2522068 - RNA, 21 nt, Human
acaauuuuuuuaauuuuguau

SEQ ID NO: 2522069 - RNA, 19 nt, Human
acacagcucuucuccaggc

SEQ ID NO: 2522070 - RNA, 22 nt, Human
acaaggauagaugcuggcccag

SEQ ID NO: 2522071 - RNA, 20 nt, Human
acaaggaugaucuaggaaga

SEQ ID NO: 2522072 - RNA, 16 nt, Human
acaaggauugcuacug

SEQ ID NO: 2522073 - RNA, 18 nt, Human
acaauuauaucaguccuc

SEQ ID NO: 2522074 - RNA, 18 nt, Human
acaauuauuuuuacaguu

SEQ ID NO: 2522075 - RNA, 14 nt, Human
acaauuuauuaugg

SEQ ID NO: 2522076 - RNA, 19 nt, Human
acaauuuacaaagugugua

SEQ ID NO: 2522077 - RNA, 17 nt, Human
acaauuuacaaagugug

SEQ ID NO: 2522078 - RNA, 13 nt, Human
acaauuuacaaag

SEQ ID NO: 2522079 - RNA, 21 nt, Human
acaauuguuugggguugaaaa

SEQ ID NO: 2522080 - RNA, 23 nt, Human
acaauuuacaaaguguguauuaa

SEQ ID NO: 2522081 - RNA, 20 nt, Human
acaauuuacaaaguguguau

SEQ ID NO: 2522082 - RNA, 18 nt, Human
acaauuuaugaauugaau

SEQ ID NO: 2522083 - RNA, 13 nt, Human
acaauuuauuaug

SEQ ID NO: 2522084 - RNA, 20 nt, Human
acaauucaugaacuucgcau

SEQ ID NO: 2522085 - RNA, 15 nt, Human
acaauucaugaacuu

SEQ ID NO: 2522086 - RNA, 14 nt, Human
acaauucaugaacu

SEQ ID NO: 2522087 - RNA, 21 nt, Human
acaauuauuuuuacaguucuc

SEQ ID NO: 2522088 - RNA, 15 nt, Human
acaauucccugcugu

SEQ ID NO: 2522089 - RNA, 14 nt, Human
acaauuccaaagga

SEQ ID NO: 2522090 - RNA, 18 nt, Human
acaauuccaaaggaaucu

SEQ ID NO: 2522091 - RNA, 22 nt, Human
acaauuccucuacuaacaauca

SEQ ID NO: 2522092 - RNA, 16 nt, Human
acaauucccugcuguc

SEQ ID NO: 2522093 - RNA, 23 nt, Human
acaauuccucuacuaacaaucag

SEQ ID NO: 2522094 - RNA, 15 nt, Human
acaauucuacauugu

SEQ ID NO: 2522095 - RNA, 13 nt, Human
acaauuuaaagca

SEQ ID NO: 2522096 - RNA, 20 nt, Human
acaauuuaaagcaaaggagu

SEQ ID NO: 2522097 - RNA, 14 nt, Human
acaauuuaaagcaa

SEQ ID NO: 2522098 - RNA, 14 nt, Human
acagacaaagcgug

SEQ ID NO: 2522099 - RNA, 15 nt, Human
acagacacacacacg

SEQ ID NO: 2522100 - RNA, 11 nt, Human
acagacacaca

SEQ ID NO: 2522101 - RNA, 14 nt, Human
acagacacacacac

SEQ ID NO: 2522102 - RNA, 13 nt, Human
acagacacacaca

SEQ ID NO: 2522103 - RNA, 12 nt, Human
acagacacacac

SEQ ID NO: 2522104 - RNA, 16 nt, Human
acagaagucaugaagc

SEQ ID NO: 2522105 - RNA, 14 nt, Human
acagacaacagaag

SEQ ID NO: 2522106 - RNA, 21 nt, Human
acagacaagguagcccuggcc

SEQ ID NO: 2522107 - RNA, 22 nt, Human
acagacaagguagcccuggcca

SEQ ID NO: 2522108 - RNA, 16 nt, Human
acagaagcuccaggua

SEQ ID NO: 2522109 - RNA, 19 nt, Human
acagaagcuucagaaguuu

SEQ ID NO: 2522110 - RNA, 18 nt, Human
acagaagcuucagaaguu

SEQ ID NO: 2522111 - RNA, 13 nt, Human
acagaagcuucca

SEQ ID NO: 2522112 - RNA, 21 nt, Human
acagaagccaggagcaaaugu

SEQ ID NO: 2522113 - RNA, 18 nt, Human
acagaagccaggagcaaa

SEQ ID NO: 2522114 - RNA, 14 nt, Human
acagaagcuucaga

SEQ ID NO: 2522115 - RNA, 13 nt, Human
acagaagcuucag

SEQ ID NO: 2522116 - RNA, 21 nt, Human
acagaagcugaagugcaucca

SEQ ID NO: 2522117 - RNA, 21 nt, Human
acagaagccucacugcaagca

SEQ ID NO: 2522118 - RNA, 23 nt, Human
acagaggccaugggccuccugug

SEQ ID NO: 2522119 - RNA, 21 nt, Human
acagaggccaugggccuccug

SEQ ID NO: 2522120 - RNA, 17 nt, Human
acagaggccaugggccu

SEQ ID NO: 2522121 - RNA, 20 nt, Human
acagaggaugagcucuaccc

SEQ ID NO: 2522122 - RNA, 17 nt, Human
acagaggccauggcaga

SEQ ID NO: 2522123 - RNA, 16 nt, Human
acagaggaugagcucu

SEQ ID NO: 2522124 - RNA, 17 nt, Human
acagaggagagucccag

SEQ ID NO: 2522125 - RNA, 13 nt, Human
acagaggcagccc

SEQ ID NO: 2522126 - RNA, 23 nt, Human
acagaggacaguauuugugggga

SEQ ID NO: 2522127 - RNA, 18 nt, Human
acagaggaagagcaggca

SEQ ID NO: 2522128 - RNA, 22 nt, Human
acagacacacacacgcacgcac

SEQ ID NO: 2522129 - RNA, 18 nt, Human
acagacacacacacgcac

SEQ ID NO: 2522130 - RNA, 17 nt, Human
acagacacacacacgca

SEQ ID NO: 2522131 - RNA, 16 nt, Human
acagacacacacacgc

SEQ ID NO: 2522132 - RNA, 17 nt, Human
acagaggaagagcaggc

SEQ ID NO: 2522133 - RNA, 23 nt, Human
acagacacacacacgcacgcaca

SEQ ID NO: 2522134 - RNA, 14 nt, Human
acagacacacgcac

SEQ ID NO: 2522135 - RNA, 23 nt, Human
acagaaccuuguuauuucucaga

SEQ ID NO: 2522136 - RNA, 17 nt, Human
acagaaccuuguuauuu

SEQ ID NO: 2522137 - RNA, 19 nt, Human
acagaaccuuguuauuucu

SEQ ID NO: 2522138 - RNA, 22 nt, Human
acagaacuaucucagcaucaga

SEQ ID NO: 2522139 - RNA, 22 nt, Human
acagaaccuuguuauuucucag

SEQ ID NO: 2522140 - RNA, 20 nt, Human
acagaacucuuucaaaaccu

SEQ ID NO: 2522141 - RNA, 18 nt, Human
acagaacucuuucaaaac

SEQ ID NO: 2522142 - RNA, 22 nt, Human
acacuguguccuggugcucucu

SEQ ID NO: 2522143 - RNA, 21 nt, Human
acacuguguccuggugcucuc

SEQ ID NO: 2522144 - RNA, 20 nt, Human
acacuguguccuggugcucu

SEQ ID NO: 2522145 - RNA, 19 nt, Human
acacuguguccuggugcuc

SEQ ID NO: 2522146 - RNA, 18 nt, Human
acacuguguccuggugcu

SEQ ID NO: 2522147 - RNA, 13 nt, Human
acacuguguccug

SEQ ID NO: 2522148 - RNA, 11 nt, Human
acacugugucc

SEQ ID NO: 2522149 - RNA, 17 nt, Human
acagaaccccuacauga

SEQ ID NO: 2522150 - RNA, 17 nt, Human
acagaacaucauuagaa

SEQ ID NO: 2522151 - RNA, 16 nt, Human
acagaaccuuguuauu

SEQ ID NO: 2522152 - RNA, 22 nt, Human
acacugugcugagucugaaggc

SEQ ID NO: 2522153 - RNA, 23 nt, Human
acacugugcuuucuauuguacag

SEQ ID NO: 2522154 - RNA, 15 nt, Human
acacugugcuuucua

SEQ ID NO: 2522155 - RNA, 14 nt, Human
acacugugcuuucu

SEQ ID NO: 2522156 - RNA, 22 nt, Human
acacugugcuuucuauuguaca

SEQ ID NO: 2522157 - RNA, 17 nt, Human
acacugugcugagucug

SEQ ID NO: 2522158 - RNA, 23 nt, Human
acacugggagaggugccagcaac

SEQ ID NO: 2522159 - RNA, 15 nt, Human
acacugggggagggg

SEQ ID NO: 2522160 - RNA, 20 nt, Human
acacuggggugccgccugcc

SEQ ID NO: 2522161 - RNA, 16 nt, Human
acacugggggagggga

SEQ ID NO: 2522162 - RNA, 18 nt, Human
acacugggacuugcaaaa

SEQ ID NO: 2522163 - RNA, 19 nt, Human
acacugggacuugcaaaaa

SEQ ID NO: 2522164 - RNA, 13 nt, Human
acacugggacuug

SEQ ID NO: 2522165 - RNA, 14 nt, Human
acacugggaaacag

SEQ ID NO: 2522166 - RNA, 20 nt, Human
acacugggagaaaugaaaaa

SEQ ID NO: 2522167 - RNA, 22 nt, Human
acacugggagaggugccagcaa

SEQ ID NO: 2522168 - RNA, 15 nt, Human
acugcuuuuggucug

SEQ ID NO: 2522169 - RNA, 14 nt, Human
acugcuuuuggucu

SEQ ID NO: 2522170 - RNA, 22 nt, Human
acugcccggcaggguccuagaa

SEQ ID NO: 2522171 - RNA, 22 nt, Human
acugcccgagcuggugcauuac

SEQ ID NO: 2522172 - RNA, 16 nt, Human
acugccaugcagggcc

SEQ ID NO: 2522173 - RNA, 17 nt, Human
acugcccggggcagcug

SEQ ID NO: 2522174 - RNA, 20 nt, Human
acugcccggggcagcugcca

SEQ ID NO: 2522175 - RNA, 20 nt, Human
acugcuuuuggucuguguga

SEQ ID NO: 2522176 - RNA, 16 nt, Human
acugcuuuuggucugu

SEQ ID NO: 2522177 - RNA, 18 nt, Human
acuggaagguggggacag

SEQ ID NO: 2522178 - RNA, 23 nt, Human
acugcccuccagcucuuuccucc

SEQ ID NO: 2522179 - RNA, 13 nt, Human
acuggaaguuuug

SEQ ID NO: 2522180 - RNA, 17 nt, Human
acuggaaguuuugcauu

SEQ ID NO: 2522181 - RNA, 18 nt, Human
acuggaaggggaagggac

SEQ ID NO: 2522182 - RNA, 20 nt, Human
acuggaagcuaauuugcauu

SEQ ID NO: 2522183 - RNA, 20 nt, Human
acugcccuccagcucuuucc

SEQ ID NO: 2522184 - RNA, 21 nt, Human
acugcccggggcagcugccag

SEQ ID NO: 2522185 - RNA, 22 nt, Human
acugcccggggcagcugccaga

SEQ ID NO: 2522186 - RNA, 23 nt, Human
acugccaggccagccuccgagag

SEQ ID NO: 2522187 - RNA, 19 nt, Human
acugccaggccagccuccg

SEQ ID NO: 2522188 - RNA, 18 nt, Human
acugccaggccagccucc

SEQ ID NO: 2522189 - RNA, 18 nt, Human
acugccagucccccugcc

SEQ ID NO: 2522190 - RNA, 15 nt, Human
acugccauaaaacau

SEQ ID NO: 2522191 - RNA, 14 nt, Human
acugccauaaaaca

SEQ ID NO: 2522192 - RNA, 13 nt, Human
acugccauaaaac

SEQ ID NO: 2522193 - RNA, 16 nt, Human
acugccagucucacug

SEQ ID NO: 2522194 - RNA, 19 nt, Human
acugccagucccccugccc

SEQ ID NO: 2522195 - RNA, 22 nt, Human
acugccauaaaacauuaagaaa

SEQ ID NO: 2522196 - RNA, 21 nt, Human
acugccauaaaacauuaagaa

SEQ ID NO: 2522197 - RNA, 23 nt, Human
acugccauaaaacauuaagaaaa

SEQ ID NO: 2522198 - RNA, 15 nt, Human
acugcccggcagggu

SEQ ID NO: 2522199 - RNA, 20 nt, Human
acugauucauaauaaauauc

SEQ ID NO: 2522200 - RNA, 17 nt, Human
acugauuucacaacaga

SEQ ID NO: 2522201 - RNA, 13 nt, Human
acugauuucacaa

SEQ ID NO: 2522202 - RNA, 13 nt, Human
acugauuguuuca

SEQ ID NO: 2522203 - RNA, 22 nt, Human
acugauuuuuuuuuccuucagu

SEQ ID NO: 2522204 - RNA, 21 nt, Human
acugauuuuuuuuuccuucag

SEQ ID NO: 2522205 - RNA, 23 nt, Human
acugauuuuuuuuuccuucagug

SEQ ID NO: 2522206 - RNA, 20 nt, Human
acugauuucacaacagauca

SEQ ID NO: 2522207 - RNA, 15 nt, Human
acugcaaaggcgcag

SEQ ID NO: 2522208 - RNA, 22 nt, Human
acugaugggcaacccccagccu

SEQ ID NO: 2522209 - RNA, 12 nt, Human
acugaugggcaa

SEQ ID NO: 2522210 - RNA, 12 nt, Human
acugaugcuuuu

SEQ ID NO: 2522211 - RNA, 23 nt, Human
acugaccauccacucuacccucc

SEQ ID NO: 2522212 - RNA, 18 nt, Human
acugaugcuuuuagcuca

SEQ ID NO: 2522213 - RNA, 22 nt, Human
acugauggcuaauguacugcau

SEQ ID NO: 2522214 - RNA, 11 nt, Human
acugaugcugc

SEQ ID NO: 2522215 - RNA, 12 nt, Human
acugaugcugcc

SEQ ID NO: 2522216 - RNA, 14 nt, Human
acugaugcugcccc

SEQ ID NO: 2522217 - RNA, 15 nt, Human
acugaugcugccccu

SEQ ID NO: 2522218 - RNA, 19 nt, Human
acugaugcugccccucauc

SEQ ID NO: 2522219 - RNA, 20 nt, Human
acugaugcugccccucaucu

SEQ ID NO: 2522220 - RNA, 15 nt, Human
acugaugcuuagaug

SEQ ID NO: 2522221 - RNA, 13 nt, Human
acugaucucucgu

SEQ ID NO: 2522222 - RNA, 23 nt, Human
acugaccagccuccaugcugccu

SEQ ID NO: 2522223 - RNA, 16 nt, Human
acugaccauccacucu

SEQ ID NO: 2522224 - RNA, 22 nt, Human
acugaccauccacucuacccuc

SEQ ID NO: 2522225 - RNA, 16 nt, Human
acugaaugaaaccccc

SEQ ID NO: 2522226 - RNA, 19 nt, Human
acugaaugaaacccccaca

SEQ ID NO: 2522227 - RNA, 21 nt, Human
acugaaugaaacccccacaca

SEQ ID NO: 2522228 - RNA, 22 nt, Human
acugaaugaaacccccacacac

SEQ ID NO: 2522229 - RNA, 21 nt, Human
acugaauauuuauauuucacu

SEQ ID NO: 2522230 - RNA, 22 nt, Human
acugaauauuuauauuucacua

SEQ ID NO: 2522231 - RNA, 15 nt, Human
acugaauauuuauau

SEQ ID NO: 2522232 - RNA, 18 nt, Human
acugaauauuuauauuuc

SEQ ID NO: 2522233 - RNA, 23 nt, Human
acugacauuguuggccaaagcca

SEQ ID NO: 2522234 - RNA, 22 nt, Human
acugacauuguuggccaaagcc

SEQ ID NO: 2522235 - RNA, 13 nt, Human
acugaccagccuc

SEQ ID NO: 2522236 - RNA, 20 nt, Human
acugaccagccuccaugcug

SEQ ID NO: 2522237 - RNA, 15 nt, Human
acugaccagccucca

SEQ ID NO: 2522238 - RNA, 21 nt, Human
acugaccaauauuguacaguu

SEQ ID NO: 2522239 - RNA, 20 nt, Human
acugaccaauauuguacagu

SEQ ID NO: 2522240 - RNA, 12 nt, Human
acugaccagaac

SEQ ID NO: 2522241 - RNA, 14 nt, Human
acugaccagaacua

SEQ ID NO: 2522242 - RNA, 22 nt, Human
acugaccaauauuguacaguuu

SEQ ID NO: 2522243 - RNA, 14 nt, Human
acucuaauagugcu

SEQ ID NO: 2522244 - RNA, 21 nt, Human
acucuaauagugcuuaaaaau

SEQ ID NO: 2522245 - RNA, 20 nt, Human
acucuaauucccauuuugca

SEQ ID NO: 2522246 - RNA, 21 nt, Human
acucuaauucccauuuugcaa

SEQ ID NO: 2522247 - RNA, 18 nt, Human
acuauuuuuacugccacu

SEQ ID NO: 2522248 - RNA, 13 nt, Human
acuauuuuuacug

SEQ ID NO: 2522249 - RNA, 18 nt, Human
acuauuuuuauuuauauu

SEQ ID NO: 2522250 - RNA, 12 nt, Human
acuauuuuuacu

SEQ ID NO: 2522251 - RNA, 15 nt, Human
acuauuuuaugcaaa

SEQ ID NO: 2522252 - RNA, 16 nt, Human
acuauuuccuuuauaa

SEQ ID NO: 2522253 - RNA, 13 nt, Human
acuauuuccuuua

SEQ ID NO: 2522254 - RNA, 12 nt, Human
acuauuuccuuu

SEQ ID NO: 2522255 - RNA, 21 nt, Human
acuauuucuuauauaugugaa

SEQ ID NO: 2522256 - RNA, 16 nt, Human
acuauuugucuuucag

SEQ ID NO: 2522257 - RNA, 14 nt, Human
acuauuuuaugcaa

SEQ ID NO: 2522258 - RNA, 13 nt, Human
acuauuuuaugca

SEQ ID NO: 2522259 - RNA, 18 nt, Human
acuauuugucuuucagga

SEQ ID NO: 2522260 - RNA, 13 nt, Human
acuauuuuacuuc

SEQ ID NO: 2522261 - RNA, 11 nt, Human
acuauuuuauu

SEQ ID NO: 2522262 - RNA, 17 nt, Human
acuauuuuauuuucuaa

SEQ ID NO: 2522263 - RNA, 20 nt, Human
acucuacuuagcaugucccu

SEQ ID NO: 2522264 - RNA, 19 nt, Human
acucuacuuaauccaaugg

SEQ ID NO: 2522265 - RNA, 22 nt, Human
acucuaauucccauuuugcaaa

SEQ ID NO: 2522266 - RNA, 21 nt, Human
acucuacuuaauccaaugggu

SEQ ID NO: 2522267 - RNA, 21 nt, Human
acucuacuuagcaugucccua

SEQ ID NO: 2522268 - RNA, 21 nt, Human
acucuagaugaaguuuuacau

SEQ ID NO: 2522269 - RNA, 22 nt, Human
acucuagaugaaguuuuacauu

SEQ ID NO: 2522270 - RNA, 19 nt, Human
acucugucucaaaaaaaca

SEQ ID NO: 2522271 - RNA, 15 nt, Human
acucugucucagucc

SEQ ID NO: 2522272 - RNA, 17 nt, Human
acucugucucaguccau

SEQ ID NO: 2522273 - RNA, 19 nt, Human
acucugugucagguggggc

SEQ ID NO: 2522274 - RNA, 21 nt, Human
acucugugucagguggggcag

SEQ ID NO: 2522275 - RNA, 19 nt, Human
acugaaguuucacaugagc

SEQ ID NO: 2522276 - RNA, 20 nt, Human
acucuuaagaagacugcauu

SEQ ID NO: 2522277 - RNA, 16 nt, Human
acugaaguuucacaug

SEQ ID NO: 2522278 - RNA, 15 nt, Human
acugaaguuucacau

SEQ ID NO: 2522279 - RNA, 21 nt, Human
acugaaguuaacagagacaga

SEQ ID NO: 2522280 - RNA, 16 nt, Human
acucuguuauuuagac

SEQ ID NO: 2522281 - RNA, 17 nt, Human
acugaaguuaacagaga

SEQ ID NO: 2522282 - RNA, 15 nt, Human
acucuuaagaagacu

SEQ ID NO: 2522283 - RNA, 14 nt, Human
acucuuaagaagac

SEQ ID NO: 2522284 - RNA, 15 nt, Human
acucuguuauuuaga

SEQ ID NO: 2522285 - RNA, 21 nt, Human
acuggaccacugggcaaugau

SEQ ID NO: 2522286 - RNA, 16 nt, Human
acuggaccacugggca

SEQ ID NO: 2522287 - RNA, 20 nt, Human
acuggaccacugggcaauga

SEQ ID NO: 2522288 - RNA, 16 nt, Human
acuggaaguuuugcau

SEQ ID NO: 2522289 - RNA, 13 nt, Human
acuuaaaaauggu

SEQ ID NO: 2522290 - RNA, 14 nt, Human
acuuaaaaaugguu

SEQ ID NO: 2522291 - RNA, 21 nt, Human
acuuaaaaaugguuuaaaugg

SEQ ID NO: 2522292 - RNA, 20 nt, Human
acuuaaaauauuccugcauu

SEQ ID NO: 2522293 - RNA, 16 nt, Human
acuuaaaaaaugucca

SEQ ID NO: 2522294 - RNA, 15 nt, Human
acuuaaaaaaugucc

SEQ ID NO: 2522295 - RNA, 19 nt, Human
acuucaaauccuugaagau

SEQ ID NO: 2522296 - RNA, 14 nt, Human
acuuaaauaaugug

SEQ ID NO: 2522297 - RNA, 22 nt, Human
acuuaaaauauuccugcauuug

SEQ ID NO: 2522298 - RNA, 13 nt, Human
acuuaaaauauuu

SEQ ID NO: 2522299 - RNA, 13 nt, Human
acuuaaagauuua

SEQ ID NO: 2522300 - RNA, 17 nt, Human
acuuaaaggcuguggua

SEQ ID NO: 2522301 - RNA, 15 nt, Human
acuuaaagauuuauc

SEQ ID NO: 2522302 - RNA, 11 nt, Human
acuuaaagauu

SEQ ID NO: 2522303 - RNA, 20 nt, Human
acuucugccauauucuguug

SEQ ID NO: 2522304 - RNA, 19 nt, Human
acuucagcgguuuauauaa

SEQ ID NO: 2522305 - RNA, 22 nt, Human
acuucaagugcaugcucucugc

SEQ ID NO: 2522306 - RNA, 23 nt, Human
acuucaagugcaugcucucugca

SEQ ID NO: 2522307 - RNA, 16 nt, Human
acuucaaguuaaagug

SEQ ID NO: 2522308 - RNA, 15 nt, Human
acuucaaugauagua

SEQ ID NO: 2522309 - RNA, 18 nt, Human
acuucagcgguuuauaua

SEQ ID NO: 2522310 - RNA, 17 nt, Human
acuucagcgguuuauau

SEQ ID NO: 2522311 - RNA, 20 nt, Human
acuucaaauccuugaagauu

SEQ ID NO: 2522312 - RNA, 13 nt, Human
acuucaaggccca

SEQ ID NO: 2522313 - RNA, 19 nt, Human
acuucaacauuuacaugua

SEQ ID NO: 2522314 - RNA, 19 nt, Human
acuuaaauaaaugucauua

SEQ ID NO: 2522315 - RNA, 16 nt, Human
acuucuuaaaaguugu

SEQ ID NO: 2522316 - RNA, 23 nt, Human
acuuggcucgaaucucugugccu

SEQ ID NO: 2522317 - RNA, 22 nt, Human
acuuggcucgaaucucugugcc

SEQ ID NO: 2522318 - RNA, 11 nt, Human
acuuggcuuuc

SEQ ID NO: 2522319 - RNA, 17 nt, Human
acuucuuauacauuuga

SEQ ID NO: 2522320 - RNA, 18 nt, Human
acuucuuauacauuugau

SEQ ID NO: 2522321 - RNA, 22 nt, Human
acuucugcuuuccacaccuggc

SEQ ID NO: 2522322 - RNA, 19 nt, Human
acuucugugagacccccac

SEQ ID NO: 2522323 - RNA, 20 nt, Human
acuucugugagacccccaca

SEQ ID NO: 2522324 - RNA, 23 nt, Human
acuucugugagacccccacaccu

SEQ ID NO: 2522325 - RNA, 16 nt, Human
acuucugccuggagac

SEQ ID NO: 2522326 - RNA, 12 nt, Human
acuucugccugu

SEQ ID NO: 2522327 - RNA, 19 nt, Human
acuucugcuuuccacaccu

SEQ ID NO: 2522328 - RNA, 16 nt, Human
acuucugcuuuccaca

SEQ ID NO: 2522329 - RNA, 14 nt, Human
acuucugcuuucca

SEQ ID NO: 2522330 - RNA, 13 nt, Human
acuucugccugga

SEQ ID NO: 2522331 - RNA, 12 nt, Human
acuucugccugg

SEQ ID NO: 2522332 - RNA, 13 nt, Human
acuucugccucuu

SEQ ID NO: 2522333 - RNA, 12 nt, Human
acuuuaugcuaa

SEQ ID NO: 2522334 - RNA, 17 nt, Human
acuuuaugcuaagugaa

SEQ ID NO: 2522335 - RNA, 13 nt, Human
acuuuauguguaa

SEQ ID NO: 2522336 - RNA, 21 nt, Human
acuuuaugccggaugugcuuu

SEQ ID NO: 2522337 - RNA, 15 nt, Human
acuuuauuuuguguu

SEQ ID NO: 2522338 - RNA, 22 nt, Human
acuuucaggccacauggcuaaa

SEQ ID NO: 2522339 - RNA, 20 nt, Human
acuuucacauagaugucccu

SEQ ID NO: 2522340 - RNA, 21 nt, Human
acuuucacauagaugucccuu

SEQ ID NO: 2522341 - RNA, 18 nt, Human
acuuucagguacuaaaua

SEQ ID NO: 2522342 - RNA, 21 nt, Human
acuuucagguacuaaauaccu

SEQ ID NO: 2522343 - RNA, 21 nt, Human
acuuuauguguaaauacauaa

SEQ ID NO: 2522344 - RNA, 16 nt, Human
acuuuauguguaaaua

SEQ ID NO: 2522345 - RNA, 23 nt, Human
acuuuaugccggaugugcuuuuc

SEQ ID NO: 2522346 - RNA, 12 nt, Human
acuuuauuaaau

SEQ ID NO: 2522347 - RNA, 15 nt, Human
acuuuauuaaauaca

SEQ ID NO: 2522348 - RNA, 15 nt, Human
acuuucacauagaug

SEQ ID NO: 2522349 - RNA, 17 nt, Human
acuuucacauagauguc

SEQ ID NO: 2522350 - RNA, 22 nt, Human
acuugggaggcugagaugggag

SEQ ID NO: 2522351 - RNA, 13 nt, Human
acuugggacauug

SEQ ID NO: 2522352 - RNA, 13 nt, Human
acuuggcuuucau

SEQ ID NO: 2522353 - RNA, 13 nt, Human
acuugggaauaua

SEQ ID NO: 2522354 - RNA, 20 nt, Human
acuugggagaccuguaauca

SEQ ID NO: 2522355 - RNA, 16 nt, Human
acuugggaggcugagg

SEQ ID NO: 2522356 - RNA, 19 nt, Human
acuaaucugggaagggaag

SEQ ID NO: 2522357 - RNA, 13 nt, Human
acuaaugauguuu

SEQ ID NO: 2522358 - RNA, 19 nt, Human
acuaaucgaacuaugaacu

SEQ ID NO: 2522359 - RNA, 18 nt, Human
acuaaucuauuggguuca

SEQ ID NO: 2522360 - RNA, 20 nt, Human
acuaaucuauuggguucauu

SEQ ID NO: 2522361 - RNA, 22 nt, Human
acuaaucuauuggguucauuau

SEQ ID NO: 2522362 - RNA, 14 nt, Human
acuaaucuuucugc

SEQ ID NO: 2522363 - RNA, 17 nt, Human
acuagggaagauaauau

SEQ ID NO: 2522364 - RNA, 17 nt, Human
acuagggagaagguuuc

SEQ ID NO: 2522365 - RNA, 22 nt, Human
acuaggcccccacuugccucuu

SEQ ID NO: 2522366 - RNA, 23 nt, Human
acuaggcccccacuugccucuuc

SEQ ID NO: 2522367 - RNA, 14 nt, Human
acuaggcucagaga

SEQ ID NO: 2522368 - RNA, 18 nt, Human
acuaguauuucuaugaaa

SEQ ID NO: 2522369 - RNA, 16 nt, Human
acuagggaucccucau

SEQ ID NO: 2522370 - RNA, 18 nt, Human
acuagguaacuucauauu

SEQ ID NO: 2522371 - RNA, 16 nt, Human
acuagguaacuucaua

SEQ ID NO: 2522372 - RNA, 22 nt, Human
acuaggugcccagaaugaggcu

SEQ ID NO: 2522373 - RNA, 19 nt, Human
acuaguauuucuaugaaau

SEQ ID NO: 2522374 - RNA, 19 nt, Human
acuaguaguuccugcuaca

SEQ ID NO: 2522375 - RNA, 16 nt, Human
acuauuguuagucucu

SEQ ID NO: 2522376 - RNA, 22 nt, Human
acuauuucccuugaaauuuuaa

SEQ ID NO: 2522377 - RNA, 13 nt, Human
acuauuggagggu

SEQ ID NO: 2522378 - RNA, 19 nt, Human
acuauuggagggugggaga

SEQ ID NO: 2522379 - RNA, 18 nt, Human
acuauugaaguugcagau

SEQ ID NO: 2522380 - RNA, 17 nt, Human
acuauugcuugcacaaa

SEQ ID NO: 2522381 - RNA, 13 nt, Human
acuauugcccagg

SEQ ID NO: 2522382 - RNA, 11 nt, Human
accugugucuc

SEQ ID NO: 2522383 - RNA, 15 nt, Human
accuguggcucuaca

SEQ ID NO: 2522384 - RNA, 23 nt, Human
accugugaccagcacugucucag

SEQ ID NO: 2522385 - RNA, 19 nt, Human
accuguggggauuucuccc

SEQ ID NO: 2522386 - RNA, 20 nt, Human
accuguggggauuucuccca

SEQ ID NO: 2522387 - RNA, 21 nt, Human
accuguggggauuucucccag

SEQ ID NO: 2522388 - RNA, 22 nt, Human
accuguggggauuucucccagc

SEQ ID NO: 2522389 - RNA, 23 nt, Human
accuguggggauuucucccagcu

SEQ ID NO: 2522390 - RNA, 17 nt, Human
accugugagcccagcug

SEQ ID NO: 2522391 - RNA, 18 nt, Human
accugugagcccagcugg

SEQ ID NO: 2522392 - RNA, 15 nt, Human
accugugagcccagc

SEQ ID NO: 2522393 - RNA, 14 nt, Human
accugugaccagca

SEQ ID NO: 2522394 - RNA, 19 nt, Human
accugugaccagcacuguc

SEQ ID NO: 2522395 - RNA, 19 nt, Human
accuguggccaaguucuua

SEQ ID NO: 2522396 - RNA, 18 nt, Human
accuguggccaaguucuu

SEQ ID NO: 2522397 - RNA, 16 nt, Human
accuguggugcaaaag

SEQ ID NO: 2522398 - RNA, 13 nt, Human
accugugucacua

SEQ ID NO: 2522399 - RNA, 17 nt, Human
acgcaccugccucagga

SEQ ID NO: 2522400 - RNA, 16 nt, Human
acgcaccugccucagg

SEQ ID NO: 2522401 - RNA, 15 nt, Human
acgcacgcacacaca

SEQ ID NO: 2522402 - RNA, 14 nt, Human
acgcacgcacacac

SEQ ID NO: 2522403 - RNA, 13 nt, Human
acgcacgcacaca

SEQ ID NO: 2522404 - RNA, 11 nt, Human
acgcacgcaca

SEQ ID NO: 2522405 - RNA, 19 nt, Human
acgcacgugggucuucagg

SEQ ID NO: 2522406 - RNA, 18 nt, Human
acgcuggagugcagugag

SEQ ID NO: 2522407 - RNA, 21 nt, Human
acgcagcaggaggccaggccg

SEQ ID NO: 2522408 - RNA, 19 nt, Human
acgcuggagugcagugagc

SEQ ID NO: 2522409 - RNA, 14 nt, Human
acgcagcaggaggc

SEQ ID NO: 2522410 - RNA, 19 nt, Human
acgcagaugauccaugagu

SEQ ID NO: 2522411 - RNA, 15 nt, Human
acgcagaugauccau

SEQ ID NO: 2522412 - RNA, 17 nt, Human
acgcagaugauccauga

SEQ ID NO: 2522413 - RNA, 21 nt, Human
acgcacuccaugagcacccca

SEQ ID NO: 2522414 - RNA, 17 nt, Human
acgcacuccaugagcac

SEQ ID NO: 2522415 - RNA, 16 nt, Human
acgcacuccaugagca

SEQ ID NO: 2522416 - RNA, 16 nt, Human
acgcacgcacacacac

SEQ ID NO: 2522417 - RNA, 20 nt, Human
acgcacgugggucuucaggg

SEQ ID NO: 2522418 - RNA, 19 nt, Human
acggacgaaccuugaaaac

SEQ ID NO: 2522419 - RNA, 16 nt, Human
acggacguuuccauca

SEQ ID NO: 2522420 - RNA, 19 nt, Human
acggacacucaaaagcugg

SEQ ID NO: 2522421 - RNA, 15 nt, Human
acggaauaguuggcu

SEQ ID NO: 2522422 - RNA, 20 nt, Human
acggaaguuuucaaugaugg

SEQ ID NO: 2522423 - RNA, 19 nt, Human
acggaaguuuucaaugaug

SEQ ID NO: 2522424 - RNA, 14 nt, Human
acggaaguuuucaa

SEQ ID NO: 2522425 - RNA, 13 nt, Human
acggaaguuuuca

SEQ ID NO: 2522426 - RNA, 15 nt, Human
acggaagagccuugc

SEQ ID NO: 2522427 - RNA, 16 nt, Human
acggaagagccuugcg

SEQ ID NO: 2522428 - RNA, 19 nt, Human
acgcugguagagauggagg

SEQ ID NO: 2522429 - RNA, 20 nt, Human
acgcugguagagauggagga

SEQ ID NO: 2522430 - RNA, 23 nt, Human
acgcugguagagauggaggagga

SEQ ID NO: 2522431 - RNA, 12 nt, Human
acgcugucucca

SEQ ID NO: 2522432 - RNA, 14 nt, Human
acgcugucuccaga

SEQ ID NO: 2522433 - RNA, 15 nt, Human
acgcugucuccagac

SEQ ID NO: 2522434 - RNA, 17 nt, Human
acgcugucuccagaccc

SEQ ID NO: 2522435 - RNA, 21 nt, Human
acgcugguagagauggaggag

SEQ ID NO: 2522436 - RNA, 11 nt, Human
acgcugucucc

SEQ ID NO: 2522437 - RNA, 23 nt, Human
acgcugucccuaguaaaaauaca

SEQ ID NO: 2522438 - RNA, 23 nt, Human
acgucugacaggcaaugcuggcu

SEQ ID NO: 2522439 - RNA, 16 nt, Human
acgucuguaagcugaa

SEQ ID NO: 2522440 - RNA, 13 nt, Human
acgucugucuuca

SEQ ID NO: 2522441 - RNA, 22 nt, Human
acgucugggagaaauugacaga

SEQ ID NO: 2522442 - RNA, 17 nt, Human
acgucugggagaaauug

SEQ ID NO: 2522443 - RNA, 16 nt, Human
acgucugacccucucc

SEQ ID NO: 2522444 - RNA, 22 nt, Human
acgucugacccucuccacccca

SEQ ID NO: 2522445 - RNA, 19 nt, Human
acggagccacuccucugac

SEQ ID NO: 2522446 - RNA, 15 nt, Human
acgucugacaggcaa

SEQ ID NO: 2522447 - RNA, 18 nt, Human
acggagccacuccucuga

SEQ ID NO: 2522448 - RNA, 14 nt, Human
acggagauguuuca

SEQ ID NO: 2522449 - RNA, 19 nt, Human
acggagagcgccugccccu

SEQ ID NO: 2522450 - RNA, 13 nt, Human
acggagagcgccu

SEQ ID NO: 2522451 - RNA, 18 nt, Human
acguggaggagcagugca

SEQ ID NO: 2522452 - RNA, 17 nt, Human
acguggaggagcagugc

SEQ ID NO: 2522453 - RNA, 13 nt, Human
acguggaggagca

SEQ ID NO: 2522454 - RNA, 21 nt, Human
acguggaggaaugcuccccca

SEQ ID NO: 2522455 - RNA, 16 nt, Human
acguggccucuugagc

SEQ ID NO: 2522456 - RNA, 14 nt, Human
acguggcucagcca

SEQ ID NO: 2522457 - RNA, 15 nt, Human
acguggcccagagaa

SEQ ID NO: 2522458 - RNA, 15 nt, Human
acguggcauguggcc

SEQ ID NO: 2522459 - RNA, 12 nt, Human
acguggagaggg

SEQ ID NO: 2522460 - RNA, 14 nt, Human
acgucugucuucac

SEQ ID NO: 2522461 - RNA, 15 nt, Human
acgucugucuucaca

SEQ ID NO: 2522462 - RNA, 19 nt, Human
acgucugucuucacagcuc

SEQ ID NO: 2522463 - RNA, 23 nt, Human
acgucugggagaaauugacagau

SEQ ID NO: 2522464 - RNA, 13 nt, Human
acguggagaggga

SEQ ID NO: 2522465 - RNA, 15 nt, Human
acguggagagggaug

SEQ ID NO: 2522466 - RNA, 16 nt, Human
acguggagcucuuggc

SEQ ID NO: 2522467 - RNA, 14 nt, Human
acguggagagggau

SEQ ID NO: 2522468 - RNA, 13 nt, Human
acuaacuagagca

SEQ ID NO: 2522469 - RNA, 12 nt, Human
acuaacuagagc

SEQ ID NO: 2522470 - RNA, 22 nt, Human
acuaacuaaacucucuuuggga

SEQ ID NO: 2522471 - RNA, 14 nt, Human
acuaacuaaacucu

SEQ ID NO: 2522472 - RNA, 13 nt, Human
acuaacuaaacuc

SEQ ID NO: 2522473 - RNA, 18 nt, Human
acuaacguugagccccug

SEQ ID NO: 2522474 - RNA, 15 nt, Human
acguggcucugcugg

SEQ ID NO: 2522475 - RNA, 14 nt, Human
acguggcucugcug

SEQ ID NO: 2522476 - RNA, 17 nt, Human
acguggcucagccagca

SEQ ID NO: 2522477 - RNA, 19 nt, Human
acguggcucagccagcacu

SEQ ID NO: 2522478 - RNA, 13 nt, Human
acuaaccugaccg

SEQ ID NO: 2522479 - RNA, 15 nt, Human
acuaaccuggguucc

SEQ ID NO: 2522480 - RNA, 14 nt, Human
acuaaccccgggcg

SEQ ID NO: 2522481 - RNA, 20 nt, Human
acuaacuccuaggaaaauac

SEQ ID NO: 2522482 - RNA, 22 nt, Human
acuaauaugggcauuguaguua

SEQ ID NO: 2522483 - RNA, 15 nt, Human
acuaauaugggcauu

SEQ ID NO: 2522484 - RNA, 19 nt, Human
acuaauauuuuaugugaga

SEQ ID NO: 2522485 - RNA, 15 nt, Human
acuaauagacaauuu

SEQ ID NO: 2522486 - RNA, 23 nt, Human
acuaacuaugcauggugccccag

SEQ ID NO: 2522487 - RNA, 15 nt, Human
acuaacuaugcaugg

SEQ ID NO: 2522488 - RNA, 23 nt, Human
acuaacuagagcagcccuggagu

SEQ ID NO: 2522489 - RNA, 14 nt, Human
accugcccugccug

SEQ ID NO: 2522490 - RNA, 13 nt, Human
accugcccugccu

SEQ ID NO: 2522491 - RNA, 16 nt, Human
accugcccugccugag

SEQ ID NO: 2522492 - RNA, 15 nt, Human
accugcccugccuga

SEQ ID NO: 2522493 - RNA, 13 nt, Human
accugugaccagc

SEQ ID NO: 2522494 - RNA, 12 nt, Human
accugcccugcc

SEQ ID NO: 2522495 - RNA, 17 nt, Human
accugcccugcccccac

SEQ ID NO: 2522496 - RNA, 23 nt, Human
accugccccuccucucugcccua

SEQ ID NO: 2522497 - RNA, 18 nt, Human
accugccauuugcacccu

SEQ ID NO: 2522498 - RNA, 19 nt, Human
accugccauuugcacccuc

SEQ ID NO: 2522499 - RNA, 16 nt, Human
accugccagggacaga

SEQ ID NO: 2522500 - RNA, 15 nt, Human
accugccagggacag

SEQ ID NO: 2522501 - RNA, 18 nt, Human
accugccagggacagagg

SEQ ID NO: 2522502 - RNA, 18 nt, Human
accugccagggagacaga

SEQ ID NO: 2522503 - RNA, 13 nt, Human
accugccagggag

SEQ ID NO: 2522504 - RNA, 20 nt, Human
accugccaggcagggguggg

SEQ ID NO: 2522505 - RNA, 18 nt, Human
accugccaggcaggggug

SEQ ID NO: 2522506 - RNA, 21 nt, Human
accugccagggagacagagcu

SEQ ID NO: 2522507 - RNA, 15 nt, Human
accugccauuugcac

SEQ ID NO: 2522508 - RNA, 13 nt, Human
accugccagggac

SEQ ID NO: 2522509 - RNA, 12 nt, Human
accugccaggga

SEQ ID NO: 2522510 - RNA, 11 nt, Human
accugccaggg

SEQ ID NO: 2522511 - RNA, 13 nt, Human
accucugccucaa

SEQ ID NO: 2522512 - RNA, 14 nt, Human
accucugccucaau

SEQ ID NO: 2522513 - RNA, 15 nt, Human
accucugccucaaug

SEQ ID NO: 2522514 - RNA, 15 nt, Human
accugccaggcaggg

SEQ ID NO: 2522515 - RNA, 17 nt, Human
accucuugagccuugaa

SEQ ID NO: 2522516 - RNA, 19 nt, Human
accucuugagccuugaacu

SEQ ID NO: 2522517 - RNA, 20 nt, Human
accucuugagccuugaacuu

SEQ ID NO: 2522518 - RNA, 21 nt, Human
accucuugagccuugaacuuu

SEQ ID NO: 2522519 - RNA, 18 nt, Human
accucugccucagaaaac

SEQ ID NO: 2522520 - RNA, 17 nt, Human
accucugccucagaaaa

SEQ ID NO: 2522521 - RNA, 12 nt, Human
accucugccuca

SEQ ID NO: 2522522 - RNA, 12 nt, Human
accucugccaga

SEQ ID NO: 2522523 - RNA, 19 nt, Human
accgggccacagagaaagu

SEQ ID NO: 2522524 - RNA, 15 nt, Human
accgggccacagaga

SEQ ID NO: 2522525 - RNA, 13 nt, Human
accgguacagaaa

SEQ ID NO: 2522526 - RNA, 14 nt, Human
accgugaggccaga

SEQ ID NO: 2522527 - RNA, 18 nt, Human
accguccucaccccuguc

SEQ ID NO: 2522528 - RNA, 17 nt, Human
accguccucaccccugu

SEQ ID NO: 2522529 - RNA, 15 nt, Human
accguccucaccccu

SEQ ID NO: 2522530 - RNA, 13 nt, Human
accguccucaccc

SEQ ID NO: 2522531 - RNA, 21 nt, Human
accguccucaccccuguccuc

SEQ ID NO: 2522532 - RNA, 12 nt, Human
accguccucacc

SEQ ID NO: 2522533 - RNA, 16 nt, Human
accguccgcccugcuc

SEQ ID NO: 2522534 - RNA, 15 nt, Human
accguccgcccugcu

SEQ ID NO: 2522535 - RNA, 14 nt, Human
accguccgcccugc

SEQ ID NO: 2522536 - RNA, 23 nt, Human
accgucauggcuuaauguuuauu

SEQ ID NO: 2522537 - RNA, 14 nt, Human
accgguggggcugg

SEQ ID NO: 2522538 - RNA, 22 nt, Human
accgucauggcuuaauguuuau

SEQ ID NO: 2522539 - RNA, 17 nt, Human
accguaauaauuauuau

SEQ ID NO: 2522540 - RNA, 18 nt, Human
accggcuggccuggcccc

SEQ ID NO: 2522541 - RNA, 17 nt, Human
accggcuggccuggccc

SEQ ID NO: 2522542 - RNA, 19 nt, Human
accggcuggccuggccccu

SEQ ID NO: 2522543 - RNA, 20 nt, Human
accgggcacucagaagacac

SEQ ID NO: 2522544 - RNA, 15 nt, Human
accggcuggccuggc

SEQ ID NO: 2522545 - RNA, 14 nt, Human
accggcuggccugg

SEQ ID NO: 2522546 - RNA, 14 nt, Human
accggcugcuuuuc

SEQ ID NO: 2522547 - RNA, 20 nt, Human
accggcugcuuuucccuaag

SEQ ID NO: 2522548 - RNA, 14 nt, Human
accggauggcggac

SEQ ID NO: 2522549 - RNA, 18 nt, Human
accggcaauuuccggcca

SEQ ID NO: 2522550 - RNA, 12 nt, Human
acccuguugcua

SEQ ID NO: 2522551 - RNA, 15 nt, Human
acccuguuuccugag

SEQ ID NO: 2522552 - RNA, 14 nt, Human
acccuguuuccuga

SEQ ID NO: 2522553 - RNA, 15 nt, Human
acccuguugcuaagc

SEQ ID NO: 2522554 - RNA, 14 nt, Human
acccuguugcuaag

SEQ ID NO: 2522555 - RNA, 17 nt, Human
acccuguuaccauuuug

SEQ ID NO: 2522556 - RNA, 23 nt, Human
acccugugcugguguccugacca

SEQ ID NO: 2522557 - RNA, 15 nt, Human
acccugugcuggugu

SEQ ID NO: 2522558 - RNA, 14 nt, Human
acccugugcuggug

SEQ ID NO: 2522559 - RNA, 19 nt, Human
acccugugcugguguccug

SEQ ID NO: 2522560 - RNA, 19 nt, Human
acccuuacagccucugacu

SEQ ID NO: 2522561 - RNA, 18 nt, Human
acccuuacagccucugac

SEQ ID NO: 2522562 - RNA, 13 nt, Human
acccuuacaguag

SEQ ID NO: 2522563 - RNA, 22 nt, Human
acccuuaccaugugccugaucc

SEQ ID NO: 2522564 - RNA, 18 nt, Human
acccuuaccaugugccug

SEQ ID NO: 2522565 - RNA, 19 nt, Human
acccuuacaguaggagccc

SEQ ID NO: 2522566 - RNA, 16 nt, Human
acccuguuuuauacug

SEQ ID NO: 2522567 - RNA, 18 nt, Human
acccuuaccccuuagccu

SEQ ID NO: 2522568 - RNA, 19 nt, Human
acccuuaccccuuagccuc

SEQ ID NO: 2522569 - RNA, 22 nt, Human
acccuuaccccuuagccucccu

SEQ ID NO: 2522570 - RNA, 23 nt, Human
acccuuaucaccagcugccucuu

SEQ ID NO: 2522571 - RNA, 23 nt, Human
accggagcuuucaaagaaggaau

SEQ ID NO: 2522572 - RNA, 13 nt, Human
accggauccuggg

SEQ ID NO: 2522573 - RNA, 14 nt, Human
accggauccugggu

SEQ ID NO: 2522574 - RNA, 16 nt, Human
accggauccugggugg

SEQ ID NO: 2522575 - RNA, 17 nt, Human
accggcaauuuccggcc

SEQ ID NO: 2522576 - RNA, 15 nt, Human
accccaacuccagua

SEQ ID NO: 2522577 - RNA, 15 nt, Human
acccaugcugcccug

SEQ ID NO: 2522578 - RNA, 14 nt, Human
acccaugcugcccu

SEQ ID NO: 2522579 - RNA, 22 nt, Human
acccugugauggggcccugccu

SEQ ID NO: 2522580 - RNA, 15 nt, Human
accccaauuccuugu

SEQ ID NO: 2522581 - RNA, 17 nt, Human
accccaauuccuuguag

SEQ ID NO: 2522582 - RNA, 16 nt, Human
accccacacacgccag

SEQ ID NO: 2522583 - RNA, 17 nt, Human
accccaaggagggagau

SEQ ID NO: 2522584 - RNA, 14 nt, Human
accccaaucccagc

SEQ ID NO: 2522585 - RNA, 23 nt, Human
accucagguaaucgaccugccuc

SEQ ID NO: 2522586 - RNA, 15 nt, Human
accucaggugaucca

SEQ ID NO: 2522587 - RNA, 19 nt, Human
accucaggcuuccuuggca

SEQ ID NO: 2522588 - RNA, 18 nt, Human
accucaggugagaagcag

SEQ ID NO: 2522589 - RNA, 23 nt, Human
accucagugccuuccuguuuuuc

SEQ ID NO: 2522590 - RNA, 16 nt, Human
accucagugucauuua

SEQ ID NO: 2522591 - RNA, 21 nt, Human
accucagugucauuuaugaaa

SEQ ID NO: 2522592 - RNA, 16 nt, Human
accucaguucccuugg

SEQ ID NO: 2522593 - RNA, 17 nt, Human
accucaguucccuuggc

SEQ ID NO: 2522594 - RNA, 18 nt, Human
accucaguucccuuggcc

SEQ ID NO: 2522595 - RNA, 19 nt, Human
accucaguucccuuggccu

SEQ ID NO: 2522596 - RNA, 20 nt, Human
accucaguucccuuggccuc

SEQ ID NO: 2522597 - RNA, 21 nt, Human
accucaguucccuuggccuca

SEQ ID NO: 2522598 - RNA, 18 nt, Human
accucaguuuuaucauuu

SEQ ID NO: 2522599 - RNA, 17 nt, Human
accucaguuuuaucauu

SEQ ID NO: 2522600 - RNA, 22 nt, Human
accucaguucccuuggccucag

SEQ ID NO: 2522601 - RNA, 23 nt, Human
accucaguucccuuggccucaga

SEQ ID NO: 2522602 - RNA, 20 nt, Human
accucaucaggaugaaccca

SEQ ID NO: 2522603 - RNA, 18 nt, Human
accucaucaggaugaacc

SEQ ID NO: 2522604 - RNA, 15 nt, Human
accucaucaggauga

SEQ ID NO: 2522605 - RNA, 14 nt, Human
accucaucaggaug

SEQ ID NO: 2522606 - RNA, 19 nt, Human
accucagugucauuuauga

SEQ ID NO: 2522607 - RNA, 13 nt, Human
accucaggccugg

SEQ ID NO: 2522608 - RNA, 12 nt, Human
accucaggccug

SEQ ID NO: 2522609 - RNA, 17 nt, Human
accgugaggccagagac

SEQ ID NO: 2522610 - RNA, 16 nt, Human
accgugaggccagaga

SEQ ID NO: 2522611 - RNA, 22 nt, Human
accucaggccugggggcugggc

SEQ ID NO: 2522612 - RNA, 14 nt, Human
accucaggccuggg

SEQ ID NO: 2522613 - RNA, 18 nt, Human
accgugagcgacaaagau

SEQ ID NO: 2522614 - RNA, 18 nt, Human
accucaggcuuccuuggc

SEQ ID NO: 2522615 - RNA, 22 nt, Human
accucagguaaucgaccugccu

SEQ ID NO: 2522616 - RNA, 14 nt, Human
cugcccugugggcc

SEQ ID NO: 2522617 - RNA, 19 nt, Human
cugccuguugggccaggag

SEQ ID NO: 2522618 - RNA, 18 nt, Human
cugccuguugggccagga

SEQ ID NO: 2522619 - RNA, 14 nt, Human
cugccuguugggcc

SEQ ID NO: 2522620 - RNA, 16 nt, Human
cugccuguugggccag

SEQ ID NO: 2522621 - RNA, 16 nt, Human
cugcuaauuccccaga

SEQ ID NO: 2522622 - RNA, 22 nt, Human
cugccuguuauaacucugcacu

SEQ ID NO: 2522623 - RNA, 21 nt, Human
cugccuguuauaacucugcac

SEQ ID NO: 2522624 - RNA, 21 nt, Human
cugcuaaguauuucccagcac

SEQ ID NO: 2522625 - RNA, 19 nt, Human
cugcuaaguauuucccagc

SEQ ID NO: 2522626 - RNA, 23 nt, Human
cugcuaaguauuucccagcacau

SEQ ID NO: 2522627 - RNA, 16 nt, Human
cugcuaauaaaaccca

SEQ ID NO: 2522628 - RNA, 12 nt, Human
cugcuacaaaga

SEQ ID NO: 2522629 - RNA, 14 nt, Human
cugcuaaucuucag

SEQ ID NO: 2522630 - RNA, 18 nt, Human
cugcuaaucuucagggca

SEQ ID NO: 2522631 - RNA, 19 nt, Human
cugcuacaaagaagacaug

SEQ ID NO: 2522632 - RNA, 18 nt, Human
cugcuacaaagaagacau

SEQ ID NO: 2522633 - RNA, 17 nt, Human
cugcuacaaagaagaca

SEQ ID NO: 2522634 - RNA, 15 nt, Human
cugcuacaaagaaga

SEQ ID NO: 2522635 - RNA, 22 nt, Human
cugcuacaaagaagacauguuu

SEQ ID NO: 2522636 - RNA, 20 nt, Human
cugcuacaaagaagacaugu

SEQ ID NO: 2522637 - RNA, 23 nt, Human
cugcuacaaauacucuuaggaag

SEQ ID NO: 2522638 - RNA, 16 nt, Human
cugcucagcccuggag

SEQ ID NO: 2522639 - RNA, 15 nt, Human
cugcucagcccugga

SEQ ID NO: 2522640 - RNA, 14 nt, Human
cugcucagcccugg

SEQ ID NO: 2522641 - RNA, 18 nt, Human
cugcucagcccuggaggu

SEQ ID NO: 2522642 - RNA, 17 nt, Human
cugcucagcccuggagg

SEQ ID NO: 2522643 - RNA, 13 nt, Human
cugcucagcucug

SEQ ID NO: 2522644 - RNA, 14 nt, Human
cugcucagcucugg

SEQ ID NO: 2522645 - RNA, 16 nt, Human
cugcucagcucugggc

SEQ ID NO: 2522646 - RNA, 22 nt, Human
cugcucagcucugggccauucu

SEQ ID NO: 2522647 - RNA, 21 nt, Human
cugcucagcccuggaggugcc

SEQ ID NO: 2522648 - RNA, 13 nt, Human
cugcucagcuucu

SEQ ID NO: 2522649 - RNA, 13 nt, Human
cugcucagacaga

SEQ ID NO: 2522650 - RNA, 13 nt, Human
cugcucagcagcu

SEQ ID NO: 2522651 - RNA, 13 nt, Human
cugcucagcccug

SEQ ID NO: 2522652 - RNA, 12 nt, Human
cugcucagcccu

SEQ ID NO: 2522653 - RNA, 17 nt, Human
cugcuaccucacugggg

SEQ ID NO: 2522654 - RNA, 15 nt, Human
cugcuaccucacugg

SEQ ID NO: 2522655 - RNA, 13 nt, Human
cugcuaccucacu

SEQ ID NO: 2522656 - RNA, 14 nt, Human
cugcuaccucacug

SEQ ID NO: 2522657 - RNA, 18 nt, Human
cugcuacccucccugcug

SEQ ID NO: 2522658 - RNA, 17 nt, Human
cugcuacccucccugcu

SEQ ID NO: 2522659 - RNA, 16 nt, Human
cugcuacccucccugc

SEQ ID NO: 2522660 - RNA, 13 nt, Human
cugcuacccuccc

SEQ ID NO: 2522661 - RNA, 20 nt, Human
cugcuacccucccugcuguc

SEQ ID NO: 2522662 - RNA, 19 nt, Human
cugcuacccucccugcugu

SEQ ID NO: 2522663 - RNA, 12 nt, Human
cugcuaccucac

SEQ ID NO: 2522664 - RNA, 15 nt, Human
cugcuacagagcaga

SEQ ID NO: 2522665 - RNA, 16 nt, Human
cugcuacacauacagg

SEQ ID NO: 2522666 - RNA, 17 nt, Human
cugcuacccagaaauca

SEQ ID NO: 2522667 - RNA, 22 nt, Human
cugccugggaucccucauccuc

SEQ ID NO: 2522668 - RNA, 18 nt, Human
cugccucgaacuggcugc

SEQ ID NO: 2522669 - RNA, 17 nt, Human
cugccucgaacuggcug

SEQ ID NO: 2522670 - RNA, 15 nt, Human
cugccucgaacuggc

SEQ ID NO: 2522671 - RNA, 15 nt, Human
cugccuguucagcuc

SEQ ID NO: 2522672 - RNA, 14 nt, Human
cugccuguucagcu

SEQ ID NO: 2522673 - RNA, 20 nt, Human
cugccuguuauaacucugca

SEQ ID NO: 2522674 - RNA, 18 nt, Human
cugccuguuauaacucug

SEQ ID NO: 2522675 - RNA, 17 nt, Human
cugccuguuauaacucu

SEQ ID NO: 2522676 - RNA, 23 nt, Human
cugccuguggcgccgucuccagg

SEQ ID NO: 2522677 - RNA, 22 nt, Human
cugccuguggcgccgucuccag

SEQ ID NO: 2522678 - RNA, 12 nt, Human
cugccuguggcg

SEQ ID NO: 2522679 - RNA, 20 nt, Human
cugccugggcuguuggcacu

SEQ ID NO: 2522680 - RNA, 19 nt, Human
cugccugggcuguuggcac

SEQ ID NO: 2522681 - RNA, 18 nt, Human
cugccugggcuguuggca

SEQ ID NO: 2522682 - RNA, 17 nt, Human
cugccugggcuguuggc

SEQ ID NO: 2522683 - RNA, 16 nt, Human
cugccugggcuguugg

SEQ ID NO: 2522684 - RNA, 15 nt, Human
cugccugggcuguug

SEQ ID NO: 2522685 - RNA, 22 nt, Human
cugccuggggcgggccccucau

SEQ ID NO: 2522686 - RNA, 19 nt, Human
cugccuggggcgggccccu

SEQ ID NO: 2522687 - RNA, 24 nt, Human
cugccugggcuguuggcacucaca

SEQ ID NO: 2522688 - RNA, 21 nt, Human
cugccugggcuguuggcacuc

SEQ ID NO: 2522689 - RNA, 20 nt, Human
cugccugguauauccaaaag

SEQ ID NO: 2522690 - RNA, 23 nt, Human
cugccugggaucccucauccuca

SEQ ID NO: 2522691 - RNA, 12 nt, Human
cugccugggcug

SEQ ID NO: 2522692 - RNA, 20 nt, Human
cugcugacagacacaggccc

SEQ ID NO: 2522693 - RNA, 19 nt, Human
cugcugacagacacaggcc

SEQ ID NO: 2522694 - RNA, 18 nt, Human
cugcugacagacacaggc

SEQ ID NO: 2522695 - RNA, 15 nt, Human
cugcugacagacaca

SEQ ID NO: 2522696 - RNA, 23 nt, Human
cugcugacagacacaggcccggc

SEQ ID NO: 2522697 - RNA, 21 nt, Human
cugcugacagacacaggcccg

SEQ ID NO: 2522698 - RNA, 23 nt, Human
cugcugaauuuucacaugaacau

SEQ ID NO: 2522699 - RNA, 13 nt, Human
cugcuuaacuuca

SEQ ID NO: 2522700 - RNA, 15 nt, Human
cugcuuaacuucaca

SEQ ID NO: 2522701 - RNA, 17 nt, Human
cugcuuaacuucacaua

SEQ ID NO: 2522702 - RNA, 13 nt, Human
cugcuucagccuc

SEQ ID NO: 2522703 - RNA, 16 nt, Human
cugcuucagccucccg

SEQ ID NO: 2522704 - RNA, 14 nt, Human
cugcuucagccucc

SEQ ID NO: 2522705 - RNA, 17 nt, Human
cugcuuuuuauggccug

SEQ ID NO: 2522706 - RNA, 22 nt, Human
cugcuuuuuaaagaaugcucuu

SEQ ID NO: 2522707 - RNA, 18 nt, Human
cugcuuuuuauggccugu

SEQ ID NO: 2522708 - RNA, 21 nt, Human
cuggaaaucaggguuaguauu

SEQ ID NO: 2522709 - RNA, 16 nt, Human
cuggaaauauuaagaa

SEQ ID NO: 2522710 - RNA, 20 nt, Human
cuggaacaucaucaaggcac

SEQ ID NO: 2522711 - RNA, 14 nt, Human
cuggaacagauuca

SEQ ID NO: 2522712 - RNA, 21 nt, Human
cuggaacagauucacacuguc

SEQ ID NO: 2522713 - RNA, 15 nt, Human
cuggaaccaucagaa

SEQ ID NO: 2522714 - RNA, 16 nt, Human
cuggaaccaucagaaa

SEQ ID NO: 2522715 - RNA, 13 nt, Human
cuggaacccagac

SEQ ID NO: 2522716 - RNA, 17 nt, Human
cuggaacacuaaugagg

SEQ ID NO: 2522717 - RNA, 23 nt, Human
cuggaaauaucaguuacucagcc

SEQ ID NO: 2522718 - RNA, 14 nt, Human
cuggaacccagacu

SEQ ID NO: 2522719 - RNA, 16 nt, Human
cuggaacccagacuca

SEQ ID NO: 2522720 - RNA, 18 nt, Human
cuggaacccagacucaga

SEQ ID NO: 2522721 - RNA, 19 nt, Human
cuggaacccagacucagac

SEQ ID NO: 2522722 - RNA, 22 nt, Human
cuggaacccagacucagacauu

SEQ ID NO: 2522723 - RNA, 12 nt, Human
cuggaaccucag

SEQ ID NO: 2522724 - RNA, 15 nt, Human
cuggaaccucagccu

SEQ ID NO: 2522725 - RNA, 16 nt, Human
cuggaaccucagccug

SEQ ID NO: 2522726 - RNA, 17 nt, Human
cuggaaccucagccugg

SEQ ID NO: 2522727 - RNA, 18 nt, Human
cuggaaccucagccuggc

SEQ ID NO: 2522728 - RNA, 20 nt, Human
cuggaaccucagccuggcca

SEQ ID NO: 2522729 - RNA, 22 nt, Human
cuggaaccucagccuggccaga

SEQ ID NO: 2522730 - RNA, 23 nt, Human
cuggaaccucagccuggccagac

SEQ ID NO: 2522731 - RNA, 16 nt, Human
cuggaacugucucuca

SEQ ID NO: 2522732 - RNA, 18 nt, Human
cuggaacugucucucaug

SEQ ID NO: 2522733 - RNA, 21 nt, Human
cuggaacucagugugacuccu

SEQ ID NO: 2522734 - RNA, 17 nt, Human
cuggaacucagugugac

SEQ ID NO: 2522735 - RNA, 19 nt, Human
cuggaacugucucucauga

SEQ ID NO: 2522736 - RNA, 15 nt, Human
cuggacuggcuagag

SEQ ID NO: 2522737 - RNA, 21 nt, Human
cuggacuggcuagaguccuca

SEQ ID NO: 2522738 - RNA, 13 nt, Human
cuggacugugugc

SEQ ID NO: 2522739 - RNA, 18 nt, Human
cuggacugucauagaaau

SEQ ID NO: 2522740 - RNA, 17 nt, Human
cuggacugggagguaga

SEQ ID NO: 2522741 - RNA, 16 nt, Human
cuggacugggagguag

SEQ ID NO: 2522742 - RNA, 14 nt, Human
cuggacugggaggu

SEQ ID NO: 2522743 - RNA, 13 nt, Human
cuggacugggagg

SEQ ID NO: 2522744 - RNA, 20 nt, Human
cugagacucgcgacaaugca

SEQ ID NO: 2522745 - RNA, 23 nt, Human
cugagacuccggggagcgcccgc

SEQ ID NO: 2522746 - RNA, 19 nt, Human
cugagacucgcgacaaugc

SEQ ID NO: 2522747 - RNA, 17 nt, Human
cugagacucgcgacaau

SEQ ID NO: 2522748 - RNA, 19 nt, Human
cugagacuccggggagcgc

SEQ ID NO: 2522749 - RNA, 14 nt, Human
cugagacucagaca

SEQ ID NO: 2522750 - RNA, 17 nt, Human
cugagacucagacagga

SEQ ID NO: 2522751 - RNA, 20 nt, Human
cugagacucagacaggaaag

SEQ ID NO: 2522752 - RNA, 21 nt, Human
cugagacucagacaggaaagg

SEQ ID NO: 2522753 - RNA, 21 nt, Human
cugaccuugaacuccugggcu

SEQ ID NO: 2522754 - RNA, 22 nt, Human
cugaccuugaacuccugggcuc

SEQ ID NO: 2522755 - RNA, 18 nt, Human
cugaccuuugucaucuuu

SEQ ID NO: 2522756 - RNA, 22 nt, Human
cugaccugucaugccccccuca

SEQ ID NO: 2522757 - RNA, 23 nt, Human
cugccauauucuguuggccagug

SEQ ID NO: 2522758 - RNA, 22 nt, Human
cugccauauucuguuggccagu

SEQ ID NO: 2522759 - RNA, 21 nt, Human
cugccauauucuguuggccag

SEQ ID NO: 2522760 - RNA, 20 nt, Human
cugccauauucuguuggcca

SEQ ID NO: 2522761 - RNA, 15 nt, Human
cugccagggacagag

SEQ ID NO: 2522762 - RNA, 12 nt, Human
cugccagggaca

SEQ ID NO: 2522763 - RNA, 11 nt, Human
cugccagggac

SEQ ID NO: 2522764 - RNA, 23 nt, Human
cugccaaggccagaguggccugg

SEQ ID NO: 2522765 - RNA, 13 nt, Human
cugccaggccccc

SEQ ID NO: 2522766 - RNA, 22 nt, Human
cugccaggcccccaagccugca

SEQ ID NO: 2522767 - RNA, 17 nt, Human
cugccaucauguuuaca

SEQ ID NO: 2522768 - RNA, 22 nt, Human
cugccaucauguuuacagagga

SEQ ID NO: 2522769 - RNA, 12 nt, Human
cugccauccagg

SEQ ID NO: 2522770 - RNA, 12 nt, Human
cugccccaggcc

SEQ ID NO: 2522771 - RNA, 15 nt, Human
cugccccagcucugg

SEQ ID NO: 2522772 - RNA, 18 nt, Human
cugccccagcucuggcuu

SEQ ID NO: 2522773 - RNA, 19 nt, Human
cugccccagcucuggcuuc

SEQ ID NO: 2522774 - RNA, 23 nt, Human
cugccaucauguuuacagaggac

SEQ ID NO: 2522775 - RNA, 18 nt, Human
cugccaggcccccaagcc

SEQ ID NO: 2522776 - RNA, 21 nt, Human
cugccaggcccccaagccugc

SEQ ID NO: 2522777 - RNA, 16 nt, Human
cugccccagcucuggc

SEQ ID NO: 2522778 - RNA, 14 nt, Human
cugcccccucugcc

SEQ ID NO: 2522779 - RNA, 15 nt, Human
cugcccccucugccc

SEQ ID NO: 2522780 - RNA, 22 nt, Human
cugccccauccuccagcaggga

SEQ ID NO: 2522781 - RNA, 15 nt, Human
cugccccaggccuga

SEQ ID NO: 2522782 - RNA, 13 nt, Human
cugccccauccuc

SEQ ID NO: 2522783 - RNA, 16 nt, Human
cugccccauccuccag

SEQ ID NO: 2522784 - RNA, 17 nt, Human
cugccccauccuccagc

SEQ ID NO: 2522785 - RNA, 18 nt, Human
cugccccauccuccagca

SEQ ID NO: 2522786 - RNA, 21 nt, Human
cugccccauccuccagcaggg

SEQ ID NO: 2522787 - RNA, 14 nt, Human
cugccccaggccug

SEQ ID NO: 2522788 - RNA, 13 nt, Human
cugccccaggccu

SEQ ID NO: 2522789 - RNA, 19 nt, Human
cugccccagggcucccggc

SEQ ID NO: 2522790 - RNA, 22 nt, Human
cugccccucaacucuccuccag

SEQ ID NO: 2522791 - RNA, 14 nt, Human
cugccccucaacuc

SEQ ID NO: 2522792 - RNA, 16 nt, Human
cugcccccucugcccu

SEQ ID NO: 2522793 - RNA, 17 nt, Human
cugcccccucugcccug

SEQ ID NO: 2522794 - RNA, 18 nt, Human
cugcccccucugcccugc

SEQ ID NO: 2522795 - RNA, 19 nt, Human
cugcccccucugcccugcg

SEQ ID NO: 2522796 - RNA, 11 nt, Human
cugccccuccc

SEQ ID NO: 2522797 - RNA, 13 nt, Human
cugccccucccag

SEQ ID NO: 2522798 - RNA, 14 nt, Human
cugccccucccaga

SEQ ID NO: 2522799 - RNA, 15 nt, Human
cugccccucccagaa

SEQ ID NO: 2522800 - RNA, 16 nt, Human
cugccccucccagaac

SEQ ID NO: 2522801 - RNA, 13 nt, Human
cugccccuccccc

SEQ ID NO: 2522802 - RNA, 14 nt, Human
cugccccuccccca

SEQ ID NO: 2522803 - RNA, 22 nt, Human
cugccccucccccaacccccac

SEQ ID NO: 2522804 - RNA, 15 nt, Human
cugccccucccugcu

SEQ ID NO: 2522805 - RNA, 19 nt, Human
cugcccuggugcugccaca

SEQ ID NO: 2522806 - RNA, 18 nt, Human
cugcccuggugcugccac

SEQ ID NO: 2522807 - RNA, 16 nt, Human
cugcccuggugcugcc

SEQ ID NO: 2522808 - RNA, 17 nt, Human
cugcccuggugcugcca

SEQ ID NO: 2522809 - RNA, 18 nt, Human
cugcccugugggccccca

SEQ ID NO: 2522810 - RNA, 16 nt, Human
cugcccugugggcccc

SEQ ID NO: 2522811 - RNA, 15 nt, Human
cugcccugugggccc

SEQ ID NO: 2522812 - RNA, 13 nt, Human
cugcccugugagu

SEQ ID NO: 2522813 - RNA, 12 nt, Human
cugcccugugag

SEQ ID NO: 2522814 - RNA, 13 nt, Human
cugcccuguaccc

SEQ ID NO: 2522815 - RNA, 21 nt, Human
cugcccuguaccccagcacuu

SEQ ID NO: 2522816 - RNA, 22 nt, Human
cugcccugguuuccugcccugg

SEQ ID NO: 2522817 - RNA, 23 nt, Human
cugcccugguuuccugcccuggg

SEQ ID NO: 2522818 - RNA, 21 nt, Human
cugcccuggugcugccacacu

SEQ ID NO: 2522819 - RNA, 20 nt, Human
cugcccuggugcugccacac

SEQ ID NO: 2522820 - RNA, 16 nt, Human
cugcauucuuucugua

SEQ ID NO: 2522821 - RNA, 15 nt, Human
cugcauucuuucugu

SEQ ID NO: 2522822 - RNA, 14 nt, Human
cugcauucuuucug

SEQ ID NO: 2522823 - RNA, 20 nt, Human
cugcauucaggaucaaaccc

SEQ ID NO: 2522824 - RNA, 19 nt, Human
cugcauucugccgugugcc

SEQ ID NO: 2522825 - RNA, 17 nt, Human
cugcauugagaacugca

SEQ ID NO: 2522826 - RNA, 20 nt, Human
cugcauuuaaaagauacagu

SEQ ID NO: 2522827 - RNA, 22 nt, Human
cugcauuuaaaagauacaguua

SEQ ID NO: 2522828 - RNA, 17 nt, Human
cugcauuucgguggcua

SEQ ID NO: 2522829 - RNA, 13 nt, Human
cugcauuucugag

SEQ ID NO: 2522830 - RNA, 18 nt, Human
cugcauuucgguggcuag

SEQ ID NO: 2522831 - RNA, 13 nt, Human
cugcauuugugaa

SEQ ID NO: 2522832 - RNA, 15 nt, Human
cugcauguuugugau

SEQ ID NO: 2522833 - RNA, 13 nt, Human
cugcauguuacau

SEQ ID NO: 2522834 - RNA, 20 nt, Human
cugcauucacccagacagcu

SEQ ID NO: 2522835 - RNA, 21 nt, Human
cugcauucacccagacagcuc

SEQ ID NO: 2522836 - RNA, 22 nt, Human
cugcauucacccagacagcucc

SEQ ID NO: 2522837 - RNA, 15 nt, Human
cugcauuagaaauua

SEQ ID NO: 2522838 - RNA, 23 nt, Human
cugcauuaccgcguuguaaaaua

SEQ ID NO: 2522839 - RNA, 21 nt, Human
cugcauuaccgcguuguaaaa

SEQ ID NO: 2522840 - RNA, 20 nt, Human
cugcauuaccgcguuguaaa

SEQ ID NO: 2522841 - RNA, 17 nt, Human
cugccaaugggagcuca

SEQ ID NO: 2522842 - RNA, 15 nt, Human
cugccaaugggagcu

SEQ ID NO: 2522843 - RNA, 18 nt, Human
cugccaaggccagagugg

SEQ ID NO: 2522844 - RNA, 21 nt, Human
cugccaaggccagaguggccu

SEQ ID NO: 2522845 - RNA, 22 nt, Human
cugccaaggccagaguggccug

SEQ ID NO: 2522846 - RNA, 22 nt, Human
cugccaacuucuucagagcuga

SEQ ID NO: 2522847 - RNA, 15 nt, Human
cugccaaggccagag

SEQ ID NO: 2522848 - RNA, 21 nt, Human
cugccaacuucuucagagcug

SEQ ID NO: 2522849 - RNA, 23 nt, Human
cugccaaccauaccuuccuuccc

SEQ ID NO: 2522850 - RNA, 22 nt, Human
cugccaaccauaccuuccuucc

SEQ ID NO: 2522851 - RNA, 21 nt, Human
cugccaaccauaccuuccuuc

SEQ ID NO: 2522852 - RNA, 15 nt, Human
cugccaaccauaccu

SEQ ID NO: 2522853 - RNA, 22 nt, Human
cugccaaaaugcucuagugccu

SEQ ID NO: 2522854 - RNA, 20 nt, Human
cugccaaauuuuggccaaag

SEQ ID NO: 2522855 - RNA, 21 nt, Human
cugccaaagggaaauaucauu

SEQ ID NO: 2522856 - RNA, 22 nt, Human
cugccaaaggaugugauauaua

SEQ ID NO: 2522857 - RNA, 19 nt, Human
cugccaaaggaugugauau

SEQ ID NO: 2522858 - RNA, 18 nt, Human
cugccaaaggaugugaua

SEQ ID NO: 2522859 - RNA, 16 nt, Human
cugccaaaggauguga

SEQ ID NO: 2522860 - RNA, 14 nt, Human
cugccaaaggaugu

SEQ ID NO: 2522861 - RNA, 15 nt, Human
cugccaaaaugcucu

SEQ ID NO: 2522862 - RNA, 16 nt, Human
cugccaaaaugcucua

SEQ ID NO: 2522863 - RNA, 18 nt, Human
cugcauuuuuagaccauu

SEQ ID NO: 2522864 - RNA, 22 nt, Human
cugcauuugugaaaugauggug

SEQ ID NO: 2522865 - RNA, 17 nt, Human
cugcauuugugaaauga

SEQ ID NO: 2522866 - RNA, 15 nt, Human
cugcauuugugaaau

SEQ ID NO: 2522867 - RNA, 14 nt, Human
cugcauuugugaaa

SEQ ID NO: 2522868 - RNA, 17 nt, Human
cugcauuuucaccccac

SEQ ID NO: 2522869 - RNA, 18 nt, Human
cugcauuuucaccccacc

SEQ ID NO: 2522870 - RNA, 21 nt, Human
cugcauuuugcuauuguaaau

SEQ ID NO: 2522871 - RNA, 20 nt, Human
cugcauuuuauucuggaugg

SEQ ID NO: 2522872 - RNA, 14 nt, Human
cugcauuuugcuau

SEQ ID NO: 2522873 - RNA, 19 nt, Human
cugcauuuuauucuggaug

SEQ ID NO: 2522874 - RNA, 22 nt, Human
cugcauuuuaauuuuaaccaaa

SEQ ID NO: 2522875 - RNA, 21 nt, Human
cugcauuuuaauuuuaaccaa

SEQ ID NO: 2522876 - RNA, 20 nt, Human
cugcauuuuaauuuuaacca

SEQ ID NO: 2522877 - RNA, 9 nt, Human
cugcauuuu

SEQ ID NO: 2522878 - RNA, 14 nt, Human
cugcauuucugagu

SEQ ID NO: 2522879 - RNA, 18 nt, Human
cugguuuccugcccuggg

SEQ ID NO: 2522880 - RNA, 21 nt, Human
cugguuuccugcccugggagg

SEQ ID NO: 2522881 - RNA, 16 nt, Human
cugguuuccugcccug

SEQ ID NO: 2522882 - RNA, 22 nt, Human
cugguuuccugcccugggaggc

SEQ ID NO: 2522883 - RNA, 17 nt, Human
cugguuuggggcgaggc

SEQ ID NO: 2522884 - RNA, 21 nt, Human
cugguuugacuccgcuggagg

SEQ ID NO: 2522885 - RNA, 15 nt, Human
cugguuuggaaugcu

SEQ ID NO: 2522886 - RNA, 19 nt, Human
cuguaggacucgcagucag

SEQ ID NO: 2522887 - RNA, 18 nt, Human
cuguaggaagguuaaugu

SEQ ID NO: 2522888 - RNA, 20 nt, Human
cuguagggagggcggcaggg

SEQ ID NO: 2522889 - RNA, 14 nt, Human
cuguagggaacucu

SEQ ID NO: 2522890 - RNA, 21 nt, Human
cuguaggaagguuaauguuca

SEQ ID NO: 2522891 - RNA, 18 nt, Human
cugucacccuccaccucu

SEQ ID NO: 2522892 - RNA, 14 nt, Human
cugucacccuccac

SEQ ID NO: 2522893 - RNA, 20 nt, Human
cugucacccaggcuggagua

SEQ ID NO: 2522894 - RNA, 13 nt, Human
cugucacccaggc

SEQ ID NO: 2522895 - RNA, 14 nt, Human
cugucacucauugc

SEQ ID NO: 2522896 - RNA, 21 nt, Human
cugucacucauugcugagccu

SEQ ID NO: 2522897 - RNA, 17 nt, Human
cuguagggcuggaccua

SEQ ID NO: 2522898 - RNA, 16 nt, Human
cuguagggcuggaccu

SEQ ID NO: 2522899 - RNA, 15 nt, Human
cuguagggcuggacc

SEQ ID NO: 2522900 - RNA, 14 nt, Human
cuguagggcuggac

SEQ ID NO: 2522901 - RNA, 21 nt, Human
cuguagggagggcggcagggg

SEQ ID NO: 2522902 - RNA, 23 nt, Human
cugucaccaagcucacaguuccu

SEQ ID NO: 2522903 - RNA, 18 nt, Human
cuguagggcuggaccuau

SEQ ID NO: 2522904 - RNA, 14 nt, Human
cugucaccaagcuc

SEQ ID NO: 2522905 - RNA, 23 nt, Human
cuguacuugcucuugaugccugg

SEQ ID NO: 2522906 - RNA, 20 nt, Human
cuguaaaccucucgagggca

SEQ ID NO: 2522907 - RNA, 22 nt, Human
cuguaaaccccuuuaguggcuu

SEQ ID NO: 2522908 - RNA, 21 nt, Human
cuguacuugcucuugaugccu

SEQ ID NO: 2522909 - RNA, 22 nt, Human
cuguacuugcucuugaugccug

SEQ ID NO: 2522910 - RNA, 17 nt, Human
cugguuuggaaugcuuc

SEQ ID NO: 2522911 - RNA, 22 nt, Human
cugguuugacuccgcuggaggu

SEQ ID NO: 2522912 - RNA, 17 nt, Human
cuguaaaauaaaagguc

SEQ ID NO: 2522913 - RNA, 16 nt, Human
cugguuuggggcgagg

SEQ ID NO: 2522914 - RNA, 22 nt, Human
cuguaaaaugcaugauuuugua

SEQ ID NO: 2522915 - RNA, 16 nt, Human
cuguaaaaugaaauua

SEQ ID NO: 2522916 - RNA, 11 nt, Human
cuguaaaaucu

SEQ ID NO: 2522917 - RNA, 10 nt, Human
cuguaaaauc

SEQ ID NO: 2522918 - RNA, 22 nt, Human
cuguaaaaucuuucuuucuuag

SEQ ID NO: 2522919 - RNA, 23 nt, Human
cuguaaaauauacuuaaauggaa

SEQ ID NO: 2522920 - RNA, 15 nt, Human
cuguaaaaugaaauu

SEQ ID NO: 2522921 - RNA, 23 nt, Human
cugucagcuccccucggagaaga

SEQ ID NO: 2522922 - RNA, 16 nt, Human
cugucauuugagcagg

SEQ ID NO: 2522923 - RNA, 18 nt, Human
cugucauuugagcagggc

SEQ ID NO: 2522924 - RNA, 17 nt, Human
cugucauuugagcaggg

SEQ ID NO: 2522925 - RNA, 22 nt, Human
cuguccugauggucagcucccu

SEQ ID NO: 2522926 - RNA, 21 nt, Human
cuguccugauggucagcuccc

SEQ ID NO: 2522927 - RNA, 20 nt, Human
cuguccugauggucagcucc

SEQ ID NO: 2522928 - RNA, 13 nt, Human
cuguccugcucca

SEQ ID NO: 2522929 - RNA, 12 nt, Human
cuguccugccua

SEQ ID NO: 2522930 - RNA, 17 nt, Human
cugucagcgcagguuua

SEQ ID NO: 2522931 - RNA, 19 nt, Human
cuguccugauggucagcuc

SEQ ID NO: 2522932 - RNA, 17 nt, Human
cuguccugauggucagc

SEQ ID NO: 2522933 - RNA, 20 nt, Human
cuguccugacuucaggggcu

SEQ ID NO: 2522934 - RNA, 18 nt, Human
cuguccugaccugucuca

SEQ ID NO: 2522935 - RNA, 23 nt, Human
cugucagccgggcccugaguaau

SEQ ID NO: 2522936 - RNA, 22 nt, Human
cugucagccgggcccugaguaa

SEQ ID NO: 2522937 - RNA, 18 nt, Human
cugucagccgggcccuga

SEQ ID NO: 2522938 - RNA, 17 nt, Human
cugucagccgggcccug

SEQ ID NO: 2522939 - RNA, 16 nt, Human
cugucagccgggcccu

SEQ ID NO: 2522940 - RNA, 13 nt, Human
cugucagccgggc

SEQ ID NO: 2522941 - RNA, 21 nt, Human
cugucagcuccccucggagaa

SEQ ID NO: 2522942 - RNA, 18 nt, Human
cugucagccauuccuguu

SEQ ID NO: 2522943 - RNA, 21 nt, Human
cugucagaugggaagacauga

SEQ ID NO: 2522944 - RNA, 22 nt, Human
cugucagaugggaagacaugaa

SEQ ID NO: 2522945 - RNA, 18 nt, Human
cugucacuuugcucuggg

SEQ ID NO: 2522946 - RNA, 19 nt, Human
cugucacuuugcucugggu

SEQ ID NO: 2522947 - RNA, 17 nt, Human
cugucacuuugcucugg

SEQ ID NO: 2522948 - RNA, 15 nt, Human
cugucacuuugcucu

SEQ ID NO: 2522949 - RNA, 14 nt, Human
cugucacuuugcuc

SEQ ID NO: 2522950 - RNA, 12 nt, Human
cugucacuuugc

SEQ ID NO: 2522951 - RNA, 20 nt, Human
cugucacuguuucucugcug

SEQ ID NO: 2522952 - RNA, 14 nt, Human
cugucacuguuucu

SEQ ID NO: 2522953 - RNA, 19 nt, Human
cugucacuguuucucugcu

SEQ ID NO: 2522954 - RNA, 22 nt, Human
cugucacucauugcugagccuc

SEQ ID NO: 2522955 - RNA, 23 nt, Human
cugucacucauugcugagccucu

SEQ ID NO: 2522956 - RNA, 13 nt, Human
cugucacugcagg

SEQ ID NO: 2522957 - RNA, 16 nt, Human
cugucacccuccaccu

SEQ ID NO: 2522958 - RNA, 16 nt, Human
cugucacugcaggcac

SEQ ID NO: 2522959 - RNA, 19 nt, Human
cugugcuccgugccuccac

SEQ ID NO: 2522960 - RNA, 18 nt, Human
cugugcuccgugccucca

SEQ ID NO: 2522961 - RNA, 17 nt, Human
cugugcuccgugccucc

SEQ ID NO: 2522962 - RNA, 15 nt, Human
cugugcuccgugccu

SEQ ID NO: 2522963 - RNA, 10 nt, Human
cugugcuccg

SEQ ID NO: 2522964 - RNA, 22 nt, Human
cugugcucccugguucugauga

SEQ ID NO: 2522965 - RNA, 23 nt, Human
cugugcucaggacucagaagccu

SEQ ID NO: 2522966 - RNA, 18 nt, Human
cugugcucaggacucaga

SEQ ID NO: 2522967 - RNA, 19 nt, Human
cugugcucaggacucagaa

SEQ ID NO: 2522968 - RNA, 14 nt, Human
cugugcucccuggu

SEQ ID NO: 2522969 - RNA, 14 nt, Human
cugugcucuggaca

SEQ ID NO: 2522970 - RNA, 16 nt, Human
cugugagaugcuagaa

SEQ ID NO: 2522971 - RNA, 17 nt, Human
cugugcucaggacucag

SEQ ID NO: 2522972 - RNA, 20 nt, Human
cugugagacucgagaacuuu

SEQ ID NO: 2522973 - RNA, 18 nt, Human
cugugagacucgagaacu

SEQ ID NO: 2522974 - RNA, 20 nt, Human
cugugagacccccacaccuc

SEQ ID NO: 2522975 - RNA, 23 nt, Human
cugugagacccccacaccucagu

SEQ ID NO: 2522976 - RNA, 16 nt, Human
cugugagacccccaca

SEQ ID NO: 2522977 - RNA, 17 nt, Human
cugugagacccccacac

SEQ ID NO: 2522978 - RNA, 18 nt, Human
cugugagacccccacacc

SEQ ID NO: 2522979 - RNA, 19 nt, Human
cugugagacccccacaccu

SEQ ID NO: 2522980 - RNA, 15 nt, Human
cugugaagagaacca

SEQ ID NO: 2522981 - RNA, 14 nt, Human
cugugaacuugggg

SEQ ID NO: 2522982 - RNA, 15 nt, Human
cugugaacuugggga

SEQ ID NO: 2522983 - RNA, 16 nt, Human
cugugaacuuggggaa

SEQ ID NO: 2522984 - RNA, 24 nt, Human
cugugaaguccuucaccucacuga

SEQ ID NO: 2522985 - RNA, 18 nt, Human
cugugaaguccuucaccu

SEQ ID NO: 2522986 - RNA, 16 nt, Human
cugugaaguccuucac

SEQ ID NO: 2522987 - RNA, 14 nt, Human
cugugaaguaagga

SEQ ID NO: 2522988 - RNA, 15 nt, Human
cugugagacccccac

SEQ ID NO: 2522989 - RNA, 21 nt, Human
cugugaagcauucgagacaga

SEQ ID NO: 2522990 - RNA, 23 nt, Human
cugugaagcauucgagacagaac

SEQ ID NO: 2522991 - RNA, 14 nt, Human
cugugaaggacccu

SEQ ID NO: 2522992 - RNA, 22 nt, Human
cugugaacuuggggaacaaggg

SEQ ID NO: 2522993 - RNA, 17 nt, Human
cuguccugcuccacagu

SEQ ID NO: 2522994 - RNA, 16 nt, Human
cuguccugcuccacag

SEQ ID NO: 2522995 - RNA, 15 nt, Human
cuguccugcuccaca

SEQ ID NO: 2522996 - RNA, 14 nt, Human
cuguccugcuccac

SEQ ID NO: 2522997 - RNA, 19 nt, Human
cuguccugcuccacagugu

SEQ ID NO: 2522998 - RNA, 18 nt, Human
cuguccugcuccacagug

SEQ ID NO: 2522999 - RNA, 13 nt, Human
cuguccugcuggu

SEQ ID NO: 2523000 - RNA, 13 nt, Human
cugucgagacacu

SEQ ID NO: 2523001 - RNA, 18 nt, Human
cugucgagacacuugccu

SEQ ID NO: 2523002 - RNA, 14 nt, Human
cugucgagacacuu

SEQ ID NO: 2523003 - RNA, 15 nt, Human
cugucgauguaggca

SEQ ID NO: 2523004 - RNA, 16 nt, Human
cugucgcccaggcugg

SEQ ID NO: 2523005 - RNA, 13 nt, Human
cugucgcccaguc

SEQ ID NO: 2523006 - RNA, 15 nt, Human
cugggacguggcuca

SEQ ID NO: 2523007 - RNA, 16 nt, Human
cugggacguggcucag

SEQ ID NO: 2523008 - RNA, 17 nt, Human
cugggacguggcucagc

SEQ ID NO: 2523009 - RNA, 20 nt, Human
cugggaccuuuagugguggc

SEQ ID NO: 2523010 - RNA, 13 nt, Human
cugggaccuuuag

SEQ ID NO: 2523011 - RNA, 20 nt, Human
cugggaccugccaggcaggg

SEQ ID NO: 2523012 - RNA, 19 nt, Human
cugggaccugccaggcagg

SEQ ID NO: 2523013 - RNA, 18 nt, Human
cugggaccugccaggcag

SEQ ID NO: 2523014 - RNA, 17 nt, Human
cugggaccugccaggca

SEQ ID NO: 2523015 - RNA, 20 nt, Human
cugggaccuccccugaggcu

SEQ ID NO: 2523016 - RNA, 16 nt, Human
cugggaccuccccuga

SEQ ID NO: 2523017 - RNA, 15 nt, Human
cugggaccuccccug

SEQ ID NO: 2523018 - RNA, 23 nt, Human
cugggacccuuuccuuccuuccc

SEQ ID NO: 2523019 - RNA, 15 nt, Human
cugggacccuuuccu

SEQ ID NO: 2523020 - RNA, 19 nt, Human
cugggacccuuuccuuccu

SEQ ID NO: 2523021 - RNA, 20 nt, Human
cugggacccuuuccuuccuu

SEQ ID NO: 2523022 - RNA, 13 nt, Human
cugggacacaguu

SEQ ID NO: 2523023 - RNA, 12 nt, Human
cugggacacagu

SEQ ID NO: 2523024 - RNA, 10 nt, Human
cugggacagg

SEQ ID NO: 2523025 - RNA, 14 nt, Human
cugggacccuuucc

SEQ ID NO: 2523026 - RNA, 19 nt, Human
cugggacacuuaacagaug

SEQ ID NO: 2523027 - RNA, 23 nt, Human
cugggacacuuaacagaugcaau

SEQ ID NO: 2523028 - RNA, 13 nt, Human
cuggcuccagcug

SEQ ID NO: 2523029 - RNA, 14 nt, Human
cuggcuccagcugg

SEQ ID NO: 2523030 - RNA, 18 nt, Human
cuggcuccagcuggccgg

SEQ ID NO: 2523031 - RNA, 20 nt, Human
cuggcuccagcuggccggga

SEQ ID NO: 2523032 - RNA, 16 nt, Human
cuggcuccaggccagg

SEQ ID NO: 2523033 - RNA, 13 nt, Human
cuggcagcucucc

SEQ ID NO: 2523034 - RNA, 20 nt, Human
cuggcucccacaggcagcuu

SEQ ID NO: 2523035 - RNA, 19 nt, Human
cuggcucccacaggcagcu

SEQ ID NO: 2523036 - RNA, 18 nt, Human
cuggcucccacaggcagc

SEQ ID NO: 2523037 - RNA, 17 nt, Human
cuggcucccacaggcag

SEQ ID NO: 2523038 - RNA, 15 nt, Human
cuggcucccacaggc

SEQ ID NO: 2523039 - RNA, 21 nt, Human
cuggccccucagggucccugg

SEQ ID NO: 2523040 - RNA, 20 nt, Human
cuggccccucagggucccug

SEQ ID NO: 2523041 - RNA, 18 nt, Human
cuggccccucaggguccc

SEQ ID NO: 2523042 - RNA, 17 nt, Human
cuggccccucagggucc

SEQ ID NO: 2523043 - RNA, 19 nt, Human
cuggcuccaaacccucgag

SEQ ID NO: 2523044 - RNA, 20 nt, Human
cuggcuccaaacccucgagg

SEQ ID NO: 2523045 - RNA, 14 nt, Human
cuggcuccagaugc

SEQ ID NO: 2523046 - RNA, 20 nt, Human
cuggcuccagaugcagggca

SEQ ID NO: 2523047 - RNA, 21 nt, Human
cuggcuccagaugcagggcag

SEQ ID NO: 2523048 - RNA, 12 nt, Human
cuggccccucac

SEQ ID NO: 2523049 - RNA, 13 nt, Human
cuggccccucacc

SEQ ID NO: 2523050 - RNA, 15 nt, Human
cuggccccucaccug

SEQ ID NO: 2523051 - RNA, 22 nt, Human
cuggccccucaccugggcaccu

SEQ ID NO: 2523052 - RNA, 19 nt, Human
cuggcucauauuccugcag

SEQ ID NO: 2523053 - RNA, 20 nt, Human
cuggcucauauuccugcagc

SEQ ID NO: 2523054 - RNA, 21 nt, Human
cuggcucauauuccugcagcc

SEQ ID NO: 2523055 - RNA, 22 nt, Human
cuggcucauauuccugcagccu

SEQ ID NO: 2523056 - RNA, 23 nt, Human
cuggcucauauuccugcagccug

SEQ ID NO: 2523057 - RNA, 24 nt, Human
cuggcucauauuccugcagccugg

SEQ ID NO: 2523058 - RNA, 13 nt, Human
cuggcucaucucu

SEQ ID NO: 2523059 - RNA, 17 nt, Human
cuggcagcucuccaguc

SEQ ID NO: 2523060 - RNA, 16 nt, Human
cuggcagcucuccagu

SEQ ID NO: 2523061 - RNA, 15 nt, Human
cuggcagcucuccag

SEQ ID NO: 2523062 - RNA, 14 nt, Human
cuggcagcucucca

SEQ ID NO: 2523063 - RNA, 23 nt, Human
cuggcagcucuccagucaggagg

SEQ ID NO: 2523064 - RNA, 18 nt, Human
cuggcagcucuccaguca

SEQ ID NO: 2523065 - RNA, 12 nt, Human
cuggcagcucug

SEQ ID NO: 2523066 - RNA, 23 nt, Human
cuggcagccucccauccagggcc

SEQ ID NO: 2523067 - RNA, 15 nt, Human
cuggcagcucagaga

SEQ ID NO: 2523068 - RNA, 17 nt, Human
cuggcagcucuggacag

SEQ ID NO: 2523069 - RNA, 18 nt, Human
cuggcagcucuggacagc

SEQ ID NO: 2523070 - RNA, 20 nt, Human
cuggcagcucuggacagccc

SEQ ID NO: 2523071 - RNA, 21 nt, Human
cuggcagcucuggacagcccc

SEQ ID NO: 2523072 - RNA, 18 nt, Human
cuggcaggaugacccugc

SEQ ID NO: 2523073 - RNA, 20 nt, Human
cuggcaggaugacccugcga

SEQ ID NO: 2523074 - RNA, 18 nt, Human
cuggcagggugggaugga

SEQ ID NO: 2523075 - RNA, 22 nt, Human
cuggccccgccgccugguacuc

SEQ ID NO: 2523076 - RNA, 16 nt, Human
cuggccccgccgccug

SEQ ID NO: 2523077 - RNA, 14 nt, Human
cuggccccgccgcc

SEQ ID NO: 2523078 - RNA, 12 nt, Human
cuggccccgccg

SEQ ID NO: 2523079 - RNA, 13 nt, Human
cuggccccucagg

SEQ ID NO: 2523080 - RNA, 17 nt, Human
cuggcagggugggaugg

SEQ ID NO: 2523081 - RNA, 18 nt, Human
cuggccccuagaaucagc

SEQ ID NO: 2523082 - RNA, 20 nt, Human
cuggccccuagaaucagccu

SEQ ID NO: 2523083 - RNA, 23 nt, Human
cuggccccgccgccugguacuca

SEQ ID NO: 2523084 - RNA, 21 nt, Human
cuggagaccaugcagagcgcc

SEQ ID NO: 2523085 - RNA, 20 nt, Human
cuggagaccaugcagagcgc

SEQ ID NO: 2523086 - RNA, 18 nt, Human
cuggagaccaugcagagc

SEQ ID NO: 2523087 - RNA, 21 nt, Human
cuggagacgggugggcggcug

SEQ ID NO: 2523088 - RNA, 18 nt, Human
cuggagacgggugggcgg

SEQ ID NO: 2523089 - RNA, 17 nt, Human
cuggagaccagggagcc

SEQ ID NO: 2523090 - RNA, 18 nt, Human
cuggagaccagggagccu

SEQ ID NO: 2523091 - RNA, 19 nt, Human
cuggagaccagggagccuu

SEQ ID NO: 2523092 - RNA, 19 nt, Human
cuggacugucauagaaauu

SEQ ID NO: 2523093 - RNA, 20 nt, Human
cuggacugucauagaaauua

SEQ ID NO: 2523094 - RNA, 23 nt, Human
cuggagacagccccagagcaggg

SEQ ID NO: 2523095 - RNA, 22 nt, Human
cuggagacagccccagagcagg

SEQ ID NO: 2523096 - RNA, 16 nt, Human
cuggacugugugcuca

SEQ ID NO: 2523097 - RNA, 14 nt, Human
cuggcagcucagag

SEQ ID NO: 2523098 - RNA, 13 nt, Human
cuggcagcucaga

SEQ ID NO: 2523099 - RNA, 19 nt, Human
cuggagacuccuaggcagg

SEQ ID NO: 2523100 - RNA, 18 nt, Human
cuggagacuccuaggcag

SEQ ID NO: 2523101 - RNA, 20 nt, Human
cuggagacuccuaggcagga

SEQ ID NO: 2523102 - RNA, 17 nt, Human
cuggagacuaaccccac

SEQ ID NO: 2523103 - RNA, 12 nt, Human
cuggcagcucag

SEQ ID NO: 2523104 - RNA, 21 nt, Human
cuggugauggagguuucauac

SEQ ID NO: 2523105 - RNA, 21 nt, Human
cuggugagucuuggcggcagc

SEQ ID NO: 2523106 - RNA, 20 nt, Human
cuggugagucuuggcggcag

SEQ ID NO: 2523107 - RNA, 19 nt, Human
cuggugagucuuggcggca

SEQ ID NO: 2523108 - RNA, 17 nt, Human
cuggugaggccuugcuc

SEQ ID NO: 2523109 - RNA, 23 nt, Human
cuggugagucuuggcggcagcag

SEQ ID NO: 2523110 - RNA, 16 nt, Human
cuggugaggccuugcu

SEQ ID NO: 2523111 - RNA, 15 nt, Human
cuggugaggccuugc

SEQ ID NO: 2523112 - RNA, 13 nt, Human
cuggugaggccuu

SEQ ID NO: 2523113 - RNA, 16 nt, Human
cuggugagcagacugg

SEQ ID NO: 2523114 - RNA, 23 nt, Human
cuggugacuuuccucuuuggucu

SEQ ID NO: 2523115 - RNA, 22 nt, Human
cuggugacugcgaucuucagag

SEQ ID NO: 2523116 - RNA, 21 nt, Human
cuggugacugcgaucuucaga

SEQ ID NO: 2523117 - RNA, 21 nt, Human
cuggugacuuuccucuuuggu

SEQ ID NO: 2523118 - RNA, 20 nt, Human
cuggugacuuuccucuuugg

SEQ ID NO: 2523119 - RNA, 15 nt, Human
cuggugacuuuccuc

SEQ ID NO: 2523120 - RNA, 23 nt, Human
cuggguuccuuccucugagccuu

SEQ ID NO: 2523121 - RNA, 18 nt, Human
cuggguuccuuccucuga

SEQ ID NO: 2523122 - RNA, 22 nt, Human
cuggguuccuuccucugagccu

SEQ ID NO: 2523123 - RNA, 13 nt, Human
cuggguuccugca

SEQ ID NO: 2523124 - RNA, 21 nt, Human
cuggguucccuuuccuuccau

SEQ ID NO: 2523125 - RNA, 16 nt, Human
cuggguucccuuuccu

SEQ ID NO: 2523126 - RNA, 20 nt, Human
cuggguucccuuuccuucca

SEQ ID NO: 2523127 - RNA, 22 nt, Human
cuggguuccagcaauucuccug

SEQ ID NO: 2523128 - RNA, 14 nt, Human
cuggguucccuuuc

SEQ ID NO: 2523129 - RNA, 14 nt, Human
cuggguucacugca

SEQ ID NO: 2523130 - RNA, 17 nt, Human
cuggguguggcgcagca

SEQ ID NO: 2523131 - RNA, 13 nt, Human
cuggguggccucg

SEQ ID NO: 2523132 - RNA, 21 nt, Human
cuggguggcccauccccccuc

SEQ ID NO: 2523133 - RNA, 20 nt, Human
cuggguggcccauccccccu

SEQ ID NO: 2523134 - RNA, 16 nt, Human
cuggguggcccauccc

SEQ ID NO: 2523135 - RNA, 15 nt, Human
cuggguggcccaucc

SEQ ID NO: 2523136 - RNA, 14 nt, Human
cuggguggcccauc

SEQ ID NO: 2523137 - RNA, 13 nt, Human
cuggguggcccau

SEQ ID NO: 2523138 - RNA, 12 nt, Human
cuggguggccca

SEQ ID NO: 2523139 - RNA, 21 nt, Human
cuggguggcacugccaugcag

SEQ ID NO: 2523140 - RNA, 16 nt, Human
cuggguguggcgcagc

SEQ ID NO: 2523141 - RNA, 23 nt, Human
cuggguggcaccagcagccugga

SEQ ID NO: 2523142 - RNA, 20 nt, Human
cuggguggcacugccaugca

SEQ ID NO: 2523143 - RNA, 16 nt, Human
cuggguggcacugcca

SEQ ID NO: 2523144 - RNA, 15 nt, Human
cuggguggcacugcc

SEQ ID NO: 2523145 - RNA, 14 nt, Human
cuggguggcacugc

SEQ ID NO: 2523146 - RNA, 19 nt, Human
cuggggccucggagccuca

SEQ ID NO: 2523147 - RNA, 22 nt, Human
cuggggccuaucagugugcccc

SEQ ID NO: 2523148 - RNA, 11 nt, Human
cuggggccucc

SEQ ID NO: 2523149 - RNA, 12 nt, Human
cuggggccucca

SEQ ID NO: 2523150 - RNA, 15 nt, Human
cuggggccuccagaa

SEQ ID NO: 2523151 - RNA, 17 nt, Human
cuggggccuccagaacu

SEQ ID NO: 2523152 - RNA, 22 nt, Human
cuggguggcaccagcagccugg

SEQ ID NO: 2523153 - RNA, 16 nt, Human
cuggggccgaaagaac

SEQ ID NO: 2523154 - RNA, 21 nt, Human
cuggggccuaucagugugccc

SEQ ID NO: 2523155 - RNA, 17 nt, Human
cuggggccuaucagugu

SEQ ID NO: 2523156 - RNA, 16 nt, Human
cuggggcaagucccug

SEQ ID NO: 2523157 - RNA, 12 nt, Human
cuggggccccuu

SEQ ID NO: 2523158 - RNA, 18 nt, Human
cuggggccaggcuggguc

SEQ ID NO: 2523159 - RNA, 22 nt, Human
cuggggaugugggagggagcag

SEQ ID NO: 2523160 - RNA, 17 nt, Human
cuggggaugugggaggg

SEQ ID NO: 2523161 - RNA, 14 nt, Human
cuggggcaaguccc

SEQ ID NO: 2523162 - RNA, 21 nt, Human
cuggggcaagucccugacucu

SEQ ID NO: 2523163 - RNA, 22 nt, Human
cuggggaugucucucaugacca

SEQ ID NO: 2523164 - RNA, 19 nt, Human
cuggggaaauaacagcugu

SEQ ID NO: 2523165 - RNA, 22 nt, Human
cuggggaaauaacagcuguggc

SEQ ID NO: 2523166 - RNA, 18 nt, Human
cuggggauugggccccug

SEQ ID NO: 2523167 - RNA, 22 nt, Human
cuggggauugggccccugccag

SEQ ID NO: 2523168 - RNA, 16 nt, Human
cuggggauugggcccc

SEQ ID NO: 2523169 - RNA, 16 nt, Human
cuggggaugugggagg

SEQ ID NO: 2523170 - RNA, 15 nt, Human
cuggggaugugggag

SEQ ID NO: 2523171 - RNA, 13 nt, Human
cugggcagaccuu

SEQ ID NO: 2523172 - RNA, 17 nt, Human
cugggcagaaggccaag

SEQ ID NO: 2523173 - RNA, 16 nt, Human
cugggcagaaggccaa

SEQ ID NO: 2523174 - RNA, 14 nt, Human
cugggcagaaggcc

SEQ ID NO: 2523175 - RNA, 18 nt, Human
cugggcagaaggaagacu

SEQ ID NO: 2523176 - RNA, 16 nt, Human
cugggcagaaggaaga

SEQ ID NO: 2523177 - RNA, 13 nt, Human
cugggcagaaggc

SEQ ID NO: 2523178 - RNA, 16 nt, Human
cuggggaaccugaccc

SEQ ID NO: 2523179 - RNA, 17 nt, Human
cuggggaaccugacccc

SEQ ID NO: 2523180 - RNA, 15 nt, Human
cuggggaaccugacc

SEQ ID NO: 2523181 - RNA, 17 nt, Human
cuggggaaauaacagcu

SEQ ID NO: 2523182 - RNA, 12 nt, Human
cugggcagcugu

SEQ ID NO: 2523183 - RNA, 17 nt, Human
cugggcagaaggaagac

SEQ ID NO: 2523184 - RNA, 14 nt, Human
cuuuuaugugaaac

SEQ ID NO: 2523185 - RNA, 15 nt, Human
cuuuuauguaguaau

SEQ ID NO: 2523186 - RNA, 18 nt, Human
cuuuuauguaguaauuga

SEQ ID NO: 2523187 - RNA, 22 nt, Human
cuuuuauguaguaauugacaug

SEQ ID NO: 2523188 - RNA, 23 nt, Human
cuuuuauguaguaauugacaugu

SEQ ID NO: 2523189 - RNA, 18 nt, Human
cuuuuaugauguauauuu

SEQ ID NO: 2523190 - RNA, 17 nt, Human
cuuuuaugauguauauu

SEQ ID NO: 2523191 - RNA, 19 nt, Human
cuuuuauagcuauuacugu

SEQ ID NO: 2523192 - RNA, 18 nt, Human
cuuuuauagcuauuacug

SEQ ID NO: 2523193 - RNA, 17 nt, Human
cuuuuauagcuauuacu

SEQ ID NO: 2523194 - RNA, 14 nt, Human
cuuuuauagcuauu

SEQ ID NO: 2523195 - RNA, 12 nt, Human
cuuuuauagcua

SEQ ID NO: 2523196 - RNA, 22 nt, Human
cuuuuauaaaccucuaauuuau

SEQ ID NO: 2523197 - RNA, 16 nt, Human
cuuuuauagaugguca

SEQ ID NO: 2523198 - RNA, 12 nt, Human
cuuuuauacucu

SEQ ID NO: 2523199 - RNA, 17 nt, Human
cuuuuauacucuuucug

SEQ ID NO: 2523200 - RNA, 19 nt, Human
cuuuuauacucuuucugua

SEQ ID NO: 2523201 - RNA, 20 nt, Human
cuuuuauacucuuucuguau

SEQ ID NO: 2523202 - RNA, 13 nt, Human
cuuuuaucaaaca

SEQ ID NO: 2523203 - RNA, 19 nt, Human
cuuuuaucacgauauuauu

SEQ ID NO: 2523204 - RNA, 17 nt, Human
cuuuuauccacuuaccu

SEQ ID NO: 2523205 - RNA, 21 nt, Human
cuuuuaguuuuaguugcagaa

SEQ ID NO: 2523206 - RNA, 22 nt, Human
cuuuuaguuuuaguugcagaaa

SEQ ID NO: 2523207 - RNA, 19 nt, Human
cuuuuaguuguaucucuuu

SEQ ID NO: 2523208 - RNA, 20 nt, Human
cuuuuaguuguaucucuuuu

SEQ ID NO: 2523209 - RNA, 21 nt, Human
cuuuuaguuguaucucuuuug

SEQ ID NO: 2523210 - RNA, 15 nt, Human
cuuuguauauuauuu

SEQ ID NO: 2523211 - RNA, 18 nt, Human
cuuuuaguuguaucucuu

SEQ ID NO: 2523212 - RNA, 10 nt, Human
cuuuguauau

SEQ ID NO: 2523213 - RNA, 13 nt, Human
cuuuuauaaacuu

SEQ ID NO: 2523214 - RNA, 16 nt, Human
cuuuuauaaaccucua

SEQ ID NO: 2523215 - RNA, 14 nt, Human
cuuuuauaaaccuc

SEQ ID NO: 2523216 - RNA, 12 nt, Human
cuuuguauauua

SEQ ID NO: 2523217 - RNA, 21 nt, Human
cuuuguaccccccaaccccug

SEQ ID NO: 2523218 - RNA, 19 nt, Human
cuuuguaccccccaacccc

SEQ ID NO: 2523219 - RNA, 14 nt, Human
cuuuguacccccca

SEQ ID NO: 2523220 - RNA, 12 nt, Human
cuuuguaccccc

SEQ ID NO: 2523221 - RNA, 19 nt, Human
cuuuguaaucguuaugugu

SEQ ID NO: 2523222 - RNA, 23 nt, Human
cuuuguaagaguguagaagcauu

SEQ ID NO: 2523223 - RNA, 21 nt, Human
cuuuguaaucguuaugugugu

SEQ ID NO: 2523224 - RNA, 14 nt, Human
cuuuguacuuugug

SEQ ID NO: 2523225 - RNA, 21 nt, Human
cuuugggcugcccuggugcug

SEQ ID NO: 2523226 - RNA, 20 nt, Human
cuuugggcugcccuggugcu

SEQ ID NO: 2523227 - RNA, 19 nt, Human
cuuugggcugcccuggugc

SEQ ID NO: 2523228 - RNA, 15 nt, Human
cuuugggcugcccug

SEQ ID NO: 2523229 - RNA, 18 nt, Human
cuuugaugucauauggaa

SEQ ID NO: 2523230 - RNA, 17 nt, Human
cuuugggccuggcuccc

SEQ ID NO: 2523231 - RNA, 14 nt, Human
cuuugggcugcccu

SEQ ID NO: 2523232 - RNA, 15 nt, Human
cuuuguaaauuguca

SEQ ID NO: 2523233 - RNA, 23 nt, Human
cuuugguuuuuuucuucuguauu

SEQ ID NO: 2523234 - RNA, 15 nt, Human
cuuugauguuaacac

SEQ ID NO: 2523235 - RNA, 17 nt, Human
cuuugauguuaacacau

SEQ ID NO: 2523236 - RNA, 20 nt, Human
cuuuguaagaguguagaagc

SEQ ID NO: 2523237 - RNA, 19 nt, Human
cuuuguaagaguguagaag

SEQ ID NO: 2523238 - RNA, 18 nt, Human
cuuuguaagaguguagaa

SEQ ID NO: 2523239 - RNA, 17 nt, Human
cuuuguaagaguguaga

SEQ ID NO: 2523240 - RNA, 22 nt, Human
cuuuguaagaguguagaagcau

SEQ ID NO: 2523241 - RNA, 21 nt, Human
cuuuguaagaguguagaagca

SEQ ID NO: 2523242 - RNA, 15 nt, Human
cuuucuagccagagg

SEQ ID NO: 2523243 - RNA, 16 nt, Human
cuuuccuuuccccagc

SEQ ID NO: 2523244 - RNA, 19 nt, Human
cuuuccuuguuccccauca

SEQ ID NO: 2523245 - RNA, 17 nt, Human
cuuuccuuuccccagcc

SEQ ID NO: 2523246 - RNA, 16 nt, Human
cuuuccuuggcuccca

SEQ ID NO: 2523247 - RNA, 14 nt, Human
cuuuccuucuugcc

SEQ ID NO: 2523248 - RNA, 15 nt, Human
cuuuccuugcucaac

SEQ ID NO: 2523249 - RNA, 22 nt, Human
cuuuccuuggcucccauucacu

SEQ ID NO: 2523250 - RNA, 17 nt, Human
cuuuccuuggcucccau

SEQ ID NO: 2523251 - RNA, 17 nt, Human
cuuucuacccagcgagc

SEQ ID NO: 2523252 - RNA, 16 nt, Human
cuuucuagccagagga

SEQ ID NO: 2523253 - RNA, 21 nt, Human
cuuugauaauguuaaauuugu

SEQ ID NO: 2523254 - RNA, 22 nt, Human
cuuugauaauguuaaauuugua

SEQ ID NO: 2523255 - RNA, 22 nt, Human
cuuugauauuuucaacgcagcc

SEQ ID NO: 2523256 - RNA, 15 nt, Human
cuuugaucagguggg

SEQ ID NO: 2523257 - RNA, 21 nt, Human
cuuugaugauuaauucaccuu

SEQ ID NO: 2523258 - RNA, 20 nt, Human
cuuucagccaagaauucuua

SEQ ID NO: 2523259 - RNA, 23 nt, Human
cuuucagccaagaauucuuaaau

SEQ ID NO: 2523260 - RNA, 20 nt, Human
cuuucacaaaauuuuauucc

SEQ ID NO: 2523261 - RNA, 13 nt, Human
cuuucagcuguga

SEQ ID NO: 2523262 - RNA, 14 nt, Human
cuuucagcugugaa

SEQ ID NO: 2523263 - RNA, 20 nt, Human
cuuucagggaauuucaggaa

SEQ ID NO: 2523264 - RNA, 23 nt, Human
cuuucaauaggaaaaacugauuu

SEQ ID NO: 2523265 - RNA, 20 nt, Human
cuuucaaugguuugcaagga

SEQ ID NO: 2523266 - RNA, 22 nt, Human
cuuucaaugguuugcaaggaag

SEQ ID NO: 2523267 - RNA, 21 nt, Human
cuuucaaugguuugcaaggaa

SEQ ID NO: 2523268 - RNA, 21 nt, Human
cuuucaauuccguagccagcu

SEQ ID NO: 2523269 - RNA, 14 nt, Human
cuuucacaaccuuc

SEQ ID NO: 2523270 - RNA, 17 nt, Human
cuuucacaaaauuuuau

SEQ ID NO: 2523271 - RNA, 12 nt, Human
cuuuccugcccc

SEQ ID NO: 2523272 - RNA, 10 nt, Human
cuuuccugcc

SEQ ID NO: 2523273 - RNA, 22 nt, Human
cuuuccugaugguacaggaaag

SEQ ID NO: 2523274 - RNA, 21 nt, Human
cuuuccugcaacucaaggacu

SEQ ID NO: 2523275 - RNA, 19 nt, Human
cuuuccugauggcaggaug

SEQ ID NO: 2523276 - RNA, 22 nt, Human
cuuuccugaggcugggcucccu

SEQ ID NO: 2523277 - RNA, 15 nt, Human
cuuuccuuccauccc

SEQ ID NO: 2523278 - RNA, 11 nt, Human
cuuuccuuccu

SEQ ID NO: 2523279 - RNA, 15 nt, Human
cuuuccuuccuuccc

SEQ ID NO: 2523280 - RNA, 13 nt, Human
cuuuccuucuugc

SEQ ID NO: 2523281 - RNA, 16 nt, Human
cuuuccuuccuucccu

SEQ ID NO: 2523282 - RNA, 19 nt, Human
cuuuccugccccaggccug

SEQ ID NO: 2523283 - RNA, 18 nt, Human
cuuuccugccccaggccu

SEQ ID NO: 2523284 - RNA, 14 nt, Human
cuuuccugccccag

SEQ ID NO: 2523285 - RNA, 13 nt, Human
cuuuccugcccca

SEQ ID NO: 2523286 - RNA, 23 nt, Human
cuuuccuggacacucagaccuga

SEQ ID NO: 2523287 - RNA, 20 nt, Human
cuuuccuggacacucagacc

SEQ ID NO: 2523288 - RNA, 11 nt, Human
cuuuccugccu

SEQ ID NO: 2523289 - RNA, 20 nt, Human
cuuuccuguagccuucugua

SEQ ID NO: 2523290 - RNA, 17 nt, Human
gaaaauuuguuauuuug

SEQ ID NO: 2523291 - RNA, 21 nt, Human
gaaaauuuguuauuuugcaac

SEQ ID NO: 2523292 - RNA, 15 nt, Human
gaaaauugcugugcc

SEQ ID NO: 2523293 - RNA, 22 nt, Human
gaaaauugcugugccucccaaa

SEQ ID NO: 2523294 - RNA, 16 nt, Human
gaaaauugcugugccu

SEQ ID NO: 2523295 - RNA, 15 nt, Human
gaaaacuuuucucag

SEQ ID NO: 2523296 - RNA, 17 nt, Human
gaaaacuuuucucagau

SEQ ID NO: 2523297 - RNA, 16 nt, Human
gaaaacuuuucucaga

SEQ ID NO: 2523298 - RNA, 9 nt, Human
gaaaagaaa

SEQ ID NO: 2523299 - RNA, 10 nt, Human
gaaaagaaaa

SEQ ID NO: 2523300 - RNA, 11 nt, Human
gaaaagaaaaa

SEQ ID NO: 2523301 - RNA, 12 nt, Human
gaaaagaaaaaa

SEQ ID NO: 2523302 - RNA, 17 nt, Human
gaaaagaaaaaaaaaga

SEQ ID NO: 2523303 - RNA, 14 nt, Human
gaaaaacugauuuu

SEQ ID NO: 2523304 - RNA, 23 nt, Human
gaaaaacucugggaaauaagaga

SEQ ID NO: 2523305 - RNA, 20 nt, Human
gaaaaacuuccaugaggcca

SEQ ID NO: 2523306 - RNA, 21 nt, Human
gaaaaugcauuguaucgaugu

SEQ ID NO: 2523307 - RNA, 23 nt, Human
gaaaaugcagcagggaugcccug

SEQ ID NO: 2523308 - RNA, 19 nt, Human
gaaaagaaaaaaaaagaaa

SEQ ID NO: 2523309 - RNA, 20 nt, Human
gaaaagaaaaaaaaagaaaa

SEQ ID NO: 2523310 - RNA, 18 nt, Human
gaaaagaaaaaugagccu

SEQ ID NO: 2523311 - RNA, 21 nt, Human
gaaaauggaagacagcucuua

SEQ ID NO: 2523312 - RNA, 23 nt, Human
gaaaaugcuguauuagucacaga

SEQ ID NO: 2523313 - RNA, 21 nt, Human
gaaaauuccuauugauuuucu

SEQ ID NO: 2523314 - RNA, 15 nt, Human
gaaaauguaugugua

SEQ ID NO: 2523315 - RNA, 18 nt, Human
gaaaauucacuauuggcu

SEQ ID NO: 2523316 - RNA, 21 nt, Human
gaaaaugucagaaaccaguua

SEQ ID NO: 2523317 - RNA, 22 nt, Human
gaaaaugucagaaaccaguuau

SEQ ID NO: 2523318 - RNA, 13 nt, Human
gaaaauucacuau

SEQ ID NO: 2523319 - RNA, 22 nt, Human
gaaaauucaaaaaguguuuauu

SEQ ID NO: 2523320 - RNA, 23 nt, Human
gaaaauggacguguuaugacucc

SEQ ID NO: 2523321 - RNA, 19 nt, Human
gaaaauggacguguuauga

SEQ ID NO: 2523322 - RNA, 17 nt, Human
gaaaauguaagcuguuu

SEQ ID NO: 2523323 - RNA, 19 nt, Human
gaaaauguacugagauuuu

SEQ ID NO: 2523324 - RNA, 18 nt, Human
gaaaauguaagcuguuua

SEQ ID NO: 2523325 - RNA, 12 nt, Human
gaaaauguacug

SEQ ID NO: 2523326 - RNA, 14 nt, Human
gaaaaugguauuuu

SEQ ID NO: 2523327 - RNA, 18 nt, Human
gaaaaugguccaggagaa

SEQ ID NO: 2523328 - RNA, 22 nt, Human
gaaaaugcagcagggaugcccu

SEQ ID NO: 2523329 - RNA, 15 nt, Human
gaaaaaaaagaaagc

SEQ ID NO: 2523330 - RNA, 19 nt, Human
gaaaaaaaaguuucagaga

SEQ ID NO: 2523331 - RNA, 22 nt, Human
gaaaaaaaaguuucagagaagu

SEQ ID NO: 2523332 - RNA, 21 nt, Human
gaaaaaaaaagucagacugcu

SEQ ID NO: 2523333 - RNA, 23 nt, Human
cuuuuuuuuuuuuuaaagacaga

SEQ ID NO: 2523334 - RNA, 21 nt, Human
cuuuuuuuuuuuugagacaga

SEQ ID NO: 2523335 - RNA, 22 nt, Human
cuuuuuuuuuuuuuaaagacag

SEQ ID NO: 2523336 - RNA, 20 nt, Human
gaaaaaaaauguucuuuggg

SEQ ID NO: 2523337 - RNA, 20 nt, Human
gaaaaaaaguuugccagaag

SEQ ID NO: 2523338 - RNA, 13 nt, Human
gaaaaaaaugacu

SEQ ID NO: 2523339 - RNA, 18 nt, Human
gaaaaaaaguuugccaga

SEQ ID NO: 2523340 - RNA, 19 nt, Human
gaaaaaaaucguccaggga

SEQ ID NO: 2523341 - RNA, 17 nt, Human
gaaaaacacaagcaaaa

SEQ ID NO: 2523342 - RNA, 15 nt, Human
gaaaaacacaagcaa

SEQ ID NO: 2523343 - RNA, 19 nt, Human
gaaaaacaaauucaucaaa

SEQ ID NO: 2523344 - RNA, 14 nt, Human
gaaaaacacaagca

SEQ ID NO: 2523345 - RNA, 11 nt, Human
gaaaaacaggu

SEQ ID NO: 2523346 - RNA, 18 nt, Human
gaaaaacaucugaaagcc

SEQ ID NO: 2523347 - RNA, 18 nt, Human
gaaaaacguguugccuug

SEQ ID NO: 2523348 - RNA, 20 nt, Human
cuuuuuuuuuuuugagacag

SEQ ID NO: 2523349 - RNA, 17 nt, Human
cuuuuuuuuucucuuuc

SEQ ID NO: 2523350 - RNA, 15 nt, Human
cuuuuuuuuucucuu

SEQ ID NO: 2523351 - RNA, 16 nt, Human
cuuuuuuuuuccaaaa

SEQ ID NO: 2523352 - RNA, 15 nt, Human
cuuuuuuuuuccaaa

SEQ ID NO: 2523353 - RNA, 22 nt, Human
cuuuuuuuuucucuuucucucc

SEQ ID NO: 2523354 - RNA, 18 nt, Human
cuuuuuuuuucucuuucu

SEQ ID NO: 2523355 - RNA, 19 nt, Human
cuuuuuuuccaucuuuaca

SEQ ID NO: 2523356 - RNA, 23 nt, Human
cuuuuuuggcuuuagacacuggc

SEQ ID NO: 2523357 - RNA, 12 nt, Human
cuuuugugcauu

SEQ ID NO: 2523358 - RNA, 13 nt, Human
cuuuugugcauua

SEQ ID NO: 2523359 - RNA, 23 nt, Human
cuuuuuuggcugcugaaggcucg

SEQ ID NO: 2523360 - RNA, 13 nt, Human
cuuuuuuguuuug

SEQ ID NO: 2523361 - RNA, 20 nt, Human
cuuuuuuggggauaugcuua

SEQ ID NO: 2523362 - RNA, 23 nt, Human
cuuuugcccacacuugggagcaa

SEQ ID NO: 2523363 - RNA, 17 nt, Human
cuuuugccauuaaacuu

SEQ ID NO: 2523364 - RNA, 20 nt, Human
cuuuugcccuucacaguguu

SEQ ID NO: 2523365 - RNA, 15 nt, Human
cuuuugcccuuugau

SEQ ID NO: 2523366 - RNA, 21 nt, Human
cuuuugcccuucacaguguuu

SEQ ID NO: 2523367 - RNA, 16 nt, Human
cuuuugccguuauuaa

SEQ ID NO: 2523368 - RNA, 13 nt, Human
cuuuuggagucag

SEQ ID NO: 2523369 - RNA, 13 nt, Human
cuuuugccauuga

SEQ ID NO: 2523370 - RNA, 15 nt, Human
cuuuugcaucauugu

SEQ ID NO: 2523371 - RNA, 16 nt, Human
cuuuugguuaagucug

SEQ ID NO: 2523372 - RNA, 20 nt, Human
cuuuugguuaagucuguuuu

SEQ ID NO: 2523373 - RNA, 15 nt, Human
cuuuuggcuuccaug

SEQ ID NO: 2523374 - RNA, 20 nt, Human
cuuuuggcccccgagcuggg

SEQ ID NO: 2523375 - RNA, 13 nt, Human
cuuuugguuaagu

SEQ ID NO: 2523376 - RNA, 13 nt, Human
cuuuuguaaaugu

SEQ ID NO: 2523377 - RNA, 15 nt, Human
cuuuuggcauuuuac

SEQ ID NO: 2523378 - RNA, 14 nt, Human
cuuuuggcuuccau

SEQ ID NO: 2523379 - RNA, 15 nt, Human
cuuuuggcacugaga

SEQ ID NO: 2523380 - RNA, 13 nt, Human
cuuuuggcccccg

SEQ ID NO: 2523381 - RNA, 14 nt, Human
cuuuugugaacuuu

SEQ ID NO: 2523382 - RNA, 18 nt, Human
cuuuugucuaugggacuc

SEQ ID NO: 2523383 - RNA, 10 nt, Human
cuuuuguaag

SEQ ID NO: 2523384 - RNA, 13 nt, Human
cuuuuguaagaca

SEQ ID NO: 2523385 - RNA, 20 nt, Human
cuuuuguaagacaaagguuu

SEQ ID NO: 2523386 - RNA, 12 nt, Human
cuuuuguaauuu

SEQ ID NO: 2523387 - RNA, 22 nt, Human
gaaacuuuauucaaguaaaaau

SEQ ID NO: 2523388 - RNA, 14 nt, Human
gaaagacuauucaa

SEQ ID NO: 2523389 - RNA, 15 nt, Human
gaaagacuauucaaa

SEQ ID NO: 2523390 - RNA, 21 nt, Human
gaaagaaaauaccaaggaaca

SEQ ID NO: 2523391 - RNA, 20 nt, Human
gaaagacuaucuaaauguug

SEQ ID NO: 2523392 - RNA, 17 nt, Human
gaaagacuauucaaaca

SEQ ID NO: 2523393 - RNA, 21 nt, Human
gaaaggcuccaggagcagcca

SEQ ID NO: 2523394 - RNA, 22 nt, Human
gaaaggcuccaggagcagccac

SEQ ID NO: 2523395 - RNA, 20 nt, Human
gaaaggcuccaggagcagcc

SEQ ID NO: 2523396 - RNA, 19 nt, Human
gaaaggcucugaaagccag

SEQ ID NO: 2523397 - RNA, 15 nt, Human
gaaaggcucugaaag

SEQ ID NO: 2523398 - RNA, 17 nt, Human
gaaaggcucugaaagcc

SEQ ID NO: 2523399 - RNA, 17 nt, Human
gaaauauuuauuuuaau

SEQ ID NO: 2523400 - RNA, 23 nt, Human
gaaaggugaguuugagcugccuu

SEQ ID NO: 2523401 - RNA, 22 nt, Human
gaaaggugaguuugagcugccu

SEQ ID NO: 2523402 - RNA, 22 nt, Human
gaaagggggucccagugggagg

SEQ ID NO: 2523403 - RNA, 18 nt, Human
gaaagggggucccagugg

SEQ ID NO: 2523404 - RNA, 17 nt, Human
gaaagggggucccagug

SEQ ID NO: 2523405 - RNA, 16 nt, Human
gaaagggggucccagu

SEQ ID NO: 2523406 - RNA, 14 nt, Human
gaaaggggugcuuu

SEQ ID NO: 2523407 - RNA, 23 nt, Human
gaaagggggucccagugggaggg

SEQ ID NO: 2523408 - RNA, 17 nt, Human
gaaaggggucggcugac

SEQ ID NO: 2523409 - RNA, 23 nt, Human
gaaaggguguuuuucuguuuuau

SEQ ID NO: 2523410 - RNA, 19 nt, Human
gaaagggugcugcuucccu

SEQ ID NO: 2523411 - RNA, 15 nt, Human
gaaaggggugcuuuu

SEQ ID NO: 2523412 - RNA, 16 nt, Human
gaaagggugcugcuuc

SEQ ID NO: 2523413 - RNA, 22 nt, Human
gaaagggacuuggaagcuccgc

SEQ ID NO: 2523414 - RNA, 17 nt, Human
gaaaggggggagcuggg

SEQ ID NO: 2523415 - RNA, 22 nt, Human
gaaagggagcuaucaggaacag

SEQ ID NO: 2523416 - RNA, 20 nt, Human
gaaagggacgcuacccggga

SEQ ID NO: 2523417 - RNA, 19 nt, Human
gaaagggacuuggaagcuc

SEQ ID NO: 2523418 - RNA, 19 nt, Human
gaaaucaaauaugcaaagc

SEQ ID NO: 2523419 - RNA, 20 nt, Human
gaaaucaaauaugcaaagca

SEQ ID NO: 2523420 - RNA, 19 nt, Human
gaaaucaccgaaaacgugg

SEQ ID NO: 2523421 - RNA, 13 nt, Human
gaaagguucugcc

SEQ ID NO: 2523422 - RNA, 18 nt, Human
gaaaucaguaauauuuau

SEQ ID NO: 2523423 - RNA, 20 nt, Human
gaaaucaguaauauuuauau

SEQ ID NO: 2523424 - RNA, 22 nt, Human
gaaauauuuauuuuaauaaugu

SEQ ID NO: 2523425 - RNA, 18 nt, Human
gaaauauuuauuuuaaua

SEQ ID NO: 2523426 - RNA, 18 nt, Human
gaaaucaaauaugcaaag

SEQ ID NO: 2523427 - RNA, 18 nt, Human
gaaagguuacccuguaac

SEQ ID NO: 2523428 - RNA, 21 nt, Human
cuuccauaaucuggacuccuc

SEQ ID NO: 2523429 - RNA, 11 nt, Human
cuuccauaauc

SEQ ID NO: 2523430 - RNA, 11 nt, Human
cuuccauaaug

SEQ ID NO: 2523431 - RNA, 22 nt, Human
cuuccauaaugcuacugucuca

SEQ ID NO: 2523432 - RNA, 18 nt, Human
cuuccauaaugcuacugu

SEQ ID NO: 2523433 - RNA, 23 nt, Human
cuuccauaauguauaaagaacaa

SEQ ID NO: 2523434 - RNA, 11 nt, Human
cuuccauaauu

SEQ ID NO: 2523435 - RNA, 11 nt, Human
cuucccaccuc

SEQ ID NO: 2523436 - RNA, 14 nt, Human
cuuccauaugaccu

SEQ ID NO: 2523437 - RNA, 16 nt, Human
cuuccauaugaccuca

SEQ ID NO: 2523438 - RNA, 22 nt, Human
cuuccauagccuaaucccuggg

SEQ ID NO: 2523439 - RNA, 14 nt, Human
cuuccauacagcuc

SEQ ID NO: 2523440 - RNA, 14 nt, Human
cuuccauaauuaug

SEQ ID NO: 2523441 - RNA, 16 nt, Human
cuuccauacagcucua

SEQ ID NO: 2523442 - RNA, 14 nt, Human
cuuccauagccuaa

SEQ ID NO: 2523443 - RNA, 23 nt, Human
cuucccaccucucucacuccuug

SEQ ID NO: 2523444 - RNA, 21 nt, Human
cuucccaccucucucacuccu

SEQ ID NO: 2523445 - RNA, 21 nt, Human
cuucccacccaucgcugugug

SEQ ID NO: 2523446 - RNA, 15 nt, Human
cuucccacucacccc

SEQ ID NO: 2523447 - RNA, 17 nt, Human
cuucccacccaucgcug

SEQ ID NO: 2523448 - RNA, 16 nt, Human
cuucacuguauaaaua

SEQ ID NO: 2523449 - RNA, 13 nt, Human
cuucacuguauaa

SEQ ID NO: 2523450 - RNA, 19 nt, Human
cuucacugccuuugcuccu

SEQ ID NO: 2523451 - RNA, 17 nt, Human
cuucacugccuuugcuc

SEQ ID NO: 2523452 - RNA, 15 nt, Human
cuucacugccuuugc

SEQ ID NO: 2523453 - RNA, 14 nt, Human
cuucacugccuuug

SEQ ID NO: 2523454 - RNA, 13 nt, Human
cuucacugccuuu

SEQ ID NO: 2523455 - RNA, 17 nt, Human
cuucagagacuccugca

SEQ ID NO: 2523456 - RNA, 15 nt, Human
cuucacuguaaaaua

SEQ ID NO: 2523457 - RNA, 14 nt, Human
cuucacuccggugu

SEQ ID NO: 2523458 - RNA, 19 nt, Human
cuucacuccggugugccug

SEQ ID NO: 2523459 - RNA, 22 nt, Human
cuucacuccggugugccugcag

SEQ ID NO: 2523460 - RNA, 23 nt, Human
cuucacuccggugugccugcagc

SEQ ID NO: 2523461 - RNA, 24 nt, Human
cuucacuccggugugccugcagcc

SEQ ID NO: 2523462 - RNA, 15 nt, Human
cuucacucucugaag

SEQ ID NO: 2523463 - RNA, 17 nt, Human
cuucacucgcccccggg

SEQ ID NO: 2523464 - RNA, 20 nt, Human
cuucacgaaguguugcaugg

SEQ ID NO: 2523465 - RNA, 19 nt, Human
cuucacgaaguguugcaug

SEQ ID NO: 2523466 - RNA, 13 nt, Human
cuucacggcagga

SEQ ID NO: 2523467 - RNA, 20 nt, Human
cuucacuccagccuggguga

SEQ ID NO: 2523468 - RNA, 16 nt, Human
cuucacggcaggacaa

SEQ ID NO: 2523469 - RNA, 17 nt, Human
cuucacggcaggacaac

SEQ ID NO: 2523470 - RNA, 17 nt, Human
cuucaguuuccuggucu

SEQ ID NO: 2523471 - RNA, 17 nt, Human
cuucaguuguuuucccg

SEQ ID NO: 2523472 - RNA, 14 nt, Human
cuucaguuguuuuc

SEQ ID NO: 2523473 - RNA, 17 nt, Human
cuucaguuaugauuuuu

SEQ ID NO: 2523474 - RNA, 9 nt, Human
cuucauaca

SEQ ID NO: 2523475 - RNA, 10 nt, Human
cuucauacac

SEQ ID NO: 2523476 - RNA, 19 nt, Human
cuucauaacaauuuuagga

SEQ ID NO: 2523477 - RNA, 15 nt, Human
cuucauaacaauuuu

SEQ ID NO: 2523478 - RNA, 14 nt, Human
cuucauaaaugaag

SEQ ID NO: 2523479 - RNA, 19 nt, Human
cuucagagacuccugcagg

SEQ ID NO: 2523480 - RNA, 18 nt, Human
cuucagagacuccugcag

SEQ ID NO: 2523481 - RNA, 20 nt, Human
cuucagagacuccugcaggc

SEQ ID NO: 2523482 - RNA, 23 nt, Human
cuucacuguauaaauaggagagg

SEQ ID NO: 2523483 - RNA, 17 nt, Human
cuucacuguauaaauag

SEQ ID NO: 2523484 - RNA, 12 nt, Human
cuucaucuggaa

SEQ ID NO: 2523485 - RNA, 13 nt, Human
cuucaucuggaac

SEQ ID NO: 2523486 - RNA, 15 nt, Human
cuucaucuggaacca

SEQ ID NO: 2523487 - RNA, 11 nt, Human
cuucaucugga

SEQ ID NO: 2523488 - RNA, 15 nt, Human
cuucauauugcugag

SEQ ID NO: 2523489 - RNA, 14 nt, Human
cuucaucuggcaac

SEQ ID NO: 2523490 - RNA, 19 nt, Human
cuucaucuggcaacaucuu

SEQ ID NO: 2523491 - RNA, 13 nt, Human
cuucaucuggcaa

SEQ ID NO: 2523492 - RNA, 12 nt, Human
cuucaucuucuc

SEQ ID NO: 2523493 - RNA, 23 nt, Human
cuucaucuggcaacaucuuuauc

SEQ ID NO: 2523494 - RNA, 12 nt, Human
cuucauacaggg

SEQ ID NO: 2523495 - RNA, 13 nt, Human
cuucauacaggga

SEQ ID NO: 2523496 - RNA, 12 nt, Human
cuucauaaucca

SEQ ID NO: 2523497 - RNA, 20 nt, Human
cuucauaccuacauguauuu

SEQ ID NO: 2523498 - RNA, 22 nt, Human
cuucauacagggaugguguuca

SEQ ID NO: 2523499 - RNA, 21 nt, Human
cuucauacuuuuuuucacagu

SEQ ID NO: 2523500 - RNA, 18 nt, Human
cuucauagcagauuuuaa

SEQ ID NO: 2523501 - RNA, 23 nt, Human
cuuccagugaggcucugcccuug

SEQ ID NO: 2523502 - RNA, 22 nt, Human
cuuccagugaggcucugcccuu

SEQ ID NO: 2523503 - RNA, 23 nt, Human
cuuccagugguuugagacacugg

SEQ ID NO: 2523504 - RNA, 19 nt, Human
cuuccaguguccuuagaac

SEQ ID NO: 2523505 - RNA, 13 nt, Human
cuucaugcaugga

SEQ ID NO: 2523506 - RNA, 15 nt, Human
cuucaugcauggaaa

SEQ ID NO: 2523507 - RNA, 18 nt, Human
cuuccaguguccuuagaa

SEQ ID NO: 2523508 - RNA, 17 nt, Human
cuucaugcaaugacauc

SEQ ID NO: 2523509 - RNA, 20 nt, Human
cuucaucuucucagcuccca

SEQ ID NO: 2523510 - RNA, 16 nt, Human
cuucaucuucucagcu

SEQ ID NO: 2523511 - RNA, 15 nt, Human
cuucaucuucucagc

SEQ ID NO: 2523512 - RNA, 17 nt, Human
cuucaucuucucagcuc

SEQ ID NO: 2523513 - RNA, 12 nt, Human
cuucaugacauu

SEQ ID NO: 2523514 - RNA, 12 nt, Human
cuucaugcaaug

SEQ ID NO: 2523515 - RNA, 13 nt, Human
cuucaugcaauga

SEQ ID NO: 2523516 - RNA, 21 nt, Human
cuuccagugaggcucugcccu

SEQ ID NO: 2523517 - RNA, 22 nt, Human
cuucaugcaaugacaucuucaa

SEQ ID NO: 2523518 - RNA, 16 nt, Human
cugugcugaggccuua

SEQ ID NO: 2523519 - RNA, 13 nt, Human
cugugcugaggcc

SEQ ID NO: 2523520 - RNA, 12 nt, Human
cugugcugaggc

SEQ ID NO: 2523521 - RNA, 18 nt, Human
cugugcugacccuccugu

SEQ ID NO: 2523522 - RNA, 19 nt, Human
cugugcugagucugaaggc

SEQ ID NO: 2523523 - RNA, 14 nt, Human
cugugcugagucug

SEQ ID NO: 2523524 - RNA, 17 nt, Human
cugugcugacccuccug

SEQ ID NO: 2523525 - RNA, 14 nt, Human
cugugcugacccuc

SEQ ID NO: 2523526 - RNA, 13 nt, Human
cugugcugacccu

SEQ ID NO: 2523527 - RNA, 22 nt, Human
cugugcuccgugccuccaccac

SEQ ID NO: 2523528 - RNA, 21 nt, Human
cugugcuccgugccuccacca

SEQ ID NO: 2523529 - RNA, 20 nt, Human
cugugcuccgugccuccacc

SEQ ID NO: 2523530 - RNA, 12 nt, Human
cugugcugaguc

SEQ ID NO: 2523531 - RNA, 21 nt, Human
cugugcugaggccuuaucauu

SEQ ID NO: 2523532 - RNA, 20 nt, Human
cuuauggaacacucugagac

SEQ ID NO: 2523533 - RNA, 19 nt, Human
cuuauggaacacucugaga

SEQ ID NO: 2523534 - RNA, 17 nt, Human
cuuauggaacacucuga

SEQ ID NO: 2523535 - RNA, 21 nt, Human
cuuauucaggaaaagccucug

SEQ ID NO: 2523536 - RNA, 17 nt, Human
cuuauuagagugucuuu

SEQ ID NO: 2523537 - RNA, 20 nt, Human
cuuauuagagugucuuucca

SEQ ID NO: 2523538 - RNA, 21 nt, Human
cuuauuagagugucuuuccac

SEQ ID NO: 2523539 - RNA, 17 nt, Human
cuuauuagggagaaaau

SEQ ID NO: 2523540 - RNA, 12 nt, Human
cuuauugcaaaa

SEQ ID NO: 2523541 - RNA, 14 nt, Human
cuuauucuguagau

SEQ ID NO: 2523542 - RNA, 12 nt, Human
cuuauucuguag

SEQ ID NO: 2523543 - RNA, 21 nt, Human
cuucaccuuuguccccaccgc

SEQ ID NO: 2523544 - RNA, 15 nt, Human
cuuauuggaacucug

SEQ ID NO: 2523545 - RNA, 17 nt, Human
cuuauuggaacucugcu

SEQ ID NO: 2523546 - RNA, 18 nt, Human
cuuauuggcagcucuacu

SEQ ID NO: 2523547 - RNA, 15 nt, Human
cuuauuguaccucuc

SEQ ID NO: 2523548 - RNA, 14 nt, Human
cuuauuguaccucu

SEQ ID NO: 2523549 - RNA, 18 nt, Human
cuuauuggaacucugcuu

SEQ ID NO: 2523550 - RNA, 13 nt, Human
cuuauuguaccuc

SEQ ID NO: 2523551 - RNA, 22 nt, Human
cuucaccuuuguccccaccgca

SEQ ID NO: 2523552 - RNA, 18 nt, Human
cuuauuguaccucucuua

SEQ ID NO: 2523553 - RNA, 18 nt, Human
cuucacgaaguguugcau

SEQ ID NO: 2523554 - RNA, 15 nt, Human
cuucacggaagagcc

SEQ ID NO: 2523555 - RNA, 19 nt, Human
cuucacggaagagccuugc

SEQ ID NO: 2523556 - RNA, 16 nt, Human
cuuauggaacacucug

SEQ ID NO: 2523557 - RNA, 13 nt, Human
cuuauggaacacu

SEQ ID NO: 2523558 - RNA, 21 nt, Human
cuuaugccauguuaauuucau

SEQ ID NO: 2523559 - RNA, 22 nt, Human
cuuaugccacgggaaguuuaga

SEQ ID NO: 2523560 - RNA, 15 nt, Human
cuucuuccaucccag

SEQ ID NO: 2523561 - RNA, 14 nt, Human
cuucuuccauccca

SEQ ID NO: 2523562 - RNA, 19 nt, Human
cuucuuccaggugcccagc

SEQ ID NO: 2523563 - RNA, 20 nt, Human
cuucuuccaucccaggacac

SEQ ID NO: 2523564 - RNA, 18 nt, Human
cuucuuccaucccaggac

SEQ ID NO: 2523565 - RNA, 20 nt, Human
cuucuucggggaacuccugg

SEQ ID NO: 2523566 - RNA, 15 nt, Human
cuucuuccugaagcu

SEQ ID NO: 2523567 - RNA, 14 nt, Human
cuucuucccucccu

SEQ ID NO: 2523568 - RNA, 17 nt, Human
cuucuucggggaacucc

SEQ ID NO: 2523569 - RNA, 22 nt, Human
cuucugacccaugcugcccugu

SEQ ID NO: 2523570 - RNA, 21 nt, Human
cuucugacccaugcugcccug

SEQ ID NO: 2523571 - RNA, 17 nt, Human
cuucucaagugccuuaa

SEQ ID NO: 2523572 - RNA, 16 nt, Human
cuucucaagugccuua

SEQ ID NO: 2523573 - RNA, 15 nt, Human
cuucucaagugccuu

SEQ ID NO: 2523574 - RNA, 14 nt, Human
cuucucaagugccu

SEQ ID NO: 2523575 - RNA, 18 nt, Human
cuucucaagugccuuaau

SEQ ID NO: 2523576 - RNA, 20 nt, Human
cuucugacccaugcugcccu

SEQ ID NO: 2523577 - RNA, 23 nt, Human
cuucugacccaugcugcccugug

SEQ ID NO: 2523578 - RNA, 15 nt, Human
cuucugaggacauuc

SEQ ID NO: 2523579 - RNA, 20 nt, Human
cuucugaggacauuccaaga

SEQ ID NO: 2523580 - RNA, 14 nt, Human
cuucugcacccucc

SEQ ID NO: 2523581 - RNA, 13 nt, Human
cuucugcacccuc

SEQ ID NO: 2523582 - RNA, 12 nt, Human
cuucugcacccu

SEQ ID NO: 2523583 - RNA, 19 nt, Human
cuucugcaauugcuuagga

SEQ ID NO: 2523584 - RNA, 17 nt, Human
cuucuguugcugccuca

SEQ ID NO: 2523585 - RNA, 18 nt, Human
cuucuguugcugccucau

SEQ ID NO: 2523586 - RNA, 19 nt, Human
cuucuguugcugccucaug

SEQ ID NO: 2523587 - RNA, 20 nt, Human
cuucuguugcugccucaugc

SEQ ID NO: 2523588 - RNA, 22 nt, Human
cuucugcacccuccacccuguc

SEQ ID NO: 2523589 - RNA, 21 nt, Human
cuucugcacccuccacccugu

SEQ ID NO: 2523590 - RNA, 20 nt, Human
cuucugcacccuccacccug

SEQ ID NO: 2523591 - RNA, 19 nt, Human
cuucugcacccuccacccu

SEQ ID NO: 2523592 - RNA, 18 nt, Human
cuucugcacccuccaccc

SEQ ID NO: 2523593 - RNA, 17 nt, Human
cuucugcacccuccacc

SEQ ID NO: 2523594 - RNA, 16 nt, Human
cuucugcacccuccac

SEQ ID NO: 2523595 - RNA, 15 nt, Human
cuucugcacccucca

SEQ ID NO: 2523596 - RNA, 18 nt, Human
cuucugccacuucccagg

SEQ ID NO: 2523597 - RNA, 17 nt, Human
cuucugccacuucccag

SEQ ID NO: 2523598 - RNA, 16 nt, Human
cuucugccacuuccca

SEQ ID NO: 2523599 - RNA, 14 nt, Human
cuucugccacuucc

SEQ ID NO: 2523600 - RNA, 12 nt, Human
cuucugccacuu

SEQ ID NO: 2523601 - RNA, 11 nt, Human
cuucugccacu

SEQ ID NO: 2523602 - RNA, 17 nt, Human
cuucuucagccaccucu

SEQ ID NO: 2523603 - RNA, 21 nt, Human
cuucuucagccaccucucuuu

SEQ ID NO: 2523604 - RNA, 16 nt, Human
cuucuucagagcugac

SEQ ID NO: 2523605 - RNA, 18 nt, Human
cuucuucagaucagugcu

SEQ ID NO: 2523606 - RNA, 14 nt, Human
cuucuucagagcug

SEQ ID NO: 2523607 - RNA, 23 nt, Human
cuucuucagagacuccugcaggc

SEQ ID NO: 2523608 - RNA, 21 nt, Human
cuucuguugcugccucaugcu

SEQ ID NO: 2523609 - RNA, 20 nt, Human
cuucugccacuucccaggua

SEQ ID NO: 2523610 - RNA, 15 nt, Human
cuucuguugcugccu

SEQ ID NO: 2523611 - RNA, 19 nt, Human
cuuccuccucccuccugcc

SEQ ID NO: 2523612 - RNA, 18 nt, Human
cuuccuccucccuccugc

SEQ ID NO: 2523613 - RNA, 16 nt, Human
cuuccuccucccuccu

SEQ ID NO: 2523614 - RNA, 14 nt, Human
cuuccuccucccuc

SEQ ID NO: 2523615 - RNA, 17 nt, Human
cuuccuccuccccacuu

SEQ ID NO: 2523616 - RNA, 16 nt, Human
cuuccuccuccccacu

SEQ ID NO: 2523617 - RNA, 21 nt, Human
cuuccuccgaggccaguaccu

SEQ ID NO: 2523618 - RNA, 20 nt, Human
cuuccuccgaggccaguacc

SEQ ID NO: 2523619 - RNA, 17 nt, Human
cuuccuccgaggccagu

SEQ ID NO: 2523620 - RNA, 17 nt, Human
cuuccugcaacaccuug

SEQ ID NO: 2523621 - RNA, 15 nt, Human
cuuccuccugggccc

SEQ ID NO: 2523622 - RNA, 14 nt, Human
cuuccugaguucag

SEQ ID NO: 2523623 - RNA, 14 nt, Human
cuuccuccuggaaa

SEQ ID NO: 2523624 - RNA, 13 nt, Human
cuuccuccuggaa

SEQ ID NO: 2523625 - RNA, 12 nt, Human
cuuccuccuggg

SEQ ID NO: 2523626 - RNA, 14 nt, Human
cuuccuccugggcc

SEQ ID NO: 2523627 - RNA, 12 nt, Human
cuuccuccugga

SEQ ID NO: 2523628 - RNA, 21 nt, Human
cuuccuccucccuccugccga

SEQ ID NO: 2523629 - RNA, 22 nt, Human
cuucuaaguaaaaccacagcag

SEQ ID NO: 2523630 - RNA, 23 nt, Human
cuucuaaguaaaaccacagcagu

SEQ ID NO: 2523631 - RNA, 15 nt, Human
cuuccugcaaggacu

SEQ ID NO: 2523632 - RNA, 13 nt, Human
cuuccugcaagga

SEQ ID NO: 2523633 - RNA, 17 nt, Human
cuuccugcauucaccca

SEQ ID NO: 2523634 - RNA, 21 nt, Human
cuuccugccaccagucacugu

SEQ ID NO: 2523635 - RNA, 18 nt, Human
cuuccugccaccagucac

SEQ ID NO: 2523636 - RNA, 16 nt, Human
cuuccugccaccaguc

SEQ ID NO: 2523637 - RNA, 15 nt, Human
cuuccugccaccagu

SEQ ID NO: 2523638 - RNA, 20 nt, Human
cuuccugcauucacccagac

SEQ ID NO: 2523639 - RNA, 21 nt, Human
cuuccugcauucacccagaca

SEQ ID NO: 2523640 - RNA, 13 nt, Human
cuuccugccacca

SEQ ID NO: 2523641 - RNA, 22 nt, Human
cuuccugcauucacccagacag

SEQ ID NO: 2523642 - RNA, 11 nt, Human
cuucuaauaua

SEQ ID NO: 2523643 - RNA, 17 nt, Human
cuuccugccaccugcug

SEQ ID NO: 2523644 - RNA, 21 nt, Human
cuucuacuuuuaaguugcuga

SEQ ID NO: 2523645 - RNA, 13 nt, Human
cuucuacuuuuaa

SEQ ID NO: 2523646 - RNA, 13 nt, Human
cuucuagaaccag

SEQ ID NO: 2523647 - RNA, 18 nt, Human
cuucuaauauauuuuuau

SEQ ID NO: 2523648 - RNA, 15 nt, Human
cuucuaauauauuuu

SEQ ID NO: 2523649 - RNA, 14 nt, Human
cuucuaauauauuu

SEQ ID NO: 2523650 - RNA, 12 nt, Human
cuucuaauauau

SEQ ID NO: 2523651 - RNA, 13 nt, Human
cuucuacuucugc

SEQ ID NO: 2523652 - RNA, 20 nt, Human
cuucuaauauauuuuuauau

SEQ ID NO: 2523653 - RNA, 21 nt, Human
cuucuacuucugcccuugcca

SEQ ID NO: 2523654 - RNA, 19 nt, Human
cuucucaaaccuguuuaaa

SEQ ID NO: 2523655 - RNA, 17 nt, Human
cuucuauuuuguaaacu

SEQ ID NO: 2523656 - RNA, 16 nt, Human
cuucucaaaccuugau

SEQ ID NO: 2523657 - RNA, 22 nt, Human
cuucucaaaccuguuuaaauau

SEQ ID NO: 2523658 - RNA, 12 nt, Human
cuucucaagugc

SEQ ID NO: 2523659 - RNA, 15 nt, Human
cuucucaagauacug

SEQ ID NO: 2523660 - RNA, 15 nt, Human
cuucuauuuuguaaa

SEQ ID NO: 2523661 - RNA, 16 nt, Human
cuucuauuuuguaaac

SEQ ID NO: 2523662 - RNA, 14 nt, Human
cuucuauuuuguaa

SEQ ID NO: 2523663 - RNA, 13 nt, Human
cuucuauuuuauu

SEQ ID NO: 2523664 - RNA, 17 nt, Human
cuucuagaaccaggcaa

SEQ ID NO: 2523665 - RNA, 19 nt, Human
cuucuaggacgccacccag

SEQ ID NO: 2523666 - RNA, 16 nt, Human
cuucuaggacgccacc

SEQ ID NO: 2523667 - RNA, 19 nt, Human
cuucuaggguuauugcauu

SEQ ID NO: 2523668 - RNA, 13 nt, Human
cuucuaggaagcu

SEQ ID NO: 2523669 - RNA, 17 nt, Human
cuuggcgcugccccugg

SEQ ID NO: 2523670 - RNA, 14 nt, Human
cuuggcgcugcccc

SEQ ID NO: 2523671 - RNA, 12 nt, Human
cuuggcgcugcc

SEQ ID NO: 2523672 - RNA, 15 nt, Human
cuuggcagcugaacu

SEQ ID NO: 2523673 - RNA, 18 nt, Human
cuuggcaucacagggcag

SEQ ID NO: 2523674 - RNA, 20 nt, Human
cuuggcgcugccccuggcag

SEQ ID NO: 2523675 - RNA, 21 nt, Human
cuugccuuauuagagugucuu

SEQ ID NO: 2523676 - RNA, 19 nt, Human
cuugccuucuucacccagc

SEQ ID NO: 2523677 - RNA, 12 nt, Human
cuugccuuucuc

SEQ ID NO: 2523678 - RNA, 20 nt, Human
cuugccuucuucacccagcu

SEQ ID NO: 2523679 - RNA, 23 nt, Human
cuuggcacauuuaagagacaguc

SEQ ID NO: 2523680 - RNA, 16 nt, Human
cuuggcaccagacacc

SEQ ID NO: 2523681 - RNA, 19 nt, Human
cuuggcaccagacacccag

SEQ ID NO: 2523682 - RNA, 14 nt, Human
cuugcgcauucuca

SEQ ID NO: 2523683 - RNA, 20 nt, Human
cuugcggaaucacucugucc

SEQ ID NO: 2523684 - RNA, 19 nt, Human
cuugcgcuuuugcugguca

SEQ ID NO: 2523685 - RNA, 19 nt, Human
cuuggcagcaccugucucc

SEQ ID NO: 2523686 - RNA, 20 nt, Human
cuuggcagcaccugucuccu

SEQ ID NO: 2523687 - RNA, 18 nt, Human
cuuggcagccgagcucgu

SEQ ID NO: 2523688 - RNA, 19 nt, Human
cuuggcagcccaggccggg

SEQ ID NO: 2523689 - RNA, 20 nt, Human
cuuggcaccagacacccagg

SEQ ID NO: 2523690 - RNA, 21 nt, Human
cuuggcaccagacacccagga

SEQ ID NO: 2523691 - RNA, 18 nt, Human
cuuggcagcaccugucuc

SEQ ID NO: 2523692 - RNA, 18 nt, Human
cuugccuuauuagagugu

SEQ ID NO: 2523693 - RNA, 20 nt, Human
cuugccuuauuagagugucu

SEQ ID NO: 2523694 - RNA, 22 nt, Human
cuugaugccaguaggcucaacu

SEQ ID NO: 2523695 - RNA, 12 nt, Human
cuugccugcagg

SEQ ID NO: 2523696 - RNA, 13 nt, Human
cuugccugcaggc

SEQ ID NO: 2523697 - RNA, 13 nt, Human
cuugaugaagaag

SEQ ID NO: 2523698 - RNA, 18 nt, Human
cuugaugaccaaaguccu

SEQ ID NO: 2523699 - RNA, 21 nt, Human
cuugaugaccaaaguccuuuu

SEQ ID NO: 2523700 - RNA, 12 nt, Human
cuugaugccugg

SEQ ID NO: 2523701 - RNA, 21 nt, Human
cuugaugcaugcacuguuccc

SEQ ID NO: 2523702 - RNA, 19 nt, Human
cuugaugccaguaggcuca

SEQ ID NO: 2523703 - RNA, 21 nt, Human
cuugaucugcucagcccugga

SEQ ID NO: 2523704 - RNA, 20 nt, Human
cuugaucugcucagcccugg

SEQ ID NO: 2523705 - RNA, 19 nt, Human
cuugaucugcucagcccug

SEQ ID NO: 2523706 - RNA, 18 nt, Human
cuugaucugcucagcccu

SEQ ID NO: 2523707 - RNA, 17 nt, Human
cuugaucugcucagccc

SEQ ID NO: 2523708 - RNA, 16 nt, Human
cuugaucugcucagcc

SEQ ID NO: 2523709 - RNA, 23 nt, Human
cuugauacuaaaaguucuucucc

SEQ ID NO: 2523710 - RNA, 22 nt, Human
cuugauacuaaaaguucuucuc

SEQ ID NO: 2523711 - RNA, 12 nt, Human
cuugaugaagaa

SEQ ID NO: 2523712 - RNA, 23 nt, Human
cuugaucugcucagcccuggagg

SEQ ID NO: 2523713 - RNA, 22 nt, Human
cuugaucugcucagcccuggag

SEQ ID NO: 2523714 - RNA, 15 nt, Human
cuugaucuguauaua

SEQ ID NO: 2523715 - RNA, 20 nt, Human
cuugaucuguauauacaaua

SEQ ID NO: 2523716 - RNA, 22 nt, Human
cuugaucuguauauacaauaac

SEQ ID NO: 2523717 - RNA, 21 nt, Human
cuugauaccccccucugucuu

SEQ ID NO: 2523718 - RNA, 20 nt, Human
cuugauaccccccucugucu

SEQ ID NO: 2523719 - RNA, 19 nt, Human
cuugauaccccccucuguc

SEQ ID NO: 2523720 - RNA, 18 nt, Human
cuugauaccccccucugu

SEQ ID NO: 2523721 - RNA, 17 nt, Human
cuugauaccccccucug

SEQ ID NO: 2523722 - RNA, 16 nt, Human
cuugauaccccccucu

SEQ ID NO: 2523723 - RNA, 21 nt, Human
cuugaguuugucgcucaugug

SEQ ID NO: 2523724 - RNA, 16 nt, Human
cuugaguuuuauuuau

SEQ ID NO: 2523725 - RNA, 16 nt, Human
cuugauaaagggccaa

SEQ ID NO: 2523726 - RNA, 22 nt, Human
cuugaauuuucccacugcaccc

SEQ ID NO: 2523727 - RNA, 16 nt, Human
cuugaguuugucgcuc

SEQ ID NO: 2523728 - RNA, 16 nt, Human
cuugacaaagucaagc

SEQ ID NO: 2523729 - RNA, 19 nt, Human
cuugacaaagucaagccac

SEQ ID NO: 2523730 - RNA, 13 nt, Human
cuugacagggcac

SEQ ID NO: 2523731 - RNA, 15 nt, Human
cuugacagggcacac

SEQ ID NO: 2523732 - RNA, 14 nt, Human
cuugacagggcaca

SEQ ID NO: 2523733 - RNA, 18 nt, Human
cuugaauuguaaggaaug

SEQ ID NO: 2523734 - RNA, 13 nt, Human
cuugaagccaagu

SEQ ID NO: 2523735 - RNA, 19 nt, Human
cuugaagccacugaagcug

SEQ ID NO: 2523736 - RNA, 21 nt, Human
cuugaagccacugaagcuggg

SEQ ID NO: 2523737 - RNA, 19 nt, Human
cuugaauuguaaggaauga

SEQ ID NO: 2523738 - RNA, 21 nt, Human
cuugaauuuucccacugcacc

SEQ ID NO: 2523739 - RNA, 20 nt, Human
cuugaauuuucccacugcac

SEQ ID NO: 2523740 - RNA, 19 nt, Human
cuugaauuuucccacugca

SEQ ID NO: 2523741 - RNA, 18 nt, Human
cuugaauuuucccacugc

SEQ ID NO: 2523742 - RNA, 17 nt, Human
cuugaauuuucccacug

SEQ ID NO: 2523743 - RNA, 20 nt, Human
cuugaauuucuaaaaaacag

SEQ ID NO: 2523744 - RNA, 13 nt, Human
cuugaagaucguu

SEQ ID NO: 2523745 - RNA, 16 nt, Human
cuugaagacuuuucuu

SEQ ID NO: 2523746 - RNA, 19 nt, Human
cuugaagccaaagaaaaau

SEQ ID NO: 2523747 - RNA, 16 nt, Human
cuugaagccaaagaaa

SEQ ID NO: 2523748 - RNA, 15 nt, Human
cuugaagccaaagaa

SEQ ID NO: 2523749 - RNA, 14 nt, Human
cuugaagccaaaga

SEQ ID NO: 2523750 - RNA, 13 nt, Human
cuugaagccaaag

SEQ ID NO: 2523751 - RNA, 12 nt, Human
cuugaagccaaa

SEQ ID NO: 2523752 - RNA, 12 nt, Human
cuugaagcagua

SEQ ID NO: 2523753 - RNA, 20 nt, Human
cuugaagaucguuaguaucu

SEQ ID NO: 2523754 - RNA, 13 nt, Human
cuugaagccacug

SEQ ID NO: 2523755 - RNA, 16 nt, Human
cuugaagccacugaag

SEQ ID NO: 2523756 - RNA, 17 nt, Human
cuugaagccacugaagc

SEQ ID NO: 2523757 - RNA, 18 nt, Human
cuugaagccacugaagcu

SEQ ID NO: 2523758 - RNA, 14 nt, Human
gcagccaggccaca

SEQ ID NO: 2523759 - RNA, 13 nt, Human
gcagccaggccac

SEQ ID NO: 2523760 - RNA, 16 nt, Human
gcagccaggccacaag

SEQ ID NO: 2523761 - RNA, 20 nt, Human
gcagcccaugcccaccugcc

SEQ ID NO: 2523762 - RNA, 17 nt, Human
gcagcccaggccggggu

SEQ ID NO: 2523763 - RNA, 13 nt, Human
gcagcccaugccc

SEQ ID NO: 2523764 - RNA, 15 nt, Human
gcagcccaugcccac

SEQ ID NO: 2523765 - RNA, 17 nt, Human
gcagcccaugcccaccu

SEQ ID NO: 2523766 - RNA, 18 nt, Human
gcagcccaugcccaccug

SEQ ID NO: 2523767 - RNA, 22 nt, Human
gcagcccaugcccaccugccca

SEQ ID NO: 2523768 - RNA, 13 nt, Human
gcagccaccagcg

SEQ ID NO: 2523769 - RNA, 14 nt, Human
gcagagcucugccg

SEQ ID NO: 2523770 - RNA, 16 nt, Human
gcagccacauuccuga

SEQ ID NO: 2523771 - RNA, 23 nt, Human
gcagagcgccgugaguucucagg

SEQ ID NO: 2523772 - RNA, 22 nt, Human
gcagagcgccgugaguucucag

SEQ ID NO: 2523773 - RNA, 20 nt, Human
gcagagcgccgugaguucuc

SEQ ID NO: 2523774 - RNA, 16 nt, Human
gcagagcccaagggaa

SEQ ID NO: 2523775 - RNA, 14 nt, Human
gcagccacuauugu

SEQ ID NO: 2523776 - RNA, 23 nt, Human
gcagccagaccuauuccuccugg

SEQ ID NO: 2523777 - RNA, 12 nt, Human
gcagccaggcca

SEQ ID NO: 2523778 - RNA, 20 nt, Human
gcauaccuuuauugugaucu

SEQ ID NO: 2523779 - RNA, 16 nt, Human
gcauaccuuuauugug

SEQ ID NO: 2523780 - RNA, 14 nt, Human
gcauacguacacau

SEQ ID NO: 2523781 - RNA, 13 nt, Human
gcauaccuuuauu

SEQ ID NO: 2523782 - RNA, 18 nt, Human
gcauaauaagcuaaagag

SEQ ID NO: 2523783 - RNA, 22 nt, Human
gcagucaucuugaccaagcagg

SEQ ID NO: 2523784 - RNA, 19 nt, Human
gcagucauuauccagguaa

SEQ ID NO: 2523785 - RNA, 23 nt, Human
gcagucaucuugaccaagcagga

SEQ ID NO: 2523786 - RNA, 18 nt, Human
gcaguccuggaagccagc

SEQ ID NO: 2523787 - RNA, 20 nt, Human
gcaguccuggaagccagcuu

SEQ ID NO: 2523788 - RNA, 19 nt, Human
gcaguccugaucagagccg

SEQ ID NO: 2523789 - RNA, 17 nt, Human
gcaguccugccucagcc

SEQ ID NO: 2523790 - RNA, 18 nt, Human
gcaguccugccucagccu

SEQ ID NO: 2523791 - RNA, 18 nt, Human
gcagucgucgcacagucu

SEQ ID NO: 2523792 - RNA, 15 nt, Human
gcagucgucgcacag

SEQ ID NO: 2523793 - RNA, 23 nt, Human
gcagucgggggcuggccuaggag

SEQ ID NO: 2523794 - RNA, 21 nt, Human
gcagucgggggcuggccuagg

SEQ ID NO: 2523795 - RNA, 20 nt, Human
gcagucgggggcuggccuag

SEQ ID NO: 2523796 - RNA, 18 nt, Human
gcagucgggggcuggccu

SEQ ID NO: 2523797 - RNA, 17 nt, Human
gcagucgggggcuggcc

SEQ ID NO: 2523798 - RNA, 16 nt, Human
gcagucgggggcuggc

SEQ ID NO: 2523799 - RNA, 15 nt, Human
gcaguuuaucauuca

SEQ ID NO: 2523800 - RNA, 15 nt, Human
gcagucgugccugug

SEQ ID NO: 2523801 - RNA, 22 nt, Human
gcagucgucgcacagucucucu

SEQ ID NO: 2523802 - RNA, 20 nt, Human
gcagucgucgcacagucucu

SEQ ID NO: 2523803 - RNA, 13 nt, Human
gcagucgugccug

SEQ ID NO: 2523804 - RNA, 20 nt, Human
gcaguuuaucauucaagugu

SEQ ID NO: 2523805 - RNA, 16 nt, Human
gcaguuuaucauucaa

SEQ ID NO: 2523806 - RNA, 16 nt, Human
gcaguuucuguccugc

SEQ ID NO: 2523807 - RNA, 20 nt, Human
gcaguuucuguccugcuggu

SEQ ID NO: 2523808 - RNA, 21 nt, Human
gcaguuugccuggugcagugg

SEQ ID NO: 2523809 - RNA, 22 nt, Human
gcauaacguauaaaagccuguu

SEQ ID NO: 2523810 - RNA, 22 nt, Human
gcaguuuuucagaguggaaugc

SEQ ID NO: 2523811 - RNA, 17 nt, Human
gcaguuuucaagucaaa

SEQ ID NO: 2523812 - RNA, 14 nt, Human
gcaguuugggaggu

SEQ ID NO: 2523813 - RNA, 17 nt, Human
gcauaccacuuuuguuc

SEQ ID NO: 2523814 - RNA, 20 nt, Human
gcauaccacuuuuguucuug

SEQ ID NO: 2523815 - RNA, 14 nt, Human
gcaguuuuucugua

SEQ ID NO: 2523816 - RNA, 14 nt, Human
gcauaauaagcuaa

SEQ ID NO: 2523817 - RNA, 22 nt, Human
gcaggcucucaggccagcugcu

SEQ ID NO: 2523818 - RNA, 20 nt, Human
gcaggcucucaggccagcug

SEQ ID NO: 2523819 - RNA, 19 nt, Human
gcagcugcgguccacccag

SEQ ID NO: 2523820 - RNA, 17 nt, Human
gcagcugcgguccaccc

SEQ ID NO: 2523821 - RNA, 23 nt, Human
gcaggcucucaggccagcugcuu

SEQ ID NO: 2523822 - RNA, 18 nt, Human
gcaggcucucaggccagc

SEQ ID NO: 2523823 - RNA, 14 nt, Human
gcaggcuggcccug

SEQ ID NO: 2523824 - RNA, 15 nt, Human
gcaggcuggcccugc

SEQ ID NO: 2523825 - RNA, 16 nt, Human
gcaggcuggcccugcc

SEQ ID NO: 2523826 - RNA, 17 nt, Human
gcaggcuggcccugccc

SEQ ID NO: 2523827 - RNA, 18 nt, Human
gcaggcuggcccugcccu

SEQ ID NO: 2523828 - RNA, 17 nt, Human
gcaggcugucuggccag

SEQ ID NO: 2523829 - RNA, 19 nt, Human
gcaggcuggcccugcccug

SEQ ID NO: 2523830 - RNA, 20 nt, Human
gcaggcuggcccugcccugg

SEQ ID NO: 2523831 - RNA, 21 nt, Human
gcaggcuggcccugcccuggu

SEQ ID NO: 2523832 - RNA, 11 nt, Human
gcaggcugaca

SEQ ID NO: 2523833 - RNA, 15 nt, Human
gcaggcuggcuggcc

SEQ ID NO: 2523834 - RNA, 23 nt, Human
gcaguaccuauaaaguaaagcua

SEQ ID NO: 2523835 - RNA, 16 nt, Human
gcaguaccuauaaagu

SEQ ID NO: 2523836 - RNA, 18 nt, Human
gcaguaagucuuuuuuga

SEQ ID NO: 2523837 - RNA, 15 nt, Human
gcaguaagucuuuuu

SEQ ID NO: 2523838 - RNA, 13 nt, Human
gcaguaauaaaaa

SEQ ID NO: 2523839 - RNA, 22 nt, Human
gcagguugggccauacuggccu

SEQ ID NO: 2523840 - RNA, 23 nt, Human
gcagguugggaaugaggcuugcu

SEQ ID NO: 2523841 - RNA, 22 nt, Human
gcaguagaaggucggaggcuug

SEQ ID NO: 2523842 - RNA, 21 nt, Human
gcaguagaaauaauaugcauu

SEQ ID NO: 2523843 - RNA, 20 nt, Human
gcaguagaaauaauaugcau

SEQ ID NO: 2523844 - RNA, 19 nt, Human
gcaguagaaauaauaugca

SEQ ID NO: 2523845 - RNA, 23 nt, Human
gcagucacuggagguugaagcca

SEQ ID NO: 2523846 - RNA, 14 nt, Human
gcagucacuggagg

SEQ ID NO: 2523847 - RNA, 24 nt, Human
gcagucacguggaggagcagugca

SEQ ID NO: 2523848 - RNA, 17 nt, Human
gcagucacaucucuucc

SEQ ID NO: 2523849 - RNA, 13 nt, Human
gcagucacugaau

SEQ ID NO: 2523850 - RNA, 15 nt, Human
gcaguaugaaaauaa

SEQ ID NO: 2523851 - RNA, 13 nt, Human
gcaguauugagca

SEQ ID NO: 2523852 - RNA, 21 nt, Human
gcaguaucaugcccugugcaa

SEQ ID NO: 2523853 - RNA, 17 nt, Human
gcaguagucucugugcu

SEQ ID NO: 2523854 - RNA, 12 nt, Human
gcaguagucucu

SEQ ID NO: 2523855 - RNA, 12 nt, Human
gcaguaucauga

SEQ ID NO: 2523856 - RNA, 15 nt, Human
gcaguaucaugaagc

SEQ ID NO: 2523857 - RNA, 20 nt, Human
gcaguagauuuucuuuaaaa

SEQ ID NO: 2523858 - RNA, 18 nt, Human
gcaguagauuuucuuuaa

SEQ ID NO: 2523859 - RNA, 15 nt, Human
gcaguagauuuucuu

SEQ ID NO: 2523860 - RNA, 21 nt, Human
gcaguagaggcuauggacagg

SEQ ID NO: 2523861 - RNA, 18 nt, Human
gcaguagagucaucucca

SEQ ID NO: 2523862 - RNA, 20 nt, Human
gcaguagagucaucuccauc

SEQ ID NO: 2523863 - RNA, 10 nt, Human
gcagggaggg

SEQ ID NO: 2523864 - RNA, 13 nt, Human
gcagggagggccu

SEQ ID NO: 2523865 - RNA, 16 nt, Human
gcagguugaggggcuc

SEQ ID NO: 2523866 - RNA, 23 nt, Human
gcagguugggccauacuggccuc

SEQ ID NO: 2523867 - RNA, 19 nt, Human
gcagguugaggggcuccug

SEQ ID NO: 2523868 - RNA, 20 nt, Human
gcagguugaggggcuccugg

SEQ ID NO: 2523869 - RNA, 21 nt, Human
gcagguugaggggcuccugga

SEQ ID NO: 2523870 - RNA, 22 nt, Human
gcagguugaggggcuccuggaa

SEQ ID NO: 2523871 - RNA, 19 nt, Human
gcagggacuugaacccaua

SEQ ID NO: 2523872 - RNA, 13 nt, Human
gcagggaaacagc

SEQ ID NO: 2523873 - RNA, 21 nt, Human
gcagggagcauggcugugagg

SEQ ID NO: 2523874 - RNA, 19 nt, Human
gcagggagcggccggccag

SEQ ID NO: 2523875 - RNA, 16 nt, Human
gcagggaggaagaagc

SEQ ID NO: 2523876 - RNA, 23 nt, Human
gcagggaggaagaagcuuaggca

SEQ ID NO: 2523877 - RNA, 22 nt, Human
gcagggagaggagugacugagc

SEQ ID NO: 2523878 - RNA, 22 nt, Human
gcaggcuuuguuuauagcuugc

SEQ ID NO: 2523879 - RNA, 22 nt, Human
gcagggagccgagaucacgcca

SEQ ID NO: 2523880 - RNA, 21 nt, Human
gcagggaaaauuauuugcaua

SEQ ID NO: 2523881 - RNA, 23 nt, Human
gcaccuaaaccaccagugcccaa

SEQ ID NO: 2523882 - RNA, 21 nt, Human
gcaccuaaaccaccagugccc

SEQ ID NO: 2523883 - RNA, 21 nt, Human
gcaccgucauggcuuaauguu

SEQ ID NO: 2523884 - RNA, 14 nt, Human
gcaccguucugugc

SEQ ID NO: 2523885 - RNA, 19 nt, Human
gcaccuaaaccaccagugc

SEQ ID NO: 2523886 - RNA, 15 nt, Human
gcaccguucugugca

SEQ ID NO: 2523887 - RNA, 15 nt, Human
gcaccuaauccaggc

SEQ ID NO: 2523888 - RNA, 12 nt, Human
gcacugacauug

SEQ ID NO: 2523889 - RNA, 16 nt, Human
gcacugacugggcaua

SEQ ID NO: 2523890 - RNA, 20 nt, Human
gcacuugugauuauuuauua

SEQ ID NO: 2523891 - RNA, 21 nt, Human
gcacuugugauuauuuauuau

SEQ ID NO: 2523892 - RNA, 23 nt, Human
gcacuugugauuauuuauuauuu

SEQ ID NO: 2523893 - RNA, 15 nt, Human
gcacuuguauauacg

SEQ ID NO: 2523894 - RNA, 16 nt, Human
gcacuuguccagcuga

SEQ ID NO: 2523895 - RNA, 17 nt, Human
gcacuugugauuauuua

SEQ ID NO: 2523896 - RNA, 12 nt, Human
gcacuuguauau

SEQ ID NO: 2523897 - RNA, 20 nt, Human
gcacuuuagggcuguaaaau

SEQ ID NO: 2523898 - RNA, 17 nt, Human
gcacuuuccuccuggca

SEQ ID NO: 2523899 - RNA, 16 nt, Human
gcacuuuccuccuggc

SEQ ID NO: 2523900 - RNA, 21 nt, Human
gcacuuucuacaaugugaacu

SEQ ID NO: 2523901 - RNA, 21 nt, Human
gcagaaagguucugcccggga

SEQ ID NO: 2523902 - RNA, 18 nt, Human
gcagaaagguucugcccg

SEQ ID NO: 2523903 - RNA, 15 nt, Human
gcagagcagagacca

SEQ ID NO: 2523904 - RNA, 14 nt, Human
gcagagcagagacc

SEQ ID NO: 2523905 - RNA, 12 nt, Human
gcagagcagaga

SEQ ID NO: 2523906 - RNA, 24 nt, Human
gcagagcaccuuagacagucccug

SEQ ID NO: 2523907 - RNA, 20 nt, Human
gcagagcagagaccaucccu

SEQ ID NO: 2523908 - RNA, 19 nt, Human
gcagagcagagaccauccc

SEQ ID NO: 2523909 - RNA, 21 nt, Human
gcagagcagugggccuggcca

SEQ ID NO: 2523910 - RNA, 18 nt, Human
gcagagcaagucugcagg

SEQ ID NO: 2523911 - RNA, 17 nt, Human
gcagagcaagucugcag

SEQ ID NO: 2523912 - RNA, 16 nt, Human
gcagagcaagucugca

SEQ ID NO: 2523913 - RNA, 14 nt, Human
gcagagcaggggca

SEQ ID NO: 2523914 - RNA, 20 nt, Human
gcagagcaggggcaggguga

SEQ ID NO: 2523915 - RNA, 23 nt, Human
gcagagcaccuuagacagucccu

SEQ ID NO: 2523916 - RNA, 22 nt, Human
gcagagcaccuuagacaguccc

SEQ ID NO: 2523917 - RNA, 19 nt, Human
gcagagcaccuuagacagu

SEQ ID NO: 2523918 - RNA, 23 nt, Human
gcagagauuggaaugggcagcuc

SEQ ID NO: 2523919 - RNA, 22 nt, Human
gcagagauuggaaugggcagcu

SEQ ID NO: 2523920 - RNA, 19 nt, Human
gcagagagccauuuuguga

SEQ ID NO: 2523921 - RNA, 15 nt, Human
gcagagagccauuuu

SEQ ID NO: 2523922 - RNA, 16 nt, Human
gcagagagaagccugu

SEQ ID NO: 2523923 - RNA, 19 nt, Human
gcagagagcggucucaggc

SEQ ID NO: 2523924 - RNA, 21 nt, Human
gcagagagccauuuugugaau

SEQ ID NO: 2523925 - RNA, 15 nt, Human
gcagagaggccaggu

SEQ ID NO: 2523926 - RNA, 14 nt, Human
gcagagagaagccu

SEQ ID NO: 2523927 - RNA, 13 nt, Human
gcagagagaagcc

SEQ ID NO: 2523928 - RNA, 17 nt, Human
gcagaacacuaaccuga

SEQ ID NO: 2523929 - RNA, 12 nt, Human
gcagagagaagc

SEQ ID NO: 2523930 - RNA, 18 nt, Human
gcagaacagccgcuccug

SEQ ID NO: 2523931 - RNA, 21 nt, Human
gcagaacagccgcuccugucu

SEQ ID NO: 2523932 - RNA, 15 nt, Human
gcagaacacuaaccu

SEQ ID NO: 2523933 - RNA, 14 nt, Human
gcagaacacuaacc

SEQ ID NO: 2523934 - RNA, 13 nt, Human
gcagaacacuaac

SEQ ID NO: 2523935 - RNA, 14 nt, Human
gcagaaaucuagaa

SEQ ID NO: 2523936 - RNA, 15 nt, Human
gcagaaaucuagaag

SEQ ID NO: 2523937 - RNA, 13 nt, Human
gauucugagagcu

SEQ ID NO: 2523938 - RNA, 22 nt, Human
gcacaagcuccaagcucccagg

SEQ ID NO: 2523939 - RNA, 21 nt, Human
gcacaagcuccaagcucccag

SEQ ID NO: 2523940 - RNA, 23 nt, Human
gcacaagcuccaagcucccaggc

SEQ ID NO: 2523941 - RNA, 14 nt, Human
gcacaagcugcacc

SEQ ID NO: 2523942 - RNA, 21 nt, Human
gcaauaaagcagcguuucuau

SEQ ID NO: 2523943 - RNA, 16 nt, Human
gcaauaaaucugaccc

SEQ ID NO: 2523944 - RNA, 18 nt, Human
gcaauaaaucugacccag

SEQ ID NO: 2523945 - RNA, 22 nt, Human
gcaagugagagagaugggagcu

SEQ ID NO: 2523946 - RNA, 17 nt, Human
gcaagugagagagaugg

SEQ ID NO: 2523947 - RNA, 20 nt, Human
gcaagugaauuuuucucuaa

SEQ ID NO: 2523948 - RNA, 20 nt, Human
gcaauaaccucaaagugacu

SEQ ID NO: 2523949 - RNA, 19 nt, Human
gcaauaaaucugacccagu

SEQ ID NO: 2523950 - RNA, 21 nt, Human
gcaauaaaucugacccagugc

SEQ ID NO: 2523951 - RNA, 12 nt, Human
gcaauaaaugaa

SEQ ID NO: 2523952 - RNA, 13 nt, Human
gcaagugagagcu

SEQ ID NO: 2523953 - RNA, 21 nt, Human
gcaagugaagguuuacaauuu

SEQ ID NO: 2523954 - RNA, 18 nt, Human
gcaagugaagguuuacaa

SEQ ID NO: 2523955 - RNA, 13 nt, Human
gcaagugaagaaa

SEQ ID NO: 2523956 - RNA, 20 nt, Human
gcaagucugcaggugcacca

SEQ ID NO: 2523957 - RNA, 13 nt, Human
gcaagucugcagg

SEQ ID NO: 2523958 - RNA, 21 nt, Human
gcaagucugcagcccggcgcc

SEQ ID NO: 2523959 - RNA, 17 nt, Human
gcaagucuggaucuggg

SEQ ID NO: 2523960 - RNA, 19 nt, Human
gcaagucucuuuauauggc

SEQ ID NO: 2523961 - RNA, 12 nt, Human
gcaagucugcag

SEQ ID NO: 2523962 - RNA, 14 nt, Human
gcacaguuuucuga

SEQ ID NO: 2523963 - RNA, 17 nt, Human
gcacaguuuucugagaa

SEQ ID NO: 2523964 - RNA, 18 nt, Human
gcacaguuuucugagaaa

SEQ ID NO: 2523965 - RNA, 14 nt, Human
gcacaguuugaaca

SEQ ID NO: 2523966 - RNA, 13 nt, Human
gcacaguuugaac

SEQ ID NO: 2523967 - RNA, 12 nt, Human
gcacaguuugaa

SEQ ID NO: 2523968 - RNA, 18 nt, Human
gcacauauggacucugca

SEQ ID NO: 2523969 - RNA, 13 nt, Human
gcacauauggacu

SEQ ID NO: 2523970 - RNA, 21 nt, Human
gcacaaucucggcucacugca

SEQ ID NO: 2523971 - RNA, 21 nt, Human
gcaauaagaauuuagggagaa

SEQ ID NO: 2523972 - RNA, 22 nt, Human
gcacaaucucggcucacugcau

SEQ ID NO: 2523973 - RNA, 14 nt, Human
gcacaauucuguuu

SEQ ID NO: 2523974 - RNA, 16 nt, Human
gcacaauucuguuuua

SEQ ID NO: 2523975 - RNA, 10 nt, Human
gcacacacac

SEQ ID NO: 2523976 - RNA, 12 nt, Human
gcacacacacaa

SEQ ID NO: 2523977 - RNA, 12 nt, Human
gcacacacacac

SEQ ID NO: 2523978 - RNA, 14 nt, Human
gcacacacacacac

SEQ ID NO: 2523979 - RNA, 16 nt, Human
gcacacacacacacag

SEQ ID NO: 2523980 - RNA, 17 nt, Human
gcacacacacacacagg

SEQ ID NO: 2523981 - RNA, 20 nt, Human
gcacacacacacacaggagg

SEQ ID NO: 2523982 - RNA, 19 nt, Human
gcacacacacacacaggag

SEQ ID NO: 2523983 - RNA, 13 nt, Human
gcacaugccucuc

SEQ ID NO: 2523984 - RNA, 13 nt, Human
gcacaugacucgg

SEQ ID NO: 2523985 - RNA, 17 nt, Human
gcacaucugugucuugu

SEQ ID NO: 2523986 - RNA, 16 nt, Human
gcacaucucugcuuga

SEQ ID NO: 2523987 - RNA, 18 nt, Human
gcacaucugugucuuguu

SEQ ID NO: 2523988 - RNA, 19 nt, Human
gcacaugacaacuuugcca

SEQ ID NO: 2523989 - RNA, 19 nt, Human
gcacaucagcacgauuucu

SEQ ID NO: 2523990 - RNA, 20 nt, Human
gcacaucagcacgauuucug

SEQ ID NO: 2523991 - RNA, 21 nt, Human
gcacaucagcacgauuucugu

SEQ ID NO: 2523992 - RNA, 15 nt, Human
gcacaucagaaagga

SEQ ID NO: 2523993 - RNA, 15 nt, Human
gcacaguuugaacaa

SEQ ID NO: 2523994 - RNA, 14 nt, Human
gcacauauugagca

SEQ ID NO: 2523995 - RNA, 13 nt, Human
gcacaucugcauu

SEQ ID NO: 2523996 - RNA, 21 nt, Human
gcacaucugcauuuucacccc

SEQ ID NO: 2523997 - RNA, 19 nt, Human
gcacaugccucucucaggc

SEQ ID NO: 2523998 - RNA, 18 nt, Human
gcacaugccucucucagg

SEQ ID NO: 2523999 - RNA, 17 nt, Human
gcacaugccucucucag

SEQ ID NO: 2524000 - RNA, 14 nt, Human
gcacaugccucucu

SEQ ID NO: 2524001 - RNA, 21 nt, Human
gcacaugccucucucaggcca

SEQ ID NO: 2524002 - RNA, 20 nt, Human
gcacaugccucucucaggcc

SEQ ID NO: 2524003 - RNA, 22 nt, Human
gcacaugccucucucaggccaa

SEQ ID NO: 2524004 - RNA, 13 nt, Human
gcacccucccucc

SEQ ID NO: 2524005 - RNA, 22 nt, Human
gcacaugcagauggggcucccg

SEQ ID NO: 2524006 - RNA, 15 nt, Human
gcacccuggggccug

SEQ ID NO: 2524007 - RNA, 14 nt, Human
gcacccuggggccu

SEQ ID NO: 2524008 - RNA, 15 nt, Human
gcacccucuauccca

SEQ ID NO: 2524009 - RNA, 19 nt, Human
gcacccucgaugaagccca

SEQ ID NO: 2524010 - RNA, 16 nt, Human
gcacccuccgccuuca

SEQ ID NO: 2524011 - RNA, 21 nt, Human
gcacccuucuuuccucuuccc

SEQ ID NO: 2524012 - RNA, 19 nt, Human
gcacccuucuuuccucuuc

SEQ ID NO: 2524013 - RNA, 18 nt, Human
gcacccuucuuuccucuu

SEQ ID NO: 2524014 - RNA, 21 nt, Human
gcacccuggggccuggaccug

SEQ ID NO: 2524015 - RNA, 20 nt, Human
gcacccuggggccuggaccu

SEQ ID NO: 2524016 - RNA, 17 nt, Human
gcacccuggggccugga

SEQ ID NO: 2524017 - RNA, 17 nt, Human
gcacccuucuuuccucu

SEQ ID NO: 2524018 - RNA, 16 nt, Human
gcacccuucuuuccuc

SEQ ID NO: 2524019 - RNA, 13 nt, Human
gcacaucucugcu

SEQ ID NO: 2524020 - RNA, 19 nt, Human
gcaccggcuggccuggccc

SEQ ID NO: 2524021 - RNA, 14 nt, Human
gcaccgccuucucu

SEQ ID NO: 2524022 - RNA, 23 nt, Human
gcaccggcuggccuggccccuca

SEQ ID NO: 2524023 - RNA, 21 nt, Human
gcaccggcuggccuggccccu

SEQ ID NO: 2524024 - RNA, 18 nt, Human
gcaccggcuggccuggcc

SEQ ID NO: 2524025 - RNA, 17 nt, Human
gcaccgucauggcuuaa

SEQ ID NO: 2524026 - RNA, 13 nt, Human
gcaccgccuucuc

SEQ ID NO: 2524027 - RNA, 14 nt, Human
gcaccguacugugg

SEQ ID NO: 2524028 - RNA, 18 nt, Human
gauucuccuucagcccuc

SEQ ID NO: 2524029 - RNA, 11 nt, Human
gauucuccuuc

SEQ ID NO: 2524030 - RNA, 17 nt, Human
gauucuccuucagcccu

SEQ ID NO: 2524031 - RNA, 13 nt, Human
gauucuccuucag

SEQ ID NO: 2524032 - RNA, 12 nt, Human
gauucuccuuca

SEQ ID NO: 2524033 - RNA, 14 nt, Human
gauuaccagggacu

SEQ ID NO: 2524034 - RNA, 21 nt, Human
gauuacccaagcaaaaucaug

SEQ ID NO: 2524035 - RNA, 14 nt, Human
gauuacccaagcaa

SEQ ID NO: 2524036 - RNA, 15 nt, Human
gauuacauaaucugu

SEQ ID NO: 2524037 - RNA, 15 nt, Human
gauuacauucaguug

SEQ ID NO: 2524038 - RNA, 14 nt, Human
gauuacaugcaugu

SEQ ID NO: 2524039 - RNA, 18 nt, Human
gauuacugccuauuuuaa

SEQ ID NO: 2524040 - RNA, 13 nt, Human
gauuaccuccuga

SEQ ID NO: 2524041 - RNA, 14 nt, Human
gauuaccuccugag

SEQ ID NO: 2524042 - RNA, 17 nt, Human
gauuaccuccugagaaa

SEQ ID NO: 2524043 - RNA, 22 nt, Human
gauuaccuaguagucauuucau

SEQ ID NO: 2524044 - RNA, 12 nt, Human
gauuacucuuug

SEQ ID NO: 2524045 - RNA, 22 nt, Human
gauuagaaugaaaauuguaugu

SEQ ID NO: 2524046 - RNA, 17 nt, Human
gauuagaaugaaaauug

SEQ ID NO: 2524047 - RNA, 14 nt, Human
gauuagaaggcaag

SEQ ID NO: 2524048 - RNA, 17 nt, Human
gauuagaagcugaaaac

SEQ ID NO: 2524049 - RNA, 21 nt, Human
gauuagaaaugaccaauauua

SEQ ID NO: 2524050 - RNA, 23 nt, Human
gauuacucuuugagauagaagaa

SEQ ID NO: 2524051 - RNA, 14 nt, Human
gaugugaacacauc

SEQ ID NO: 2524052 - RNA, 16 nt, Human
gaugugaacacaucag

SEQ ID NO: 2524053 - RNA, 16 nt, Human
gaugcuggcccagggc

SEQ ID NO: 2524054 - RNA, 17 nt, Human
gaugcuggcccagggcc

SEQ ID NO: 2524055 - RNA, 19 nt, Human
gaugcuggcccagggccca

SEQ ID NO: 2524056 - RNA, 21 nt, Human
gaugcuggcccagggcccaga

SEQ ID NO: 2524057 - RNA, 13 nt, Human
gaugcugggcugg

SEQ ID NO: 2524058 - RNA, 12 nt, Human
gaugcugggcug

SEQ ID NO: 2524059 - RNA, 11 nt, Human
gaugcugggau

SEQ ID NO: 2524060 - RNA, 22 nt, Human
gaugcuggcccagggcccagag

SEQ ID NO: 2524061 - RNA, 23 nt, Human
gaugcuggcccagggcccagagc

SEQ ID NO: 2524062 - RNA, 12 nt, Human
gaugugaagcca

SEQ ID NO: 2524063 - RNA, 13 nt, Human
gaugugaagccaa

SEQ ID NO: 2524064 - RNA, 14 nt, Human
gaugugaagccaau

SEQ ID NO: 2524065 - RNA, 23 nt, Human
gaugugaauugccugcagagaga

SEQ ID NO: 2524066 - RNA, 22 nt, Human
gaugugaauugccugcagagag

SEQ ID NO: 2524067 - RNA, 21 nt, Human
gaugugaauugccugcagaga

SEQ ID NO: 2524068 - RNA, 16 nt, Human
gaugcugggcuggcuc

SEQ ID NO: 2524069 - RNA, 23 nt, Human
gaugugaagccaauucagacagg

SEQ ID NO: 2524070 - RNA, 20 nt, Human
gauuacaggugugagccacc

SEQ ID NO: 2524071 - RNA, 14 nt, Human
gauuacauaaucug

SEQ ID NO: 2524072 - RNA, 20 nt, Human
gauuacaggugugaaccacc

SEQ ID NO: 2524073 - RNA, 17 nt, Human
gauuauaacuugucuaa

SEQ ID NO: 2524074 - RNA, 23 nt, Human
gauuagggcauuugagaaaugca

SEQ ID NO: 2524075 - RNA, 14 nt, Human
gauuagcucuggac

SEQ ID NO: 2524076 - RNA, 16 nt, Human
gauuagcucuggacca

SEQ ID NO: 2524077 - RNA, 15 nt, Human
gauuaguaaagaaau

SEQ ID NO: 2524078 - RNA, 19 nt, Human
gauuauguagcaaaauaca

SEQ ID NO: 2524079 - RNA, 20 nt, Human
gauuauuagccagguaaugu

SEQ ID NO: 2524080 - RNA, 15 nt, Human
gauuaugguuuugug

SEQ ID NO: 2524081 - RNA, 16 nt, Human
gauuaugguuuuguga

SEQ ID NO: 2524082 - RNA, 17 nt, Human
gauuaugguuuugugau

SEQ ID NO: 2524083 - RNA, 17 nt, Human
gauuagggagagaagau

SEQ ID NO: 2524084 - RNA, 13 nt, Human
gauuagcucugga

SEQ ID NO: 2524085 - RNA, 12 nt, Human
gauuagcucugg

SEQ ID NO: 2524086 - RNA, 19 nt, Human
gauuagcaaguuacaguga

SEQ ID NO: 2524087 - RNA, 14 nt, Human
gauuagagggaggu

SEQ ID NO: 2524088 - RNA, 13 nt, Human
gauuagagggagg

SEQ ID NO: 2524089 - RNA, 18 nt, Human
gauuagaggcagaucugg

SEQ ID NO: 2524090 - RNA, 20 nt, Human
gauuagagggagguguuuaa

SEQ ID NO: 2524091 - RNA, 17 nt, Human
gauuagagggagguguu

SEQ ID NO: 2524092 - RNA, 15 nt, Human
gauuagaucuuuuaa

SEQ ID NO: 2524093 - RNA, 23 nt, Human
gauuauuucacuuuagaugcuga

SEQ ID NO: 2524094 - RNA, 23 nt, Human
gauuauuuaauaacauuaccuua

SEQ ID NO: 2524095 - RNA, 22 nt, Human
gauuauuuaauaacauuaccuu

SEQ ID NO: 2524096 - RNA, 21 nt, Human
gauuauuuaauaacauuaccu

SEQ ID NO: 2524097 - RNA, 18 nt, Human
gauuauuuaauaacauua

SEQ ID NO: 2524098 - RNA, 17 nt, Human
gauuauuuaauaacauu

SEQ ID NO: 2524099 - RNA, 16 nt, Human
gauuauuuaauaacau

SEQ ID NO: 2524100 - RNA, 15 nt, Human
gauuauuuaauaaca

SEQ ID NO: 2524101 - RNA, 14 nt, Human
gauuauuuaauaac

SEQ ID NO: 2524102 - RNA, 13 nt, Human
gauuauuuaauaa

SEQ ID NO: 2524103 - RNA, 12 nt, Human
gauuauuuaaua

SEQ ID NO: 2524104 - RNA, 17 nt, Human
gauuauuguauuuauuc

SEQ ID NO: 2524105 - RNA, 14 nt, Human
gauuauuaucuaaa

SEQ ID NO: 2524106 - RNA, 23 nt, Human
gauuauuaacuaauaugggcauu

SEQ ID NO: 2524107 - RNA, 14 nt, Human
gauuauuguauuua

SEQ ID NO: 2524108 - RNA, 15 nt, Human
gauuauuuuuucaga

SEQ ID NO: 2524109 - RNA, 23 nt, Human
gauuauuuguuauuuguacaguu

SEQ ID NO: 2524110 - RNA, 14 nt, Human
gauuauuuuuucag

SEQ ID NO: 2524111 - RNA, 22 nt, Human
gauuauuuguuauuuguacagu

SEQ ID NO: 2524112 - RNA, 21 nt, Human
gauuauuuguuauuuguacag

SEQ ID NO: 2524113 - RNA, 22 nt, Human
gauuauuucacuuuagaugcug

SEQ ID NO: 2524114 - RNA, 14 nt, Human
gauuauuucacuuu

SEQ ID NO: 2524115 - RNA, 21 nt, Human
gauuauuuucuacacauacau

SEQ ID NO: 2524116 - RNA, 17 nt, Human
gaucucuugagccuggg

SEQ ID NO: 2524117 - RNA, 12 nt, Human
gaucucuugagc

SEQ ID NO: 2524118 - RNA, 16 nt, Human
gaucucuugagccugg

SEQ ID NO: 2524119 - RNA, 13 nt, Human
gaucuccaaggac

SEQ ID NO: 2524120 - RNA, 19 nt, Human
gaucuccaaggaccagguu

SEQ ID NO: 2524121 - RNA, 16 nt, Human
gaucuccaaggaccag

SEQ ID NO: 2524122 - RNA, 20 nt, Human
gaucuccaaggaccagguua

SEQ ID NO: 2524123 - RNA, 17 nt, Human
gaucuccauauguuaca

SEQ ID NO: 2524124 - RNA, 23 nt, Human
gaucucagugguuaagauuccua

SEQ ID NO: 2524125 - RNA, 21 nt, Human
gaucucauuggacccuuccau

SEQ ID NO: 2524126 - RNA, 13 nt, Human
gaucuccugaccu

SEQ ID NO: 2524127 - RNA, 18 nt, Human
gaucucccugccgccuca

SEQ ID NO: 2524128 - RNA, 20 nt, Human
gaucucccugccgccucaau

SEQ ID NO: 2524129 - RNA, 12 nt, Human
gaucucccugcc

SEQ ID NO: 2524130 - RNA, 19 nt, Human
gaucuccauggcuuccucc

SEQ ID NO: 2524131 - RNA, 13 nt, Human
gaucucccugccg

SEQ ID NO: 2524132 - RNA, 14 nt, Human
gaucucccugccgc

SEQ ID NO: 2524133 - RNA, 15 nt, Human
gaucucccugccgcc

SEQ ID NO: 2524134 - RNA, 22 nt, Human
gauccaugaguuugcccugguu

SEQ ID NO: 2524135 - RNA, 16 nt, Human
gauccauguagcagga

SEQ ID NO: 2524136 - RNA, 19 nt, Human
gauccauguagcaggacug

SEQ ID NO: 2524137 - RNA, 12 nt, Human
gauccagggaca

SEQ ID NO: 2524138 - RNA, 13 nt, Human
gauccagggacag

SEQ ID NO: 2524139 - RNA, 14 nt, Human
gauccagggacaga

SEQ ID NO: 2524140 - RNA, 15 nt, Human
gauccagggacagag

SEQ ID NO: 2524141 - RNA, 18 nt, Human
gauccagggacagaggcc

SEQ ID NO: 2524142 - RNA, 22 nt, Human
gauccagggacagaggccccag

SEQ ID NO: 2524143 - RNA, 16 nt, Human
gauccagggacugaag

SEQ ID NO: 2524144 - RNA, 13 nt, Human
gauccagccuggg

SEQ ID NO: 2524145 - RNA, 21 nt, Human
gauccagccuggggucuggag

SEQ ID NO: 2524146 - RNA, 12 nt, Human
gauccaggacua

SEQ ID NO: 2524147 - RNA, 16 nt, Human
gauauuuugcuuugug

SEQ ID NO: 2524148 - RNA, 22 nt, Human
gauauugucagaguucugcucu

SEQ ID NO: 2524149 - RNA, 15 nt, Human
gauauuuuuuucuuu

SEQ ID NO: 2524150 - RNA, 17 nt, Human
gauauuuuuaucuuuau

SEQ ID NO: 2524151 - RNA, 18 nt, Human
gauauuuuuccauuuuuu

SEQ ID NO: 2524152 - RNA, 16 nt, Human
gauauuuuuucugaau

SEQ ID NO: 2524153 - RNA, 21 nt, Human
gauauuuuuucagaaauaugu

SEQ ID NO: 2524154 - RNA, 18 nt, Human
gaugagaguuuuggaugc

SEQ ID NO: 2524155 - RNA, 13 nt, Human
gaugagaguuuug

SEQ ID NO: 2524156 - RNA, 23 nt, Human
gaugagccgcugugagccccugg

SEQ ID NO: 2524157 - RNA, 13 nt, Human
gaugagccgcugu

SEQ ID NO: 2524158 - RNA, 19 nt, Human
gaugagcccucagaacccu

SEQ ID NO: 2524159 - RNA, 22 nt, Human
gaugagcccucagaacccuugg

SEQ ID NO: 2524160 - RNA, 14 nt, Human
gaugaucuuugcag

SEQ ID NO: 2524161 - RNA, 17 nt, Human
gaugagcauggagcugg

SEQ ID NO: 2524162 - RNA, 16 nt, Human
gaugagcauggagcug

SEQ ID NO: 2524163 - RNA, 15 nt, Human
gaugagcauggagcu

SEQ ID NO: 2524164 - RNA, 17 nt, Human
gaugagcaucccaggau

SEQ ID NO: 2524165 - RNA, 16 nt, Human
gaugagcaucccagga

SEQ ID NO: 2524166 - RNA, 21 nt, Human
gaugagaguuuuggaugcagu

SEQ ID NO: 2524167 - RNA, 15 nt, Human
gaugagcccucagaa

SEQ ID NO: 2524168 - RNA, 12 nt, Human
gaugagcauuua

SEQ ID NO: 2524169 - RNA, 18 nt, Human
gaugagcauuuagggcaa

SEQ ID NO: 2524170 - RNA, 21 nt, Human
gaugagcauuuagggcaagga

SEQ ID NO: 2524171 - RNA, 22 nt, Human
gaugagcauuuagggcaaggag

SEQ ID NO: 2524172 - RNA, 21 nt, Human
gaugaucuuugcagacaggca

SEQ ID NO: 2524173 - RNA, 20 nt, Human
gaugaucuuugcagacaggc

SEQ ID NO: 2524174 - RNA, 12 nt, Human
gaugcuggccca

SEQ ID NO: 2524175 - RNA, 13 nt, Human
gaugcuggcccag

SEQ ID NO: 2524176 - RNA, 14 nt, Human
gaugcuggcccagg

SEQ ID NO: 2524177 - RNA, 15 nt, Human
gaugcuggcccaggg

SEQ ID NO: 2524178 - RNA, 22 nt, Human
gaugcuggaugucugccaauuu

SEQ ID NO: 2524179 - RNA, 20 nt, Human
gaugcuggaugucugccaau

SEQ ID NO: 2524180 - RNA, 17 nt, Human
gaugcuggaugucugcc

SEQ ID NO: 2524181 - RNA, 18 nt, Human
gaugcuggaugcuccuuc

SEQ ID NO: 2524182 - RNA, 21 nt, Human
gaugaugaaaugaggucagag

SEQ ID NO: 2524183 - RNA, 18 nt, Human
gaguuuguguguugucuu

SEQ ID NO: 2524184 - RNA, 12 nt, Human
gaguuugguccc

SEQ ID NO: 2524185 - RNA, 15 nt, Human
gaguuuggucccugg

SEQ ID NO: 2524186 - RNA, 22 nt, Human
gaguuugucgcucaugugugca

SEQ ID NO: 2524187 - RNA, 18 nt, Human
gaguuugucgcucaugug

SEQ ID NO: 2524188 - RNA, 17 nt, Human
gaguuugucgcucaugu

SEQ ID NO: 2524189 - RNA, 18 nt, Human
gaguuugcuauuagagca

SEQ ID NO: 2524190 - RNA, 20 nt, Human
gaguuugggguaugggagag

SEQ ID NO: 2524191 - RNA, 23 nt, Human
gaguggaauaguauccuccaggu

SEQ ID NO: 2524192 - RNA, 22 nt, Human
gaguggaauaguauccuccagg

SEQ ID NO: 2524193 - RNA, 20 nt, Human
gaguggaauaguauccucca

SEQ ID NO: 2524194 - RNA, 13 nt, Human
gaguuggcuggga

SEQ ID NO: 2524195 - RNA, 19 nt, Human
gaguuguaaauauauaaau

SEQ ID NO: 2524196 - RNA, 15 nt, Human
gaguuguaaauauau

SEQ ID NO: 2524197 - RNA, 14 nt, Human
gaguuguaaauaua

SEQ ID NO: 2524198 - RNA, 12 nt, Human
gaguuguaaaua

SEQ ID NO: 2524199 - RNA, 11 nt, Human
gaguugggggu

SEQ ID NO: 2524200 - RNA, 17 nt, Human
gaguggacuggagugga

SEQ ID NO: 2524201 - RNA, 19 nt, Human
gaguggacuguucccugag

SEQ ID NO: 2524202 - RNA, 16 nt, Human
gaguuguuacauuuuu

SEQ ID NO: 2524203 - RNA, 20 nt, Human
gaguuguuacauuuuuaagu

SEQ ID NO: 2524204 - RNA, 17 nt, Human
gagugcaguccugauca

SEQ ID NO: 2524205 - RNA, 18 nt, Human
gagugcaguccugaucag

SEQ ID NO: 2524206 - RNA, 22 nt, Human
gagugcaguccugaucagagcc

SEQ ID NO: 2524207 - RNA, 18 nt, Human
gagugccuuacacaaugg

SEQ ID NO: 2524208 - RNA, 19 nt, Human
gaguggaauaguauccucc

SEQ ID NO: 2524209 - RNA, 14 nt, Human
gagugcgugcucag

SEQ ID NO: 2524210 - RNA, 17 nt, Human
gaguuugagcugccuuc

SEQ ID NO: 2524211 - RNA, 22 nt, Human
gaguuugaaggaggugagggau

SEQ ID NO: 2524212 - RNA, 13 nt, Human
gaguuugcccugg

SEQ ID NO: 2524213 - RNA, 15 nt, Human
gaguuucgagguaga

SEQ ID NO: 2524214 - RNA, 21 nt, Human
gaguuuccucaggcugcugga

SEQ ID NO: 2524215 - RNA, 16 nt, Human
gaguuuccucaggcug

SEQ ID NO: 2524216 - RNA, 20 nt, Human
gaguuuccucaggcugcugg

SEQ ID NO: 2524217 - RNA, 23 nt, Human
gaguuuccucaggcugcuggagg

SEQ ID NO: 2524218 - RNA, 15 nt, Human
gaguuucauguacaa

SEQ ID NO: 2524219 - RNA, 18 nt, Human
gaguuucauguacaagau

SEQ ID NO: 2524220 - RNA, 21 nt, Human
gaguuuagugaucugaacaga

SEQ ID NO: 2524221 - RNA, 20 nt, Human
gaguuucauucuccugccug

SEQ ID NO: 2524222 - RNA, 19 nt, Human
gaguuucauucuccugccu

SEQ ID NO: 2524223 - RNA, 18 nt, Human
gaguuucauucuccugcc

SEQ ID NO: 2524224 - RNA, 15 nt, Human
gaguuuccucaggcu

SEQ ID NO: 2524225 - RNA, 16 nt, Human
gaguuuccaaaaccag

SEQ ID NO: 2524226 - RNA, 16 nt, Human
gaguuuagcuggaaaa

SEQ ID NO: 2524227 - RNA, 16 nt, Human
gaguuguggaaagccu

SEQ ID NO: 2524228 - RNA, 20 nt, Human
gaguuguggaaagccucugc

SEQ ID NO: 2524229 - RNA, 13 nt, Human
gaggucuguucuu

SEQ ID NO: 2524230 - RNA, 14 nt, Human
gaggucuguucuuu

SEQ ID NO: 2524231 - RNA, 19 nt, Human
gaggucugugcugaggccu

SEQ ID NO: 2524232 - RNA, 16 nt, Human
gaggucugugcugagg

SEQ ID NO: 2524233 - RNA, 15 nt, Human
gaggucugugcugag

SEQ ID NO: 2524234 - RNA, 13 nt, Human
gaggucugugcug

SEQ ID NO: 2524235 - RNA, 21 nt, Human
gaggugcagagugcccagaac

SEQ ID NO: 2524236 - RNA, 19 nt, Human
gaggugcagagugcccaga

SEQ ID NO: 2524237 - RNA, 18 nt, Human
gaggucuuuugacaugug

SEQ ID NO: 2524238 - RNA, 18 nt, Human
gaggugcagagugcccag

SEQ ID NO: 2524239 - RNA, 17 nt, Human
gaggucucuugagggag

SEQ ID NO: 2524240 - RNA, 18 nt, Human
gaggucucuugagggagc

SEQ ID NO: 2524241 - RNA, 14 nt, Human
gaggucugaaaugg

SEQ ID NO: 2524242 - RNA, 21 nt, Human
gaggucuguacguuaccucuu

SEQ ID NO: 2524243 - RNA, 17 nt, Human
gaggucuggcugcuugc

SEQ ID NO: 2524244 - RNA, 19 nt, Human
gaggucugcucggccgucu

SEQ ID NO: 2524245 - RNA, 23 nt, Human
gaggucugcucggccgucuucac

SEQ ID NO: 2524246 - RNA, 22 nt, Human
gaggugccagcaacugaauaaa

SEQ ID NO: 2524247 - RNA, 20 nt, Human
gaggugccagcaacugaaua

SEQ ID NO: 2524248 - RNA, 17 nt, Human
gaggugccagcaacuga

SEQ ID NO: 2524249 - RNA, 20 nt, Human
gaggugccagcaaagcccca

SEQ ID NO: 2524250 - RNA, 19 nt, Human
gaggugccagcaaagcccc

SEQ ID NO: 2524251 - RNA, 17 nt, Human
gaggugccagcaaagcc

SEQ ID NO: 2524252 - RNA, 16 nt, Human
gaggugccagcaaagc

SEQ ID NO: 2524253 - RNA, 15 nt, Human
gaggugccagcaaag

SEQ ID NO: 2524254 - RNA, 13 nt, Human
gaggugccagcaa

SEQ ID NO: 2524255 - RNA, 14 nt, Human
gaggugccagcaaa

SEQ ID NO: 2524256 - RNA, 21 nt, Human
gaggugccugucccaccccca

SEQ ID NO: 2524257 - RNA, 15 nt, Human
gaggugccuguccca

SEQ ID NO: 2524258 - RNA, 13 nt, Human
gaggugccugucc

SEQ ID NO: 2524259 - RNA, 11 nt, Human
gaggugggagg

SEQ ID NO: 2524260 - RNA, 23 nt, Human
gaggugggagcaggagauugaga

SEQ ID NO: 2524261 - RNA, 15 nt, Human
gaggugggaggugga

SEQ ID NO: 2524262 - RNA, 18 nt, Human
gaggugggagguggaaga

SEQ ID NO: 2524263 - RNA, 16 nt, Human
gaggugggauaucccu

SEQ ID NO: 2524264 - RNA, 20 nt, Human
gagucaauccccucauucag

SEQ ID NO: 2524265 - RNA, 19 nt, Human
gagucaauccccucauuca

SEQ ID NO: 2524266 - RNA, 15 nt, Human
gagucaaugugcagu

SEQ ID NO: 2524267 - RNA, 12 nt, Human
gaggugggaucc

SEQ ID NO: 2524268 - RNA, 16 nt, Human
gaggugcugggaggga

SEQ ID NO: 2524269 - RNA, 14 nt, Human
gaggugggagcagg

SEQ ID NO: 2524270 - RNA, 15 nt, Human
gaggugggagcagga

SEQ ID NO: 2524271 - RNA, 23 nt, Human
gaggugcuacugacuuucucagc

SEQ ID NO: 2524272 - RNA, 18 nt, Human
gaggugggagcaggagau

SEQ ID NO: 2524273 - RNA, 17 nt, Human
gaggugggagcaggaga

SEQ ID NO: 2524274 - RNA, 20 nt, Human
gaggugggaggaucuuuuga

SEQ ID NO: 2524275 - RNA, 12 nt, Human
gagugagcuggu

SEQ ID NO: 2524276 - RNA, 13 nt, Human
gagucccaccuug

SEQ ID NO: 2524277 - RNA, 13 nt, Human
gagugagccuggc

SEQ ID NO: 2524278 - RNA, 22 nt, Human
gagugaggaauaguugagcccc

SEQ ID NO: 2524279 - RNA, 13 nt, Human
gaguccagucucu

SEQ ID NO: 2524280 - RNA, 21 nt, Human
gagucccaccuuggcugcagg

SEQ ID NO: 2524281 - RNA, 24 nt, Human
gagugagcacuaaggugugcucug

SEQ ID NO: 2524282 - RNA, 12 nt, Human
gagugcagugag

SEQ ID NO: 2524283 - RNA, 11 nt, Human
gagugcaguga

SEQ ID NO: 2524284 - RNA, 19 nt, Human
gagugcaggccugcucagg

SEQ ID NO: 2524285 - RNA, 17 nt, Human
gagugcaggccugcuca

SEQ ID NO: 2524286 - RNA, 14 nt, Human
gagugcaguccuga

SEQ ID NO: 2524287 - RNA, 22 nt, Human
gagugaggguuucugagcugcu

SEQ ID NO: 2524288 - RNA, 21 nt, Human
gagugagggguaaaagcugau

SEQ ID NO: 2524289 - RNA, 18 nt, Human
gagugaggaugucugggc

SEQ ID NO: 2524290 - RNA, 19 nt, Human
gagugagggguaaaagcug

SEQ ID NO: 2524291 - RNA, 14 nt, Human
gagugagggccuga

SEQ ID NO: 2524292 - RNA, 13 nt, Human
gagugagggccug

SEQ ID NO: 2524293 - RNA, 20 nt, Human
gagucccaccuuggcugcag

SEQ ID NO: 2524294 - RNA, 16 nt, Human
gagucccaccuuggcu

SEQ ID NO: 2524295 - RNA, 14 nt, Human
gagucaccaagccc

SEQ ID NO: 2524296 - RNA, 13 nt, Human
gagucaccaagcc

SEQ ID NO: 2524297 - RNA, 22 nt, Human
gaguccacuuuguuucgugggg

SEQ ID NO: 2524298 - RNA, 11 nt, Human
gaguccacucc

SEQ ID NO: 2524299 - RNA, 13 nt, Human
gaguccaggcccc

SEQ ID NO: 2524300 - RNA, 12 nt, Human
gaguccagggaa

SEQ ID NO: 2524301 - RNA, 14 nt, Human
gaguccaggcccca

SEQ ID NO: 2524302 - RNA, 13 nt, Human
gaguccacuuugu

SEQ ID NO: 2524303 - RNA, 16 nt, Human
gauacuugaaaauuaa

SEQ ID NO: 2524304 - RNA, 20 nt, Human
gauaugauuuaaaacaugua

SEQ ID NO: 2524305 - RNA, 14 nt, Human
gauaugauuuaaaa

SEQ ID NO: 2524306 - RNA, 18 nt, Human
gauaugcaguuuuccuua

SEQ ID NO: 2524307 - RNA, 14 nt, Human
gauaugcagaagga

SEQ ID NO: 2524308 - RNA, 17 nt, Human
gauauggcagaagacac

SEQ ID NO: 2524309 - RNA, 15 nt, Human
gauauggcagaagac

SEQ ID NO: 2524310 - RNA, 14 nt, Human
gauauggcagaaga

SEQ ID NO: 2524311 - RNA, 21 nt, Human
gauauggagcccuguaauuuu

SEQ ID NO: 2524312 - RNA, 15 nt, Human
gauauggagcccugu

SEQ ID NO: 2524313 - RNA, 12 nt, Human
gauauggagccc

SEQ ID NO: 2524314 - RNA, 16 nt, Human
gauaugcuuaguaaug

SEQ ID NO: 2524315 - RNA, 14 nt, Human
gauaugcuuaguaa

SEQ ID NO: 2524316 - RNA, 21 nt, Human
gauaugguggguggacagggg

SEQ ID NO: 2524317 - RNA, 16 nt, Human
gauaugggacauuuuu

SEQ ID NO: 2524318 - RNA, 17 nt, Human
gauaugggacauuuuug

SEQ ID NO: 2524319 - RNA, 20 nt, Human
gauauguaccuaacgaagua

SEQ ID NO: 2524320 - RNA, 19 nt, Human
gauauguaaacauaauucu

SEQ ID NO: 2524321 - RNA, 19 nt, Human
gauauuccaugaauguauc

SEQ ID NO: 2524322 - RNA, 21 nt, Human
gauauuccaugaauguaucag

SEQ ID NO: 2524323 - RNA, 20 nt, Human
gauauuccccccacuuaaga

SEQ ID NO: 2524324 - RNA, 15 nt, Human
gauauuauucuugua

SEQ ID NO: 2524325 - RNA, 16 nt, Human
gauauuccaugaaugu

SEQ ID NO: 2524326 - RNA, 18 nt, Human
gauauuccaugaauguau

SEQ ID NO: 2524327 - RNA, 16 nt, Human
gauauuaaaggaguua

SEQ ID NO: 2524328 - RNA, 14 nt, Human
gauacccaucccau

SEQ ID NO: 2524329 - RNA, 13 nt, Human
gauacccauccca

SEQ ID NO: 2524330 - RNA, 21 nt, Human
gauaccccccucugucuugug

SEQ ID NO: 2524331 - RNA, 20 nt, Human
gauacccauagcuuccauga

SEQ ID NO: 2524332 - RNA, 13 nt, Human
gauaccccccucu

SEQ ID NO: 2524333 - RNA, 16 nt, Human
gauacuacaguuuguu

SEQ ID NO: 2524334 - RNA, 22 nt, Human
gauacuaaaaguucuucuccaa

SEQ ID NO: 2524335 - RNA, 16 nt, Human
gauacgcaucagacag

SEQ ID NO: 2524336 - RNA, 20 nt, Human
gauacuaaaaguucuucucc

SEQ ID NO: 2524337 - RNA, 11 nt, Human
gauacuacagu

SEQ ID NO: 2524338 - RNA, 13 nt, Human
gauacgacuuuau

SEQ ID NO: 2524339 - RNA, 15 nt, Human
gacuuucugccugga

SEQ ID NO: 2524340 - RNA, 18 nt, Human
gacuuuugaaaagaggug

SEQ ID NO: 2524341 - RNA, 23 nt, Human
gacuuuuguauagguagauguuc

SEQ ID NO: 2524342 - RNA, 23 nt, Human
gacuuuucuuucagccaagaauu

SEQ ID NO: 2524343 - RNA, 21 nt, Human
gacuuuucuuuguggcuuccu

SEQ ID NO: 2524344 - RNA, 18 nt, Human
gacuuucggaguuggggg

SEQ ID NO: 2524345 - RNA, 12 nt, Human
gacuuuccugca

SEQ ID NO: 2524346 - RNA, 11 nt, Human
gacuuuccugc

SEQ ID NO: 2524347 - RNA, 16 nt, Human
gacuuuccuaaauguu

SEQ ID NO: 2524348 - RNA, 14 nt, Human
gacuuucugccugg

SEQ ID NO: 2524349 - RNA, 12 nt, Human
gacuuucugccu

SEQ ID NO: 2524350 - RNA, 19 nt, Human
gacuuucggaguugggggu

SEQ ID NO: 2524351 - RNA, 23 nt, Human
gacuuucucagccucugaauaug

SEQ ID NO: 2524352 - RNA, 11 nt, Human
gacuuuccucu

SEQ ID NO: 2524353 - RNA, 23 nt, Human
gacuggugcuauaggcuggagaa

SEQ ID NO: 2524354 - RNA, 22 nt, Human
gacuggugcuauaggcuggaga

SEQ ID NO: 2524355 - RNA, 13 nt, Human
gacuuuccacccc

SEQ ID NO: 2524356 - RNA, 15 nt, Human
gacuuuccacccccu

SEQ ID NO: 2524357 - RNA, 16 nt, Human
gacuuuccacccccuc

SEQ ID NO: 2524358 - RNA, 17 nt, Human
gacuuuccacccccucc

SEQ ID NO: 2524359 - RNA, 18 nt, Human
gacuuuccacccccuccc

SEQ ID NO: 2524360 - RNA, 19 nt, Human
gacuuuccacccccucccu

SEQ ID NO: 2524361 - RNA, 20 nt, Human
gacuggugcuauaggcugga

SEQ ID NO: 2524362 - RNA, 19 nt, Human
gacuggugcuauaggcugg

SEQ ID NO: 2524363 - RNA, 17 nt, Human
gacuggugagcagacug

SEQ ID NO: 2524364 - RNA, 16 nt, Human
gacugguaaguaacug

SEQ ID NO: 2524365 - RNA, 23 nt, Human
gacuggguuuggaccccagcugg

SEQ ID NO: 2524366 - RNA, 15 nt, Human
gacugguccugugug

SEQ ID NO: 2524367 - RNA, 14 nt, Human
gacuggugagcaga

SEQ ID NO: 2524368 - RNA, 22 nt, Human
gacuggguuuggaccccagcug

SEQ ID NO: 2524369 - RNA, 21 nt, Human
gacuggguuuggaccccagcu

SEQ ID NO: 2524370 - RNA, 14 nt, Human
gacuggguuucuag

SEQ ID NO: 2524371 - RNA, 16 nt, Human
gacuggguuuaugucc

SEQ ID NO: 2524372 - RNA, 21 nt, Human
gacucuuuuuguaccugguga

SEQ ID NO: 2524373 - RNA, 23 nt, Human
gacugggucucgcuuuguugccc

SEQ ID NO: 2524374 - RNA, 17 nt, Human
gagaagcuuugcccucc

SEQ ID NO: 2524375 - RNA, 16 nt, Human
gagaagcggcuggcag

SEQ ID NO: 2524376 - RNA, 13 nt, Human
gagaagcggcugg

SEQ ID NO: 2524377 - RNA, 15 nt, Human
gagaagcggcuggca

SEQ ID NO: 2524378 - RNA, 21 nt, Human
gagaagcuuuugaauaaaaac

SEQ ID NO: 2524379 - RNA, 22 nt, Human
gagaagcuuuugaauaaaaacu

SEQ ID NO: 2524380 - RNA, 20 nt, Human
gagaaggacccggaggggcc

SEQ ID NO: 2524381 - RNA, 12 nt, Human
gagaaggaagcc

SEQ ID NO: 2524382 - RNA, 22 nt, Human
gagaaggacccggaggggccug

SEQ ID NO: 2524383 - RNA, 14 nt, Human
gagaaggaaggaga

SEQ ID NO: 2524384 - RNA, 21 nt, Human
gagaaggaaggagacucaccu

SEQ ID NO: 2524385 - RNA, 17 nt, Human
gagacccuacaggagag

SEQ ID NO: 2524386 - RNA, 17 nt, Human
gagaccccuggccuccg

SEQ ID NO: 2524387 - RNA, 19 nt, Human
gagacccucguggccuucc

SEQ ID NO: 2524388 - RNA, 16 nt, Human
gagaccccuggccucc

SEQ ID NO: 2524389 - RNA, 15 nt, Human
gagaccccuggccuc

SEQ ID NO: 2524390 - RNA, 14 nt, Human
gagaccccuggccu

SEQ ID NO: 2524391 - RNA, 13 nt, Human
gagaccccuggcc

SEQ ID NO: 2524392 - RNA, 15 nt, Human
gagacccccacaccu

SEQ ID NO: 2524393 - RNA, 23 nt, Human
gagacccccacaccucaguuccc

SEQ ID NO: 2524394 - RNA, 21 nt, Human
gagacccucugccaccagaga

SEQ ID NO: 2524395 - RNA, 15 nt, Human
gagacccucugccac

SEQ ID NO: 2524396 - RNA, 11 nt, Human
gagaccucagc

SEQ ID NO: 2524397 - RNA, 13 nt, Human
gagaccucagcca

SEQ ID NO: 2524398 - RNA, 14 nt, Human
gagaccucagccau

SEQ ID NO: 2524399 - RNA, 21 nt, Human
gagaccucaucaggaugaacc

SEQ ID NO: 2524400 - RNA, 20 nt, Human
gagaccucaucaggaugaac

SEQ ID NO: 2524401 - RNA, 19 nt, Human
gagaccucaucaggaugaa

SEQ ID NO: 2524402 - RNA, 18 nt, Human
gagaccucaucaggauga

SEQ ID NO: 2524403 - RNA, 12 nt, Human
gagaccucauca

SEQ ID NO: 2524404 - RNA, 11 nt, Human
gagaccucauc

SEQ ID NO: 2524405 - RNA, 15 nt, Human
gagaccucagccaug

SEQ ID NO: 2524406 - RNA, 16 nt, Human
gagaccuccugccucc

SEQ ID NO: 2524407 - RNA, 15 nt, Human
gagaccuccugccuc

SEQ ID NO: 2524408 - RNA, 13 nt, Human
gagaccuccugcc

SEQ ID NO: 2524409 - RNA, 11 nt, Human
gagaccugccc

SEQ ID NO: 2524410 - RNA, 12 nt, Human
gagaccugcccc

SEQ ID NO: 2524411 - RNA, 22 nt, Human
gagacguuuuuggaagaguagu

SEQ ID NO: 2524412 - RNA, 23 nt, Human
gagacuaaccccaccacacccuc

SEQ ID NO: 2524413 - RNA, 15 nt, Human
gagacuaagcccugu

SEQ ID NO: 2524414 - RNA, 14 nt, Human
gagacuaagcccug

SEQ ID NO: 2524415 - RNA, 19 nt, Human
gagaccugacaagcacugc

SEQ ID NO: 2524416 - RNA, 18 nt, Human
gagaccugacaagcacug

SEQ ID NO: 2524417 - RNA, 22 nt, Human
gagacuaagcccugucgagaca

SEQ ID NO: 2524418 - RNA, 16 nt, Human
gagacuaagcccuguc

SEQ ID NO: 2524419 - RNA, 16 nt, Human
gagacuagauugccuu

SEQ ID NO: 2524420 - RNA, 18 nt, Human
gagacccagcccucaucc

SEQ ID NO: 2524421 - RNA, 14 nt, Human
gagacccaaggagg

SEQ ID NO: 2524422 - RNA, 12 nt, Human
gagacccccaca

SEQ ID NO: 2524423 - RNA, 13 nt, Human
gagacccccacac

SEQ ID NO: 2524424 - RNA, 14 nt, Human
gagacccccacacc

SEQ ID NO: 2524425 - RNA, 15 nt, Human
gagaaucacuugaac

SEQ ID NO: 2524426 - RNA, 20 nt, Human
gagaaucagaucauuucaaa

SEQ ID NO: 2524427 - RNA, 13 nt, Human
gagaaucacuuga

SEQ ID NO: 2524428 - RNA, 21 nt, Human
gagaaucauacuuagcaaagu

SEQ ID NO: 2524429 - RNA, 14 nt, Human
gagaaucacuugaa

SEQ ID NO: 2524430 - RNA, 19 nt, Human
gagaagugacagggaagcu

SEQ ID NO: 2524431 - RNA, 17 nt, Human
gagaagugacagggaag

SEQ ID NO: 2524432 - RNA, 16 nt, Human
gagaagugacagggaa

SEQ ID NO: 2524433 - RNA, 15 nt, Human
gagaagugacaggga

SEQ ID NO: 2524434 - RNA, 23 nt, Human
gagaagugacagggaagcuacag

SEQ ID NO: 2524435 - RNA, 21 nt, Human
gagaagugacagggaagcuac

SEQ ID NO: 2524436 - RNA, 24 nt, Human
gagaagugacagggaagcuacagg

SEQ ID NO: 2524437 - RNA, 23 nt, Human
gagaagucuuagacuugaaauac

SEQ ID NO: 2524438 - RNA, 20 nt, Human
gagaagugaaugcugggacu

SEQ ID NO: 2524439 - RNA, 19 nt, Human
gagaagugaaugcugggac

SEQ ID NO: 2524440 - RNA, 17 nt, Human
gagaagugaaugcuggg

SEQ ID NO: 2524441 - RNA, 15 nt, Human
gacuaggguccuggg

SEQ ID NO: 2524442 - RNA, 16 nt, Human
gacuaggguccugggg

SEQ ID NO: 2524443 - RNA, 18 nt, Human
gacuaggguccuggggaa

SEQ ID NO: 2524444 - RNA, 22 nt, Human
gacuauauuugggccugcucca

SEQ ID NO: 2524445 - RNA, 21 nt, Human
gacuagggauucaggcugcuu

SEQ ID NO: 2524446 - RNA, 22 nt, Human
gacuaucuaaauguugaaagau

SEQ ID NO: 2524447 - RNA, 13 nt, Human
gacuaucagccca

SEQ ID NO: 2524448 - RNA, 18 nt, Human
gacuaucugucugguggc

SEQ ID NO: 2524449 - RNA, 18 nt, Human
gacuaucaaacugaagcc

SEQ ID NO: 2524450 - RNA, 22 nt, Human
gacuaucaaacugaagccagaa

SEQ ID NO: 2524451 - RNA, 16 nt, Human
gacuaugaaugggcaa

SEQ ID NO: 2524452 - RNA, 20 nt, Human
gacuaugaacuucucucaga

SEQ ID NO: 2524453 - RNA, 19 nt, Human
gacuaugaacuucucucag

SEQ ID NO: 2524454 - RNA, 23 nt, Human
gacuagccccuguggagacuggg

SEQ ID NO: 2524455 - RNA, 16 nt, Human
gacuauuuaacuugag

SEQ ID NO: 2524456 - RNA, 13 nt, Human
gacuauuuaugaa

SEQ ID NO: 2524457 - RNA, 21 nt, Human
gacuaugaaugggcaaaacug

SEQ ID NO: 2524458 - RNA, 14 nt, Human
gacuauucaguuuu

SEQ ID NO: 2524459 - RNA, 21 nt, Human
gacuagccccuguggagacug

SEQ ID NO: 2524460 - RNA, 23 nt, Human
gacuagggaaaugaucaguuuuu

SEQ ID NO: 2524461 - RNA, 14 nt, Human
gacuaggagcacug

SEQ ID NO: 2524462 - RNA, 17 nt, Human
gacuagggauucaggcu

SEQ ID NO: 2524463 - RNA, 18 nt, Human
gacuagggauucaggcug

SEQ ID NO: 2524464 - RNA, 19 nt, Human
gacuagggauucaggcugc

SEQ ID NO: 2524465 - RNA, 20 nt, Human
gacuagggauucaggcugcu

SEQ ID NO: 2524466 - RNA, 15 nt, Human
gacucuggccuccac

SEQ ID NO: 2524467 - RNA, 16 nt, Human
gacucuggcaaagcuu

SEQ ID NO: 2524468 - RNA, 15 nt, Human
gacucugcacauguc

SEQ ID NO: 2524469 - RNA, 14 nt, Human
gacucugcacauga

SEQ ID NO: 2524470 - RNA, 19 nt, Human
gacucugcacaugucuugu

SEQ ID NO: 2524471 - RNA, 17 nt, Human
gacucugaccucuuggc

SEQ ID NO: 2524472 - RNA, 16 nt, Human
gacucuggggacuccg

SEQ ID NO: 2524473 - RNA, 13 nt, Human
gacucuggccucc

SEQ ID NO: 2524474 - RNA, 12 nt, Human
gacucugucuca

SEQ ID NO: 2524475 - RNA, 21 nt, Human
gacucugaaucuuuuucagaa

SEQ ID NO: 2524476 - RNA, 20 nt, Human
gacucugaaucuuuuucaga

SEQ ID NO: 2524477 - RNA, 19 nt, Human
gacucugaagccucuggga

SEQ ID NO: 2524478 - RNA, 18 nt, Human
gacucugaagccucuggg

SEQ ID NO: 2524479 - RNA, 17 nt, Human
gacucugaagccucugg

SEQ ID NO: 2524480 - RNA, 16 nt, Human
gacucugaagccucug

SEQ ID NO: 2524481 - RNA, 15 nt, Human
gacucugaagccucu

SEQ ID NO: 2524482 - RNA, 18 nt, Human
gacucugaaaucugaaga

SEQ ID NO: 2524483 - RNA, 12 nt, Human
gacucugcacau

SEQ ID NO: 2524484 - RNA, 22 nt, Human
gacucugaggcucuuucugggc

SEQ ID NO: 2524485 - RNA, 23 nt, Human
gacucugaccucuuggccacaga

SEQ ID NO: 2524486 - RNA, 19 nt, Human
gacucugaggcucuuucug

SEQ ID NO: 2524487 - RNA, 15 nt, Human
gacucugaaaucuga

SEQ ID NO: 2524488 - RNA, 14 nt, Human
gacucugaaaucug

SEQ ID NO: 2524489 - RNA, 19 nt, Human
gacucucugugaccugccc

SEQ ID NO: 2524490 - RNA, 23 nt, Human
gacucaaaacccaucugggcucc

SEQ ID NO: 2524491 - RNA, 22 nt, Human
gacucaaaacccaucugggcuc

SEQ ID NO: 2524492 - RNA, 15 nt, Human
gacucucugugaccu

SEQ ID NO: 2524493 - RNA, 14 nt, Human
gacucucugugacc

SEQ ID NO: 2524494 - RNA, 16 nt, Human
gacucuuaagaagacu

SEQ ID NO: 2524495 - RNA, 18 nt, Human
gacucuuaagaagacugc

SEQ ID NO: 2524496 - RNA, 17 nt, Human
gacucuuaagaagacug

SEQ ID NO: 2524497 - RNA, 22 nt, Human
gacucugucaauuucccugacu

SEQ ID NO: 2524498 - RNA, 19 nt, Human
gacucuuguuuucaguuuc

SEQ ID NO: 2524499 - RNA, 18 nt, Human
gacucuuugguggcuuug

SEQ ID NO: 2524500 - RNA, 21 nt, Human
gacucuuugguggcuuugcau

SEQ ID NO: 2524501 - RNA, 20 nt, Human
gacucuuugguggcuuugca

SEQ ID NO: 2524502 - RNA, 19 nt, Human
gacucuuugguggcuuugc

SEQ ID NO: 2524503 - RNA, 18 nt, Human
gacucuuuuuguaccugg

SEQ ID NO: 2524504 - RNA, 22 nt, Human
gacucuuuuuagggccaggcag

SEQ ID NO: 2524505 - RNA, 20 nt, Human
gacucuuuuuagggccaggc

SEQ ID NO: 2524506 - RNA, 19 nt, Human
gacucuuuuuagggccagg

SEQ ID NO: 2524507 - RNA, 17 nt, Human
gacucuuuugccauuaa

SEQ ID NO: 2524508 - RNA, 16 nt, Human
gacugaaaaccucucc

SEQ ID NO: 2524509 - RNA, 17 nt, Human
gacugaaaaccucuccu

SEQ ID NO: 2524510 - RNA, 18 nt, Human
gacugaaaaccucuccuc

SEQ ID NO: 2524511 - RNA, 20 nt, Human
gacugaaaaccucuccucau

SEQ ID NO: 2524512 - RNA, 12 nt, Human
gagauuuuccuu

SEQ ID NO: 2524513 - RNA, 12 nt, Human
gagauuuuucau

SEQ ID NO: 2524514 - RNA, 23 nt, Human
gagauuucaucugcucuccuucc

SEQ ID NO: 2524515 - RNA, 18 nt, Human
gagauuucuuguugcuca

SEQ ID NO: 2524516 - RNA, 22 nt, Human
gagauuucaucugcucuccuuc

SEQ ID NO: 2524517 - RNA, 21 nt, Human
gagauuucaucugcucuccuu

SEQ ID NO: 2524518 - RNA, 20 nt, Human
gagauuucaucugcucuccu

SEQ ID NO: 2524519 - RNA, 19 nt, Human
gagauuucaucugcucucc

SEQ ID NO: 2524520 - RNA, 15 nt, Human
gagauuucaagagau

SEQ ID NO: 2524521 - RNA, 17 nt, Human
gagauuucaucugcucu

SEQ ID NO: 2524522 - RNA, 13 nt, Human
gagauuucaucug

SEQ ID NO: 2524523 - RNA, 23 nt, Human
gagauuuaauuaaucaugaaugu

SEQ ID NO: 2524524 - RNA, 20 nt, Human
gagauugagaaggagagaaa

SEQ ID NO: 2524525 - RNA, 18 nt, Human
gagauugagaaggagaga

SEQ ID NO: 2524526 - RNA, 17 nt, Human
gagauugagaaggagag

SEQ ID NO: 2524527 - RNA, 13 nt, Human
gagauugagaagg

SEQ ID NO: 2524528 - RNA, 13 nt, Human
gagauuuacaacu

SEQ ID NO: 2524529 - RNA, 17 nt, Human
gagauucaguuuucauu

SEQ ID NO: 2524530 - RNA, 12 nt, Human
gagaugucuucg

SEQ ID NO: 2524531 - RNA, 16 nt, Human
gagauguaauuguuuu

SEQ ID NO: 2524532 - RNA, 14 nt, Human
gagauguaauuguu

SEQ ID NO: 2524533 - RNA, 15 nt, Human
gagauguagcaaaac

SEQ ID NO: 2524534 - RNA, 21 nt, Human
gagauugcaccacugcacucc

SEQ ID NO: 2524535 - RNA, 18 nt, Human
gagauugcaccacugcac

SEQ ID NO: 2524536 - RNA, 14 nt, Human
gagauguagccccu

SEQ ID NO: 2524537 - RNA, 16 nt, Human
gagauguaaaagguau

SEQ ID NO: 2524538 - RNA, 17 nt, Human
gagauguaaaagguauu

SEQ ID NO: 2524539 - RNA, 14 nt, Human
gagauggggugggg

SEQ ID NO: 2524540 - RNA, 15 nt, Human
gagauggaggaggag

SEQ ID NO: 2524541 - RNA, 15 nt, Human
gagauggccugagaa

SEQ ID NO: 2524542 - RNA, 20 nt, Human
gagaugggaaugagguggga

SEQ ID NO: 2524543 - RNA, 21 nt, Human
gagaugggaaugaggugggag

SEQ ID NO: 2524544 - RNA, 17 nt, Human
gagaugggacugggagg

SEQ ID NO: 2524545 - RNA, 23 nt, Human
gagaugggagcuccucuccugga

SEQ ID NO: 2524546 - RNA, 18 nt, Human
gagaugggcuuguuuucu

SEQ ID NO: 2524547 - RNA, 22 nt, Human
gagaugggagcuccucuccugg

SEQ ID NO: 2524548 - RNA, 15 nt, Human
gagaugggagcuccu

SEQ ID NO: 2524549 - RNA, 14 nt, Human
gagaugggagcucc

SEQ ID NO: 2524550 - RNA, 19 nt, Human
gagaugggacugggagggc

SEQ ID NO: 2524551 - RNA, 20 nt, Human
gagaugaugaaaauauuuaa

SEQ ID NO: 2524552 - RNA, 21 nt, Human
gagaggcaggcauagaggcuu

SEQ ID NO: 2524553 - RNA, 15 nt, Human
gagaggcaggcauag

SEQ ID NO: 2524554 - RNA, 19 nt, Human
gagaugaugaaaauauuua

SEQ ID NO: 2524555 - RNA, 22 nt, Human
gagaggcauccaguaucuugaa

SEQ ID NO: 2524556 - RNA, 14 nt, Human
gagaugcagaggua

SEQ ID NO: 2524557 - RNA, 12 nt, Human
gagaugcagagg

SEQ ID NO: 2524558 - RNA, 21 nt, Human
gagaugcaccaccaagccaag

SEQ ID NO: 2524559 - RNA, 18 nt, Human
gagaugauucagaagggg

SEQ ID NO: 2524560 - RNA, 17 nt, Human
gagaugauucagaaggg

SEQ ID NO: 2524561 - RNA, 18 nt, Human
gagaugcaccaccaagcc

SEQ ID NO: 2524562 - RNA, 21 nt, Human
gagaugaugccaugggcccuc

SEQ ID NO: 2524563 - RNA, 21 nt, Human
gagaugcuggagaagagagga

SEQ ID NO: 2524564 - RNA, 20 nt, Human
gagaugcuggagaagagagg

SEQ ID NO: 2524565 - RNA, 19 nt, Human
gagaugcuggagaagagag

SEQ ID NO: 2524566 - RNA, 19 nt, Human
gagaugccuccaccgcugc

SEQ ID NO: 2524567 - RNA, 13 nt, Human
gagaugcagcugg

SEQ ID NO: 2524568 - RNA, 16 nt, Human
gagaugcagagguaaa

SEQ ID NO: 2524569 - RNA, 23 nt, Human
gagaugcauucuugguuggcugg

SEQ ID NO: 2524570 - RNA, 14 nt, Human
gagaugccuccacc

SEQ ID NO: 2524571 - RNA, 15 nt, Human
gagaugccuccaccg

SEQ ID NO: 2524572 - RNA, 18 nt, Human
gagaugcuggagaagaga

SEQ ID NO: 2524573 - RNA, 20 nt, Human
gagauggaaguugcagugag

SEQ ID NO: 2524574 - RNA, 23 nt, Human
gagauggaacccuuuuggccccc

SEQ ID NO: 2524575 - RNA, 12 nt, Human
gagauggaggag

SEQ ID NO: 2524576 - RNA, 13 nt, Human
gagauggaggagg

SEQ ID NO: 2524577 - RNA, 14 nt, Human
gagauggaggagga

SEQ ID NO: 2524578 - RNA, 18 nt, Human
gagauggaguucuugugc

SEQ ID NO: 2524579 - RNA, 16 nt, Human
gagauggaggaggagg

SEQ ID NO: 2524580 - RNA, 23 nt, Human
gagauggaucaaucaaacccggc

SEQ ID NO: 2524581 - RNA, 16 nt, Human
gagacuccugcaggca

SEQ ID NO: 2524582 - RNA, 15 nt, Human
gagacuccugcaggc

SEQ ID NO: 2524583 - RNA, 15 nt, Human
gagacucaccucugc

SEQ ID NO: 2524584 - RNA, 16 nt, Human
gagacucaccucugcc

SEQ ID NO: 2524585 - RNA, 20 nt, Human
gagacuaugcguuuuuauaa

SEQ ID NO: 2524586 - RNA, 18 nt, Human
gagacuaugcguuuuuau

SEQ ID NO: 2524587 - RNA, 21 nt, Human
gagacuagauuuaugaauaca

SEQ ID NO: 2524588 - RNA, 17 nt, Human
gagacucaccucugccu

SEQ ID NO: 2524589 - RNA, 18 nt, Human
gagacucaccucugccuc

SEQ ID NO: 2524590 - RNA, 19 nt, Human
gagacucaccucugccuca

SEQ ID NO: 2524591 - RNA, 20 nt, Human
gagacucaccucugccucaa

SEQ ID NO: 2524592 - RNA, 23 nt, Human
gagacucaccucugccucaaugu

SEQ ID NO: 2524593 - RNA, 13 nt, Human
gagacucagacag

SEQ ID NO: 2524594 - RNA, 14 nt, Human
gagaggcauccagu

SEQ ID NO: 2524595 - RNA, 16 nt, Human
gagaggcagagagcgg

SEQ ID NO: 2524596 - RNA, 14 nt, Human
gagaggcagagagc

SEQ ID NO: 2524597 - RNA, 13 nt, Human
gagaggcagagag

SEQ ID NO: 2524598 - RNA, 16 nt, Human
gagaggcagagaaaga

SEQ ID NO: 2524599 - RNA, 11 nt, Human
gagaggcaggc

SEQ ID NO: 2524600 - RNA, 12 nt, Human
gagaggcaggca

SEQ ID NO: 2524601 - RNA, 17 nt, Human
gagacuccugcaggcag

SEQ ID NO: 2524602 - RNA, 18 nt, Human
gagacuccugcaggcagc

SEQ ID NO: 2524603 - RNA, 22 nt, Human
gagaggcagacuucccugaaug

SEQ ID NO: 2524604 - RNA, 12 nt, Human
gagaggcagaga

SEQ ID NO: 2524605 - RNA, 15 nt, Human
gagcuggggaccugg

SEQ ID NO: 2524606 - RNA, 13 nt, Human
gagcuggggaccu

SEQ ID NO: 2524607 - RNA, 12 nt, Human
gagcuggggaag

SEQ ID NO: 2524608 - RNA, 19 nt, Human
gagcugggcagaaggccaa

SEQ ID NO: 2524609 - RNA, 22 nt, Human
gagcuggcucugagcgccucca

SEQ ID NO: 2524610 - RNA, 21 nt, Human
gagcugggacacuuaacagau

SEQ ID NO: 2524611 - RNA, 14 nt, Human
gagcugggaggaaa

SEQ ID NO: 2524612 - RNA, 17 nt, Human
gagcugggcagaaggcc

SEQ ID NO: 2524613 - RNA, 18 nt, Human
gagcugggaggcauggcc

SEQ ID NO: 2524614 - RNA, 16 nt, Human
gagcugggauccuaag

SEQ ID NO: 2524615 - RNA, 17 nt, Human
gagcugggaggcauggc

SEQ ID NO: 2524616 - RNA, 12 nt, Human
gagcugggaggc

SEQ ID NO: 2524617 - RNA, 16 nt, Human
gagcugggaggaaaag

SEQ ID NO: 2524618 - RNA, 17 nt, Human
gagcugggaggaaaaga

SEQ ID NO: 2524619 - RNA, 18 nt, Human
gagcugggugucaagagg

SEQ ID NO: 2524620 - RNA, 19 nt, Human
gagcuggggaugucucuca

SEQ ID NO: 2524621 - RNA, 19 nt, Human
gagcuggggaccugguacc

SEQ ID NO: 2524622 - RNA, 18 nt, Human
gagcugggggccaugagc

SEQ ID NO: 2524623 - RNA, 14 nt, Human
gagcuggugcauua

SEQ ID NO: 2524624 - RNA, 16 nt, Human
gagcuggugcauuaca

SEQ ID NO: 2524625 - RNA, 19 nt, Human
gagcugggggccaugagcu

SEQ ID NO: 2524626 - RNA, 24 nt, Human
gagcugggggccaugagcuccaga

SEQ ID NO: 2524627 - RNA, 21 nt, Human
gagcugguaguuaguagcaug

SEQ ID NO: 2524628 - RNA, 11 nt, Human
gagcuggugca

SEQ ID NO: 2524629 - RNA, 21 nt, Human
gagcggagaaaggaagggcug

SEQ ID NO: 2524630 - RNA, 18 nt, Human
gagcggagaaaggaaggg

SEQ ID NO: 2524631 - RNA, 17 nt, Human
gagcgggaccuguggcu

SEQ ID NO: 2524632 - RNA, 16 nt, Human
gagcgggaccuguggc

SEQ ID NO: 2524633 - RNA, 14 nt, Human
gagcgggaccugug

SEQ ID NO: 2524634 - RNA, 14 nt, Human
gagcggucucaggc

SEQ ID NO: 2524635 - RNA, 22 nt, Human
gagcugccuguucagcuccagc

SEQ ID NO: 2524636 - RNA, 21 nt, Human
gagcugccuguucagcuccag

SEQ ID NO: 2524637 - RNA, 17 nt, Human
gagcuggcucugagcgc

SEQ ID NO: 2524638 - RNA, 13 nt, Human
gagcuggcucuga

SEQ ID NO: 2524639 - RNA, 19 nt, Human
gagcugccuucccuagcuu

SEQ ID NO: 2524640 - RNA, 14 nt, Human
gagcugccuucccu

SEQ ID NO: 2524641 - RNA, 23 nt, Human
gagcugccuucccuagcuuuaga

SEQ ID NO: 2524642 - RNA, 13 nt, Human
gagcugccuuccc

SEQ ID NO: 2524643 - RNA, 11 nt, Human
gagcugccuuc

SEQ ID NO: 2524644 - RNA, 16 nt, Human
gagcggucucaggcug

SEQ ID NO: 2524645 - RNA, 20 nt, Human
gagcugccuguucagcucca

SEQ ID NO: 2524646 - RNA, 17 nt, Human
gagccuuccaggggugg

SEQ ID NO: 2524647 - RNA, 16 nt, Human
gagccuuccaggggug

SEQ ID NO: 2524648 - RNA, 15 nt, Human
gagccuuccaggggu

SEQ ID NO: 2524649 - RNA, 14 nt, Human
gagccuuccagggg

SEQ ID NO: 2524650 - RNA, 22 nt, Human
gagccuugaacuuugaccucug

SEQ ID NO: 2524651 - RNA, 19 nt, Human
gagccuugaacuuugaccu

SEQ ID NO: 2524652 - RNA, 22 nt, Human
gagcccccccaacacugugccc

SEQ ID NO: 2524653 - RNA, 17 nt, Human
gagcccccgccccgccc

SEQ ID NO: 2524654 - RNA, 21 nt, Human
gagcccccgccccgccccaca

SEQ ID NO: 2524655 - RNA, 22 nt, Human
gagcccccgccccgccccacau

SEQ ID NO: 2524656 - RNA, 23 nt, Human
gagccuuuucccucuuuggcucc

SEQ ID NO: 2524657 - RNA, 23 nt, Human
gagccuuugguucuggccagaau

SEQ ID NO: 2524658 - RNA, 13 nt, Human
gagcgaaacuccg

SEQ ID NO: 2524659 - RNA, 18 nt, Human
gagccuuugguucuggcc

SEQ ID NO: 2524660 - RNA, 22 nt, Human
gagccuugguguccaccuggcc

SEQ ID NO: 2524661 - RNA, 17 nt, Human
gagccuuuggaugacca

SEQ ID NO: 2524662 - RNA, 19 nt, Human
gagccuugguguccaccug

SEQ ID NO: 2524663 - RNA, 20 nt, Human
gagccuugguguccaccugg

SEQ ID NO: 2524664 - RNA, 22 nt, Human
gagcagggauuaaccucugcac

SEQ ID NO: 2524665 - RNA, 21 nt, Human
gagcagggauuaaccucugca

SEQ ID NO: 2524666 - RNA, 20 nt, Human
gagcagggauuaaccucugc

SEQ ID NO: 2524667 - RNA, 14 nt, Human
gagcagggcucagc

SEQ ID NO: 2524668 - RNA, 22 nt, Human
gagcaggcuggcagcucuccag

SEQ ID NO: 2524669 - RNA, 21 nt, Human
gagcaggcuggcagcucucca

SEQ ID NO: 2524670 - RNA, 20 nt, Human
gagcaggcuggcagcucucc

SEQ ID NO: 2524671 - RNA, 19 nt, Human
gagcaggcuggcagcucuc

SEQ ID NO: 2524672 - RNA, 18 nt, Human
gagcaggcuggcagcucu

SEQ ID NO: 2524673 - RNA, 17 nt, Human
gagcaugggccuggcca

SEQ ID NO: 2524674 - RNA, 13 nt, Human
gagccccagcccc

SEQ ID NO: 2524675 - RNA, 12 nt, Human
gagccccagccc

SEQ ID NO: 2524676 - RNA, 17 nt, Human
gagccccaggccucugu

SEQ ID NO: 2524677 - RNA, 16 nt, Human
gagccccaggccucug

SEQ ID NO: 2524678 - RNA, 13 nt, Human
gagccccaggccu

SEQ ID NO: 2524679 - RNA, 14 nt, Human
gagccccagcugac

SEQ ID NO: 2524680 - RNA, 13 nt, Human
gagccccagcuga

SEQ ID NO: 2524681 - RNA, 19 nt, Human
gagccccagcccccuuugg

SEQ ID NO: 2524682 - RNA, 16 nt, Human
gagccccagcuacccu

SEQ ID NO: 2524683 - RNA, 18 nt, Human
gagccccaggccucugug

SEQ ID NO: 2524684 - RNA, 12 nt, Human
gagccccagggu

SEQ ID NO: 2524685 - RNA, 13 nt, Human
gagccccaggguc

SEQ ID NO: 2524686 - RNA, 14 nt, Human
gagccccagggucu

SEQ ID NO: 2524687 - RNA, 13 nt, Human
gagcccccccaac

SEQ ID NO: 2524688 - RNA, 17 nt, Human
gagccccagugccaagc

SEQ ID NO: 2524689 - RNA, 17 nt, Human
gagccccauuccuggga

SEQ ID NO: 2524690 - RNA, 18 nt, Human
gagccccauuccugggaa

SEQ ID NO: 2524691 - RNA, 16 nt, Human
gagccccauuccuggg

SEQ ID NO: 2524692 - RNA, 12 nt, Human
gagccccagugc

SEQ ID NO: 2524693 - RNA, 14 nt, Human
gagccccagugcca

SEQ ID NO: 2524694 - RNA, 18 nt, Human
gagccccaucagcuccag

SEQ ID NO: 2524695 - RNA, 19 nt, Human
gagccccagggucuucccu

SEQ ID NO: 2524696 - RNA, 24 nt, Human
gagccccagggucuucccuaccuc

SEQ ID NO: 2524697 - RNA, 14 nt, Human
gagcauagaaggca

SEQ ID NO: 2524698 - RNA, 22 nt, Human
gagcaguuucuguccugcuggu

SEQ ID NO: 2524699 - RNA, 16 nt, Human
gagcauagaaggcagg

SEQ ID NO: 2524700 - RNA, 12 nt, Human
gagcaucaggcc

SEQ ID NO: 2524701 - RNA, 17 nt, Human
gagcagugucuuccaua

SEQ ID NO: 2524702 - RNA, 21 nt, Human
gagcauaauaaauggaugagg

SEQ ID NO: 2524703 - RNA, 21 nt, Human
gagcaguuucuguccugcugg

SEQ ID NO: 2524704 - RNA, 20 nt, Human
gagcaguuucuguccugcug

SEQ ID NO: 2524705 - RNA, 18 nt, Human
gagcagugucuuccauaa

SEQ ID NO: 2524706 - RNA, 19 nt, Human
gagcagugucuuccauaau

SEQ ID NO: 2524707 - RNA, 17 nt, Human
gagcaguuucuguccug

SEQ ID NO: 2524708 - RNA, 14 nt, Human
gagcauggagcugg

SEQ ID NO: 2524709 - RNA, 22 nt, Human
gagcaugccuggauggggcugc

SEQ ID NO: 2524710 - RNA, 15 nt, Human
gagcaugggccuggc

SEQ ID NO: 2524711 - RNA, 21 nt, Human
gagcauggcugugaggauggg

SEQ ID NO: 2524712 - RNA, 19 nt, Human
gagcauggcugugaggaug

SEQ ID NO: 2524713 - RNA, 16 nt, Human
gagcauggcugugagg

SEQ ID NO: 2524714 - RNA, 14 nt, Human
gagcauggcuguga

SEQ ID NO: 2524715 - RNA, 17 nt, Human
gagcauggagcuggccg

SEQ ID NO: 2524716 - RNA, 15 nt, Human
gagcauggagcuggc

SEQ ID NO: 2524717 - RNA, 21 nt, Human
gagcauggggauaaaggagaa

SEQ ID NO: 2524718 - RNA, 22 nt, Human
gagcauggggauaaaggagaag

SEQ ID NO: 2524719 - RNA, 22 nt, Human
gagcauguacugagccuuguaa

SEQ ID NO: 2524720 - RNA, 17 nt, Human
gaaguguaggcagacac

SEQ ID NO: 2524721 - RNA, 16 nt, Human
gaaguguaggcagaca

SEQ ID NO: 2524722 - RNA, 11 nt, Human
gaagugugauu

SEQ ID NO: 2524723 - RNA, 23 nt, Human
gaagugugauugggaauaaauau

SEQ ID NO: 2524724 - RNA, 20 nt, Human
gaagugugauugggaauaaa

SEQ ID NO: 2524725 - RNA, 18 nt, Human
gaaguguaggcagacaca

SEQ ID NO: 2524726 - RNA, 17 nt, Human
gaaguguaacagcugag

SEQ ID NO: 2524727 - RNA, 18 nt, Human
gaaguguaacagcugagg

SEQ ID NO: 2524728 - RNA, 15 nt, Human
gaaguguaggcagac

SEQ ID NO: 2524729 - RNA, 23 nt, Human
gaaguguaacagcugaggucucu

SEQ ID NO: 2524730 - RNA, 17 nt, Human
gaagugugggucugugu

SEQ ID NO: 2524731 - RNA, 18 nt, Human
gaagugugggucugugug

SEQ ID NO: 2524732 - RNA, 19 nt, Human
gaagugugggucugugugu

SEQ ID NO: 2524733 - RNA, 22 nt, Human
gaaugaaugucagugugacuga

SEQ ID NO: 2524734 - RNA, 18 nt, Human
gaaugaaugucaguguga

SEQ ID NO: 2524735 - RNA, 14 nt, Human
gaaugaaugucagu

SEQ ID NO: 2524736 - RNA, 11 nt, Human
gaaugaauguc

SEQ ID NO: 2524737 - RNA, 16 nt, Human
gaaugacaacagaagc

SEQ ID NO: 2524738 - RNA, 16 nt, Human
gaaugaauuaaauaaa

SEQ ID NO: 2524739 - RNA, 13 nt, Human
gaaugacaaagag

SEQ ID NO: 2524740 - RNA, 14 nt, Human
gaaugaauuaaaua

SEQ ID NO: 2524741 - RNA, 20 nt, Human
gaaugagagacacacugaag

SEQ ID NO: 2524742 - RNA, 18 nt, Human
gaaugaccuuguugcaug

SEQ ID NO: 2524743 - RNA, 23 nt, Human
gaaugagagacacacugaagaag

SEQ ID NO: 2524744 - RNA, 22 nt, Human
gaaugagagacacacugaagaa

SEQ ID NO: 2524745 - RNA, 11 nt, Human
gaaugagccuc

SEQ ID NO: 2524746 - RNA, 13 nt, Human
gaaugagccucgg

SEQ ID NO: 2524747 - RNA, 22 nt, Human
gaaugagccuacgcugaagaug

SEQ ID NO: 2524748 - RNA, 20 nt, Human
gaaugagccuacgcugaaga

SEQ ID NO: 2524749 - RNA, 14 nt, Human
gaaugagaguguga

SEQ ID NO: 2524750 - RNA, 17 nt, Human
gaaauccauccagaggc

SEQ ID NO: 2524751 - RNA, 14 nt, Human
gaaauccauucaca

SEQ ID NO: 2524752 - RNA, 18 nt, Human
gaaauccagggugguggu

SEQ ID NO: 2524753 - RNA, 13 nt, Human
gaaauccagggug

SEQ ID NO: 2524754 - RNA, 19 nt, Human
gaagcucagggccuggcuc

SEQ ID NO: 2524755 - RNA, 18 nt, Human
gaagcucagggccuggcu

SEQ ID NO: 2524756 - RNA, 17 nt, Human
gaagcucagggccuggc

SEQ ID NO: 2524757 - RNA, 16 nt, Human
gaagcucagggccugg

SEQ ID NO: 2524758 - RNA, 21 nt, Human
gaagcucagggccuggcucag

SEQ ID NO: 2524759 - RNA, 20 nt, Human
gaagcucagggccuggcuca

SEQ ID NO: 2524760 - RNA, 23 nt, Human
gaagcuccacugucacccuccac

SEQ ID NO: 2524761 - RNA, 19 nt, Human
gaagcuccacugucacccu

SEQ ID NO: 2524762 - RNA, 18 nt, Human
gaagcuccacugucaccc

SEQ ID NO: 2524763 - RNA, 16 nt, Human
gaagcuccacugucac

SEQ ID NO: 2524764 - RNA, 15 nt, Human
gaagcuccacuguca

SEQ ID NO: 2524765 - RNA, 14 nt, Human
gaagcuccacuguc

SEQ ID NO: 2524766 - RNA, 13 nt, Human
gaagcuccacugu

SEQ ID NO: 2524767 - RNA, 23 nt, Human
gaagcucagggccuggcucaggu

SEQ ID NO: 2524768 - RNA, 15 nt, Human
gaagcucagggccug

SEQ ID NO: 2524769 - RNA, 14 nt, Human
gaagcucagggccu

SEQ ID NO: 2524770 - RNA, 22 nt, Human
gaagcuacagguuacaacagau

SEQ ID NO: 2524771 - RNA, 21 nt, Human
gaagcuacagguuacaacaga

SEQ ID NO: 2524772 - RNA, 15 nt, Human
gaagcuacugugugu

SEQ ID NO: 2524773 - RNA, 20 nt, Human
gaagcuacugugugugugaa

SEQ ID NO: 2524774 - RNA, 22 nt, Human
gaagcuacugugugugugaaug

SEQ ID NO: 2524775 - RNA, 23 nt, Human
gaagcuacugugugugugaauga

SEQ ID NO: 2524776 - RNA, 23 nt, Human
gaagcuacagguuacaacagauu

SEQ ID NO: 2524777 - RNA, 22 nt, Human
gaagcucagcccaccccccuca

SEQ ID NO: 2524778 - RNA, 21 nt, Human
gaagcucagcccaccccccuc

SEQ ID NO: 2524779 - RNA, 14 nt, Human
gaagcuaauuugca

SEQ ID NO: 2524780 - RNA, 15 nt, Human
gaagcuaauuugcau

SEQ ID NO: 2524781 - RNA, 16 nt, Human
gaagcuaauuugcauu

SEQ ID NO: 2524782 - RNA, 17 nt, Human
gaagcuaauuugcauua

SEQ ID NO: 2524783 - RNA, 19 nt, Human
gaagcuacagguuacaaca

SEQ ID NO: 2524784 - RNA, 15 nt, Human
gaagcuacagguuac

SEQ ID NO: 2524785 - RNA, 14 nt, Human
gaagcuacagguua

SEQ ID NO: 2524786 - RNA, 16 nt, Human
gaagugaggaagccag

SEQ ID NO: 2524787 - RNA, 18 nt, Human
gaagugagcuuugcugcu

SEQ ID NO: 2524788 - RNA, 16 nt, Human
gaagugagcacagccu

SEQ ID NO: 2524789 - RNA, 21 nt, Human
gaagugacuuuggcugcaugc

SEQ ID NO: 2524790 - RNA, 15 nt, Human
gaagugacuuuggcu

SEQ ID NO: 2524791 - RNA, 20 nt, Human
gaagugacuuuggcugcaug

SEQ ID NO: 2524792 - RNA, 13 nt, Human
gaagugacuuugg

SEQ ID NO: 2524793 - RNA, 14 nt, Human
gaagugaggcauug

SEQ ID NO: 2524794 - RNA, 18 nt, Human
gaagugcaaauuugauac

SEQ ID NO: 2524795 - RNA, 14 nt, Human
gaagugcauccaaa

SEQ ID NO: 2524796 - RNA, 13 nt, Human
gaagugccccugc

SEQ ID NO: 2524797 - RNA, 14 nt, Human
gaagugccccugcu

SEQ ID NO: 2524798 - RNA, 15 nt, Human
gaagugccccugcug

SEQ ID NO: 2524799 - RNA, 18 nt, Human
gaagugccccugcugccu

SEQ ID NO: 2524800 - RNA, 22 nt, Human
gaagugccccugcugccucccc

SEQ ID NO: 2524801 - RNA, 15 nt, Human
gaaguggggacagag

SEQ ID NO: 2524802 - RNA, 14 nt, Human
gaaguguaacagcu

SEQ ID NO: 2524803 - RNA, 15 nt, Human
gaaguguaacagcug

SEQ ID NO: 2524804 - RNA, 16 nt, Human
gaaguguaacagcuga

SEQ ID NO: 2524805 - RNA, 20 nt, Human
gaaguggacuggccccuggg

SEQ ID NO: 2524806 - RNA, 18 nt, Human
gaaguggacuggccccug

SEQ ID NO: 2524807 - RNA, 17 nt, Human
gaaguggacuggccccu

SEQ ID NO: 2524808 - RNA, 22 nt, Human
gaaguggaccaggacaggacca

SEQ ID NO: 2524809 - RNA, 16 nt, Human
gaagugggccaggaca

SEQ ID NO: 2524810 - RNA, 18 nt, Human
gaagugggccaggacagg

SEQ ID NO: 2524811 - RNA, 19 nt, Human
gaagugggccaggacaggc

SEQ ID NO: 2524812 - RNA, 21 nt, Human
gaagugggccaggacaggccc

SEQ ID NO: 2524813 - RNA, 20 nt, Human
gaagugcuggcaaccacuaa

SEQ ID NO: 2524814 - RNA, 23 nt, Human
gaagugccccugcugccucccca

SEQ ID NO: 2524815 - RNA, 21 nt, Human
gaagugcuuaguguacuugga

SEQ ID NO: 2524816 - RNA, 16 nt, Human
gaaguggaccaggaca

SEQ ID NO: 2524817 - RNA, 18 nt, Human
gaaguggaccaggacagg

SEQ ID NO: 2524818 - RNA, 20 nt, Human
gaagucuuuguacagacaac

SEQ ID NO: 2524819 - RNA, 19 nt, Human
gaagucuuuguacagacaa

SEQ ID NO: 2524820 - RNA, 18 nt, Human
gaagucuuuguacagaca

SEQ ID NO: 2524821 - RNA, 19 nt, Human
gaagggcagggcugaggcc

SEQ ID NO: 2524822 - RNA, 23 nt, Human
gaagggcaggaaggagagccugc

SEQ ID NO: 2524823 - RNA, 18 nt, Human
gaagggcaucaugcaucu

SEQ ID NO: 2524824 - RNA, 17 nt, Human
gaagugaaugcugggac

SEQ ID NO: 2524825 - RNA, 10 nt, Human
gaagggccag

SEQ ID NO: 2524826 - RNA, 18 nt, Human
gaagugacaaggccccag

SEQ ID NO: 2524827 - RNA, 21 nt, Human
gaagugacaaggccccagaga

SEQ ID NO: 2524828 - RNA, 23 nt, Human
gaagugacaaggccccagagacu

SEQ ID NO: 2524829 - RNA, 12 nt, Human
gaagugacaggg

SEQ ID NO: 2524830 - RNA, 24 nt, Human
gaagugacaaggccccagagacuc

SEQ ID NO: 2524831 - RNA, 18 nt, Human
gaagugacagggaagcua

SEQ ID NO: 2524832 - RNA, 15 nt, Human
gaagugacagggaag

SEQ ID NO: 2524833 - RNA, 14 nt, Human
gaagugacagggaa

SEQ ID NO: 2524834 - RNA, 13 nt, Human
gaagugacaggga

SEQ ID NO: 2524835 - RNA, 21 nt, Human
gaagugacagggaagcuacag

SEQ ID NO: 2524836 - RNA, 20 nt, Human
gaagugacagggaagcuaca

SEQ ID NO: 2524837 - RNA, 22 nt, Human
gaagugacagggaagcuacagg

SEQ ID NO: 2524838 - RNA, 14 nt, Human
gaagugaaacugcu

SEQ ID NO: 2524839 - RNA, 14 nt, Human
gaagucuuuuguuc

SEQ ID NO: 2524840 - RNA, 19 nt, Human
gaagggcauccuucugccu

SEQ ID NO: 2524841 - RNA, 20 nt, Human
gaagggauuuuagucacacg

SEQ ID NO: 2524842 - RNA, 16 nt, Human
gaagugaaugcuggga

SEQ ID NO: 2524843 - RNA, 15 nt, Human
gaagugaaugcuggg

SEQ ID NO: 2524844 - RNA, 14 nt, Human
gaagugaacauuuc

SEQ ID NO: 2524845 - RNA, 17 nt, Human
gaagcuggccgaggguc

SEQ ID NO: 2524846 - RNA, 23 nt, Human
gaagcuggccgaggguccuggcu

SEQ ID NO: 2524847 - RNA, 18 nt, Human
gaagcugcucuggaauuu

SEQ ID NO: 2524848 - RNA, 17 nt, Human
gaagcugcucuggaauu

SEQ ID NO: 2524849 - RNA, 13 nt, Human
gaagcugcuccgu

SEQ ID NO: 2524850 - RNA, 16 nt, Human
gaagcugcccugccca

SEQ ID NO: 2524851 - RNA, 13 nt, Human
gaagcugccugcu

SEQ ID NO: 2524852 - RNA, 14 nt, Human
gaagcugccugcuu

SEQ ID NO: 2524853 - RNA, 15 nt, Human
gaagcucccaggaac

SEQ ID NO: 2524854 - RNA, 14 nt, Human
gaagcucccaggaa

SEQ ID NO: 2524855 - RNA, 17 nt, Human
gaaggcucgagcaugcc

SEQ ID NO: 2524856 - RNA, 16 nt, Human
gaaggcucgagcaugc

SEQ ID NO: 2524857 - RNA, 22 nt, Human
gaagcuguguccuugcaccugc

SEQ ID NO: 2524858 - RNA, 12 nt, Human
gaagcugugucc

SEQ ID NO: 2524859 - RNA, 17 nt, Human
gaagcuguguccuugca

SEQ ID NO: 2524860 - RNA, 20 nt, Human
gaagcuguguccuugcaccu

SEQ ID NO: 2524861 - RNA, 21 nt, Human
gaagcugucauaaaaagacaa

SEQ ID NO: 2524862 - RNA, 23 nt, Human
gaagcuguaguagcccuuucugu

SEQ ID NO: 2524863 - RNA, 15 nt, Human
gaaggcuauggggau

SEQ ID NO: 2524864 - RNA, 17 nt, Human
gaagggaccuugaaggg

SEQ ID NO: 2524865 - RNA, 22 nt, Human
gaagggaccaaggcaaggcagg

SEQ ID NO: 2524866 - RNA, 21 nt, Human
gaagggaccaaggcaaggcag

SEQ ID NO: 2524867 - RNA, 20 nt, Human
gaagggaccaaggcaaggca

SEQ ID NO: 2524868 - RNA, 20 nt, Human
gaagggaccuugaaggguaa

SEQ ID NO: 2524869 - RNA, 18 nt, Human
gaagggaccuugaagggu

SEQ ID NO: 2524870 - RNA, 16 nt, Human
gaagggagaagaaagg

SEQ ID NO: 2524871 - RNA, 15 nt, Human
gaagggaccaaggca

SEQ ID NO: 2524872 - RNA, 21 nt, Human
gaagggagaaggaucuagaau

SEQ ID NO: 2524873 - RNA, 12 nt, Human
gaagggagaagg

SEQ ID NO: 2524874 - RNA, 21 nt, Human
gaagggacuaggagcacugua

SEQ ID NO: 2524875 - RNA, 16 nt, Human
gaagggagagccagcu

SEQ ID NO: 2524876 - RNA, 13 nt, Human
gaagggaggcugg

SEQ ID NO: 2524877 - RNA, 10 nt, Human
gaagggaggu

SEQ ID NO: 2524878 - RNA, 22 nt, Human
gaagggcaggaaggagagccug

SEQ ID NO: 2524879 - RNA, 14 nt, Human
gaagggaggugggg

SEQ ID NO: 2524880 - RNA, 17 nt, Human
gaagggauggauuccaa

SEQ ID NO: 2524881 - RNA, 14 nt, Human
gacauucaccugcc

SEQ ID NO: 2524882 - RNA, 18 nt, Human
gacauuaacaguuuucca

SEQ ID NO: 2524883 - RNA, 19 nt, Human
gacauuaacaguuuuccau

SEQ ID NO: 2524884 - RNA, 22 nt, Human
gacauuaacaguuuuccaugaa

SEQ ID NO: 2524885 - RNA, 23 nt, Human
gacauuaacaguuuuccaugaaa

SEQ ID NO: 2524886 - RNA, 15 nt, Human
gacauucaccugccc

SEQ ID NO: 2524887 - RNA, 16 nt, Human
gacauucaccugcccc

SEQ ID NO: 2524888 - RNA, 17 nt, Human
gacauucaccugcccca

SEQ ID NO: 2524889 - RNA, 19 nt, Human
gacagccuggcacagggca

SEQ ID NO: 2524890 - RNA, 13 nt, Human
gacagccuggcac

SEQ ID NO: 2524891 - RNA, 15 nt, Human
gacagacacacacac

SEQ ID NO: 2524892 - RNA, 13 nt, Human
gacagacacacac

SEQ ID NO: 2524893 - RNA, 11 nt, Human
gacagcuccuu

SEQ ID NO: 2524894 - RNA, 12 nt, Human
gacagcuccacc

SEQ ID NO: 2524895 - RNA, 11 nt, Human
gacagccugua

SEQ ID NO: 2524896 - RNA, 20 nt, Human
gacagccuguggcggugccu

SEQ ID NO: 2524897 - RNA, 22 nt, Human
gacagccuguggcggugccugg

SEQ ID NO: 2524898 - RNA, 23 nt, Human
gacagccuguggcggugccuggg

SEQ ID NO: 2524899 - RNA, 22 nt, Human
gacaggguuuugccauguuggc

SEQ ID NO: 2524900 - RNA, 20 nt, Human
gacaggguuuugccauguug

SEQ ID NO: 2524901 - RNA, 18 nt, Human
gacagcuccacccuggcc

SEQ ID NO: 2524902 - RNA, 16 nt, Human
gacagcucccucugcc

SEQ ID NO: 2524903 - RNA, 14 nt, Human
gacagguaaauuaa

SEQ ID NO: 2524904 - RNA, 23 nt, Human
gacaggguuuggcugugucuaaa

SEQ ID NO: 2524905 - RNA, 17 nt, Human
gacagcucccucugccu

SEQ ID NO: 2524906 - RNA, 18 nt, Human
gacagcucccucugccug

SEQ ID NO: 2524907 - RNA, 17 nt, Human
gacaggucccucaccca

SEQ ID NO: 2524908 - RNA, 16 nt, Human
gacaggugugccgaca

SEQ ID NO: 2524909 - RNA, 14 nt, Human
gacagugaaagaaa

SEQ ID NO: 2524910 - RNA, 23 nt, Human
gacagucuuuggguaccuauuuu

SEQ ID NO: 2524911 - RNA, 15 nt, Human
gacagucuugugcuu

SEQ ID NO: 2524912 - RNA, 23 nt, Human
gacauuaaaucuaugaaguauau

SEQ ID NO: 2524913 - RNA, 12 nt, Human
gacauuaacagu

SEQ ID NO: 2524914 - RNA, 18 nt, Human
gacauguuuuuguuuucu

SEQ ID NO: 2524915 - RNA, 14 nt, Human
gacauuaacaguuu

SEQ ID NO: 2524916 - RNA, 17 nt, Human
gacauuaacaguuuucc

SEQ ID NO: 2524917 - RNA, 13 nt, Human
gacagucucacuu

SEQ ID NO: 2524918 - RNA, 24 nt, Human
gacaguccucuccaccuaguggcu

SEQ ID NO: 2524919 - RNA, 13 nt, Human
gacagucuugugc

SEQ ID NO: 2524920 - RNA, 23 nt, Human
gacaguccugggagaaccucagg

SEQ ID NO: 2524921 - RNA, 15 nt, Human
gacaguccugggaga

SEQ ID NO: 2524922 - RNA, 18 nt, Human
gacaguccugggagaacc

SEQ ID NO: 2524923 - RNA, 17 nt, Human
gacagucaccucaugga

SEQ ID NO: 2524924 - RNA, 17 nt, Human
gacaguccucuccaccu

SEQ ID NO: 2524925 - RNA, 21 nt, Human
gacaggguuuggcugugucua

SEQ ID NO: 2524926 - RNA, 16 nt, Human
gacaguccucuccacc

SEQ ID NO: 2524927 - RNA, 16 nt, Human
gacagucaccccagga

SEQ ID NO: 2524928 - RNA, 14 nt, Human
gacagucaccccag

SEQ ID NO: 2524929 - RNA, 13 nt, Human
gacaguccuggga

SEQ ID NO: 2524930 - RNA, 14 nt, Human
gacaguccugggag

SEQ ID NO: 2524931 - RNA, 15 nt, Human
gacaguauuuguggg

SEQ ID NO: 2524932 - RNA, 22 nt, Human
gacagucaaggaguggcuuacu

SEQ ID NO: 2524933 - RNA, 19 nt, Human
gacagucaaggaguggcuu

SEQ ID NO: 2524934 - RNA, 17 nt, Human
gacagucaaggaguggc

SEQ ID NO: 2524935 - RNA, 16 nt, Human
gacagucaaggagugg

SEQ ID NO: 2524936 - RNA, 23 nt, Human
gacacugugcccagcccggaccu

SEQ ID NO: 2524937 - RNA, 16 nt, Human
gacacugugcccagcc

SEQ ID NO: 2524938 - RNA, 20 nt, Human
gacacugugcccagcccgga

SEQ ID NO: 2524939 - RNA, 16 nt, Human
gacacuuaaaaauggu

SEQ ID NO: 2524940 - RNA, 16 nt, Human
gacacugccacacagg

SEQ ID NO: 2524941 - RNA, 13 nt, Human
gacacuguacaag

SEQ ID NO: 2524942 - RNA, 12 nt, Human
gacacuguacaa

SEQ ID NO: 2524943 - RNA, 15 nt, Human
gacacugaugggcaa

SEQ ID NO: 2524944 - RNA, 13 nt, Human
gacacucugcucu

SEQ ID NO: 2524945 - RNA, 13 nt, Human
gacacugaugggc

SEQ ID NO: 2524946 - RNA, 15 nt, Human
gacacucuggcuggu

SEQ ID NO: 2524947 - RNA, 16 nt, Human
gacacucugcucugcc

SEQ ID NO: 2524948 - RNA, 15 nt, Human
gacacucugcucugc

SEQ ID NO: 2524949 - RNA, 17 nt, Human
gacacucugcucugccc

SEQ ID NO: 2524950 - RNA, 23 nt, Human
gacacugaaauauacacacagca

SEQ ID NO: 2524951 - RNA, 23 nt, Human
gacagcccgggcucugccuccca

SEQ ID NO: 2524952 - RNA, 22 nt, Human
gacagcccgggcucugccuccc

SEQ ID NO: 2524953 - RNA, 21 nt, Human
gacagcccgggcucugccucc

SEQ ID NO: 2524954 - RNA, 12 nt, Human
gacagacacagg

SEQ ID NO: 2524955 - RNA, 17 nt, Human
gacagaagcaggcugga

SEQ ID NO: 2524956 - RNA, 16 nt, Human
gacagaagcaggcugg

SEQ ID NO: 2524957 - RNA, 15 nt, Human
gacagaagcaggcug

SEQ ID NO: 2524958 - RNA, 13 nt, Human
gacagaagcaggc

SEQ ID NO: 2524959 - RNA, 20 nt, Human
gacacuuaauacuaccuuga

SEQ ID NO: 2524960 - RNA, 19 nt, Human
gacacuguuuacaagaaaa

SEQ ID NO: 2524961 - RNA, 22 nt, Human
gacacuguuuacaagaaaaaau

SEQ ID NO: 2524962 - RNA, 23 nt, Human
gacagacaacacugggaaacaga

SEQ ID NO: 2524963 - RNA, 12 nt, Human
gacacacaugaa

SEQ ID NO: 2524964 - RNA, 21 nt, Human
gacacacagcucuguccuggg

SEQ ID NO: 2524965 - RNA, 13 nt, Human
gacacacugaaga

SEQ ID NO: 2524966 - RNA, 16 nt, Human
gacaaacaccucccag

SEQ ID NO: 2524967 - RNA, 15 nt, Human
gacacacgcacacac

SEQ ID NO: 2524968 - RNA, 14 nt, Human
gacacacugaagaa

SEQ ID NO: 2524969 - RNA, 23 nt, Human
gaauuuuggcugugucucccuuc

SEQ ID NO: 2524970 - RNA, 20 nt, Human
gaauuuugugcccccaugua

SEQ ID NO: 2524971 - RNA, 21 nt, Human
gaauuuugugcccccauguaa

SEQ ID NO: 2524972 - RNA, 17 nt, Human
gaauuuucuguguuuug

SEQ ID NO: 2524973 - RNA, 22 nt, Human
gaauuuucuuuuuaauaaaaag

SEQ ID NO: 2524974 - RNA, 14 nt, Human
gaauuuuucucuaa

SEQ ID NO: 2524975 - RNA, 14 nt, Human
gaauuuuuauuauu

SEQ ID NO: 2524976 - RNA, 16 nt, Human
gacaaaaaguuuccau

SEQ ID NO: 2524977 - RNA, 16 nt, Human
gaauuuuucauugaua

SEQ ID NO: 2524978 - RNA, 21 nt, Human
gacaaaaaugaacugaaguuu

SEQ ID NO: 2524979 - RNA, 15 nt, Human
gaauuuuguugcugu

SEQ ID NO: 2524980 - RNA, 22 nt, Human
gaauuuuguuuggacuucuuuu

SEQ ID NO: 2524981 - RNA, 19 nt, Human
gacacacagcucuguccug

SEQ ID NO: 2524982 - RNA, 18 nt, Human
gacacacagcucuguccu

SEQ ID NO: 2524983 - RNA, 17 nt, Human
gacacacagcucugucc

SEQ ID NO: 2524984 - RNA, 15 nt, Human
gacacacagcucugu

SEQ ID NO: 2524985 - RNA, 15 nt, Human
gacaaaacuagagac

SEQ ID NO: 2524986 - RNA, 18 nt, Human
gacaaaaaguuuccauau

SEQ ID NO: 2524987 - RNA, 21 nt, Human
gacaaaaauucaacucagacu

SEQ ID NO: 2524988 - RNA, 14 nt, Human
gacacacagcucug

SEQ ID NO: 2524989 - RNA, 19 nt, Human
gaauuuuggcugugucucc

SEQ ID NO: 2524990 - RNA, 21 nt, Human
gaauuuucuuuguguagcuuu

SEQ ID NO: 2524991 - RNA, 23 nt, Human
gaauuuucuuuguguagcuuugc

SEQ ID NO: 2524992 - RNA, 14 nt, Human
gaauuuucccacug

SEQ ID NO: 2524993 - RNA, 13 nt, Human
gaauuuucugugu

SEQ ID NO: 2524994 - RNA, 14 nt, Human
gaauuuucagaccc

SEQ ID NO: 2524995 - RNA, 23 nt, Human
gaauuuucagaccccagcggcug

SEQ ID NO: 2524996 - RNA, 21 nt, Human
gaauuuuauuuuuugggaaaa

SEQ ID NO: 2524997 - RNA, 22 nt, Human
gaauuuucacaugaacauacug

SEQ ID NO: 2524998 - RNA, 12 nt, Human
gaauuuuaaaag

SEQ ID NO: 2524999 - RNA, 15 nt, Human
gaauuuuaaaagaug

SEQ ID NO: 2525000 - RNA, 21 nt, Human
gaauuuuaaaagaugcaaugu

SEQ ID NO: 2525001 - RNA, 23 nt, Human
gaauuuuaaaagaugcaauguag

SEQ ID NO: 2525002 - RNA, 23 nt, Human
gaauuuuacuguguuucuuuugg

SEQ ID NO: 2525003 - RNA, 15 nt, Human
gaauuuuaagugcuu

SEQ ID NO: 2525004 - RNA, 11 nt, Human
gaauuaguuuu

SEQ ID NO: 2525005 - RNA, 16 nt, Human
gaaugaggucccaggc

SEQ ID NO: 2525006 - RNA, 17 nt, Human
gaaugaggucccaggca

SEQ ID NO: 2525007 - RNA, 18 nt, Human
gaaugaggucccaggcag

SEQ ID NO: 2525008 - RNA, 19 nt, Human
gaaugaggucccaggcaga

SEQ ID NO: 2525009 - RNA, 23 nt, Human
gaaugaggaauaauaaguuaaac

SEQ ID NO: 2525010 - RNA, 13 nt, Human
gaaugaggaggaa

SEQ ID NO: 2525011 - RNA, 14 nt, Human
gaaugaggaggaag

SEQ ID NO: 2525012 - RNA, 17 nt, Human
gaaugaggcuugcugag

SEQ ID NO: 2525013 - RNA, 15 nt, Human
gaaugaggcuugcug

SEQ ID NO: 2525014 - RNA, 14 nt, Human
gaaugaggcuugcu

SEQ ID NO: 2525015 - RNA, 20 nt, Human
gaaugaggaggaaggagaga

SEQ ID NO: 2525016 - RNA, 18 nt, Human
gaaugaggcuugcugaga

SEQ ID NO: 2525017 - RNA, 14 nt, Human
gaaugaggucccag

SEQ ID NO: 2525018 - RNA, 15 nt, Human
gaaugaggucccagg

SEQ ID NO: 2525019 - RNA, 21 nt, Human
gaaugaggucccaggcagaga

SEQ ID NO: 2525020 - RNA, 22 nt, Human
gaaugaggucccaggcagagaa

SEQ ID NO: 2525021 - RNA, 18 nt, Human
gaauuaguccuugcuugg

SEQ ID NO: 2525022 - RNA, 14 nt, Human
gaaugaggugggag

SEQ ID NO: 2525023 - RNA, 13 nt, Human
gaauuuguuauca

SEQ ID NO: 2525024 - RNA, 15 nt, Human
gaauuuuaaaaauga

SEQ ID NO: 2525025 - RNA, 22 nt, Human
gaauuaucuauacauaucuuua

SEQ ID NO: 2525026 - RNA, 20 nt, Human
gaauuugugaagguggaaau

SEQ ID NO: 2525027 - RNA, 20 nt, Human
gaauuaucuugguugaaaau

SEQ ID NO: 2525028 - RNA, 16 nt, Human
ggagcaucagugcccu

SEQ ID NO: 2525029 - RNA, 13 nt, Human
ggagcagugucuu

SEQ ID NO: 2525030 - RNA, 17 nt, Human
ggagcagugucuuccau

SEQ ID NO: 2525031 - RNA, 22 nt, Human
ggagcauccaccuccuucucug

SEQ ID NO: 2525032 - RNA, 19 nt, Human
ggagcauccaccuccuucu

SEQ ID NO: 2525033 - RNA, 18 nt, Human
ggagcauccaccuccuuc

SEQ ID NO: 2525034 - RNA, 17 nt, Human
ggagcauccaccuccuu

SEQ ID NO: 2525035 - RNA, 18 nt, Human
ggagcauagaaggcaggu

SEQ ID NO: 2525036 - RNA, 18 nt, Human
ggagcagugucuuccaua

SEQ ID NO: 2525037 - RNA, 16 nt, Human
ggagcaucucuugagg

SEQ ID NO: 2525038 - RNA, 20 nt, Human
ggagcaucucuugaggccag

SEQ ID NO: 2525039 - RNA, 16 nt, Human
ggagcaucugacucac

SEQ ID NO: 2525040 - RNA, 14 nt, Human
ggagcaucugacuc

SEQ ID NO: 2525041 - RNA, 21 nt, Human
ggagcaucucuugaggccagg

SEQ ID NO: 2525042 - RNA, 16 nt, Human
ggagcaugggccuggc

SEQ ID NO: 2525043 - RNA, 17 nt, Human
ggagcauggcugugagg

SEQ ID NO: 2525044 - RNA, 15 nt, Human
ggagcauggcuguga

SEQ ID NO: 2525045 - RNA, 19 nt, Human
ggagcauuggcugagagac

SEQ ID NO: 2525046 - RNA, 14 nt, Human
ggagcaugggccug

SEQ ID NO: 2525047 - RNA, 20 nt, Human
ggagguggaagaagggagaa

SEQ ID NO: 2525048 - RNA, 20 nt, Human
ggagguggagguugcaguga

SEQ ID NO: 2525049 - RNA, 17 nt, Human
ggagguggaagaaggga

SEQ ID NO: 2525050 - RNA, 22 nt, Human
ggaggugcuuaagcagaagcau

SEQ ID NO: 2525051 - RNA, 19 nt, Human
ggaggugccagcaaagccc

SEQ ID NO: 2525052 - RNA, 14 nt, Human
ggaggugccagcaa

SEQ ID NO: 2525053 - RNA, 20 nt, Human
ggagguggaggcugcaguga

SEQ ID NO: 2525054 - RNA, 19 nt, Human
ggagguggagguugcagug

SEQ ID NO: 2525055 - RNA, 13 nt, Human
ggaggugagggau

SEQ ID NO: 2525056 - RNA, 13 nt, Human
ggaggugccagca

SEQ ID NO: 2525057 - RNA, 14 nt, Human
ggaggugaccccag

SEQ ID NO: 2525058 - RNA, 18 nt, Human
ggaggucgguagguucag

SEQ ID NO: 2525059 - RNA, 17 nt, Human
ggaggucguguauuugg

SEQ ID NO: 2525060 - RNA, 17 nt, Human
ggaggucacuggaaagg

SEQ ID NO: 2525061 - RNA, 22 nt, Human
ggaggucgaccccaaagccccu

SEQ ID NO: 2525062 - RNA, 20 nt, Human
ggaggucaaggcugcaguga

SEQ ID NO: 2525063 - RNA, 21 nt, Human
ggaggucacuggaaaggggag

SEQ ID NO: 2525064 - RNA, 13 nt, Human
ggaggucacugga

SEQ ID NO: 2525065 - RNA, 23 nt, Human
ggaggucacauucaggaagauga

SEQ ID NO: 2525066 - RNA, 20 nt, Human
ggaggucacauucaggaaga

SEQ ID NO: 2525067 - RNA, 19 nt, Human
ggaggucacauucaggaag

SEQ ID NO: 2525068 - RNA, 20 nt, Human
ggagguagagguugugguga

SEQ ID NO: 2525069 - RNA, 22 nt, Human
ggagguauucguaaggauggga

SEQ ID NO: 2525070 - RNA, 23 nt, Human
ggaggguaaaugauguggugccu

SEQ ID NO: 2525071 - RNA, 22 nt, Human
ggagggguugccacaggccucc

SEQ ID NO: 2525072 - RNA, 21 nt, Human
ggagggguugccacaggccuc

SEQ ID NO: 2525073 - RNA, 19 nt, Human
ggagggguugccacaggcc

SEQ ID NO: 2525074 - RNA, 18 nt, Human
ggagggguugccacaggc

SEQ ID NO: 2525075 - RNA, 17 nt, Human
ggagggguugccacagg

SEQ ID NO: 2525076 - RNA, 21 nt, Human
ggagguagcuuugagguggaa

SEQ ID NO: 2525077 - RNA, 22 nt, Human
ggaggggguuugcuggggaacu

SEQ ID NO: 2525078 - RNA, 23 nt, Human
ggagggguaacuugcaccucuga

SEQ ID NO: 2525079 - RNA, 23 nt, Human
ggaggggguuugcuggggaacug

SEQ ID NO: 2525080 - RNA, 18 nt, Human
ggaggggguuugggggcu

SEQ ID NO: 2525081 - RNA, 16 nt, Human
ggagggguugccacag

SEQ ID NO: 2525082 - RNA, 14 nt, Human
ggagggguugccac

SEQ ID NO: 2525083 - RNA, 15 nt, Human
ggagggguguggcuc

SEQ ID NO: 2525084 - RNA, 17 nt, Human
ggagggguguggcagug

SEQ ID NO: 2525085 - RNA, 17 nt, Human
ggaggggugguccugac

SEQ ID NO: 2525086 - RNA, 23 nt, Human
ggaggccccuggcccagcggccc

SEQ ID NO: 2525087 - RNA, 22 nt, Human
ggaggccccuggcccagcggcc

SEQ ID NO: 2525088 - RNA, 19 nt, Human
ggaggccccuggcccagcg

SEQ ID NO: 2525089 - RNA, 18 nt, Human
ggaggccccuggcccagc

SEQ ID NO: 2525090 - RNA, 17 nt, Human
ggaggcccguccggcag

SEQ ID NO: 2525091 - RNA, 18 nt, Human
ggaggccgggugcucagg

SEQ ID NO: 2525092 - RNA, 16 nt, Human
ggaggggggagguggg

SEQ ID NO: 2525093 - RNA, 22 nt, Human
ggaggcgcacuuuccuccuggc

SEQ ID NO: 2525094 - RNA, 18 nt, Human
ggaggccugggggcaggg

SEQ ID NO: 2525095 - RNA, 14 nt, Human
ggaggccugggggc

SEQ ID NO: 2525096 - RNA, 20 nt, Human
ggaggaccagggcagggcca

SEQ ID NO: 2525097 - RNA, 19 nt, Human
ggaggacaauucaugaacu

SEQ ID NO: 2525098 - RNA, 18 nt, Human
ggaggccaagugcaggcu

SEQ ID NO: 2525099 - RNA, 20 nt, Human
ggaggccaaggugggaggau

SEQ ID NO: 2525100 - RNA, 14 nt, Human
ggaggaaggcaaga

SEQ ID NO: 2525101 - RNA, 19 nt, Human
ggaggaaucgaggaaccag

SEQ ID NO: 2525102 - RNA, 20 nt, Human
ggaggaaucgaggaaccaga

SEQ ID NO: 2525103 - RNA, 21 nt, Human
ggaggaaucgaggaaccagag

SEQ ID NO: 2525104 - RNA, 22 nt, Human
ggaggaaucgaggaaccagagc

SEQ ID NO: 2525105 - RNA, 23 nt, Human
ggaggaaucgaggaaccagagcc

SEQ ID NO: 2525106 - RNA, 15 nt, Human
ggaggaaugcucccc

SEQ ID NO: 2525107 - RNA, 16 nt, Human
ggaggaaugcuccccc

SEQ ID NO: 2525108 - RNA, 18 nt, Human
ggaggaaugcucccccau

SEQ ID NO: 2525109 - RNA, 14 nt, Human
ggaggacaauucau

SEQ ID NO: 2525110 - RNA, 13 nt, Human
ggaggacaauuca

SEQ ID NO: 2525111 - RNA, 17 nt, Human
ggaggaaugcuccccca

SEQ ID NO: 2525112 - RNA, 12 nt, Human
ggaggccagccu

SEQ ID NO: 2525113 - RNA, 21 nt, Human
ggaggccaccucuccaagggc

SEQ ID NO: 2525114 - RNA, 12 nt, Human
ggaggccagcca

SEQ ID NO: 2525115 - RNA, 13 nt, Human
ggaggccagccag

SEQ ID NO: 2525116 - RNA, 17 nt, Human
ggaggccccacugggga

SEQ ID NO: 2525117 - RNA, 17 nt, Human
ggaggccccuggcccag

SEQ ID NO: 2525118 - RNA, 16 nt, Human
ggaggccccuggccca

SEQ ID NO: 2525119 - RNA, 16 nt, Human
ggaggccagccaguga

SEQ ID NO: 2525120 - RNA, 11 nt, Human
ggaggccagcc

SEQ ID NO: 2525121 - RNA, 19 nt, Human
ggaggccaccucuccaagg

SEQ ID NO: 2525122 - RNA, 18 nt, Human
ggaggccaccucuccaag

SEQ ID NO: 2525123 - RNA, 14 nt, Human
ggaggccaccucuc

SEQ ID NO: 2525124 - RNA, 12 nt, Human
ggaggccaccuc

SEQ ID NO: 2525125 - RNA, 20 nt, Human
ggaggccaagugcaggcugg

SEQ ID NO: 2525126 - RNA, 18 nt, Human
ggagcuguaaaccagaga

SEQ ID NO: 2525127 - RNA, 18 nt, Human
ggagcugguuagaaaugc

SEQ ID NO: 2525128 - RNA, 23 nt, Human
ggagcugguuagaaaugcagaau

SEQ ID NO: 2525129 - RNA, 19 nt, Human
ggaggaaggaaacccagcu

SEQ ID NO: 2525130 - RNA, 21 nt, Human
ggagcugggacacuuaacaga

SEQ ID NO: 2525131 - RNA, 14 nt, Human
ggagcugggaggaa

SEQ ID NO: 2525132 - RNA, 15 nt, Human
ggagcugggaggaaa

SEQ ID NO: 2525133 - RNA, 21 nt, Human
ggagcuggccgugggccuggg

SEQ ID NO: 2525134 - RNA, 17 nt, Human
ggagcuggcgucugucu

SEQ ID NO: 2525135 - RNA, 17 nt, Human
ggagcuggggaucccuc

SEQ ID NO: 2525136 - RNA, 19 nt, Human
ggagcugggcagaaggcca

SEQ ID NO: 2525137 - RNA, 18 nt, Human
ggagcugggcagaaggcc

SEQ ID NO: 2525138 - RNA, 23 nt, Human
ggaggaaggaaacccagcucugg

SEQ ID NO: 2525139 - RNA, 20 nt, Human
ggaggaaggaaacccagcuc

SEQ ID NO: 2525140 - RNA, 11 nt, Human
ggaggaaggau

SEQ ID NO: 2525141 - RNA, 20 nt, Human
ggagcuucauggcagaaggc

SEQ ID NO: 2525142 - RNA, 21 nt, Human
ggagcuuagccaaugugggag

SEQ ID NO: 2525143 - RNA, 13 nt, Human
ggaggaaggcaag

SEQ ID NO: 2525144 - RNA, 13 nt, Human
ggaggaaggauug

SEQ ID NO: 2525145 - RNA, 13 nt, Human
ggaggaaggagag

SEQ ID NO: 2525146 - RNA, 21 nt, Human
ggaggaaggcuuacacccaca

SEQ ID NO: 2525147 - RNA, 18 nt, Human
ggagcccacuguccuggg

SEQ ID NO: 2525148 - RNA, 20 nt, Human
ggagcccacuguccugggcc

SEQ ID NO: 2525149 - RNA, 22 nt, Human
ggagcccacuguccugggccug

SEQ ID NO: 2525150 - RNA, 23 nt, Human
ggagcccacuguccugggccugc

SEQ ID NO: 2525151 - RNA, 14 nt, Human
ggagcccacugucc

SEQ ID NO: 2525152 - RNA, 17 nt, Human
ggagcccacuguccugg

SEQ ID NO: 2525153 - RNA, 12 nt, Human
ggagccagcucu

SEQ ID NO: 2525154 - RNA, 22 nt, Human
ggagcccacuguacuugcucuu

SEQ ID NO: 2525155 - RNA, 16 nt, Human
ggagcccagcccuccc

SEQ ID NO: 2525156 - RNA, 19 nt, Human
ggagcccagcccuccccau

SEQ ID NO: 2525157 - RNA, 16 nt, Human
ggagcccagcucugaa

SEQ ID NO: 2525158 - RNA, 22 nt, Human
ggagcccaggcgggagcggugg

SEQ ID NO: 2525159 - RNA, 19 nt, Human
ggagcccaggcgggagcgg

SEQ ID NO: 2525160 - RNA, 16 nt, Human
ggagccaauggagacu

SEQ ID NO: 2525161 - RNA, 17 nt, Human
ggagccaaguccagauu

SEQ ID NO: 2525162 - RNA, 23 nt, Human
ggagccaaggguucagagacuca

SEQ ID NO: 2525163 - RNA, 19 nt, Human
ggagcauuuggagagaagg

SEQ ID NO: 2525164 - RNA, 15 nt, Human
ggagcauuuggagag

SEQ ID NO: 2525165 - RNA, 20 nt, Human
ggagccaacagaagcuucca

SEQ ID NO: 2525166 - RNA, 17 nt, Human
ggagccaacugcugcuu

SEQ ID NO: 2525167 - RNA, 16 nt, Human
ggagccaacugcugcu

SEQ ID NO: 2525168 - RNA, 15 nt, Human
ggagccaacugcugc

SEQ ID NO: 2525169 - RNA, 19 nt, Human
ggagccacuccucugacuc

SEQ ID NO: 2525170 - RNA, 21 nt, Human
ggagccacuccucugacucag

SEQ ID NO: 2525171 - RNA, 21 nt, Human
ggagccagcucccucuauuua

SEQ ID NO: 2525172 - RNA, 16 nt, Human
ggagccacuccucuga

SEQ ID NO: 2525173 - RNA, 18 nt, Human
ggagccacuaacuagagc

SEQ ID NO: 2525174 - RNA, 22 nt, Human
ggagccccgaggccuucucuga

SEQ ID NO: 2525175 - RNA, 21 nt, Human
ggagccccuggguggguggug

SEQ ID NO: 2525176 - RNA, 16 nt, Human
ggagccccuggguggg

SEQ ID NO: 2525177 - RNA, 15 nt, Human
ggagccccugggugg

SEQ ID NO: 2525178 - RNA, 14 nt, Human
ggagccccugggug

SEQ ID NO: 2525179 - RNA, 13 nt, Human
ggagcccccgccc

SEQ ID NO: 2525180 - RNA, 13 nt, Human
ggagccccugggu

SEQ ID NO: 2525181 - RNA, 20 nt, Human
ggagcccccgccccgcccca

SEQ ID NO: 2525182 - RNA, 16 nt, Human
ggagccccgaggccuu

SEQ ID NO: 2525183 - RNA, 12 nt, Human
ggagcugccugu

SEQ ID NO: 2525184 - RNA, 13 nt, Human
ggagcugcccaga

SEQ ID NO: 2525185 - RNA, 21 nt, Human
ggagcugccuguucagcucca

SEQ ID NO: 2525186 - RNA, 18 nt, Human
ggagcuggccccgccgcc

SEQ ID NO: 2525187 - RNA, 20 nt, Human
ggagcuggccccgccgccug

SEQ ID NO: 2525188 - RNA, 15 nt, Human
ggagugcagugagcc

SEQ ID NO: 2525189 - RNA, 15 nt, Human
ggaguucugguuccu

SEQ ID NO: 2525190 - RNA, 20 nt, Human
ggaguucgagaccagccugg

SEQ ID NO: 2525191 - RNA, 15 nt, Human
ggaguucgaggcugc

SEQ ID NO: 2525192 - RNA, 20 nt, Human
ggaguucgaggcugcaguca

SEQ ID NO: 2525193 - RNA, 21 nt, Human
ggaguucgaggcugcagucag

SEQ ID NO: 2525194 - RNA, 14 nt, Human
ggaguugaucugga

SEQ ID NO: 2525195 - RNA, 17 nt, Human
ggaguugaucuggaacc

SEQ ID NO: 2525196 - RNA, 21 nt, Human
ggaguugaucuggaacccaga

SEQ ID NO: 2525197 - RNA, 22 nt, Human
ggaguugaucuggaacccagac

SEQ ID NO: 2525198 - RNA, 20 nt, Human
ggaguugaucgccuuuccca

SEQ ID NO: 2525199 - RNA, 23 nt, Human
ggaguugaucgccuuucccaggu

SEQ ID NO: 2525200 - RNA, 16 nt, Human
ggaguucuaugcucuc

SEQ ID NO: 2525201 - RNA, 23 nt, Human
ggaguggaauaguauccuccagg

SEQ ID NO: 2525202 - RNA, 22 nt, Human
ggaguggaauaguauccuccag

SEQ ID NO: 2525203 - RNA, 13 nt, Human
ggaguggagugga

SEQ ID NO: 2525204 - RNA, 18 nt, Human
ggaguucgagaccagccu

SEQ ID NO: 2525205 - RNA, 14 nt, Human
ggaguggccacaga

SEQ ID NO: 2525206 - RNA, 12 nt, Human
ggagugcagugg

SEQ ID NO: 2525207 - RNA, 20 nt, Human
ggaguggaauaguauccucc

SEQ ID NO: 2525208 - RNA, 19 nt, Human
ggaguggaagaagagggag

SEQ ID NO: 2525209 - RNA, 16 nt, Human
ggaguuucuuuccugc

SEQ ID NO: 2525210 - RNA, 13 nt, Human
ggaguuugaggcu

SEQ ID NO: 2525211 - RNA, 21 nt, Human
ggaguuggaagugugugaucu

SEQ ID NO: 2525212 - RNA, 22 nt, Human
ggaguugucaagucucugcugg

SEQ ID NO: 2525213 - RNA, 19 nt, Human
ggaguuugaggcugcagcg

SEQ ID NO: 2525214 - RNA, 20 nt, Human
ggaguuugaggcugcagcga

SEQ ID NO: 2525215 - RNA, 18 nt, Human
ggaguuucuuuccugccu

SEQ ID NO: 2525216 - RNA, 15 nt, Human
ggauaaaaagauguu

SEQ ID NO: 2525217 - RNA, 20 nt, Human
ggaguuuuuguuuggagagc

SEQ ID NO: 2525218 - RNA, 14 nt, Human
ggauaaaaugaggu

SEQ ID NO: 2525219 - RNA, 15 nt, Human
ggauaaagccacuga

SEQ ID NO: 2525220 - RNA, 15 nt, Human
ggauaaaaugagguu

SEQ ID NO: 2525221 - RNA, 14 nt, Human
ggauaaccuauaug

SEQ ID NO: 2525222 - RNA, 21 nt, Human
ggauaagguaccuuucacaua

SEQ ID NO: 2525223 - RNA, 20 nt, Human
ggauaaugcuguugccucau

SEQ ID NO: 2525224 - RNA, 14 nt, Human
ggauccugagccag

SEQ ID NO: 2525225 - RNA, 13 nt, Human
ggauccugagcca

SEQ ID NO: 2525226 - RNA, 14 nt, Human
ggauccuccaggug

SEQ ID NO: 2525227 - RNA, 15 nt, Human
ggauccuccaggugc

SEQ ID NO: 2525228 - RNA, 15 nt, Human
ggaucugugcccaga

SEQ ID NO: 2525229 - RNA, 16 nt, Human
ggaucugugcccagag

SEQ ID NO: 2525230 - RNA, 15 nt, Human
ggaucuucaauggcu

SEQ ID NO: 2525231 - RNA, 23 nt, Human
ggaucuguuguguacguggagag

SEQ ID NO: 2525232 - RNA, 16 nt, Human
ggaucuguccaaggaa

SEQ ID NO: 2525233 - RNA, 15 nt, Human
ggaucuguccaagga

SEQ ID NO: 2525234 - RNA, 19 nt, Human
ggaucugucacaccagcca

SEQ ID NO: 2525235 - RNA, 23 nt, Human
ggaucugggacccuuuccuuccu

SEQ ID NO: 2525236 - RNA, 17 nt, Human
ggaucugguccuaccca

SEQ ID NO: 2525237 - RNA, 21 nt, Human
ggaucugguagggggaaaaug

SEQ ID NO: 2525238 - RNA, 18 nt, Human
ggaucuggggcucuggga

SEQ ID NO: 2525239 - RNA, 17 nt, Human
ggaucuggagaaccuca

SEQ ID NO: 2525240 - RNA, 19 nt, Human
ggaucugggacccuuuccu

SEQ ID NO: 2525241 - RNA, 20 nt, Human
ggaucugccccucccugcuu

SEQ ID NO: 2525242 - RNA, 17 nt, Human
ggaucugccccucccug

SEQ ID NO: 2525243 - RNA, 15 nt, Human
ggaucugccccuccc

SEQ ID NO: 2525244 - RNA, 14 nt, Human
ggaucugccccucc

SEQ ID NO: 2525245 - RNA, 15 nt, Human
ggaucugagaaucuu

SEQ ID NO: 2525246 - RNA, 22 nt, Human
ggauggcccuucccacuggagg

SEQ ID NO: 2525247 - RNA, 16 nt, Human
ggauggccccagcaca

SEQ ID NO: 2525248 - RNA, 16 nt, Human
ggauggccuggccagg

SEQ ID NO: 2525249 - RNA, 21 nt, Human
ggauggccuggccagggccug

SEQ ID NO: 2525250 - RNA, 23 nt, Human
ggauggcggguggggguggaaua

SEQ ID NO: 2525251 - RNA, 18 nt, Human
ggauggcgggugggggug

SEQ ID NO: 2525252 - RNA, 16 nt, Human
ggauggcggguggggg

SEQ ID NO: 2525253 - RNA, 15 nt, Human
ggauggcgggugggg

SEQ ID NO: 2525254 - RNA, 12 nt, Human
ggaugggaagga

SEQ ID NO: 2525255 - RNA, 15 nt, Human
ggaugggaaggaggg

SEQ ID NO: 2525256 - RNA, 15 nt, Human
ggaugggagugagac

SEQ ID NO: 2525257 - RNA, 17 nt, Human
ggaugggaaggagggag

SEQ ID NO: 2525258 - RNA, 16 nt, Human
ggauggggcugcaccg

SEQ ID NO: 2525259 - RNA, 21 nt, Human
ggauguacaaggacagccccu

SEQ ID NO: 2525260 - RNA, 14 nt, Human
ggaugggccaccgc

SEQ ID NO: 2525261 - RNA, 16 nt, Human
ggaugggcugcagcag

SEQ ID NO: 2525262 - RNA, 12 nt, Human
ggauggcaagau

SEQ ID NO: 2525263 - RNA, 18 nt, Human
ggauggauuuccagccaa

SEQ ID NO: 2525264 - RNA, 22 nt, Human
ggauggccagugucugucccgg

SEQ ID NO: 2525265 - RNA, 15 nt, Human
ggauggccagugucu

SEQ ID NO: 2525266 - RNA, 14 nt, Human
ggauggccaguguc

SEQ ID NO: 2525267 - RNA, 15 nt, Human
ggauggcaccagagg

SEQ ID NO: 2525268 - RNA, 14 nt, Human
ggauggccccagca

SEQ ID NO: 2525269 - RNA, 13 nt, Human
ggauggccccagc

SEQ ID NO: 2525270 - RNA, 14 nt, Human
ggauggaggagaag

SEQ ID NO: 2525271 - RNA, 19 nt, Human
ggauggaggggugguccug

SEQ ID NO: 2525272 - RNA, 21 nt, Human
ggauggaggggugguccugac

SEQ ID NO: 2525273 - RNA, 13 nt, Human
ggauggccagugu

SEQ ID NO: 2525274 - RNA, 24 nt, Human
ggcacagaaaauggaagacagcuc

SEQ ID NO: 2525275 - RNA, 13 nt, Human
ggcacacaccugu

SEQ ID NO: 2525276 - RNA, 20 nt, Human
ggcacaauggcuaauuccca

SEQ ID NO: 2525277 - RNA, 21 nt, Human
ggcacagaaacacaauauuuu

SEQ ID NO: 2525278 - RNA, 22 nt, Human
ggcacaaucucggcucacugca

SEQ ID NO: 2525279 - RNA, 22 nt, Human
ggcacaauggcuaauucccaga

SEQ ID NO: 2525280 - RNA, 22 nt, Human
ggcacaagcaaaagggugucug

SEQ ID NO: 2525281 - RNA, 14 nt, Human
ggcaauuuuguaac

SEQ ID NO: 2525282 - RNA, 13 nt, Human
ggcacagccuucu

SEQ ID NO: 2525283 - RNA, 18 nt, Human
ggcacagcggggccccag

SEQ ID NO: 2525284 - RNA, 20 nt, Human
ggcacagcaacucuaagacu

SEQ ID NO: 2525285 - RNA, 16 nt, Human
ggcacagaaaccucua

SEQ ID NO: 2525286 - RNA, 13 nt, Human
ggcaccagacacc

SEQ ID NO: 2525287 - RNA, 16 nt, Human
ggcaccagacacccag

SEQ ID NO: 2525288 - RNA, 16 nt, Human
ggcacagggcaguggg

SEQ ID NO: 2525289 - RNA, 14 nt, Human
ggcacaggcccccu

SEQ ID NO: 2525290 - RNA, 15 nt, Human
ggcacaggcccccuu

SEQ ID NO: 2525291 - RNA, 20 nt, Human
ggaugucugccaauuuuugc

SEQ ID NO: 2525292 - RNA, 13 nt, Human
ggauguucuggga

SEQ ID NO: 2525293 - RNA, 22 nt, Human
ggauguugaaaaaguucugcag

SEQ ID NO: 2525294 - RNA, 16 nt, Human
ggauguucugggacac

SEQ ID NO: 2525295 - RNA, 14 nt, Human
ggaugucugccaau

SEQ ID NO: 2525296 - RNA, 13 nt, Human
ggaugucugggcc

SEQ ID NO: 2525297 - RNA, 15 nt, Human
ggauguucugggaca

SEQ ID NO: 2525298 - RNA, 16 nt, Human
ggauguacauuuccaa

SEQ ID NO: 2525299 - RNA, 21 nt, Human
ggauguaaacagugccugcug

SEQ ID NO: 2525300 - RNA, 18 nt, Human
ggauguauaugucaucuc

SEQ ID NO: 2525301 - RNA, 22 nt, Human
ggauguauccaugggggcaggg

SEQ ID NO: 2525302 - RNA, 23 nt, Human
ggauguauccaugggggcagggc

SEQ ID NO: 2525303 - RNA, 18 nt, Human
ggauguccacagaugccu

SEQ ID NO: 2525304 - RNA, 18 nt, Human
ggaugucacucagaugga

SEQ ID NO: 2525305 - RNA, 17 nt, Human
ggauguccacagaugcc

SEQ ID NO: 2525306 - RNA, 15 nt, Human
ggaugucacagggcc

SEQ ID NO: 2525307 - RNA, 16 nt, Human
ggaugucacagggcca

SEQ ID NO: 2525308 - RNA, 13 nt, Human
ggaugucaccaau

SEQ ID NO: 2525309 - RNA, 19 nt, Human
ggccgcuccagggguggcu

SEQ ID NO: 2525310 - RNA, 16 nt, Human
ggccgcuccaggggug

SEQ ID NO: 2525311 - RNA, 13 nt, Human
ggccgcuccaggg

SEQ ID NO: 2525312 - RNA, 12 nt, Human
ggccgcccccug

SEQ ID NO: 2525313 - RNA, 17 nt, Human
ggccgcugaguggcagg

SEQ ID NO: 2525314 - RNA, 12 nt, Human
ggccgcugccac

SEQ ID NO: 2525315 - RNA, 13 nt, Human
ggccgcugccacc

SEQ ID NO: 2525316 - RNA, 15 nt, Human
ggccgcugccaccca

SEQ ID NO: 2525317 - RNA, 19 nt, Human
ggccgcugccacccaccuc

SEQ ID NO: 2525318 - RNA, 21 nt, Human
ggccgcugccacccaccuccc

SEQ ID NO: 2525319 - RNA, 18 nt, Human
ggccgcagcucuugcccu

SEQ ID NO: 2525320 - RNA, 19 nt, Human
ggccgaucggggcacugca

SEQ ID NO: 2525321 - RNA, 14 nt, Human
ggccgagugagagc

SEQ ID NO: 2525322 - RNA, 23 nt, Human
ggccgcagcucuugcccuucccu

SEQ ID NO: 2525323 - RNA, 22 nt, Human
ggccgcagcucuugcccuuccc

SEQ ID NO: 2525324 - RNA, 21 nt, Human
ggccgcagcucuugcccuucc

SEQ ID NO: 2525325 - RNA, 20 nt, Human
ggccgcagcucuugcccuuc

SEQ ID NO: 2525326 - RNA, 15 nt, Human
ggccgcauucccuga

SEQ ID NO: 2525327 - RNA, 16 nt, Human
ggccgcauucccugag

SEQ ID NO: 2525328 - RNA, 17 nt, Human
ggccgcauucccugagu

SEQ ID NO: 2525329 - RNA, 18 nt, Human
ggccgccccagccucuga

SEQ ID NO: 2525330 - RNA, 18 nt, Human
ggcccuucucuccagccc

SEQ ID NO: 2525331 - RNA, 17 nt, Human
ggcccuuccucuccacu

SEQ ID NO: 2525332 - RNA, 13 nt, Human
ggccgaguccaag

SEQ ID NO: 2525333 - RNA, 16 nt, Human
ggccgaguccaagcug

SEQ ID NO: 2525334 - RNA, 16 nt, Human
ggccgaggguccuggc

SEQ ID NO: 2525335 - RNA, 18 nt, Human
ggccgaggguccuggcuc

SEQ ID NO: 2525336 - RNA, 16 nt, Human
ggccgacggagccggg

SEQ ID NO: 2525337 - RNA, 14 nt, Human
ggccgacggagccg

SEQ ID NO: 2525338 - RNA, 21 nt, Human
ggcccuucacugccuuugcuc

SEQ ID NO: 2525339 - RNA, 15 nt, Human
ggccgagaagcaaga

SEQ ID NO: 2525340 - RNA, 12 nt, Human
ggccgagaagca

SEQ ID NO: 2525341 - RNA, 17 nt, Human
ggcccuucucuccagcc

SEQ ID NO: 2525342 - RNA, 16 nt, Human
ggcccuucucuccagc

SEQ ID NO: 2525343 - RNA, 14 nt, Human
ggcccuuccuuuuc

SEQ ID NO: 2525344 - RNA, 15 nt, Human
ggcccuuccucucca

SEQ ID NO: 2525345 - RNA, 13 nt, Human
ggcccuuccucuc

SEQ ID NO: 2525346 - RNA, 19 nt, Human
ggcccuucccacaggacau

SEQ ID NO: 2525347 - RNA, 20 nt, Human
ggcccuucacugccuuugcu

SEQ ID NO: 2525348 - RNA, 17 nt, Human
ggcccugugccuuggug

SEQ ID NO: 2525349 - RNA, 18 nt, Human
ggccccuuuucacucccu

SEQ ID NO: 2525350 - RNA, 16 nt, Human
ggccccuuuucacucc

SEQ ID NO: 2525351 - RNA, 20 nt, Human
ggccccuuuucacucccucc

SEQ ID NO: 2525352 - RNA, 19 nt, Human
ggccccuuuuuacuccccu

SEQ ID NO: 2525353 - RNA, 23 nt, Human
ggccccugggucagucugguggg

SEQ ID NO: 2525354 - RNA, 23 nt, Human
ggccccugggcuuggccugcugu

SEQ ID NO: 2525355 - RNA, 22 nt, Human
ggccccugggcuuggccugcug

SEQ ID NO: 2525356 - RNA, 21 nt, Human
ggccccugggcuuggccugcu

SEQ ID NO: 2525357 - RNA, 20 nt, Human
ggccccugggcuuggccugc

SEQ ID NO: 2525358 - RNA, 20 nt, Human
ggccccuggcccagcggccc

SEQ ID NO: 2525359 - RNA, 18 nt, Human
ggccccuggcccagcggc

SEQ ID NO: 2525360 - RNA, 17 nt, Human
ggccccuggcccagcgg

SEQ ID NO: 2525361 - RNA, 20 nt, Human
ggccccuugacucuggggac

SEQ ID NO: 2525362 - RNA, 21 nt, Human
ggccccuucacuucugaccac

SEQ ID NO: 2525363 - RNA, 13 nt, Human
ggccccugugagu

SEQ ID NO: 2525364 - RNA, 20 nt, Human
ggccccuucacuucugacca

SEQ ID NO: 2525365 - RNA, 22 nt, Human
ggccccuucacuucugaccaca

SEQ ID NO: 2525366 - RNA, 16 nt, Human
ggcccagggcccagag

SEQ ID NO: 2525367 - RNA, 18 nt, Human
ggcccaggaccagcuggg

SEQ ID NO: 2525368 - RNA, 15 nt, Human
ggcccagggcccaga

SEQ ID NO: 2525369 - RNA, 17 nt, Human
ggcccagggcccagagc

SEQ ID NO: 2525370 - RNA, 18 nt, Human
ggcccagggcccagagcc

SEQ ID NO: 2525371 - RNA, 17 nt, Human
ggcccaggaccagcugg

SEQ ID NO: 2525372 - RNA, 16 nt, Human
ggcccaggaccagcug

SEQ ID NO: 2525373 - RNA, 15 nt, Human
ggcccaggaccagcu

SEQ ID NO: 2525374 - RNA, 21 nt, Human
ggcccagcugggcucugccac

SEQ ID NO: 2525375 - RNA, 22 nt, Human
ggcccaggaccaucauccuacu

SEQ ID NO: 2525376 - RNA, 17 nt, Human
ggcccagcugggcucug

SEQ ID NO: 2525377 - RNA, 15 nt, Human
ggcccagcugggcuc

SEQ ID NO: 2525378 - RNA, 14 nt, Human
ggcccagcugggcu

SEQ ID NO: 2525379 - RNA, 16 nt, Human
ggcccagcucccccgg

SEQ ID NO: 2525380 - RNA, 15 nt, Human
ggcccagcucccccg

SEQ ID NO: 2525381 - RNA, 14 nt, Human
ggcccagcuccccc

SEQ ID NO: 2525382 - RNA, 12 nt, Human
ggcccagcuccc

SEQ ID NO: 2525383 - RNA, 23 nt, Human
ggcccagcggccccucccacaca

SEQ ID NO: 2525384 - RNA, 18 nt, Human
ggcccagcggccccuccc

SEQ ID NO: 2525385 - RNA, 17 nt, Human
ggcccagcggccccucc

SEQ ID NO: 2525386 - RNA, 23 nt, Human
ggccccacccugggcccugggcu

SEQ ID NO: 2525387 - RNA, 21 nt, Human
ggccccacccugggcccuggg

SEQ ID NO: 2525388 - RNA, 17 nt, Human
ggccccacccugggccc

SEQ ID NO: 2525389 - RNA, 15 nt, Human
ggccccacccugggc

SEQ ID NO: 2525390 - RNA, 15 nt, Human
ggccccuggcccagc

SEQ ID NO: 2525391 - RNA, 14 nt, Human
ggccccuggcccag

SEQ ID NO: 2525392 - RNA, 13 nt, Human
ggccccuggccca

SEQ ID NO: 2525393 - RNA, 21 nt, Human
ggccccugcuucuccagccug

SEQ ID NO: 2525394 - RNA, 20 nt, Human
ggccccugcuucuccagccu

SEQ ID NO: 2525395 - RNA, 12 nt, Human
ggccccacuggg

SEQ ID NO: 2525396 - RNA, 19 nt, Human
ggccccagaaggcagggaa

SEQ ID NO: 2525397 - RNA, 11 nt, Human
ggccccagaga

SEQ ID NO: 2525398 - RNA, 12 nt, Human
ggccccagagac

SEQ ID NO: 2525399 - RNA, 13 nt, Human
ggccccagagacu

SEQ ID NO: 2525400 - RNA, 14 nt, Human
ggccccagagacuc

SEQ ID NO: 2525401 - RNA, 18 nt, Human
ggccccagagacucagag

SEQ ID NO: 2525402 - RNA, 23 nt, Human
ggccccagagacucagagggagg

SEQ ID NO: 2525403 - RNA, 19 nt, Human
ggcccagugucaaguugug

SEQ ID NO: 2525404 - RNA, 16 nt, Human
ggcccaguccuggccu

SEQ ID NO: 2525405 - RNA, 21 nt, Human
ggcccaguccuggccuggcuu

SEQ ID NO: 2525406 - RNA, 23 nt, Human
ggcccagugucaaguugugcuug

SEQ ID NO: 2525407 - RNA, 22 nt, Human
ggcccagugucaaguugugcuu

SEQ ID NO: 2525408 - RNA, 13 nt, Human
ggccccacccugg

SEQ ID NO: 2525409 - RNA, 19 nt, Human
ggcccagggcccagagccc

SEQ ID NO: 2525410 - RNA, 21 nt, Human
ggcccagggcccagagcccag

SEQ ID NO: 2525411 - RNA, 22 nt, Human
ggcccagggcccagagcccagc

SEQ ID NO: 2525412 - RNA, 14 nt, Human
ggcccaguccuggc

SEQ ID NO: 2525413 - RNA, 22 nt, Human
ggcccaguaugagcccuagaag

SEQ ID NO: 2525414 - RNA, 17 nt, Human
ggcccaguaugagcccu

SEQ ID NO: 2525415 - RNA, 23 nt, Human
ggcagugggucccacuuccccuc

SEQ ID NO: 2525416 - RNA, 20 nt, Human
ggcagugggucccacuuccc

SEQ ID NO: 2525417 - RNA, 19 nt, Human
ggcauagcccagacacaga

SEQ ID NO: 2525418 - RNA, 15 nt, Human
ggcauagcccagaca

SEQ ID NO: 2525419 - RNA, 21 nt, Human
ggcauagcuccccgcuucugc

SEQ ID NO: 2525420 - RNA, 19 nt, Human
ggcagugggagcugccugu

SEQ ID NO: 2525421 - RNA, 18 nt, Human
ggcagugggagcugccug

SEQ ID NO: 2525422 - RNA, 18 nt, Human
ggcauccaguaucuugaa

SEQ ID NO: 2525423 - RNA, 13 nt, Human
ggcaucacagggc

SEQ ID NO: 2525424 - RNA, 14 nt, Human
ggcaucacagggca

SEQ ID NO: 2525425 - RNA, 16 nt, Human
ggcaucacagggcaga

SEQ ID NO: 2525426 - RNA, 17 nt, Human
ggcaucacagggcagag

SEQ ID NO: 2525427 - RNA, 21 nt, Human
ggcauagcccagacacagaag

SEQ ID NO: 2525428 - RNA, 14 nt, Human
ggcauaggccuggg

SEQ ID NO: 2525429 - RNA, 15 nt, Human
ggcauaggccugggu

SEQ ID NO: 2525430 - RNA, 16 nt, Human
ggcauaggccugggug

SEQ ID NO: 2525431 - RNA, 17 nt, Human
ggcauaggccugggugc

SEQ ID NO: 2525432 - RNA, 22 nt, Human
ggcauauccaccaccucccuca

SEQ ID NO: 2525433 - RNA, 18 nt, Human
ggcauuuuacuguacaga

SEQ ID NO: 2525434 - RNA, 15 nt, Human
ggcauuuuuauuuua

SEQ ID NO: 2525435 - RNA, 21 nt, Human
ggcaucuuugccuugggcugc

SEQ ID NO: 2525436 - RNA, 16 nt, Human
ggcaucuuugccuugg

SEQ ID NO: 2525437 - RNA, 17 nt, Human
ggcaucuuugccuuggg

SEQ ID NO: 2525438 - RNA, 19 nt, Human
ggcaucuuugccuugggcu

SEQ ID NO: 2525439 - RNA, 15 nt, Human
ggcaucugcacccuc

SEQ ID NO: 2525440 - RNA, 14 nt, Human
ggcaucugccccuc

SEQ ID NO: 2525441 - RNA, 22 nt, Human
ggcaucugcacccucgaugaag

SEQ ID NO: 2525442 - RNA, 19 nt, Human
ggcaucugccccuccccca

SEQ ID NO: 2525443 - RNA, 16 nt, Human
ggcaucugccccuccc

SEQ ID NO: 2525444 - RNA, 18 nt, Human
ggcaucugccccuccccc

SEQ ID NO: 2525445 - RNA, 20 nt, Human
ggcauccucagguggucagg

SEQ ID NO: 2525446 - RNA, 21 nt, Human
ggcaucccaguggccucaacc

SEQ ID NO: 2525447 - RNA, 15 nt, Human
ggcaucccaggggac

SEQ ID NO: 2525448 - RNA, 18 nt, Human
ggcaucccaguggccuca

SEQ ID NO: 2525449 - RNA, 18 nt, Human
ggcaucucuaauuggaag

SEQ ID NO: 2525450 - RNA, 16 nt, Human
ggcaucuccugugcau

SEQ ID NO: 2525451 - RNA, 17 nt, Human
ggcaucuccugugcaug

SEQ ID NO: 2525452 - RNA, 15 nt, Human
ggcaucucuaauugg

SEQ ID NO: 2525453 - RNA, 21 nt, Human
ggcaucuccugugcaugggug

SEQ ID NO: 2525454 - RNA, 13 nt, Human
ggcauccugugaa

SEQ ID NO: 2525455 - RNA, 20 nt, Human
ggcauccuuccucacaccag

SEQ ID NO: 2525456 - RNA, 17 nt, Human
ggcagugggagcugccu

SEQ ID NO: 2525457 - RNA, 17 nt, Human
ggcaccagacacccagg

SEQ ID NO: 2525458 - RNA, 18 nt, Human
ggcaccagacacccagga

SEQ ID NO: 2525459 - RNA, 19 nt, Human
ggcaccagacacccaggac

SEQ ID NO: 2525460 - RNA, 20 nt, Human
ggcaccagacacccaggacu

SEQ ID NO: 2525461 - RNA, 15 nt, Human
ggcaccagcagccug

SEQ ID NO: 2525462 - RNA, 22 nt, Human
ggcacugcuuccagugaggcuc

SEQ ID NO: 2525463 - RNA, 22 nt, Human
ggcaccagaggcugcagaaggc

SEQ ID NO: 2525464 - RNA, 19 nt, Human
ggcaccagaggcugcagaa

SEQ ID NO: 2525465 - RNA, 12 nt, Human
ggcaccagaggc

SEQ ID NO: 2525466 - RNA, 16 nt, Human
ggcaccagcagccugg

SEQ ID NO: 2525467 - RNA, 21 nt, Human
ggcacuggcauugucccugug

SEQ ID NO: 2525468 - RNA, 20 nt, Human
ggcacuggcauugucccugu

SEQ ID NO: 2525469 - RNA, 24 nt, Human
ggcacugcuuccagugaggcucug

SEQ ID NO: 2525470 - RNA, 20 nt, Human
ggcacugggaugagccgcug

SEQ ID NO: 2525471 - RNA, 19 nt, Human
ggcacugggaugagccgcu

SEQ ID NO: 2525472 - RNA, 21 nt, Human
ggcacugggaugagccgcugu

SEQ ID NO: 2525473 - RNA, 13 nt, Human
ggccagugucugu

SEQ ID NO: 2525474 - RNA, 19 nt, Human
ggccaguggcuggaucugu

SEQ ID NO: 2525475 - RNA, 16 nt, Human
ggccagugugacaagg

SEQ ID NO: 2525476 - RNA, 16 nt, Human
ggccauacuggccucg

SEQ ID NO: 2525477 - RNA, 15 nt, Human
ggccauacuggccuc

SEQ ID NO: 2525478 - RNA, 23 nt, Human
ggccagugucugucccggggucc

SEQ ID NO: 2525479 - RNA, 22 nt, Human
ggccagugucugucccgggguc

SEQ ID NO: 2525480 - RNA, 23 nt, Human
ggccauacuggccucgccuggcc

SEQ ID NO: 2525481 - RNA, 22 nt, Human
ggccauacuggccucgccuggc

SEQ ID NO: 2525482 - RNA, 17 nt, Human
ggccauagcuccugcuc

SEQ ID NO: 2525483 - RNA, 22 nt, Human
ggccauccggcccccagagcgc

SEQ ID NO: 2525484 - RNA, 19 nt, Human
ggccauccggcccccagag

SEQ ID NO: 2525485 - RNA, 14 nt, Human
ggccaucccacaag

SEQ ID NO: 2525486 - RNA, 20 nt, Human
ggccagggcuauagcucagg

SEQ ID NO: 2525487 - RNA, 19 nt, Human
ggccagggcuauagcucag

SEQ ID NO: 2525488 - RNA, 23 nt, Human
ggccagggccuggaagacagaga

SEQ ID NO: 2525489 - RNA, 19 nt, Human
ggccagggccuggaagaca

SEQ ID NO: 2525490 - RNA, 13 nt, Human
ggccagggcagag

SEQ ID NO: 2525491 - RNA, 23 nt, Human
ggccagggccccucacccugccu

SEQ ID NO: 2525492 - RNA, 13 nt, Human
ggccagggcccug

SEQ ID NO: 2525493 - RNA, 16 nt, Human
ggccagggcccugcag

SEQ ID NO: 2525494 - RNA, 17 nt, Human
ggccagggcccugcaga

SEQ ID NO: 2525495 - RNA, 17 nt, Human
ggccagggccuggaaga

SEQ ID NO: 2525496 - RNA, 12 nt, Human
ggccagggccug

SEQ ID NO: 2525497 - RNA, 18 nt, Human
ggccagggcccugcagag

SEQ ID NO: 2525498 - RNA, 15 nt, Human
ggccaugauggcaac

SEQ ID NO: 2525499 - RNA, 21 nt, Human
ggccaugaggccucaguggac

SEQ ID NO: 2525500 - RNA, 17 nt, Human
ggccaugagcuccagac

SEQ ID NO: 2525501 - RNA, 18 nt, Human
ggccaugagcuccagacc

SEQ ID NO: 2525502 - RNA, 21 nt, Human
ggccaugagcuccagaccccc

SEQ ID NO: 2525503 - RNA, 22 nt, Human
ggccaugagcuccagaccccca

SEQ ID NO: 2525504 - RNA, 18 nt, Human
ggccaugauggcaacaga

SEQ ID NO: 2525505 - RNA, 22 nt, Human
ggccaugauggcaacagaucug

SEQ ID NO: 2525506 - RNA, 21 nt, Human
ggccaugauucgcccaaagcc

SEQ ID NO: 2525507 - RNA, 14 nt, Human
ggccaugccucagc

SEQ ID NO: 2525508 - RNA, 22 nt, Human
ggccaucuuccaggugggguga

SEQ ID NO: 2525509 - RNA, 16 nt, Human
ggccaugagcuccaga

SEQ ID NO: 2525510 - RNA, 19 nt, Human
ggccaucuuccaggugggg

SEQ ID NO: 2525511 - RNA, 18 nt, Human
ggccaucuuccagguggg

SEQ ID NO: 2525512 - RNA, 17 nt, Human
ggccaucuuccaggugg

SEQ ID NO: 2525513 - RNA, 22 nt, Human
ggccaucugggcuccuccaggg

SEQ ID NO: 2525514 - RNA, 23 nt, Human
ggccaucuccacccccagcugcu

SEQ ID NO: 2525515 - RNA, 18 nt, Human
ggccaucuccacccccag

SEQ ID NO: 2525516 - RNA, 19 nt, Human
ggccaucucuggaugccug

SEQ ID NO: 2525517 - RNA, 15 nt, Human
ggccauccuguccca

SEQ ID NO: 2525518 - RNA, 23 nt, Human
ggccauccggcccccagagcgcc

SEQ ID NO: 2525519 - RNA, 20 nt, Human
ggccauccuucccugucugc

SEQ ID NO: 2525520 - RNA, 14 nt, Human
ggccaggcuggucu

SEQ ID NO: 2525521 - RNA, 16 nt, Human
ggccagccccacccag

SEQ ID NO: 2525522 - RNA, 20 nt, Human
ggccagccccacccaggagg

SEQ ID NO: 2525523 - RNA, 11 nt, Human
ggccagccccg

SEQ ID NO: 2525524 - RNA, 23 nt, Human
ggccagccccacagcccacgucc

SEQ ID NO: 2525525 - RNA, 21 nt, Human
ggccagccccacccaggaggg

SEQ ID NO: 2525526 - RNA, 14 nt, Human
ggccagccaggcgg

SEQ ID NO: 2525527 - RNA, 13 nt, Human
ggccagccaggcg

SEQ ID NO: 2525528 - RNA, 16 nt, Human
ggccagccaggcgggc

SEQ ID NO: 2525529 - RNA, 14 nt, Human
ggccagccaugucu

SEQ ID NO: 2525530 - RNA, 15 nt, Human
ggccagccccacagc

SEQ ID NO: 2525531 - RNA, 14 nt, Human
ggccagccccacag

SEQ ID NO: 2525532 - RNA, 13 nt, Human
ggccagccccaca

SEQ ID NO: 2525533 - RNA, 15 nt, Human
ggccagccaugucug

SEQ ID NO: 2525534 - RNA, 19 nt, Human
ggccagccccacagcccac

SEQ ID NO: 2525535 - RNA, 18 nt, Human
ggccagccccacagccca

SEQ ID NO: 2525536 - RNA, 13 nt, Human
ggccagccccacc

SEQ ID NO: 2525537 - RNA, 14 nt, Human
ggccagccccaccc

SEQ ID NO: 2525538 - RNA, 15 nt, Human
ggccagccccaccca

SEQ ID NO: 2525539 - RNA, 12 nt, Human
ggccaggcuggu

SEQ ID NO: 2525540 - RNA, 15 nt, Human
ggccagccccggccc

SEQ ID NO: 2525541 - RNA, 15 nt, Human
ggccagggagaagcu

SEQ ID NO: 2525542 - RNA, 16 nt, Human
ggccagggagaagcuc

SEQ ID NO: 2525543 - RNA, 17 nt, Human
ggccagggagaagcucc

SEQ ID NO: 2525544 - RNA, 18 nt, Human
ggccagggagaagcuccu

SEQ ID NO: 2525545 - RNA, 18 nt, Human
ggccaggcuggucucaaa

SEQ ID NO: 2525546 - RNA, 16 nt, Human
ggccaggcuggucuca

SEQ ID NO: 2525547 - RNA, 18 nt, Human
ggccagaggcccccagcc

SEQ ID NO: 2525548 - RNA, 16 nt, Human
ggccagaggcccccag

SEQ ID NO: 2525549 - RNA, 12 nt, Human
ggccagccaggc

SEQ ID NO: 2525550 - RNA, 11 nt, Human
ggccagccagg

SEQ ID NO: 2525551 - RNA, 12 nt, Human
ggccagcagcuu

SEQ ID NO: 2525552 - RNA, 13 nt, Human
ggccagcagcuug

SEQ ID NO: 2525553 - RNA, 17 nt, Human
ggccagagcugggaggc

SEQ ID NO: 2525554 - RNA, 16 nt, Human
ggccagagcugggagg

SEQ ID NO: 2525555 - RNA, 14 nt, Human
ggccagagcuggga

SEQ ID NO: 2525556 - RNA, 21 nt, Human
ggccagaggaacuguccagag

SEQ ID NO: 2525557 - RNA, 21 nt, Human
ggccagagcugggaggcaugg

SEQ ID NO: 2525558 - RNA, 22 nt, Human
ggccagaggaacuguccagaga

SEQ ID NO: 2525559 - RNA, 14 nt, Human
ggccagagccaggg

SEQ ID NO: 2525560 - RNA, 22 nt, Human
ggccagagcuacccgcagaguu

SEQ ID NO: 2525561 - RNA, 22 nt, Human
ggccagagagccuggugcugcu

SEQ ID NO: 2525562 - RNA, 11 nt, Human
ggccagagcca

SEQ ID NO: 2525563 - RNA, 12 nt, Human
ggccagagccag

SEQ ID NO: 2525564 - RNA, 13 nt, Human
ggccagagccagg

SEQ ID NO: 2525565 - RNA, 21 nt, Human
ggccaaacucaccugccccuc

SEQ ID NO: 2525566 - RNA, 15 nt, Human
ggccaaaccucuguu

SEQ ID NO: 2525567 - RNA, 16 nt, Human
ggccaaaccucuguuc

SEQ ID NO: 2525568 - RNA, 23 nt, Human
ggccagagagccuggugcugcug

SEQ ID NO: 2525569 - RNA, 17 nt, Human
ggccaaacucaccugcc

SEQ ID NO: 2525570 - RNA, 12 nt, Human
ggccaaaccucu

SEQ ID NO: 2525571 - RNA, 18 nt, Human
ggccugaggaugagcugg

SEQ ID NO: 2525572 - RNA, 13 nt, Human
ggccugaggauga

SEQ ID NO: 2525573 - RNA, 21 nt, Human
ggccugaggucucgcugaugc

SEQ ID NO: 2525574 - RNA, 18 nt, Human
ggccugaggucucgcuga

SEQ ID NO: 2525575 - RNA, 22 nt, Human
ggccugaggaugagcuggaagg

SEQ ID NO: 2525576 - RNA, 19 nt, Human
ggccugaggaugagcugga

SEQ ID NO: 2525577 - RNA, 15 nt, Human
ggccugagcugggau

SEQ ID NO: 2525578 - RNA, 12 nt, Human
ggccugagcugg

SEQ ID NO: 2525579 - RNA, 16 nt, Human
ggccggccaggugggc

SEQ ID NO: 2525580 - RNA, 15 nt, Human
ggccggccagguggg

SEQ ID NO: 2525581 - RNA, 14 nt, Human
ggccggccaggugg

SEQ ID NO: 2525582 - RNA, 20 nt, Human
ggccggagucagugccaggu

SEQ ID NO: 2525583 - RNA, 15 nt, Human
ggccggccagccccu

SEQ ID NO: 2525584 - RNA, 22 nt, Human
ggccgcugccacccaccucccu

SEQ ID NO: 2525585 - RNA, 23 nt, Human
ggccgcugccacccaccucccug

SEQ ID NO: 2525586 - RNA, 16 nt, Human
ggccgcuguucaccca

SEQ ID NO: 2525587 - RNA, 19 nt, Human
ggccgcuguucacccacag

SEQ ID NO: 2525588 - RNA, 17 nt, Human
ggccucauguggcugga

SEQ ID NO: 2525589 - RNA, 16 nt, Human
ggccucauguggcugg

SEQ ID NO: 2525590 - RNA, 17 nt, Human
ggccggccaggugggcg

SEQ ID NO: 2525591 - RNA, 15 nt, Human
ggccucauguggcug

SEQ ID NO: 2525592 - RNA, 20 nt, Human
ggccucauguggcuggaaga

SEQ ID NO: 2525593 - RNA, 19 nt, Human
ggccucauguggcuggaag

SEQ ID NO: 2525594 - RNA, 13 nt, Human
ggccuccauccug

SEQ ID NO: 2525595 - RNA, 15 nt, Human
ggccuccagaacuca

SEQ ID NO: 2525596 - RNA, 20 nt, Human
ggccuccagaacucacuggg

SEQ ID NO: 2525597 - RNA, 17 nt, Human
ggccucauuacuuuacc

SEQ ID NO: 2525598 - RNA, 23 nt, Human
ggccuucggccuccauccugagg

SEQ ID NO: 2525599 - RNA, 12 nt, Human
ggccuucucuga

SEQ ID NO: 2525600 - RNA, 22 nt, Human
ggccugugucccaugacccacc

SEQ ID NO: 2525601 - RNA, 21 nt, Human
ggccugugucccaugacccac

SEQ ID NO: 2525602 - RNA, 22 nt, Human
ggccugugugugaaaggaagcu

SEQ ID NO: 2525603 - RNA, 20 nt, Human
ggccugugucccaugaccca

SEQ ID NO: 2525604 - RNA, 21 nt, Human
ggccugugucuaguuguuuga

SEQ ID NO: 2525605 - RNA, 20 nt, Human
ggccugugggagccugcaaa

SEQ ID NO: 2525606 - RNA, 17 nt, Human
ggccugugggagccugc

SEQ ID NO: 2525607 - RNA, 20 nt, Human
ggccuguggccuguguccca

SEQ ID NO: 2525608 - RNA, 18 nt, Human
ggccuguggccugugucc

SEQ ID NO: 2525609 - RNA, 23 nt, Human
ggccuggcccacagcaggugcug

SEQ ID NO: 2525610 - RNA, 20 nt, Human
ggccuguggaucaaauccag

SEQ ID NO: 2525611 - RNA, 18 nt, Human
ggccuggccagggccugg

SEQ ID NO: 2525612 - RNA, 17 nt, Human
ggccuggccagggccug

SEQ ID NO: 2525613 - RNA, 22 nt, Human
ggccuggccagggccuggaaga

SEQ ID NO: 2525614 - RNA, 14 nt, Human
ggccuggccaggca

SEQ ID NO: 2525615 - RNA, 13 nt, Human
ggccuggccaggc

SEQ ID NO: 2525616 - RNA, 23 nt, Human
ggccuggccaggagcucuucagg

SEQ ID NO: 2525617 - RNA, 17 nt, Human
ggccuggagauccuccu

SEQ ID NO: 2525618 - RNA, 15 nt, Human
ggccuggagauccuc

SEQ ID NO: 2525619 - RNA, 14 nt, Human
ggccuggagauccu

SEQ ID NO: 2525620 - RNA, 11 nt, Human
ggccuggagau

SEQ ID NO: 2525621 - RNA, 21 nt, Human
ggccuggccagaugcaccagc

SEQ ID NO: 2525622 - RNA, 19 nt, Human
ggccuggagauccuccugc

SEQ ID NO: 2525623 - RNA, 18 nt, Human
ggccuggagauccuccug

SEQ ID NO: 2525624 - RNA, 14 nt, Human
ggccuggccaggag

SEQ ID NO: 2525625 - RNA, 15 nt, Human
ggccuggccaggagc

SEQ ID NO: 2525626 - RNA, 16 nt, Human
ggccuggccaggagcu

SEQ ID NO: 2525627 - RNA, 17 nt, Human
ggccuggccaggagcuc

SEQ ID NO: 2525628 - RNA, 18 nt, Human
ggccuggccaggagcucu

SEQ ID NO: 2525629 - RNA, 15 nt, Human
ggccugaucagacca

SEQ ID NO: 2525630 - RNA, 18 nt, Human
ggccugaucagaccacgg

SEQ ID NO: 2525631 - RNA, 19 nt, Human
ggccugaggucuggcugcu

SEQ ID NO: 2525632 - RNA, 22 nt, Human
ggccugaggucucgcugaugcu

SEQ ID NO: 2525633 - RNA, 21 nt, Human
ggccugaggucuggcugcuug

SEQ ID NO: 2525634 - RNA, 20 nt, Human
ggccugaucagaccacggcu

SEQ ID NO: 2525635 - RNA, 14 nt, Human
ggccugaugacaga

SEQ ID NO: 2525636 - RNA, 20 nt, Human
ggccugcugggcucuccacc

SEQ ID NO: 2525637 - RNA, 18 nt, Human
ggccugaugacagagcga

SEQ ID NO: 2525638 - RNA, 21 nt, Human
ggccugcugggcucuccaccu

SEQ ID NO: 2525639 - RNA, 22 nt, Human
ggccuggaccugccuccugccu

SEQ ID NO: 2525640 - RNA, 21 nt, Human
ggccuggaccugccuccugcc

SEQ ID NO: 2525641 - RNA, 16 nt, Human
ggccuggaccugccuc

SEQ ID NO: 2525642 - RNA, 15 nt, Human
ggccuggaccugccu

SEQ ID NO: 2525643 - RNA, 21 nt, Human
ggccuggacuuuccugcaacu

SEQ ID NO: 2525644 - RNA, 18 nt, Human
ggccuggacuuuccugca

SEQ ID NO: 2525645 - RNA, 13 nt, Human
ggccuggaccugc

SEQ ID NO: 2525646 - RNA, 17 nt, Human
ggccugcuuccugucuu

SEQ ID NO: 2525647 - RNA, 16 nt, Human
ggccuggaagacagag

SEQ ID NO: 2525648 - RNA, 19 nt, Human
ggccugcugugauuccacu

SEQ ID NO: 2525649 - RNA, 10 nt, Human
ggccugcugu

SEQ ID NO: 2525650 - RNA, 22 nt, Human
ggccugcugggcucuccaccuc

SEQ ID NO: 2525651 - RNA, 23 nt, Human
ggccugcugggcucuccaccuca

SEQ ID NO: 2525652 - RNA, 16 nt, Human
ggccuucucugaagga

SEQ ID NO: 2525653 - RNA, 15 nt, Human
ggccuucucugaagg

SEQ ID NO: 2525654 - RNA, 16 nt, Human
ggccuugaguccccca

SEQ ID NO: 2525655 - RNA, 13 nt, Human
ggccuugcccaga

SEQ ID NO: 2525656 - RNA, 14 nt, Human
ggccuugcccagag

SEQ ID NO: 2525657 - RNA, 22 nt, Human
ggccuugcgguauccgccccca

SEQ ID NO: 2525658 - RNA, 15 nt, Human
ggccuugcccagaga

SEQ ID NO: 2525659 - RNA, 16 nt, Human
ggccuugcccagagau

SEQ ID NO: 2525660 - RNA, 19 nt, Human
ggccuuugagcccacaaag

SEQ ID NO: 2525661 - RNA, 16 nt, Human
ggccuuucugugugug

SEQ ID NO: 2525662 - RNA, 23 nt, Human
ggccuuugagcccacaaagccuu

SEQ ID NO: 2525663 - RNA, 13 nt, Human
ggccuuuggcuuc

SEQ ID NO: 2525664 - RNA, 12 nt, Human
ggccuuguccca

SEQ ID NO: 2525665 - RNA, 22 nt, Human
ggccuuuaaaauuuuuuuagaa

SEQ ID NO: 2525666 - RNA, 14 nt, Human
ggccuuuaaaauuu

SEQ ID NO: 2525667 - RNA, 15 nt, Human
ggcgaaucauuuguu

SEQ ID NO: 2525668 - RNA, 20 nt, Human
ggcgacagagcgagacuccg

SEQ ID NO: 2525669 - RNA, 23 nt, Human
ggcgacagagcgagagucugucu

SEQ ID NO: 2525670 - RNA, 16 nt, Human
ggcgaagcccaggccc

SEQ ID NO: 2525671 - RNA, 18 nt, Human
ggcgacaguuuuccuucu

SEQ ID NO: 2525672 - RNA, 14 nt, Human
ggccuuuggcuuca

SEQ ID NO: 2525673 - RNA, 12 nt, Human
ggccuuuuccua

SEQ ID NO: 2525674 - RNA, 18 nt, Human
ggcgucagccuccagccu

SEQ ID NO: 2525675 - RNA, 17 nt, Human
ggcgucagccuccagcc

SEQ ID NO: 2525676 - RNA, 16 nt, Human
ggcgucagccuccagc

SEQ ID NO: 2525677 - RNA, 14 nt, Human
ggcgucagccucca

SEQ ID NO: 2525678 - RNA, 13 nt, Human
ggcgucagccucc

SEQ ID NO: 2525679 - RNA, 20 nt, Human
ggcgaccccgucacagccuc

SEQ ID NO: 2525680 - RNA, 19 nt, Human
ggcgaccccgucacagccu

SEQ ID NO: 2525681 - RNA, 22 nt, Human
ggcggugggcacccacccuggg

SEQ ID NO: 2525682 - RNA, 21 nt, Human
ggcggugggcacccacccugg

SEQ ID NO: 2525683 - RNA, 11 nt, Human
ggcucagccug

SEQ ID NO: 2525684 - RNA, 23 nt, Human
ggcucagcggggacagcuccuuc

SEQ ID NO: 2525685 - RNA, 22 nt, Human
ggcucagcggggacagcuccuu

SEQ ID NO: 2525686 - RNA, 21 nt, Human
ggcucagcggggacagcuccu

SEQ ID NO: 2525687 - RNA, 23 nt, Human
ggcucagcaaaagaugcuucuca

SEQ ID NO: 2525688 - RNA, 14 nt, Human
ggcucacugccagg

SEQ ID NO: 2525689 - RNA, 13 nt, Human
ggcucacugccag

SEQ ID NO: 2525690 - RNA, 19 nt, Human
ggcucagcaaaagaugcuu

SEQ ID NO: 2525691 - RNA, 15 nt, Human
ggcucagccagcacu

SEQ ID NO: 2525692 - RNA, 10 nt, Human
ggcucagccu

SEQ ID NO: 2525693 - RNA, 12 nt, Human
ggcucagccugg

SEQ ID NO: 2525694 - RNA, 19 nt, Human
ggcgugcaguggugcgauc

SEQ ID NO: 2525695 - RNA, 15 nt, Human
ggcguggagcugccu

SEQ ID NO: 2525696 - RNA, 16 nt, Human
ggcgucuguucccccu

SEQ ID NO: 2525697 - RNA, 20 nt, Human
ggcguggagagcccggcgcc

SEQ ID NO: 2525698 - RNA, 12 nt, Human
ggcguggagcug

SEQ ID NO: 2525699 - RNA, 14 nt, Human
ggcgugcaguggug

SEQ ID NO: 2525700 - RNA, 22 nt, Human
ggcgucagccuccagccucugu

SEQ ID NO: 2525701 - RNA, 20 nt, Human
ggcgucagccuccagccucu

SEQ ID NO: 2525702 - RNA, 19 nt, Human
ggcgucagccuccagccuc

SEQ ID NO: 2525703 - RNA, 16 nt, Human
ggcgucuguauauuuu

SEQ ID NO: 2525704 - RNA, 21 nt, Human
ggcguccgcgcgccagcacag

SEQ ID NO: 2525705 - RNA, 15 nt, Human
ggcgucugucuucaa

SEQ ID NO: 2525706 - RNA, 16 nt, Human
ggcucacugcagccuc

SEQ ID NO: 2525707 - RNA, 17 nt, Human
ggcguggucacugcugu

SEQ ID NO: 2525708 - RNA, 15 nt, Human
ggcguggucacugcu

SEQ ID NO: 2525709 - RNA, 17 nt, Human
ggcguggucaagcacuc

SEQ ID NO: 2525710 - RNA, 19 nt, Human
ggcguggucacugcuguca

SEQ ID NO: 2525711 - RNA, 18 nt, Human
ggcguggucacugcuguc

SEQ ID NO: 2525712 - RNA, 16 nt, Human
ggcgugguggcgggca

SEQ ID NO: 2525713 - RNA, 16 nt, Human
ggcucacugcauccuc

SEQ ID NO: 2525714 - RNA, 19 nt, Human
ggcucacugcauccuccgc

SEQ ID NO: 2525715 - RNA, 17 nt, Human
ggcucacugcagccuca

SEQ ID NO: 2525716 - RNA, 22 nt, Human
gguucccuuugacgccauccca

SEQ ID NO: 2525717 - RNA, 16 nt, Human
gguuccuccccuccuc

SEQ ID NO: 2525718 - RNA, 18 nt, Human
gguuccuauggcuggcca

SEQ ID NO: 2525719 - RNA, 21 nt, Human
gguucccuuugacgccauccc

SEQ ID NO: 2525720 - RNA, 16 nt, Human
gguucccucugagaau

SEQ ID NO: 2525721 - RNA, 13 nt, Human
gguucccucugag

SEQ ID NO: 2525722 - RNA, 17 nt, Human
gguucccuuuccuucca

SEQ ID NO: 2525723 - RNA, 22 nt, Human
gguucccuuuccuuccaucccu

SEQ ID NO: 2525724 - RNA, 23 nt, Human
gguuccagcaauucuccugccuc

SEQ ID NO: 2525725 - RNA, 23 nt, Human
gguucauuucaaauacaucuuug

SEQ ID NO: 2525726 - RNA, 15 nt, Human
gguucaucugagcaa

SEQ ID NO: 2525727 - RNA, 16 nt, Human
gguucauuauuggaau

SEQ ID NO: 2525728 - RNA, 17 nt, Human
gguucauuauuggaauu

SEQ ID NO: 2525729 - RNA, 18 nt, Human
gguucauuauuggaauua

SEQ ID NO: 2525730 - RNA, 19 nt, Human
gguucauuauuggaauuaa

SEQ ID NO: 2525731 - RNA, 16 nt, Human
gguucccccagcccug

SEQ ID NO: 2525732 - RNA, 24 nt, Human
gguuccagcaauucuccugccuca

SEQ ID NO: 2525733 - RNA, 15 nt, Human
gguuccccuguucac

SEQ ID NO: 2525734 - RNA, 17 nt, Human
gguucccguuucuccac

SEQ ID NO: 2525735 - RNA, 21 nt, Human
gguucccccagcccuguggaa

SEQ ID NO: 2525736 - RNA, 21 nt, Human
gguucaggguuggccccugcc

SEQ ID NO: 2525737 - RNA, 18 nt, Human
gguucaggguuggccccu

SEQ ID NO: 2525738 - RNA, 22 nt, Human
ggugugcugggagcuccacucu

SEQ ID NO: 2525739 - RNA, 21 nt, Human
gguucauaggucacuggcucu

SEQ ID NO: 2525740 - RNA, 22 nt, Human
gguucaggguuggccccugccc

SEQ ID NO: 2525741 - RNA, 19 nt, Human
ggugugcugggagcuccac

SEQ ID NO: 2525742 - RNA, 12 nt, Human
ggugugcuggga

SEQ ID NO: 2525743 - RNA, 12 nt, Human
gguguggaagag

SEQ ID NO: 2525744 - RNA, 13 nt, Human
ggugugcucugau

SEQ ID NO: 2525745 - RNA, 21 nt, Human
ggugugcggccuuuggcuuca

SEQ ID NO: 2525746 - RNA, 12 nt, Human
gguuucagaaau

SEQ ID NO: 2525747 - RNA, 13 nt, Human
gguuucagaaaug

SEQ ID NO: 2525748 - RNA, 19 nt, Human
gguuucaccauguugccca

SEQ ID NO: 2525749 - RNA, 19 nt, Human
gguuucaccauguuggcca

SEQ ID NO: 2525750 - RNA, 14 nt, Human
gguuucagaaaugu

SEQ ID NO: 2525751 - RNA, 21 nt, Human
gguuucucgcauaggaccuuu

SEQ ID NO: 2525752 - RNA, 17 nt, Human
gguuucugaguuccugc

SEQ ID NO: 2525753 - RNA, 14 nt, Human
gguuucugagcugc

SEQ ID NO: 2525754 - RNA, 13 nt, Human
gguuucugaaaau

SEQ ID NO: 2525755 - RNA, 16 nt, Human
gguuuagaaagcuugc

SEQ ID NO: 2525756 - RNA, 20 nt, Human
gguuuaggcugguggcccag

SEQ ID NO: 2525757 - RNA, 22 nt, Human
gguuuaggcugguggcccagga

SEQ ID NO: 2525758 - RNA, 17 nt, Human
gguuuaggcugguggcc

SEQ ID NO: 2525759 - RNA, 17 nt, Human
gguucuggggccccuuu

SEQ ID NO: 2525760 - RNA, 20 nt, Human
gguucugccugccagcugca

SEQ ID NO: 2525761 - RNA, 21 nt, Human
gguucugaugaugugccuggg

SEQ ID NO: 2525762 - RNA, 17 nt, Human
gguucuccucuccccuc

SEQ ID NO: 2525763 - RNA, 12 nt, Human
gguucuggcugc

SEQ ID NO: 2525764 - RNA, 19 nt, Human
gguucugccugccagcugc

SEQ ID NO: 2525765 - RNA, 18 nt, Human
gguucuggugugaacuaa

SEQ ID NO: 2525766 - RNA, 12 nt, Human
gguucuggggcc

SEQ ID NO: 2525767 - RNA, 21 nt, Human
gguucuccguuagcuccugug

SEQ ID NO: 2525768 - RNA, 20 nt, Human
gguucuccguuagcuccugu

SEQ ID NO: 2525769 - RNA, 19 nt, Human
gguucuccguuagcuccug

SEQ ID NO: 2525770 - RNA, 18 nt, Human
gguucucccccuuucucu

SEQ ID NO: 2525771 - RNA, 18 nt, Human
gguucucagguguugcca

SEQ ID NO: 2525772 - RNA, 12 nt, Human
gguucucaucuu

SEQ ID NO: 2525773 - RNA, 18 nt, Human
gguuccucugccugcccc

SEQ ID NO: 2525774 - RNA, 23 nt, Human
gguucucacagugggagccaggg

SEQ ID NO: 2525775 - RNA, 19 nt, Human
gguuccuuccucugagccu

SEQ ID NO: 2525776 - RNA, 20 nt, Human
gguuccuuccucugagccuu

SEQ ID NO: 2525777 - RNA, 17 nt, Human
gguuccucugccugccc

SEQ ID NO: 2525778 - RNA, 15 nt, Human
gguuccucugccugc

SEQ ID NO: 2525779 - RNA, 14 nt, Human
gguuccucugccug

SEQ ID NO: 2525780 - RNA, 12 nt, Human
gguuccucugcc

SEQ ID NO: 2525781 - RNA, 22 nt, Human
gguuccuauggcuggccacugc

SEQ ID NO: 2525782 - RNA, 18 nt, Human
ggugugaucgucugacug

SEQ ID NO: 2525783 - RNA, 20 nt, Human
ggugugcaaugucugaguga

SEQ ID NO: 2525784 - RNA, 15 nt, Human
ggugugaucgucuga

SEQ ID NO: 2525785 - RNA, 18 nt, Human
ggugugagucaccaagcc

SEQ ID NO: 2525786 - RNA, 16 nt, Human
ggugugcaccaggguu

SEQ ID NO: 2525787 - RNA, 17 nt, Human
ggugugcaccaggguug

SEQ ID NO: 2525788 - RNA, 15 nt, Human
ggugugcacaucucu

SEQ ID NO: 2525789 - RNA, 16 nt, Human
ggugugcacaucucug

SEQ ID NO: 2525790 - RNA, 18 nt, Human
ggugugcacaucucugcu

SEQ ID NO: 2525791 - RNA, 23 nt, Human
ggugugcacaucucugcuugagu

SEQ ID NO: 2525792 - RNA, 24 nt, Human
ggugugcacguggcauguggccug

SEQ ID NO: 2525793 - RNA, 15 nt, Human
ggugugccugcagcc

SEQ ID NO: 2525794 - RNA, 13 nt, Human
ggugugccugcag

SEQ ID NO: 2525795 - RNA, 14 nt, Human
ggugugccugcagc

SEQ ID NO: 2525796 - RNA, 23 nt, Human
ggugucuccaaccccccagcacu

SEQ ID NO: 2525797 - RNA, 19 nt, Human
ggugucuccaaccccccag

SEQ ID NO: 2525798 - RNA, 20 nt, Human
ggugucuugggcagagcugg

SEQ ID NO: 2525799 - RNA, 23 nt, Human
ggugucuguguuccaaccacuga

SEQ ID NO: 2525800 - RNA, 16 nt, Human
ggugugaccacugcag

SEQ ID NO: 2525801 - RNA, 16 nt, Human
ggugugacugaauuuc

SEQ ID NO: 2525802 - RNA, 15 nt, Human
ggugugaccugaggg

SEQ ID NO: 2525803 - RNA, 16 nt, Human
ggugucugcacccagg

SEQ ID NO: 2525804 - RNA, 20 nt, Human
ggugugaaagucagaugccc

SEQ ID NO: 2525805 - RNA, 21 nt, Human
ggugucgcgccuucucccccc

SEQ ID NO: 2525806 - RNA, 20 nt, Human
ggugucgcgccuucuccccc

SEQ ID NO: 2525807 - RNA, 21 nt, Human
ggugucgcucugcuggccugg

SEQ ID NO: 2525808 - RNA, 16 nt, Human
ggugucgggcaugaca

SEQ ID NO: 2525809 - RNA, 16 nt, Human
gguggggguggaggcu

SEQ ID NO: 2525810 - RNA, 17 nt, Human
ggugucgcgccuucucc

SEQ ID NO: 2525811 - RNA, 15 nt, Human
ggugucgcgccuucu

SEQ ID NO: 2525812 - RNA, 15 nt, Human
gguggggucaugccc

SEQ ID NO: 2525813 - RNA, 19 nt, Human
gguggggucaugcccuccu

SEQ ID NO: 2525814 - RNA, 13 nt, Human
ggugucgggcaug

SEQ ID NO: 2525815 - RNA, 23 nt, Human
gguggggucacucuggcagcuca

SEQ ID NO: 2525816 - RNA, 15 nt, Human
gguggggucacucug

SEQ ID NO: 2525817 - RNA, 17 nt, Human
gguggggggggugcugg

SEQ ID NO: 2525818 - RNA, 23 nt, Human
gguggggguagagcugauccaga

SEQ ID NO: 2525819 - RNA, 12 nt, Human
gguggggcggga

SEQ ID NO: 2525820 - RNA, 18 nt, Human
aaagccuguuuaagagac

SEQ ID NO: 2525821 - RNA, 16 nt, Human
aaagccuguuuaagag

SEQ ID NO: 2525822 - RNA, 21 nt, Human
aaagccuugugucuacagaga

SEQ ID NO: 2525823 - RNA, 17 nt, Human
aaagccuuaucaagugu

SEQ ID NO: 2525824 - RNA, 14 nt, Human
aaagcaugaauggu

SEQ ID NO: 2525825 - RNA, 15 nt, Human
ggugggauccuccag

SEQ ID NO: 2525826 - RNA, 14 nt, Human
ggugggauccucca

SEQ ID NO: 2525827 - RNA, 14 nt, Human
aaagcgaauuuuaa

SEQ ID NO: 2525828 - RNA, 23 nt, Human
aaagccuugugucuacagagaac

SEQ ID NO: 2525829 - RNA, 20 nt, Human
ggugggaggauugcuugagc

SEQ ID NO: 2525830 - RNA, 14 nt, Human
gguggggaggggcg

SEQ ID NO: 2525831 - RNA, 13 nt, Human
gguggggaggggc

SEQ ID NO: 2525832 - RNA, 12 nt, Human
gguggggagggg

SEQ ID NO: 2525833 - RNA, 11 nt, Human
gguggggaggg

SEQ ID NO: 2525834 - RNA, 17 nt, Human
gguggggcagcuugagg

SEQ ID NO: 2525835 - RNA, 14 nt, Human
ggugggccucuggu

SEQ ID NO: 2525836 - RNA, 13 nt, Human
ggugggccucugg

SEQ ID NO: 2525837 - RNA, 16 nt, Human
ggugggccgcaggcgg

SEQ ID NO: 2525838 - RNA, 23 nt, Human
ggugggcccaggaccagcugggg

SEQ ID NO: 2525839 - RNA, 13 nt, Human
gguggggcagcuu

SEQ ID NO: 2525840 - RNA, 22 nt, Human
ggugggcccaggaccagcuggg

SEQ ID NO: 2525841 - RNA, 21 nt, Human
ggugggcccaggaccagcugg

SEQ ID NO: 2525842 - RNA, 20 nt, Human
ggugggcccaggaccagcug

SEQ ID NO: 2525843 - RNA, 18 nt, Human
ggugggcccaggaccagc

SEQ ID NO: 2525844 - RNA, 17 nt, Human
ggugggcccaggaccag

SEQ ID NO: 2525845 - RNA, 12 nt, Human
ggugggcccagg

SEQ ID NO: 2525846 - RNA, 12 nt, Human
ggugggccaggc

SEQ ID NO: 2525847 - RNA, 14 nt, Human
ggugggccaggcug

SEQ ID NO: 2525848 - RNA, 16 nt, Human
ggugggcagguggugg

SEQ ID NO: 2525849 - RNA, 14 nt, Human
ggugggcagguggu

SEQ ID NO: 2525850 - RNA, 16 nt, Human
ggugggccagccccuc

SEQ ID NO: 2525851 - RNA, 20 nt, Human
ggugggccagccccucccac

SEQ ID NO: 2525852 - RNA, 14 nt, Human
ggugggcaggaaaa

SEQ ID NO: 2525853 - RNA, 18 nt, Human
ggugggcacccacccugg

SEQ ID NO: 2525854 - RNA, 19 nt, Human
ggugggauccuccaggugc

SEQ ID NO: 2525855 - RNA, 16 nt, Human
ggugggauggaggaga

SEQ ID NO: 2525856 - RNA, 17 nt, Human
ggugggauggaggagaa

SEQ ID NO: 2525857 - RNA, 17 nt, Human
ggugggcacccacccug

SEQ ID NO: 2525858 - RNA, 22 nt, Human
guaaagauauuuuuaucuuuau

SEQ ID NO: 2525859 - RNA, 23 nt, Human
guaaagagaccuaccucagguug

SEQ ID NO: 2525860 - RNA, 22 nt, Human
guaaagagaccuaccucagguu

SEQ ID NO: 2525861 - RNA, 19 nt, Human
guaaagauauuuuuaucuu

SEQ ID NO: 2525862 - RNA, 21 nt, Human
guaaagagaccuaccucaggu

SEQ ID NO: 2525863 - RNA, 14 nt, Human
guaaagagaccuac

SEQ ID NO: 2525864 - RNA, 14 nt, Human
guaaagacuggcuu

SEQ ID NO: 2525865 - RNA, 22 nt, Human
guaaagaaauuuaaaagacacu

SEQ ID NO: 2525866 - RNA, 19 nt, Human
guaaagacuggcuuuuauu

SEQ ID NO: 2525867 - RNA, 15 nt, Human
guaaagacuggcuuu

SEQ ID NO: 2525868 - RNA, 16 nt, Human
guaaagacuguagaag

SEQ ID NO: 2525869 - RNA, 17 nt, Human
guaacaaugaagauaaa

SEQ ID NO: 2525870 - RNA, 16 nt, Human
guaaauuuaugugaug

SEQ ID NO: 2525871 - RNA, 17 nt, Human
guaaauuuaugugaugg

SEQ ID NO: 2525872 - RNA, 19 nt, Human
guaaauugaaucaguauaa

SEQ ID NO: 2525873 - RNA, 16 nt, Human
guaaagcauuccaaca

SEQ ID NO: 2525874 - RNA, 22 nt, Human
guaaaaugugaagugaaugaaa

SEQ ID NO: 2525875 - RNA, 20 nt, Human
guaaaaugugaagugaauga

SEQ ID NO: 2525876 - RNA, 19 nt, Human
guaaaaugugaagugaaug

SEQ ID NO: 2525877 - RNA, 12 nt, Human
guaaaaugugaa

SEQ ID NO: 2525878 - RNA, 15 nt, Human
guaaaaucuuucuuu

SEQ ID NO: 2525879 - RNA, 14 nt, Human
guaaaaucuuucuu

SEQ ID NO: 2525880 - RNA, 21 nt, Human
guaaaaucuuucuuucuuaga

SEQ ID NO: 2525881 - RNA, 19 nt, Human
guaaaauauuuugaaucaa

SEQ ID NO: 2525882 - RNA, 18 nt, Human
guaaaauauuuugaauca

SEQ ID NO: 2525883 - RNA, 21 nt, Human
guaaaauauuuugaaucaaua

SEQ ID NO: 2525884 - RNA, 21 nt, Human
guaaaauauagcuguacaaau

SEQ ID NO: 2525885 - RNA, 20 nt, Human
guaaaauauagcuguacaaa

SEQ ID NO: 2525886 - RNA, 18 nt, Human
guaaaauauagcuguaca

SEQ ID NO: 2525887 - RNA, 15 nt, Human
guaaaauauuuugaa

SEQ ID NO: 2525888 - RNA, 16 nt, Human
guaaaauauagcugua

SEQ ID NO: 2525889 - RNA, 15 nt, Human
guaaaauauagcugu

SEQ ID NO: 2525890 - RNA, 20 nt, Human
aaauaauuuuuauauuugaa

SEQ ID NO: 2525891 - RNA, 18 nt, Human
aaauaauuuuuauauuug

SEQ ID NO: 2525892 - RNA, 15 nt, Human
aaauaauuuuuauau

SEQ ID NO: 2525893 - RNA, 13 nt, Human
aaauaaugugaaa

SEQ ID NO: 2525894 - RNA, 20 nt, Human
aaauaagugguuauuucuca

SEQ ID NO: 2525895 - RNA, 12 nt, Human
aaauaaugugaa

SEQ ID NO: 2525896 - RNA, 12 nt, Human
aaauaaugucuc

SEQ ID NO: 2525897 - RNA, 13 nt, Human
aaauaaugucucu

SEQ ID NO: 2525898 - RNA, 18 nt, Human
aaauaagggcagagucac

SEQ ID NO: 2525899 - RNA, 18 nt, Human
aaaguuuugaaaagcuau

SEQ ID NO: 2525900 - RNA, 16 nt, Human
aaaguuuugaaaagcu

SEQ ID NO: 2525901 - RNA, 13 nt, Human
aaauaaaaaaaag

SEQ ID NO: 2525902 - RNA, 15 nt, Human
aaauaaaaaaaagaa

SEQ ID NO: 2525903 - RNA, 17 nt, Human
aaauaaaaaaaagaaaa

SEQ ID NO: 2525904 - RNA, 20 nt, Human
aaauaaaaaaaagaaaaaag

SEQ ID NO: 2525905 - RNA, 22 nt, Human
aaauaaaaaaaagaaaaaagag

SEQ ID NO: 2525906 - RNA, 19 nt, Human
aaaguuuugaaaagcuauu

SEQ ID NO: 2525907 - RNA, 14 nt, Human
aaaguuuugaaaag

SEQ ID NO: 2525908 - RNA, 13 nt, Human
aaaguuuugaaaa

SEQ ID NO: 2525909 - RNA, 12 nt, Human
aaaguuuugaaa

SEQ ID NO: 2525910 - RNA, 15 nt, Human
aaaguuuuccugaga

SEQ ID NO: 2525911 - RNA, 16 nt, Human
aaaguuuuauuuuucu

SEQ ID NO: 2525912 - RNA, 15 nt, Human
aaaguuuucccuuga

SEQ ID NO: 2525913 - RNA, 16 nt, Human
aaaguuuguugaaaca

SEQ ID NO: 2525914 - RNA, 17 nt, Human
aaaguuucucagauccu

SEQ ID NO: 2525915 - RNA, 13 nt, Human
aaaguuucucaga

SEQ ID NO: 2525916 - RNA, 12 nt, Human
aaaguuucucag

SEQ ID NO: 2525917 - RNA, 16 nt, Human
aaaguuugcuuagaaa

SEQ ID NO: 2525918 - RNA, 15 nt, Human
aaaguuugcuuagaa

SEQ ID NO: 2525919 - RNA, 13 nt, Human
aaaguuugccaga

SEQ ID NO: 2525920 - RNA, 15 nt, Human
aaaguuugccagaag

SEQ ID NO: 2525921 - RNA, 22 nt, Human
aaaguuuacaguaaauaaauug

SEQ ID NO: 2525922 - RNA, 21 nt, Human
aaaguuuacaguaaauaaauu

SEQ ID NO: 2525923 - RNA, 18 nt, Human
aaaguuuacaguaaauaa

SEQ ID NO: 2525924 - RNA, 15 nt, Human
aaaguuuacaguaaa

SEQ ID NO: 2525925 - RNA, 14 nt, Human
aaaguuuccauaug

SEQ ID NO: 2525926 - RNA, 13 nt, Human
aaaguuuccauau

SEQ ID NO: 2525927 - RNA, 13 nt, Human
aaaguuucaaugu

SEQ ID NO: 2525928 - RNA, 12 nt, Human
aaaguuucaaug

SEQ ID NO: 2525929 - RNA, 23 nt, Human
aaaguuucucuuuucaaaacauu

SEQ ID NO: 2525930 - RNA, 21 nt, Human
aaaguuucucuuuucaaaaca

SEQ ID NO: 2525931 - RNA, 19 nt, Human
aaaguuuacaaguguauau

SEQ ID NO: 2525932 - RNA, 18 nt, Human
aaaguugcacggcugcug

SEQ ID NO: 2525933 - RNA, 23 nt, Human
aaaguucccuacuuccugugacu

SEQ ID NO: 2525934 - RNA, 19 nt, Human
aaaguguggucccaacagg

SEQ ID NO: 2525935 - RNA, 13 nt, Human
aaaguguguauua

SEQ ID NO: 2525936 - RNA, 12 nt, Human
aaaguguguauu

SEQ ID NO: 2525937 - RNA, 22 nt, Human
aaagugugcuuuaugcugaaac

SEQ ID NO: 2525938 - RNA, 23 nt, Human
aaagugugcuuuaugcugaaaca

SEQ ID NO: 2525939 - RNA, 22 nt, Human
aaagugugagcagugaguuaca

SEQ ID NO: 2525940 - RNA, 13 nt, Human
aaagugugcuuua

SEQ ID NO: 2525941 - RNA, 14 nt, Human
aaagugugcuuuau

SEQ ID NO: 2525942 - RNA, 19 nt, Human
aaagugugcuuuaugcuga

SEQ ID NO: 2525943 - RNA, 14 nt, Human
aaagugugagcagu

SEQ ID NO: 2525944 - RNA, 18 nt, Human
aaagugugagcaaacuaa

SEQ ID NO: 2525945 - RNA, 20 nt, Human
aaaguguaaauccuuuuucu

SEQ ID NO: 2525946 - RNA, 23 nt, Human
aaaguguccauugacauguacag

SEQ ID NO: 2525947 - RNA, 22 nt, Human
aaaguguccauugacauguaca

SEQ ID NO: 2525948 - RNA, 21 nt, Human
aaaguguccauugacauguac

SEQ ID NO: 2525949 - RNA, 19 nt, Human
aaaguguccauugacaugu

SEQ ID NO: 2525950 - RNA, 20 nt, Human
aaaguguguuguugcuuuag

SEQ ID NO: 2525951 - RNA, 14 nt, Human
aaaguguguuguug

SEQ ID NO: 2525952 - RNA, 23 nt, Human
aaaguguguauuaaaaaaaacaa

SEQ ID NO: 2525953 - RNA, 22 nt, Human
aaaguguguauuaaaaaaaaca

SEQ ID NO: 2525954 - RNA, 17 nt, Human
aaaguguguauuaaaaa

SEQ ID NO: 2525955 - RNA, 15 nt, Human
aaaguguguauuaaa

SEQ ID NO: 2525956 - RNA, 14 nt, Human
aaaguguguauuaa

SEQ ID NO: 2525957 - RNA, 17 nt, Human
aaaguguguuguugcuu

SEQ ID NO: 2525958 - RNA, 21 nt, Human
aaaguucccuacuuccuguga

SEQ ID NO: 2525959 - RNA, 22 nt, Human
aaaguucauagggucucuucag

SEQ ID NO: 2525960 - RNA, 22 nt, Human
aaaguguaaagcauuccaacaa

SEQ ID NO: 2525961 - RNA, 18 nt, Human
aaaguguaaagcauucca

SEQ ID NO: 2525962 - RNA, 17 nt, Human
aaaguguaaagcauucc

SEQ ID NO: 2525963 - RNA, 16 nt, Human
aaaguguaaagcauuc

SEQ ID NO: 2525964 - RNA, 15 nt, Human
aaaguguaaagcauu

SEQ ID NO: 2525965 - RNA, 13 nt, Human
aaaguguaaagca

SEQ ID NO: 2525966 - RNA, 12 nt, Human
aaaguguaaagc

SEQ ID NO: 2525967 - RNA, 11 nt, Human
aaaguguaaag

SEQ ID NO: 2525968 - RNA, 14 nt, Human
aaagugguuguuag

SEQ ID NO: 2525969 - RNA, 22 nt, Human
aaaguggugcucaguuguagaa

SEQ ID NO: 2525970 - RNA, 21 nt, Human
aaaguggugcucaguuguaga

SEQ ID NO: 2525971 - RNA, 19 nt, Human
aaaguggugcucaguugua

SEQ ID NO: 2525972 - RNA, 21 nt, Human
gguuuggcugugucuaaacug

SEQ ID NO: 2525973 - RNA, 15 nt, Human
gguuuggcugugucu

SEQ ID NO: 2525974 - RNA, 16 nt, Human
aaaguggugcucaguu

SEQ ID NO: 2525975 - RNA, 12 nt, Human
aaaguggugaga

SEQ ID NO: 2525976 - RNA, 17 nt, Human
gguuuggcgggccaagg

SEQ ID NO: 2525977 - RNA, 19 nt, Human
gguuuggcgggccaaggac

SEQ ID NO: 2525978 - RNA, 19 nt, Human
gguuuggaccccagcuggg

SEQ ID NO: 2525979 - RNA, 23 nt, Human
gguuuggccaucucuggaugccu

SEQ ID NO: 2525980 - RNA, 14 nt, Human
gguuuggcgggcca

SEQ ID NO: 2525981 - RNA, 22 nt, Human
gguuucuucaacaggagaauuu

SEQ ID NO: 2525982 - RNA, 15 nt, Human
gguuucuggucucua

SEQ ID NO: 2525983 - RNA, 22 nt, Human
gguuugacuccgcuggaggugg

SEQ ID NO: 2525984 - RNA, 18 nt, Human
gguuugaauauaaacacu

SEQ ID NO: 2525985 - RNA, 17 nt, Human
gguuugaagccuggaac

SEQ ID NO: 2525986 - RNA, 15 nt, Human
gguuugaagccugga

SEQ ID NO: 2525987 - RNA, 15 nt, Human
gguuugaauauaaac

SEQ ID NO: 2525988 - RNA, 20 nt, Human
gguuuggaccccagcuggga

SEQ ID NO: 2525989 - RNA, 12 nt, Human
gguuuggacccc

SEQ ID NO: 2525990 - RNA, 15 nt, Human
gguuuggaaugcuuc

SEQ ID NO: 2525991 - RNA, 18 nt, Human
gguuugcagaugacaaaa

SEQ ID NO: 2525992 - RNA, 14 nt, Human
gguuugcaaggaag

SEQ ID NO: 2525993 - RNA, 16 nt, Human
gguuugccugagggcg

SEQ ID NO: 2525994 - RNA, 13 nt, Human
gguccugagaccu

SEQ ID NO: 2525995 - RNA, 15 nt, Human
gguccucuugccucc

SEQ ID NO: 2525996 - RNA, 13 nt, Human
gguccucugucag

SEQ ID NO: 2525997 - RNA, 21 nt, Human
gguccucugucagucacagcc

SEQ ID NO: 2525998 - RNA, 23 nt, Human
gguccucugucagucacagccac

SEQ ID NO: 2525999 - RNA, 23 nt, Human
gguccugcugcaguugccaguca

SEQ ID NO: 2526000 - RNA, 21 nt, Human
gguccugcugcaguugccagu

SEQ ID NO: 2526001 - RNA, 21 nt, Human
gguccucugauacccagagca

SEQ ID NO: 2526002 - RNA, 14 nt, Human
gguccucagagaau

SEQ ID NO: 2526003 - RNA, 21 nt, Human
gguccucagagaauuucuacc

SEQ ID NO: 2526004 - RNA, 21 nt, Human
aaagcaacuguuaugaaauaa

SEQ ID NO: 2526005 - RNA, 21 nt, Human
aaagcaacugucuauuucugc

SEQ ID NO: 2526006 - RNA, 14 nt, Human
aaagcaagacuguu

SEQ ID NO: 2526007 - RNA, 13 nt, Human
aaagcaaaugucu

SEQ ID NO: 2526008 - RNA, 19 nt, Human
aaagcaacugucuauuucu

SEQ ID NO: 2526009 - RNA, 16 nt, Human
aaagcaaaugugaccu

SEQ ID NO: 2526010 - RNA, 23 nt, Human
aaagauugaaguauuuugcugga

SEQ ID NO: 2526011 - RNA, 19 nt, Human
aaagauugcugaaauuuua

SEQ ID NO: 2526012 - RNA, 21 nt, Human
aaagauugcugaaauuuuaua

SEQ ID NO: 2526013 - RNA, 13 nt, Human
aaagauuuaucaa

SEQ ID NO: 2526014 - RNA, 12 nt, Human
aaagauuuauca

SEQ ID NO: 2526015 - RNA, 15 nt, Human
aaagacuauucaaac

SEQ ID NO: 2526016 - RNA, 23 nt, Human
aaagacuaauuuaaaaaauaacu

SEQ ID NO: 2526017 - RNA, 20 nt, Human
aaagacuaauuuaaaaaaua

SEQ ID NO: 2526018 - RNA, 14 nt, Human
aaagacuaauuuaa

SEQ ID NO: 2526019 - RNA, 13 nt, Human
aaagcaaaggaga

SEQ ID NO: 2526020 - RNA, 13 nt, Human
aaagcaaaugaga

SEQ ID NO: 2526021 - RNA, 13 nt, Human
aaagauuuucaga

SEQ ID NO: 2526022 - RNA, 14 nt, Human
aaagcaaaacaaaa

SEQ ID NO: 2526023 - RNA, 14 nt, Human
aaagauuucuugag

SEQ ID NO: 2526024 - RNA, 15 nt, Human
aaagauuuuaaucaa

SEQ ID NO: 2526025 - RNA, 18 nt, Human
aaagauuuuaaucaaguu

SEQ ID NO: 2526026 - RNA, 14 nt, Human
aaagauuuuaauca

SEQ ID NO: 2526027 - RNA, 14 nt, Human
ggucgcuccugccc

SEQ ID NO: 2526028 - RNA, 13 nt, Human
ggucgcuccugcc

SEQ ID NO: 2526029 - RNA, 12 nt, Human
ggucgcuccugc

SEQ ID NO: 2526030 - RNA, 13 nt, Human
ggucggaaaacau

SEQ ID NO: 2526031 - RNA, 20 nt, Human
ggucgcccuggacugugugc

SEQ ID NO: 2526032 - RNA, 21 nt, Human
gguccuggccaucccacaagu

SEQ ID NO: 2526033 - RNA, 23 nt, Human
gguccuggggcucugugcaggga

SEQ ID NO: 2526034 - RNA, 21 nt, Human
gguccuggagcagaccacccc

SEQ ID NO: 2526035 - RNA, 17 nt, Human
gguccuggagcagacca

SEQ ID NO: 2526036 - RNA, 14 nt, Human
gguccugcugcagu

SEQ ID NO: 2526037 - RNA, 12 nt, Human
gguccuggccau

SEQ ID NO: 2526038 - RNA, 13 nt, Human
gguccuggccauc

SEQ ID NO: 2526039 - RNA, 14 nt, Human
gguccuggccaucc

SEQ ID NO: 2526040 - RNA, 16 nt, Human
gguccuggccauccca

SEQ ID NO: 2526041 - RNA, 12 nt, Human
gguccuggcucc

SEQ ID NO: 2526042 - RNA, 12 nt, Human
gguccuggggcc

SEQ ID NO: 2526043 - RNA, 16 nt, Human
gguccuggcuccugag

SEQ ID NO: 2526044 - RNA, 14 nt, Human
gguccuggcuccug

SEQ ID NO: 2526045 - RNA, 15 nt, Human
gguccuggcuccuga

SEQ ID NO: 2526046 - RNA, 14 nt, Human
gguccuggggccuc

SEQ ID NO: 2526047 - RNA, 12 nt, Human
gguccuggggcu

SEQ ID NO: 2526048 - RNA, 15 nt, Human
gguccuggggcucug

SEQ ID NO: 2526049 - RNA, 22 nt, Human
gguccuggggcucugugcaggg

SEQ ID NO: 2526050 - RNA, 17 nt, Human
ggucuacacugugcuga

SEQ ID NO: 2526051 - RNA, 14 nt, Human
ggucuagggagaga

SEQ ID NO: 2526052 - RNA, 18 nt, Human
ggucuaaagugagcucua

SEQ ID NO: 2526053 - RNA, 11 nt, Human
ggucugugugu

SEQ ID NO: 2526054 - RNA, 17 nt, Human
ggucuguguguguguau

SEQ ID NO: 2526055 - RNA, 22 nt, Human
ggucugugccaaagaagaaucc

SEQ ID NO: 2526056 - RNA, 13 nt, Human
ggucugugucucu

SEQ ID NO: 2526057 - RNA, 18 nt, Human
ggucugugucucuuuucu

SEQ ID NO: 2526058 - RNA, 19 nt, Human
ggucugugucucuuuucuc

SEQ ID NO: 2526059 - RNA, 20 nt, Human
ggucgguagguucagccaag

SEQ ID NO: 2526060 - RNA, 16 nt, Human
ggucggaggcuuggga

SEQ ID NO: 2526061 - RNA, 14 nt, Human
ggucggaccagcuu

SEQ ID NO: 2526062 - RNA, 14 nt, Human
ggucggaaaacaug

SEQ ID NO: 2526063 - RNA, 13 nt, Human
ggucggaccagcu

SEQ ID NO: 2526064 - RNA, 15 nt, Human
ggucggaacccaagc

SEQ ID NO: 2526065 - RNA, 22 nt, Human
ggucgcuuacuuugagugaucc

SEQ ID NO: 2526066 - RNA, 20 nt, Human
ggugcaaugaccuuucaaua

SEQ ID NO: 2526067 - RNA, 19 nt, Human
ggugcaaugaccuuucaau

SEQ ID NO: 2526068 - RNA, 18 nt, Human
ggugcaaugaccuuucaa

SEQ ID NO: 2526069 - RNA, 20 nt, Human
ggucuucccuaccucaggca

SEQ ID NO: 2526070 - RNA, 22 nt, Human
ggucuucccuaccucaggcagg

SEQ ID NO: 2526071 - RNA, 20 nt, Human
ggucuguuuuccuuucucac

SEQ ID NO: 2526072 - RNA, 20 nt, Human
ggucuguuggcaggcuggcc

SEQ ID NO: 2526073 - RNA, 19 nt, Human
ggucuguuggcaggcuggc

SEQ ID NO: 2526074 - RNA, 20 nt, Human
ggucuguguguguguaugug

SEQ ID NO: 2526075 - RNA, 21 nt, Human
ggucuguguguguguaugugg

SEQ ID NO: 2526076 - RNA, 17 nt, Human
ggucuguuuuccuuucu

SEQ ID NO: 2526077 - RNA, 18 nt, Human
ggucuucagccucuuucu

SEQ ID NO: 2526078 - RNA, 20 nt, Human
ggucuucccaggcuggggcu

SEQ ID NO: 2526079 - RNA, 17 nt, Human
ggucuucccaggcuggg

SEQ ID NO: 2526080 - RNA, 17 nt, Human
ggucuucccuaccucag

SEQ ID NO: 2526081 - RNA, 13 nt, Human
ggucuucccaggc

SEQ ID NO: 2526082 - RNA, 14 nt, Human
ggucuucagccauc

SEQ ID NO: 2526083 - RNA, 19 nt, Human
ggucuucagggggccaggu

SEQ ID NO: 2526084 - RNA, 19 nt, Human
ggugccagcaaagccccau

SEQ ID NO: 2526085 - RNA, 18 nt, Human
ggugccagcaaagcccca

SEQ ID NO: 2526086 - RNA, 17 nt, Human
ggugccagcaaagcccc

SEQ ID NO: 2526087 - RNA, 16 nt, Human
ggugccagcaaagccc

SEQ ID NO: 2526088 - RNA, 15 nt, Human
ggugccagcaaagcc

SEQ ID NO: 2526089 - RNA, 13 nt, Human
ggugccagcaaag

SEQ ID NO: 2526090 - RNA, 12 nt, Human
ggugccagcaaa

SEQ ID NO: 2526091 - RNA, 18 nt, Human
ggugccacaaauaaaaug

SEQ ID NO: 2526092 - RNA, 22 nt, Human
ggugccaauggaaccuccuuuc

SEQ ID NO: 2526093 - RNA, 22 nt, Human
ggugccaacaguguuaggccug

SEQ ID NO: 2526094 - RNA, 23 nt, Human
ggugccaauuucaaguuccaagu

SEQ ID NO: 2526095 - RNA, 23 nt, Human
ggugccaaacaaaaagguucuca

SEQ ID NO: 2526096 - RNA, 22 nt, Human
ggucuucuuacaugcauuugag

SEQ ID NO: 2526097 - RNA, 20 nt, Human
ggugccagccuuccucugca

SEQ ID NO: 2526098 - RNA, 15 nt, Human
ggugccagccuuccu

SEQ ID NO: 2526099 - RNA, 14 nt, Human
ggugccagccuucc

SEQ ID NO: 2526100 - RNA, 17 nt, Human
ggugccagcaacugaau

SEQ ID NO: 2526101 - RNA, 19 nt, Human
ggugccagcaacugaauaa

SEQ ID NO: 2526102 - RNA, 15 nt, Human
ggugccagcaacuga

SEQ ID NO: 2526103 - RNA, 14 nt, Human
ggugccagcaacug

SEQ ID NO: 2526104 - RNA, 20 nt, Human
ggugcugggccccugccucu

SEQ ID NO: 2526105 - RNA, 17 nt, Human
ggugccagguuuucugg

SEQ ID NO: 2526106 - RNA, 23 nt, Human
ggugccagccuuccucugcagcu

SEQ ID NO: 2526107 - RNA, 21 nt, Human
ggugccagguuuucugggugu

SEQ ID NO: 2526108 - RNA, 19 nt, Human
ggugcugggccccugccuc

SEQ ID NO: 2526109 - RNA, 23 nt, Human
ggugcuguccucagguggccaug

SEQ ID NO: 2526110 - RNA, 20 nt, Human
ggugcuguccucagguggcc

SEQ ID NO: 2526111 - RNA, 19 nt, Human
ggugcuguccucagguggc

SEQ ID NO: 2526112 - RNA, 15 nt, Human
ggugcuguccucagg

SEQ ID NO: 2526113 - RNA, 20 nt, Human
gguggcaaggcugugcuccc

SEQ ID NO: 2526114 - RNA, 17 nt, Human
gguggcaaggcugugcu

SEQ ID NO: 2526115 - RNA, 13 nt, Human
gguggcaagagcc

SEQ ID NO: 2526116 - RNA, 17 nt, Human
gguggcacaggcccccu

SEQ ID NO: 2526117 - RNA, 16 nt, Human
aaagcagcguuucuau

SEQ ID NO: 2526118 - RNA, 18 nt, Human
aaagcagcguuucuauga

SEQ ID NO: 2526119 - RNA, 22 nt, Human
aaagcagcguuucuaugacaca

SEQ ID NO: 2526120 - RNA, 21 nt, Human
gguggaugccugguggcagcu

SEQ ID NO: 2526121 - RNA, 20 nt, Human
ggugcuuaagcagaagcauu

SEQ ID NO: 2526122 - RNA, 18 nt, Human
ggugcuuaagcagaagca

SEQ ID NO: 2526123 - RNA, 14 nt, Human
gguggauggcccca

SEQ ID NO: 2526124 - RNA, 22 nt, Human
gguggauggccccagcacagcu

SEQ ID NO: 2526125 - RNA, 17 nt, Human
ggugcuuacacaucuca

SEQ ID NO: 2526126 - RNA, 19 nt, Human
ggugcuguggccaggguga

SEQ ID NO: 2526127 - RNA, 16 nt, Human
ggugcuguggccaggg

SEQ ID NO: 2526128 - RNA, 14 nt, Human
gguggaugccuggu

SEQ ID NO: 2526129 - RNA, 13 nt, Human
aaagcaugaaugg

SEQ ID NO: 2526130 - RNA, 20 nt, Human
aaagcaucauggcuaucugu

SEQ ID NO: 2526131 - RNA, 13 nt, Human
aaagcauccaugu

SEQ ID NO: 2526132 - RNA, 16 nt, Human
aaagcaucaccucagg

SEQ ID NO: 2526133 - RNA, 17 nt, Human
aaagcaucaccucaggc

SEQ ID NO: 2526134 - RNA, 18 nt, Human
aaagcaucaccucaggcc

SEQ ID NO: 2526135 - RNA, 16 nt, Human
aaagcaucacuuggga

SEQ ID NO: 2526136 - RNA, 15 nt, Human
aaagcauaaaugcaa

SEQ ID NO: 2526137 - RNA, 18 nt, Human
aaagcagcucuccccuca

SEQ ID NO: 2526138 - RNA, 17 nt, Human
aaagcagggacuugaac

SEQ ID NO: 2526139 - RNA, 19 nt, Human
aaagcaggcagaacucauc

SEQ ID NO: 2526140 - RNA, 17 nt, Human
aaagcaggcagaacuca

SEQ ID NO: 2526141 - RNA, 15 nt, Human
aaagcagcguuucua

SEQ ID NO: 2526142 - RNA, 18 nt, Human
aaagcagcucaaaggcac

SEQ ID NO: 2526143 - RNA, 19 nt, Human
aaagcagcucaaaggcaca

SEQ ID NO: 2526144 - RNA, 15 nt, Human
aaagcagcucucccc

SEQ ID NO: 2526145 - RNA, 20 nt, Human
gguaacaggcagauacagga

SEQ ID NO: 2526146 - RNA, 14 nt, Human
gguaacaggcagau

SEQ ID NO: 2526147 - RNA, 21 nt, Human
gguaacaguucauguuugcuu

SEQ ID NO: 2526148 - RNA, 22 nt, Human
gguaacauccuuucuauugaaa

SEQ ID NO: 2526149 - RNA, 15 nt, Human
gguaauaaacuuaga

SEQ ID NO: 2526150 - RNA, 19 nt, Human
gguaauaaguacuguguac

SEQ ID NO: 2526151 - RNA, 18 nt, Human
gguaacuagggaagauaa

SEQ ID NO: 2526152 - RNA, 13 nt, Human
gguaacaggcaga

SEQ ID NO: 2526153 - RNA, 17 nt, Human
ggguuucuaaagcugcc

SEQ ID NO: 2526154 - RNA, 22 nt, Human
ggguuucugagcugcucugaau

SEQ ID NO: 2526155 - RNA, 20 nt, Human
ggguuucgucauguuggcca

SEQ ID NO: 2526156 - RNA, 17 nt, Human
ggguuucgagaagcugc

SEQ ID NO: 2526157 - RNA, 13 nt, Human
gggugugggaggc

SEQ ID NO: 2526158 - RNA, 13 nt, Human
ggguuuuaaugua

SEQ ID NO: 2526159 - RNA, 21 nt, Human
ggguuuggcugugucuaaacu

SEQ ID NO: 2526160 - RNA, 20 nt, Human
ggguuuuauuguuuaaaauc

SEQ ID NO: 2526161 - RNA, 14 nt, Human
ggguuuuauauuuu

SEQ ID NO: 2526162 - RNA, 19 nt, Human
ggguuuggaccccagcugg

SEQ ID NO: 2526163 - RNA, 18 nt, Human
ggguuuggaccccagcug

SEQ ID NO: 2526164 - RNA, 18 nt, Human
ggguuugaggauaggagu

SEQ ID NO: 2526165 - RNA, 21 nt, Human
ggguuuggaccccagcuggga

SEQ ID NO: 2526166 - RNA, 20 nt, Human
ggguuuggaccccagcuggg

SEQ ID NO: 2526167 - RNA, 20 nt, Human
ggguuuggcgggccaaggac

SEQ ID NO: 2526168 - RNA, 22 nt, Human
ggguuuggcgggccaaggacug

SEQ ID NO: 2526169 - RNA, 20 nt, Human
gguaaucuugcucugcuuga

SEQ ID NO: 2526170 - RNA, 18 nt, Human
gguaaucgaccugccucg

SEQ ID NO: 2526171 - RNA, 14 nt, Human
gguaaucgaccugc

SEQ ID NO: 2526172 - RNA, 17 nt, Human
gguaaucgaccugccuc

SEQ ID NO: 2526173 - RNA, 24 nt, Human
gguacaaccuguucugcuuuccuc

SEQ ID NO: 2526174 - RNA, 23 nt, Human
gguaauuauuuugguacuuuuau

SEQ ID NO: 2526175 - RNA, 22 nt, Human
gguaauuguugcuaaucuucuu

SEQ ID NO: 2526176 - RNA, 23 nt, Human
gguacaaccuguucugcuuuccu

SEQ ID NO: 2526177 - RNA, 15 nt, Human
gguaccaaugcugca

SEQ ID NO: 2526178 - RNA, 17 nt, Human
gguaccagauaaaauua

SEQ ID NO: 2526179 - RNA, 14 nt, Human
gguaccacugauuu

SEQ ID NO: 2526180 - RNA, 15 nt, Human
gguagcuagaggaac

SEQ ID NO: 2526181 - RNA, 20 nt, Human
gguagcccuggccagaggcu

SEQ ID NO: 2526182 - RNA, 17 nt, Human
gguagcuagaggaacca

SEQ ID NO: 2526183 - RNA, 16 nt, Human
gguagcccgccugcca

SEQ ID NO: 2526184 - RNA, 15 nt, Human
gguagcccuggccag

SEQ ID NO: 2526185 - RNA, 18 nt, Human
gguagcccuggccagagg

SEQ ID NO: 2526186 - RNA, 18 nt, Human
gguacauuucccugugcu

SEQ ID NO: 2526187 - RNA, 15 nt, Human
gguacauuucccugu

SEQ ID NO: 2526188 - RNA, 17 nt, Human
ggguggaugccuggugg

SEQ ID NO: 2526189 - RNA, 15 nt, Human
ggguggcaccagcag

SEQ ID NO: 2526190 - RNA, 12 nt, Human
ggggccuggcag

SEQ ID NO: 2526191 - RNA, 11 nt, Human
ggggccuggca

SEQ ID NO: 2526192 - RNA, 13 nt, Human
ggguggaugccug

SEQ ID NO: 2526193 - RNA, 19 nt, Human
gggugggacacccugugau

SEQ ID NO: 2526194 - RNA, 16 nt, Human
ggggccuggaccugcc

SEQ ID NO: 2526195 - RNA, 15 nt, Human
ggggccuggaccugc

SEQ ID NO: 2526196 - RNA, 14 nt, Human
gggugggagagccc

SEQ ID NO: 2526197 - RNA, 19 nt, Human
gggugggagagcccagcca

SEQ ID NO: 2526198 - RNA, 20 nt, Human
ggguggggaccucaggccug

SEQ ID NO: 2526199 - RNA, 15 nt, Human
gggugggcaggaaaa

SEQ ID NO: 2526200 - RNA, 13 nt, Human
gggugggccaggc

SEQ ID NO: 2526201 - RNA, 19 nt, Human
gggugggccaggcugaugg

SEQ ID NO: 2526202 - RNA, 23 nt, Human
ggguggauuuggguuggaaguga

SEQ ID NO: 2526203 - RNA, 17 nt, Human
gggugggauggaggaga

SEQ ID NO: 2526204 - RNA, 16 nt, Human
ggguguggcccugcca

SEQ ID NO: 2526205 - RNA, 12 nt, Human
ggguguggcagu

SEQ ID NO: 2526206 - RNA, 13 nt, Human
gggugugcuggga

SEQ ID NO: 2526207 - RNA, 23 nt, Human
gggugucuugggcagagcuggcu

SEQ ID NO: 2526208 - RNA, 21 nt, Human
gggugugcaaugucugaguga

SEQ ID NO: 2526209 - RNA, 17 nt, Human
gggugugcacaucucug

SEQ ID NO: 2526210 - RNA, 17 nt, Human
ggguguggcgcagcaua

SEQ ID NO: 2526211 - RNA, 21 nt, Human
gggugucuugggcagagcugg

SEQ ID NO: 2526212 - RNA, 15 nt, Human
gggugucuugggcag

SEQ ID NO: 2526213 - RNA, 21 nt, Human
ggguggggucaugcccuccuc

SEQ ID NO: 2526214 - RNA, 16 nt, Human
ggguggucugcaggca

SEQ ID NO: 2526215 - RNA, 13 nt, Human
gggugguccugac

SEQ ID NO: 2526216 - RNA, 18 nt, Human
ggguggggggggugcugg

SEQ ID NO: 2526217 - RNA, 22 nt, Human
ggguggggaauguuugggcaga

SEQ ID NO: 2526218 - RNA, 13 nt, Human
gggugggccucug

SEQ ID NO: 2526219 - RNA, 12 nt, Human
gggugggccucu

SEQ ID NO: 2526220 - RNA, 14 nt, Human
gggugggccaggcu

SEQ ID NO: 2526221 - RNA, 15 nt, Human
ggguggggggggugc

SEQ ID NO: 2526222 - RNA, 12 nt, Human
ggguggugaccu

SEQ ID NO: 2526223 - RNA, 12 nt, Human
ggguggguauaa

SEQ ID NO: 2526224 - RNA, 17 nt, Human
ggguggggucaugcccu

SEQ ID NO: 2526225 - RNA, 23 nt, Human
ggguggggacguccugccaccug

SEQ ID NO: 2526226 - RNA, 16 nt, Human
gggugggguagggcug

SEQ ID NO: 2526227 - RNA, 17 nt, Human
gggugggguagggcuga

SEQ ID NO: 2526228 - RNA, 19 nt, Human
aaagacaaaucaaagcaga

SEQ ID NO: 2526229 - RNA, 16 nt, Human
aaagacaaaucaaagc

SEQ ID NO: 2526230 - RNA, 16 nt, Human
aaagacaaauucuguu

SEQ ID NO: 2526231 - RNA, 17 nt, Human
aaagacaaauucuguuu

SEQ ID NO: 2526232 - RNA, 11 nt, Human
aaagacaauuc

SEQ ID NO: 2526233 - RNA, 17 nt, Human
aaagacaagacuucagu

SEQ ID NO: 2526234 - RNA, 13 nt, Human
aaagacaagacuu

SEQ ID NO: 2526235 - RNA, 19 nt, Human
aaagacaaauucuguuucu

SEQ ID NO: 2526236 - RNA, 22 nt, Human
aaagacaaauucuguuucuuga

SEQ ID NO: 2526237 - RNA, 22 nt, Human
aaagaaugagaaggagucagaa

SEQ ID NO: 2526238 - RNA, 16 nt, Human
aaagaaugaaagagua

SEQ ID NO: 2526239 - RNA, 14 nt, Human
aaagaaugaaagag

SEQ ID NO: 2526240 - RNA, 13 nt, Human
aaagaaugaaaga

SEQ ID NO: 2526241 - RNA, 16 nt, Human
aaagacaauucuuuau

SEQ ID NO: 2526242 - RNA, 15 nt, Human
aaagacaauucuuua

SEQ ID NO: 2526243 - RNA, 13 nt, Human
aaagacaauucuu

SEQ ID NO: 2526244 - RNA, 12 nt, Human
aaagacaauucu

SEQ ID NO: 2526245 - RNA, 19 nt, Human
aaagacaauucuuuauaca

SEQ ID NO: 2526246 - RNA, 17 nt, Human
aaagacaauucuuuaua

SEQ ID NO: 2526247 - RNA, 20 nt, Human
aaagacaauucuuuauacaa

SEQ ID NO: 2526248 - RNA, 19 nt, Human
aaagacaccuacugagugg

SEQ ID NO: 2526249 - RNA, 13 nt, Human
aaagacaccuacu

SEQ ID NO: 2526250 - RNA, 14 nt, Human
aaagacuauucaaa

SEQ ID NO: 2526251 - RNA, 17 nt, Human
aaagacuaucuaaaugu

SEQ ID NO: 2526252 - RNA, 17 nt, Human
aaacuuuaccuuuuuua

SEQ ID NO: 2526253 - RNA, 22 nt, Human
aaacuuuaccuuuuuuauacau

SEQ ID NO: 2526254 - RNA, 15 nt, Human
gguccauagagagca

SEQ ID NO: 2526255 - RNA, 17 nt, Human
gguccauggaaugcuug

SEQ ID NO: 2526256 - RNA, 13 nt, Human
gguccaugggcag

SEQ ID NO: 2526257 - RNA, 21 nt, Human
gguccaggguugaucacacuc

SEQ ID NO: 2526258 - RNA, 13 nt, Human
gguccaggguuga

SEQ ID NO: 2526259 - RNA, 12 nt, Human
aaacuuuacuau

SEQ ID NO: 2526260 - RNA, 14 nt, Human
gguccaugggcaga

SEQ ID NO: 2526261 - RNA, 18 nt, Human
aaacuuuacuaagaugac

SEQ ID NO: 2526262 - RNA, 18 nt, Human
aaacuuuacuauggcccu

SEQ ID NO: 2526263 - RNA, 17 nt, Human
aaagaauacagaaagau

SEQ ID NO: 2526264 - RNA, 15 nt, Human
aaagaaguuugauau

SEQ ID NO: 2526265 - RNA, 15 nt, Human
aaagaauacagaaag

SEQ ID NO: 2526266 - RNA, 18 nt, Human
aaagaaguggggacagag

SEQ ID NO: 2526267 - RNA, 21 nt, Human
aaacuuuacuaagaugacauu

SEQ ID NO: 2526268 - RNA, 19 nt, Human
aaacuuuacuaagaugaca

SEQ ID NO: 2526269 - RNA, 16 nt, Human
gguccacccaggagcc

SEQ ID NO: 2526270 - RNA, 15 nt, Human
gguccacccaggagc

SEQ ID NO: 2526271 - RNA, 13 nt, Human
gguccacccagga

SEQ ID NO: 2526272 - RNA, 12 nt, Human
gguccacccagg

SEQ ID NO: 2526273 - RNA, 23 nt, Human
gguccaggggccccuccagcuug

SEQ ID NO: 2526274 - RNA, 22 nt, Human
gguccaggggccccuccagcuu

SEQ ID NO: 2526275 - RNA, 20 nt, Human
gguccaggggccccuccagc

SEQ ID NO: 2526276 - RNA, 17 nt, Human
gguccaggggccccucc

SEQ ID NO: 2526277 - RNA, 15 nt, Human
gguccaggggccccu

SEQ ID NO: 2526278 - RNA, 16 nt, Human
gguccacccagcaaag

SEQ ID NO: 2526279 - RNA, 12 nt, Human
gguccagggcua

SEQ ID NO: 2526280 - RNA, 11 nt, Human
gguccagggaa

SEQ ID NO: 2526281 - RNA, 21 nt, Human
gguccagggaagcuggccgag

SEQ ID NO: 2526282 - RNA, 16 nt, Human
gguccagggagcaggc

SEQ ID NO: 2526283 - RNA, 12 nt, Human
gguccagggagc

SEQ ID NO: 2526284 - RNA, 17 nt, Human
gguccacccaggagccc

SEQ ID NO: 2526285 - RNA, 17 nt, Human
gguccacaucccgggac

SEQ ID NO: 2526286 - RNA, 20 nt, Human
gguccacaggaagugaagaa

SEQ ID NO: 2526287 - RNA, 12 nt, Human
gguagcuguaag

SEQ ID NO: 2526288 - RNA, 19 nt, Human
gguagcugccccuggcucu

SEQ ID NO: 2526289 - RNA, 13 nt, Human
gguagcucaggug

SEQ ID NO: 2526290 - RNA, 12 nt, Human
gguagcucaggu

SEQ ID NO: 2526291 - RNA, 17 nt, Human
gguagcucaggugggcg

SEQ ID NO: 2526292 - RNA, 15 nt, Human
gguagcugccccugg

SEQ ID NO: 2526293 - RNA, 17 nt, Human
gguagcuuugaggugga

SEQ ID NO: 2526294 - RNA, 21 nt, Human
gguagcuguaaggcaugaagg

SEQ ID NO: 2526295 - RNA, 18 nt, Human
gguagcugccccuggcuc

SEQ ID NO: 2526296 - RNA, 14 nt, Human
gguagcuuuucccu

SEQ ID NO: 2526297 - RNA, 21 nt, Human
gguaugaccuucuaggaagcu

SEQ ID NO: 2526298 - RNA, 22 nt, Human
gguaugaucacggcucacugca

SEQ ID NO: 2526299 - RNA, 14 nt, Human
gguaugcaaucaaa

SEQ ID NO: 2526300 - RNA, 14 nt, Human
gguaugagcugagg

SEQ ID NO: 2526301 - RNA, 16 nt, Human
gguaugagcugagggg

SEQ ID NO: 2526302 - RNA, 15 nt, Human
gguaugagcugaggg

SEQ ID NO: 2526303 - RNA, 15 nt, Human
gguauggaacucucu

SEQ ID NO: 2526304 - RNA, 16 nt, Human
gguccacaacacacag

SEQ ID NO: 2526305 - RNA, 18 nt, Human
gggcugcacucugugccc

SEQ ID NO: 2526306 - RNA, 16 nt, Human
gggcugcacucugugc

SEQ ID NO: 2526307 - RNA, 14 nt, Human
gggcucacacaccu

SEQ ID NO: 2526308 - RNA, 18 nt, Human
gggcucagagugggguag

SEQ ID NO: 2526309 - RNA, 18 nt, Human
gggcugcaugcgggcuuc

SEQ ID NO: 2526310 - RNA, 21 nt, Human
gggcugcaugcgggcuuccuc

SEQ ID NO: 2526311 - RNA, 19 nt, Human
gggcugcagcauguugcug

SEQ ID NO: 2526312 - RNA, 11 nt, Human
gggcugcagca

SEQ ID NO: 2526313 - RNA, 20 nt, Human
gggcugcacucugugcccau

SEQ ID NO: 2526314 - RNA, 19 nt, Human
gggcugcacucugugccca

SEQ ID NO: 2526315 - RNA, 22 nt, Human
gggcugcagcauguugcugagg

SEQ ID NO: 2526316 - RNA, 18 nt, Human
gggcugccaugugaagag

SEQ ID NO: 2526317 - RNA, 10 nt, Human
gggcucagca

SEQ ID NO: 2526318 - RNA, 20 nt, Human
gggcuacccugagcugaggc

SEQ ID NO: 2526319 - RNA, 13 nt, Human
gggcuacaagagg

SEQ ID NO: 2526320 - RNA, 16 nt, Human
gggcucaagcagucua

SEQ ID NO: 2526321 - RNA, 22 nt, Human
gggcugcaccggcuggccuggc

SEQ ID NO: 2526322 - RNA, 18 nt, Human
gggcucagcaaaagaugc

SEQ ID NO: 2526323 - RNA, 15 nt, Human
gggcugcccuggugc

SEQ ID NO: 2526324 - RNA, 16 nt, Human
gggcuggcccagcccu

SEQ ID NO: 2526325 - RNA, 19 nt, Human
gggcuggccucuggcucuc

SEQ ID NO: 2526326 - RNA, 15 nt, Human
gggcuggccuaggag

SEQ ID NO: 2526327 - RNA, 13 nt, Human
gggcuggccuagg

SEQ ID NO: 2526328 - RNA, 17 nt, Human
gggcuggcccagcccug

SEQ ID NO: 2526329 - RNA, 19 nt, Human
gggcuggcccagcccugcu

SEQ ID NO: 2526330 - RNA, 13 nt, Human
gggcugcccugcc

SEQ ID NO: 2526331 - RNA, 14 nt, Human
gggcugcccuggug

SEQ ID NO: 2526332 - RNA, 13 nt, Human
gggcugcccuggu

SEQ ID NO: 2526333 - RNA, 19 nt, Human
gggcugcccgcucccagug

SEQ ID NO: 2526334 - RNA, 18 nt, Human
gggcugcccgcucccagu

SEQ ID NO: 2526335 - RNA, 15 nt, Human
gggcugcccgcuccc

SEQ ID NO: 2526336 - RNA, 14 nt, Human
gggcugcccgcucc

SEQ ID NO: 2526337 - RNA, 22 nt, Human
gggcugcccgcucccagugucu

SEQ ID NO: 2526338 - RNA, 12 nt, Human
gggcugcccugc

SEQ ID NO: 2526339 - RNA, 20 nt, Human
gggcuggguucuacccaggu

SEQ ID NO: 2526340 - RNA, 18 nt, Human
gggcugggagcucugcag

SEQ ID NO: 2526341 - RNA, 16 nt, Human
gggcugggagcucugc

SEQ ID NO: 2526342 - RNA, 17 nt, Human
gggcuggcuucaggagg

SEQ ID NO: 2526343 - RNA, 12 nt, Human
gggcuggcuuca

SEQ ID NO: 2526344 - RNA, 15 nt, Human
gggcuggcucccucu

SEQ ID NO: 2526345 - RNA, 13 nt, Human
gggcuggcucccu

SEQ ID NO: 2526346 - RNA, 15 nt, Human
gggcuggccuuccug

SEQ ID NO: 2526347 - RNA, 19 nt, Human
gggcuggcggcuacucagc

SEQ ID NO: 2526348 - RNA, 22 nt, Human
aaaauuuuuucucuaggaaaua

SEQ ID NO: 2526349 - RNA, 14 nt, Human
aaaauuuguugcau

SEQ ID NO: 2526350 - RNA, 13 nt, Human
aaaauuuguugca

SEQ ID NO: 2526351 - RNA, 14 nt, Human
aaaauuuuuuuaga

SEQ ID NO: 2526352 - RNA, 19 nt, Human
aaaauuuguuugaaaucuu

SEQ ID NO: 2526353 - RNA, 18 nt, Human
aaaauuugaaauuuagcu

SEQ ID NO: 2526354 - RNA, 18 nt, Human
aaaauuuguuauuuugca

SEQ ID NO: 2526355 - RNA, 16 nt, Human
aaaauuugcccuccca

SEQ ID NO: 2526356 - RNA, 20 nt, Human
aaaaugugcuauacugcaua

SEQ ID NO: 2526357 - RNA, 11 nt, Human
aaaauguguaa

SEQ ID NO: 2526358 - RNA, 20 nt, Human
aaaauguguaauuuuguucu

SEQ ID NO: 2526359 - RNA, 16 nt, Human
aaaauguguaauuuug

SEQ ID NO: 2526360 - RNA, 12 nt, Human
aaaaugugugug

SEQ ID NO: 2526361 - RNA, 17 nt, Human
aaaauguguaauuuugu

SEQ ID NO: 2526362 - RNA, 15 nt, Human
aaaauuucuauuaaa

SEQ ID NO: 2526363 - RNA, 17 nt, Human
aaaauuuccaguaccuu

SEQ ID NO: 2526364 - RNA, 23 nt, Human
aaaauuuccaguaccuuugucac

SEQ ID NO: 2526365 - RNA, 13 nt, Human
aaaauuucacauu

SEQ ID NO: 2526366 - RNA, 20 nt, Human
aaaauuucacauuaauauuu

SEQ ID NO: 2526367 - RNA, 22 nt, Human
gggcuggguucuacccaggugc

SEQ ID NO: 2526368 - RNA, 18 nt, Human
gggcugguagcucaggug

SEQ ID NO: 2526369 - RNA, 17 nt, Human
gggcugguagcucaggu

SEQ ID NO: 2526370 - RNA, 23 nt, Human
gggcuggguuggcgcacccuccc

SEQ ID NO: 2526371 - RNA, 22 nt, Human
gggcuggguuggcgcacccucc

SEQ ID NO: 2526372 - RNA, 21 nt, Human
gggcuggguuggcgcacccuc

SEQ ID NO: 2526373 - RNA, 19 nt, Human
gggcuggguuggcgcaccc

SEQ ID NO: 2526374 - RNA, 16 nt, Human
gggcuggguuggcgca

SEQ ID NO: 2526375 - RNA, 20 nt, Human
gggcuggugccagccuuccu

SEQ ID NO: 2526376 - RNA, 14 nt, Human
gggcugguucugua

SEQ ID NO: 2526377 - RNA, 17 nt, Human
gggcuggugccagccuu

SEQ ID NO: 2526378 - RNA, 16 nt, Human
gggcuggugccagccu

SEQ ID NO: 2526379 - RNA, 15 nt, Human
gggcuggugccagcc

SEQ ID NO: 2526380 - RNA, 21 nt, Human
gggcuggugacccagucagag

SEQ ID NO: 2526381 - RNA, 18 nt, Human
aaaaugucuuguguuacc

SEQ ID NO: 2526382 - RNA, 18 nt, Human
aaaaugucuguuaacuua

SEQ ID NO: 2526383 - RNA, 19 nt, Human
aaaaugugacccagauccu

SEQ ID NO: 2526384 - RNA, 18 nt, Human
aaaaugugaauaaaauua

SEQ ID NO: 2526385 - RNA, 21 nt, Human
aaaaugucuguagcuccucaa

SEQ ID NO: 2526386 - RNA, 12 nt, Human
aaaaugugaagu

SEQ ID NO: 2526387 - RNA, 15 nt, Human
aaaaugugauaugua

SEQ ID NO: 2526388 - RNA, 16 nt, Human
aaaaugugacccagau

SEQ ID NO: 2526389 - RNA, 12 nt, Human
aaaaugugauuu

SEQ ID NO: 2526390 - RNA, 13 nt, Human
aaaaugugauuuu

SEQ ID NO: 2526391 - RNA, 17 nt, Human
aaaaugugcaaaacagc

SEQ ID NO: 2526392 - RNA, 18 nt, Human
aaaaugugauuuuucuga

SEQ ID NO: 2526393 - RNA, 19 nt, Human
aaaaugugcuauacugcau

SEQ ID NO: 2526394 - RNA, 19 nt, Human
aaaaugugcaaaacagcgu

SEQ ID NO: 2526395 - RNA, 20 nt, Human
ggggacagcuccuucugucc

SEQ ID NO: 2526396 - RNA, 14 nt, Human
ggggacagcuccuu

SEQ ID NO: 2526397 - RNA, 12 nt, Human
ggggacagcucc

SEQ ID NO: 2526398 - RNA, 19 nt, Human
aaacaugacccuaaaucuu

SEQ ID NO: 2526399 - RNA, 21 nt, Human
aaacaugacccuaaaucuuga

SEQ ID NO: 2526400 - RNA, 12 nt, Human
aaacaugaagug

SEQ ID NO: 2526401 - RNA, 17 nt, Human
aaacauccaauauuuuc

SEQ ID NO: 2526402 - RNA, 19 nt, Human
aaacauccaauauuuucuu

SEQ ID NO: 2526403 - RNA, 18 nt, Human
aaacauccuacaagacac

SEQ ID NO: 2526404 - RNA, 22 nt, Human
aaacauauuuguuaaauauuua

SEQ ID NO: 2526405 - RNA, 23 nt, Human
aaacaucaguuacucugaagggc

SEQ ID NO: 2526406 - RNA, 15 nt, Human
aaacaucuauucucu

SEQ ID NO: 2526407 - RNA, 20 nt, Human
aaacaucuauucucuccaaa

SEQ ID NO: 2526408 - RNA, 11 nt, Human
aaacaucugga

SEQ ID NO: 2526409 - RNA, 22 nt, Human
aaacauccuacaagacacagug

SEQ ID NO: 2526410 - RNA, 18 nt, Human
aaacauccuucaagaacu

SEQ ID NO: 2526411 - RNA, 20 nt, Human
aaacauccuucaagaacucu

SEQ ID NO: 2526412 - RNA, 13 nt, Human
ggggacagggaug

SEQ ID NO: 2526413 - RNA, 16 nt, Human
ggggcaugcuggggca

SEQ ID NO: 2526414 - RNA, 19 nt, Human
ggggcauguauuggccugg

SEQ ID NO: 2526415 - RNA, 18 nt, Human
ggggcauguauuggccug

SEQ ID NO: 2526416 - RNA, 23 nt, Human
ggggcauguauuggccuggaggu

SEQ ID NO: 2526417 - RNA, 16 nt, Human
ggggccacacagaaac

SEQ ID NO: 2526418 - RNA, 23 nt, Human
ggggccagaggaacuguccagag

SEQ ID NO: 2526419 - RNA, 12 nt, Human
ggggccagagga

SEQ ID NO: 2526420 - RNA, 12 nt, Human
ggggccagaggc

SEQ ID NO: 2526421 - RNA, 19 nt, Human
ggggccacuuuugacuagg

SEQ ID NO: 2526422 - RNA, 13 nt, Human
ggggccagaggcu

SEQ ID NO: 2526423 - RNA, 13 nt, Human
ggggccagaucca

SEQ ID NO: 2526424 - RNA, 14 nt, Human
ggggccagauccag

SEQ ID NO: 2526425 - RNA, 17 nt, Human
ggggccagauccagccu

SEQ ID NO: 2526426 - RNA, 12 nt, Human
ggggccucccug

SEQ ID NO: 2526427 - RNA, 19 nt, Human
ggggccagauccagccugg

SEQ ID NO: 2526428 - RNA, 19 nt, Human
ggggccuggagauccuccu

SEQ ID NO: 2526429 - RNA, 14 nt, Human
ggggccuggaccug

SEQ ID NO: 2526430 - RNA, 18 nt, Human
aaacagugccugcugaau

SEQ ID NO: 2526431 - RNA, 13 nt, Human
aaacaguguuuug

SEQ ID NO: 2526432 - RNA, 14 nt, Human
aaacaguuaacuuu

SEQ ID NO: 2526433 - RNA, 18 nt, Human
aaacaguuaacuuucaga

SEQ ID NO: 2526434 - RNA, 23 nt, Human
aaacaguuaacuuucagaagaga

SEQ ID NO: 2526435 - RNA, 22 nt, Human
aaacaucacacacacagacaga

SEQ ID NO: 2526436 - RNA, 14 nt, Human
aaacaucacacaca

SEQ ID NO: 2526437 - RNA, 16 nt, Human
aaacaucaguuacucu

SEQ ID NO: 2526438 - RNA, 19 nt, Human
aaacaucaguuacucugaa

SEQ ID NO: 2526439 - RNA, 20 nt, Human
aaacaucaguuacucugaag

SEQ ID NO: 2526440 - RNA, 22 nt, Human
aaacaucaguuacucugaaggg

SEQ ID NO: 2526441 - RNA, 15 nt, Human
aaacaccuagcuuua

SEQ ID NO: 2526442 - RNA, 18 nt, Human
aaacaccuccucauguac

SEQ ID NO: 2526443 - RNA, 14 nt, Human
aaacaccuagcuuu

SEQ ID NO: 2526444 - RNA, 15 nt, Human
aaacacccucacacu

SEQ ID NO: 2526445 - RNA, 19 nt, Human
aaacaccaacauguuggga

SEQ ID NO: 2526446 - RNA, 17 nt, Human
aaacaccggguuccagc

SEQ ID NO: 2526447 - RNA, 20 nt, Human
aaacagucucaggaaaucaa

SEQ ID NO: 2526448 - RNA, 14 nt, Human
aaacagugagccug

SEQ ID NO: 2526449 - RNA, 12 nt, Human
aaacagugccug

SEQ ID NO: 2526450 - RNA, 16 nt, Human
aaacacauuuuucuua

SEQ ID NO: 2526451 - RNA, 22 nt, Human
aaacaagauuuuaaagacaugu

SEQ ID NO: 2526452 - RNA, 15 nt, Human
aaacaagauuuuaaa

SEQ ID NO: 2526453 - RNA, 19 nt, Human
aaacaagaugcuggauguc

SEQ ID NO: 2526454 - RNA, 12 nt, Human
aaacacauuuuu

SEQ ID NO: 2526455 - RNA, 20 nt, Human
aaacaagcacuaaacaaaga

SEQ ID NO: 2526456 - RNA, 12 nt, Human
aaacaaaaagaa

SEQ ID NO: 2526457 - RNA, 11 nt, Human
aaacaaaaaga

SEQ ID NO: 2526458 - RNA, 13 nt, Human
aaacaaaaacacu

SEQ ID NO: 2526459 - RNA, 17 nt, Human
aaacaaaaagaacaaaa

SEQ ID NO: 2526460 - RNA, 16 nt, Human
aaacaaaaagaacaaa

SEQ ID NO: 2526461 - RNA, 19 nt, Human
aaacaaaaauuaaaauccu

SEQ ID NO: 2526462 - RNA, 16 nt, Human
aaaauuuuuuuagaaa

SEQ ID NO: 2526463 - RNA, 15 nt, Human
aaaauuuuuuuucau

SEQ ID NO: 2526464 - RNA, 16 nt, Human
aaaauuuuuuuucaug

SEQ ID NO: 2526465 - RNA, 17 nt, Human
aaaauuuuuuuucaugu

SEQ ID NO: 2526466 - RNA, 18 nt, Human
aaaauuuuuuuucauguu

SEQ ID NO: 2526467 - RNA, 19 nt, Human
aaaauuuuuuuucauguuu

SEQ ID NO: 2526468 - RNA, 20 nt, Human
aaacaagaccacguuucuaa

SEQ ID NO: 2526469 - RNA, 21 nt, Human
aaacaaaaauuagguauuuug

SEQ ID NO: 2526470 - RNA, 18 nt, Human
aaacaagaccacguuucu

SEQ ID NO: 2526471 - RNA, 17 nt, Human
gggccugagccaagcua

SEQ ID NO: 2526472 - RNA, 15 nt, Human
gggccugagccuggc

SEQ ID NO: 2526473 - RNA, 16 nt, Human
gggccugagccuggcc

SEQ ID NO: 2526474 - RNA, 16 nt, Human
gggccugauggggagg

SEQ ID NO: 2526475 - RNA, 23 nt, Human
gggccugaggucuggcugcuugc

SEQ ID NO: 2526476 - RNA, 18 nt, Human
gggccugcaggaccugcc

SEQ ID NO: 2526477 - RNA, 18 nt, Human
gggccugagccuggccag

SEQ ID NO: 2526478 - RNA, 20 nt, Human
gggccucuuaugggcugggu

SEQ ID NO: 2526479 - RNA, 19 nt, Human
gggccucuuaugggcuggg

SEQ ID NO: 2526480 - RNA, 21 nt, Human
gggccucuuggaaaaagugau

SEQ ID NO: 2526481 - RNA, 23 nt, Human
gggccucuugcggucccuucuua

SEQ ID NO: 2526482 - RNA, 13 nt, Human
gggccuccugugu

SEQ ID NO: 2526483 - RNA, 19 nt, Human
gggccucaaaggcccgcuc

SEQ ID NO: 2526484 - RNA, 21 nt, Human
gggccuccucuguccagggcc

SEQ ID NO: 2526485 - RNA, 14 nt, Human
gggccuccagaacu

SEQ ID NO: 2526486 - RNA, 22 nt, Human
gggccucggacuuagcugggag

SEQ ID NO: 2526487 - RNA, 15 nt, Human
gggccuccugugugu

SEQ ID NO: 2526488 - RNA, 16 nt, Human
gggcuacccugagcug

SEQ ID NO: 2526489 - RNA, 19 nt, Human
gggcuacccugagcugagg

SEQ ID NO: 2526490 - RNA, 15 nt, Human
gggcuacaaggaccc

SEQ ID NO: 2526491 - RNA, 13 nt, Human
gggcuacccugag

SEQ ID NO: 2526492 - RNA, 15 nt, Human
gggcgugguggugag

SEQ ID NO: 2526493 - RNA, 23 nt, Human
gggcuacaccuuagccugcccuc

SEQ ID NO: 2526494 - RNA, 23 nt, Human
gggcuaagagcuagcgcugccgc

SEQ ID NO: 2526495 - RNA, 14 nt, Human
gggcguguuguuuu

SEQ ID NO: 2526496 - RNA, 20 nt, Human
gggcuaagagcuagcgcugc

SEQ ID NO: 2526497 - RNA, 17 nt, Human
gggcgggacccaggcac

SEQ ID NO: 2526498 - RNA, 13 nt, Human
gggcggcugagag

SEQ ID NO: 2526499 - RNA, 15 nt, Human
gggcgggcagcacag

SEQ ID NO: 2526500 - RNA, 15 nt, Human
gggcgggccccucau

SEQ ID NO: 2526501 - RNA, 20 nt, Human
gggcgggcagcacagcaagg

SEQ ID NO: 2526502 - RNA, 14 nt, Human
gggcggggccuugc

SEQ ID NO: 2526503 - RNA, 15 nt, Human
gggcgggaggauguu

SEQ ID NO: 2526504 - RNA, 14 nt, Human
gggcggcacagccu

SEQ ID NO: 2526505 - RNA, 23 nt, Human
gggcgcuggcccagccggccucu

SEQ ID NO: 2526506 - RNA, 19 nt, Human
gggcgcuggcccagccggc

SEQ ID NO: 2526507 - RNA, 18 nt, Human
gggcgcuggcccagccgg

SEQ ID NO: 2526508 - RNA, 17 nt, Human
gggcgcuggcccagccg

SEQ ID NO: 2526509 - RNA, 16 nt, Human
gggcgcuggcccagcc

SEQ ID NO: 2526510 - RNA, 15 nt, Human
gggcgcuggcccagc

SEQ ID NO: 2526511 - RNA, 14 nt, Human
gggcgcuggcccag

SEQ ID NO: 2526512 - RNA, 21 nt, Human
gggcggcaggggccuggagau

SEQ ID NO: 2526513 - RNA, 17 nt, Human
gggcggcaggggccugg

SEQ ID NO: 2526514 - RNA, 14 nt, Human
gggcggcagagagg

SEQ ID NO: 2526515 - RNA, 23 nt, Human
gggccaguuggucccccuuccau

SEQ ID NO: 2526516 - RNA, 22 nt, Human
gggccaguuggucccccuucca

SEQ ID NO: 2526517 - RNA, 18 nt, Human
gggccaguuggucccccu

SEQ ID NO: 2526518 - RNA, 14 nt, Human
gggccaguuggucc

SEQ ID NO: 2526519 - RNA, 14 nt, Human
gggccaugcugaag

SEQ ID NO: 2526520 - RNA, 23 nt, Human
gggccaugauggcaacagaucug

SEQ ID NO: 2526521 - RNA, 15 nt, Human
gggccaugcugaggc

SEQ ID NO: 2526522 - RNA, 14 nt, Human
gggccaugcugagg

SEQ ID NO: 2526523 - RNA, 15 nt, Human
gggccaugcugaagg

SEQ ID NO: 2526524 - RNA, 19 nt, Human
gggccaugagcuccagacc

SEQ ID NO: 2526525 - RNA, 16 nt, Human
gggccauacuggccuc

SEQ ID NO: 2526526 - RNA, 15 nt, Human
gggccauacuggccu

SEQ ID NO: 2526527 - RNA, 14 nt, Human
gggccauacuggcc

SEQ ID NO: 2526528 - RNA, 20 nt, Human
gggccagucugggcugccgg

SEQ ID NO: 2526529 - RNA, 17 nt, Human
gggccauccugucccac

SEQ ID NO: 2526530 - RNA, 15 nt, Human
gggccauagcuccug

SEQ ID NO: 2526531 - RNA, 22 nt, Human
gggccauacuggccucgccugg

SEQ ID NO: 2526532 - RNA, 17 nt, Human
gggccauacuggccucg

SEQ ID NO: 2526533 - RNA, 22 nt, Human
gggccaugauggcaacagaucu

SEQ ID NO: 2526534 - RNA, 18 nt, Human
gggccaugagcuccagac

SEQ ID NO: 2526535 - RNA, 18 nt, Human
gggccgaauccccucccu

SEQ ID NO: 2526536 - RNA, 17 nt, Human
gggcccuuugagugcag

SEQ ID NO: 2526537 - RNA, 23 nt, Human
gggccgcaggcgggaaaagcagc

SEQ ID NO: 2526538 - RNA, 13 nt, Human
gggccgcaggcgg

SEQ ID NO: 2526539 - RNA, 21 nt, Human
gggcccuucacugccuuugcu

SEQ ID NO: 2526540 - RNA, 21 nt, Human
gggcccugguguuucuagcac

SEQ ID NO: 2526541 - RNA, 17 nt, Human
gggccaugcugaggccu

SEQ ID NO: 2526542 - RNA, 19 nt, Human
gggcccugguccuuccagg

SEQ ID NO: 2526543 - RNA, 23 nt, Human
gggccuaucagugugccccccau

SEQ ID NO: 2526544 - RNA, 22 nt, Human
gggccuaucagugugcccccca

SEQ ID NO: 2526545 - RNA, 20 nt, Human
gggccuaucagugugccccc

SEQ ID NO: 2526546 - RNA, 18 nt, Human
gggccuaucagugugccc

SEQ ID NO: 2526547 - RNA, 15 nt, Human
gggccuaucagugug

SEQ ID NO: 2526548 - RNA, 17 nt, Human
gggccuaggccucagcc

SEQ ID NO: 2526549 - RNA, 14 nt, Human
gggccuaucagugu

SEQ ID NO: 2526550 - RNA, 23 nt, Human
gggccuagcugcuacaaagaaga

SEQ ID NO: 2526551 - RNA, 22 nt, Human
gggccuagauccacacacagag

SEQ ID NO: 2526552 - RNA, 14 nt, Human
gggccgugcccagg

SEQ ID NO: 2526553 - RNA, 13 nt, Human
gggccgugcccag

SEQ ID NO: 2526554 - RNA, 17 nt, Human
gggccuacuagagucug

SEQ ID NO: 2526555 - RNA, 17 nt, Human
gggccgugcccaggggc

SEQ ID NO: 2526556 - RNA, 20 nt, Human
gggccuagauccacacacag

SEQ ID NO: 2526557 - RNA, 23 nt, Human
gggccuagauccacacacagagg

SEQ ID NO: 2526558 - RNA, 22 nt, Human
gggccguaccccacccucagca

SEQ ID NO: 2526559 - RNA, 18 nt, Human
gggccagucccugaggca

SEQ ID NO: 2526560 - RNA, 18 nt, Human
gggccagggcccugcaga

SEQ ID NO: 2526561 - RNA, 21 nt, Human
gggccagucccugaggcaggu

SEQ ID NO: 2526562 - RNA, 23 nt, Human
gggccaggggucucccuggagug

SEQ ID NO: 2526563 - RNA, 15 nt, Human
gggccaguccugccu

SEQ ID NO: 2526564 - RNA, 22 nt, Human
gggccagucuguggaucagaga

SEQ ID NO: 2526565 - RNA, 16 nt, Human
gggccagucugggcug

SEQ ID NO: 2526566 - RNA, 15 nt, Human
gggccagucugggcu

SEQ ID NO: 2526567 - RNA, 22 nt, Human
gggccaguccugccuggccagg

SEQ ID NO: 2526568 - RNA, 18 nt, Human
gggccaguccugccuggc

SEQ ID NO: 2526569 - RNA, 19 nt, Human
gggccaguccugccuggcc

SEQ ID NO: 2526570 - RNA, 20 nt, Human
gggccaguccugccuggcca

SEQ ID NO: 2526571 - RNA, 21 nt, Human
gggccaguccugccuggccag

SEQ ID NO: 2526572 - RNA, 15 nt, Human
gggccaggcuggguc

SEQ ID NO: 2526573 - RNA, 14 nt, Human
gggccaggcugggu

SEQ ID NO: 2526574 - RNA, 21 nt, Human
gggccaggcugggucgcccug

SEQ ID NO: 2526575 - RNA, 13 nt, Human
gggccagggcccu

SEQ ID NO: 2526576 - RNA, 14 nt, Human
gggccagggcccug

SEQ ID NO: 2526577 - RNA, 16 nt, Human
gggccagggcccugca

SEQ ID NO: 2526578 - RNA, 14 nt, Human
aaaaugccuuugag

SEQ ID NO: 2526579 - RNA, 12 nt, Human
aaaaugccuuug

SEQ ID NO: 2526580 - RNA, 11 nt, Human
aaaaugccuuu

SEQ ID NO: 2526581 - RNA, 22 nt, Human
aaaaugccucaguguauuugua

SEQ ID NO: 2526582 - RNA, 20 nt, Human
aaaaugccucaguguauuug

SEQ ID NO: 2526583 - RNA, 19 nt, Human
aaaaugccucaguguauuu

SEQ ID NO: 2526584 - RNA, 18 nt, Human
aaaaugccucaguguauu

SEQ ID NO: 2526585 - RNA, 16 nt, Human
aaaaugccucagugua

SEQ ID NO: 2526586 - RNA, 23 nt, Human
aaaaugccuuugagacaguuucu

SEQ ID NO: 2526587 - RNA, 22 nt, Human
aaaaugccuuugagacaguuuc

SEQ ID NO: 2526588 - RNA, 17 nt, Human
aaaaugccuuugagaca

SEQ ID NO: 2526589 - RNA, 15 nt, Human
aaaaugccuuugaga

SEQ ID NO: 2526590 - RNA, 19 nt, Human
gggccagauccagccuggg

SEQ ID NO: 2526591 - RNA, 20 nt, Human
aaaaugcugaacauugcaua

SEQ ID NO: 2526592 - RNA, 15 nt, Human
aaaaugcugaacauu

SEQ ID NO: 2526593 - RNA, 16 nt, Human
aaaaugcugaacauug

SEQ ID NO: 2526594 - RNA, 18 nt, Human
aaaaugcugaacauugca

SEQ ID NO: 2526595 - RNA, 22 nt, Human
gggccagccaggcgggcucaag

SEQ ID NO: 2526596 - RNA, 18 nt, Human
gggccagccaggcgggcu

SEQ ID NO: 2526597 - RNA, 17 nt, Human
gggccagccaggcgggc

SEQ ID NO: 2526598 - RNA, 16 nt, Human
gggccagccaggcggg

SEQ ID NO: 2526599 - RNA, 15 nt, Human
gggccagccaggcgg

SEQ ID NO: 2526600 - RNA, 14 nt, Human
gggccagccaggcg

SEQ ID NO: 2526601 - RNA, 13 nt, Human
gggccagccaggc

SEQ ID NO: 2526602 - RNA, 12 nt, Human
gggccagccagg

SEQ ID NO: 2526603 - RNA, 17 nt, Human
gggccagccccucccac

SEQ ID NO: 2526604 - RNA, 13 nt, Human
gggccagccccuc

SEQ ID NO: 2526605 - RNA, 12 nt, Human
gggccagccccu

SEQ ID NO: 2526606 - RNA, 15 nt, Human
gggccagccccuccc

SEQ ID NO: 2526607 - RNA, 11 nt, Human
gggccaggagc

SEQ ID NO: 2526608 - RNA, 13 nt, Human
gggccaggcuggg

SEQ ID NO: 2526609 - RNA, 17 nt, Human
gggccaggacugagccc

SEQ ID NO: 2526610 - RNA, 14 nt, Human
gggccaggacugag

SEQ ID NO: 2526611 - RNA, 16 nt, Human
gggccaggacaggccc

SEQ ID NO: 2526612 - RNA, 17 nt, Human
gggccaggacaggcccg

SEQ ID NO: 2526613 - RNA, 12 nt, Human
aaaaguauuuuc

SEQ ID NO: 2526614 - RNA, 19 nt, Human
aaaaucuguuugaucccug

SEQ ID NO: 2526615 - RNA, 18 nt, Human
aaaaucuuggcacagaaa

SEQ ID NO: 2526616 - RNA, 17 nt, Human
aaaaucuuggcacagaa

SEQ ID NO: 2526617 - RNA, 19 nt, Human
aaaaguauguuagugcaaa

SEQ ID NO: 2526618 - RNA, 13 nt, Human
aaaaguauauguu

SEQ ID NO: 2526619 - RNA, 14 nt, Human
aaaaguauauguua

SEQ ID NO: 2526620 - RNA, 20 nt, Human
aaaaguagguuuacauucau

SEQ ID NO: 2526621 - RNA, 22 nt, Human
aaaaguauuauuuuccaaaagu

SEQ ID NO: 2526622 - RNA, 20 nt, Human
aaaaguauuauuuuccaaaa

SEQ ID NO: 2526623 - RNA, 14 nt, Human
aaaaguauuauuuu

SEQ ID NO: 2526624 - RNA, 15 nt, Human
aaaaguauauguuag

SEQ ID NO: 2526625 - RNA, 14 nt, Human
aaaaguauuuuccu

SEQ ID NO: 2526626 - RNA, 16 nt, Human
aaaaucuguggugguc

SEQ ID NO: 2526627 - RNA, 20 nt, Human
aaaaugaagguuaggauuua

SEQ ID NO: 2526628 - RNA, 22 nt, Human
aaaaugaaagcaugucucaaua

SEQ ID NO: 2526629 - RNA, 21 nt, Human
aaaaucuuucuuucuuagaaa

SEQ ID NO: 2526630 - RNA, 20 nt, Human
aaaaucuuucuuucuuagaa

SEQ ID NO: 2526631 - RNA, 19 nt, Human
aaaaucuuucuuucuuaga

SEQ ID NO: 2526632 - RNA, 17 nt, Human
aaaaucuuucuuucuua

SEQ ID NO: 2526633 - RNA, 23 nt, Human
aaaaucuuucuuucuuagaaauu

SEQ ID NO: 2526634 - RNA, 22 nt, Human
aaaaucuuucuuucuuagaaau

SEQ ID NO: 2526635 - RNA, 19 nt, Human
aaaaugaaagcaugucuca

SEQ ID NO: 2526636 - RNA, 14 nt, Human
aaaaugagccuggc

SEQ ID NO: 2526637 - RNA, 21 nt, Human
aaaaugagccuggcaagaaug

SEQ ID NO: 2526638 - RNA, 18 nt, Human
aaaaugaggaauguauau

SEQ ID NO: 2526639 - RNA, 16 nt, Human
aaaaugaggaauguau

SEQ ID NO: 2526640 - RNA, 15 nt, Human
aaaaugaggaaugua

SEQ ID NO: 2526641 - RNA, 16 nt, Human
aaaaugaauccuacac

SEQ ID NO: 2526642 - RNA, 15 nt, Human
aaaaugaauccuaca

SEQ ID NO: 2526643 - RNA, 23 nt, Human
aaaaugagcucgcauuugucaau

SEQ ID NO: 2526644 - RNA, 18 nt, Human
aaaaugagguucaacugu

SEQ ID NO: 2526645 - RNA, 23 nt, Human
aaaaugaguuuuuauggggcuga

SEQ ID NO: 2526646 - RNA, 17 nt, Human
aaaaugcccuuaaauca

SEQ ID NO: 2526647 - RNA, 16 nt, Human
aaaaugaggacauguu

SEQ ID NO: 2526648 - RNA, 19 nt, Human
aaaaugaggaauguauaug

SEQ ID NO: 2526649 - RNA, 21 nt, Human
aaaaugaguuaccuacauuuu

SEQ ID NO: 2526650 - RNA, 21 nt, Human
aaaaauaugaccacacuccag

SEQ ID NO: 2526651 - RNA, 23 nt, Human
aaaaauaugaccacacuccagcu

SEQ ID NO: 2526652 - RNA, 19 nt, Human
aaaaauauauuuaaugaua

SEQ ID NO: 2526653 - RNA, 15 nt, Human
aaaaauauauuuaau

SEQ ID NO: 2526654 - RNA, 13 nt, Human
aaaaauauauuua

SEQ ID NO: 2526655 - RNA, 16 nt, Human
aaaaauauuauaacuu

SEQ ID NO: 2526656 - RNA, 20 nt, Human
aaaaauauggaacuucuaau

SEQ ID NO: 2526657 - RNA, 13 nt, Human
aaaaauauuccau

SEQ ID NO: 2526658 - RNA, 11 nt, Human
aaaaauauuua

SEQ ID NO: 2526659 - RNA, 17 nt, Human
aaaaaucauaaacugug

SEQ ID NO: 2526660 - RNA, 16 nt, Human
aaaaaucauguuugcu

SEQ ID NO: 2526661 - RNA, 15 nt, Human
aaaaaucacauccug

SEQ ID NO: 2526662 - RNA, 16 nt, Human
aaaaauccagaaagaa

SEQ ID NO: 2526663 - RNA, 21 nt, Human
gggacauuugcucauggaauu

SEQ ID NO: 2526664 - RNA, 20 nt, Human
gggacauuugcucauggaau

SEQ ID NO: 2526665 - RNA, 12 nt, Human
aaaaauauaaaa

SEQ ID NO: 2526666 - RNA, 14 nt, Human
aaaaauauaacuua

SEQ ID NO: 2526667 - RNA, 14 nt, Human
aaaaauauaaaacu

SEQ ID NO: 2526668 - RNA, 13 nt, Human
aaaaauauaaaac

SEQ ID NO: 2526669 - RNA, 14 nt, Human
gggacagggcucgc

SEQ ID NO: 2526670 - RNA, 16 nt, Human
gggaccaacugggccc

SEQ ID NO: 2526671 - RNA, 13 nt, Human
gggaccaaggacc

SEQ ID NO: 2526672 - RNA, 19 nt, Human
gggacauuugcucauggaa

SEQ ID NO: 2526673 - RNA, 21 nt, Human
gggacagcuccuucuguccua

SEQ ID NO: 2526674 - RNA, 18 nt, Human
gggacagaggccugcccg

SEQ ID NO: 2526675 - RNA, 15 nt, Human
gggacagagucuggg

SEQ ID NO: 2526676 - RNA, 13 nt, Human
gggaaggauacaa

SEQ ID NO: 2526677 - RNA, 15 nt, Human
gggacagaggccugc

SEQ ID NO: 2526678 - RNA, 17 nt, Human
gggacagaggccugccc

SEQ ID NO: 2526679 - RNA, 20 nt, Human
gggaaggaggguuagggagg

SEQ ID NO: 2526680 - RNA, 20 nt, Human
gggaagcuucuuaaaugaga

SEQ ID NO: 2526681 - RNA, 17 nt, Human
gggaaggaggcuggcuu

SEQ ID NO: 2526682 - RNA, 17 nt, Human
gggaaggaacucuggcu

SEQ ID NO: 2526683 - RNA, 21 nt, Human
gggaagcugaggcgggagaau

SEQ ID NO: 2526684 - RNA, 16 nt, Human
gggaagcuacagguua

SEQ ID NO: 2526685 - RNA, 23 nt, Human
gggaagcggagguugcagggagc

SEQ ID NO: 2526686 - RNA, 22 nt, Human
gggacagaggggguggccuccc

SEQ ID NO: 2526687 - RNA, 13 nt, Human
gggacagaggggg

SEQ ID NO: 2526688 - RNA, 23 nt, Human
gggacagaggggguggccuccca

SEQ ID NO: 2526689 - RNA, 16 nt, Human
gggacagcuccuucug

SEQ ID NO: 2526690 - RNA, 22 nt, Human
gggaagagcacagcccucccgc

SEQ ID NO: 2526691 - RNA, 20 nt, Human
gggaagagcacagcccuccc

SEQ ID NO: 2526692 - RNA, 18 nt, Human
gggaagagcacagcccuc

SEQ ID NO: 2526693 - RNA, 16 nt, Human
gggaagagcacagccc

SEQ ID NO: 2526694 - RNA, 15 nt, Human
gggaagagcacagcc

SEQ ID NO: 2526695 - RNA, 14 nt, Human
gggaagagcacagc

SEQ ID NO: 2526696 - RNA, 24 nt, Human
gggaagagaggaguucaaugaucu

SEQ ID NO: 2526697 - RNA, 23 nt, Human
gggaagagaggaguucaaugauc

SEQ ID NO: 2526698 - RNA, 22 nt, Human
gggaagagaggaguucaaugau

SEQ ID NO: 2526699 - RNA, 21 nt, Human
gggaagagaggaguucaauga

SEQ ID NO: 2526700 - RNA, 18 nt, Human
gggaagagaggaguucaa

SEQ ID NO: 2526701 - RNA, 11 nt, Human
gggaagagagg

SEQ ID NO: 2526702 - RNA, 17 nt, Human
gggaagagaggaguuca

SEQ ID NO: 2526703 - RNA, 22 nt, Human
gggaagauaggcucugcacaga

SEQ ID NO: 2526704 - RNA, 22 nt, Human
gggaagcagaauagcaaggugc

SEQ ID NO: 2526705 - RNA, 12 nt, Human
gggaagcccugg

SEQ ID NO: 2526706 - RNA, 17 nt, Human
gggaagaguguacuggg

SEQ ID NO: 2526707 - RNA, 16 nt, Human
gggaagaguguacugg

SEQ ID NO: 2526708 - RNA, 14 nt, Human
gggaagagggggcg

SEQ ID NO: 2526709 - RNA, 15 nt, Human
aaaacucuacuuaau

SEQ ID NO: 2526710 - RNA, 12 nt, Human
aaaacucuacuu

SEQ ID NO: 2526711 - RNA, 22 nt, Human
aaaacucgaggacuguauuugu

SEQ ID NO: 2526712 - RNA, 13 nt, Human
aaaacucauuuuu

SEQ ID NO: 2526713 - RNA, 20 nt, Human
aaaacugcugacuguuuucu

SEQ ID NO: 2526714 - RNA, 19 nt, Human
aaaacucuacuuaauccaa

SEQ ID NO: 2526715 - RNA, 18 nt, Human
aaaacucuacuuaaucca

SEQ ID NO: 2526716 - RNA, 22 nt, Human
aaaacugcugacuguuuucucu

SEQ ID NO: 2526717 - RNA, 23 nt, Human
aaaacugcugacuguuuucucuu

SEQ ID NO: 2526718 - RNA, 17 nt, Human
aaaagaugaaaauauuu

SEQ ID NO: 2526719 - RNA, 13 nt, Human
aaaagaugcuucu

SEQ ID NO: 2526720 - RNA, 15 nt, Human
aaaacccugccccca

SEQ ID NO: 2526721 - RNA, 22 nt, Human
aaaaccccacuacacagucugc

SEQ ID NO: 2526722 - RNA, 21 nt, Human
aaaaccuaaguccuuuaugug

SEQ ID NO: 2526723 - RNA, 20 nt, Human
aaaaccuaaguccuuuaugu

SEQ ID NO: 2526724 - RNA, 13 nt, Human
aaaaccugacaaa

SEQ ID NO: 2526725 - RNA, 22 nt, Human
aaaaccucacccgaggcugccc

SEQ ID NO: 2526726 - RNA, 15 nt, Human
aaaacccagauaaag

SEQ ID NO: 2526727 - RNA, 13 nt, Human
aaaacccagagag

SEQ ID NO: 2526728 - RNA, 12 nt, Human
aaaacccagaga

SEQ ID NO: 2526729 - RNA, 15 nt, Human
aaaacccagagagga

SEQ ID NO: 2526730 - RNA, 13 nt, Human
aaaaccacagcag

SEQ ID NO: 2526731 - RNA, 14 nt, Human
aaaaccacagcagu

SEQ ID NO: 2526732 - RNA, 12 nt, Human
aaaaccacagca

SEQ ID NO: 2526733 - RNA, 21 nt, Human
aaaaccaauguucucucuucu

SEQ ID NO: 2526734 - RNA, 18 nt, Human
aaaacauuaagaaaauca

SEQ ID NO: 2526735 - RNA, 16 nt, Human
aaaacauuaagaaaau

SEQ ID NO: 2526736 - RNA, 15 nt, Human
aaaacauuaagaaaa

SEQ ID NO: 2526737 - RNA, 23 nt, Human
aaaacauuaagaaaaucauauug

SEQ ID NO: 2526738 - RNA, 19 nt, Human
aaaacauuaagaaaaucau

SEQ ID NO: 2526739 - RNA, 16 nt, Human
aaaacauuccauccuu

SEQ ID NO: 2526740 - RNA, 12 nt, Human
aaaacauuguuc

SEQ ID NO: 2526741 - RNA, 13 nt, Human
aaaacauuguucc

SEQ ID NO: 2526742 - RNA, 15 nt, Human
aaaacaugcuacaca

SEQ ID NO: 2526743 - RNA, 14 nt, Human
aaaacauuaagaaa

SEQ ID NO: 2526744 - RNA, 19 nt, Human
aaaacauguaauauaaaga

SEQ ID NO: 2526745 - RNA, 14 nt, Human
aaaacaugguagaa

SEQ ID NO: 2526746 - RNA, 16 nt, Human
aaaacaugguagaauu

SEQ ID NO: 2526747 - RNA, 20 nt, Human
aaaacauaaucuucugccuu

SEQ ID NO: 2526748 - RNA, 24 nt, Human
aaaacauaaucuucugccuucuca

SEQ ID NO: 2526749 - RNA, 17 nt, Human
aaaacauaaucuucugc

SEQ ID NO: 2526750 - RNA, 18 nt, Human
aaaacauaaucuucugcc

SEQ ID NO: 2526751 - RNA, 20 nt, Human
aaaacaguccuucaaacuuc

SEQ ID NO: 2526752 - RNA, 22 nt, Human
aaaaauggaacauaaaauacaa

SEQ ID NO: 2526753 - RNA, 23 nt, Human
aaaaauggaaacauuuauuccuu

SEQ ID NO: 2526754 - RNA, 19 nt, Human
aaaaaugcugaacauugca

SEQ ID NO: 2526755 - RNA, 15 nt, Human
aaaaaugcugaacau

SEQ ID NO: 2526756 - RNA, 16 nt, Human
aaaaaugcugaacauu

SEQ ID NO: 2526757 - RNA, 18 nt, Human
aaaacagguggagaaauu

SEQ ID NO: 2526758 - RNA, 21 nt, Human
aaaacaggucuucaucgaauc

SEQ ID NO: 2526759 - RNA, 18 nt, Human
aaaacaggucaauacagu

SEQ ID NO: 2526760 - RNA, 14 nt, Human
aaaaauggcucaga

SEQ ID NO: 2526761 - RNA, 14 nt, Human
aaaaaucucaaauu

SEQ ID NO: 2526762 - RNA, 22 nt, Human
aaaaaucuaccuucuguaguuu

SEQ ID NO: 2526763 - RNA, 19 nt, Human
aaaaaucuaccuucuguag

SEQ ID NO: 2526764 - RNA, 19 nt, Human
aaaaauccucuuccucuga

SEQ ID NO: 2526765 - RNA, 15 nt, Human
aaaaauccucuuccu

SEQ ID NO: 2526766 - RNA, 18 nt, Human
aaaaaucuaccuucugua

SEQ ID NO: 2526767 - RNA, 22 nt, Human
aaaaaugccuuugagacaguuu

SEQ ID NO: 2526768 - RNA, 21 nt, Human
aaaaaugccuuugagacaguu

SEQ ID NO: 2526769 - RNA, 20 nt, Human
aaaaaugccuuugagacagu

SEQ ID NO: 2526770 - RNA, 19 nt, Human
aaaaaugccuuugagacag

SEQ ID NO: 2526771 - RNA, 24 nt, Human
aaaaaugccuuugagacaguuucu

SEQ ID NO: 2526772 - RNA, 14 nt, Human
aaaaaugcugaaca

SEQ ID NO: 2526773 - RNA, 18 nt, Human
aaaaaugccuuugagaca

SEQ ID NO: 2526774 - RNA, 15 nt, Human
aaaaaugccuuugag

SEQ ID NO: 2526775 - RNA, 14 nt, Human
aaaaaugccuuuga

SEQ ID NO: 2526776 - RNA, 17 nt, Human
gggagggcuccagacac

SEQ ID NO: 2526777 - RNA, 15 nt, Human
gggagggcuccagac

SEQ ID NO: 2526778 - RNA, 14 nt, Human
gggagggcuccaga

SEQ ID NO: 2526779 - RNA, 22 nt, Human
gggaggcucuggagcccacugu

SEQ ID NO: 2526780 - RNA, 18 nt, Human
gggagggcuccagacaca

SEQ ID NO: 2526781 - RNA, 17 nt, Human
gggaggucgaggcagga

SEQ ID NO: 2526782 - RNA, 18 nt, Human
gggaggucgaggcaggag

SEQ ID NO: 2526783 - RNA, 19 nt, Human
gggaggucgaggcaggagg

SEQ ID NO: 2526784 - RNA, 22 nt, Human
gggauguacaaggcgaucccau

SEQ ID NO: 2526785 - RNA, 13 nt, Human
gggauggugcccu

SEQ ID NO: 2526786 - RNA, 18 nt, Human
gggaugguggagggccac

SEQ ID NO: 2526787 - RNA, 14 nt, Human
gggaugucucucau

SEQ ID NO: 2526788 - RNA, 12 nt, Human
gggauggugccc

SEQ ID NO: 2526789 - RNA, 17 nt, Human
gggaugguggagggcca

SEQ ID NO: 2526790 - RNA, 16 nt, Human
gggaugguguucaaaa

SEQ ID NO: 2526791 - RNA, 14 nt, Human
gggaugugggaggg

SEQ ID NO: 2526792 - RNA, 20 nt, Human
gggauguggcugcagcagcg

SEQ ID NO: 2526793 - RNA, 23 nt, Human
gggauguauccaugggggcaggg

SEQ ID NO: 2526794 - RNA, 22 nt, Human
gggaugugaauugccugcagag

SEQ ID NO: 2526795 - RNA, 16 nt, Human
gggauuaaccucugca

SEQ ID NO: 2526796 - RNA, 20 nt, Human
gggauuaauaugaaaacuua

SEQ ID NO: 2526797 - RNA, 22 nt, Human
gggauguucagcacugucccuu

SEQ ID NO: 2526798 - RNA, 13 nt, Human
gggauguucuggc

SEQ ID NO: 2526799 - RNA, 16 nt, Human
gggauguucuggcccu

SEQ ID NO: 2526800 - RNA, 18 nt, Human
gggauggaggagaagaau

SEQ ID NO: 2526801 - RNA, 15 nt, Human
gggaugggccaccgc

SEQ ID NO: 2526802 - RNA, 14 nt, Human
gggaugggccaccg

SEQ ID NO: 2526803 - RNA, 13 nt, Human
gggaugggccacc

SEQ ID NO: 2526804 - RNA, 12 nt, Human
gggaugggaggu

SEQ ID NO: 2526805 - RNA, 16 nt, Human
gggaugggccaccgcc

SEQ ID NO: 2526806 - RNA, 15 nt, Human
gggaugguccugggg

SEQ ID NO: 2526807 - RNA, 16 nt, Human
gggaugguccuggggc

SEQ ID NO: 2526808 - RNA, 16 nt, Human
gggaugcccuggaggu

SEQ ID NO: 2526809 - RNA, 15 nt, Human
gggauggaaaaggaa

SEQ ID NO: 2526810 - RNA, 18 nt, Human
gggauggacugaugcuuu

SEQ ID NO: 2526811 - RNA, 14 nt, Human
gggauggaggagaa

SEQ ID NO: 2526812 - RNA, 15 nt, Human
gggauggaggagaag

SEQ ID NO: 2526813 - RNA, 15 nt, Human
gggaggcucaggucc

SEQ ID NO: 2526814 - RNA, 20 nt, Human
gggaggcggagaguacagug

SEQ ID NO: 2526815 - RNA, 22 nt, Human
gggagaagaaaggugaguuuga

SEQ ID NO: 2526816 - RNA, 13 nt, Human
aaaagcauguaca

SEQ ID NO: 2526817 - RNA, 12 nt, Human
aaaagcauguac

SEQ ID NO: 2526818 - RNA, 19 nt, Human
gggagaaugucaguaugug

SEQ ID NO: 2526819 - RNA, 22 nt, Human
gggagaaugucaguauguggaa

SEQ ID NO: 2526820 - RNA, 12 nt, Human
gggagaagcucc

SEQ ID NO: 2526821 - RNA, 15 nt, Human
gggagaaucauguga

SEQ ID NO: 2526822 - RNA, 14 nt, Human
aaaagcacaagaag

SEQ ID NO: 2526823 - RNA, 19 nt, Human
aaaagcagcccuuggccag

SEQ ID NO: 2526824 - RNA, 14 nt, Human
aaaagcagcuacca

SEQ ID NO: 2526825 - RNA, 16 nt, Human
aaaagcagcucucccc

SEQ ID NO: 2526826 - RNA, 13 nt, Human
aaaagcauaaaug

SEQ ID NO: 2526827 - RNA, 15 nt, Human
aaaagcauaaaugca

SEQ ID NO: 2526828 - RNA, 17 nt, Human
aaaagcagcucuccccu

SEQ ID NO: 2526829 - RNA, 15 nt, Human
aaaagaugcaaugua

SEQ ID NO: 2526830 - RNA, 21 nt, Human
aaaagauggggucuguaaaau

SEQ ID NO: 2526831 - RNA, 13 nt, Human
aaaagauguagau

SEQ ID NO: 2526832 - RNA, 19 nt, Human
aaaagauggggucuguaaa

SEQ ID NO: 2526833 - RNA, 12 nt, Human
aaaagcaagacu

SEQ ID NO: 2526834 - RNA, 14 nt, Human
aaaagcaaaaucau

SEQ ID NO: 2526835 - RNA, 14 nt, Human
aaaagauguagauu

SEQ ID NO: 2526836 - RNA, 14 nt, Human
aaaagcaaaugaga

SEQ ID NO: 2526837 - RNA, 14 nt, Human
aaaagcaagacugu

SEQ ID NO: 2526838 - RNA, 16 nt, Human
aaaagcaauuccaacc

SEQ ID NO: 2526839 - RNA, 21 nt, Human
aaaagcacacucauccccuca

SEQ ID NO: 2526840 - RNA, 15 nt, Human
gggagacaugugaca

SEQ ID NO: 2526841 - RNA, 12 nt, Human
gggagacagcau

SEQ ID NO: 2526842 - RNA, 19 nt, Human
gggagacacuggccccuca

SEQ ID NO: 2526843 - RNA, 14 nt, Human
gggagacacuggcc

SEQ ID NO: 2526844 - RNA, 15 nt, Human
gggagagggucugga

SEQ ID NO: 2526845 - RNA, 11 nt, Human
gggagcacugg

SEQ ID NO: 2526846 - RNA, 17 nt, Human
gggagauucaagggacc

SEQ ID NO: 2526847 - RNA, 16 nt, Human
gggagcacuggagugc

SEQ ID NO: 2526848 - RNA, 14 nt, Human
gggagcacuggagu

SEQ ID NO: 2526849 - RNA, 16 nt, Human
gggagcagacaggagg

SEQ ID NO: 2526850 - RNA, 13 nt, Human
gggagcagagaca

SEQ ID NO: 2526851 - RNA, 17 nt, Human
gggagagugcaggccug

SEQ ID NO: 2526852 - RNA, 16 nt, Human
gggagaggugccagca

SEQ ID NO: 2526853 - RNA, 19 nt, Human
gggagauggaguucuugug

SEQ ID NO: 2526854 - RNA, 19 nt, Human
gggagauggaucaaucaaa

SEQ ID NO: 2526855 - RNA, 11 nt, Human
gggaggcccca

SEQ ID NO: 2526856 - RNA, 16 nt, Human
gggaggccccacuggg

SEQ ID NO: 2526857 - RNA, 17 nt, Human
gggaggccuaggcgggc

SEQ ID NO: 2526858 - RNA, 18 nt, Human
gggaggccccacugggga

SEQ ID NO: 2526859 - RNA, 18 nt, Human
gggaggcggagaguacag

SEQ ID NO: 2526860 - RNA, 21 nt, Human
gggaggcggacguuccagccg

SEQ ID NO: 2526861 - RNA, 20 nt, Human
gggaggcggacguuccagcc

SEQ ID NO: 2526862 - RNA, 14 nt, Human
gggaggcgcgagcc

SEQ ID NO: 2526863 - RNA, 13 nt, Human
gggaggcucaggu

SEQ ID NO: 2526864 - RNA, 20 nt, Human
gggaggcggagcuugcagug

SEQ ID NO: 2526865 - RNA, 19 nt, Human
gggaggccaaggugggagg

SEQ ID NO: 2526866 - RNA, 21 nt, Human
gggagcaggcggugggcaccc

SEQ ID NO: 2526867 - RNA, 18 nt, Human
gggagcaggagauugaga

SEQ ID NO: 2526868 - RNA, 13 nt, Human
gggagcaggagau

SEQ ID NO: 2526869 - RNA, 12 nt, Human
gggagcaggaga

SEQ ID NO: 2526870 - RNA, 21 nt, Human
gggagcaggagauugagaagg

SEQ ID NO: 2526871 - RNA, 15 nt, Human
gggagcaggcggugg

SEQ ID NO: 2526872 - RNA, 14 nt, Human
gggcagaggaaagc

SEQ ID NO: 2526873 - RNA, 22 nt, Human
gggcagagcagagaccaucccu

SEQ ID NO: 2526874 - RNA, 17 nt, Human
gggcagagcagagacca

SEQ ID NO: 2526875 - RNA, 16 nt, Human
gggcagagcagagacc

SEQ ID NO: 2526876 - RNA, 18 nt, Human
gggcaacccccagccugc

SEQ ID NO: 2526877 - RNA, 16 nt, Human
gggcaacccccagccu

SEQ ID NO: 2526878 - RNA, 15 nt, Human
gggauugggccccug

SEQ ID NO: 2526879 - RNA, 15 nt, Human
gggauugcugccacu

SEQ ID NO: 2526880 - RNA, 16 nt, Human
gggauuguaaaauggu

SEQ ID NO: 2526881 - RNA, 17 nt, Human
gggauugcugccacuuu

SEQ ID NO: 2526882 - RNA, 16 nt, Human
gggauugggggcuggu

SEQ ID NO: 2526883 - RNA, 14 nt, Human
gggcaaagccuagu

SEQ ID NO: 2526884 - RNA, 17 nt, Human
gggauuguaaaauggug

SEQ ID NO: 2526885 - RNA, 14 nt, Human
gggauuacaggcgu

SEQ ID NO: 2526886 - RNA, 13 nt, Human
gggauuacaggcu

SEQ ID NO: 2526887 - RNA, 16 nt, Human
gggauuacaggcuccu

SEQ ID NO: 2526888 - RNA, 21 nt, Human
gggauuacaggcuccugccac

SEQ ID NO: 2526889 - RNA, 16 nt, Human
gggauuacccaagcaa

SEQ ID NO: 2526890 - RNA, 15 nt, Human
gggauuacccaagca

SEQ ID NO: 2526891 - RNA, 20 nt, Human
gggauuacaggcgugagcca

SEQ ID NO: 2526892 - RNA, 12 nt, Human
gggauuacaggu

SEQ ID NO: 2526893 - RNA, 15 nt, Human
gggauuacaggugug

SEQ ID NO: 2526894 - RNA, 13 nt, Human
gggcaggcugaca

SEQ ID NO: 2526895 - RNA, 23 nt, Human
gggcaggcccugcacuguccugc

SEQ ID NO: 2526896 - RNA, 22 nt, Human
gggcaggcccugcacuguccug

SEQ ID NO: 2526897 - RNA, 21 nt, Human
gggcaggcccugcacuguccu

SEQ ID NO: 2526898 - RNA, 20 nt, Human
gggcagggaaggggaggcag

SEQ ID NO: 2526899 - RNA, 15 nt, Human
gggcaggcacagcac

SEQ ID NO: 2526900 - RNA, 14 nt, Human
gggcaggcacagca

SEQ ID NO: 2526901 - RNA, 13 nt, Human
gggcaggcacagc

SEQ ID NO: 2526902 - RNA, 12 nt, Human
gggcaggcacag

SEQ ID NO: 2526903 - RNA, 15 nt, Human
gggcaggcaugaagu

SEQ ID NO: 2526904 - RNA, 17 nt, Human
gggcaggcacagcacag

SEQ ID NO: 2526905 - RNA, 11 nt, Human
gggcaggcagu

SEQ ID NO: 2526906 - RNA, 19 nt, Human
gggcaggcccugcacuguc

SEQ ID NO: 2526907 - RNA, 17 nt, Human
gggcaggcccugcacug

SEQ ID NO: 2526908 - RNA, 14 nt, Human
gggcaggcccugca

SEQ ID NO: 2526909 - RNA, 13 nt, Human
gggcaggcccugc

SEQ ID NO: 2526910 - RNA, 15 nt, Human
gggcaggccagagcu

SEQ ID NO: 2526911 - RNA, 12 nt, Human
gggcagggagcg

SEQ ID NO: 2526912 - RNA, 19 nt, Human
aaaagggacugagaaauuu

SEQ ID NO: 2526913 - RNA, 18 nt, Human
aaaagggauuacccaagc

SEQ ID NO: 2526914 - RNA, 23 nt, Human
aaaagggcagggcaucuccugug

SEQ ID NO: 2526915 - RNA, 21 nt, Human
aaaagggucuugggaaauaug

SEQ ID NO: 2526916 - RNA, 19 nt, Human
aaaagggucuugggaaaua

SEQ ID NO: 2526917 - RNA, 19 nt, Human
aaaagggcucuuuagccag

SEQ ID NO: 2526918 - RNA, 19 nt, Human
aaaagguaugcaaucaaau

SEQ ID NO: 2526919 - RNA, 14 nt, Human
aaaagguaaaacuu

SEQ ID NO: 2526920 - RNA, 23 nt, Human
aaaagguaaaacuuuuuauauuu

SEQ ID NO: 2526921 - RNA, 14 nt, Human
gggcagcccuugcu

SEQ ID NO: 2526922 - RNA, 12 nt, Human
gggcagagucac

SEQ ID NO: 2526923 - RNA, 17 nt, Human
gggcagagugagaccca

SEQ ID NO: 2526924 - RNA, 16 nt, Human
gggcagagucacacgg

SEQ ID NO: 2526925 - RNA, 22 nt, Human
gggcaacagagcaagauccugu

SEQ ID NO: 2526926 - RNA, 15 nt, Human
gggcagaggcuggag

SEQ ID NO: 2526927 - RNA, 14 nt, Human
gggcagaggcugga

SEQ ID NO: 2526928 - RNA, 15 nt, Human
gggcagagggcagag

SEQ ID NO: 2526929 - RNA, 20 nt, Human
gggcagagggcagaggcugg

SEQ ID NO: 2526930 - RNA, 16 nt, Human
gggcagaggcuggagg

SEQ ID NO: 2526931 - RNA, 21 nt, Human
gggcagaggcuggaggcaggg

SEQ ID NO: 2526932 - RNA, 23 nt, Human
gggcagaggcuggaggcagggcc

SEQ ID NO: 2526933 - RNA, 14 nt, Human
gggcagagggcaga

SEQ ID NO: 2526934 - RNA, 13 nt, Human
gggcagcgccagg

SEQ ID NO: 2526935 - RNA, 15 nt, Human
gggcagcgccaggcu

SEQ ID NO: 2526936 - RNA, 16 nt, Human
gggcagcgccaggcug

SEQ ID NO: 2526937 - RNA, 19 nt, Human
gggcagcccuugcuuguug

SEQ ID NO: 2526938 - RNA, 16 nt, Human
gggcagcugccagaga

SEQ ID NO: 2526939 - RNA, 18 nt, Human
gggcagcugccagagaag

SEQ ID NO: 2526940 - RNA, 12 nt, Human
gggcagcugcca

SEQ ID NO: 2526941 - RNA, 21 nt, Human
gggcagcgcccuuccucucca

SEQ ID NO: 2526942 - RNA, 20 nt, Human
gggcagcgcccuuccucucc

SEQ ID NO: 2526943 - RNA, 18 nt, Human
gggcagcgcccuuccucu

SEQ ID NO: 2526944 - RNA, 16 nt, Human
gggcagcgcccuuccu

SEQ ID NO: 2526945 - RNA, 23 nt, Human
gggcagcgcccuuccucuccacc

SEQ ID NO: 2526946 - RNA, 14 nt, Human
gcuuuuccuugggg

SEQ ID NO: 2526947 - RNA, 20 nt, Human
gcuuuuccuuggggcaggca

SEQ ID NO: 2526948 - RNA, 21 nt, Human
gcuuuuccuuggggcaggcag

SEQ ID NO: 2526949 - RNA, 14 nt, Human
gcuuuucucagcug

SEQ ID NO: 2526950 - RNA, 22 nt, Human
gcuuuuccuuggggcaggcagu

SEQ ID NO: 2526951 - RNA, 23 nt, Human
gcuuuuccuuggggcaggcagug

SEQ ID NO: 2526952 - RNA, 17 nt, Human
gcuuuucuccucuuucc

SEQ ID NO: 2526953 - RNA, 16 nt, Human
gcuuuucuccucuuuc

SEQ ID NO: 2526954 - RNA, 13 nt, Human
gcuuuucuccucu

SEQ ID NO: 2526955 - RNA, 22 nt, Human
gcuuuuccuuuguuuuuaugaa

SEQ ID NO: 2526956 - RNA, 16 nt, Human
gcuuuucugcccuggc

SEQ ID NO: 2526957 - RNA, 11 nt, Human
gcuuuuggcaa

SEQ ID NO: 2526958 - RNA, 15 nt, Human
gcuuuucugcccugg

SEQ ID NO: 2526959 - RNA, 14 nt, Human
gcuuuucugcccug

SEQ ID NO: 2526960 - RNA, 18 nt, Human
gcuuuugucuaugggacu

SEQ ID NO: 2526961 - RNA, 15 nt, Human
gcuuuuggucugugu

SEQ ID NO: 2526962 - RNA, 13 nt, Human
gcuuuuuccagag

SEQ ID NO: 2526963 - RNA, 17 nt, Human
gcuuuuuauuucugcau

SEQ ID NO: 2526964 - RNA, 21 nt, Human
gcuuuuuauuucugcauaugu

SEQ ID NO: 2526965 - RNA, 22 nt, Human
gcuuuuuaauuguuguuucuuu

SEQ ID NO: 2526966 - RNA, 21 nt, Human
gcuuuuuaauuguuguuucuu

SEQ ID NO: 2526967 - RNA, 20 nt, Human
gcuuuuuaauuguuguuucu

SEQ ID NO: 2526968 - RNA, 19 nt, Human
gcuuuuuauuccuccugcu

SEQ ID NO: 2526969 - RNA, 15 nt, Human
gcuuuuuauuucugc

SEQ ID NO: 2526970 - RNA, 13 nt, Human
gcuuuuuaauugu

SEQ ID NO: 2526971 - RNA, 12 nt, Human
gcuuuugugcau

SEQ ID NO: 2526972 - RNA, 20 nt, Human
gcuuuuuuaucaugugaaau

SEQ ID NO: 2526973 - RNA, 18 nt, Human
gcuuuuuuaucaugugaa

SEQ ID NO: 2526974 - RNA, 21 nt, Human
gcuuuuugagguggcacuuuu

SEQ ID NO: 2526975 - RNA, 18 nt, Human
gcuuuuucugacuccagu

SEQ ID NO: 2526976 - RNA, 14 nt, Human
gcuuuuucugacuc

SEQ ID NO: 2526977 - RNA, 12 nt, Human
gcuuuuucugac

SEQ ID NO: 2526978 - RNA, 11 nt, Human
gcuuuuucuga

SEQ ID NO: 2526979 - RNA, 15 nt, Human
gcuuuuuuaucaugu

SEQ ID NO: 2526980 - RNA, 18 nt, Human
ggaaaauuuuaaaaauac

SEQ ID NO: 2526981 - RNA, 20 nt, Human
gcuuuuugagguggcacuuu

SEQ ID NO: 2526982 - RNA, 16 nt, Human
gcuuuuugucuuuucu

SEQ ID NO: 2526983 - RNA, 17 nt, Human
gcuuuuuuguuuuggcu

SEQ ID NO: 2526984 - RNA, 14 nt, Human
ggaaacaaagcuua

SEQ ID NO: 2526985 - RNA, 12 nt, Human
ggaaacaauaua

SEQ ID NO: 2526986 - RNA, 16 nt, Human
ggaaacaacagcuuua

SEQ ID NO: 2526987 - RNA, 23 nt, Human
ggaaacaaagcuuagcaggagag

SEQ ID NO: 2526988 - RNA, 22 nt, Human
ggaaacaaagcuuagcaggaga

SEQ ID NO: 2526989 - RNA, 13 nt, Human
ggaaacaacagcu

SEQ ID NO: 2526990 - RNA, 16 nt, Human
ggaaacccagcucugg

SEQ ID NO: 2526991 - RNA, 13 nt, Human
ggaaacagacucg

SEQ ID NO: 2526992 - RNA, 18 nt, Human
ggaaaccugcccugccug

SEQ ID NO: 2526993 - RNA, 17 nt, Human
ggaaaccugcccugccu

SEQ ID NO: 2526994 - RNA, 14 nt, Human
ggaaaccugcccug

SEQ ID NO: 2526995 - RNA, 13 nt, Human
ggaaaccugcccu

SEQ ID NO: 2526996 - RNA, 22 nt, Human
ggaaaccugcccugccugaggg

SEQ ID NO: 2526997 - RNA, 19 nt, Human
ggaaaccugcccugccuga

SEQ ID NO: 2526998 - RNA, 12 nt, Human
ggaaaccugccc

SEQ ID NO: 2526999 - RNA, 22 nt, Human
ggaaacagacucgauucauauu

SEQ ID NO: 2527000 - RNA, 17 nt, Human
gcuuugaucccuucuua

SEQ ID NO: 2527001 - RNA, 14 nt, Human
gcuuugaucccuuc

SEQ ID NO: 2527002 - RNA, 14 nt, Human
gcuuugaucccuga

SEQ ID NO: 2527003 - RNA, 15 nt, Human
gcuuugaucccugac

SEQ ID NO: 2527004 - RNA, 15 nt, Human
ggaagacgaggcccu

SEQ ID NO: 2527005 - RNA, 14 nt, Human
ggaagaccuggcaa

SEQ ID NO: 2527006 - RNA, 15 nt, Human
ggaagacgccugagc

SEQ ID NO: 2527007 - RNA, 16 nt, Human
ggaagacgccugagcu

SEQ ID NO: 2527008 - RNA, 16 nt, Human
ggaagacgaggcccuc

SEQ ID NO: 2527009 - RNA, 20 nt, Human
ggaagacuucaucccucugg

SEQ ID NO: 2527010 - RNA, 17 nt, Human
ggaagacuucaucccuc

SEQ ID NO: 2527011 - RNA, 18 nt, Human
ggaagaagggagaagaaa

SEQ ID NO: 2527012 - RNA, 23 nt, Human
ggaagaccccacccaagcuuggc

SEQ ID NO: 2527013 - RNA, 19 nt, Human
ggaagaccccacccaagcu

SEQ ID NO: 2527014 - RNA, 15 nt, Human
ggaagaccccaccca

SEQ ID NO: 2527015 - RNA, 19 nt, Human
ggaagaauuuuaaaaauga

SEQ ID NO: 2527016 - RNA, 14 nt, Human
ggaagaauuuuaaa

SEQ ID NO: 2527017 - RNA, 22 nt, Human
ggaaaugggcagagcagagacc

SEQ ID NO: 2527018 - RNA, 18 nt, Human
ggaaaugggcagagcaga

SEQ ID NO: 2527019 - RNA, 17 nt, Human
ggaaaugggcagagcag

SEQ ID NO: 2527020 - RNA, 16 nt, Human
ggaaaugggcagagca

SEQ ID NO: 2527021 - RNA, 15 nt, Human
ggaaaccuuggugua

SEQ ID NO: 2527022 - RNA, 14 nt, Human
ggaaaugggcagag

SEQ ID NO: 2527023 - RNA, 15 nt, Human
ggaaaugcugggcug

SEQ ID NO: 2527024 - RNA, 18 nt, Human
ggaaaugaucaguuuuuu

SEQ ID NO: 2527025 - RNA, 15 nt, Human
ggaaaugaaagaaag

SEQ ID NO: 2527026 - RNA, 16 nt, Human
ggaaaugaaugugugu

SEQ ID NO: 2527027 - RNA, 21 nt, Human
ggaacaaggcaaggcugucaa

SEQ ID NO: 2527028 - RNA, 17 nt, Human
ggaacaaggcaaggcug

SEQ ID NO: 2527029 - RNA, 15 nt, Human
ggaacaaggcaaggc

SEQ ID NO: 2527030 - RNA, 18 nt, Human
ggaacaaggagucagaca

SEQ ID NO: 2527031 - RNA, 22 nt, Human
ggaaauucccuucaucuggaac

SEQ ID NO: 2527032 - RNA, 23 nt, Human
ggaaauugagauuagagggaggu

SEQ ID NO: 2527033 - RNA, 20 nt, Human
ggaaauucccuucaucugga

SEQ ID NO: 2527034 - RNA, 13 nt, Human
ggaaauggugccu

SEQ ID NO: 2527035 - RNA, 14 nt, Human
ggaaauuaagaaga

SEQ ID NO: 2527036 - RNA, 19 nt, Human
ggaaauucccuucaucugg

SEQ ID NO: 2527037 - RNA, 19 nt, Human
ggaaauuaagaagaaacua

SEQ ID NO: 2527038 - RNA, 15 nt, Human
ggaaauggaauacug

SEQ ID NO: 2527039 - RNA, 22 nt, Human
ggaaauggaaccccaccacugu

SEQ ID NO: 2527040 - RNA, 19 nt, Human
ggaaaugguaugagcugag

SEQ ID NO: 2527041 - RNA, 17 nt, Human
ggaaaugucaacaagua

SEQ ID NO: 2527042 - RNA, 16 nt, Human
ggaagaagggagaaga

SEQ ID NO: 2527043 - RNA, 15 nt, Human
ggaagaagggagaag

SEQ ID NO: 2527044 - RNA, 14 nt, Human
ggaagaagggagaa

SEQ ID NO: 2527045 - RNA, 13 nt, Human
ggaagaagggaga

SEQ ID NO: 2527046 - RNA, 19 nt, Human
ggaagaagcuuaggcaggg

SEQ ID NO: 2527047 - RNA, 18 nt, Human
ggaagaagcuuaggcagg

SEQ ID NO: 2527048 - RNA, 16 nt, Human
ggaagaagagggagag

SEQ ID NO: 2527049 - RNA, 15 nt, Human
ggaagaagagggaga

SEQ ID NO: 2527050 - RNA, 21 nt, Human
ggaagaacggggcucuucuca

SEQ ID NO: 2527051 - RNA, 14 nt, Human
ggaagacaauguga

SEQ ID NO: 2527052 - RNA, 16 nt, Human
ggaagacaaugugaaa

SEQ ID NO: 2527053 - RNA, 14 nt, Human
ggaacugcugggcu

SEQ ID NO: 2527054 - RNA, 23 nt, Human
ggaacuuggggaguuaagaccug

SEQ ID NO: 2527055 - RNA, 15 nt, Human
ggaacugcugggcuu

SEQ ID NO: 2527056 - RNA, 16 nt, Human
ggaagaaauuccugua

SEQ ID NO: 2527057 - RNA, 19 nt, Human
ggaagaaagagaaggagcc

SEQ ID NO: 2527058 - RNA, 16 nt, Human
ggaagaaagagaagga

SEQ ID NO: 2527059 - RNA, 14 nt, Human
ggaagaaaagagcu

SEQ ID NO: 2527060 - RNA, 19 nt, Human
ggaagaaauuccuguagca

SEQ ID NO: 2527061 - RNA, 18 nt, Human
ggaagaaauuccuguagc

SEQ ID NO: 2527062 - RNA, 11 nt, Human
ggaagaacacc

SEQ ID NO: 2527063 - RNA, 23 nt, Human
ggaagaaauuccuguagcaucuu

SEQ ID NO: 2527064 - RNA, 13 nt, Human
ggaagaacauaga

SEQ ID NO: 2527065 - RNA, 14 nt, Human
ggaagaacauagaa

SEQ ID NO: 2527066 - RNA, 16 nt, Human
ggaagaacauagaacu

SEQ ID NO: 2527067 - RNA, 23 nt, Human
ggaacaaggcaaggcugucaauu

SEQ ID NO: 2527068 - RNA, 14 nt, Human
ggaacacacuugga

SEQ ID NO: 2527069 - RNA, 13 nt, Human
ggaacaaucuaaa

SEQ ID NO: 2527070 - RNA, 13 nt, Human
ggaacaccuccuc

SEQ ID NO: 2527071 - RNA, 14 nt, Human
ggaacacggccaca

SEQ ID NO: 2527072 - RNA, 17 nt, Human
ggaacaccauaggucac

SEQ ID NO: 2527073 - RNA, 14 nt, Human
ggaacugcagaccu

SEQ ID NO: 2527074 - RNA, 13 nt, Human
ggaacugcagacc

SEQ ID NO: 2527075 - RNA, 19 nt, Human
ggaacucuggcuuccaggu

SEQ ID NO: 2527076 - RNA, 20 nt, Human
ggaacucuggcuuccaggua

SEQ ID NO: 2527077 - RNA, 16 nt, Human
ggaacugcaugcugcu

SEQ ID NO: 2527078 - RNA, 17 nt, Human
ggaacugcagaccuguc

SEQ ID NO: 2527079 - RNA, 15 nt, Human
ggaacugcagaccug

SEQ ID NO: 2527080 - RNA, 21 nt, Human
ggaacugcagaccuguccucc

SEQ ID NO: 2527081 - RNA, 15 nt, Human
ggaacugcaugcugc

SEQ ID NO: 2527082 - RNA, 15 nt, Human
ggaacacuccuucac

SEQ ID NO: 2527083 - RNA, 19 nt, Human
ggaacacuccuucacagau

SEQ ID NO: 2527084 - RNA, 17 nt, Human
ggaacugaacauuccag

SEQ ID NO: 2527085 - RNA, 22 nt, Human
gcuuccagugaggcucugcccu

SEQ ID NO: 2527086 - RNA, 20 nt, Human
gcuugaccgugaggccagag

SEQ ID NO: 2527087 - RNA, 15 nt, Human
gcuugacaacaucug

SEQ ID NO: 2527088 - RNA, 20 nt, Human
gcuugaagccaaagaaaaau

SEQ ID NO: 2527089 - RNA, 18 nt, Human
gcuugaagccaaagaaaa

SEQ ID NO: 2527090 - RNA, 14 nt, Human
gcuugaagccaagu

SEQ ID NO: 2527091 - RNA, 16 nt, Human
gcuugaagccaaagaa

SEQ ID NO: 2527092 - RNA, 15 nt, Human
gcuugaagccaaaga

SEQ ID NO: 2527093 - RNA, 14 nt, Human
gcuugaagccaaag

SEQ ID NO: 2527094 - RNA, 12 nt, Human
gcuugaagccaa

SEQ ID NO: 2527095 - RNA, 11 nt, Human
gcuugaagcca

SEQ ID NO: 2527096 - RNA, 22 nt, Human
gcuugaagaucguuaguaucua

SEQ ID NO: 2527097 - RNA, 13 nt, Human
gcuugaacccagg

SEQ ID NO: 2527098 - RNA, 21 nt, Human
gcuugaagaucguuaguaucu

SEQ ID NO: 2527099 - RNA, 20 nt, Human
gcuugaaagaaaauaugcau

SEQ ID NO: 2527100 - RNA, 15 nt, Human
gcuucuucagagacu

SEQ ID NO: 2527101 - RNA, 23 nt, Human
gcuucuuaaucuuuucacaaaua

SEQ ID NO: 2527102 - RNA, 22 nt, Human
gcuucuuaaucuuuucacaaau

SEQ ID NO: 2527103 - RNA, 13 nt, Human
gcuugaaagaaaa

SEQ ID NO: 2527104 - RNA, 12 nt, Human
gcuucuucagag

SEQ ID NO: 2527105 - RNA, 21 nt, Human
gcuucuuaaucuuuucacaaa

SEQ ID NO: 2527106 - RNA, 19 nt, Human
gcuucuuaaucuuuucaca

SEQ ID NO: 2527107 - RNA, 22 nt, Human
gcuucuuaauauaacugccuua

SEQ ID NO: 2527108 - RNA, 21 nt, Human
gcuucuuaauauaacugccuu

SEQ ID NO: 2527109 - RNA, 15 nt, Human
gcuuccaugauucua

SEQ ID NO: 2527110 - RNA, 18 nt, Human
gcuuccaugauucuauuu

SEQ ID NO: 2527111 - RNA, 14 nt, Human
gcuuccaugauucu

SEQ ID NO: 2527112 - RNA, 17 nt, Human
gcuuccaugagaacagc

SEQ ID NO: 2527113 - RNA, 17 nt, Human
gcuuccauuugugugug

SEQ ID NO: 2527114 - RNA, 18 nt, Human
gcuuccugacaaucaacu

SEQ ID NO: 2527115 - RNA, 19 nt, Human
gcuuccaugauucuauuua

SEQ ID NO: 2527116 - RNA, 12 nt, Human
gcuuccauucca

SEQ ID NO: 2527117 - RNA, 23 nt, Human
gcuuccagugaggcucugcccuu

SEQ ID NO: 2527118 - RNA, 20 nt, Human
gcuuccugcguccuccucac

SEQ ID NO: 2527119 - RNA, 19 nt, Human
gcuuccuggcaauagucaa

SEQ ID NO: 2527120 - RNA, 19 nt, Human
gcuucuuaauauaacugcc

SEQ ID NO: 2527121 - RNA, 18 nt, Human
gcuugaccuuuaagagaa

SEQ ID NO: 2527122 - RNA, 23 nt, Human
gcuugaccgugaggccagagaca

SEQ ID NO: 2527123 - RNA, 22 nt, Human
gcuugaccuuuaagagaaauga

SEQ ID NO: 2527124 - RNA, 17 nt, Human
gcuuguaaauagcucag

SEQ ID NO: 2527125 - RNA, 14 nt, Human
gcuuuccccugugg

SEQ ID NO: 2527126 - RNA, 12 nt, Human
gcuuuccccugu

SEQ ID NO: 2527127 - RNA, 22 nt, Human
gcuuuccccaugucucgacuca

SEQ ID NO: 2527128 - RNA, 14 nt, Human
gcuugaccugaggc

SEQ ID NO: 2527129 - RNA, 21 nt, Human
gcuuuccccaugucucgacuc

SEQ ID NO: 2527130 - RNA, 19 nt, Human
gcuuguaaauagcucaggu

SEQ ID NO: 2527131 - RNA, 18 nt, Human
gcuuguaaauagcucagg

SEQ ID NO: 2527132 - RNA, 16 nt, Human
gcuuuccucuuccuga

SEQ ID NO: 2527133 - RNA, 22 nt, Human
gcuuuccccuguggggaucuca

SEQ ID NO: 2527134 - RNA, 17 nt, Human
gcuuuccccugugggga

SEQ ID NO: 2527135 - RNA, 16 nt, Human
gcuuuccccugugggg

SEQ ID NO: 2527136 - RNA, 15 nt, Human
gcuuuccccuguggg

SEQ ID NO: 2527137 - RNA, 15 nt, Human
gcuuucccugccucu

SEQ ID NO: 2527138 - RNA, 16 nt, Human
gcuuucccuuaucaaa

SEQ ID NO: 2527139 - RNA, 19 nt, Human
gcuuuccucaucaggccau

SEQ ID NO: 2527140 - RNA, 17 nt, Human
gcuuucuauuguacaga

SEQ ID NO: 2527141 - RNA, 15 nt, Human
gcuuucuauuguaca

SEQ ID NO: 2527142 - RNA, 19 nt, Human
gcuuugagguggaagaggg

SEQ ID NO: 2527143 - RNA, 22 nt, Human
gcuuugagguggaagagggcug

SEQ ID NO: 2527144 - RNA, 18 nt, Human
gcuuucugcucagcuucu

SEQ ID NO: 2527145 - RNA, 19 nt, Human
gcuuucugcucagcuucuc

SEQ ID NO: 2527146 - RNA, 22 nt, Human
gcuuucuggaaaagaggaguuu

SEQ ID NO: 2527147 - RNA, 21 nt, Human
gcuuucugcucagcuucuccu

SEQ ID NO: 2527148 - RNA, 11 nt, Human
gcuuucugucu

SEQ ID NO: 2527149 - RNA, 13 nt, Human
gcuuucuggagag

SEQ ID NO: 2527150 - RNA, 13 nt, Human
gcuuucugcucag

SEQ ID NO: 2527151 - RNA, 20 nt, Human
gcuguacuucgucuucuaau

SEQ ID NO: 2527152 - RNA, 23 nt, Human
gcuguacaucuauuuuggauugu

SEQ ID NO: 2527153 - RNA, 20 nt, Human
gcuguagacauuugcuauga

SEQ ID NO: 2527154 - RNA, 13 nt, Human
gcuguagaaggag

SEQ ID NO: 2527155 - RNA, 12 nt, Human
gcuguacaucua

SEQ ID NO: 2527156 - RNA, 16 nt, Human
gcuguacaucuauuuu

SEQ ID NO: 2527157 - RNA, 20 nt, Human
gcuguacaucuauuuuggau

SEQ ID NO: 2527158 - RNA, 22 nt, Human
gcuguacaucuauuuuggauug

SEQ ID NO: 2527159 - RNA, 20 nt, Human
gcugguuuuguaagaugcug

SEQ ID NO: 2527160 - RNA, 12 nt, Human
gcugguuuuccu

SEQ ID NO: 2527161 - RNA, 14 nt, Human
gcugguuuuccuaa

SEQ ID NO: 2527162 - RNA, 23 nt, Human
gcugguuuuccuaaaugcaguga

SEQ ID NO: 2527163 - RNA, 12 nt, Human
gcuguauuuuaa

SEQ ID NO: 2527164 - RNA, 19 nt, Human
gcuguauuagucacagaga

SEQ ID NO: 2527165 - RNA, 18 nt, Human
gcuguauugaaucaugua

SEQ ID NO: 2527166 - RNA, 17 nt, Human
gcuguauugaaucaugu

SEQ ID NO: 2527167 - RNA, 13 nt, Human
gcuguauucuucu

SEQ ID NO: 2527168 - RNA, 13 nt, Human
gcuguauuuuaaa

SEQ ID NO: 2527169 - RNA, 21 nt, Human
gcugguucggauuuggggugg

SEQ ID NO: 2527170 - RNA, 20 nt, Human
gcugguucggauuuggggug

SEQ ID NO: 2527171 - RNA, 14 nt, Human
gcugguugcugugu

SEQ ID NO: 2527172 - RNA, 13 nt, Human
gcugguugcugug

SEQ ID NO: 2527173 - RNA, 12 nt, Human
gcugguucugua

SEQ ID NO: 2527174 - RNA, 17 nt, Human
gcugguuggagagcuag

SEQ ID NO: 2527175 - RNA, 16 nt, Human
gcugguuggagagcua

SEQ ID NO: 2527176 - RNA, 16 nt, Human
gcugguugcugugugg

SEQ ID NO: 2527177 - RNA, 15 nt, Human
gcugguugcugugug

SEQ ID NO: 2527178 - RNA, 15 nt, Human
gcugguuuccucauu

SEQ ID NO: 2527179 - RNA, 18 nt, Human
gcugguuggagagcuaga

SEQ ID NO: 2527180 - RNA, 24 nt, Human
gcugguugucauuuuugcaguaga

SEQ ID NO: 2527181 - RNA, 23 nt, Human
gcugguucaggguuggccccugc

SEQ ID NO: 2527182 - RNA, 23 nt, Human
gcuggagccuguguaacagcucc

SEQ ID NO: 2527183 - RNA, 22 nt, Human
gcuggagccuguguaacagcuc

SEQ ID NO: 2527184 - RNA, 20 nt, Human
gcuggagugcagugguguga

SEQ ID NO: 2527185 - RNA, 20 nt, Human
gcuggaguucagugguguga

SEQ ID NO: 2527186 - RNA, 16 nt, Human
gcuggaguuucaugua

SEQ ID NO: 2527187 - RNA, 15 nt, Human
gcuggauaaaaugag

SEQ ID NO: 2527188 - RNA, 19 nt, Human
gcuggaucacagcugcuuu

SEQ ID NO: 2527189 - RNA, 14 nt, Human
gcuggauaaaauga

SEQ ID NO: 2527190 - RNA, 23 nt, Human
gcuggaucacagcugcuuucugu

SEQ ID NO: 2527191 - RNA, 13 nt, Human
gcuggaucuguga

SEQ ID NO: 2527192 - RNA, 18 nt, Human
gcugugccacccugggcu

SEQ ID NO: 2527193 - RNA, 17 nt, Human
gcugugccacccugggc

SEQ ID NO: 2527194 - RNA, 15 nt, Human
gcugugccacccugg

SEQ ID NO: 2527195 - RNA, 14 nt, Human
gcugugccacccug

SEQ ID NO: 2527196 - RNA, 13 nt, Human
gcugugccacccu

SEQ ID NO: 2527197 - RNA, 16 nt, Human
gcugugcagccugucc

SEQ ID NO: 2527198 - RNA, 12 nt, Human
gcugugccaccc

SEQ ID NO: 2527199 - RNA, 16 nt, Human
gcugugcccucuugau

SEQ ID NO: 2527200 - RNA, 22 nt, Human
gcugugccacccugggcucugu

SEQ ID NO: 2527201 - RNA, 21 nt, Human
gcugugccacccugggcucug

SEQ ID NO: 2527202 - RNA, 19 nt, Human
gcugugccacccugggcuc

SEQ ID NO: 2527203 - RNA, 17 nt, Human
gcugugccucccaaaau

SEQ ID NO: 2527204 - RNA, 15 nt, Human
gcuguugcugaauag

SEQ ID NO: 2527205 - RNA, 14 nt, Human
gcuguugcugaaua

SEQ ID NO: 2527206 - RNA, 12 nt, Human
gcugugccucug

SEQ ID NO: 2527207 - RNA, 23 nt, Human
gcuguuggccucugcaaaggaaa

SEQ ID NO: 2527208 - RNA, 22 nt, Human
gcuguuggcagugagugagccu

SEQ ID NO: 2527209 - RNA, 20 nt, Human
gcuguuuguuugacaaagaa

SEQ ID NO: 2527210 - RNA, 12 nt, Human
gcuguuugucau

SEQ ID NO: 2527211 - RNA, 16 nt, Human
gcuguuggcagugagu

SEQ ID NO: 2527212 - RNA, 23 nt, Human
gcuguuggcacucacagaccugg

SEQ ID NO: 2527213 - RNA, 22 nt, Human
gcuguuggcacucacagaccug

SEQ ID NO: 2527214 - RNA, 16 nt, Human
gcuguuggcacucaca

SEQ ID NO: 2527215 - RNA, 14 nt, Human
gcuguuggcugggg

SEQ ID NO: 2527216 - RNA, 19 nt, Human
gcuguugcugaauaggcga

SEQ ID NO: 2527217 - RNA, 16 nt, Human
gcuguugcugaauagg

SEQ ID NO: 2527218 - RNA, 13 nt, Human
gcuguuggcacuc

SEQ ID NO: 2527219 - RNA, 13 nt, Human
gcuguugcugaau

SEQ ID NO: 2527220 - RNA, 13 nt, Human
gcuguuggcuggg

SEQ ID NO: 2527221 - RNA, 23 nt, Human
gcuuaauguuuauuccugauaau

SEQ ID NO: 2527222 - RNA, 17 nt, Human
gcuuaauguuuauuccu

SEQ ID NO: 2527223 - RNA, 14 nt, Human
gcuuaauguuuauu

SEQ ID NO: 2527224 - RNA, 16 nt, Human
gcuuaaugcuucuuuc

SEQ ID NO: 2527225 - RNA, 14 nt, Human
gcuuaaugcuucuu

SEQ ID NO: 2527226 - RNA, 12 nt, Human
gcuuaauguuua

SEQ ID NO: 2527227 - RNA, 19 nt, Human
gcuuacaagccagcuggag

SEQ ID NO: 2527228 - RNA, 13 nt, Human
gcuuacaagccag

SEQ ID NO: 2527229 - RNA, 19 nt, Human
gcuguuuuguggauuuuug

SEQ ID NO: 2527230 - RNA, 20 nt, Human
gcuguuuuccucccuucugc

SEQ ID NO: 2527231 - RNA, 21 nt, Human
gcuguuuuccucccuucugcu

SEQ ID NO: 2527232 - RNA, 13 nt, Human
gcuguuuugugga

SEQ ID NO: 2527233 - RNA, 22 nt, Human
gcuguuuuccucccuucugcua

SEQ ID NO: 2527234 - RNA, 16 nt, Human
gcuguuuuccucccuu

SEQ ID NO: 2527235 - RNA, 18 nt, Human
gcuguuuuccucccuucu

SEQ ID NO: 2527236 - RNA, 15 nt, Human
gcuguuuuccucccu

SEQ ID NO: 2527237 - RNA, 21 nt, Human
gcuguuuguuugacaaagaaa

SEQ ID NO: 2527238 - RNA, 21 nt, Human
gcuguuuuaguuaaauuucug

SEQ ID NO: 2527239 - RNA, 17 nt, Human
gcuguuuucccugaccu

SEQ ID NO: 2527240 - RNA, 18 nt, Human
gcuguuuuguucuguggu

SEQ ID NO: 2527241 - RNA, 15 nt, Human
gcuuaaaaaucauug

SEQ ID NO: 2527242 - RNA, 18 nt, Human
gcuuaaugacacuagcua

SEQ ID NO: 2527243 - RNA, 12 nt, Human
gcuuaaugaaaa

SEQ ID NO: 2527244 - RNA, 23 nt, Human
gcuucagguuaucgaaauaacaa

SEQ ID NO: 2527245 - RNA, 14 nt, Human
gcuucaguggagaa

SEQ ID NO: 2527246 - RNA, 15 nt, Human
gcuucaguggcagcu

SEQ ID NO: 2527247 - RNA, 22 nt, Human
gcuucagguuaucgaaauaaca

SEQ ID NO: 2527248 - RNA, 21 nt, Human
gcuucagguuaucgaaauaac

SEQ ID NO: 2527249 - RNA, 20 nt, Human
gcuucagguuaucgaaauaa

SEQ ID NO: 2527250 - RNA, 19 nt, Human
gcuucagguuaucgaaaua

SEQ ID NO: 2527251 - RNA, 12 nt, Human
gcuucagguuau

SEQ ID NO: 2527252 - RNA, 17 nt, Human
gcuucagguuaucgaaa

SEQ ID NO: 2527253 - RNA, 14 nt, Human
gcuucaguggcagc

SEQ ID NO: 2527254 - RNA, 23 nt, Human
gcuucagggcgcacagcaugaga

SEQ ID NO: 2527255 - RNA, 16 nt, Human
gcuucaaaauagagaa

SEQ ID NO: 2527256 - RNA, 13 nt, Human
gcuucaggaggga

SEQ ID NO: 2527257 - RNA, 14 nt, Human
gcuucaaggauccu

SEQ ID NO: 2527258 - RNA, 16 nt, Human
gcuucaaauuguaagc

SEQ ID NO: 2527259 - RNA, 12 nt, Human
gcuuauuuuaaa

SEQ ID NO: 2527260 - RNA, 22 nt, Human
gcuuauuuuuaaaauuuuaaua

SEQ ID NO: 2527261 - RNA, 17 nt, Human
gcuuauuuuuaaaauuu

SEQ ID NO: 2527262 - RNA, 18 nt, Human
gcuucaaccuugagacag

SEQ ID NO: 2527263 - RNA, 18 nt, Human
gcucucaggccagcugcu

SEQ ID NO: 2527264 - RNA, 17 nt, Human
gcucucaggccagcugc

SEQ ID NO: 2527265 - RNA, 19 nt, Human
gcucucaggccagcugcuu

SEQ ID NO: 2527266 - RNA, 20 nt, Human
gcucucaggccagcugcuug

SEQ ID NO: 2527267 - RNA, 11 nt, Human
gcucucagaag

SEQ ID NO: 2527268 - RNA, 13 nt, Human
gcucucagaagcc

SEQ ID NO: 2527269 - RNA, 10 nt, Human
gcucucagcc

SEQ ID NO: 2527270 - RNA, 11 nt, Human
gcucucagcca

SEQ ID NO: 2527271 - RNA, 17 nt, Human
gcucucagccaacgagu

SEQ ID NO: 2527272 - RNA, 16 nt, Human
gcucucagcucagcgc

SEQ ID NO: 2527273 - RNA, 12 nt, Human
gcucucagaagg

SEQ ID NO: 2527274 - RNA, 17 nt, Human
gcucuauuguagcauuu

SEQ ID NO: 2527275 - RNA, 19 nt, Human
gcucucaacccaggagcau

SEQ ID NO: 2527276 - RNA, 18 nt, Human
gcucucaaguuaucaggg

SEQ ID NO: 2527277 - RNA, 22 nt, Human
gcucuaucuugcucuguaaucu

SEQ ID NO: 2527278 - RNA, 21 nt, Human
gcucuaucuugcucuguaauc

SEQ ID NO: 2527279 - RNA, 19 nt, Human
gcucuaucuugcucuguaa

SEQ ID NO: 2527280 - RNA, 12 nt, Human
gcucuagugccu

SEQ ID NO: 2527281 - RNA, 15 nt, Human
gcucuagugccuucu

SEQ ID NO: 2527282 - RNA, 21 nt, Human
gcucuaugggcagaucuaccc

SEQ ID NO: 2527283 - RNA, 18 nt, Human
gcucuaugggcagaucua

SEQ ID NO: 2527284 - RNA, 15 nt, Human
gcucuauguuuacaa

SEQ ID NO: 2527285 - RNA, 16 nt, Human
gcucuauguuuacaaa

SEQ ID NO: 2527286 - RNA, 23 nt, Human
gcucuagauugagagaagagaca

SEQ ID NO: 2527287 - RNA, 21 nt, Human
gcucuagccugggcaacaaca

SEQ ID NO: 2527288 - RNA, 14 nt, Human
gcucuagugggaag

SEQ ID NO: 2527289 - RNA, 14 nt, Human
gcucuagguggggc

SEQ ID NO: 2527290 - RNA, 14 nt, Human
gcucuagccugggc

SEQ ID NO: 2527291 - RNA, 16 nt, Human
gcuccucuccccagcc

SEQ ID NO: 2527292 - RNA, 18 nt, Human
gcuccucuccccagccca

SEQ ID NO: 2527293 - RNA, 19 nt, Human
gcuccucuccccagcccag

SEQ ID NO: 2527294 - RNA, 20 nt, Human
gcuccucuccccagcccaga

SEQ ID NO: 2527295 - RNA, 21 nt, Human
gcuccucuccccagcccagag

SEQ ID NO: 2527296 - RNA, 22 nt, Human
gcuccucuccccagcccagaga

SEQ ID NO: 2527297 - RNA, 18 nt, Human
gcucuacaucuucugccu

SEQ ID NO: 2527298 - RNA, 23 nt, Human
gcuccucuccccagcccagagac

SEQ ID NO: 2527299 - RNA, 19 nt, Human
gcuccucuccccagcaagu

SEQ ID NO: 2527300 - RNA, 16 nt, Human
gcuccucuccccagca

SEQ ID NO: 2527301 - RNA, 20 nt, Human
gcucuacaucuucugccuua

SEQ ID NO: 2527302 - RNA, 19 nt, Human
gcucuacaucuucugccuu

SEQ ID NO: 2527303 - RNA, 14 nt, Human
gcucuacccagggc

SEQ ID NO: 2527304 - RNA, 15 nt, Human
gcucuacccagggcc

SEQ ID NO: 2527305 - RNA, 19 nt, Human
gcucuacugaggugcuaug

SEQ ID NO: 2527306 - RNA, 16 nt, Human
gcucuagacaacccug

SEQ ID NO: 2527307 - RNA, 18 nt, Human
gcucuagacaacccugca

SEQ ID NO: 2527308 - RNA, 19 nt, Human
gcucuagacaacccugcaa

SEQ ID NO: 2527309 - RNA, 18 nt, Human
gcucuacccagggccugc

SEQ ID NO: 2527310 - RNA, 19 nt, Human
gcucuacccagggccugca

SEQ ID NO: 2527311 - RNA, 21 nt, Human
gcucuacuggucuuguggaau

SEQ ID NO: 2527312 - RNA, 21 nt, Human
gcuccagacacauguccaaga

SEQ ID NO: 2527313 - RNA, 18 nt, Human
gcuccagacacaugucca

SEQ ID NO: 2527314 - RNA, 23 nt, Human
gcuccagacacauguccaagaag

SEQ ID NO: 2527315 - RNA, 20 nt, Human
gcuccagaaaugucuaaaug

SEQ ID NO: 2527316 - RNA, 15 nt, Human
gcuccagacccccag

SEQ ID NO: 2527317 - RNA, 14 nt, Human
gcuccagaccccca

SEQ ID NO: 2527318 - RNA, 20 nt, Human
gcuccagagggcacucugcu

SEQ ID NO: 2527319 - RNA, 21 nt, Human
gcuccagagggcacucugcuu

SEQ ID NO: 2527320 - RNA, 17 nt, Human
gcuccagaugcagggca

SEQ ID NO: 2527321 - RNA, 18 nt, Human
gcuccagaugcagggcag

SEQ ID NO: 2527322 - RNA, 19 nt, Human
gcuccagaugcagggcagu

SEQ ID NO: 2527323 - RNA, 21 nt, Human
gcuccagaugcagggcaguca

SEQ ID NO: 2527324 - RNA, 22 nt, Human
gcuccagacguaggggaggggu

SEQ ID NO: 2527325 - RNA, 22 nt, Human
gcuccagaugcagggcagucau

SEQ ID NO: 2527326 - RNA, 12 nt, Human
gcuccagagggc

SEQ ID NO: 2527327 - RNA, 23 nt, Human
gcuccagaccugauccuggaggc

SEQ ID NO: 2527328 - RNA, 21 nt, Human
gcuccagaccugauccuggag

SEQ ID NO: 2527329 - RNA, 22 nt, Human
gcuccagaccugauccuggagg

SEQ ID NO: 2527330 - RNA, 13 nt, Human
gcuccagaccuga

SEQ ID NO: 2527331 - RNA, 20 nt, Human
gcuccagaccugauccugga

SEQ ID NO: 2527332 - RNA, 12 nt, Human
gcuccagaccug

SEQ ID NO: 2527333 - RNA, 17 nt, Human
gcuccagacccccagca

SEQ ID NO: 2527334 - RNA, 23 nt, Human
gcuccagacccccagcaacccuc

SEQ ID NO: 2527335 - RNA, 20 nt, Human
gcuccacuuggucugugaga

SEQ ID NO: 2527336 - RNA, 9 nt, Human
gcuccagac

SEQ ID NO: 2527337 - RNA, 20 nt, Human
gcuccucgagggcagggacu

SEQ ID NO: 2527338 - RNA, 18 nt, Human
gcuccucgagggcaggga

SEQ ID NO: 2527339 - RNA, 17 nt, Human
gcuccucgagggcaggg

SEQ ID NO: 2527340 - RNA, 15 nt, Human
gcuccucgagggcag

SEQ ID NO: 2527341 - RNA, 20 nt, Human
gcuccuccucccugcaucug

SEQ ID NO: 2527342 - RNA, 16 nt, Human
gcuccuccucccugca

SEQ ID NO: 2527343 - RNA, 18 nt, Human
gcuccuccucccugcauc

SEQ ID NO: 2527344 - RNA, 20 nt, Human
gcuccuccgugcuuccucag

SEQ ID NO: 2527345 - RNA, 14 nt, Human
gcuccuccgugcuu

SEQ ID NO: 2527346 - RNA, 14 nt, Human
gcuccuccucccug

SEQ ID NO: 2527347 - RNA, 15 nt, Human
gcuccuccucccugc

SEQ ID NO: 2527348 - RNA, 22 nt, Human
gcuccucuccaggcacccuucu

SEQ ID NO: 2527349 - RNA, 17 nt, Human
gcuccucuccaggcacc

SEQ ID NO: 2527350 - RNA, 16 nt, Human
gcuccucuccaggcac

SEQ ID NO: 2527351 - RNA, 15 nt, Human
gcuccucuccaggca

SEQ ID NO: 2527352 - RNA, 14 nt, Human
gcuccucuccaggc

SEQ ID NO: 2527353 - RNA, 13 nt, Human
gcuccucuccagg

SEQ ID NO: 2527354 - RNA, 12 nt, Human
gcuccucuccag

SEQ ID NO: 2527355 - RNA, 12 nt, Human
gcuccucucagu

SEQ ID NO: 2527356 - RNA, 15 nt, Human
gcuccucuccccagc

SEQ ID NO: 2527357 - RNA, 23 nt, Human
gcuccucccuggcugcccuggcc

SEQ ID NO: 2527358 - RNA, 22 nt, Human
gcuccucccuggcugcccuggc

SEQ ID NO: 2527359 - RNA, 21 nt, Human
gcuccucccuggcugcccugg

SEQ ID NO: 2527360 - RNA, 20 nt, Human
gcuccucccuggcugcccug

SEQ ID NO: 2527361 - RNA, 19 nt, Human
gcuccucccuggcugcccu

SEQ ID NO: 2527362 - RNA, 18 nt, Human
gcuccucccuggcugccc

SEQ ID NO: 2527363 - RNA, 17 nt, Human
gcuccucccuggcugcc

SEQ ID NO: 2527364 - RNA, 16 nt, Human
gcuccucccuggcugc

SEQ ID NO: 2527365 - RNA, 15 nt, Human
gcuccucccuggcug

SEQ ID NO: 2527366 - RNA, 14 nt, Human
gcuccucccuggcu

SEQ ID NO: 2527367 - RNA, 13 nt, Human
gcuccucccuggc

SEQ ID NO: 2527368 - RNA, 22 nt, Human
gcuccucccucugaggcuguag

SEQ ID NO: 2527369 - RNA, 21 nt, Human
gcuccucccucugaggcugua

SEQ ID NO: 2527370 - RNA, 20 nt, Human
gcuccucccucugaggcugu

SEQ ID NO: 2527371 - RNA, 19 nt, Human
gcuccucccucugaggcug

SEQ ID NO: 2527372 - RNA, 23 nt, Human
gcucccagugucuuccugugggg

SEQ ID NO: 2527373 - RNA, 22 nt, Human
gcucccagugucuuccuguggg

SEQ ID NO: 2527374 - RNA, 20 nt, Human
gcucccauucacucuuccag

SEQ ID NO: 2527375 - RNA, 16 nt, Human
gcuccucccggugccc

SEQ ID NO: 2527376 - RNA, 17 nt, Human
gcuccucccucugaggc

SEQ ID NO: 2527377 - RNA, 21 nt, Human
gcucccauucacucuuccaga

SEQ ID NO: 2527378 - RNA, 19 nt, Human
gcuccucccggugcccaag

SEQ ID NO: 2527379 - RNA, 15 nt, Human
gcuccagccuggcuc

SEQ ID NO: 2527380 - RNA, 19 nt, Human
gcuccagcaccauccgcca

SEQ ID NO: 2527381 - RNA, 14 nt, Human
gcuccagccaaccc

SEQ ID NO: 2527382 - RNA, 16 nt, Human
gcuccagccaaccccu

SEQ ID NO: 2527383 - RNA, 17 nt, Human
gcuccagccaaccccug

SEQ ID NO: 2527384 - RNA, 18 nt, Human
gcuccagccaaccccugu

SEQ ID NO: 2527385 - RNA, 22 nt, Human
gcuccagccaaccccuguggag

SEQ ID NO: 2527386 - RNA, 23 nt, Human
gcuccagccaaccccuguggagc

SEQ ID NO: 2527387 - RNA, 14 nt, Human
gcuccagcucacca

SEQ ID NO: 2527388 - RNA, 13 nt, Human
gcuccagcucacc

SEQ ID NO: 2527389 - RNA, 23 nt, Human
gcucccaggcauuccccaggagg

SEQ ID NO: 2527390 - RNA, 17 nt, Human
gcuccagcucaccagcc

SEQ ID NO: 2527391 - RNA, 23 nt, Human
gcucccaggccgagaagccagug

SEQ ID NO: 2527392 - RNA, 22 nt, Human
gcucccaggccgagaagccagu

SEQ ID NO: 2527393 - RNA, 12 nt, Human
gcucccaggccg

SEQ ID NO: 2527394 - RNA, 11 nt, Human
gcucccaggcc

SEQ ID NO: 2527395 - RNA, 20 nt, Human
gcucccagugucuuccugug

SEQ ID NO: 2527396 - RNA, 19 nt, Human
gcucccagugucuuccugu

SEQ ID NO: 2527397 - RNA, 18 nt, Human
gcucccagugucuuccug

SEQ ID NO: 2527398 - RNA, 13 nt, Human
gcucccagugucu

SEQ ID NO: 2527399 - RNA, 15 nt, Human
gcucugcccauccug

SEQ ID NO: 2527400 - RNA, 22 nt, Human
gcucugccacccuaccuguuca

SEQ ID NO: 2527401 - RNA, 18 nt, Human
gcucugccacccuaccug

SEQ ID NO: 2527402 - RNA, 23 nt, Human
gcucugccacccuaccuguucag

SEQ ID NO: 2527403 - RNA, 16 nt, Human
gcucugacagaaagca

SEQ ID NO: 2527404 - RNA, 22 nt, Human
gcucugaucauccacugugcca

SEQ ID NO: 2527405 - RNA, 21 nt, Human
gcucugaucauccacugugcc

SEQ ID NO: 2527406 - RNA, 16 nt, Human
gcucuggagcccacug

SEQ ID NO: 2527407 - RNA, 15 nt, Human
gcucuggagcccacu

SEQ ID NO: 2527408 - RNA, 21 nt, Human
gcucugcccauccugccccug

SEQ ID NO: 2527409 - RNA, 18 nt, Human
gcucuggagacagcccca

SEQ ID NO: 2527410 - RNA, 14 nt, Human
gcucuggagacagc

SEQ ID NO: 2527411 - RNA, 20 nt, Human
gcucucugugggcuggcagu

SEQ ID NO: 2527412 - RNA, 21 nt, Human
gcucugaauuaguccuugcuu

SEQ ID NO: 2527413 - RNA, 23 nt, Human
gcucugaagucacaucacaggac

SEQ ID NO: 2527414 - RNA, 17 nt, Human
gcucugaaagccagcug

SEQ ID NO: 2527415 - RNA, 22 nt, Human
gcucugaagucacaucacagga

SEQ ID NO: 2527416 - RNA, 20 nt, Human
gcucugaucauccacugugc

SEQ ID NO: 2527417 - RNA, 19 nt, Human
gcucucugugggcuggcag

SEQ ID NO: 2527418 - RNA, 19 nt, Human
gcucucuggccuuuuccua

SEQ ID NO: 2527419 - RNA, 16 nt, Human
gcucugaaaccagugu

SEQ ID NO: 2527420 - RNA, 15 nt, Human
gcucugaaagccagc

SEQ ID NO: 2527421 - RNA, 16 nt, Human
gcugaggccugggccg

SEQ ID NO: 2527422 - RNA, 15 nt, Human
gcugaggccugggcc

SEQ ID NO: 2527423 - RNA, 14 nt, Human
gcugaggccugggc

SEQ ID NO: 2527424 - RNA, 13 nt, Human
gcugaggccuggg

SEQ ID NO: 2527425 - RNA, 21 nt, Human
gcugaggccuggacuuuccug

SEQ ID NO: 2527426 - RNA, 14 nt, Human
gcugaggccuggac

SEQ ID NO: 2527427 - RNA, 13 nt, Human
gcugaggccugga

SEQ ID NO: 2527428 - RNA, 12 nt, Human
gcugaggccugg

SEQ ID NO: 2527429 - RNA, 13 nt, Human
gcugagccucugc

SEQ ID NO: 2527430 - RNA, 19 nt, Human
gcugagccucugcucccca

SEQ ID NO: 2527431 - RNA, 20 nt, Human
gcugagccucugcuccccag

SEQ ID NO: 2527432 - RNA, 14 nt, Human
gcugaggccucuca

SEQ ID NO: 2527433 - RNA, 15 nt, Human
gcugagccuggcugg

SEQ ID NO: 2527434 - RNA, 14 nt, Human
gcugagccuggcug

SEQ ID NO: 2527435 - RNA, 14 nt, Human
gcugagccucucac

SEQ ID NO: 2527436 - RNA, 16 nt, Human
gcugagccucagucuc

SEQ ID NO: 2527437 - RNA, 12 nt, Human
gcugagccucag

SEQ ID NO: 2527438 - RNA, 15 nt, Human
gcugagcccuggcag

SEQ ID NO: 2527439 - RNA, 16 nt, Human
gcugagcccuggcagg

SEQ ID NO: 2527440 - RNA, 13 nt, Human
gcugacagacaca

SEQ ID NO: 2527441 - RNA, 21 nt, Human
gcugacacaaaccugccuggg

SEQ ID NO: 2527442 - RNA, 19 nt, Human
gcugacacguccaccccag

SEQ ID NO: 2527443 - RNA, 13 nt, Human
gcugagcccuggc

SEQ ID NO: 2527444 - RNA, 14 nt, Human
gcugagcccuggca

SEQ ID NO: 2527445 - RNA, 16 nt, Human
gcugaagguugaagag

SEQ ID NO: 2527446 - RNA, 15 nt, Human
gcugaagguugaaga

SEQ ID NO: 2527447 - RNA, 20 nt, Human
gcugaagggaccuugaaggg

SEQ ID NO: 2527448 - RNA, 13 nt, Human
gcugaagauggca

SEQ ID NO: 2527449 - RNA, 12 nt, Human
gcugaauaaaug

SEQ ID NO: 2527450 - RNA, 20 nt, Human
gcugaagugcauccaaaggu

SEQ ID NO: 2527451 - RNA, 23 nt, Human
gcugaaggcucgagcaugccugg

SEQ ID NO: 2527452 - RNA, 20 nt, Human
gcugaacuuguuuucuggga

SEQ ID NO: 2527453 - RNA, 15 nt, Human
gcugaacucaugaga

SEQ ID NO: 2527454 - RNA, 18 nt, Human
gcugaagaugaaucaaug

SEQ ID NO: 2527455 - RNA, 17 nt, Human
gcugaacccugugcugg

SEQ ID NO: 2527456 - RNA, 16 nt, Human
gcugaacccugugcug

SEQ ID NO: 2527457 - RNA, 13 nt, Human
gcugaacccugug

SEQ ID NO: 2527458 - RNA, 22 nt, Human
gcugaacccauuuugagugacu

SEQ ID NO: 2527459 - RNA, 21 nt, Human
gcugaacccugugcugguguc

SEQ ID NO: 2527460 - RNA, 20 nt, Human
gcugaacccugugcuggugu

SEQ ID NO: 2527461 - RNA, 16 nt, Human
gcugaacggggagaaa

SEQ ID NO: 2527462 - RNA, 17 nt, Human
gcugaacggggagaaaa

SEQ ID NO: 2527463 - RNA, 17 nt, Human
gcugaauaaaugucuuu

SEQ ID NO: 2527464 - RNA, 16 nt, Human
gcugaauaaaugucuu

SEQ ID NO: 2527465 - RNA, 14 nt, Human
gcugaauaaauguc

SEQ ID NO: 2527466 - RNA, 13 nt, Human
gcugaauaaaugu

SEQ ID NO: 2527467 - RNA, 17 nt, Human
gcugaauacagaggcaa

SEQ ID NO: 2527468 - RNA, 12 nt, Human
gcugaauuuuca

SEQ ID NO: 2527469 - RNA, 14 nt, Human
gcugaauuuucaca

SEQ ID NO: 2527470 - RNA, 18 nt, Human
gcugaauaaaugucuuuu

SEQ ID NO: 2527471 - RNA, 21 nt, Human
gcugaauuuucacaugaacau

SEQ ID NO: 2527472 - RNA, 19 nt, Human
gcugacaaccaccgcuccc

SEQ ID NO: 2527473 - RNA, 20 nt, Human
gcugacacaaaccugccugg

SEQ ID NO: 2527474 - RNA, 19 nt, Human
gcugacacaaaccugccug

SEQ ID NO: 2527475 - RNA, 18 nt, Human
gcugacacaaaccugccu

SEQ ID NO: 2527476 - RNA, 17 nt, Human
gcugacacaaaccugcc

SEQ ID NO: 2527477 - RNA, 21 nt, Human
gcugacaaccaccgcucccca

SEQ ID NO: 2527478 - RNA, 22 nt, Human
gcugacaaccaccgcuccccag

SEQ ID NO: 2527479 - RNA, 23 nt, Human
gcugacaaccaccgcuccccagc

SEQ ID NO: 2527480 - RNA, 18 nt, Human
gcucuguaucaggaccca

SEQ ID NO: 2527481 - RNA, 19 nt, Human
gcucuguaucaggacccag

SEQ ID NO: 2527482 - RNA, 22 nt, Human
gcucuguaucaggacccagagg

SEQ ID NO: 2527483 - RNA, 23 nt, Human
gcucuguaucaggacccagagga

SEQ ID NO: 2527484 - RNA, 16 nt, Human
gcucugucacccaggc

SEQ ID NO: 2527485 - RNA, 23 nt, Human
gcucugucgcccaggcuggagug

SEQ ID NO: 2527486 - RNA, 17 nt, Human
gcucugugcccacccuc

SEQ ID NO: 2527487 - RNA, 14 nt, Human
gcucugugcaggga

SEQ ID NO: 2527488 - RNA, 14 nt, Human
gcucuggagagaaa

SEQ ID NO: 2527489 - RNA, 13 nt, Human
gcucuggagagaa

SEQ ID NO: 2527490 - RNA, 20 nt, Human
gcucuggagacagccccaga

SEQ ID NO: 2527491 - RNA, 19 nt, Human
gcucuggagacagccccag

SEQ ID NO: 2527492 - RNA, 17 nt, Human
gcucuggagcccacugu

SEQ ID NO: 2527493 - RNA, 23 nt, Human
gcucuguaaucucguuucaaaaa

SEQ ID NO: 2527494 - RNA, 19 nt, Human
gcucuguaaucucguuuca

SEQ ID NO: 2527495 - RNA, 18 nt, Human
gcucuguaaucucguuuc

SEQ ID NO: 2527496 - RNA, 19 nt, Human
gcucuggugacaccagccu

SEQ ID NO: 2527497 - RNA, 20 nt, Human
gcucuggugacaccagccuu

SEQ ID NO: 2527498 - RNA, 15 nt, Human
gcucuggagagaaac

SEQ ID NO: 2527499 - RNA, 18 nt, Human
gcucuggugacaccagcc

SEQ ID NO: 2527500 - RNA, 15 nt, Human
gcugaacauugcaua

SEQ ID NO: 2527501 - RNA, 17 nt, Human
gcugaacauugcauaua

SEQ ID NO: 2527502 - RNA, 22 nt, Human
gcugaacaguggaggaagaggg

SEQ ID NO: 2527503 - RNA, 13 nt, Human
gcugaacagugga

SEQ ID NO: 2527504 - RNA, 23 nt, Human
gcugaacacuccaauuaaggauu

SEQ ID NO: 2527505 - RNA, 18 nt, Human
gcugaaacaggagagaaa

SEQ ID NO: 2527506 - RNA, 13 nt, Human
gcugaaagccauu

SEQ ID NO: 2527507 - RNA, 16 nt, Human
gcugaaacaacaaaua

SEQ ID NO: 2527508 - RNA, 20 nt, Human
gcugaaaaccuaaguccuuu

SEQ ID NO: 2527509 - RNA, 16 nt, Human
gcugaaacagaauacu

SEQ ID NO: 2527510 - RNA, 23 nt, Human
gcugaaagaacauggacuuguau

SEQ ID NO: 2527511 - RNA, 16 nt, Human
gcugaaacaggagaga

SEQ ID NO: 2527512 - RNA, 17 nt, Human
gcugaaacaggagagaa

SEQ ID NO: 2527513 - RNA, 14 nt, Human
gcucugugggcugc

SEQ ID NO: 2527514 - RNA, 12 nt, Human
gcucugugggcu

SEQ ID NO: 2527515 - RNA, 21 nt, Human
gcucugugcugacccuccugu

SEQ ID NO: 2527516 - RNA, 19 nt, Human
gcucugugcugacccuccu

SEQ ID NO: 2527517 - RNA, 22 nt, Human
gcucugugcugacccuccuguu

SEQ ID NO: 2527518 - RNA, 18 nt, Human
gcucugugcugacccucc

SEQ ID NO: 2527519 - RNA, 16 nt, Human
gcucugugcugacccu

SEQ ID NO: 2527520 - RNA, 15 nt, Human
gcucugugcugaccc

SEQ ID NO: 2527521 - RNA, 14 nt, Human
gcucugugcugacc

SEQ ID NO: 2527522 - RNA, 21 nt, Human
gcucugugcagucacuggagg

SEQ ID NO: 2527523 - RNA, 19 nt, Human
gcucugugcagucacugga

SEQ ID NO: 2527524 - RNA, 14 nt, Human
gcucugugcaguca

SEQ ID NO: 2527525 - RNA, 24 nt, Human
gcucugugggcugcacucugugcc

SEQ ID NO: 2527526 - RNA, 23 nt, Human
gcucugugggcugcacucugugc

SEQ ID NO: 2527527 - RNA, 16 nt, Human
gcucuguguugccaug

SEQ ID NO: 2527528 - RNA, 20 nt, Human
gcugaaaaaucacauccugg

SEQ ID NO: 2527529 - RNA, 11 nt, Human
gcugaaaauau

SEQ ID NO: 2527530 - RNA, 19 nt, Human
gcugaaaaaucacauccug

SEQ ID NO: 2527531 - RNA, 23 nt, Human
gcugcugucccucccccuugucc

SEQ ID NO: 2527532 - RNA, 22 nt, Human
gcugcugucccucccccuuguc

SEQ ID NO: 2527533 - RNA, 18 nt, Human
gcugcugucccucccccu

SEQ ID NO: 2527534 - RNA, 16 nt, Human
gcugcugucccucccc

SEQ ID NO: 2527535 - RNA, 15 nt, Human
gcugcugucccuccc

SEQ ID NO: 2527536 - RNA, 15 nt, Human
gcugcuggcuugcag

SEQ ID NO: 2527537 - RNA, 19 nt, Human
gcugcugaccuccacagcu

SEQ ID NO: 2527538 - RNA, 16 nt, Human
gcugcugacugauguu

SEQ ID NO: 2527539 - RNA, 12 nt, Human
gcugcugacagu

SEQ ID NO: 2527540 - RNA, 18 nt, Human
gcugcuccuagagggagg

SEQ ID NO: 2527541 - RNA, 16 nt, Human
gcugcuccuagaggga

SEQ ID NO: 2527542 - RNA, 18 nt, Human
gcugcugaccuccacagc

SEQ ID NO: 2527543 - RNA, 16 nt, Human
gcugccccuggcagcc

SEQ ID NO: 2527544 - RNA, 15 nt, Human
gcugccccuggcagc

SEQ ID NO: 2527545 - RNA, 13 nt, Human
gcugccccuggca

SEQ ID NO: 2527546 - RNA, 17 nt, Human
gcugccauccagguuca

SEQ ID NO: 2527547 - RNA, 17 nt, Human
gcugccccuggcagccc

SEQ ID NO: 2527548 - RNA, 15 nt, Human
gcugcuccuagaggg

SEQ ID NO: 2527549 - RNA, 16 nt, Human
gcugcuccccagcagc

SEQ ID NO: 2527550 - RNA, 19 nt, Human
gcugcuccccagcagcgga

SEQ ID NO: 2527551 - RNA, 12 nt, Human
gcugcuccccuc

SEQ ID NO: 2527552 - RNA, 20 nt, Human
gcugcuccccucccuccucu

SEQ ID NO: 2527553 - RNA, 15 nt, Human
gcuggagauguuuua

SEQ ID NO: 2527554 - RNA, 12 nt, Human
gcuggagagguu

SEQ ID NO: 2527555 - RNA, 13 nt, Human
gcuggagagguua

SEQ ID NO: 2527556 - RNA, 21 nt, Human
gcuggagccuguguaacagcu

SEQ ID NO: 2527557 - RNA, 14 nt, Human
gcuggagccugugu

SEQ ID NO: 2527558 - RNA, 13 nt, Human
gcuggagccugug

SEQ ID NO: 2527559 - RNA, 17 nt, Human
gcuggagccuggugccc

SEQ ID NO: 2527560 - RNA, 11 nt, Human
gcuggagccug

SEQ ID NO: 2527561 - RNA, 21 nt, Human
gcuggagccuagaacaggccu

SEQ ID NO: 2527562 - RNA, 10 nt, Human
gcuggagccu

SEQ ID NO: 2527563 - RNA, 15 nt, Human
gcuggagccacuaac

SEQ ID NO: 2527564 - RNA, 19 nt, Human
gcuggagccacuaacuaga

SEQ ID NO: 2527565 - RNA, 16 nt, Human
gcuggagccacuaacu

SEQ ID NO: 2527566 - RNA, 16 nt, Human
gcuggagcccagggag

SEQ ID NO: 2527567 - RNA, 22 nt, Human
gcuggagcccagggagcggaaa

SEQ ID NO: 2527568 - RNA, 15 nt, Human
gcugaggcgggagaa

SEQ ID NO: 2527569 - RNA, 21 nt, Human
gcugaggccuuaucauucauu

SEQ ID NO: 2527570 - RNA, 23 nt, Human
gcugaggccugggccgcugccac

SEQ ID NO: 2527571 - RNA, 20 nt, Human
gcugaggccugggccgcugc

SEQ ID NO: 2527572 - RNA, 17 nt, Human
gcugaggccugggccgc

SEQ ID NO: 2527573 - RNA, 15 nt, Human
gcugaggugggagga

SEQ ID NO: 2527574 - RNA, 21 nt, Human
gcugagguugcgccacuacac

SEQ ID NO: 2527575 - RNA, 23 nt, Human
gcugagguuccucugccugcccc

SEQ ID NO: 2527576 - RNA, 22 nt, Human
gcugagguuccucugccugccc

SEQ ID NO: 2527577 - RNA, 21 nt, Human
gcugagguuccucugccugcc

SEQ ID NO: 2527578 - RNA, 20 nt, Human
gcugagguuccucugccugc

SEQ ID NO: 2527579 - RNA, 19 nt, Human
gcugagguuccucugccug

SEQ ID NO: 2527580 - RNA, 18 nt, Human
gcugagguuccucugccu

SEQ ID NO: 2527581 - RNA, 23 nt, Human
gcugaggcucugacccagugaga

SEQ ID NO: 2527582 - RNA, 16 nt, Human
gcugaggcgggagaau

SEQ ID NO: 2527583 - RNA, 17 nt, Human
gcugagguuccucugcc

SEQ ID NO: 2527584 - RNA, 16 nt, Human
gcugagguuccucugc

SEQ ID NO: 2527585 - RNA, 13 nt, Human
gcugagguuccuc

SEQ ID NO: 2527586 - RNA, 21 nt, Human
gcugaggugucuuaagccuuu

SEQ ID NO: 2527587 - RNA, 23 nt, Human
gcugagucaugaucucccugccg

SEQ ID NO: 2527588 - RNA, 21 nt, Human
gcugaguauguuaagcucuuu

SEQ ID NO: 2527589 - RNA, 17 nt, Human
gcugaguaggaggccuc

SEQ ID NO: 2527590 - RNA, 21 nt, Human
gcugagucaugaucucccugc

SEQ ID NO: 2527591 - RNA, 22 nt, Human
gcugagucaugaucucccugcc

SEQ ID NO: 2527592 - RNA, 13 nt, Human
gcugcagaggggc

SEQ ID NO: 2527593 - RNA, 12 nt, Human
gcugcagagggg

SEQ ID NO: 2527594 - RNA, 22 nt, Human
gcugcagaggccagaggccccc

SEQ ID NO: 2527595 - RNA, 18 nt, Human
gcugcagaggccagaggc

SEQ ID NO: 2527596 - RNA, 15 nt, Human
gcugcagaggccaga

SEQ ID NO: 2527597 - RNA, 19 nt, Human
gcugcagaggggcaggccc

SEQ ID NO: 2527598 - RNA, 15 nt, Human
gcugcagaggggcag

SEQ ID NO: 2527599 - RNA, 16 nt, Human
gcugcagccugcgcca

SEQ ID NO: 2527600 - RNA, 21 nt, Human
gcugcagccugcgccaccgcc

SEQ ID NO: 2527601 - RNA, 15 nt, Human
gcugcagcucaccca

SEQ ID NO: 2527602 - RNA, 20 nt, Human
gcugcagaggggcaggcccu

SEQ ID NO: 2527603 - RNA, 17 nt, Human
gcugcaggacuugagaa

SEQ ID NO: 2527604 - RNA, 13 nt, Human
gcugccauccagg

SEQ ID NO: 2527605 - RNA, 12 nt, Human
gcugccauccag

SEQ ID NO: 2527606 - RNA, 20 nt, Human
gcugcaggggcucuggagag

SEQ ID NO: 2527607 - RNA, 17 nt, Human
gcugcaggggcucugga

SEQ ID NO: 2527608 - RNA, 16 nt, Human
gcugcaggggcucugg

SEQ ID NO: 2527609 - RNA, 15 nt, Human
gcugcaggggcucug

SEQ ID NO: 2527610 - RNA, 13 nt, Human
gcugcaggggcuc

SEQ ID NO: 2527611 - RNA, 11 nt, Human
gcugcaggggc

SEQ ID NO: 2527612 - RNA, 12 nt, Human
gcugcaggggcu

SEQ ID NO: 2527613 - RNA, 16 nt, Human
gcugcagaaggccaag

SEQ ID NO: 2527614 - RNA, 23 nt, Human
gcugcacucugugcccaugggca

SEQ ID NO: 2527615 - RNA, 20 nt, Human
gcugcacugaugcugccccu

SEQ ID NO: 2527616 - RNA, 22 nt, Human
gcugcacucugugcccaugggc

SEQ ID NO: 2527617 - RNA, 16 nt, Human
gcugcacccucaggca

SEQ ID NO: 2527618 - RNA, 21 nt, Human
gcugcagagcagugggccugg

SEQ ID NO: 2527619 - RNA, 19 nt, Human
gcugcagagccacccugug

SEQ ID NO: 2527620 - RNA, 13 nt, Human
gcugcagagccac

SEQ ID NO: 2527621 - RNA, 20 nt, Human
gcugcacucugugcccaugg

SEQ ID NO: 2527622 - RNA, 20 nt, Human
gcugcagagcagugggccug

SEQ ID NO: 2527623 - RNA, 19 nt, Human
gcugcagaaggccaagaau

SEQ ID NO: 2527624 - RNA, 17 nt, Human
gcugcagaaggccaaga

SEQ ID NO: 2527625 - RNA, 18 nt, Human
gcugcagagacagagagg

SEQ ID NO: 2527626 - RNA, 13 nt, Human
gcugcacccucag

SEQ ID NO: 2527627 - RNA, 15 nt, Human
gcugcacccucaggc

SEQ ID NO: 2527628 - RNA, 23 nt, Human
gcugcaccaacccagccgcugcc

SEQ ID NO: 2527629 - RNA, 21 nt, Human
gcugcaccaacccagccgcug

SEQ ID NO: 2527630 - RNA, 17 nt, Human
gccagccccacagccca

SEQ ID NO: 2527631 - RNA, 16 nt, Human
gccagccccacagccc

SEQ ID NO: 2527632 - RNA, 15 nt, Human
gccagccccacagcc

SEQ ID NO: 2527633 - RNA, 14 nt, Human
gccagccccacagc

SEQ ID NO: 2527634 - RNA, 14 nt, Human
gccagcccagccca

SEQ ID NO: 2527635 - RNA, 13 nt, Human
gccagcccagccc

SEQ ID NO: 2527636 - RNA, 13 nt, Human
gccagccaugucu

SEQ ID NO: 2527637 - RNA, 22 nt, Human
gccagccagugaccugaggaag

SEQ ID NO: 2527638 - RNA, 21 nt, Human
gccagccaggcgggcucaagg

SEQ ID NO: 2527639 - RNA, 19 nt, Human
gccagccagugaccugagg

SEQ ID NO: 2527640 - RNA, 18 nt, Human
gccagccaggcgggcuca

SEQ ID NO: 2527641 - RNA, 13 nt, Human
gccagccaggcgg

SEQ ID NO: 2527642 - RNA, 11 nt, Human
gccagccaggc

SEQ ID NO: 2527643 - RNA, 16 nt, Human
gccagccagcagccag

SEQ ID NO: 2527644 - RNA, 19 nt, Human
gccagccagcagccagcuc

SEQ ID NO: 2527645 - RNA, 22 nt, Human
gccaggcacacacugugcuuuc

SEQ ID NO: 2527646 - RNA, 17 nt, Human
gccaggcacacacugug

SEQ ID NO: 2527647 - RNA, 15 nt, Human
gccaggcacacacug

SEQ ID NO: 2527648 - RNA, 23 nt, Human
gccaggcacacacugugcuuucu

SEQ ID NO: 2527649 - RNA, 21 nt, Human
gccaggcacccccuggagaga

SEQ ID NO: 2527650 - RNA, 20 nt, Human
gccaggcacccccuggagag

SEQ ID NO: 2527651 - RNA, 19 nt, Human
gccaggcacccccuggaga

SEQ ID NO: 2527652 - RNA, 14 nt, Human
gccaggauggaaug

SEQ ID NO: 2527653 - RNA, 22 nt, Human
gccaggauggaacacggccaca

SEQ ID NO: 2527654 - RNA, 17 nt, Human
gccagccccacccagga

SEQ ID NO: 2527655 - RNA, 19 nt, Human
gccagccccacagcccacg

SEQ ID NO: 2527656 - RNA, 18 nt, Human
gccagccccacagcccac

SEQ ID NO: 2527657 - RNA, 13 nt, Human
gccagccccaccc

SEQ ID NO: 2527658 - RNA, 14 nt, Human
gccagccccaccca

SEQ ID NO: 2527659 - RNA, 15 nt, Human
gccagccccacccag

SEQ ID NO: 2527660 - RNA, 14 nt, Human
gccaggcccucugc

SEQ ID NO: 2527661 - RNA, 13 nt, Human
gccaggcccucug

SEQ ID NO: 2527662 - RNA, 23 nt, Human
gccaggcccccaagccugcaguc

SEQ ID NO: 2527663 - RNA, 19 nt, Human
gccaggcccccaagccugc

SEQ ID NO: 2527664 - RNA, 16 nt, Human
gccaggcccggggcug

SEQ ID NO: 2527665 - RNA, 17 nt, Human
gccaggcccggggcugg

SEQ ID NO: 2527666 - RNA, 18 nt, Human
gccaggcccggggcuggc

SEQ ID NO: 2527667 - RNA, 19 nt, Human
gccaggccagccuccgaga

SEQ ID NO: 2527668 - RNA, 18 nt, Human
gccaggcccccaagccug

SEQ ID NO: 2527669 - RNA, 14 nt, Human
gccaggccccaggc

SEQ ID NO: 2527670 - RNA, 13 nt, Human
gccaggccagcug

SEQ ID NO: 2527671 - RNA, 13 nt, Human
gccaggccccagg

SEQ ID NO: 2527672 - RNA, 18 nt, Human
gccaggccacaagacccu

SEQ ID NO: 2527673 - RNA, 13 nt, Human
gccaggccacaag

SEQ ID NO: 2527674 - RNA, 17 nt, Human
gccaggcaggggugggg

SEQ ID NO: 2527675 - RNA, 16 nt, Human
gccaggcagggguggg

SEQ ID NO: 2527676 - RNA, 15 nt, Human
gccaggcaggggugg

SEQ ID NO: 2527677 - RNA, 14 nt, Human
gccaggcaggggug

SEQ ID NO: 2527678 - RNA, 19 nt, Human
gccaggcagguagccaggg

SEQ ID NO: 2527679 - RNA, 18 nt, Human
gccaggcaggugccugga

SEQ ID NO: 2527680 - RNA, 14 nt, Human
gccaggcagaucug

SEQ ID NO: 2527681 - RNA, 15 nt, Human
gccaggcagaucugu

SEQ ID NO: 2527682 - RNA, 21 nt, Human
gccaggcagaucugugcccca

SEQ ID NO: 2527683 - RNA, 23 nt, Human
gccaggcagaucugugccccaug

SEQ ID NO: 2527684 - RNA, 21 nt, Human
gccaggccacaagacccuugu

SEQ ID NO: 2527685 - RNA, 15 nt, Human
gccaggccagaggga

SEQ ID NO: 2527686 - RNA, 22 nt, Human
gccaggccagagggagugacag

SEQ ID NO: 2527687 - RNA, 13 nt, Human
gccaggccagccu

SEQ ID NO: 2527688 - RNA, 12 nt, Human
gccaggccagcc

SEQ ID NO: 2527689 - RNA, 15 nt, Human
gccaggccagccucc

SEQ ID NO: 2527690 - RNA, 14 nt, Human
gccaggccagccuc

SEQ ID NO: 2527691 - RNA, 12 nt, Human
gccaggccagcu

SEQ ID NO: 2527692 - RNA, 14 nt, Human
gccaguggcuggau

SEQ ID NO: 2527693 - RNA, 23 nt, Human
gccaguggcuggaucugugaggg

SEQ ID NO: 2527694 - RNA, 21 nt, Human
gccagugccuuaccuccugcc

SEQ ID NO: 2527695 - RNA, 20 nt, Human
gccagugccuuaccuccugc

SEQ ID NO: 2527696 - RNA, 22 nt, Human
gccagugccuuaccuccugccc

SEQ ID NO: 2527697 - RNA, 23 nt, Human
gccagugccuuaccuccugccca

SEQ ID NO: 2527698 - RNA, 13 nt, Human
gccagugucuguc

SEQ ID NO: 2527699 - RNA, 13 nt, Human
gccagugugacaa

SEQ ID NO: 2527700 - RNA, 22 nt, Human
gccaguuauggcuauaggugcu

SEQ ID NO: 2527701 - RNA, 13 nt, Human
gccaguugguccc

SEQ ID NO: 2527702 - RNA, 21 nt, Human
gccagugucugucccgggguc

SEQ ID NO: 2527703 - RNA, 16 nt, Human
gccagugucugucccg

SEQ ID NO: 2527704 - RNA, 15 nt, Human
gccagugucuguccc

SEQ ID NO: 2527705 - RNA, 17 nt, Human
gccagugugaucccaag

SEQ ID NO: 2527706 - RNA, 22 nt, Human
gccagugucugucccggggucc

SEQ ID NO: 2527707 - RNA, 20 nt, Human
gccagugugaucccaagugc

SEQ ID NO: 2527708 - RNA, 17 nt, Human
gccauauuuucaccauu

SEQ ID NO: 2527709 - RNA, 23 nt, Human
gccauauaaguuugaaggaaaca

SEQ ID NO: 2527710 - RNA, 19 nt, Human
gccauauacucuucaagga

SEQ ID NO: 2527711 - RNA, 22 nt, Human
gccauauaaguuugaaggaaac

SEQ ID NO: 2527712 - RNA, 19 nt, Human
gccauauaaguuugaagga

SEQ ID NO: 2527713 - RNA, 18 nt, Human
gccauauaaguuugaagg

SEQ ID NO: 2527714 - RNA, 17 nt, Human
gccauauaaguuugaag

SEQ ID NO: 2527715 - RNA, 16 nt, Human
gccauauaaguuugaa

SEQ ID NO: 2527716 - RNA, 16 nt, Human
gccauagucacauggc

SEQ ID NO: 2527717 - RNA, 16 nt, Human
gccauaugaaaaggcu

SEQ ID NO: 2527718 - RNA, 20 nt, Human
gccauacuggccucgccugg

SEQ ID NO: 2527719 - RNA, 19 nt, Human
gccauacuggccucgccug

SEQ ID NO: 2527720 - RNA, 18 nt, Human
gccauacuggccucgccu

SEQ ID NO: 2527721 - RNA, 17 nt, Human
gccauacuggccucgcc

SEQ ID NO: 2527722 - RNA, 22 nt, Human
gccauacuggccucgccuggcc

SEQ ID NO: 2527723 - RNA, 21 nt, Human
gccauacuggccucgccuggc

SEQ ID NO: 2527724 - RNA, 18 nt, Human
gccauacuuaucucucug

SEQ ID NO: 2527725 - RNA, 15 nt, Human
gccauacuggccucg

SEQ ID NO: 2527726 - RNA, 14 nt, Human
gccauacuggccuc

SEQ ID NO: 2527727 - RNA, 13 nt, Human
gccauacuggccu

SEQ ID NO: 2527728 - RNA, 22 nt, Human
gccauaaaacauuaagaaaauc

SEQ ID NO: 2527729 - RNA, 22 nt, Human
gccauacuuaucucucugugcu

SEQ ID NO: 2527730 - RNA, 21 nt, Human
gccauacuuaucucucugugc

SEQ ID NO: 2527731 - RNA, 20 nt, Human
gccauacuuaucucucugug

SEQ ID NO: 2527732 - RNA, 23 nt, Human
gccauacuggccucgccuggccu

SEQ ID NO: 2527733 - RNA, 16 nt, Human
gccauacuuugucuga

SEQ ID NO: 2527734 - RNA, 15 nt, Human
gccauagcuccugcu

SEQ ID NO: 2527735 - RNA, 12 nt, Human
gccauagcuccu

SEQ ID NO: 2527736 - RNA, 16 nt, Human
gccauagaguuuaaca

SEQ ID NO: 2527737 - RNA, 23 nt, Human
gccauagcuccugcuccacagcc

SEQ ID NO: 2527738 - RNA, 18 nt, Human
gccauagcuccugcucca

SEQ ID NO: 2527739 - RNA, 21 nt, Human
gccaguuggucccccuuccau

SEQ ID NO: 2527740 - RNA, 20 nt, Human
gccaguuggucccccuucca

SEQ ID NO: 2527741 - RNA, 18 nt, Human
gccaguuggucccccuuc

SEQ ID NO: 2527742 - RNA, 16 nt, Human
gccaguuggucccccu

SEQ ID NO: 2527743 - RNA, 23 nt, Human
gccaguuggucccccuuccaugg

SEQ ID NO: 2527744 - RNA, 22 nt, Human
gccaguuggucccccuuccaug

SEQ ID NO: 2527745 - RNA, 21 nt, Human
gccauaaaacauuaagaaaau

SEQ ID NO: 2527746 - RNA, 20 nt, Human
gccauaaaacauuaagaaaa

SEQ ID NO: 2527747 - RNA, 14 nt, Human
gccauaaaacauua

SEQ ID NO: 2527748 - RNA, 13 nt, Human
gccauaaaacauu

SEQ ID NO: 2527749 - RNA, 22 nt, Human
gccauaaaacagguaauauaaa

SEQ ID NO: 2527750 - RNA, 20 nt, Human
gccaguuuuguuuccuuuca

SEQ ID NO: 2527751 - RNA, 22 nt, Human
gccaguucaguaccuggaggag

SEQ ID NO: 2527752 - RNA, 21 nt, Human
gccaguucaguaccuggagga

SEQ ID NO: 2527753 - RNA, 20 nt, Human
gccaguucaguaccuggagg

SEQ ID NO: 2527754 - RNA, 15 nt, Human
gccaguucaguaccu

SEQ ID NO: 2527755 - RNA, 18 nt, Human
gccaguugaauuuaugga

SEQ ID NO: 2527756 - RNA, 19 nt, Human
gcccucaggggacuugaau

SEQ ID NO: 2527757 - RNA, 15 nt, Human
gcccucacccugggg

SEQ ID NO: 2527758 - RNA, 19 nt, Human
gcccucagaacccuuggcu

SEQ ID NO: 2527759 - RNA, 22 nt, Human
gcccucaggucagggugaggau

SEQ ID NO: 2527760 - RNA, 23 nt, Human
gcccucaggucagggugaggaug

SEQ ID NO: 2527761 - RNA, 16 nt, Human
gcccucauggccccuc

SEQ ID NO: 2527762 - RNA, 12 nt, Human
gcccucaucccg

SEQ ID NO: 2527763 - RNA, 18 nt, Human
gccccaacuccuggaagc

SEQ ID NO: 2527764 - RNA, 20 nt, Human
gccccugcuucuccagccug

SEQ ID NO: 2527765 - RNA, 19 nt, Human
gccccugcuucuccagccu

SEQ ID NO: 2527766 - RNA, 18 nt, Human
gccccugcuucuccagcc

SEQ ID NO: 2527767 - RNA, 16 nt, Human
gccccugcuucuccag

SEQ ID NO: 2527768 - RNA, 19 nt, Human
gccccuggacaagcagagg

SEQ ID NO: 2527769 - RNA, 15 nt, Human
gccccuggaugcagc

SEQ ID NO: 2527770 - RNA, 18 nt, Human
gcccuagagccugccugg

SEQ ID NO: 2527771 - RNA, 17 nt, Human
gcccuagagccugccug

SEQ ID NO: 2527772 - RNA, 16 nt, Human
gcccuagagccugccu

SEQ ID NO: 2527773 - RNA, 15 nt, Human
gcccuagagccugcc

SEQ ID NO: 2527774 - RNA, 14 nt, Human
gcccuagagccugc

SEQ ID NO: 2527775 - RNA, 13 nt, Human
gcccuagagccug

SEQ ID NO: 2527776 - RNA, 21 nt, Human
gcccuagagcacacuguagca

SEQ ID NO: 2527777 - RNA, 23 nt, Human
gcccuagagccugccuggagcgu

SEQ ID NO: 2527778 - RNA, 20 nt, Human
gcccuagagccugccuggag

SEQ ID NO: 2527779 - RNA, 19 nt, Human
gcccuagagccugccugga

SEQ ID NO: 2527780 - RNA, 13 nt, Human
gcccuagcuccac

SEQ ID NO: 2527781 - RNA, 12 nt, Human
gcccuaggcucc

SEQ ID NO: 2527782 - RNA, 17 nt, Human
gcccucagaacccuugg

SEQ ID NO: 2527783 - RNA, 18 nt, Human
gcccucagaacccuuggc

SEQ ID NO: 2527784 - RNA, 23 nt, Human
gcccucagaacccuuggcuugcc

SEQ ID NO: 2527785 - RNA, 17 nt, Human
gcccuauuuuugcaaug

SEQ ID NO: 2527786 - RNA, 15 nt, Human
gcccuauuuuugcaa

SEQ ID NO: 2527787 - RNA, 14 nt, Human
gcccucagaacccu

SEQ ID NO: 2527788 - RNA, 17 nt, Human
gcccucacccuggggcu

SEQ ID NO: 2527789 - RNA, 16 nt, Human
gcccucacccuggggc

SEQ ID NO: 2527790 - RNA, 11 nt, Human
gcccuaucugu

SEQ ID NO: 2527791 - RNA, 14 nt, Human
gcccuauggaugug

SEQ ID NO: 2527792 - RNA, 13 nt, Human
gcccuauggaugu

SEQ ID NO: 2527793 - RNA, 21 nt, Human
gcccuagagccugccuggagc

SEQ ID NO: 2527794 - RNA, 17 nt, Human
gcccuaggcuccgucag

SEQ ID NO: 2527795 - RNA, 19 nt, Human
gcccauucauuccauucug

SEQ ID NO: 2527796 - RNA, 23 nt, Human
gcccauucauuccauucuggaag

SEQ ID NO: 2527797 - RNA, 16 nt, Human
gcccauucauuccauu

SEQ ID NO: 2527798 - RNA, 16 nt, Human
gcccauuccucaccuu

SEQ ID NO: 2527799 - RNA, 21 nt, Human
gccccaacucuccccugaccu

SEQ ID NO: 2527800 - RNA, 20 nt, Human
gccccaaguccugaagaggc

SEQ ID NO: 2527801 - RNA, 19 nt, Human
gccccaaguccugaagagg

SEQ ID NO: 2527802 - RNA, 16 nt, Human
gccccaaguccugaag

SEQ ID NO: 2527803 - RNA, 15 nt, Human
gccccaaguccugaa

SEQ ID NO: 2527804 - RNA, 13 nt, Human
gccccaaguccug

SEQ ID NO: 2527805 - RNA, 18 nt, Human
gcccauuucaauucucaa

SEQ ID NO: 2527806 - RNA, 19 nt, Human
gcccauuucaauucucaaa

SEQ ID NO: 2527807 - RNA, 20 nt, Human
gcccauucucucuccugucc

SEQ ID NO: 2527808 - RNA, 20 nt, Human
gcccauuucaauucucaaaa

SEQ ID NO: 2527809 - RNA, 22 nt, Human
gccccaacuccuggaagcugug

SEQ ID NO: 2527810 - RNA, 17 nt, Human
gcccauucucucuccug

SEQ ID NO: 2527811 - RNA, 19 nt, Human
gcccauucucucuccuguc

SEQ ID NO: 2527812 - RNA, 21 nt, Human
gcccauucucucuccugucca

SEQ ID NO: 2527813 - RNA, 14 nt, Human
gcccauucucucuc

SEQ ID NO: 2527814 - RNA, 15 nt, Human
gcccauucucucucc

SEQ ID NO: 2527815 - RNA, 18 nt, Human
gccccugccucucugcag

SEQ ID NO: 2527816 - RNA, 17 nt, Human
gccccugccucucugca

SEQ ID NO: 2527817 - RNA, 22 nt, Human
gccccugcugguucaggguugg

SEQ ID NO: 2527818 - RNA, 15 nt, Human
gccccugcuucucca

SEQ ID NO: 2527819 - RNA, 14 nt, Human
gccccugcuucucc

SEQ ID NO: 2527820 - RNA, 21 nt, Human
gccccugcugguucaggguug

SEQ ID NO: 2527821 - RNA, 16 nt, Human
gccccugccucucugc

SEQ ID NO: 2527822 - RNA, 15 nt, Human
gccccugccucucug

SEQ ID NO: 2527823 - RNA, 15 nt, Human
gccccugcccggcug

SEQ ID NO: 2527824 - RNA, 18 nt, Human
gcccccgggccgacggag

SEQ ID NO: 2527825 - RNA, 20 nt, Human
gcccccgcuguaaugaaaca

SEQ ID NO: 2527826 - RNA, 16 nt, Human
gcccccgcccccggcg

SEQ ID NO: 2527827 - RNA, 13 nt, Human
gcccccgccccgc

SEQ ID NO: 2527828 - RNA, 15 nt, Human
gcccccggcggcgcc

SEQ ID NO: 2527829 - RNA, 13 nt, Human
gcccccggcggcg

SEQ ID NO: 2527830 - RNA, 14 nt, Human
gcccccggcccccu

SEQ ID NO: 2527831 - RNA, 16 nt, Human
gcccccgccccgcccc

SEQ ID NO: 2527832 - RNA, 18 nt, Human
gccccaaucccuuuauua

SEQ ID NO: 2527833 - RNA, 21 nt, Human
gccccaaguccugaagaggcg

SEQ ID NO: 2527834 - RNA, 19 nt, Human
gccccaaucccuuuauuac

SEQ ID NO: 2527835 - RNA, 23 nt, Human
gccccacacuggggugccgccug

SEQ ID NO: 2527836 - RNA, 22 nt, Human
gccccacacuggggugccgccu

SEQ ID NO: 2527837 - RNA, 11 nt, Human
gccccacagcc

SEQ ID NO: 2527838 - RNA, 19 nt, Human
gccccacacuggggugccg

SEQ ID NO: 2527839 - RNA, 16 nt, Human
gccccacacuggggug

SEQ ID NO: 2527840 - RNA, 20 nt, Human
gccccacacggaggcaucug

SEQ ID NO: 2527841 - RNA, 17 nt, Human
gccccaccccagguccu

SEQ ID NO: 2527842 - RNA, 12 nt, Human
gccccacccugg

SEQ ID NO: 2527843 - RNA, 20 nt, Human
gccccccuccuugcucugca

SEQ ID NO: 2527844 - RNA, 16 nt, Human
gccccccuccuugcuc

SEQ ID NO: 2527845 - RNA, 13 nt, Human
gcccccgagcugg

SEQ ID NO: 2527846 - RNA, 14 nt, Human
gcccccgagcuggg

SEQ ID NO: 2527847 - RNA, 22 nt, Human
gcccccgagcugggggccauga

SEQ ID NO: 2527848 - RNA, 11 nt, Human
gcccccgcccc

SEQ ID NO: 2527849 - RNA, 17 nt, Human
gcccaggccccugccac

SEQ ID NO: 2527850 - RNA, 13 nt, Human
gcccaggccccug

SEQ ID NO: 2527851 - RNA, 15 nt, Human
gcccaggccccugcc

SEQ ID NO: 2527852 - RNA, 16 nt, Human
gcccaggcaggucuug

SEQ ID NO: 2527853 - RNA, 14 nt, Human
gcccaggcaggucu

SEQ ID NO: 2527854 - RNA, 22 nt, Human
gcccaggaguuugaggcugcag

SEQ ID NO: 2527855 - RNA, 12 nt, Human
gcccaggcaggu

SEQ ID NO: 2527856 - RNA, 13 nt, Human
gcccaggcagguc

SEQ ID NO: 2527857 - RNA, 14 nt, Human
gccaucaaaaugcu

SEQ ID NO: 2527858 - RNA, 15 nt, Human
gccaucaaaaugcuu

SEQ ID NO: 2527859 - RNA, 16 nt, Human
gccaucaaaaugcuuu

SEQ ID NO: 2527860 - RNA, 18 nt, Human
gccaucaaaaugcuuuuu

SEQ ID NO: 2527861 - RNA, 17 nt, Human
gccaucaacaagaguug

SEQ ID NO: 2527862 - RNA, 19 nt, Human
gccaucaaaaugcuuuuua

SEQ ID NO: 2527863 - RNA, 22 nt, Human
gccaugugcuaguaauuggaaa

SEQ ID NO: 2527864 - RNA, 14 nt, Human
gccaugugccaggu

SEQ ID NO: 2527865 - RNA, 21 nt, Human
gcccaggagagccagcccucc

SEQ ID NO: 2527866 - RNA, 18 nt, Human
gccauguuccaauaaaca

SEQ ID NO: 2527867 - RNA, 18 nt, Human
gcccaggagagccagccc

SEQ ID NO: 2527868 - RNA, 23 nt, Human
gccauguuaauguaaucugaugg

SEQ ID NO: 2527869 - RNA, 19 nt, Human
gcccaggagagccagcccu

SEQ ID NO: 2527870 - RNA, 20 nt, Human
gcccaggagagccagcccuc

SEQ ID NO: 2527871 - RNA, 17 nt, Human
gccugcuccagaccuga

SEQ ID NO: 2527872 - RNA, 21 nt, Human
gccugcuccagaccugauccu

SEQ ID NO: 2527873 - RNA, 18 nt, Human
gccugcgcccaccccgcu

SEQ ID NO: 2527874 - RNA, 13 nt, Human
gccugcuccagcu

SEQ ID NO: 2527875 - RNA, 21 nt, Human
gccugcccuccccagagcacu

SEQ ID NO: 2527876 - RNA, 19 nt, Human
gccugcccuccccagagca

SEQ ID NO: 2527877 - RNA, 22 nt, Human
gccugcccuccccagagcacug

SEQ ID NO: 2527878 - RNA, 13 nt, Human
gccugcccuuguc

SEQ ID NO: 2527879 - RNA, 21 nt, Human
gccugcccuugucugagaugc

SEQ ID NO: 2527880 - RNA, 14 nt, Human
gccugcccuugucu

SEQ ID NO: 2527881 - RNA, 22 nt, Human
gccugcgcccaccccgcucugc

SEQ ID NO: 2527882 - RNA, 20 nt, Human
gccugcgcccaccccgcucu

SEQ ID NO: 2527883 - RNA, 17 nt, Human
gccugcggccugcugga

SEQ ID NO: 2527884 - RNA, 20 nt, Human
gccugcguuuuggaagcucu

SEQ ID NO: 2527885 - RNA, 20 nt, Human
gccugcguucuugugacaga

SEQ ID NO: 2527886 - RNA, 23 nt, Human
gccugcgcccaccccgcucugca

SEQ ID NO: 2527887 - RNA, 12 nt, Human
gccugcuccaga

SEQ ID NO: 2527888 - RNA, 13 nt, Human
gccugcuccagac

SEQ ID NO: 2527889 - RNA, 14 nt, Human
gccugcuccagacc

SEQ ID NO: 2527890 - RNA, 15 nt, Human
gccugcuccagaccu

SEQ ID NO: 2527891 - RNA, 16 nt, Human
gccugcuccagaccug

SEQ ID NO: 2527892 - RNA, 23 nt, Human
gccugcuaauuccccagauugca

SEQ ID NO: 2527893 - RNA, 17 nt, Human
gccugcuaauuccccag

SEQ ID NO: 2527894 - RNA, 18 nt, Human
gccugcccuccccagagc

SEQ ID NO: 2527895 - RNA, 17 nt, Human
gccugcccuccccagag

SEQ ID NO: 2527896 - RNA, 15 nt, Human
gccugcccuccccag

SEQ ID NO: 2527897 - RNA, 14 nt, Human
gccugcccucaggg

SEQ ID NO: 2527898 - RNA, 22 nt, Human
gccugcccucauggccccucug

SEQ ID NO: 2527899 - RNA, 21 nt, Human
gccugcccucauggccccucu

SEQ ID NO: 2527900 - RNA, 20 nt, Human
gccugcccgucucucuccca

SEQ ID NO: 2527901 - RNA, 18 nt, Human
gccugcccgucucucucc

SEQ ID NO: 2527902 - RNA, 20 nt, Human
gccugcccucauggccccuc

SEQ ID NO: 2527903 - RNA, 16 nt, Human
gccugcccguaaacac

SEQ ID NO: 2527904 - RNA, 21 nt, Human
gccugcccguaaacacgccug

SEQ ID NO: 2527905 - RNA, 17 nt, Human
gccugccccucucccgc

SEQ ID NO: 2527906 - RNA, 14 nt, Human
gccugccccucucc

SEQ ID NO: 2527907 - RNA, 18 nt, Human
gccugccccucccagaac

SEQ ID NO: 2527908 - RNA, 13 nt, Human
gccucggacuuag

SEQ ID NO: 2527909 - RNA, 15 nt, Human
gccucgccuggccug

SEQ ID NO: 2527910 - RNA, 14 nt, Human
gccucgccuggccu

SEQ ID NO: 2527911 - RNA, 13 nt, Human
gccucgccuggcc

SEQ ID NO: 2527912 - RNA, 20 nt, Human
gccucgcccaccgcaugccc

SEQ ID NO: 2527913 - RNA, 16 nt, Human
gccucgcccaccgcau

SEQ ID NO: 2527914 - RNA, 15 nt, Human
gccucgcccaccgca

SEQ ID NO: 2527915 - RNA, 14 nt, Human
gccucgcccaccgc

SEQ ID NO: 2527916 - RNA, 23 nt, Human
gccucgcccaccgcaugcccccu

SEQ ID NO: 2527917 - RNA, 20 nt, Human
gccuccagggcuggacugag

SEQ ID NO: 2527918 - RNA, 19 nt, Human
gccuccagggcuggacuga

SEQ ID NO: 2527919 - RNA, 18 nt, Human
gccuccagggcuggacug

SEQ ID NO: 2527920 - RNA, 17 nt, Human
gccuccagggcuggacu

SEQ ID NO: 2527921 - RNA, 16 nt, Human
gccuccagggcuggac

SEQ ID NO: 2527922 - RNA, 16 nt, Human
gccuccauccugaggc

SEQ ID NO: 2527923 - RNA, 20 nt, Human
gccuccauccugaggcucca

SEQ ID NO: 2527924 - RNA, 21 nt, Human
gccuccuuugugaggaagccg

SEQ ID NO: 2527925 - RNA, 20 nt, Human
gccuccuuugugaggaagcc

SEQ ID NO: 2527926 - RNA, 19 nt, Human
gccuccuuugugaggaagc

SEQ ID NO: 2527927 - RNA, 11 nt, Human
gccuccaucuc

SEQ ID NO: 2527928 - RNA, 21 nt, Human
gccuccaggccacauggggcu

SEQ ID NO: 2527929 - RNA, 20 nt, Human
gccuccuuccuugcuguccu

SEQ ID NO: 2527930 - RNA, 22 nt, Human
gccuccaaggaggggcuguaaa

SEQ ID NO: 2527931 - RNA, 23 nt, Human
gccuccaaggaggggcuguaaaa

SEQ ID NO: 2527932 - RNA, 19 nt, Human
gccuccagaacucacuggg

SEQ ID NO: 2527933 - RNA, 11 nt, Human
gccuccagccu

SEQ ID NO: 2527934 - RNA, 17 nt, Human
gccuccagaacucacug

SEQ ID NO: 2527935 - RNA, 14 nt, Human
gccuccagggcugg

SEQ ID NO: 2527936 - RNA, 13 nt, Human
gccuccagggcug

SEQ ID NO: 2527937 - RNA, 22 nt, Human
gccuccaggccacauggggcug

SEQ ID NO: 2527938 - RNA, 12 nt, Human
gccuccagggcu

SEQ ID NO: 2527939 - RNA, 15 nt, Human
gccuccagccucugu

SEQ ID NO: 2527940 - RNA, 14 nt, Human
gccuccagccucug

SEQ ID NO: 2527941 - RNA, 12 nt, Human
gccuccagccuc

SEQ ID NO: 2527942 - RNA, 12 nt, Human
gccuccaggcca

SEQ ID NO: 2527943 - RNA, 19 nt, Human
gccuccaggaaccacacca

SEQ ID NO: 2527944 - RNA, 18 nt, Human
gccuccagcugccccggg

SEQ ID NO: 2527945 - RNA, 17 nt, Human
gccuccaagcuccaucu

SEQ ID NO: 2527946 - RNA, 22 nt, Human
gccuccaaaugccaacuugucc

SEQ ID NO: 2527947 - RNA, 21 nt, Human
gccucauuuagagaggaaaag

SEQ ID NO: 2527948 - RNA, 17 nt, Human
gccuccaaaugccaacu

SEQ ID NO: 2527949 - RNA, 19 nt, Human
gccucauguggcuggaaga

SEQ ID NO: 2527950 - RNA, 21 nt, Human
gccucauuacuuuaccacccc

SEQ ID NO: 2527951 - RNA, 18 nt, Human
gccucauguggcuggaag

SEQ ID NO: 2527952 - RNA, 16 nt, Human
gcgacuuucugccugg

SEQ ID NO: 2527953 - RNA, 14 nt, Human
gcgacuuucugccu

SEQ ID NO: 2527954 - RNA, 17 nt, Human
gcgacuuucugccugga

SEQ ID NO: 2527955 - RNA, 20 nt, Human
gcgagaaccuaaguuucagu

SEQ ID NO: 2527956 - RNA, 18 nt, Human
gcgagacuccgucucaaa

SEQ ID NO: 2527957 - RNA, 14 nt, Human
gcgagacuccgucu

SEQ ID NO: 2527958 - RNA, 16 nt, Human
gcgagaggaggggccc

SEQ ID NO: 2527959 - RNA, 16 nt, Human
gcgagaggcagagaaa

SEQ ID NO: 2527960 - RNA, 15 nt, Human
gcgagaggcagagaa

SEQ ID NO: 2527961 - RNA, 15 nt, Human
gcgagagucccugca

SEQ ID NO: 2527962 - RNA, 23 nt, Human
gcgagauggggugggguggagaa

SEQ ID NO: 2527963 - RNA, 16 nt, Human
gcgagagucugucuca

SEQ ID NO: 2527964 - RNA, 16 nt, Human
gcgaggcagaggacag

SEQ ID NO: 2527965 - RNA, 13 nt, Human
gcgaggcagagga

SEQ ID NO: 2527966 - RNA, 12 nt, Human
gcgaggcagagg

SEQ ID NO: 2527967 - RNA, 16 nt, Human
gcgagcauccuggcca

SEQ ID NO: 2527968 - RNA, 18 nt, Human
gcgaggaggcuccagagg

SEQ ID NO: 2527969 - RNA, 14 nt, Human
gcgaggcagaggac

SEQ ID NO: 2527970 - RNA, 14 nt, Human
gcgaggggagggug

SEQ ID NO: 2527971 - RNA, 13 nt, Human
gcgauucuucugc

SEQ ID NO: 2527972 - RNA, 17 nt, Human
gcgauucuccugccuca

SEQ ID NO: 2527973 - RNA, 20 nt, Human
gcgagugugugcaugugugu

SEQ ID NO: 2527974 - RNA, 16 nt, Human
gcgaggucaacagaga

SEQ ID NO: 2527975 - RNA, 17 nt, Human
gcgaggucaacagagaa

SEQ ID NO: 2527976 - RNA, 18 nt, Human
gcgaggucaacagagaag

SEQ ID NO: 2527977 - RNA, 19 nt, Human
gcgaggucaacagagaagg

SEQ ID NO: 2527978 - RNA, 15 nt, Human
gcgagugccaggacu

SEQ ID NO: 2527979 - RNA, 22 nt, Human
gcgaguauguguuugugugugu

SEQ ID NO: 2527980 - RNA, 22 nt, Human
gcgaggucaacagagaaggcag

SEQ ID NO: 2527981 - RNA, 23 nt, Human
gcgaggucaacagagaaggcagg

SEQ ID NO: 2527982 - RNA, 22 nt, Human
gcgagugccaggacuccccagg

SEQ ID NO: 2527983 - RNA, 21 nt, Human
gcgagugccaggacuccccag

SEQ ID NO: 2527984 - RNA, 17 nt, Human
gcgaguuguggaaagcc

SEQ ID NO: 2527985 - RNA, 16 nt, Human
gcgauccaccugucuc

SEQ ID NO: 2527986 - RNA, 14 nt, Human
gcgauucuucugcu

SEQ ID NO: 2527987 - RNA, 19 nt, Human
gcgauucuggauaaagcca

SEQ ID NO: 2527988 - RNA, 20 nt, Human
gcgauucuggauaaagccac

SEQ ID NO: 2527989 - RNA, 13 nt, Human
gcuaauuugcauu

SEQ ID NO: 2527990 - RNA, 15 nt, Human
gcuaauuugcauuaa

SEQ ID NO: 2527991 - RNA, 20 nt, Human
gcuaauuuauccugaaauuu

SEQ ID NO: 2527992 - RNA, 12 nt, Human
gcuaauuugcau

SEQ ID NO: 2527993 - RNA, 18 nt, Human
gcuaauuuugaaaaacug

SEQ ID NO: 2527994 - RNA, 16 nt, Human
gcuaauuuuucauuuu

SEQ ID NO: 2527995 - RNA, 17 nt, Human
gcguuucuaugacacau

SEQ ID NO: 2527996 - RNA, 19 nt, Human
gcguuuaagacuguaauga

SEQ ID NO: 2527997 - RNA, 20 nt, Human
gcguuguaaaauauagcugu

SEQ ID NO: 2527998 - RNA, 19 nt, Human
gcguuguaaaauauagcug

SEQ ID NO: 2527999 - RNA, 15 nt, Human
gcguugcaugucgug

SEQ ID NO: 2528000 - RNA, 21 nt, Human
gcgugguggaagaggggacag

SEQ ID NO: 2528001 - RNA, 15 nt, Human
gcguuguaaaauaua

SEQ ID NO: 2528002 - RNA, 14 nt, Human
gcguuguaaaauau

SEQ ID NO: 2528003 - RNA, 18 nt, Human
gcuacaaaaacacagcaa

SEQ ID NO: 2528004 - RNA, 19 nt, Human
gcuacaaaaacacagcaag

SEQ ID NO: 2528005 - RNA, 17 nt, Human
gcuacaaaaacacagca

SEQ ID NO: 2528006 - RNA, 15 nt, Human
gcuaauuuuuguaau

SEQ ID NO: 2528007 - RNA, 16 nt, Human
gcuaauuuuuguaauu

SEQ ID NO: 2528008 - RNA, 17 nt, Human
gcuaauuuuuguaauuu

SEQ ID NO: 2528009 - RNA, 22 nt, Human
gcuacaauuuucucccaggaag

SEQ ID NO: 2528010 - RNA, 21 nt, Human
gcuacaauuuucucccaggaa

SEQ ID NO: 2528011 - RNA, 20 nt, Human
gcuacaauuuucucccagga

SEQ ID NO: 2528012 - RNA, 15 nt, Human
gcuacaauuuucucc

SEQ ID NO: 2528013 - RNA, 17 nt, Human
gcuacaacuucagcagu

SEQ ID NO: 2528014 - RNA, 15 nt, Human
gcuacaacuucagca

SEQ ID NO: 2528015 - RNA, 22 nt, Human
gcuacaaagaagacauguuuua

SEQ ID NO: 2528016 - RNA, 23 nt, Human
gcuacuggcaaaaggaucuuugu

SEQ ID NO: 2528017 - RNA, 16 nt, Human
gcuacaaagaagacau

SEQ ID NO: 2528018 - RNA, 15 nt, Human
gcuacaaagaagaca

SEQ ID NO: 2528019 - RNA, 14 nt, Human
gcuacaaagaagac

SEQ ID NO: 2528020 - RNA, 20 nt, Human
gcuacaaagaagacauguuu

SEQ ID NO: 2528021 - RNA, 19 nt, Human
gcuacaaagaagacauguu

SEQ ID NO: 2528022 - RNA, 18 nt, Human
gcuacaaagaagacaugu

SEQ ID NO: 2528023 - RNA, 17 nt, Human
gcuacaaagaagacaug

SEQ ID NO: 2528024 - RNA, 20 nt, Human
gcuacaaauacucuuaggaa

SEQ ID NO: 2528025 - RNA, 15 nt, Human
gcuacugucagcucc

SEQ ID NO: 2528026 - RNA, 18 nt, Human
gcuacuguaauuuuauau

SEQ ID NO: 2528027 - RNA, 22 nt, Human
gcuacuguaauuuuauaugaag

SEQ ID NO: 2528028 - RNA, 19 nt, Human
gcuacuguaaggcaaucau

SEQ ID NO: 2528029 - RNA, 18 nt, Human
gcuacuguaaggcaauca

SEQ ID NO: 2528030 - RNA, 21 nt, Human
gcuacugucucacugaaacau

SEQ ID NO: 2528031 - RNA, 16 nt, Human
gcuacugucucacuga

SEQ ID NO: 2528032 - RNA, 12 nt, Human
gcuacugucuca

SEQ ID NO: 2528033 - RNA, 15 nt, Human
gcuacugugugugug

SEQ ID NO: 2528034 - RNA, 18 nt, Human
gcuacugugugugugaau

SEQ ID NO: 2528035 - RNA, 21 nt, Human
gcuacuuaauuccuuucucau

SEQ ID NO: 2528036 - RNA, 17 nt, Human
gcuacuuaauuccuuuc

SEQ ID NO: 2528037 - RNA, 19 nt, Human
gcuacugugugugugaaug

SEQ ID NO: 2528038 - RNA, 21 nt, Human
gcuacugugugugugaaugaa

SEQ ID NO: 2528039 - RNA, 20 nt, Human
gcuacuguccuacccacccu

SEQ ID NO: 2528040 - RNA, 19 nt, Human
gcuacuguccuacccaccc

SEQ ID NO: 2528041 - RNA, 15 nt, Human
gcuagaaccuggagg

SEQ ID NO: 2528042 - RNA, 20 nt, Human
gcuagaaccuggagagcuag

SEQ ID NO: 2528043 - RNA, 19 nt, Human
gcuagaaccuggagagcua

SEQ ID NO: 2528044 - RNA, 15 nt, Human
gcuagaaccuggaga

SEQ ID NO: 2528045 - RNA, 20 nt, Human
gcuagaaccuggaagggcua

SEQ ID NO: 2528046 - RNA, 19 nt, Human
gcuagaaccuggaagggcu

SEQ ID NO: 2528047 - RNA, 18 nt, Human
gcuagaaccuggaagggc

SEQ ID NO: 2528048 - RNA, 20 nt, Human
gcuagaaccuagaagggcua

SEQ ID NO: 2528049 - RNA, 19 nt, Human
gcuagaaccuagaagggcu

SEQ ID NO: 2528050 - RNA, 18 nt, Human
gcuagaaccuagaagggc

SEQ ID NO: 2528051 - RNA, 20 nt, Human
gcuagaaccaagaagggcua

SEQ ID NO: 2528052 - RNA, 19 nt, Human
gcuagaaccaagaagggcu

SEQ ID NO: 2528053 - RNA, 18 nt, Human
gcuagaaccaagaagggc

SEQ ID NO: 2528054 - RNA, 20 nt, Human
gcuagaaccuguagagcuag

SEQ ID NO: 2528055 - RNA, 19 nt, Human
gcuagaaccuggagggcug

SEQ ID NO: 2528056 - RNA, 17 nt, Human
gcuacuugggaggcuga

SEQ ID NO: 2528057 - RNA, 20 nt, Human
gcuacuucccucacccacuu

SEQ ID NO: 2528058 - RNA, 23 nt, Human
gcuacuuaauuccuuucucaucc

SEQ ID NO: 2528059 - RNA, 18 nt, Human
gcuacuuccuccucccca

SEQ ID NO: 2528060 - RNA, 19 nt, Human
gcuacuuccuccuccccac

SEQ ID NO: 2528061 - RNA, 13 nt, Human
gcuacuugggagg

SEQ ID NO: 2528062 - RNA, 16 nt, Human
gcuacuuugccuuuug

SEQ ID NO: 2528063 - RNA, 21 nt, Human
gcuacuuuauuuauacacugu

SEQ ID NO: 2528064 - RNA, 18 nt, Human
gcuacuugggccauagcu

SEQ ID NO: 2528065 - RNA, 18 nt, Human
gcuagaaauaugauuuua

SEQ ID NO: 2528066 - RNA, 11 nt, Human
gcuagaaauga

SEQ ID NO: 2528067 - RNA, 21 nt, Human
gcggcccagcccggcucccac

SEQ ID NO: 2528068 - RNA, 18 nt, Human
gcggcccagcccggcucc

SEQ ID NO: 2528069 - RNA, 16 nt, Human
gcggcccagcccggcu

SEQ ID NO: 2528070 - RNA, 15 nt, Human
gcggcccagcccggc

SEQ ID NO: 2528071 - RNA, 13 nt, Human
gcggcccagcccg

SEQ ID NO: 2528072 - RNA, 23 nt, Human
gcggcccaagcccgacuugcugu

SEQ ID NO: 2528073 - RNA, 22 nt, Human
gcggcccaagcccgacuugcug

SEQ ID NO: 2528074 - RNA, 22 nt, Human
gcggagugaagaggggcagccc

SEQ ID NO: 2528075 - RNA, 21 nt, Human
gcggagugaagaggggcagcc

SEQ ID NO: 2528076 - RNA, 20 nt, Human
gcggagugaagaggggcagc

SEQ ID NO: 2528077 - RNA, 18 nt, Human
gcggagugaagaggggca

SEQ ID NO: 2528078 - RNA, 14 nt, Human
gcggagugaagagg

SEQ ID NO: 2528079 - RNA, 13 nt, Human
gcggccggccagc

SEQ ID NO: 2528080 - RNA, 19 nt, Human
gcggccgcauucccugagu

SEQ ID NO: 2528081 - RNA, 16 nt, Human
gcggccgcauucccug

SEQ ID NO: 2528082 - RNA, 17 nt, Human
gcggccgcauucccuga

SEQ ID NO: 2528083 - RNA, 18 nt, Human
gcggccgcauucccugag

SEQ ID NO: 2528084 - RNA, 15 nt, Human
gcggccccucccaca

SEQ ID NO: 2528085 - RNA, 14 nt, Human
gcggccccucccac

SEQ ID NO: 2528086 - RNA, 13 nt, Human
gcggccccucccg

SEQ ID NO: 2528087 - RNA, 16 nt, Human
gcggccccucccgccc

SEQ ID NO: 2528088 - RNA, 15 nt, Human
gcggccgcauucccu

SEQ ID NO: 2528089 - RNA, 17 nt, Human
gcguggucacugcuguc

SEQ ID NO: 2528090 - RNA, 18 nt, Human
gcguggucacugcuguca

SEQ ID NO: 2528091 - RNA, 20 nt, Human
gcgugguggacaugcacagc

SEQ ID NO: 2528092 - RNA, 13 nt, Human
gcguggggagggc

SEQ ID NO: 2528093 - RNA, 17 nt, Human
gcguggggacagggcuc

SEQ ID NO: 2528094 - RNA, 16 nt, Human
gcguggucacugcugu

SEQ ID NO: 2528095 - RNA, 16 nt, Human
gcguggagggcguggg

SEQ ID NO: 2528096 - RNA, 23 nt, Human
gcgugaucucggcucacugcaac

SEQ ID NO: 2528097 - RNA, 19 nt, Human
gcguggagggcguggaggg

SEQ ID NO: 2528098 - RNA, 18 nt, Human
gcgugcacacaccagagc

SEQ ID NO: 2528099 - RNA, 14 nt, Human
gcgugcacacacca

SEQ ID NO: 2528100 - RNA, 20 nt, Human
gcgugaucaaagccacacuc

SEQ ID NO: 2528101 - RNA, 19 nt, Human
gcgugaucaaagccacacu

SEQ ID NO: 2528102 - RNA, 15 nt, Human
gcggagaguacagug

SEQ ID NO: 2528103 - RNA, 22 nt, Human
gcggagagaggccuugucccag

SEQ ID NO: 2528104 - RNA, 12 nt, Human
gcggagcuggcc

SEQ ID NO: 2528105 - RNA, 20 nt, Human
gcggagaguacagugagcca

SEQ ID NO: 2528106 - RNA, 16 nt, Human
gcggagaguacaguga

SEQ ID NO: 2528107 - RNA, 22 nt, Human
gcggagaguacagugagccaag

SEQ ID NO: 2528108 - RNA, 21 nt, Human
gcggagguguggagccgaggc

SEQ ID NO: 2528109 - RNA, 16 nt, Human
gcggagcuugcaguga

SEQ ID NO: 2528110 - RNA, 15 nt, Human
gcggagguugcaggg

SEQ ID NO: 2528111 - RNA, 16 nt, Human
gcggagguugcaggga

SEQ ID NO: 2528112 - RNA, 17 nt, Human
gcggagcuggccccgcc

SEQ ID NO: 2528113 - RNA, 14 nt, Human
gcggagcuggcccc

SEQ ID NO: 2528114 - RNA, 14 nt, Human
auguuuguggccuc

SEQ ID NO: 2528115 - RNA, 15 nt, Human
auguuuguggccuca

SEQ ID NO: 2528116 - RNA, 16 nt, Human
auguuuguggccucag

SEQ ID NO: 2528117 - RNA, 17 nt, Human
auguuuguggccucaga

SEQ ID NO: 2528118 - RNA, 14 nt, Human
auguuuguaaaacu

SEQ ID NO: 2528119 - RNA, 23 nt, Human
auguuugggcagaagggagaagg

SEQ ID NO: 2528120 - RNA, 23 nt, Human
auguuuguccugaacacuuuugu

SEQ ID NO: 2528121 - RNA, 10 nt, Human
auguuugugg

SEQ ID NO: 2528122 - RNA, 13 nt, Human
auguuuguggccu

SEQ ID NO: 2528123 - RNA, 18 nt, Human
auguuugggcagaaggga

SEQ ID NO: 2528124 - RNA, 23 nt, Human
auguuugggagacugcugaguca

SEQ ID NO: 2528125 - RNA, 18 nt, Human
auguuugccucugccucu

SEQ ID NO: 2528126 - RNA, 13 nt, Human
auuaauguuaauu

SEQ ID NO: 2528127 - RNA, 12 nt, Human
auuaauguuaau

SEQ ID NO: 2528128 - RNA, 18 nt, Human
auuaauguuaauucagca

SEQ ID NO: 2528129 - RNA, 21 nt, Human
auuaauuuuuuuauuguuuaa

SEQ ID NO: 2528130 - RNA, 22 nt, Human
auuacaaauugcuuacuuugga

SEQ ID NO: 2528131 - RNA, 15 nt, Human
auuacaaauugcuua

SEQ ID NO: 2528132 - RNA, 14 nt, Human
auuacaaauugcuu

SEQ ID NO: 2528133 - RNA, 13 nt, Human
auuacaaauugcu

SEQ ID NO: 2528134 - RNA, 18 nt, Human
auuacagagaggagaaac

SEQ ID NO: 2528135 - RNA, 19 nt, Human
auuacagagaggagaaaca

SEQ ID NO: 2528136 - RNA, 22 nt, Human
auuacaaaaugacauuuugcca

SEQ ID NO: 2528137 - RNA, 22 nt, Human
auuaauuuuuuuauuguuuaaa

SEQ ID NO: 2528138 - RNA, 17 nt, Human
auuaauuggcagcagau

SEQ ID NO: 2528139 - RNA, 16 nt, Human
auuaauuggcagcaga

SEQ ID NO: 2528140 - RNA, 12 nt, Human
auuaauugcuuu

SEQ ID NO: 2528141 - RNA, 13 nt, Human
auuaauugcuuug

SEQ ID NO: 2528142 - RNA, 14 nt, Human
auuaauugcuuuga

SEQ ID NO: 2528143 - RNA, 14 nt, Human
auuaauucuauaag

SEQ ID NO: 2528144 - RNA, 14 nt, Human
auuaauuaaaugca

SEQ ID NO: 2528145 - RNA, 13 nt, Human
auuaauucuauaa

SEQ ID NO: 2528146 - RNA, 19 nt, Human
auuaauucaccuuccagug

SEQ ID NO: 2528147 - RNA, 15 nt, Human
auuacagcuggagaa

SEQ ID NO: 2528148 - RNA, 21 nt, Human
auuacagaugggcaaauuaag

SEQ ID NO: 2528149 - RNA, 20 nt, Human
auuacaggcaccugccacca

SEQ ID NO: 2528150 - RNA, 22 nt, Human
auuacaggcaccugccaccaug

SEQ ID NO: 2528151 - RNA, 16 nt, Human
auuacaggugugaacc

SEQ ID NO: 2528152 - RNA, 17 nt, Human
auuacaggaaguacugg

SEQ ID NO: 2528153 - RNA, 19 nt, Human
auuacagaugggcaaauua

SEQ ID NO: 2528154 - RNA, 17 nt, Human
auuacagaggaaguuau

SEQ ID NO: 2528155 - RNA, 15 nt, Human
auuacagaggaaguu

SEQ ID NO: 2528156 - RNA, 21 nt, Human
auuacagagaggagaaacaca

SEQ ID NO: 2528157 - RNA, 22 nt, Human
auuacagagaggagaaacacau

SEQ ID NO: 2528158 - RNA, 23 nt, Human
auuagauguucucuaucauuuaa

SEQ ID NO: 2528159 - RNA, 21 nt, Human
auuagauguucucuaucauuu

SEQ ID NO: 2528160 - RNA, 19 nt, Human
auuagauguucucuaucau

SEQ ID NO: 2528161 - RNA, 23 nt, Human
auuagauuucucauuugccaaua

SEQ ID NO: 2528162 - RNA, 22 nt, Human
auuagcaauugacugucacugu

SEQ ID NO: 2528163 - RNA, 17 nt, Human
auuagcaguuugcuuug

SEQ ID NO: 2528164 - RNA, 19 nt, Human
auuagcauuugucaacaaa

SEQ ID NO: 2528165 - RNA, 15 nt, Human
auuagccagguaaug

SEQ ID NO: 2528166 - RNA, 22 nt, Human
auuagccaggaucaugguguaa

SEQ ID NO: 2528167 - RNA, 21 nt, Human
auuagccaggaucauggugua

SEQ ID NO: 2528168 - RNA, 15 nt, Human
auuagccaggaucau

SEQ ID NO: 2528169 - RNA, 14 nt, Human
auuagccaggauca

SEQ ID NO: 2528170 - RNA, 17 nt, Human
auuagccacaaaauugg

SEQ ID NO: 2528171 - RNA, 13 nt, Human
auuagccaggauc

SEQ ID NO: 2528172 - RNA, 14 nt, Human
auuagcauuuaguc

SEQ ID NO: 2528173 - RNA, 16 nt, Human
auuagccugaguagaa

SEQ ID NO: 2528174 - RNA, 14 nt, Human
auuagccugaguag

SEQ ID NO: 2528175 - RNA, 17 nt, Human
auuagccagugaaaaac

SEQ ID NO: 2528176 - RNA, 18 nt, Human
auuagccgggcauggugg

SEQ ID NO: 2528177 - RNA, 17 nt, Human
auuagccugaguagaaa

SEQ ID NO: 2528178 - RNA, 12 nt, Human
auuagcucugga

SEQ ID NO: 2528179 - RNA, 19 nt, Human
auuagcucacuuggugaua

SEQ ID NO: 2528180 - RNA, 13 nt, Human
auuagcucuggac

SEQ ID NO: 2528181 - RNA, 19 nt, Human
auucauagcagcuuauuca

SEQ ID NO: 2528182 - RNA, 22 nt, Human
auucauagcagcuuauucacaa

SEQ ID NO: 2528183 - RNA, 19 nt, Human
auucauaaugacuuaagca

SEQ ID NO: 2528184 - RNA, 21 nt, Human
auucauaauuauuauuuggcc

SEQ ID NO: 2528185 - RNA, 15 nt, Human
auucauaaugacuua

SEQ ID NO: 2528186 - RNA, 14 nt, Human
auucauaaugacuu

SEQ ID NO: 2528187 - RNA, 19 nt, Human
auucacaagacccaaaagg

SEQ ID NO: 2528188 - RNA, 18 nt, Human
auucaauuccucugggaa

SEQ ID NO: 2528189 - RNA, 17 nt, Human
auucaauuccucuggga

SEQ ID NO: 2528190 - RNA, 15 nt, Human
auucacaccugacuc

SEQ ID NO: 2528191 - RNA, 11 nt, Human
auucacacugu

SEQ ID NO: 2528192 - RNA, 13 nt, Human
auucaauuguaaa

SEQ ID NO: 2528193 - RNA, 14 nt, Human
auucaauuguaaau

SEQ ID NO: 2528194 - RNA, 13 nt, Human
auucacaauagaa

SEQ ID NO: 2528195 - RNA, 14 nt, Human
auucacaauagaaa

SEQ ID NO: 2528196 - RNA, 22 nt, Human
auucacaaugaaaugcucuccu

SEQ ID NO: 2528197 - RNA, 22 nt, Human
auucaaucuguaaacuguguau

SEQ ID NO: 2528198 - RNA, 23 nt, Human
auucaauguuuaugcaaggaagg

SEQ ID NO: 2528199 - RNA, 22 nt, Human
auucaauguuuaugcaaggaag

SEQ ID NO: 2528200 - RNA, 16 nt, Human
auucaauuccucuggg

SEQ ID NO: 2528201 - RNA, 14 nt, Human
auucaauuccucug

SEQ ID NO: 2528202 - RNA, 23 nt, Human
auuaugcaugaaguaauaugcac

SEQ ID NO: 2528203 - RNA, 17 nt, Human
auuaugcagaauacuuu

SEQ ID NO: 2528204 - RNA, 16 nt, Human
auuaugcagaauacuu

SEQ ID NO: 2528205 - RNA, 18 nt, Human
auuaugaauuacauuugu

SEQ ID NO: 2528206 - RNA, 12 nt, Human
auuaugacaguu

SEQ ID NO: 2528207 - RNA, 14 nt, Human
auuaugacaguuau

SEQ ID NO: 2528208 - RNA, 15 nt, Human
auuaugacaguuaua

SEQ ID NO: 2528209 - RNA, 16 nt, Human
auuaugacaguuauac

SEQ ID NO: 2528210 - RNA, 17 nt, Human
auuaugacaguuauacu

SEQ ID NO: 2528211 - RNA, 19 nt, Human
auuaugacaguuauacugu

SEQ ID NO: 2528212 - RNA, 16 nt, Human
auuaugaguuugcuua

SEQ ID NO: 2528213 - RNA, 20 nt, Human
auuaugagaggcaaugauug

SEQ ID NO: 2528214 - RNA, 21 nt, Human
auuaugaugugggucaaggaa

SEQ ID NO: 2528215 - RNA, 17 nt, Human
auuaugaauuacauuug

SEQ ID NO: 2528216 - RNA, 14 nt, Human
auuaugaauuacau

SEQ ID NO: 2528217 - RNA, 21 nt, Human
auuaggugugacugaauuucu

SEQ ID NO: 2528218 - RNA, 16 nt, Human
auuaggugugacugaa

SEQ ID NO: 2528219 - RNA, 18 nt, Human
auuaggugugacugaauu

SEQ ID NO: 2528220 - RNA, 19 nt, Human
auuagggcauuugagaaau

SEQ ID NO: 2528221 - RNA, 18 nt, Human
auuagggcauuugagaaa

SEQ ID NO: 2528222 - RNA, 17 nt, Human
auuagggagaaaauuca

SEQ ID NO: 2528223 - RNA, 18 nt, Human
auuagggagaaaauucaa

SEQ ID NO: 2528224 - RNA, 20 nt, Human
auuagggagaaaauucaauu

SEQ ID NO: 2528225 - RNA, 23 nt, Human
auuagggagaaaauucaauugua

SEQ ID NO: 2528226 - RNA, 15 nt, Human
auuagggguugcuaa

SEQ ID NO: 2528227 - RNA, 13 nt, Human
auuagguauuuug

SEQ ID NO: 2528228 - RNA, 22 nt, Human
auuagggguugcuaagaagcga

SEQ ID NO: 2528229 - RNA, 16 nt, Human
auuagggagagaagau

SEQ ID NO: 2528230 - RNA, 22 nt, Human
auuaggaaguguaacagcugag

SEQ ID NO: 2528231 - RNA, 13 nt, Human
auuaggaauaaau

SEQ ID NO: 2528232 - RNA, 16 nt, Human
auuaggaauaaauaaa

SEQ ID NO: 2528233 - RNA, 22 nt, Human
auuaggacaaucaguccccucc

SEQ ID NO: 2528234 - RNA, 21 nt, Human
auuaggaaguguaacagcuga

SEQ ID NO: 2528235 - RNA, 15 nt, Human
auuagcuuuacuguu

SEQ ID NO: 2528236 - RNA, 20 nt, Human
auuagcuuuacuguuuguua

SEQ ID NO: 2528237 - RNA, 15 nt, Human
auuaggaaaauaugg

SEQ ID NO: 2528238 - RNA, 20 nt, Human
auuaggaaguguaacagcug

SEQ ID NO: 2528239 - RNA, 16 nt, Human
auuagcugugugaaau

SEQ ID NO: 2528240 - RNA, 20 nt, Human
auuagcugguuggagagcua

SEQ ID NO: 2528241 - RNA, 18 nt, Human
auuguuggcacauccuau

SEQ ID NO: 2528242 - RNA, 21 nt, Human
auuguuguacacagaaauaca

SEQ ID NO: 2528243 - RNA, 20 nt, Human
auuguugguaauuauuuugg

SEQ ID NO: 2528244 - RNA, 12 nt, Human
auuguugcauua

SEQ ID NO: 2528245 - RNA, 22 nt, Human
auuguugagguggucugaaugu

SEQ ID NO: 2528246 - RNA, 23 nt, Human
auuguugagguggucugaauguu

SEQ ID NO: 2528247 - RNA, 22 nt, Human
auuguugacaguucugaagaau

SEQ ID NO: 2528248 - RNA, 21 nt, Human
auuguugacaguucugaagaa

SEQ ID NO: 2528249 - RNA, 16 nt, Human
auuguugagcuauugc

SEQ ID NO: 2528250 - RNA, 19 nt, Human
auuguugagcuauugcugu

SEQ ID NO: 2528251 - RNA, 20 nt, Human
auuguugagguggucugaau

SEQ ID NO: 2528252 - RNA, 21 nt, Human
auuguugagguggucugaaug

SEQ ID NO: 2528253 - RNA, 15 nt, Human
auuguuccaagacau

SEQ ID NO: 2528254 - RNA, 16 nt, Human
auuguuccaagacauu

SEQ ID NO: 2528255 - RNA, 17 nt, Human
auuguuccaagacauug

SEQ ID NO: 2528256 - RNA, 18 nt, Human
auuguuccaagacauugu

SEQ ID NO: 2528257 - RNA, 17 nt, Human
auuguugacaguucuga

SEQ ID NO: 2528258 - RNA, 18 nt, Human
auuguugacaguucugaa

SEQ ID NO: 2528259 - RNA, 20 nt, Human
auuguuccaagacauuguca

SEQ ID NO: 2528260 - RNA, 21 nt, Human
auugcugccacuuuuuaacua

SEQ ID NO: 2528261 - RNA, 14 nt, Human
auugcugccacuuu

SEQ ID NO: 2528262 - RNA, 20 nt, Human
auugcugccccaucagugcu

SEQ ID NO: 2528263 - RNA, 23 nt, Human
auugcugagccucugcuccccag

SEQ ID NO: 2528264 - RNA, 23 nt, Human
auugcugauggugcaaugaccuu

SEQ ID NO: 2528265 - RNA, 12 nt, Human
auugcugcuuga

SEQ ID NO: 2528266 - RNA, 21 nt, Human
auugcugccccaucagugcuc

SEQ ID NO: 2528267 - RNA, 15 nt, Human
auugcugcugguaau

SEQ ID NO: 2528268 - RNA, 19 nt, Human
auugcuggcaaagacagaa

SEQ ID NO: 2528269 - RNA, 20 nt, Human
auugcuggcaaagacagaag

SEQ ID NO: 2528270 - RNA, 22 nt, Human
auugcuucuucuccuaugugua

SEQ ID NO: 2528271 - RNA, 17 nt, Human
auugcuucuucuccuau

SEQ ID NO: 2528272 - RNA, 22 nt, Human
auugcugguucuauuuaaugga

SEQ ID NO: 2528273 - RNA, 21 nt, Human
auugcugguucuauuuaaugg

SEQ ID NO: 2528274 - RNA, 23 nt, Human
auugcugucaaguuccuuugggu

SEQ ID NO: 2528275 - RNA, 18 nt, Human
auugcuggcuggaaggga

SEQ ID NO: 2528276 - RNA, 22 nt, Human
auugcuggcaaagacagaagcc

SEQ ID NO: 2528277 - RNA, 14 nt, Human
auugcugguucuau

SEQ ID NO: 2528278 - RNA, 23 nt, Human
auugcuucuucuccuauguguaa

SEQ ID NO: 2528279 - RNA, 16 nt, Human
auugcuugaaagaaaa

SEQ ID NO: 2528280 - RNA, 17 nt, Human
auugcuugagcccagga

SEQ ID NO: 2528281 - RNA, 18 nt, Human
auugcuugagcccaggag

SEQ ID NO: 2528282 - RNA, 14 nt, Human
auugcuugagcuca

SEQ ID NO: 2528283 - RNA, 19 nt, Human
auugcugauggugcaauga

SEQ ID NO: 2528284 - RNA, 18 nt, Human
auugcugauggugcaaug

SEQ ID NO: 2528285 - RNA, 16 nt, Human
auugcugauggugcaa

SEQ ID NO: 2528286 - RNA, 15 nt, Human
auugcugauggugca

SEQ ID NO: 2528287 - RNA, 18 nt, Human
auugcugaaaaugguauu

SEQ ID NO: 2528288 - RNA, 16 nt, Human
auugcugaaaauggua

SEQ ID NO: 2528289 - RNA, 12 nt, Human
auugcugaaauu

SEQ ID NO: 2528290 - RNA, 12 nt, Human
auugcuccuuga

SEQ ID NO: 2528291 - RNA, 22 nt, Human
auugcugagagaaauauggaac

SEQ ID NO: 2528292 - RNA, 23 nt, Human
auugcugagagaaauauggaacu

SEQ ID NO: 2528293 - RNA, 14 nt, Human
auugcugagccucu

SEQ ID NO: 2528294 - RNA, 16 nt, Human
auugcugagccucugc

SEQ ID NO: 2528295 - RNA, 22 nt, Human
auugcugagccucugcucccca

SEQ ID NO: 2528296 - RNA, 13 nt, Human
auugcugaaauuu

SEQ ID NO: 2528297 - RNA, 16 nt, Human
auugcugaaauuuuau

SEQ ID NO: 2528298 - RNA, 21 nt, Human
auugcugagagaaauauggaa

SEQ ID NO: 2528299 - RNA, 13 nt, Human
auuguaaucacug

SEQ ID NO: 2528300 - RNA, 13 nt, Human
auuguaauguuac

SEQ ID NO: 2528301 - RNA, 15 nt, Human
auuguaauguuacug

SEQ ID NO: 2528302 - RNA, 17 nt, Human
auuguaauguuacugau

SEQ ID NO: 2528303 - RNA, 24 nt, Human
auuguaauguuacugaucaugcau

SEQ ID NO: 2528304 - RNA, 23 nt, Human
auuguaauaggcguaacuaauuu

SEQ ID NO: 2528305 - RNA, 14 nt, Human
auuguaaauaguau

SEQ ID NO: 2528306 - RNA, 12 nt, Human
auuguaaucacu

SEQ ID NO: 2528307 - RNA, 10 nt, Human
auuguaaaua

SEQ ID NO: 2528308 - RNA, 14 nt, Human
auuguaaaauggug

SEQ ID NO: 2528309 - RNA, 18 nt, Human
auugcuugagcucaggag

SEQ ID NO: 2528310 - RNA, 17 nt, Human
auuguaaaauuguauag

SEQ ID NO: 2528311 - RNA, 23 nt, Human
auugcuugaaagaaaauaugcau

SEQ ID NO: 2528312 - RNA, 16 nt, Human
auuguaaacauguguu

SEQ ID NO: 2528313 - RNA, 15 nt, Human
auuguaaacaugugu

SEQ ID NO: 2528314 - RNA, 15 nt, Human
auuguaaaauuguau

SEQ ID NO: 2528315 - RNA, 23 nt, Human
auugugucucuugguccugcugc

SEQ ID NO: 2528316 - RNA, 21 nt, Human
auugugucucuugguccugcu

SEQ ID NO: 2528317 - RNA, 14 nt, Human
auugugucugcagg

SEQ ID NO: 2528318 - RNA, 17 nt, Human
auugugucuuuugcaug

SEQ ID NO: 2528319 - RNA, 16 nt, Human
auugugucuuuugcau

SEQ ID NO: 2528320 - RNA, 15 nt, Human
auugugucuuuugca

SEQ ID NO: 2528321 - RNA, 13 nt, Human
auugugucuuuug

SEQ ID NO: 2528322 - RNA, 18 nt, Human
auugugucuuuugcauga

SEQ ID NO: 2528323 - RNA, 18 nt, Human
auuguucauuuugagcug

SEQ ID NO: 2528324 - RNA, 12 nt, Human
auuguucauuuu

SEQ ID NO: 2528325 - RNA, 18 nt, Human
auuguuccaaaugaaugu

SEQ ID NO: 2528326 - RNA, 20 nt, Human
auuguucauuuugagcugaa

SEQ ID NO: 2528327 - RNA, 12 nt, Human
auuguuccaaga

SEQ ID NO: 2528328 - RNA, 14 nt, Human
auuguuccaagaca

SEQ ID NO: 2528329 - RNA, 16 nt, Human
auuguuagucucuuga

SEQ ID NO: 2528330 - RNA, 13 nt, Human
auugugugauguu

SEQ ID NO: 2528331 - RNA, 12 nt, Human
auugugugaugu

SEQ ID NO: 2528332 - RNA, 21 nt, Human
auucuuucccaauucacaucu

SEQ ID NO: 2528333 - RNA, 13 nt, Human
auucuuuccugag

SEQ ID NO: 2528334 - RNA, 13 nt, Human
auucugaauguac

SEQ ID NO: 2528335 - RNA, 10 nt, Human
auucugaaug

SEQ ID NO: 2528336 - RNA, 20 nt, Human
auucugaccacccuucucau

SEQ ID NO: 2528337 - RNA, 13 nt, Human
auucuucugaacu

SEQ ID NO: 2528338 - RNA, 12 nt, Human
auucuucugcuu

SEQ ID NO: 2528339 - RNA, 11 nt, Human
auucuucugcu

SEQ ID NO: 2528340 - RNA, 16 nt, Human
auucugaaggagcccc

SEQ ID NO: 2528341 - RNA, 17 nt, Human
auucugaagccauuguc

SEQ ID NO: 2528342 - RNA, 15 nt, Human
auucugaaggagccc

SEQ ID NO: 2528343 - RNA, 16 nt, Human
auucugaacaauucuc

SEQ ID NO: 2528344 - RNA, 16 nt, Human
auucauaguaacuucu

SEQ ID NO: 2528345 - RNA, 17 nt, Human
auucauaguaacuucuu

SEQ ID NO: 2528346 - RNA, 18 nt, Human
auucauaguaacuucuua

SEQ ID NO: 2528347 - RNA, 14 nt, Human
auucucuuucaaag

SEQ ID NO: 2528348 - RNA, 11 nt, Human
auucuuuccug

SEQ ID NO: 2528349 - RNA, 13 nt, Human
auucuugaguuua

SEQ ID NO: 2528350 - RNA, 21 nt, Human
auucuucugaacucaaacuga

SEQ ID NO: 2528351 - RNA, 14 nt, Human
auucuucugccuca

SEQ ID NO: 2528352 - RNA, 14 nt, Human
auucuucugcuuca

SEQ ID NO: 2528353 - RNA, 15 nt, Human
auucuugaaggaaaa

SEQ ID NO: 2528354 - RNA, 22 nt, Human
auucuucuuccaacguggccca

SEQ ID NO: 2528355 - RNA, 18 nt, Human
auucuugaaggaaaauga

SEQ ID NO: 2528356 - RNA, 16 nt, Human
auucuugaaagcugug

SEQ ID NO: 2528357 - RNA, 21 nt, Human
auugaguauccuuucaguguu

SEQ ID NO: 2528358 - RNA, 23 nt, Human
auugagguguauggagagaaaac

SEQ ID NO: 2528359 - RNA, 15 nt, Human
auugagucaaauggu

SEQ ID NO: 2528360 - RNA, 21 nt, Human
auugauaagaaccuuuugagu

SEQ ID NO: 2528361 - RNA, 15 nt, Human
auugaguuuucagug

SEQ ID NO: 2528362 - RNA, 16 nt, Human
auugaguuuucagugg

SEQ ID NO: 2528363 - RNA, 19 nt, Human
auugauaacagcacugacu

SEQ ID NO: 2528364 - RNA, 16 nt, Human
auugauaauugcauuc

SEQ ID NO: 2528365 - RNA, 22 nt, Human
auugcuacuguccuacccaccc

SEQ ID NO: 2528366 - RNA, 20 nt, Human
auugcuacuguccuacccac

SEQ ID NO: 2528367 - RNA, 22 nt, Human
auugcuauguuuugacauuuuu

SEQ ID NO: 2528368 - RNA, 17 nt, Human
auugauaugaaaaauau

SEQ ID NO: 2528369 - RNA, 14 nt, Human
auugauaugaaaaa

SEQ ID NO: 2528370 - RNA, 15 nt, Human
auugauaugaaaaau

SEQ ID NO: 2528371 - RNA, 16 nt, Human
auugauaugaaaaaua

SEQ ID NO: 2528372 - RNA, 15 nt, Human
auugcuacuguccua

SEQ ID NO: 2528373 - RNA, 17 nt, Human
auugauaugcuuauaca

SEQ ID NO: 2528374 - RNA, 18 nt, Human
auugauagaguguuauca

SEQ ID NO: 2528375 - RNA, 18 nt, Human
auugauauaaauaaaaca

SEQ ID NO: 2528376 - RNA, 21 nt, Human
auugauauacacggaugacuu

SEQ ID NO: 2528377 - RNA, 19 nt, Human
auugauauaaauaaaacau

SEQ ID NO: 2528378 - RNA, 18 nt, Human
caaagauauuuugcuuug

SEQ ID NO: 2528379 - RNA, 20 nt, Human
caaagauauuuugcuuugug

SEQ ID NO: 2528380 - RNA, 23 nt, Human
auuuuuuuuuccuucagugccuu

SEQ ID NO: 2528381 - RNA, 19 nt, Human
auuuuuuuuucuaagagaa

SEQ ID NO: 2528382 - RNA, 18 nt, Human
auuuuuuuuucuaagaga

SEQ ID NO: 2528383 - RNA, 15 nt, Human
auuuuuuuuucuaag

SEQ ID NO: 2528384 - RNA, 14 nt, Human
auuuuuuuuucuaa

SEQ ID NO: 2528385 - RNA, 19 nt, Human
auuuuuuuuuuaaauuauu

SEQ ID NO: 2528386 - RNA, 20 nt, Human
caaaaaaaaaaaaaaauuag

SEQ ID NO: 2528387 - RNA, 20 nt, Human
caaaagaugcucuucugugg

SEQ ID NO: 2528388 - RNA, 19 nt, Human
caaaagaugcucuucugug

SEQ ID NO: 2528389 - RNA, 16 nt, Human
caaaagaugcuucuca

SEQ ID NO: 2528390 - RNA, 16 nt, Human
caaaagauugcugaaa

SEQ ID NO: 2528391 - RNA, 19 nt, Human
caaaagauugcugaaauuu

SEQ ID NO: 2528392 - RNA, 19 nt, Human
caaaaggaucuuuguggcc

SEQ ID NO: 2528393 - RNA, 20 nt, Human
caaaaggaucuuuguggcca

SEQ ID NO: 2528394 - RNA, 18 nt, Human
caaaagaugcuucucacu

SEQ ID NO: 2528395 - RNA, 15 nt, Human
caaaaggcagaagca

SEQ ID NO: 2528396 - RNA, 21 nt, Human
caaaaggaucuuuguggccaa

SEQ ID NO: 2528397 - RNA, 22 nt, Human
caaaaggaucuuuguggccaag

SEQ ID NO: 2528398 - RNA, 24 nt, Human
caaaaggaucuuuguggccaagga

SEQ ID NO: 2528399 - RNA, 16 nt, Human
caaaagggugucugag

SEQ ID NO: 2528400 - RNA, 13 nt, Human
caaacagccacac

SEQ ID NO: 2528401 - RNA, 19 nt, Human
caaaccaucauugaaaucu

SEQ ID NO: 2528402 - RNA, 21 nt, Human
caaaccaucauugaaaucuuu

SEQ ID NO: 2528403 - RNA, 19 nt, Human
caaacaguagguuggcagu

SEQ ID NO: 2528404 - RNA, 14 nt, Human
caaacaguagguug

SEQ ID NO: 2528405 - RNA, 15 nt, Human
caaauccuugaagau

SEQ ID NO: 2528406 - RNA, 21 nt, Human
caaauccuaugugauuuuaac

SEQ ID NO: 2528407 - RNA, 22 nt, Human
caaauccuaugugauuuuaacu

SEQ ID NO: 2528408 - RNA, 13 nt, Human
caaauccucucca

SEQ ID NO: 2528409 - RNA, 23 nt, Human
caaauccuaugugauuuuaacuc

SEQ ID NO: 2528410 - RNA, 20 nt, Human
caaauggaaaugggcagagc

SEQ ID NO: 2528411 - RNA, 13 nt, Human
caaauggaaagga

SEQ ID NO: 2528412 - RNA, 18 nt, Human
caaaugcuuggcuucuca

SEQ ID NO: 2528413 - RNA, 17 nt, Human
caaaugcuuggcuucuc

SEQ ID NO: 2528414 - RNA, 15 nt, Human
caaaugcuguauucu

SEQ ID NO: 2528415 - RNA, 21 nt, Human
caaauggaaaggagaggaaag

SEQ ID NO: 2528416 - RNA, 22 nt, Human
caaauggaaaugggcagagcag

SEQ ID NO: 2528417 - RNA, 21 nt, Human
caaauggaaaugggcagagca

SEQ ID NO: 2528418 - RNA, 14 nt, Human
caacaagaguuuau

SEQ ID NO: 2528419 - RNA, 14 nt, Human
caacaagggagaga

SEQ ID NO: 2528420 - RNA, 15 nt, Human
caacaagaguuuauu

SEQ ID NO: 2528421 - RNA, 14 nt, Human
caaauggaaaggag

SEQ ID NO: 2528422 - RNA, 14 nt, Human
caacaagagcgaaa

SEQ ID NO: 2528423 - RNA, 16 nt, Human
caacaauaaaauagca

SEQ ID NO: 2528424 - RNA, 13 nt, Human
caacaaguaacuu

SEQ ID NO: 2528425 - RNA, 18 nt, Human
caacaagggagagaccuc

SEQ ID NO: 2528426 - RNA, 15 nt, Human
caacaagggagagac

SEQ ID NO: 2528427 - RNA, 21 nt, Human
caacaagggagagaccucauc

SEQ ID NO: 2528428 - RNA, 14 nt, Human
caacaccagccccu

SEQ ID NO: 2528429 - RNA, 13 nt, Human
caacaccagcccc

SEQ ID NO: 2528430 - RNA, 20 nt, Human
caacaccacagacacacaca

SEQ ID NO: 2528431 - RNA, 19 nt, Human
caacaccacagacacacac

SEQ ID NO: 2528432 - RNA, 18 nt, Human
caacaccacagacacaca

SEQ ID NO: 2528433 - RNA, 17 nt, Human
caacaccacagacacac

SEQ ID NO: 2528434 - RNA, 16 nt, Human
caacaccacagacaca

SEQ ID NO: 2528435 - RNA, 15 nt, Human
caacaccacagacac

SEQ ID NO: 2528436 - RNA, 15 nt, Human
caacaccaagcacag

SEQ ID NO: 2528437 - RNA, 22 nt, Human
caacaccaagcacagcagccug

SEQ ID NO: 2528438 - RNA, 14 nt, Human
caacaccacagaca

SEQ ID NO: 2528439 - RNA, 13 nt, Human
caacaccacagac

SEQ ID NO: 2528440 - RNA, 12 nt, Human
caacaccacaga

SEQ ID NO: 2528441 - RNA, 13 nt, Human
caacaauaacacu

SEQ ID NO: 2528442 - RNA, 17 nt, Human
caacaaucccaaggccc

SEQ ID NO: 2528443 - RNA, 22 nt, Human
caacaauacaugcugcuaauuc

SEQ ID NO: 2528444 - RNA, 13 nt, Human
caacaauaaaaua

SEQ ID NO: 2528445 - RNA, 15 nt, Human
caacaauccuagugc

SEQ ID NO: 2528446 - RNA, 17 nt, Human
caacaauccuagugcuu

SEQ ID NO: 2528447 - RNA, 18 nt, Human
caacaauccuagugcuuu

SEQ ID NO: 2528448 - RNA, 23 nt, Human
caacacgagcaggcuacugucag

SEQ ID NO: 2528449 - RNA, 15 nt, Human
caacacgcaccugcc

SEQ ID NO: 2528450 - RNA, 17 nt, Human
caacacgcaccugccuc

SEQ ID NO: 2528451 - RNA, 22 nt, Human
caacaccagccccugccccagc

SEQ ID NO: 2528452 - RNA, 18 nt, Human
caacaccagccccugccc

SEQ ID NO: 2528453 - RNA, 17 nt, Human
caacaccagccccugcc

SEQ ID NO: 2528454 - RNA, 16 nt, Human
caacacccaucuguuu

SEQ ID NO: 2528455 - RNA, 20 nt, Human
caacaccucugcacaagcug

SEQ ID NO: 2528456 - RNA, 14 nt, Human
caacacuaacauga

SEQ ID NO: 2528457 - RNA, 19 nt, Human
caacacgcaccugccucag

SEQ ID NO: 2528458 - RNA, 15 nt, Human
caaauccuaugugau

SEQ ID NO: 2528459 - RNA, 16 nt, Human
caaauccuaugugauu

SEQ ID NO: 2528460 - RNA, 17 nt, Human
caaauccuaugugauuu

SEQ ID NO: 2528461 - RNA, 18 nt, Human
caaauccuaugugauuuu

SEQ ID NO: 2528462 - RNA, 21 nt, Human
caaauccgaaccuccucugug

SEQ ID NO: 2528463 - RNA, 13 nt, Human
caaauccuaugug

SEQ ID NO: 2528464 - RNA, 16 nt, Human
caaauccgaaccuccu

SEQ ID NO: 2528465 - RNA, 22 nt, Human
caaauccgaaccuccucuguga

SEQ ID NO: 2528466 - RNA, 16 nt, Human
caaauccauccagaau

SEQ ID NO: 2528467 - RNA, 22 nt, Human
caaagucuuaaaauaacuuaua

SEQ ID NO: 2528468 - RNA, 20 nt, Human
caaagucuuaaaauaacuua

SEQ ID NO: 2528469 - RNA, 14 nt, Human
caaagucuguguga

SEQ ID NO: 2528470 - RNA, 20 nt, Human
caaagucugauuugugauga

SEQ ID NO: 2528471 - RNA, 13 nt, Human
caaagucugugug

SEQ ID NO: 2528472 - RNA, 16 nt, Human
caaagugccacucauu

SEQ ID NO: 2528473 - RNA, 22 nt, Human
caaagugccacucauuccugua

SEQ ID NO: 2528474 - RNA, 21 nt, Human
caaagucucuggaauuugaaa

SEQ ID NO: 2528475 - RNA, 14 nt, Human
caaaguagaagucu

SEQ ID NO: 2528476 - RNA, 21 nt, Human
caaaguagaagucuuagaugu

SEQ ID NO: 2528477 - RNA, 22 nt, Human
caaaguacacuguuucaaacuu

SEQ ID NO: 2528478 - RNA, 18 nt, Human
caaaguaaaacuugcugc

SEQ ID NO: 2528479 - RNA, 15 nt, Human
caaagguugagaugu

SEQ ID NO: 2528480 - RNA, 11 nt, Human
caaagguuuuc

SEQ ID NO: 2528481 - RNA, 19 nt, Human
caaagguuuuccucuucua

SEQ ID NO: 2528482 - RNA, 16 nt, Human
caaaguaaaacuugcu

SEQ ID NO: 2528483 - RNA, 17 nt, Human
caaagcagugcaugcug

SEQ ID NO: 2528484 - RNA, 15 nt, Human
caaagcagugcaugc

SEQ ID NO: 2528485 - RNA, 13 nt, Human
caaagguggcucu

SEQ ID NO: 2528486 - RNA, 19 nt, Human
caaaggugaaggaauauau

SEQ ID NO: 2528487 - RNA, 14 nt, Human
caaagguggcucuc

SEQ ID NO: 2528488 - RNA, 18 nt, Human
caaaggugaaggaauaua

SEQ ID NO: 2528489 - RNA, 16 nt, Human
caaaggugaaggaaua

SEQ ID NO: 2528490 - RNA, 13 nt, Human
caaaggugaagga

SEQ ID NO: 2528491 - RNA, 15 nt, Human
caaagcagggucugg

SEQ ID NO: 2528492 - RNA, 14 nt, Human
caaagguauaauuu

SEQ ID NO: 2528493 - RNA, 20 nt, Human
caaagcacugacuucuaagu

SEQ ID NO: 2528494 - RNA, 22 nt, Human
caaagcacugacuucuaaguaa

SEQ ID NO: 2528495 - RNA, 19 nt, Human
caaagcaccaaaauaagaa

SEQ ID NO: 2528496 - RNA, 21 nt, Human
caaagcaccaaaauaagaaaa

SEQ ID NO: 2528497 - RNA, 22 nt, Human
caaagcaccaaaauaagaaaag

SEQ ID NO: 2528498 - RNA, 24 nt, Human
caaagcaccaaaauaagaaaagau

SEQ ID NO: 2528499 - RNA, 17 nt, Human
caaagcaccaaaauaag

SEQ ID NO: 2528500 - RNA, 18 nt, Human
caaagcaccaaaauaaga

SEQ ID NO: 2528501 - RNA, 16 nt, Human
caaagcacaguuugaa

SEQ ID NO: 2528502 - RNA, 22 nt, Human
caaagcacaguguuaaaugaaa

SEQ ID NO: 2528503 - RNA, 17 nt, Human
caaagcacaguuugaac

SEQ ID NO: 2528504 - RNA, 17 nt, Human
caaagcacauugaaaga

SEQ ID NO: 2528505 - RNA, 12 nt, Human
caaagcagccac

SEQ ID NO: 2528506 - RNA, 13 nt, Human
caaagcagccacg

SEQ ID NO: 2528507 - RNA, 22 nt, Human
caaagcaggggaguaugcaaaa

SEQ ID NO: 2528508 - RNA, 21 nt, Human
caaagcaggggaguaugcaaa

SEQ ID NO: 2528509 - RNA, 18 nt, Human
caaagcaggggaguaugc

SEQ ID NO: 2528510 - RNA, 16 nt, Human
caaagcagacagcucc

SEQ ID NO: 2528511 - RNA, 17 nt, Human
caaagcagacagcucca

SEQ ID NO: 2528512 - RNA, 19 nt, Human
caaagcagacagcuccacc

SEQ ID NO: 2528513 - RNA, 23 nt, Human
caaagcacuuggacucuugcucu

SEQ ID NO: 2528514 - RNA, 22 nt, Human
caaagcacuuggacucuugcuc

SEQ ID NO: 2528515 - RNA, 12 nt, Human
caaagcagacag

SEQ ID NO: 2528516 - RNA, 13 nt, Human
caaagcagacagc

SEQ ID NO: 2528517 - RNA, 15 nt, Human
caaagcagacagcuc

SEQ ID NO: 2528518 - RNA, 21 nt, Human
caaagcacuuggacucuugcu

SEQ ID NO: 2528519 - RNA, 21 nt, Human
caaagcaccagcuucuccagg

SEQ ID NO: 2528520 - RNA, 22 nt, Human
caaagcacgaaauguuauuuuu

SEQ ID NO: 2528521 - RNA, 20 nt, Human
caaagcacgaaauguuauuu

SEQ ID NO: 2528522 - RNA, 12 nt, Human
caaagcaccagc

SEQ ID NO: 2528523 - RNA, 18 nt, Human
caaagcacauugaaagag

SEQ ID NO: 2528524 - RNA, 19 nt, Human
caaagcacaguguuaaaug

SEQ ID NO: 2528525 - RNA, 15 nt, Human
caaagcacaguguua

SEQ ID NO: 2528526 - RNA, 14 nt, Human
caaagcacaguguu

SEQ ID NO: 2528527 - RNA, 13 nt, Human
caaagcacagugu

SEQ ID NO: 2528528 - RNA, 16 nt, Human
caaagcaauaauagua

SEQ ID NO: 2528529 - RNA, 14 nt, Human
caaagcaauaauag

SEQ ID NO: 2528530 - RNA, 15 nt, Human
caaagcaaugcauuu

SEQ ID NO: 2528531 - RNA, 18 nt, Human
caaagcaaugcauuuugg

SEQ ID NO: 2528532 - RNA, 13 nt, Human
caaagcaaggaaa

SEQ ID NO: 2528533 - RNA, 15 nt, Human
caaagcaaggaaacu

SEQ ID NO: 2528534 - RNA, 21 nt, Human
caaagauucaaaauugacauu

SEQ ID NO: 2528535 - RNA, 17 nt, Human
caaagauucaaaauuga

SEQ ID NO: 2528536 - RNA, 22 nt, Human
caaagauguuugucagauauga

SEQ ID NO: 2528537 - RNA, 22 nt, Human
caaagauauuuugcuuugugau

SEQ ID NO: 2528538 - RNA, 23 nt, Human
caaagauauuuugcuuugugauu

SEQ ID NO: 2528539 - RNA, 13 nt, Human
caaagaucaaaau

SEQ ID NO: 2528540 - RNA, 16 nt, Human
caaagauguuugucag

SEQ ID NO: 2528541 - RNA, 18 nt, Human
caaagauguuugucagau

SEQ ID NO: 2528542 - RNA, 16 nt, Human
auuugccaauaauaau

SEQ ID NO: 2528543 - RNA, 15 nt, Human
auuugcccuccuccu

SEQ ID NO: 2528544 - RNA, 24 nt, Human
auuugccaugggcuucacuguaua

SEQ ID NO: 2528545 - RNA, 19 nt, Human
auuugccaugggcuucacu

SEQ ID NO: 2528546 - RNA, 15 nt, Human
auuugccaugggcuu

SEQ ID NO: 2528547 - RNA, 16 nt, Human
auuugcauugaacaca

SEQ ID NO: 2528548 - RNA, 21 nt, Human
auuugcauugaacacaaacug

SEQ ID NO: 2528549 - RNA, 22 nt, Human
auuugcauugaacacaaacugu

SEQ ID NO: 2528550 - RNA, 15 nt, Human
auuugccaauaauaa

SEQ ID NO: 2528551 - RNA, 16 nt, Human
auuugcuaugagcugg

SEQ ID NO: 2528552 - RNA, 20 nt, Human
auuugcuaugagcuggggau

SEQ ID NO: 2528553 - RNA, 15 nt, Human
auuugccugugccac

SEQ ID NO: 2528554 - RNA, 22 nt, Human
auuugccuauucccacaccucc

SEQ ID NO: 2528555 - RNA, 14 nt, Human
auuugcccucccau

SEQ ID NO: 2528556 - RNA, 21 nt, Human
auuugccuguuucugcuugcu

SEQ ID NO: 2528557 - RNA, 15 nt, Human
auuugccuugcugga

SEQ ID NO: 2528558 - RNA, 15 nt, Human
auuugcgaaugguuc

SEQ ID NO: 2528559 - RNA, 17 nt, Human
auuugauuucuauucaa

SEQ ID NO: 2528560 - RNA, 13 nt, Human
auuugauuucuau

SEQ ID NO: 2528561 - RNA, 20 nt, Human
auuugauguuuacaggugga

SEQ ID NO: 2528562 - RNA, 13 nt, Human
auuugauugauuu

SEQ ID NO: 2528563 - RNA, 16 nt, Human
auuugauugauuugaa

SEQ ID NO: 2528564 - RNA, 23 nt, Human
auuugauucuguguguuuucaua

SEQ ID NO: 2528565 - RNA, 19 nt, Human
auuugcaagucauggcugu

SEQ ID NO: 2528566 - RNA, 18 nt, Human
auuugcaagucauggcug

SEQ ID NO: 2528567 - RNA, 22 nt, Human
auuugcagcugagagaaaauaa

SEQ ID NO: 2528568 - RNA, 15 nt, Human
auuugcaagggaaaa

SEQ ID NO: 2528569 - RNA, 20 nt, Human
auuugcaagggaaaagucuc

SEQ ID NO: 2528570 - RNA, 21 nt, Human
auuugcauaacaauuccucua

SEQ ID NO: 2528571 - RNA, 22 nt, Human
auuugcauaacaauuccucuac

SEQ ID NO: 2528572 - RNA, 21 nt, Human
auuugcagcugagagaaaaua

SEQ ID NO: 2528573 - RNA, 18 nt, Human
auuugcauuaaauucaca

SEQ ID NO: 2528574 - RNA, 19 nt, Human
auuugcauuaaauucacaa

SEQ ID NO: 2528575 - RNA, 23 nt, Human
auuugcauuaaauucacaaacuu

SEQ ID NO: 2528576 - RNA, 17 nt, Human
auuugcauauguaugac

SEQ ID NO: 2528577 - RNA, 22 nt, Human
auuugcauggcuccagaaaugu

SEQ ID NO: 2528578 - RNA, 21 nt, Human
auuugcauggcuccagaaaug

SEQ ID NO: 2528579 - RNA, 15 nt, Human
auuugcauauguaug

SEQ ID NO: 2528580 - RNA, 16 nt, Human
auuuuaugcaaauauu

SEQ ID NO: 2528581 - RNA, 17 nt, Human
auuuuaugcuuuaaaca

SEQ ID NO: 2528582 - RNA, 12 nt, Human
auuuuaugcuuu

SEQ ID NO: 2528583 - RNA, 21 nt, Human
auuuuaugccuuuuauuucuu

SEQ ID NO: 2528584 - RNA, 14 nt, Human
auuuuaugcaaaua

SEQ ID NO: 2528585 - RNA, 23 nt, Human
auuuuaucuuugauucuccuuca

SEQ ID NO: 2528586 - RNA, 20 nt, Human
auuuuaugccuuuuauuucu

SEQ ID NO: 2528587 - RNA, 17 nt, Human
auuugcucauggaauug

SEQ ID NO: 2528588 - RNA, 14 nt, Human
auuugcucauggaa

SEQ ID NO: 2528589 - RNA, 13 nt, Human
auuugcuccuuuc

SEQ ID NO: 2528590 - RNA, 11 nt, Human
auuugcuuuuu

SEQ ID NO: 2528591 - RNA, 18 nt, Human
auuugcuuuuucaccaga

SEQ ID NO: 2528592 - RNA, 13 nt, Human
auuugcuggggaa

SEQ ID NO: 2528593 - RNA, 23 nt, Human
auuugcugggcuuuuuuuuucuc

SEQ ID NO: 2528594 - RNA, 18 nt, Human
auuugcugggcaguuuuu

SEQ ID NO: 2528595 - RNA, 12 nt, Human
auuuggaaaaua

SEQ ID NO: 2528596 - RNA, 13 nt, Human
auuuggaaaauaa

SEQ ID NO: 2528597 - RNA, 15 nt, Human
auuugugauacaaug

SEQ ID NO: 2528598 - RNA, 17 nt, Human
auuugugauacaaugcu

SEQ ID NO: 2528599 - RNA, 15 nt, Human
auuugugauagcacu

SEQ ID NO: 2528600 - RNA, 17 nt, Human
auuugugauagcacuuu

SEQ ID NO: 2528601 - RNA, 20 nt, Human
auuugugauacaaugcugug

SEQ ID NO: 2528602 - RNA, 18 nt, Human
auuugugauagcacuuuc

SEQ ID NO: 2528603 - RNA, 21 nt, Human
auuugugaugacaacuggaau

SEQ ID NO: 2528604 - RNA, 14 nt, Human
auuugugccagaau

SEQ ID NO: 2528605 - RNA, 22 nt, Human
auuuguuugaacugauaaagau

SEQ ID NO: 2528606 - RNA, 23 nt, Human
auuuguuugaacugauaaagaug

SEQ ID NO: 2528607 - RNA, 13 nt, Human
auuuguuuaaaag

SEQ ID NO: 2528608 - RNA, 14 nt, Human
auuuguuuaaaagg

SEQ ID NO: 2528609 - RNA, 15 nt, Human
auuuguuggaaugaa

SEQ ID NO: 2528610 - RNA, 12 nt, Human
auuuguuuaaaa

SEQ ID NO: 2528611 - RNA, 16 nt, Human
auuuguuuaaaaggau

SEQ ID NO: 2528612 - RNA, 15 nt, Human
auuuguuuaaaagga

SEQ ID NO: 2528613 - RNA, 13 nt, Human
auuuguuggaaug

SEQ ID NO: 2528614 - RNA, 14 nt, Human
auuuguuggaauga

SEQ ID NO: 2528615 - RNA, 11 nt, Human
auuuguugcau

SEQ ID NO: 2528616 - RNA, 20 nt, Human
auuuguugaaauuauguaug

SEQ ID NO: 2528617 - RNA, 18 nt, Human
auuuguugaaauuaugua

SEQ ID NO: 2528618 - RNA, 21 nt, Human
auuuguguaauagaaaacuga

SEQ ID NO: 2528619 - RNA, 22 nt, Human
auuuguguauuuaacagggagg

SEQ ID NO: 2528620 - RNA, 12 nt, Human
auuuguggaaua

SEQ ID NO: 2528621 - RNA, 11 nt, Human
auuuguggaau

SEQ ID NO: 2528622 - RNA, 22 nt, Human
auuuguggggagggauuugggg

SEQ ID NO: 2528623 - RNA, 13 nt, Human
auuuguguaauag

SEQ ID NO: 2528624 - RNA, 14 nt, Human
auuuguguauuuaa

SEQ ID NO: 2528625 - RNA, 17 nt, Human
auuuuauagcuacuaau

SEQ ID NO: 2528626 - RNA, 21 nt, Human
auuuuaugaaagguuuacauu

SEQ ID NO: 2528627 - RNA, 14 nt, Human
auuuguuuucaugg

SEQ ID NO: 2528628 - RNA, 18 nt, Human
auuuuauagcucaguuua

SEQ ID NO: 2528629 - RNA, 19 nt, Human
auuuuauagcucaguuuau

SEQ ID NO: 2528630 - RNA, 22 nt, Human
auuuuauagcucaguuuaucca

SEQ ID NO: 2528631 - RNA, 16 nt, Human
auuuuaugaaugucuu

SEQ ID NO: 2528632 - RNA, 19 nt, Human
auuuuauagcuacuaauuu

SEQ ID NO: 2528633 - RNA, 20 nt, Human
auuuguuugaacugauaaag

SEQ ID NO: 2528634 - RNA, 12 nt, Human
auuuguuugcau

SEQ ID NO: 2528635 - RNA, 15 nt, Human
auuuguuugugcuuc

SEQ ID NO: 2528636 - RNA, 17 nt, Human
auuuguuugugcuucua

SEQ ID NO: 2528637 - RNA, 16 nt, Human
auuuguuugugcuucu

SEQ ID NO: 2528638 - RNA, 18 nt, Human
auuuguuugugcuucuaa

SEQ ID NO: 2528639 - RNA, 13 nt, Human
caccccacccucc

SEQ ID NO: 2528640 - RNA, 22 nt, Human
caccccacccccuucagugccc

SEQ ID NO: 2528641 - RNA, 20 nt, Human
caccccacccucccuggagu

SEQ ID NO: 2528642 - RNA, 19 nt, Human
caccccacccucccuggag

SEQ ID NO: 2528643 - RNA, 15 nt, Human
caccccacccucccu

SEQ ID NO: 2528644 - RNA, 14 nt, Human
caccccacccuucc

SEQ ID NO: 2528645 - RNA, 19 nt, Human
caccccacuuaucccucuc

SEQ ID NO: 2528646 - RNA, 22 nt, Human
caccccacugcaauccugucuu

SEQ ID NO: 2528647 - RNA, 11 nt, Human
caccccagccc

SEQ ID NO: 2528648 - RNA, 24 nt, Human
caccccacuuaucccucuccauaa

SEQ ID NO: 2528649 - RNA, 24 nt, Human
caccugccuguugggccaggagcc

SEQ ID NO: 2528650 - RNA, 19 nt, Human
caccugccuguugggccag

SEQ ID NO: 2528651 - RNA, 13 nt, Human
caccugccucagg

SEQ ID NO: 2528652 - RNA, 14 nt, Human
caccugccucagga

SEQ ID NO: 2528653 - RNA, 20 nt, Human
caccugccucaggacugcga

SEQ ID NO: 2528654 - RNA, 17 nt, Human
caccugccuguugggcc

SEQ ID NO: 2528655 - RNA, 13 nt, Human
caccuuggcugca

SEQ ID NO: 2528656 - RNA, 15 nt, Human
caccuuggcucaagu

SEQ ID NO: 2528657 - RNA, 14 nt, Human
caccuuggcucaag

SEQ ID NO: 2528658 - RNA, 14 nt, Human
caccuuggcugcag

SEQ ID NO: 2528659 - RNA, 16 nt, Human
cacccuccccucucuu

SEQ ID NO: 2528660 - RNA, 15 nt, Human
cacccuccccucucu

SEQ ID NO: 2528661 - RNA, 13 nt, Human
cacccuccccucu

SEQ ID NO: 2528662 - RNA, 14 nt, Human
cacccuccccuccc

SEQ ID NO: 2528663 - RNA, 13 nt, Human
cacccuccccucc

SEQ ID NO: 2528664 - RNA, 12 nt, Human
cacccuccccuc

SEQ ID NO: 2528665 - RNA, 11 nt, Human
cacccuccccu

SEQ ID NO: 2528666 - RNA, 22 nt, Human
cacccucccagaccugccucuu

SEQ ID NO: 2528667 - RNA, 19 nt, Human
cacccuccccucucuugca

SEQ ID NO: 2528668 - RNA, 17 nt, Human
cacccuccccucucuug

SEQ ID NO: 2528669 - RNA, 23 nt, Human
cacccuccccucucuugcacccg

SEQ ID NO: 2528670 - RNA, 13 nt, Human
cacccucccugga

SEQ ID NO: 2528671 - RNA, 23 nt, Human
cacccucccuccgauccuuccuc

SEQ ID NO: 2528672 - RNA, 22 nt, Human
cacccucccuccgauccuuccu

SEQ ID NO: 2528673 - RNA, 17 nt, Human
cacccuccacccugucc

SEQ ID NO: 2528674 - RNA, 16 nt, Human
cacccuccacccuguc

SEQ ID NO: 2528675 - RNA, 14 nt, Human
cacccuccacccug

SEQ ID NO: 2528676 - RNA, 13 nt, Human
cacccuccacccu

SEQ ID NO: 2528677 - RNA, 12 nt, Human
cacccuccaccc

SEQ ID NO: 2528678 - RNA, 22 nt, Human
cacccucagcaccccuuccaug

SEQ ID NO: 2528679 - RNA, 17 nt, Human
cacccucauucuacuga

SEQ ID NO: 2528680 - RNA, 17 nt, Human
cacccuccaccucuuca

SEQ ID NO: 2528681 - RNA, 14 nt, Human
cacccuccaccucu

SEQ ID NO: 2528682 - RNA, 18 nt, Human
cacccuccacccuguccc

SEQ ID NO: 2528683 - RNA, 19 nt, Human
cacccucccagaccugccu

SEQ ID NO: 2528684 - RNA, 20 nt, Human
cacccucccccgccacuccu

SEQ ID NO: 2528685 - RNA, 21 nt, Human
cacccucagcaccccuuccau

SEQ ID NO: 2528686 - RNA, 20 nt, Human
cacccucagcaccccuucca

SEQ ID NO: 2528687 - RNA, 19 nt, Human
cacccucagcaccccuucc

SEQ ID NO: 2528688 - RNA, 13 nt, Human
cacccucaugcug

SEQ ID NO: 2528689 - RNA, 14 nt, Human
cacccucaugcugu

SEQ ID NO: 2528690 - RNA, 16 nt, Human
cacccucaugcugugu

SEQ ID NO: 2528691 - RNA, 21 nt, Human
cacccucaugcugugugacuc

SEQ ID NO: 2528692 - RNA, 14 nt, Human
cacccucaggcagg

SEQ ID NO: 2528693 - RNA, 16 nt, Human
cacccuggggagaaag

SEQ ID NO: 2528694 - RNA, 15 nt, Human
cacccuggggagaaa

SEQ ID NO: 2528695 - RNA, 12 nt, Human
cacccugggcuc

SEQ ID NO: 2528696 - RNA, 18 nt, Human
cacccugaaugguuccau

SEQ ID NO: 2528697 - RNA, 23 nt, Human
cacccugggcccugggcuggaau

SEQ ID NO: 2528698 - RNA, 17 nt, Human
cacccugaaagcccuga

SEQ ID NO: 2528699 - RNA, 16 nt, Human
cacccuccugucuucc

SEQ ID NO: 2528700 - RNA, 14 nt, Human
cacccuccugucuu

SEQ ID NO: 2528701 - RNA, 15 nt, Human
cacccucccuggagu

SEQ ID NO: 2528702 - RNA, 14 nt, Human
cacccucccuggag

SEQ ID NO: 2528703 - RNA, 16 nt, Human
cacccucccuggagug

SEQ ID NO: 2528704 - RNA, 18 nt, Human
cacccuccugucuuccca

SEQ ID NO: 2528705 - RNA, 17 nt, Human
cacccuccugucuuccc

SEQ ID NO: 2528706 - RNA, 16 nt, Human
cacccucuaaauggga

SEQ ID NO: 2528707 - RNA, 22 nt, Human
cacccucugagcuuugcauguu

SEQ ID NO: 2528708 - RNA, 14 nt, Human
cacccucuauccca

SEQ ID NO: 2528709 - RNA, 16 nt, Human
cacccucuaucccaau

SEQ ID NO: 2528710 - RNA, 15 nt, Human
cacccucucccagga

SEQ ID NO: 2528711 - RNA, 18 nt, Human
cacccucugagcuuugca

SEQ ID NO: 2528712 - RNA, 13 nt, Human
cacccucugagcu

SEQ ID NO: 2528713 - RNA, 12 nt, Human
cacccucugagc

SEQ ID NO: 2528714 - RNA, 16 nt, Human
cacccucucccaggac

SEQ ID NO: 2528715 - RNA, 16 nt, Human
caccugccccucaacu

SEQ ID NO: 2528716 - RNA, 15 nt, Human
caccugccccucaac

SEQ ID NO: 2528717 - RNA, 14 nt, Human
caccugccccucaa

SEQ ID NO: 2528718 - RNA, 12 nt, Human
caccucagccuu

SEQ ID NO: 2528719 - RNA, 13 nt, Human
caccucagccuug

SEQ ID NO: 2528720 - RNA, 15 nt, Human
caccucaggccaggu

SEQ ID NO: 2528721 - RNA, 15 nt, Human
caccucagccuugga

SEQ ID NO: 2528722 - RNA, 15 nt, Human
caccugcccccuucu

SEQ ID NO: 2528723 - RNA, 17 nt, Human
caccugcccccuucucc

SEQ ID NO: 2528724 - RNA, 19 nt, Human
caccugcccccuucuccca

SEQ ID NO: 2528725 - RNA, 20 nt, Human
caccugcccccuucucccac

SEQ ID NO: 2528726 - RNA, 21 nt, Human
caccugcccccuucucccaca

SEQ ID NO: 2528727 - RNA, 22 nt, Human
caccugcccccuucucccacac

SEQ ID NO: 2528728 - RNA, 13 nt, Human
caccugccgaccu

SEQ ID NO: 2528729 - RNA, 23 nt, Human
caccugcccccuucucccacacu

SEQ ID NO: 2528730 - RNA, 21 nt, Human
caccugccgaccucguccucc

SEQ ID NO: 2528731 - RNA, 24 nt, Human
caccugccguggacuuggggucag

SEQ ID NO: 2528732 - RNA, 23 nt, Human
caccugccgaccucguccucccc

SEQ ID NO: 2528733 - RNA, 23 nt, Human
caccugccucggccucccaaagu

SEQ ID NO: 2528734 - RNA, 17 nt, Human
cacccugggcucugugg

SEQ ID NO: 2528735 - RNA, 16 nt, Human
cacccugggcucugug

SEQ ID NO: 2528736 - RNA, 15 nt, Human
cacccugggcucugu

SEQ ID NO: 2528737 - RNA, 21 nt, Human
cacccugggcucugggagcag

SEQ ID NO: 2528738 - RNA, 17 nt, Human
caccuaauccaggcaga

SEQ ID NO: 2528739 - RNA, 21 nt, Human
cacccugggcucugugggcug

SEQ ID NO: 2528740 - RNA, 19 nt, Human
cacccugggcucugugggc

SEQ ID NO: 2528741 - RNA, 20 nt, Human
caccuaauccaggcagaucc

SEQ ID NO: 2528742 - RNA, 21 nt, Human
caccuaauccaggcagaucca

SEQ ID NO: 2528743 - RNA, 22 nt, Human
caccuaauccaggcagauccag

SEQ ID NO: 2528744 - RNA, 17 nt, Human
caccuacaguguacagu

SEQ ID NO: 2528745 - RNA, 16 nt, Human
caccuacaguguacag

SEQ ID NO: 2528746 - RNA, 22 nt, Human
cacccugggcucugugggcugc

SEQ ID NO: 2528747 - RNA, 14 nt, Human
caccuaauguuuau

SEQ ID NO: 2528748 - RNA, 20 nt, Human
caccuaauguuuaugagcca

SEQ ID NO: 2528749 - RNA, 21 nt, Human
caccuaauguuuaugagccag

SEQ ID NO: 2528750 - RNA, 13 nt, Human
caccuacagugua

SEQ ID NO: 2528751 - RNA, 18 nt, Human
caccucagccuccugugu

SEQ ID NO: 2528752 - RNA, 14 nt, Human
caccucagccuccc

SEQ ID NO: 2528753 - RNA, 13 nt, Human
caccucagccucc

SEQ ID NO: 2528754 - RNA, 20 nt, Human
caccuacaguguacagucuu

SEQ ID NO: 2528755 - RNA, 12 nt, Human
cacucuuuguaa

SEQ ID NO: 2528756 - RNA, 15 nt, Human
cacucuuuugcuuua

SEQ ID NO: 2528757 - RNA, 23 nt, Human
cacucuuuugcuuuauuccagaa

SEQ ID NO: 2528758 - RNA, 15 nt, Human
cacucuuuguaagag

SEQ ID NO: 2528759 - RNA, 21 nt, Human
cacucuuggagccugcagagc

SEQ ID NO: 2528760 - RNA, 22 nt, Human
cacucuuggagccugcagagcu

SEQ ID NO: 2528761 - RNA, 23 nt, Human
cacucuuggagccugcagagcug

SEQ ID NO: 2528762 - RNA, 22 nt, Human
cacucuuguggauguuuuaauu

SEQ ID NO: 2528763 - RNA, 13 nt, Human
cacuccccugcug

SEQ ID NO: 2528764 - RNA, 12 nt, Human
cacuccccugcu

SEQ ID NO: 2528765 - RNA, 14 nt, Human
cacuccccugcugg

SEQ ID NO: 2528766 - RNA, 15 nt, Human
cacuccccugcuggg

SEQ ID NO: 2528767 - RNA, 14 nt, Human
cacuccccugcacu

SEQ ID NO: 2528768 - RNA, 17 nt, Human
cacuccccugcacugga

SEQ ID NO: 2528769 - RNA, 23 nt, Human
cacugacacugguauuccugccu

SEQ ID NO: 2528770 - RNA, 15 nt, Human
cacugaauuaaucau

SEQ ID NO: 2528771 - RNA, 21 nt, Human
cacugaaugccucaaugugac

SEQ ID NO: 2528772 - RNA, 14 nt, Human
cacugaauauuuau

SEQ ID NO: 2528773 - RNA, 13 nt, Human
cacugaauauuua

SEQ ID NO: 2528774 - RNA, 22 nt, Human
cacugaaguuaacagagacaga

SEQ ID NO: 2528775 - RNA, 20 nt, Human
cacugacacugguauuccug

SEQ ID NO: 2528776 - RNA, 13 nt, Human
cacugacacuggu

SEQ ID NO: 2528777 - RNA, 22 nt, Human
cacugacaccuuugcaggcaug

SEQ ID NO: 2528778 - RNA, 21 nt, Human
cacugacaccuuugcaggcau

SEQ ID NO: 2528779 - RNA, 17 nt, Human
cacugacaccuuugcag

SEQ ID NO: 2528780 - RNA, 16 nt, Human
cacugacaccuuugca

SEQ ID NO: 2528781 - RNA, 14 nt, Human
cacugacaccuuug

SEQ ID NO: 2528782 - RNA, 17 nt, Human
cacugaauuccauuuuu

SEQ ID NO: 2528783 - RNA, 23 nt, Human
cacugaauuaaugacagagccag

SEQ ID NO: 2528784 - RNA, 19 nt, Human
cacugacacaaaaaguaga

SEQ ID NO: 2528785 - RNA, 20 nt, Human
cacuagggcagggacaggau

SEQ ID NO: 2528786 - RNA, 21 nt, Human
cacuagggcagggacaggaua

SEQ ID NO: 2528787 - RNA, 14 nt, Human
cacuaggcuucugg

SEQ ID NO: 2528788 - RNA, 11 nt, Human
cacuccagcug

SEQ ID NO: 2528789 - RNA, 12 nt, Human
cacuccagcugg

SEQ ID NO: 2528790 - RNA, 13 nt, Human
cacuccccugcac

SEQ ID NO: 2528791 - RNA, 15 nt, Human
cacuccagcugggau

SEQ ID NO: 2528792 - RNA, 13 nt, Human
cacuccagcuccu

SEQ ID NO: 2528793 - RNA, 23 nt, Human
cacuccagccugggcgacagagc

SEQ ID NO: 2528794 - RNA, 17 nt, Human
cacuccaauuaaggauu

SEQ ID NO: 2528795 - RNA, 18 nt, Human
cacuccaauuaaggauuu

SEQ ID NO: 2528796 - RNA, 16 nt, Human
cacuccagccugggug

SEQ ID NO: 2528797 - RNA, 21 nt, Human
cacuaggggauauaggagagg

SEQ ID NO: 2528798 - RNA, 23 nt, Human
cacuaggcccccacuugccucuu

SEQ ID NO: 2528799 - RNA, 16 nt, Human
cacucauugcugagcc

SEQ ID NO: 2528800 - RNA, 19 nt, Human
cacucauugcugagccucu

SEQ ID NO: 2528801 - RNA, 21 nt, Human
cacucauugcugagccucugc

SEQ ID NO: 2528802 - RNA, 23 nt, Human
cacucauugcugagccucugcuc

SEQ ID NO: 2528803 - RNA, 19 nt, Human
cacuccaagauauggacac

SEQ ID NO: 2528804 - RNA, 20 nt, Human
cacuaggggauauaggagag

SEQ ID NO: 2528805 - RNA, 13 nt, Human
cacuccaauuaag

SEQ ID NO: 2528806 - RNA, 15 nt, Human
cacuccaauuaagga

SEQ ID NO: 2528807 - RNA, 21 nt, Human
cacugcagaagacaguauggc

SEQ ID NO: 2528808 - RNA, 12 nt, Human
cacugcagccuc

SEQ ID NO: 2528809 - RNA, 20 nt, Human
cacugcacuccagccugggu

SEQ ID NO: 2528810 - RNA, 13 nt, Human
cacugcacuccgg

SEQ ID NO: 2528811 - RNA, 17 nt, Human
cacugcacuccagccug

SEQ ID NO: 2528812 - RNA, 20 nt, Human
cacugcacuccagccugggc

SEQ ID NO: 2528813 - RNA, 15 nt, Human
cacugcacuccagcc

SEQ ID NO: 2528814 - RNA, 16 nt, Human
cacugcacuccagccu

SEQ ID NO: 2528815 - RNA, 18 nt, Human
cacugcacuccagccugg

SEQ ID NO: 2528816 - RNA, 19 nt, Human
cacugcacuccagccuggg

SEQ ID NO: 2528817 - RNA, 19 nt, Human
cacugcacuauagccuagg

SEQ ID NO: 2528818 - RNA, 18 nt, Human
cacuggcugccuccacuc

SEQ ID NO: 2528819 - RNA, 17 nt, Human
cacuggcugccuccacu

SEQ ID NO: 2528820 - RNA, 16 nt, Human
cacuggcugccuccac

SEQ ID NO: 2528821 - RNA, 15 nt, Human
cacuggcugccucca

SEQ ID NO: 2528822 - RNA, 14 nt, Human
cacuggcugccucc

SEQ ID NO: 2528823 - RNA, 13 nt, Human
cacuggcugccuc

SEQ ID NO: 2528824 - RNA, 20 nt, Human
cacuggcugccagcuauuuu

SEQ ID NO: 2528825 - RNA, 18 nt, Human
cacuggcugccagcuauu

SEQ ID NO: 2528826 - RNA, 15 nt, Human
cacuggcugccagcu

SEQ ID NO: 2528827 - RNA, 14 nt, Human
cacuggcugccagc

SEQ ID NO: 2528828 - RNA, 12 nt, Human
cacugccaggcc

SEQ ID NO: 2528829 - RNA, 18 nt, Human
cacugggagaaaugaaaa

SEQ ID NO: 2528830 - RNA, 22 nt, Human
cacuggcugccuccacucccac

SEQ ID NO: 2528831 - RNA, 21 nt, Human
cacuggcugccuccacuccca

SEQ ID NO: 2528832 - RNA, 20 nt, Human
cacuggcugccuccacuccc

SEQ ID NO: 2528833 - RNA, 19 nt, Human
cacuggcugccuccacucc

SEQ ID NO: 2528834 - RNA, 22 nt, Human
cacuggcugucaguaugacauu

SEQ ID NO: 2528835 - RNA, 13 nt, Human
cacuggggcuggc

SEQ ID NO: 2528836 - RNA, 14 nt, Human
cacugggggagggg

SEQ ID NO: 2528837 - RNA, 15 nt, Human
cacugggggagggga

SEQ ID NO: 2528838 - RNA, 18 nt, Human
cacugggggaggggacau

SEQ ID NO: 2528839 - RNA, 21 nt, Human
cacugggggaggggacauuga

SEQ ID NO: 2528840 - RNA, 17 nt, Human
cacugggacuugcaaaa

SEQ ID NO: 2528841 - RNA, 14 nt, Human
cacuggggccuaca

SEQ ID NO: 2528842 - RNA, 23 nt, Human
cacuggcugccuccacucccacu

SEQ ID NO: 2528843 - RNA, 16 nt, Human
cacuggggccuacagc

SEQ ID NO: 2528844 - RNA, 13 nt, Human
cacugggaaacag

SEQ ID NO: 2528845 - RNA, 18 nt, Human
cacugggaaacagaggcu

SEQ ID NO: 2528846 - RNA, 19 nt, Human
cacugcauggcucccacag

SEQ ID NO: 2528847 - RNA, 22 nt, Human
cacugcaugagcuuuuauacua

SEQ ID NO: 2528848 - RNA, 18 nt, Human
cacugcaugagcuuuuau

SEQ ID NO: 2528849 - RNA, 18 nt, Human
cacugcauccuccgccuc

SEQ ID NO: 2528850 - RNA, 11 nt, Human
cacugccacac

SEQ ID NO: 2528851 - RNA, 16 nt, Human
cacugcauguuuguga

SEQ ID NO: 2528852 - RNA, 14 nt, Human
cacugcauccuccg

SEQ ID NO: 2528853 - RNA, 16 nt, Human
cacugcauccuccgcc

SEQ ID NO: 2528854 - RNA, 13 nt, Human
cacugcagccuca

SEQ ID NO: 2528855 - RNA, 13 nt, Human
cacugcaggcccc

SEQ ID NO: 2528856 - RNA, 13 nt, Human
cacugcaggggcc

SEQ ID NO: 2528857 - RNA, 16 nt, Human
cacugcaggccccgcu

SEQ ID NO: 2528858 - RNA, 16 nt, Human
cacugcauaccaaccu

SEQ ID NO: 2528859 - RNA, 22 nt, Human
cacuuguguuuugcaagccaga

SEQ ID NO: 2528860 - RNA, 13 nt, Human
cacuuguuccagc

SEQ ID NO: 2528861 - RNA, 15 nt, Human
cacuuguuccagcuc

SEQ ID NO: 2528862 - RNA, 18 nt, Human
cacuuguuccagcucuuu

SEQ ID NO: 2528863 - RNA, 16 nt, Human
cacuuguuccagcucu

SEQ ID NO: 2528864 - RNA, 17 nt, Human
cacuuguuccagcucuu

SEQ ID NO: 2528865 - RNA, 15 nt, Human
cacuuaucccucucc

SEQ ID NO: 2528866 - RNA, 22 nt, Human
cacuuauauguucuaauuaaua

SEQ ID NO: 2528867 - RNA, 15 nt, Human
cacuuagcuaucaga

SEQ ID NO: 2528868 - RNA, 23 nt, Human
cacuuaggaacguaaucgugucc

SEQ ID NO: 2528869 - RNA, 24 nt, Human
cacuuagaaauugcauuuccugac

SEQ ID NO: 2528870 - RNA, 17 nt, Human
cacuuguacaaaauaaa

SEQ ID NO: 2528871 - RNA, 17 nt, Human
cacuuauucucaagaag

SEQ ID NO: 2528872 - RNA, 16 nt, Human
cacuuaucccucucca

SEQ ID NO: 2528873 - RNA, 20 nt, Human
cacuuauuccccauucuucc

SEQ ID NO: 2528874 - RNA, 12 nt, Human
cacuuaugauuu

SEQ ID NO: 2528875 - RNA, 19 nt, Human
cacuuguguuuugcaagcc

SEQ ID NO: 2528876 - RNA, 14 nt, Human
cacuuguccagcug

SEQ ID NO: 2528877 - RNA, 15 nt, Human
cacuuguccagcuga

SEQ ID NO: 2528878 - RNA, 16 nt, Human
cacuugucaauaaaau

SEQ ID NO: 2528879 - RNA, 16 nt, Human
cacuuguauauacgca

SEQ ID NO: 2528880 - RNA, 13 nt, Human
cacuuguauauac

SEQ ID NO: 2528881 - RNA, 21 nt, Human
cacuuguauauacgcaucuau

SEQ ID NO: 2528882 - RNA, 16 nt, Human
cacuuacacuuuaugc

SEQ ID NO: 2528883 - RNA, 18 nt, Human
cacuuacacuuuaugcac

SEQ ID NO: 2528884 - RNA, 20 nt, Human
cacugguugcacuuaugauu

SEQ ID NO: 2528885 - RNA, 18 nt, Human
cacuuaccuagauuuaca

SEQ ID NO: 2528886 - RNA, 15 nt, Human
cacugguugcacuua

SEQ ID NO: 2528887 - RNA, 13 nt, Human
cacuuaccuucaa

SEQ ID NO: 2528888 - RNA, 14 nt, Human
cacuuaccuucaau

SEQ ID NO: 2528889 - RNA, 15 nt, Human
cacuuaccuucaaua

SEQ ID NO: 2528890 - RNA, 16 nt, Human
cacuuaccuucaauaa

SEQ ID NO: 2528891 - RNA, 17 nt, Human
cacuuaccuucaauaaa

SEQ ID NO: 2528892 - RNA, 18 nt, Human
cacuuaccuucaauaaag

SEQ ID NO: 2528893 - RNA, 19 nt, Human
cacuuaccuucaauaaagu

SEQ ID NO: 2528894 - RNA, 21 nt, Human
cacuuaccuucaauaaaguau

SEQ ID NO: 2528895 - RNA, 22 nt, Human
cacugguucuucuuggucucag

SEQ ID NO: 2528896 - RNA, 20 nt, Human
cacuggugugaccugagggc

SEQ ID NO: 2528897 - RNA, 22 nt, Human
cacugguguggauuaaccugcc

SEQ ID NO: 2528898 - RNA, 23 nt, Human
cacuggugugagggccccugccu

SEQ ID NO: 2528899 - RNA, 19 nt, Human
cacuggugugaccugaggg

SEQ ID NO: 2528900 - RNA, 16 nt, Human
cacuggggcuggcaca

SEQ ID NO: 2528901 - RNA, 23 nt, Human
cacugguggcccgacagccuggc

SEQ ID NO: 2528902 - RNA, 18 nt, Human
cacugggguccuggggcc

SEQ ID NO: 2528903 - RNA, 19 nt, Human
cacugggguccuggggccu

SEQ ID NO: 2528904 - RNA, 15 nt, Human
cacugggguccuggg

SEQ ID NO: 2528905 - RNA, 19 nt, Human
cacugggguccagggagca

SEQ ID NO: 2528906 - RNA, 15 nt, Human
caauaaagcauuuau

SEQ ID NO: 2528907 - RNA, 16 nt, Human
caauaaagcauuuaua

SEQ ID NO: 2528908 - RNA, 14 nt, Human
caauaaagcauuua

SEQ ID NO: 2528909 - RNA, 19 nt, Human
caauaaagcagcguuucua

SEQ ID NO: 2528910 - RNA, 23 nt, Human
caagucccugacucucugugacc

SEQ ID NO: 2528911 - RNA, 20 nt, Human
caagucccugacucucugug

SEQ ID NO: 2528912 - RNA, 21 nt, Human
caagucccugacucucuguga

SEQ ID NO: 2528913 - RNA, 14 nt, Human
caaguccccaagau

SEQ ID NO: 2528914 - RNA, 18 nt, Human
caagucccugacucucug

SEQ ID NO: 2528915 - RNA, 13 nt, Human
caauaaaguauuu

SEQ ID NO: 2528916 - RNA, 19 nt, Human
caauaaagcauuuauaaau

SEQ ID NO: 2528917 - RNA, 12 nt, Human
caauaaaguauc

SEQ ID NO: 2528918 - RNA, 16 nt, Human
caauaaaguaucuaca

SEQ ID NO: 2528919 - RNA, 11 nt, Human
caauaaaguau

SEQ ID NO: 2528920 - RNA, 16 nt, Human
caagcucaggaccagg

SEQ ID NO: 2528921 - RNA, 17 nt, Human
caagcucagaaggcucu

SEQ ID NO: 2528922 - RNA, 21 nt, Human
caagcucagaggcgcacugug

SEQ ID NO: 2528923 - RNA, 15 nt, Human
caagcucagaaggcu

SEQ ID NO: 2528924 - RNA, 16 nt, Human
caagcucaaagcgugg

SEQ ID NO: 2528925 - RNA, 12 nt, Human
caagcucacagu

SEQ ID NO: 2528926 - RNA, 16 nt, Human
caagcucacaguuccu

SEQ ID NO: 2528927 - RNA, 19 nt, Human
caagcucacaguuccucgc

SEQ ID NO: 2528928 - RNA, 20 nt, Human
caagcucacaguuccucgcc

SEQ ID NO: 2528929 - RNA, 21 nt, Human
caagcucacaguuccucgccc

SEQ ID NO: 2528930 - RNA, 22 nt, Human
caagcucacaguuccucgcccu

SEQ ID NO: 2528931 - RNA, 16 nt, Human
caagcuauccuggcuc

SEQ ID NO: 2528932 - RNA, 15 nt, Human
caagcuauccuggcu

SEQ ID NO: 2528933 - RNA, 18 nt, Human
caagcuagaaggccacau

SEQ ID NO: 2528934 - RNA, 17 nt, Human
caagcuagaaggccaca

SEQ ID NO: 2528935 - RNA, 18 nt, Human
caagcuagaaccuggagg

SEQ ID NO: 2528936 - RNA, 17 nt, Human
caagcuagaaccuggag

SEQ ID NO: 2528937 - RNA, 16 nt, Human
caagcuagaaccugga

SEQ ID NO: 2528938 - RNA, 19 nt, Human
caagcucuaucaccaagga

SEQ ID NO: 2528939 - RNA, 19 nt, Human
caagcuccaagccccaucu

SEQ ID NO: 2528940 - RNA, 18 nt, Human
caagcucaggaccaggca

SEQ ID NO: 2528941 - RNA, 22 nt, Human
caagcuccuugggaggccccac

SEQ ID NO: 2528942 - RNA, 13 nt, Human
caagcucugcucc

SEQ ID NO: 2528943 - RNA, 12 nt, Human
caagcuccaagc

SEQ ID NO: 2528944 - RNA, 14 nt, Human
caagcuccaagccc

SEQ ID NO: 2528945 - RNA, 13 nt, Human
caagcuccaagcc

SEQ ID NO: 2528946 - RNA, 17 nt, Human
caagcuccuugggaggc

SEQ ID NO: 2528947 - RNA, 14 nt, Human
caagcucugcuccu

SEQ ID NO: 2528948 - RNA, 13 nt, Human
caagcugcacccu

SEQ ID NO: 2528949 - RNA, 14 nt, Human
caagcugcacccuc

SEQ ID NO: 2528950 - RNA, 18 nt, Human
caagcugcacccucaggc

SEQ ID NO: 2528951 - RNA, 13 nt, Human
caaggcacugccu

SEQ ID NO: 2528952 - RNA, 12 nt, Human
caaggcacugcc

SEQ ID NO: 2528953 - RNA, 13 nt, Human
caagcucucugca

SEQ ID NO: 2528954 - RNA, 17 nt, Human
caagcucuagugggaag

SEQ ID NO: 2528955 - RNA, 20 nt, Human
caagcugcacccucaggcag

SEQ ID NO: 2528956 - RNA, 18 nt, Human
caaggcacugccugaugg

SEQ ID NO: 2528957 - RNA, 16 nt, Human
caaggcacugccugau

SEQ ID NO: 2528958 - RNA, 15 nt, Human
caaggcacugccuga

SEQ ID NO: 2528959 - RNA, 14 nt, Human
caaggcacugccug

SEQ ID NO: 2528960 - RNA, 23 nt, Human
caaggcaggugccuccaggugug

SEQ ID NO: 2528961 - RNA, 22 nt, Human
caaggcaggugccuccaggugu

SEQ ID NO: 2528962 - RNA, 20 nt, Human
caaggcaggugccuccaggu

SEQ ID NO: 2528963 - RNA, 19 nt, Human
caaggcaggugccuccagg

SEQ ID NO: 2528964 - RNA, 18 nt, Human
caaggcaggugccuccag

SEQ ID NO: 2528965 - RNA, 17 nt, Human
caaggcaggugccucca

SEQ ID NO: 2528966 - RNA, 16 nt, Human
caaggcaggugccucc

SEQ ID NO: 2528967 - RNA, 15 nt, Human
caaggcaggugccuc

SEQ ID NO: 2528968 - RNA, 14 nt, Human
caaggcaggugccu

SEQ ID NO: 2528969 - RNA, 13 nt, Human
caaggcaggugcc

SEQ ID NO: 2528970 - RNA, 16 nt, Human
caaggccaaaggaagc

SEQ ID NO: 2528971 - RNA, 15 nt, Human
caaggccaaaggaag

SEQ ID NO: 2528972 - RNA, 18 nt, Human
caaggccaaaggaagcac

SEQ ID NO: 2528973 - RNA, 17 nt, Human
caaggccaaaggaagca

SEQ ID NO: 2528974 - RNA, 16 nt, Human
caaguaugaauaaaga

SEQ ID NO: 2528975 - RNA, 21 nt, Human
caaguaugaauaaagacaccu

SEQ ID NO: 2528976 - RNA, 19 nt, Human
caaguaugaauaaagacac

SEQ ID NO: 2528977 - RNA, 15 nt, Human
caaguaugugagugu

SEQ ID NO: 2528978 - RNA, 13 nt, Human
caagucaagugaa

SEQ ID NO: 2528979 - RNA, 17 nt, Human
caagucaagugaaaaag

SEQ ID NO: 2528980 - RNA, 14 nt, Human
caagucaaauuaau

SEQ ID NO: 2528981 - RNA, 15 nt, Human
caagucaaauuaaua

SEQ ID NO: 2528982 - RNA, 16 nt, Human
caagucaaauuaauaa

SEQ ID NO: 2528983 - RNA, 17 nt, Human
caagucaugugcauuuc

SEQ ID NO: 2528984 - RNA, 19 nt, Human
caagucaaccaauguagaa

SEQ ID NO: 2528985 - RNA, 12 nt, Human
caagucauuuua

SEQ ID NO: 2528986 - RNA, 15 nt, Human
caaguccaaauguuu

SEQ ID NO: 2528987 - RNA, 17 nt, Human
caagucauuuuaacuuu

SEQ ID NO: 2528988 - RNA, 14 nt, Human
caaguccaagcaua

SEQ ID NO: 2528989 - RNA, 22 nt, Human
caaguccagauuuacacuggga

SEQ ID NO: 2528990 - RNA, 21 nt, Human
caaguccagauuuacacuggg

SEQ ID NO: 2528991 - RNA, 20 nt, Human
cacagguucacgugcagcuc

SEQ ID NO: 2528992 - RNA, 15 nt, Human
cacagguguuuauac

SEQ ID NO: 2528993 - RNA, 19 nt, Human
cacagguucaugccaccau

SEQ ID NO: 2528994 - RNA, 21 nt, Human
cacaguauuacuucugcuaca

SEQ ID NO: 2528995 - RNA, 20 nt, Human
cacaguauuacuucugcuac

SEQ ID NO: 2528996 - RNA, 20 nt, Human
cacaggccugagauuucauc

SEQ ID NO: 2528997 - RNA, 19 nt, Human
cacaggccugagauuucau

SEQ ID NO: 2528998 - RNA, 15 nt, Human
cacaggccugagauu

SEQ ID NO: 2528999 - RNA, 14 nt, Human
cacaggccugagau

SEQ ID NO: 2529000 - RNA, 14 nt, Human
cacaggccucccug

SEQ ID NO: 2529001 - RNA, 13 nt, Human
cacaggccucccu

SEQ ID NO: 2529002 - RNA, 12 nt, Human
cacaggccuccc

SEQ ID NO: 2529003 - RNA, 11 nt, Human
cacaggccucc

SEQ ID NO: 2529004 - RNA, 16 nt, Human
cacaggccucccuguu

SEQ ID NO: 2529005 - RNA, 15 nt, Human
cacaggccucccugu

SEQ ID NO: 2529006 - RNA, 13 nt, Human
cacaggccugaga

SEQ ID NO: 2529007 - RNA, 18 nt, Human
cacaggggaaaagaggag

SEQ ID NO: 2529008 - RNA, 17 nt, Human
cacaggggaaaagagga

SEQ ID NO: 2529009 - RNA, 19 nt, Human
cacaggggaaaagaggagu

SEQ ID NO: 2529010 - RNA, 23 nt, Human
cacaggccugagauuucaucugc

SEQ ID NO: 2529011 - RNA, 22 nt, Human
cacaggccugagauuucaucug

SEQ ID NO: 2529012 - RNA, 13 nt, Human
cacagggcuaaga

SEQ ID NO: 2529013 - RNA, 14 nt, Human
cacagggucugcac

SEQ ID NO: 2529014 - RNA, 15 nt, Human
cacagggucugcucu

SEQ ID NO: 2529015 - RNA, 15 nt, Human
cacaggucuuuccua

SEQ ID NO: 2529016 - RNA, 18 nt, Human
cacaggucuuuccuaagg

SEQ ID NO: 2529017 - RNA, 20 nt, Human
cacaggucuuuccuaaggcu

SEQ ID NO: 2529018 - RNA, 18 nt, Human
cacaggugggcuucccag

SEQ ID NO: 2529019 - RNA, 21 nt, Human
cacagccucuuagaugcaguu

SEQ ID NO: 2529020 - RNA, 23 nt, Human
cacagccucugaccccuccucac

SEQ ID NO: 2529021 - RNA, 22 nt, Human
cacagccucugaccccuccuca

SEQ ID NO: 2529022 - RNA, 17 nt, Human
cacagccucuuagaugc

SEQ ID NO: 2529023 - RNA, 20 nt, Human
cacagccucugaccccuccu

SEQ ID NO: 2529024 - RNA, 17 nt, Human
cacagccucugaccccu

SEQ ID NO: 2529025 - RNA, 15 nt, Human
cacagccucugaccc

SEQ ID NO: 2529026 - RNA, 14 nt, Human
cacagccucugacc

SEQ ID NO: 2529027 - RNA, 13 nt, Human
cacagccucugac

SEQ ID NO: 2529028 - RNA, 12 nt, Human
cacagccucuga

SEQ ID NO: 2529029 - RNA, 18 nt, Human
cacagacauucugccagg

SEQ ID NO: 2529030 - RNA, 20 nt, Human
cacagacauucugccaggcc

SEQ ID NO: 2529031 - RNA, 20 nt, Human
cacagcggagguguggagcc

SEQ ID NO: 2529032 - RNA, 23 nt, Human
cacaggcccuuccucuccacugc

SEQ ID NO: 2529033 - RNA, 23 nt, Human
cacaggcccuuuccucaggcaag

SEQ ID NO: 2529034 - RNA, 22 nt, Human
cacaggcccuuuccucaggcaa

SEQ ID NO: 2529035 - RNA, 20 nt, Human
cacaggcccuuuccucaggc

SEQ ID NO: 2529036 - RNA, 19 nt, Human
cacaggcccuuuccucagg

SEQ ID NO: 2529037 - RNA, 18 nt, Human
cacaggcccuuuccucag

SEQ ID NO: 2529038 - RNA, 22 nt, Human
cacaggcccuuccucuccacug

SEQ ID NO: 2529039 - RNA, 19 nt, Human
cacagcgcuggccgggacc

SEQ ID NO: 2529040 - RNA, 22 nt, Human
cacagcgcuggccgggaccccg

SEQ ID NO: 2529041 - RNA, 18 nt, Human
cacagccuucuccacugg

SEQ ID NO: 2529042 - RNA, 17 nt, Human
cacagcgagacuccguc

SEQ ID NO: 2529043 - RNA, 22 nt, Human
cacagaaaauggaagacagcuc

SEQ ID NO: 2529044 - RNA, 20 nt, Human
cacagaaaauggaagacagc

SEQ ID NO: 2529045 - RNA, 19 nt, Human
cacagaaaauggaagacag

SEQ ID NO: 2529046 - RNA, 18 nt, Human
cacagaaaauggaagaca

SEQ ID NO: 2529047 - RNA, 14 nt, Human
cacacaugcauaca

SEQ ID NO: 2529048 - RNA, 15 nt, Human
cacacaugcauacac

SEQ ID NO: 2529049 - RNA, 16 nt, Human
cacacaugcauacaca

SEQ ID NO: 2529050 - RNA, 17 nt, Human
cacacaugcauacacac

SEQ ID NO: 2529051 - RNA, 18 nt, Human
cacacaugcauacacaca

SEQ ID NO: 2529052 - RNA, 19 nt, Human
cacacaugcauacacacac

SEQ ID NO: 2529053 - RNA, 21 nt, Human
cacagaaaauauacuguaaag

SEQ ID NO: 2529054 - RNA, 22 nt, Human
cacacaugagcaucaggccagg

SEQ ID NO: 2529055 - RNA, 21 nt, Human
cacacaugagcaucaggccag

SEQ ID NO: 2529056 - RNA, 19 nt, Human
cacagacauacuaaccagc

SEQ ID NO: 2529057 - RNA, 21 nt, Human
cacagacauacuaaccagcag

SEQ ID NO: 2529058 - RNA, 13 nt, Human
cacagacccugcc

SEQ ID NO: 2529059 - RNA, 11 nt, Human
cacagccucug

SEQ ID NO: 2529060 - RNA, 19 nt, Human
cacagaaaauucuucucca

SEQ ID NO: 2529061 - RNA, 23 nt, Human
cacagaaaauggaagacagcucu

SEQ ID NO: 2529062 - RNA, 18 nt, Human
cacagacauacuaaccag

SEQ ID NO: 2529063 - RNA, 22 nt, Human
cacagaaaauauacuguaaaga

SEQ ID NO: 2529064 - RNA, 13 nt, Human
cacagaaacacaa

SEQ ID NO: 2529065 - RNA, 21 nt, Human
cacagaaacacaauauuuugu

SEQ ID NO: 2529066 - RNA, 18 nt, Human
cacagaaacacaauauuu

SEQ ID NO: 2529067 - RNA, 22 nt, Human
cacacaugaaguccaagcauuu

SEQ ID NO: 2529068 - RNA, 20 nt, Human
cacacaugagcaucaggcca

SEQ ID NO: 2529069 - RNA, 17 nt, Human
cacacaugaaguccaag

SEQ ID NO: 2529070 - RNA, 13 nt, Human
cacacaucaggag

SEQ ID NO: 2529071 - RNA, 23 nt, Human
cacacagugagucgaggacaggg

SEQ ID NO: 2529072 - RNA, 21 nt, Human
cacacagugagucgaggacag

SEQ ID NO: 2529073 - RNA, 15 nt, Human
cacacauacacacac

SEQ ID NO: 2529074 - RNA, 23 nt, Human
cacacauauaaacaucacacaca

SEQ ID NO: 2529075 - RNA, 21 nt, Human
cacacauauaaacaucacaca

SEQ ID NO: 2529076 - RNA, 14 nt, Human
cacacauacacaca

SEQ ID NO: 2529077 - RNA, 23 nt, Human
cacacaguauuacuucugcuaca

SEQ ID NO: 2529078 - RNA, 20 nt, Human
cacacaguauuacuucugcu

SEQ ID NO: 2529079 - RNA, 21 nt, Human
cacacaguauuaagugacagu

SEQ ID NO: 2529080 - RNA, 17 nt, Human
cacacaguauuaaguga

SEQ ID NO: 2529081 - RNA, 23 nt, Human
cacacagggucugcaaggucuuu

SEQ ID NO: 2529082 - RNA, 18 nt, Human
cacacagugagucgagga

SEQ ID NO: 2529083 - RNA, 19 nt, Human
cacacaggggccacccggg

SEQ ID NO: 2529084 - RNA, 12 nt, Human
cacacagggcag

SEQ ID NO: 2529085 - RNA, 20 nt, Human
cacacaggacccccuucccc

SEQ ID NO: 2529086 - RNA, 20 nt, Human
cacacaggcaacugaggcag

SEQ ID NO: 2529087 - RNA, 16 nt, Human
cacacaggcaacugag

SEQ ID NO: 2529088 - RNA, 19 nt, Human
cacacaggcaacugaggca

SEQ ID NO: 2529089 - RNA, 18 nt, Human
cacacagcugggcugugg

SEQ ID NO: 2529090 - RNA, 17 nt, Human
cacacaggacccccuuc

SEQ ID NO: 2529091 - RNA, 19 nt, Human
cacacaggacccccuuccc

SEQ ID NO: 2529092 - RNA, 18 nt, Human
cacacaggacccccuucc

SEQ ID NO: 2529093 - RNA, 13 nt, Human
cacacaggcaacu

SEQ ID NO: 2529094 - RNA, 16 nt, Human
cacacagcucuguccu

SEQ ID NO: 2529095 - RNA, 15 nt, Human
cacacagcugcagag

SEQ ID NO: 2529096 - RNA, 20 nt, Human
cacacagcucuguccuggga

SEQ ID NO: 2529097 - RNA, 17 nt, Human
cacacagcucuguccug

SEQ ID NO: 2529098 - RNA, 21 nt, Human
cacaagagcccagcagggccu

SEQ ID NO: 2529099 - RNA, 23 nt, Human
cacaagcuccaagcucccaggca

SEQ ID NO: 2529100 - RNA, 17 nt, Human
cacaagcuccaagcucc

SEQ ID NO: 2529101 - RNA, 17 nt, Human
cacaagcugcacccuca

SEQ ID NO: 2529102 - RNA, 23 nt, Human
cacaagcugcacccucaggcagg

SEQ ID NO: 2529103 - RNA, 15 nt, Human
cacaagcuccaagcu

SEQ ID NO: 2529104 - RNA, 14 nt, Human
cacaagcuccaagc

SEQ ID NO: 2529105 - RNA, 13 nt, Human
cacaagcuccaag

SEQ ID NO: 2529106 - RNA, 16 nt, Human
cacaagagcccaggcc

SEQ ID NO: 2529107 - RNA, 18 nt, Human
cacaagacugcacaucaa

SEQ ID NO: 2529108 - RNA, 14 nt, Human
caauuuaugaauug

SEQ ID NO: 2529109 - RNA, 21 nt, Human
caauuuauauuuaauaaaauu

SEQ ID NO: 2529110 - RNA, 14 nt, Human
cacaagagcccagg

SEQ ID NO: 2529111 - RNA, 22 nt, Human
caauuuauuaaaaugauuguaa

SEQ ID NO: 2529112 - RNA, 14 nt, Human
caauuuauuaaaau

SEQ ID NO: 2529113 - RNA, 23 nt, Human
caauuuauuaaaaugauuguaaa

SEQ ID NO: 2529114 - RNA, 20 nt, Human
cacaagagcccagcagggcc

SEQ ID NO: 2529115 - RNA, 15 nt, Human
caaugcuguauuuua

SEQ ID NO: 2529116 - RNA, 17 nt, Human
caaugcuguauuuuaaa

SEQ ID NO: 2529117 - RNA, 16 nt, Human
caaugcuguauuuuaa

SEQ ID NO: 2529118 - RNA, 20 nt, Human
caauggagacugucucaaga

SEQ ID NO: 2529119 - RNA, 22 nt, Human
caauggauuugaugcuguuuga

SEQ ID NO: 2529120 - RNA, 19 nt, Human
caauggauuugaugcuguu

SEQ ID NO: 2529121 - RNA, 17 nt, Human
caauggauuugaugcug

SEQ ID NO: 2529122 - RNA, 13 nt, Human
caauggauuugau

SEQ ID NO: 2529123 - RNA, 15 nt, Human
caauucuugccaaau

SEQ ID NO: 2529124 - RNA, 12 nt, Human
caauggcagccu

SEQ ID NO: 2529125 - RNA, 11 nt, Human
caauggcagcc

SEQ ID NO: 2529126 - RNA, 19 nt, Human
caauucuuuauacaacagu

SEQ ID NO: 2529127 - RNA, 16 nt, Human
caauucuuuauacaac

SEQ ID NO: 2529128 - RNA, 18 nt, Human
caauugaacuuaaauaaa

SEQ ID NO: 2529129 - RNA, 23 nt, Human
caauucuuuauacaacagugcua

SEQ ID NO: 2529130 - RNA, 12 nt, Human
caauuuaaagca

SEQ ID NO: 2529131 - RNA, 13 nt, Human
caauucuuuauac

SEQ ID NO: 2529132 - RNA, 12 nt, Human
caauucuuuaua

SEQ ID NO: 2529133 - RNA, 22 nt, Human
caauucuucccuaucuuugcca

SEQ ID NO: 2529134 - RNA, 21 nt, Human
caauucuucccuaucuuugcc

SEQ ID NO: 2529135 - RNA, 20 nt, Human
caauucuucccuaucuuugc

SEQ ID NO: 2529136 - RNA, 17 nt, Human
caauuuacaaagugugu

SEQ ID NO: 2529137 - RNA, 15 nt, Human
caauuuacaaagugu

SEQ ID NO: 2529138 - RNA, 14 nt, Human
caauuuacaaagug

SEQ ID NO: 2529139 - RNA, 13 nt, Human
caauuuacaaagu

SEQ ID NO: 2529140 - RNA, 20 nt, Human
caauuuacaaaguguguauu

SEQ ID NO: 2529141 - RNA, 18 nt, Human
caauuuacaaagugugua

SEQ ID NO: 2529142 - RNA, 21 nt, Human
caauuuacaaaguguguauua

SEQ ID NO: 2529143 - RNA, 13 nt, Human
caauuuaaagcaa

SEQ ID NO: 2529144 - RNA, 14 nt, Human
ccaaaacuccugcc

SEQ ID NO: 2529145 - RNA, 19 nt, Human
ccaaagugcugggauuaca

SEQ ID NO: 2529146 - RNA, 22 nt, Human
ccaaagugcugggauuacaggc

SEQ ID NO: 2529147 - RNA, 22 nt, Human
ccaaagugcugggauuacaggg

SEQ ID NO: 2529148 - RNA, 21 nt, Human
ccaacuugagggcccagagca

SEQ ID NO: 2529149 - RNA, 20 nt, Human
ccaacuugagggcccagagc

SEQ ID NO: 2529150 - RNA, 13 nt, Human
ccaacuuggcuuu

SEQ ID NO: 2529151 - RNA, 11 nt, Human
ccaacuuguaa

SEQ ID NO: 2529152 - RNA, 14 nt, Human
ccaacuuggcuuuc

SEQ ID NO: 2529153 - RNA, 17 nt, Human
ccaacuuguaaauacac

SEQ ID NO: 2529154 - RNA, 23 nt, Human
ccaacuuguauuaaagacagagg

SEQ ID NO: 2529155 - RNA, 18 nt, Human
ccaacuagacauucuguc

SEQ ID NO: 2529156 - RNA, 17 nt, Human
ccaacuagacauucugu

SEQ ID NO: 2529157 - RNA, 16 nt, Human
ccaacuagacauucug

SEQ ID NO: 2529158 - RNA, 19 nt, Human
ccaacuugagggcccagag

SEQ ID NO: 2529159 - RNA, 18 nt, Human
ccaacuucuucagagcug

SEQ ID NO: 2529160 - RNA, 19 nt, Human
ccaacuucuucagagcuga

SEQ ID NO: 2529161 - RNA, 21 nt, Human
ccaacuucauuugaugcuaaa

SEQ ID NO: 2529162 - RNA, 13 nt, Human
ccaacuucccagu

SEQ ID NO: 2529163 - RNA, 23 nt, Human
ccaacuacaaccaagcucucugc

SEQ ID NO: 2529164 - RNA, 22 nt, Human
ccaacuacaaccaagcucucug

SEQ ID NO: 2529165 - RNA, 16 nt, Human
ccaacuacaaccaagc

SEQ ID NO: 2529166 - RNA, 19 nt, Human
ccaacuaacaagaaacuca

SEQ ID NO: 2529167 - RNA, 19 nt, Human
ccaacuaaugccuuacucu

SEQ ID NO: 2529168 - RNA, 20 nt, Human
ccaacuaaugccuuacucuu

SEQ ID NO: 2529169 - RNA, 20 nt, Human
ccaacguggggcagcacaga

SEQ ID NO: 2529170 - RNA, 18 nt, Human
ccaaauuauuuguguaau

SEQ ID NO: 2529171 - RNA, 17 nt, Human
ccaaauuauuuguguaa

SEQ ID NO: 2529172 - RNA, 14 nt, Human
ccaaauuauuugug

SEQ ID NO: 2529173 - RNA, 12 nt, Human
ccaaauuauuug

SEQ ID NO: 2529174 - RNA, 16 nt, Human
ccaacgucugugccau

SEQ ID NO: 2529175 - RNA, 16 nt, Human
ccaacguggggcagca

SEQ ID NO: 2529176 - RNA, 15 nt, Human
ccaacguggggcagc

SEQ ID NO: 2529177 - RNA, 23 nt, Human
ccaaauguuuacagggagccucc

SEQ ID NO: 2529178 - RNA, 18 nt, Human
ccaaauguuuacagggag

SEQ ID NO: 2529179 - RNA, 19 nt, Human
ccaaauguuuacagggagc

SEQ ID NO: 2529180 - RNA, 11 nt, Human
ccaaauuauuu

SEQ ID NO: 2529181 - RNA, 18 nt, Human
ccaaauguucaucaauga

SEQ ID NO: 2529182 - RNA, 22 nt, Human
ccaaaugagggucuugguucca

SEQ ID NO: 2529183 - RNA, 16 nt, Human
ccaaaugaaugaccuu

SEQ ID NO: 2529184 - RNA, 14 nt, Human
ccaaaucuggaagc

SEQ ID NO: 2529185 - RNA, 18 nt, Human
ccaaauccucuccagcua

SEQ ID NO: 2529186 - RNA, 13 nt, Human
ccaaauccucucc

SEQ ID NO: 2529187 - RNA, 23 nt, Human
ccaaauccgaaccuccucuguga

SEQ ID NO: 2529188 - RNA, 17 nt, Human
ccaaauccgaaccuccu

SEQ ID NO: 2529189 - RNA, 21 nt, Human
ccaaauccgaaccuccucugu

SEQ ID NO: 2529190 - RNA, 22 nt, Human
ccaaauccgaaccuccucugug

SEQ ID NO: 2529191 - RNA, 24 nt, Human
ccaaauccgaaccuccucugugaa

SEQ ID NO: 2529192 - RNA, 15 nt, Human
ccaaauccccuaagc

SEQ ID NO: 2529193 - RNA, 22 nt, Human
ccaaagugcugggauuacaggu

SEQ ID NO: 2529194 - RNA, 19 nt, Human
ccaaagugguauagaaaug

SEQ ID NO: 2529195 - RNA, 22 nt, Human
ccaaugcacuuuguucuggcuc

SEQ ID NO: 2529196 - RNA, 20 nt, Human
ccaaugcacuuuguucuggc

SEQ ID NO: 2529197 - RNA, 23 nt, Human
ccaaugcacuuuguucuggcucu

SEQ ID NO: 2529198 - RNA, 16 nt, Human
ccaagcuuggcagccg

SEQ ID NO: 2529199 - RNA, 15 nt, Human
ccaagcuuggcagcc

SEQ ID NO: 2529200 - RNA, 17 nt, Human
ccaagcuuggcagccga

SEQ ID NO: 2529201 - RNA, 23 nt, Human
ccaagcuuguccaacccgaggcc

SEQ ID NO: 2529202 - RNA, 17 nt, Human
ccaacuuucuguaaacu

SEQ ID NO: 2529203 - RNA, 14 nt, Human
ccaacuuucuguaa

SEQ ID NO: 2529204 - RNA, 13 nt, Human
ccaacuuucugua

SEQ ID NO: 2529205 - RNA, 15 nt, Human
ccaagcugugccacc

SEQ ID NO: 2529206 - RNA, 14 nt, Human
ccaagcugugccac

SEQ ID NO: 2529207 - RNA, 22 nt, Human
ccaacuuuguggaugucuuccu

SEQ ID NO: 2529208 - RNA, 13 nt, Human
ccaagcugugcca

SEQ ID NO: 2529209 - RNA, 20 nt, Human
ccaagcuggucccacucagu

SEQ ID NO: 2529210 - RNA, 21 nt, Human
ccaagcugugccacccugggc

SEQ ID NO: 2529211 - RNA, 18 nt, Human
ccaagcugugccacccug

SEQ ID NO: 2529212 - RNA, 17 nt, Human
ccaagcugugccacccu

SEQ ID NO: 2529213 - RNA, 16 nt, Human
ccaagcugugccaccc

SEQ ID NO: 2529214 - RNA, 14 nt, Human
ccaagcuguuuucu

SEQ ID NO: 2529215 - RNA, 17 nt, Human
ccaagcuguuuucuucu

SEQ ID NO: 2529216 - RNA, 18 nt, Human
ccaagcuguuuucuucua

SEQ ID NO: 2529217 - RNA, 22 nt, Human
ccaagcugugccacccugggcu

SEQ ID NO: 2529218 - RNA, 17 nt, Human
ccaagcuuccuuuguuu

SEQ ID NO: 2529219 - RNA, 22 nt, Human
ccaauuaaggauuuuaugcuuu

SEQ ID NO: 2529220 - RNA, 17 nt, Human
ccaauuaggaaguguaa

SEQ ID NO: 2529221 - RNA, 23 nt, Human
ccaauuaggaaguguaacagcug

SEQ ID NO: 2529222 - RNA, 13 nt, Human
ccaauuaaggauu

SEQ ID NO: 2529223 - RNA, 18 nt, Human
ccaauuaaggauuuuaug

SEQ ID NO: 2529224 - RNA, 15 nt, Human
ccaauuaaccagaaa

SEQ ID NO: 2529225 - RNA, 20 nt, Human
ccaauguucucucuucucca

SEQ ID NO: 2529226 - RNA, 23 nt, Human
ccaaugcaugcagccacugugcu

SEQ ID NO: 2529227 - RNA, 21 nt, Human
ccaaugcaugcagccacugug

SEQ ID NO: 2529228 - RNA, 17 nt, Human
ccaaugcaugcagccac

SEQ ID NO: 2529229 - RNA, 13 nt, Human
ccaaugccaaaaa

SEQ ID NO: 2529230 - RNA, 22 nt, Human
ccacacuucaggcucuucuccu

SEQ ID NO: 2529231 - RNA, 20 nt, Human
ccacacuuccuguccagaga

SEQ ID NO: 2529232 - RNA, 21 nt, Human
ccacacuuccuguccagagag

SEQ ID NO: 2529233 - RNA, 12 nt, Human
ccacacuuccug

SEQ ID NO: 2529234 - RNA, 13 nt, Human
ccacacuuccugu

SEQ ID NO: 2529235 - RNA, 16 nt, Human
ccacacuuccugucca

SEQ ID NO: 2529236 - RNA, 18 nt, Human
ccacacuuccuguccaga

SEQ ID NO: 2529237 - RNA, 21 nt, Human
ccaccacuggccaccaggcug

SEQ ID NO: 2529238 - RNA, 20 nt, Human
ccaccacuggccaccaggcu

SEQ ID NO: 2529239 - RNA, 19 nt, Human
ccaccacuggccaccaggc

SEQ ID NO: 2529240 - RNA, 19 nt, Human
ccacacuugagaggaugaa

SEQ ID NO: 2529241 - RNA, 11 nt, Human
ccaccagaagc

SEQ ID NO: 2529242 - RNA, 12 nt, Human
ccaccagaagcc

SEQ ID NO: 2529243 - RNA, 13 nt, Human
ccaccagaagccc

SEQ ID NO: 2529244 - RNA, 17 nt, Human
ccacacuugagaggaug

SEQ ID NO: 2529245 - RNA, 17 nt, Human
ccacagaagccaggagc

SEQ ID NO: 2529246 - RNA, 20 nt, Human
ccacacuuguuccagcucuu

SEQ ID NO: 2529247 - RNA, 21 nt, Human
ccacacuuguuccagcucuuu

SEQ ID NO: 2529248 - RNA, 17 nt, Human
ccaccaucaagccacca

SEQ ID NO: 2529249 - RNA, 16 nt, Human
ccaccaucaagccacc

SEQ ID NO: 2529250 - RNA, 19 nt, Human
ccaccaggccaccucccca

SEQ ID NO: 2529251 - RNA, 13 nt, Human
ccaccaggccacc

SEQ ID NO: 2529252 - RNA, 18 nt, Human
ccaccaggaucccagggg

SEQ ID NO: 2529253 - RNA, 18 nt, Human
ccaccaggaaccucuuca

SEQ ID NO: 2529254 - RNA, 19 nt, Human
ccaccaggagaaccacuac

SEQ ID NO: 2529255 - RNA, 14 nt, Human
ccaccaggaaccuc

SEQ ID NO: 2529256 - RNA, 16 nt, Human
ccaccaggaaccucuu

SEQ ID NO: 2529257 - RNA, 13 nt, Human
ccaccaggagaac

SEQ ID NO: 2529258 - RNA, 14 nt, Human
ccaccaggagaacc

SEQ ID NO: 2529259 - RNA, 14 nt, Human
ccaccagaagccca

SEQ ID NO: 2529260 - RNA, 15 nt, Human
ccaccagaagcccag

SEQ ID NO: 2529261 - RNA, 16 nt, Human
ccaccagaagcccaga

SEQ ID NO: 2529262 - RNA, 18 nt, Human
ccaccagaagcccagaau

SEQ ID NO: 2529263 - RNA, 11 nt, Human
ccaccagccug

SEQ ID NO: 2529264 - RNA, 14 nt, Human
ccaccagccugcac

SEQ ID NO: 2529265 - RNA, 12 nt, Human
ccaccagagcug

SEQ ID NO: 2529266 - RNA, 22 nt, Human
ccaccagagaccguccucaccc

SEQ ID NO: 2529267 - RNA, 21 nt, Human
ccaccagagaccguccucacc

SEQ ID NO: 2529268 - RNA, 20 nt, Human
ccaccagagaccguccucac

SEQ ID NO: 2529269 - RNA, 17 nt, Human
ccaccagagaccguccu

SEQ ID NO: 2529270 - RNA, 23 nt, Human
ccaccacuggccaccaggcuggc

SEQ ID NO: 2529271 - RNA, 23 nt, Human
ccaccagacugacaaauguguau

SEQ ID NO: 2529272 - RNA, 15 nt, Human
ccaccuuggcucaag

SEQ ID NO: 2529273 - RNA, 14 nt, Human
ccaccuuggcucaa

SEQ ID NO: 2529274 - RNA, 13 nt, Human
ccaccguggagga

SEQ ID NO: 2529275 - RNA, 20 nt, Human
ccaccguccgcccugcuccu

SEQ ID NO: 2529276 - RNA, 19 nt, Human
ccaccguccgcccugcucc

SEQ ID NO: 2529277 - RNA, 18 nt, Human
ccaccguccgcccugcuc

SEQ ID NO: 2529278 - RNA, 17 nt, Human
ccaccuaaucaggcuga

SEQ ID NO: 2529279 - RNA, 16 nt, Human
ccaccguggaggagga

SEQ ID NO: 2529280 - RNA, 13 nt, Human
ccaccuuggcuca

SEQ ID NO: 2529281 - RNA, 23 nt, Human
ccaccuacuuuucuuuccucaga

SEQ ID NO: 2529282 - RNA, 17 nt, Human
ccaccguccgcccugcu

SEQ ID NO: 2529283 - RNA, 16 nt, Human
ccaccguccgcccugc

SEQ ID NO: 2529284 - RNA, 15 nt, Human
ccaccguccgcccug

SEQ ID NO: 2529285 - RNA, 14 nt, Human
ccaccguccgcccu

SEQ ID NO: 2529286 - RNA, 13 nt, Human
ccaccguccgccc

SEQ ID NO: 2529287 - RNA, 23 nt, Human
ccaccgggcugggagcucugcag

SEQ ID NO: 2529288 - RNA, 18 nt, Human
ccaccgcagacaggacca

SEQ ID NO: 2529289 - RNA, 13 nt, Human
ccacccugggccc

SEQ ID NO: 2529290 - RNA, 22 nt, Human
ccaccgggcugggagcucugca

SEQ ID NO: 2529291 - RNA, 21 nt, Human
ccaccaggccaccuccccagc

SEQ ID NO: 2529292 - RNA, 13 nt, Human
ccacccugcucuc

SEQ ID NO: 2529293 - RNA, 20 nt, Human
ccaccaucaagccaccaaca

SEQ ID NO: 2529294 - RNA, 20 nt, Human
ccaccaggcugcucagggcu

SEQ ID NO: 2529295 - RNA, 17 nt, Human
ccaccgcagacaggacc

SEQ ID NO: 2529296 - RNA, 14 nt, Human
ccaccgcagacagg

SEQ ID NO: 2529297 - RNA, 21 nt, Human
ccacccuggccgaguccaagc

SEQ ID NO: 2529298 - RNA, 22 nt, Human
ccacccuggccgaguccaagcu

SEQ ID NO: 2529299 - RNA, 20 nt, Human
ccacccuggccgaguccaag

SEQ ID NO: 2529300 - RNA, 11 nt, Human
ccacccuggaa

SEQ ID NO: 2529301 - RNA, 10 nt, Human
ccacccuggg

SEQ ID NO: 2529302 - RNA, 12 nt, Human
ccacccugggac

SEQ ID NO: 2529303 - RNA, 12 nt, Human
ccacccugggcc

SEQ ID NO: 2529304 - RNA, 13 nt, Human
ccacccugggacc

SEQ ID NO: 2529305 - RNA, 15 nt, Human
cauuaggauggcuag

SEQ ID NO: 2529306 - RNA, 12 nt, Human
cauuaucuagau

SEQ ID NO: 2529307 - RNA, 16 nt, Human
cauuaucuagauacug

SEQ ID NO: 2529308 - RNA, 17 nt, Human
cauuaucuagauacugu

SEQ ID NO: 2529309 - RNA, 21 nt, Human
cauuaggaauuaaguuaucuu

SEQ ID NO: 2529310 - RNA, 23 nt, Human
cauuagccugaguagaaaggccu

SEQ ID NO: 2529311 - RNA, 19 nt, Human
cauuagccugaguagaaag

SEQ ID NO: 2529312 - RNA, 18 nt, Human
cauuagccugaguagaaa

SEQ ID NO: 2529313 - RNA, 17 nt, Human
cauuagccugaguagaa

SEQ ID NO: 2529314 - RNA, 14 nt, Human
cauuagccugagua

SEQ ID NO: 2529315 - RNA, 9 nt, Human
cauuagccu

SEQ ID NO: 2529316 - RNA, 23 nt, Human
cauguuccuucaagaucauguac

SEQ ID NO: 2529317 - RNA, 20 nt, Human
cauguuccuucaagaucaug

SEQ ID NO: 2529318 - RNA, 16 nt, Human
cauguuccuucaagau

SEQ ID NO: 2529319 - RNA, 14 nt, Human
cauguuccuucaag

SEQ ID NO: 2529320 - RNA, 18 nt, Human
cauuagcaguuugcuuug

SEQ ID NO: 2529321 - RNA, 15 nt, Human
cauguucucugagga

SEQ ID NO: 2529322 - RNA, 17 nt, Human
cauggcuuaaugcuucu

SEQ ID NO: 2529323 - RNA, 14 nt, Human
cauggcugugagga

SEQ ID NO: 2529324 - RNA, 24 nt, Human
cauggcugggaacugcagaccugu

SEQ ID NO: 2529325 - RNA, 23 nt, Human
cauggcugggaacugcagaccug

SEQ ID NO: 2529326 - RNA, 21 nt, Human
cauggcugggaacugcagacc

SEQ ID NO: 2529327 - RNA, 20 nt, Human
cauggcuuaauguuuauucc

SEQ ID NO: 2529328 - RNA, 17 nt, Human
cauggcuuaauguuuau

SEQ ID NO: 2529329 - RNA, 15 nt, Human
cauggcuuaauguuu

SEQ ID NO: 2529330 - RNA, 18 nt, Human
cauggcuuaaugcuucuu

SEQ ID NO: 2529331 - RNA, 14 nt, Human
cauggcuuccuccu

SEQ ID NO: 2529332 - RNA, 13 nt, Human
cauggcuuccucc

SEQ ID NO: 2529333 - RNA, 19 nt, Human
cauguuccaauaaacagga

SEQ ID NO: 2529334 - RNA, 17 nt, Human
cauguuccaauaaacag

SEQ ID NO: 2529335 - RNA, 16 nt, Human
cauguuccaauaaaca

SEQ ID NO: 2529336 - RNA, 14 nt, Human
cauguuccaauaaa

SEQ ID NO: 2529337 - RNA, 22 nt, Human
cauguucacaccgcugcacuca

SEQ ID NO: 2529338 - RNA, 20 nt, Human
cauguucacaccgcugcacu

SEQ ID NO: 2529339 - RNA, 13 nt, Human
cauguuccuucaa

SEQ ID NO: 2529340 - RNA, 12 nt, Human
cauguuccuuca

SEQ ID NO: 2529341 - RNA, 21 nt, Human
cauguuccucaaaagcacccu

SEQ ID NO: 2529342 - RNA, 16 nt, Human
cauguuccacuaaccc

SEQ ID NO: 2529343 - RNA, 15 nt, Human
cauguuccacuaacc

SEQ ID NO: 2529344 - RNA, 13 nt, Human
cauguuccucaaa

SEQ ID NO: 2529345 - RNA, 14 nt, Human
cauggcuaacuggc

SEQ ID NO: 2529346 - RNA, 16 nt, Human
cauggcuaacuggcga

SEQ ID NO: 2529347 - RNA, 14 nt, Human
cauggcgugucccu

SEQ ID NO: 2529348 - RNA, 19 nt, Human
cauggcgugucccucucgg

SEQ ID NO: 2529349 - RNA, 22 nt, Human
cauggccucuucagaucucuaa

SEQ ID NO: 2529350 - RNA, 22 nt, Human
cauggcugccaaugggagcuca

SEQ ID NO: 2529351 - RNA, 17 nt, Human
cauggcugccaauggga

SEQ ID NO: 2529352 - RNA, 13 nt, Human
cauuaugaugugu

SEQ ID NO: 2529353 - RNA, 21 nt, Human
cauuaugaugugggucaagga

SEQ ID NO: 2529354 - RNA, 13 nt, Human
cauuaugauucuu

SEQ ID NO: 2529355 - RNA, 22 nt, Human
cauuauguccacuguguauaga

SEQ ID NO: 2529356 - RNA, 21 nt, Human
cauuauguccacuguguauag

SEQ ID NO: 2529357 - RNA, 20 nt, Human
cauuauguccacuguguaua

SEQ ID NO: 2529358 - RNA, 19 nt, Human
cauuauguccacuguguau

SEQ ID NO: 2529359 - RNA, 17 nt, Human
cauuauguccacugugu

SEQ ID NO: 2529360 - RNA, 20 nt, Human
cauuauguaaaauguuuuag

SEQ ID NO: 2529361 - RNA, 17 nt, Human
cauuauguaaaauguuu

SEQ ID NO: 2529362 - RNA, 14 nt, Human
cauuaugauucuuu

SEQ ID NO: 2529363 - RNA, 18 nt, Human
cauuaucuagauacugua

SEQ ID NO: 2529364 - RNA, 22 nt, Human
cauuaggacaaucaguccccuc

SEQ ID NO: 2529365 - RNA, 19 nt, Human
cauuaggacaaucaguccc

SEQ ID NO: 2529366 - RNA, 23 nt, Human
cauuaugaugugggucaaggaau

SEQ ID NO: 2529367 - RNA, 22 nt, Human
cauuaugaugugggucaaggaa

SEQ ID NO: 2529368 - RNA, 16 nt, Human
cauucucacuccuacc

SEQ ID NO: 2529369 - RNA, 17 nt, Human
cauucucacuccuaccu

SEQ ID NO: 2529370 - RNA, 16 nt, Human
cauucucauggagaag

SEQ ID NO: 2529371 - RNA, 15 nt, Human
cauucucauggagaa

SEQ ID NO: 2529372 - RNA, 15 nt, Human
cauucuccugccugu

SEQ ID NO: 2529373 - RNA, 13 nt, Human
cauucuccugccu

SEQ ID NO: 2529374 - RNA, 11 nt, Human
cauucuccugc

SEQ ID NO: 2529375 - RNA, 21 nt, Human
cauucucccagguaccagcug

SEQ ID NO: 2529376 - RNA, 23 nt, Human
cauucuccugccuguagcaguga

SEQ ID NO: 2529377 - RNA, 22 nt, Human
cauucuccugccuguagcagug

SEQ ID NO: 2529378 - RNA, 16 nt, Human
cauucuccuuguguua

SEQ ID NO: 2529379 - RNA, 19 nt, Human
cauucucauggagaaguua

SEQ ID NO: 2529380 - RNA, 12 nt, Human
cauucucccagg

SEQ ID NO: 2529381 - RNA, 23 nt, Human
cauucucccagguaccagcugcg

SEQ ID NO: 2529382 - RNA, 15 nt, Human
cauucucccagguac

SEQ ID NO: 2529383 - RNA, 17 nt, Human
cauugccuuaacuggag

SEQ ID NO: 2529384 - RNA, 21 nt, Human
cauugcggacagccacggcca

SEQ ID NO: 2529385 - RNA, 17 nt, Human
cauugcggacagccacg

SEQ ID NO: 2529386 - RNA, 15 nt, Human
cauugcggacagcca

SEQ ID NO: 2529387 - RNA, 14 nt, Human
cauugcggacagcc

SEQ ID NO: 2529388 - RNA, 16 nt, Human
cauugcugagccucug

SEQ ID NO: 2529389 - RNA, 17 nt, Human
cauugcugagccucugc

SEQ ID NO: 2529390 - RNA, 18 nt, Human
cauugcugagccucugcu

SEQ ID NO: 2529391 - RNA, 21 nt, Human
cauugcugagccucugcuccc

SEQ ID NO: 2529392 - RNA, 18 nt, Human
cauugcugggcuugucug

SEQ ID NO: 2529393 - RNA, 22 nt, Human
cauugcugaaaaugguauuuuc

SEQ ID NO: 2529394 - RNA, 16 nt, Human
cauugcugaaaauggu

SEQ ID NO: 2529395 - RNA, 16 nt, Human
cauugcuaagaugcuc

SEQ ID NO: 2529396 - RNA, 14 nt, Human
cauugcugagccuc

SEQ ID NO: 2529397 - RNA, 15 nt, Human
cauugcugagccucu

SEQ ID NO: 2529398 - RNA, 23 nt, Human
cauugcguuugaccuuuuaugua

SEQ ID NO: 2529399 - RNA, 15 nt, Human
cauugcuaagaugcu

SEQ ID NO: 2529400 - RNA, 21 nt, Human
cauugcgcucuagccugggca

SEQ ID NO: 2529401 - RNA, 21 nt, Human
cauugccuuaacuggagcccc

SEQ ID NO: 2529402 - RNA, 13 nt, Human
cauugccuuuucu

SEQ ID NO: 2529403 - RNA, 22 nt, Human
cauuuuuguacaguuugcugua

SEQ ID NO: 2529404 - RNA, 13 nt, Human
cauuuuuguauuu

SEQ ID NO: 2529405 - RNA, 23 nt, Human
cauuuuuguuucuaccucccaga

SEQ ID NO: 2529406 - RNA, 22 nt, Human
cauuuuuguuucuaccucccag

SEQ ID NO: 2529407 - RNA, 20 nt, Human
cauuuuuguauuuuguuuaa

SEQ ID NO: 2529408 - RNA, 17 nt, Human
ccaaaaaaugcuugcuu

SEQ ID NO: 2529409 - RNA, 20 nt, Human
ccaaaaaauucuacaacaca

SEQ ID NO: 2529410 - RNA, 22 nt, Human
ccaaaaaauucuacaacacaca

SEQ ID NO: 2529411 - RNA, 17 nt, Human
ccaaaaagaccagacua

SEQ ID NO: 2529412 - RNA, 16 nt, Human
ccaaaaagaccagacu

SEQ ID NO: 2529413 - RNA, 15 nt, Human
ccaaaaagaccagac

SEQ ID NO: 2529414 - RNA, 17 nt, Human
ccaaaacucuccucugc

SEQ ID NO: 2529415 - RNA, 18 nt, Human
ccaaaacaaacaaacaga

SEQ ID NO: 2529416 - RNA, 15 nt, Human
ccaaaaccacagccc

SEQ ID NO: 2529417 - RNA, 19 nt, Human
ccaaaaagauuuucagaaa

SEQ ID NO: 2529418 - RNA, 12 nt, Human
ccaaaacaaaca

SEQ ID NO: 2529419 - RNA, 21 nt, Human
cauuuccaacaccacagacac

SEQ ID NO: 2529420 - RNA, 20 nt, Human
cauuuccaacaccacagaca

SEQ ID NO: 2529421 - RNA, 16 nt, Human
cauuugguucauuaau

SEQ ID NO: 2529422 - RNA, 20 nt, Human
cauuugguucauuaauucua

SEQ ID NO: 2529423 - RNA, 21 nt, Human
cauuugguucauuaauucuau

SEQ ID NO: 2529424 - RNA, 23 nt, Human
cauuuuucuuagggaaggauaca

SEQ ID NO: 2529425 - RNA, 21 nt, Human
cauuuuuguacaguuugcugu

SEQ ID NO: 2529426 - RNA, 20 nt, Human
cauuuuuguacaguuugcug

SEQ ID NO: 2529427 - RNA, 14 nt, Human
cauuuuuguacagu

SEQ ID NO: 2529428 - RNA, 13 nt, Human
cauuuuuguacag

SEQ ID NO: 2529429 - RNA, 12 nt, Human
cauuuuuguaca

SEQ ID NO: 2529430 - RNA, 17 nt, Human
cauuuuugauuuaugca

SEQ ID NO: 2529431 - RNA, 22 nt, Human
cauuuccaacaccacagacaca

SEQ ID NO: 2529432 - RNA, 20 nt, Human
cauuuuugaauacaggcaua

SEQ ID NO: 2529433 - RNA, 18 nt, Human
cauuuuugaauacaggca

SEQ ID NO: 2529434 - RNA, 22 nt, Human
cauuuggugguuucagaaaugu

SEQ ID NO: 2529435 - RNA, 23 nt, Human
cauuuggugguuucagaaaugug

SEQ ID NO: 2529436 - RNA, 12 nt, Human
cauuuccaagca

SEQ ID NO: 2529437 - RNA, 19 nt, Human
cauuuccaacaccacagac

SEQ ID NO: 2529438 - RNA, 18 nt, Human
cauuuccaacaccacaga

SEQ ID NO: 2529439 - RNA, 13 nt, Human
cauuuccaacacc

SEQ ID NO: 2529440 - RNA, 21 nt, Human
cauuuccaaaugaaugaccuu

SEQ ID NO: 2529441 - RNA, 17 nt, Human
cauuuccaaaugaauga

SEQ ID NO: 2529442 - RNA, 23 nt, Human
cauuucauuguaugauguguugu

SEQ ID NO: 2529443 - RNA, 17 nt, Human
cauuuccaaauucacaa

SEQ ID NO: 2529444 - RNA, 20 nt, Human
cauuucaccccucccuuucu

SEQ ID NO: 2529445 - RNA, 19 nt, Human
cauuucaccccucccuuuc

SEQ ID NO: 2529446 - RNA, 18 nt, Human
cauuucaccccucccuuu

SEQ ID NO: 2529447 - RNA, 17 nt, Human
cauuucaccccucccuu

SEQ ID NO: 2529448 - RNA, 22 nt, Human
cauuucaccccucccuuucucc

SEQ ID NO: 2529449 - RNA, 21 nt, Human
cauuucaccccucccuuucuc

SEQ ID NO: 2529450 - RNA, 23 nt, Human
cauuucaccccucccuuucuccc

SEQ ID NO: 2529451 - RNA, 18 nt, Human
cauuucaaaugugcuguc

SEQ ID NO: 2529452 - RNA, 20 nt, Human
cauuucauuguaugaugugu

SEQ ID NO: 2529453 - RNA, 18 nt, Human
cauuucauuguaugaugu

SEQ ID NO: 2529454 - RNA, 14 nt, Human
cauuucauuuccua

SEQ ID NO: 2529455 - RNA, 18 nt, Human
cauuucauuugugccaga

SEQ ID NO: 2529456 - RNA, 16 nt, Human
cauuucauuguaugau

SEQ ID NO: 2529457 - RNA, 13 nt, Human
cauuucauuguau

SEQ ID NO: 2529458 - RNA, 12 nt, Human
cauuucauugua

SEQ ID NO: 2529459 - RNA, 16 nt, Human
cauuucaauucucaaa

SEQ ID NO: 2529460 - RNA, 15 nt, Human
cauuucaacuguuug

SEQ ID NO: 2529461 - RNA, 16 nt, Human
cauuucaccccucccu

SEQ ID NO: 2529462 - RNA, 15 nt, Human
cauuucaccccuccc

SEQ ID NO: 2529463 - RNA, 14 nt, Human
cauuucaccccucc

SEQ ID NO: 2529464 - RNA, 13 nt, Human
cauuucaccccuc

SEQ ID NO: 2529465 - RNA, 13 nt, Human
cauuuauuuguga

SEQ ID NO: 2529466 - RNA, 18 nt, Human
cauuuauuuuucucauga

SEQ ID NO: 2529467 - RNA, 19 nt, Human
cauuuauuuuuuacauuau

SEQ ID NO: 2529468 - RNA, 17 nt, Human
cauuuauuuuuuacauu

SEQ ID NO: 2529469 - RNA, 23 nt, Human
cauuggcagcaggugcugcuacc

SEQ ID NO: 2529470 - RNA, 21 nt, Human
cauuggcagcaggugcugcua

SEQ ID NO: 2529471 - RNA, 20 nt, Human
cauuggcagcaggugcugcu

SEQ ID NO: 2529472 - RNA, 17 nt, Human
cauuggcagcaggugcu

SEQ ID NO: 2529473 - RNA, 16 nt, Human
cauuggcagcaggugc

SEQ ID NO: 2529474 - RNA, 14 nt, Human
cauuggcagcaggu

SEQ ID NO: 2529475 - RNA, 21 nt, Human
cauuggcaccuaauccaggca

SEQ ID NO: 2529476 - RNA, 17 nt, Human
cauugcuuacacggaug

SEQ ID NO: 2529477 - RNA, 21 nt, Human
cauugcuguugucccucugcu

SEQ ID NO: 2529478 - RNA, 20 nt, Human
cauuggcaccuaauccaggc

SEQ ID NO: 2529479 - RNA, 22 nt, Human
cauugcugugaauuagcucacu

SEQ ID NO: 2529480 - RNA, 21 nt, Human
cauugcugguucuauuuaaug

SEQ ID NO: 2529481 - RNA, 15 nt, Human
cauugcugguucuau

SEQ ID NO: 2529482 - RNA, 15 nt, Human
cauuggcugagagac

SEQ ID NO: 2529483 - RNA, 24 nt, Human
cauuggcagcaggugcugcuaccc

SEQ ID NO: 2529484 - RNA, 19 nt, Human
cauuggcuauuuaaaacuu

SEQ ID NO: 2529485 - RNA, 22 nt, Human
cauuggcuuuauccucuuuaga

SEQ ID NO: 2529486 - RNA, 13 nt, Human
cauuggcuuuauc

SEQ ID NO: 2529487 - RNA, 18 nt, Human
cauuggcuauuuaaaacu

SEQ ID NO: 2529488 - RNA, 14 nt, Human
cauuggcuauuuaa

SEQ ID NO: 2529489 - RNA, 22 nt, Human
cauuggcucuugaacugagcuu

SEQ ID NO: 2529490 - RNA, 16 nt, Human
cauuuauucugcucac

SEQ ID NO: 2529491 - RNA, 23 nt, Human
cauugggcagcgcccuuccucuc

SEQ ID NO: 2529492 - RNA, 22 nt, Human
cauugggcagcgcccuuccucu

SEQ ID NO: 2529493 - RNA, 20 nt, Human
cauugggcagcgcccuuccu

SEQ ID NO: 2529494 - RNA, 19 nt, Human
cauugggcagcgcccuucc

SEQ ID NO: 2529495 - RNA, 23 nt, Human
cauugggaaggggacccccgccc

SEQ ID NO: 2529496 - RNA, 22 nt, Human
caugcaaggucauuuuuuuuaa

SEQ ID NO: 2529497 - RNA, 19 nt, Human
caugcugagucucccaagg

SEQ ID NO: 2529498 - RNA, 17 nt, Human
caugcugagucucccaa

SEQ ID NO: 2529499 - RNA, 15 nt, Human
caugcugagucuccc

SEQ ID NO: 2529500 - RNA, 14 nt, Human
caugcugagucucc

SEQ ID NO: 2529501 - RNA, 19 nt, Human
caugcugaggccugggccg

SEQ ID NO: 2529502 - RNA, 18 nt, Human
caugcugaggccugggcc

SEQ ID NO: 2529503 - RNA, 17 nt, Human
caugcugaggccugggc

SEQ ID NO: 2529504 - RNA, 16 nt, Human
caugcugaggccuggg

SEQ ID NO: 2529505 - RNA, 15 nt, Human
caugcugaggccugg

SEQ ID NO: 2529506 - RNA, 16 nt, Human
caugcaaugacaucuu

SEQ ID NO: 2529507 - RNA, 17 nt, Human
caugcaaggucauuuuu

SEQ ID NO: 2529508 - RNA, 18 nt, Human
caugcaaggucauuuuuu

SEQ ID NO: 2529509 - RNA, 18 nt, Human
caugauucauuuuaacau

SEQ ID NO: 2529510 - RNA, 14 nt, Human
caugauuccuuccu

SEQ ID NO: 2529511 - RNA, 16 nt, Human
caugauuccuuccugu

SEQ ID NO: 2529512 - RNA, 19 nt, Human
caugauuccuuccuguucu

SEQ ID NO: 2529513 - RNA, 14 nt, Human
caugauucuauuua

SEQ ID NO: 2529514 - RNA, 21 nt, Human
caugauucgcccaaagccaga

SEQ ID NO: 2529515 - RNA, 21 nt, Human
caugcugagucucccaaggcu

SEQ ID NO: 2529516 - RNA, 18 nt, Human
caugcugcccugugagua

SEQ ID NO: 2529517 - RNA, 16 nt, Human
caugcugcccugugag

SEQ ID NO: 2529518 - RNA, 19 nt, Human
cauggccuuugcuugaaag

SEQ ID NO: 2529519 - RNA, 22 nt, Human
cauggccuuugcuugaaagaaa

SEQ ID NO: 2529520 - RNA, 12 nt, Human
caugcugccucc

SEQ ID NO: 2529521 - RNA, 20 nt, Human
caugcugagucucccaaggc

SEQ ID NO: 2529522 - RNA, 19 nt, Human
caugcugcuggacaguauc

SEQ ID NO: 2529523 - RNA, 14 nt, Human
caugcugccuccag

SEQ ID NO: 2529524 - RNA, 16 nt, Human
caugaauuaguuuuau

SEQ ID NO: 2529525 - RNA, 20 nt, Human
caugaauucuuaugcuuaua

SEQ ID NO: 2529526 - RNA, 19 nt, Human
caugacaagccccaggcag

SEQ ID NO: 2529527 - RNA, 14 nt, Human
caugacacgaauau

SEQ ID NO: 2529528 - RNA, 14 nt, Human
caugaauuugugaa

SEQ ID NO: 2529529 - RNA, 18 nt, Human
caugaauucuuaugcuua

SEQ ID NO: 2529530 - RNA, 13 nt, Human
caugaauguauca

SEQ ID NO: 2529531 - RNA, 17 nt, Human
caugaauguaucaggaa

SEQ ID NO: 2529532 - RNA, 18 nt, Human
caugaauguaucaggaaa

SEQ ID NO: 2529533 - RNA, 17 nt, Human
caugacccaggcugggc

SEQ ID NO: 2529534 - RNA, 16 nt, Human
caugacccaggcuggg

SEQ ID NO: 2529535 - RNA, 15 nt, Human
caugacccaggcugg

SEQ ID NO: 2529536 - RNA, 13 nt, Human
caugacccaggcu

SEQ ID NO: 2529537 - RNA, 19 nt, Human
caugacccaccccugugcu

SEQ ID NO: 2529538 - RNA, 18 nt, Human
caugacccaccccugugc

SEQ ID NO: 2529539 - RNA, 17 nt, Human
caugacccaccccugug

SEQ ID NO: 2529540 - RNA, 16 nt, Human
caugacccaccccugu

SEQ ID NO: 2529541 - RNA, 15 nt, Human
caugacccaccccug

SEQ ID NO: 2529542 - RNA, 14 nt, Human
caugacccaccccu

SEQ ID NO: 2529543 - RNA, 13 nt, Human
caugacccacccc

SEQ ID NO: 2529544 - RNA, 12 nt, Human
caugacccaccc

SEQ ID NO: 2529545 - RNA, 18 nt, Human
caugaccauacugaggga

SEQ ID NO: 2529546 - RNA, 16 nt, Human
caugauucaugccaau

SEQ ID NO: 2529547 - RNA, 21 nt, Human
caugauucaugccaauuagca

SEQ ID NO: 2529548 - RNA, 13 nt, Human
caugauucauuuu

SEQ ID NO: 2529549 - RNA, 14 nt, Human
caugauucauuuua

SEQ ID NO: 2529550 - RNA, 19 nt, Human
caugacccaggcugggcaa

SEQ ID NO: 2529551 - RNA, 18 nt, Human
caugaccuaguuuuccau

SEQ ID NO: 2529552 - RNA, 12 nt, Human
caugauuagcaa

SEQ ID NO: 2529553 - RNA, 18 nt, Human
caugacacgaauauugcu

SEQ ID NO: 2529554 - RNA, 17 nt, Human
caugacacgaauauugc

SEQ ID NO: 2529555 - RNA, 23 nt, Human
caugacacagcuuuaucaccaga

SEQ ID NO: 2529556 - RNA, 16 nt, Human
caugacauguuauaua

SEQ ID NO: 2529557 - RNA, 22 nt, Human
caugacacagcuuuaucaccag

SEQ ID NO: 2529558 - RNA, 12 nt, Human
caugacacagcu

SEQ ID NO: 2529559 - RNA, 20 nt, Human
caugacaagccccaggcagg

SEQ ID NO: 2529560 - RNA, 23 nt, Human
caugacauuccuaaacuaucuuu

SEQ ID NO: 2529561 - RNA, 19 nt, Human
caugacauguuauauauuu

SEQ ID NO: 2529562 - RNA, 17 nt, Human
caugacauguuauauau

SEQ ID NO: 2529563 - RNA, 17 nt, Human
caugaccacauagcaug

SEQ ID NO: 2529564 - RNA, 13 nt, Human
caugacauuucuu

SEQ ID NO: 2529565 - RNA, 23 nt, Human
caucaggccaggcccucugccca

SEQ ID NO: 2529566 - RNA, 22 nt, Human
caucaggccaggcccucugccc

SEQ ID NO: 2529567 - RNA, 21 nt, Human
caucaggccaggcccucugcc

SEQ ID NO: 2529568 - RNA, 20 nt, Human
caucaggccaggcccucugc

SEQ ID NO: 2529569 - RNA, 14 nt, Human
caucccagccccaa

SEQ ID NO: 2529570 - RNA, 13 nt, Human
caucccagcccca

SEQ ID NO: 2529571 - RNA, 16 nt, Human
caucccagccccaaug

SEQ ID NO: 2529572 - RNA, 16 nt, Human
caucccauugcccugg

SEQ ID NO: 2529573 - RNA, 16 nt, Human
cauccccacccuugga

SEQ ID NO: 2529574 - RNA, 13 nt, Human
caucccauugccc

SEQ ID NO: 2529575 - RNA, 15 nt, Human
caucccauugcccug

SEQ ID NO: 2529576 - RNA, 17 nt, Human
caucccauugcccuggu

SEQ ID NO: 2529577 - RNA, 11 nt, Human
cauccccaggg

SEQ ID NO: 2529578 - RNA, 12 nt, Human
cauccccagggg

SEQ ID NO: 2529579 - RNA, 18 nt, Human
cauccccaggggucccag

SEQ ID NO: 2529580 - RNA, 21 nt, Human
cauccccaggggucccagcca

SEQ ID NO: 2529581 - RNA, 17 nt, Human
caucccauguaacagaa

SEQ ID NO: 2529582 - RNA, 20 nt, Human
caucccaugauguagugccu

SEQ ID NO: 2529583 - RNA, 16 nt, Human
caucccauguaacaga

SEQ ID NO: 2529584 - RNA, 15 nt, Human
caucccauguauuua

SEQ ID NO: 2529585 - RNA, 19 nt, Human
caucccauguaacagaaag

SEQ ID NO: 2529586 - RNA, 12 nt, Human
caucccauugcc

SEQ ID NO: 2529587 - RNA, 18 nt, Human
caucccaugauguagugc

SEQ ID NO: 2529588 - RNA, 17 nt, Human
caucccaugaacacacu

SEQ ID NO: 2529589 - RNA, 19 nt, Human
caucaggaugaacccagga

SEQ ID NO: 2529590 - RNA, 17 nt, Human
caucaggaugaacccag

SEQ ID NO: 2529591 - RNA, 23 nt, Human
cauccuggccuggcacaucagaa

SEQ ID NO: 2529592 - RNA, 14 nt, Human
cauccuggccuggc

SEQ ID NO: 2529593 - RNA, 19 nt, Human
cauccuggcccaucagugu

SEQ ID NO: 2529594 - RNA, 16 nt, Human
cauccuggcccaucag

SEQ ID NO: 2529595 - RNA, 15 nt, Human
cauccuggcccauca

SEQ ID NO: 2529596 - RNA, 12 nt, Human
cauccugugaag

SEQ ID NO: 2529597 - RNA, 20 nt, Human
cauccugucccaccaugcag

SEQ ID NO: 2529598 - RNA, 18 nt, Human
cauccugucccaccaugc

SEQ ID NO: 2529599 - RNA, 15 nt, Human
cauccugucccacca

SEQ ID NO: 2529600 - RNA, 21 nt, Human
cauccuggccuggcacaucag

SEQ ID NO: 2529601 - RNA, 18 nt, Human
cauccuggccuggcacau

SEQ ID NO: 2529602 - RNA, 14 nt, Human
cauccuggcccauc

SEQ ID NO: 2529603 - RNA, 13 nt, Human
cauccuggcccau

SEQ ID NO: 2529604 - RNA, 11 nt, Human
cauccuggccc

SEQ ID NO: 2529605 - RNA, 12 nt, Human
cauccuggccca

SEQ ID NO: 2529606 - RNA, 17 nt, Human
cauccccauccuccagc

SEQ ID NO: 2529607 - RNA, 16 nt, Human
cauccccauccuccag

SEQ ID NO: 2529608 - RNA, 15 nt, Human
cauccccauccucca

SEQ ID NO: 2529609 - RNA, 14 nt, Human
cauccccacucacg

SEQ ID NO: 2529610 - RNA, 23 nt, Human
cauccuggcacccggccccugcu

SEQ ID NO: 2529611 - RNA, 17 nt, Human
caucagcacgauuucug

SEQ ID NO: 2529612 - RNA, 18 nt, Human
caucagcacgauuucugu

SEQ ID NO: 2529613 - RNA, 14 nt, Human
caucagacagaugg

SEQ ID NO: 2529614 - RNA, 23 nt, Human
caucagaaggagaaggaaggaga

SEQ ID NO: 2529615 - RNA, 15 nt, Human
caucagaaggagaag

SEQ ID NO: 2529616 - RNA, 14 nt, Human
caucagaaggagaa

SEQ ID NO: 2529617 - RNA, 17 nt, Human
caucagcugcugaaaca

SEQ ID NO: 2529618 - RNA, 18 nt, Human
caucagcugcugaaacaa

SEQ ID NO: 2529619 - RNA, 15 nt, Human
caucagcugcugaaa

SEQ ID NO: 2529620 - RNA, 13 nt, Human
caucaggccaggc

SEQ ID NO: 2529621 - RNA, 13 nt, Human
caucaggaugaac

SEQ ID NO: 2529622 - RNA, 22 nt, Human
caucaggagaaaaagccuccag

SEQ ID NO: 2529623 - RNA, 19 nt, Human
caucaggagaaaaagccuc

SEQ ID NO: 2529624 - RNA, 15 nt, Human
caucaggacucuugu

SEQ ID NO: 2529625 - RNA, 13 nt, Human
caucaggacucuu

SEQ ID NO: 2529626 - RNA, 23 nt, Human
caucagcuguaagaagagacugg

SEQ ID NO: 2529627 - RNA, 23 nt, Human
caucagcuuaggggcugcugacc

SEQ ID NO: 2529628 - RNA, 20 nt, Human
caucagcuugcccuguuaaa

SEQ ID NO: 2529629 - RNA, 17 nt, Human
caucagcuguaagaaga

SEQ ID NO: 2529630 - RNA, 19 nt, Human
caucagcuguaagaagaga

SEQ ID NO: 2529631 - RNA, 16 nt, Human
caucagagcaaauuug

SEQ ID NO: 2529632 - RNA, 17 nt, Human
caucagagcaaauuugg

SEQ ID NO: 2529633 - RNA, 11 nt, Human
caucugugaau

SEQ ID NO: 2529634 - RNA, 15 nt, Human
caucuuaagagaugc

SEQ ID NO: 2529635 - RNA, 13 nt, Human
caucuuacugaag

SEQ ID NO: 2529636 - RNA, 21 nt, Human
caucuuagguuggcaaaaagg

SEQ ID NO: 2529637 - RNA, 22 nt, Human
caucuuagguuggcaaaaaggc

SEQ ID NO: 2529638 - RNA, 14 nt, Human
caucuuacugaagg

SEQ ID NO: 2529639 - RNA, 15 nt, Human
caucuuacugaaggu

SEQ ID NO: 2529640 - RNA, 22 nt, Human
caucuuacuguaccuguuccuu

SEQ ID NO: 2529641 - RNA, 23 nt, Human
caucuuagagcaaagagccagca

SEQ ID NO: 2529642 - RNA, 19 nt, Human
caucugugaaaggaaagag

SEQ ID NO: 2529643 - RNA, 18 nt, Human
caucugugaaaggaaaga

SEQ ID NO: 2529644 - RNA, 15 nt, Human
caucgaauguguaca

SEQ ID NO: 2529645 - RNA, 13 nt, Human
caucgaaugugua

SEQ ID NO: 2529646 - RNA, 16 nt, Human
caucugucccuccggg

SEQ ID NO: 2529647 - RNA, 17 nt, Human
caucugucccuccggga

SEQ ID NO: 2529648 - RNA, 18 nt, Human
caucugucccuccgggac

SEQ ID NO: 2529649 - RNA, 12 nt, Human
caucuguccuca

SEQ ID NO: 2529650 - RNA, 20 nt, Human
caucugucccuccgggaccu

SEQ ID NO: 2529651 - RNA, 17 nt, Human
caucugucccugccuca

SEQ ID NO: 2529652 - RNA, 12 nt, Human
caucgcaaugua

SEQ ID NO: 2529653 - RNA, 21 nt, Human
caucgaaucuacuaauuccac

SEQ ID NO: 2529654 - RNA, 19 nt, Human
cauccuuuucugcagaggg

SEQ ID NO: 2529655 - RNA, 19 nt, Human
cauccuuucugccucucaa

SEQ ID NO: 2529656 - RNA, 18 nt, Human
cauccuuucugccucuca

SEQ ID NO: 2529657 - RNA, 16 nt, Human
cauccuuucugccucu

SEQ ID NO: 2529658 - RNA, 14 nt, Human
cauccuuuccagca

SEQ ID NO: 2529659 - RNA, 16 nt, Human
cauccuuugcacuguc

SEQ ID NO: 2529660 - RNA, 17 nt, Human
cauccuuuucugcagag

SEQ ID NO: 2529661 - RNA, 14 nt, Human
cauccuugagucaa

SEQ ID NO: 2529662 - RNA, 15 nt, Human
cauccuucugccuuu

SEQ ID NO: 2529663 - RNA, 12 nt, Human
cauccuucugcc

SEQ ID NO: 2529664 - RNA, 18 nt, Human
caguauuuuggagaaauu

SEQ ID NO: 2529665 - RNA, 17 nt, Human
caguauuuuggagaaau

SEQ ID NO: 2529666 - RNA, 18 nt, Human
cagucaccccggccaccu

SEQ ID NO: 2529667 - RNA, 21 nt, Human
caguuuaauccuucuaguuuc

SEQ ID NO: 2529668 - RNA, 16 nt, Human
caguuuaauccuucua

SEQ ID NO: 2529669 - RNA, 13 nt, Human
caguuuaucauuc

SEQ ID NO: 2529670 - RNA, 21 nt, Human
caguuugcagaaaagcaccug

SEQ ID NO: 2529671 - RNA, 22 nt, Human
caguuugcagaaaagcaccugc

SEQ ID NO: 2529672 - RNA, 23 nt, Human
caguuugcagaaaagcaccugcc

SEQ ID NO: 2529673 - RNA, 21 nt, Human
caguuugcuuuguaugcacuu

SEQ ID NO: 2529674 - RNA, 14 nt, Human
caguuugcuuugua

SEQ ID NO: 2529675 - RNA, 19 nt, Human
caguuugcuguacuagaga

SEQ ID NO: 2529676 - RNA, 12 nt, Human
caguuugcugua

SEQ ID NO: 2529677 - RNA, 12 nt, Human
caguuugcuuug

SEQ ID NO: 2529678 - RNA, 17 nt, Human
caguuuggcaaacucuc

SEQ ID NO: 2529679 - RNA, 13 nt, Human
caguuuguauaua

SEQ ID NO: 2529680 - RNA, 21 nt, Human
caguuuguacagacguaugcu

SEQ ID NO: 2529681 - RNA, 19 nt, Human
cauaaucuggacuccucug

SEQ ID NO: 2529682 - RNA, 16 nt, Human
caguuugugugucuua

SEQ ID NO: 2529683 - RNA, 15 nt, Human
caguuugugugucuu

SEQ ID NO: 2529684 - RNA, 16 nt, Human
caguuugucacaugaa

SEQ ID NO: 2529685 - RNA, 14 nt, Human
caguuuguauauac

SEQ ID NO: 2529686 - RNA, 13 nt, Human
caguuugucagac

SEQ ID NO: 2529687 - RNA, 23 nt, Human
caguuugugugucuuaauuauua

SEQ ID NO: 2529688 - RNA, 21 nt, Human
caguuugugugucuuaauuau

SEQ ID NO: 2529689 - RNA, 20 nt, Human
cauaaucuggacuccucugu

SEQ ID NO: 2529690 - RNA, 22 nt, Human
cauaaucuggacuccucugucc

SEQ ID NO: 2529691 - RNA, 21 nt, Human
cauaaucuggacuccucuguc

SEQ ID NO: 2529692 - RNA, 14 nt, Human
cauaaugcgugcau

SEQ ID NO: 2529693 - RNA, 17 nt, Human
cauaaugcgugcauacc

SEQ ID NO: 2529694 - RNA, 18 nt, Human
cauaaucuguacaaugaa

SEQ ID NO: 2529695 - RNA, 21 nt, Human
cauaaucuucugccuucucau

SEQ ID NO: 2529696 - RNA, 22 nt, Human
cauaaucuucugccuucucaug

SEQ ID NO: 2529697 - RNA, 13 nt, Human
cauaaucuucugc

SEQ ID NO: 2529698 - RNA, 15 nt, Human
cauaaucuucugccu

SEQ ID NO: 2529699 - RNA, 23 nt, Human
cauaaucuggacuccucugucca

SEQ ID NO: 2529700 - RNA, 14 nt, Human
caguuguuggccuc

SEQ ID NO: 2529701 - RNA, 15 nt, Human
caguuguuggccucc

SEQ ID NO: 2529702 - RNA, 20 nt, Human
caguuguuggccuccggccu

SEQ ID NO: 2529703 - RNA, 13 nt, Human
caguuguuugaug

SEQ ID NO: 2529704 - RNA, 14 nt, Human
caguuguuuucccg

SEQ ID NO: 2529705 - RNA, 13 nt, Human
caguuguuuuccc

SEQ ID NO: 2529706 - RNA, 16 nt, Human
caguuuaaaaaaauug

SEQ ID NO: 2529707 - RNA, 18 nt, Human
caguuuaaaaaaauuggu

SEQ ID NO: 2529708 - RNA, 20 nt, Human
caguuuaaccugaugcaguc

SEQ ID NO: 2529709 - RNA, 20 nt, Human
cauauuaccacagacauacu

SEQ ID NO: 2529710 - RNA, 21 nt, Human
cauauuaccacagacauacua

SEQ ID NO: 2529711 - RNA, 17 nt, Human
cauauuaccacagacau

SEQ ID NO: 2529712 - RNA, 15 nt, Human
cauaggccugggugc

SEQ ID NO: 2529713 - RNA, 17 nt, Human
cauaggccugggugcug

SEQ ID NO: 2529714 - RNA, 18 nt, Human
cauaggccugggugcugg

SEQ ID NO: 2529715 - RNA, 19 nt, Human
cauaggccugggugcuggc

SEQ ID NO: 2529716 - RNA, 17 nt, Human
cauagggucucuucagg

SEQ ID NO: 2529717 - RNA, 23 nt, Human
cauaggaaaaguacauuuaauac

SEQ ID NO: 2529718 - RNA, 22 nt, Human
cauaggaaaaguacauuuaaua

SEQ ID NO: 2529719 - RNA, 19 nt, Human
cauaggaaaaguacauuua

SEQ ID NO: 2529720 - RNA, 18 nt, Human
cauaggaaaaguacauuu

SEQ ID NO: 2529721 - RNA, 24 nt, Human
cauaggaagggaccaaggcaaggc

SEQ ID NO: 2529722 - RNA, 12 nt, Human
cauaggaaaagu

SEQ ID NO: 2529723 - RNA, 21 nt, Human
cauagcuugauaaagggccaa

SEQ ID NO: 2529724 - RNA, 16 nt, Human
cauagcuaucaagugu

SEQ ID NO: 2529725 - RNA, 21 nt, Human
cauagcuaagaaauaaaacug

SEQ ID NO: 2529726 - RNA, 22 nt, Human
cauagcuaagaaauaaaacugu

SEQ ID NO: 2529727 - RNA, 18 nt, Human
cauaggaccuuuccacca

SEQ ID NO: 2529728 - RNA, 16 nt, Human
cauaggaccuuuccac

SEQ ID NO: 2529729 - RNA, 23 nt, Human
cauaggacucaaaguuucagaga

SEQ ID NO: 2529730 - RNA, 17 nt, Human
cauaggaggcuucuguu

SEQ ID NO: 2529731 - RNA, 13 nt, Human
cauaggcccagug

SEQ ID NO: 2529732 - RNA, 14 nt, Human
cauaggccugggug

SEQ ID NO: 2529733 - RNA, 15 nt, Human
cauagggucucuuca

SEQ ID NO: 2529734 - RNA, 18 nt, Human
cauagcccagacacagaa

SEQ ID NO: 2529735 - RNA, 16 nt, Human
cauagcccagacacag

SEQ ID NO: 2529736 - RNA, 11 nt, Human
cauagcccagu

SEQ ID NO: 2529737 - RNA, 15 nt, Human
cauagccaggaaacu

SEQ ID NO: 2529738 - RNA, 16 nt, Human
cauagcccaucccugc

SEQ ID NO: 2529739 - RNA, 13 nt, Human
cauagcccauccc

SEQ ID NO: 2529740 - RNA, 15 nt, Human
cauagcccaguagac

SEQ ID NO: 2529741 - RNA, 12 nt, Human
cauagcccucac

SEQ ID NO: 2529742 - RNA, 15 nt, Human
cauagcccucacccu

SEQ ID NO: 2529743 - RNA, 19 nt, Human
cauagcccucacccugggg

SEQ ID NO: 2529744 - RNA, 18 nt, Human
cauagcccaucccugccu

SEQ ID NO: 2529745 - RNA, 17 nt, Human
cauagcccaucccugcc

SEQ ID NO: 2529746 - RNA, 23 nt, Human
cauagcccaucccugccugguca

SEQ ID NO: 2529747 - RNA, 18 nt, Human
cauagccuaaucccuggg

SEQ ID NO: 2529748 - RNA, 15 nt, Human
cauagccuauauuua

SEQ ID NO: 2529749 - RNA, 13 nt, Human
cauagccuauauu

SEQ ID NO: 2529750 - RNA, 12 nt, Human
cauagccuauau

SEQ ID NO: 2529751 - RNA, 19 nt, Human
cauagccuaaucccugggc

SEQ ID NO: 2529752 - RNA, 15 nt, Human
cauagccaccccaga

SEQ ID NO: 2529753 - RNA, 15 nt, Human
cauagcauuaacuaa

SEQ ID NO: 2529754 - RNA, 16 nt, Human
cauagcauuaacuaau

SEQ ID NO: 2529755 - RNA, 23 nt, Human
cauagcauuaacuaaucuauugg

SEQ ID NO: 2529756 - RNA, 21 nt, Human
cauagcauagcuagagauugg

SEQ ID NO: 2529757 - RNA, 15 nt, Human
cauagaugcagguga

SEQ ID NO: 2529758 - RNA, 15 nt, Human
cauagcaugacauuu

SEQ ID NO: 2529759 - RNA, 17 nt, Human
cauagcaugacauuucu

SEQ ID NO: 2529760 - RNA, 18 nt, Human
cauagcaugacauuucuu

SEQ ID NO: 2529761 - RNA, 11 nt, Human
cauagcauuaa

SEQ ID NO: 2529762 - RNA, 20 nt, Human
cauagcagcuuauucacaag

SEQ ID NO: 2529763 - RNA, 18 nt, Human
cauagauugagaaguuuu

SEQ ID NO: 2529764 - RNA, 17 nt, Human
cauagauucccugagca

SEQ ID NO: 2529765 - RNA, 18 nt, Human
cauagauucccugagcag

SEQ ID NO: 2529766 - RNA, 14 nt, Human
cauacacacacaca

SEQ ID NO: 2529767 - RNA, 15 nt, Human
cauacacacacacac

SEQ ID NO: 2529768 - RNA, 16 nt, Human
cauacacacacacaca

SEQ ID NO: 2529769 - RNA, 19 nt, Human
cauacacacacacacacag

SEQ ID NO: 2529770 - RNA, 20 nt, Human
cauacacacacacacacagc

SEQ ID NO: 2529771 - RNA, 23 nt, Human
cauagaugucccuuucuuggcca

SEQ ID NO: 2529772 - RNA, 21 nt, Human
cauaaugcgugcauaccacuu

SEQ ID NO: 2529773 - RNA, 20 nt, Human
cauaauuuucuucaugcaau

SEQ ID NO: 2529774 - RNA, 14 nt, Human
cauaauuuucuuca

SEQ ID NO: 2529775 - RNA, 15 nt, Human
cauacaauuccaaac

SEQ ID NO: 2529776 - RNA, 13 nt, Human
cauacaaggccca

SEQ ID NO: 2529777 - RNA, 12 nt, Human
cauacacacaca

SEQ ID NO: 2529778 - RNA, 21 nt, Human
cagagguuaucugucccaggu

SEQ ID NO: 2529779 - RNA, 19 nt, Human
cagagguuaucugucccag

SEQ ID NO: 2529780 - RNA, 18 nt, Human
cagagguuaucuguccca

SEQ ID NO: 2529781 - RNA, 23 nt, Human
cagauacaggaaaagcugcugac

SEQ ID NO: 2529782 - RNA, 23 nt, Human
cagaggugggcaggugguggcac

SEQ ID NO: 2529783 - RNA, 22 nt, Human
cagaggugggcaggugguggca

SEQ ID NO: 2529784 - RNA, 20 nt, Human
cagaggugggcagguggugg

SEQ ID NO: 2529785 - RNA, 17 nt, Human
cagaggugggcaggugg

SEQ ID NO: 2529786 - RNA, 16 nt, Human
cagaggugggcaggug

SEQ ID NO: 2529787 - RNA, 15 nt, Human
cagaggugggcaggu

SEQ ID NO: 2529788 - RNA, 14 nt, Human
cagaggugggcagg

SEQ ID NO: 2529789 - RNA, 13 nt, Human
cagaggugggcag

SEQ ID NO: 2529790 - RNA, 17 nt, Human
cagagguggccagagcu

SEQ ID NO: 2529791 - RNA, 14 nt, Human
cagagguggccaga

SEQ ID NO: 2529792 - RNA, 16 nt, Human
cagaggucugugcuga

SEQ ID NO: 2529793 - RNA, 21 nt, Human
cagagguggccagagcuggga

SEQ ID NO: 2529794 - RNA, 19 nt, Human
cagagguggccagagcugg

SEQ ID NO: 2529795 - RNA, 12 nt, Human
cagaggugggca

SEQ ID NO: 2529796 - RNA, 17 nt, Human
cagagcuggcucugagc

SEQ ID NO: 2529797 - RNA, 13 nt, Human
cagagcuggcucu

SEQ ID NO: 2529798 - RNA, 18 nt, Human
cagagcuggcucugagcg

SEQ ID NO: 2529799 - RNA, 10 nt, Human
cagagcuggg

SEQ ID NO: 2529800 - RNA, 15 nt, Human
cagaggucugugcug

SEQ ID NO: 2529801 - RNA, 14 nt, Human
cagaggucugugcu

SEQ ID NO: 2529802 - RNA, 23 nt, Human
cagaggucucugccggcucuuuc

SEQ ID NO: 2529803 - RNA, 20 nt, Human
cagaggucucugccggcucu

SEQ ID NO: 2529804 - RNA, 19 nt, Human
cagaggucucugccggcuc

SEQ ID NO: 2529805 - RNA, 20 nt, Human
cagagcugggaggcauggcc

SEQ ID NO: 2529806 - RNA, 15 nt, Human
cagaggucucugccg

SEQ ID NO: 2529807 - RNA, 23 nt, Human
cagagcugggaggcauggcccug

SEQ ID NO: 2529808 - RNA, 15 nt, Human
cagagcugggaggca

SEQ ID NO: 2529809 - RNA, 14 nt, Human
cagagcugggaggc

SEQ ID NO: 2529810 - RNA, 13 nt, Human
cagagcugggagg

SEQ ID NO: 2529811 - RNA, 22 nt, Human
cagaucauugugaaauuauuca

SEQ ID NO: 2529812 - RNA, 23 nt, Human
cagaucauuaucagccugugcca

SEQ ID NO: 2529813 - RNA, 12 nt, Human
cagauccagccu

SEQ ID NO: 2529814 - RNA, 19 nt, Human
cagaucauuucaaaacuca

SEQ ID NO: 2529815 - RNA, 13 nt, Human
cagauccagccug

SEQ ID NO: 2529816 - RNA, 14 nt, Human
cagauccagccugg

SEQ ID NO: 2529817 - RNA, 15 nt, Human
cagauccagccuggg

SEQ ID NO: 2529818 - RNA, 17 nt, Human
cagauccagccuggggu

SEQ ID NO: 2529819 - RNA, 22 nt, Human
cagauacuggaaguuuugcauu

SEQ ID NO: 2529820 - RNA, 15 nt, Human
cagauaccucacccu

SEQ ID NO: 2529821 - RNA, 16 nt, Human
cagauaccagccccug

SEQ ID NO: 2529822 - RNA, 17 nt, Human
cagauacauaugagugu

SEQ ID NO: 2529823 - RNA, 14 nt, Human
cagauaccagcccc

SEQ ID NO: 2529824 - RNA, 17 nt, Human
cagauacaugguuguga

SEQ ID NO: 2529825 - RNA, 16 nt, Human
cagaucauugugaaau

SEQ ID NO: 2529826 - RNA, 18 nt, Human
cagauacuggaaguuuug

SEQ ID NO: 2529827 - RNA, 21 nt, Human
cagauacuggaaguuuugcau

SEQ ID NO: 2529828 - RNA, 20 nt, Human
cagagacuccugcaggcagc

SEQ ID NO: 2529829 - RNA, 22 nt, Human
cagagacuccugcaggcagcca

SEQ ID NO: 2529830 - RNA, 21 nt, Human
cagagacuccugcaggcagcc

SEQ ID NO: 2529831 - RNA, 24 nt, Human
cagagagagaagugccccugcugc

SEQ ID NO: 2529832 - RNA, 22 nt, Human
cagagagaggggagaagccugg

SEQ ID NO: 2529833 - RNA, 20 nt, Human
cagagagcaacucugagauc

SEQ ID NO: 2529834 - RNA, 12 nt, Human
cagagagagugu

SEQ ID NO: 2529835 - RNA, 20 nt, Human
cagagagccauuuugugaau

SEQ ID NO: 2529836 - RNA, 19 nt, Human
cagagagccauuuugugaa

SEQ ID NO: 2529837 - RNA, 18 nt, Human
cagagagccauuuuguga

SEQ ID NO: 2529838 - RNA, 15 nt, Human
cagagagccauuuug

SEQ ID NO: 2529839 - RNA, 23 nt, Human
cagagagccauuuugugaaugga

SEQ ID NO: 2529840 - RNA, 21 nt, Human
cagagagccauuuugugaaug

SEQ ID NO: 2529841 - RNA, 19 nt, Human
cagagagccuggugcugcu

SEQ ID NO: 2529842 - RNA, 21 nt, Human
cagagagcggucucaggcugg

SEQ ID NO: 2529843 - RNA, 18 nt, Human
cagagagcggucucaggc

SEQ ID NO: 2529844 - RNA, 20 nt, Human
cagagagccuggugcugcug

SEQ ID NO: 2529845 - RNA, 22 nt, Human
cagagagcggucucaggcuggu

SEQ ID NO: 2529846 - RNA, 12 nt, Human
cagagagcuggu

SEQ ID NO: 2529847 - RNA, 19 nt, Human
cagagagcugguaguuagu

SEQ ID NO: 2529848 - RNA, 13 nt, Human
cagagagcuggua

SEQ ID NO: 2529849 - RNA, 13 nt, Human
cagagaggaauca

SEQ ID NO: 2529850 - RNA, 15 nt, Human
cagagaggaaucaga

SEQ ID NO: 2529851 - RNA, 17 nt, Human
cagagaggacgugggcg

SEQ ID NO: 2529852 - RNA, 16 nt, Human
cagagaggacgugggc

SEQ ID NO: 2529853 - RNA, 22 nt, Human
cagagagggugggagugggccc

SEQ ID NO: 2529854 - RNA, 20 nt, Human
cagagagggugggagugggc

SEQ ID NO: 2529855 - RNA, 14 nt, Human
cagagccugcaguu

SEQ ID NO: 2529856 - RNA, 16 nt, Human
cagagagggugggagu

SEQ ID NO: 2529857 - RNA, 18 nt, Human
cagagaggccaggugcag

SEQ ID NO: 2529858 - RNA, 16 nt, Human
cagagaggccaggugc

SEQ ID NO: 2529859 - RNA, 20 nt, Human
cagagaggccuuuuggaaug

SEQ ID NO: 2529860 - RNA, 13 nt, Human
cagagaggguggg

SEQ ID NO: 2529861 - RNA, 13 nt, Human
cagagaggagaaa

SEQ ID NO: 2529862 - RNA, 16 nt, Human
cagagaggagaaacac

SEQ ID NO: 2529863 - RNA, 17 nt, Human
cagagaggagaaacaca

SEQ ID NO: 2529864 - RNA, 18 nt, Human
cagagaggagaaacacau

SEQ ID NO: 2529865 - RNA, 21 nt, Human
cagagaggagaaacacaucuu

SEQ ID NO: 2529866 - RNA, 22 nt, Human
cagagaggagaaacacaucuuc

SEQ ID NO: 2529867 - RNA, 17 nt, Human
cagagaggagucagaga

SEQ ID NO: 2529868 - RNA, 20 nt, Human
cagagaggagucagagagaa

SEQ ID NO: 2529869 - RNA, 20 nt, Human
cagagaggacuguagggagg

SEQ ID NO: 2529870 - RNA, 18 nt, Human
cagagaggacuguaggga

SEQ ID NO: 2529871 - RNA, 21 nt, Human
cagagaggacgugggcggcag

SEQ ID NO: 2529872 - RNA, 18 nt, Human
cagagaggacgugggcgg

SEQ ID NO: 2529873 - RNA, 22 nt, Human
cagagcgccgugaguucucagg

SEQ ID NO: 2529874 - RNA, 21 nt, Human
cagagcgccgugaguucucag

SEQ ID NO: 2529875 - RNA, 20 nt, Human
cagagcgccgugaguucuca

SEQ ID NO: 2529876 - RNA, 19 nt, Human
cagagcgccgugaguucuc

SEQ ID NO: 2529877 - RNA, 19 nt, Human
cagagcgccccucccuagu

SEQ ID NO: 2529878 - RNA, 15 nt, Human
cagagcgccccuccc

SEQ ID NO: 2529879 - RNA, 23 nt, Human
cagagccuucugaggacauucca

SEQ ID NO: 2529880 - RNA, 20 nt, Human
cagagccuuuggaugaccag

SEQ ID NO: 2529881 - RNA, 19 nt, Human
cagagccuuuggaugacca

SEQ ID NO: 2529882 - RNA, 18 nt, Human
cagagccuuuggaugacc

SEQ ID NO: 2529883 - RNA, 16 nt, Human
cagagccuuuggauga

SEQ ID NO: 2529884 - RNA, 20 nt, Human
cagagcgagagucugucuca

SEQ ID NO: 2529885 - RNA, 22 nt, Human
cagagcuacacaggggaaaaga

SEQ ID NO: 2529886 - RNA, 17 nt, Human
cagagcuacacagggga

SEQ ID NO: 2529887 - RNA, 16 nt, Human
cagagcuacuugggcc

SEQ ID NO: 2529888 - RNA, 9 nt, Human
cagagcugg

SEQ ID NO: 2529889 - RNA, 16 nt, Human
cagagcugcgggcugg

SEQ ID NO: 2529890 - RNA, 20 nt, Human
cagagcuacccgcagaguuc

SEQ ID NO: 2529891 - RNA, 23 nt, Human
cagccgccauugccaccaggaga

SEQ ID NO: 2529892 - RNA, 21 nt, Human
cagccgccauugccaccagga

SEQ ID NO: 2529893 - RNA, 22 nt, Human
cagccgccauugccaccaggag

SEQ ID NO: 2529894 - RNA, 17 nt, Human
cagccgccauugccacc

SEQ ID NO: 2529895 - RNA, 18 nt, Human
cagccgccauugccacca

SEQ ID NO: 2529896 - RNA, 19 nt, Human
cagccgccauugccaccag

SEQ ID NO: 2529897 - RNA, 14 nt, Human
cagccucuccccag

SEQ ID NO: 2529898 - RNA, 12 nt, Human
cagccgcuccug

SEQ ID NO: 2529899 - RNA, 23 nt, Human
cagccgccaugcuccuggcccac

SEQ ID NO: 2529900 - RNA, 21 nt, Human
cagcccugucugaaggacacu

SEQ ID NO: 2529901 - RNA, 11 nt, Human
cagcccugugg

SEQ ID NO: 2529902 - RNA, 13 nt, Human
cagcccuuagcag

SEQ ID NO: 2529903 - RNA, 16 nt, Human
cagcccugucagugca

SEQ ID NO: 2529904 - RNA, 18 nt, Human
cagcccugucagugcagc

SEQ ID NO: 2529905 - RNA, 20 nt, Human
cagcccugucagugcagccc

SEQ ID NO: 2529906 - RNA, 21 nt, Human
cagcccugucagugcagcccg

SEQ ID NO: 2529907 - RNA, 23 nt, Human
cagccucuccccagguccagcuc

SEQ ID NO: 2529908 - RNA, 20 nt, Human
cagccucuccccagguccag

SEQ ID NO: 2529909 - RNA, 19 nt, Human
cagccucuccccaggucca

SEQ ID NO: 2529910 - RNA, 16 nt, Human
cagccucuccccaggu

SEQ ID NO: 2529911 - RNA, 18 nt, Human
cagccucucucccagucu

SEQ ID NO: 2529912 - RNA, 16 nt, Human
cagccucucucccagu

SEQ ID NO: 2529913 - RNA, 15 nt, Human
cagccucucucccag

SEQ ID NO: 2529914 - RNA, 19 nt, Human
cagccucuccccugauuac

SEQ ID NO: 2529915 - RNA, 17 nt, Human
cagccucuccccugauu

SEQ ID NO: 2529916 - RNA, 12 nt, Human
cagccucucucc

SEQ ID NO: 2529917 - RNA, 23 nt, Human
cagccugagcgacagugagacuc

SEQ ID NO: 2529918 - RNA, 22 nt, Human
cagccugagucuccugugccca

SEQ ID NO: 2529919 - RNA, 19 nt, Human
cagccugagucuccugugc

SEQ ID NO: 2529920 - RNA, 18 nt, Human
cagccugagucuccugug

SEQ ID NO: 2529921 - RNA, 17 nt, Human
cagccugagucuccugu

SEQ ID NO: 2529922 - RNA, 16 nt, Human
cagccugagucuccug

SEQ ID NO: 2529923 - RNA, 15 nt, Human
cagccugagucuccu

SEQ ID NO: 2529924 - RNA, 14 nt, Human
cagccugagucucc

SEQ ID NO: 2529925 - RNA, 20 nt, Human
cagccugagucuccugugcc

SEQ ID NO: 2529926 - RNA, 18 nt, Human
cagccugcagacucacug

SEQ ID NO: 2529927 - RNA, 22 nt, Human
cagccucucuugguuuccuucc

SEQ ID NO: 2529928 - RNA, 23 nt, Human
cagccucucucccagucuaccca

SEQ ID NO: 2529929 - RNA, 22 nt, Human
cagccucucucccagucuaccc

SEQ ID NO: 2529930 - RNA, 12 nt, Human
cagccugaggcu

SEQ ID NO: 2529931 - RNA, 15 nt, Human
cagccugaggcugag

SEQ ID NO: 2529932 - RNA, 18 nt, Human
cagccugaggcugagacu

SEQ ID NO: 2529933 - RNA, 19 nt, Human
cagccugaggcugagacug

SEQ ID NO: 2529934 - RNA, 10 nt, Human
cagccugagu

SEQ ID NO: 2529935 - RNA, 23 nt, Human
cagccucucuugguuuccuuccu

SEQ ID NO: 2529936 - RNA, 11 nt, Human
cagccugccac

SEQ ID NO: 2529937 - RNA, 12 nt, Human
cagccugccacu

SEQ ID NO: 2529938 - RNA, 16 nt, Human
cagccugccacucagg

SEQ ID NO: 2529939 - RNA, 17 nt, Human
cagccugccacucaggc

SEQ ID NO: 2529940 - RNA, 20 nt, Human
cagcggccccugcauccccu

SEQ ID NO: 2529941 - RNA, 17 nt, Human
cagcggccccuugacuc

SEQ ID NO: 2529942 - RNA, 17 nt, Human
cagccugcccucuucau

SEQ ID NO: 2529943 - RNA, 19 nt, Human
cagccugccuggcaggcug

SEQ ID NO: 2529944 - RNA, 15 nt, Human
cagccugccuggcag

SEQ ID NO: 2529945 - RNA, 22 nt, Human
cagcgggaauggcagcugccac

SEQ ID NO: 2529946 - RNA, 23 nt, Human
cagcgggaauggcagcugccacg

SEQ ID NO: 2529947 - RNA, 19 nt, Human
cagcgugcuuuaaaaaaua

SEQ ID NO: 2529948 - RNA, 17 nt, Human
cagcggcuggaauuggg

SEQ ID NO: 2529949 - RNA, 16 nt, Human
cagcggcuggacuugg

SEQ ID NO: 2529950 - RNA, 18 nt, Human
cagcggcuggacuuggag

SEQ ID NO: 2529951 - RNA, 16 nt, Human
cagcgggaauggcagc

SEQ ID NO: 2529952 - RNA, 17 nt, Human
cagcguugcaugucgug

SEQ ID NO: 2529953 - RNA, 14 nt, Human
cagcguugcauguc

SEQ ID NO: 2529954 - RNA, 13 nt, Human
cagcguugcaugu

SEQ ID NO: 2529955 - RNA, 16 nt, Human
cagcguuucuaugaca

SEQ ID NO: 2529956 - RNA, 14 nt, Human
cagcguuucuauga

SEQ ID NO: 2529957 - RNA, 22 nt, Human
cagccccucccaccacagcagg

SEQ ID NO: 2529958 - RNA, 13 nt, Human
cagccccucccac

SEQ ID NO: 2529959 - RNA, 14 nt, Human
cagccccucccacc

SEQ ID NO: 2529960 - RNA, 15 nt, Human
cagccccucccacca

SEQ ID NO: 2529961 - RNA, 21 nt, Human
cagccccucccaccacagcag

SEQ ID NO: 2529962 - RNA, 12 nt, Human
cagccccuccuc

SEQ ID NO: 2529963 - RNA, 13 nt, Human
cagccccuccucu

SEQ ID NO: 2529964 - RNA, 14 nt, Human
cagccccuccucug

SEQ ID NO: 2529965 - RNA, 15 nt, Human
cagccccuccucugc

SEQ ID NO: 2529966 - RNA, 16 nt, Human
cagccccuccucugcc

SEQ ID NO: 2529967 - RNA, 17 nt, Human
cagccccuccucugcca

SEQ ID NO: 2529968 - RNA, 19 nt, Human
cagccccuccucugccacc

SEQ ID NO: 2529969 - RNA, 20 nt, Human
cagccccuccucugccaccu

SEQ ID NO: 2529970 - RNA, 16 nt, Human
cagccccucuggucgc

SEQ ID NO: 2529971 - RNA, 14 nt, Human
cagccccucugguc

SEQ ID NO: 2529972 - RNA, 13 nt, Human
cagccccucuggu

SEQ ID NO: 2529973 - RNA, 21 nt, Human
cagccccuccucugccaccuc

SEQ ID NO: 2529974 - RNA, 22 nt, Human
cagccccuccucugccaccucc

SEQ ID NO: 2529975 - RNA, 21 nt, Human
cagccccucuggucgcuccug

SEQ ID NO: 2529976 - RNA, 18 nt, Human
cagccccucuggucgcuc

SEQ ID NO: 2529977 - RNA, 22 nt, Human
cagccccucuggucgcuccugc

SEQ ID NO: 2529978 - RNA, 23 nt, Human
cagccccuccucugccaccuccc

SEQ ID NO: 2529979 - RNA, 11 nt, Human
cagccccucuu

SEQ ID NO: 2529980 - RNA, 19 nt, Human
cagccccugauccugugaa

SEQ ID NO: 2529981 - RNA, 14 nt, Human
cagccccugauccu

SEQ ID NO: 2529982 - RNA, 13 nt, Human
cagccccugcaca

SEQ ID NO: 2529983 - RNA, 23 nt, Human
cagccccucuugccccccacccc

SEQ ID NO: 2529984 - RNA, 15 nt, Human
cagccccucuugccc

SEQ ID NO: 2529985 - RNA, 17 nt, Human
cagccccucuugccccc

SEQ ID NO: 2529986 - RNA, 21 nt, Human
cagccccucuugccccccacc

SEQ ID NO: 2529987 - RNA, 22 nt, Human
cagccccucuugccccccaccc

SEQ ID NO: 2529988 - RNA, 22 nt, Human
cagccccugccccagcccaagu

SEQ ID NO: 2529989 - RNA, 19 nt, Human
cagccccugccccagccca

SEQ ID NO: 2529990 - RNA, 17 nt, Human
cagccccugccccagcc

SEQ ID NO: 2529991 - RNA, 15 nt, Human
cagccccugccccag

SEQ ID NO: 2529992 - RNA, 11 nt, Human
cagccccugcc

SEQ ID NO: 2529993 - RNA, 21 nt, Human
cagccccugauccugugaagu

SEQ ID NO: 2529994 - RNA, 20 nt, Human
cagccccugauccugugaag

SEQ ID NO: 2529995 - RNA, 16 nt, Human
cagcccuggucucagc

SEQ ID NO: 2529996 - RNA, 15 nt, Human
cagcccuggucucag

SEQ ID NO: 2529997 - RNA, 13 nt, Human
cagcccuggucuc

SEQ ID NO: 2529998 - RNA, 12 nt, Human
cagcccuggucu

SEQ ID NO: 2529999 - RNA, 19 nt, Human
cagcccuggucucagcagc

SEQ ID NO: 2530000 - RNA, 18 nt, Human
cagcccuggucucagcag

SEQ ID NO: 2530001 - RNA, 12 nt, Human
cagcccugucag

SEQ ID NO: 2530002 - RNA, 24 nt, Human
cagccccuagcccaggagagagaa

SEQ ID NO: 2530003 - RNA, 23 nt, Human
cagccccuagcccaggagagaga

SEQ ID NO: 2530004 - RNA, 22 nt, Human
cagccccuagcccaggagagag

SEQ ID NO: 2530005 - RNA, 17 nt, Human
cagccccuagcccagga

SEQ ID NO: 2530006 - RNA, 16 nt, Human
cagccccuagcccagg

SEQ ID NO: 2530007 - RNA, 15 nt, Human
cagccccuagcccag

SEQ ID NO: 2530008 - RNA, 13 nt, Human
cagccccuagccc

SEQ ID NO: 2530009 - RNA, 12 nt, Human
cagccccuagcc

SEQ ID NO: 2530010 - RNA, 19 nt, Human
cagccccggcccugggcuc

SEQ ID NO: 2530011 - RNA, 17 nt, Human
cagccccggcccugggc

SEQ ID NO: 2530012 - RNA, 16 nt, Human
cagccccggcccuggg

SEQ ID NO: 2530013 - RNA, 15 nt, Human
cagccccggcccugg

SEQ ID NO: 2530014 - RNA, 19 nt, Human
cagccccgugggguuccuc

SEQ ID NO: 2530015 - RNA, 22 nt, Human
cagcccccuuugggcccaggga

SEQ ID NO: 2530016 - RNA, 15 nt, Human
cagcccccuuugggc

SEQ ID NO: 2530017 - RNA, 18 nt, Human
cagccccgccuccaggcc

SEQ ID NO: 2530018 - RNA, 21 nt, Human
cagcccccuuugggcccaggg

SEQ ID NO: 2530019 - RNA, 20 nt, Human
cagcccccuuugggcccagg

SEQ ID NO: 2530020 - RNA, 19 nt, Human
cagcccccuuugggcccag

SEQ ID NO: 2530021 - RNA, 16 nt, Human
cagccccgcgccuccu

SEQ ID NO: 2530022 - RNA, 18 nt, Human
cagccccgcgccuccuuc

SEQ ID NO: 2530023 - RNA, 22 nt, Human
cagccccauucugccugcccag

SEQ ID NO: 2530024 - RNA, 20 nt, Human
cagccccauucugccugccc

SEQ ID NO: 2530025 - RNA, 19 nt, Human
cagccccauucugccugcc

SEQ ID NO: 2530026 - RNA, 24 nt, Human
cagccccauucugccugcccaggc

SEQ ID NO: 2530027 - RNA, 23 nt, Human
cagccccauucugccugcccagg

SEQ ID NO: 2530028 - RNA, 20 nt, Human
cagcccccacagugcugucu

SEQ ID NO: 2530029 - RNA, 19 nt, Human
cagcccccacagugcuguc

SEQ ID NO: 2530030 - RNA, 17 nt, Human
cagcccccacagugcug

SEQ ID NO: 2530031 - RNA, 13 nt, Human
cagcccccacagu

SEQ ID NO: 2530032 - RNA, 21 nt, Human
cagcccccacugccuuugacc

SEQ ID NO: 2530033 - RNA, 21 nt, Human
cagcccccacagugcugucug

SEQ ID NO: 2530034 - RNA, 23 nt, Human
cagcaguuccggauuggcuugug

SEQ ID NO: 2530035 - RNA, 20 nt, Human
cagcacuggcucucuccagg

SEQ ID NO: 2530036 - RNA, 19 nt, Human
cagcacuggcucucuccag

SEQ ID NO: 2530037 - RNA, 17 nt, Human
cagcauagaaguaacuu

SEQ ID NO: 2530038 - RNA, 18 nt, Human
cagcacuggcucucucca

SEQ ID NO: 2530039 - RNA, 17 nt, Human
cagcacuggcucucucc

SEQ ID NO: 2530040 - RNA, 16 nt, Human
cagcacuggcucucuc

SEQ ID NO: 2530041 - RNA, 14 nt, Human
cagcacuggcucuc

SEQ ID NO: 2530042 - RNA, 17 nt, Human
cagcauauucaggaagc

SEQ ID NO: 2530043 - RNA, 16 nt, Human
cagcauauucaggaag

SEQ ID NO: 2530044 - RNA, 18 nt, Human
cagcauauucaggaagcu

SEQ ID NO: 2530045 - RNA, 20 nt, Human
cagcauaugggggccuggau

SEQ ID NO: 2530046 - RNA, 21 nt, Human
cagcacuggcucucuccagga

SEQ ID NO: 2530047 - RNA, 19 nt, Human
cagcauagcaagacacauc

SEQ ID NO: 2530048 - RNA, 21 nt, Human
cagcacagcuugaccugaggc

SEQ ID NO: 2530049 - RNA, 20 nt, Human
cagcacagcuugaccugagg

SEQ ID NO: 2530050 - RNA, 17 nt, Human
cagcacagcuugaccug

SEQ ID NO: 2530051 - RNA, 16 nt, Human
cagcacagcuugaccu

SEQ ID NO: 2530052 - RNA, 15 nt, Human
cagcacagcuugacc

SEQ ID NO: 2530053 - RNA, 13 nt, Human
cagcacagcuuga

SEQ ID NO: 2530054 - RNA, 18 nt, Human
cagcacagggauccgacu

SEQ ID NO: 2530055 - RNA, 22 nt, Human
cagcacagcuugaccugaggcu

SEQ ID NO: 2530056 - RNA, 13 nt, Human
cagcaccacccua

SEQ ID NO: 2530057 - RNA, 16 nt, Human
cagcacugcuugagga

SEQ ID NO: 2530058 - RNA, 18 nt, Human
cagcacugcuugaggaaa

SEQ ID NO: 2530059 - RNA, 12 nt, Human
cagcacuggcuc

SEQ ID NO: 2530060 - RNA, 19 nt, Human
cagcacugcuugaggaaaa

SEQ ID NO: 2530061 - RNA, 13 nt, Human
cagcacugcccaa

SEQ ID NO: 2530062 - RNA, 14 nt, Human
cagcacugauuuca

SEQ ID NO: 2530063 - RNA, 17 nt, Human
cagcacugaggaagaac

SEQ ID NO: 2530064 - RNA, 15 nt, Human
cagcacugaggaaga

SEQ ID NO: 2530065 - RNA, 13 nt, Human
cagcacugaggaa

SEQ ID NO: 2530066 - RNA, 12 nt, Human
cagcacugagga

SEQ ID NO: 2530067 - RNA, 11 nt, Human
cagcacugagg

SEQ ID NO: 2530068 - RNA, 22 nt, Human
cagcacucacacaggacccccu

SEQ ID NO: 2530069 - RNA, 17 nt, Human
cagcacucacacaggac

SEQ ID NO: 2530070 - RNA, 15 nt, Human
cagcacucacacagg

SEQ ID NO: 2530071 - RNA, 12 nt, Human
cagauugcaugu

SEQ ID NO: 2530072 - RNA, 13 nt, Human
cagauugcaugug

SEQ ID NO: 2530073 - RNA, 15 nt, Human
cagauugcaugugac

SEQ ID NO: 2530074 - RNA, 16 nt, Human
cagauugcaugugacu

SEQ ID NO: 2530075 - RNA, 21 nt, Human
cagauugcaacaggcugggcu

SEQ ID NO: 2530076 - RNA, 18 nt, Human
cagauugcaugugacucu

SEQ ID NO: 2530077 - RNA, 20 nt, Human
cagauugcaugugacucuga

SEQ ID NO: 2530078 - RNA, 23 nt, Human
cagauugcaugugacucugaagc

SEQ ID NO: 2530079 - RNA, 21 nt, Human
cagauugcaugugacucugaa

SEQ ID NO: 2530080 - RNA, 17 nt, Human
cagauuggcucacacug

SEQ ID NO: 2530081 - RNA, 18 nt, Human
cagauuggagaaacccuu

SEQ ID NO: 2530082 - RNA, 18 nt, Human
cagauuucacucuccuug

SEQ ID NO: 2530083 - RNA, 19 nt, Human
cagauuugaacucuucaau

SEQ ID NO: 2530084 - RNA, 16 nt, Human
cagauuucacucuccu

SEQ ID NO: 2530085 - RNA, 15 nt, Human
cagauuucacucucc

SEQ ID NO: 2530086 - RNA, 16 nt, Human
cagauuugagcucagc

SEQ ID NO: 2530087 - RNA, 18 nt, Human
cagauuugggcuggaaca

SEQ ID NO: 2530088 - RNA, 15 nt, Human
cagauuugggcugga

SEQ ID NO: 2530089 - RNA, 14 nt, Human
cagauuugggcugg

SEQ ID NO: 2530090 - RNA, 20 nt, Human
cagauuugcuaauuuauccu

SEQ ID NO: 2530091 - RNA, 13 nt, Human
cagauuugagcuc

SEQ ID NO: 2530092 - RNA, 14 nt, Human
cagauuugagcuca

SEQ ID NO: 2530093 - RNA, 13 nt, Human
cagauuucacucu

SEQ ID NO: 2530094 - RNA, 18 nt, Human
cagauuggcucacacuga

SEQ ID NO: 2530095 - RNA, 16 nt, Human
cagccagcaccuggca

SEQ ID NO: 2530096 - RNA, 14 nt, Human
cagccagcaccugg

SEQ ID NO: 2530097 - RNA, 12 nt, Human
cagccagcagcc

SEQ ID NO: 2530098 - RNA, 11 nt, Human
cagccagcagc

SEQ ID NO: 2530099 - RNA, 15 nt, Human
cagccagcagccagc

SEQ ID NO: 2530100 - RNA, 14 nt, Human
cagccagcagccag

SEQ ID NO: 2530101 - RNA, 23 nt, Human
cagccagcaaugauguccagaag

SEQ ID NO: 2530102 - RNA, 22 nt, Human
cagccagcaaugauguccagaa

SEQ ID NO: 2530103 - RNA, 20 nt, Human
cagccagcaaugauguccag

SEQ ID NO: 2530104 - RNA, 13 nt, Human
cagccagcaauga

SEQ ID NO: 2530105 - RNA, 13 nt, Human
cagccagcaccug

SEQ ID NO: 2530106 - RNA, 12 nt, Human
cagccagcaccu

SEQ ID NO: 2530107 - RNA, 22 nt, Human
cagccagauggacuccagccug

SEQ ID NO: 2530108 - RNA, 17 nt, Human
cagccagauccucuugg

SEQ ID NO: 2530109 - RNA, 21 nt, Human
cagccagaguuccugcggagu

SEQ ID NO: 2530110 - RNA, 20 nt, Human
cagccagaguuccugcggag

SEQ ID NO: 2530111 - RNA, 19 nt, Human
cagccagaguuccugcgga

SEQ ID NO: 2530112 - RNA, 15 nt, Human
cagccagaguuccug

SEQ ID NO: 2530113 - RNA, 19 nt, Human
caggaaaucaaauaugcaa

SEQ ID NO: 2530114 - RNA, 13 nt, Human
caggaaauaaagu

SEQ ID NO: 2530115 - RNA, 21 nt, Human
caggaaagggaaggccccaca

SEQ ID NO: 2530116 - RNA, 13 nt, Human
caggaaauauaua

SEQ ID NO: 2530117 - RNA, 15 nt, Human
caggaaauauauaug

SEQ ID NO: 2530118 - RNA, 16 nt, Human
caggaaauauauaugu

SEQ ID NO: 2530119 - RNA, 17 nt, Human
caggaaauauauaugug

SEQ ID NO: 2530120 - RNA, 21 nt, Human
caggaaaucaaauaugcaaag

SEQ ID NO: 2530121 - RNA, 22 nt, Human
caggaaaucaaauaugcaaagc

SEQ ID NO: 2530122 - RNA, 23 nt, Human
caggaaauauauaugugugugua

SEQ ID NO: 2530123 - RNA, 20 nt, Human
caggaaaagcugcugacagu

SEQ ID NO: 2530124 - RNA, 19 nt, Human
caggaaaagcugcugacag

SEQ ID NO: 2530125 - RNA, 23 nt, Human
caggaaaauuguuugaacccagg

SEQ ID NO: 2530126 - RNA, 22 nt, Human
caggaaaggcuccaggagcagc

SEQ ID NO: 2530127 - RNA, 21 nt, Human
caggaaaggcuccaggagcag

SEQ ID NO: 2530128 - RNA, 23 nt, Human
caggaaaggcuccaggagcagcc

SEQ ID NO: 2530129 - RNA, 17 nt, Human
caggaaagggaaggccc

SEQ ID NO: 2530130 - RNA, 16 nt, Human
caggaaaauccucugg

SEQ ID NO: 2530131 - RNA, 17 nt, Human
caggaaaauccucuggc

SEQ ID NO: 2530132 - RNA, 16 nt, Human
cagcuuauucacaaga

SEQ ID NO: 2530133 - RNA, 17 nt, Human
cagcuuauucacaagac

SEQ ID NO: 2530134 - RNA, 17 nt, Human
cagcuuaggggcugcug

SEQ ID NO: 2530135 - RNA, 15 nt, Human
cagcuguucagcugg

SEQ ID NO: 2530136 - RNA, 16 nt, Human
cagcuguucagcuggu

SEQ ID NO: 2530137 - RNA, 22 nt, Human
cagcuguuagaguccaacgugg

SEQ ID NO: 2530138 - RNA, 13 nt, Human
caggaggccagcc

SEQ ID NO: 2530139 - RNA, 12 nt, Human
caggaggccagc

SEQ ID NO: 2530140 - RNA, 20 nt, Human
caggcaaugcuggcuguugg

SEQ ID NO: 2530141 - RNA, 19 nt, Human
caggcaaugcuggcuguug

SEQ ID NO: 2530142 - RNA, 23 nt, Human
caggcacugagauaccagcgagg

SEQ ID NO: 2530143 - RNA, 17 nt, Human
caggcacugcugcccag

SEQ ID NO: 2530144 - RNA, 16 nt, Human
caggcacugcugccca

SEQ ID NO: 2530145 - RNA, 21 nt, Human
caggcaaugcuggcuguuggc

SEQ ID NO: 2530146 - RNA, 22 nt, Human
caggcacugagauaccagcgag

SEQ ID NO: 2530147 - RNA, 16 nt, Human
caggccaccuccccag

SEQ ID NO: 2530148 - RNA, 15 nt, Human
caggccaccucccca

SEQ ID NO: 2530149 - RNA, 12 nt, Human
caggccaccucc

SEQ ID NO: 2530150 - RNA, 16 nt, Human
caggccaccuccagaa

SEQ ID NO: 2530151 - RNA, 20 nt, Human
caggccaccuccccagcauu

SEQ ID NO: 2530152 - RNA, 19 nt, Human
caggccaccuccccagcau

SEQ ID NO: 2530153 - RNA, 18 nt, Human
caggccaccuccagaaac

SEQ ID NO: 2530154 - RNA, 13 nt, Human
caggccaccugcc

SEQ ID NO: 2530155 - RNA, 15 nt, Human
caggccaccugcccc

SEQ ID NO: 2530156 - RNA, 16 nt, Human
caggccaccugccccc

SEQ ID NO: 2530157 - RNA, 11 nt, Human
caggccaccuc

SEQ ID NO: 2530158 - RNA, 23 nt, Human
caggcacugcugcccagccucca

SEQ ID NO: 2530159 - RNA, 15 nt, Human
caggccagcugcuug

SEQ ID NO: 2530160 - RNA, 13 nt, Human
caggccagcugcu

SEQ ID NO: 2530161 - RNA, 22 nt, Human
caggccaccugcccccuucucc

SEQ ID NO: 2530162 - RNA, 23 nt, Human
caggccaccugcccccuucuccc

SEQ ID NO: 2530163 - RNA, 17 nt, Human
caggccaccugcccccu

SEQ ID NO: 2530164 - RNA, 18 nt, Human
caggccaccugcccccuu

SEQ ID NO: 2530165 - RNA, 19 nt, Human
caggccaccugcccccuuc

SEQ ID NO: 2530166 - RNA, 21 nt, Human
caggccaccugcccccuucuc

SEQ ID NO: 2530167 - RNA, 15 nt, Human
caggccagccuccga

SEQ ID NO: 2530168 - RNA, 13 nt, Human
caggccagccucc

SEQ ID NO: 2530169 - RNA, 12 nt, Human
caggccagccuc

SEQ ID NO: 2530170 - RNA, 11 nt, Human
caggccagccu

SEQ ID NO: 2530171 - RNA, 16 nt, Human
caggccacggcagccu

SEQ ID NO: 2530172 - RNA, 16 nt, Human
caggccaggcccucug

SEQ ID NO: 2530173 - RNA, 15 nt, Human
caggccaggcccucu

SEQ ID NO: 2530174 - RNA, 14 nt, Human
caggccaggcccuc

SEQ ID NO: 2530175 - RNA, 13 nt, Human
caggccaggcccu

SEQ ID NO: 2530176 - RNA, 23 nt, Human
caggccagccuccgagagggaga

SEQ ID NO: 2530177 - RNA, 21 nt, Human
caggccagccuccgagaggga

SEQ ID NO: 2530178 - RNA, 19 nt, Human
caggccagccuccgagagg

SEQ ID NO: 2530179 - RNA, 16 nt, Human
caggccagccuccgag

SEQ ID NO: 2530180 - RNA, 15 nt, Human
caggccagcugccuc

SEQ ID NO: 2530181 - RNA, 14 nt, Human
caggacagaugcca

SEQ ID NO: 2530182 - RNA, 17 nt, Human
caggacagaugccacac

SEQ ID NO: 2530183 - RNA, 13 nt, Human
caggacagaugcc

SEQ ID NO: 2530184 - RNA, 15 nt, Human
caggacacggggcag

SEQ ID NO: 2530185 - RNA, 22 nt, Human
caggacaccacacccagccuca

SEQ ID NO: 2530186 - RNA, 17 nt, Human
caggacccugaaggggc

SEQ ID NO: 2530187 - RNA, 18 nt, Human
caggacccugaaggggcc

SEQ ID NO: 2530188 - RNA, 18 nt, Human
caggaccaggcaauguga

SEQ ID NO: 2530189 - RNA, 14 nt, Human
caggaccaggacua

SEQ ID NO: 2530190 - RNA, 13 nt, Human
caggaccaggacu

SEQ ID NO: 2530191 - RNA, 23 nt, Human
caggaccagcuggggcgugggga

SEQ ID NO: 2530192 - RNA, 16 nt, Human
caggacccugaagggg

SEQ ID NO: 2530193 - RNA, 13 nt, Human
caggaccagggau

SEQ ID NO: 2530194 - RNA, 13 nt, Human
caggaccucaggu

SEQ ID NO: 2530195 - RNA, 21 nt, Human
caggaccuaggauaucuucuc

SEQ ID NO: 2530196 - RNA, 22 nt, Human
caggaccuaggauaucuucucc

SEQ ID NO: 2530197 - RNA, 23 nt, Human
caggaccuaggauaucuucucca

SEQ ID NO: 2530198 - RNA, 20 nt, Human
caggaccucagaguccaggc

SEQ ID NO: 2530199 - RNA, 18 nt, Human
caggaggcaggaccuucg

SEQ ID NO: 2530200 - RNA, 15 nt, Human
caggaggcaggaccu

SEQ ID NO: 2530201 - RNA, 23 nt, Human
caggaggauugcuugagcccagg

SEQ ID NO: 2530202 - RNA, 21 nt, Human
caggaccucagaguccaggcc

SEQ ID NO: 2530203 - RNA, 22 nt, Human
caggaccucagaguccaggccc

SEQ ID NO: 2530204 - RNA, 15 nt, Human
caggaccagcucagg

SEQ ID NO: 2530205 - RNA, 16 nt, Human
caggaccagcucagga

SEQ ID NO: 2530206 - RNA, 17 nt, Human
caggaccagcucaggac

SEQ ID NO: 2530207 - RNA, 19 nt, Human
caggaccagcucaggacag

SEQ ID NO: 2530208 - RNA, 16 nt, Human
caggaccagcuggggc

SEQ ID NO: 2530209 - RNA, 15 nt, Human
caggaccagcugggg

SEQ ID NO: 2530210 - RNA, 14 nt, Human
caggaccagcuggg

SEQ ID NO: 2530211 - RNA, 13 nt, Human
caggaccagcugg

SEQ ID NO: 2530212 - RNA, 12 nt, Human
caggaccagcug

SEQ ID NO: 2530213 - RNA, 20 nt, Human
caggaccagcucaggacaga

SEQ ID NO: 2530214 - RNA, 20 nt, Human
caggacaugcgguagccagc

SEQ ID NO: 2530215 - RNA, 21 nt, Human
caggacaugcgguagccagca

SEQ ID NO: 2530216 - RNA, 22 nt, Human
caggacaugcgguagccagcac

SEQ ID NO: 2530217 - RNA, 14 nt, Human
caggaccagcucag

SEQ ID NO: 2530218 - RNA, 18 nt, Human
caggacaugcgguagcca

SEQ ID NO: 2530219 - RNA, 22 nt, Human
caggacagugcuucagccugag

SEQ ID NO: 2530220 - RNA, 20 nt, Human
caggacagugcuucagccug

SEQ ID NO: 2530221 - RNA, 21 nt, Human
caggacagugcuucagccuga

SEQ ID NO: 2530222 - RNA, 24 nt, Human
caggacagcccuucuuuccacaga

SEQ ID NO: 2530223 - RNA, 23 nt, Human
caggacagcccuucuuuccacag

SEQ ID NO: 2530224 - RNA, 16 nt, Human
caggacagugcuucag

SEQ ID NO: 2530225 - RNA, 13 nt, Human
caggacaggcccg

SEQ ID NO: 2530226 - RNA, 12 nt, Human
caggacaggccc

SEQ ID NO: 2530227 - RNA, 13 nt, Human
caggacaggacca

SEQ ID NO: 2530228 - RNA, 23 nt, Human
caggacaccacacccagccucag

SEQ ID NO: 2530229 - RNA, 12 nt, Human
caggacaggacc

SEQ ID NO: 2530230 - RNA, 23 nt, Human
cagggucucacucugucgcccag

SEQ ID NO: 2530231 - RNA, 16 nt, Human
caggguuggccccugc

SEQ ID NO: 2530232 - RNA, 15 nt, Human
caggguuggccccug

SEQ ID NO: 2530233 - RNA, 22 nt, Human
caggguggacuuagaaagcagg

SEQ ID NO: 2530234 - RNA, 13 nt, Human
cagggugcugugg

SEQ ID NO: 2530235 - RNA, 18 nt, Human
cagggugaugccagguuc

SEQ ID NO: 2530236 - RNA, 20 nt, Human
cagggugcaguaucaugccc

SEQ ID NO: 2530237 - RNA, 16 nt, Human
cagggugaugccaggu

SEQ ID NO: 2530238 - RNA, 15 nt, Human
cagggugaugccagg

SEQ ID NO: 2530239 - RNA, 14 nt, Human
cagggugaggaugg

SEQ ID NO: 2530240 - RNA, 22 nt, Human
cagggugagagcugcucuggaa

SEQ ID NO: 2530241 - RNA, 21 nt, Human
cagggugagagcugcucugga

SEQ ID NO: 2530242 - RNA, 15 nt, Human
cagggugagagcugc

SEQ ID NO: 2530243 - RNA, 14 nt, Human
cagggugagagcug

SEQ ID NO: 2530244 - RNA, 23 nt, Human
cagggucuuuucaucugggaaag

SEQ ID NO: 2530245 - RNA, 22 nt, Human
cagggucuuuucaucugggaaa

SEQ ID NO: 2530246 - RNA, 21 nt, Human
cagggucuuuucaucugggaa

SEQ ID NO: 2530247 - RNA, 17 nt, Human
cagggucuuuucaucug

SEQ ID NO: 2530248 - RNA, 22 nt, Human
cagggucucuagugcugugaaa

SEQ ID NO: 2530249 - RNA, 21 nt, Human
cagggucuucccuaccucagg

SEQ ID NO: 2530250 - RNA, 15 nt, Human
cagggucuuuucauc

SEQ ID NO: 2530251 - RNA, 22 nt, Human
cagggucuucccuaccucaggc

SEQ ID NO: 2530252 - RNA, 19 nt, Human
cagggucucuagugcugug

SEQ ID NO: 2530253 - RNA, 20 nt, Human
cagggucucuagugcuguga

SEQ ID NO: 2530254 - RNA, 21 nt, Human
cagggucucuagugcugugaa

SEQ ID NO: 2530255 - RNA, 21 nt, Human
cagggucucuaccauccccug

SEQ ID NO: 2530256 - RNA, 17 nt, Human
cagucaccccggccacc

SEQ ID NO: 2530257 - RNA, 16 nt, Human
cagucaccccggccac

SEQ ID NO: 2530258 - RNA, 14 nt, Human
cagucaccccggcc

SEQ ID NO: 2530259 - RNA, 14 nt, Human
caguauuuuggaga

SEQ ID NO: 2530260 - RNA, 16 nt, Human
caguauuuucccugcu

SEQ ID NO: 2530261 - RNA, 20 nt, Human
caguauuguuuugguuugcu

SEQ ID NO: 2530262 - RNA, 16 nt, Human
caguauugaagcauuu

SEQ ID NO: 2530263 - RNA, 17 nt, Human
caguauugaagcauuuu

SEQ ID NO: 2530264 - RNA, 20 nt, Human
caguauugaagcauuuuaua

SEQ ID NO: 2530265 - RNA, 15 nt, Human
caguauuugugggga

SEQ ID NO: 2530266 - RNA, 19 nt, Human
caguaaaugggggugcauu

SEQ ID NO: 2530267 - RNA, 19 nt, Human
caguauucuugucaaaaaa

SEQ ID NO: 2530268 - RNA, 16 nt, Human
caguauucuugucaaa

SEQ ID NO: 2530269 - RNA, 12 nt, Human
caguauugaagc

SEQ ID NO: 2530270 - RNA, 14 nt, Human
caguauugaagcau

SEQ ID NO: 2530271 - RNA, 15 nt, Human
caguauugaagcauu

SEQ ID NO: 2530272 - RNA, 15 nt, Human
caguauucuagguag

SEQ ID NO: 2530273 - RNA, 13 nt, Human
caguauucuuguc

SEQ ID NO: 2530274 - RNA, 21 nt, Human
caguauucuagguagugcccu

SEQ ID NO: 2530275 - RNA, 12 nt, Human
caguaaaucuuu

SEQ ID NO: 2530276 - RNA, 20 nt, Human
caguaaaucuuuuacaacug

SEQ ID NO: 2530277 - RNA, 18 nt, Human
caguaaaugggggugcau

SEQ ID NO: 2530278 - RNA, 16 nt, Human
caguaaaauugccaua

SEQ ID NO: 2530279 - RNA, 15 nt, Human
caguaaaauugccau

SEQ ID NO: 2530280 - RNA, 19 nt, Human
caguaaauaaauuguuuga

SEQ ID NO: 2530281 - RNA, 24 nt, Human
caguaaauaaauuguuugaccaug

SEQ ID NO: 2530282 - RNA, 11 nt, Human
caguaaaauug

SEQ ID NO: 2530283 - RNA, 21 nt, Human
caggguuggccccugcccggc

SEQ ID NO: 2530284 - RNA, 17 nt, Human
caggguuggccccugcc

SEQ ID NO: 2530285 - RNA, 14 nt, Human
caggguuggccccu

SEQ ID NO: 2530286 - RNA, 17 nt, Human
caggguggacuuagaaa

SEQ ID NO: 2530287 - RNA, 13 nt, Human
caggguugggccc

SEQ ID NO: 2530288 - RNA, 14 nt, Human
caggguugggccca

SEQ ID NO: 2530289 - RNA, 15 nt, Human
caggguugggcccag

SEQ ID NO: 2530290 - RNA, 16 nt, Human
caggguugggcccaga

SEQ ID NO: 2530291 - RNA, 20 nt, Human
caggguugggcccagaucug

SEQ ID NO: 2530292 - RNA, 14 nt, Human
caggugcugccauc

SEQ ID NO: 2530293 - RNA, 13 nt, Human
caggugcugccau

SEQ ID NO: 2530294 - RNA, 22 nt, Human
caggguuuggcugugucuaaac

SEQ ID NO: 2530295 - RNA, 21 nt, Human
caggguuuggcugugucuaaa

SEQ ID NO: 2530296 - RNA, 20 nt, Human
caggguuuggcugugucuaa

SEQ ID NO: 2530297 - RNA, 20 nt, Human
caggguuucgagaagcugcu

SEQ ID NO: 2530298 - RNA, 19 nt, Human
caggugcucaauaaaugau

SEQ ID NO: 2530299 - RNA, 19 nt, Human
caggguuucgagaagcugc

SEQ ID NO: 2530300 - RNA, 17 nt, Human
caggguuucgagaagcu

SEQ ID NO: 2530301 - RNA, 17 nt, Human
cagggugggauggagga

SEQ ID NO: 2530302 - RNA, 19 nt, Human
caggguuucaccauguugc

SEQ ID NO: 2530303 - RNA, 21 nt, Human
caggguugggcccagaucugg

SEQ ID NO: 2530304 - RNA, 23 nt, Human
cagguucuccguuagcuccugug

SEQ ID NO: 2530305 - RNA, 22 nt, Human
cagguucuccguuagcuccugu

SEQ ID NO: 2530306 - RNA, 19 nt, Human
caggugcugcuacccuccc

SEQ ID NO: 2530307 - RNA, 16 nt, Human
caggugcugcuacccu

SEQ ID NO: 2530308 - RNA, 21 nt, Human
cagguucuccguuagcuccug

SEQ ID NO: 2530309 - RNA, 20 nt, Human
caggugcugacuucaucucc

SEQ ID NO: 2530310 - RNA, 21 nt, Human
caggugcugacuucaucuccc

SEQ ID NO: 2530311 - RNA, 13 nt, Human
caggugcugcuac

SEQ ID NO: 2530312 - RNA, 23 nt, Human
caggugcugacuucaucucccac

SEQ ID NO: 2530313 - RNA, 20 nt, Human
cagguucuucuuccugaagc

SEQ ID NO: 2530314 - RNA, 24 nt, Human
cagguucuccguuagcuccugugg

SEQ ID NO: 2530315 - RNA, 20 nt, Human
caggugcugcuacccucccu

SEQ ID NO: 2530316 - RNA, 18 nt, Human
cagguucuucuuccugaa

SEQ ID NO: 2530317 - RNA, 19 nt, Human
cagguuuuucaauuaaacg

SEQ ID NO: 2530318 - RNA, 18 nt, Human
cagguuuuucaauuaaac

SEQ ID NO: 2530319 - RNA, 18 nt, Human
cagguugcugguugcugu

SEQ ID NO: 2530320 - RNA, 17 nt, Human
cagguuuuucaauuaaa

SEQ ID NO: 2530321 - RNA, 17 nt, Human
cagguugcugguugcug

SEQ ID NO: 2530322 - RNA, 20 nt, Human
cagguugaggggcuccugga

SEQ ID NO: 2530323 - RNA, 21 nt, Human
cagguugaggggcuccuggaa

SEQ ID NO: 2530324 - RNA, 22 nt, Human
cagguugaggggcuccuggaaa

SEQ ID NO: 2530325 - RNA, 23 nt, Human
cagguuuuuggucugacccacug

SEQ ID NO: 2530326 - RNA, 22 nt, Human
cagguuuuucaauuaaacggau

SEQ ID NO: 2530327 - RNA, 21 nt, Human
cagguuuuucaauuaaacgga

SEQ ID NO: 2530328 - RNA, 23 nt, Human
cagguuuuucaauuaaacggauu

SEQ ID NO: 2530329 - RNA, 23 nt, Human
cagggcuggcccagcccugcugg

SEQ ID NO: 2530330 - RNA, 21 nt, Human
cagggcuggcccagcccugcu

SEQ ID NO: 2530331 - RNA, 20 nt, Human
cagggcuggcccagcccugc

SEQ ID NO: 2530332 - RNA, 19 nt, Human
cagggcuggcccagcccug

SEQ ID NO: 2530333 - RNA, 18 nt, Human
cagggcuggcccagcccu

SEQ ID NO: 2530334 - RNA, 17 nt, Human
cagggcuggcccagccc

SEQ ID NO: 2530335 - RNA, 16 nt, Human
cagggcuggcccagcc

SEQ ID NO: 2530336 - RNA, 15 nt, Human
cagggcuggcccagc

SEQ ID NO: 2530337 - RNA, 14 nt, Human
cagggcuggcccag

SEQ ID NO: 2530338 - RNA, 13 nt, Human
cagggcuggccca

SEQ ID NO: 2530339 - RNA, 12 nt, Human
cagggcuggccc

SEQ ID NO: 2530340 - RNA, 23 nt, Human
cagggcuggacugaggccugagc

SEQ ID NO: 2530341 - RNA, 22 nt, Human
cagggcuggacugaggccugag

SEQ ID NO: 2530342 - RNA, 22 nt, Human
cagggcuggcccagcccugcug

SEQ ID NO: 2530343 - RNA, 17 nt, Human
caggccugggccagagu

SEQ ID NO: 2530344 - RNA, 12 nt, Human
caggccugggcc

SEQ ID NO: 2530345 - RNA, 20 nt, Human
caggccuggcaaguggguga

SEQ ID NO: 2530346 - RNA, 17 nt, Human
caggccuggcaaguggg

SEQ ID NO: 2530347 - RNA, 22 nt, Human
caggccugggggcugggcagag

SEQ ID NO: 2530348 - RNA, 20 nt, Human
caggccugggggcugggcag

SEQ ID NO: 2530349 - RNA, 19 nt, Human
caggcuggcgugcaguggu

SEQ ID NO: 2530350 - RNA, 18 nt, Human
caggcuggcgugcagugg

SEQ ID NO: 2530351 - RNA, 23 nt, Human
caggccugggggcugggcagagg

SEQ ID NO: 2530352 - RNA, 17 nt, Human
caggcuggcgugcagug

SEQ ID NO: 2530353 - RNA, 18 nt, Human
caggcugggagagccuuc

SEQ ID NO: 2530354 - RNA, 16 nt, Human
caggcugggagagccu

SEQ ID NO: 2530355 - RNA, 19 nt, Human
caggcugggagagccuucc

SEQ ID NO: 2530356 - RNA, 20 nt, Human
caggcugggagagccuucca

SEQ ID NO: 2530357 - RNA, 18 nt, Human
caggcugggcaaggaggc

SEQ ID NO: 2530358 - RNA, 23 nt, Human
cagggaggagaggggaagggcca

SEQ ID NO: 2530359 - RNA, 22 nt, Human
cagggaggagaggggaagggcc

SEQ ID NO: 2530360 - RNA, 12 nt, Human
cagggaggagag

SEQ ID NO: 2530361 - RNA, 18 nt, Human
cagggaggagguggcagc

SEQ ID NO: 2530362 - RNA, 19 nt, Human
cagggaggagguggcagcc

SEQ ID NO: 2530363 - RNA, 20 nt, Human
cagggaggagguggcagccc

SEQ ID NO: 2530364 - RNA, 21 nt, Human
cagggaggagguggcagcccu

SEQ ID NO: 2530365 - RNA, 22 nt, Human
cagggaggacgcucucuggccu

SEQ ID NO: 2530366 - RNA, 19 nt, Human
cagggaggacgcucucugg

SEQ ID NO: 2530367 - RNA, 14 nt, Human
caggcugggcuuca

SEQ ID NO: 2530368 - RNA, 15 nt, Human
cagggcucagcgggg

SEQ ID NO: 2530369 - RNA, 12 nt, Human
cagggcucagcg

SEQ ID NO: 2530370 - RNA, 20 nt, Human
cagggcucagcggggacagc

SEQ ID NO: 2530371 - RNA, 21 nt, Human
cagggcuggacugaggccuga

SEQ ID NO: 2530372 - RNA, 20 nt, Human
cagggcuggacugaggccug

SEQ ID NO: 2530373 - RNA, 19 nt, Human
cagggcuggacugaggccu

SEQ ID NO: 2530374 - RNA, 19 nt, Human
cagggcucagccugguggg

SEQ ID NO: 2530375 - RNA, 17 nt, Human
cagggagggccugggcc

SEQ ID NO: 2530376 - RNA, 18 nt, Human
cagggagggccugggccc

SEQ ID NO: 2530377 - RNA, 16 nt, Human
cagggagggcuucugc

SEQ ID NO: 2530378 - RNA, 16 nt, Human
cagggaggucauuuug

SEQ ID NO: 2530379 - RNA, 13 nt, Human
cagggaggggacu

SEQ ID NO: 2530380 - RNA, 19 nt, Human
cagggaggggacuauuuau

SEQ ID NO: 2530381 - RNA, 15 nt, Human
cagggcucagccugg

SEQ ID NO: 2530382 - RNA, 16 nt, Human
cagggcucagccuggu

SEQ ID NO: 2530383 - RNA, 21 nt, Human
cagggaggggacuauuuauga

SEQ ID NO: 2530384 - RNA, 12 nt, Human
cagggaggggac

SEQ ID NO: 2530385 - RNA, 16 nt, Human
cagggaggggaagagg

SEQ ID NO: 2530386 - RNA, 15 nt, Human
ccugcaggaccugcc

SEQ ID NO: 2530387 - RNA, 16 nt, Human
ccugcaggaccugccu

SEQ ID NO: 2530388 - RNA, 17 nt, Human
ccugcaggaccugccug

SEQ ID NO: 2530389 - RNA, 18 nt, Human
ccugcaggaccugccugu

SEQ ID NO: 2530390 - RNA, 20 nt, Human
ccugaguagaaaggccuuua

SEQ ID NO: 2530391 - RNA, 14 nt, Human
ccugaguagaaagg

SEQ ID NO: 2530392 - RNA, 13 nt, Human
ccugaguagcugg

SEQ ID NO: 2530393 - RNA, 21 nt, Human
ccugaguagaaaggccuuuaa

SEQ ID NO: 2530394 - RNA, 23 nt, Human
ccugaguaaucgcuuaaagaugu

SEQ ID NO: 2530395 - RNA, 20 nt, Human
ccugaguaaucgcuuaaaga

SEQ ID NO: 2530396 - RNA, 22 nt, Human
ccugaguaaaaaagcugugugc

SEQ ID NO: 2530397 - RNA, 15 nt, Human
ccugagaggcaggca

SEQ ID NO: 2530398 - RNA, 14 nt, Human
ccugagaggcaggc

SEQ ID NO: 2530399 - RNA, 13 nt, Human
ccugagaggcagg

SEQ ID NO: 2530400 - RNA, 12 nt, Human
ccugagaggcag

SEQ ID NO: 2530401 - RNA, 18 nt, Human
ccugagaggcaggcauag

SEQ ID NO: 2530402 - RNA, 17 nt, Human
ccugagaggcaggcaua

SEQ ID NO: 2530403 - RNA, 23 nt, Human
ccugaggugugggggcugcagca

SEQ ID NO: 2530404 - RNA, 22 nt, Human
ccugaggugugggggcugcagc

SEQ ID NO: 2530405 - RNA, 21 nt, Human
ccugaggugugggggcugcag

SEQ ID NO: 2530406 - RNA, 20 nt, Human
ccugagagaaacugagguca

SEQ ID NO: 2530407 - RNA, 19 nt, Human
ccugagaccccuggccucc

SEQ ID NO: 2530408 - RNA, 18 nt, Human
ccugagaccccuggccuc

SEQ ID NO: 2530409 - RNA, 20 nt, Human
ccugagaccccuggccuccg

SEQ ID NO: 2530410 - RNA, 17 nt, Human
ccugagaccccuggccu

SEQ ID NO: 2530411 - RNA, 16 nt, Human
ccugagaccccuggcc

SEQ ID NO: 2530412 - RNA, 15 nt, Human
ccugagaccccuggc

SEQ ID NO: 2530413 - RNA, 21 nt, Human
ccugagaccaguugggagcac

SEQ ID NO: 2530414 - RNA, 22 nt, Human
ccugagaccaguugggagcacu

SEQ ID NO: 2530415 - RNA, 18 nt, Human
ccugagaccacagagaga

SEQ ID NO: 2530416 - RNA, 12 nt, Human
ccugagaccaca

SEQ ID NO: 2530417 - RNA, 21 nt, Human
ccugagacaaauggaggccug

SEQ ID NO: 2530418 - RNA, 20 nt, Human
ccugagacaaauggaggccu

SEQ ID NO: 2530419 - RNA, 19 nt, Human
ccugagacaaauggaggcc

SEQ ID NO: 2530420 - RNA, 22 nt, Human
ccugagaauaagaaaguuucac

SEQ ID NO: 2530421 - RNA, 12 nt, Human
ccugagaagaga

SEQ ID NO: 2530422 - RNA, 15 nt, Human
ccugagacaaaugga

SEQ ID NO: 2530423 - RNA, 22 nt, Human
ccugagaagugucuaaaaacac

SEQ ID NO: 2530424 - RNA, 13 nt, Human
ccugcagccugga

SEQ ID NO: 2530425 - RNA, 15 nt, Human
ccugcagccuggagg

SEQ ID NO: 2530426 - RNA, 16 nt, Human
ccugcagccuggaggc

SEQ ID NO: 2530427 - RNA, 16 nt, Human
ccugcagaauuugggu

SEQ ID NO: 2530428 - RNA, 15 nt, Human
ccugcagacucacug

SEQ ID NO: 2530429 - RNA, 12 nt, Human
ccugcagccugg

SEQ ID NO: 2530430 - RNA, 22 nt, Human
ccugcacuugcagacucuacag

SEQ ID NO: 2530431 - RNA, 19 nt, Human
ccugaguagcuggauuaca

SEQ ID NO: 2530432 - RNA, 15 nt, Human
ccugaguagcuggau

SEQ ID NO: 2530433 - RNA, 19 nt, Human
ccugcacuugcagacucua

SEQ ID NO: 2530434 - RNA, 20 nt, Human
ccugaguagcuggauuacag

SEQ ID NO: 2530435 - RNA, 13 nt, Human
ccucuugagccuu

SEQ ID NO: 2530436 - RNA, 19 nt, Human
ccucuugagccuugaacuu

SEQ ID NO: 2530437 - RNA, 17 nt, Human
ccucuugagcaguggcu

SEQ ID NO: 2530438 - RNA, 16 nt, Human
ccucuugagcaguggc

SEQ ID NO: 2530439 - RNA, 15 nt, Human
ccucuugagcagugg

SEQ ID NO: 2530440 - RNA, 14 nt, Human
ccucuugagcagug

SEQ ID NO: 2530441 - RNA, 16 nt, Human
ccugaccucccucuaa

SEQ ID NO: 2530442 - RNA, 12 nt, Human
ccugaccuccca

SEQ ID NO: 2530443 - RNA, 13 nt, Human
ccugaccucccag

SEQ ID NO: 2530444 - RNA, 16 nt, Human
ccugaccgugggcggg

SEQ ID NO: 2530445 - RNA, 19 nt, Human
ccugacccuguauauagcc

SEQ ID NO: 2530446 - RNA, 17 nt, Human
ccucuuuagaguuagac

SEQ ID NO: 2530447 - RNA, 12 nt, Human
ccucuuuagagu

SEQ ID NO: 2530448 - RNA, 12 nt, Human
ccucuuuaagag

SEQ ID NO: 2530449 - RNA, 17 nt, Human
ccugacccuguauauag

SEQ ID NO: 2530450 - RNA, 24 nt, Human
ccucuugagcaguggcugguccag

SEQ ID NO: 2530451 - RNA, 19 nt, Human
ccucuugagcaguggcugg

SEQ ID NO: 2530452 - RNA, 21 nt, Human
ccucuuggucuucccaggcug

SEQ ID NO: 2530453 - RNA, 13 nt, Human
ccucuuggguuca

SEQ ID NO: 2530454 - RNA, 20 nt, Human
ccucuuguaaauaaagcccu

SEQ ID NO: 2530455 - RNA, 18 nt, Human
ccucuuguaaauaaagcc

SEQ ID NO: 2530456 - RNA, 17 nt, Human
ccucuuguaaauaaagc

SEQ ID NO: 2530457 - RNA, 14 nt, Human
ccucuuguaaauaa

SEQ ID NO: 2530458 - RNA, 13 nt, Human
ccucuuguaaaua

SEQ ID NO: 2530459 - RNA, 12 nt, Human
ccucuuguaaau

SEQ ID NO: 2530460 - RNA, 14 nt, Human
ccugacucucagca

SEQ ID NO: 2530461 - RNA, 15 nt, Human
ccugaccugaggcuc

SEQ ID NO: 2530462 - RNA, 14 nt, Human
ccugaccugucuca

SEQ ID NO: 2530463 - RNA, 18 nt, Human
ccugacucgucugacugu

SEQ ID NO: 2530464 - RNA, 18 nt, Human
ccugaccucccagcccua

SEQ ID NO: 2530465 - RNA, 17 nt, Human
ccugaccucccagcccu

SEQ ID NO: 2530466 - RNA, 15 nt, Human
ccugaccucccagcc

SEQ ID NO: 2530467 - RNA, 14 nt, Human
ccugaccucccagc

SEQ ID NO: 2530468 - RNA, 14 nt, Human
ccugaccugaggcu

SEQ ID NO: 2530469 - RNA, 13 nt, Human
ccugaccugaggc

SEQ ID NO: 2530470 - RNA, 13 nt, Human
ccugacucucugu

SEQ ID NO: 2530471 - RNA, 15 nt, Human
ccugacucucuguga

SEQ ID NO: 2530472 - RNA, 16 nt, Human
ccugacucucugugac

SEQ ID NO: 2530473 - RNA, 17 nt, Human
ccugacucucugugacc

SEQ ID NO: 2530474 - RNA, 14 nt, Human
ccugacucugcccc

SEQ ID NO: 2530475 - RNA, 13 nt, Human
ccugacucugccc

SEQ ID NO: 2530476 - RNA, 12 nt, Human
ccugacucugcc

SEQ ID NO: 2530477 - RNA, 18 nt, Human
ccugacucugaaaucuga

SEQ ID NO: 2530478 - RNA, 13 nt, Human
ccugacucugaaa

SEQ ID NO: 2530479 - RNA, 21 nt, Human
ccugacucgucugacugugug

SEQ ID NO: 2530480 - RNA, 18 nt, Human
ccugacucucugugaccu

SEQ ID NO: 2530481 - RNA, 22 nt, Human
ccugacucugcccccugcuggc

SEQ ID NO: 2530482 - RNA, 17 nt, Human
ccugacucugcccccug

SEQ ID NO: 2530483 - RNA, 16 nt, Human
ccugacucugcccccu

SEQ ID NO: 2530484 - RNA, 15 nt, Human
ccugacucugccccc

SEQ ID NO: 2530485 - RNA, 21 nt, Human
ccugacuggugcuauaggcug

SEQ ID NO: 2530486 - RNA, 13 nt, Human
ccugagaagagag

SEQ ID NO: 2530487 - RNA, 23 nt, Human
ccugacuucaggggcugcccgcu

SEQ ID NO: 2530488 - RNA, 23 nt, Human
ccugacuuggggagauggaguuc

SEQ ID NO: 2530489 - RNA, 22 nt, Human
ccugacuucaggggcugcccgc

SEQ ID NO: 2530490 - RNA, 21 nt, Human
ccugacuucaggggcugcccg

SEQ ID NO: 2530491 - RNA, 19 nt, Human
ccugacuuggggagaugga

SEQ ID NO: 2530492 - RNA, 20 nt, Human
ccugacuucaggggcugccc

SEQ ID NO: 2530493 - RNA, 19 nt, Human
ccugacuucaggggcugcc

SEQ ID NO: 2530494 - RNA, 23 nt, Human
ccugacuggugcuauaggcugga

SEQ ID NO: 2530495 - RNA, 15 nt, Human
ccucugcuucucacg

SEQ ID NO: 2530496 - RNA, 21 nt, Human
ccucugcuggcacauuucccc

SEQ ID NO: 2530497 - RNA, 20 nt, Human
ccucugcugcugucccuccc

SEQ ID NO: 2530498 - RNA, 19 nt, Human
ccucugcugcugucccucc

SEQ ID NO: 2530499 - RNA, 14 nt, Human
ccucugcugcuguc

SEQ ID NO: 2530500 - RNA, 15 nt, Human
ccucugcugccaugg

SEQ ID NO: 2530501 - RNA, 22 nt, Human
ccucucugcaggucccuaauaa

SEQ ID NO: 2530502 - RNA, 21 nt, Human
ccucucugcaggucccuaaua

SEQ ID NO: 2530503 - RNA, 23 nt, Human
ccucucugcaggucccuaauaaa

SEQ ID NO: 2530504 - RNA, 12 nt, Human
ccucucugcccu

SEQ ID NO: 2530505 - RNA, 22 nt, Human
ccucugccugaagucacacagu

SEQ ID NO: 2530506 - RNA, 11 nt, Human
ccucugccugc

SEQ ID NO: 2530507 - RNA, 16 nt, Human
ccucucugcaucugac

SEQ ID NO: 2530508 - RNA, 16 nt, Human
ccucugccugccccgc

SEQ ID NO: 2530509 - RNA, 13 nt, Human
ccucugccugccc

SEQ ID NO: 2530510 - RNA, 12 nt, Human
ccucugccugcc

SEQ ID NO: 2530511 - RNA, 17 nt, Human
ccucugccugcauucug

SEQ ID NO: 2530512 - RNA, 12 nt, Human
ccucugccuguc

SEQ ID NO: 2530513 - RNA, 21 nt, Human
ccucugccugccccgccccca

SEQ ID NO: 2530514 - RNA, 14 nt, Human
ccucugccuguccc

SEQ ID NO: 2530515 - RNA, 15 nt, Human
ccucugccugucccu

SEQ ID NO: 2530516 - RNA, 16 nt, Human
ccucugccugucccuc

SEQ ID NO: 2530517 - RNA, 18 nt, Human
ccucugcuccuggagccu

SEQ ID NO: 2530518 - RNA, 13 nt, Human
ccucugcuccugg

SEQ ID NO: 2530519 - RNA, 17 nt, Human
ccucugccugucccucu

SEQ ID NO: 2530520 - RNA, 14 nt, Human
ccucugcuccccag

SEQ ID NO: 2530521 - RNA, 13 nt, Human
ccucugcucccca

SEQ ID NO: 2530522 - RNA, 18 nt, Human
ccucugcugcuggcuggu

SEQ ID NO: 2530523 - RNA, 17 nt, Human
ccucugcugcuggcugg

SEQ ID NO: 2530524 - RNA, 16 nt, Human
ccucugcugcuggcug

SEQ ID NO: 2530525 - RNA, 15 nt, Human
ccucugcugcuggcu

SEQ ID NO: 2530526 - RNA, 14 nt, Human
ccucugcugcuggc

SEQ ID NO: 2530527 - RNA, 13 nt, Human
ccucugcugcugg

SEQ ID NO: 2530528 - RNA, 21 nt, Human
ccucugcucugaggcuuccag

SEQ ID NO: 2530529 - RNA, 20 nt, Human
ccucugcucugaggcuucca

SEQ ID NO: 2530530 - RNA, 14 nt, Human
ccucugcucugagg

SEQ ID NO: 2530531 - RNA, 22 nt, Human
ccucugcuccuggagccuuuga

SEQ ID NO: 2530532 - RNA, 15 nt, Human
ccucugcugauccuc

SEQ ID NO: 2530533 - RNA, 18 nt, Human
ccucugcugauccuccca

SEQ ID NO: 2530534 - RNA, 22 nt, Human
ccucugcucugaggcuuccaga

SEQ ID NO: 2530535 - RNA, 14 nt, Human
ccucugcugccaug

SEQ ID NO: 2530536 - RNA, 12 nt, Human
ccucucucaggc

SEQ ID NO: 2530537 - RNA, 17 nt, Human
ccucucucacuccuuga

SEQ ID NO: 2530538 - RNA, 15 nt, Human
ccucucucacuccuu

SEQ ID NO: 2530539 - RNA, 14 nt, Human
ccucucucacuccu

SEQ ID NO: 2530540 - RNA, 13 nt, Human
ccucucucacucc

SEQ ID NO: 2530541 - RNA, 12 nt, Human
ccucucucuccg

SEQ ID NO: 2530542 - RNA, 14 nt, Human
ccucucuccuuugc

SEQ ID NO: 2530543 - RNA, 15 nt, Human
ccucucucccagucu

SEQ ID NO: 2530544 - RNA, 14 nt, Human
ccucucucccaguc

SEQ ID NO: 2530545 - RNA, 12 nt, Human
ccucucucccag

SEQ ID NO: 2530546 - RNA, 14 nt, Human
ccucucucaggcca

SEQ ID NO: 2530547 - RNA, 14 nt, Human
ccucucucugacuc

SEQ ID NO: 2530548 - RNA, 13 nt, Human
ccucucucugacu

SEQ ID NO: 2530549 - RNA, 12 nt, Human
ccucucucugac

SEQ ID NO: 2530550 - RNA, 11 nt, Human
ccucucucuga

SEQ ID NO: 2530551 - RNA, 17 nt, Human
ccucucucugacucuca

SEQ ID NO: 2530552 - RNA, 15 nt, Human
ccucucucugacucu

SEQ ID NO: 2530553 - RNA, 12 nt, Human
ccucucucuucu

SEQ ID NO: 2530554 - RNA, 16 nt, Human
ccucucucuucugcuc

SEQ ID NO: 2530555 - RNA, 18 nt, Human
ccucucucuucugcucca

SEQ ID NO: 2530556 - RNA, 19 nt, Human
ccucucucuucugcuccac

SEQ ID NO: 2530557 - RNA, 20 nt, Human
ccucucucuucugcuccacc

SEQ ID NO: 2530558 - RNA, 13 nt, Human
ccucucugcaggu

SEQ ID NO: 2530559 - RNA, 21 nt, Human
ccucucucuucugcuccaccc

SEQ ID NO: 2530560 - RNA, 22 nt, Human
ccucucucuucugcuccacccu

SEQ ID NO: 2530561 - RNA, 15 nt, Human
ccucucugcaggucc

SEQ ID NO: 2530562 - RNA, 20 nt, Human
ccucucugcaggucccuaau

SEQ ID NO: 2530563 - RNA, 12 nt, Human
ccucucugcacc

SEQ ID NO: 2530564 - RNA, 22 nt, Human
ccuggcccucaaggccucccac

SEQ ID NO: 2530565 - RNA, 13 nt, Human
ccuggcccucaag

SEQ ID NO: 2530566 - RNA, 15 nt, Human
ccuggccucugcacu

SEQ ID NO: 2530567 - RNA, 14 nt, Human
ccuggccucugcac

SEQ ID NO: 2530568 - RNA, 13 nt, Human
ccuggccugagcu

SEQ ID NO: 2530569 - RNA, 20 nt, Human
ccuggccgcccccugccccc

SEQ ID NO: 2530570 - RNA, 15 nt, Human
ccuggccgcccccug

SEQ ID NO: 2530571 - RNA, 16 nt, Human
ccuggccucugcacuc

SEQ ID NO: 2530572 - RNA, 14 nt, Human
ccuggccgcccccu

SEQ ID NO: 2530573 - RNA, 12 nt, Human
ccuggccgcccc

SEQ ID NO: 2530574 - RNA, 18 nt, Human
ccuggccgaguccaagcu

SEQ ID NO: 2530575 - RNA, 19 nt, Human
ccuggccgaguccaagcug

SEQ ID NO: 2530576 - RNA, 12 nt, Human
ccuggccucugc

SEQ ID NO: 2530577 - RNA, 15 nt, Human
ccuggcccucugugu

SEQ ID NO: 2530578 - RNA, 13 nt, Human
ccuggcccucugu

SEQ ID NO: 2530579 - RNA, 12 nt, Human
ccuggcccucug

SEQ ID NO: 2530580 - RNA, 23 nt, Human
ccuggcccucaaggccucccaca

SEQ ID NO: 2530581 - RNA, 16 nt, Human
ccuggcccugaggugu

SEQ ID NO: 2530582 - RNA, 15 nt, Human
ccuggcccugaggug

SEQ ID NO: 2530583 - RNA, 19 nt, Human
ccuggcacagugucugggc

SEQ ID NO: 2530584 - RNA, 15 nt, Human
ccuggcacagugucu

SEQ ID NO: 2530585 - RNA, 13 nt, Human
ccuggcacagugu

SEQ ID NO: 2530586 - RNA, 12 nt, Human
ccuggcacagug

SEQ ID NO: 2530587 - RNA, 18 nt, Human
ccuggcacagggcagugg

SEQ ID NO: 2530588 - RNA, 17 nt, Human
ccuggcacagggcagug

SEQ ID NO: 2530589 - RNA, 16 nt, Human
ccuggcacagggcagu

SEQ ID NO: 2530590 - RNA, 23 nt, Human
ccuggcacagugucugggcugac

SEQ ID NO: 2530591 - RNA, 22 nt, Human
ccuggcacagugucugggcuga

SEQ ID NO: 2530592 - RNA, 21 nt, Human
ccuggcacagugucugggcug

SEQ ID NO: 2530593 - RNA, 20 nt, Human
ccuggcacagugucugggcu

SEQ ID NO: 2530594 - RNA, 14 nt, Human
ccuggaggugccag

SEQ ID NO: 2530595 - RNA, 13 nt, Human
ccuggaggugcca

SEQ ID NO: 2530596 - RNA, 21 nt, Human
ccuggaggggcuagaaccuag

SEQ ID NO: 2530597 - RNA, 20 nt, Human
ccuggaggggcuagaaccua

SEQ ID NO: 2530598 - RNA, 22 nt, Human
ccuggaggggcuagaaccuaga

SEQ ID NO: 2530599 - RNA, 21 nt, Human
ccuggaggugccagcaaagcc

SEQ ID NO: 2530600 - RNA, 19 nt, Human
ccuggaggugccagcaaag

SEQ ID NO: 2530601 - RNA, 18 nt, Human
ccuggaggugccagcaaa

SEQ ID NO: 2530602 - RNA, 16 nt, Human
ccuggaggugccagca

SEQ ID NO: 2530603 - RNA, 23 nt, Human
ccuggaggugccagcaaagcccc

SEQ ID NO: 2530604 - RNA, 22 nt, Human
ccuggaggugccagcaaagccc

SEQ ID NO: 2530605 - RNA, 14 nt, Human
ccuggagguggcug

SEQ ID NO: 2530606 - RNA, 21 nt, Human
ccuggagguggcugagccccu

SEQ ID NO: 2530607 - RNA, 18 nt, Human
ccuggagggcuagaacug

SEQ ID NO: 2530608 - RNA, 23 nt, Human
ccuggagggcuagaaccuggaga

SEQ ID NO: 2530609 - RNA, 22 nt, Human
ccuggagggcuagaaccuggag

SEQ ID NO: 2530610 - RNA, 21 nt, Human
ccuggagggcuagaaccugga

SEQ ID NO: 2530611 - RNA, 21 nt, Human
ccuggagggcuagaaccuaga

SEQ ID NO: 2530612 - RNA, 20 nt, Human
ccuggagggcuagaaccuag

SEQ ID NO: 2530613 - RNA, 19 nt, Human
ccuggagggcuagaaccua

SEQ ID NO: 2530614 - RNA, 12 nt, Human
ccuggagggcua

SEQ ID NO: 2530615 - RNA, 18 nt, Human
ccuggaggauugcaggug

SEQ ID NO: 2530616 - RNA, 21 nt, Human
ccuggagggaaugaaccugga

SEQ ID NO: 2530617 - RNA, 17 nt, Human
ccuggaguucugguucc

SEQ ID NO: 2530618 - RNA, 16 nt, Human
ccuggaguucugguuc

SEQ ID NO: 2530619 - RNA, 18 nt, Human
ccuggagucaugccaagc

SEQ ID NO: 2530620 - RNA, 20 nt, Human
ccuggaggugggguugggau

SEQ ID NO: 2530621 - RNA, 22 nt, Human
ccuggaguguaugacugcacau

SEQ ID NO: 2530622 - RNA, 15 nt, Human
ccuggaguauaauau

SEQ ID NO: 2530623 - RNA, 22 nt, Human
ccuggagguggcugagccccug

SEQ ID NO: 2530624 - RNA, 23 nt, Human
ccuggagguggcugagccccugu

SEQ ID NO: 2530625 - RNA, 15 nt, Human
ccuggaguucugguu

SEQ ID NO: 2530626 - RNA, 17 nt, Human
ccuggaugcagccucac

SEQ ID NO: 2530627 - RNA, 14 nt, Human
ccuggaugcagccu

SEQ ID NO: 2530628 - RNA, 19 nt, Human
ccuggaugcagccucacag

SEQ ID NO: 2530629 - RNA, 21 nt, Human
ccuggcacacaucaggaguuc

SEQ ID NO: 2530630 - RNA, 19 nt, Human
ccuggaucuccccacucua

SEQ ID NO: 2530631 - RNA, 22 nt, Human
ccuggauauuauucuuguaguu

SEQ ID NO: 2530632 - RNA, 18 nt, Human
ccuggauauuauucuugu

SEQ ID NO: 2530633 - RNA, 21 nt, Human
ccuggaguguggcugaggagg

SEQ ID NO: 2530634 - RNA, 20 nt, Human
ccuggaguguggcugaggag

SEQ ID NO: 2530635 - RNA, 19 nt, Human
ccuggaguguggcugagga

SEQ ID NO: 2530636 - RNA, 14 nt, Human
ccuggagugcaguu

SEQ ID NO: 2530637 - RNA, 21 nt, Human
ccuggauccaucaggccacuu

SEQ ID NO: 2530638 - RNA, 13 nt, Human
ccuggaugcagcc

SEQ ID NO: 2530639 - RNA, 16 nt, Human
ccuggaucuaccagca

SEQ ID NO: 2530640 - RNA, 22 nt, Human
ccuggaucuaccagcauaaaua

SEQ ID NO: 2530641 - RNA, 16 nt, Human
ccugcccaggccccug

SEQ ID NO: 2530642 - RNA, 15 nt, Human
ccugcccaggccccu

SEQ ID NO: 2530643 - RNA, 14 nt, Human
ccugcccaggcccc

SEQ ID NO: 2530644 - RNA, 20 nt, Human
ccugcuggguguggcgcagc

SEQ ID NO: 2530645 - RNA, 14 nt, Human
ccugcugggugugg

SEQ ID NO: 2530646 - RNA, 22 nt, Human
ccuggagccccugggugggugg

SEQ ID NO: 2530647 - RNA, 21 nt, Human
ccugcugggcucuccaccuca

SEQ ID NO: 2530648 - RNA, 22 nt, Human
ccugcugggcucuccaccucag

SEQ ID NO: 2530649 - RNA, 24 nt, Human
ccugcugggcucuccaccucagcc

SEQ ID NO: 2530650 - RNA, 22 nt, Human
ccuggagcguuucuagcaagug

SEQ ID NO: 2530651 - RNA, 15 nt, Human
ccugcuggguaaacu

SEQ ID NO: 2530652 - RNA, 23 nt, Human
ccugcugggcucuccaccucagc

SEQ ID NO: 2530653 - RNA, 13 nt, Human
ccuggaggcccag

SEQ ID NO: 2530654 - RNA, 14 nt, Human
ccuggaggcccagu

SEQ ID NO: 2530655 - RNA, 16 nt, Human
ccuggaggcccaguuc

SEQ ID NO: 2530656 - RNA, 22 nt, Human
ccuggaggcacugaagugcuua

SEQ ID NO: 2530657 - RNA, 12 nt, Human
ccuggaggccca

SEQ ID NO: 2530658 - RNA, 14 nt, Human
ccuggaggcacuga

SEQ ID NO: 2530659 - RNA, 16 nt, Human
ccuggaggauuucauc

SEQ ID NO: 2530660 - RNA, 17 nt, Human
ccugcuggguaaacugu

SEQ ID NO: 2530661 - RNA, 18 nt, Human
ccuggaggacggccggcu

SEQ ID NO: 2530662 - RNA, 20 nt, Human
ccuggaggaggagcaggggc

SEQ ID NO: 2530663 - RNA, 15 nt, Human
ccuggaggaggagca

SEQ ID NO: 2530664 - RNA, 17 nt, Human
ccugcuggccgccucac

SEQ ID NO: 2530665 - RNA, 16 nt, Human
ccugcuggccgccuca

SEQ ID NO: 2530666 - RNA, 15 nt, Human
ccugcuggccgccuc

SEQ ID NO: 2530667 - RNA, 14 nt, Human
ccugcuggccgccu

SEQ ID NO: 2530668 - RNA, 13 nt, Human
ccugcuggcucuu

SEQ ID NO: 2530669 - RNA, 12 nt, Human
ccugcuggcucu

SEQ ID NO: 2530670 - RNA, 19 nt, Human
ccugcuggccgccucaccc

SEQ ID NO: 2530671 - RNA, 14 nt, Human
ccugcuggccccuc

SEQ ID NO: 2530672 - RNA, 15 nt, Human
ccugcuggccccuca

SEQ ID NO: 2530673 - RNA, 16 nt, Human
ccugcuggccccucac

SEQ ID NO: 2530674 - RNA, 17 nt, Human
ccugcuggccccucacc

SEQ ID NO: 2530675 - RNA, 18 nt, Human
ccugcuggccccucaccu

SEQ ID NO: 2530676 - RNA, 13 nt, Human
ccugcuggccgcc

SEQ ID NO: 2530677 - RNA, 21 nt, Human
ccugcuggccccucaccuggg

SEQ ID NO: 2530678 - RNA, 12 nt, Human
ccugcugggugu

SEQ ID NO: 2530679 - RNA, 19 nt, Human
ccugcuggcucuucugccc

SEQ ID NO: 2530680 - RNA, 17 nt, Human
ccugcuggcucuucugc

SEQ ID NO: 2530681 - RNA, 12 nt, Human
ccugcugggcuc

SEQ ID NO: 2530682 - RNA, 16 nt, Human
ccugcugggcucucca

SEQ ID NO: 2530683 - RNA, 17 nt, Human
ccugcugggcucuccac

SEQ ID NO: 2530684 - RNA, 18 nt, Human
ccugcugggcucuccacc

SEQ ID NO: 2530685 - RNA, 19 nt, Human
ccugcugggcucuccaccu

SEQ ID NO: 2530686 - RNA, 20 nt, Human
ccugcugggcucuccaccuc

SEQ ID NO: 2530687 - RNA, 16 nt, Human
ccugcccaguccccca

SEQ ID NO: 2530688 - RNA, 15 nt, Human
ccugcccaguccccc

SEQ ID NO: 2530689 - RNA, 12 nt, Human
ccugcccagucc

SEQ ID NO: 2530690 - RNA, 23 nt, Human
ccugcccagucccccaaccccag

SEQ ID NO: 2530691 - RNA, 22 nt, Human
ccugcccagucccccaacccca

SEQ ID NO: 2530692 - RNA, 21 nt, Human
ccugcccagucccccaacccc

SEQ ID NO: 2530693 - RNA, 19 nt, Human
ccugcccagucccccaacc

SEQ ID NO: 2530694 - RNA, 22 nt, Human
ccugcccaugucgcgcucagca

SEQ ID NO: 2530695 - RNA, 16 nt, Human
ccugcccaucugggaa

SEQ ID NO: 2530696 - RNA, 23 nt, Human
ccugcccaugucgcgcucagcau

SEQ ID NO: 2530697 - RNA, 16 nt, Human
ccugcccaugggagcu

SEQ ID NO: 2530698 - RNA, 16 nt, Human
ccugcccauuggagag

SEQ ID NO: 2530699 - RNA, 19 nt, Human
ccucccagcugacaguccu

SEQ ID NO: 2530700 - RNA, 16 nt, Human
ccucccagcugacagu

SEQ ID NO: 2530701 - RNA, 12 nt, Human
ccucccagcuga

SEQ ID NO: 2530702 - RNA, 20 nt, Human
ccucccagcccuauggaugu

SEQ ID NO: 2530703 - RNA, 11 nt, Human
ccucccagcug

SEQ ID NO: 2530704 - RNA, 20 nt, Human
ccucccaggcgccccuuccc

SEQ ID NO: 2530705 - RNA, 14 nt, Human
ccucccaggcgccc

SEQ ID NO: 2530706 - RNA, 23 nt, Human
ccucccacagugacucgggcucc

SEQ ID NO: 2530707 - RNA, 13 nt, Human
ccucccacaguga

SEQ ID NO: 2530708 - RNA, 12 nt, Human
ccucccacagug

SEQ ID NO: 2530709 - RNA, 11 nt, Human
ccucccacaca

SEQ ID NO: 2530710 - RNA, 20 nt, Human
ccucccaauuucagacuccc

SEQ ID NO: 2530711 - RNA, 19 nt, Human
ccucccaauuucagacucc

SEQ ID NO: 2530712 - RNA, 17 nt, Human
ccucccaaguggugccu

SEQ ID NO: 2530713 - RNA, 12 nt, Human
ccucccaccaca

SEQ ID NO: 2530714 - RNA, 14 nt, Human
ccucccaccacagc

SEQ ID NO: 2530715 - RNA, 15 nt, Human
ccucccaccacagca

SEQ ID NO: 2530716 - RNA, 21 nt, Human
ccucccagaucggaucuguug

SEQ ID NO: 2530717 - RNA, 13 nt, Human
ccucccacccacc

SEQ ID NO: 2530718 - RNA, 13 nt, Human
ccucccagcccua

SEQ ID NO: 2530719 - RNA, 12 nt, Human
ccucccagcccu

SEQ ID NO: 2530720 - RNA, 19 nt, Human
ccucccagcccuauggaug

SEQ ID NO: 2530721 - RNA, 18 nt, Human
ccucccagcccuauggau

SEQ ID NO: 2530722 - RNA, 12 nt, Human
ccucccagccug

SEQ ID NO: 2530723 - RNA, 23 nt, Human
ccucauguggcuggaagauccug

SEQ ID NO: 2530724 - RNA, 18 nt, Human
ccucauguggcuggaaga

SEQ ID NO: 2530725 - RNA, 15 nt, Human
ccucauuaaugacac

SEQ ID NO: 2530726 - RNA, 17 nt, Human
ccucauuaaugacacuu

SEQ ID NO: 2530727 - RNA, 19 nt, Human
ccucauguucuuaauucuu

SEQ ID NO: 2530728 - RNA, 22 nt, Human
ccuccaagcuccaucuccacuc

SEQ ID NO: 2530729 - RNA, 21 nt, Human
ccuccaagcuccaucuccacu

SEQ ID NO: 2530730 - RNA, 18 nt, Human
ccucauuagcauuuugcu

SEQ ID NO: 2530731 - RNA, 22 nt, Human
ccuccaaucccaccaacccuca

SEQ ID NO: 2530732 - RNA, 22 nt, Human
ccucccaaggggcccaaauucu

SEQ ID NO: 2530733 - RNA, 21 nt, Human
ccuccaaggaggggcuguaaa

SEQ ID NO: 2530734 - RNA, 20 nt, Human
ccuccaaggaggggcuguaa

SEQ ID NO: 2530735 - RNA, 22 nt, Human
ccucauuacuuuaccaccccca

SEQ ID NO: 2530736 - RNA, 15 nt, Human
ccucauguccacugg

SEQ ID NO: 2530737 - RNA, 23 nt, Human
ccucagccgacugcacagcggcc

SEQ ID NO: 2530738 - RNA, 22 nt, Human
ccucagccucccaaguagcugg

SEQ ID NO: 2530739 - RNA, 13 nt, Human
ccucagccuccug

SEQ ID NO: 2530740 - RNA, 22 nt, Human
ccucagccucccgaauagcugg

SEQ ID NO: 2530741 - RNA, 23 nt, Human
ccucagccucccaaagugcuggg

SEQ ID NO: 2530742 - RNA, 17 nt, Human
ccucauguggcuggaag

SEQ ID NO: 2530743 - RNA, 16 nt, Human
ccucauguggcuggaa

SEQ ID NO: 2530744 - RNA, 15 nt, Human
ccucauguggcugga

SEQ ID NO: 2530745 - RNA, 13 nt, Human
ccucauguggcug

SEQ ID NO: 2530746 - RNA, 13 nt, Human
ccucauguucuua

SEQ ID NO: 2530747 - RNA, 20 nt, Human
ccucauguccacugguucuu

SEQ ID NO: 2530748 - RNA, 18 nt, Human
ccucaugugaucacaauu

SEQ ID NO: 2530749 - RNA, 12 nt, Human
ccucagccuccg

SEQ ID NO: 2530750 - RNA, 14 nt, Human
ccucagccuccuga

SEQ ID NO: 2530751 - RNA, 12 nt, Human
ccucaaccucuu

SEQ ID NO: 2530752 - RNA, 17 nt, Human
ccucaaccucuucuggc

SEQ ID NO: 2530753 - RNA, 20 nt, Human
ccucaaccucuucuggcuca

SEQ ID NO: 2530754 - RNA, 18 nt, Human
ccucaacguauuguuucg

SEQ ID NO: 2530755 - RNA, 13 nt, Human
ccucaaccuguga

SEQ ID NO: 2530756 - RNA, 21 nt, Human
ccucaacucaccuaauguuua

SEQ ID NO: 2530757 - RNA, 19 nt, Human
ccucaacguugcuccccau

SEQ ID NO: 2530758 - RNA, 14 nt, Human
ccucaaccugugau

SEQ ID NO: 2530759 - RNA, 23 nt, Human
ccuauuuugaaaaauuccuauug

SEQ ID NO: 2530760 - RNA, 22 nt, Human
ccuauuuugaaaaauuccuauu

SEQ ID NO: 2530761 - RNA, 21 nt, Human
ccuauuuugaaaaauuccuau

SEQ ID NO: 2530762 - RNA, 20 nt, Human
ccuauuuugaaaaauuccua

SEQ ID NO: 2530763 - RNA, 16 nt, Human
ccucaaccuccugggc

SEQ ID NO: 2530764 - RNA, 19 nt, Human
ccuauuuugaaaaauuccu

SEQ ID NO: 2530765 - RNA, 13 nt, Human
ccuauuuucauug

SEQ ID NO: 2530766 - RNA, 17 nt, Human
ccuauuugccaugggcu

SEQ ID NO: 2530767 - RNA, 22 nt, Human
ccuauugugauuugacuguuuu

SEQ ID NO: 2530768 - RNA, 15 nt, Human
ccuauuuuaauaaac

SEQ ID NO: 2530769 - RNA, 18 nt, Human
ccuauuuccauucaacaa

SEQ ID NO: 2530770 - RNA, 15 nt, Human
ccuauuuccccaccc

SEQ ID NO: 2530771 - RNA, 15 nt, Human
ccucaagagaaggca

SEQ ID NO: 2530772 - RNA, 15 nt, Human
ccucaacucuccucc

SEQ ID NO: 2530773 - RNA, 20 nt, Human
ccucaagccaauccccuccu

SEQ ID NO: 2530774 - RNA, 18 nt, Human
ccucaagccaauccccuc

SEQ ID NO: 2530775 - RNA, 16 nt, Human
ccucaagccaaucccc

SEQ ID NO: 2530776 - RNA, 16 nt, Human
ccucaagaaauaaaag

SEQ ID NO: 2530777 - RNA, 17 nt, Human
ccucaagaugaaggcaa

SEQ ID NO: 2530778 - RNA, 15 nt, Human
ccucaagcugcaucu

SEQ ID NO: 2530779 - RNA, 12 nt, Human
ccucaaggacuu

SEQ ID NO: 2530780 - RNA, 13 nt, Human
ccucaaggacuug

SEQ ID NO: 2530781 - RNA, 19 nt, Human
ccucaaggacuugaaagca

SEQ ID NO: 2530782 - RNA, 20 nt, Human
ccucaaggacuugaaagcau

SEQ ID NO: 2530783 - RNA, 21 nt, Human
ccucaaggacuugaaagcauc

SEQ ID NO: 2530784 - RNA, 22 nt, Human
ccucagccucccaaagugcugg

SEQ ID NO: 2530785 - RNA, 11 nt, Human
ccucagccucc

SEQ ID NO: 2530786 - RNA, 14 nt, Human
ccucagccuagacc

SEQ ID NO: 2530787 - RNA, 16 nt, Human
ccucagccuagacccu

SEQ ID NO: 2530788 - RNA, 19 nt, Human
ccucagccuagacccuccu

SEQ ID NO: 2530789 - RNA, 20 nt, Human
ccucagccuagacccuccuc

SEQ ID NO: 2530790 - RNA, 16 nt, Human
ccucaaggccucccac

SEQ ID NO: 2530791 - RNA, 15 nt, Human
ccucaaggccuccca

SEQ ID NO: 2530792 - RNA, 22 nt, Human
ccucaaggacuugaaagcaucc

SEQ ID NO: 2530793 - RNA, 23 nt, Human
ccucaaggacuugaaagcaucca

SEQ ID NO: 2530794 - RNA, 18 nt, Human
ccucaaggccucccacag

SEQ ID NO: 2530795 - RNA, 17 nt, Human
ccucaaggccucccaca

SEQ ID NO: 2530796 - RNA, 19 nt, Human
ccucaaggccucccacagu

SEQ ID NO: 2530797 - RNA, 21 nt, Human
ccucagcccugacccugugga

SEQ ID NO: 2530798 - RNA, 23 nt, Human
ccuagauggcagucacugaauuc

SEQ ID NO: 2530799 - RNA, 17 nt, Human
ccuagauccacacacag

SEQ ID NO: 2530800 - RNA, 19 nt, Human
ccuagauccacacacagag

SEQ ID NO: 2530801 - RNA, 20 nt, Human
ccuagauccacacacagagg

SEQ ID NO: 2530802 - RNA, 17 nt, Human
ccuagcacacacuuuug

SEQ ID NO: 2530803 - RNA, 19 nt, Human
ccuaggagauaucugaggg

SEQ ID NO: 2530804 - RNA, 17 nt, Human
ccuaggagauaucugag

SEQ ID NO: 2530805 - RNA, 12 nt, Human
ccuaggagacca

SEQ ID NO: 2530806 - RNA, 23 nt, Human
ccuaggcaggacaugcugaagcc

SEQ ID NO: 2530807 - RNA, 22 nt, Human
ccuaggcaggacaugcugaagc

SEQ ID NO: 2530808 - RNA, 18 nt, Human
ccuaggcaggacaugcug

SEQ ID NO: 2530809 - RNA, 13 nt, Human
ccuaggcaggaca

SEQ ID NO: 2530810 - RNA, 16 nt, Human
ccuaggauugugccug

SEQ ID NO: 2530811 - RNA, 22 nt, Human
ccuaggagauaucugagggagg

SEQ ID NO: 2530812 - RNA, 20 nt, Human
ccuaggagauaucugaggga

SEQ ID NO: 2530813 - RNA, 20 nt, Human
ccuaggagugccccauucuu

SEQ ID NO: 2530814 - RNA, 23 nt, Human
ccuaauaaagcuguguggcaguc

SEQ ID NO: 2530815 - RNA, 16 nt, Human
ccuaauaaaguucugu

SEQ ID NO: 2530816 - RNA, 21 nt, Human
ccuaauaaaguucuguacuca

SEQ ID NO: 2530817 - RNA, 23 nt, Human
ccuagagguacuuuccacuugau

SEQ ID NO: 2530818 - RNA, 18 nt, Human
ccuagagggaggggccua

SEQ ID NO: 2530819 - RNA, 18 nt, Human
ccuagaguagaguggagg

SEQ ID NO: 2530820 - RNA, 22 nt, Human
ccuagaguagaguggagggagg

SEQ ID NO: 2530821 - RNA, 23 nt, Human
ccuagagugagggccugaggucu

SEQ ID NO: 2530822 - RNA, 14 nt, Human
ccuaauccaggcag

SEQ ID NO: 2530823 - RNA, 15 nt, Human
ccuaauccaggcaga

SEQ ID NO: 2530824 - RNA, 13 nt, Human
ccuaauccaggca

SEQ ID NO: 2530825 - RNA, 17 nt, Human
ccuaaucaggcugaggu

SEQ ID NO: 2530826 - RNA, 14 nt, Human
ccuaauaaagcugu

SEQ ID NO: 2530827 - RNA, 14 nt, Human
ccuaaguggcugcu

SEQ ID NO: 2530828 - RNA, 15 nt, Human
ccuaaguggcugcug

SEQ ID NO: 2530829 - RNA, 16 nt, Human
ccuaaguggcugcuga

SEQ ID NO: 2530830 - RNA, 20 nt, Human
ccuaaguuucaguugauuuu

SEQ ID NO: 2530831 - RNA, 13 nt, Human
ccuaauaaagcug

SEQ ID NO: 2530832 - RNA, 16 nt, Human
ccuaaguccuuuaugu

SEQ ID NO: 2530833 - RNA, 18 nt, Human
ccuaaguccuuuaugugg

SEQ ID NO: 2530834 - RNA, 22 nt, Human
ccuaaggaaaggaauuggcaug

SEQ ID NO: 2530835 - RNA, 13 nt, Human
ccuaaggacacac

SEQ ID NO: 2530836 - RNA, 24 nt, Human
ccuaaggaucucucaggagcacag

SEQ ID NO: 2530837 - RNA, 12 nt, Human
ccuaaggcugca

SEQ ID NO: 2530838 - RNA, 23 nt, Human
ccuaagggacauguuuugauaaa

SEQ ID NO: 2530839 - RNA, 22 nt, Human
ccuaaggcugcaagguuuaggc

SEQ ID NO: 2530840 - RNA, 19 nt, Human
ccuaagggcucaccguggc

SEQ ID NO: 2530841 - RNA, 13 nt, Human
ccuaagccaaggg

SEQ ID NO: 2530842 - RNA, 21 nt, Human
ccuaagccaagggccucuugc

SEQ ID NO: 2530843 - RNA, 22 nt, Human
ccgucucucucccauggagccc

SEQ ID NO: 2530844 - RNA, 19 nt, Human
ccgucucucucccauggag

SEQ ID NO: 2530845 - RNA, 18 nt, Human
ccgucucugguuccuccc

SEQ ID NO: 2530846 - RNA, 17 nt, Human
ccgucugggguucagcc

SEQ ID NO: 2530847 - RNA, 19 nt, Human
ccgucugggguucagcccc

SEQ ID NO: 2530848 - RNA, 20 nt, Human
ccgucugggguucagccccu

SEQ ID NO: 2530849 - RNA, 21 nt, Human
ccgucugggguucagccccuc

SEQ ID NO: 2530850 - RNA, 12 nt, Human
ccuaagaguguu

SEQ ID NO: 2530851 - RNA, 16 nt, Human
ccuaagaguguuuaau

SEQ ID NO: 2530852 - RNA, 18 nt, Human
ccuaagaguugagcucuc

SEQ ID NO: 2530853 - RNA, 22 nt, Human
ccgucugggguucagccccucc

SEQ ID NO: 2530854 - RNA, 23 nt, Human
ccgucugggguucagccccuccu

SEQ ID NO: 2530855 - RNA, 22 nt, Human
ccggcgugguggaagaggggac

SEQ ID NO: 2530856 - RNA, 16 nt, Human
ccggcgugguggaaga

SEQ ID NO: 2530857 - RNA, 16 nt, Human
ccguagguuauuuuca

SEQ ID NO: 2530858 - RNA, 19 nt, Human
ccggcuaauuuuuguauuu

SEQ ID NO: 2530859 - RNA, 17 nt, Human
ccggcuaugggggcacu

SEQ ID NO: 2530860 - RNA, 23 nt, Human
ccggcuaugggggcacugaggac

SEQ ID NO: 2530861 - RNA, 22 nt, Human
ccggcuaugggggcacugagga

SEQ ID NO: 2530862 - RNA, 17 nt, Human
ccgucagccaaauguaa

SEQ ID NO: 2530863 - RNA, 14 nt, Human
ccgucagggcccaa

SEQ ID NO: 2530864 - RNA, 12 nt, Human
ccgucagggccc

SEQ ID NO: 2530865 - RNA, 16 nt, Human
ccgucagggcccaagu

SEQ ID NO: 2530866 - RNA, 20 nt, Human
ccgucaguaucaggccugcc

SEQ ID NO: 2530867 - RNA, 21 nt, Human
ccgucauggcuuaauguuuau

SEQ ID NO: 2530868 - RNA, 15 nt, Human
ccgucauguuccuca

SEQ ID NO: 2530869 - RNA, 16 nt, Human
ccgucauguuccucaa

SEQ ID NO: 2530870 - RNA, 14 nt, Human
ccguccagaccuug

SEQ ID NO: 2530871 - RNA, 17 nt, Human
ccgucauguuccucaaa

SEQ ID NO: 2530872 - RNA, 22 nt, Human
ccguccagccgccauugccacc

SEQ ID NO: 2530873 - RNA, 16 nt, Human
ccguccaggagccugg

SEQ ID NO: 2530874 - RNA, 18 nt, Human
ccguccaggagccugugc

SEQ ID NO: 2530875 - RNA, 21 nt, Human
ccgucucaguguugagccuuu

SEQ ID NO: 2530876 - RNA, 19 nt, Human
ccgucuaguuaacauuuca

SEQ ID NO: 2530877 - RNA, 14 nt, Human
ccgucucucuccca

SEQ ID NO: 2530878 - RNA, 13 nt, Human
ccgucucucuccc

SEQ ID NO: 2530879 - RNA, 21 nt, Human
ccgucuccaggggcugcuucc

SEQ ID NO: 2530880 - RNA, 20 nt, Human
ccgucuccaggggcugcuuc

SEQ ID NO: 2530881 - RNA, 16 nt, Human
ccgucucaugaggggc

SEQ ID NO: 2530882 - RNA, 15 nt, Human
ccguaguucccugaa

SEQ ID NO: 2530883 - RNA, 16 nt, Human
ccguaguucccugaaa

SEQ ID NO: 2530884 - RNA, 14 nt, Human
ccguaguucccuga

SEQ ID NO: 2530885 - RNA, 18 nt, Human
ccggcuaauuuuuguaau

SEQ ID NO: 2530886 - RNA, 13 nt, Human
ccgucacagccuc

SEQ ID NO: 2530887 - RNA, 12 nt, Human
ccguauuucaga

SEQ ID NO: 2530888 - RNA, 22 nt, Human
ccguaguucccugaaaacccag

SEQ ID NO: 2530889 - RNA, 12 nt, Human
ccgucacagccu

SEQ ID NO: 2530890 - RNA, 13 nt, Human
cccuggcagcccc

SEQ ID NO: 2530891 - RNA, 12 nt, Human
cccuggcagccc

SEQ ID NO: 2530892 - RNA, 16 nt, Human
cccucacccugccuua

SEQ ID NO: 2530893 - RNA, 22 nt, Human
cccucacccugagccccuuccu

SEQ ID NO: 2530894 - RNA, 20 nt, Human
cccucacccugagccccuuc

SEQ ID NO: 2530895 - RNA, 13 nt, Human
cccucacccugcc

SEQ ID NO: 2530896 - RNA, 21 nt, Human
cccugcccugugggcccccaa

SEQ ID NO: 2530897 - RNA, 20 nt, Human
cccugcccugugggccccca

SEQ ID NO: 2530898 - RNA, 16 nt, Human
cccugcccugugggcc

SEQ ID NO: 2530899 - RNA, 15 nt, Human
cccugcccugugggc

SEQ ID NO: 2530900 - RNA, 14 nt, Human
cccugcccuguggg

SEQ ID NO: 2530901 - RNA, 15 nt, Human
cccucacccugagcc

SEQ ID NO: 2530902 - RNA, 21 nt, Human
cccucacccacuuuggccucc

SEQ ID NO: 2530903 - RNA, 22 nt, Human
cccucaccccugguucucaucu

SEQ ID NO: 2530904 - RNA, 20 nt, Human
cccucaccccugguucucau

SEQ ID NO: 2530905 - RNA, 13 nt, Human
cccucaccccugg

SEQ ID NO: 2530906 - RNA, 11 nt, Human
cccugcccugu

SEQ ID NO: 2530907 - RNA, 12 nt, Human
cccugcccugug

SEQ ID NO: 2530908 - RNA, 13 nt, Human
cccugcccugugg

SEQ ID NO: 2530909 - RNA, 19 nt, Human
cccucaaaccuccucuucu

SEQ ID NO: 2530910 - RNA, 15 nt, Human
cccucaaaccuccuc

SEQ ID NO: 2530911 - RNA, 21 nt, Human
cccuauuuuuuuucuguuaua

SEQ ID NO: 2530912 - RNA, 21 nt, Human
cccucaaaccuccucuucuga

SEQ ID NO: 2530913 - RNA, 20 nt, Human
cccucaaaccuccucuucug

SEQ ID NO: 2530914 - RNA, 24 nt, Human
cccucaaaccuccucuucugacgu

SEQ ID NO: 2530915 - RNA, 16 nt, Human
cccuauuuccccaccc

SEQ ID NO: 2530916 - RNA, 20 nt, Human
cccuauuuuuuuucuguuau

SEQ ID NO: 2530917 - RNA, 21 nt, Human
cccuauuuaacagggucucua

SEQ ID NO: 2530918 - RNA, 23 nt, Human
cccuauuuaacagggucucuagu

SEQ ID NO: 2530919 - RNA, 17 nt, Human
cccucacagccucugac

SEQ ID NO: 2530920 - RNA, 16 nt, Human
cccucacagccucuga

SEQ ID NO: 2530921 - RNA, 15 nt, Human
cccucacagccucug

SEQ ID NO: 2530922 - RNA, 14 nt, Human
cccucacagccucu

SEQ ID NO: 2530923 - RNA, 14 nt, Human
cccucaccaggggc

SEQ ID NO: 2530924 - RNA, 12 nt, Human
cccucaccaaca

SEQ ID NO: 2530925 - RNA, 18 nt, Human
cccucacagccucugacc

SEQ ID NO: 2530926 - RNA, 13 nt, Human
cccucaccccugc

SEQ ID NO: 2530927 - RNA, 20 nt, Human
cccuggcuuguaacuccacc

SEQ ID NO: 2530928 - RNA, 23 nt, Human
cccuggcuuguaacuccaccaac

SEQ ID NO: 2530929 - RNA, 13 nt, Human
cccuggcuuuuca

SEQ ID NO: 2530930 - RNA, 13 nt, Human
cccuggcuccagg

SEQ ID NO: 2530931 - RNA, 16 nt, Human
cccuggcuccaggcca

SEQ ID NO: 2530932 - RNA, 19 nt, Human
cccuggcugcccuggcccu

SEQ ID NO: 2530933 - RNA, 17 nt, Human
cccuggcucccacaggc

SEQ ID NO: 2530934 - RNA, 14 nt, Human
cccuggcugcugcc

SEQ ID NO: 2530935 - RNA, 13 nt, Human
cccuggcugcugc

SEQ ID NO: 2530936 - RNA, 22 nt, Human
cccuggcugcccuggcccugag

SEQ ID NO: 2530937 - RNA, 20 nt, Human
cccuggcugcccuggcccug

SEQ ID NO: 2530938 - RNA, 18 nt, Human
cccuggcugcugccccca

SEQ ID NO: 2530939 - RNA, 15 nt, Human
cccuggcugcugccc

SEQ ID NO: 2530940 - RNA, 23 nt, Human
cccuggcugggacguggcucagc

SEQ ID NO: 2530941 - RNA, 19 nt, Human
cccuggcuuguaacuccac

SEQ ID NO: 2530942 - RNA, 22 nt, Human
cccuggcugcugcccccacccc

SEQ ID NO: 2530943 - RNA, 16 nt, Human
cccuggcagccccugu

SEQ ID NO: 2530944 - RNA, 14 nt, Human
cccuggcagccccu

SEQ ID NO: 2530945 - RNA, 22 nt, Human
cccuggcaggaugacccugcga

SEQ ID NO: 2530946 - RNA, 20 nt, Human
cccuggcaggaugacccugc

SEQ ID NO: 2530947 - RNA, 23 nt, Human
cccuggccaccaccccccacucu

SEQ ID NO: 2530948 - RNA, 20 nt, Human
cccuggccaccaccccccac

SEQ ID NO: 2530949 - RNA, 23 nt, Human
cccuggcauuauguccacugugu

SEQ ID NO: 2530950 - RNA, 13 nt, Human
cccuggccagagg

SEQ ID NO: 2530951 - RNA, 14 nt, Human
cccuggccagaggc

SEQ ID NO: 2530952 - RNA, 15 nt, Human
cccuggccagaggcu

SEQ ID NO: 2530953 - RNA, 13 nt, Human
cccuggcccucaa

SEQ ID NO: 2530954 - RNA, 21 nt, Human
cccuggcccagcggccccucc

SEQ ID NO: 2530955 - RNA, 13 nt, Human
cccuggccccagg

SEQ ID NO: 2530956 - RNA, 14 nt, Human
cccuggccccagga

SEQ ID NO: 2530957 - RNA, 17 nt, Human
cccuggccuuucauauu

SEQ ID NO: 2530958 - RNA, 15 nt, Human
cccuggccuguucug

SEQ ID NO: 2530959 - RNA, 19 nt, Human
cccuggccuguucuguuuu

SEQ ID NO: 2530960 - RNA, 13 nt, Human
cccuggccugcug

SEQ ID NO: 2530961 - RNA, 14 nt, Human
cccuggccugcugg

SEQ ID NO: 2530962 - RNA, 21 nt, Human
cccuggccugcugggcucucc

SEQ ID NO: 2530963 - RNA, 22 nt, Human
cccuggccugcugggcucucca

SEQ ID NO: 2530964 - RNA, 21 nt, Human
cccuggccucugugccuucuu

SEQ ID NO: 2530965 - RNA, 24 nt, Human
cccugugccuuggugugcuguauc

SEQ ID NO: 2530966 - RNA, 22 nt, Human
cccugugccuaacaccagcguu

SEQ ID NO: 2530967 - RNA, 21 nt, Human
cccugugccuaacaccagcgu

SEQ ID NO: 2530968 - RNA, 20 nt, Human
cccugugccuaacaccagcg

SEQ ID NO: 2530969 - RNA, 22 nt, Human
cccugugcagccgcugagcgag

SEQ ID NO: 2530970 - RNA, 18 nt, Human
cccuucgcuccugugucu

SEQ ID NO: 2530971 - RNA, 16 nt, Human
cccuucgcuccugugu

SEQ ID NO: 2530972 - RNA, 16 nt, Human
cccuucuaccuuccug

SEQ ID NO: 2530973 - RNA, 17 nt, Human
cccugugcuccgugccu

SEQ ID NO: 2530974 - RNA, 16 nt, Human
cccuucuaccugccac

SEQ ID NO: 2530975 - RNA, 17 nt, Human
cccuucuaccugccacu

SEQ ID NO: 2530976 - RNA, 23 nt, Human
cccuucucuguagggaacucugg

SEQ ID NO: 2530977 - RNA, 23 nt, Human
cccuucugacccaugcugcccug
